United States Patent 7,250,496 (BIOINFORMATICALLY DETECTABLE GROUP OF NOVEL REGULATORY GENES AND USES THEREOF) - sequence listing, part 23

SEQ ID NO: 971125 - RNA, 22 nt, Human
ugugucaaggucuggcugcgga

SEQ ID NO: 971126 - RNA, 22 nt, Human
uguuguauggccuuccaggguu

SEQ ID NO: 971127 - RNA, 18 nt, Human
uuagaaguagauaccaaa

SEQ ID NO: 971128 - RNA, 20 nt, Human
uuagaaguagauaccaaaau

SEQ ID NO: 971129 - RNA, 22 nt, Human
uugcuagauuacccaaaugugu

SEQ ID NO: 971130 - RNA, 24 nt, Human
uuuaaagacuucccuaaaauacuc

SEQ ID NO: 971131 - RNA, 25 nt, Human
uuuuuuuuuuuuuuuuuuucacaag

SEQ ID NO: 971132 - RNA, 22 nt, Human
aaaagaacaacuuuaguaugau

SEQ ID NO: 971133 - RNA, 19 nt, Human
aaacauauagcaaaucaca

SEQ ID NO: 971134 - RNA, 25 nt, Human
aaauggccaaugaaugucagcaaac

SEQ ID NO: 971135 - RNA, 19 nt, Human
aaauguaccuuacauuaac

SEQ ID NO: 971136 - RNA, 19 nt, Human
aacaccaccaccucacccc

SEQ ID NO: 971137 - RNA, 20 nt, Human
aacauucugaugacuacaga

SEQ ID NO: 971138 - RNA, 22 nt, Human
aagaagccucccaauacauuga

SEQ ID NO: 971139 - RNA, 22 nt, Human
aagcagcaaaaauacaccuuca

SEQ ID NO: 971140 - RNA, 19 nt, Human
aagccaaucaacaccacca

SEQ ID NO: 971141 - RNA, 19 nt, Human
aaugaaugucagcaaacac

SEQ ID NO: 971142 - RNA, 23 nt, Human
accaacuuaauucccugccccca

SEQ ID NO: 971143 - RNA, 20 nt, Human
accaccaccucaccccaaca

SEQ ID NO: 971144 - RNA, 25 nt, Human
accccaacaccuccuucuguccaac

SEQ ID NO: 971145 - RNA, 23 nt, Human
acuuucuguaauaaaaaagaagc

SEQ ID NO: 971146 - RNA, 23 nt, Human
agaaacagaaacaguuccuaaga

SEQ ID NO: 971147 - RNA, 25 nt, Human
agaaacagaaacaguuccuaagaca

SEQ ID NO: 971148 - RNA, 26 nt, Human
agaaagaaaacuacacauguaaaaaa

SEQ ID NO: 971149 - RNA, 24 nt, Human
agaauaagauuauauacauaaaca

SEQ ID NO: 971150 - RNA, 22 nt, Human
agacaagccaaucaacaccacc

SEQ ID NO: 971151 - RNA, 23 nt, Human
agacaagccaaucaacaccacca

SEQ ID NO: 971152 - RNA, 27 nt, Human
agcaaaaauacaccuucaucaucucac

SEQ ID NO: 971153 - RNA, 19 nt, Human
aggaauaacaugaaaaagc

SEQ ID NO: 971154 - RNA, 21 nt, Human
aggcggcagccucccgcgauc

SEQ ID NO: 971155 - RNA, 19 nt, Human
aguguaucuccacgauugu

SEQ ID NO: 971156 - RNA, 22 nt, Human
auaaaaaucaaauguaccuuac

SEQ ID NO: 971157 - RNA, 19 nt, Human
aucaacaccaccaccucac

SEQ ID NO: 971158 - RNA, 20 nt, Human
augacuacagaauaagauua

SEQ ID NO: 971159 - RNA, 26 nt, Human
caacaccaccaccucaccccaacacc

SEQ ID NO: 971160 - RNA, 25 nt, Human
caagccaaucaacaccaccaccuca

SEQ ID NO: 971161 - RNA, 21 nt, Human
caauaauauaaaugcuuugac

SEQ ID NO: 971162 - RNA, 21 nt, Human
cacucaacacuguauuaaaug

SEQ ID NO: 971163 - RNA, 20 nt, Human
cagaagauaccuuuuuccac

SEQ ID NO: 971164 - RNA, 22 nt, Human
cagcaaacaccugugugagcua

SEQ ID NO: 971165 - RNA, 20 nt, Human
caggcaguuuagcuauaagc

SEQ ID NO: 971166 - RNA, 24 nt, Human
cauuuuuguuugauguucugagaa

SEQ ID NO: 971167 - RNA, 22 nt, Human
cccaacaccuccuucuguccaa

SEQ ID NO: 971168 - RNA, 23 nt, Human
cccaccaacuuaauucccugccc

SEQ ID NO: 971169 - RNA, 21 nt, Human
ccccaacaccuccuucugucc

SEQ ID NO: 971170 - RNA, 22 nt, Human
ccccaacaccuccuucugucca

SEQ ID NO: 971171 - RNA, 21 nt, Human
cccguguaacagcuuugauuu

SEQ ID NO: 971172 - RNA, 22 nt, Human
ccugcacugaauguuuaucaaa

SEQ ID NO: 971173 - RNA, 20 nt, Human
cuagaacaggcaguuuagcu

SEQ ID NO: 971174 - RNA, 22 nt, Human
cucacacugcucuagcaaaacc

SEQ ID NO: 971175 - RNA, 21 nt, Human
gaggagacggcaggggaaaga

SEQ ID NO: 971176 - RNA, 21 nt, Human
gaggauggaagacgagaggga

SEQ ID NO: 971177 - RNA, 24 nt, Human
gaugaggagacggcaggggaaaga

SEQ ID NO: 971178 - RNA, 25 nt, Human
ggugcaggaugaggagacggcaggg

SEQ ID NO: 971179 - RNA, 19 nt, Human
guaaagcagcaaaaauaca

SEQ ID NO: 971180 - RNA, 22 nt, Human
guccacacacaagccccuucag

SEQ ID NO: 971181 - RNA, 23 nt, Human
guguaacagcuuugauuuauaug

SEQ ID NO: 971182 - RNA, 24 nt, Human
uaaaaaagaagccucccaauacau

SEQ ID NO: 971183 - RNA, 23 nt, Human
uaaacagaccagagacuuuggug

SEQ ID NO: 971184 - RNA, 21 nt, Human
uaaacauauagcaaaucacag

SEQ ID NO: 971185 - RNA, 18 nt, Human
uaaagaccagugggagug

SEQ ID NO: 971186 - RNA, 22 nt, Human
uaaagcagcaaaaauacaccuu

SEQ ID NO: 971187 - RNA, 23 nt, Human
uaaauuaaaagaacaacuuuagu

SEQ ID NO: 971188 - RNA, 21 nt, Human
uaaauuaaucagcacaagcua

SEQ ID NO: 971189 - RNA, 24 nt, Human
uaaccauuuccaauagaaaaagaa

SEQ ID NO: 971190 - RNA, 20 nt, Human
uaacuuguaaccauuuccaa

SEQ ID NO: 971191 - RNA, 22 nt, Human
uaauaaaaaagaagccucccaa

SEQ ID NO: 971192 - RNA, 21 nt, Human
uaauucccugcccccaccccc

SEQ ID NO: 971193 - RNA, 22 nt, Human
uacacauguaaaaaauaaaaau

SEQ ID NO: 971194 - RNA, 20 nt, Human
uaccuuacagaaacagaaac

SEQ ID NO: 971195 - RNA, 21 nt, Human
uaccuuacagaaacagaaaca

SEQ ID NO: 971196 - RNA, 22 nt, Human
uaccuuacagaaacagaaacag

SEQ ID NO: 971197 - RNA, 25 nt, Human
uaccuuacagaaacagaaacaguuc

SEQ ID NO: 971198 - RNA, 18 nt, Human
uauauacauaaacauaua

SEQ ID NO: 971199 - RNA, 23 nt, Human
ucaacaccaccaccucaccccaa

SEQ ID NO: 971200 - RNA, 20 nt, Human
ucaccccaacaccuccuucu

SEQ ID NO: 971201 - RNA, 24 nt, Human
ucagcaaacaccugugugagcuaa

SEQ ID NO: 971202 - RNA, 18 nt, Human
ucauauguaugucugccc

SEQ ID NO: 971203 - RNA, 19 nt, Human
ucccgaggcggcagccucc

SEQ ID NO: 971204 - RNA, 18 nt, Human
ucuaugauugaaauaaag

SEQ ID NO: 971205 - RNA, 22 nt, Human
ucugcccugcaguauauaugaa

SEQ ID NO: 971206 - RNA, 24 nt, Human
ucuuacuaugauuugaaaaaaagg

SEQ ID NO: 971207 - RNA, 18 nt, Human
ugaaauaaagccccucuc

SEQ ID NO: 971208 - RNA, 23 nt, Human
ugaagaaagaaaacuacacaugu

SEQ ID NO: 971209 - RNA, 21 nt, Human
ugacaaaaacagugauuuucc

SEQ ID NO: 971210 - RNA, 18 nt, Human
ugacaagaggauuuagga

SEQ ID NO: 971211 - RNA, 22 nt, Human
ugagagaagacauuaaauggug

SEQ ID NO: 971212 - RNA, 24 nt, Human
ugagcuaaacugaacuaauuccua

SEQ ID NO: 971213 - RNA, 21 nt, Human
ugaggauggaagacgagaggg

SEQ ID NO: 971214 - RNA, 24 nt, Human
ugaguaggaauuuuuaaauccauu

SEQ ID NO: 971215 - RNA, 19 nt, Human
ugccuggugauauuacugg

SEQ ID NO: 971216 - RNA, 21 nt, Human
uggguaguguaucuccacgau

SEQ ID NO: 971217 - RNA, 24 nt, Human
uggguaguguaucuccacgauugu

SEQ ID NO: 971218 - RNA, 21 nt, Human
uguaaguuuguuauagaagug

SEQ ID NO: 971219 - RNA, 21 nt, Human
ugugcauuucuucguaguguu

SEQ ID NO: 971220 - RNA, 19 nt, Human
uguucagaacacucuguuc

SEQ ID NO: 971221 - RNA, 22 nt, Human
uguucagaacacucuguucuua

SEQ ID NO: 971222 - RNA, 18 nt, Human
uuaaauggccaaugaaug

SEQ ID NO: 971223 - RNA, 21 nt, Human
uuaggaauaacaugaaaaagc

SEQ ID NO: 971224 - RNA, 23 nt, Human
uuauccccagacauuuguagaca

SEQ ID NO: 971225 - RNA, 22 nt, Human
uucaaugacaaaaguaugacaa

SEQ ID NO: 971226 - RNA, 22 nt, Human
uucugagaaugcaaauguuugg

SEQ ID NO: 971227 - RNA, 18 nt, Human
uugaagaagagcauugcc

SEQ ID NO: 971228 - RNA, 20 nt, Human
uugaagaagagcauugcccc

SEQ ID NO: 971229 - RNA, 22 nt, Human
uuggugcaagacugagagaaga

SEQ ID NO: 971230 - RNA, 23 nt, Human
uuguagacagauacauaugaaug

SEQ ID NO: 971231 - RNA, 19 nt, Human
uuguucaaugacaaaagua

SEQ ID NO: 971232 - RNA, 22 nt, Human
uuuaggaauaacaugaaaaagc

SEQ ID NO: 971233 - RNA, 19 nt, Human
uuucuuguagaucauccua

SEQ ID NO: 971234 - RNA, 19 nt, Human
aaagaaagcaggcaugaga

SEQ ID NO: 971235 - RNA, 24 nt, Human
aaagauugaggguguagacccaca

SEQ ID NO: 971236 - RNA, 21 nt, Human
aaaggugcagagaggagacag

SEQ ID NO: 971237 - RNA, 22 nt, Human
aacagacagaccacagaaggga

SEQ ID NO: 971238 - RNA, 24 nt, Human
aacagcuucagccaggaggaggca

SEQ ID NO: 971239 - RNA, 23 nt, Human
aagacagaugggcgggaggaggg

SEQ ID NO: 971240 - RNA, 21 nt, Human
aauggccugaaagauugaggg

SEQ ID NO: 971241 - RNA, 19 nt, Human
acaaagaaagcaggcauga

SEQ ID NO: 971242 - RNA, 20 nt, Human
acagacagaccacagaaggg

SEQ ID NO: 971243 - RNA, 21 nt, Human
acagagccagacagcucccca

SEQ ID NO: 971244 - RNA, 21 nt, Human
acagcacaggaacagacagac

SEQ ID NO: 971245 - RNA, 20 nt, Human
acaggagaaaagaggcagag

SEQ ID NO: 971246 - RNA, 21 nt, Human
acaggagaaaagaggcagaga

SEQ ID NO: 971247 - RNA, 22 nt, Human
acaggcagacucagaaacaaac

SEQ ID NO: 971248 - RNA, 18 nt, Human
agaaaaaggugcagagag

SEQ ID NO: 971249 - RNA, 21 nt, Human
agaaacagcacaggaacagac

SEQ ID NO: 971250 - RNA, 19 nt, Human
agaaagcaggcaugagaaa

SEQ ID NO: 971251 - RNA, 26 nt, Human
agacaggagacacaggcuggccaaga

SEQ ID NO: 971252 - RNA, 22 nt, Human
agacggacagcaggaugggaug

SEQ ID NO: 971253 - RNA, 21 nt, Human
agacucagaaacaaacaggug

SEQ ID NO: 971254 - RNA, 20 nt, Human
agacuccuggagggacagga

SEQ ID NO: 971255 - RNA, 18 nt, Human
agagacagggagaaaggg

SEQ ID NO: 971256 - RNA, 21 nt, Human
agagagaggcagauucaggca

SEQ ID NO: 971257 - RNA, 26 nt, Human
agaggcagauucaggcagagaggccu

SEQ ID NO: 971258 - RNA, 22 nt, Human
agaggccuggggacagcagggg

SEQ ID NO: 971259 - RNA, 21 nt, Human
agaugggcgggaggaggggau

SEQ ID NO: 971260 - RNA, 19 nt, Human
agccagacagcuccccaaa

SEQ ID NO: 971261 - RNA, 19 nt, Human
agcgguacuuuuuuuuuuu

SEQ ID NO: 971262 - RNA, 20 nt, Human
agcuagagagagugacaggc

SEQ ID NO: 971263 - RNA, 21 nt, Human
agcucagagagaugaaggggc

SEQ ID NO: 971264 - RNA, 21 nt, Human
aggaacagacagaccacagaa

SEQ ID NO: 971265 - RNA, 21 nt, Human
aggacugggcugggcaaaggc

SEQ ID NO: 971266 - RNA, 22 nt, Human
aggaggaggcagagaggacugg

SEQ ID NO: 971267 - RNA, 21 nt, Human
aggcagacagaggggaugacu

SEQ ID NO: 971268 - RNA, 22 nt, Human
aggcagagagacuccuggaggg

SEQ ID NO: 971269 - RNA, 18 nt, Human
aggcagagaggacugggc

SEQ ID NO: 971270 - RNA, 22 nt, Human
aggcagagaggacugggcuggg

SEQ ID NO: 971271 - RNA, 18 nt, Human
aggcagagaggccugggg

SEQ ID NO: 971272 - RNA, 19 nt, Human
aggcagagaggccugggga

SEQ ID NO: 971273 - RNA, 20 nt, Human
aggggagcuuggaagacagg

SEQ ID NO: 971274 - RNA, 19 nt, Human
agguggguagggauaggcu

SEQ ID NO: 971275 - RNA, 21 nt, Human
auggauggcagaaaaaggugc

SEQ ID NO: 971276 - RNA, 23 nt, Human
cacacaggcagacucagaaacaa

SEQ ID NO: 971277 - RNA, 23 nt, Human
caccugcagaaaggcaacaggca

SEQ ID NO: 971278 - RNA, 22 nt, Human
cagaagggacagaaagacagau

SEQ ID NO: 971279 - RNA, 23 nt, Human
cagaagggacagaaagacagaug

SEQ ID NO: 971280 - RNA, 24 nt, Human
cagagacagggagaaagggacaca

SEQ ID NO: 971281 - RNA, 21 nt, Human
cagagaggacugggcugggca

SEQ ID NO: 971282 - RNA, 21 nt, Human
cagccucugcugucccccgcc

SEQ ID NO: 971283 - RNA, 24 nt, Human
cagcucagagagaugaaggggcag

SEQ ID NO: 971284 - RNA, 24 nt, Human
caggagaaaagaggcagagagagg

SEQ ID NO: 971285 - RNA, 24 nt, Human
cagggaccugggccagcaggccuu

SEQ ID NO: 971286 - RNA, 19 nt, Human
cagguucgggcacccucuc

SEQ ID NO: 971287 - RNA, 25 nt, Human
cccacagcuagagagagugacaggc

SEQ ID NO: 971288 - RNA, 18 nt, Human
cccuaucuggacccacuu

SEQ ID NO: 971289 - RNA, 19 nt, Human
cccugggcgggggaagagg

SEQ ID NO: 971290 - RNA, 26 nt, Human
ccuccuccuccuccucuucuuccucc

SEQ ID NO: 971291 - RNA, 18 nt, Human
ccuccuucuggcccuggg

SEQ ID NO: 971292 - RNA, 18 nt, Human
ccuccuucuggcccuggg

SEQ ID NO: 971293 - RNA, 21 nt, Human
ccuccuucuggcccugggcgg

SEQ ID NO: 971294 - RNA, 24 nt, Human
ccugcagaaaggcaacaggcaauu

SEQ ID NO: 971295 - RNA, 21 nt, Human
cggcugccuaggcuccugcuc

SEQ ID NO: 971296 - RNA, 24 nt, Human
cgggggaagagguggagaaggggc

SEQ ID NO: 971297 - RNA, 19 nt, Human
cucagguucgggcacccuc

SEQ ID NO: 971298 - RNA, 20 nt, Human
cuccuccuccuccuccuccu

SEQ ID NO: 971299 - RNA, 20 nt, Human
cuccuccuccuccuccuccu

SEQ ID NO: 971300 - RNA, 26 nt, Human
cuccuccuccucuucuuccuccuccu

SEQ ID NO: 971301 - RNA, 21 nt, Human
cugaccccuccaugugcaugc

SEQ ID NO: 971302 - RNA, 24 nt, Human
cuggagggacaggagaaaagaggc

SEQ ID NO: 971303 - RNA, 20 nt, Human
cuggcccugggcgggggaag

SEQ ID NO: 971304 - RNA, 20 nt, Human
gaacagacagaccacagaag

SEQ ID NO: 971305 - RNA, 23 nt, Human
gacagagccagacagcuccccaa

SEQ ID NO: 971306 - RNA, 19 nt, Human
gagaaacagcacaggaaca

SEQ ID NO: 971307 - RNA, 20 nt, Human
gagcgguacuuuuuuuuuuu

SEQ ID NO: 971308 - RNA, 21 nt, Human
gagcgguacuuuuuuuuuuuu

SEQ ID NO: 971309 - RNA, 18 nt, Human
gagcuuggaagacaggca

SEQ ID NO: 971310 - RNA, 19 nt, Human
gaggcagagaggacugggc

SEQ ID NO: 971311 - RNA, 22 nt, Human
gaggccuggggacagcagggga

SEQ ID NO: 971312 - RNA, 22 nt, Human
gcacagggaccugggccagcag

SEQ ID NO: 971313 - RNA, 18 nt, Human
gcagacagaggggaugac

SEQ ID NO: 971314 - RNA, 21 nt, Human
gcagauucaggcagagaggcc

SEQ ID NO: 971315 - RNA, 18 nt, Human
gcaggaugggauggaugg

SEQ ID NO: 971316 - RNA, 25 nt, Human
gccucugcugucccccgccucugac

SEQ ID NO: 971317 - RNA, 22 nt, Human
gcgcccccuaucuggacccacu

SEQ ID NO: 971318 - RNA, 23 nt, Human
gcgggaggaggggaugcuagggg

SEQ ID NO: 971319 - RNA, 18 nt, Human
ggaacagacagaccacag

SEQ ID NO: 971320 - RNA, 19 nt, Human
ggaagacaggcagagacag

SEQ ID NO: 971321 - RNA, 25 nt, Human
ggagcgguacuuuuuuuuuuuuccu

SEQ ID NO: 971322 - RNA, 18 nt, Human
ggcaggagggacccuagg

SEQ ID NO: 971323 - RNA, 18 nt, Human
ggcgggaggaggggaugc

SEQ ID NO: 971324 - RNA, 25 nt, Human
gggacagagccagacagcuccccaa

SEQ ID NO: 971325 - RNA, 19 nt, Human
gggcaggagggacccuagg

SEQ ID NO: 971326 - RNA, 23 nt, Human
ggggacagcaggggaacaggugc

SEQ ID NO: 971327 - RNA, 19 nt, Human
ggggagcuuggaagacagg

SEQ ID NO: 971328 - RNA, 18 nt, Human
guaauccugacaaacagc

SEQ ID NO: 971329 - RNA, 19 nt, Human
guugggguugggauuaggg

SEQ ID NO: 971330 - RNA, 19 nt, Human
uaucuggacccacuuggag

SEQ ID NO: 971331 - RNA, 20 nt, Human
ucagagagaugaaggggcag

SEQ ID NO: 971332 - RNA, 20 nt, Human
uccacauguugggcaggagg

SEQ ID NO: 971333 - RNA, 18 nt, Human
uccuccucuucuuccucc

SEQ ID NO: 971334 - RNA, 23 nt, Human
ucuggcccugggcgggggaagag

SEQ ID NO: 971335 - RNA, 22 nt, Human
ucuucuuccuccuccucccccc

SEQ ID NO: 971336 - RNA, 21 nt, Human
ugacucacagagcagacggac

SEQ ID NO: 971337 - RNA, 19 nt, Human
ugagaaacagcacaggaac

SEQ ID NO: 971338 - RNA, 25 nt, Human
ugaggcagagagacuccccccgagg

SEQ ID NO: 971339 - RNA, 19 nt, Human
ugaggcagagagacuccug

SEQ ID NO: 971340 - RNA, 20 nt, Human
ugaggcagagagacuccugg

SEQ ID NO: 971341 - RNA, 20 nt, Human
ugcagccucugcuguccccc

SEQ ID NO: 971342 - RNA, 27 nt, Human
uggaagacaggcagagacagggagaaa

SEQ ID NO: 971343 - RNA, 20 nt, Human
uggauggcagaaaaaggugc

SEQ ID NO: 971344 - RNA, 24 nt, Human
ugggccagucugcagccucugcug

SEQ ID NO: 971345 - RNA, 24 nt, Human
uggggacagcaggggaacaggugc

SEQ ID NO: 971346 - RNA, 19 nt, Human
ugggggaaauggccugaaa

SEQ ID NO: 971347 - RNA, 24 nt, Human
ugggguugggauuagggccaugau

SEQ ID NO: 971348 - RNA, 22 nt, Human
uggguagggauaggcucgugga

SEQ ID NO: 971349 - RNA, 20 nt, Human
ugguugaggcagagagacuc

SEQ ID NO: 971350 - RNA, 26 nt, Human
ugugcaugcgcacagggaccugggcc

SEQ ID NO: 971351 - RNA, 21 nt, Human
uucuuccuccuccucccaugg

SEQ ID NO: 971352 - RNA, 18 nt, Human
uuuuuuuuuuuuuuuuug

SEQ ID NO: 971353 - RNA, 20 nt, Human
uuuuuuuuuuuuuuuuuggu

SEQ ID NO: 971354 - RNA, 22 nt, Human
uuuuuuuuuuuuuuuuugguag

SEQ ID NO: 971355 - RNA, 19 nt, Human
aaaccugggguccagucca

SEQ ID NO: 971356 - RNA, 21 nt, Human
aggaaaccugggguccagucc

SEQ ID NO: 971357 - RNA, 18 nt, Human
auucuccaauuaauagcu

SEQ ID NO: 971358 - RNA, 24 nt, Human
cacaguagcauaaaugggauaaga

SEQ ID NO: 971359 - RNA, 22 nt, Human
caucagaaaagccaggaaucuc

SEQ ID NO: 971360 - RNA, 24 nt, Human
cgugaguuucaggaggcuguuggu

SEQ ID NO: 971361 - RNA, 20 nt, Human
cugcucaaccuaaauaucuu

SEQ ID NO: 971362 - RNA, 22 nt, Human
guccuaaauagguccaucagaa

SEQ ID NO: 971363 - RNA, 19 nt, Human
uaggguaagcccaggaguc

SEQ ID NO: 971364 - RNA, 24 nt, Human
uagguccaucagaaaagccaggaa

SEQ ID NO: 971365 - RNA, 25 nt, Human
uagguccaucagaaaagccaggaau

SEQ ID NO: 971366 - RNA, 18 nt, Human
ucagaaaagccaggaauc

SEQ ID NO: 971367 - RNA, 18 nt, Human
uccagggugagaaauggg

SEQ ID NO: 971368 - RNA, 20 nt, Human
uccagggugagaaaugggau

SEQ ID NO: 971369 - RNA, 23 nt, Human
ucccuggggauagagagguuguc

SEQ ID NO: 971370 - RNA, 19 nt, Human
ugagaaaugggaucucaug

SEQ ID NO: 971371 - RNA, 18 nt, Human
ugaguaaagaaaugucug

SEQ ID NO: 971372 - RNA, 18 nt, Human
uguaaaggaaaccugggg

SEQ ID NO: 971373 - RNA, 19 nt, Human
uguaaaggaaaccuggggu

SEQ ID NO: 971374 - RNA, 24 nt, Human
uuguccuaaauagguccaucagaa

SEQ ID NO: 971375 - RNA, 22 nt, Human
uuugucuuaguccagggugaga

SEQ ID NO: 971376 - RNA, 19 nt, Human
aagagacagacguugauca

SEQ ID NO: 971377 - RNA, 22 nt, Human
aagaguccaccuccugguggcu

SEQ ID NO: 971378 - RNA, 23 nt, Human
aagcagggccagggguuggggga

SEQ ID NO: 971379 - RNA, 24 nt, Human
aagcauggccagggcuggucacac

SEQ ID NO: 971380 - RNA, 24 nt, Human
aagccacucacccagggucaccca

SEQ ID NO: 971381 - RNA, 18 nt, Human
aaggaacugaucaugcug

SEQ ID NO: 971382 - RNA, 26 nt, Human
acaccgcguaacgaacgaaugcagac

SEQ ID NO: 971383 - RNA, 24 nt, Human
accaagaucuccauccucgcagug

SEQ ID NO: 971384 - RNA, 25 nt, Human
acccuggaacucuacucugccacac

SEQ ID NO: 971385 - RNA, 23 nt, Human
accguguccuggcuggcuguugg

SEQ ID NO: 971386 - RNA, 18 nt, Human
acucagccacgcggaaca

SEQ ID NO: 971387 - RNA, 18 nt, Human
agaaacugugagaugaua

SEQ ID NO: 971388 - RNA, 25 nt, Human
agaccccugacucacaggacccguc

SEQ ID NO: 971389 - RNA, 23 nt, Human
agcaagcauggccagggcugguc

SEQ ID NO: 971390 - RNA, 22 nt, Human
agcaggacacuggggcagaggg

SEQ ID NO: 971391 - RNA, 18 nt, Human
agccacgcggaacagcag

SEQ ID NO: 971392 - RNA, 28 nt, Human
agcccgaggacaggagaacggcgggaaa

SEQ ID NO: 971393 - RNA, 23 nt, Human
aggggcuggaagcucagggagcc

SEQ ID NO: 971394 - RNA, 20 nt, Human
aggggggcuggcaguggccu

SEQ ID NO: 971395 - RNA, 19 nt, Human
agggugucaucagggcuga

SEQ ID NO: 971396 - RNA, 19 nt, Human
agugggugaggcugggggc

SEQ ID NO: 971397 - RNA, 19 nt, Human
caacaguagcugacugaua

SEQ ID NO: 971398 - RNA, 21 nt, Human
caagagacagacguugaucag

SEQ ID NO: 971399 - RNA, 22 nt, Human
cacagcaaauucacuuccuacu

SEQ ID NO: 971400 - RNA, 20 nt, Human
cacccagcaagcauggccag

SEQ ID NO: 971401 - RNA, 19 nt, Human
caccgcguaacgaacgaau

SEQ ID NO: 971402 - RNA, 19 nt, Human
caccguguccuggcuggcu

SEQ ID NO: 971403 - RNA, 21 nt, Human
caccucugcaugacaugggac

SEQ ID NO: 971404 - RNA, 24 nt, Human
cagacuccaagauggccccagaag

SEQ ID NO: 971405 - RNA, 23 nt, Human
cagccauacccugugagguccug

SEQ ID NO: 971406 - RNA, 25 nt, Human
cagccauacccugugagguccuggc

SEQ ID NO: 971407 - RNA, 26 nt, Human
cagcccgaggacaggagaacggcggg

SEQ ID NO: 971408 - RNA, 21 nt, Human
cagcgcuaaccgaucuggggc

SEQ ID NO: 971409 - RNA, 24 nt, Human
caggagagaugaggcagaugcacg

SEQ ID NO: 971410 - RNA, 26 nt, Human
caggcaucgcccaguguucccugggg

SEQ ID NO: 971411 - RNA, 18 nt, Human
cagggccaaaccaucugu

SEQ ID NO: 971412 - RNA, 18 nt, Human
cagggucacccagcaagc

SEQ ID NO: 971413 - RNA, 21 nt, Human
caggugacaaccgacaagucc

SEQ ID NO: 971414 - RNA, 23 nt, Human
cagucucgaccccacagacgcgg

SEQ ID NO: 971415 - RNA, 25 nt, Human
cauaucuccaccaaguauguaacca

SEQ ID NO: 971416 - RNA, 20 nt, Human
cauucggggcuggauuguuc

SEQ ID NO: 971417 - RNA, 19 nt, Human
ccacacucugggcugcuga

SEQ ID NO: 971418 - RNA, 21 nt, Human
ccagccaacagacacugacaa

SEQ ID NO: 971419 - RNA, 18 nt, Human
ccaggcccacccccuccc

SEQ ID NO: 971420 - RNA, 22 nt, Human
ccaggcccacccccucccuuuu

SEQ ID NO: 971421 - RNA, 18 nt, Human
ccaggccugcagucagag

SEQ ID NO: 971422 - RNA, 21 nt, Human
cccaagucccacgaugugcua

SEQ ID NO: 971423 - RNA, 20 nt, Human
ccccacagacgcggcccgga

SEQ ID NO: 971424 - RNA, 20 nt, Human
ccccagaagccccugccucu

SEQ ID NO: 971425 - RNA, 22 nt, Human
ccccgguugaacguugagauga

SEQ ID NO: 971426 - RNA, 19 nt, Human
cccuggaacucuacucugc

SEQ ID NO: 971427 - RNA, 28 nt, Human
cccuggaacucuacucugccacacuaac

SEQ ID NO: 971428 - RNA, 20 nt, Human
ccucgcuucaugcccuucuc

SEQ ID NO: 971429 - RNA, 30 nt, Human
ccucuugacagccauacccugugagguccu

SEQ ID NO: 971430 - RNA, 18 nt, Human
ccugcagugggugaggcu

SEQ ID NO: 971431 - RNA, 24 nt, Human
cgaaugcagacucagccacgcgga

SEQ ID NO: 971432 - RNA, 21 nt, Human
cgacaaguccaccuguuggga

SEQ ID NO: 971433 - RNA, 21 nt, Human
cgcggaacagcaggaaugcgg

SEQ ID NO: 971434 - RNA, 18 nt, Human
cguccugggcacugcagg

SEQ ID NO: 971435 - RNA, 21 nt, Human
cgugacaaccacaaugucccc

SEQ ID NO: 971436 - RNA, 20 nt, Human
cucugagggcugccccagcc

SEQ ID NO: 971437 - RNA, 27 nt, Human
cugagggcugccccagccaacagacac

SEQ ID NO: 971438 - RNA, 18 nt, Human
cugcagucagagggugac

SEQ ID NO: 971439 - RNA, 22 nt, Human
cuggaacucuacucugccacac

SEQ ID NO: 971440 - RNA, 20 nt, Human
cuggacacuaggcacgagga

SEQ ID NO: 971441 - RNA, 19 nt, Human
cuuaacucccucacugacc

SEQ ID NO: 971442 - RNA, 23 nt, Human
cuuggcaccgagaggcugcccuc

SEQ ID NO: 971443 - RNA, 23 nt, Human
cuugugagcuccugaagcagugc

SEQ ID NO: 971444 - RNA, 19 nt, Human
gaaggugcugacauucggg

SEQ ID NO: 971445 - RNA, 22 nt, Human
gacaaccaaugaggaacugaac

SEQ ID NO: 971446 - RNA, 21 nt, Human
gagcaccccccaucgugacaa

SEQ ID NO: 971447 - RNA, 19 nt, Human
gaggcugggggcucgggag

SEQ ID NO: 971448 - RNA, 21 nt, Human
gagggugacgggggugacacc

SEQ ID NO: 971449 - RNA, 20 nt, Human
gccaacagacacugacaaac

SEQ ID NO: 971450 - RNA, 18 nt, Human
gccacucacccaggguca

SEQ ID NO: 971451 - RNA, 19 nt, Human
gcccagagagaggaagcca

SEQ ID NO: 971452 - RNA, 20 nt, Human
gccccagaagccccugccuc

SEQ ID NO: 971453 - RNA, 18 nt, Human
gcggaacagcaggaaugg

SEQ ID NO: 971454 - RNA, 20 nt, Human
gcggagcaggggcuggaagc

SEQ ID NO: 971455 - RNA, 19 nt, Human
gcuggcaguggccucugcg

SEQ ID NO: 971456 - RNA, 18 nt, Human
ggaacaggucagcagagg

SEQ ID NO: 971457 - RNA, 23 nt, Human
ggagccacccuggaacucuacuc

SEQ ID NO: 971458 - RNA, 22 nt, Human
ggcagucccagcccuacccaca

SEQ ID NO: 971459 - RNA, 23 nt, Human
ggccagggguugggggauaagcu

SEQ ID NO: 971460 - RNA, 23 nt, Human
ggccagggguugggggauaagcu

SEQ ID NO: 971461 - RNA, 27 nt, Human
ggccgcgcagucucgaccccacagacg

SEQ ID NO: 971462 - RNA, 18 nt, Human
ggcucugagggcugcccc

SEQ ID NO: 971463 - RNA, 20 nt, Human
ggcuggaagcucagggagcc

SEQ ID NO: 971464 - RNA, 18 nt, Human
gggacccacacucugggc

SEQ ID NO: 971465 - RNA, 18 nt, Human
gggagggaagagcauggg

SEQ ID NO: 971466 - RNA, 18 nt, Human
ggggagggaagagcaugg

SEQ ID NO: 971467 - RNA, 18 nt, Human
gggggugacaccaugacc

SEQ ID NO: 971468 - RNA, 21 nt, Human
gugcugcugagcagugucucu

SEQ ID NO: 971469 - RNA, 23 nt, Human
guggccaggcucugagggcugcc

SEQ ID NO: 971470 - RNA, 19 nt, Human
gugucucuggccuccaccc

SEQ ID NO: 971471 - RNA, 21 nt, Human
uaaccagcaggacacuggggc

SEQ ID NO: 971472 - RNA, 21 nt, Human
uaagcuuagggcuuccaugcu

SEQ ID NO: 971473 - RNA, 24 nt, Human
ucacaaucacacagcaaauucacu

SEQ ID NO: 971474 - RNA, 21 nt, Human
ucacccagggucacccagcaa

SEQ ID NO: 971475 - RNA, 19 nt, Human
ucacuuccuacuuuccguc

SEQ ID NO: 971476 - RNA, 22 nt, Human
uccaccuguugggaaucccagg

SEQ ID NO: 971477 - RNA, 18 nt, Human
uccaggugcgggcuagcg

SEQ ID NO: 971478 - RNA, 22 nt, Human
uccccaggcaucgcccaguguu

SEQ ID NO: 971479 - RNA, 23 nt, Human
uccccgcagucgcccaggccugc

SEQ ID NO: 971480 - RNA, 18 nt, Human
ucccugggggcaguucac

SEQ ID NO: 971481 - RNA, 21 nt, Human
ucccugggggcaguucacgcu

SEQ ID NO: 971482 - RNA, 22 nt, Human
uccuccuuucuggacacuaggc

SEQ ID NO: 971483 - RNA, 24 nt, Human
uccucgcuucaugcccuucuccug

SEQ ID NO: 971484 - RNA, 19 nt, Human
ucucacugacacccagggu

SEQ ID NO: 971485 - RNA, 18 nt, Human
ucuccuggcacacccugg

SEQ ID NO: 971486 - RNA, 21 nt, Human
ucuccuggcacacccuggcuu

SEQ ID NO: 971487 - RNA, 19 nt, Human
ucucuggccuccacccacu

SEQ ID NO: 971488 - RNA, 21 nt, Human
ucugacaaccaaugaggaacu

SEQ ID NO: 971489 - RNA, 20 nt, Human
ucuggacacuaggcacgagg

SEQ ID NO: 971490 - RNA, 18 nt, Human
ucuggcacuggcccagag

SEQ ID NO: 971491 - RNA, 18 nt, Human
ugaagcagugcccagacc

SEQ ID NO: 971492 - RNA, 23 nt, Human
ugacaaacagacaccuucggucu

SEQ ID NO: 971493 - RNA, 19 nt, Human
ugacaggggacccacacuc

SEQ ID NO: 971494 - RNA, 20 nt, Human
ugacaugggacugugcccuc

SEQ ID NO: 971495 - RNA, 19 nt, Human
ugaccaugggggaaaaggg

SEQ ID NO: 971496 - RNA, 19 nt, Human
ugagagccuggcccugcag

SEQ ID NO: 971497 - RNA, 21 nt, Human
ugagagccuggcccugcagug

SEQ ID NO: 971498 - RNA, 22 nt, Human
ugagaucucacugacacccagg

SEQ ID NO: 971499 - RNA, 18 nt, Human
ugaggcagaugcacggga

SEQ ID NO: 971500 - RNA, 25 nt, Human
ugagggggagggaagagcaagcucc

SEQ ID NO: 971501 - RNA, 23 nt, Human
ugauuaggccaggcccacccccu

SEQ ID NO: 971502 - RNA, 31 nt, Human
ugauuuaaucccagacaacagcccuucuccc

SEQ ID NO: 971503 - RNA, 27 nt, Human
ugcccagaccccugacucacagaaacu

SEQ ID NO: 971504 - RNA, 21 nt, Human
ugcuaccgagcccaaccacac

SEQ ID NO: 971505 - RNA, 22 nt, Human
ugcuuucguugggaggaagaac

SEQ ID NO: 971506 - RNA, 22 nt, Human
uggaggcucaugucucagucca

SEQ ID NO: 971507 - RNA, 21 nt, Human
uggcggggauggcucuuggcc

SEQ ID NO: 971508 - RNA, 21 nt, Human
uggcuguggacugaggcaccg

SEQ ID NO: 971509 - RNA, 18 nt, Human
ugggaaucccaggucugg

SEQ ID NO: 971510 - RNA, 21 nt, Human
ugggcugcucuggucacugca

SEQ ID NO: 971511 - RNA, 19 nt, Human
uggggcagaggggaaggga

SEQ ID NO: 971512 - RNA, 18 nt, Human
ugggggauaagcuuaggg

SEQ ID NO: 971513 - RNA, 19 nt, Human
ugucacaucuggcacuggc

SEQ ID NO: 971514 - RNA, 23 nt, Human
ugucacaucuggcacuggcccag

SEQ ID NO: 971515 - RNA, 20 nt, Human
uguccuggcuggcuguuggc

SEQ ID NO: 971516 - RNA, 23 nt, Human
ugucucaguccagcaacucccgg

SEQ ID NO: 971517 - RNA, 20 nt, Human
ugugacugcugccuugugag

SEQ ID NO: 971518 - RNA, 22 nt, Human
ugugacugcugccuugugagcu

SEQ ID NO: 971519 - RNA, 20 nt, Human
uucaaugucacaucuggcac

SEQ ID NO: 971520 - RNA, 22 nt, Human
uuccagcuucaggacagagugu

SEQ ID NO: 971521 - RNA, 19 nt, Human
uucccugggggcaguucac

SEQ ID NO: 971522 - RNA, 18 nt, Human
uuggcaccgagaggcugc

SEQ ID NO: 971523 - RNA, 20 nt, Human
uugggaggaagaacaggggg

SEQ ID NO: 971524 - RNA, 23 nt, Human
uugggaggaagaacagggggucc

SEQ ID NO: 971525 - RNA, 26 nt, Human
uugucuggaaacauuuuuuauuuuca

SEQ ID NO: 971526 - RNA, 22 nt, Human
uuuccagcuucaggacagagug

SEQ ID NO: 971527 - RNA, 22 nt, Human
uuuuuuuuuuuuuuuugucugg

SEQ ID NO: 971528 - RNA, 18 nt, Human
uuuuuuuuuuuuuuuuug

SEQ ID NO: 971529 - RNA, 24 nt, Human
aaggauaaugggagaggggugggc

SEQ ID NO: 971530 - RNA, 23 nt, Human
acacaccuacaccuccccucaca

SEQ ID NO: 971531 - RNA, 23 nt, Human
acauaccacugcaccccuacaau

SEQ ID NO: 971532 - RNA, 22 nt, Human
aggaaaugguuucucuuucagg

SEQ ID NO: 971533 - RNA, 24 nt, Human
aucaaggaaaugguuucucuuuca

SEQ ID NO: 971534 - RNA, 19 nt, Human
auccugcucagucccaccc

SEQ ID NO: 971535 - RNA, 24 nt, Human
cacauaccacugcaccccuacaau

SEQ ID NO: 971536 - RNA, 26 nt, Human
cacccacacaccuacaccuccccuca

SEQ ID NO: 971537 - RNA, 25 nt, Human
caccuccccucacagcuccagagcc

SEQ ID NO: 971538 - RNA, 19 nt, Human
cacugcaccccuacaaugc

SEQ ID NO: 971539 - RNA, 21 nt, Human
cacugcaccccuacaaugccc

SEQ ID NO: 971540 - RNA, 20 nt, Human
cagcaaguuccuuacacaau

SEQ ID NO: 971541 - RNA, 22 nt, Human
cauccugcucagucccacccac

SEQ ID NO: 971542 - RNA, 23 nt, Human
cccacacaccuacaccuccccuc

SEQ ID NO: 971543 - RNA, 24 nt, Human
cccacccacccugggcagaagcug

SEQ ID NO: 971544 - RNA, 18 nt, Human
cccagaugccccaggccu

SEQ ID NO: 971545 - RNA, 22 nt, Human
cccugagcaacgcucuuggccu

SEQ ID NO: 971546 - RNA, 21 nt, Human
ccuacaaugcccagaugcccc

SEQ ID NO: 971547 - RNA, 22 nt, Human
ccuacaccuccccucacagcuc

SEQ ID NO: 971548 - RNA, 24 nt, Human
cugcaccccuacaaugcccagaug

SEQ ID NO: 971549 - RNA, 20 nt, Human
gcacagagcagucacccaca

SEQ ID NO: 971550 - RNA, 24 nt, Human
gcccugagcaacgcucuuggccua

SEQ ID NO: 971551 - RNA, 18 nt, Human
ggacguggagggcuggcg

SEQ ID NO: 971552 - RNA, 19 nt, Human
ggaggacguggagggcugg

SEQ ID NO: 971553 - RNA, 18 nt, Human
ggcagaagcugcccugag

SEQ ID NO: 971554 - RNA, 19 nt, Human
uacaaugcccagaugcccc

SEQ ID NO: 971555 - RNA, 19 nt, Human
ucccacccacccugggcag

SEQ ID NO: 971556 - RNA, 22 nt, Human
uccgagggaugcaacccacgcc

SEQ ID NO: 971557 - RNA, 20 nt, Human
ugccccaggccugagucagc

SEQ ID NO: 971558 - RNA, 20 nt, Human
uuuuuuuuuuuuaggagccu

SEQ ID NO: 971559 - RNA, 25 nt, Human
uuuuuuuuuuuuuuuuuuuuuuagg

SEQ ID NO: 971560 - RNA, 21 nt, Human
agccccccagcccagggcugg

SEQ ID NO: 971561 - RNA, 21 nt, Human
aggagccccccagcccagggc

SEQ ID NO: 971562 - RNA, 20 nt, Human
ccagcccagggcugggcucu

SEQ ID NO: 971563 - RNA, 18 nt, Human
cccagcccagggcugggc

SEQ ID NO: 971564 - RNA, 19 nt, Human
ccccagcccagggcugggc

SEQ ID NO: 971565 - RNA, 21 nt, Human
ccccccagcccagggcugggc

SEQ ID NO: 971566 - RNA, 23 nt, Human
cgggcagaagucaggggggccac

SEQ ID NO: 971567 - RNA, 25 nt, Human
cuaaggucuuggggucucugagggg

SEQ ID NO: 971568 - RNA, 24 nt, Human
cucugaggggcacugucuucaggg

SEQ ID NO: 971569 - RNA, 20 nt, Human
gggucucugaggggcacugu

SEQ ID NO: 971570 - RNA, 18 nt, Human
uaaggucuuggggucucu

SEQ ID NO: 971571 - RNA, 22 nt, Human
uaaggucuuggggucucugagg

SEQ ID NO: 971572 - RNA, 18 nt, Human
ucaaucccuaaggucuug

SEQ ID NO: 971573 - RNA, 23 nt, Human
ucccuaaggucuuggggucucug

SEQ ID NO: 971574 - RNA, 18 nt, Human
ucucugaggggcacuguc

SEQ ID NO: 971575 - RNA, 25 nt, Human
ucuuggggucucugaggggcacugu

SEQ ID NO: 971576 - RNA, 18 nt, Human
ugaggagccccccagccc

SEQ ID NO: 971577 - RNA, 24 nt, Human
ugaggcccaggugucaaucccuaa

SEQ ID NO: 971578 - RNA, 19 nt, Human
ccucaugcuguuuccuggg

SEQ ID NO: 971579 - RNA, 24 nt, Human
ccuggggucuccacucccagacuc

SEQ ID NO: 971580 - RNA, 20 nt, Human
cucacacccucaccucaugc

SEQ ID NO: 971581 - RNA, 20 nt, Human
ucccucacacccucaccuca

SEQ ID NO: 971582 - RNA, 18 nt, Human
uccuggggucuccacucc

SEQ ID NO: 971583 - RNA, 24 nt, Human
ucuccacucccagacuccuacucc

SEQ ID NO: 971584 - RNA, 18 nt, Human
ugcacagaaucucagaac

SEQ ID NO: 971585 - RNA, 28 nt, Human
aaaaggaaacagagcacggaugacagaa

SEQ ID NO: 971586 - RNA, 19 nt, Human
aaaggaagagggggucggc

SEQ ID NO: 971587 - RNA, 20 nt, Human
aaaggggaaaaggaagaggg

SEQ ID NO: 971588 - RNA, 18 nt, Human
aagcagcuuccaguuuua

SEQ ID NO: 971589 - RNA, 21 nt, Human
aaggaaacagagcacggauga

SEQ ID NO: 971590 - RNA, 20 nt, Human
aaggucccuuugugcuuccu

SEQ ID NO: 971591 - RNA, 20 nt, Human
acaccaaaaccucccucuuc

SEQ ID NO: 971592 - RNA, 23 nt, Human
agacaaauggaucuucuauuccc

SEQ ID NO: 971593 - RNA, 19 nt, Human
agccaguugcugcuccagg

SEQ ID NO: 971594 - RNA, 19 nt, Human
aggaugcacuuccaucccu

SEQ ID NO: 971595 - RNA, 23 nt, Human
agggcucugggguagggcagggg

SEQ ID NO: 971596 - RNA, 18 nt, Human
aggggcccgaguuucugc

SEQ ID NO: 971597 - RNA, 18 nt, Human
auggagacagugaggugg

SEQ ID NO: 971598 - RNA, 25 nt, Human
caagcgacgagaaaaacggugccuc

SEQ ID NO: 971599 - RNA, 18 nt, Human
cacuguggcuggcagaac

SEQ ID NO: 971600 - RNA, 27 nt, Human
caggaacaaagauaauguggagaagaa

SEQ ID NO: 971601 - RNA, 26 nt, Human
ccagccacagucucacagucuuccuc

SEQ ID NO: 971602 - RNA, 23 nt, Human
ccagggugagcuccgugguucag

SEQ ID NO: 971603 - RNA, 19 nt, Human
ccugaaucaggcccugggg

SEQ ID NO: 971604 - RNA, 18 nt, Human
ccugucccugcagaacac

SEQ ID NO: 971605 - RNA, 20 nt, Human
cgagaaaaacggugccucac

SEQ ID NO: 971606 - RNA, 23 nt, Human
cgcgaccucggcguccggacgcg

SEQ ID NO: 971607 - RNA, 22 nt, Human
cgcucccuuuucugagggcgga

SEQ ID NO: 971608 - RNA, 18 nt, Human
cggaugacagaaaugaca

SEQ ID NO: 971609 - RNA, 21 nt, Human
cggcagccuggcucaggaguc

SEQ ID NO: 971610 - RNA, 25 nt, Human
cggggaacaccgggcugagggaguc

SEQ ID NO: 971611 - RNA, 20 nt, Human
cucugggguagggcaggggc

SEQ ID NO: 971612 - RNA, 24 nt, Human
cugaaaguaauaauaggggcucac

SEQ ID NO: 971613 - RNA, 27 nt, Human
cuuggauccacauuugccccgucucuu

SEQ ID NO: 971614 - RNA, 22 nt, Human
cuuugguaugagcuagaucauc

SEQ ID NO: 971615 - RNA, 20 nt, Human
gaagagggggucggccagua

SEQ ID NO: 971616 - RNA, 22 nt, Human
gaagccgcgcggcgacggggga

SEQ ID NO: 971617 - RNA, 20 nt, Human
gaccucggcguccggacgcg

SEQ ID NO: 971618 - RNA, 18 nt, Human
gaccuggucauggcccug

SEQ ID NO: 971619 - RNA, 21 nt, Human
gagaaaaacggugccucacau

SEQ ID NO: 971620 - RNA, 25 nt, Human
gagucaguccugaaucaggcccugg

SEQ ID NO: 971621 - RNA, 22 nt, Human
gcggcgacgggggaggccuuca

SEQ ID NO: 971622 - RNA, 23 nt, Human
gcggcgacgggggaggccuucac

SEQ ID NO: 971623 - RNA, 21 nt, Human
ggagacagugagguggaaaac

SEQ ID NO: 971624 - RNA, 19 nt, Human
ggauggagacagugaggug

SEQ ID NO: 971625 - RNA, 18 nt, Human
ggcacagugaggacagag

SEQ ID NO: 971626 - RNA, 19 nt, Human
guccuuugguaugagcuag

SEQ ID NO: 971627 - RNA, 20 nt, Human
guggcuggcagaacugguac

SEQ ID NO: 971628 - RNA, 23 nt, Human
uaauguggagaagaaacuccaaa

SEQ ID NO: 971629 - RNA, 20 nt, Human
uacacaaagacaaauggauc

SEQ ID NO: 971630 - RNA, 20 nt, Human
uauguugaaucagaagccau

SEQ ID NO: 971631 - RNA, 19 nt, Human
ucacuaaaggggaaaagga

SEQ ID NO: 971632 - RNA, 23 nt, Human
ucagagguggaggauggagacag

SEQ ID NO: 971633 - RNA, 20 nt, Human
uccaaaaggaaacagagcac

SEQ ID NO: 971634 - RNA, 24 nt, Human
ucccagaggaccagggacaccucg

SEQ ID NO: 971635 - RNA, 19 nt, Human
uccccgaaagagggcuagg

SEQ ID NO: 971636 - RNA, 19 nt, Human
ucccucuucagaauggagg

SEQ ID NO: 971637 - RNA, 20 nt, Human
ucccucuucagaauggaggu

SEQ ID NO: 971638 - RNA, 20 nt, Human
ucccuguacuacaggguggc

SEQ ID NO: 971639 - RNA, 18 nt, Human
uccgugguucagucagag

SEQ ID NO: 971640 - RNA, 19 nt, Human
ugacagcuucuccugcagg

SEQ ID NO: 971641 - RNA, 19 nt, Human
ugagaucaacaucgcuccc

SEQ ID NO: 971642 - RNA, 21 nt, Human
ugagcuagaucauccaggccu

SEQ ID NO: 971643 - RNA, 22 nt, Human
ugagcuagaucauccaggccug

SEQ ID NO: 971644 - RNA, 21 nt, Human
ugaggacagaggcgggguccu

SEQ ID NO: 971645 - RNA, 21 nt, Human
ugagguggaaaacgugcuugc

SEQ ID NO: 971646 - RNA, 25 nt, Human
ugccccgucucuuaaguguccaucu

SEQ ID NO: 971647 - RNA, 27 nt, Human
ugccucacaugcuugagaugugacagc

SEQ ID NO: 971648 - RNA, 21 nt, Human
uggagaagaaacuccaaaagg

SEQ ID NO: 971649 - RNA, 21 nt, Human
uggauccacauuugccccguc

SEQ ID NO: 971650 - RNA, 26 nt, Human
uggcucaggagucagguagauagaug

SEQ ID NO: 971651 - RNA, 19 nt, Human
uggggacuacaggggaagc

SEQ ID NO: 971652 - RNA, 26 nt, Human
ugguggagagucaguccugaaucagg

SEQ ID NO: 971653 - RNA, 20 nt, Human
ugucacagacaaucugaaag

SEQ ID NO: 971654 - RNA, 20 nt, Human
ugugacagcuucuccugcag

SEQ ID NO: 971655 - RNA, 27 nt, Human
uucagaauggagguagacagauaaaaa

SEQ ID NO: 971656 - RNA, 18 nt, Human
uuuuuuuuuuuuaggucc

SEQ ID NO: 971657 - RNA, 21 nt, Human
uuuuuuuuuuuuuuuuuuagg

SEQ ID NO: 971658 - RNA, 18 nt, Human
aaaaauauacuucuucca

SEQ ID NO: 971659 - RNA, 21 nt, Human
aaagcgcuccgcccggggccg

SEQ ID NO: 971660 - RNA, 20 nt, Human
aagaaccugggagcgcgcag

SEQ ID NO: 971661 - RNA, 22 nt, Human
aagcacugaaaauaugagacau

SEQ ID NO: 971662 - RNA, 18 nt, Human
aaggaauucuagggucaa

SEQ ID NO: 971663 - RNA, 20 nt, Human
aaugccaauacauaauuuuu

SEQ ID NO: 971664 - RNA, 19 nt, Human
aauuuccuuuuucuuaggc

SEQ ID NO: 971665 - RNA, 23 nt, Human
acacacacacacauacacacaca

SEQ ID NO: 971666 - RNA, 23 nt, Human
acacacacacauacacacacaca

SEQ ID NO: 971667 - RNA, 21 nt, Human
acacauacacacacacacaua

SEQ ID NO: 971668 - RNA, 18 nt, Human
agaaagggagggugcggg

SEQ ID NO: 971669 - RNA, 21 nt, Human
agaaagggagggugcggggug

SEQ ID NO: 971670 - RNA, 21 nt, Human
agcacugaaaauaugagacau

SEQ ID NO: 971671 - RNA, 19 nt, Human
agcagguugagacagaugc

SEQ ID NO: 971672 - RNA, 20 nt, Human
aggaauucuagggucaaggu

SEQ ID NO: 971673 - RNA, 22 nt, Human
agggagggugcggggugggucg

SEQ ID NO: 971674 - RNA, 23 nt, Human
agggagggugcggggugggucgg

SEQ ID NO: 971675 - RNA, 23 nt, Human
agggugcagaaagggagggugcg

SEQ ID NO: 971676 - RNA, 21 nt, Human
caauacauaauuuuuugugug

SEQ ID NO: 971677 - RNA, 24 nt, Human
cacacacacacauacacacacaca

SEQ ID NO: 971678 - RNA, 22 nt, Human
cacacacauacacacacacaca

SEQ ID NO: 971679 - RNA, 19 nt, Human
cacacuaagaaaaaucagc

SEQ ID NO: 971680 - RNA, 18 nt, Human
cacuggauuuaagugugg

SEQ ID NO: 971681 - RNA, 21 nt, Human
cagauucccugaucacuuuuc

SEQ ID NO: 971682 - RNA, 20 nt, Human
cagggcaaacauuuuccccc

SEQ ID NO: 971683 - RNA, 22 nt, Human
caguaugagugagguguuuccu

SEQ ID NO: 971684 - RNA, 19 nt, Human
caguauuuuauuuagaugg

SEQ ID NO: 971685 - RNA, 23 nt, Human
cccauacuuacugguuccaaaaa

SEQ ID NO: 971686 - RNA, 22 nt, Human
cuacuauggaugagaaacaaag

SEQ ID NO: 971687 - RNA, 19 nt, Human
cugcacgcgaaagcgcucc

SEQ ID NO: 971688 - RNA, 21 nt, Human
gacucaucagugcauuagcaa

SEQ ID NO: 971689 - RNA, 18 nt, Human
gcaaacaaaguuuguauc

SEQ ID NO: 971690 - RNA, 20 nt, Human
gcuguguagcuaccucuccu

SEQ ID NO: 971691 - RNA, 23 nt, Human
ggaagucugugccucagcagguu

SEQ ID NO: 971692 - RNA, 20 nt, Human
ggagcggggccgggcgguca

SEQ ID NO: 971693 - RNA, 23 nt, Human
ggagugguggcugcacgcgaaag

SEQ ID NO: 971694 - RNA, 18 nt, Human
ggaugagaaacaaaguug

SEQ ID NO: 971695 - RNA, 21 nt, Human
ggcaaaacuuuauauacuuga

SEQ ID NO: 971696 - RNA, 22 nt, Human
ggggugugggugcgagggugca

SEQ ID NO: 971697 - RNA, 22 nt, Human
gggucggggugcagugcggagc

SEQ ID NO: 971698 - RNA, 22 nt, Human
ggugcgagggugcagaaaggga

SEQ ID NO: 971699 - RNA, 20 nt, Human
ggugcggggugggucggggu

SEQ ID NO: 971700 - RNA, 24 nt, Human
uaaagagagagaccuguagagaga

SEQ ID NO: 971701 - RNA, 25 nt, Human
uaaauaaaugccaauacauaauuuu

SEQ ID NO: 971702 - RNA, 19 nt, Human
uaaauacaauauaauauua

SEQ ID NO: 971703 - RNA, 20 nt, Human
uaaguaaagaccuugugacc

SEQ ID NO: 971704 - RNA, 22 nt, Human
uaaguuaacuucauuuuguuca

SEQ ID NO: 971705 - RNA, 23 nt, Human
uacuacuauggaugagaaacaaa

SEQ ID NO: 971706 - RNA, 20 nt, Human
uacugauugaagcuggaaga

SEQ ID NO: 971707 - RNA, 19 nt, Human
uagcaaacaaaguuuguau

SEQ ID NO: 971708 - RNA, 22 nt, Human
uagcaaacaaaguuuguaucaa

SEQ ID NO: 971709 - RNA, 20 nt, Human
uagcaugcuggguagcaugg

SEQ ID NO: 971710 - RNA, 24 nt, Human
uaggugcuuccuucuagcuuggcc

SEQ ID NO: 971711 - RNA, 18 nt, Human
uauaaugaaacuagacuc

SEQ ID NO: 971712 - RNA, 24 nt, Human
uaucauaacaaauauaaaaacucu

SEQ ID NO: 971713 - RNA, 18 nt, Human
uauuuuauuuagaugggg

SEQ ID NO: 971714 - RNA, 19 nt, Human
ucaagggagugacugaagu

SEQ ID NO: 971715 - RNA, 21 nt, Human
ucaauaccugagaaucgugga

SEQ ID NO: 971716 - RNA, 20 nt, Human
ucagcucaucacuucacuuu

SEQ ID NO: 971717 - RNA, 22 nt, Human
ucauagucacauaaaauucauu

SEQ ID NO: 971718 - RNA, 18 nt, Human
uccaagaaccugggagcg

SEQ ID NO: 971719 - RNA, 24 nt, Human
uccaauauuaacuuauguauuaau

SEQ ID NO: 971720 - RNA, 23 nt, Human
ucccccuguuucugucuauugug

SEQ ID NO: 971721 - RNA, 22 nt, Human
ucugugccucagcagguugaga

SEQ ID NO: 971722 - RNA, 20 nt, Human
ucuuaggcuuuuucacaucu

SEQ ID NO: 971723 - RNA, 20 nt, Human
ugaaaaagugccaaagagua

SEQ ID NO: 971724 - RNA, 23 nt, Human
ugaaaaucaggucuacugauuga

SEQ ID NO: 971725 - RNA, 18 nt, Human
ugagaaagcacugaaaau

SEQ ID NO: 971726 - RNA, 24 nt, Human
ugagaaagcacugaaaauaugaga

SEQ ID NO: 971727 - RNA, 21 nt, Human
ugagaaauugaauuacgugga

SEQ ID NO: 971728 - RNA, 23 nt, Human
ugagaaauugaauuacguggaag

SEQ ID NO: 971729 - RNA, 23 nt, Human
ugaggguaggugaggaauaaugg

SEQ ID NO: 971730 - RNA, 23 nt, Human
ugaguguguauguguaacaccag

SEQ ID NO: 971731 - RNA, 22 nt, Human
ugcauaaguaaagaccuuguga

SEQ ID NO: 971732 - RNA, 19 nt, Human
ugcauaccaucucuccaga

SEQ ID NO: 971733 - RNA, 21 nt, Human
ugcauaccaucucuccagaac

SEQ ID NO: 971734 - RNA, 22 nt, Human
ugcauaccaucucuccagaacu

SEQ ID NO: 971735 - RNA, 23 nt, Human
ugccauuaauaaaagaauaacaa

SEQ ID NO: 971736 - RNA, 24 nt, Human
ugccauuaauaaaagaauaacaaa

SEQ ID NO: 971737 - RNA, 21 nt, Human
ugcuauaaugaaacuagacuc

SEQ ID NO: 971738 - RNA, 22 nt, Human
uggaaacauacaaauuagccca

SEQ ID NO: 971739 - RNA, 20 nt, Human
uggaugagaaacaaaguugu

SEQ ID NO: 971740 - RNA, 20 nt, Human
uguuacuuauuuuaucaugg

SEQ ID NO: 971741 - RNA, 23 nt, Human
uuaaugaauuucuugccccuuuc

SEQ ID NO: 971742 - RNA, 19 nt, Human
uuagcagugugccucucau

SEQ ID NO: 971743 - RNA, 20 nt, Human
uucaagggagugacugaagu

SEQ ID NO: 971744 - RNA, 20 nt, Human
uucaagggagugacugaagu

SEQ ID NO: 971745 - RNA, 24 nt, Human
uucaagggagugacugaaguuauu

SEQ ID NO: 971746 - RNA, 19 nt, Human
uuccugaugcacauggugg

SEQ ID NO: 971747 - RNA, 22 nt, Human
uugaauuacguggaagaaauuu

SEQ ID NO: 971748 - RNA, 20 nt, Human
uuucuugccccuuucucuuu

SEQ ID NO: 971749 - RNA, 23 nt, Human
uuugcccgugcucagaauauuac

SEQ ID NO: 971750 - RNA, 23 nt, Human
aagagccccagauggcugguggg

SEQ ID NO: 971751 - RNA, 23 nt, Human
aaggaagaagagccccagauggc

SEQ ID NO: 971752 - RNA, 20 nt, Human
agaaaggaagaagagcccca

SEQ ID NO: 971753 - RNA, 21 nt, Human
agaaaggaagaagagccccag

SEQ ID NO: 971754 - RNA, 19 nt, Human
auacacggggggaagaaag

SEQ ID NO: 971755 - RNA, 19 nt, Human
ccccagauggcugguggcc

SEQ ID NO: 971756 - RNA, 22 nt, Human
aaauaccccucuugucuuaucc

SEQ ID NO: 971757 - RNA, 21 nt, Human
aaggaugagagggcccgaagc

SEQ ID NO: 971758 - RNA, 20 nt, Human
acacucuuggcacuggccuu

SEQ ID NO: 971759 - RNA, 25 nt, Human
agcagguggacuccaaaauaccccu

SEQ ID NO: 971760 - RNA, 20 nt, Human
aggcacacaggcaccaucca

SEQ ID NO: 971761 - RNA, 20 nt, Human
caacaaccccugagcugaaa

SEQ ID NO: 971762 - RNA, 20 nt, Human
cacuccaggucgggggcagg

SEQ ID NO: 971763 - RNA, 21 nt, Human
ccacccagcuucccaaggguc

SEQ ID NO: 971764 - RNA, 19 nt, Human
ccacuccaggucgggggca

SEQ ID NO: 971765 - RNA, 21 nt, Human
ccagcuucccaagggucucag

SEQ ID NO: 971766 - RNA, 24 nt, Human
cccuccacagccauccccaaggcc

SEQ ID NO: 971767 - RNA, 23 nt, Human
ccgaagccagcaagucucgcccc

SEQ ID NO: 971768 - RNA, 21 nt, Human
ccucuugucuuauccacucca

SEQ ID NO: 971769 - RNA, 20 nt, Human
cgccccaccuaccagccccc

SEQ ID NO: 971770 - RNA, 21 nt, Human
cguucccuccacagccauccc

SEQ ID NO: 971771 - RNA, 24 nt, Human
cuaccagcccccacccagcuuccc

SEQ ID NO: 971772 - RNA, 20 nt, Human
cuuccgccacguucccucca

SEQ ID NO: 971773 - RNA, 19 nt, Human
cuuggcacuggccuuucac

SEQ ID NO: 971774 - RNA, 26 nt, Human
gccccaccuaccagcccccacccagc

SEQ ID NO: 971775 - RNA, 20 nt, Human
ggacuccaaaauaccccucu

SEQ ID NO: 971776 - RNA, 19 nt, Human
ggaugagagggcccgaagc

SEQ ID NO: 971777 - RNA, 18 nt, Human
ggcagggaagcacauggg

SEQ ID NO: 971778 - RNA, 19 nt, Human
gggcagggaagcacauggg

SEQ ID NO: 971779 - RNA, 23 nt, Human
uccaaaauaccccucuugucuua

SEQ ID NO: 971780 - RNA, 31 nt, Human
uccaaaauaccccucuugucuuauccacucu

SEQ ID NO: 971781 - RNA, 22 nt, Human
uccaggucgggggcagggaagc

SEQ ID NO: 971782 - RNA, 24 nt, Human
uccgccacguucccuccacagcca

SEQ ID NO: 971783 - RNA, 23 nt, Human
ugccagagguccagucaggggag

SEQ ID NO: 971784 - RNA, 18 nt, Human
uggacuccaaaauacccc

SEQ ID NO: 971785 - RNA, 19 nt, Human
uuaauggaaugaaggauga

SEQ ID NO: 971786 - RNA, 18 nt, Human
uuuuuuuuuuuuuugcgg

SEQ ID NO: 971787 - RNA, 18 nt, Human
uuuuuuuuuuuuuuuuug

SEQ ID NO: 971788 - RNA, 21 nt, Human
uuuuuuuuuuuuuuuuugcgg

SEQ ID NO: 971789 - RNA, 22 nt, Human
uuuuuuuuuuuuuuuuugcggg

SEQ ID NO: 971790 - RNA, 21 nt, Human
aaaaaaggaaaaagaaaaaga

SEQ ID NO: 971791 - RNA, 23 nt, Human
aaaaccaccauugagcacccuac

SEQ ID NO: 971792 - RNA, 24 nt, Human
aaaagaaaaagaaaacccucagaa

SEQ ID NO: 971793 - RNA, 25 nt, Human
aaaagucaccuauagaaaauugcac

SEQ ID NO: 971794 - RNA, 23 nt, Human
aaaccuacggacucucucccuag

SEQ ID NO: 971795 - RNA, 23 nt, Human
aaaugcuagaauugauuaaagcc

SEQ ID NO: 971796 - RNA, 20 nt, Human
aaccuacggacucucucccu

SEQ ID NO: 971797 - RNA, 23 nt, Human
aagaaauuaguucaaaauaaagc

SEQ ID NO: 971798 - RNA, 20 nt, Human
aagacucugacccccagccc

SEQ ID NO: 971799 - RNA, 22 nt, Human
aagacucugacccccagccccc

SEQ ID NO: 971800 - RNA, 25 nt, Human
aagacucugacccccagccccccac

SEQ ID NO: 971801 - RNA, 25 nt, Human
aagcacaaaaagccagcagcacuuc

SEQ ID NO: 971802 - RNA, 24 nt, Human
aaucacuugaauccagaaggcaga

SEQ ID NO: 971803 - RNA, 24 nt, Human
aaugauguuucuugccacugugga

SEQ ID NO: 971804 - RNA, 20 nt, Human
acaaucauauauuuuuuuca

SEQ ID NO: 971805 - RNA, 25 nt, Human
accuaccuucauguccccucccccc

SEQ ID NO: 971806 - RNA, 21 nt, Human
acguacauaacuuagagaggu

SEQ ID NO: 971807 - RNA, 22 nt, Human
acucuuuguggucagcuuuuga

SEQ ID NO: 971808 - RNA, 24 nt, Human
acugcacuccagcccaggcaacag

SEQ ID NO: 971809 - RNA, 18 nt, Human
acuugaauccagaaggca

SEQ ID NO: 971810 - RNA, 24 nt, Human
acuugaggucgggaguucaagacc

SEQ ID NO: 971811 - RNA, 21 nt, Human
agaaugcauguaacauacugu

SEQ ID NO: 971812 - RNA, 26 nt, Human
agacagaucacuugaggucgggaguu

SEQ ID NO: 971813 - RNA, 18 nt, Human
agagguugcagugagcug

SEQ ID NO: 971814 - RNA, 22 nt, Human
agagguugcagugagcugagau

SEQ ID NO: 971815 - RNA, 23 nt, Human
agagguugcagugagcugagauc

SEQ ID NO: 971816 - RNA, 24 nt, Human
agagguugcagugagcugagauca

SEQ ID NO: 971817 - RNA, 20 nt, Human
agagguugcagugagcuggc

SEQ ID NO: 971818 - RNA, 23 nt, Human
agaucacuugaggucgggaguuc

SEQ ID NO: 971819 - RNA, 18 nt, Human
agcaccaaaauguagugg

SEQ ID NO: 971820 - RNA, 18 nt, Human
agccuagguuaagaaauu

SEQ ID NO: 971821 - RNA, 22 nt, Human
agccuggccaacauggggaaac

SEQ ID NO: 971822 - RNA, 18 nt, Human
aggaaaaagaaaaagaaa

SEQ ID NO: 971823 - RNA, 23 nt, Human
aggaaaaagaaaaagaaaacccu

SEQ ID NO: 971824 - RNA, 22 nt, Human
aggaagagaaaacguuuuaaaa

SEQ ID NO: 971825 - RNA, 21 nt, Human
aggauccuaauuuuuccaucu

SEQ ID NO: 971826 - RNA, 22 nt, Human
aggauccuaauuuuuccaucuu

SEQ ID NO: 971827 - RNA, 22 nt, Human
aggcaacagaacaagacucuga

SEQ ID NO: 971828 - RNA, 19 nt, Human
aggcagagguugcagugag

SEQ ID NO: 971829 - RNA, 20 nt, Human
aggcagagguugcagugagc

SEQ ID NO: 971830 - RNA, 24 nt, Human
aggcagagguugcagugagcugag

SEQ ID NO: 971831 - RNA, 18 nt, Human
aggcaggagaaucacuug

SEQ ID NO: 971832 - RNA, 23 nt, Human
aggcaggagaaucacuugaaucc

SEQ ID NO: 971833 - RNA, 24 nt, Human
aggcaggagaaucacuugaaucca

SEQ ID NO: 971834 - RNA, 21 nt, Human
aggccgagguagacagaucac

SEQ ID NO: 971835 - RNA, 24 nt, Human
aggcugaggcaggagaaucacuug

SEQ ID NO: 971836 - RNA, 22 nt, Human
agguagacagaucacuugaggg

SEQ ID NO: 971837 - RNA, 22 nt, Human
agguagacagaucacuugaggu

SEQ ID NO: 971838 - RNA, 26 nt, Human
agguagacagaucacuugaggucggg

SEQ ID NO: 971839 - RNA, 20 nt, Human
aguauguauaguccauuugu

SEQ ID NO: 971840 - RNA, 22 nt, Human
auagaaaacaugagcuguaaca

SEQ ID NO: 971841 - RNA, 23 nt, Human
aucaugccacugcacuccagccc

SEQ ID NO: 971842 - RNA, 21 nt, Human
aucuccugaaacuuacuaaca

SEQ ID NO: 971843 - RNA, 21 nt, Human
augcauguaacauacugugga

SEQ ID NO: 971844 - RNA, 25 nt, Human
augccacugcacuccagcccaggca

SEQ ID NO: 971845 - RNA, 18 nt, Human
auguccccuccccccuaa

SEQ ID NO: 971846 - RNA, 24 nt, Human
caaaaaaaaaaaaaaaggaaaaag

SEQ ID NO: 971847 - RNA, 23 nt, Human
caacacugaauuuggugaaacac

SEQ ID NO: 971848 - RNA, 24 nt, Human
caagaggcugaggcaggagaauca

SEQ ID NO: 971849 - RNA, 25 nt, Human
caauagaaauuaaaugggucauagu

SEQ ID NO: 971850 - RNA, 21 nt, Human
caauguauuaaaaaugcauau

SEQ ID NO: 971851 - RNA, 18 nt, Human
cacacaaauaaauaaggu

SEQ ID NO: 971852 - RNA, 23 nt, Human
cacaccuguaaucucagcacuuu

SEQ ID NO: 971853 - RNA, 22 nt, Human
cacccuacaauaugccaagcac

SEQ ID NO: 971854 - RNA, 18 nt, Human
caccuguaaucucagcac

SEQ ID NO: 971855 - RNA, 22 nt, Human
caccuguaaucucagcacuuua

SEQ ID NO: 971856 - RNA, 19 nt, Human
caccuguagucccagcuac

SEQ ID NO: 971857 - RNA, 22 nt, Human
caccuguagucccagcuacuca

SEQ ID NO: 971858 - RNA, 19 nt, Human
cacugcacuccagcccagg

SEQ ID NO: 971859 - RNA, 21 nt, Human
cacugcacuccagcccaggca

SEQ ID NO: 971860 - RNA, 22 nt, Human
cacugcacuccagcccaggcaa

SEQ ID NO: 971861 - RNA, 23 nt, Human
cacugcacuccagcccaggcaac

SEQ ID NO: 971862 - RNA, 26 nt, Human
cacugcacuccagcccaggcaacaga

SEQ ID NO: 971863 - RNA, 23 nt, Human
cacuugaggucgggaguucaaga

SEQ ID NO: 971864 - RNA, 19 nt, Human
cagaacaagacucugaccc

SEQ ID NO: 971865 - RNA, 23 nt, Human
cagaacaagacucugacccccag

SEQ ID NO: 971866 - RNA, 24 nt, Human
cagaacaagacucugacccccagc

SEQ ID NO: 971867 - RNA, 24 nt, Human
cagaucacuugaggucgggaguuc

SEQ ID NO: 971868 - RNA, 18 nt, Human
cagcacuuuaggaggccg

SEQ ID NO: 971869 - RNA, 24 nt, Human
cagcacuuuaggaggccgagguag

SEQ ID NO: 971870 - RNA, 18 nt, Human
cagcagcacuguauguga

SEQ ID NO: 971871 - RNA, 20 nt, Human
cagcccaggcaacagaacaa

SEQ ID NO: 971872 - RNA, 21 nt, Human
cagccccccaccaaaaaaaaa

SEQ ID NO: 971873 - RNA, 24 nt, Human
cagccuggccaacauggggaaacu

SEQ ID NO: 971874 - RNA, 24 nt, Human
cagcuacucaagaggcugaggcag

SEQ ID NO: 971875 - RNA, 24 nt, Human
caugagcuguaacaaaugcacgau

SEQ ID NO: 971876 - RNA, 25 nt, Human
cauguacacacagaaaauguuccau

SEQ ID NO: 971877 - RNA, 26 nt, Human
ccaagcacucuguugaaaucugugcu

SEQ ID NO: 971878 - RNA, 24 nt, Human
ccaccaaaaaaaaaaaaaaaggaa

SEQ ID NO: 971879 - RNA, 19 nt, Human
ccacugcacuccagcccag

SEQ ID NO: 971880 - RNA, 20 nt, Human
ccacugcacuccagcccagg

SEQ ID NO: 971881 - RNA, 20 nt, Human
ccacugcacuccagcccagg

SEQ ID NO: 971882 - RNA, 21 nt, Human
ccacugcacuccagcccaggc

SEQ ID NO: 971883 - RNA, 24 nt, Human
ccacugcacuccagcccaggcaac

SEQ ID NO: 971884 - RNA, 18 nt, Human
ccagccccccaccaaaaa

SEQ ID NO: 971885 - RNA, 28 nt, Human
ccagccccccaccaaaaaaaaaaaaaaa

SEQ ID NO: 971886 - RNA, 26 nt, Human
cccaccaaaaaaaaaaaaaaaggaaa

SEQ ID NO: 971887 - RNA, 18 nt, Human
ccccaccaaaaaaaaaaa

SEQ ID NO: 971888 - RNA, 22 nt, Human
ccccaccaaaaaaaaaaaaaaa

SEQ ID NO: 971889 - RNA, 21 nt, Human
cccccuauucuaaaaaaaauc

SEQ ID NO: 971890 - RNA, 22 nt, Human
ccgagguagacagaucacuuga

SEQ ID NO: 971891 - RNA, 25 nt, Human
ccuacaauaugccaagcacucuguu

SEQ ID NO: 971892 - RNA, 28 nt, Human
ccuaccuucauguccccuccccccuaaa

SEQ ID NO: 971893 - RNA, 21 nt, Human
ccuacggacucucucccuaga

SEQ ID NO: 971894 - RNA, 20 nt, Human
ccuggccaacauggggaaac

SEQ ID NO: 971895 - RNA, 24 nt, Human
ccuggccaacauggggaaacuucg

SEQ ID NO: 971896 - RNA, 22 nt, Human
ccuguagucccagcuacucaag

SEQ ID NO: 971897 - RNA, 24 nt, Human
cgagguagacagaucacuugaggu

SEQ ID NO: 971898 - RNA, 20 nt, Human
cgccucuacuaaaaauacaa

SEQ ID NO: 971899 - RNA, 23 nt, Human
cggcuggcuccgccucgccuccu

SEQ ID NO: 971900 - RNA, 21 nt, Human
cgggcaccuguagucccagcu

SEQ ID NO: 971901 - RNA, 23 nt, Human
cuaaaaagaaauauaauaagcac

SEQ ID NO: 971902 - RNA, 21 nt, Human
cuauucuaaaaaaaaucacau

SEQ ID NO: 971903 - RNA, 22 nt, Human
cucacaccuguaaucucagcac

SEQ ID NO: 971904 - RNA, 24 nt, Human
cucacaccuguaaucucagcacuu

SEQ ID NO: 971905 - RNA, 20 nt, Human
cucuacuaaaaauacaaaaa

SEQ ID NO: 971906 - RNA, 19 nt, Human
cugaauugcaaaagucacc

SEQ ID NO: 971907 - RNA, 26 nt, Human
cuuaaacuucuuugggucacaguuuu

SEQ ID NO: 971908 - RNA, 23 nt, Human
gaaaaagaaaacccucagaaugu

SEQ ID NO: 971909 - RNA, 23 nt, Human
gaccugucuucaaagaaaacccu

SEQ ID NO: 971910 - RNA, 21 nt, Human
gacucugacccccagcccccc

SEQ ID NO: 971911 - RNA, 23 nt, Human
gagaucaugccacugcacuccag

SEQ ID NO: 971912 - RNA, 23 nt, Human
gagguagacagaucacuugaggu

SEQ ID NO: 971913 - RNA, 23 nt, Human
gaucacuugaggucgggaguuca

SEQ ID NO: 971914 - RNA, 24 nt, Human
gaucacuugaggucgggaguucaa

SEQ ID NO: 971915 - RNA, 21 nt, Human
gauguaaauguuuuccauuau

SEQ ID NO: 971916 - RNA, 22 nt, Human
gcaggagaaucacuugaaucca

SEQ ID NO: 971917 - RNA, 22 nt, Human
gcauguacauguacacacagug

SEQ ID NO: 971918 - RNA, 20 nt, Human
gcugagaucaugccacugca

SEQ ID NO: 971919 - RNA, 18 nt, Human
ggauuugauguaaauguu

SEQ ID NO: 971920 - RNA, 19 nt, Human
ggcaccuguagucccagcu

SEQ ID NO: 971921 - RNA, 23 nt, Human
ggcacgguggcucacaccuguaa

SEQ ID NO: 971922 - RNA, 21 nt, Human
ggccgggcacgguggcucaca

SEQ ID NO: 971923 - RNA, 21 nt, Human
ggcgggcaccuguagucccag

SEQ ID NO: 971924 - RNA, 25 nt, Human
gggaaaagagguacucaaaacucaa

SEQ ID NO: 971925 - RNA, 21 nt, Human
gggaaacuucgccucuacuaa

SEQ ID NO: 971926 - RNA, 24 nt, Human
gguggcgggcaccuguagucccag

SEQ ID NO: 971927 - RNA, 23 nt, Human
gguggcucacaccuguaaucuca

SEQ ID NO: 971928 - RNA, 24 nt, Human
gguggcucacaccuguaaucucag

SEQ ID NO: 971929 - RNA, 22 nt, Human
ggugugguggcgggcaccugua

SEQ ID NO: 971930 - RNA, 20 nt, Human
gugaaacacaauagaaauua

SEQ ID NO: 971931 - RNA, 24 nt, Human
guugcagugagcugagaucaugcc

SEQ ID NO: 971932 - RNA, 22 nt, Human
uaaaaagaaauauaauaagcac

SEQ ID NO: 971933 - RNA, 25 nt, Human
uaaagaacauuaaugacuaaguuca

SEQ ID NO: 971934 - RNA, 23 nt, Human
uaaaugggucauaguuuucuucc

SEQ ID NO: 971935 - RNA, 19 nt, Human
uaauaagcacauggcugag

SEQ ID NO: 971936 - RNA, 27 nt, Human
uacaauaccauaaauuaucuccaaggg

SEQ ID NO: 971937 - RNA, 21 nt, Human
uacaauaugccaagcacucug

SEQ ID NO: 971938 - RNA, 22 nt, Human
uacguacauaacuuagagaggu

SEQ ID NO: 971939 - RNA, 21 nt, Human
uagaaugggccgggcacggug

SEQ ID NO: 971940 - RNA, 20 nt, Human
uagauauucuuucauuuaau

SEQ ID NO: 971941 - RNA, 24 nt, Human
uaggaggccgagguagacagauca

SEQ ID NO: 971942 - RNA, 21 nt, Human
uaggauccuaauuuuuccauc

SEQ ID NO: 971943 - RNA, 18 nt, Human
uaggugugugugugugug

SEQ ID NO: 971944 - RNA, 23 nt, Human
uauaaagaacauuaaugacuaag

SEQ ID NO: 971945 - RNA, 22 nt, Human
uauaauugugaaauagagacuc

SEQ ID NO: 971946 - RNA, 24 nt, Human
ucaaucacaaggaagagaaaacgu

SEQ ID NO: 971947 - RNA, 24 nt, Human
ucaccuauagaaaauugcacaccu

SEQ ID NO: 971948 - RNA, 23 nt, Human
ucacuugaggucgggaguucaag

SEQ ID NO: 971949 - RNA, 18 nt, Human
ucccucggcuggcuccgc

SEQ ID NO: 971950 - RNA, 20 nt, Human
ucuuugggucacaguuuucc

SEQ ID NO: 971951 - RNA, 18 nt, Human
ugaaaagaauuucuuucc

SEQ ID NO: 971952 - RNA, 21 nt, Human
ugaaauagagacucuuaggug

SEQ ID NO: 971953 - RNA, 18 nt, Human
ugaauuuggugaaacaca

SEQ ID NO: 971954 - RNA, 19 nt, Human
ugacccccagccccccacc

SEQ ID NO: 971955 - RNA, 22 nt, Human
ugagcugagaucaugccacugc

SEQ ID NO: 971956 - RNA, 20 nt, Human
ugaggcaggagaaucacuug

SEQ ID NO: 971957 - RNA, 24 nt, Human
ugaggcaggagaaucacuugaauc

SEQ ID NO: 971958 - RNA, 25 nt, Human
ugaggcaggagaaucacuugaaucc

SEQ ID NO: 971959 - RNA, 23 nt, Human
ugccaagcacucuguugaaaucu

SEQ ID NO: 971960 - RNA, 24 nt, Human
ugccacugcacuccagcccaggca

SEQ ID NO: 971961 - RNA, 20 nt, Human
ugcccaaaucuucccugaau

SEQ ID NO: 971962 - RNA, 21 nt, Human
uggcucacaccuguaaucuca

SEQ ID NO: 971963 - RNA, 22 nt, Human
uggcucacaccuguaaucucag

SEQ ID NO: 971964 - RNA, 24 nt, Human
uggcucacaccuguaaucucagca

SEQ ID NO: 971965 - RNA, 24 nt, Human
ugguagcaggugcacucuccccug

SEQ ID NO: 971966 - RNA, 24 nt, Human
ugguggcgggcaccuguaguccca

SEQ ID NO: 971967 - RNA, 23 nt, Human
ugugguggcgggcaccuguaguc

SEQ ID NO: 971968 - RNA, 20 nt, Human
uuaaaugugaaaaaaaucac

SEQ ID NO: 971969 - RNA, 18 nt, Human
uucauauagaaaacauga

SEQ ID NO: 971970 - RNA, 19 nt, Human
uucaucuucaaucacaagg

SEQ ID NO: 971971 - RNA, 21 nt, Human
uucaucuucaaucacaaggaa

SEQ ID NO: 971972 - RNA, 22 nt, Human
uuccauauaauuuugguuucau

SEQ ID NO: 971973 - RNA, 27 nt, Human
uugacugguagcaggugcacucucccc

SEQ ID NO: 971974 - RNA, 18 nt, Human
uugcagugagcugagauc

SEQ ID NO: 971975 - RNA, 20 nt, Human
uugcagugagcugagaucau

SEQ ID NO: 971976 - RNA, 21 nt, Human
uugcagugagcugagaucaug

SEQ ID NO: 971977 - RNA, 23 nt, Human
uuuauaaaaucugguauaacuga

SEQ ID NO: 971978 - RNA, 21 nt, Human
uuucccacucauauuugugga

SEQ ID NO: 971979 - RNA, 21 nt, Human
uuuuuccaucuuauuucacuu

SEQ ID NO: 971980 - RNA, 23 nt, Human
aaacaacauguaaacagaaacaa

SEQ ID NO: 971981 - RNA, 22 nt, Human
aaacagaaacaacugcuucagu

SEQ ID NO: 971982 - RNA, 22 nt, Human
aacaacugcuucagucucuaca

SEQ ID NO: 971983 - RNA, 21 nt, Human
aacccaguccacauuuuagga

SEQ ID NO: 971984 - RNA, 20 nt, Human
agggcagugcuaagacagga

SEQ ID NO: 971985 - RNA, 21 nt, Human
auaaacaacauguaaacagaa

SEQ ID NO: 971986 - RNA, 23 nt, Human
caggaagagcuagcagggcagug

SEQ ID NO: 971987 - RNA, 20 nt, Human
ccgccgcguccccgcucccu

SEQ ID NO: 971988 - RNA, 22 nt, Human
cggccgcccgucgguccgucgg

SEQ ID NO: 971989 - RNA, 20 nt, Human
gcagugcuaagacaggaaac

SEQ ID NO: 971990 - RNA, 22 nt, Human
uaaacaacauguaaacagaaac

SEQ ID NO: 971991 - RNA, 19 nt, Human
uaagacaggaaacccaguc

SEQ ID NO: 971992 - RNA, 22 nt, Human
uccagaaaaaaacaaaacaaaa

SEQ ID NO: 971993 - RNA, 24 nt, Human
ucccugcgcugccccgucuguccg

SEQ ID NO: 971994 - RNA, 25 nt, Human
ugccaaaacaccuccucaauaaaca

SEQ ID NO: 971995 - RNA, 23 nt, Human
ugccccgucuguccggccggccg

SEQ ID NO: 971996 - RNA, 21 nt, Human
uuccagaaaaaaacaaaacaa

SEQ ID NO: 971997 - RNA, 20 nt, Human
uuugccaaaacaccuccuca

SEQ ID NO: 971998 - RNA, 23 nt, Human
uuuuuuuuuuuuuuuuuuaacag

SEQ ID NO: 971999 - RNA, 19 nt, Human
aaagugcugggauuacaga

SEQ ID NO: 972000 - RNA, 26 nt, Human
aaauagccauaaauuuaaaaaacuuc

SEQ ID NO: 972001 - RNA, 22 nt, Human
aacacuuauccacagauucuca

SEQ ID NO: 972002 - RNA, 25 nt, Human
aagcaaugcaaugucaauguaaaau

SEQ ID NO: 972003 - RNA, 18 nt, Human
aagugcugggauuacaga

SEQ ID NO: 972004 - RNA, 26 nt, Human
aagugcugggauuacagauguaagcc

SEQ ID NO: 972005 - RNA, 24 nt, Human
aauuuuguauuuuuaguagagaug

SEQ ID NO: 972006 - RNA, 18 nt, Human
acagauguaagccaccau

SEQ ID NO: 972007 - RNA, 19 nt, Human
acccaggcuggaguacagu

SEQ ID NO: 972008 - RNA, 18 nt, Human
acuuugucacccaggcug

SEQ ID NO: 972009 - RNA, 25 nt, Human
acuuugucacccaggcuggaguaca

SEQ ID NO: 972010 - RNA, 19 nt, Human
agaaacucuucuuuaaugu

SEQ ID NO: 972011 - RNA, 23 nt, Human
aggugauccacccccucagccuc

SEQ ID NO: 972012 - RNA, 25 nt, Human
agguguggaaauuacugacaaagcc

SEQ ID NO: 972013 - RNA, 20 nt, Human
aguacaguggugcaaucuug

SEQ ID NO: 972014 - RNA, 24 nt, Human
aguacaguggugcaaucuuggcuc

SEQ ID NO: 972015 - RNA, 21 nt, Human
augggguuucuccauguuggu

SEQ ID NO: 972016 - RNA, 24 nt, Human
augggguuucuccauguuggucag

SEQ ID NO: 972017 - RNA, 21 nt, Human
auuauuuugaacaucuucuuu

SEQ ID NO: 972018 - RNA, 21 nt, Human
auugccaagaucucaagucca

SEQ ID NO: 972019 - RNA, 20 nt, Human
caaaacaacaucuucugaac

SEQ ID NO: 972020 - RNA, 24 nt, Human
caaagugcugggauuacagaugua

SEQ ID NO: 972021 - RNA, 22 nt, Human
caagcaauucuccugccucagc

SEQ ID NO: 972022 - RNA, 20 nt, Human
caaggauuuuuacuuaaaca

SEQ ID NO: 972023 - RNA, 25 nt, Human
caauagcugagauuaccagcaugug

SEQ ID NO: 972024 - RNA, 18 nt, Human
caccaugcccggcucaca

SEQ ID NO: 972025 - RNA, 21 nt, Human
cacugcaaccuccgccucccg

SEQ ID NO: 972026 - RNA, 23 nt, Human
cacugcaaccuccgccucccggg

SEQ ID NO: 972027 - RNA, 21 nt, Human
ccaaagugcugggauuacaga

SEQ ID NO: 972028 - RNA, 22 nt, Human
ccaaagugcugggauuacagau

SEQ ID NO: 972029 - RNA, 24 nt, Human
ccaaagugcugggauuacagaugu

SEQ ID NO: 972030 - RNA, 18 nt, Human
ccaccaugcccggcucac

SEQ ID NO: 972031 - RNA, 19 nt, Human
ccauguuggucaggcuggu

SEQ ID NO: 972032 - RNA, 20 nt, Human
ccauguuggucaggcugguc

SEQ ID NO: 972033 - RNA, 24 nt, Human
ccccucagccucccaaagugcugg

SEQ ID NO: 972034 - RNA, 24 nt, Human
cccgaccucaggugauccaccccc

SEQ ID NO: 972035 - RNA, 26 nt, Human
cccgaccucaggugauccacccccuc

SEQ ID NO: 972036 - RNA, 23 nt, Human
cccggguucaagcaauucuccug

SEQ ID NO: 972037 - RNA, 26 nt, Human
ccgccucccggguucaagcaauucuu

SEQ ID NO: 972038 - RNA, 24 nt, Human
ccucccggguucaagcaauucucc

SEQ ID NO: 972039 - RNA, 22 nt, Human
cgaccucaggugauccaccccc

SEQ ID NO: 972040 - RNA, 20 nt, Human
cuaaaacuuccugauaauga

SEQ ID NO: 972041 - RNA, 24 nt, Human
cuaauuuuguauuuuuaguagaga

SEQ ID NO: 972042 - RNA, 24 nt, Human
cucaagaauugugcgacucauaga

SEQ ID NO: 972043 - RNA, 24 nt, Human
cucacugcaaccuccgccucccgg

SEQ ID NO: 972044 - RNA, 22 nt, Human
cuccauguuggucaggcugguc

SEQ ID NO: 972045 - RNA, 19 nt, Human
cuccuggaugugucucaua

SEQ ID NO: 972046 - RNA, 24 nt, Human
cugaacacaaacacuuauccacag

SEQ ID NO: 972047 - RNA, 23 nt, Human
cugcaaccuccgccucccggguu

SEQ ID NO: 972048 - RNA, 24 nt, Human
cugcaaccuccgccucccggguuc

SEQ ID NO: 972049 - RNA, 23 nt, Human
cugccucagccuccucaauagcu

SEQ ID NO: 972050 - RNA, 23 nt, Human
gaccucaggugauccacccccuc

SEQ ID NO: 972051 - RNA, 24 nt, Human
gagaugggguuucuccauguuggu

SEQ ID NO: 972052 - RNA, 18 nt, Human
gauuacagauguaagcca

SEQ ID NO: 972053 - RNA, 24 nt, Human
gauuacagauguaagccaccaugc

SEQ ID NO: 972054 - RNA, 23 nt, Human
gcuggucuagaacucccgaccuc

SEQ ID NO: 972055 - RNA, 24 nt, Human
ggauuacagauguaagccaccaug

SEQ ID NO: 972056 - RNA, 18 nt, Human
gggguuucuccauguugg

SEQ ID NO: 972057 - RNA, 22 nt, Human
gggguuucuccauguuggucag

SEQ ID NO: 972058 - RNA, 23 nt, Human
ggugauccacccccucagccucc

SEQ ID NO: 972059 - RNA, 22 nt, Human
guaaaauaaauuucuuucucuc

SEQ ID NO: 972060 - RNA, 24 nt, Human
gugaaacaggugguuguucuaaug

SEQ ID NO: 972061 - RNA, 23 nt, Human
gugauccacccccucagccuccc

SEQ ID NO: 972062 - RNA, 18 nt, Human
uaaaaugcauauguuuag

SEQ ID NO: 972063 - RNA, 24 nt, Human
uaaauuucuuucucuccucuuugc

SEQ ID NO: 972064 - RNA, 22 nt, Human
uaacuccuggaugugucucaua

SEQ ID NO: 972065 - RNA, 20 nt, Human
uaaggggaagcaaugcaaug

SEQ ID NO: 972066 - RNA, 23 nt, Human
uacagauguaagccaccaugccc

SEQ ID NO: 972067 - RNA, 19 nt, Human
uacaguggugcaaucuugg

SEQ ID NO: 972068 - RNA, 22 nt, Human
uacaguggugcaaucuuggcuc

SEQ ID NO: 972069 - RNA, 23 nt, Human
uaccagcaugugccaccaugccc

SEQ ID NO: 972070 - RNA, 20 nt, Human
uagagaaugaccacauagua

SEQ ID NO: 972071 - RNA, 24 nt, Human
uaguagagaugggguuucuccaug

SEQ ID NO: 972072 - RNA, 23 nt, Human
uauuauuuugaacaucuucuuug

SEQ ID NO: 972073 - RNA, 24 nt, Human
ucaauagcugagauuaccagcaug

SEQ ID NO: 972074 - RNA, 23 nt, Human
ucacugcaaccuccgccucccgg

SEQ ID NO: 972075 - RNA, 24 nt, Human
ucacugcaaccuccgccucccggg

SEQ ID NO: 972076 - RNA, 25 nt, Human
ucacugcaaccuccgccucccgggu

SEQ ID NO: 972077 - RNA, 27 nt, Human
ucacugcaaccuccgccucccggguuc

SEQ ID NO: 972078 - RNA, 25 nt, Human
ucagaaaaugaaguaaaaaucccua

SEQ ID NO: 972079 - RNA, 18 nt, Human
ucagccucccaaagugcu

SEQ ID NO: 972080 - RNA, 18 nt, Human
ucagccuccucaauagcu

SEQ ID NO: 972081 - RNA, 21 nt, Human
ucagccuccucaauagcugag

SEQ ID NO: 972082 - RNA, 18 nt, Human
ucaguugucucuuuugca

SEQ ID NO: 972083 - RNA, 18 nt, Human
uccacccccucagccucc

SEQ ID NO: 972084 - RNA, 18 nt, Human
ucccaaagugcugggauu

SEQ ID NO: 972085 - RNA, 23 nt, Human
ucccaaagugcugggauuacaga

SEQ ID NO: 972086 - RNA, 21 nt, Human
ucccggguucaagcaauucuc

SEQ ID NO: 972087 - RNA, 24 nt, Human
ucccggguucaagcaauucuccug

SEQ ID NO: 972088 - RNA, 24 nt, Human
uccgccucccggguucaagcaauu

SEQ ID NO: 972089 - RNA, 24 nt, Human
ucuagaaacaucaguuguaaaucu

SEQ ID NO: 972090 - RNA, 24 nt, Human
ucuccugccucagccuccucaaua

SEQ ID NO: 972091 - RNA, 24 nt, Human
ucugacuuugucacccaggcugga

SEQ ID NO: 972092 - RNA, 31 nt, Human
ugaaaaaacaucugacauaauaaauucucaa

SEQ ID NO: 972093 - RNA, 24 nt, Human
ugaacaucuucuuuguugguuauu

SEQ ID NO: 972094 - RNA, 25 nt, Human
ugaagagauauuuuaacagaagaau

SEQ ID NO: 972095 - RNA, 18 nt, Human
ugacaaagccuagauaua

SEQ ID NO: 972096 - RNA, 21 nt, Human
ugacaaagccuagauauagaa

SEQ ID NO: 972097 - RNA, 24 nt, Human
ugacuuugucacccaggcuggagu

SEQ ID NO: 972098 - RNA, 24 nt, Human
ugagauuaccagcaugugccacca

SEQ ID NO: 972099 - RNA, 22 nt, Human
ugaugugaaaaaaaaaaaugaa

SEQ ID NO: 972100 - RNA, 19 nt, Human
ugccaagaucucaagucca

SEQ ID NO: 972101 - RNA, 21 nt, Human
ugccucagccuccucaauagc

SEQ ID NO: 972102 - RNA, 24 nt, Human
ugccucagccuccucaauagcuga

SEQ ID NO: 972103 - RNA, 18 nt, Human
ugcugggauuacagaugu

SEQ ID NO: 972104 - RNA, 24 nt, Human
ugcugggauuacagauguaagcca

SEQ ID NO: 972105 - RNA, 19 nt, Human
ugcuuuuuuucagaauuga

SEQ ID NO: 972106 - RNA, 24 nt, Human
uggaguacaguggugcaaucuugg

SEQ ID NO: 972107 - RNA, 22 nt, Human
ugggauuacagauguaagccac

SEQ ID NO: 972108 - RNA, 24 nt, Human
ugggauuacagauguaagccacca

SEQ ID NO: 972109 - RNA, 25 nt, Human
ugggauuacagauguaagccaccau

SEQ ID NO: 972110 - RNA, 24 nt, Human
ugggguuucuccauguuggucagg

SEQ ID NO: 972111 - RNA, 21 nt, Human
uggucaggcuggucuagaacu

SEQ ID NO: 972112 - RNA, 23 nt, Human
uggucuagaacucccgaccucag

SEQ ID NO: 972113 - RNA, 21 nt, Human
uguauuuuuaguagagauggg

SEQ ID NO: 972114 - RNA, 20 nt, Human
uguuuaucaccaaaguugua

SEQ ID NO: 972115 - RNA, 20 nt, Human
uuaaagcaugaguguuuguu

SEQ ID NO: 972116 - RNA, 18 nt, Human
uuaguagagaugggguuu

SEQ ID NO: 972117 - RNA, 24 nt, Human
uuaguagagaugggguuucuccau

SEQ ID NO: 972118 - RNA, 21 nt, Human
uucaagcaauucuccugccuc

SEQ ID NO: 972119 - RNA, 24 nt, Human
uucaagcaauucuccugccucagc

SEQ ID NO: 972120 - RNA, 21 nt, Human
uucuuucucuccucuuugcca

SEQ ID NO: 972121 - RNA, 23 nt, Human
uuguauuuuuaguagagaugggg

SEQ ID NO: 972122 - RNA, 21 nt, Human
uuucuccauguuggucaggcu

SEQ ID NO: 972123 - RNA, 19 nt, Human
uuuuguauuuuuaguagag

SEQ ID NO: 972124 - RNA, 20 nt, Human
uuuuguauuuuuaguagaga

SEQ ID NO: 972125 - RNA, 22 nt, Human
uuuuuaguagagaugggguuuc

SEQ ID NO: 972126 - RNA, 23 nt, Human
uuuuuuuuuuuuuuggagaugga

SEQ ID NO: 972127 - RNA, 18 nt, Human
agagagcuguugcaaacc

SEQ ID NO: 972128 - RNA, 19 nt, Human
cagcauuuaggugugacga

SEQ ID NO: 972129 - RNA, 18 nt, Human
ccaccaccaccaucacag

SEQ ID NO: 972130 - RNA, 25 nt, Human
gaucagagagcuguugcaaaccuag

SEQ ID NO: 972131 - RNA, 19 nt, Human
gccgaguuggguuggagcu

SEQ ID NO: 972132 - RNA, 21 nt, Human
ggggucaggaguacucuccau

SEQ ID NO: 972133 - RNA, 19 nt, Human
ggugaggcggaguuaagcc

SEQ ID NO: 972134 - RNA, 19 nt, Human
uagcaggaauugaagaaga

SEQ ID NO: 972135 - RNA, 24 nt, Human
ucacaggggagggcuagcuguugc

SEQ ID NO: 972136 - RNA, 23 nt, Human
uggacugggcucggugaggcgga

SEQ ID NO: 972137 - RNA, 19 nt, Human
agggaggggggugaggaag

SEQ ID NO: 972138 - RNA, 23 nt, Human
aggggggugaggaagguacgcga

SEQ ID NO: 972139 - RNA, 19 nt, Human
cccccgcgggcugcccgcc

SEQ ID NO: 972140 - RNA, 22 nt, Human
ccccgcgggcugcccgccggcc

SEQ ID NO: 972141 - RNA, 18 nt, Human
ggagugggcaagggaggg

SEQ ID NO: 972142 - RNA, 18 nt, Human
uccuccugauaggccaga

SEQ ID NO: 972143 - RNA, 18 nt, Human
ugaggaagguacgcgaug

SEQ ID NO: 972144 - RNA, 22 nt, Human
acagcacuccaggauguggcag

SEQ ID NO: 972145 - RNA, 20 nt, Human
agaguccuccucgucccccc

SEQ ID NO: 972146 - RNA, 18 nt, Human
agcaggaggcccugagcc

SEQ ID NO: 972147 - RNA, 20 nt, Human
agcaggaggcccugagccug

SEQ ID NO: 972148 - RNA, 25 nt, Human
aggagaccccgggccccaggacccc

SEQ ID NO: 972149 - RNA, 21 nt, Human
cacagcacuccaggauguggc

SEQ ID NO: 972150 - RNA, 22 nt, Human
cacagcacuccaggauguggca

SEQ ID NO: 972151 - RNA, 18 nt, Human
cagcgccaccuugggcgg

SEQ ID NO: 972152 - RNA, 21 nt, Human
ccccaggacccuggcgucggg

SEQ ID NO: 972153 - RNA, 24 nt, Human
ccccaggccgacuccuccggcccu

SEQ ID NO: 972154 - RNA, 20 nt, Human
cccccaggccgacuccuccg

SEQ ID NO: 972155 - RNA, 24 nt, Human
cccccaggccgacuccuccggccc

SEQ ID NO: 972156 - RNA, 20 nt, Human
ccccccaggccgacuccucc

SEQ ID NO: 972157 - RNA, 21 nt, Human
cccgggccccaggacccuggc

SEQ ID NO: 972158 - RNA, 18 nt, Human
ccuccucguccccccagg

SEQ ID NO: 972159 - RNA, 25 nt, Human
cgagcaggaggcccugagccugacg

SEQ ID NO: 972160 - RNA, 26 nt, Human
cgagcaggaggcccugagccugacgc

SEQ ID NO: 972161 - RNA, 20 nt, Human
cggagaggcugaggccauca

SEQ ID NO: 972162 - RNA, 23 nt, Human
cggcggcggcggcggcguccccg

SEQ ID NO: 972163 - RNA, 22 nt, Human
cguggcaggcacggagaggcug

SEQ ID NO: 972164 - RNA, 24 nt, Human
cucggcggcggcggcggcgucccc

SEQ ID NO: 972165 - RNA, 28 nt, Human
cucugugccaggcccucacagcacuccc

SEQ ID NO: 972166 - RNA, 19 nt, Human
cuuccggauccacucggcg

SEQ ID NO: 972167 - RNA, 29 nt, Human
gauccacucggcggcggcggcggcgacga

SEQ ID NO: 972168 - RNA, 20 nt, Human
gccaccuugggcgggcugug

SEQ ID NO: 972169 - RNA, 20 nt, Human
gcccagcggcggcuccuucc

SEQ ID NO: 972170 - RNA, 19 nt, Human
ggagaggcugaggccauca

SEQ ID NO: 972171 - RNA, 21 nt, Human
ggcaggagcuggucaccugcg

SEQ ID NO: 972172 - RNA, 19 nt, Human
ggggcagcgccaccuuggg

SEQ ID NO: 972173 - RNA, 24 nt, Human
gggguguagccagccgugcgcggg

SEQ ID NO: 972174 - RNA, 24 nt, Human
ggguuggagcagcgagcaggaggc

SEQ ID NO: 972175 - RNA, 24 nt, Human
uaccgcacgacguaggagaccccg

SEQ ID NO: 972176 - RNA, 19 nt, Human
ucacagcacuccaggaugu

SEQ ID NO: 972177 - RNA, 22 nt, Human
ucacagcacuccaggauguggc

SEQ ID NO: 972178 - RNA, 20 nt, Human
ucauguccgugucuccgccu

SEQ ID NO: 972179 - RNA, 21 nt, Human
uccaaagaguccuccucgucc

SEQ ID NO: 972180 - RNA, 20 nt, Human
uccacucggcggcggcggcg

SEQ ID NO: 972181 - RNA, 18 nt, Human
uccccccaggccgacucc

SEQ ID NO: 972182 - RNA, 21 nt, Human
uccggcccugccagccuuucu

SEQ ID NO: 972183 - RNA, 23 nt, Human
ucucugguugaugggguccuugg

SEQ ID NO: 972184 - RNA, 18 nt, Human
ugacgcgggguccguguc

SEQ ID NO: 972185 - RNA, 23 nt, Human
ugaugaugcucugugccaggccc

SEQ ID NO: 972186 - RNA, 24 nt, Human
ugaugggguccuuggcgacguagg

SEQ ID NO: 972187 - RNA, 18 nt, Human
ugcagcccauguaccgca

SEQ ID NO: 972188 - RNA, 22 nt, Human
ugccaggcccucacagcacucc

SEQ ID NO: 972189 - RNA, 20 nt, Human
ugcuccaaagaguccuccuc

SEQ ID NO: 972190 - RNA, 19 nt, Human
uggagcagcgagcaggagg

SEQ ID NO: 972191 - RNA, 22 nt, Human
ugggggcagcgccaccuugggc

SEQ ID NO: 972192 - RNA, 19 nt, Human
uguaccgcacgacguagga

SEQ ID NO: 972193 - RNA, 21 nt, Human
uguggugguuggcgaugaccu

SEQ ID NO: 972194 - RNA, 22 nt, Human
uuuguggaugaagcugcccuuc

SEQ ID NO: 972195 - RNA, 23 nt, Human
accaccccacccaggagggccca

SEQ ID NO: 972196 - RNA, 21 nt, Human
accuugcuccuccaagcgacg

SEQ ID NO: 972197 - RNA, 23 nt, Human
caccaccccacccaggagggccc

SEQ ID NO: 972198 - RNA, 23 nt, Human
caccccacccaggagggcccagc

SEQ ID NO: 972199 - RNA, 19 nt, Human
cagccgcugaccauccccc

SEQ ID NO: 972200 - RNA, 22 nt, Human
ccacccaggagggcccagcugc

SEQ ID NO: 972201 - RNA, 21 nt, Human
ccaccccacccaggagggccc

SEQ ID NO: 972202 - RNA, 24 nt, Human
cccacccaggagggcccagcugcc

SEQ ID NO: 972203 - RNA, 21 nt, Human
cccagcugcccaggagccguc

SEQ ID NO: 972204 - RNA, 19 nt, Human
ccccagcccagcugcuggc

SEQ ID NO: 972205 - RNA, 24 nt, Human
cccccagcuauggcgcaauuugcu

SEQ ID NO: 972206 - RNA, 19 nt, Human
ccccgcugcccccagcuag

SEQ ID NO: 972207 - RNA, 22 nt, Human
cccucaccggccuguccacgcc

SEQ ID NO: 972208 - RNA, 20 nt, Human
ccggggccgccuccaggugc

SEQ ID NO: 972209 - RNA, 22 nt, Human
ccggggccgccuccaggugcag

SEQ ID NO: 972210 - RNA, 20 nt, Human
ccuccaagcgacggcgccug

SEQ ID NO: 972211 - RNA, 25 nt, Human
ccugcaccccagcccagcugcuggc

SEQ ID NO: 972212 - RNA, 24 nt, Human
ccuugggcggagggggcucggcuc

SEQ ID NO: 972213 - RNA, 23 nt, Human
cgcagcucaggccucgcccaccc

SEQ ID NO: 972214 - RNA, 21 nt, Human
cgggcuugcgcgcggcgcccc

SEQ ID NO: 972215 - RNA, 24 nt, Human
cucacagcgucccgcucgcgagcc

SEQ ID NO: 972216 - RNA, 21 nt, Human
cugcaccccagcccagcugcu

SEQ ID NO: 972217 - RNA, 24 nt, Human
cugcugcagcggcuggggccccuu

SEQ ID NO: 972218 - RNA, 20 nt, Human
gagggcgccuugggcggagg

SEQ ID NO: 972219 - RNA, 25 nt, Human
gccagacggcagcagccgcugacca

SEQ ID NO: 972220 - RNA, 20 nt, Human
gccccugcgggcugggaggc

SEQ ID NO: 972221 - RNA, 25 nt, Human
gccucgcccacccccgcugccccca

SEQ ID NO: 972222 - RNA, 23 nt, Human
gcugcagcggcuggggccccuug

SEQ ID NO: 972223 - RNA, 22 nt, Human
ggacuuccggagagggcagccc

SEQ ID NO: 972224 - RNA, 24 nt, Human
gggcggagggggcucggcuccucu

SEQ ID NO: 972225 - RNA, 18 nt, Human
gggcugggaggcaccuug

SEQ ID NO: 972226 - RNA, 20 nt, Human
gggcugggaggcaccuugcu

SEQ ID NO: 972227 - RNA, 19 nt, Human
ggggcagagccaccgaaga

SEQ ID NO: 972228 - RNA, 18 nt, Human
ucccgcucgcgagccaga

SEQ ID NO: 972229 - RNA, 22 nt, Human
uccgcugcugcagcggcugggg

SEQ ID NO: 972230 - RNA, 18 nt, Human
uccggggccgccuccagg

SEQ ID NO: 972231 - RNA, 23 nt, Human
ucuggcaccaccccacccaggag

SEQ ID NO: 972232 - RNA, 22 nt, Human
ugaugaccugcaccccagccca

SEQ ID NO: 972233 - RNA, 24 nt, Human
ugaugaccugcaccccagcccagc

SEQ ID NO: 972234 - RNA, 23 nt, Human
ugcccccagcuauggcgcaauuu

SEQ ID NO: 972235 - RNA, 21 nt, Human
ugugcaaggacuuccggagag

SEQ ID NO: 972236 - RNA, 22 nt, Human
uuccggagagggcagcccgcag

SEQ ID NO: 972237 - RNA, 23 nt, Human
aaaaaaggaaaacaccuagaagg

SEQ ID NO: 972238 - RNA, 20 nt, Human
aaaaacaaaaaaggaaaaca

SEQ ID NO: 972239 - RNA, 25 nt, Human
aaaacaaaaaaaacaaaaaaggaaa

SEQ ID NO: 972240 - RNA, 24 nt, Human
aaaacaaaaaaggaaaacaccuag

SEQ ID NO: 972241 - RNA, 24 nt, Human
aaaacaaaacaaaacaaaaaaaac

SEQ ID NO: 972242 - RNA, 22 nt, Human
aaaacaccuagaaggugaggca

SEQ ID NO: 972243 - RNA, 18 nt, Human
aaaaccaagacauaagua

SEQ ID NO: 972244 - RNA, 18 nt, Human
aaacaaaaaaaacaaaaa

SEQ ID NO: 972245 - RNA, 21 nt, Human
aaacaaaaaaggaaaacaccu

SEQ ID NO: 972246 - RNA, 25 nt, Human
aaacaaaaaaggaaaacaccuagaa

SEQ ID NO: 972247 - RNA, 19 nt, Human
aaacaaaacaaaacaaaaa

SEQ ID NO: 972248 - RNA, 24 nt, Human
aaacaaaacaaaacaaaaaaaaca

SEQ ID NO: 972249 - RNA, 22 nt, Human
aaagagguuguuccuauuuaaa

SEQ ID NO: 972250 - RNA, 22 nt, Human
aacacagauagcuaaaccuaua

SEQ ID NO: 972251 - RNA, 20 nt, Human
aaccauguuuuuaauucuaa

SEQ ID NO: 972252 - RNA, 21 nt, Human
aacucacagccugcaggccuc

SEQ ID NO: 972253 - RNA, 20 nt, Human
aacugcaagaaagugcuaca

SEQ ID NO: 972254 - RNA, 22 nt, Human
aagagaagcaaaaauuccaaaa

SEQ ID NO: 972255 - RNA, 25 nt, Human
aagagaagcaaaaauuccaaaacaa

SEQ ID NO: 972256 - RNA, 21 nt, Human
aagcaaaaauuccaaaacaac

SEQ ID NO: 972257 - RNA, 24 nt, Human
aagcaaaaauuccaaaacaaccau

SEQ ID NO: 972258 - RNA, 23 nt, Human
aagcaaaaauuccaaaacaaccc

SEQ ID NO: 972259 - RNA, 20 nt, Human
aagcucgcucccacccggcc

SEQ ID NO: 972260 - RNA, 22 nt, Human
acaaaaaaggaaaacaccuaga

SEQ ID NO: 972261 - RNA, 18 nt, Human
acaaaacaaaaaaaacaa

SEQ ID NO: 972262 - RNA, 22 nt, Human
acaaaacaaaaaaaacaaaaaa

SEQ ID NO: 972263 - RNA, 26 nt, Human
acaaaacaaaacaaaaaaaacaaaaa

SEQ ID NO: 972264 - RNA, 23 nt, Human
acaaacaagguucagcauccaaa

SEQ ID NO: 972265 - RNA, 18 nt, Human
acauuuuucaacccagca

SEQ ID NO: 972266 - RNA, 22 nt, Human
acgguaagagaagcaaaaauuc

SEQ ID NO: 972267 - RNA, 22 nt, Human
agaagccgagcccucccgccuc

SEQ ID NO: 972268 - RNA, 21 nt, Human
agaaggugaggcaggugauug

SEQ ID NO: 972269 - RNA, 24 nt, Human
agagcugauccaccaaaagaaaau

SEQ ID NO: 972270 - RNA, 18 nt, Human
agcgucugucuuaguucg

SEQ ID NO: 972271 - RNA, 20 nt, Human
agcuaucugagagacugugg

SEQ ID NO: 972272 - RNA, 21 nt, Human
aggaaaacaccuagaagguga

SEQ ID NO: 972273 - RNA, 25 nt, Human
auaaaaccaagacauaaguagccuc

SEQ ID NO: 972274 - RNA, 22 nt, Human
auaaauauaacucacagccugc

SEQ ID NO: 972275 - RNA, 25 nt, Human
auauauguauauauauuuauauaaa

SEQ ID NO: 972276 - RNA, 21 nt, Human
auuucuccaacaguuuucagg

SEQ ID NO: 972277 - RNA, 19 nt, Human
caacuacagaauuuaggca

SEQ ID NO: 972278 - RNA, 23 nt, Human
caagacauaaguagccucauuuc

SEQ ID NO: 972279 - RNA, 23 nt, Human
caagaugcuacuuugccaacaug

SEQ ID NO: 972280 - RNA, 23 nt, Human
caagguucagcauccaaaguuuu

SEQ ID NO: 972281 - RNA, 22 nt, Human
cacaccagcaaccacaugauaa

SEQ ID NO: 972282 - RNA, 24 nt, Human
caccaagaugcuacuuugccaaca

SEQ ID NO: 972283 - RNA, 18 nt, Human
caccagcaaccacaugau

SEQ ID NO: 972284 - RNA, 20 nt, Human
caccagcaaccacaugauaa

SEQ ID NO: 972285 - RNA, 22 nt, Human
cacccggccugauccgacgggu

SEQ ID NO: 972286 - RNA, 20 nt, Human
cagcagagcuucaacuacag

SEQ ID NO: 972287 - RNA, 22 nt, Human
cauaaguagccucauuucaaaa

SEQ ID NO: 972288 - RNA, 21 nt, Human
ccaaacccacgcacagaaugc

SEQ ID NO: 972289 - RNA, 21 nt, Human
ccaccaaaagaaaauuauccc

SEQ ID NO: 972290 - RNA, 20 nt, Human
ccaggggcggcggccacucu

SEQ ID NO: 972291 - RNA, 18 nt, Human
cccgcaagcucgcuccca

SEQ ID NO: 972292 - RNA, 21 nt, Human
cccgggcuccggcccgcggug

SEQ ID NO: 972293 - RNA, 22 nt, Human
cccgugucacggcgagucucca

SEQ ID NO: 972294 - RNA, 20 nt, Human
cccuccgccgagcccggccc

SEQ ID NO: 972295 - RNA, 22 nt, Human
ccggcuggcggcggcgggcgcg

SEQ ID NO: 972296 - RNA, 22 nt, Human
ccucgccuccggcccacccucc

SEQ ID NO: 972297 - RNA, 19 nt, Human
ccuggcaaacucuucuucc

SEQ ID NO: 972298 - RNA, 18 nt, Human
cgcggugggcgccucgcc

SEQ ID NO: 972299 - RNA, 22 nt, Human
cggccacucugggagagagaag

SEQ ID NO: 972300 - RNA, 20 nt, Human
cggcccccgcagcuccggcc

SEQ ID NO: 972301 - RNA, 19 nt, Human
cggccggcggccucggagg

SEQ ID NO: 972302 - RNA, 23 nt, Human
cggccggcggccucggaggcggg

SEQ ID NO: 972303 - RNA, 20 nt, Human
cgggagaaggcggggcggcg

SEQ ID NO: 972304 - RNA, 21 nt, Human
cuaaagauguuuuugucccug

SEQ ID NO: 972305 - RNA, 24 nt, Human
cugauccaccaaaagaaaauuauc

SEQ ID NO: 972306 - RNA, 27 nt, Human
cuggcggcggcgggcgcggcgucccuc

SEQ ID NO: 972307 - RNA, 20 nt, Human
cugucucagacagcaaagua

SEQ ID NO: 972308 - RNA, 22 nt, Human
cuugcacuuaaggacuaaaaac

SEQ ID NO: 972309 - RNA, 24 nt, Human
cuuucaaaacauuuuucaacccag

SEQ ID NO: 972310 - RNA, 21 nt, Human
gaagcaaaaauuccaaaacaa

SEQ ID NO: 972311 - RNA, 24 nt, Human
gaagcaaaaauuccaaaacaacca

SEQ ID NO: 972312 - RNA, 20 nt, Human
gagcccggcccgcgagccgc

SEQ ID NO: 972313 - RNA, 21 nt, Human
gagcuaucugagagacugugg

SEQ ID NO: 972314 - RNA, 19 nt, Human
gauugucuucaugagcuau

SEQ ID NO: 972315 - RNA, 18 nt, Human
gcggccucggaggcgggc

SEQ ID NO: 972316 - RNA, 21 nt, Human
gcggcgucccucggcccccgc

SEQ ID NO: 972317 - RNA, 22 nt, Human
gcuggcggcggcgggcgcggcg

SEQ ID NO: 972318 - RNA, 20 nt, Human
ggaacaaaauaaaaccaaga

SEQ ID NO: 972319 - RNA, 27 nt, Human
ggcagaagaugagaacagaagggaccc

SEQ ID NO: 972320 - RNA, 20 nt, Human
gggcgcggcgucccucggcc

SEQ ID NO: 972321 - RNA, 18 nt, Human
guccaaguaaauuaugcu

SEQ ID NO: 972322 - RNA, 21 nt, Human
uaaaaaacaaacuuggccaga

SEQ ID NO: 972323 - RNA, 23 nt, Human
uaaaaccaagacauaaguagccu

SEQ ID NO: 972324 - RNA, 24 nt, Human
uaaaaccaagacauaaguagccuc

SEQ ID NO: 972325 - RNA, 23 nt, Human
uaaaaccaagacauaaguagcug

SEQ ID NO: 972326 - RNA, 23 nt, Human
uaaacagaauuagcuaagaugga

SEQ ID NO: 972327 - RNA, 19 nt, Human
uaaaucaucuaaaucacug

SEQ ID NO: 972328 - RNA, 18 nt, Human
uaaauuuuucaccagccu

SEQ ID NO: 972329 - RNA, 25 nt, Human
uaacucacagccugcaggccucuga

SEQ ID NO: 972330 - RNA, 23 nt, Human
uaacugaaaacaaacuuucacaa

SEQ ID NO: 972331 - RNA, 25 nt, Human
uaacugcaagaaagugcuacagaca

SEQ ID NO: 972332 - RNA, 24 nt, Human
uaagaagaauuuauuaauacuuag

SEQ ID NO: 972333 - RNA, 22 nt, Human
uaagagaagcaaaaauuccaaa

SEQ ID NO: 972334 - RNA, 18 nt, Human
uaagaugaauauacaaag

SEQ ID NO: 972335 - RNA, 21 nt, Human
uaagaugaauauacaaaguca

SEQ ID NO: 972336 - RNA, 19 nt, Human
uaagccucauaagggacua

SEQ ID NO: 972337 - RNA, 21 nt, Human
uaaguguaugaauuuacaacc

SEQ ID NO: 972338 - RNA, 22 nt, Human
uacaaagucaccuuagucacca

SEQ ID NO: 972339 - RNA, 19 nt, Human
uacaguaacacauucaugu

SEQ ID NO: 972340 - RNA, 18 nt, Human
uacauaauauguauauau

SEQ ID NO: 972341 - RNA, 18 nt, Human
uacauaauauguauauau

SEQ ID NO: 972342 - RNA, 18 nt, Human
uacauaauauguauauau

SEQ ID NO: 972343 - RNA, 22 nt, Human
uauauguauauauauuuauaua

SEQ ID NO: 972344 - RNA, 18 nt, Human
uauguauauauguauaua

SEQ ID NO: 972345 - RNA, 24 nt, Human
uauguauauauguauauauauuua

SEQ ID NO: 972346 - RNA, 20 nt, Human
uauguauauauguauauauu

SEQ ID NO: 972347 - RNA, 24 nt, Human
ucaaaucaaacugaaugauuuaaa

SEQ ID NO: 972348 - RNA, 18 nt, Human
ucccacucaaaucaaacu

SEQ ID NO: 972349 - RNA, 21 nt, Human
ucccacucaaaucaaacugaa

SEQ ID NO: 972350 - RNA, 21 nt, Human
ucccucggcccccgcagcucc

SEQ ID NO: 972351 - RNA, 18 nt, Human
ucccuguugaucaaaaag

SEQ ID NO: 972352 - RNA, 22 nt, Human
uccgagcggucaggacucccgc

SEQ ID NO: 972353 - RNA, 24 nt, Human
uccuccgccgccguccgcucccgc

SEQ ID NO: 972354 - RNA, 21 nt, Human
ucuccuccgccgccguccgcu

SEQ ID NO: 972355 - RNA, 24 nt, Human
ugacauacugaaagagccaaaccc

SEQ ID NO: 972356 - RNA, 27 nt, Human
ugaggcaggugauugucuucaugagcu

SEQ ID NO: 972357 - RNA, 21 nt, Human
uggaacaaaauaaaaccaaga

SEQ ID NO: 972358 - RNA, 24 nt, Human
uggcggcggcgggcgcggcguccc

SEQ ID NO: 972359 - RNA, 20 nt, Human
ugggaauaggauaaaauuug

SEQ ID NO: 972360 - RNA, 24 nt, Human
uguauacaguaacacauucaugug

SEQ ID NO: 972361 - RNA, 19 nt, Human
uguauauauguauauauau

SEQ ID NO: 972362 - RNA, 21 nt, Human
ugucccuguugaucaaaaaga

SEQ ID NO: 972363 - RNA, 26 nt, Human
uuaaaaacaaaacaaaacaaaaaaaa

SEQ ID NO: 972364 - RNA, 30 nt, Human
uuaaaaacaaaacaaaacaaaaaaaacaaa

SEQ ID NO: 972365 - RNA, 23 nt, Human
uuaauaauuacacacaccagcaa

SEQ ID NO: 972366 - RNA, 22 nt, Human
uuauacugucauuuuuaucaua

SEQ ID NO: 972367 - RNA, 19 nt, Human
uucccugcucucccgcgcg

SEQ ID NO: 972368 - RNA, 21 nt, Human
uuccuguuccuguaguuuccu

SEQ ID NO: 972369 - RNA, 23 nt, Human
uuuaaauuuuucaccagccucaa

SEQ ID NO: 972370 - RNA, 22 nt, Human
uuuaagaugaauauacaaaguc

SEQ ID NO: 972371 - RNA, 23 nt, Human
uuuccuggcaaacucuucuucca

SEQ ID NO: 972372 - RNA, 19 nt, Human
uuuucccuucaucuuugcu

SEQ ID NO: 972373 - RNA, 23 nt, Human
uuuuucaucuuuccaaacuuugu

SEQ ID NO: 972374 - RNA, 20 nt, Human
uuuuucucuuuuaaaagagg

SEQ ID NO: 972375 - RNA, 23 nt, Human
cccuacagcuguauucuuggacu

SEQ ID NO: 972376 - RNA, 22 nt, Human
gacccuacagcuguauucuugg

SEQ ID NO: 972377 - RNA, 19 nt, Human
uagaggaggcgguguacgg

SEQ ID NO: 972378 - RNA, 22 nt, Human
uuaaagcaaugacccuacagcu

SEQ ID NO: 972379 - RNA, 19 nt, Human
uuuaagagguaaagaggaa

SEQ ID NO: 972380 - RNA, 21 nt, Human
aacuggcacuucuugaaagcc

SEQ ID NO: 972381 - RNA, 23 nt, Human
aacuggcacuucuugaaagccug

SEQ ID NO: 972382 - RNA, 19 nt, Human
acagagcaggacuccagag

SEQ ID NO: 972383 - RNA, 25 nt, Human
accuggaccacacagagcaggacuc

SEQ ID NO: 972384 - RNA, 22 nt, Human
cucaggguggaaaggaccugga

SEQ ID NO: 972385 - RNA, 21 nt, Human
cugugugccaagccuuucccc

SEQ ID NO: 972386 - RNA, 19 nt, Human
gacuccagagccuccucca

SEQ ID NO: 972387 - RNA, 24 nt, Human
gagcaggacuccagagccuccucc

SEQ ID NO: 972388 - RNA, 21 nt, Human
ucagugguggagccaagucuc

SEQ ID NO: 972389 - RNA, 23 nt, Human
uggaccacacagagcaggacucc

SEQ ID NO: 972390 - RNA, 19 nt, Human
aaggauuuuucuaucuaca

SEQ ID NO: 972391 - RNA, 22 nt, Human
aucaauaagaagcugaaaagaa

SEQ ID NO: 972392 - RNA, 26 nt, Human
auccaagccaaucucguaauguuuac

SEQ ID NO: 972393 - RNA, 28 nt, Human
ucugaaauauuuauuaaagccaggcagc

SEQ ID NO: 972394 - RNA, 19 nt, Human
uugugaggcaucugaaaua

SEQ ID NO: 972395 - RNA, 22 nt, Human
uuuugugaggcaucugaaauau

SEQ ID NO: 972396 - RNA, 21 nt, Human
uuuuuuuuuuuuuuugugagg

SEQ ID NO: 972397 - RNA, 22 nt, Human
uuuuuuuuuuuuuuuugugagg

SEQ ID NO: 972398 - RNA, 18 nt, Human
uuuuuuuuuuuuuuuuug

SEQ ID NO: 972399 - RNA, 19 nt, Human
uuuuuuuuuuuuuuuuugu

SEQ ID NO: 972400 - RNA, 19 nt, Human
aaagacuggugaaacccua

SEQ ID NO: 972401 - RNA, 19 nt, Human
aaagugcugguauuacagg

SEQ ID NO: 972402 - RNA, 24 nt, Human
aaagugcugguauuacaggcguga

SEQ ID NO: 972403 - RNA, 19 nt, Human
aaccugcucuuucacucug

SEQ ID NO: 972404 - RNA, 19 nt, Human
aaccugcucuuucacucuu

SEQ ID NO: 972405 - RNA, 20 nt, Human
aaguagcugggacuacaggc

SEQ ID NO: 972406 - RNA, 22 nt, Human
aaguagcugggacuacaggcau

SEQ ID NO: 972407 - RNA, 24 nt, Human
aaguagcugggacuacaggcaugc

SEQ ID NO: 972408 - RNA, 24 nt, Human
aagugauccgccugccucagccuc

SEQ ID NO: 972409 - RNA, 22 nt, Human
aaguucuccaaguacccaccgg

SEQ ID NO: 972410 - RNA, 24 nt, Human
acaggcauccuggagauuaucucc

SEQ ID NO: 972411 - RNA, 24 nt, Human
acccaggcuggagugcaguggcau

SEQ ID NO: 972412 - RNA, 21 nt, Human
agcaauucuuccugccucggc

SEQ ID NO: 972413 - RNA, 18 nt, Human
aggaagcuucaggacuac

SEQ ID NO: 972414 - RNA, 23 nt, Human
aggaagcuucaggacuacaccaa

SEQ ID NO: 972415 - RNA, 25 nt, Human
aggcuggagugcaguggcaugaucu

SEQ ID NO: 972416 - RNA, 24 nt, Human
agugauccgccugccucagccucc

SEQ ID NO: 972417 - RNA, 20 nt, Human
agugcaguggcaugaucucg

SEQ ID NO: 972418 - RNA, 23 nt, Human
agugcaguggcaugaucucggcu

SEQ ID NO: 972419 - RNA, 24 nt, Human
agugcaguggcaugaucucggcuc

SEQ ID NO: 972420 - RNA, 24 nt, Human
aguggcaugaucucggcucacugc

SEQ ID NO: 972421 - RNA, 24 nt, Human
aguggcucugucacccaggcugga

SEQ ID NO: 972422 - RNA, 21 nt, Human
auggagcuugaguucuugagc

SEQ ID NO: 972423 - RNA, 20 nt, Human
auggaguuuugccacguugg

SEQ ID NO: 972424 - RNA, 24 nt, Human
auggaguuuugccacguuggccag

SEQ ID NO: 972425 - RNA, 20 nt, Human
auuacaggcgugagcacugc

SEQ ID NO: 972426 - RNA, 24 nt, Human
caaagugcugguauuacaggcgug

SEQ ID NO: 972427 - RNA, 27 nt, Human
caaguacccaccggacucaggagcccc

SEQ ID NO: 972428 - RNA, 22 nt, Human
caagugauccgccugccucagc

SEQ ID NO: 972429 - RNA, 20 nt, Human
caccaaagaagcagaaccug

SEQ ID NO: 972430 - RNA, 23 nt, Human
cacguuggccaggcuaguuucaa

SEQ ID NO: 972431 - RNA, 24 nt, Human
cacuaugccuggcuaauuuuugua

SEQ ID NO: 972432 - RNA, 19 nt, Human
caggcgugagcacugcggc

SEQ ID NO: 972433 - RNA, 24 nt, Human
cagggaucuuucuucacaggcauc

SEQ ID NO: 972434 - RNA, 22 nt, Human
ccaaagugcugguauuacaggc

SEQ ID NO: 972435 - RNA, 24 nt, Human
ccaaagugcugguauuacaggcgu

SEQ ID NO: 972436 - RNA, 19 nt, Human
ccacguuggccaggcuagu

SEQ ID NO: 972437 - RNA, 23 nt, Human
cccaaguagcugggacuacaggc

SEQ ID NO: 972438 - RNA, 24 nt, Human
cccaaguagcugggacuacaggca

SEQ ID NO: 972439 - RNA, 24 nt, Human
cccagguucaagcaauucuuccug

SEQ ID NO: 972440 - RNA, 26 nt, Human
ccgccugccucagccucccaaagugc

SEQ ID NO: 972441 - RNA, 22 nt, Human
ccucccagguucaagcaauucu

SEQ ID NO: 972442 - RNA, 18 nt, Human
ccugaccucaagugaucc

SEQ ID NO: 972443 - RNA, 21 nt, Human
ccugaccucaagugauccgcc

SEQ ID NO: 972444 - RNA, 23 nt, Human
ccugaccucaagugauccgccug

SEQ ID NO: 972445 - RNA, 18 nt, Human
ccugcucuuucacucugu

SEQ ID NO: 972446 - RNA, 18 nt, Human
cgcucugaauaaugggau

SEQ ID NO: 972447 - RNA, 21 nt, Human
cuacaccaaagaagcagaacc

SEQ ID NO: 972448 - RNA, 23 nt, Human
cucaagugauccgccugccucag

SEQ ID NO: 972449 - RNA, 22 nt, Human
cuccaaguacccaccggacuca

SEQ ID NO: 972450 - RNA, 26 nt, Human
cuccugaccucaagugauccgccugc

SEQ ID NO: 972451 - RNA, 18 nt, Human
cucugucacccaggcugg

SEQ ID NO: 972452 - RNA, 23 nt, Human
cugccucagccucccaaagugcu

SEQ ID NO: 972453 - RNA, 24 nt, Human
cugccucagccucccaaagugcug

SEQ ID NO: 972454 - RNA, 23 nt, Human
cuggaagucuucuggccugcugg

SEQ ID NO: 972455 - RNA, 24 nt, Human
cuggagugcaguggcaugaucucg

SEQ ID NO: 972456 - RNA, 22 nt, Human
cuguugcauuguguggagugca

SEQ ID NO: 972457 - RNA, 18 nt, Human
gaaugaguuucccuggaa

SEQ ID NO: 972458 - RNA, 24 nt, Human
gaccucaagugauccgccugccuc

SEQ ID NO: 972459 - RNA, 19 nt, Human
gacuacaggcaugcaccac

SEQ ID NO: 972460 - RNA, 20 nt, Human
gcaccacuaugccuggcuaa

SEQ ID NO: 972461 - RNA, 22 nt, Human
gcagacucugccucccagguuc

SEQ ID NO: 972462 - RNA, 20 nt, Human
gccuagugcaucccggcugc

SEQ ID NO: 972463 - RNA, 23 nt, Human
gcuaguuucaaacuccugaccuc

SEQ ID NO: 972464 - RNA, 20 nt, Human
gcucugucacccaggcugga

SEQ ID NO: 972465 - RNA, 25 nt, Human
gcucugucacccaggcuggagugca

SEQ ID NO: 972466 - RNA, 19 nt, Human
gcuggagugcaguggcaug

SEQ ID NO: 972467 - RNA, 24 nt, Human
ggacuacaggcaugcaccacuaug

SEQ ID NO: 972468 - RNA, 20 nt, Human
ggagcccagcuggcuuugcc

SEQ ID NO: 972469 - RNA, 22 nt, Human
ggaguuuugccacguuggccag

SEQ ID NO: 972470 - RNA, 24 nt, Human
ggcucugucacccaggcuggagug

SEQ ID NO: 972471 - RNA, 18 nt, Human
gugauccgccugccucag

SEQ ID NO: 972472 - RNA, 24 nt, Human
gugauccgccugccucagccuccc

SEQ ID NO: 972473 - RNA, 19 nt, Human
guucuccaaguacccaccg

SEQ ID NO: 972474 - RNA, 24 nt, Human
uaauagagauggaguuuugccacg

SEQ ID NO: 972475 - RNA, 24 nt, Human
uaauuuuuguauuuuuaauagaga

SEQ ID NO: 972476 - RNA, 22 nt, Human
uacaggcaugcaccacuaugcc

SEQ ID NO: 972477 - RNA, 22 nt, Human
uagagauggaguuuugccacgu

SEQ ID NO: 972478 - RNA, 19 nt, Human
uauuacaggcgugagcacu

SEQ ID NO: 972479 - RNA, 21 nt, Human
uauuacaggcgugagcacugc

SEQ ID NO: 972480 - RNA, 22 nt, Human
ucaagugauccgccugccucag

SEQ ID NO: 972481 - RNA, 24 nt, Human
ucacccaggcuggagugcaguggc

SEQ ID NO: 972482 - RNA, 19 nt, Human
ucacugcagacucugccuc

SEQ ID NO: 972483 - RNA, 24 nt, Human
ucacugcagacucugccucccagg

SEQ ID NO: 972484 - RNA, 19 nt, Human
ucauccaucauuuucaccu

SEQ ID NO: 972485 - RNA, 19 nt, Human
uccaaguacccaccggacu

SEQ ID NO: 972486 - RNA, 19 nt, Human
uccauacgcgcucugaaua

SEQ ID NO: 972487 - RNA, 24 nt, Human
uccauuuucaucuuggaggaguca

SEQ ID NO: 972488 - RNA, 24 nt, Human
ucccaaagugcugguauuacaggc

SEQ ID NO: 972489 - RNA, 24 nt, Human
ucccaaguagcugggacuacaggc

SEQ ID NO: 972490 - RNA, 20 nt, Human
ucccagguucaagcaauucu

SEQ ID NO: 972491 - RNA, 25 nt, Human
ucccagguucaagcaauucuuccug

SEQ ID NO: 972492 - RNA, 24 nt, Human
ucggaguucccugggaaagacugg

SEQ ID NO: 972493 - RNA, 23 nt, Human
ucuccaaguacccaccggacucu

SEQ ID NO: 972494 - RNA, 23 nt, Human
ucuccucuguuguaucuccugga

SEQ ID NO: 972495 - RNA, 22 nt, Human
ucucgacaaugaaacaucuccu

SEQ ID NO: 972496 - RNA, 24 nt, Human
ucugucacccaggcuggagugcag

SEQ ID NO: 972497 - RNA, 22 nt, Human
ucuucacaggcauccuggagau

SEQ ID NO: 972498 - RNA, 21 nt, Human
ugaaacccuacaagcguuucc

SEQ ID NO: 972499 - RNA, 23 nt, Human
ugaaugaguuucccuggaagucu

SEQ ID NO: 972500 - RNA, 18 nt, Human
ugaccucaagugauccgc

SEQ ID NO: 972501 - RNA, 24 nt, Human
ugaccucaagugauccgccugccu

SEQ ID NO: 972502 - RNA, 24 nt, Human
ugccacguuggccaggcuaguuuc

SEQ ID NO: 972503 - RNA, 31 nt, Human
ugccacguuggccaggcuaguuucaaacucc

SEQ ID NO: 972504 - RNA, 24 nt, Human
ugccucagccucccaaagugcugg

SEQ ID NO: 972505 - RNA, 21 nt, Human
ugccucggcaucccaaguagc

SEQ ID NO: 972506 - RNA, 21 nt, Human
ugcucucgacaaugaaacauc

SEQ ID NO: 972507 - RNA, 19 nt, Human
uggagugcaguggcaugau

SEQ ID NO: 972508 - RNA, 24 nt, Human
uggagugcaguggcaugaucucgg

SEQ ID NO: 972509 - RNA, 24 nt, Human
uggaguuuugccacguuggccagg

SEQ ID NO: 972510 - RNA, 24 nt, Human
uggccaggcuaguuucaaacuccu

SEQ ID NO: 972511 - RNA, 24 nt, Human
uggcucugucacccaggcuggagu

SEQ ID NO: 972512 - RNA, 21 nt, Human
ugggaaagacuggugaaaccc

SEQ ID NO: 972513 - RNA, 21 nt, Human
ugggacuacaggcaugcacca

SEQ ID NO: 972514 - RNA, 23 nt, Human
ugggacuacaggcaugcaccacu

SEQ ID NO: 972515 - RNA, 24 nt, Human
ugggacuacaggcaugcaccacua

SEQ ID NO: 972516 - RNA, 20 nt, Human
ugguauuacaggcgugagca

SEQ ID NO: 972517 - RNA, 22 nt, Human
ugguauuacaggcgugagcacu

SEQ ID NO: 972518 - RNA, 23 nt, Human
ugguauuacaggcgugagcacug

SEQ ID NO: 972519 - RNA, 18 nt, Human
uuaauagagauggaguuu

SEQ ID NO: 972520 - RNA, 18 nt, Human
uuaauagagauggaguuu

SEQ ID NO: 972521 - RNA, 22 nt, Human
uucaagcaauucuuccugccuc

SEQ ID NO: 972522 - RNA, 20 nt, Human
uucuugguucacucgcucau

SEQ ID NO: 972523 - RNA, 21 nt, Human
uucuugguucacucgcucauu

SEQ ID NO: 972524 - RNA, 23 nt, Human
uugagacggaguggcucugucac

SEQ ID NO: 972525 - RNA, 24 nt, Human
uuucacucuguugcauugugugga

SEQ ID NO: 972526 - RNA, 21 nt, Human
uuucccuggaagucuucuggc

SEQ ID NO: 972527 - RNA, 21 nt, Human
uuuuuaauagagauggaguuu

SEQ ID NO: 972528 - RNA, 20 nt, Human
uuuuuguauuuuuaauagag

SEQ ID NO: 972529 - RNA, 23 nt, Human
uuuuuguauuuuuaauagagaug

SEQ ID NO: 972530 - RNA, 23 nt, Human
uuuuuuuuuuugagacggagugg

SEQ ID NO: 972531 - RNA, 22 nt, Human
uuuuuuuuuuuuuugagacgga

SEQ ID NO: 972532 - RNA, 18 nt, Human
uuuuuuuuuuuuuuuuug

SEQ ID NO: 972533 - RNA, 24 nt, Human
aaagugcugggauuacaggcguga

SEQ ID NO: 972534 - RNA, 19 nt, Human
aagugcugggauuacaggc

SEQ ID NO: 972535 - RNA, 19 nt, Human
aagugcugggauuacaggc

SEQ ID NO: 972536 - RNA, 26 nt, Human
aagugcugggauuacaggcgugagcu

SEQ ID NO: 972537 - RNA, 28 nt, Human
acccaggcuggauggagugcaguggugu

SEQ ID NO: 972538 - RNA, 18 nt, Human
acccugucacccaggcug

SEQ ID NO: 972539 - RNA, 18 nt, Human
acugcaagcuccgccucc

SEQ ID NO: 972540 - RNA, 18 nt, Human
agcuccgccuccuggguu

SEQ ID NO: 972541 - RNA, 24 nt, Human
agcuccgccuccuggguucacacu

SEQ ID NO: 972542 - RNA, 21 nt, Human
agcuucacuaaucccaaacaa

SEQ ID NO: 972543 - RNA, 22 nt, Human
agguccuuuuuguacaucuggc

SEQ ID NO: 972544 - RNA, 18 nt, Human
aguagcugggacuacagg

SEQ ID NO: 972545 - RNA, 19 nt, Human
aguagcugggacuacaggc

SEQ ID NO: 972546 - RNA, 19 nt, Human
agugcaguggugugaucuc

SEQ ID NO: 972547 - RNA, 20 nt, Human
agugcaguggugugaucucg

SEQ ID NO: 972548 - RNA, 23 nt, Human
agugcaguggugugaucucggcu

SEQ ID NO: 972549 - RNA, 24 nt, Human
agugcaguggugugaucucggcuc

SEQ ID NO: 972550 - RNA, 24 nt, Human
caaagugcugggauuacaggcgug

SEQ ID NO: 972551 - RNA, 18 nt, Human
caaggaaaaagguuuuuc

SEQ ID NO: 972552 - RNA, 22 nt, Human
cacacuuuucuccugccucagc

SEQ ID NO: 972553 - RNA, 18 nt, Human
cacccugucacccaggcu

SEQ ID NO: 972554 - RNA, 22 nt, Human
cacccugucacccaggcuggau

SEQ ID NO: 972555 - RNA, 18 nt, Human
caccguguuaaccaggau

SEQ ID NO: 972556 - RNA, 24 nt, Human
caccguguuaaccaggauggucuc

SEQ ID NO: 972557 - RNA, 22 nt, Human
cagaaagaaauagcauuucuua

SEQ ID NO: 972558 - RNA, 19 nt, Human
cagacccugaaccagcccc

SEQ ID NO: 972559 - RNA, 20 nt, Human
cagccuccugaguagcuggg

SEQ ID NO: 972560 - RNA, 21 nt, Human
caggcgcccgccaccacgccc

SEQ ID NO: 972561 - RNA, 22 nt, Human
ccaaagugcugggauuacaggc

SEQ ID NO: 972562 - RNA, 22 nt, Human
ccaaagugcugggauuacaggc

SEQ ID NO: 972563 - RNA, 24 nt, Human
ccaaagugcugggauuacaggcgu

SEQ ID NO: 972564 - RNA, 22 nt, Human
cccaaacaacccccaaacucug

SEQ ID NO: 972565 - RNA, 22 nt, Human
cccaaacaacccccaaaggccc

SEQ ID NO: 972566 - RNA, 23 nt, Human
ccccaaacucuguuucagacccu

SEQ ID NO: 972567 - RNA, 20 nt, Human
cccccaaacucuguuucaga

SEQ ID NO: 972568 - RNA, 24 nt, Human
cccccaaacucuguuucagacccu

SEQ ID NO: 972569 - RNA, 21 nt, Human
cccgccaccacgcccagcuaa

SEQ ID NO: 972570 - RNA, 24 nt, Human
cccuugugauccgcccgccucggc

SEQ ID NO: 972571 - RNA, 22 nt, Human
ccuccuggguucacacuuuucu

SEQ ID NO: 972572 - RNA, 23 nt, Human
ccugaguagcugggacuacaggc

SEQ ID NO: 972573 - RNA, 23 nt, Human
ccugaguagcugggacuacaggc

SEQ ID NO: 972574 - RNA, 23 nt, Human
ccugccucagccuccugaguagc

SEQ ID NO: 972575 - RNA, 28 nt, Human
ccugucacccaggcuggauggagugcag

SEQ ID NO: 972576 - RNA, 20 nt, Human
ccuugugauccgcccgccuc

SEQ ID NO: 972577 - RNA, 19 nt, Human
cgccuccuggguucacacu

SEQ ID NO: 972578 - RNA, 24 nt, Human
cgccucggccucccaaagugcugg

SEQ ID NO: 972579 - RNA, 23 nt, Human
cgggguuucaccguguuaaccag

SEQ ID NO: 972580 - RNA, 24 nt, Human
cucagccuccugaguagcugggac

SEQ ID NO: 972581 - RNA, 24 nt, Human
cuccugcccuugugauccgcccgc

SEQ ID NO: 972582 - RNA, 23 nt, Human
cugccucagccuccugaguagcu

SEQ ID NO: 972583 - RNA, 24 nt, Human
cuggcggcaaaggcaguagcuucu

SEQ ID NO: 972584 - RNA, 25 nt, Human
gaguagcugggacuacaggcgcccg

SEQ ID NO: 972585 - RNA, 19 nt, Human
gauuacaggcgugagcuac

SEQ ID NO: 972586 - RNA, 21 nt, Human
gauuacaggcgugagcuacca

SEQ ID NO: 972587 - RNA, 18 nt, Human
ggauggagugcaguggug

SEQ ID NO: 972588 - RNA, 23 nt, Human
gggguuucaccguguuaaccagg

SEQ ID NO: 972589 - RNA, 22 nt, Human
ggguuucaccguguuaaccagg

SEQ ID NO: 972590 - RNA, 23 nt, Human
guauaaacacaaacauuuaaagc

SEQ ID NO: 972591 - RNA, 24 nt, Human
gugauccgcccgccucggccuccc

SEQ ID NO: 972592 - RNA, 21 nt, Human
gugaucucggcucacugcaag

SEQ ID NO: 972593 - RNA, 22 nt, Human
guugcgcugcagcaguuugcug

SEQ ID NO: 972594 - RNA, 24 nt, Human
guuuuaguagagucgggguuucac

SEQ ID NO: 972595 - RNA, 23 nt, Human
uaaacacaaacauuuaaagcuag

SEQ ID NO: 972596 - RNA, 24 nt, Human
uacaggcgcccgccaccacgccca

SEQ ID NO: 972597 - RNA, 23 nt, Human
uagcuucacuaaucccaaacaac

SEQ ID NO: 972598 - RNA, 21 nt, Human
uaguagagucgggguuucacc

SEQ ID NO: 972599 - RNA, 24 nt, Human
uaguagagucgggguuucaccgug

SEQ ID NO: 972600 - RNA, 25 nt, Human
uaguagagucgggguuucaccgugu

SEQ ID NO: 972601 - RNA, 24 nt, Human
ucaccguguuaaccaggauggucu

SEQ ID NO: 972602 - RNA, 18 nt, Human
ucacugcaagcuccgccu

SEQ ID NO: 972603 - RNA, 23 nt, Human
ucacugcaagcuccgccuccugg

SEQ ID NO: 972604 - RNA, 24 nt, Human
ucacugcaagcuccgccuccuggg

SEQ ID NO: 972605 - RNA, 23 nt, Human
ucagccuccugaguagcugggac

SEQ ID NO: 972606 - RNA, 24 nt, Human
ucccaaacaacccccaaacucugu

SEQ ID NO: 972607 - RNA, 24 nt, Human
ucccaaagugcugggauuacaggc

SEQ ID NO: 972608 - RNA, 23 nt, Human
ucccacaguugauaaaaaucuau

SEQ ID NO: 972609 - RNA, 24 nt, Human
uccugaguagcugggacuacaggc

SEQ ID NO: 972610 - RNA, 24 nt, Human
uccuggguucacacuuuucuccug

SEQ ID NO: 972611 - RNA, 18 nt, Human
ucggccucccaaagugcu

SEQ ID NO: 972612 - RNA, 24 nt, Human
ucucacccugucacccaggcugga

SEQ ID NO: 972613 - RNA, 25 nt, Human
ucucacccugucacccaggcuggau

SEQ ID NO: 972614 - RNA, 26 nt, Human
ucucacccugucacccaggcuggaug

SEQ ID NO: 972615 - RNA, 24 nt, Human
ucuccugccucagccuccugagua

SEQ ID NO: 972616 - RNA, 22 nt, Human
ucuguuucagacccugaaccag

SEQ ID NO: 972617 - RNA, 18 nt, Human
ugagacagagucucaccc

SEQ ID NO: 972618 - RNA, 22 nt, Human
ugagacagagucucacccuguc

SEQ ID NO: 972619 - RNA, 24 nt, Human
ugccucagccuccugaguagcugg

SEQ ID NO: 972620 - RNA, 20 nt, Human
ugcugggauuacaggcguga

SEQ ID NO: 972621 - RNA, 19 nt, Human
uggagugcaguggugugau

SEQ ID NO: 972622 - RNA, 23 nt, Human
uggagugcaguggugugaucucg

SEQ ID NO: 972623 - RNA, 24 nt, Human
uggagugcaguggugugaucucgg

SEQ ID NO: 972624 - RNA, 23 nt, Human
uggauggagugcaguggugugau

SEQ ID NO: 972625 - RNA, 21 nt, Human
ugggacuacaggcgcccgcca

SEQ ID NO: 972626 - RNA, 22 nt, Human
ugggacuacaggcgcccgccac

SEQ ID NO: 972627 - RNA, 24 nt, Human
ugggacuacaggcgcccgccacca

SEQ ID NO: 972628 - RNA, 18 nt, Human
ugggauuacaggcgugag

SEQ ID NO: 972629 - RNA, 19 nt, Human
ugggauuacaggcgugagc

SEQ ID NO: 972630 - RNA, 22 nt, Human
ugggauuacaggcgugagcuac

SEQ ID NO: 972631 - RNA, 23 nt, Human
ugggauuacaggcgugagcuacc

SEQ ID NO: 972632 - RNA, 24 nt, Human
ugggauuacaggcgugagcuacca

SEQ ID NO: 972633 - RNA, 21 nt, Human
uguuucagacccugaaccagc

SEQ ID NO: 972634 - RNA, 22 nt, Human
uuaguagagucgggguuucacc

SEQ ID NO: 972635 - RNA, 24 nt, Human
uuaguagagucgggguuucaccgu

SEQ ID NO: 972636 - RNA, 18 nt, Human
uugcaaggaaaaagguuu

SEQ ID NO: 972637 - RNA, 24 nt, Human
uuuguacaucuggcccacugauua

SEQ ID NO: 972638 - RNA, 22 nt, Human
uuuguaguuuuaguagagucgg

SEQ ID NO: 972639 - RNA, 18 nt, Human
uuuuguaguuuuaguaga

SEQ ID NO: 972640 - RNA, 21 nt, Human
uuuuuuguaguuuuaguagag

SEQ ID NO: 972641 - RNA, 20 nt, Human
uuuuuuuuuuugagacagag

SEQ ID NO: 972642 - RNA, 26 nt, Human
uuuuuuuuuuuugagacagagucuca

SEQ ID NO: 972643 - RNA, 18 nt, Human
uuuuuuuuuuuuuuuuug

SEQ ID NO: 972644 - RNA, 24 nt, Human
aaaagaaaaaaaauaugcauauga

SEQ ID NO: 972645 - RNA, 22 nt, Human
aacacaauuacugucauaaacc

SEQ ID NO: 972646 - RNA, 22 nt, Human
aagcacaucauaacaacagcac

SEQ ID NO: 972647 - RNA, 19 nt, Human
agacuugaacagguuggua

SEQ ID NO: 972648 - RNA, 18 nt, Human
agcagccuuucuugucau

SEQ ID NO: 972649 - RNA, 19 nt, Human
agucgaagaacuggaaccg

SEQ ID NO: 972650 - RNA, 23 nt, Human
agucucuuuuuuuuuuuuuauuu

SEQ ID NO: 972651 - RNA, 19 nt, Human
aucaaccugcuuuucacca

SEQ ID NO: 972652 - RNA, 22 nt, Human
aucauaggaaauaaaaacccac

SEQ ID NO: 972653 - RNA, 24 nt, Human
aucuuccuuucacuaaucacguuc

SEQ ID NO: 972654 - RNA, 20 nt, Human
augaaauaagagcauuuuga

SEQ ID NO: 972655 - RNA, 21 nt, Human
augaagagugcgcuacccaag

SEQ ID NO: 972656 - RNA, 21 nt, Human
auucauuacacuugugcugcc

SEQ ID NO: 972657 - RNA, 23 nt, Human
caaacagauaacaacagucgaag

SEQ ID NO: 972658 - RNA, 21 nt, Human
caaauaacugcacuaagguau

SEQ ID NO: 972659 - RNA, 19 nt, Human
caacgagccaaaguaccac

SEQ ID NO: 972660 - RNA, 18 nt, Human
caagcuauuuccuucccc

SEQ ID NO: 972661 - RNA, 19 nt, Human
caauacuaggcaccauaaa

SEQ ID NO: 972662 - RNA, 21 nt, Human
caccuggacacagugaaaauu

SEQ ID NO: 972663 - RNA, 22 nt, Human
caguacagaccaacacggucaa

SEQ ID NO: 972664 - RNA, 18 nt, Human
cauaaaauguaaacacaa

SEQ ID NO: 972665 - RNA, 27 nt, Human
caugauaacuacuucccuuauaugcaa

SEQ ID NO: 972666 - RNA, 22 nt, Human
ccaaaguaccaccuggacacag

SEQ ID NO: 972667 - RNA, 22 nt, Human
ccgauacugcaagauaccacuc

SEQ ID NO: 972668 - RNA, 20 nt, Human
ccgccgggaccgcgggcgga

SEQ ID NO: 972669 - RNA, 24 nt, Human
ccuuauaugcaaacauuagagcua

SEQ ID NO: 972670 - RNA, 20 nt, Human
cggcggcggacgcuggcugg

SEQ ID NO: 972671 - RNA, 23 nt, Human
cugcccuugacauaaaaugauuu

SEQ ID NO: 972672 - RNA, 19 nt, Human
cuuucuugucaucugaugg

SEQ ID NO: 972673 - RNA, 18 nt, Human
gaacgcaccuggcgccgc

SEQ ID NO: 972674 - RNA, 23 nt, Human
gaacgcaccuggcgccgccggga

SEQ ID NO: 972675 - RNA, 22 nt, Human
gacgcuggcuggagccgggcag

SEQ ID NO: 972676 - RNA, 24 nt, Human
gagcagcuucucaaauaaugcagu

SEQ ID NO: 972677 - RNA, 23 nt, Human
gaggaaaacugauuuugcaaguu

SEQ ID NO: 972678 - RNA, 23 nt, Human
gcaaagcugcccuugacauaaaa

SEQ ID NO: 972679 - RNA, 18 nt, Human
ggaagaggauguuuggag

SEQ ID NO: 972680 - RNA, 24 nt, Human
ggaguuuaggcuacagagcauuca

SEQ ID NO: 972681 - RNA, 20 nt, Human
ggcggacucagcccaggaag

SEQ ID NO: 972682 - RNA, 21 nt, Human
ggcggcggcggacgcuggcug

SEQ ID NO: 972683 - RNA, 20 nt, Human
gggcggggagccuggggcag

SEQ ID NO: 972684 - RNA, 25 nt, Human
gugcaguuuguccagccaguggaag

SEQ ID NO: 972685 - RNA, 23 nt, Human
uaaaaacccacaaaugaaaaggu

SEQ ID NO: 972686 - RNA, 20 nt, Human
uaaaacagacaaguauuuug

SEQ ID NO: 972687 - RNA, 22 nt, Human
uaaacacaauuacugucauaaa

SEQ ID NO: 972688 - RNA, 18 nt, Human
uaacaacagcacagugaa

SEQ ID NO: 972689 - RNA, 22 nt, Human
uaacauuuugucaauacuaggc

SEQ ID NO: 972690 - RNA, 18 nt, Human
uaagaagagauccaaauu

SEQ ID NO: 972691 - RNA, 23 nt, Human
uacaggauuacuggcuaauuuug

SEQ ID NO: 972692 - RNA, 19 nt, Human
uacuaggcaccauaaaaug

SEQ ID NO: 972693 - RNA, 25 nt, Human
uaugaauaaacaggggaacuagaug

SEQ ID NO: 972694 - RNA, 30 nt, Human
uaugauuaaacauuugaucauacaguaccc

SEQ ID NO: 972695 - RNA, 24 nt, Human
uauugagaggaaaacugauuuugc

SEQ ID NO: 972696 - RNA, 21 nt, Human
ucaaccugcuuuucaccacau

SEQ ID NO: 972697 - RNA, 28 nt, Human
uccaaauuacaagagaggcagauaaaaa

SEQ ID NO: 972698 - RNA, 18 nt, Human
ucggcagcggggcgggga

SEQ ID NO: 972699 - RNA, 22 nt, Human
ucuucauuuguucugcauguuu

SEQ ID NO: 972700 - RNA, 20 nt, Human
ugaaugaugaaauaagagca

SEQ ID NO: 972701 - RNA, 20 nt, Human
ugcaaacauuagagcuauaa

SEQ ID NO: 972702 - RNA, 19 nt, Human
ugcauguuuucucuacaac

SEQ ID NO: 972703 - RNA, 20 nt, Human
ugcccgaccucgagugucac

SEQ ID NO: 972704 - RNA, 24 nt, Human
ugcguuucagcaaggaaugucagg

SEQ ID NO: 972705 - RNA, 20 nt, Human
uggaaccgaaagcaaauaac

SEQ ID NO: 972706 - RNA, 26 nt, Human
uggaugguugguacaaaauguauguu

SEQ ID NO: 972707 - RNA, 20 nt, Human
uggguaaaaagaaaaaaaau

SEQ ID NO: 972708 - RNA, 25 nt, Human
ugguugguacaaaauguauguuuug

SEQ ID NO: 972709 - RNA, 18 nt, Human
ugucaggugguaguucug

SEQ ID NO: 972710 - RNA, 26 nt, Human
ugucauaaaccuagauauaccggcgc

SEQ ID NO: 972711 - RNA, 23 nt, Human
uguuuggaguuuaggcuacagag

SEQ ID NO: 972712 - RNA, 22 nt, Human
uuaauaugaacaaauggguaaa

SEQ ID NO: 972713 - RNA, 26 nt, Human
uuaggcuacagagcauucagguauug

SEQ ID NO: 972714 - RNA, 20 nt, Human
uuccccuucagguucucgug

SEQ ID NO: 972715 - RNA, 19 nt, Human
uuccugacuuugcaauacu

SEQ ID NO: 972716 - RNA, 19 nt, Human
uuuuuuuuuuuuuuuuuaa

SEQ ID NO: 972717 - RNA, 21 nt, Human
aaacagguaucguguguuccc

SEQ ID NO: 972718 - RNA, 22 nt, Human
aagaagccgccgccgccgccaa

SEQ ID NO: 972719 - RNA, 27 nt, Human
acgcacaugcauccacacuuaacuaca

SEQ ID NO: 972720 - RNA, 18 nt, Human
caacaguacugccagcaa

SEQ ID NO: 972721 - RNA, 19 nt, Human
caacggaaaagaaaaacag

SEQ ID NO: 972722 - RNA, 22 nt, Human
caccgcccccccuucacacaca

SEQ ID NO: 972723 - RNA, 18 nt, Human
caggacagggccagucac

SEQ ID NO: 972724 - RNA, 20 nt, Human
ccaccgcccccccuucacac

SEQ ID NO: 972725 - RNA, 19 nt, Human
ccagucacaaacaguccua

SEQ ID NO: 972726 - RNA, 23 nt, Human
ccccgccccuccgcgcggggccg

SEQ ID NO: 972727 - RNA, 20 nt, Human
cccgccccuccgcgcggggc

SEQ ID NO: 972728 - RNA, 19 nt, Human
cccgcccgccucggccacc

SEQ ID NO: 972729 - RNA, 22 nt, Human
cccggcgccucccccgccccuc

SEQ ID NO: 972730 - RNA, 23 nt, Human
cccggcgccucccccgccccucc

SEQ ID NO: 972731 - RNA, 21 nt, Human
ccgccgccgccgccaaacgag

SEQ ID NO: 972732 - RNA, 18 nt, Human
ccgcgcccccgcugcgcg

SEQ ID NO: 972733 - RNA, 21 nt, Human
ccuccgcgcggggccgggggc

SEQ ID NO: 972734 - RNA, 25 nt, Human
cgcaacaguacugccagcaacggaa

SEQ ID NO: 972735 - RNA, 22 nt, Human
cgccgggcccccggcgagucug

SEQ ID NO: 972736 - RNA, 20 nt, Human
cggcgccgucgacuucccgg

SEQ ID NO: 972737 - RNA, 21 nt, Human
cggcgccucccccgccccucc

SEQ ID NO: 972738 - RNA, 19 nt, Human
cggggucgagacuggaaug

SEQ ID NO: 972739 - RNA, 24 nt, Human
cugcgcgcgcgcucgccggcuccc

SEQ ID NO: 972740 - RNA, 24 nt, Human
cuucacacacacgcgcgccacccc

SEQ ID NO: 972741 - RNA, 18 nt, Human
gacuucccggcgccuccc

SEQ ID NO: 972742 - RNA, 20 nt, Human
gacuucccggcgccuccccc

SEQ ID NO: 972743 - RNA, 19 nt, Human
gcagacaguggccuccugc

SEQ ID NO: 972744 - RNA, 22 nt, Human
gccacccgcgcccccgcugcgc

SEQ ID NO: 972745 - RNA, 24 nt, Human
gccaccgcccccccuucacacaca

SEQ ID NO: 972746 - RNA, 20 nt, Human
gcccgccucggccaccgccc

SEQ ID NO: 972747 - RNA, 18 nt, Human
gccggcuccccucccccu

SEQ ID NO: 972748 - RNA, 24 nt, Human
gccucggccaccgcccccccuuca

SEQ ID NO: 972749 - RNA, 21 nt, Human
gcgcggggccgggggcagaau

SEQ ID NO: 972750 - RNA, 26 nt, Human
gcgcucgccggcuccccucccccuca

SEQ ID NO: 972751 - RNA, 22 nt, Human
gcucgccggcuccccucccccu

SEQ ID NO: 972752 - RNA, 22 nt, Human
ggcuccccucccccucagcacc

SEQ ID NO: 972753 - RNA, 19 nt, Human
guaggaggaguggacggug

SEQ ID NO: 972754 - RNA, 30 nt, Human
uaagacaguuaaugcuguuacagaugcuac

SEQ ID NO: 972755 - RNA, 22 nt, Human
uacugccagcaacggaaaagaa

SEQ ID NO: 972756 - RNA, 18 nt, Human
uauuacuguuugacaucc

SEQ ID NO: 972757 - RNA, 24 nt, Human
ucagcucuggaacgaggggcucgg

SEQ ID NO: 972758 - RNA, 20 nt, Human
uccaaacugcggcgcaacag

SEQ ID NO: 972759 - RNA, 20 nt, Human
ucccggcgccucccccgccc

SEQ ID NO: 972760 - RNA, 22 nt, Human
ucgcgcgcgcgcccgcccgccu

SEQ ID NO: 972761 - RNA, 22 nt, Human
ugacauccagugacacugacau

SEQ ID NO: 972762 - RNA, 19 nt, Human
uguuugacauccagugaca

SEQ ID NO: 972763 - RNA, 21 nt, Human
uuacuccaagucugaaacuac

SEQ ID NO: 972764 - RNA, 19 nt, Human
uucccggcgccucccccgc

SEQ ID NO: 972765 - RNA, 22 nt, Human
uugacauccagugacacugaca

SEQ ID NO: 972766 - RNA, 23 nt, Human
aaaaaaguauuuagaacacacaa

SEQ ID NO: 972767 - RNA, 24 nt, Human
aaaguauuuagaacacacaaaaca

SEQ ID NO: 972768 - RNA, 23 nt, Human
aaggugacugacugagccauuag

SEQ ID NO: 972769 - RNA, 19 nt, Human
acacacaaaacaaggcaac

SEQ ID NO: 972770 - RNA, 20 nt, Human
accacguaacaccauuaaaa

SEQ ID NO: 972771 - RNA, 21 nt, Human
agaaacaagauccaaagaaaa

SEQ ID NO: 972772 - RNA, 18 nt, Human
auccaaagaaaagagcca

SEQ ID NO: 972773 - RNA, 22 nt, Human
caaagaaaagagccaucuucac

SEQ ID NO: 972774 - RNA, 21 nt, Human
cacaaaccacguaacaccauu

SEQ ID NO: 972775 - RNA, 18 nt, Human
ccccgccccucgcguccg

SEQ ID NO: 972776 - RNA, 20 nt, Human
ccuuugguggugugauaugg

SEQ ID NO: 972777 - RNA, 23 nt, Human
cgcccgcagcuccggcuucgcuu

SEQ ID NO: 972778 - RNA, 21 nt, Human
gaaaaagcgcccgcagcuccg

SEQ ID NO: 972779 - RNA, 23 nt, Human
gccaucuucacaacacuuaagaa

SEQ ID NO: 972780 - RNA, 30 nt, Human
ggacaagaaaaaaaauuaauacacaaaccc

SEQ ID NO: 972781 - RNA, 18 nt, Human
ggcuagaaacaagaucca

SEQ ID NO: 972782 - RNA, 19 nt, Human
uaagaaugaaucugagaca

SEQ ID NO: 972783 - RNA, 18 nt, Human
uagaacacacaaaacaag

SEQ ID NO: 972784 - RNA, 21 nt, Human
uagaacacacaaaacaaggca

SEQ ID NO: 972785 - RNA, 27 nt, Human
uagaacacacaaaacaaggcaaccggc

SEQ ID NO: 972786 - RNA, 18 nt, Human
uaggcucaugaugcuaaa

SEQ ID NO: 972787 - RNA, 19 nt, Human
uaggcucaugaugcuaaau

SEQ ID NO: 972788 - RNA, 26 nt, Human
uauggacaagaaaaaaaauuaauaca

SEQ ID NO: 972789 - RNA, 24 nt, Human
ucaguuccuuaagaaugaaucuga

SEQ ID NO: 972790 - RNA, 22 nt, Human
ucccgcgcucgccccgccccuc

SEQ ID NO: 972791 - RNA, 21 nt, Human
aaaacaaaaacccagaaaaaa

SEQ ID NO: 972792 - RNA, 21 nt, Human
aaaacaaaacaaaacaaaaac

SEQ ID NO: 972793 - RNA, 23 nt, Human
aaaacaaaacaaaacaaaaaccc

SEQ ID NO: 972794 - RNA, 23 nt, Human
aaaacaaaacaaaacaaaaaccc

SEQ ID NO: 972795 - RNA, 20 nt, Human
aaacaaaacaaaaacccaga

SEQ ID NO: 972796 - RNA, 20 nt, Human
aaacaaaacaaaaacccaga

SEQ ID NO: 972797 - RNA, 21 nt, Human
aaacaaaacaaaaacccagaa

SEQ ID NO: 972798 - RNA, 21 nt, Human
aaacaaaacaaaaacccagaa

SEQ ID NO: 972799 - RNA, 26 nt, Human
aaacaaaacaaaaacccagaaaaaaa

SEQ ID NO: 972800 - RNA, 19 nt, Human
aaacaaaacaaaacaaaaa

SEQ ID NO: 972801 - RNA, 19 nt, Human
aaacaaaacaaaacaaaaa

SEQ ID NO: 972802 - RNA, 23 nt, Human
aaacaaaacaaaacaaaaaccca

SEQ ID NO: 972803 - RNA, 23 nt, Human
aaacaaaacaaaacaaaaaccca

SEQ ID NO: 972804 - RNA, 25 nt, Human
aaacaggagagacuuuuucccaagg

SEQ ID NO: 972805 - RNA, 25 nt, Human
aaacaggagagacuuuuucccaagg

SEQ ID NO: 972806 - RNA, 20 nt, Human
aaacucacuguaaacaacag

SEQ ID NO: 972807 - RNA, 18 nt, Human
aaacuugcugcucuccuu

SEQ ID NO: 972808 - RNA, 23 nt, Human
aaagaaaacaaaacaaaacaaaa

SEQ ID NO: 972809 - RNA, 24 nt, Human
aaagaaaacaaaacaaaacaaaaa

SEQ ID NO: 972810 - RNA, 27 nt, Human
aaagaaaacaaaacaaaacaaaaaccc

SEQ ID NO: 972811 - RNA, 27 nt, Human
aaagaaaacaaaacaaaacaaaaaccc

SEQ ID NO: 972812 - RNA, 21 nt, Human
aaagccagcaaggacugggaa

SEQ ID NO: 972813 - RNA, 18 nt, Human
aacaaaaacccagaaaaa

SEQ ID NO: 972814 - RNA, 18 nt, Human
aacaaaaacccagaaaaa

SEQ ID NO: 972815 - RNA, 19 nt, Human
aacaaaaacccagaaaaaa

SEQ ID NO: 972816 - RNA, 22 nt, Human
aacaaaacaaaacaaaaaccca

SEQ ID NO: 972817 - RNA, 21 nt, Human
aaccaaugaguucaucaacgg

SEQ ID NO: 972818 - RNA, 18 nt, Human
aaccacacacaguucagc

SEQ ID NO: 972819 - RNA, 18 nt, Human
aaccacacacaguucagc

SEQ ID NO: 972820 - RNA, 19 nt, Human
aacucacuguaaacaacag

SEQ ID NO: 972821 - RNA, 19 nt, Human
aacucacuguaaacaacag

SEQ ID NO: 972822 - RNA, 20 nt, Human
aagaaaacaaaacaaaacaa

SEQ ID NO: 972823 - RNA, 20 nt, Human
aagaaaacaaaacaaaacaa

SEQ ID NO: 972824 - RNA, 23 nt, Human
aagcccuugccugggaaugaggg

SEQ ID NO: 972825 - RNA, 21 nt, Human
aagccuuuuuuuuuuuucucc

SEQ ID NO: 972826 - RNA, 20 nt, Human
aaggacugggaaagccagca

SEQ ID NO: 972827 - RNA, 19 nt, Human
aauguacauuuauucuuaa

SEQ ID NO: 972828 - RNA, 19 nt, Human
aauguacauuuauucuuaa

SEQ ID NO: 972829 - RNA, 18 nt, Human
acaaaacaaaacaaaaac

SEQ ID NO: 972830 - RNA, 18 nt, Human
acaaaacaaaacaaaaac

SEQ ID NO: 972831 - RNA, 25 nt, Human
acaaaacaaaacaaaaacccagaaa

SEQ ID NO: 972832 - RNA, 22 nt, Human
acaaggaacagaaaggcgugag

SEQ ID NO: 972833 - RNA, 22 nt, Human
acaaggaacagaaaggcgugag

SEQ ID NO: 972834 - RNA, 19 nt, Human
acacaguucagcagucacc

SEQ ID NO: 972835 - RNA, 18 nt, Human
acaguaucagguguacag

SEQ ID NO: 972836 - RNA, 21 nt, Human
accaaacuguggggauccaag

SEQ ID NO: 972837 - RNA, 22 nt, Human
accaaacuguggggauccaaga

SEQ ID NO: 972838 - RNA, 24 nt, Human
accgagauguccaacagccgugau

SEQ ID NO: 972839 - RNA, 21 nt, Human
accuuggccaaggcaagcagc

SEQ ID NO: 972840 - RNA, 24 nt, Human
acucuacugcacaggccucuccag

SEQ ID NO: 972841 - RNA, 24 nt, Human
acucuacugcacaggccucuccag

SEQ ID NO: 972842 - RNA, 21 nt, Human
acuggauucugaggugguuuu

SEQ ID NO: 972843 - RNA, 21 nt, Human
acuggauucugaggugguuuu

SEQ ID NO: 972844 - RNA, 25 nt, Human
agaaaacaaaacaaaacaaaaaaga

SEQ ID NO: 972845 - RNA, 24 nt, Human
agaaagaaaacaaaacaaaacaaa

SEQ ID NO: 972846 - RNA, 25 nt, Human
agaaagaaaacaaaacaaaacaaaa

SEQ ID NO: 972847 - RNA, 18 nt, Human
agaacuuuuucacaccuc

SEQ ID NO: 972848 - RNA, 18 nt, Human
agaacuuuuucacaccuc

SEQ ID NO: 972849 - RNA, 19 nt, Human
agaaggguacacagugggg

SEQ ID NO: 972850 - RNA, 18 nt, Human
agaccagacuugagggac

SEQ ID NO: 972851 - RNA, 22 nt, Human
agagaaacaggagagacuuuuu

SEQ ID NO: 972852 - RNA, 22 nt, Human
agagaaacaggagagacuuuuu

SEQ ID NO: 972853 - RNA, 26 nt, Human
agcacaggguaaacuggauucugagg

SEQ ID NO: 972854 - RNA, 26 nt, Human
agcacaggguaaacuggauucugagg

SEQ ID NO: 972855 - RNA, 26 nt, Human
aggaacagaaaggcgugaggugaugg

SEQ ID NO: 972856 - RNA, 26 nt, Human
aggaacagaaaggcgugaggugaugg

SEQ ID NO: 972857 - RNA, 22 nt, Human
aggaagcccaggagguugccga

SEQ ID NO: 972858 - RNA, 20 nt, Human
aggagagacuuuuucccaag

SEQ ID NO: 972859 - RNA, 20 nt, Human
aggagagacuuuuucccaag

SEQ ID NO: 972860 - RNA, 24 nt, Human
aggaggaggaggcggcggcggcgg

SEQ ID NO: 972861 - RNA, 21 nt, Human
aggaggcuggccuggcucugc

SEQ ID NO: 972862 - RNA, 18 nt, Human
aggcgccggcggcucagc

SEQ ID NO: 972863 - RNA, 21 nt, Human
aggcggcggcggcggccgagg

SEQ ID NO: 972864 - RNA, 23 nt, Human
aggcugucccccugagccagguu

SEQ ID NO: 972865 - RNA, 19 nt, Human
agggagaagcuggacagca

SEQ ID NO: 972866 - RNA, 24 nt, Human
aggguguuguagguucacacauga

SEQ ID NO: 972867 - RNA, 24 nt, Human
aggugggggccccuccuggucugu

SEQ ID NO: 972868 - RNA, 21 nt, Human
agguugaaggucaugaugcug

SEQ ID NO: 972869 - RNA, 21 nt, Human
aguaaacucugagugguucuc

SEQ ID NO: 972870 - RNA, 22 nt, Human
aucacaaaugacuugugaaacc

SEQ ID NO: 972871 - RNA, 24 nt, Human
augcucaguggugucccccccacc

SEQ ID NO: 972872 - RNA, 21 nt, Human
auggagggaggggagguggaa

SEQ ID NO: 972873 - RNA, 21 nt, Human
auggagggaggggagguggaa

SEQ ID NO: 972874 - RNA, 21 nt, Human
auguacaacgucauauauaua

SEQ ID NO: 972875 - RNA, 22 nt, Human
auuccccccaagcccuugccug

SEQ ID NO: 972876 - RNA, 19 nt, Human
caaaaaaggaaaaaaagga

SEQ ID NO: 972877 - RNA, 23 nt, Human
caaaaaaggaaaaaaaggaggaa

SEQ ID NO: 972878 - RNA, 22 nt, Human
caaaugacuugugaaaccaaug

SEQ ID NO: 972879 - RNA, 21 nt, Human
caagagaauccugccagucca

SEQ ID NO: 972880 - RNA, 21 nt, Human
caagaggggcgauaucuggca

SEQ ID NO: 972881 - RNA, 27 nt, Human
caagcccuugccugggaaugagggggg

SEQ ID NO: 972882 - RNA, 26 nt, Human
caaggcaagcagcgcgcgggcagccc

SEQ ID NO: 972883 - RNA, 21 nt, Human
cacacacacgggggggggagg

SEQ ID NO: 972884 - RNA, 21 nt, Human
cacacacacgggggggggagg

SEQ ID NO: 972885 - RNA, 26 nt, Human
cacacacacgggggggggaggugucc

SEQ ID NO: 972886 - RNA, 26 nt, Human
cacacacacgggggggggaggugucc

SEQ ID NO: 972887 - RNA, 20 nt, Human
cacacaguucagcagucacc

SEQ ID NO: 972888 - RNA, 20 nt, Human
cacacaguucagcagucacc

SEQ ID NO: 972889 - RNA, 22 nt, Human
cacacuaguuggcucaaagggu

SEQ ID NO: 972890 - RNA, 18 nt, Human
cacaguucagcagucacc

SEQ ID NO: 972891 - RNA, 21 nt, Human
cacccaccucauacuccuuua

SEQ ID NO: 972892 - RNA, 23 nt, Human
caccccgccccggggcccagucc

SEQ ID NO: 972893 - RNA, 20 nt, Human
caccucauacuccuuuaaaa

SEQ ID NO: 972894 - RNA, 25 nt, Human
caccuugcugaaccucccaggaucc

SEQ ID NO: 972895 - RNA, 19 nt, Human
cacuuuguugcagcucacc

SEQ ID NO: 972896 - RNA, 20 nt, Human
cagaaaggcgugaggugaug

SEQ ID NO: 972897 - RNA, 27 nt, Human
cagcacaggguaaacuggauucugagg

SEQ ID NO: 972898 - RNA, 24 nt, Human
cagcaggaucagcuugcccaggau

SEQ ID NO: 972899 - RNA, 18 nt, Human
cagcaggccacugucaaa

SEQ ID NO: 972900 - RNA, 18 nt, Human
caggaugagcagcagccc

SEQ ID NO: 972901 - RNA, 19 nt, Human
caggugggggccccuccug

SEQ ID NO: 972902 - RNA, 26 nt, Human
cauauauauacacacguggcagcgua

SEQ ID NO: 972903 - RNA, 21 nt, Human
caucaacggugauaccgagau

SEQ ID NO: 972904 - RNA, 20 nt, Human
caucaggugggggccccucc

SEQ ID NO: 972905 - RNA, 18 nt, Human
cauuggggcccagggugg

SEQ ID NO: 972906 - RNA, 21 nt, Human
ccaaucaaaaacaguacauca

SEQ ID NO: 972907 - RNA, 18 nt, Human
ccacacacgcacacacac

SEQ ID NO: 972908 - RNA, 18 nt, Human
ccacacacgcacacacac

SEQ ID NO: 972909 - RNA, 24 nt, Human
ccacacuaguuggcucaaagggug

SEQ ID NO: 972910 - RNA, 20 nt, Human
ccagucucugcggggaaagg

SEQ ID NO: 972911 - RNA, 23 nt, Human
ccaugugcucucugccaggagac

SEQ ID NO: 972912 - RNA, 18 nt, Human
cccaccccgccccggggc

SEQ ID NO: 972913 - RNA, 19 nt, Human
cccaggaugagcagcagcc

SEQ ID NO: 972914 - RNA, 27 nt, Human
ccccacccgcccgggcgggccucgcgg

SEQ ID NO: 972915 - RNA, 23 nt, Human
ccccacccuccaugggagcugga

SEQ ID NO: 972916 - RNA, 26 nt, Human
cccccaagcccuugccugggaaugag

SEQ ID NO: 972917 - RNA, 23 nt, Human
ccccccgccccgccggcucaggc

SEQ ID NO: 972918 - RNA, 19 nt, Human
cccgccccgccggcucagg

SEQ ID NO: 972919 - RNA, 20 nt, Human
cccgccgcaucauguccaca

SEQ ID NO: 972920 - RNA, 21 nt, Human
cccgccgcaucauguccacag

SEQ ID NO: 972921 - RNA, 22 nt, Human
cccggagcaucuccaagcaguc

SEQ ID NO: 972922 - RNA, 23 nt, Human
ccgccccgccggcucaggcuccg

SEQ ID NO: 972923 - RNA, 21 nt, Human
ccucccaccccgccccggggc

SEQ ID NO: 972924 - RNA, 19 nt, Human
ccucucccccccgccccgc

SEQ ID NO: 972925 - RNA, 19 nt, Human
ccugaggggaguaagguga

SEQ ID NO: 972926 - RNA, 19 nt, Human
ccugaggggaguaagguga

SEQ ID NO: 972927 - RNA, 21 nt, Human
ccugcuuccguucugggugcu

SEQ ID NO: 972928 - RNA, 22 nt, Human
ccuggccccgcugugacucucc

SEQ ID NO: 972929 - RNA, 23 nt, Human
ccuguacagcaucgcaccaagag

SEQ ID NO: 972930 - RNA, 23 nt, Human
ccuguacagcaucgcaccaagag

SEQ ID NO: 972931 - RNA, 18 nt, Human
ccuugauggccucugaac

SEQ ID NO: 972932 - RNA, 19 nt, Human
ccuuggccaaggcaagcag

SEQ ID NO: 972933 - RNA, 22 nt, Human
cgauuagaaagaaaacaaaaca

SEQ ID NO: 972934 - RNA, 22 nt, Human
cgauuagaaagaaaacaaaaca

SEQ ID NO: 972935 - RNA, 18 nt, Human
cggccgaggcgccggcgg

SEQ ID NO: 972936 - RNA, 18 nt, Human
cuccaagcagucccacca

SEQ ID NO: 972937 - RNA, 19 nt, Human
cucccccccucccaccccg

SEQ ID NO: 972938 - RNA, 21 nt, Human
cuccuggucuguugucccugg

SEQ ID NO: 972939 - RNA, 20 nt, Human
cucgcggggcuccgcugcuc

SEQ ID NO: 972940 - RNA, 20 nt, Human
cucugugcugggcuaaugcc

SEQ ID NO: 972941 - RNA, 20 nt, Human
cucuucuaguuuaggaccua

SEQ ID NO: 972942 - RNA, 23 nt, Human
cugaaccucccaggauccaguag

SEQ ID NO: 972943 - RNA, 22 nt, Human
cugccaggcugucccccugagc

SEQ ID NO: 972944 - RNA, 23 nt, Human
cugccaggcugucccccugagcc

SEQ ID NO: 972945 - RNA, 18 nt, Human
cuggcacaaaugacaggc

SEQ ID NO: 972946 - RNA, 19 nt, Human
cuggccccgcugugacucu

SEQ ID NO: 972947 - RNA, 18 nt, Human
cuguacagcaucgcacca

SEQ ID NO: 972948 - RNA, 19 nt, Human
cuguacagcaucgcaccaa

SEQ ID NO: 972949 - RNA, 19 nt, Human
cuguacagcaucgcaccaa

SEQ ID NO: 972950 - RNA, 19 nt, Human
cuucaacugaaccuagaac

SEQ ID NO: 972951 - RNA, 19 nt, Human
cuucaacugaaccuagaac

SEQ ID NO: 972952 - RNA, 26 nt, Human
cuucgucuucucccccccucccaccc

SEQ ID NO: 972953 - RNA, 23 nt, Human
cuugcugaaccucccaggaucca

SEQ ID NO: 972954 - RNA, 19 nt, Human
cuuggccaaggcaagcagc

SEQ ID NO: 972955 - RNA, 22 nt, Human
gaaaacaaaacaaaacaaaaac

SEQ ID NO: 972956 - RNA, 22 nt, Human
gaaaacaaaacaaaacaaaaac

SEQ ID NO: 972957 - RNA, 19 nt, Human
gaaugaggggggcggugga

SEQ ID NO: 972958 - RNA, 22 nt, Human
gacagcacaggguaaacuggau

SEQ ID NO: 972959 - RNA, 22 nt, Human
gacagcacaggguaaacuggau

SEQ ID NO: 972960 - RNA, 22 nt, Human
gaccagucucugcggggaaagg

SEQ ID NO: 972961 - RNA, 20 nt, Human
gacccggcucucccggcuca

SEQ ID NO: 972962 - RNA, 18 nt, Human
gaccgaguagacaacaug

SEQ ID NO: 972963 - RNA, 21 nt, Human
gagaaagaggucaggguguug

SEQ ID NO: 972964 - RNA, 21 nt, Human
gagaaagaggucaggguguug

SEQ ID NO: 972965 - RNA, 22 nt, Human
gagcaguccaccacaaauggaa

SEQ ID NO: 972966 - RNA, 21 nt, Human
gaggagagagaaacaggagag

SEQ ID NO: 972967 - RNA, 23 nt, Human
gaggagagagaaacaggagagac

SEQ ID NO: 972968 - RNA, 23 nt, Human
gaggagagagaaacaggagagac

SEQ ID NO: 972969 - RNA, 18 nt, Human
gaggaggaggaggcggcg

SEQ ID NO: 972970 - RNA, 19 nt, Human
gaggaggcuggccuggcuc

SEQ ID NO: 972971 - RNA, 20 nt, Human
gaggaggcuggccuggcucu

SEQ ID NO: 972972 - RNA, 24 nt, Human
gaggcggcggcggcggccgaggcg

SEQ ID NO: 972973 - RNA, 20 nt, Human
gaguagacaacaugucaucc

SEQ ID NO: 972974 - RNA, 23 nt, Human
gauugugaauguacaacaauaaa

SEQ ID NO: 972975 - RNA, 23 nt, Human
gauugugaauguacaacaauaaa

SEQ ID NO: 972976 - RNA, 19 nt, Human
gcaaggcuguccucuagga

SEQ ID NO: 972977 - RNA, 21 nt, Human
gcagagcuuugucuuuucaaa

SEQ ID NO: 972978 - RNA, 21 nt, Human
gcagagcuuugucuuuucaaa

SEQ ID NO: 972979 - RNA, 24 nt, Human
gcagagcuuugucuuuucaaagga

SEQ ID NO: 972980 - RNA, 24 nt, Human
gcagagcuuugucuuuucaaagga

SEQ ID NO: 972981 - RNA, 26 nt, Human
gcccugucuucgucuucucccccccu

SEQ ID NO: 972982 - RNA, 19 nt, Human
gcggaggaggaggaggcgg

SEQ ID NO: 972983 - RNA, 19 nt, Human
gcggcggcggcggccgagg

SEQ ID NO: 972984 - RNA, 22 nt, Human
gcugaagggcaaacugcccagu

SEQ ID NO: 972985 - RNA, 25 nt, Human
ggaaaagccuuuuuuuuuuuucucc

SEQ ID NO: 972986 - RNA, 18 nt, Human
ggacccggcucucccggc

SEQ ID NO: 972987 - RNA, 18 nt, Human
ggacugggaaagccagca

SEQ ID NO: 972988 - RNA, 22 nt, Human
ggaggagagagaaacaggagag

SEQ ID NO: 972989 - RNA, 22 nt, Human
ggaggagagagaaacaggagag

SEQ ID NO: 972990 - RNA, 18 nt, Human
ggaggaggcuggccuggc

SEQ ID NO: 972991 - RNA, 18 nt, Human
ggagggaggggaggugga

SEQ ID NO: 972992 - RNA, 18 nt, Human
ggagggaggggaggugga

SEQ ID NO: 972993 - RNA, 21 nt, Human
ggcagcguagccgcugcagcu

SEQ ID NO: 972994 - RNA, 20 nt, Human
ggccccgcugugacucuccg

SEQ ID NO: 972995 - RNA, 20 nt, Human
ggcggaggaggaggaggcgg

SEQ ID NO: 972996 - RNA, 20 nt, Human
ggcggcggcggcggccgagg

SEQ ID NO: 972997 - RNA, 21 nt, Human
ggcggcggcggcggccgaggc

SEQ ID NO: 972998 - RNA, 23 nt, Human
ggcucaggcuccgggcuggcggc

SEQ ID NO: 972999 - RNA, 20 nt, Human
ggcugaagggggguguggcc

SEQ ID NO: 973000 - RNA, 18 nt, Human
ggcuggugggcagggugc

SEQ ID NO: 973001 - RNA, 25 nt, Human
gggaaaagccuuuuuuuuuuuucuc

SEQ ID NO: 973002 - RNA, 19 nt, Human
gggcuggcggcggcggagg

SEQ ID NO: 973003 - RNA, 20 nt, Human
gggggccccuccuggucugu

SEQ ID NO: 973004 - RNA, 21 nt, Human
ggguggaaaagggguccuggg

SEQ ID NO: 973005 - RNA, 23 nt, Human
gucaccuuuuuuguccuucagaa

SEQ ID NO: 973006 - RNA, 23 nt, Human
gucaccuuuuuuguccuucagaa

SEQ ID NO: 973007 - RNA, 23 nt, Human
gucacugaggaagcgcaccauag

SEQ ID NO: 973008 - RNA, 21 nt, Human
guccugaggggaguaagguga

SEQ ID NO: 973009 - RNA, 21 nt, Human
guccugaggggaguaagguga

SEQ ID NO: 973010 - RNA, 21 nt, Human
gugauaccgagauguccaacu

SEQ ID NO: 973011 - RNA, 21 nt, Human
gugauggagggaggggaggug

SEQ ID NO: 973012 - RNA, 21 nt, Human
gugauggagggaggggaggug

SEQ ID NO: 973013 - RNA, 21 nt, Human
guguuguagguucacacauga

SEQ ID NO: 973014 - RNA, 21 nt, Human
guguuguagguucacacauga

SEQ ID NO: 973015 - RNA, 20 nt, Human
uaaacaacaguaacuuuggu

SEQ ID NO: 973016 - RNA, 20 nt, Human
uaaacaacaguaacuuuggu

SEQ ID NO: 973017 - RNA, 22 nt, Human
uaaggugaggacaaggaacaga

SEQ ID NO: 973018 - RNA, 22 nt, Human
uacaacgucauauauauacaca

SEQ ID NO: 973019 - RNA, 22 nt, Human
uacaacgucauauauauacaca

SEQ ID NO: 973020 - RNA, 21 nt, Human
uacaguaucagguguacagua

SEQ ID NO: 973021 - RNA, 21 nt, Human
uacaguaucagguguacagua

SEQ ID NO: 973022 - RNA, 18 nt, Human
uacaguauguuuacagua

SEQ ID NO: 973023 - RNA, 18 nt, Human
uacaguauguuuacagua

SEQ ID NO: 973024 - RNA, 22 nt, Human
uacaugaaagggucuacacucu

SEQ ID NO: 973025 - RNA, 27 nt, Human
uaccacagccaucucccggcacaccgg

SEQ ID NO: 973026 - RNA, 25 nt, Human
uagaaagaaaacaaaacaaaacaaa

SEQ ID NO: 973027 - RNA, 25 nt, Human
uagaaagaaaacaaaacaaaacaaa

SEQ ID NO: 973028 - RNA, 22 nt, Human
uagcaacccugggagcugacug

SEQ ID NO: 973029 - RNA, 22 nt, Human
ucaaaaacaguacaucacaaau

SEQ ID NO: 973030 - RNA, 22 nt, Human
ucacugaaaaaaucucaauugu

SEQ ID NO: 973031 - RNA, 23 nt, Human
ucagcagucaccuuuuuuguccu

SEQ ID NO: 973032 - RNA, 23 nt, Human
ucagcagucaccuuuuuuguccu

SEQ ID NO: 973033 - RNA, 20 nt, Human
uccacacacgcacacacaca

SEQ ID NO: 973034 - RNA, 20 nt, Human
uccacacacgcacacacaca

SEQ ID NO: 973035 - RNA, 22 nt, Human
uccacacacgcacacacacagu

SEQ ID NO: 973036 - RNA, 19 nt, Human
uccacauuguuguccugga

SEQ ID NO: 973037 - RNA, 20 nt, Human
uccccagggccuggccccgc

SEQ ID NO: 973038 - RNA, 24 nt, Human
uccccagggccuggccccgcugug

SEQ ID NO: 973039 - RNA, 20 nt, Human
uccccccaagcccuugccug

SEQ ID NO: 973040 - RNA, 18 nt, Human
ucccccccgccccgccgg

SEQ ID NO: 973041 - RNA, 20 nt, Human
ucccccccgccccgccggcu

SEQ ID NO: 973042 - RNA, 21 nt, Human
ucccccgggcugcccucccca

SEQ ID NO: 973043 - RNA, 21 nt, Human
ucccccugagccagguuggcc

SEQ ID NO: 973044 - RNA, 23 nt, Human
ucccggcucauuccccccaagcc

SEQ ID NO: 973045 - RNA, 21 nt, Human
uccgcggagagacccggcccu

SEQ ID NO: 973046 - RNA, 21 nt, Human
uccgguggcucugugcugggc

SEQ ID NO: 973047 - RNA, 22 nt, Human
ucgcuccucucccccccgcccc

SEQ ID NO: 973048 - RNA, 18 nt, Human
ucgggacccggcucuccc

SEQ ID NO: 973049 - RNA, 19 nt, Human
ucguacagaguaaacucug

SEQ ID NO: 973050 - RNA, 21 nt, Human
ucuacugcacaggccucucca

SEQ ID NO: 973051 - RNA, 21 nt, Human
ucuacugcacaggccucucca

SEQ ID NO: 973052 - RNA, 19 nt, Human
ucuaggaagcccaggaggu

SEQ ID NO: 973053 - RNA, 23 nt, Human
ucuccaggcggcugaaggggggu

SEQ ID NO: 973054 - RNA, 24 nt, Human
ucuccaggcggcugaaggggggug

SEQ ID NO: 973055 - RNA, 21 nt, Human
ucuccagugaacagggucugu

SEQ ID NO: 973056 - RNA, 18 nt, Human
ucucccccccucccaccc

SEQ ID NO: 973057 - RNA, 19 nt, Human
ucucccccccucccacccc

SEQ ID NO: 973058 - RNA, 21 nt, Human
ucucccggcucauucccccca

SEQ ID NO: 973059 - RNA, 21 nt, Human
ucugcacugcaauggcacgag

SEQ ID NO: 973060 - RNA, 23 nt, Human
ucuguaggcucgggacccggcuc

SEQ ID NO: 973061 - RNA, 21 nt, Human
ugacccagcguuuucuguuuc

SEQ ID NO: 973062 - RNA, 21 nt, Human
ugacccagcguuuucuguuuc

SEQ ID NO: 973063 - RNA, 21 nt, Human
ugagcagcagcccuggguguu

SEQ ID NO: 973064 - RNA, 23 nt, Human
ugaggugauggagggaggggagg

SEQ ID NO: 973065 - RNA, 23 nt, Human
ugaggugauggagggaggggagg

SEQ ID NO: 973066 - RNA, 23 nt, Human
ugauggccucugaacucuuagcu

SEQ ID NO: 973067 - RNA, 18 nt, Human
ugauguuccgguggcucu

SEQ ID NO: 973068 - RNA, 19 nt, Human
ugcagcucaccccuugguc

SEQ ID NO: 973069 - RNA, 23 nt, Human
ugcauguggaggaggcuggccug

SEQ ID NO: 973070 - RNA, 19 nt, Human
ugccaaagaucucaaucag

SEQ ID NO: 973071 - RNA, 20 nt, Human
ugccaaagaucucaaucagg

SEQ ID NO: 973072 - RNA, 24 nt, Human
ugcccaggaugagcagcagcccug

SEQ ID NO: 973073 - RNA, 21 nt, Human
ugcccuccccacccgcccggg

SEQ ID NO: 973074 - RNA, 20 nt, Human
ugccugggaaugaggggggc

SEQ ID NO: 973075 - RNA, 22 nt, Human
ugcuagaccgaguagacaacau

SEQ ID NO: 973076 - RNA, 22 nt, Human
ugcuauacaacuucuccaggcg

SEQ ID NO: 973077 - RNA, 21 nt, Human
ugcucccggcucuguaggcuc

SEQ ID NO: 973078 - RNA, 24 nt, Human
ugcugaguuugcugaggguuucca

SEQ ID NO: 973079 - RNA, 21 nt, Human
uggaaacuugcugcucuccuu

SEQ ID NO: 973080 - RNA, 18 nt, Human
uggagggaggggaggugg

SEQ ID NO: 973081 - RNA, 18 nt, Human
uggagggaggggaggugg

SEQ ID NO: 973082 - RNA, 19 nt, Human
uggagggaggggaggugga

SEQ ID NO: 973083 - RNA, 19 nt, Human
uggagggaggggaggugga

SEQ ID NO: 973084 - RNA, 20 nt, Human
uggcacgagcugccaggcug

SEQ ID NO: 973085 - RNA, 22 nt, Human
uggcagcguagccgcugcagcu

SEQ ID NO: 973086 - RNA, 21 nt, Human
uggccaaggcaagcagcgcgc

SEQ ID NO: 973087 - RNA, 26 nt, Human
uggcggcggcggaggaggaggaggcg

SEQ ID NO: 973088 - RNA, 18 nt, Human
uggcuuguccuugccuga

SEQ ID NO: 973089 - RNA, 21 nt, Human
ugggagcuggacuagacaccu

SEQ ID NO: 973090 - RNA, 23 nt, Human
ugggaggaggaccaaacuguggg

SEQ ID NO: 973091 - RNA, 23 nt, Human
ugggaggaggaccaaacuguggg

SEQ ID NO: 973092 - RNA, 22 nt, Human
uggggauccaaggguaugugca

SEQ ID NO: 973093 - RNA, 22 nt, Human
uggggauccaaggguaugugca

SEQ ID NO: 973094 - RNA, 29 nt, Human
ugggggaaaagccuuuuuuuuuuuucucc

SEQ ID NO: 973095 - RNA, 22 nt, Human
ugggugcuuguggugcagcagg

SEQ ID NO: 973096 - RNA, 19 nt, Human
ugguccuguuccuccuccu

SEQ ID NO: 973097 - RNA, 22 nt, Human
uguacaacaauaaaccacacac

SEQ ID NO: 973098 - RNA, 22 nt, Human
uguacaacaauaaaccacacac

SEQ ID NO: 973099 - RNA, 21 nt, Human
uguccuggaugcugaguuugc

SEQ ID NO: 973100 - RNA, 26 nt, Human
ugucuucgucuucucccccccuccca

SEQ ID NO: 973101 - RNA, 21 nt, Human
ugugauccguuuuucuggagg

SEQ ID NO: 973102 - RNA, 18 nt, Human
uguguggcggcaaggcug

SEQ ID NO: 973103 - RNA, 23 nt, Human
uguucacaacugcgaacuucuug

SEQ ID NO: 973104 - RNA, 23 nt, Human
uguucacaacugcgaacuucuug

SEQ ID NO: 973105 - RNA, 20 nt, Human
uuacaguaucagguguacag

SEQ ID NO: 973106 - RNA, 23 nt, Human
uucaaagagggugggguaggguc

SEQ ID NO: 973107 - RNA, 23 nt, Human
uucaaagagggugggguaggguc

SEQ ID NO: 973108 - RNA, 22 nt, Human
uuccccaaacucacuguaaaca

SEQ ID NO: 973109 - RNA, 25 nt, Human
uucgucuucucccccccucccaccc

SEQ ID NO: 973110 - RNA, 18 nt, Human
uucucccccccucccacc

SEQ ID NO: 973111 - RNA, 21 nt, Human
uugaaauacaaauaugcagau

SEQ ID NO: 973112 - RNA, 21 nt, Human
uugaaauacaaauaugcagau

SEQ ID NO: 973113 - RNA, 20 nt, Human
uugcccaggaugagcagcag

SEQ ID NO: 973114 - RNA, 22 nt, Human
uugcccaggaugagcagcagcc

SEQ ID NO: 973115 - RNA, 23 nt, Human
uugccgauacugcccuucugcac

SEQ ID NO: 973116 - RNA, 22 nt, Human
uuggcuccugcaagauugugaa

SEQ ID NO: 973117 - RNA, 22 nt, Human
uuggcuccugcaagauugugaa

SEQ ID NO: 973118 - RNA, 18 nt, Human
uuuacuggaagcuuguca

SEQ ID NO: 973119 - RNA, 18 nt, Human
uuuuccccaaacucacug

SEQ ID NO: 973120 - RNA, 18 nt, Human
uuuuccccaaacucacug

SEQ ID NO: 973121 - RNA, 22 nt, Human
uuuuuuuuuuuuuuaccauuaa

SEQ ID NO: 973122 - RNA, 24 nt, Human
aaaaaagucaaaaaagaacccaga

SEQ ID NO: 973123 - RNA, 22 nt, Human
aaaacaaccccccucccaaaag

SEQ ID NO: 973124 - RNA, 18 nt, Human
aaacaaccccccucccaa

SEQ ID NO: 973125 - RNA, 24 nt, Human
aaacaaccccccucccaaaagaag

SEQ ID NO: 973126 - RNA, 18 nt, Human
aaacccaaaagauuuaag

SEQ ID NO: 973127 - RNA, 23 nt, Human
aaacccaaaagauuuaagacuaa

SEQ ID NO: 973128 - RNA, 21 nt, Human
aaagaaauugauccaaaguuc

SEQ ID NO: 973129 - RNA, 23 nt, Human
aaccuucauucaaacccaaaaga

SEQ ID NO: 973130 - RNA, 20 nt, Human
aagaaaacaaccccccuccc

SEQ ID NO: 973131 - RNA, 25 nt, Human
aagaggaaaaaaguaaucuuucugg

SEQ ID NO: 973132 - RNA, 25 nt, Human
aagcagucaggaagaaccuaggauc

SEQ ID NO: 973133 - RNA, 20 nt, Human
aagccaccgacgaaagagag

SEQ ID NO: 973134 - RNA, 22 nt, Human
acacaucuauuuccacaaaaca

SEQ ID NO: 973135 - RNA, 25 nt, Human
acagaagaaaacaaccccccuccca

SEQ ID NO: 973136 - RNA, 21 nt, Human
accacuuuuaccccaucccca

SEQ ID NO: 973137 - RNA, 19 nt, Human
agaaaacaaccccccuccc

SEQ ID NO: 973138 - RNA, 20 nt, Human
agaaaacaaccccccuccca

SEQ ID NO: 973139 - RNA, 19 nt, Human
agaaaauaaacagaagaaa

SEQ ID NO: 973140 - RNA, 19 nt, Human
agaaaauaaacagaagaaa

SEQ ID NO: 973141 - RNA, 21 nt, Human
agaaaauaaacagaagaaaac

SEQ ID NO: 973142 - RNA, 26 nt, Human
agaagaaaacaaccccccucccaaaa

SEQ ID NO: 973143 - RNA, 30 nt, Human
agauauauuacaugcaggauuuaauauuuu

SEQ ID NO: 973144 - RNA, 21 nt, Human
aggaagaaccuaggaucaaug

SEQ ID NO: 973145 - RNA, 18 nt, Human
aguugguccaacuaagau

SEQ ID NO: 973146 - RNA, 22 nt, Human
auuuguugauccaacaguacgu

SEQ ID NO: 973147 - RNA, 19 nt, Human
caaauugcaaacacaucua

SEQ ID NO: 973148 - RNA, 22 nt, Human
cagaagaaaacaaccccccucc

SEQ ID NO: 973149 - RNA, 23 nt, Human
caguacguuaaccacuuuuaccc

SEQ ID NO: 973150 - RNA, 21 nt, Human
cauccaaaugcauuugggaau

SEQ ID NO: 973151 - RNA, 23 nt, Human
cauuugcugugaacaguuggaga

SEQ ID NO: 973152 - RNA, 25 nt, Human
ccaccgacgaaagagagacccacaa

SEQ ID NO: 973153 - RNA, 19 nt, Human
cccaaaagaaguaugacac

SEQ ID NO: 973154 - RNA, 21 nt, Human
gaaaaaaaaaaagucaaaaaa

SEQ ID NO: 973155 - RNA, 20 nt, Human
gauguaaaagcccacccaaa

SEQ ID NO: 973156 - RNA, 23 nt, Human
gcaagauguaaaagcccacccaa

SEQ ID NO: 973157 - RNA, 24 nt, Human
ggaaaaaaaaaaagucaaaaaaga

SEQ ID NO: 973158 - RNA, 19 nt, Human
ggauugggaaaaaaaaaaa

SEQ ID NO: 973159 - RNA, 25 nt, Human
guaaaaccuucauucaaacccaaaa

SEQ ID NO: 973160 - RNA, 23 nt, Human
guaauuuugccuucuggacagaa

SEQ ID NO: 973161 - RNA, 18 nt, Human
guaucuucuuuggaugga

SEQ ID NO: 973162 - RNA, 21 nt, Human
gucaaaaaagaacccagauuc

SEQ ID NO: 973163 - RNA, 20 nt, Human
uaaaagcccacccaaaucac

SEQ ID NO: 973164 - RNA, 24 nt, Human
uaacuuggggggaaaaaagauaau

SEQ ID NO: 973165 - RNA, 18 nt, Human
uaagaaaaaaguacucug

SEQ ID NO: 973166 - RNA, 24 nt, Human
uaauaaaaacaaguaucuucucca

SEQ ID NO: 973167 - RNA, 18 nt, Human
uaggaucaauggaaauag

SEQ ID NO: 973168 - RNA, 22 nt, Human
uauauacauuuauuacccaccc

SEQ ID NO: 973169 - RNA, 25 nt, Human
ucaaacccaaaagauuuaagacuaa

SEQ ID NO: 973170 - RNA, 23 nt, Human
ucucuaaauuacaaauuuggcuc

SEQ ID NO: 973171 - RNA, 18 nt, Human
ucucucuuuuaaaaaaaa

SEQ ID NO: 973172 - RNA, 21 nt, Human
ugaaaaagaaauugauccaaa

SEQ ID NO: 973173 - RNA, 23 nt, Human
ugaaaaagaaauugauccaaagu

SEQ ID NO: 973174 - RNA, 18 nt, Human
ugcguuuguuuguuuuug

SEQ ID NO: 973175 - RNA, 21 nt, Human
ugcugugcaaguuccaccccu

SEQ ID NO: 973176 - RNA, 21 nt, Human
uggaauuaagauguaacugua

SEQ ID NO: 973177 - RNA, 19 nt, Human
uggauugggaaaaaaaaaa

SEQ ID NO: 973178 - RNA, 23 nt, Human
uguacuguaguaaugccuacugc

SEQ ID NO: 973179 - RNA, 24 nt, Human
uguaugagaguagcauaguuuaua

SEQ ID NO: 973180 - RNA, 21 nt, Human
uuaaugagcuaguuuuuggga

SEQ ID NO: 973181 - RNA, 20 nt, Human
uucaugcaaugguaggcaag

SEQ ID NO: 973182 - RNA, 19 nt, Human
uucugucuucaaacuguau

SEQ ID NO: 973183 - RNA, 23 nt, Human
uucuuuggauggaauuaagaugu

SEQ ID NO: 973184 - RNA, 18 nt, Human
uugaagaaaccccaaugu

SEQ ID NO: 973185 - RNA, 19 nt, Human
uugaagaaaccccaauguu

SEQ ID NO: 973186 - RNA, 20 nt, Human
uuucuggaacaucauuuuuc

SEQ ID NO: 973187 - RNA, 18 nt, Human
uuugcugugcaaguucca

SEQ ID NO: 973188 - RNA, 25 nt, Human
aaaagggccaggagguagggggaag

SEQ ID NO: 973189 - RNA, 21 nt, Human
aaacaggucuccaauauccuu

SEQ ID NO: 973190 - RNA, 26 nt, Human
aacauacucacaugcacacaugcgga

SEQ ID NO: 973191 - RNA, 21 nt, Human
aacccauaacugucugucccc

SEQ ID NO: 973192 - RNA, 22 nt, Human
aacccauaacugucugucccca

SEQ ID NO: 973193 - RNA, 18 nt, Human
aagcacagagccugacaa

SEQ ID NO: 973194 - RNA, 25 nt, Human
acacacauacauacccacacacaca

SEQ ID NO: 973195 - RNA, 32 nt, Human
acacaugcggauacauacauacacacauacag

SEQ ID NO: 973196 - RNA, 20 nt, Human
acccacuguaucuccuuacu

SEQ ID NO: 973197 - RNA, 21 nt, Human
acccauaacugucugucccca

SEQ ID NO: 973198 - RNA, 21 nt, Human
accuuugcccagcucaggggu

SEQ ID NO: 973199 - RNA, 19 nt, Human
acucuguauuccaagcaca

SEQ ID NO: 973200 - RNA, 19 nt, Human
agcugggaucagaagcucu

SEQ ID NO: 973201 - RNA, 19 nt, Human
aggaaggggguguguguga

SEQ ID NO: 973202 - RNA, 21 nt, Human
aggagguagggggaagguugg

SEQ ID NO: 973203 - RNA, 22 nt, Human
aggcacagaaggucaaaugacu

SEQ ID NO: 973204 - RNA, 24 nt, Human
agggauccagacagggcgggaggg

SEQ ID NO: 973205 - RNA, 19 nt, Human
agggccaggagguaggggg

SEQ ID NO: 973206 - RNA, 21 nt, Human
aguaagugauaaaaaguggga

SEQ ID NO: 973207 - RNA, 23 nt, Human
auacauacacacauacauaccca

SEQ ID NO: 973208 - RNA, 25 nt, Human
augcacacaugcggauacauacaua

SEQ ID NO: 973209 - RNA, 20 nt, Human
caaaugacuugcccaagguc

SEQ ID NO: 973210 - RNA, 23 nt, Human
cacccacuucucaaauucaaagu

SEQ ID NO: 973211 - RNA, 24 nt, Human
cagaacccauaacugucugucccc

SEQ ID NO: 973212 - RNA, 18 nt, Human
cagcucagcaccuccuuu

SEQ ID NO: 973213 - RNA, 25 nt, Human
cagcuuagggauccagacagggcgg

SEQ ID NO: 973214 - RNA, 23 nt, Human
caggagguagggggaagguuggg

SEQ ID NO: 973215 - RNA, 21 nt, Human
cagguaacugccuaagacucc

SEQ ID NO: 973216 - RNA, 22 nt, Human
cauacauacccacacacacagu

SEQ ID NO: 973217 - RNA, 20 nt, Human
caugaacccacuguaucucc

SEQ ID NO: 973218 - RNA, 21 nt, Human
caugaacccacuguaucuccu

SEQ ID NO: 973219 - RNA, 22 nt, Human
ccacgaagggauaaggccucca

SEQ ID NO: 973220 - RNA, 18 nt, Human
ccaggagguagggggaag

SEQ ID NO: 973221 - RNA, 24 nt, Human
ccagugaggagcuugacaucauua

SEQ ID NO: 973222 - RNA, 18 nt, Human
ccauaacugucugucccc

SEQ ID NO: 973223 - RNA, 23 nt, Human
cccacacacacagugggcaagag

SEQ ID NO: 973224 - RNA, 22 nt, Human
cccagagcucaugcuccacucc

SEQ ID NO: 973225 - RNA, 18 nt, Human
cccagauuggggcucagg

SEQ ID NO: 973226 - RNA, 27 nt, Human
cccaugacuacaccaaaaagggccagg

SEQ ID NO: 973227 - RNA, 22 nt, Human
ccugaguaccuuugcccagcuc

SEQ ID NO: 973228 - RNA, 23 nt, Human
cggcaccuagugggcuccacgaa

SEQ ID NO: 973229 - RNA, 19 nt, Human
cggcggcaguaggacaggc

SEQ ID NO: 973230 - RNA, 21 nt, Human
cuagugccugaccaaauccua

SEQ ID NO: 973231 - RNA, 23 nt, Human
cuauagucauucaugaacccacu

SEQ ID NO: 973232 - RNA, 25 nt, Human
cuccagugaggagcuugagguaccc

SEQ ID NO: 973233 - RNA, 24 nt, Human
cucuccccuauuuccucacaaccc

SEQ ID NO: 973234 - RNA, 21 nt, Human
cugggaucagaagcucucagg

SEQ ID NO: 973235 - RNA, 22 nt, Human
cugucuguccccagagcucaug

SEQ ID NO: 973236 - RNA, 19 nt, Human
gagcucaugcuccacuccu

SEQ ID NO: 973237 - RNA, 24 nt, Human
gaggaaacugaggcacagaagguc

SEQ ID NO: 973238 - RNA, 22 nt, Human
gaggaagggggugugugugaug

SEQ ID NO: 973239 - RNA, 24 nt, Human
gaucacccacuucucaaauucaaa

SEQ ID NO: 973240 - RNA, 20 nt, Human
gcucucuuggaaucaaauuc

SEQ ID NO: 973241 - RNA, 22 nt, Human
ggacuuaacuuuuaaaaagcaa

SEQ ID NO: 973242 - RNA, 18 nt, Human
ggaggaagggggugugug

SEQ ID NO: 973243 - RNA, 18 nt, Human
ggugugugugaugaacag

SEQ ID NO: 973244 - RNA, 25 nt, Human
uaaaucccaugacuacaccaaaaag

SEQ ID NO: 973245 - RNA, 19 nt, Human
uaacugccuaagacuccua

SEQ ID NO: 973246 - RNA, 22 nt, Human
uaauagcugggaucagaagcuc

SEQ ID NO: 973247 - RNA, 27 nt, Human
uacauacacacauacauacccacacac

SEQ ID NO: 973248 - RNA, 26 nt, Human
uacauacauacacacauacauaccca

SEQ ID NO: 973249 - RNA, 27 nt, Human
uacauacauacacacauacauacccac

SEQ ID NO: 973250 - RNA, 21 nt, Human
uaccuuugcccagcucagggg

SEQ ID NO: 973251 - RNA, 30 nt, Human
uacucacaugcacacaugcggauacauaca

SEQ ID NO: 973252 - RNA, 24 nt, Human
uauacagauuggaauuaaagugug

SEQ ID NO: 973253 - RNA, 24 nt, Human
uaugacauucagcuaacuauaguc

SEQ ID NO: 973254 - RNA, 29 nt, Human
ucacaugcacacaugcggauacauacaua

SEQ ID NO: 973255 - RNA, 19 nt, Human
ucagcagggcauucagcac

SEQ ID NO: 973256 - RNA, 26 nt, Human
ucaggcacccgguuaccagacaugau

SEQ ID NO: 973257 - RNA, 22 nt, Human
uccaagcacagagccugacaaa

SEQ ID NO: 973258 - RNA, 20 nt, Human
uccaggaagccuagagggga

SEQ ID NO: 973259 - RNA, 18 nt, Human
ucccaugacuacaccaaa

SEQ ID NO: 973260 - RNA, 22 nt, Human
ucgcacccggcuuugcugccuc

SEQ ID NO: 973261 - RNA, 23 nt, Human
ucucagggguccaggcaugaggg

SEQ ID NO: 973262 - RNA, 24 nt, Human
ucuccuuacuaggaggguagagau

SEQ ID NO: 973263 - RNA, 19 nt, Human
ugaauacacaaaugaguga

SEQ ID NO: 973264 - RNA, 20 nt, Human
ugaccuccaggaagccuaga

SEQ ID NO: 973265 - RNA, 22 nt, Human
ugacuacaccaaaaagggccag

SEQ ID NO: 973266 - RNA, 23 nt, Human
ugacuacaccaaaaagggccagg

SEQ ID NO: 973267 - RNA, 22 nt, Human
ugaggaaacugaggcacagaag

SEQ ID NO: 973268 - RNA, 24 nt, Human
ugagguagguaauauuguuagccc

SEQ ID NO: 973269 - RNA, 26 nt, Human
ugagguuaguuccuaaaaugaaccuc

SEQ ID NO: 973270 - RNA, 21 nt, Human
ugcccaaggucaaacaacuag

SEQ ID NO: 973271 - RNA, 20 nt, Human
uggaauuaaagugugauggu

SEQ ID NO: 973272 - RNA, 21 nt, Human
uggcccaggauaccucucccu

SEQ ID NO: 973273 - RNA, 27 nt, Human
ugggaccagaacccauaacugucuguc

SEQ ID NO: 973274 - RNA, 21 nt, Human
ugggauguggcccaggauacc

SEQ ID NO: 973275 - RNA, 21 nt, Human
ugggcaagaggcccaaggggc

SEQ ID NO: 973276 - RNA, 23 nt, Human
ugucaaggucuagcuuaaaugug

SEQ ID NO: 973277 - RNA, 24 nt, Human
uuaccagguagaccccaucagugc

SEQ ID NO: 973278 - RNA, 22 nt, Human
uuagaauggacuuaacuuuuaa

SEQ ID NO: 973279 - RNA, 24 nt, Human
uuaguuccuaaaaugaaccucaca

SEQ ID NO: 973280 - RNA, 22 nt, Human
uucagaggccagaauacucccu

SEQ ID NO: 973281 - RNA, 23 nt, Human
uucaugcauauuuggguaauuag

SEQ ID NO: 973282 - RNA, 18 nt, Human
uugcccaaggucaaacaa

SEQ ID NO: 973283 - RNA, 21 nt, Human
uuuugcaaacauacucacaug

SEQ ID NO: 973284 - RNA, 20 nt, Human
aaacaggccacaaaccaguu

SEQ ID NO: 973285 - RNA, 22 nt, Human
aaacaggccacaaaccaguucg

SEQ ID NO: 973286 - RNA, 22 nt, Human
aagcuccuccgggucacaaagg

SEQ ID NO: 973287 - RNA, 18 nt, Human
accacaccgcucucaaca

SEQ ID NO: 973288 - RNA, 19 nt, Human
acgcacccccaaaagcucc

SEQ ID NO: 973289 - RNA, 25 nt, Human
acgcacccccaaaagcuccuccggg

SEQ ID NO: 973290 - RNA, 22 nt, Human
agcaaaccucugacaggaauca

SEQ ID NO: 973291 - RNA, 19 nt, Human
augaagaaauaacuuugua

SEQ ID NO: 973292 - RNA, 20 nt, Human
caacaccuaccacaccgcuc

SEQ ID NO: 973293 - RNA, 21 nt, Human
caccauagcggcuacaacacc

SEQ ID NO: 973294 - RNA, 21 nt, Human
caccgcucucaacacccgcgc

SEQ ID NO: 973295 - RNA, 24 nt, Human
ccacaauaauuggaccauaauuag

SEQ ID NO: 973296 - RNA, 23 nt, Human
ccacaccgcucucaacacccgcg

SEQ ID NO: 973297 - RNA, 20 nt, Human
cccuaauauauaaaagaccc

SEQ ID NO: 973298 - RNA, 20 nt, Human
cgcuacaaagcgaacuucac

SEQ ID NO: 973299 - RNA, 22 nt, Human
cuacaaagcgaacuucaccaua

SEQ ID NO: 973300 - RNA, 21 nt, Human
gcuacaacaccuaccacaccg

SEQ ID NO: 973301 - RNA, 18 nt, Human
ggucacaaaggcagggaa

SEQ ID NO: 973302 - RNA, 21 nt, Human
ggucagcaaaccucugacagg

SEQ ID NO: 973303 - RNA, 22 nt, Human
ucagcuacauuuaucauguaau

SEQ ID NO: 973304 - RNA, 22 nt, Human
ucaggccaggggcuugacgcac

SEQ ID NO: 973305 - RNA, 23 nt, Human
ucccuaauauauaaaagacccgc

SEQ ID NO: 973306 - RNA, 24 nt, Human
ucgcugccucaggccaggggcuug

SEQ ID NO: 973307 - RNA, 25 nt, Human
ucucuagccggggccgcuacaaagc

SEQ ID NO: 973308 - RNA, 24 nt, Human
aaaaaccaagugguugccaacuua

SEQ ID NO: 973309 - RNA, 23 nt, Human
aaacagaaaccaguuucaugauc

SEQ ID NO: 973310 - RNA, 20 nt, Human
aaaccaguuucaugaucuag

SEQ ID NO: 973311 - RNA, 20 nt, Human
acagugggacuacauccugg

SEQ ID NO: 973312 - RNA, 24 nt, Human
accccuaaauagaugcuccucaac

SEQ ID NO: 973313 - RNA, 23 nt, Human
agaaaaaaaucaguaauacacug

SEQ ID NO: 973314 - RNA, 22 nt, Human
agagccccgcuuaacacuccgc

SEQ ID NO: 973315 - RNA, 25 nt, Human
agccaucgaaagacacgaguggcaa

SEQ ID NO: 973316 - RNA, 18 nt, Human
agccuugauagcacaacc

SEQ ID NO: 973317 - RNA, 22 nt, Human
agccuugauagcacaaccuugc

SEQ ID NO: 973318 - RNA, 19 nt, Human
aggacuuugccucaacuaa

SEQ ID NO: 973319 - RNA, 18 nt, Human
aggcaaacauuacucaag

SEQ ID NO: 973320 - RNA, 25 nt, Human
auaccgaaaguccuuccaaaaacca

SEQ ID NO: 973321 - RNA, 22 nt, Human
caauaccgaaaguccuuccaaa

SEQ ID NO: 973322 - RNA, 22 nt, Human
cacgaagguaugcugagccuug

SEQ ID NO: 973323 - RNA, 18 nt, Human
ccaagauuaguuggcagg

SEQ ID NO: 973324 - RNA, 20 nt, Human
cccacugaagaaaggaacaa

SEQ ID NO: 973325 - RNA, 22 nt, Human
cccgccccacccggggaaaucu

SEQ ID NO: 973326 - RNA, 19 nt, Human
ccgcgcccgccccacccgg

SEQ ID NO: 973327 - RNA, 19 nt, Human
ccucaacuaacauacuuuu

SEQ ID NO: 973328 - RNA, 18 nt, Human
cgaaagacacgaguggca

SEQ ID NO: 973329 - RNA, 28 nt, Human
cuaaguggaaugccuuaaagaaucuauc

SEQ ID NO: 973330 - RNA, 18 nt, Human
cucaacagugggacuaca

SEQ ID NO: 973331 - RNA, 25 nt, Human
gaaccaguguaaaucagaggccauu

SEQ ID NO: 973332 - RNA, 20 nt, Human
gagccaucgaaagacacgag

SEQ ID NO: 973333 - RNA, 24 nt, Human
gaugcuccucaacagugggacuac

SEQ ID NO: 973334 - RNA, 19 nt, Human
gcaagaaggcaggacuggu

SEQ ID NO: 973335 - RNA, 20 nt, Human
gcccacugaagaaaggaaca

SEQ ID NO: 973336 - RNA, 22 nt, Human
gcuuagaggcagcgggacuucg

SEQ ID NO: 973337 - RNA, 22 nt, Human
ggauaaaccuaucauaaaguug

SEQ ID NO: 973338 - RNA, 22 nt, Human
ggcagcgggacuucgggaaggg

SEQ ID NO: 973339 - RNA, 20 nt, Human
gugguugccaacuuaugucc

SEQ ID NO: 973340 - RNA, 18 nt, Human
uaaagaaucuauccaaga

SEQ ID NO: 973341 - RNA, 22 nt, Human
uaaccccuaaauagaugcuccu

SEQ ID NO: 973342 - RNA, 23 nt, Human
uaaccccuaaauagaugcuccuu

SEQ ID NO: 973343 - RNA, 19 nt, Human
uaaucuagaagcaauuaua

SEQ ID NO: 973344 - RNA, 24 nt, Human
uagcauuauaacauucuugagcca

SEQ ID NO: 973345 - RNA, 28 nt, Human
uaggauaaauacccagaaauuuaacagc

SEQ ID NO: 973346 - RNA, 24 nt, Human
ucaacuugaagaaucuucagcaua

SEQ ID NO: 973347 - RNA, 21 nt, Human
ucagcccgcgggccgcuacac

SEQ ID NO: 973348 - RNA, 21 nt, Human
uccgagagccccgcuuaacac

SEQ ID NO: 973349 - RNA, 18 nt, Human
ucuccauagucugcuacu

SEQ ID NO: 973350 - RNA, 21 nt, Human
ucugcuacuuacaagauuguc

SEQ ID NO: 973351 - RNA, 19 nt, Human
ucuuuauuuaaaaguccau

SEQ ID NO: 973352 - RNA, 24 nt, Human
ugaaaugcauuuaguacccggaua

SEQ ID NO: 973353 - RNA, 21 nt, Human
ugacaacugcauaaaacagaa

SEQ ID NO: 973354 - RNA, 25 nt, Human
uggcaagaaggcaggacugguuucu

SEQ ID NO: 973355 - RNA, 24 nt, Human
ugguaaaucaaaggcccacgaagg

SEQ ID NO: 973356 - RNA, 23 nt, Human
ugguuuacaaaaauauguucaua

SEQ ID NO: 973357 - RNA, 20 nt, Human
uucaugaucuaguuuaggga

SEQ ID NO: 973358 - RNA, 22 nt, Human
uuuacaaauagaaaaaaaucag

SEQ ID NO: 973359 - RNA, 26 nt, Human
uuuuuuuuuuuuuuuugcuuucuuua

SEQ ID NO: 973360 - RNA, 18 nt, Human
uuuuuuuuuuuuuuuuug

SEQ ID NO: 973361 - RNA, 23 nt, Human
uuuuuuuuuuuuuuuuuugcuuu

SEQ ID NO: 973362 - RNA, 21 nt, Human
aaaccggagccccagccccua

SEQ ID NO: 973363 - RNA, 22 nt, Human
aaagagagagaaaucagccagu

SEQ ID NO: 973364 - RNA, 23 nt, Human
aaagugcuggcauuacaguguga

SEQ ID NO: 973365 - RNA, 21 nt, Human
aaccccugucccaccugaccc

SEQ ID NO: 973366 - RNA, 19 nt, Human
aaccggagccccagccccu

SEQ ID NO: 973367 - RNA, 22 nt, Human
aacugaagcccagaggggccca

SEQ ID NO: 973368 - RNA, 22 nt, Human
aagagcaauguggggaauuacc

SEQ ID NO: 973369 - RNA, 25 nt, Human
aagcaauccuccuaccucagcuucc

SEQ ID NO: 973370 - RNA, 25 nt, Human
aagcaauccuccugccuuagccucc

SEQ ID NO: 973371 - RNA, 19 nt, Human
aaguaaacugcccaagguc

SEQ ID NO: 973372 - RNA, 26 nt, Human
acaaagcacagagagguuaaguaaac

SEQ ID NO: 973373 - RNA, 20 nt, Human
acaagacaaggcaucagccg

SEQ ID NO: 973374 - RNA, 18 nt, Human
accaagcacauuauccca

SEQ ID NO: 973375 - RNA, 20 nt, Human
accagcuaggcagaugcucu

SEQ ID NO: 973376 - RNA, 22 nt, Human
accauuuuacccucccaucccc

SEQ ID NO: 973377 - RNA, 22 nt, Human
acugaagcccagaggggcccag

SEQ ID NO: 973378 - RNA, 23 nt, Human
acugcacccggcccuguacacac

SEQ ID NO: 973379 - RNA, 21 nt, Human
agaccucaacccucagcccca

SEQ ID NO: 973380 - RNA, 21 nt, Human
aguggggaaacugaagcccag

SEQ ID NO: 973381 - RNA, 21 nt, Human
auagaaaguacaagacuugga

SEQ ID NO: 973382 - RNA, 21 nt, Human
auccuccugccuuagccuccc

SEQ ID NO: 973383 - RNA, 21 nt, Human
augagucuuguaccccaugac

SEQ ID NO: 973384 - RNA, 21 nt, Human
auuacagugugagccacugca

SEQ ID NO: 973385 - RNA, 23 nt, Human
caaagugcuggcauuacagugug

SEQ ID NO: 973386 - RNA, 22 nt, Human
caacagcacugaaaguuugcug

SEQ ID NO: 973387 - RNA, 27 nt, Human
caagcaauccuccuaccucagcuuccc

SEQ ID NO: 973388 - RNA, 28 nt, Human
caagcaauccuccuaccucagcuuccca

SEQ ID NO: 973389 - RNA, 22 nt, Human
caagcaauccuccugccuuagc

SEQ ID NO: 973390 - RNA, 27 nt, Human
caagcaauccuccugccuuagccuccc

SEQ ID NO: 973391 - RNA, 27 nt, Human
caagcaauccuccugccuuagccuccc

SEQ ID NO: 973392 - RNA, 25 nt, Human
caccucuuuccccaugcccucaacc

SEQ ID NO: 973393 - RNA, 18 nt, Human
cagaacccagagucuucc

SEQ ID NO: 973394 - RNA, 18 nt, Human
cagacacaagacaaggca

SEQ ID NO: 973395 - RNA, 22 nt, Human
cagagccagagccuuguccuga

SEQ ID NO: 973396 - RNA, 23 nt, Human
cagagucuagccauuuacaauca

SEQ ID NO: 973397 - RNA, 23 nt, Human
cagaugguggcuccucucacccc

SEQ ID NO: 973398 - RNA, 20 nt, Human
cagcagacugcgugucuggg

SEQ ID NO: 973399 - RNA, 19 nt, Human
cagccaauagaaccuccca

SEQ ID NO: 973400 - RNA, 24 nt, Human
cagccaggccuccagggaggccaa

SEQ ID NO: 973401 - RNA, 22 nt, Human
caggauguacacuuuaauguuu

SEQ ID NO: 973402 - RNA, 28 nt, Human
caggcaauaggcuucacccccugaaagg

SEQ ID NO: 973403 - RNA, 19 nt, Human
caggccucagaccuguguu

SEQ ID NO: 973404 - RNA, 21 nt, Human
caggccuccagggaggccagg

SEQ ID NO: 973405 - RNA, 23 nt, Human
cauguuacccaggcuggucucaa

SEQ ID NO: 973406 - RNA, 24 nt, Human
cauguuacccaggcuggucucaaa

SEQ ID NO: 973407 - RNA, 20 nt, Human
ccaaagugcuggcauuacag

SEQ ID NO: 973408 - RNA, 23 nt, Human
ccaaagugcuggcauuacagugu

SEQ ID NO: 973409 - RNA, 19 nt, Human
ccacugcacccggcccugu

SEQ ID NO: 973410 - RNA, 21 nt, Human
cccagaauguccuccccagcu

SEQ ID NO: 973411 - RNA, 20 nt, Human
cccagccucagcagaaccca

SEQ ID NO: 973412 - RNA, 18 nt, Human
ccccagaauguccucccc

SEQ ID NO: 973413 - RNA, 19 nt, Human
ccccagccccuaugagccc

SEQ ID NO: 973414 - RNA, 25 nt, Human
ccccaggccugccucuggagcagug

SEQ ID NO: 973415 - RNA, 20 nt, Human
ccccaugaacugguggcccu

SEQ ID NO: 973416 - RNA, 20 nt, Human
ccccaugcccucaccagcua

SEQ ID NO: 973417 - RNA, 24 nt, Human
ccccauguuacccaggcuggucuc

SEQ ID NO: 973418 - RNA, 27 nt, Human
ccccauguuacccaggcuggucucaaa

SEQ ID NO: 973419 - RNA, 21 nt, Human
ccccugaaaccggagccccag

SEQ ID NO: 973420 - RNA, 23 nt, Human
ccccugaaaccggagccccagcc

SEQ ID NO: 973421 - RNA, 25 nt, Human
ccccugaaaccggagccccagcccc

SEQ ID NO: 973422 - RNA, 20 nt, Human
ccccugucccaccugacccg

SEQ ID NO: 973423 - RNA, 22 nt, Human
cccucagccccagaauguccuc

SEQ ID NO: 973424 - RNA, 20 nt, Human
cccugccagcuaccaagcac

SEQ ID NO: 973425 - RNA, 18 nt, Human
ccggaggguugcccaggc

SEQ ID NO: 973426 - RNA, 19 nt, Human
ccggcaccagagucuagcc

SEQ ID NO: 973427 - RNA, 24 nt, Human
ccguaguaaauggaagcucccuuc

SEQ ID NO: 973428 - RNA, 19 nt, Human
ccucagaccuguguuuugg

SEQ ID NO: 973429 - RNA, 25 nt, Human
ccucccauccccaacuagauugggc

SEQ ID NO: 973430 - RNA, 24 nt, Human
ccuccuaccucagcuucccaagua

SEQ ID NO: 973431 - RNA, 18 nt, Human
ccuuacaaauacucaagg

SEQ ID NO: 973432 - RNA, 22 nt, Human
ccuuacagcugcagaaccccug

SEQ ID NO: 973433 - RNA, 26 nt, Human
cguuaccaacugcaagaucucaggca

SEQ ID NO: 973434 - RNA, 24 nt, Human
cucaagcaauccuccuaccucagc

SEQ ID NO: 973435 - RNA, 24 nt, Human
cucaagcaauccuccugccuuagc

SEQ ID NO: 973436 - RNA, 22 nt, Human
cucagccaauagaaccucccag

SEQ ID NO: 973437 - RNA, 24 nt, Human
cucagcuucccaaguagcugggac

SEQ ID NO: 973438 - RNA, 24 nt, Human
cugaaaccggagccccagccccua

SEQ ID NO: 973439 - RNA, 25 nt, Human
cugaaaccggagccccagccccuau

SEQ ID NO: 973440 - RNA, 20 nt, Human
cugagggcuuggggacacag

SEQ ID NO: 973441 - RNA, 24 nt, Human
cugcaucaaaaucugcgucucacc

SEQ ID NO: 973442 - RNA, 23 nt, Human
cugccuuagccucccaaagugcu

SEQ ID NO: 973443 - RNA, 24 nt, Human
cugccuuagccucccaaagugcug

SEQ ID NO: 973444 - RNA, 23 nt, Human
cuggcugguggcuggcucucccc

SEQ ID NO: 973445 - RNA, 22 nt, Human
cuguuccaaagagagagaaauc

SEQ ID NO: 973446 - RNA, 20 nt, Human
gaaaccggagccccagcccc

SEQ ID NO: 973447 - RNA, 21 nt, Human
gaaaccggagccccagccccu

SEQ ID NO: 973448 - RNA, 18 nt, Human
gaacugguggcccuggaa

SEQ ID NO: 973449 - RNA, 18 nt, Human
gaauguccuccccagcuc

SEQ ID NO: 973450 - RNA, 19 nt, Human
gagcagccaggccuccagg

SEQ ID NO: 973451 - RNA, 22 nt, Human
gauuggauuauggugagaaguu

SEQ ID NO: 973452 - RNA, 18 nt, Human
gcauuacagugugagcca

SEQ ID NO: 973453 - RNA, 22 nt, Human
gccugggcaugugugggggccu

SEQ ID NO: 973454 - RNA, 23 nt, Human
gcucugucgcccagacugugcag

SEQ ID NO: 973455 - RNA, 25 nt, Human
ggaaacugaagcccagaggggccca

SEQ ID NO: 973456 - RNA, 28 nt, Human
ggcaugagagcagccaggccuccaggga

SEQ ID NO: 973457 - RNA, 20 nt, Human
ggcaugugugggggccugag

SEQ ID NO: 973458 - RNA, 26 nt, Human
gggaggccaggacagcguggcgggcg

SEQ ID NO: 973459 - RNA, 22 nt, Human
gggcucaagcaauccuccuacc

SEQ ID NO: 973460 - RNA, 18 nt, Human
ggggaaacugaagcccag

SEQ ID NO: 973461 - RNA, 20 nt, Human
ggggcccaggccuugaagug

SEQ ID NO: 973462 - RNA, 23 nt, Human
guggugcagucacagcucacugc

SEQ ID NO: 973463 - RNA, 22 nt, Human
uacagugugagccacugcaccc

SEQ ID NO: 973464 - RNA, 24 nt, Human
uaccucagcuucccaaguagcugg

SEQ ID NO: 973465 - RNA, 22 nt, Human
uagagguaggaucuccccaugu

SEQ ID NO: 973466 - RNA, 20 nt, Human
uagaugcaaaugccuaggac

SEQ ID NO: 973467 - RNA, 24 nt, Human
uagcugggaccgcaggcaaacacc

SEQ ID NO: 973468 - RNA, 23 nt, Human
uaggacagugccuggaacaucga

SEQ ID NO: 973469 - RNA, 21 nt, Human
uaguaaauggaagcucccuuc

SEQ ID NO: 973470 - RNA, 22 nt, Human
uaguaaauggaagcucccuucu

SEQ ID NO: 973471 - RNA, 19 nt, Human
uagucuguugucggggagg

SEQ ID NO: 973472 - RNA, 24 nt, Human
uaucccagcuucccacugugccag

SEQ ID NO: 973473 - RNA, 18 nt, Human
uaucucccucaucccccu

SEQ ID NO: 973474 - RNA, 20 nt, Human
uaugaauccagagcugaccc

SEQ ID NO: 973475 - RNA, 25 nt, Human
uauugccagaaagcucuccaaagag

SEQ ID NO: 973476 - RNA, 23 nt, Human
ucaaaaucugcgucucaccagga

SEQ ID NO: 973477 - RNA, 18 nt, Human
ucaacccucagccccaga

SEQ ID NO: 973478 - RNA, 20 nt, Human
ucaagggccugggcaugugu

SEQ ID NO: 973479 - RNA, 21 nt, Human
ucaccagcuaggcagaugcuc

SEQ ID NO: 973480 - RNA, 23 nt, Human
ucacugcagccugacuucauggg

SEQ ID NO: 973481 - RNA, 22 nt, Human
ucagaaguggcuguucuuacga

SEQ ID NO: 973482 - RNA, 19 nt, Human
ucagccaguuguccauuca

SEQ ID NO: 973483 - RNA, 22 nt, Human
ucagccgacaaccaaaggcaaa

SEQ ID NO: 973484 - RNA, 19 nt, Human
ucaggcaauaggcuucacc

SEQ ID NO: 973485 - RNA, 22 nt, Human
ucccaaagugcuggcauuacag

SEQ ID NO: 973486 - RNA, 25 nt, Human
ucccaaagugcuggcauuacagugu

SEQ ID NO: 973487 - RNA, 24 nt, Human
ucccaaguagcugggaccgcaggc

SEQ ID NO: 973488 - RNA, 22 nt, Human
uccccaacuagauugggcaccu

SEQ ID NO: 973489 - RNA, 19 nt, Human
uccccagcucugucgcaga

SEQ ID NO: 973490 - RNA, 22 nt, Human
uccccgaaggucgcugcuucug

SEQ ID NO: 973491 - RNA, 20 nt, Human
ucccggguggccccaggccu

SEQ ID NO: 973492 - RNA, 19 nt, Human
ucccguguuuugcugcugc

SEQ ID NO: 973493 - RNA, 18 nt, Human
ucccugggaggcauagaa

SEQ ID NO: 973494 - RNA, 18 nt, Human
ucccugggaggcauagaa

SEQ ID NO: 973495 - RNA, 19 nt, Human
ucccugucuugaaacccca

SEQ ID NO: 973496 - RNA, 18 nt, Human
uccggaggguugcccagg

SEQ ID NO: 973497 - RNA, 22 nt, Human
uccuaggcccguaguaaaugga

SEQ ID NO: 973498 - RNA, 27 nt, Human
uccuccugccuuagccucccaaagugc

SEQ ID NO: 973499 - RNA, 22 nt, Human
ucuaugggcagaccucaacccu

SEQ ID NO: 973500 - RNA, 18 nt, Human
ucucaccccugaaaccgg

SEQ ID NO: 973501 - RNA, 21 nt, Human
ucuccccgaaggucgcugcuu

SEQ ID NO: 973502 - RNA, 18 nt, Human
ucucucugagcccagccu

SEQ ID NO: 973503 - RNA, 22 nt, Human
ucugagacugagggcuugggga

SEQ ID NO: 973504 - RNA, 21 nt, Human
ucugugccaagaaaaccaaac

SEQ ID NO: 973505 - RNA, 18 nt, Human
ucuugcucugucgcccag

SEQ ID NO: 973506 - RNA, 19 nt, Human
ucuugcucugucgcccaga

SEQ ID NO: 973507 - RNA, 21 nt, Human
ucuugcucugucgcccagacu

SEQ ID NO: 973508 - RNA, 25 nt, Human
ucuugcucugucgcccagacugugc

SEQ ID NO: 973509 - RNA, 23 nt, Human
ugaaaccccagcccuugauauca

SEQ ID NO: 973510 - RNA, 23 nt, Human
ugaagcccagaggggcccaggcc

SEQ ID NO: 973511 - RNA, 24 nt, Human
ugaauccagagcugaccccggcac

SEQ ID NO: 973512 - RNA, 18 nt, Human
ugaauggagaguccggag

SEQ ID NO: 973513 - RNA, 19 nt, Human
ugacugcagucaugggaug

SEQ ID NO: 973514 - RNA, 21 nt, Human
ugagccccugccagcuaccaa

SEQ ID NO: 973515 - RNA, 24 nt, Human
ugaggaaagccucccggguggccc

SEQ ID NO: 973516 - RNA, 22 nt, Human
ugcaguggugcagucacagcuc

SEQ ID NO: 973517 - RNA, 18 nt, Human
ugccaagaaaaccaaaca

SEQ ID NO: 973518 - RNA, 21 nt, Human
ugccaguggggaaacugaagc

SEQ ID NO: 973519 - RNA, 18 nt, Human
ugccuggaacaucgaggc

SEQ ID NO: 973520 - RNA, 24 nt, Human
ugccuuagccucccaaagugcugg

SEQ ID NO: 973521 - RNA, 21 nt, Human
ugcucugucgcccagacugug

SEQ ID NO: 973522 - RNA, 19 nt, Human
uggacaggacaaaacuugu

SEQ ID NO: 973523 - RNA, 20 nt, Human
uggagggugcuccuuggaca

SEQ ID NO: 973524 - RNA, 22 nt, Human
uggauggacagcuaggggaucc

SEQ ID NO: 973525 - RNA, 20 nt, Human
uggcauuacagugugagcca

SEQ ID NO: 973526 - RNA, 23 nt, Human
uggcauuacagugugagccacug

SEQ ID NO: 973527 - RNA, 24 nt, Human
uggcuccucucaccccugaaaccc

SEQ ID NO: 973528 - RNA, 18 nt, Human
ugggaagggaugaaggga

SEQ ID NO: 973529 - RNA, 18 nt, Human
ugggaccgcaggcaaaca

SEQ ID NO: 973530 - RNA, 20 nt, Human
ugggaccgcaggcaaacacc

SEQ ID NO: 973531 - RNA, 19 nt, Human
ugggccccacaguucccug

SEQ ID NO: 973532 - RNA, 21 nt, Human
uggggaaacugaagcccagag

SEQ ID NO: 973533 - RNA, 24 nt, Human
uggugcagucacagcucacugcag

SEQ ID NO: 973534 - RNA, 18 nt, Human
ugucgcccagacugugca

SEQ ID NO: 973535 - RNA, 23 nt, Human
ugugcaguggugcagucacagcu

SEQ ID NO: 973536 - RNA, 20 nt, Human
ugugccaagaaaaccaaaca

SEQ ID NO: 973537 - RNA, 18 nt, Human
ugugggggccugagucca

SEQ ID NO: 973538 - RNA, 23 nt, Human
uguuugaggagcacugagacuca

SEQ ID NO: 973539 - RNA, 20 nt, Human
uguuuugggaagggaugaag

SEQ ID NO: 973540 - RNA, 20 nt, Human
uuagcuuaucccagcuuccc

SEQ ID NO: 973541 - RNA, 20 nt, Human
uucaccaacuugaagacugc

SEQ ID NO: 973542 - RNA, 25 nt, Human
uucaugggcucaagcaauccuccua

SEQ ID NO: 973543 - RNA, 24 nt, Human
uuccagggcugagaucuugccgua

SEQ ID NO: 973544 - RNA, 18 nt, Human
uugcccaggccacugcag

SEQ ID NO: 973545 - RNA, 20 nt, Human
uuguauucucucucugagcc

SEQ ID NO: 973546 - RNA, 19 nt, Human
uuuagaguaucuugcagcu

SEQ ID NO: 973547 - RNA, 19 nt, Human
aaacacaccauaccuacca

SEQ ID NO: 973548 - RNA, 22 nt, Human
aacaaacacaccauaccuacca

SEQ ID NO: 973549 - RNA, 18 nt, Human
aacaggcuucaaagucag

SEQ ID NO: 973550 - RNA, 19 nt, Human
aagaaaacacucaccuggc

SEQ ID NO: 973551 - RNA, 18 nt, Human
aagcaggcccuaacucca

SEQ ID NO: 973552 - RNA, 20 nt, Human
aagcugccugaggcagccca

SEQ ID NO: 973553 - RNA, 24 nt, Human
acagaacaaacacaccauaccuac

SEQ ID NO: 973554 - RNA, 19 nt, Human
acagagccaaagguccugg

SEQ ID NO: 973555 - RNA, 18 nt, Human
accaggugacuccagccc

SEQ ID NO: 973556 - RNA, 28 nt, Human
agaagacagcaggaaaaugccgguaccc

SEQ ID NO: 973557 - RNA, 22 nt, Human
agcaagaaaacuaaacgcacag

SEQ ID NO: 973558 - RNA, 22 nt, Human
agcacagagccucagcuccccc

SEQ ID NO: 973559 - RNA, 23 nt, Human
agcacagagccucagcuccccca

SEQ ID NO: 973560 - RNA, 26 nt, Human
aggaaaaugccauccuuuaacagcca

SEQ ID NO: 973561 - RNA, 19 nt, Human
aggauaccagaggcaggag

SEQ ID NO: 973562 - RNA, 22 nt, Human
aggcaggaggagggucacuugg

SEQ ID NO: 973563 - RNA, 25 nt, Human
agggaaaaagggccuugcccugagg

SEQ ID NO: 973564 - RNA, 27 nt, Human
cacaccauaccuaccaucaggcaccag

SEQ ID NO: 973565 - RNA, 25 nt, Human
caccagacgccucaaaacgccugga

SEQ ID NO: 973566 - RNA, 24 nt, Human
caccauaccuaccaucaggcacca

SEQ ID NO: 973567 - RNA, 19 nt, Human
cacggccccggagcucaga

SEQ ID NO: 973568 - RNA, 18 nt, Human
cacucaggugacagugac

SEQ ID NO: 973569 - RNA, 22 nt, Human
cagaaaugugaagcuggccuuc

SEQ ID NO: 973570 - RNA, 18 nt, Human
cagcaagaaaacuaaacg

SEQ ID NO: 973571 - RNA, 19 nt, Human
cagcaagaaaacuaaacgc

SEQ ID NO: 973572 - RNA, 21 nt, Human
cagcaagaaaacuaaacgcac

SEQ ID NO: 973573 - RNA, 21 nt, Human
cagcacagagccucagcuccc

SEQ ID NO: 973574 - RNA, 24 nt, Human
cagcauuagaaaacauggcaacca

SEQ ID NO: 973575 - RNA, 18 nt, Human
cagcugugggcugggggu

SEQ ID NO: 973576 - RNA, 20 nt, Human
caggacccucagcugccuga

SEQ ID NO: 973577 - RNA, 20 nt, Human
caggugacagugacccaagc

SEQ ID NO: 973578 - RNA, 25 nt, Human
cauagcccaagcacauccugaugcc

SEQ ID NO: 973579 - RNA, 22 nt, Human
cauggcaaccacccguuuccac

SEQ ID NO: 973580 - RNA, 23 nt, Human
ccaacgacuagggccccgggggc

SEQ ID NO: 973581 - RNA, 23 nt, Human
ccauccuuuaacagccaaaaauc

SEQ ID NO: 973582 - RNA, 19 nt, Human
cccccaggacccucagcug

SEQ ID NO: 973583 - RNA, 19 nt, Human
ccccggagcucagaccagc

SEQ ID NO: 973584 - RNA, 20 nt, Human
ccccggagcucagaccagcc

SEQ ID NO: 973585 - RNA, 22 nt, Human
ccccugggggacagaacaaaca

SEQ ID NO: 973586 - RNA, 24 nt, Human
cccggagcucagaccagccuggga

SEQ ID NO: 973587 - RNA, 21 nt, Human
ccuaccaucaggcaccagacg

SEQ ID NO: 973588 - RNA, 20 nt, Human
ccucugcucuccaguggggc

SEQ ID NO: 973589 - RNA, 24 nt, Human
ccucugcucuccaguggggccugg

SEQ ID NO: 973590 - RNA, 24 nt, Human
ccuggagcuagggccggaaaaggc

SEQ ID NO: 973591 - RNA, 21 nt, Human
ccugggguuggccccaagagc

SEQ ID NO: 973592 - RNA, 21 nt, Human
ccugggguuggccccaagagc

SEQ ID NO: 973593 - RNA, 18 nt, Human
cgacuagggccccggggg

SEQ ID NO: 973594 - RNA, 22 nt, Human
cuccagugagaugccccagcug

SEQ ID NO: 973595 - RNA, 19 nt, Human
cucccgcucagcaagaaaa

SEQ ID NO: 973596 - RNA, 28 nt, Human
cuccuuuguucuggcaaaaagcuagaga

SEQ ID NO: 973597 - RNA, 20 nt, Human
cucuagcccccuugcuaccu

SEQ ID NO: 973598 - RNA, 24 nt, Human
cugccugaggcagcccagcugcac

SEQ ID NO: 973599 - RNA, 21 nt, Human
cugggcucaggguuuauggcc

SEQ ID NO: 973600 - RNA, 23 nt, Human
cuucaggggcaccaggugacucc

SEQ ID NO: 973601 - RNA, 24 nt, Human
gaaaaaccacuauucaaaucccug

SEQ ID NO: 973602 - RNA, 23 nt, Human
gaaaaugccauccuuuaacagcc

SEQ ID NO: 973603 - RNA, 20 nt, Human
gaauggaacgugaaggaccc

SEQ ID NO: 973604 - RNA, 20 nt, Human
gcaggaggagggucacuugg

SEQ ID NO: 973605 - RNA, 18 nt, Human
gccccagcugugggcugg

SEQ ID NO: 973606 - RNA, 19 nt, Human
gccccggagcucagaccag

SEQ ID NO: 973607 - RNA, 25 nt, Human
gcucaggguuuauggccaccauagc

SEQ ID NO: 973608 - RNA, 20 nt, Human
ggacuucgcagcacgcagac

SEQ ID NO: 973609 - RNA, 18 nt, Human
ggagggaaaaagggccuu

SEQ ID NO: 973610 - RNA, 21 nt, Human
gggcaccaggugacuccagcc

SEQ ID NO: 973611 - RNA, 21 nt, Human
gggcagccgcggacuucgcag

SEQ ID NO: 973612 - RNA, 21 nt, Human
ggugauggacagagccaaagg

SEQ ID NO: 973613 - RNA, 22 nt, Human
guccugggguuggccccaagag

SEQ ID NO: 973614 - RNA, 23 nt, Human
uaaacgcacagaagacagcagga

SEQ ID NO: 973615 - RNA, 22 nt, Human
uagaaaacauggcaaccacccg

SEQ ID NO: 973616 - RNA, 20 nt, Human
uagcccccuugcuaccucuc

SEQ ID NO: 973617 - RNA, 18 nt, Human
ucacuugggaggggaggu

SEQ ID NO: 973618 - RNA, 19 nt, Human
ucacuugggaggggaggug

SEQ ID NO: 973619 - RNA, 19 nt, Human
ucacuugggaggggaggug

SEQ ID NO: 973620 - RNA, 24 nt, Human
ucacuugggaggggagguggaauc

SEQ ID NO: 973621 - RNA, 19 nt, Human
ucagaauacagccaucagc

SEQ ID NO: 973622 - RNA, 21 nt, Human
ucagcaagaaaacuaaacgca

SEQ ID NO: 973623 - RNA, 18 nt, Human
ucagcagaaaugugaagc

SEQ ID NO: 973624 - RNA, 22 nt, Human
ucagcucccccaggacccucag

SEQ ID NO: 973625 - RNA, 19 nt, Human
ucagguccucugcucucca

SEQ ID NO: 973626 - RNA, 21 nt, Human
uccagugagaugccccagcug

SEQ ID NO: 973627 - RNA, 21 nt, Human
ucccccaggacccucagcugc

SEQ ID NO: 973628 - RNA, 23 nt, Human
ucccgcucagcaagaaaacuaaa

SEQ ID NO: 973629 - RNA, 22 nt, Human
ucugccugcgucgcagcuuccg

SEQ ID NO: 973630 - RNA, 27 nt, Human
ugaagaaaacacucaccuggcuggagg

SEQ ID NO: 973631 - RNA, 22 nt, Human
ugagagcaguucauuuuggcac

SEQ ID NO: 973632 - RNA, 19 nt, Human
ugagaugccccagcugugg

SEQ ID NO: 973633 - RNA, 21 nt, Human
ugcagcuccccagcauuagaa

SEQ ID NO: 973634 - RNA, 20 nt, Human
ugcgucgcagcuuccgcacg

SEQ ID NO: 973635 - RNA, 23 nt, Human
uggaacccaacgacuagggcccc

SEQ ID NO: 973636 - RNA, 24 nt, Human
uggaaucucccuccucuagccccc

SEQ ID NO: 973637 - RNA, 19 nt, Human
uggcaaaaagcuagagaaa

SEQ ID NO: 973638 - RNA, 24 nt, Human
uggcaaaaagcuagagaaaaacca

SEQ ID NO: 973639 - RNA, 18 nt, Human
uggcacuccaagcugccu

SEQ ID NO: 973640 - RNA, 22 nt, Human
uggccuucagcuucugcccagg

SEQ ID NO: 973641 - RNA, 20 nt, Human
uuagaaaacauggcaaccac

SEQ ID NO: 973642 - RNA, 19 nt, Human
uugcuaccucuuaacaggc

SEQ ID NO: 973643 - RNA, 22 nt, Human
aacucuagcagcccccucacag

SEQ ID NO: 973644 - RNA, 24 nt, Human
acacccgaggagaagaacucuagc

SEQ ID NO: 973645 - RNA, 20 nt, Human
acauagucaaaccugagcau

SEQ ID NO: 973646 - RNA, 19 nt, Human
acauugagaggaaguggga

SEQ ID NO: 973647 - RNA, 25 nt, Human
accacccuaacauccucauucacca

SEQ ID NO: 973648 - RNA, 20 nt, Human
acccuaacauccucauucac

SEQ ID NO: 973649 - RNA, 22 nt, Human
accugcacucuccggaacccac

SEQ ID NO: 973650 - RNA, 22 nt, Human
acgccaaggccgcaggcccaac

SEQ ID NO: 973651 - RNA, 23 nt, Human
agauuuuauacaaaaagcugggg

SEQ ID NO: 973652 - RNA, 26 nt, Human
agcaugggguggcuggucccuggaga

SEQ ID NO: 973653 - RNA, 21 nt, Human
aggaaggccuuggagcagagc

SEQ ID NO: 973654 - RNA, 23 nt, Human
aggcaggccuccggagaaggaag

SEQ ID NO: 973655 - RNA, 24 nt, Human
aggcugcuucucacacacccgagg

SEQ ID NO: 973656 - RNA, 21 nt, Human
caaaagcccccgcucugaaca

SEQ ID NO: 973657 - RNA, 19 nt, Human
cacccgaggagaagaacuc

SEQ ID NO: 973658 - RNA, 18 nt, Human
caugcagguaguaggugc

SEQ ID NO: 973659 - RNA, 21 nt, Human
ccacugcgacagcaaaagccc

SEQ ID NO: 973660 - RNA, 21 nt, Human
cccacugcgacagcaaaagcu

SEQ ID NO: 973661 - RNA, 22 nt, Human
ccuaacauccucauucaccaga

SEQ ID NO: 973662 - RNA, 20 nt, Human
ccuccggagaaggaagugaa

SEQ ID NO: 973663 - RNA, 23 nt, Human
cgacuccccgaacccgggguccu

SEQ ID NO: 973664 - RNA, 18 nt, Human
cucagccagguacuggac

SEQ ID NO: 973665 - RNA, 19 nt, Human
cuccucugucuccuugucg

SEQ ID NO: 973666 - RNA, 22 nt, Human
cucuccggaacccacugcgaca

SEQ ID NO: 973667 - RNA, 25 nt, Human
cuuacggccuucuuugcgacucccc

SEQ ID NO: 973668 - RNA, 18 nt, Human
cuucagcagcucagccag

SEQ ID NO: 973669 - RNA, 20 nt, Human
cuucuuugcgacuccccgaa

SEQ ID NO: 973670 - RNA, 20 nt, Human
gaagaaaacauugagaggaa

SEQ ID NO: 973671 - RNA, 19 nt, Human
gagcagagcugggugagca

SEQ ID NO: 973672 - RNA, 24 nt, Human
gcagcccccucacaguuguagcuc

SEQ ID NO: 973673 - RNA, 18 nt, Human
gcaggguuuuguugucaa

SEQ ID NO: 973674 - RNA, 19 nt, Human
gcccuucucuucuucgucc

SEQ ID NO: 973675 - RNA, 22 nt, Human
gcugcuucucacacacccgagg

SEQ ID NO: 973676 - RNA, 18 nt, Human
gcuggcuaccagcuccuc

SEQ ID NO: 973677 - RNA, 23 nt, Human
ggacauagucaaaccugagcaug

SEQ ID NO: 973678 - RNA, 18 nt, Human
gggaaagaaugcgguguu

SEQ ID NO: 973679 - RNA, 22 nt, Human
gggcagcgcaggguuuuguugu

SEQ ID NO: 973680 - RNA, 25 nt, Human
gggguggcuggucccuggagauucc

SEQ ID NO: 973681 - RNA, 19 nt, Human
gguggcuggucccuggaga

SEQ ID NO: 973682 - RNA, 22 nt, Human
guacuggaccacccuaacaucc

SEQ ID NO: 973683 - RNA, 19 nt, Human
guccaggaugcucguguag

SEQ ID NO: 973684 - RNA, 19 nt, Human
gugcagcuucagcagcuca

SEQ ID NO: 973685 - RNA, 26 nt, Human
guuguagcuccuccggagcucucuga

SEQ ID NO: 973686 - RNA, 21 nt, Human
uauaugaagaaaacauugaga

SEQ ID NO: 973687 - RNA, 24 nt, Human
ucaccugcacucuccggaacccac

SEQ ID NO: 973688 - RNA, 23 nt, Human
ucagauuuuauacaaaaagcugg

SEQ ID NO: 973689 - RNA, 18 nt, Human
uccucugucuccuugucg

SEQ ID NO: 973690 - RNA, 21 nt, Human
uccucugucuccuugucgugg

SEQ ID NO: 973691 - RNA, 23 nt, Human
ugaagaaaacauugagaggaagu

SEQ ID NO: 973692 - RNA, 18 nt, Human
ugagaggaagugggaaag

SEQ ID NO: 973693 - RNA, 20 nt, Human
ugagaggaagugggaaagaa

SEQ ID NO: 973694 - RNA, 28 nt, Human
ugagaggaagugggaaagaaugcggugg

SEQ ID NO: 973695 - RNA, 18 nt, Human
ugcgacagcaaaagcccc

SEQ ID NO: 973696 - RNA, 20 nt, Human
uggcuaccagcuccucuguc

SEQ ID NO: 973697 - RNA, 22 nt, Human
ugguggcagaagguguagagga

SEQ ID NO: 973698 - RNA, 24 nt, Human
uuccugcauguagugcagcuucag

SEQ ID NO: 973699 - RNA, 22 nt, Human
uuguagcuccuccggagcucuc

SEQ ID NO: 973700 - RNA, 19 nt, Human
aaacaaaacacgcaaguaa

SEQ ID NO: 973701 - RNA, 22 nt, Human
aaaccaaaaacaaaacacgcaa

SEQ ID NO: 973702 - RNA, 30 nt, Human
aacacccucccccacccccccaaaacccuu

SEQ ID NO: 973703 - RNA, 19 nt, Human
aaccaaaaacaaaacacgc

SEQ ID NO: 973704 - RNA, 20 nt, Human
aauggcauggggcaauauag

SEQ ID NO: 973705 - RNA, 21 nt, Human
acaacacccucccccaccccc

SEQ ID NO: 973706 - RNA, 18 nt, Human
acacagucaugaaccgcg

SEQ ID NO: 973707 - RNA, 19 nt, Human
acacagucaugaaccgcgc

SEQ ID NO: 973708 - RNA, 19 nt, Human
acccaccaaugcugggccc

SEQ ID NO: 973709 - RNA, 29 nt, Human
acccccccaaaacccucuaaaaguuguca

SEQ ID NO: 973710 - RNA, 18 nt, Human
acccucccccaccccccc

SEQ ID NO: 973711 - RNA, 25 nt, Human
agagaauaaagucuuucuucccuuu

SEQ ID NO: 973712 - RNA, 19 nt, Human
agaggucacacccaaucug

SEQ ID NO: 973713 - RNA, 24 nt, Human
agaguuucccuguuggcaccgcac

SEQ ID NO: 973714 - RNA, 18 nt, Human
aggcagagggagagaaau

SEQ ID NO: 973715 - RNA, 18 nt, Human
agggaggugaagaguuuc

SEQ ID NO: 973716 - RNA, 19 nt, Human
agugcccaccacccacagc

SEQ ID NO: 973717 - RNA, 18 nt, Human
auaaacaaacagcaaugc

SEQ ID NO: 973718 - RNA, 24 nt, Human
auaaaucucuuucuucucaggccc

SEQ ID NO: 973719 - RNA, 23 nt, Human
auccugccucccuggacucucca

SEQ ID NO: 973720 - RNA, 23 nt, Human
aucucuuucuucucaggccccaa

SEQ ID NO: 973721 - RNA, 22 nt, Human
caaaacccucuaaaaguuguca

SEQ ID NO: 973722 - RNA, 24 nt, Human
caacaacacccucccccacccccc

SEQ ID NO: 973723 - RNA, 21 nt, Human
caacacccucccccacccccc

SEQ ID NO: 973724 - RNA, 24 nt, Human
caacgcugaagguuaggugucugg

SEQ ID NO: 973725 - RNA, 21 nt, Human
caaugccaaugccuguacaaa

SEQ ID NO: 973726 - RNA, 22 nt, Human
cacagcgcgccucccuuccuuc

SEQ ID NO: 973727 - RNA, 22 nt, Human
cacccucccccacccccccaaa

SEQ ID NO: 973728 - RNA, 21 nt, Human
caccgcaccccucagugcagg

SEQ ID NO: 973729 - RNA, 20 nt, Human
cagcgcgccucccuuccuuc

SEQ ID NO: 973730 - RNA, 19 nt, Human
caggauagaguccuggauu

SEQ ID NO: 973731 - RNA, 24 nt, Human
cauccugccucccuggacucucca

SEQ ID NO: 973732 - RNA, 19 nt, Human
ccagggcaguuuccaucuc

SEQ ID NO: 973733 - RNA, 19 nt, Human
cccaaaacccucuaaaagu

SEQ ID NO: 973734 - RNA, 20 nt, Human
cccaaaacccucuaaaaguu

SEQ ID NO: 973735 - RNA, 23 nt, Human
cccaacaacacccucccccaccc

SEQ ID NO: 973736 - RNA, 24 nt, Human
cccaccagaaaagaacucguggag

SEQ ID NO: 973737 - RNA, 26 nt, Human
cccacccccccaaaacccucuaaaag

SEQ ID NO: 973738 - RNA, 20 nt, Human
ccccaacaacacccuccccc

SEQ ID NO: 973739 - RNA, 24 nt, Human
ccccaacaacacccucccccaccc

SEQ ID NO: 973740 - RNA, 21 nt, Human
cccccacccccccaaaacccc

SEQ ID NO: 973741 - RNA, 23 nt, Human
cccccacccccccaaaacccucu

SEQ ID NO: 973742 - RNA, 21 nt, Human
ccccccaaaacccucuaaaag

SEQ ID NO: 973743 - RNA, 21 nt, Human
cccucccccacccccccaaaa

SEQ ID NO: 973744 - RNA, 19 nt, Human
ccgcaccccucagugcagg

SEQ ID NO: 973745 - RNA, 23 nt, Human
ccucccuggacaaggccgagagc

SEQ ID NO: 973746 - RNA, 18 nt, Human
ccucugagagccgguacc

SEQ ID NO: 973747 - RNA, 24 nt, Human
ccugcggcgggggcucgcagaggc

SEQ ID NO: 973748 - RNA, 23 nt, Human
ccuguuggcaccgcaccccucag

SEQ ID NO: 973749 - RNA, 19 nt, Human
ccuuuucuucuuugccucc

SEQ ID NO: 973750 - RNA, 18 nt, Human
cggcggggcccaggcggc

SEQ ID NO: 973751 - RNA, 20 nt, Human
cucccaccagaaaagaacuc

SEQ ID NO: 973752 - RNA, 18 nt, Human
cuccuuagcccaaccucc

SEQ ID NO: 973753 - RNA, 26 nt, Human
cucuccuuagcccaaccucccuggac

SEQ ID NO: 973754 - RNA, 19 nt, Human
cugggcccuuugggggucc

SEQ ID NO: 973755 - RNA, 24 nt, Human
cuguccuguccccuccccugcuua

SEQ ID NO: 973756 - RNA, 19 nt, Human
cuuagcccaaccucccugg

SEQ ID NO: 973757 - RNA, 21 nt, Human
gaaauaaacaaacagcaaugc

SEQ ID NO: 973758 - RNA, 19 nt, Human
gagaaauaaacaaacagca

SEQ ID NO: 973759 - RNA, 18 nt, Human
gagcaggaaugcacggac

SEQ ID NO: 973760 - RNA, 22 nt, Human
gcagcgagcgggguucgcgggc

SEQ ID NO: 973761 - RNA, 18 nt, Human
gcaggcuuucuguccugu

SEQ ID NO: 973762 - RNA, 19 nt, Human
gcccuuggguuuucugcuc

SEQ ID NO: 973763 - RNA, 18 nt, Human
gcggcggcggggagcggg

SEQ ID NO: 973764 - RNA, 20 nt, Human
ggagcgcgagcgugugcucu

SEQ ID NO: 973765 - RNA, 23 nt, Human
ggggagcgggccgugguccugcg

SEQ ID NO: 973766 - RNA, 21 nt, Human
guccuuuucuucuuugccucc

SEQ ID NO: 973767 - RNA, 18 nt, Human
gugauccauccugccucc

SEQ ID NO: 973768 - RNA, 22 nt, Human
uaaaaugaaaccaaaaacaaaa

SEQ ID NO: 973769 - RNA, 23 nt, Human
uaaaaugaaaccaaaaacaaaac

SEQ ID NO: 973770 - RNA, 25 nt, Human
uaaacaaacagcaaugccaaugccu

SEQ ID NO: 973771 - RNA, 24 nt, Human
uacaauaagagagagaauaaaguc

SEQ ID NO: 973772 - RNA, 22 nt, Human
uacacaagggucagucuccaaa

SEQ ID NO: 973773 - RNA, 21 nt, Human
uagcagauccaaaaacuuaca

SEQ ID NO: 973774 - RNA, 19 nt, Human
uccagagugcccaccaccc

SEQ ID NO: 973775 - RNA, 25 nt, Human
uccagagugcccaccacccacagca

SEQ ID NO: 973776 - RNA, 21 nt, Human
ucccccacccccccaaaaccc

SEQ ID NO: 973777 - RNA, 22 nt, Human
ucccuuccuuccuucgcucggg

SEQ ID NO: 973778 - RNA, 23 nt, Human
uccguguguccuuuucuucuuug

SEQ ID NO: 973779 - RNA, 22 nt, Human
uccugccucccuggacucucca

SEQ ID NO: 973780 - RNA, 22 nt, Human
ucgcucggggcccucgcggcgg

SEQ ID NO: 973781 - RNA, 20 nt, Human
ucucaggccccaacaacacc

SEQ ID NO: 973782 - RNA, 21 nt, Human
ucucaggccccaacaacaccc

SEQ ID NO: 973783 - RNA, 22 nt, Human
ucucaggccccaacaacacccu

SEQ ID NO: 973784 - RNA, 24 nt, Human
ucucaggccccaacaacacccucc

SEQ ID NO: 973785 - RNA, 18 nt, Human
ucuucccuuuccuuuucc

SEQ ID NO: 973786 - RNA, 21 nt, Human
ucuucuuugccuccccucuca

SEQ ID NO: 973787 - RNA, 22 nt, Human
ugaaaccaaaaacaaaacacgc

SEQ ID NO: 973788 - RNA, 19 nt, Human
ugacguaaugcaaauccuu

SEQ ID NO: 973789 - RNA, 19 nt, Human
ugcacggacccucugagag

SEQ ID NO: 973790 - RNA, 18 nt, Human
ugcggucaggggacacag

SEQ ID NO: 973791 - RNA, 23 nt, Human
uggacaaggccgagagccaagug

SEQ ID NO: 973792 - RNA, 19 nt, Human
uguacaaaagaacuauaca

SEQ ID NO: 973793 - RNA, 19 nt, Human
uguccuguccccuccccug

SEQ ID NO: 973794 - RNA, 20 nt, Human
uuaaaagugcaaacauggug

SEQ ID NO: 973795 - RNA, 23 nt, Human
uuaaaggcccuuccguguguccu

SEQ ID NO: 973796 - RNA, 24 nt, Human
uuaaaggcccuuccguguguccuu

SEQ ID NO: 973797 - RNA, 19 nt, Human
uuagaaagcuggacuaugu

SEQ ID NO: 973798 - RNA, 23 nt, Human
uuaggugucuggugauccauccu

SEQ ID NO: 973799 - RNA, 18 nt, Human
uuggggguccggagagca

SEQ ID NO: 973800 - RNA, 20 nt, Human
uuuacauauauauuuauaua

SEQ ID NO: 973801 - RNA, 23 nt, Human
uuugcuccgagggucacuaagau

SEQ ID NO: 973802 - RNA, 22 nt, Human
aaaacaagacaaacuaacagaa

SEQ ID NO: 973803 - RNA, 22 nt, Human
aaaaucccaagaaacaaaccag

SEQ ID NO: 973804 - RNA, 23 nt, Human
aaaauggaaaagcaaagauccuu

SEQ ID NO: 973805 - RNA, 21 nt, Human
aaacaagacaaacuaacagaa

SEQ ID NO: 973806 - RNA, 19 nt, Human
aaacuaacagaaaauccca

SEQ ID NO: 973807 - RNA, 18 nt, Human
aaagcaaaacaagacaaa

SEQ ID NO: 973808 - RNA, 19 nt, Human
aacaccagccccgggggca

SEQ ID NO: 973809 - RNA, 18 nt, Human
aagaucuuuuuccaacca

SEQ ID NO: 973810 - RNA, 26 nt, Human
aagcacaaccacgggacgcaccgcgc

SEQ ID NO: 973811 - RNA, 19 nt, Human
aagcaucacaacaucacaa

SEQ ID NO: 973812 - RNA, 19 nt, Human
aaggcgaagaaauuaagcc

SEQ ID NO: 973813 - RNA, 19 nt, Human
aaggcgaagaaauuaagcc

SEQ ID NO: 973814 - RNA, 23 nt, Human
aauugcucuuuggugagggaaau

SEQ ID NO: 973815 - RNA, 19 nt, Human
acaagacaaacuaacagaa

SEQ ID NO: 973816 - RNA, 22 nt, Human
acaagccuguuagccagcucgg

SEQ ID NO: 973817 - RNA, 31 nt, Human
acacgcacgcacucauacccacgcgcgcggg

SEQ ID NO: 973818 - RNA, 20 nt, Human
acagauuuccaaggucaaaa

SEQ ID NO: 973819 - RNA, 26 nt, Human
acccagagguccuccgcguucuuugc

SEQ ID NO: 973820 - RNA, 22 nt, Human
accccggagcuucccggauccu

SEQ ID NO: 973821 - RNA, 18 nt, Human
accuuccgguagcccugg

SEQ ID NO: 973822 - RNA, 23 nt, Human
acugcagccgggagagcccagug

SEQ ID NO: 973823 - RNA, 24 nt, Human
agaaaggaaccguggggacccuca

SEQ ID NO: 973824 - RNA, 23 nt, Human
agacaagccuguuagccagcucg

SEQ ID NO: 973825 - RNA, 21 nt, Human
agacacugggugcccugagcu

SEQ ID NO: 973826 - RNA, 20 nt, Human
agcgggggccaccagggcug

SEQ ID NO: 973827 - RNA, 18 nt, Human
agcucuggggcccaggcc

SEQ ID NO: 973828 - RNA, 19 nt, Human
aggcagccucccaccaucc

SEQ ID NO: 973829 - RNA, 25 nt, Human
agguaggaggaucaggagaauaaug

SEQ ID NO: 973830 - RNA, 24 nt, Human
auaaaagauuauccaaaaaguuua

SEQ ID NO: 973831 - RNA, 21 nt, Human
auacagauuuccaaggucaaa

SEQ ID NO: 973832 - RNA, 18 nt, Human
aucacaaaaucauucuac

SEQ ID NO: 973833 - RNA, 22 nt, Human
aucacaaaaucauucuacaagg

SEQ ID NO: 973834 - RNA, 20 nt, Human
auccgaacgacucucuggga

SEQ ID NO: 973835 - RNA, 18 nt, Human
caaaacaagacaaacuaa

SEQ ID NO: 973836 - RNA, 19 nt, Human
caaaacucaaaacagaagc

SEQ ID NO: 973837 - RNA, 20 nt, Human
caaaacucaaaacagaagcu

SEQ ID NO: 973838 - RNA, 21 nt, Human
caaaacucaaaacagaagcuu

SEQ ID NO: 973839 - RNA, 27 nt, Human
caaacuaacagaaaaucccaagaaaca

SEQ ID NO: 973840 - RNA, 24 nt, Human
caagaaacaaaccagcccaugcau

SEQ ID NO: 973841 - RNA, 21 nt, Human
caagcaucacaacaucacaaa

SEQ ID NO: 973842 - RNA, 28 nt, Human
caagccccagggcaaaacucaaaacaga

SEQ ID NO: 973843 - RNA, 23 nt, Human
cacacacacacgugcacacuuac

SEQ ID NO: 973844 - RNA, 31 nt, Human
cacacacgugcacacuuacacacacgcacag

SEQ ID NO: 973845 - RNA, 24 nt, Human
cacacuuacacacacgcacaccca

SEQ ID NO: 973846 - RNA, 18 nt, Human
caccagggcugcgcagug

SEQ ID NO: 973847 - RNA, 23 nt, Human
caccagggcugcgcaguggccug

SEQ ID NO: 973848 - RNA, 22 nt, Human
cacccaggcacacgcacgcacu

SEQ ID NO: 973849 - RNA, 18 nt, Human
caccgcucccggcggccc

SEQ ID NO: 973850 - RNA, 20 nt, Human
cacgcacucauacccacgcg

SEQ ID NO: 973851 - RNA, 18 nt, Human
cagcuccccugcaggcac

SEQ ID NO: 973852 - RNA, 20 nt, Human
cagcuccccugcaggcaccc

SEQ ID NO: 973853 - RNA, 22 nt, Human
caggcacacgcacgcacucaua

SEQ ID NO: 973854 - RNA, 20 nt, Human
caggccugaggguggcagcu

SEQ ID NO: 973855 - RNA, 25 nt, Human
cagggcaaaacucaaaacagaagcu

SEQ ID NO: 973856 - RNA, 19 nt, Human
caguggccuguccgggcug

SEQ ID NO: 973857 - RNA, 23 nt, Human
ccaaaagucugagccgagauaga

SEQ ID NO: 973858 - RNA, 22 nt, Human
ccaagcacaaccacgggacgca

SEQ ID NO: 973859 - RNA, 21 nt, Human
ccacauacagauuuccaaggu

SEQ ID NO: 973860 - RNA, 23 nt, Human
ccagcccaugcauguuaacugcc

SEQ ID NO: 973861 - RNA, 23 nt, Human
ccauccgaacgacucucugggac

SEQ ID NO: 973862 - RNA, 21 nt, Human
ccaugcauguuaacugccugu

SEQ ID NO: 973863 - RNA, 18 nt, Human
ccccaccucccagcgccc

SEQ ID NO: 973864 - RNA, 21 nt, Human
cccccagccccaccucccagc

SEQ ID NO: 973865 - RNA, 18 nt, Human
cccccggcugccaacacc

SEQ ID NO: 973866 - RNA, 23 nt, Human
cccccggcugccaacaccagccc

SEQ ID NO: 973867 - RNA, 24 nt, Human
cccccggcugccaacaccagcccc

SEQ ID NO: 973868 - RNA, 21 nt, Human
ccccggcugccaacaccagcc

SEQ ID NO: 973869 - RNA, 19 nt, Human
ccccucuccucccccagcc

SEQ ID NO: 973870 - RNA, 21 nt, Human
cccgcccgccucucucccucc

SEQ ID NO: 973871 - RNA, 18 nt, Human
cccgcgcgcacucucaca

SEQ ID NO: 973872 - RNA, 22 nt, Human
cccucccgcccgccucucuccc

SEQ ID NO: 973873 - RNA, 20 nt, Human
ccgcgcccgcuccgcuccgg

SEQ ID NO: 973874 - RNA, 23 nt, Human
ccgcgcccuccucacgccccagg

SEQ ID NO: 973875 - RNA, 21 nt, Human
ccgcugccgcgcccgcuccgc

SEQ ID NO: 973876 - RNA, 20 nt, Human
ccucaggcaccuccccccgg

SEQ ID NO: 973877 - RNA, 18 nt, Human
ccucccccucuccucccc

SEQ ID NO: 973878 - RNA, 18 nt, Human
ccuguagggucggccgua

SEQ ID NO: 973879 - RNA, 23 nt, Human
ccuucaguaaggagacugcucau

SEQ ID NO: 973880 - RNA, 30 nt, Human
cgcgcgcacucucacacacacacgugcaca

SEQ ID NO: 973881 - RNA, 21 nt, Human
cggugcccgcugcggcccaga

SEQ ID NO: 973882 - RNA, 19 nt, Human
cucccccagccccaccucc

SEQ ID NO: 973883 - RNA, 20 nt, Human
cucucagacuguccuccaaa

SEQ ID NO: 973884 - RNA, 18 nt, Human
cugcagccgggagagccc

SEQ ID NO: 973885 - RNA, 23 nt, Human
cugguucuguggcuccaaaggcu

SEQ ID NO: 973886 - RNA, 18 nt, Human
cugugccuccuuccccgc

SEQ ID NO: 973887 - RNA, 20 nt, Human
gaaggcgaagaaauuaagcc

SEQ ID NO: 973888 - RNA, 21 nt, Human
gaauuuacauuuaaaguacaa

SEQ ID NO: 973889 - RNA, 19 nt, Human
gagagcccagugggcgagc

SEQ ID NO: 973890 - RNA, 19 nt, Human
gagcgcggcugggcgggcg

SEQ ID NO: 973891 - RNA, 19 nt, Human
gagcucuggggcccaggcc

SEQ ID NO: 973892 - RNA, 20 nt, Human
gagguggagcgggggccacc

SEQ ID NO: 973893 - RNA, 18 nt, Human
gauccuccccucccgccc

SEQ ID NO: 973894 - RNA, 24 nt, Human
gcaaaacaagacaaacuaacagaa

SEQ ID NO: 973895 - RNA, 20 nt, Human
gcaaaacucaaaacagaagc

SEQ ID NO: 973896 - RNA, 20 nt, Human
gcaaauacuauguguuucug

SEQ ID NO: 973897 - RNA, 20 nt, Human
gcaagaagccuuacgcgaug

SEQ ID NO: 973898 - RNA, 19 nt, Human
gcacacccaggcacacgca

SEQ ID NO: 973899 - RNA, 23 nt, Human
gccaacaccagccccgggggcac

SEQ ID NO: 973900 - RNA, 21 nt, Human
gccagcucggucacaccgcga

SEQ ID NO: 973901 - RNA, 19 nt, Human
gcccaggccugaggguggc

SEQ ID NO: 973902 - RNA, 19 nt, Human
gcccugagcucuggggccc

SEQ ID NO: 973903 - RNA, 24 nt, Human
gccggagugcauagagcucuacug

SEQ ID NO: 973904 - RNA, 20 nt, Human
gccugaggguggcagcuggu

SEQ ID NO: 973905 - RNA, 24 nt, Human
gcgcggcugggcgggcgcguggag

SEQ ID NO: 973906 - RNA, 25 nt, Human
ggagcgggggccaccagggcugcga

SEQ ID NO: 973907 - RNA, 21 nt, Human
ggagcuuccaacaugauucca

SEQ ID NO: 973908 - RNA, 18 nt, Human
ggauccuccccucccgcc

SEQ ID NO: 973909 - RNA, 20 nt, Human
ggggcccaggccugagggug

SEQ ID NO: 973910 - RNA, 18 nt, Human
guggaggggcggcuccgc

SEQ ID NO: 973911 - RNA, 19 nt, Human
guggaggggcggcuccgcg

SEQ ID NO: 973912 - RNA, 20 nt, Human
gugugggcauuccacuccua

SEQ ID NO: 973913 - RNA, 22 nt, Human
uaaaauggaaaagcaaagaucc

SEQ ID NO: 973914 - RNA, 18 nt, Human
uaaauaagcaagaagccu

SEQ ID NO: 973915 - RNA, 20 nt, Human
uaacuggauagcuuuagugg

SEQ ID NO: 973916 - RNA, 28 nt, Human
uaagcaagaagccuuacgcuguaaugac

SEQ ID NO: 973917 - RNA, 32 nt, Human
uacacacacgcacacccaggcacacgcacggu

SEQ ID NO: 973918 - RNA, 27 nt, Human
uacacacacgcacacccaggcacacgg

SEQ ID NO: 973919 - RNA, 18 nt, Human
uaccccggagcuucccgg

SEQ ID NO: 973920 - RNA, 18 nt, Human
uaggaucauaacuguuuc

SEQ ID NO: 973921 - RNA, 23 nt, Human
uaugagcaagaucucuggaaagc

SEQ ID NO: 973922 - RNA, 18 nt, Human
uauguguuucuguuuuug

SEQ ID NO: 973923 - RNA, 22 nt, Human
uccacaagcaucacaacaucac

SEQ ID NO: 973924 - RNA, 21 nt, Human
uccaccacauacagauuucca

SEQ ID NO: 973925 - RNA, 23 nt, Human
uccauggacauguggagcuucca

SEQ ID NO: 973926 - RNA, 22 nt, Human
uccccaccgcucccggcggccc

SEQ ID NO: 973927 - RNA, 18 nt, Human
ucccccagccccaccucc

SEQ ID NO: 973928 - RNA, 19 nt, Human
ucccccagccccaccuccc

SEQ ID NO: 973929 - RNA, 23 nt, Human
ucccccagccccaccucccagcg

SEQ ID NO: 973930 - RNA, 23 nt, Human
ucccccucuccucccccagcccc

SEQ ID NO: 973931 - RNA, 22 nt, Human
uccccugcaggcacccagaggu

SEQ ID NO: 973932 - RNA, 22 nt, Human
ucccggauccuccccucccgcc

SEQ ID NO: 973933 - RNA, 18 nt, Human
uccgcgaugcucucccca

SEQ ID NO: 973934 - RNA, 18 nt, Human
uccggugcccgcugcggc

SEQ ID NO: 973935 - RNA, 18 nt, Human
uccuaggcagccucccac

SEQ ID NO: 973936 - RNA, 21 nt, Human
ucgcuccugucaaauaccccg

SEQ ID NO: 973937 - RNA, 24 nt, Human
ucggccguacaucacaaacuucca

SEQ ID NO: 973938 - RNA, 24 nt, Human
ucuacaaagugaauuuacauuuaa

SEQ ID NO: 973939 - RNA, 24 nt, Human
ucucuggaaagcaaaacaagacaa

SEQ ID NO: 973940 - RNA, 21 nt, Human
ucugaagccagcucuccauuu

SEQ ID NO: 973941 - RNA, 21 nt, Human
ugaagaucuuuuuccaaccaa

SEQ ID NO: 973942 - RNA, 20 nt, Human
ugagggaaauuucccaugug

SEQ ID NO: 973943 - RNA, 22 nt, Human
ugauuaaauucaaaggucagaa

SEQ ID NO: 973944 - RNA, 21 nt, Human
ugcaaauacuauguguuucug

SEQ ID NO: 973945 - RNA, 27 nt, Human
ugcacacuuacacacacgcacacccag

SEQ ID NO: 973946 - RNA, 19 nt, Human
ugcacuuaacuggauagcu

SEQ ID NO: 973947 - RNA, 21 nt, Human
ugcagccggagugcauagagc

SEQ ID NO: 973948 - RNA, 23 nt, Human
ugcauucagaaaagcagaaagga

SEQ ID NO: 973949 - RNA, 22 nt, Human
ugccaacaccagccccgggggc

SEQ ID NO: 973950 - RNA, 23 nt, Human
ugcccugagcucuggggcccagg

SEQ ID NO: 973951 - RNA, 20 nt, Human
ugccuccuaggcagccuccc

SEQ ID NO: 973952 - RNA, 20 nt, Human
ugccuucgggguaugagcca

SEQ ID NO: 973953 - RNA, 21 nt, Human
ugcggcccagaggccucccug

SEQ ID NO: 973954 - RNA, 18 nt, Human
uggaaagcaaaacaagac

SEQ ID NO: 973955 - RNA, 21 nt, Human
uggaggggcggcuccgcgaug

SEQ ID NO: 973956 - RNA, 20 nt, Human
uggcauguacuugagcuggu

SEQ ID NO: 973957 - RNA, 19 nt, Human
ugggccccucccaggcacu

SEQ ID NO: 973958 - RNA, 18 nt, Human
uggggcccaggccugagg

SEQ ID NO: 973959 - RNA, 20 nt, Human
ugugauuaauuuucugaagc

SEQ ID NO: 973960 - RNA, 21 nt, Human
uuauccaaaaaguuuaggauc

SEQ ID NO: 973961 - RNA, 22 nt, Human
uucaaauacuucuccaccacau

SEQ ID NO: 973962 - RNA, 19 nt, Human
uuccauggacauguggagc

SEQ ID NO: 973963 - RNA, 21 nt, Human
uuucugaagccagcucuccau

SEQ ID NO: 973964 - RNA, 22 nt, Human
ccaggcucgguaagggccgcgc

SEQ ID NO: 973965 - RNA, 22 nt, Human
cccccgggugggcggcucccgg

SEQ ID NO: 973966 - RNA, 25 nt, Human
cccccgggugggcggcucccgguuc

SEQ ID NO: 973967 - RNA, 18 nt, Human
cccuggggguccggagag

SEQ ID NO: 973968 - RNA, 18 nt, Human
cgacucccgcguuccccc

SEQ ID NO: 973969 - RNA, 19 nt, Human
cgcccaggcucgguaaggg

SEQ ID NO: 973970 - RNA, 22 nt, Human
cgcccccgggugggcggcuccc

SEQ ID NO: 973971 - RNA, 21 nt, Human
cggcucccgguuccuuuuccu

SEQ ID NO: 973972 - RNA, 23 nt, Human
cggcucgaacucuccagcgacgg

SEQ ID NO: 973973 - RNA, 18 nt, Human
cuaggacccugggggucc

SEQ ID NO: 973974 - RNA, 24 nt, Human
cuccagcgacggccgcgggguacc

SEQ ID NO: 973975 - RNA, 24 nt, Human
gcaaccggccggcuguucccaauc

SEQ ID NO: 973976 - RNA, 22 nt, Human
gcgcacaggugggcaccaagcc

SEQ ID NO: 973977 - RNA, 22 nt, Human
gcuaggacccuggggguccgga

SEQ ID NO: 973978 - RNA, 22 nt, Human
ggcggcgcgcacaggugggcac

SEQ ID NO: 973979 - RNA, 22 nt, Human
ggggacgggggcggccggcggc

SEQ ID NO: 973980 - RNA, 24 nt, Human
gggugggcggcucccgguuccuuu

SEQ ID NO: 973981 - RNA, 19 nt, Human
ucccccggcaaccggccgg

SEQ ID NO: 973982 - RNA, 19 nt, Human
ucuccagcgacggccgcgg

SEQ ID NO: 973983 - RNA, 22 nt, Human
ugggcggcucccgguuccuuuu

SEQ ID NO: 973984 - RNA, 22 nt, Human
uuccuccaagcucguccccggc

SEQ ID NO: 973985 - RNA, 20 nt, Human
uuuuuuuuuuuuaaagggcc

SEQ ID NO: 973986 - RNA, 21 nt, Human
uuuuuuuuuuuuuaaagggcc

SEQ ID NO: 973987 - RNA, 24 nt, Human
uuuuuuuuuuuuuuuuuuaaaggg

SEQ ID NO: 973988 - RNA, 19 nt, Human
aaaaaaaaaaaaaaugcaa

SEQ ID NO: 973989 - RNA, 21 nt, Human
aaaaaaaaaaaaaaugcaaua

SEQ ID NO: 973990 - RNA, 22 nt, Human
aaacaacaagacgcuugacuug

SEQ ID NO: 973991 - RNA, 21 nt, Human
aacagcuacguacaaaaaagu

SEQ ID NO: 973992 - RNA, 18 nt, Human
aagcagcaccaggagcgg

SEQ ID NO: 973993 - RNA, 25 nt, Human
aagcagcaccaggagcggcagaaga

SEQ ID NO: 973994 - RNA, 21 nt, Human
acaugugcuacccuauacccu

SEQ ID NO: 973995 - RNA, 22 nt, Human
agcaacaaaggcaaaaucagaa

SEQ ID NO: 973996 - RNA, 25 nt, Human
agcaccaggagcggcagaagaagga

SEQ ID NO: 973997 - RNA, 22 nt, Human
agcagcaccaggagcggcagaa

SEQ ID NO: 973998 - RNA, 22 nt, Human
aguuaaaaaaaaaaaaaaugca

SEQ ID NO: 973999 - RNA, 24 nt, Human
caaacgagcacacaagcagcacca

SEQ ID NO: 974000 - RNA, 18 nt, Human
caauaaaggaauggggaa

SEQ ID NO: 974001 - RNA, 20 nt, Human
cacaagcagcaccaggagcg

SEQ ID NO: 974002 - RNA, 24 nt, Human
cacaagcagcaccaggagcggcag

SEQ ID NO: 974003 - RNA, 25 nt, Human
cacagaaucaguauuuuuccccauc

SEQ ID NO: 974004 - RNA, 23 nt, Human
cagcaacaaaggcaaaaucagaa

SEQ ID NO: 974005 - RNA, 18 nt, Human
caggagcggcagaagaag

SEQ ID NO: 974006 - RNA, 23 nt, Human
caggagcggcagaagaaggaggc

SEQ ID NO: 974007 - RNA, 20 nt, Human
cagucugucagaaacaccaa

SEQ ID NO: 974008 - RNA, 18 nt, Human
caugccacuaauggagaa

SEQ ID NO: 974009 - RNA, 25 nt, Human
ccagguccgcaccaaacgagcacac

SEQ ID NO: 974010 - RNA, 19 nt, Human
cucagaauaaagaaaacag

SEQ ID NO: 974011 - RNA, 19 nt, Human
cuggaguaaagaagcaggu

SEQ ID NO: 974012 - RNA, 21 nt, Human
cuugaaauguuacuucuaagc

SEQ ID NO: 974013 - RNA, 20 nt, Human
gagaaaggggguauuuucac

SEQ ID NO: 974014 - RNA, 19 nt, Human
gagcaugccacuaauggag

SEQ ID NO: 974015 - RNA, 21 nt, Human
gaggcggcagcgguggacgag

SEQ ID NO: 974016 - RNA, 18 nt, Human
gaguaaagaagcagguuc

SEQ ID NO: 974017 - RNA, 21 nt, Human
gcagaagaaggaggcggcagc

SEQ ID NO: 974018 - RNA, 18 nt, Human
gcggcagcgguggacgag

SEQ ID NO: 974019 - RNA, 20 nt, Human
ggaaaacuaucuaggauucu

SEQ ID NO: 974020 - RNA, 21 nt, Human
ggaccuagagaaacuuuugga

SEQ ID NO: 974021 - RNA, 25 nt, Human
ggcuguuuaguuaaaaaaaaaaaaa

SEQ ID NO: 974022 - RNA, 23 nt, Human
gguauuuucacagaaucaguauu

SEQ ID NO: 974023 - RNA, 19 nt, Human
uaaaauucuccaauugaac

SEQ ID NO: 974024 - RNA, 19 nt, Human
uaagagcugaaugagcaug

SEQ ID NO: 974025 - RNA, 20 nt, Human
uaauauuucucagaauaaag

SEQ ID NO: 974026 - RNA, 21 nt, Human
uagagaaacuuuuggaacaag

SEQ ID NO: 974027 - RNA, 23 nt, Human
uaguagucaggaugugguggaac

SEQ ID NO: 974028 - RNA, 24 nt, Human
uauacagaaaauaccuggaaaucc

SEQ ID NO: 974029 - RNA, 25 nt, Human
ucaauuuucuauuuaauauuucuca

SEQ ID NO: 974030 - RNA, 20 nt, Human
ucagcaacaaaggcaaaauc

SEQ ID NO: 974031 - RNA, 21 nt, Human
ucagcugccgcuucacaaaag

SEQ ID NO: 974032 - RNA, 24 nt, Human
uccucagcugccgcuucacaaaag

SEQ ID NO: 974033 - RNA, 20 nt, Human
ucuggaguaaagaagcaggu

SEQ ID NO: 974034 - RNA, 20 nt, Human
ugcuacccuauacccuaugc

SEQ ID NO: 974035 - RNA, 19 nt, Human
uggggaagggggaaaugaa

SEQ ID NO: 974036 - RNA, 26 nt, Human
uucacagaaucaguauuuuuccccau

SEQ ID NO: 974037 - RNA, 23 nt, Human
uuucacagaaucaguauuuuucc

SEQ ID NO: 974038 - RNA, 22 nt, Human
uuuccuugccacaugugcuacc

SEQ ID NO: 974039 - RNA, 18 nt, Human
uuuuuuuuuuuuuuuuug

SEQ ID NO: 974040 - RNA, 26 nt, Human
aaagcuggcaaaaaaaaaaaaaagca

SEQ ID NO: 974041 - RNA, 19 nt, Human
agcuggcaaaaaaaaaaaa

SEQ ID NO: 974042 - RNA, 22 nt, Human
cucuccgggagcaggccccagc

SEQ ID NO: 974043 - RNA, 19 nt, Human
cuggcaaaaaaaaaaaaaa

SEQ ID NO: 974044 - RNA, 19 nt, Human
cuggcaaaaaaaaaaaaaa

SEQ ID NO: 974045 - RNA, 18 nt, Human
gcaaaaaaaaaaaaaagc

SEQ ID NO: 974046 - RNA, 24 nt, Human
ucuccgggagcaggccccagcucu

SEQ ID NO: 974047 - RNA, 27 nt, Human
ugaauaugcuucauuuaaguacaugcu

SEQ ID NO: 974048 - RNA, 26 nt, Human
aaacaggaguagugucaaaagggacc

SEQ ID NO: 974049 - RNA, 20 nt, Human
aaaggggcaauguuaaaagg

SEQ ID NO: 974050 - RNA, 22 nt, Human
aaagguaacuguucuauaagga

SEQ ID NO: 974051 - RNA, 20 nt, Human
aaagucucccaaggaaacac

SEQ ID NO: 974052 - RNA, 22 nt, Human
aagaaauccaaaaagaguaaaa

SEQ ID NO: 974053 - RNA, 21 nt, Human
aaggauggguagguauccugg

SEQ ID NO: 974054 - RNA, 23 nt, Human
agaaagcaggaaucaggagggcc

SEQ ID NO: 974055 - RNA, 23 nt, Human
agaauacguuucccagcgaccag

SEQ ID NO: 974056 - RNA, 23 nt, Human
agccaggucuucugacuugcacu

SEQ ID NO: 974057 - RNA, 23 nt, Human
agcgaccagggugcacagaagga

SEQ ID NO: 974058 - RNA, 20 nt, Human
aggaaucaggagggcaaaca

SEQ ID NO: 974059 - RNA, 20 nt, Human
aggagggcaaacaggaguag

SEQ ID NO: 974060 - RNA, 19 nt, Human
agggcaaacaggaguagug

SEQ ID NO: 974061 - RNA, 22 nt, Human
caaucaaaaaguuccaaguuuc

SEQ ID NO: 974062 - RNA, 22 nt, Human
cacagaaggaccuuuugcucca

SEQ ID NO: 974063 - RNA, 21 nt, Human
cacucuuaauuucauguccca

SEQ ID NO: 974064 - RNA, 22 nt, Human
cacuggauuuuuccucugaucc

SEQ ID NO: 974065 - RNA, 19 nt, Human
cagggugcacagaaggacc

SEQ ID NO: 974066 - RNA, 27 nt, Human
ccaaaaagaguaaaauguaggccaggc

SEQ ID NO: 974067 - RNA, 21 nt, Human
cugaggcauagagagguuuau

SEQ ID NO: 974068 - RNA, 22 nt, Human
cugcagauucccuacaaagugg

SEQ ID NO: 974069 - RNA, 19 nt, Human
cugcagccucccauaagaa

SEQ ID NO: 974070 - RNA, 19 nt, Human
cuuuugcuccaguccagga

SEQ ID NO: 974071 - RNA, 24 nt, Human
gaaugugucccaugcaaggcccca

SEQ ID NO: 974072 - RNA, 24 nt, Human
gaguagugucaaaacugccauggc

SEQ ID NO: 974073 - RNA, 25 nt, Human
gucacacuggauuuuuccucugauc

SEQ ID NO: 974074 - RNA, 19 nt, Human
gucccaugcuuugucuugg

SEQ ID NO: 974075 - RNA, 22 nt, Human
uaaucugcugguccagcucccc

SEQ ID NO: 974076 - RNA, 21 nt, Human
ucacacuggauuuuuccucug

SEQ ID NO: 974077 - RNA, 22 nt, Human
ucccagcgaccagggugcacag

SEQ ID NO: 974078 - RNA, 22 nt, Human
ucccuacaaagugggguccccu

SEQ ID NO: 974079 - RNA, 20 nt, Human
ucuguaagcucauaaucugc

SEQ ID NO: 974080 - RNA, 24 nt, Human
ugaaaagccaggucuucugacuug

SEQ ID NO: 974081 - RNA, 24 nt, Human
ugaggaagaaauccaaaaagagua

SEQ ID NO: 974082 - RNA, 22 nt, Human
uggcaagauauuuccucugaaa

SEQ ID NO: 974083 - RNA, 23 nt, Human
ugucacacuggauuuuuccucug

SEQ ID NO: 974084 - RNA, 18 nt, Human
ugucacaugacaggcacu

SEQ ID NO: 974085 - RNA, 21 nt, Human
ugucacaugacaggcacugca

SEQ ID NO: 974086 - RNA, 24 nt, Human
ugucccaugcaaggccccaagggc

SEQ ID NO: 974087 - RNA, 23 nt, Human
ugucuuggucccugugaggaaag

SEQ ID NO: 974088 - RNA, 24 nt, Human
uuaaaagguaaagaaagcaggaau

SEQ ID NO: 974089 - RNA, 24 nt, Human
uuagaaguuacugucuagggcacu

SEQ ID NO: 974090 - RNA, 18 nt, Human
uugcacucugucacacug

SEQ ID NO: 974091 - RNA, 25 nt, Human
caccacagcggccggggcuggggcc

SEQ ID NO: 974092 - RNA, 23 nt, Human
ccggcggcgggggcggcgggggc

SEQ ID NO: 974093 - RNA, 21 nt, Human
cgacggcgaggcgcggcggag

SEQ ID NO: 974094 - RNA, 20 nt, Human
cgccucggccgccacggccg

SEQ ID NO: 974095 - RNA, 22 nt, Human
cggcgaggcgcggcggagucac

SEQ ID NO: 974096 - RNA, 18 nt, Human
cggggcuggggcccgagc

SEQ ID NO: 974097 - RNA, 19 nt, Human
gccucggccgccacggccg

SEQ ID NO: 974098 - RNA, 18 nt, Human
gcgggggcggcgggcggc

SEQ ID NO: 974099 - RNA, 18 nt, Human
ggccggggcuggggcccg

SEQ ID NO: 974100 - RNA, 19 nt, Human
ggcggcgggggcggcgggc

SEQ ID NO: 974101 - RNA, 18 nt, Human
gggcggcacgggggcgac

SEQ ID NO: 974102 - RNA, 20 nt, Human
gggggcggcgggggcggcgg

SEQ ID NO: 974103 - RNA, 22 nt, Human
gggggcggcgggggcggcgggc

SEQ ID NO: 974104 - RNA, 19 nt, Human
aaacagaaggaggagcccc

SEQ ID NO: 974105 - RNA, 20 nt, Human
aaacagaaggaggagcccca

SEQ ID NO: 974106 - RNA, 19 nt, Human
aaacgcccaagauaugcag

SEQ ID NO: 974107 - RNA, 20 nt, Human
aaaggucacaugggccagug

SEQ ID NO: 974108 - RNA, 23 nt, Human
aaauggcaaaggucacaugggcc

SEQ ID NO: 974109 - RNA, 19 nt, Human
aacaaaagagcaagauggc

SEQ ID NO: 974110 - RNA, 21 nt, Human
aagaaccagaaacaauuacag

SEQ ID NO: 974111 - RNA, 19 nt, Human
aagacaagggccuuguggc

SEQ ID NO: 974112 - RNA, 22 nt, Human
aagcagccuuuuugcugaaagc

SEQ ID NO: 974113 - RNA, 22 nt, Human
aagggccuuguggcuccaacua

SEQ ID NO: 974114 - RNA, 18 nt, Human
aaguuaccuugcaagaag

SEQ ID NO: 974115 - RNA, 18 nt, Human
acguggggaagaggggcu

SEQ ID NO: 974116 - RNA, 18 nt, Human
acuuguggagguuuccuu

SEQ ID NO: 974117 - RNA, 18 nt, Human
agaaauagaggcucaugg

SEQ ID NO: 974118 - RNA, 22 nt, Human
agaaaugcaacucuucuuauuc

SEQ ID NO: 974119 - RNA, 21 nt, Human
agaaggaggagccccacugcc

SEQ ID NO: 974120 - RNA, 18 nt, Human
agaaucccugagguggcu

SEQ ID NO: 974121 - RNA, 22 nt, Human
agaaucccugagguggcuggaa

SEQ ID NO: 974122 - RNA, 22 nt, Human
agcaaaaaugucuuaagaccua

SEQ ID NO: 974123 - RNA, 21 nt, Human
aggaagaccauugugcagcug

SEQ ID NO: 974124 - RNA, 20 nt, Human
aggauggggggcuggaggga

SEQ ID NO: 974125 - RNA, 19 nt, Human
aggcacuguuauuuuaagu

SEQ ID NO: 974126 - RNA, 21 nt, Human
aguaaguggaaccgugcacaa

SEQ ID NO: 974127 - RNA, 22 nt, Human
auggggggcuggagggaagcgg

SEQ ID NO: 974128 - RNA, 27 nt, Human
augugcucagagugugugugugugugu

SEQ ID NO: 974129 - RNA, 22 nt, Human
auugugcagcugcaucugugca

SEQ ID NO: 974130 - RNA, 22 nt, Human
caacaaaagagcaagauggcac

SEQ ID NO: 974131 - RNA, 23 nt, Human
caacaaaagagcaagauggcaca

SEQ ID NO: 974132 - RNA, 22 nt, Human
cacaauagaguggaaauccguc

SEQ ID NO: 974133 - RNA, 19 nt, Human
caccaaacgacuggcucac

SEQ ID NO: 974134 - RNA, 18 nt, Human
cagaaggaggagccccac

SEQ ID NO: 974135 - RNA, 19 nt, Human
cagaaucccugagguggcu

SEQ ID NO: 974136 - RNA, 24 nt, Human
cagacaaaaacucuaauaagcauu

SEQ ID NO: 974137 - RNA, 20 nt, Human
caggagacccccgguaccaa

SEQ ID NO: 974138 - RNA, 18 nt, Human
ccacugccgccgccgucc

SEQ ID NO: 974139 - RNA, 21 nt, Human
ccccacugccgccgccgucca

SEQ ID NO: 974140 - RNA, 21 nt, Human
ccccgcccgccgaccccgcgg

SEQ ID NO: 974141 - RNA, 19 nt, Human
ccuaaacaaagguguggga

SEQ ID NO: 974142 - RNA, 22 nt, Human
ccuaggaaaaugugggacaaac

SEQ ID NO: 974143 - RNA, 24 nt, Human
cgagccaguggaagaccuguugca

SEQ ID NO: 974144 - RNA, 19 nt, Human
cgcagugagcagugcuggu

SEQ ID NO: 974145 - RNA, 23 nt, Human
cgccgaccccgcggucgucgcgc

SEQ ID NO: 974146 - RNA, 22 nt, Human
cggucugggaaacagaaggagg

SEQ ID NO: 974147 - RNA, 22 nt, Human
cguccagggccucgccccgccc

SEQ ID NO: 974148 - RNA, 24 nt, Human
cucucggucugggaaacagaagga

SEQ ID NO: 974149 - RNA, 19 nt, Human
cugccaacaaaagagcaag

SEQ ID NO: 974150 - RNA, 21 nt, Human
cugugcaauacuccauuccca

SEQ ID NO: 974151 - RNA, 28 nt, Human
gaaacaauuacaguaaguggaaccgugc

SEQ ID NO: 974152 - RNA, 23 nt, Human
gccgccgccguccagggccucgg

SEQ ID NO: 974153 - RNA, 25 nt, Human
gccuuguggcuccaacuauuuuguu

SEQ ID NO: 974154 - RNA, 22 nt, Human
gcggggacaucugccaacaaaa

SEQ ID NO: 974155 - RNA, 19 nt, Human
ggaaacagaaggaggagcc

SEQ ID NO: 974156 - RNA, 23 nt, Human
ggaaauggcaaaggucacauggg

SEQ ID NO: 974157 - RNA, 24 nt, Human
ggaaguacugggaaauggcaaagg

SEQ ID NO: 974158 - RNA, 19 nt, Human
gggaaauggcaaaggucac

SEQ ID NO: 974159 - RNA, 21 nt, Human
gugugugugugugugugugag

SEQ ID NO: 974160 - RNA, 20 nt, Human
gugugugugugugugugugu

SEQ ID NO: 974161 - RNA, 21 nt, Human
gugugugugugugugugugug

SEQ ID NO: 974162 - RNA, 23 nt, Human
uaaacaaaugucuaguucgauaa

SEQ ID NO: 974163 - RNA, 20 nt, Human
uaaugccgagcucaucuaau

SEQ ID NO: 974164 - RNA, 22 nt, Human
uacauggaagguguuagaggaa

SEQ ID NO: 974165 - RNA, 19 nt, Human
uagagugccaguccuaaaa

SEQ ID NO: 974166 - RNA, 21 nt, Human
uagaguggaaauccgucuguc

SEQ ID NO: 974167 - RNA, 18 nt, Human
uauuuuguuggauguacc

SEQ ID NO: 974168 - RNA, 23 nt, Human
uauuuuguuuuuuuaaaaagaca

SEQ ID NO: 974169 - RNA, 23 nt, Human
ucacccaauuccccacacauuuc

SEQ ID NO: 974170 - RNA, 22 nt, Human
ucagacaaaaacucuaauaagc

SEQ ID NO: 974171 - RNA, 23 nt, Human
ucagacaaaaacucuaauaagca

SEQ ID NO: 974172 - RNA, 27 nt, Human
ucagcgucauuuauagagugccagucc

SEQ ID NO: 974173 - RNA, 18 nt, Human
ucagucacuuucaccauc

SEQ ID NO: 974174 - RNA, 19 nt, Human
uccuucuauacaaagucag

SEQ ID NO: 974175 - RNA, 22 nt, Human
ugaguguuauguuuaaaauuuc

SEQ ID NO: 974176 - RNA, 24 nt, Human
ugaugcuucugcaugauuucuuuu

SEQ ID NO: 974177 - RNA, 18 nt, Human
ugcuggaagaacuuggug

SEQ ID NO: 974178 - RNA, 18 nt, Human
ugggaaggacccuccucc

SEQ ID NO: 974179 - RNA, 18 nt, Human
ugggaggaugaaagaauc

SEQ ID NO: 974180 - RNA, 20 nt, Human
uggugugaagcccuccuacu

SEQ ID NO: 974181 - RNA, 18 nt, Human
uguaaagggaaguacugg

SEQ ID NO: 974182 - RNA, 33 nt, Human
ugugcucagaguguguguguguguguguguggu

SEQ ID NO: 974183 - RNA, 21 nt, Human
uguggagguuuccuuugcuuu

SEQ ID NO: 974184 - RNA, 19 nt, Human
ugugugugugugugugaau

SEQ ID NO: 974185 - RNA, 18 nt, Human
ugugugugugugugugug

SEQ ID NO: 974186 - RNA, 18 nt, Human
ugugugugugugugugug

SEQ ID NO: 974187 - RNA, 18 nt, Human
ugugugugugugugugug

SEQ ID NO: 974188 - RNA, 18 nt, Human
ugugugugugugugugug

SEQ ID NO: 974189 - RNA, 18 nt, Human
ugugugugugugugugug

SEQ ID NO: 974190 - RNA, 18 nt, Human
ugugugugugugugugug

SEQ ID NO: 974191 - RNA, 18 nt, Human
ugugugugugugugugug

SEQ ID NO: 974192 - RNA, 18 nt, Human
ugugugugugugugugug

SEQ ID NO: 974193 - RNA, 18 nt, Human
ugugugugugugugugug

SEQ ID NO: 974194 - RNA, 18 nt, Human
ugugugugugugugugug

SEQ ID NO: 974195 - RNA, 18 nt, Human
ugugugugugugugugug

SEQ ID NO: 974196 - RNA, 20 nt, Human
ugugugugugugugugugug

SEQ ID NO: 974197 - RNA, 21 nt, Human
ugugugugugugugugugugu

SEQ ID NO: 974198 - RNA, 21 nt, Human
ugugugugugugugugugugu

SEQ ID NO: 974199 - RNA, 21 nt, Human
ugugugugugugugugugugu

SEQ ID NO: 974200 - RNA, 21 nt, Human
ugugugugugugugugugugu

SEQ ID NO: 974201 - RNA, 21 nt, Human
ugugugugugugugugugugu

SEQ ID NO: 974202 - RNA, 21 nt, Human
ugugugugugugugugugugu

SEQ ID NO: 974203 - RNA, 21 nt, Human
ugugugugugugugugugugu

SEQ ID NO: 974204 - RNA, 21 nt, Human
ugugugugugugugugugugu

SEQ ID NO: 974205 - RNA, 21 nt, Human
ugugugugugugugugugugu

SEQ ID NO: 974206 - RNA, 21 nt, Human
ugugugugugugugugugugu

SEQ ID NO: 974207 - RNA, 21 nt, Human
ugugugugugugugugugugu

SEQ ID NO: 974208 - RNA, 21 nt, Human
ugugugugugugugugugugu

SEQ ID NO: 974209 - RNA, 21 nt, Human
ugugugugugugugugugugu

SEQ ID NO: 974210 - RNA, 21 nt, Human
ugugugugugugugugugugu

SEQ ID NO: 974211 - RNA, 21 nt, Human
ugugugugugugugugugugu

SEQ ID NO: 974212 - RNA, 21 nt, Human
ugugugugugugugugugugu

SEQ ID NO: 974213 - RNA, 21 nt, Human
ugugugugugugugugugugu

SEQ ID NO: 974214 - RNA, 21 nt, Human
ugugugugugugugugugugu

SEQ ID NO: 974215 - RNA, 21 nt, Human
ugugugugugugugugugugu

SEQ ID NO: 974216 - RNA, 22 nt, Human
ugugugugugugugugugugug

SEQ ID NO: 974217 - RNA, 22 nt, Human
ugugugugugugugugugugug

SEQ ID NO: 974218 - RNA, 22 nt, Human
ugugugugugugugugugugug

SEQ ID NO: 974219 - RNA, 22 nt, Human
ugugugugugugugugugugug

SEQ ID NO: 974220 - RNA, 22 nt, Human
ugugugugugugugugugugug

SEQ ID NO: 974221 - RNA, 22 nt, Human
ugugugugugugugugugugug

SEQ ID NO: 974222 - RNA, 22 nt, Human
ugugugugugugugugugugug

SEQ ID NO: 974223 - RNA, 22 nt, Human
ugugugugugugugugugugug

SEQ ID NO: 974224 - RNA, 22 nt, Human
ugugugugugugugugugugug

SEQ ID NO: 974225 - RNA, 23 nt, Human
uguguguguguguguguguguug

SEQ ID NO: 974226 - RNA, 21 nt, Human
uuaaaaucagucacuuucacc

SEQ ID NO: 974227 - RNA, 24 nt, Human
uuccaggagucgcagugagcagug

SEQ ID NO: 974228 - RNA, 18 nt, Human
uuuaaucaggcccucaca

SEQ ID NO: 974229 - RNA, 21 nt, Human
uuucccauucuaacacugauc

SEQ ID NO: 974230 - RNA, 18 nt, Human
aaacacacaaagaaacac

SEQ ID NO: 974231 - RNA, 22 nt, Human
aaacacacaaagaaacacuaaa

SEQ ID NO: 974232 - RNA, 22 nt, Human
aaacugaaauacaaagaaagcc

SEQ ID NO: 974233 - RNA, 23 nt, Human
aaacugaaauacaaagaaagcca

SEQ ID NO: 974234 - RNA, 19 nt, Human
aaagauacaauucucugaa

SEQ ID NO: 974235 - RNA, 19 nt, Human
aacaaaaccuacuuugagc

SEQ ID NO: 974236 - RNA, 22 nt, Human
aaccacuuuuaaaugguaccau

SEQ ID NO: 974237 - RNA, 18 nt, Human
acaauuucaagaguaggg

SEQ ID NO: 974238 - RNA, 18 nt, Human
acagaagaaaagauaauu

SEQ ID NO: 974239 - RNA, 27 nt, Human
acagacaguaugacaacaaauuaaaac

SEQ ID NO: 974240 - RNA, 25 nt, Human
acaguaaaagauacaauucucugaa

SEQ ID NO: 974241 - RNA, 23 nt, Human
acugaaauacaaagaaagccagu

SEQ ID NO: 974242 - RNA, 18 nt, Human
acuggguuuuuaaacuga

SEQ ID NO: 974243 - RNA, 21 nt, Human
agaacacuagucuacaaaaca

SEQ ID NO: 974244 - RNA, 21 nt, Human
agauguacuaaaaacccacag

SEQ ID NO: 974245 - RNA, 22 nt, Human
agcccuggccgggccccgcucc

SEQ ID NO: 974246 - RNA, 19 nt, Human
agguagcuucaaagagaag

SEQ ID NO: 974247 - RNA, 18 nt, Human
agguguuuauugcaucuc

SEQ ID NO: 974248 - RNA, 22 nt, Human
agguguuuauugcaucucagag

SEQ ID NO: 974249 - RNA, 19 nt, Human
augacacaaacagacccuu

SEQ ID NO: 974250 - RNA, 21 nt, Human
auggaagaacacuagucuaca

SEQ ID NO: 974251 - RNA, 18 nt, Human
auucagucacaaauauug

SEQ ID NO: 974252 - RNA, 19 nt, Human
auuuaugaguguuuuccuu

SEQ ID NO: 974253 - RNA, 22 nt, Human
caaaaaagcacuaacggcauca

SEQ ID NO: 974254 - RNA, 21 nt, Human
caagguguuuauugcaucuca

SEQ ID NO: 974255 - RNA, 21 nt, Human
cacaaauaauccaaauacacu

SEQ ID NO: 974256 - RNA, 23 nt, Human
cacacaaagaaacacuaaauuaa

SEQ ID NO: 974257 - RNA, 21 nt, Human
cacacugaaaaaguuuuguau

SEQ ID NO: 974258 - RNA, 24 nt, Human
cacuaaauuaacagauguacuaaa

SEQ ID NO: 974259 - RNA, 22 nt, Human
caguaugacaacaaauuaaaac

SEQ ID NO: 974260 - RNA, 21 nt, Human
cauuuaugcaucaaaaucuua

SEQ ID NO: 974261 - RNA, 24 nt, Human
ccaaaaaagcacuaacggcaucag

SEQ ID NO: 974262 - RNA, 25 nt, Human
ccauacaucuauuaaauaauuugaa

SEQ ID NO: 974263 - RNA, 21 nt, Human
ccauucauuguuuacaucgua

SEQ ID NO: 974264 - RNA, 20 nt, Human
ccccagaagccaguacccgc

SEQ ID NO: 974265 - RNA, 21 nt, Human
ccccagaagccaguacccgcc

SEQ ID NO: 974266 - RNA, 22 nt, Human
ccccagaagccaguacccgccc

SEQ ID NO: 974267 - RNA, 21 nt, Human
cccccgggcgcaaagucucca

SEQ ID NO: 974268 - RNA, 21 nt, Human
ccccgcuccucagcuccgcgg

SEQ ID NO: 974269 - RNA, 20 nt, Human
ccccugagcggcgccgcccg

SEQ ID NO: 974270 - RNA, 23 nt, Human
ccccuggccccagaagccaguac

SEQ ID NO: 974271 - RNA, 22 nt, Human
cccuggccgggccccgcuccuc

SEQ ID NO: 974272 - RNA, 22 nt, Human
ccgcgcgcagccccggugcccc

SEQ ID NO: 974273 - RNA, 20 nt, Human
ccgcggucccggcgcccacc

SEQ ID NO: 974274 - RNA, 19 nt, Human
ccggcgcccaccgccccug

SEQ ID NO: 974275 - RNA, 25 nt, Human
ccggugcccccgggcgcaaagucuc

SEQ ID NO: 974276 - RNA, 18 nt, Human
ccucagcuccgcgguccc

SEQ ID NO: 974277 - RNA, 20 nt, Human
ccucagcuccgcggucccgg

SEQ ID NO: 974278 - RNA, 22 nt, Human
ccuggccccuggccccagaagc

SEQ ID NO: 974279 - RNA, 19 nt, Human
ccuucaaaaacacagacgu

SEQ ID NO: 974280 - RNA, 18 nt, Human
cgaccgcgcgcagccccg

SEQ ID NO: 974281 - RNA, 22 nt, Human
cggcgcccaccgccccuggccc

SEQ ID NO: 974282 - RNA, 26 nt, Human
cuccgcggucccggcgcccaccgccc

SEQ ID NO: 974283 - RNA, 21 nt, Human
cugagcggcgccgcccgccgc

SEQ ID NO: 974284 - RNA, 24 nt, Human
cuuaacauauacagugccacaaaa

SEQ ID NO: 974285 - RNA, 18 nt, Human
gagcggagcccgggccgc

SEQ ID NO: 974286 - RNA, 22 nt, Human
ggccccuggccccagaagccag

SEQ ID NO: 974287 - RNA, 19 nt, Human
guaaauucagauacaacca

SEQ ID NO: 974288 - RNA, 22 nt, Human
gugaaguccaaaaaagcacuaa

SEQ ID NO: 974289 - RNA, 21 nt, Human
guugaaggauggaagaacacu

SEQ ID NO: 974290 - RNA, 21 nt, Human
uaacagagauacagaagaaaa

SEQ ID NO: 974291 - RNA, 22 nt, Human
uaacagauguacuaaaaaccca

SEQ ID NO: 974292 - RNA, 24 nt, Human
uaacagauguacuaaaaacccaca

SEQ ID NO: 974293 - RNA, 22 nt, Human
uaagguagcuucaaagagaagu

SEQ ID NO: 974294 - RNA, 19 nt, Human
uacaaaacacacaaagaaa

SEQ ID NO: 974295 - RNA, 22 nt, Human
uacaaaacacacaaagaaacac

SEQ ID NO: 974296 - RNA, 23 nt, Human
uacauugaaaccuucaaaaacac

SEQ ID NO: 974297 - RNA, 19 nt, Human
uauucagucacaaauauug

SEQ ID NO: 974298 - RNA, 22 nt, Human
ucagcuccgcggucccggcgcc

SEQ ID NO: 974299 - RNA, 24 nt, Human
ucaggugaaguccaaaaaagcacu

SEQ ID NO: 974300 - RNA, 23 nt, Human
ucagucacaaauauugcagcuua

SEQ ID NO: 974301 - RNA, 30 nt, Human
ucgcgucuaccgccuccucuucccgccccu

SEQ ID NO: 974302 - RNA, 25 nt, Human
ugaaaaauaggcaaacaccuuucca

SEQ ID NO: 974303 - RNA, 24 nt, Human
ugaauaaauaggucaauuuagaug

SEQ ID NO: 974304 - RNA, 23 nt, Human
ugccacaaaaauaaacauuucuc

SEQ ID NO: 974305 - RNA, 25 nt, Human
ugcgaccgcgcgcagccccggugcc

SEQ ID NO: 974306 - RNA, 19 nt, Human
uggaagaacacuagucuac

SEQ ID NO: 974307 - RNA, 21 nt, Human
uggccccuggccccagaagcc

SEQ ID NO: 974308 - RNA, 28 nt, Human
uggccccuggccccagaagccaguaccc

SEQ ID NO: 974309 - RNA, 22 nt, Human
uguaacagagauacagaagaaa

SEQ ID NO: 974310 - RNA, 25 nt, Human
uuaaagaauacaguauguacaguaa

SEQ ID NO: 974311 - RNA, 20 nt, Human
uuaacagauguacuaaaaac

SEQ ID NO: 974312 - RNA, 18 nt, Human
uuccaaauagcucgccac

SEQ ID NO: 974313 - RNA, 22 nt, Human
uucuguggucgcgucuaccgcc

SEQ ID NO: 974314 - RNA, 19 nt, Human
uuguucaagguguuuauug

SEQ ID NO: 974315 - RNA, 23 nt, Human
uuucacggcuguguuacacauuu

SEQ ID NO: 974316 - RNA, 25 nt, Human
uuugaagucuccaaacucauuuauu

SEQ ID NO: 974317 - RNA, 27 nt, Human
uuuuucguucuugauaagguagcuuca

SEQ ID NO: 974318 - RNA, 21 nt, Human
aaaaacaguugagccaacaac

SEQ ID NO: 974319 - RNA, 19 nt, Human
aaaaugcugggauuacagg

SEQ ID NO: 974320 - RNA, 21 nt, Human
aaaaugcugggauuacaggca

SEQ ID NO: 974321 - RNA, 23 nt, Human
aaaaugcugggauuacaggcaug

SEQ ID NO: 974322 - RNA, 24 nt, Human
aaaaugcugggauuacaggcaugc

SEQ ID NO: 974323 - RNA, 22 nt, Human
aaaauuaaaaacuacaccaggc

SEQ ID NO: 974324 - RNA, 18 nt, Human
aaagaauauuuaauugcg

SEQ ID NO: 974325 - RNA, 19 nt, Human
aaaugcugggauuacaggc

SEQ ID NO: 974326 - RNA, 18 nt, Human
aacagaguggcauauuca

SEQ ID NO: 974327 - RNA, 20 nt, Human
aacauagcgauacuccaucu

SEQ ID NO: 974328 - RNA, 20 nt, Human
aauaucaacuauucuguacc

SEQ ID NO: 974329 - RNA, 19 nt, Human
acaggcgcccgccaccacg

SEQ ID NO: 974330 - RNA, 19 nt, Human
acgggguuucacuguguua

SEQ ID NO: 974331 - RNA, 20 nt, Human
acgggguuucacuguguuag

SEQ ID NO: 974332 - RNA, 21 nt, Human
acgggguuucacuguguuagu

SEQ ID NO: 974333 - RNA, 25 nt, Human
acucuguugcccaggcuggagugca

SEQ ID NO: 974334 - RNA, 18 nt, Human
acuggguucacaccauuc

SEQ ID NO: 974335 - RNA, 24 nt, Human
acuguguuagucacgauggucucg

SEQ ID NO: 974336 - RNA, 20 nt, Human
agaaaguacuuaaauacuua

SEQ ID NO: 974337 - RNA, 24 nt, Human
agccugagcaacauagcgauacuc

SEQ ID NO: 974338 - RNA, 23 nt, Human
aggaguucaagaccagccugagc

SEQ ID NO: 974339 - RNA, 18 nt, Human
aggcaggaggauagcuug

SEQ ID NO: 974340 - RNA, 24 nt, Human
aggcaggaggauagcuugagccca

SEQ ID NO: 974341 - RNA, 27 nt, Human
aggcaggaggauagcuugagcccagga

SEQ ID NO: 974342 - RNA, 24 nt, Human
aggcugaggcaggaggauagcuug

SEQ ID NO: 974343 - RNA, 25 nt, Human
aggcuggagugcaguggcacgaucu

SEQ ID NO: 974344 - RNA, 22 nt, Human
aggcuggguacaguagcucaca

SEQ ID NO: 974345 - RNA, 26 nt, Human
aguaauaauaaacaagcacuaaagaa

SEQ ID NO: 974346 - RNA, 24 nt, Human
aguacuuugggaggcugaggcagg

SEQ ID NO: 974347 - RNA, 24 nt, Human
aguagcucacaccuauaaucccag

SEQ ID NO: 974348 - RNA, 18 nt, Human
aguagcugggauuacagg

SEQ ID NO: 974349 - RNA, 20 nt, Human
agugcaguggcacgaucucg

SEQ ID NO: 974350 - RNA, 23 nt, Human
agugcaguggcacgaucucggcu

SEQ ID NO: 974351 - RNA, 24 nt, Human
agugcaguggcacgaucucggcuc

SEQ ID NO: 974352 - RNA, 20 nt, Human
auuaaaaacuacaccaggcu

SEQ ID NO: 974353 - RNA, 19 nt, Human
auuauccgacuguagauac

SEQ ID NO: 974354 - RNA, 24 nt, Human
caaaaugcugggauuacaggcaug

SEQ ID NO: 974355 - RNA, 23 nt, Human
caacccaaacuuuuuuuuuuuuu

SEQ ID NO: 974356 - RNA, 19 nt, Human
caagaaauaaccuacagau

SEQ ID NO: 974357 - RNA, 22 nt, Human
cacaccauucuccugccucagc

SEQ ID NO: 974358 - RNA, 24 nt, Human
cacaccuauaaucccaguacuuug

SEQ ID NO: 974359 - RNA, 19 nt, Human
caccuauaaucccaguacu

SEQ ID NO: 974360 - RNA, 24 nt, Human
caccuauaaucccaguacuuuggg

SEQ ID NO: 974361 - RNA, 24 nt, Human
caccucggccucccaaaaugcugg

SEQ ID NO: 974362 - RNA, 24 nt, Human
cacucuguugcccaggcuggagug

SEQ ID NO: 974363 - RNA, 24 nt, Human
cacuguguuagucacgauggucuc

SEQ ID NO: 974364 - RNA, 21 nt, Human
caggcgcccgccaccacgccu

SEQ ID NO: 974365 - RNA, 24 nt, Human
caguacuuugggaggcugaggcag

SEQ ID NO: 974366 - RNA, 25 nt, Human
caguacuuugggaggcugaggcagg

SEQ ID NO: 974367 - RNA, 26 nt, Human
caucucuauuagggaaaaaaaaaaaa

SEQ ID NO: 974368 - RNA, 23 nt, Human
ccaaaaugcugggauuacaggca

SEQ ID NO: 974369 - RNA, 24 nt, Human
ccaaaaugcugggauuacaggcau

SEQ ID NO: 974370 - RNA, 22 nt, Human
ccaugcuggaaaacagcaugaa

SEQ ID NO: 974371 - RNA, 24 nt, Human
cccaaaaugcugggauuacaggca

SEQ ID NO: 974372 - RNA, 24 nt, Human
cccaaacuuuaaaucccuuaauaa

SEQ ID NO: 974373 - RNA, 19 nt, Human
cccaggcuggagugcagug

SEQ ID NO: 974374 - RNA, 23 nt, Human
cccgaguagcugggauuacaggc

SEQ ID NO: 974375 - RNA, 24 nt, Human
cccgaguagcugggauuacaggcg

SEQ ID NO: 974376 - RNA, 22 nt, Human
ccgaguagcugggauuacaggc

SEQ ID NO: 974377 - RNA, 22 nt, Human
cgcccaccucggccucccaaaa

SEQ ID NO: 974378 - RNA, 22 nt, Human
cucacaccuauaaucccaguac

SEQ ID NO: 974379 - RNA, 24 nt, Human
cucacaccuauaaucccaguacuu

SEQ ID NO: 974380 - RNA, 24 nt, Human
cucacucuguugcccaggcuggag

SEQ ID NO: 974381 - RNA, 24 nt, Human
cucagcuucccgaguagcugggau

SEQ ID NO: 974382 - RNA, 22 nt, Human
cuccugaccucgugauccgccc

SEQ ID NO: 974383 - RNA, 23 nt, Human
cugccucagcuucccgaguagcu

SEQ ID NO: 974384 - RNA, 20 nt, Human
cuugagcccaggaguucaag

SEQ ID NO: 974385 - RNA, 18 nt, Human
cuuuuuuuuuuuuuuuug

SEQ ID NO: 974386 - RNA, 22 nt, Human
gaccucgugauccgcccaccuc

SEQ ID NO: 974387 - RNA, 22 nt, Human
gaccucgugauccgcccaccuc

SEQ ID NO: 974388 - RNA, 24 nt, Human
gaccucgugauccgcccaccucgg

SEQ ID NO: 974389 - RNA, 25 nt, Human
gaguagcugggauuacaggcgcccg

SEQ ID NO: 974390 - RNA, 18 nt, Human
gauuacaggcgcccgcca

SEQ ID NO: 974391 - RNA, 22 nt, Human
gcccaggaguucaagaccagcc

SEQ ID NO: 974392 - RNA, 19 nt, Human
gcccaggcuggagugcagu

SEQ ID NO: 974393 - RNA, 24 nt, Human
gccucagcuucccgaguagcuggg

SEQ ID NO: 974394 - RNA, 19 nt, Human
gcuggagugcaguggcacg

SEQ ID NO: 974395 - RNA, 22 nt, Human
ggaaaaaaaaaaaacaguugag

SEQ ID NO: 974396 - RNA, 19 nt, Human
ggaaaacagcaugaaguau

SEQ ID NO: 974397 - RNA, 22 nt, Human
gggaaaaaaaaaaaacaguuga

SEQ ID NO: 974398 - RNA, 18 nt, Human
guagcugggauuacaggc

SEQ ID NO: 974399 - RNA, 24 nt, Human
gugauccgcccaccucggccuccc

SEQ ID NO: 974400 - RNA, 20 nt, Human
uaaaaaauaaagcaaggcaa

SEQ ID NO: 974401 - RNA, 21 nt, Human
uaaacaagcacuaaagaauau

SEQ ID NO: 974402 - RNA, 23 nt, Human
uaaauauacaaaauaaaaaaucc

SEQ ID NO: 974403 - RNA, 24 nt, Human
uaauuuuucguauuuuuauuagag

SEQ ID NO: 974404 - RNA, 25 nt, Human
uaauuuuucguauuuuuauuagaga

SEQ ID NO: 974405 - RNA, 18 nt, Human
uaauuuuuuguacuuuua

SEQ ID NO: 974406 - RNA, 22 nt, Human
uacaggcgcccgccaccacgcc

SEQ ID NO: 974407 - RNA, 23 nt, Human
uacauugugaacuuccuaaguua

SEQ ID NO: 974408 - RNA, 22 nt, Human
uagagacgggguuucacugugu

SEQ ID NO: 974409 - RNA, 22 nt, Human
uagcucacaccuauaaucccag

SEQ ID NO: 974410 - RNA, 24 nt, Human
uauaguaucacaaaaccuuauagg

SEQ ID NO: 974411 - RNA, 25 nt, Human
uauuagaaaguacuuaaauacuuaa

SEQ ID NO: 974412 - RNA, 22 nt, Human
uauuagagacgggguuucacug

SEQ ID NO: 974413 - RNA, 24 nt, Human
uauuagagacgggguuucacugug

SEQ ID NO: 974414 - RNA, 23 nt, Human
ucaacugugaaacagguuaaggc

SEQ ID NO: 974415 - RNA, 21 nt, Human
ucacaccauucuccugccuca

SEQ ID NO: 974416 - RNA, 24 nt, Human
ucacucuguugcccaggcuggagu

SEQ ID NO: 974417 - RNA, 20 nt, Human
ucagcuucccgaguagcugg

SEQ ID NO: 974418 - RNA, 20 nt, Human
uccaagaaauaaccuacaga

SEQ ID NO: 974419 - RNA, 24 nt, Human
ucccaaaaugcugggauuacaggc

SEQ ID NO: 974420 - RNA, 24 nt, Human
ucccgaguagcugggauuacaggc

SEQ ID NO: 974421 - RNA, 18 nt, Human
ucggccucccaaaaugcu

SEQ ID NO: 974422 - RNA, 23 nt, Human
ucucacucuguugcccaggcugg

SEQ ID NO: 974423 - RNA, 24 nt, Human
ucucacucuguugcccaggcugga

SEQ ID NO: 974424 - RNA, 26 nt, Human
ucucacucuguugcccaggcuggagu

SEQ ID NO: 974425 - RNA, 27 nt, Human
ucucacucuguugcccaggcuggagug

SEQ ID NO: 974426 - RNA, 18 nt, Human
ucuguugcccaggcugga

SEQ ID NO: 974427 - RNA, 24 nt, Human
ucuguugcccaggcuggagugcag

SEQ ID NO: 974428 - RNA, 24 nt, Human
ugaacuuccuaaguuaucaaucac

SEQ ID NO: 974429 - RNA, 22 nt, Human
ugaaguauaaucaacugugaaa

SEQ ID NO: 974430 - RNA, 22 nt, Human
ugagacgaagucucacucuguu

SEQ ID NO: 974431 - RNA, 23 nt, Human
ugagcccaggaguucaagaccag

SEQ ID NO: 974432 - RNA, 24 nt, Human
ugaggcaggaggauagcuugagcc

SEQ ID NO: 974433 - RNA, 25 nt, Human
ugaggcaggaggauagcuugagccc

SEQ ID NO: 974434 - RNA, 24 nt, Human
ugauccgcccaccucggccuccca

SEQ ID NO: 974435 - RNA, 22 nt, Human
ugcaguggcacgaucucggcuc

SEQ ID NO: 974436 - RNA, 18 nt, Human
ugcccaggcuggagugca

SEQ ID NO: 974437 - RNA, 22 nt, Human
ugcccaggcuggagugcagugg

SEQ ID NO: 974438 - RNA, 24 nt, Human
ugcccaggcuggagugcaguggca

SEQ ID NO: 974439 - RNA, 24 nt, Human
ugccucagcuucccgaguagcugg

SEQ ID NO: 974440 - RNA, 18 nt, Human
ugcugggauuacaggcau

SEQ ID NO: 974441 - RNA, 23 nt, Human
uggagugcaguggcacgaucucg

SEQ ID NO: 974442 - RNA, 24 nt, Human
uggagugcaguggcacgaucucgg

SEQ ID NO: 974443 - RNA, 20 nt, Human
ugggaggcugaggcaggagg

SEQ ID NO: 974444 - RNA, 22 nt, Human
ugggaggcugaggcaggaggau

SEQ ID NO: 974445 - RNA, 21 nt, Human
ugggauuacaggcaugcaacc

SEQ ID NO: 974446 - RNA, 22 nt, Human
ugggauuacaggcaugcaaccc

SEQ ID NO: 974447 - RNA, 23 nt, Human
ugggauuacaggcaugcaaccca

SEQ ID NO: 974448 - RNA, 21 nt, Human
ugggauuacaggcgcccgcca

SEQ ID NO: 974449 - RNA, 22 nt, Human
ugggauuacaggcgcccgccac

SEQ ID NO: 974450 - RNA, 24 nt, Human
ugggauuacaggcgcccgccacca

SEQ ID NO: 974451 - RNA, 20 nt, Human
uggguucacaccauucuccu

SEQ ID NO: 974452 - RNA, 18 nt, Human
uuagagacgggguuucac

SEQ ID NO: 974453 - RNA, 24 nt, Human
uuauuagagacgggguuucacugu

SEQ ID NO: 974454 - RNA, 22 nt, Human
uucaauacacaaaauaucaauc

SEQ ID NO: 974455 - RNA, 21 nt, Human
uucacuguguuagucacgaug

SEQ ID NO: 974456 - RNA, 21 nt, Human
uuccaagaaauaaccuacaga

SEQ ID NO: 974457 - RNA, 22 nt, Human
uugagcccaggaguucaagacc

SEQ ID NO: 974458 - RNA, 24 nt, Human
uugcccaggcuggagugcaguggc

SEQ ID NO: 974459 - RNA, 24 nt, Human
uuugcuaauaaaugaaaauuuuau

SEQ ID NO: 974460 - RNA, 21 nt, Human
uuuucguauuuuuauuagaga

SEQ ID NO: 974461 - RNA, 24 nt, Human
uuuuuauuagagacgggguuucac

SEQ ID NO: 974462 - RNA, 26 nt, Human
uuuuuuuuuuuugagacgaagucuca

SEQ ID NO: 974463 - RNA, 23 nt, Human
uuuuuuuuuuuuuuugcuaauaa

SEQ ID NO: 974464 - RNA, 18 nt, Human
uuuuuuuuuuuuuuuuug

SEQ ID NO: 974465 - RNA, 20 nt, Human
uuuuuuuuuuuuuuuuugcu

SEQ ID NO: 974466 - RNA, 23 nt, Human
uuuuuuuuuuuuuuuuuugcuaa

SEQ ID NO: 974467 - RNA, 19 nt, Human
aaagagaaagagaauggua

SEQ ID NO: 974468 - RNA, 25 nt, Human
accuggcagcagggaguaaccacga

SEQ ID NO: 974469 - RNA, 21 nt, Human
agaaugguaacuuuauucaug

SEQ ID NO: 974470 - RNA, 20 nt, Human
agacccccaaaguauggggc

SEQ ID NO: 974471 - RNA, 22 nt, Human
aucaucucaaggaccuuccccc

SEQ ID NO: 974472 - RNA, 23 nt, Human
auggucacagaauacccccggga

SEQ ID NO: 974473 - RNA, 22 nt, Human
cacaguggggcuuggggacugg

SEQ ID NO: 974474 - RNA, 23 nt, Human
cagcccuguccgccuguccuuga

SEQ ID NO: 974475 - RNA, 26 nt, Human
cagcuauggccccccagcagacaaca

SEQ ID NO: 974476 - RNA, 19 nt, Human
cagggaguaaccacgacug

SEQ ID NO: 974477 - RNA, 22 nt, Human
cccacagcugagcaucaucuca

SEQ ID NO: 974478 - RNA, 21 nt, Human
ccccgggaaggggaaggaccu

SEQ ID NO: 974479 - RNA, 23 nt, Human
ccccuguacaacggggguuccau

SEQ ID NO: 974480 - RNA, 18 nt, Human
ccgcucagaaagaggcag

SEQ ID NO: 974481 - RNA, 18 nt, Human
ccugcaacccccacccaa

SEQ ID NO: 974482 - RNA, 20 nt, Human
cgagcagaaccgaggggcag

SEQ ID NO: 974483 - RNA, 19 nt, Human
cuggccccgagguguacag

SEQ ID NO: 974484 - RNA, 22 nt, Human
cuggccccgagguguacaggaa

SEQ ID NO: 974485 - RNA, 22 nt, Human
gaccuggcagcagggaguaacc

SEQ ID NO: 974486 - RNA, 23 nt, Human
gagccagggccagccgagcagaa

SEQ ID NO: 974487 - RNA, 20 nt, Human
gcaacccccacccaaccccu

SEQ ID NO: 974488 - RNA, 19 nt, Human
gccagccgagcagaaccga

SEQ ID NO: 974489 - RNA, 18 nt, Human
gccagcuauggcccccca

SEQ ID NO: 974490 - RNA, 19 nt, Human
gccugguguggccuccugc

SEQ ID NO: 974491 - RNA, 24 nt, Human
gcuugugaguggaguccugcaacc

SEQ ID NO: 974492 - RNA, 19 nt, Human
ggacugggggaggccagcc

SEQ ID NO: 974493 - RNA, 21 nt, Human
ggaguccugcaacccccaccc

SEQ ID NO: 974494 - RNA, 19 nt, Human
gggacugggggaggccagc

SEQ ID NO: 974495 - RNA, 21 nt, Human
gggauccucagaaagagccag

SEQ ID NO: 974496 - RNA, 19 nt, Human
uccugcaacccccacccaa

SEQ ID NO: 974497 - RNA, 19 nt, Human
ugagacccccaaaguaugg

SEQ ID NO: 974498 - RNA, 19 nt, Human
ugaguggaguccugcaacc

SEQ ID NO: 974499 - RNA, 21 nt, Human
uggaguccugcaacccccacc

SEQ ID NO: 974500 - RNA, 22 nt, Human
uggaguccugcaacccccaccc

SEQ ID NO: 974501 - RNA, 21 nt, Human
uggccccccagcagacaacaa

SEQ ID NO: 974502 - RNA, 18 nt, Human
ugggcagugccagcuaug

SEQ ID NO: 974503 - RNA, 20 nt, Human
ugggcagugccagcuauggc

SEQ ID NO: 974504 - RNA, 18 nt, Human
ugggggaggccagcccug

SEQ ID NO: 974505 - RNA, 19 nt, Human
ugggggaggccagcccugu

SEQ ID NO: 974506 - RNA, 19 nt, Human
ugguguggccuccugcccg

SEQ ID NO: 974507 - RNA, 21 nt, Human
uuccauuucugagacccccaa

SEQ ID NO: 974508 - RNA, 23 nt, Human
uucccccaugacgggauccucag

SEQ ID NO: 974509 - RNA, 18 nt, Human
aaaguaaaaauuuaggua

SEQ ID NO: 974510 - RNA, 18 nt, Human
aaaucuaugguuugcugg

SEQ ID NO: 974511 - RNA, 22 nt, Human
aaggcauggauugggagaaaga

SEQ ID NO: 974512 - RNA, 20 nt, Human
acuacaacucaacucaaaau

SEQ ID NO: 974513 - RNA, 24 nt, Human
agaagguguagcucucacauucuu

SEQ ID NO: 974514 - RNA, 19 nt, Human
aggaauuucuuuugacuug

SEQ ID NO: 974515 - RNA, 23 nt, Human
aguuuuccauguguaagauaaau

SEQ ID NO: 974516 - RNA, 20 nt, Human
auaacugauacauaacacac

SEQ ID NO: 974517 - RNA, 22 nt, Human
auacagaaaguaaaaauuuagg

SEQ ID NO: 974518 - RNA, 19 nt, Human
aucaaaauuuagcccaugg

SEQ ID NO: 974519 - RNA, 21 nt, Human
aucuuuagcaaaaaacucugg

SEQ ID NO: 974520 - RNA, 21 nt, Human
auggaauuucggguuggguaa

SEQ ID NO: 974521 - RNA, 21 nt, Human
auuaacuuuucuccucaguuu

SEQ ID NO: 974522 - RNA, 23 nt, Human
caguuucaccagggaacaauaau

SEQ ID NO: 974523 - RNA, 20 nt, Human
cuagacauaccagaaacucg

SEQ ID NO: 974524 - RNA, 23 nt, Human
cuccucaguuucaccagggaaca

SEQ ID NO: 974525 - RNA, 19 nt, Human
cuuaaguucucuauaguga

SEQ ID NO: 974526 - RNA, 18 nt, Human
gagaacacuagacauacc

SEQ ID NO: 974527 - RNA, 19 nt, Human
gagaaugaauagggaaggc

SEQ ID NO: 974528 - RNA, 21 nt, Human
gagaaugaauagggaaggccg

SEQ ID NO: 974529 - RNA, 22 nt, Human
uaaaacauacuucacugucaaa

SEQ ID NO: 974530 - RNA, 18 nt, Human
uaacauaagccagccucu

SEQ ID NO: 974531 - RNA, 22 nt, Human
uaacuuuucuccucaguuucac

SEQ ID NO: 974532 - RNA, 21 nt, Human
uaagguaaccauccaagagaa

SEQ ID NO: 974533 - RNA, 18 nt, Human
uaaguccauaaaacauac

SEQ ID NO: 974534 - RNA, 21 nt, Human
uacaacucaacucaaaauggg

SEQ ID NO: 974535 - RNA, 23 nt, Human
uauaaaauuaaacuauguuauaa

SEQ ID NO: 974536 - RNA, 20 nt, Human
uaucuggaauaaauauaaaa

SEQ ID NO: 974537 - RNA, 20 nt, Human
uaucuggaauaaauauaaaa

SEQ ID NO: 974538 - RNA, 20 nt, Human
ucaaaacacuuccacuacuu

SEQ ID NO: 974539 - RNA, 22 nt, Human
ucacugucaaacacauaggcuu

SEQ ID NO: 974540 - RNA, 20 nt, Human
ucagucaaauuuaaauacaa

SEQ ID NO: 974541 - RNA, 23 nt, Human
ucuccaagccaauggacuuaacu

SEQ ID NO: 974542 - RNA, 23 nt, Human
ucuuagccauccagauauucagu

SEQ ID NO: 974543 - RNA, 24 nt, Human
ugaaaugaaugaauaagauaaaau

SEQ ID NO: 974544 - RNA, 18 nt, Human
ugaaugagaacacuagac

SEQ ID NO: 974545 - RNA, 21 nt, Human
ugagaacacuagacauaccag

SEQ ID NO: 974546 - RNA, 25 nt, Human
ugagaacacuagacauaccagaaac

SEQ ID NO: 974547 - RNA, 24 nt, Human
ugagcaaaggauuuaaagucagaa

SEQ ID NO: 974548 - RNA, 22 nt, Human
ugcuugucaucuccaagccaau

SEQ ID NO: 974549 - RNA, 26 nt, Human
uggguaaaaagcacuaaauuaaauac

SEQ ID NO: 974550 - RNA, 25 nt, Human
uuaaauacaaccuuggaagccucau

SEQ ID NO: 974551 - RNA, 19 nt, Human
uuagaaauaagguaaccau

SEQ ID NO: 974552 - RNA, 22 nt, Human
uuaucaaucugcucaauuuuag

SEQ ID NO: 974553 - RNA, 26 nt, Human
uuuuuuuuuuuuuucuuaaaucaggg

SEQ ID NO: 974554 - RNA, 20 nt, Human
aaaccaagaccgugccggga

SEQ ID NO: 974555 - RNA, 22 nt, Human
aacacaccccgagauguuagaa

SEQ ID NO: 974556 - RNA, 23 nt, Human
aacuuuauuccuccaaguguuca

SEQ ID NO: 974557 - RNA, 24 nt, Human
aagccacauggaaacuggccaccc

SEQ ID NO: 974558 - RNA, 18 nt, Human
accccgagauguuagaaa

SEQ ID NO: 974559 - RNA, 19 nt, Human
acccugggacaggaaccuc

SEQ ID NO: 974560 - RNA, 18 nt, Human
agauguuagaaaccaagc

SEQ ID NO: 974561 - RNA, 23 nt, Human
aggcagggaguggaugaacaagg

SEQ ID NO: 974562 - RNA, 18 nt, Human
agucggcaggcccgccuc

SEQ ID NO: 974563 - RNA, 19 nt, Human
caagaacaucucccgccug

SEQ ID NO: 974564 - RNA, 24 nt, Human
cacacagucagucggcaggcccgc

SEQ ID NO: 974565 - RNA, 24 nt, Human
cagaccccacaaacuccugcuaug

SEQ ID NO: 974566 - RNA, 19 nt, Human
caggaaccucagaccccac

SEQ ID NO: 974567 - RNA, 21 nt, Human
caggaaccucagaccccacaa

SEQ ID NO: 974568 - RNA, 22 nt, Human
ccaaaacacaccccgagauguu

SEQ ID NO: 974569 - RNA, 20 nt, Human
ccaaaacacaccccgagauu

SEQ ID NO: 974570 - RNA, 21 nt, Human
ccacaaacuccugcuaugugc

SEQ ID NO: 974571 - RNA, 24 nt, Human
ccgcccaugggggauggcaggagc

SEQ ID NO: 974572 - RNA, 19 nt, Human
ccgccucuguucacugcgg

SEQ ID NO: 974573 - RNA, 19 nt, Human
ccucagaccccacaaacuc

SEQ ID NO: 974574 - RNA, 20 nt, Human
ccuccaaaacacaccccgag

SEQ ID NO: 974575 - RNA, 20 nt, Human
ccuccaaguguucaggugug

SEQ ID NO: 974576 - RNA, 21 nt, Human
ccugccuccaaaacacacccc

SEQ ID NO: 974577 - RNA, 19 nt, Human
ccuggccucuggcugccuc

SEQ ID NO: 974578 - RNA, 24 nt, Human
ccuggccucuggcugccucucuug

SEQ ID NO: 974579 - RNA, 21 nt, Human
ccuucagacacacccgcccau

SEQ ID NO: 974580 - RNA, 20 nt, Human
cgugccgggaucccauucuc

SEQ ID NO: 974581 - RNA, 18 nt, Human
gaccuggucagucagcgg

SEQ ID NO: 974582 - RNA, 22 nt, Human
gaucccauucuccuucagacac

SEQ ID NO: 974583 - RNA, 24 nt, Human
gccccaagaacaucucccgccugc

SEQ ID NO: 974584 - RNA, 22 nt, Human
gccuaagccccaagaacaucuc

SEQ ID NO: 974585 - RNA, 19 nt, Human
gccuccaaaacacaccccg

SEQ ID NO: 974586 - RNA, 25 nt, Human
ggaccuggucagucagcggccagca

SEQ ID NO: 974587 - RNA, 21 nt, Human
ggcugccucucuugcaggcug

SEQ ID NO: 974588 - RNA, 23 nt, Human
uaaaaacagaacuuuauuccucc

SEQ ID NO: 974589 - RNA, 23 nt, Human
uaggccaggcacagaaucgggga

SEQ ID NO: 974590 - RNA, 21 nt, Human
ucucgucagcagggccacggg

SEQ ID NO: 974591 - RNA, 24 nt, Human
ucucucgucagcagggccacgggc

SEQ ID NO: 974592 - RNA, 23 nt, Human
ucucuugcaggcugggggugggc

SEQ ID NO: 974593 - RNA, 22 nt, Human
ucugccaggagccuaagcccca

SEQ ID NO: 974594 - RNA, 18 nt, Human
ugaacaaggacaggcccc

SEQ ID NO: 974595 - RNA, 18 nt, Human
ugagaaagugcuuguccu

SEQ ID NO: 974596 - RNA, 19 nt, Human
ugagaaagugcuuguccug

SEQ ID NO: 974597 - RNA, 19 nt, Human
ugccacacagucagucggc

SEQ ID NO: 974598 - RNA, 25 nt, Human
ugccaggagccuaagccccaagaac

SEQ ID NO: 974599 - RNA, 21 nt, Human
ugccgggaucccauucuccuu

SEQ ID NO: 974600 - RNA, 21 nt, Human
ugcuaugugcucugccaggag

SEQ ID NO: 974601 - RNA, 21 nt, Human
uggaugaacaaggacaggccc

SEQ ID NO: 974602 - RNA, 23 nt, Human
ugggacaggaaccucagacccca

SEQ ID NO: 974603 - RNA, 18 nt, Human
uguucaggugugcacuug

SEQ ID NO: 974604 - RNA, 22 nt, Human
uuuuuuuuuuuccacaauuaaa

SEQ ID NO: 974605 - RNA, 18 nt, Human
agaagggagagacaauaa

SEQ ID NO: 974606 - RNA, 23 nt, Human
aggaggccuggccacaggugccc

SEQ ID NO: 974607 - RNA, 25 nt, Human
caauaagcaucuuuauuauccaaau

SEQ ID NO: 974608 - RNA, 23 nt, Human
cacccacggccucgcgccggccc

SEQ ID NO: 974609 - RNA, 18 nt, Human
cagcuggcugguccugga

SEQ ID NO: 974610 - RNA, 21 nt, Human
ccagguaugaaaaugaccaag

SEQ ID NO: 974611 - RNA, 18 nt, Human
ccccgcgcgccagucccg

SEQ ID NO: 974612 - RNA, 25 nt, Human
ccccgcuacuccacgcgucggccca

SEQ ID NO: 974613 - RNA, 22 nt, Human
ccccucaggcuucccgcucucc

SEQ ID NO: 974614 - RNA, 20 nt, Human
cccgcccccucaggcuuccc

SEQ ID NO: 974615 - RNA, 19 nt, Human
cccgccgccggcauccucg

SEQ ID NO: 974616 - RNA, 24 nt, Human
cccgcgcgccagucccggcagccg

SEQ ID NO: 974617 - RNA, 20 nt, Human
cccggcagccguccuucccg

SEQ ID NO: 974618 - RNA, 21 nt, Human
cccggcagccguccuucccgu

SEQ ID NO: 974619 - RNA, 18 nt, Human
ccgccgccggcauccucg

SEQ ID NO: 974620 - RNA, 18 nt, Human
ccggcccgccccgccccg

SEQ ID NO: 974621 - RNA, 22 nt, Human
ccucgcgccggccccgcccccu

SEQ ID NO: 974622 - RNA, 23 nt, Human
ccucgugccgcacccacggccuc

SEQ ID NO: 974623 - RNA, 20 nt, Human
cucgugccgcacccacggcc

SEQ ID NO: 974624 - RNA, 19 nt, Human
cucugcauaacagcagaac

SEQ ID NO: 974625 - RNA, 24 nt, Human
cuucccgcucuccccgcuacucca

SEQ ID NO: 974626 - RNA, 22 nt, Human
gagcccagucugcagggaacac

SEQ ID NO: 974627 - RNA, 24 nt, Human
gccacaggugcccccuguauacaa

SEQ ID NO: 974628 - RNA, 22 nt, Human
gcugccaggguggaugagaagu

SEQ ID NO: 974629 - RNA, 21 nt, Human
ggaugagaagucacuccugag

SEQ ID NO: 974630 - RNA, 20 nt, Human
ggaugucgggcugagcccag

SEQ ID NO: 974631 - RNA, 23 nt, Human
guaaauucccagaacuggagaag

SEQ ID NO: 974632 - RNA, 27 nt, Human
guaaauucccagaacuggagaagggag

SEQ ID NO: 974633 - RNA, 24 nt, Human
guguccccgcgcgccagucccggc

SEQ ID NO: 974634 - RNA, 23 nt, Human
uccaugcuggaucugcacaaggg

SEQ ID NO: 974635 - RNA, 20 nt, Human
uccccgcuacuccacgcguc

SEQ ID NO: 974636 - RNA, 22 nt, Human
ucccggcagccguccuucccgu

SEQ ID NO: 974637 - RNA, 23 nt, Human
uccuggagcucccaggaggaggc

SEQ ID NO: 974638 - RNA, 19 nt, Human
ugaaaaugaccaaggcucc

SEQ ID NO: 974639 - RNA, 25 nt, Human
ugaaaaugaccaaggcuccuugcug

SEQ ID NO: 974640 - RNA, 18 nt, Human
ugagaagucacuccugag

SEQ ID NO: 974641 - RNA, 26 nt, Human
ugcauaacagcagaaccuacuagcug

SEQ ID NO: 974642 - RNA, 21 nt, Human
ugccaggguggaugagaaguc

SEQ ID NO: 974643 - RNA, 20 nt, Human
ugcuggaucugcacaagggc

SEQ ID NO: 974644 - RNA, 19 nt, Human
uggcucugcauaacagcag

SEQ ID NO: 974645 - RNA, 19 nt, Human
ugggcagaggagugucccc

SEQ ID NO: 974646 - RNA, 22 nt, Human
ugggcagaggaguguccccggc

SEQ ID NO: 974647 - RNA, 23 nt, Human
aaaaacaccugguccacaaagcu

SEQ ID NO: 974648 - RNA, 19 nt, Human
aaaacaccugguccacaaa

SEQ ID NO: 974649 - RNA, 25 nt, Human
aaacugaaguacaguuaauaugauc

SEQ ID NO: 974650 - RNA, 20 nt, Human
aaagaacagauccacagcca

SEQ ID NO: 974651 - RNA, 22 nt, Human
aaagcaccaacuaaaaccacaa

SEQ ID NO: 974652 - RNA, 23 nt, Human
aagaaaaacaccugguccacaaa

SEQ ID NO: 974653 - RNA, 18 nt, Human
aagaacagauccacagcc

SEQ ID NO: 974654 - RNA, 24 nt, Human
aagaggcauuacagagagcaccau

SEQ ID NO: 974655 - RNA, 20 nt, Human
aagcucaagagcucaaacaa

SEQ ID NO: 974656 - RNA, 18 nt, Human
aauaaaguaacuguacaa

SEQ ID NO: 974657 - RNA, 20 nt, Human
acaaagaacagauccacagc

SEQ ID NO: 974658 - RNA, 18 nt, Human
agagauaacauuugaaua

SEQ ID NO: 974659 - RNA, 18 nt, Human
aggaaaugacgaguuuaa

SEQ ID NO: 974660 - RNA, 18 nt, Human
aggaauucuuucacaaag

SEQ ID NO: 974661 - RNA, 20 nt, Human
aguuuccuaggcagcaguuc

SEQ ID NO: 974662 - RNA, 24 nt, Human
auauauacauacauacacacuaua

SEQ ID NO: 974663 - RNA, 28 nt, Human
auauauacauacauacacacuauaugua

SEQ ID NO: 974664 - RNA, 22 nt, Human
caaagaacagauccacagccaa

SEQ ID NO: 974665 - RNA, 23 nt, Human
caaucaaagacuuccaagaagga

SEQ ID NO: 974666 - RNA, 28 nt, Human
cagaaaaaguuuaacaaacauuagucag

SEQ ID NO: 974667 - RNA, 22 nt, Human
cagcacccacugguagcaacca

SEQ ID NO: 974668 - RNA, 22 nt, Human
caguacauucccaccccccaaa

SEQ ID NO: 974669 - RNA, 26 nt, Human
cauauauacauacauacacacuauau

SEQ ID NO: 974670 - RNA, 22 nt, Human
cccccaaaaaaauaagugcaaa

SEQ ID NO: 974671 - RNA, 22 nt, Human
ccucucucaacaacuuuuuaaa

SEQ ID NO: 974672 - RNA, 22 nt, Human
ccugguccacaaagcuuaacac

SEQ ID NO: 974673 - RNA, 24 nt, Human
cugacugcaguacauucccacccc

SEQ ID NO: 974674 - RNA, 20 nt, Human
cugcucuucaaaugcaggga

SEQ ID NO: 974675 - RNA, 22 nt, Human
cuugagcaggugccauaaagca

SEQ ID NO: 974676 - RNA, 19 nt, Human
gaaaaacaccugguccaca

SEQ ID NO: 974677 - RNA, 20 nt, Human
gaaagacuuaaggcaguaag

SEQ ID NO: 974678 - RNA, 18 nt, Human
gaagguaaauacaaccuc

SEQ ID NO: 974679 - RNA, 21 nt, Human
gaggaaagacuuaaggcagua

SEQ ID NO: 974680 - RNA, 18 nt, Human
gcaguaagaggcauuaca

SEQ ID NO: 974681 - RNA, 24 nt, Human
guuguguacaugcuccauggagaa

SEQ ID NO: 974682 - RNA, 23 nt, Human
uaaaguaacuguacaaagagaac

SEQ ID NO: 974683 - RNA, 24 nt, Human
uaacacacaauuuacauauauaca

SEQ ID NO: 974684 - RNA, 19 nt, Human
uaacuguacaaagagaaca

SEQ ID NO: 974685 - RNA, 25 nt, Human
uacauacauacacacuauauguaag

SEQ ID NO: 974686 - RNA, 19 nt, Human
uagcaaccaggauccuucu

SEQ ID NO: 974687 - RNA, 25 nt, Human
uauauacauacauacacacuauaug

SEQ ID NO: 974688 - RNA, 26 nt, Human
uauauacauacauacacacuauaugg

SEQ ID NO: 974689 - RNA, 22 nt, Human
ucaacuucuaagcucaagagcu

SEQ ID NO: 974690 - RNA, 18 nt, Human
ucacaaagaacagaucca

SEQ ID NO: 974691 - RNA, 25 nt, Human
ucagcacccacugguagcaaccagg

SEQ ID NO: 974692 - RNA, 18 nt, Human
uccacaaagcuuaacacc

SEQ ID NO: 974693 - RNA, 20 nt, Human
uccacaaagcuuaacaccua

SEQ ID NO: 974694 - RNA, 21 nt, Human
ucgccccaaaagaaaaacacc

SEQ ID NO: 974695 - RNA, 24 nt, Human
ucugaaagcaccaacuaaaaccac

SEQ ID NO: 974696 - RNA, 28 nt, Human
ugaaagcaccaacuaaaacuggagaccc

SEQ ID NO: 974697 - RNA, 21 nt, Human
ugaaguacaguuaauaugauc

SEQ ID NO: 974698 - RNA, 22 nt, Human
ugccacagaaaaaguuuaacaa

SEQ ID NO: 974699 - RNA, 18 nt, Human
ugggcgaaagaaaacaga

SEQ ID NO: 974700 - RNA, 22 nt, Human
uguggccaaggugccacagaaa

SEQ ID NO: 974701 - RNA, 23 nt, Human
uuaacaccuauauaaauaaagua

SEQ ID NO: 974702 - RNA, 20 nt, Human
uucacaaagaacagauccac

SEQ ID NO: 974703 - RNA, 19 nt, Human
aaaaggacaaaggagacaa

SEQ ID NO: 974704 - RNA, 23 nt, Human
aaacaguuccacacccaaaacua

SEQ ID NO: 974705 - RNA, 23 nt, Human
aaagaaacaguuccacacccaaa

SEQ ID NO: 974706 - RNA, 21 nt, Human
aaaggggaggccccaaagauu

SEQ ID NO: 974707 - RNA, 22 nt, Human
aaagugcuguaagauaccccug

SEQ ID NO: 974708 - RNA, 20 nt, Human
aacucaagcccggcuucccc

SEQ ID NO: 974709 - RNA, 21 nt, Human
aacucaagcccggcuucccca

SEQ ID NO: 974710 - RNA, 27 nt, Human
aagauaccccugcgcuuguggcaauug

SEQ ID NO: 974711 - RNA, 19 nt, Human
aagaucccuccccgccucc

SEQ ID NO: 974712 - RNA, 22 nt, Human
aaggaaaagggucacuguggag

SEQ ID NO: 974713 - RNA, 21 nt, Human
aauaaacuccacucaagccca

SEQ ID NO: 974714 - RNA, 20 nt, Human
acacacaugcacuccagagc

SEQ ID NO: 974715 - RNA, 23 nt, Human
acacagaacccacacugcccucc

SEQ ID NO: 974716 - RNA, 23 nt, Human
acacaugcacuccagagcugggc

SEQ ID NO: 974717 - RNA, 25 nt, Human
acagaacccacacugcccuccgcca

SEQ ID NO: 974718 - RNA, 21 nt, Human
acagacagacacagaacccac

SEQ ID NO: 974719 - RNA, 20 nt, Human
acagacgcaagacacagaca

SEQ ID NO: 974720 - RNA, 23 nt, Human
acaggagcagaggggccugaagc

SEQ ID NO: 974721 - RNA, 18 nt, Human
acagguucccaccaccca

SEQ ID NO: 974722 - RNA, 20 nt, Human
acaugcacuccagagcuggg

SEQ ID NO: 974723 - RNA, 21 nt, Human
accaaaacacaagacacaaua

SEQ ID NO: 974724 - RNA, 21 nt, Human
accaaccccaaagugaacaua

SEQ ID NO: 974725 - RNA, 19 nt, Human
acccacacugcccuccgcc

SEQ ID NO: 974726 - RNA, 19 nt, Human
acccuuggauggcugagaa

SEQ ID NO: 974727 - RNA, 23 nt, Human
accuuggaaggcugggggagccc

SEQ ID NO: 974728 - RNA, 19 nt, Human
acucaagcccggcuucccc

SEQ ID NO: 974729 - RNA, 18 nt, Human
acucaccuccuccacagg

SEQ ID NO: 974730 - RNA, 23 nt, Human
agaagggcagagcccaugaguua

SEQ ID NO: 974731 - RNA, 19 nt, Human
agacagcaagcagccaccu

SEQ ID NO: 974732 - RNA, 22 nt, Human
agacagccagagacuuccugag

SEQ ID NO: 974733 - RNA, 24 nt, Human
agacagccagagacuuccugagca

SEQ ID NO: 974734 - RNA, 25 nt, Human
agacagccagagacuuccugagcaa

SEQ ID NO: 974735 - RNA, 23 nt, Human
agagccaaggggacagaggggcc

SEQ ID NO: 974736 - RNA, 24 nt, Human
agagggggcuccugccccgagggc

SEQ ID NO: 974737 - RNA, 19 nt, Human
agaucccuccccgccuccc

SEQ ID NO: 974738 - RNA, 24 nt, Human
agaucccuccccgccuccccacuu

SEQ ID NO: 974739 - RNA, 21 nt, Human
agcagaaguugggcccgaggg

SEQ ID NO: 974740 - RNA, 18 nt, Human
aggaccaggaaccccaaa

SEQ ID NO: 974741 - RNA, 23 nt, Human
aggacccugauacucagacccac

SEQ ID NO: 974742 - RNA, 20 nt, Human
aggccucaggcaucuggguu

SEQ ID NO: 974743 - RNA, 22 nt, Human
aggccucaggcaucuggguuug

SEQ ID NO: 974744 - RNA, 21 nt, Human
aggccucaggcccaaccacag

SEQ ID NO: 974745 - RNA, 22 nt, Human
aggcugagggcaggaggaaaag

SEQ ID NO: 974746 - RNA, 25 nt, Human
aucuggguuugguuuggcugggcug

SEQ ID NO: 974747 - RNA, 20 nt, Human
augcacuccagagcugggcc

SEQ ID NO: 974748 - RNA, 22 nt, Human
caacaacccugaguccacuggc

SEQ ID NO: 974749 - RNA, 18 nt, Human
caaccacagcccaguccu

SEQ ID NO: 974750 - RNA, 23 nt, Human
caaccagauggguguaaccccug

SEQ ID NO: 974751 - RNA, 22 nt, Human
caacccugaguccacuggcccu

SEQ ID NO: 974752 - RNA, 21 nt, Human
caagaucccuccccgccuccc

SEQ ID NO: 974753 - RNA, 21 nt, Human
caaggcggggggagcuuugga

SEQ ID NO: 974754 - RNA, 21 nt, Human
cacacccaaaacuaaauaaau

SEQ ID NO: 974755 - RNA, 18 nt, Human
cacacccagaagugccaa

SEQ ID NO: 974756 - RNA, 22 nt, Human
cacacccccuugcuguucaguc

SEQ ID NO: 974757 - RNA, 24 nt, Human
cacagaggcuucaggagcagggcc

SEQ ID NO: 974758 - RNA, 18 nt, Human
cacagcccaguccuccac

SEQ ID NO: 974759 - RNA, 25 nt, Human
cacagcccaguccuccacagguggc

SEQ ID NO: 974760 - RNA, 19 nt, Human
cacaggccucaggcccaac

SEQ ID NO: 974761 - RNA, 22 nt, Human
cacccaacuuaaaaccacaacu

SEQ ID NO: 974762 - RNA, 23 nt, Human
caccugagcagcagcugccgcac

SEQ ID NO: 974763 - RNA, 24 nt, Human
cacugcccuccgccaccuugcgcc

SEQ ID NO: 974764 - RNA, 23 nt, Human
cacuggacaggauggugcagggc

SEQ ID NO: 974765 - RNA, 20 nt, Human
cagaacccacacugcccucc

SEQ ID NO: 974766 - RNA, 20 nt, Human
cagaauaccccacccuccuc

SEQ ID NO: 974767 - RNA, 20 nt, Human
cagacagacacagaacccac

SEQ ID NO: 974768 - RNA, 21 nt, Human
cagacagagugaaggccgugc

SEQ ID NO: 974769 - RNA, 18 nt, Human
cagcccaguccuccacag

SEQ ID NO: 974770 - RNA, 19 nt, Human
caggagagcccccgaaaga

SEQ ID NO: 974771 - RNA, 22 nt, Human
cauccugccagaauaccccacc

SEQ ID NO: 974772 - RNA, 19 nt, Human
cauggcaccugagcagcag

SEQ ID NO: 974773 - RNA, 22 nt, Human
cauggcaccugagcagcagcug

SEQ ID NO: 974774 - RNA, 20 nt, Human
ccaaccccaaagugaacaua

SEQ ID NO: 974775 - RNA, 24 nt, Human
ccaaccccaaagugaacauagugc

SEQ ID NO: 974776 - RNA, 19 nt, Human
ccacacugcccuccgccac

SEQ ID NO: 974777 - RNA, 19 nt, Human
ccacagcccaguccuccuu

SEQ ID NO: 974778 - RNA, 22 nt, Human
ccaccaaaacacaagacacaau

SEQ ID NO: 974779 - RNA, 21 nt, Human
ccaccggccaccacaguccca

SEQ ID NO: 974780 - RNA, 22 nt, Human
ccaccggccaccacagucccag

SEQ ID NO: 974781 - RNA, 22 nt, Human
ccacugacaagaagaaaagccc

SEQ ID NO: 974782 - RNA, 21 nt, Human
ccagaauaccccacccuccuc

SEQ ID NO: 974783 - RNA, 22 nt, Human
ccagacagagugaaggccgugc

SEQ ID NO: 974784 - RNA, 19 nt, Human
ccagagguggggccuagcc

SEQ ID NO: 974785 - RNA, 24 nt, Human
cccagcccugucacauccaccaaa

SEQ ID NO: 974786 - RNA, 18 nt, Human
cccaggagagcccccgaa

SEQ ID NO: 974787 - RNA, 20 nt, Human
ccccaaauuaggaugggcug

SEQ ID NO: 974788 - RNA, 23 nt, Human
ccccacaugaagacagccagaga

SEQ ID NO: 974789 - RNA, 22 nt, Human
ccccaggacccugauacucaga

SEQ ID NO: 974790 - RNA, 21 nt, Human
ccccaucuuugcccucccagc

SEQ ID NO: 974791 - RNA, 23 nt, Human
cccccagagguggggccuagccu

SEQ ID NO: 974792 - RNA, 18 nt, Human
cccccgaaagagaggacc

SEQ ID NO: 974793 - RNA, 21 nt, Human
cccccgaaagagaggacccuc

SEQ ID NO: 974794 - RNA, 18 nt, Human
ccccgaaagagaggaccc

SEQ ID NO: 974795 - RNA, 22 nt, Human
ccccgccccaucuuugcccucc

SEQ ID NO: 974796 - RNA, 25 nt, Human
ccccuuggguuucugccccugccuc

SEQ ID NO: 974797 - RNA, 19 nt, Human
cccgagcccuagaacucag

SEQ ID NO: 974798 - RNA, 21 nt, Human
cccgagcccuagaacucagga

SEQ ID NO: 974799 - RNA, 25 nt, Human
cccuccacugacaagaagaaaagcc

SEQ ID NO: 974800 - RNA, 23 nt, Human
cccucccagccccauguguaccc

SEQ ID NO: 974801 - RNA, 22 nt, Human
cccugaccaaggcggggggagc

SEQ ID NO: 974802 - RNA, 18 nt, Human
cccugaguccacuggccc

SEQ ID NO: 974803 - RNA, 22 nt, Human
cccugcgcuuguggcaauuggg

SEQ ID NO: 974804 - RNA, 18 nt, Human
ccgaccaucaacuuccca

SEQ ID NO: 974805 - RNA, 18 nt, Human
ccgcugccggaaugggcc

SEQ ID NO: 974806 - RNA, 20 nt, Human
ccuaugggcaacucaagccc

SEQ ID NO: 974807 - RNA, 25 nt, Human
ccuaugggcaacucaagcccggcuu

SEQ ID NO: 974808 - RNA, 18 nt, Human
ccuccccgccuccccacu

SEQ ID NO: 974809 - RNA, 23 nt, Human
ccuccccgccuccccacuuccca

SEQ ID NO: 974810 - RNA, 21 nt, Human
ccuccuaccccagcacugagc

SEQ ID NO: 974811 - RNA, 21 nt, Human
ccucgugacccacaccggugg

SEQ ID NO: 974812 - RNA, 23 nt, Human
ccucucaacaacccugaguccac

SEQ ID NO: 974813 - RNA, 24 nt, Human
ccucugcagucgcugcugcagccg

SEQ ID NO: 974814 - RNA, 19 nt, Human
ccugaguccagcccugccu

SEQ ID NO: 974815 - RNA, 21 nt, Human
ccugagucccaaggugggcag

SEQ ID NO: 974816 - RNA, 27 nt, Human
ccugccagaauaccccacccuccucca

SEQ ID NO: 974817 - RNA, 22 nt, Human
ccuggcagaccacggcugccuc

SEQ ID NO: 974818 - RNA, 24 nt, Human
ccugucacauccaccaaaacacaa

SEQ ID NO: 974819 - RNA, 24 nt, Human
ccuugcgcccagccccgucucucc

SEQ ID NO: 974820 - RNA, 22 nt, Human
ccuuggccccagaaccuugcag

SEQ ID NO: 974821 - RNA, 23 nt, Human
ccuuggguuucugccccugccuc

SEQ ID NO: 974822 - RNA, 23 nt, Human
cgagcagaagggcagagcccaug

SEQ ID NO: 974823 - RNA, 21 nt, Human
cgccccaucuuugcccuccca

SEQ ID NO: 974824 - RNA, 23 nt, Human
cgccgcugccggaaugggccccc

SEQ ID NO: 974825 - RNA, 20 nt, Human
cgccuggcccugaucagcga

SEQ ID NO: 974826 - RNA, 21 nt, Human
cggcccagugguucuggccuc

SEQ ID NO: 974827 - RNA, 19 nt, Human
cuaaaaguaaucaguccaa

SEQ ID NO: 974828 - RNA, 24 nt, Human
cuacaauaaacuccacucaagccc

SEQ ID NO: 974829 - RNA, 22 nt, Human
cucaccuccuccacaggccuca

SEQ ID NO: 974830 - RNA, 20 nt, Human
cucagacccacacacccccu

SEQ ID NO: 974831 - RNA, 21 nt, Human
cuccagccuguggccuugacc

SEQ ID NO: 974832 - RNA, 21 nt, Human
cuccuaccccagcacugagcu

SEQ ID NO: 974833 - RNA, 22 nt, Human
cucgcaccacuccggcccggcu

SEQ ID NO: 974834 - RNA, 22 nt, Human
cucgccgaccaucaacuuccca

SEQ ID NO: 974835 - RNA, 22 nt, Human
cucugugcagagcccgggcccc

SEQ ID NO: 974836 - RNA, 20 nt, Human
cugaagcuugacuaaauucc

SEQ ID NO: 974837 - RNA, 25 nt, Human
cugaagcuugacuaaauuccagugg

SEQ ID NO: 974838 - RNA, 23 nt, Human
cugagucccaaggugggcagcag

SEQ ID NO: 974839 - RNA, 21 nt, Human
cugauacucagacccacacac

SEQ ID NO: 974840 - RNA, 18 nt, Human
cugaucagcgaccugcgg

SEQ ID NO: 974841 - RNA, 19 nt, Human
cugaucagcgaccugcgga

SEQ ID NO: 974842 - RNA, 20 nt, Human
cugccgcaccuccaccgccu

SEQ ID NO: 974843 - RNA, 19 nt, Human
cugccuccucuucuugugc

SEQ ID NO: 974844 - RNA, 20 nt, Human
cugcgauucauccugccaga

SEQ ID NO: 974845 - RNA, 21 nt, Human
cuggagcaggaccaggaaccc

SEQ ID NO: 974846 - RNA, 21 nt, Human
cuggcccugucugaagagcca

SEQ ID NO: 974847 - RNA, 18 nt, Human
cuggccgggcaguagugc

SEQ ID NO: 974848 - RNA, 18 nt, Human
cugguguaccuccugccu

SEQ ID NO: 974849 - RNA, 29 nt, Human
cuguggccccagcccugucaccgguuccg

SEQ ID NO: 974850 - RNA, 21 nt, Human
cuuaaaaccacaacugucagg

SEQ ID NO: 974851 - RNA, 18 nt, Human
cuucccaguuggcccgug

SEQ ID NO: 974852 - RNA, 25 nt, Human
gaaaaaaagaaacaguuccacaccc

SEQ ID NO: 974853 - RNA, 21 nt, Human
gaaccaaccccaaagugaaca

SEQ ID NO: 974854 - RNA, 22 nt, Human
gaaccaaccccaaagugaacau

SEQ ID NO: 974855 - RNA, 18 nt, Human
gacacacccagaagugcc

SEQ ID NO: 974856 - RNA, 18 nt, Human
gaccaggaaccccaaauu

SEQ ID NO: 974857 - RNA, 20 nt, Human
gagacuuccugagcagggcu

SEQ ID NO: 974858 - RNA, 18 nt, Human
gagagauuuuauguuguc

SEQ ID NO: 974859 - RNA, 22 nt, Human
gagagcccccgaaagagaggac

SEQ ID NO: 974860 - RNA, 21 nt, Human
gagcaggaccaggaaccccaa

SEQ ID NO: 974861 - RNA, 18 nt, Human
gagcugcucccuccacug

SEQ ID NO: 974862 - RNA, 22 nt, Human
gcacaggaggcuggguccgcag

SEQ ID NO: 974863 - RNA, 20 nt, Human
gcagcagagacagaguagac

SEQ ID NO: 974864 - RNA, 18 nt, Human
gcagccccagccaggccu

SEQ ID NO: 974865 - RNA, 19 nt, Human
gcaggugccccgccucacg

SEQ ID NO: 974866 - RNA, 25 nt, Human
gccacaguguccugcgggggcagcc

SEQ ID NO: 974867 - RNA, 22 nt, Human
gcccagccccgucucuccucca

SEQ ID NO: 974868 - RNA, 27 nt, Human
gcccaucgaaggccccaggagagcccc

SEQ ID NO: 974869 - RNA, 23 nt, Human
gccccgccccaucuuugcccucc

SEQ ID NO: 974870 - RNA, 18 nt, Human
gcccgagcccuagaacuc

SEQ ID NO: 974871 - RNA, 23 nt, Human
gcccuagaacucaggagaagcca

SEQ ID NO: 974872 - RNA, 24 nt, Human
gccgacuggccuugggcugggagc

SEQ ID NO: 974873 - RNA, 19 nt, Human
gccgcaggcgccgcugccg

SEQ ID NO: 974874 - RNA, 23 nt, Human
gccggcccagugguucuggccuc

SEQ ID NO: 974875 - RNA, 20 nt, Human
gccucaggcccaaccacagc

SEQ ID NO: 974876 - RNA, 18 nt, Human
gccuugggcugggagcag

SEQ ID NO: 974877 - RNA, 18 nt, Human
gcgccuaccugcucugcc

SEQ ID NO: 974878 - RNA, 18 nt, Human
gcgggggcagccccagcc

SEQ ID NO: 974879 - RNA, 21 nt, Human
gcguguggcagagggggcucc

SEQ ID NO: 974880 - RNA, 19 nt, Human
ggaaaggggaggccccaaa

SEQ ID NO: 974881 - RNA, 25 nt, Human
ggagaagccacgucuggccgcuagg

SEQ ID NO: 974882 - RNA, 19 nt, Human
ggagaagggaggggggaac

SEQ ID NO: 974883 - RNA, 21 nt, Human
ggagcagggagggugcagggc

SEQ ID NO: 974884 - RNA, 22 nt, Human
ggagcuuuggaggcacaaagcg

SEQ ID NO: 974885 - RNA, 22 nt, Human
ggcaagguggcuuggaagagac

SEQ ID NO: 974886 - RNA, 20 nt, Human
ggcaggaaggaaaaggguca

SEQ ID NO: 974887 - RNA, 20 nt, Human
ggcagucauggccucuggcu

SEQ ID NO: 974888 - RNA, 21 nt, Human
ggcauggccacaguguccugc

SEQ ID NO: 974889 - RNA, 22 nt, Human
ggccucaggcccaaccacagcc

SEQ ID NO: 974890 - RNA, 20 nt, Human
ggccuggcagaccacggcug

SEQ ID NO: 974891 - RNA, 18 nt, Human
ggcuuccauggcuucagc

SEQ ID NO: 974892 - RNA, 18 nt, Human
ggcuuggaagagacggca

SEQ ID NO: 974893 - RNA, 24 nt, Human
gggaagggugugucagugagaagc

SEQ ID NO: 974894 - RNA, 23 nt, Human
gggacacuguuccucaggaccuc

SEQ ID NO: 974895 - RNA, 18 nt, Human
gggagaaaucuacaauaa

SEQ ID NO: 974896 - RNA, 21 nt, Human
gggaugccuuucuccaacccc

SEQ ID NO: 974897 - RNA, 18 nt, Human
ggggaaaggggaggcccc

SEQ ID NO: 974898 - RNA, 24 nt, Human
ggggcagucauggccucuggcuuu

SEQ ID NO: 974899 - RNA, 23 nt, Human
gggggcuccugccccgagggcug

SEQ ID NO: 974900 - RNA, 18 nt, Human
gggucccccuucccugcu

SEQ ID NO: 974901 - RNA, 22 nt, Human
ggucccccuucccugcucucca

SEQ ID NO: 974902 - RNA, 20 nt, Human
guaagacacagggucccucc

SEQ ID NO: 974903 - RNA, 22 nt, Human
guacaacucugucugaacaaaa

SEQ ID NO: 974904 - RNA, 18 nt, Human
guccucgugacccacacc

SEQ ID NO: 974905 - RNA, 24 nt, Human
gugaaggggauggccuaauauggg

SEQ ID NO: 974906 - RNA, 21 nt, Human
gugaaugugccccagacagag

SEQ ID NO: 974907 - RNA, 19 nt, Human
guggcuucaguacgcgcca

SEQ ID NO: 974908 - RNA, 19 nt, Human
gugguuccuggggacacug

SEQ ID NO: 974909 - RNA, 20 nt, Human
guuccacacccaaaacuaaa

SEQ ID NO: 974910 - RNA, 26 nt, Human
uaagacacagggucccuccaaccccc

SEQ ID NO: 974911 - RNA, 22 nt, Human
uaagauaccccugcgcuugugg

SEQ ID NO: 974912 - RNA, 21 nt, Human
uacaauaaacuccacucaagc

SEQ ID NO: 974913 - RNA, 18 nt, Human
uaccccacccuccuccag

SEQ ID NO: 974914 - RNA, 24 nt, Human
uacgcagcuccgugagugcgcggc

SEQ ID NO: 974915 - RNA, 21 nt, Human
uagagagauuuuauguuguca

SEQ ID NO: 974916 - RNA, 19 nt, Human
uagcagcagagacagagga

SEQ ID NO: 974917 - RNA, 20 nt, Human
uaggacuccuggagcaggac

SEQ ID NO: 974918 - RNA, 22 nt, Human
ucaagaucccuccccgccuccc

SEQ ID NO: 974919 - RNA, 22 nt, Human
ucagacccacacacccccuugc

SEQ ID NO: 974920 - RNA, 23 nt, Human
ucagacccacacacccccuugcu

SEQ ID NO: 974921 - RNA, 21 nt, Human
ucagaggcugagggcaggagg

SEQ ID NO: 974922 - RNA, 22 nt, Human
uccacacccaaaacuaaauaaa

SEQ ID NO: 974923 - RNA, 22 nt, Human
uccacaggccucaggcccaacc

SEQ ID NO: 974924 - RNA, 22 nt, Human
uccacugacaagaagaaaagcc

SEQ ID NO: 974925 - RNA, 20 nt, Human
uccagagcugggccagggcc

SEQ ID NO: 974926 - RNA, 18 nt, Human
uccagcugggagcuggga

SEQ ID NO: 974927 - RNA, 22 nt, Human
ucccaggccgacuggccuuggg

SEQ ID NO: 974928 - RNA, 22 nt, Human
ucccagggccugucccagggcu

SEQ ID NO: 974929 - RNA, 18 nt, Human
uccccacuucccacaucc

SEQ ID NO: 974930 - RNA, 22 nt, Human
uccccaggacccugauacucag

SEQ ID NO: 974931 - RNA, 23 nt, Human
uccccgccuccccacuucccaca

SEQ ID NO: 974932 - RNA, 27 nt, Human
uccccgccuccccacuucccacauccc

SEQ ID NO: 974933 - RNA, 22 nt, Human
uccccuaggucagagagggggu

SEQ ID NO: 974934 - RNA, 18 nt, Human
uccgcagccagucccggc

SEQ ID NO: 974935 - RNA, 26 nt, Human
uccgcagccccgccggcucgcaccac

SEQ ID NO: 974936 - RNA, 20 nt, Human
uccugagucccaaggugggc

SEQ ID NO: 974937 - RNA, 23 nt, Human
uccuggagcaggaccaggaaccc

SEQ ID NO: 974938 - RNA, 23 nt, Human
uccuggggacacuguuccucagg

SEQ ID NO: 974939 - RNA, 21 nt, Human
ucgccgaccaucaacuuccca

SEQ ID NO: 974940 - RNA, 23 nt, Human
ucuccaaccccugcuccuuccac

SEQ ID NO: 974941 - RNA, 21 nt, Human
ucucugggcagaggccccugg

SEQ ID NO: 974942 - RNA, 21 nt, Human
ucuggguuugguuuggcuggg

SEQ ID NO: 974943 - RNA, 21 nt, Human
ugaacagacagacacagaacc

SEQ ID NO: 974944 - RNA, 23 nt, Human
ugaagacagccagagacuuccug

SEQ ID NO: 974945 - RNA, 18 nt, Human
ugaagagccaaggggaca

SEQ ID NO: 974946 - RNA, 19 nt, Human
ugaagagugggugggacaa

SEQ ID NO: 974947 - RNA, 20 nt, Human
ugacaagaagaaaagcccau

SEQ ID NO: 974948 - RNA, 24 nt, Human
ugacacacccagaagugccaagag

SEQ ID NO: 974949 - RNA, 26 nt, Human
ugacacacccagaagugccaagagga

SEQ ID NO: 974950 - RNA, 23 nt, Human
ugacugacacacccagaagugcc

SEQ ID NO: 974951 - RNA, 19 nt, Human
ugagauggccucaccuugg

SEQ ID NO: 974952 - RNA, 21 nt, Human
ugagcagcagcugccgcaccu

SEQ ID NO: 974953 - RNA, 22 nt, Human
ugagcagcagcugccgcaccuc

SEQ ID NO: 974954 - RNA, 21 nt, Human
ugagcuccugagucccaaggu

SEQ ID NO: 974955 - RNA, 18 nt, Human
ugagcuugccgggcuuag

SEQ ID NO: 974956 - RNA, 23 nt, Human
ugaggagacuacgcagcuccgug

SEQ ID NO: 974957 - RNA, 22 nt, Human
ugaguccagcccugccucccag

SEQ ID NO: 974958 - RNA, 21 nt, Human
ugagugcgcggcacaggaggc

SEQ ID NO: 974959 - RNA, 24 nt, Human
ugcauuguccccuaggucagagag

SEQ ID NO: 974960 - RNA, 21 nt, Human
ugccagaauaccccacccucc

SEQ ID NO: 974961 - RNA, 25 nt, Human
ugccauugacuccucucaacaaccc

SEQ ID NO: 974962 - RNA, 19 nt, Human
ugcucugccacgccccugc

SEQ ID NO: 974963 - RNA, 18 nt, Human
uggagacccuuggauggc

SEQ ID NO: 974964 - RNA, 26 nt, Human
uggagacccuuggauggccgguagac

SEQ ID NO: 974965 - RNA, 25 nt, Human
uggagacccuuggauggccgguagc

SEQ ID NO: 974966 - RNA, 22 nt, Human
uggagcaggaccaggaacccca

SEQ ID NO: 974967 - RNA, 24 nt, Human
uggagcaggaccaggaaccccaaa

SEQ ID NO: 974968 - RNA, 22 nt, Human
uggcccucgcucccuccccucc

SEQ ID NO: 974969 - RNA, 22 nt, Human
uggccgcuaggcuccagaaggu

SEQ ID NO: 974970 - RNA, 21 nt, Human
uggcgcagcgccucugcaguc

SEQ ID NO: 974971 - RNA, 19 nt, Human
uggcuacacucaccuccuc

SEQ ID NO: 974972 - RNA, 26 nt, Human
uggcugagaaccaaccccaaagugaa

SEQ ID NO: 974973 - RNA, 22 nt, Human
uggcuggucugaggcccugacc

SEQ ID NO: 974974 - RNA, 19 nt, Human
ugggacaaccagaugggug

SEQ ID NO: 974975 - RNA, 22 nt, Human
ugggagcagggagggugcaggg

SEQ ID NO: 974976 - RNA, 19 nt, Human
ugggaugccuuucuccaac

SEQ ID NO: 974977 - RNA, 18 nt, Human
ugggcagaggccccuggg

SEQ ID NO: 974978 - RNA, 22 nt, Human
ugggccagccgcccccucccag

SEQ ID NO: 974979 - RNA, 23 nt, Human
ugggcugggagcagggagggugc

SEQ ID NO: 974980 - RNA, 21 nt, Human
ugggcuggggcuuauuccaca

SEQ ID NO: 974981 - RNA, 19 nt, Human
uggggcuuauuccacaaag

SEQ ID NO: 974982 - RNA, 18 nt, Human
ugggugggacaaccagau

SEQ ID NO: 974983 - RNA, 21 nt, Human
uggguuucugccccugccucc

SEQ ID NO: 974984 - RNA, 18 nt, Human
ugguggauucuccagcug

SEQ ID NO: 974985 - RNA, 23 nt, Human
ugguucuggccucugcucugagc

SEQ ID NO: 974986 - RNA, 21 nt, Human
ugucacauccaccaaaacaca

SEQ ID NO: 974987 - RNA, 22 nt, Human
uguggcaauugggaagggugug

SEQ ID NO: 974988 - RNA, 19 nt, Human
uucauacauuucuuuucuc

SEQ ID NO: 974989 - RNA, 18 nt, Human
uuccauggcuucagcugc

SEQ ID NO: 974990 - RNA, 20 nt, Human
uucggcaggacaccccagga

SEQ ID NO: 974991 - RNA, 20 nt, Human
uucugggggcagucauggcc

SEQ ID NO: 974992 - RNA, 24 nt, Human
uugcaguuugucccaccccucccc

SEQ ID NO: 974993 - RNA, 20 nt, Human
uugggaagggugugucagug

SEQ ID NO: 974994 - RNA, 22 nt, Human
uugggcugggagcagggagggu

SEQ ID NO: 974995 - RNA, 23 nt, Human
uuucagaggcugagggcaggagg

SEQ ID NO: 974996 - RNA, 19 nt, Human
uuugucccaccccucccca

SEQ ID NO: 974997 - RNA, 20 nt, Human
aaaaaaccauugaaaccaaa

SEQ ID NO: 974998 - RNA, 19 nt, Human
aaaacagcugcaacaaaga

SEQ ID NO: 974999 - RNA, 18 nt, Human
aaaguagcagagucagug

SEQ ID NO: 975000 - RNA, 18 nt, Human
aagcauuuuuucucucuc

SEQ ID NO: 975001 - RNA, 22 nt, Human
aagcugccuuauaaaucuaagu

SEQ ID NO: 975002 - RNA, 21 nt, Human
aaggagcccgagccggcaccc

SEQ ID NO: 975003 - RNA, 24 nt, Human
aaggagcccgagccggcacccaac

SEQ ID NO: 975004 - RNA, 19 nt, Human
aaugaaaauaacaaaagag

SEQ ID NO: 975005 - RNA, 22 nt, Human
acacacauacagaaaaauacaa

SEQ ID NO: 975006 - RNA, 22 nt, Human
acacaugacucggggcugaaga

SEQ ID NO: 975007 - RNA, 24 nt, Human
acaccagagagugugucucagagc

SEQ ID NO: 975008 - RNA, 23 nt, Human
acacugcugauccuaaagugagc

SEQ ID NO: 975009 - RNA, 19 nt, Human
acagaaaaauacaagacug

SEQ ID NO: 975010 - RNA, 19 nt, Human
accacacaacuaauaaggc

SEQ ID NO: 975011 - RNA, 20 nt, Human
accacacaacuaauaaggcu

SEQ ID NO: 975012 - RNA, 24 nt, Human
accacacaacuaauaaggcuauaa

SEQ ID NO: 975013 - RNA, 19 nt, Human
acggagcauccagcagccc

SEQ ID NO: 975014 - RNA, 21 nt, Human
acuaucuaugugaaccacaca

SEQ ID NO: 975015 - RNA, 26 nt, Human
acuaugacauacaaaacaugcacaau

SEQ ID NO: 975016 - RNA, 19 nt, Human
acugcucugagcaggaagc

SEQ ID NO: 975017 - RNA, 20 nt, Human
agaaaaaggcaaagugaaaa

SEQ ID NO: 975018 - RNA, 19 nt, Human
agaaugccacaacagauga

SEQ ID NO: 975019 - RNA, 22 nt, Human
agacacucacuguccucugcuc

SEQ ID NO: 975020 - RNA, 20 nt, Human
agacauacacucucuaagua

SEQ ID NO: 975021 - RNA, 22 nt, Human
agaguggggaagggcccugggu

SEQ ID NO: 975022 - RNA, 21 nt, Human
agcauuggaagcaacugacca

SEQ ID NO: 975023 - RNA, 22 nt, Human
agcuaccggaggccaccgagcg

SEQ ID NO: 975024 - RNA, 22 nt, Human
aggagcauuuccgcaggagccu

SEQ ID NO: 975025 - RNA, 21 nt, Human
aggcaaagugaaaaacaauuc

SEQ ID NO: 975026 - RNA, 24 nt, Human
aggccaccgagcgcugccaccacc

SEQ ID NO: 975027 - RNA, 20 nt, Human
aggcuuugugcauuuuuguu

SEQ ID NO: 975028 - RNA, 20 nt, Human
aggggccagcccgccagccc

SEQ ID NO: 975029 - RNA, 24 nt, Human
agugaaaaacaauuccagaaaaaa

SEQ ID NO: 975030 - RNA, 23 nt, Human
aucacaaugaacuagagcuguag

SEQ ID NO: 975031 - RNA, 22 nt, Human
aucugcaugguuugccugagcu

SEQ ID NO: 975032 - RNA, 18 nt, Human
augaaaaaacagcaacug

SEQ ID NO: 975033 - RNA, 18 nt, Human
augcaacuuuugaagaca

SEQ ID NO: 975034 - RNA, 24 nt, Human
augcaguucuuuggugaugugccc

SEQ ID NO: 975035 - RNA, 22 nt, Human
auugcuccuaacgcccacuuua

SEQ ID NO: 975036 - RNA, 18 nt, Human
caaguaacuguuuagagc

SEQ ID NO: 975037 - RNA, 20 nt, Human
cacacauacagaaaaauaca

SEQ ID NO: 975038 - RNA, 23 nt, Human
cacaugcuaucaccaauguugcu

SEQ ID NO: 975039 - RNA, 18 nt, Human
caccaauguugcuaagca

SEQ ID NO: 975040 - RNA, 23 nt, Human
caccaauguugcuaagcacugcu

SEQ ID NO: 975041 - RNA, 21 nt, Human
cacuaucuaugugaaccacac

SEQ ID NO: 975042 - RNA, 18 nt, Human
cacucccccucugugguc

SEQ ID NO: 975043 - RNA, 21 nt, Human
cacugcaugaaaaaacagcaa

SEQ ID NO: 975044 - RNA, 18 nt, Human
cagacacucacuguccuc

SEQ ID NO: 975045 - RNA, 19 nt, Human
cagcuaccggaggccaccg

SEQ ID NO: 975046 - RNA, 19 nt, Human
caggggccagcccgccagc

SEQ ID NO: 975047 - RNA, 23 nt, Human
caucaucacuucaucacauuaca

SEQ ID NO: 975048 - RNA, 24 nt, Human
caucaucacuucaucacauuacaa

SEQ ID NO: 975049 - RNA, 18 nt, Human
ccacagucacucccccuc

SEQ ID NO: 975050 - RNA, 22 nt, Human
ccagaaaaaaaaguuacgaagc

SEQ ID NO: 975051 - RNA, 18 nt, Human
ccagaucaaagcggccaa

SEQ ID NO: 975052 - RNA, 20 nt, Human
ccagcccgccagccccucug

SEQ ID NO: 975053 - RNA, 22 nt, Human
ccagcccgccagccccucugcc

SEQ ID NO: 975054 - RNA, 20 nt, Human
cccaacuccguguccaucac

SEQ ID NO: 975055 - RNA, 21 nt, Human
cccucccggccgccgaaaccc

SEQ ID NO: 975056 - RNA, 21 nt, Human
cccugggucccagccacaugc

SEQ ID NO: 975057 - RNA, 23 nt, Human
ccgaaacccccucgugccgaauu

SEQ ID NO: 975058 - RNA, 18 nt, Human
ccgcaggagccugggcaa

SEQ ID NO: 975059 - RNA, 18 nt, Human
ccgcgcccgggccugcca

SEQ ID NO: 975060 - RNA, 19 nt, Human
ccugaagggagcgccuccu

SEQ ID NO: 975061 - RNA, 23 nt, Human
cgacauacuaugacauacaaaac

SEQ ID NO: 975062 - RNA, 20 nt, Human
cggccgccgaaacccccucg

SEQ ID NO: 975063 - RNA, 20 nt, Human
cggcugggaaagaaaagugu

SEQ ID NO: 975064 - RNA, 22 nt, Human
cuaaagugagcaccauauauac

SEQ ID NO: 975065 - RNA, 23 nt, Human
cuagccuaggucuagaaaguaaa

SEQ ID NO: 975066 - RNA, 24 nt, Human
cucugcccacauggucagccacag

SEQ ID NO: 975067 - RNA, 22 nt, Human
cugcucaagaauuucaagcaag

SEQ ID NO: 975068 - RNA, 20 nt, Human
cuuuggugaugugcccacuc

SEQ ID NO: 975069 - RNA, 18 nt, Human
gaaaaacaauuccagaaa

SEQ ID NO: 975070 - RNA, 23 nt, Human
gacauacuaugacauacaaaaca

SEQ ID NO: 975071 - RNA, 18 nt, Human
gagccggcacccaacucc

SEQ ID NO: 975072 - RNA, 20 nt, Human
gagcguccguccgcagcggc

SEQ ID NO: 975073 - RNA, 26 nt, Human
gaucugcaugguuugccugagcuuuc

SEQ ID NO: 975074 - RNA, 24 nt, Human
gcacaaagaccaugcauugucaca

SEQ ID NO: 975075 - RNA, 19 nt, Human
gccagcccgccagccccuc

SEQ ID NO: 975076 - RNA, 24 nt, Human
gccccuuccauaaucagcaauuug

SEQ ID NO: 975077 - RNA, 24 nt, Human
gccgccgaaacccccucgugccga

SEQ ID NO: 975078 - RNA, 19 nt, Human
gccuaggguuuccacauca

SEQ ID NO: 975079 - RNA, 19 nt, Human
ggaaaacagcugcaacaaa

SEQ ID NO: 975080 - RNA, 21 nt, Human
ggaaagaaaagugucuagcag

SEQ ID NO: 975081 - RNA, 19 nt, Human
ggacggagcauccagcagc

SEQ ID NO: 975082 - RNA, 20 nt, Human
ggcacaaggucgcuagcugg

SEQ ID NO: 975083 - RNA, 19 nt, Human
gggaagggcccuggguccc

SEQ ID NO: 975084 - RNA, 19 nt, Human
ggggcugaagaguggggaa

SEQ ID NO: 975085 - RNA, 22 nt, Human
gguuaagggguacaaguaacug

SEQ ID NO: 975086 - RNA, 21 nt, Human
gucaacacugcugauccuaaa

SEQ ID NO: 975087 - RNA, 23 nt, Human
gugaaaaacaauuccagaaaaaa

SEQ ID NO: 975088 - RNA, 20 nt, Human
guuuuggcagaaaaaggcaa

SEQ ID NO: 975089 - RNA, 21 nt, Human
uaaacaaaggaguaagacacc

SEQ ID NO: 975090 - RNA, 21 nt, Human
uaagacaaacaggugugggua

SEQ ID NO: 975091 - RNA, 22 nt, Human
uaagacucccagggcacugcau

SEQ ID NO: 975092 - RNA, 21 nt, Human
uacaaggagcccgagccggca

SEQ ID NO: 975093 - RNA, 21 nt, Human
uacaguguccuacaagauaga

SEQ ID NO: 975094 - RNA, 22 nt, Human
uacauaauuauauauauauaca

SEQ ID NO: 975095 - RNA, 21 nt, Human
uaccccaagggucaaccacac

SEQ ID NO: 975096 - RNA, 21 nt, Human
uaccugucaauguuuacacaa

SEQ ID NO: 975097 - RNA, 20 nt, Human
uagaauugccagaaguacau

SEQ ID NO: 975098 - RNA, 18 nt, Human
uagagcuguagcuuaaaa

SEQ ID NO: 975099 - RNA, 22 nt, Human
uagcuuaagacaaacaggugug

SEQ ID NO: 975100 - RNA, 22 nt, Human
uaguucuucuaucuacauggaa

SEQ ID NO: 975101 - RNA, 18 nt, Human
uauaaaaaaccauugaaa

SEQ ID NO: 975102 - RNA, 22 nt, Human
uauaagaauaucuggugaauac

SEQ ID NO: 975103 - RNA, 18 nt, Human
uauauauacacacauaca

SEQ ID NO: 975104 - RNA, 24 nt, Human
uauccugcaaacugcauacugaau

SEQ ID NO: 975105 - RNA, 18 nt, Human
uaucuggugaauacaaaa

SEQ ID NO: 975106 - RNA, 22 nt, Human
uaugacauacaaaacaugcaca

SEQ ID NO: 975107 - RNA, 24 nt, Human
uauuuggauuuuuuuucccauuug

SEQ ID NO: 975108 - RNA, 24 nt, Human
ucaaccagcauuggaagcaacuga

SEQ ID NO: 975109 - RNA, 23 nt, Human
ucacaggaaaaaguauuuacacu

SEQ ID NO: 975110 - RNA, 19 nt, Human
ucacauuacaaaauaagau

SEQ ID NO: 975111 - RNA, 21 nt, Human
ucacauuacaaaauaagauug

SEQ ID NO: 975112 - RNA, 21 nt, Human
uccaaggcuauacauaaucac

SEQ ID NO: 975113 - RNA, 24 nt, Human
uccacaauauuuaauuuauacacu

SEQ ID NO: 975114 - RNA, 24 nt, Human
ucggcacgaggccgcgcccgggcc

SEQ ID NO: 975115 - RNA, 24 nt, Human
ucggucucacagcuauucuuaaaa

SEQ ID NO: 975116 - RNA, 22 nt, Human
ucuaaguagaguuaagacauca

SEQ ID NO: 975117 - RNA, 20 nt, Human
ucucaguccgucaccucaga

SEQ ID NO: 975118 - RNA, 25 nt, Human
ucuguacuaggcccuauaguucuuc

SEQ ID NO: 975119 - RNA, 21 nt, Human
ugaaaaaacagcaacuggccc

SEQ ID NO: 975120 - RNA, 18 nt, Human
ugaagaguggggaagggc

SEQ ID NO: 975121 - RNA, 23 nt, Human
ugcacaaagaccaugcauuguca

SEQ ID NO: 975122 - RNA, 21 nt, Human
ugcccacauggucagccacag

SEQ ID NO: 975123 - RNA, 22 nt, Human
ugccugagcuuugaacagucag

SEQ ID NO: 975124 - RNA, 23 nt, Human
ugcuagcggccagauggggccac

SEQ ID NO: 975125 - RNA, 18 nt, Human
uggaaaacagcugcaaca

SEQ ID NO: 975126 - RNA, 19 nt, Human
uggaaaacagcugcaacaa

SEQ ID NO: 975127 - RNA, 18 nt, Human
uggcuccaggccuguggg

SEQ ID NO: 975128 - RNA, 19 nt, Human
uggggaagggcccuggguc

SEQ ID NO: 975129 - RNA, 21 nt, Human
uggucuccugaagggagcgcc

SEQ ID NO: 975130 - RNA, 19 nt, Human
uggugaugugcccacucuc

SEQ ID NO: 975131 - RNA, 22 nt, Human
uguacaggaauagguuaaagca

SEQ ID NO: 975132 - RNA, 24 nt, Human
uguggucuccugaagggagcgccu

SEQ ID NO: 975133 - RNA, 18 nt, Human
ugugguuuaagguucuca

SEQ ID NO: 975134 - RNA, 23 nt, Human
uguuagacagacauacacucucu

SEQ ID NO: 975135 - RNA, 21 nt, Human
uuaaaauaguaaaaccaaaug

SEQ ID NO: 975136 - RNA, 19 nt, Human
uucuggcccuuuauaagau

SEQ ID NO: 975137 - RNA, 24 nt, Human
uuuacacugcuuggaaaacagcug

SEQ ID NO: 975138 - RNA, 18 nt, Human
uuugccaacauuugugug

SEQ ID NO: 975139 - RNA, 20 nt, Human
aagaaccaaaagcaggaaac

SEQ ID NO: 975140 - RNA, 20 nt, Human
aagcaggaaacggagccagg

SEQ ID NO: 975141 - RNA, 24 nt, Human
agaauacaaauaaaaguuuauugu

SEQ ID NO: 975142 - RNA, 24 nt, Human
agcgagguagaaggcgcacgaacc

SEQ ID NO: 975143 - RNA, 23 nt, Human
auaauuuaaguccuucacaaaaa

SEQ ID NO: 975144 - RNA, 23 nt, Human
auaguucaccaaggcuaaagaaa

SEQ ID NO: 975145 - RNA, 25 nt, Human
caaaacaaacacuguaaauaacacc

SEQ ID NO: 975146 - RNA, 18 nt, Human
cagcuucgcgcuucgucc

SEQ ID NO: 975147 - RNA, 19 nt, Human
caggaaaaccgaaacagcg

SEQ ID NO: 975148 - RNA, 24 nt, Human
caucucuaacuauuaaaaugaccc

SEQ ID NO: 975149 - RNA, 20 nt, Human
ccaaaagcaggaaacggagc

SEQ ID NO: 975150 - RNA, 18 nt, Human
ccaccuaaggccuacgcc

SEQ ID NO: 975151 - RNA, 19 nt, Human
gaaacagcgagguagaagg

SEQ ID NO: 975152 - RNA, 19 nt, Human
gaacccaccuaaggccuac

SEQ ID NO: 975153 - RNA, 24 nt, Human
gagguagaaggcgcacgaacccac

SEQ ID NO: 975154 - RNA, 22 nt, Human
ggagacaguaaaaaaucccagc

SEQ ID NO: 975155 - RNA, 19 nt, Human
uaaaaugacccagccaaau

SEQ ID NO: 975156 - RNA, 21 nt, Human
uaaguccuucacaaaaauuuc

SEQ ID NO: 975157 - RNA, 19 nt, Human
uucgcgcuucguccgcucc

SEQ ID NO: 975158 - RNA, 20 nt, Human
uucguccgcucccagcugca

SEQ ID NO: 975159 - RNA, 23 nt, Human
uuuuuuuuuuuugcacagaauac

SEQ ID NO: 975160 - RNA, 23 nt, Human
uuuuuuuuuuuuuuuuugcacag

SEQ ID NO: 975161 - RNA, 27 nt, Human
uuuuuuuuuuuuuuuuuuuuuuugggg

SEQ ID NO: 975162 - RNA, 20 nt, Human
aaacaaacacaaccuguaca

SEQ ID NO: 975163 - RNA, 18 nt, Human
aaagcaaaagaaacaaaa

SEQ ID NO: 975164 - RNA, 27 nt, Human
aaccuguacaaaaaauaucccaaaucu

SEQ ID NO: 975165 - RNA, 25 nt, Human
aagcaaaagaaacaaaaguaagaca

SEQ ID NO: 975166 - RNA, 21 nt, Human
aagccucugagccuauuaugg

SEQ ID NO: 975167 - RNA, 22 nt, Human
aagcgccuacuccaggggcucc

SEQ ID NO: 975168 - RNA, 20 nt, Human
accauauucaaauaaggcag

SEQ ID NO: 975169 - RNA, 18 nt, Human
acccuuaauuuagaagac

SEQ ID NO: 975170 - RNA, 21 nt, Human
aggaaacuacuaaaacuuuga

SEQ ID NO: 975171 - RNA, 23 nt, Human
aguaggucuuuucucuuuuauuc

SEQ ID NO: 975172 - RNA, 18 nt, Human
augaauggccggaagcgc

SEQ ID NO: 975173 - RNA, 18 nt, Human
augcagcugggcugaagc

SEQ ID NO: 975174 - RNA, 18 nt, Human
caacaaagcaaugacccu

SEQ ID NO: 975175 - RNA, 21 nt, Human
caacuaugcagcugggcugaa

SEQ ID NO: 975176 - RNA, 19 nt, Human
caacuuuuuaccagguacc

SEQ ID NO: 975177 - RNA, 22 nt, Human
cacuaaguuucagccaaccaaa

SEQ ID NO: 975178 - RNA, 18 nt, Human
cagccaaccaaagacagc

SEQ ID NO: 975179 - RNA, 23 nt, Human
cagcugggcugaagccucugagc

SEQ ID NO: 975180 - RNA, 23 nt, Human
ccaaagacagcgaacuguucaaa

SEQ ID NO: 975181 - RNA, 19 nt, Human
ccaaccaaagacagcgaac

SEQ ID NO: 975182 - RNA, 21 nt, Human
cgccgucacccucuggguccg

SEQ ID NO: 975183 - RNA, 24 nt, Human
cuaaaacuuugauauacuaaauag

SEQ ID NO: 975184 - RNA, 21 nt, Human
cuagaccccaucccauaagga

SEQ ID NO: 975185 - RNA, 21 nt, Human
cuagcggcgccgucacccucu

SEQ ID NO: 975186 - RNA, 28 nt, Human
cucacugugguaauuucgugaaugugga

SEQ ID NO: 975187 - RNA, 18 nt, Human
cugaacuguaacuaaucc

SEQ ID NO: 975188 - RNA, 20 nt, Human
gacaacaaagcaaugacccu

SEQ ID NO: 975189 - RNA, 24 nt, Human
gacccuuaauuuagaagacaacuu

SEQ ID NO: 975190 - RNA, 21 nt, Human
gagcgcgcggagcacuggggg

SEQ ID NO: 975191 - RNA, 23 nt, Human
gcuagacaacaaagcaaugaccc

SEQ ID NO: 975192 - RNA, 19 nt, Human
gcucaauuaaacucugccc

SEQ ID NO: 975193 - RNA, 22 nt, Human
guuaaguuuagccuaaagucuc

SEQ ID NO: 975194 - RNA, 24 nt, Human
uaaacaaacacaaccuguacagcg

SEQ ID NO: 975195 - RNA, 25 nt, Human
uaaaucuucaacuaugcagcugggc

SEQ ID NO: 975196 - RNA, 23 nt, Human
uaaggcaaacgcugaacuguaac

SEQ ID NO: 975197 - RNA, 24 nt, Human
uaaucuagugaccauuaacuccaa

SEQ ID NO: 975198 - RNA, 20 nt, Human
uaccagguaccuaagacucc

SEQ ID NO: 975199 - RNA, 25 nt, Human
uacccuacucuuguggcaaucacua

SEQ ID NO: 975200 - RNA, 20 nt, Human
uagaagacaacuuuuuacca

SEQ ID NO: 975201 - RNA, 19 nt, Human
uagcggcgccgucacccuc

SEQ ID NO: 975202 - RNA, 19 nt, Human
uaugaauggccggaagcgc

SEQ ID NO: 975203 - RNA, 19 nt, Human
ucaggggcuaccugauuug

SEQ ID NO: 975204 - RNA, 23 nt, Human
ucaucauaaaaagaaaaagaaaa

SEQ ID NO: 975205 - RNA, 24 nt, Human
ucaucauaaaaagaaaaagaaaaa

SEQ ID NO: 975206 - RNA, 26 nt, Human
uccccuguggguaggugccacagaau

SEQ ID NO: 975207 - RNA, 21 nt, Human
ucucuuuuauucucaaagaac

SEQ ID NO: 975208 - RNA, 19 nt, Human
ugauuugugaauuguccuu

SEQ ID NO: 975209 - RNA, 25 nt, Human
ugccacagaaugaagaguaaagcaa

SEQ ID NO: 975210 - RNA, 19 nt, Human
uggaggaaacuacuaaaac

SEQ ID NO: 975211 - RNA, 26 nt, Human
uggaguaaaacucaggaaaggagaau

SEQ ID NO: 975212 - RNA, 24 nt, Human
uuaaaaagcaaaagaaacaaaagu

SEQ ID NO: 975213 - RNA, 22 nt, Human
uuaaaaccugaucaacuaaaaa

SEQ ID NO: 975214 - RNA, 20 nt, Human
uuagaagacaacuuuuuacc

SEQ ID NO: 975215 - RNA, 26 nt, Human
uucaacuaugcagcugggcugaagcc

SEQ ID NO: 975216 - RNA, 19 nt, Human
uuuacauaucucaaguuca

SEQ ID NO: 975217 - RNA, 20 nt, Human
uuucucaguacauagaacug

SEQ ID NO: 975218 - RNA, 21 nt, Human
uuuuccauacaucacuuuccu

SEQ ID NO: 975219 - RNA, 24 nt, Human
ucaacaccaauggcagcggucuuc

SEQ ID NO: 975220 - RNA, 24 nt, Human
acaaaguucuguucaacuuagaaa

SEQ ID NO: 975221 - RNA, 28 nt, Human
agcacccacuccaaugaacucagauaac

SEQ ID NO: 975222 - RNA, 22 nt, Human
aggaagagaguucggcucuggc

SEQ ID NO: 975223 - RNA, 22 nt, Human
caaaguucuguucaacuuagaa

SEQ ID NO: 975224 - RNA, 23 nt, Human
cugcgaaagaugcuacggcgaag

SEQ ID NO: 975225 - RNA, 20 nt, Human
gaaagaugcuacggcgaagg

SEQ ID NO: 975226 - RNA, 24 nt, Human
ggcaggaagagaguucggcucugg

SEQ ID NO: 975227 - RNA, 18 nt, Human
uccgcugcgaaagaugcu

SEQ ID NO: 975228 - RNA, 22 nt, Human
ucuaaagagaaagauggcaaaa

SEQ ID NO: 975229 - RNA, 21 nt, Human
uggcaaaagauaccuagauau

SEQ ID NO: 975230 - RNA, 23 nt, Human
uuccccugaucuaaagagaaaga

SEQ ID NO: 975231 - RNA, 18 nt, Human
uaaaaaaaaucccccaca

SEQ ID NO: 975232 - RNA, 21 nt, Human
uaaaaaaaaucccccacaaaa

SEQ ID NO: 975233 - RNA, 21 nt, Human
aaacuggaaugagagcugaua

SEQ ID NO: 975234 - RNA, 22 nt, Human
aacccuuugaaaucaaugucaa

SEQ ID NO: 975235 - RNA, 21 nt, Human
aauaugaaaauguacaugacc

SEQ ID NO: 975236 - RNA, 18 nt, Human
caggcccuauggagagag

SEQ ID NO: 975237 - RNA, 19 nt, Human
cucccgcuguaggcccggc

SEQ ID NO: 975238 - RNA, 24 nt, Human
gaacgcaacgcacggcuuuccuca

SEQ ID NO: 975239 - RNA, 21 nt, Human
gaugccuuggaacgcaacgca

SEQ ID NO: 975240 - RNA, 23 nt, Human
gcaacgcacggcuuuccucacgc

SEQ ID NO: 975241 - RNA, 21 nt, Human
ggcuuuccucacgcucccgcu

SEQ ID NO: 975242 - RNA, 22 nt, Human
uaacaaaaagucuaauaugaaa

SEQ ID NO: 975243 - RNA, 22 nt, Human
uaagauucuuucacuuuaaugc

SEQ ID NO: 975244 - RNA, 25 nt, Human
uauauucagaacaucugagaaagca

SEQ ID NO: 975245 - RNA, 22 nt, Human
ucacagaugccuuggaacgcaa

SEQ ID NO: 975246 - RNA, 18 nt, Human
ucacgcucccgcuguagg

SEQ ID NO: 975247 - RNA, 20 nt, Human
ucagaacaucugagaaagca

SEQ ID NO: 975248 - RNA, 23 nt, Human
ucuauauucagaacaucugagaa

SEQ ID NO: 975249 - RNA, 18 nt, Human
uggaaugagagcugauau

SEQ ID NO: 975250 - RNA, 21 nt, Human
uggagagaggacauggguuuc

SEQ ID NO: 975251 - RNA, 19 nt, Human
uuagaaaaaacuggaaugg

SEQ ID NO: 975252 - RNA, 22 nt, Human
uuuuuuuuuuuuucgcauuuaa

SEQ ID NO: 975253 - RNA, 18 nt, Human
uuuuuuuuuuuuuuuucg

SEQ ID NO: 975254 - RNA, 20 nt, Human
uuuuuuuuuuuuuuuuucgc

SEQ ID NO: 975255 - RNA, 24 nt, Human
aacccccagacuccgacccgcgcu

SEQ ID NO: 975256 - RNA, 20 nt, Human
accauguuuucuuuguuugc

SEQ ID NO: 975257 - RNA, 21 nt, Human
agagggagcagggcgcggguc

SEQ ID NO: 975258 - RNA, 20 nt, Human
cccccagacuccgacccgcc

SEQ ID NO: 975259 - RNA, 20 nt, Human
cccuacuuggagcagaucga

SEQ ID NO: 975260 - RNA, 26 nt, Human
gggcgcgaacccccagacuccgaccc

SEQ ID NO: 975261 - RNA, 20 nt, Human
uggagcagaucgagucucag

SEQ ID NO: 975262 - RNA, 20 nt, Human
uucaaaauaccauguuuucu

SEQ ID NO: 975263 - RNA, 24 nt, Human
aaaaaaacacacacggacagucgg

SEQ ID NO: 975264 - RNA, 18 nt, Human
aaccaaaaaaaacacaca

SEQ ID NO: 975265 - RNA, 26 nt, Human
aagcaacccugaacccuggggagggu

SEQ ID NO: 975266 - RNA, 21 nt, Human
acaggaacccuucacaguuga

SEQ ID NO: 975267 - RNA, 23 nt, Human
acccuucucuccccagccuggag

SEQ ID NO: 975268 - RNA, 20 nt, Human
agaacgggagggcgcuaaac

SEQ ID NO: 975269 - RNA, 21 nt, Human
agacaaauggacagaacggga

SEQ ID NO: 975270 - RNA, 18 nt, Human
agaggcuggaucauggug

SEQ ID NO: 975271 - RNA, 23 nt, Human
aggaacccuucacaguugacguc

SEQ ID NO: 975272 - RNA, 23 nt, Human
caaauggacagaacgggagggcg

SEQ ID NO: 975273 - RNA, 22 nt, Human
caacagguacaaaauguuucaa

SEQ ID NO: 975274 - RNA, 19 nt, Human
caaccaaaaaaaacacacc

SEQ ID NO: 975275 - RNA, 19 nt, Human
cacccuucucuccccagcc

SEQ ID NO: 975276 - RNA, 25 nt, Human
cacccuucucuccccagccuggaga

SEQ ID NO: 975277 - RNA, 18 nt, Human
caccuccaugccuucugc

SEQ ID NO: 975278 - RNA, 18 nt, Human
caggagugugaggcagag

SEQ ID NO: 975279 - RNA, 22 nt, Human
ccaaaaaaaacacacacggaca

SEQ ID NO: 975280 - RNA, 19 nt, Human
ccaaccaaaaaaaacacac

SEQ ID NO: 975281 - RNA, 21 nt, Human
ccagccagcacagggaagcug

SEQ ID NO: 975282 - RNA, 22 nt, Human
ccucgccuggucacccuucucu

SEQ ID NO: 975283 - RNA, 23 nt, Human
ccucgccuggucacccuucucuc

SEQ ID NO: 975284 - RNA, 24 nt, Human
cgggagggcgcuaaacgcaaucac

SEQ ID NO: 975285 - RNA, 23 nt, Human
cuccccagccuggagacagacca

SEQ ID NO: 975286 - RNA, 21 nt, Human
cuccucgccuggucacccuuc

SEQ ID NO: 975287 - RNA, 22 nt, Human
cucuccccagccuggagacaga

SEQ ID NO: 975288 - RNA, 22 nt, Human
cugcaaagcaacccugaacccu

SEQ ID NO: 975289 - RNA, 18 nt, Human
gacagucggcagacaaga

SEQ ID NO: 975290 - RNA, 20 nt, Human
gcaaagcaacccugaacccu

SEQ ID NO: 975291 - RNA, 21 nt, Human
gcaaagcaacccugaacccug

SEQ ID NO: 975292 - RNA, 24 nt, Human
ggggacuccagccagcacagggaa

SEQ ID NO: 975293 - RNA, 19 nt, Human
ggggaggguggguucagag

SEQ ID NO: 975294 - RNA, 20 nt, Human
ggguggugaggaccgggaag

SEQ ID NO: 975295 - RNA, 22 nt, Human
gguggcugauaucucuggggac

SEQ ID NO: 975296 - RNA, 22 nt, Human
gguggugaggaccgggaaggaa

SEQ ID NO: 975297 - RNA, 19 nt, Human
uaaaaucaacagguacaaa

SEQ ID NO: 975298 - RNA, 22 nt, Human
uaaaaucaacagguacaaaaug

SEQ ID NO: 975299 - RNA, 20 nt, Human
uaaacgcaaucacaggaacc

SEQ ID NO: 975300 - RNA, 23 nt, Human
uaaacugauaaauaaaaucaaca

SEQ ID NO: 975301 - RNA, 21 nt, Human
uagaaaaauaaacugauaaau

SEQ ID NO: 975302 - RNA, 26 nt, Human
ucacccuucucuccccagccuggaga

SEQ ID NO: 975303 - RNA, 18 nt, Human
ucaugguggggcagaggg

SEQ ID NO: 975304 - RNA, 22 nt, Human
uuuuuuuuuuuuuuuuuuucag

SEQ ID NO: 975305 - RNA, 22 nt, Human
aagagaaaaaccagacucccca

SEQ ID NO: 975306 - RNA, 22 nt, Human
aagcgcccagggcagagggcag

SEQ ID NO: 975307 - RNA, 22 nt, Human
accccaggguacuccagcuuca

SEQ ID NO: 975308 - RNA, 21 nt, Human
agaccaauccagucucccuca

SEQ ID NO: 975309 - RNA, 24 nt, Human
aggagagagacaggaugaagagaa

SEQ ID NO: 975310 - RNA, 26 nt, Human
aggcagucgguggaggcccagcucag

SEQ ID NO: 975311 - RNA, 21 nt, Human
aggccggggcggggcccggga

SEQ ID NO: 975312 - RNA, 19 nt, Human
agggcagcgggggcccggc

SEQ ID NO: 975313 - RNA, 23 nt, Human
aucuccucuucuuucucuugcug

SEQ ID NO: 975314 - RNA, 20 nt, Human
caccccaucacaggcagagu

SEQ ID NO: 975315 - RNA, 18 nt, Human
cacucuguccugcgucug

SEQ ID NO: 975316 - RNA, 22 nt, Human
cagcccaggggugagcaggcag

SEQ ID NO: 975317 - RNA, 19 nt, Human
cagccgccacccuaccccg

SEQ ID NO: 975318 - RNA, 19 nt, Human
caggcagaguccacucugu

SEQ ID NO: 975319 - RNA, 23 nt, Human
cagugcuggggagggggccucgg

SEQ ID NO: 975320 - RNA, 22 nt, Human
ccccaggguacuccagcuucag

SEQ ID NO: 975321 - RNA, 23 nt, Human
ccccaggguacuccagcuucaga

SEQ ID NO: 975322 - RNA, 18 nt, Human
ccccgggccgccgcgcuc

SEQ ID NO: 975323 - RNA, 19 nt, Human
cccucagcccaggggugag

SEQ ID NO: 975324 - RNA, 20 nt, Human
ccgccgcgcucgcccugucc

SEQ ID NO: 975325 - RNA, 21 nt, Human
ccgccgcgcucgcccuguccc

SEQ ID NO: 975326 - RNA, 18 nt, Human
ccgcuccgaccaagcgcc

SEQ ID NO: 975327 - RNA, 18 nt, Human
ccucuccucucccuuccc

SEQ ID NO: 975328 - RNA, 21 nt, Human
ccuuguuccucuccucucccu

SEQ ID NO: 975329 - RNA, 22 nt, Human
cgcccagggcagagggcagcgg

SEQ ID NO: 975330 - RNA, 21 nt, Human
cggcagcucagcuguuggcug

SEQ ID NO: 975331 - RNA, 18 nt, Human
cggcugggccagccgcca

SEQ ID NO: 975332 - RNA, 20 nt, Human
cggggcggggcccgggagcc

SEQ ID NO: 975333 - RNA, 22 nt, Human
cugggccccaagaccaauccag

SEQ ID NO: 975334 - RNA, 18 nt, Human
cuggggagggggccucgg

SEQ ID NO: 975335 - RNA, 24 nt, Human
cugggggcggggcuacccuggggu

SEQ ID NO: 975336 - RNA, 21 nt, Human
cuuucucuugcugcugacccc

SEQ ID NO: 975337 - RNA, 23 nt, Human
gaggggggcagcaggaaggccac

SEQ ID NO: 975338 - RNA, 21 nt, Human
gcaaaugcaggaggccggggc

SEQ ID NO: 975339 - RNA, 20 nt, Human
gcagcaggaaggccacccca

SEQ ID NO: 975340 - RNA, 27 nt, Human
gcagcaggaaggccaccccaucacagg

SEQ ID NO: 975341 - RNA, 22 nt, Human
gccccaagaccaauccagucuc

SEQ ID NO: 975342 - RNA, 22 nt, Human
gcccugucccgcuuugcccagc

SEQ ID NO: 975343 - RNA, 21 nt, Human
gccgccgcgcucgcccugucc

SEQ ID NO: 975344 - RNA, 19 nt, Human
gccucgggcaaaugcagga

SEQ ID NO: 975345 - RNA, 18 nt, Human
ggacaccccucuucaggg

SEQ ID NO: 975346 - RNA, 24 nt, Human
ggcaaaugcaggaggccggggcgg

SEQ ID NO: 975347 - RNA, 18 nt, Human
ggccaccccaucacaggc

SEQ ID NO: 975348 - RNA, 18 nt, Human
gggcagagggcagcgggg

SEQ ID NO: 975349 - RNA, 20 nt, Human
gggcagagggcagcgggggc

SEQ ID NO: 975350 - RNA, 23 nt, Human
gguggcagggcugaggggaaaaa

SEQ ID NO: 975351 - RNA, 18 nt, Human
gguguggccagugcuggg

SEQ ID NO: 975352 - RNA, 24 nt, Human
gguugggguuucggaggcccuugu

SEQ ID NO: 975353 - RNA, 18 nt, Human
guccugggccccaagacc

SEQ ID NO: 975354 - RNA, 19 nt, Human
ucaggauccgcacaggggc

SEQ ID NO: 975355 - RNA, 21 nt, Human
uccugggccccaagaccaauc

SEQ ID NO: 975356 - RNA, 21 nt, Human
ucgccuccgagcccccgggcc

SEQ ID NO: 975357 - RNA, 21 nt, Human
ucucccuucccucagcccagg

SEQ ID NO: 975358 - RNA, 20 nt, Human
ucuggguccugggccccaag

SEQ ID NO: 975359 - RNA, 20 nt, Human
ucuguccugcgucugggucc

SEQ ID NO: 975360 - RNA, 22 nt, Human
ucuguguacacaaaauaucucu

SEQ ID NO: 975361 - RNA, 22 nt, Human
ucuucuuucucuugcugcugac

SEQ ID NO: 975362 - RNA, 21 nt, Human
ugaagagaaaaaccagacucc

SEQ ID NO: 975363 - RNA, 24 nt, Human
ugagcaggcagucgguggaggccc

SEQ ID NO: 975364 - RNA, 24 nt, Human
ugccugugugcucacaggcuguuu

SEQ ID NO: 975365 - RNA, 22 nt, Human
ugcuggggagggggccucgggc

SEQ ID NO: 975366 - RNA, 23 nt, Human
uggacaccccucuucagggcuag

SEQ ID NO: 975367 - RNA, 27 nt, Human
uggcuggggucaggauccgcacagggg

SEQ ID NO: 975368 - RNA, 21 nt, Human
uggcuuaggggccucgaggag

SEQ ID NO: 975369 - RNA, 20 nt, Human
ugggaccucuggggguggcu

SEQ ID NO: 975370 - RNA, 22 nt, Human
ugggggcggggcuacccugggg

SEQ ID NO: 975371 - RNA, 20 nt, Human
ugggguguggccagugcugg

SEQ ID NO: 975372 - RNA, 21 nt, Human
uggguccugggccccaagacc

SEQ ID NO: 975373 - RNA, 19 nt, Human
ugguggaggggggcagcag

SEQ ID NO: 975374 - RNA, 24 nt, Human
ugucauggacaccccucuucaggg

SEQ ID NO: 975375 - RNA, 23 nt, Human
uguggccagugcuggggaggggg

SEQ ID NO: 975376 - RNA, 20 nt, Human
uguuuauuuauccaagagua

SEQ ID NO: 975377 - RNA, 23 nt, Human
uugcccagcccgcuccgaccaag

SEQ ID NO: 975378 - RNA, 19 nt, Human
aagauaaaaacaauuggaa

SEQ ID NO: 975379 - RNA, 23 nt, Human
aagcaacugagugagaacaagcu

SEQ ID NO: 975380 - RNA, 19 nt, Human
aauuccucccagaccccua

SEQ ID NO: 975381 - RNA, 21 nt, Human
acacaagggcaaauuuacauc

SEQ ID NO: 975382 - RNA, 22 nt, Human
accacaaaggaugucguuugaa

SEQ ID NO: 975383 - RNA, 25 nt, Human
acugaaggacagagacuguguucca

SEQ ID NO: 975384 - RNA, 18 nt, Human
agaauuccucccagaccc

SEQ ID NO: 975385 - RNA, 22 nt, Human
agaauuguuucucacaccauau

SEQ ID NO: 975386 - RNA, 22 nt, Human
agucauggggugugucaaugaa

SEQ ID NO: 975387 - RNA, 22 nt, Human
auauuauuuucucuacaaaagg

SEQ ID NO: 975388 - RNA, 21 nt, Human
aucagcaaauuaaagugcauc

SEQ ID NO: 975389 - RNA, 22 nt, Human
caaaaaagcuguacugaaggac

SEQ ID NO: 975390 - RNA, 23 nt, Human
caaaauaccuaaaacaaccugca

SEQ ID NO: 975391 - RNA, 20 nt, Human
caaagcaacugagugagaac

SEQ ID NO: 975392 - RNA, 23 nt, Human
cagugauccaagggagaauaguc

SEQ ID NO: 975393 - RNA, 24 nt, Human
cauucuguuuauuucaagaagugu

SEQ ID NO: 975394 - RNA, 21 nt, Human
ccuccagaauuccucccagac

SEQ ID NO: 975395 - RNA, 19 nt, Human
ccucccagaccccuauaga

SEQ ID NO: 975396 - RNA, 18 nt, Human
cgggggacauuuuaguuc

SEQ ID NO: 975397 - RNA, 20 nt, Human
cuccuccagaauuccuccca

SEQ ID NO: 975398 - RNA, 21 nt, Human
cugaguaaauugcacaccucu

SEQ ID NO: 975399 - RNA, 21 nt, Human
gaaauuuuccaucacucauaa

SEQ ID NO: 975400 - RNA, 22 nt, Human
gaccccuauagaaaaaugauuc

SEQ ID NO: 975401 - RNA, 18 nt, Human
gagcaagaguacuccuca

SEQ ID NO: 975402 - RNA, 21 nt, Human
gaggggguaauagggaggcac

SEQ ID NO: 975403 - RNA, 25 nt, Human
gcaauacacuuacugguacaaagca

SEQ ID NO: 975404 - RNA, 20 nt, Human
uaaaacaaccugcauaguug

SEQ ID NO: 975405 - RNA, 22 nt, Human
uaaaacaaccugcauaguuggc

SEQ ID NO: 975406 - RNA, 22 nt, Human
uaaggaagggggccgggaggcg

SEQ ID NO: 975407 - RNA, 22 nt, Human
uaaggcuuucaaauuucccagc

SEQ ID NO: 975408 - RNA, 27 nt, Human
uaaucuguggagcaagaguacuccucu

SEQ ID NO: 975409 - RNA, 21 nt, Human
uacaaagcaacugagugagaa

SEQ ID NO: 975410 - RNA, 21 nt, Human
uacaaaucucuuucaaaccaa

SEQ ID NO: 975411 - RNA, 19 nt, Human
uacaucagcaaauuaaagu

SEQ ID NO: 975412 - RNA, 18 nt, Human
uagaugucuuuucagucu

SEQ ID NO: 975413 - RNA, 19 nt, Human
uagcucuccacccucuuuu

SEQ ID NO: 975414 - RNA, 18 nt, Human
uaggacaaaauaccuaaa

SEQ ID NO: 975415 - RNA, 19 nt, Human
uaggacaaaauaccuaaaa

SEQ ID NO: 975416 - RNA, 21 nt, Human
uagguaaaauacaaaucucuu

SEQ ID NO: 975417 - RNA, 20 nt, Human
ucaaaaaagcuguacugaag

SEQ ID NO: 975418 - RNA, 21 nt, Human
ucaaaaaagcuguacugaagg

SEQ ID NO: 975419 - RNA, 20 nt, Human
ucaaaccaaggaagaaauga

SEQ ID NO: 975420 - RNA, 20 nt, Human
ucacauuguaucuaucaugg

SEQ ID NO: 975421 - RNA, 18 nt, Human
uccaagggagaauagucc

SEQ ID NO: 975422 - RNA, 23 nt, Human
uccacaugaccuucuuuuucugc

SEQ ID NO: 975423 - RNA, 19 nt, Human
uccacccucuuuucacaaa

SEQ ID NO: 975424 - RNA, 23 nt, Human
ucccucauaauacaagauagggc

SEQ ID NO: 975425 - RNA, 22 nt, Human
uccuuuggaaguucuucggaau

SEQ ID NO: 975426 - RNA, 23 nt, Human
ucuacaaaagguuuuggguucac

SEQ ID NO: 975427 - RNA, 22 nt, Human
ucuccacccucuuuucacaaaa

SEQ ID NO: 975428 - RNA, 27 nt, Human
ucugccgaaauuuugauuugccuccaa

SEQ ID NO: 975429 - RNA, 19 nt, Human
ugaaggacagagacugugu

SEQ ID NO: 975430 - RNA, 21 nt, Human
ugagaacaagcuguucuguuc

SEQ ID NO: 975431 - RNA, 23 nt, Human
ugaguagcucuccacccucuuuu

SEQ ID NO: 975432 - RNA, 24 nt, Human
ugagugagaacaagcuguucuguu

SEQ ID NO: 975433 - RNA, 20 nt, Human
ugccgagcaaugaaauuaga

SEQ ID NO: 975434 - RNA, 23 nt, Human
uggaccuuugagcauuucaaccc

SEQ ID NO: 975435 - RNA, 23 nt, Human
uggcauauuugauugacuuuggc

SEQ ID NO: 975436 - RNA, 22 nt, Human
uguagagggagggguacuuuuc

SEQ ID NO: 975437 - RNA, 23 nt, Human
ugucccucauaauacaagauagg

SEQ ID NO: 975438 - RNA, 20 nt, Human
ugugucaaugaagaguucag

SEQ ID NO: 975439 - RNA, 19 nt, Human
uuauauuauuuucucuaca

SEQ ID NO: 975440 - RNA, 22 nt, Human
uucaaaccaaggaagaaaugag

SEQ ID NO: 975441 - RNA, 28 nt, Human
uucaaauaauuuauucuuuugucuccac

SEQ ID NO: 975442 - RNA, 21 nt, Human
uuccaaaacaguugcaauccc

SEQ ID NO: 975443 - RNA, 20 nt, Human
uucccagccuuucacauuua

SEQ ID NO: 975444 - RNA, 26 nt, Human
uucucgggcaaucucaacauucuggg

SEQ ID NO: 975445 - RNA, 18 nt, Human
uugcuggggucacuucuc

SEQ ID NO: 975446 - RNA, 24 nt, Human
uuucacauuguaucuaucaugggu

SEQ ID NO: 975447 - RNA, 21 nt, Human
uuuuaugucccucauaauaca

SEQ ID NO: 975448 - RNA, 19 nt, Human
uuuugagguuccacaugac

SEQ ID NO: 975449 - RNA, 23 nt, Human
auaaaacaacacaaaguugcaau

SEQ ID NO: 975450 - RNA, 19 nt, Human
cacaacuauaggcucauca

SEQ ID NO: 975451 - RNA, 21 nt, Human
uaucacaacuauaggcucauu

SEQ ID NO: 975452 - RNA, 19 nt, Human
ucagcacucaacagaaaca

SEQ ID NO: 975453 - RNA, 19 nt, Human
aacaccagacccaaaaccc

SEQ ID NO: 975454 - RNA, 22 nt, Human
aacccgcuuuucuucacgcucu

SEQ ID NO: 975455 - RNA, 21 nt, Human
acgcagcaacaccagacccaa

SEQ ID NO: 975456 - RNA, 22 nt, Human
acgcggguucuccuagaaacaa

SEQ ID NO: 975457 - RNA, 18 nt, Human
agcaauacuggcagucgc

SEQ ID NO: 975458 - RNA, 18 nt, Human
agcugcccuaccaacccc

SEQ ID NO: 975459 - RNA, 20 nt, Human
aggugccaaugaagauucgg

SEQ ID NO: 975460 - RNA, 19 nt, Human
agguggaccucuaaugccu

SEQ ID NO: 975461 - RNA, 21 nt, Human
caaaagccuuaaaggugccaa

SEQ ID NO: 975462 - RNA, 24 nt, Human
caaaagccuuaaaggugccaauga

SEQ ID NO: 975463 - RNA, 18 nt, Human
caacagcagcagcugcua

SEQ ID NO: 975464 - RNA, 19 nt, Human
caacagcagcagcugcuac

SEQ ID NO: 975465 - RNA, 23 nt, Human
caacaguaugcuaaggucuuggu

SEQ ID NO: 975466 - RNA, 21 nt, Human
caacagucaugauugcuguuc

SEQ ID NO: 975467 - RNA, 22 nt, Human
caaccccagggccuccagcagc

SEQ ID NO: 975468 - RNA, 21 nt, Human
cagauuccucgcuacuccaaa

SEQ ID NO: 975469 - RNA, 18 nt, Human
cagcaacaccagacccaa

SEQ ID NO: 975470 - RNA, 22 nt, Human
cagcaacaccagacccaaaacc

SEQ ID NO: 975471 - RNA, 25 nt, Human
cagcaauacuggcagucgcagcaac

SEQ ID NO: 975472 - RNA, 21 nt, Human
cagcagcagcugcuacagugc

SEQ ID NO: 975473 - RNA, 20 nt, Human
cagcaucuugcuacucuugc

SEQ ID NO: 975474 - RNA, 24 nt, Human
caucucauucuauagucaaugugc

SEQ ID NO: 975475 - RNA, 20 nt, Human
caucuugcuacucuugccaa

SEQ ID NO: 975476 - RNA, 22 nt, Human
caucuugcuacucuugccaaca

SEQ ID NO: 975477 - RNA, 27 nt, Human
ccaaauccaauguccacaguuaaaacu

SEQ ID NO: 975478 - RNA, 21 nt, Human
ccacagucauggauaccaagu

SEQ ID NO: 975479 - RNA, 18 nt, Human
ccaccaaauccaaugucc

SEQ ID NO: 975480 - RNA, 21 nt, Human
ccacgcagcaacaccagaccc

SEQ ID NO: 975481 - RNA, 21 nt, Human
cccacgcagcaacaccagacc

SEQ ID NO: 975482 - RNA, 23 nt, Human
ccccacgcagcaacaccagaccc

SEQ ID NO: 975483 - RNA, 24 nt, Human
ccccagggccuccagcagcuccag

SEQ ID NO: 975484 - RNA, 27 nt, Human
ccccagggccuccagcagcuccagcaa

SEQ ID NO: 975485 - RNA, 26 nt, Human
cccccaacuccucggacagggccugc

SEQ ID NO: 975486 - RNA, 23 nt, Human
cccucgagcagggggaagcccaa

SEQ ID NO: 975487 - RNA, 18 nt, Human
ccugccaauccagcaggg

SEQ ID NO: 975488 - RNA, 20 nt, Human
ccugcugggaugguccccca

SEQ ID NO: 975489 - RNA, 24 nt, Human
cgucacugaccgcuccucagacag

SEQ ID NO: 975490 - RNA, 23 nt, Human
cuccacagucauggauaccaagu

SEQ ID NO: 975491 - RNA, 18 nt, Human
cucuaccagcugcccuac

SEQ ID NO: 975492 - RNA, 20 nt, Human
cugcagcaucuugcuacucu

SEQ ID NO: 975493 - RNA, 18 nt, Human
gacagggccugccaaucc

SEQ ID NO: 975494 - RNA, 21 nt, Human
gaccgcuccucagacagaugc

SEQ ID NO: 975495 - RNA, 19 nt, Human
gcaacaccagacccaaaac

SEQ ID NO: 975496 - RNA, 21 nt, Human
gcagcaacaccagacccaaaa

SEQ ID NO: 975497 - RNA, 20 nt, Human
gccaauccagcaggggccug

SEQ ID NO: 975498 - RNA, 19 nt, Human
gcuacagugccucuucccu

SEQ ID NO: 975499 - RNA, 19 nt, Human
gcugcagcaucuugcuacu

SEQ ID NO: 975500 - RNA, 24 nt, Human
ggaacaaaaagcucacaaacacuc

SEQ ID NO: 975501 - RNA, 19 nt, Human
ggaggagccauaaugccug

SEQ ID NO: 975502 - RNA, 24 nt, Human
ggcagucgcagcaacagcagcagc

SEQ ID NO: 975503 - RNA, 24 nt, Human
gggaauuggcacaccagcugguac

SEQ ID NO: 975504 - RNA, 19 nt, Human
gggccuccagcagcuccag

SEQ ID NO: 975505 - RNA, 21 nt, Human
gggccugccaauccagcaggg

SEQ ID NO: 975506 - RNA, 20 nt, Human
gggcuccagcaauacuggca

SEQ ID NO: 975507 - RNA, 18 nt, Human
uaaaacuugaugcuucug

SEQ ID NO: 975508 - RNA, 22 nt, Human
uaccagcugcccuaccaacccc

SEQ ID NO: 975509 - RNA, 24 nt, Human
uaccagcugcccuaccaaccccag

SEQ ID NO: 975510 - RNA, 20 nt, Human
uacuggcagucgcagcaaca

SEQ ID NO: 975511 - RNA, 24 nt, Human
uagauggagccugguuuuugcuug

SEQ ID NO: 975512 - RNA, 18 nt, Human
ucccggaggcggcaugcc

SEQ ID NO: 975513 - RNA, 22 nt, Human
ucccuguggagucauuaccugc

SEQ ID NO: 975514 - RNA, 21 nt, Human
ucuccuagaaacaaugcaagc

SEQ ID NO: 975515 - RNA, 23 nt, Human
ucuccuagaaacaaugcaagcuc

SEQ ID NO: 975516 - RNA, 22 nt, Human
ucuuugggggguggccccucca

SEQ ID NO: 975517 - RNA, 23 nt, Human
ugagauggaucaacaguaugcua

SEQ ID NO: 975518 - RNA, 21 nt, Human
ugcaagcugggcagaagcuuc

SEQ ID NO: 975519 - RNA, 19 nt, Human
ugcaggggaaaaagugacu

SEQ ID NO: 975520 - RNA, 27 nt, Human
ugcccuaccaaccccagggccuccagc

SEQ ID NO: 975521 - RNA, 20 nt, Human
ugccuggaggugggguugcu

SEQ ID NO: 975522 - RNA, 21 nt, Human
ugggggcggagugccccgucc

SEQ ID NO: 975523 - RNA, 20 nt, Human
ugguacccgagcaaugccag

SEQ ID NO: 975524 - RNA, 21 nt, Human
uguuggggcuccagcaauacu

SEQ ID NO: 975525 - RNA, 20 nt, Human
uucaaagaguagauggagcc

SEQ ID NO: 975526 - RNA, 23 nt, Human
uuccugggggagguggaccucua

SEQ ID NO: 975527 - RNA, 21 nt, Human
uugcucugccgacgggugggg

SEQ ID NO: 975528 - RNA, 24 nt, Human
uugguggacgcauuccugggggag

SEQ ID NO: 975529 - RNA, 20 nt, Human
aaacaaauaguugcaccaag

SEQ ID NO: 975530 - RNA, 27 nt, Human
agaagcacaaacacaacccacucuuua

SEQ ID NO: 975531 - RNA, 18 nt, Human
agcaagagguuacuuugc

SEQ ID NO: 975532 - RNA, 23 nt, Human
caaaguagaauuuucuauccccc

SEQ ID NO: 975533 - RNA, 23 nt, Human
caagagguuacuuugcccacucc

SEQ ID NO: 975534 - RNA, 21 nt, Human
caggacaguuccaguauguga

SEQ ID NO: 975535 - RNA, 27 nt, Human
cauuaaccccaaacuacuagugucaca

SEQ ID NO: 975536 - RNA, 19 nt, Human
gagaagcacaaacacaacc

SEQ ID NO: 975537 - RNA, 19 nt, Human
gagaagcacaaacacaacc

SEQ ID NO: 975538 - RNA, 20 nt, Human
gcacaaacacaacccacucu

SEQ ID NO: 975539 - RNA, 27 nt, Human
ggguaagaguucauucacuuuggagag

SEQ ID NO: 975540 - RNA, 19 nt, Human
uacuuugcccacuccaaau

SEQ ID NO: 975541 - RNA, 24 nt, Human
uccaaauuaaaacagagcacaaaa

SEQ ID NO: 975542 - RNA, 19 nt, Human
ugaaacaaauaguugcacc

SEQ ID NO: 975543 - RNA, 21 nt, Human
ugaacaucuuccuccucacug

SEQ ID NO: 975544 - RNA, 22 nt, Human
ugggagaagcacaaacacaacc

SEQ ID NO: 975545 - RNA, 24 nt, Human
ugggagaagcacaaacacaaccca

SEQ ID NO: 975546 - RNA, 25 nt, Human
uugaaacaaauaguugcaccaagca

SEQ ID NO: 975547 - RNA, 18 nt, Human
uuuuuuuuuuuuuuuuug

SEQ ID NO: 975548 - RNA, 19 nt, Human
uuuuuuuuuuuuuuuuugu

SEQ ID NO: 975549 - RNA, 23 nt, Human
aaaaaaaagacauuuuaugaaaa

SEQ ID NO: 975550 - RNA, 20 nt, Human
aaaacauguaagucauuuca

SEQ ID NO: 975551 - RNA, 26 nt, Human
aaagaaaaaaaggacaaauuaaagaa

SEQ ID NO: 975552 - RNA, 21 nt, Human
aaggauaguauuguauucaca

SEQ ID NO: 975553 - RNA, 28 nt, Human
aaggauaguauuguauucacaggaucaa

SEQ ID NO: 975554 - RNA, 26 nt, Human
aaguaaccaccacugauacugaaagu

SEQ ID NO: 975555 - RNA, 18 nt, Human
acauggaugaaacuuggg

SEQ ID NO: 975556 - RNA, 18 nt, Human
accaaagaaaaaaaggac

SEQ ID NO: 975557 - RNA, 22 nt, Human
accaaagaaaaaaaggacaaau

SEQ ID NO: 975558 - RNA, 23 nt, Human
acccaaaagcauaguguuuugcc

SEQ ID NO: 975559 - RNA, 21 nt, Human
accuaaaauaagacaacauaa

SEQ ID NO: 975560 - RNA, 24 nt, Human
acugccccacugauacaagaagga

SEQ ID NO: 975561 - RNA, 25 nt, Human
agaaaaaaaggacaaauuaaagaaa

SEQ ID NO: 975562 - RNA, 23 nt, Human
agacaacauaaaaauaccacuaa

SEQ ID NO: 975563 - RNA, 22 nt, Human
agauaucuuugggacacuaaaa

SEQ ID NO: 975564 - RNA, 26 nt, Human
augauaaugaaaacaaauuauuuguc

SEQ ID NO: 975565 - RNA, 22 nt, Human
caacauaaaaauaccacuaaua

SEQ ID NO: 975566 - RNA, 19 nt, Human
caaggcaggagucccugac

SEQ ID NO: 975567 - RNA, 23 nt, Human
caccuccauucucucacugagga

SEQ ID NO: 975568 - RNA, 22 nt, Human
caccuccauucucucacuggcc

SEQ ID NO: 975569 - RNA, 22 nt, Human
cacugccccacugauacaagaa

SEQ ID NO: 975570 - RNA, 23 nt, Human
cagcacaggacacgaucaaucuu

SEQ ID NO: 975571 - RNA, 19 nt, Human
caggagucccugaccucac

SEQ ID NO: 975572 - RNA, 19 nt, Human
cgugaaacagaauacugga

SEQ ID NO: 975573 - RNA, 21 nt, Human
cgugaaacagaauacuggaaa

SEQ ID NO: 975574 - RNA, 23 nt, Human
cuaguuaucugaaaauaucuucc

SEQ ID NO: 975575 - RNA, 24 nt, Human
cucuaugacuggacauaauuugcu

SEQ ID NO: 975576 - RNA, 22 nt, Human
cugauacugaaaguuaucuagu

SEQ ID NO: 975577 - RNA, 20 nt, Human
cuggacauaauuugcuauuc

SEQ ID NO: 975578 - RNA, 19 nt, Human
gauacauuuccaucuaagc

SEQ ID NO: 975579 - RNA, 21 nt, Human
gauggcagaggcaaggcagga

SEQ ID NO: 975580 - RNA, 21 nt, Human
gugaacucaaauacauauugc

SEQ ID NO: 975581 - RNA, 23 nt, Human
gugaacucaaauacauauugcug

SEQ ID NO: 975582 - RNA, 20 nt, Human
gugcaggggagguauccaca

SEQ ID NO: 975583 - RNA, 21 nt, Human
uaaaacagaaauagugugaac

SEQ ID NO: 975584 - RNA, 23 nt, Human
uaaaacagaaauagugugaacuu

SEQ ID NO: 975585 - RNA, 24 nt, Human
uaaguaaccaccacugauacugaa

SEQ ID NO: 975586 - RNA, 23 nt, Human
uaauaaguaaccaccacugauac

SEQ ID NO: 975587 - RNA, 24 nt, Human
uaauguuuuagaccaaagaaaaaa

SEQ ID NO: 975588 - RNA, 18 nt, Human
uacaccguguuuauggua

SEQ ID NO: 975589 - RNA, 19 nt, Human
uaccacuaauaaacaaccc

SEQ ID NO: 975590 - RNA, 18 nt, Human
uagcaagucgacauccuu

SEQ ID NO: 975591 - RNA, 25 nt, Human
uauuacaguuauaaguaauauuacu

SEQ ID NO: 975592 - RNA, 18 nt, Human
ucacugaggagccccugc

SEQ ID NO: 975593 - RNA, 23 nt, Human
ucacugaggagccccugcagaag

SEQ ID NO: 975594 - RNA, 20 nt, Human
ucacuggaagugauggcaga

SEQ ID NO: 975595 - RNA, 25 nt, Human
ucaggcacauaucugagagaggcag

SEQ ID NO: 975596 - RNA, 19 nt, Human
uccacaaaauaucaggcac

SEQ ID NO: 975597 - RNA, 18 nt, Human
ucuacacuguuacucuuc

SEQ ID NO: 975598 - RNA, 19 nt, Human
ucugaaauuagcaagucga

SEQ ID NO: 975599 - RNA, 20 nt, Human
ucuuugggacacuaaaaaaa

SEQ ID NO: 975600 - RNA, 24 nt, Human
ugaauaauuauuucugaaauuagc

SEQ ID NO: 975601 - RNA, 18 nt, Human
uguuacucuucauagggu

SEQ ID NO: 975602 - RNA, 21 nt, Human
uuaaauaccuaacaucaugac

SEQ ID NO: 975603 - RNA, 21 nt, Human
uuaaaugcuacuuaguuaccu

SEQ ID NO: 975604 - RNA, 22 nt, Human
uuagaccaaagaaaaaaaggac

SEQ ID NO: 975605 - RNA, 25 nt, Human
uucaaguagaugcuuuaaaaggggc

SEQ ID NO: 975606 - RNA, 23 nt, Human
uuccucugauuuaaguaauaagu

SEQ ID NO: 975607 - RNA, 22 nt, Human
uugaaacaagcauuguaaagac

SEQ ID NO: 975608 - RNA, 23 nt, Human
uugaaacaagcauuguaaagacu

SEQ ID NO: 975609 - RNA, 23 nt, Human
uuuuggauaaugaaaauguauuu

SEQ ID NO: 975610 - RNA, 22 nt, Human
aaagcccuccacucugaacuaa

SEQ ID NO: 975611 - RNA, 18 nt, Human
aaaggcccugggcuguua

SEQ ID NO: 975612 - RNA, 21 nt, Human
aaaguaaauauucaucccccu

SEQ ID NO: 975613 - RNA, 24 nt, Human
aaccagaagagacaguaacagccc

SEQ ID NO: 975614 - RNA, 20 nt, Human
aagaaaggagcccacucuaa

SEQ ID NO: 975615 - RNA, 23 nt, Human
aagaggccagccucccacaaaca

SEQ ID NO: 975616 - RNA, 21 nt, Human
aagcccuggaggcagggagcu

SEQ ID NO: 975617 - RNA, 18 nt, Human
aaggagguaggcaagagg

SEQ ID NO: 975618 - RNA, 18 nt, Human
accagcuccccacagcga

SEQ ID NO: 975619 - RNA, 21 nt, Human
accagcuccccacagcgacac

SEQ ID NO: 975620 - RNA, 25 nt, Human
accagcuccccacagcgacaccgcc

SEQ ID NO: 975621 - RNA, 18 nt, Human
acgccccgccccuacagg

SEQ ID NO: 975622 - RNA, 21 nt, Human
acugcacugcgcaacacagca

SEQ ID NO: 975623 - RNA, 24 nt, Human
agaaacaaagcccuugcaccccac

SEQ ID NO: 975624 - RNA, 22 nt, Human
agacaggguaggauagccagga

SEQ ID NO: 975625 - RNA, 20 nt, Human
agcaaaaacugaagccagcc

SEQ ID NO: 975626 - RNA, 27 nt, Human
agccacuucucucucauuggucccaac

SEQ ID NO: 975627 - RNA, 23 nt, Human
aggagaagaaaaggauuccaaaa

SEQ ID NO: 975628 - RNA, 25 nt, Human
aggagaagaaaaggauuccaaaaag

SEQ ID NO: 975629 - RNA, 21 nt, Human
aggagugggcgacagggaggg

SEQ ID NO: 975630 - RNA, 19 nt, Human
agguaggcaagaggccagc

SEQ ID NO: 975631 - RNA, 21 nt, Human
aguagagcaaugcagaaugcc

SEQ ID NO: 975632 - RNA, 21 nt, Human
aucuccauccccagagcccuc

SEQ ID NO: 975633 - RNA, 19 nt, Human
caaaauaaaggcccugggc

SEQ ID NO: 975634 - RNA, 23 nt, Human
caaaauaaaggcccugggcuguu

SEQ ID NO: 975635 - RNA, 21 nt, Human
caaaugaccugcagaaacuca

SEQ ID NO: 975636 - RNA, 19 nt, Human
cacaaaccuaagaguagag

SEQ ID NO: 975637 - RNA, 27 nt, Human
cacacacacaaaccuaagaguagagcu

SEQ ID NO: 975638 - RNA, 22 nt, Human
caccauauagccagaucacggc

SEQ ID NO: 975639 - RNA, 22 nt, Human
cacugcgcaacacagcagagac

SEQ ID NO: 975640 - RNA, 24 nt, Human
cagaaacaaagcccuugcaccccc

SEQ ID NO: 975641 - RNA, 22 nt, Human
cagcaaaaacugaagccagcca

SEQ ID NO: 975642 - RNA, 24 nt, Human
cagcagcaggagucacagcaccag

SEQ ID NO: 975643 - RNA, 23 nt, Human
cagccaggcuaaggucucgggac

SEQ ID NO: 975644 - RNA, 22 nt, Human
cagccccggacagccuuuccca

SEQ ID NO: 975645 - RNA, 22 nt, Human
cauacaaaugaccugcagaaac

SEQ ID NO: 975646 - RNA, 20 nt, Human
caucuccauccccagagccc

SEQ ID NO: 975647 - RNA, 21 nt, Human
caucugagaacagcaccagcu

SEQ ID NO: 975648 - RNA, 22 nt, Human
ccacagcgacaccgcccgcgcc

SEQ ID NO: 975649 - RNA, 25 nt, Human
ccacagcgacaccgcccgcgcccca

SEQ ID NO: 975650 - RNA, 20 nt, Human
ccacauaccugcccugugcc

SEQ ID NO: 975651 - RNA, 24 nt, Human
cccacaaacaaagugcucuagggc

SEQ ID NO: 975652 - RNA, 24 nt, Human
cccacagcgacaccgcccgcgccc

SEQ ID NO: 975653 - RNA, 18 nt, Human
ccccaaucccgggugccc

SEQ ID NO: 975654 - RNA, 19 nt, Human
ccccacugcacugcgcaac

SEQ ID NO: 975655 - RNA, 27 nt, Human
ccccagagcccucucuuucaggagacu

SEQ ID NO: 975656 - RNA, 18 nt, Human
ccccgccccuacaggccc

SEQ ID NO: 975657 - RNA, 24 nt, Human
cccgcaucuucucugaccaucuca

SEQ ID NO: 975658 - RNA, 20 nt, Human
cccgccccuacaggcccggg

SEQ ID NO: 975659 - RNA, 24 nt, Human
cccgcgccccaccauauagccaga

SEQ ID NO: 975660 - RNA, 23 nt, Human
cccgggcucugagugggauuccc

SEQ ID NO: 975661 - RNA, 23 nt, Human
ccgcgccccaccauauagccaga

SEQ ID NO: 975662 - RNA, 19 nt, Human
ccucgugccgaaucuuggc

SEQ ID NO: 975663 - RNA, 21 nt, Human
ccugaguaagucuccuggccc

SEQ ID NO: 975664 - RNA, 20 nt, Human
ccugcagaaacucagauccc

SEQ ID NO: 975665 - RNA, 18 nt, Human
ccuggcccgcaucuucuc

SEQ ID NO: 975666 - RNA, 22 nt, Human
cuacagcaaaaacugaagccag

SEQ ID NO: 975667 - RNA, 23 nt, Human
cuagaagacacuaagcagcccag

SEQ ID NO: 975668 - RNA, 19 nt, Human
cuggucaccugaggagaua

SEQ ID NO: 975669 - RNA, 19 nt, Human
gacuggagucgggaucccc

SEQ ID NO: 975670 - RNA, 23 nt, Human
gagaagaaaaggauuccaaaaag

SEQ ID NO: 975671 - RNA, 22 nt, Human
gagcccacagacaggguaggau

SEQ ID NO: 975672 - RNA, 18 nt, Human
gaucacggcuucuccuuc

SEQ ID NO: 975673 - RNA, 19 nt, Human
gccagccacuucucucuca

SEQ ID NO: 975674 - RNA, 22 nt, Human
gcccgggcucugagugggauuc

SEQ ID NO: 975675 - RNA, 28 nt, Human
gccucccacaaacaaagugcucuagggc

SEQ ID NO: 975676 - RNA, 19 nt, Human
ggaaggaaacaucugagaa

SEQ ID NO: 975677 - RNA, 21 nt, Human
ggagucgggauccccccucca

SEQ ID NO: 975678 - RNA, 20 nt, Human
ggagugggcgacagggaggg

SEQ ID NO: 975679 - RNA, 19 nt, Human
ggauacaacauaaccacuc

SEQ ID NO: 975680 - RNA, 20 nt, Human
ggcagggagcugcuaccaaa

SEQ ID NO: 975681 - RNA, 20 nt, Human
ggcgacagggaggggaagga

SEQ ID NO: 975682 - RNA, 20 nt, Human
ggcuguuacuguucccgucu

SEQ ID NO: 975683 - RNA, 18 nt, Human
ggugcacgacgggagacg

SEQ ID NO: 975684 - RNA, 23 nt, Human
gucucaggcuccacucagccagg

SEQ ID NO: 975685 - RNA, 23 nt, Human
uaaaagagcccacagacagggua

SEQ ID NO: 975686 - RNA, 22 nt, Human
uaaauccccagcagcaggaguc

SEQ ID NO: 975687 - RNA, 24 nt, Human
uaaccacucccagugggaugaugu

SEQ ID NO: 975688 - RNA, 19 nt, Human
uaagucuccuggcccgcaa

SEQ ID NO: 975689 - RNA, 21 nt, Human
uaccaaaggagaagaaaagga

SEQ ID NO: 975690 - RNA, 18 nt, Human
uagaagacacuaagcagc

SEQ ID NO: 975691 - RNA, 25 nt, Human
ucagcccaagcagaggugacuagaa

SEQ ID NO: 975692 - RNA, 21 nt, Human
uccaaaaagaaaggagcccac

SEQ ID NO: 975693 - RNA, 18 nt, Human
uccauccccagagcccuc

SEQ ID NO: 975694 - RNA, 19 nt, Human
uccccaaaacuggucaccu

SEQ ID NO: 975695 - RNA, 20 nt, Human
uccccacagcgacaccgccc

SEQ ID NO: 975696 - RNA, 21 nt, Human
ucccgggugcccgggacgccc

SEQ ID NO: 975697 - RNA, 22 nt, Human
ucggcuccuaccagcucuggcu

SEQ ID NO: 975698 - RNA, 25 nt, Human
ucggcuccuaccagcucuggcucuc

SEQ ID NO: 975699 - RNA, 21 nt, Human
ucuccauccccagagcccucu

SEQ ID NO: 975700 - RNA, 22 nt, Human
ucuccuuccgggugagucgccg

SEQ ID NO: 975701 - RNA, 20 nt, Human
ucucgggacauaaaucccca

SEQ ID NO: 975702 - RNA, 21 nt, Human
ucucuuucaggcaggcagaaa

SEQ ID NO: 975703 - RNA, 25 nt, Human
ucugagaacagcaccagcuccccac

SEQ ID NO: 975704 - RNA, 19 nt, Human
ugaaagaaaaagcaaggag

SEQ ID NO: 975705 - RNA, 19 nt, Human
ugaaagaaaaagcaaggag

SEQ ID NO: 975706 - RNA, 22 nt, Human
ugaccugcagaaacucagaucc

SEQ ID NO: 975707 - RNA, 23 nt, Human
ugaccugcagaaacucagauccc

SEQ ID NO: 975708 - RNA, 21 nt, Human
ugacuagaagacacuaagcag

SEQ ID NO: 975709 - RNA, 20 nt, Human
ugagaacagcaccagcuccc

SEQ ID NO: 975710 - RNA, 19 nt, Human
ugcggaaaagauggccaca

SEQ ID NO: 975711 - RNA, 24 nt, Human
ugcuaccaaaggagaagaaaagga

SEQ ID NO: 975712 - RNA, 23 nt, Human
ugcuguggccagccacuucucuc

SEQ ID NO: 975713 - RNA, 27 nt, Human
uggaagaggcauaaggggcuguaaugg

SEQ ID NO: 975714 - RNA, 20 nt, Human
uggaaggaaacaucugagaa

SEQ ID NO: 975715 - RNA, 19 nt, Human
uggagaugaagaauggcag

SEQ ID NO: 975716 - RNA, 18 nt, Human
uggcggaagcccuggagg

SEQ ID NO: 975717 - RNA, 22 nt, Human
ugguaucagugaaagaaaaagc

SEQ ID NO: 975718 - RNA, 18 nt, Human
uguuacuguucccgucug

SEQ ID NO: 975719 - RNA, 21 nt, Human
uguuacuguucccgucugguc

SEQ ID NO: 975720 - RNA, 21 nt, Human
uguuguuucucaucuccaucc

SEQ ID NO: 975721 - RNA, 20 nt, Human
uuauuucaggccaaagcccu

SEQ ID NO: 975722 - RNA, 21 nt, Human
uuccaaaaagaaaggagccca

SEQ ID NO: 975723 - RNA, 18 nt, Human
aagagcauuaacauuuca

SEQ ID NO: 975724 - RNA, 21 nt, Human
aaucaaggcuaucuuaucacu

SEQ ID NO: 975725 - RNA, 21 nt, Human
aggaauucacuaucucaaacc

SEQ ID NO: 975726 - RNA, 19 nt, Human
aggcaaacucacuaaaucu

SEQ ID NO: 975727 - RNA, 21 nt, Human
auaaagaagaauauaucaccc

SEQ ID NO: 975728 - RNA, 26 nt, Human
cauguaaacauuaaaaacucaacuaa

SEQ ID NO: 975729 - RNA, 20 nt, Human
cuuugguacuagaaagucau

SEQ ID NO: 975730 - RNA, 18 nt, Human
gagcauuaacauuucaaa

SEQ ID NO: 975731 - RNA, 21 nt, Human
gauauaaagaagaauauauca

SEQ ID NO: 975732 - RNA, 24 nt, Human
uaaauguaauuggauaaaauacaa

SEQ ID NO: 975733 - RNA, 21 nt, Human
uaacacacauacauauauaca

SEQ ID NO: 975734 - RNA, 21 nt, Human
uauguaaacuuuauacaugug

SEQ ID NO: 975735 - RNA, 22 nt, Human
ugaguccacuuagagaacaacu

SEQ ID NO: 975736 - RNA, 29 nt, Human
uggugauuuaacacacauacauauauaca

SEQ ID NO: 975737 - RNA, 25 nt, Human
uucuugcucuuuucuauauguuuua

SEQ ID NO: 975738 - RNA, 21 nt, Human
uuuaaaauaguauuugccacu

SEQ ID NO: 975739 - RNA, 22 nt, Human
uuuaaaauaguauuugccacuc

SEQ ID NO: 975740 - RNA, 21 nt, Human
aggcauccuugcugaacaccu

SEQ ID NO: 975741 - RNA, 19 nt, Human
auauaucuauauacauaua

SEQ ID NO: 975742 - RNA, 20 nt, Human
auccagaaagaauaacuuug

SEQ ID NO: 975743 - RNA, 22 nt, Human
auccagcaccuccgccugcagc

SEQ ID NO: 975744 - RNA, 26 nt, Human
cacagucaaauauuuaagaaaaaaaa

SEQ ID NO: 975745 - RNA, 19 nt, Human
cagaaagaauaacuuuggu

SEQ ID NO: 975746 - RNA, 19 nt, Human
cagugaccuggaauaccug

SEQ ID NO: 975747 - RNA, 21 nt, Human
ccaagccagauaucucucugu

SEQ ID NO: 975748 - RNA, 21 nt, Human
ccugcagcagggcggaagagc

SEQ ID NO: 975749 - RNA, 23 nt, Human
cucguccagauccagcaccuccg

SEQ ID NO: 975750 - RNA, 21 nt, Human
gcauguuccacagucaaauau

SEQ ID NO: 975751 - RNA, 21 nt, Human
uaagaaaaaaaaucuauaugc

SEQ ID NO: 975752 - RNA, 20 nt, Human
uaccugagauuucaaguugu

SEQ ID NO: 975753 - RNA, 19 nt, Human
uauaugcaauuauuggcac

SEQ ID NO: 975754 - RNA, 21 nt, Human
uauuuaaaauggcauguucca

SEQ ID NO: 975755 - RNA, 20 nt, Human
ucccaaagaucaaacagaag

SEQ ID NO: 975756 - RNA, 22 nt, Human
uccucguccagauccagcaccu

SEQ ID NO: 975757 - RNA, 20 nt, Human
ucguccucguccagauccag

SEQ ID NO: 975758 - RNA, 26 nt, Human
ucucccaaagaucaaacagaaguugg

SEQ ID NO: 975759 - RNA, 18 nt, Human
ugaggcauccuugcugaa

SEQ ID NO: 975760 - RNA, 22 nt, Human
ugucagugaccuggaauaccug

SEQ ID NO: 975761 - RNA, 22 nt, Human
uuaagaacauaauuaaaaccaa

SEQ ID NO: 975762 - RNA, 22 nt, Human
uucaaguuguugguuuuccaga

SEQ ID NO: 975763 - RNA, 19 nt, Human
uugguuuuccagaugggua

SEQ ID NO: 975764 - RNA, 21 nt, Human
cagggagcaccaccucagccu

SEQ ID NO: 975765 - RNA, 21 nt, Human
ugacuuccucccgcgccaccc

SEQ ID NO: 975766 - RNA, 19 nt, Human
cagcugucaggaacuccca

SEQ ID NO: 975767 - RNA, 22 nt, Human
cccgcagcgccgccaucuugug

SEQ ID NO: 975768 - RNA, 24 nt, Human
uucuacuucuagaauccagcuguc

SEQ ID NO: 975769 - RNA, 18 nt, Human
agccuggucagccgcgca

SEQ ID NO: 975770 - RNA, 25 nt, Human
agccuggucagccgcgcagaggccc

SEQ ID NO: 975771 - RNA, 21 nt, Human
cauuaaaaaggcacauuggaa

SEQ ID NO: 975772 - RNA, 23 nt, Human
ccccgaguccccgcuccgcagac

SEQ ID NO: 975773 - RNA, 25 nt, Human
ccccgaguccccgcuccgcagaccc

SEQ ID NO: 975774 - RNA, 19 nt, Human
ccccgcaccccgggccgcc

SEQ ID NO: 975775 - RNA, 20 nt, Human
ccccgcaccccgggccgccc

SEQ ID NO: 975776 - RNA, 23 nt, Human
cccgccgaggccccgaguccccg

SEQ ID NO: 975777 - RNA, 21 nt, Human
cccuccucccggccgggcugg

SEQ ID NO: 975778 - RNA, 19 nt, Human
ccgccccgccugcgugugc

SEQ ID NO: 975779 - RNA, 21 nt, Human
ccgccgaggccccgagucccc

SEQ ID NO: 975780 - RNA, 18 nt, Human
ccgggccgccccgccugc

SEQ ID NO: 975781 - RNA, 19 nt, Human
ccgggcuggagacccgagc

SEQ ID NO: 975782 - RNA, 23 nt, Human
cgaccccggacagcuccggccgg

SEQ ID NO: 975783 - RNA, 19 nt, Human
cgccgaggccccgaguccc

SEQ ID NO: 975784 - RNA, 24 nt, Human
cgccgaggccccgaguccccgcuc

SEQ ID NO: 975785 - RNA, 20 nt, Human
cggcucacgaccccggacag

SEQ ID NO: 975786 - RNA, 24 nt, Human
cucucaauagaagacacuagacac

SEQ ID NO: 975787 - RNA, 24 nt, Human
gccccgaguccccgcuccgcagac

SEQ ID NO: 975788 - RNA, 23 nt, Human
ggcggcgcugacgcucugggagc

SEQ ID NO: 975789 - RNA, 18 nt, Human
uaccuguguauguagaua

SEQ ID NO: 975790 - RNA, 21 nt, Human
uacucucaauagaagacacua

SEQ ID NO: 975791 - RNA, 19 nt, Human
ucacagaaauaaagaccac

SEQ ID NO: 975792 - RNA, 22 nt, Human
ucacgaccccggacagcuccgg

SEQ ID NO: 975793 - RNA, 23 nt, Human
ucacgaccccggacagcuccggc

SEQ ID NO: 975794 - RNA, 22 nt, Human
uccgcagacccggucccuccuc

SEQ ID NO: 975795 - RNA, 25 nt, Human
uccucacagaaauaaagaccacgau

SEQ ID NO: 975796 - RNA, 22 nt, Human
uccugcccccgccccuccgcgg

SEQ ID NO: 975797 - RNA, 24 nt, Human
uggaaauaagcuuaauuaauagua

SEQ ID NO: 975798 - RNA, 21 nt, Human
ugugcgcgccccgccgaggcc

SEQ ID NO: 975799 - RNA, 22 nt, Human
uuaaaaaggcacauuggaaaua

SEQ ID NO: 975800 - RNA, 21 nt, Human
uuaauuaauaguaguacucuc

SEQ ID NO: 975801 - RNA, 26 nt, Human
aaaaaacaacaacagcaacaacaaaa

SEQ ID NO: 975802 - RNA, 19 nt, Human
aaaaaacacacccaggaca

SEQ ID NO: 975803 - RNA, 18 nt, Human
aaaaacaacaacagcaac

SEQ ID NO: 975804 - RNA, 22 nt, Human
aaaacaacaacagcaacaaaac

SEQ ID NO: 975805 - RNA, 21 nt, Human
aaaacccaggagucugaggau

SEQ ID NO: 975806 - RNA, 23 nt, Human
aaacaacaacagcaacaacaaaa

SEQ ID NO: 975807 - RNA, 22 nt, Human
aacaacaaaaacccaggagucu

SEQ ID NO: 975808 - RNA, 21 nt, Human
aacaacaacagcaacaacaaa

SEQ ID NO: 975809 - RNA, 23 nt, Human
aacaacaacagcaacaacaaaaa

SEQ ID NO: 975810 - RNA, 23 nt, Human
aacaacagcaacaacaaaaaccc

SEQ ID NO: 975811 - RNA, 23 nt, Human
aacacaccuuuuaaaaaacaaca

SEQ ID NO: 975812 - RNA, 19 nt, Human
aacagcaacaacaaaaacc

SEQ ID NO: 975813 - RNA, 24 nt, Human
aaccucacccccccaaacuguuca

SEQ ID NO: 975814 - RNA, 18 nt, Human
acaaaauaaauuaccaua

SEQ ID NO: 975815 - RNA, 20 nt, Human
acaacaacagcaacaacaaa

SEQ ID NO: 975816 - RNA, 22 nt, Human
acaacagcaacaacaaaaaccc

SEQ ID NO: 975817 - RNA, 27 nt, Human
acaacagcaacaacaaaaacccaggag

SEQ ID NO: 975818 - RNA, 22 nt, Human
acacugcuucuggccugcaggc

SEQ ID NO: 975819 - RNA, 24 nt, Human
acagcaacaacaaaaacccaggag

SEQ ID NO: 975820 - RNA, 23 nt, Human
acccaggacaacauuucuuugau

SEQ ID NO: 975821 - RNA, 21 nt, Human
acccagggcccccagccggcc

SEQ ID NO: 975822 - RNA, 18 nt, Human
acugcuucuggccugcag

SEQ ID NO: 975823 - RNA, 24 nt, Human
agauugaaaaaacacacccaggac

SEQ ID NO: 975824 - RNA, 21 nt, Human
agcaacaacaaaaacccagga

SEQ ID NO: 975825 - RNA, 22 nt, Human
aggaaguguguaacacugcuuc

SEQ ID NO: 975826 - RNA, 22 nt, Human
caaaaacccaggagucugagga

SEQ ID NO: 975827 - RNA, 20 nt, Human
caacaacagcaacaacaaaa

SEQ ID NO: 975828 - RNA, 25 nt, Human
caacagcaacaacaaaaacccagga

SEQ ID NO: 975829 - RNA, 19 nt, Human
cacugagaugccccgaggg

SEQ ID NO: 975830 - RNA, 24 nt, Human
cagcaacaacaaaaacccaggagu

SEQ ID NO: 975831 - RNA, 25 nt, Human
cagcaacaacaaaaacccaggaguc

SEQ ID NO: 975832 - RNA, 21 nt, Human
cagcguacccagggcccccag

SEQ ID NO: 975833 - RNA, 18 nt, Human
ccccgagggcugcgcggg

SEQ ID NO: 975834 - RNA, 23 nt, Human
ccccgagggcugcgcgggucucc

SEQ ID NO: 975835 - RNA, 24 nt, Human
cccuccgccggacgcgccgccucc

SEQ ID NO: 975836 - RNA, 18 nt, Human
ccgcuccccucaacccuc

SEQ ID NO: 975837 - RNA, 24 nt, Human
ccucccccgacccgggggaggggg

SEQ ID NO: 975838 - RNA, 25 nt, Human
cgccgcccguguucuggccugucgc

SEQ ID NO: 975839 - RNA, 22 nt, Human
cugcuucuggccugcaggcugg

SEQ ID NO: 975840 - RNA, 18 nt, Human
cuucuggccugcaggcug

SEQ ID NO: 975841 - RNA, 21 nt, Human
cuucuggccugcaggcugggg

SEQ ID NO: 975842 - RNA, 26 nt, Human
gacacauucaaagcuaguuaacuuga

SEQ ID NO: 975843 - RNA, 22 nt, Human
gacgcgccgccucccccgaccc

SEQ ID NO: 975844 - RNA, 18 nt, Human
ggagucugaggauuuccu

SEQ ID NO: 975845 - RNA, 19 nt, Human
gggaggggguggggaauga

SEQ ID NO: 975846 - RNA, 19 nt, Human
ggggaggggguggggaaug

SEQ ID NO: 975847 - RNA, 20 nt, Human
ggggaggggguggggaauga

SEQ ID NO: 975848 - RNA, 21 nt, Human
uaaaugaaaccucaccccccc

SEQ ID NO: 975849 - RNA, 22 nt, Human
uaaaugaaaccucaccccccca

SEQ ID NO: 975850 - RNA, 24 nt, Human
uagcuccuccaggaaguguguaac

SEQ ID NO: 975851 - RNA, 23 nt, Human
uccaacugugggaaacaaaucuc

SEQ ID NO: 975852 - RNA, 20 nt, Human
ucugaggauuuccuuagcuc

SEQ ID NO: 975853 - RNA, 23 nt, Human
ucuggccugucgcggucuggucu

SEQ ID NO: 975854 - RNA, 21 nt, Human
ugaaaaaacacacccaggaca

SEQ ID NO: 975855 - RNA, 19 nt, Human
ugaaaccucacccccccaa

SEQ ID NO: 975856 - RNA, 18 nt, Human
ugccccgcuccccucaac

SEQ ID NO: 975857 - RNA, 23 nt, Human
uggaaauaggguuuugacaaucc

SEQ ID NO: 975858 - RNA, 25 nt, Human
uggcagacaaaauaaauuaccauaa

SEQ ID NO: 975859 - RNA, 18 nt, Human
uuaaaugaaaccucaccc

SEQ ID NO: 975860 - RNA, 24 nt, Human
uuaaaugaaaccucacccccccaa

SEQ ID NO: 975861 - RNA, 23 nt, Human
uuagaagauugaaaaaacacacc

SEQ ID NO: 975862 - RNA, 18 nt, Human
uucaaguggcagacaaaa

SEQ ID NO: 975863 - RNA, 21 nt, Human
uuuuucaggauuccagauuuu

SEQ ID NO: 975864 - RNA, 21 nt, Human
uuuuuuuuuuucaggauucca

SEQ ID NO: 975865 - RNA, 23 nt, Human
uuuuuuuuuuuuuuuuuuucagg

SEQ ID NO: 975866 - RNA, 21 nt, Human
aaaaagcaaacaaaaaaucau

SEQ ID NO: 975867 - RNA, 23 nt, Human
aaaauguauccugagauaaaaua

SEQ ID NO: 975868 - RNA, 18 nt, Human
aagagccuugcaaggccu

SEQ ID NO: 975869 - RNA, 21 nt, Human
aaggaguugaugucggggcug

SEQ ID NO: 975870 - RNA, 23 nt, Human
acaaagaacgauguaugccaaau

SEQ ID NO: 975871 - RNA, 21 nt, Human
acccagaacccuacgcgguuc

SEQ ID NO: 975872 - RNA, 18 nt, Human
acuugcuggaugcuagaa

SEQ ID NO: 975873 - RNA, 21 nt, Human
acuuucaacaaagaauucuag

SEQ ID NO: 975874 - RNA, 25 nt, Human
agacauucuccaagguuccaauguc

SEQ ID NO: 975875 - RNA, 27 nt, Human
aggaguugucaaaauacuuucaaaaug

SEQ ID NO: 975876 - RNA, 19 nt, Human
auacauguugaugcaaauu

SEQ ID NO: 975877 - RNA, 18 nt, Human
cacauacaacugugaggc

SEQ ID NO: 975878 - RNA, 25 nt, Human
cacccaaucacaacgaccgauaccc

SEQ ID NO: 975879 - RNA, 23 nt, Human
cacuaugcuagauuuauuucccc

SEQ ID NO: 975880 - RNA, 22 nt, Human
ccaauguccagcugaggcacag

SEQ ID NO: 975881 - RNA, 21 nt, Human
ccagacucuaguuucacuaau

SEQ ID NO: 975882 - RNA, 23 nt, Human
cccagaacccuacgcgguucaaa

SEQ ID NO: 975883 - RNA, 23 nt, Human
ccccucacauacaacugugaggc

SEQ ID NO: 975884 - RNA, 22 nt, Human
cccguggacggccaaucacagg

SEQ ID NO: 975885 - RNA, 18 nt, Human
cccugagcacuuuuucuu

SEQ ID NO: 975886 - RNA, 22 nt, Human
ccguuuguuggcgaccuucccc

SEQ ID NO: 975887 - RNA, 23 nt, Human
ccucccccuuucgguuaagagcc

SEQ ID NO: 975888 - RNA, 24 nt, Human
cgcgguucaaaacgcagcugucug

SEQ ID NO: 975889 - RNA, 20 nt, Human
cuacccagaacccuacgcgg

SEQ ID NO: 975890 - RNA, 20 nt, Human
cuccaagguuccaaugucca

SEQ ID NO: 975891 - RNA, 27 nt, Human
cuccucaucacugucggugacauugac

SEQ ID NO: 975892 - RNA, 24 nt, Human
cugugaagacauucuccaagguuc

SEQ ID NO: 975893 - RNA, 21 nt, Human
cuugcaaggccuuugcuaccc

SEQ ID NO: 975894 - RNA, 22 nt, Human
gaagacauucuccaagguucca

SEQ ID NO: 975895 - RNA, 20 nt, Human
gaaguuccauucauguucuc

SEQ ID NO: 975896 - RNA, 24 nt, Human
gaauucuaggcuuuuuuuuuucuc

SEQ ID NO: 975897 - RNA, 18 nt, Human
gcaaggccuuugcuaccc

SEQ ID NO: 975898 - RNA, 20 nt, Human
gcuuuuuuuuuucucauacc

SEQ ID NO: 975899 - RNA, 20 nt, Human
guuccaauguccagcugagg

SEQ ID NO: 975900 - RNA, 24 nt, Human
uaaguuuucuuccccacuguggcu

SEQ ID NO: 975901 - RNA, 20 nt, Human
uacauaaaaagcaaacaaaa

SEQ ID NO: 975902 - RNA, 26 nt, Human
uacauaaaaagcaaacaaaaaaucau

SEQ ID NO: 975903 - RNA, 27 nt, Human
uacccagaacccuacgcgguucaaaac

SEQ ID NO: 975904 - RNA, 22 nt, Human
uagcugaagaaucacccaggug

SEQ ID NO: 975905 - RNA, 20 nt, Human
uauuuugcauguuccaggau

SEQ ID NO: 975906 - RNA, 24 nt, Human
ucaaaucacgacugaaaacuuuca

SEQ ID NO: 975907 - RNA, 22 nt, Human
uccccuuuccccucacauacaa

SEQ ID NO: 975908 - RNA, 24 nt, Human
ucccugagcacuuuuucuucuucc

SEQ ID NO: 975909 - RNA, 21 nt, Human
ucucauaccaacugacccaga

SEQ ID NO: 975910 - RNA, 20 nt, Human
ugaaacauccagacucuagu

SEQ ID NO: 975911 - RNA, 25 nt, Human
ugaagacauucuccaagguuccaau

SEQ ID NO: 975912 - RNA, 19 nt, Human
ugcuagaaggaguugaugu

SEQ ID NO: 975913 - RNA, 19 nt, Human
uggacggccaaucacaggc

SEQ ID NO: 975914 - RNA, 21 nt, Human
uuaaauuuagcaaccaagucc

SEQ ID NO: 975915 - RNA, 21 nt, Human
uucccccucccccuuucgguu

SEQ ID NO: 975916 - RNA, 24 nt, Human
uuccuccucaucacugucggugac

SEQ ID NO: 975917 - RNA, 19 nt, Human
uuuguuggcgaccuucccc

SEQ ID NO: 975918 - RNA, 18 nt, Human
uuuuccggcucuuccugg

SEQ ID NO: 975919 - RNA, 22 nt, Human
aaaaaacucaaguucaugaaaa

SEQ ID NO: 975920 - RNA, 20 nt, Human
aaaaaucagggaaaacuuaa

SEQ ID NO: 975921 - RNA, 25 nt, Human
aaaagaaaaaaaaaguaagacaaaa

SEQ ID NO: 975922 - RNA, 26 nt, Human
aaaagaaaaaaaaaguaagacaaaaa

SEQ ID NO: 975923 - RNA, 22 nt, Human
aaaauaauucagaauaaaaaca

SEQ ID NO: 975924 - RNA, 19 nt, Human
aaauaucagccccagcacc

SEQ ID NO: 975925 - RNA, 18 nt, Human
aacaaaaaacucaaguuc

SEQ ID NO: 975926 - RNA, 23 nt, Human
aacaacaacaacaacaauaacaa

SEQ ID NO: 975927 - RNA, 24 nt, Human
aacaacaacaacaacaauaacaau

SEQ ID NO: 975928 - RNA, 31 nt, Human
aacaacaacaacaacaauaacaauaacaacu

SEQ ID NO: 975929 - RNA, 26 nt, Human
aacaacaauaacaauaacaacaaaag

SEQ ID NO: 975930 - RNA, 22 nt, Human
aacauccaaaagaaaaaaaaag

SEQ ID NO: 975931 - RNA, 18 nt, Human
aaccuguaggccggcaca

SEQ ID NO: 975932 - RNA, 22 nt, Human
acaauaacaauaacaacaaaaa

SEQ ID NO: 975933 - RNA, 22 nt, Human
acaauaacaauaacaacaaaac

SEQ ID NO: 975934 - RNA, 18 nt, Human
agacaaaaauauaagacu

SEQ ID NO: 975935 - RNA, 24 nt, Human
agaugccaaagauugucuaagacu

SEQ ID NO: 975936 - RNA, 21 nt, Human
aggcaaacacaauugggucca

SEQ ID NO: 975937 - RNA, 22 nt, Human
auaacucuuuguuggggagggg

SEQ ID NO: 975938 - RNA, 26 nt, Human
auuggguccaugcacuguggcaaccu

SEQ ID NO: 975939 - RNA, 24 nt, Human
caaaagaaaaaaaaaguaagacaa

SEQ ID NO: 975940 - RNA, 18 nt, Human
caacaacaacaacaauaa

SEQ ID NO: 975941 - RNA, 21 nt, Human
caacaacaacaacaauaacaa

SEQ ID NO: 975942 - RNA, 22 nt, Human
caacauccaaaagaaaaaaaaa

SEQ ID NO: 975943 - RNA, 18 nt, Human
caaguccuggugucucau

SEQ ID NO: 975944 - RNA, 22 nt, Human
caaguucaugaaaaaucaggga

SEQ ID NO: 975945 - RNA, 19 nt, Human
cacacgccguggacuuguu

SEQ ID NO: 975946 - RNA, 19 nt, Human
cagcacccagaaaucacug

SEQ ID NO: 975947 - RNA, 23 nt, Human
ccaucuaaaacaguaacuuaaac

SEQ ID NO: 975948 - RNA, 22 nt, Human
ccuaaauuaaaaaaacaacaac

SEQ ID NO: 975949 - RNA, 24 nt, Human
ccuuaccauuuucuggaaaaaaaa

SEQ ID NO: 975950 - RNA, 19 nt, Human
cuugucuccagauuccuga

SEQ ID NO: 975951 - RNA, 20 nt, Human
gcacccagaaaucacuggua

SEQ ID NO: 975952 - RNA, 26 nt, Human
gcagugucuccuuuaagacuuucaaa

SEQ ID NO: 975953 - RNA, 19 nt, Human
ggcgguugcucuggugugu

SEQ ID NO: 975954 - RNA, 22 nt, Human
uaaaaaaacaacaacaacaaca

SEQ ID NO: 975955 - RNA, 18 nt, Human
uaaaacaguaacuuaaac

SEQ ID NO: 975956 - RNA, 26 nt, Human
uaaaacaguaacuuaaaccuuuauca

SEQ ID NO: 975957 - RNA, 20 nt, Human
uaaauaugcacaaaaaauau

SEQ ID NO: 975958 - RNA, 24 nt, Human
uaacaacaaaaaacucaaguucau

SEQ ID NO: 975959 - RNA, 23 nt, Human
uaacaauaacaacaaaaaacuca

SEQ ID NO: 975960 - RNA, 22 nt, Human
uaaccccaucuaaaacaguaac

SEQ ID NO: 975961 - RNA, 22 nt, Human
uaagacaaaaauauaagacuug

SEQ ID NO: 975962 - RNA, 23 nt, Human
uaagaccauucugcugauguagu

SEQ ID NO: 975963 - RNA, 20 nt, Human
uacaugcagcugcacacgcc

SEQ ID NO: 975964 - RNA, 24 nt, Human
uagcaaguggacccuugacauucu

SEQ ID NO: 975965 - RNA, 19 nt, Human
ucagccccagcacccagaa

SEQ ID NO: 975966 - RNA, 21 nt, Human
ucaggguuaaaggcaaaggga

SEQ ID NO: 975967 - RNA, 22 nt, Human
ucaugaaaaaucagggaaaacu

SEQ ID NO: 975968 - RNA, 27 nt, Human
uccaaaagaaaaaaaaaguaagacaaa

SEQ ID NO: 975969 - RNA, 20 nt, Human
ugagaauguuuaaccccauc

SEQ ID NO: 975970 - RNA, 23 nt, Human
ugaguaccuuaccauuuucugga

SEQ ID NO: 975971 - RNA, 25 nt, Human
ugcacaaaaaauaucagccccagca

SEQ ID NO: 975972 - RNA, 23 nt, Human
ugccaccaacaauugaaaaaaaa

SEQ ID NO: 975973 - RNA, 25 nt, Human
uggaaugaauaaauuauuuaagaua

SEQ ID NO: 975974 - RNA, 18 nt, Human
uggacccuugacauucug

SEQ ID NO: 975975 - RNA, 23 nt, Human
uguggcgguugcucuggugugug

SEQ ID NO: 975976 - RNA, 27 nt, Human
uuuaagacuuucaaaauauuaagauuc

SEQ ID NO: 975977 - RNA, 19 nt, Human
aaaauuauaaauguaggcu

SEQ ID NO: 975978 - RNA, 22 nt, Human
agaagggaccuuggcuaucaag

SEQ ID NO: 975979 - RNA, 23 nt, Human
agagggcgcgagggcugaccgga

SEQ ID NO: 975980 - RNA, 20 nt, Human
agcggugggaggaaagcugg

SEQ ID NO: 975981 - RNA, 21 nt, Human
agggcgcgagggcugaccgga

SEQ ID NO: 975982 - RNA, 23 nt, Human
augagucccuuugaaauuuugug

SEQ ID NO: 975983 - RNA, 20 nt, Human
caacagccuguuuuguuuuu

SEQ ID NO: 975984 - RNA, 22 nt, Human
cagcuuaggccaaaggcucugg

SEQ ID NO: 975985 - RNA, 20 nt, Human
caguucagaccucccugccc

SEQ ID NO: 975986 - RNA, 20 nt, Human
ccucccugcccugagcggug

SEQ ID NO: 975987 - RNA, 22 nt, Human
ccucgugguccuugggcugugc

SEQ ID NO: 975988 - RNA, 21 nt, Human
cguggggaaggggauagaggc

SEQ ID NO: 975989 - RNA, 20 nt, Human
cucaaggcacaagaaggaga

SEQ ID NO: 975990 - RNA, 23 nt, Human
cuccucugccacucaaggcacaa

SEQ ID NO: 975991 - RNA, 23 nt, Human
cuguuuuguuuuuaaacaucaua

SEQ ID NO: 975992 - RNA, 23 nt, Human
cuuggcuaucaagucuguccccc

SEQ ID NO: 975993 - RNA, 21 nt, Human
gagagggcgcgagggcugacc

SEQ ID NO: 975994 - RNA, 18 nt, Human
gccucgcuucgccuggcg

SEQ ID NO: 975995 - RNA, 21 nt, Human
gccucgugguccuugggcugu

SEQ ID NO: 975996 - RNA, 20 nt, Human
ggcugcaggggcuggaacgu

SEQ ID NO: 975997 - RNA, 18 nt, Human
ggcugggcgcgguggcuc

SEQ ID NO: 975998 - RNA, 19 nt, Human
gggcaggcgcggaccuggc

SEQ ID NO: 975999 - RNA, 19 nt, Human
ggggcuggaacguggggaa

SEQ ID NO: 976000 - RNA, 18 nt, Human
gguaaaagagaaugaaaa

SEQ ID NO: 976001 - RNA, 23 nt, Human
guaggcugggcgcgguggcucuu

SEQ ID NO: 976002 - RNA, 28 nt, Human
uaauaaacaaauuaacaaaaaaaaagaa

SEQ ID NO: 976003 - RNA, 23 nt, Human
uaaucuugagagaacccuaaauc

SEQ ID NO: 976004 - RNA, 24 nt, Human
uaccaagaaaagacgucagugaac

SEQ ID NO: 976005 - RNA, 26 nt, Human
uaugagucccuuugaaauuuuguggu

SEQ ID NO: 976006 - RNA, 24 nt, Human
uauguaaugaaacuaauacacuga

SEQ ID NO: 976007 - RNA, 23 nt, Human
ucaaucccauuuucugugauaua

SEQ ID NO: 976008 - RNA, 18 nt, Human
uccuauguaaugaaacua

SEQ ID NO: 976009 - RNA, 23 nt, Human
ucuggggccgcaguucagaccuc

SEQ ID NO: 976010 - RNA, 21 nt, Human
ugagagaacccuaaaucagaa

SEQ ID NO: 976011 - RNA, 19 nt, Human
ugcaggggcuggaacgugg

SEQ ID NO: 976012 - RNA, 21 nt, Human
uggaagggggugcagaaagug

SEQ ID NO: 976013 - RNA, 20 nt, Human
ugggaggaaagcuggugugg

SEQ ID NO: 976014 - RNA, 18 nt, Human
uguccccccauuaguuuc

SEQ ID NO: 976015 - RNA, 24 nt, Human
ugugggcugcaggggcuggaacgu

SEQ ID NO: 976016 - RNA, 23 nt, Human
uuacaacagccuguuuuguuuuu

SEQ ID NO: 976017 - RNA, 20 nt, Human
uucuccuauguaaugaaacu

SEQ ID NO: 976018 - RNA, 24 nt, Human
uuuuuuuuuuuacaacagccuguu

SEQ ID NO: 976019 - RNA, 22 nt, Human
uuuuuuuuuuuuacaacagccu

SEQ ID NO: 976020 - RNA, 24 nt, Human
aaagcuuggcugguuuucagacaa

SEQ ID NO: 976021 - RNA, 20 nt, Human
aagcugccaacugccccucg

SEQ ID NO: 976022 - RNA, 22 nt, Human
aagucaguggcaaaccagcggc

SEQ ID NO: 976023 - RNA, 18 nt, Human
acauauguuugcacagga

SEQ ID NO: 976024 - RNA, 25 nt, Human
acuccgagaagagucagaugaugga

SEQ ID NO: 976025 - RNA, 22 nt, Human
agguggccacggaagugggaaa

SEQ ID NO: 976026 - RNA, 20 nt, Human
agugggaaagugaaggcaag

SEQ ID NO: 976027 - RNA, 21 nt, Human
auaacauauguuugcacagga

SEQ ID NO: 976028 - RNA, 27 nt, Human
caagugaccucauuuugaagucagugg

SEQ ID NO: 976029 - RNA, 26 nt, Human
cacuuacucuucccuggcugaugaga

SEQ ID NO: 976030 - RNA, 22 nt, Human
ccaacugccccucggugcucag

SEQ ID NO: 976031 - RNA, 24 nt, Human
ccaagugaccucauuuugaaguca

SEQ ID NO: 976032 - RNA, 19 nt, Human
cccuggcugaugagauacu

SEQ ID NO: 976033 - RNA, 22 nt, Human
cugcauggagguggccacggaa

SEQ ID NO: 976034 - RNA, 20 nt, Human
cugccccguuccuuccugca

SEQ ID NO: 976035 - RNA, 20 nt, Human
gaugaaggaggcucagagaa

SEQ ID NO: 976036 - RNA, 23 nt, Human
gcugaugagauacuugggguugu

SEQ ID NO: 976037 - RNA, 19 nt, Human
ggaaagugaaggcaagaag

SEQ ID NO: 976038 - RNA, 19 nt, Human
ggacacucaugcaccaccg

SEQ ID NO: 976039 - RNA, 18 nt, Human
ggugaagcugccaacugc

SEQ ID NO: 976040 - RNA, 18 nt, Human
ucagagaaaagccccucc

SEQ ID NO: 976041 - RNA, 20 nt, Human
ucagucaaagaggaaaagga

SEQ ID NO: 976042 - RNA, 23 nt, Human
ucccacaaaauaugagacuccga

SEQ ID NO: 976043 - RNA, 20 nt, Human
ucccuggcugaugagauacu

SEQ ID NO: 976044 - RNA, 23 nt, Human
ucccuggcugaugagauacuugg

SEQ ID NO: 976045 - RNA, 19 nt, Human
ucccugugaucccacuuac

SEQ ID NO: 976046 - RNA, 20 nt, Human
ucgcugccaacauccuuccc

SEQ ID NO: 976047 - RNA, 23 nt, Human
ucgcugccaacauccuucccugu

SEQ ID NO: 976048 - RNA, 21 nt, Human
ucggugcucagucaaagagga

SEQ ID NO: 976049 - RNA, 18 nt, Human
ucuuugggcagaugaagg

SEQ ID NO: 976050 - RNA, 21 nt, Human
uggugucgcugccaacauccu

SEQ ID NO: 976051 - RNA, 21 nt, Human
ugucuggagcagcccucagga

SEQ ID NO: 976052 - RNA, 23 nt, Human
uucaugaugauugaauuuccuuu

SEQ ID NO: 976053 - RNA, 22 nt, Human
uucugcauggagguggccacgg

SEQ ID NO: 976054 - RNA, 26 nt, Human
uuggcugguuuucagacaaaaggucu

SEQ ID NO: 976055 - RNA, 19 nt, Human
uuuuuuuuuuuuaacagga

SEQ ID NO: 976056 - RNA, 22 nt, Human
uuuuuuuuuuuuuuuaacagga

SEQ ID NO: 976057 - RNA, 23 nt, Human
uuuuuuuuuuuuuuuuuaacagg

SEQ ID NO: 976058 - RNA, 26 nt, Human
aaaaaaaacaaaaaaaaacaaccaaa

SEQ ID NO: 976059 - RNA, 27 nt, Human
aaaaaaaacaaaaaaaaacaaccaaaa

SEQ ID NO: 976060 - RNA, 28 nt, Human
aaaaaaacaaaaaaaaacaaccaaaaaa

SEQ ID NO: 976061 - RNA, 23 nt, Human
aaaaaacaaccaaaaaaacccac

SEQ ID NO: 976062 - RNA, 20 nt, Human
aaaaacaaccaaaaaaaccc

SEQ ID NO: 976063 - RNA, 27 nt, Human
aaaaacaaccaaaaaaacccacauaug

SEQ ID NO: 976064 - RNA, 20 nt, Human
aaaaaggaaaaagaaaaaaa

SEQ ID NO: 976065 - RNA, 24 nt, Human
aaaacaaaaaaaaacaaccaaaaa

SEQ ID NO: 976066 - RNA, 30 nt, Human
aaaacaaaaaaaaacaaccaaaaaaacccc

SEQ ID NO: 976067 - RNA, 22 nt, Human
aaaagaaaaaaaaaacaaaaaa

SEQ ID NO: 976068 - RNA, 22 nt, Human
aaaagcaaaacaagccaauugc

SEQ ID NO: 976069 - RNA, 18 nt, Human
aaacaagccaauugcucu

SEQ ID NO: 976070 - RNA, 28 nt, Human
aaaggaaaaagaaaaaaaaaacaaaaaa

SEQ ID NO: 976071 - RNA, 25 nt, Human
aacaauaacaaaagcaaaacaagcc

SEQ ID NO: 976072 - RNA, 20 nt, Human
aaccucauggccaggauccc

SEQ ID NO: 976073 - RNA, 21 nt, Human
aaccucugugguccuguuucu

SEQ ID NO: 976074 - RNA, 21 nt, Human
aagaaaaaaaaaacaaaaaaa

SEQ ID NO: 976075 - RNA, 20 nt, Human
aagaaaaggaaaagaacgau

SEQ ID NO: 976076 - RNA, 21 nt, Human
aagaauaacacaacauuuccu

SEQ ID NO: 976077 - RNA, 21 nt, Human
acaauaacaaaagcaaaacaa

SEQ ID NO: 976078 - RNA, 23 nt, Human
acacagaguuuacugggucagau

SEQ ID NO: 976079 - RNA, 21 nt, Human
acagggaagaacaauaacaaa

SEQ ID NO: 976080 - RNA, 24 nt, Human
aggaaaaagaaaaaaaaaacaaaa

SEQ ID NO: 976081 - RNA, 28 nt, Human
aggaaaaagaaaaaaaaaacaaaaaaaa

SEQ ID NO: 976082 - RNA, 22 nt, Human
agggggggaaggggaaagagcu

SEQ ID NO: 976083 - RNA, 20 nt, Human
auauauacuggguguguaug

SEQ ID NO: 976084 - RNA, 24 nt, Human
aucucccacaagguuuccuuguua

SEQ ID NO: 976085 - RNA, 21 nt, Human
caaaaaggaaaaagaaaaaaa

SEQ ID NO: 976086 - RNA, 26 nt, Human
caacauaagaaaaggaaaagaacgau

SEQ ID NO: 976087 - RNA, 22 nt, Human
caagaauaacacaacauuuccu

SEQ ID NO: 976088 - RNA, 18 nt, Human
caccucauucaacuuccu

SEQ ID NO: 976089 - RNA, 22 nt, Human
cagcuggaucucccacaagguu

SEQ ID NO: 976090 - RNA, 23 nt, Human
cagcuggaucucccacaagguuu

SEQ ID NO: 976091 - RNA, 23 nt, Human
caguaguuucccccucgagacuu

SEQ ID NO: 976092 - RNA, 20 nt, Human
ccaaaaaggaaaaagaaaaa

SEQ ID NO: 976093 - RNA, 18 nt, Human
ccugacacguuuccaaaa

SEQ ID NO: 976094 - RNA, 19 nt, Human
ccugcacugccagcuccua

SEQ ID NO: 976095 - RNA, 27 nt, Human
cuggguguguaugugugugugugugug

SEQ ID NO: 976096 - RNA, 18 nt, Human
cuuucaguaaggugaggc

SEQ ID NO: 976097 - RNA, 22 nt, Human
gaaaggggaaaaggggaagggg

SEQ ID NO: 976098 - RNA, 22 nt, Human
gaugcaaaauauuuauuccaag

SEQ ID NO: 976099 - RNA, 23 nt, Human
gcagcacgacuuaugaugaagca

SEQ ID NO: 976100 - RNA, 23 nt, Human
ggaaaggggaaaaggggaagggg

SEQ ID NO: 976101 - RNA, 18 nt, Human
ggaagaacaauaacaaaa

SEQ ID NO: 976102 - RNA, 22 nt, Human
ggggaaagagcuguaucuaugu

SEQ ID NO: 976103 - RNA, 18 nt, Human
ggggaaggggaaagagcu

SEQ ID NO: 976104 - RNA, 18 nt, Human
ggggggaaggggaaagag

SEQ ID NO: 976105 - RNA, 19 nt, Human
guuaguuauuuuaugcagu

SEQ ID NO: 976106 - RNA, 20 nt, Human
uaaaaaaucugucccaccac

SEQ ID NO: 976107 - RNA, 21 nt, Human
uaaaaaaucugucccaccaca

SEQ ID NO: 976108 - RNA, 25 nt, Human
uaaaaaaucugucccaccacacaaa

SEQ ID NO: 976109 - RNA, 20 nt, Human
uaaagcagauaacagggaag

SEQ ID NO: 976110 - RNA, 19 nt, Human
uaaaguuacccgagcagcc

SEQ ID NO: 976111 - RNA, 22 nt, Human
uaacacaacauuuccuauaucc

SEQ ID NO: 976112 - RNA, 18 nt, Human
uaaccuggccggcagcac

SEQ ID NO: 976113 - RNA, 23 nt, Human
uagaagcuguugcugcagaccag

SEQ ID NO: 976114 - RNA, 20 nt, Human
uaguagaagcuguugcugca

SEQ ID NO: 976115 - RNA, 23 nt, Human
uaugugugugugugugugagugu

SEQ ID NO: 976116 - RNA, 25 nt, Human
uaugugugugugugugugagugugu

SEQ ID NO: 976117 - RNA, 21 nt, Human
uauuuuacagcuguacccaaa

SEQ ID NO: 976118 - RNA, 22 nt, Human
ucacucucucaguccccucaac

SEQ ID NO: 976119 - RNA, 18 nt, Human
ucccacaagguuuccuug

SEQ ID NO: 976120 - RNA, 24 nt, Human
ucccuaaacacacagaguuuacug

SEQ ID NO: 976121 - RNA, 21 nt, Human
ucccugcacugccagcuccua

SEQ ID NO: 976122 - RNA, 24 nt, Human
ucgaucacucucucaguccccuca

SEQ ID NO: 976123 - RNA, 21 nt, Human
ucuuugggauaugauuauuuc

SEQ ID NO: 976124 - RNA, 23 nt, Human
ugaguguguuuaaaaaaucuguc

SEQ ID NO: 976125 - RNA, 21 nt, Human
ugcaguaguuucccccucgag

SEQ ID NO: 976126 - RNA, 22 nt, Human
ugggucagauuuaacugugagc

SEQ ID NO: 976127 - RNA, 20 nt, Human
uguguaugugugugugugug

SEQ ID NO: 976128 - RNA, 21 nt, Human
uguguaugugugugugugugu

SEQ ID NO: 976129 - RNA, 19 nt, Human
ugugugugugugagugugu

SEQ ID NO: 976130 - RNA, 20 nt, Human
ugugugugugugugugagug

SEQ ID NO: 976131 - RNA, 19 nt, Human
uuaaaaagggggggaaggg

SEQ ID NO: 976132 - RNA, 20 nt, Human
uucccugcacugccagcucc

SEQ ID NO: 976133 - RNA, 20 nt, Human
uucccuugugaaugaaguau

SEQ ID NO: 976134 - RNA, 23 nt, Human
uuuuuuuuuuuuacugaugcaaa

SEQ ID NO: 976135 - RNA, 23 nt, Human
uuuuuuuuuuuuuuuuuuacuga

SEQ ID NO: 976136 - RNA, 18 nt, Human
aagcaggcaucagggagg

SEQ ID NO: 976137 - RNA, 22 nt, Human
aagggagcaauuaaauaaaacu

SEQ ID NO: 976138 - RNA, 24 nt, Human
aauaacaaggaaaggaagaaggga

SEQ ID NO: 976139 - RNA, 21 nt, Human
acaagcaauguguuuuuaaac

SEQ ID NO: 976140 - RNA, 19 nt, Human
acaaggaaaggaagaaggg

SEQ ID NO: 976141 - RNA, 19 nt, Human
acccucaacugaaagcagg

SEQ ID NO: 976142 - RNA, 20 nt, Human
agagcuggaaugugcuggag

SEQ ID NO: 976143 - RNA, 21 nt, Human
agagcuugggccgggcagggg

SEQ ID NO: 976144 - RNA, 22 nt, Human
agagggaggaggugcaggaugu

SEQ ID NO: 976145 - RNA, 24 nt, Human
aggagagguuguggcggggcuggg

SEQ ID NO: 976146 - RNA, 19 nt, Human
aggcccaaggcagccacag

SEQ ID NO: 976147 - RNA, 18 nt, Human
aggccgggagcucguggu

SEQ ID NO: 976148 - RNA, 22 nt, Human
agggagagggaggaggugcagg

SEQ ID NO: 976149 - RNA, 25 nt, Human
agggaggaggugcaggaugugcagg

SEQ ID NO: 976150 - RNA, 22 nt, Human
aggggaagggccaaggcagagc

SEQ ID NO: 976151 - RNA, 18 nt, Human
aggggugaggugaaggga

SEQ ID NO: 976152 - RNA, 20 nt, Human
auaaaacauaccucaagcag

SEQ ID NO: 976153 - RNA, 20 nt, Human
auaacaaggaaaggaagaag

SEQ ID NO: 976154 - RNA, 21 nt, Human
aucaaucgucccagccaauga

SEQ ID NO: 976155 - RNA, 21 nt, Human
aucauugcccccaacccucaa

SEQ ID NO: 976156 - RNA, 20 nt, Human
auccagaauaccaacucaau

SEQ ID NO: 976157 - RNA, 22 nt, Human
aucugaaguagagaguauaagg

SEQ ID NO: 976158 - RNA, 19 nt, Human
auggaguggagguggcccc

SEQ ID NO: 976159 - RNA, 21 nt, Human
auggcaugacgcgacuccggc

SEQ ID NO: 976160 - RNA, 20 nt, Human
caacuaaauuuauuagcaaa

SEQ ID NO: 976161 - RNA, 20 nt, Human
caagaauuuaaaacaaaaca

SEQ ID NO: 976162 - RNA, 24 nt, Human
cacaagaauuuaaaacaaaacaag

SEQ ID NO: 976163 - RNA, 18 nt, Human
cacacaguacacaguguu

SEQ ID NO: 976164 - RNA, 18 nt, Human
cacaguggccggcagggc

SEQ ID NO: 976165 - RNA, 18 nt, Human
caccaggggcccagggag

SEQ ID NO: 976166 - RNA, 20 nt, Human
cacggccaguguccacaguc

SEQ ID NO: 976167 - RNA, 19 nt, Human
cagagccaaggggcuucag

SEQ ID NO: 976168 - RNA, 24 nt, Human
cagccaaugauaauccauuuccaa

SEQ ID NO: 976169 - RNA, 21 nt, Human
cagcccagugcugaccaacaa

SEQ ID NO: 976170 - RNA, 22 nt, Human
caggcccaaggcagccacaggg

SEQ ID NO: 976171 - RNA, 21 nt, Human
cagggccagggaggugcagga

SEQ ID NO: 976172 - RNA, 18 nt, Human
cauugcccccaacccuca

SEQ ID NO: 976173 - RNA, 19 nt, Human
ccaacacucuaaacuuucu

SEQ ID NO: 976174 - RNA, 22 nt, Human
ccagaauaccaacucaauacag

SEQ ID NO: 976175 - RNA, 20 nt, Human
ccagugcugaccaacaaagu

SEQ ID NO: 976176 - RNA, 25 nt, Human
ccugugagccagccaacacucuaaa

SEQ ID NO: 976177 - RNA, 19 nt, Human
cggggcugggcacauggag

SEQ ID NO: 976178 - RNA, 19 nt, Human
cucaaaaauaacaagcaau

SEQ ID NO: 976179 - RNA, 18 nt, Human
cuggacuccaccauuauu

SEQ ID NO: 976180 - RNA, 24 nt, Human
gaagggccaaggcagagccaaggg

SEQ ID NO: 976181 - RNA, 21 nt, Human
gaauaacaaggaaaggaagaa

SEQ ID NO: 976182 - RNA, 19 nt, Human
gacaguugcagaacaggag

SEQ ID NO: 976183 - RNA, 20 nt, Human
gaggacaauacagggaacag

SEQ ID NO: 976184 - RNA, 18 nt, Human
gaggacacagguggggga

SEQ ID NO: 976185 - RNA, 24 nt, Human
gaggugggugccaagccccagggc

SEQ ID NO: 976186 - RNA, 21 nt, Human
gcacacaagaauuuaaaacaa

SEQ ID NO: 976187 - RNA, 18 nt, Human
gcccccuucaucgcacac

SEQ ID NO: 976188 - RNA, 20 nt, Human
gccucaaaaauaacaagcaa

SEQ ID NO: 976189 - RNA, 18 nt, Human
gcuugggccgggcagggg

SEQ ID NO: 976190 - RNA, 22 nt, Human
ggacaguugcagaacaggagug

SEQ ID NO: 976191 - RNA, 24 nt, Human
ggagcggggaucgggguggggggu

SEQ ID NO: 976192 - RNA, 20 nt, Human
ggaggugcaggagagggggc

SEQ ID NO: 976193 - RNA, 20 nt, Human
ggcaggggugaggugaaggg

SEQ ID NO: 976194 - RNA, 19 nt, Human
ggccucccgccgcaguugg

SEQ ID NO: 976195 - RNA, 21 nt, Human
gggacaguugcagaacaggag

SEQ ID NO: 976196 - RNA, 18 nt, Human
gggcaggggugaggugaa

SEQ ID NO: 976197 - RNA, 18 nt, Human
ggggaucggggugggggg

SEQ ID NO: 976198 - RNA, 21 nt, Human
ggugaagggagagggaggagg

SEQ ID NO: 976199 - RNA, 18 nt, Human
guucuccauagaaaaaga

SEQ ID NO: 976200 - RNA, 22 nt, Human
uaaaacaaaacaagacacugca

SEQ ID NO: 976201 - RNA, 22 nt, Human
uaccucaagcaguuacaacuaa

SEQ ID NO: 976202 - RNA, 19 nt, Human
uagauucgcccccuucauc

SEQ ID NO: 976203 - RNA, 19 nt, Human
uaguaauugaaauuacugc

SEQ ID NO: 976204 - RNA, 19 nt, Human
ucagggccucccgccgcag

SEQ ID NO: 976205 - RNA, 28 nt, Human
ucauaugcucaucauugcccccaacccu

SEQ ID NO: 976206 - RNA, 25 nt, Human
uccacagucugggcaggccgggagc

SEQ ID NO: 976207 - RNA, 21 nt, Human
uccauagaaaaagagggggau

SEQ ID NO: 976208 - RNA, 20 nt, Human
uccuguggggacaguugcag

SEQ ID NO: 976209 - RNA, 23 nt, Human
ugaaagcaggcaucagggaggug

SEQ ID NO: 976210 - RNA, 22 nt, Human
ugaaaugcauguuuuuccuuug

SEQ ID NO: 976211 - RNA, 19 nt, Human
ugcagccugugagccagcc

SEQ ID NO: 976212 - RNA, 19 nt, Human
ugccucaggcaacuaaauu

SEQ ID NO: 976213 - RNA, 19 nt, Human
uggaaugugcuggaggaga

SEQ ID NO: 976214 - RNA, 22 nt, Human
uggaaugugcuggaggagaggu

SEQ ID NO: 976215 - RNA, 22 nt, Human
uggccccgaguuucuccagagg

SEQ ID NO: 976216 - RNA, 21 nt, Human
ugggagcggggaucgggggga

SEQ ID NO: 976217 - RNA, 18 nt, Human
ugggcacauggaguggag

SEQ ID NO: 976218 - RNA, 19 nt, Human
ugggcacauggaguggagg

SEQ ID NO: 976219 - RNA, 21 nt, Human
ugggcaggccgggagcucgug

SEQ ID NO: 976220 - RNA, 29 nt, Human
ugggggacugcaucuucagggccccaguc

SEQ ID NO: 976221 - RNA, 18 nt, Human
ugggugucuuuacuuuuu

SEQ ID NO: 976222 - RNA, 19 nt, Human
uuaaagcacacacaguaca

SEQ ID NO: 976223 - RNA, 22 nt, Human
uuaauuuaaaagccucaaaaau

SEQ ID NO: 976224 - RNA, 24 nt, Human
uucauaugcucaucauugccccca

SEQ ID NO: 976225 - RNA, 24 nt, Human
uuguaucauccagaauaccaacuc

SEQ ID NO: 976226 - RNA, 22 nt, Human
uugucugauagauucgcccccu

SEQ ID NO: 976227 - RNA, 21 nt, Human
uuuaaacauguaguagacaca

SEQ ID NO: 976228 - RNA, 24 nt, Human
uuugcuccucgacggagugaaaug

SEQ ID NO: 976229 - RNA, 20 nt, Human
aaaaaagcacacaagacaca

SEQ ID NO: 976230 - RNA, 22 nt, Human
aaaagcacacaagacacaaaca

SEQ ID NO: 976231 - RNA, 22 nt, Human
aaauggagacucagucaaaaaa

SEQ ID NO: 976232 - RNA, 21 nt, Human
aacugcaugccucaagucccu

SEQ ID NO: 976233 - RNA, 24 nt, Human
aagaagaaaaaggcacagauuuaa

SEQ ID NO: 976234 - RNA, 23 nt, Human
aaguaaauggagacucagucaaa

SEQ ID NO: 976235 - RNA, 25 nt, Human
aauaacaacaaaaaagcacacaaga

SEQ ID NO: 976236 - RNA, 26 nt, Human
acaacaaaaaagcacacaagacacaa

SEQ ID NO: 976237 - RNA, 27 nt, Human
acaacaaaaaagcacacaagacacaaa

SEQ ID NO: 976238 - RNA, 20 nt, Human
agaaaaacaaaagucuuuca

SEQ ID NO: 976239 - RNA, 18 nt, Human
agaagaaaaaggcacaga

SEQ ID NO: 976240 - RNA, 23 nt, Human
agccuuucucacagcugcuuucc

SEQ ID NO: 976241 - RNA, 21 nt, Human
agucaagaaaaacaaaagucu

SEQ ID NO: 976242 - RNA, 19 nt, Human
augaaguaaauggagacuc

SEQ ID NO: 976243 - RNA, 24 nt, Human
caacaaaaaagcacacaagacaca

SEQ ID NO: 976244 - RNA, 19 nt, Human
caagaagaaaaaggcacag

SEQ ID NO: 976245 - RNA, 22 nt, Human
caagacacaaacacucuucaac

SEQ ID NO: 976246 - RNA, 27 nt, Human
cacaagacacaaacacucuucaacagg

SEQ ID NO: 976247 - RNA, 19 nt, Human
cagcugggauaaacauccu

SEQ ID NO: 976248 - RNA, 24 nt, Human
ccuuucucacagcugcuuuccucg

SEQ ID NO: 976249 - RNA, 21 nt, Human
cucaagaagaaaaaggcacga

SEQ ID NO: 976250 - RNA, 28 nt, Human
cugacagccuuucucacagcugcuuucc

SEQ ID NO: 976251 - RNA, 23 nt, Human
cugaugggaguuguaccucuuuc

SEQ ID NO: 976252 - RNA, 22 nt, Human
cuggaguuucccacugugcugg

SEQ ID NO: 976253 - RNA, 20 nt, Human
cuggcgguggugcugcugca

SEQ ID NO: 976254 - RNA, 20 nt, Human
cuuucucacagcugcuuucc

SEQ ID NO: 976255 - RNA, 20 nt, Human
cuuucugacaaaauagcugg

SEQ ID NO: 976256 - RNA, 20 nt, Human
gcaguguugugugagcugga

SEQ ID NO: 976257 - RNA, 22 nt, Human
guggugcugcugcagcugggau

SEQ ID NO: 976258 - RNA, 22 nt, Human
uaagaaagaacuacagcuuugg

SEQ ID NO: 976259 - RNA, 19 nt, Human
uacuaagaaagaacuacag

SEQ ID NO: 976260 - RNA, 24 nt, Human
uagcaaaccgagccaggaccuccc

SEQ ID NO: 976261 - RNA, 19 nt, Human
uauaagguuuaguuggugu

SEQ ID NO: 976262 - RNA, 26 nt, Human
ucacuggugaccugacagccuuucuc

SEQ ID NO: 976263 - RNA, 23 nt, Human
ucccuauauagcaaaccgagcca

SEQ ID NO: 976264 - RNA, 24 nt, Human
ucccuguggagcacucuggcagcu

SEQ ID NO: 976265 - RNA, 23 nt, Human
ucuggaaacuuuuccauuucccu

SEQ ID NO: 976266 - RNA, 23 nt, Human
ugaaguaaauggagacucaguca

SEQ ID NO: 976267 - RNA, 21 nt, Human
ugacaaaauagcuggaaagga

SEQ ID NO: 976268 - RNA, 22 nt, Human
ugaccugacagccuuucucaca

SEQ ID NO: 976269 - RNA, 23 nt, Human
ugagcuggaguuucccacugugc

SEQ ID NO: 976270 - RNA, 21 nt, Human
ugccucaagucccuguggagc

SEQ ID NO: 976271 - RNA, 19 nt, Human
uggaaaggaggagggacca

SEQ ID NO: 976272 - RNA, 21 nt, Human
uggcccaucugaugggaguug

SEQ ID NO: 976273 - RNA, 26 nt, Human
ugugagcuggaguuucccacugugcu

SEQ ID NO: 976274 - RNA, 19 nt, Human
ugugcuggcgguggugcug

SEQ ID NO: 976275 - RNA, 22 nt, Human
uucaccguccuuacaaagucgg

SEQ ID NO: 976276 - RNA, 21 nt, Human
uucaggaauaucccuagcugc

SEQ ID NO: 976277 - RNA, 24 nt, Human
uucaugaauuaagucaagaaaaac

SEQ ID NO: 976278 - RNA, 23 nt, Human
uuuuuuaagcucauaagucuuuu

SEQ ID NO: 976279 - RNA, 24 nt, Human
uuuuuuaagcucauaagucuuuuu

SEQ ID NO: 976280 - RNA, 25 nt, Human
uuuuuuuuuuuuuuuuaaaguuuuu

SEQ ID NO: 976281 - RNA, 23 nt, Human
aacaaacucaugaucucagagaa

SEQ ID NO: 976282 - RNA, 21 nt, Human
caggaagaaaugacauuaaua

SEQ ID NO: 976283 - RNA, 24 nt, Human
ccucugagaucucuguaaucucag

SEQ ID NO: 976284 - RNA, 20 nt, Human
uaauaguuagaacacauaac

SEQ ID NO: 976285 - RNA, 24 nt, Human
ucuccgagcuggugccgccgguuc

SEQ ID NO: 976286 - RNA, 24 nt, Human
ucuuccuuccucaggaagaaauga

SEQ ID NO: 976287 - RNA, 20 nt, Human
ucuuuaaaaaaaaaaaaaaa

SEQ ID NO: 976288 - RNA, 23 nt, Human
ugagacaaguguaaacaaacuca

SEQ ID NO: 976289 - RNA, 18 nt, Human
ugccuauggaaccuccuu

SEQ ID NO: 976290 - RNA, 19 nt, Human
ugcuuauuaaacaaaugcu

SEQ ID NO: 976291 - RNA, 23 nt, Human
uggguaaccguuuuuucuuuaaa

SEQ ID NO: 976292 - RNA, 18 nt, Human
ugguaagaacugccuaug

SEQ ID NO: 976293 - RNA, 18 nt, Human
uuuuuuuuuugggggaug

SEQ ID NO: 976294 - RNA, 18 nt, Human
uuuuuuuuuuuuuggggg

SEQ ID NO: 976295 - RNA, 20 nt, Human
uuuuuuuuuuuuuuggggga

SEQ ID NO: 976296 - RNA, 20 nt, Human
uuuuuuuuuuuuuuuggggg

SEQ ID NO: 976297 - RNA, 21 nt, Human
uuuuuuuuuuuuuuuuugggg

SEQ ID NO: 976298 - RNA, 22 nt, Human
uuuuuuuuuuuuuuuuuggggg

SEQ ID NO: 976299 - RNA, 23 nt, Human
aaaauaguccuauccccacacug

SEQ ID NO: 976300 - RNA, 19 nt, Human
aaacaggcaaaucaccuaa

SEQ ID NO: 976301 - RNA, 20 nt, Human
aaacaggcaaaucaccuaag

SEQ ID NO: 976302 - RNA, 26 nt, Human
aaagcauuucuauauuacauuguucu

SEQ ID NO: 976303 - RNA, 22 nt, Human
aacuguacuggaaaaaugcacu

SEQ ID NO: 976304 - RNA, 24 nt, Human
aacuguacuggaaaaaugcacuga

SEQ ID NO: 976305 - RNA, 22 nt, Human
caaaacaggcaaaucaccuaag

SEQ ID NO: 976306 - RNA, 23 nt, Human
cccacacugcauuuccuucacac

SEQ ID NO: 976307 - RNA, 20 nt, Human
ccugaaauaaguguugagaa

SEQ ID NO: 976308 - RNA, 21 nt, Human
gcggcuccugaggacagguac

SEQ ID NO: 976309 - RNA, 26 nt, Human
uaacuguacuggaaaaaugcacugau

SEQ ID NO: 976310 - RNA, 19 nt, Human
uaagacaaaacaggcaaau

SEQ ID NO: 976311 - RNA, 23 nt, Human
uaccugaaauaaguguugagaac

SEQ ID NO: 976312 - RNA, 24 nt, Human
ucuaaaguaugauuuacuuuagca

SEQ ID NO: 976313 - RNA, 21 nt, Human
ugaggacagguacgucgaagc

SEQ ID NO: 976314 - RNA, 22 nt, Human
ugcacuuagaagauuuguuggg

SEQ ID NO: 976315 - RNA, 27 nt, Human
uguuggggguacuuuaggaggucuacc

SEQ ID NO: 976316 - RNA, 19 nt, Human
uucaugucuuacaaacuuu

SEQ ID NO: 976317 - RNA, 21 nt, Human
uuuauuguuaucauuaucguu

SEQ ID NO: 976318 - RNA, 27 nt, Human
aaaaagaaacaaauuuucucuggaaaa

SEQ ID NO: 976319 - RNA, 21 nt, Human
aaaaugcauauaugaauuuua

SEQ ID NO: 976320 - RNA, 18 nt, Human
aaacaaggccacauaagc

SEQ ID NO: 976321 - RNA, 19 nt, Human
aaacaaggccacauaagcc

SEQ ID NO: 976322 - RNA, 20 nt, Human
aaaccacaccacaaauuucc

SEQ ID NO: 976323 - RNA, 19 nt, Human
aacugauugaaacuuaugc

SEQ ID NO: 976324 - RNA, 22 nt, Human
acauacacuuuuuuauaucccu

SEQ ID NO: 976325 - RNA, 23 nt, Human
accacaccacaaauuuccaggua

SEQ ID NO: 976326 - RNA, 25 nt, Human
acucucaaaaaauuuuaaaaagaaa

SEQ ID NO: 976327 - RNA, 27 nt, Human
agaaccaaagccccuaaauucuacuga

SEQ ID NO: 976328 - RNA, 23 nt, Human
agagauuaagaaggcuaaaacaa

SEQ ID NO: 976329 - RNA, 24 nt, Human
cacaagguacccuagccgaagcag

SEQ ID NO: 976330 - RNA, 20 nt, Human
caguagaaaagccgacucaa

SEQ ID NO: 976331 - RNA, 22 nt, Human
ccacaccacaaauuuccaggua

SEQ ID NO: 976332 - RNA, 19 nt, Human
ccacauaagccuggcuggc

SEQ ID NO: 976333 - RNA, 18 nt, Human
ccccuaaauucuacugaa

SEQ ID NO: 976334 - RNA, 24 nt, Human
cccuagccgaagcaguagaaaagc

SEQ ID NO: 976335 - RNA, 19 nt, Human
cgaagcaguagaaaagccg

SEQ ID NO: 976336 - RNA, 20 nt, Human
cgcaaaugaaaaagcuaaac

SEQ ID NO: 976337 - RNA, 22 nt, Human
cuacugaacauacuucaaacau

SEQ ID NO: 976338 - RNA, 20 nt, Human
cucagagauauuuucacugu

SEQ ID NO: 976339 - RNA, 22 nt, Human
cuggcuggccuucaaaaauaaa

SEQ ID NO: 976340 - RNA, 23 nt, Human
gaaaaagaaaucgcuucauggga

SEQ ID NO: 976341 - RNA, 21 nt, Human
gaaaaucuguaagaaccaaag

SEQ ID NO: 976342 - RNA, 24 nt, Human
gaacauacuucaaacauuuugccu

SEQ ID NO: 976343 - RNA, 19 nt, Human
gcaguagaaaagccgacuc

SEQ ID NO: 976344 - RNA, 18 nt, Human
uacccuagccgaagcagu

SEQ ID NO: 976345 - RNA, 25 nt, Human
uacccuagccgaagcaguagaaaag

SEQ ID NO: 976346 - RNA, 19 nt, Human
uagaaaagccgacucaaug

SEQ ID NO: 976347 - RNA, 23 nt, Human
uaggucgcaaaugaaaaagcuaa

SEQ ID NO: 976348 - RNA, 21 nt, Human
uauaucccuaaagauuacaaa

SEQ ID NO: 976349 - RNA, 24 nt, Human
ucaaacagauucuggaaaaagaaa

SEQ ID NO: 976350 - RNA, 24 nt, Human
uccacauacacuuuuuuauauccc

SEQ ID NO: 976351 - RNA, 24 nt, Human
uccacauauacuuuuuuauauccc

SEQ ID NO: 976352 - RNA, 26 nt, Human
uccagguaaaacugauugaaacuuau

SEQ ID NO: 976353 - RNA, 19 nt, Human
ucccuaaagauuacaaaaa

SEQ ID NO: 976354 - RNA, 22 nt, Human
ucuggaaaaagaaaucgcuuca

SEQ ID NO: 976355 - RNA, 23 nt, Human
ucuguaagaaccaaagccccuaa

SEQ ID NO: 976356 - RNA, 19 nt, Human
ugaaaaagcuaaacauuug

SEQ ID NO: 976357 - RNA, 21 nt, Human
uggaaaaagaaaucgcuucau

SEQ ID NO: 976358 - RNA, 18 nt, Human
uguaagaaccaaagcccc

SEQ ID NO: 976359 - RNA, 23 nt, Human
uguacuuacaugacuugaaaauc

SEQ ID NO: 976360 - RNA, 22 nt, Human
gggauggagaugggaacucugg

SEQ ID NO: 976361 - RNA, 22 nt, Human
ugaggaggaaggggcugaugcc

SEQ ID NO: 976362 - RNA, 18 nt, Human
ugccucugaauguccccu

SEQ ID NO: 976363 - RNA, 23 nt, Human
uggagaugggaacucugggagcu

SEQ ID NO: 976364 - RNA, 18 nt, Human
uggggauggagaugggaa

SEQ ID NO: 976365 - RNA, 21 nt, Human
uggugaggaggaaggggcuga

SEQ ID NO: 976366 - RNA, 19 nt, Human
uuuuuuuuuuuggggguaa

SEQ ID NO: 976367 - RNA, 19 nt, Human
uuuuuuuuuuuuugggggu

SEQ ID NO: 976368 - RNA, 20 nt, Human
uuuuuuuuuuuuuuuggggg

SEQ ID NO: 976369 - RNA, 20 nt, Human
acaguauuuauugaauguaa

SEQ ID NO: 976370 - RNA, 26 nt, Human
cagccccauggggaagaaaauuccaa

SEQ ID NO: 976371 - RNA, 22 nt, Human
ccccauggggaagaaaauucca

SEQ ID NO: 976372 - RNA, 18 nt, Human
guaaaguaccccagcccc

SEQ ID NO: 976373 - RNA, 19 nt, Human
uaaaguaccccagccccau

SEQ ID NO: 976374 - RNA, 21 nt, Human
uacccaccugugcauucacac

SEQ ID NO: 976375 - RNA, 18 nt, Human
uuuuuuuuuuuuuuuuug

SEQ ID NO: 976376 - RNA, 23 nt, Human
uuuuuuuuuuuuuuuuuuugggu

SEQ ID NO: 976377 - RNA, 26 nt, Human
uuuuuuuuuuuuuuuuuuuuuuuggg

SEQ ID NO: 976378 - RNA, 21 nt, Human
acuuuauuuucauugccgaag

SEQ ID NO: 976379 - RNA, 18 nt, Human
caguagguuuuuggagcu

SEQ ID NO: 976380 - RNA, 18 nt, Human
cccuaugcauacccuccu

SEQ ID NO: 976381 - RNA, 19 nt, Human
uagguuuuuggagcuuuug

SEQ ID NO: 976382 - RNA, 21 nt, Human
ucuacaguagguuuuuggagc

SEQ ID NO: 976383 - RNA, 21 nt, Human
acaaagccccacugcugacca

SEQ ID NO: 976384 - RNA, 27 nt, Human
acaggcagugucccagccaauggcagc

SEQ ID NO: 976385 - RNA, 20 nt, Human
acgucacaaagccccacugc

SEQ ID NO: 976386 - RNA, 24 nt, Human
cccacugcugaccacucccugggc

SEQ ID NO: 976387 - RNA, 23 nt, Human
cucccugggcuugcgggcgaggg

SEQ ID NO: 976388 - RNA, 24 nt, Human
gacaaggcaaagccacacccuuga

SEQ ID NO: 976389 - RNA, 20 nt, Human
gacgucacaaagccccacug

SEQ ID NO: 976390 - RNA, 18 nt, Human
gaucugccgccgcuccuc

SEQ ID NO: 976391 - RNA, 18 nt, Human
gcccaagguugagagaug

SEQ ID NO: 976392 - RNA, 18 nt, Human
gcgggcgagggguggcag

SEQ ID NO: 976393 - RNA, 22 nt, Human
ucaaugucagcggcaggcuuuu

SEQ ID NO: 976394 - RNA, 24 nt, Human
ucacaaagccccacugcugaccac

SEQ ID NO: 976395 - RNA, 19 nt, Human
ucauacaggcaguguccca

SEQ ID NO: 976396 - RNA, 28 nt, Human
ucucaaacuuuauugucauuccaacgug

SEQ ID NO: 976397 - RNA, 23 nt, Human
ugucccagccaauggcagcccua

SEQ ID NO: 976398 - RNA, 22 nt, Human
aaacacccaagaaaaagggagc

SEQ ID NO: 976399 - RNA, 22 nt, Human
aaauuacuaugaauuaaacuuc

SEQ ID NO: 976400 - RNA, 19 nt, Human
aacaauacaaaugcauuau

SEQ ID NO: 976401 - RNA, 18 nt, Human
acagaggaggaugcugga

SEQ ID NO: 976402 - RNA, 22 nt, Human
agaauuuggagguuggcaccag

SEQ ID NO: 976403 - RNA, 27 nt, Human
agauauugaaaauaauacacguaaacc

SEQ ID NO: 976404 - RNA, 19 nt, Human
aguauuucagacugucauc

SEQ ID NO: 976405 - RNA, 23 nt, Human
cacguaaaccacaaaagaguagc

SEQ ID NO: 976406 - RNA, 26 nt, Human
cauuuuuguuuccaaaguuaauguua

SEQ ID NO: 976407 - RNA, 19 nt, Human
cucugcuucuuugcccaga

SEQ ID NO: 976408 - RNA, 21 nt, Human
cugcugcucugucaacuagug

SEQ ID NO: 976409 - RNA, 19 nt, Human
cuggacccagagccacugc

SEQ ID NO: 976410 - RNA, 18 nt, Human
gcaggcuggccucucaug

SEQ ID NO: 976411 - RNA, 21 nt, Human
gccacugcagaaaauugaagu

SEQ ID NO: 976412 - RNA, 19 nt, Human
ggacccagagccacugcag

SEQ ID NO: 976413 - RNA, 23 nt, Human
ggacccagagccacugcagaaaa

SEQ ID NO: 976414 - RNA, 19 nt, Human
gggcuggacccagagccac

SEQ ID NO: 976415 - RNA, 20 nt, Human
guaaaccacaaaagaguagc

SEQ ID NO: 976416 - RNA, 23 nt, Human
gucaucguuuuuguugcagauuc

SEQ ID NO: 976417 - RNA, 20 nt, Human
uaaaccacaaaagaguagca

SEQ ID NO: 976418 - RNA, 20 nt, Human
uaaggggcuggacccagagc

SEQ ID NO: 976419 - RNA, 23 nt, Human
uaaggggcuggacccagagccac

SEQ ID NO: 976420 - RNA, 24 nt, Human
uaauacacguaaaccacaaaagag

SEQ ID NO: 976421 - RNA, 21 nt, Human
uacaaguaucacagcugcaua

SEQ ID NO: 976422 - RNA, 24 nt, Human
uagaacagaggaggaugcuggaaa

SEQ ID NO: 976423 - RNA, 20 nt, Human
uauaaaucuacaaguaucac

SEQ ID NO: 976424 - RNA, 22 nt, Human
uaucacagcugcauauauuucu

SEQ ID NO: 976425 - RNA, 24 nt, Human
uauuaugaacaauacaaaugcauu

SEQ ID NO: 976426 - RNA, 19 nt, Human
ucuguucacaauguacagu

SEQ ID NO: 976427 - RNA, 20 nt, Human
ugacaaacacccaagaaaaa

SEQ ID NO: 976428 - RNA, 24 nt, Human
ugacaaacacccaagaaaaacucu

SEQ ID NO: 976429 - RNA, 21 nt, Human
ugacagacgagaauuuggagg

SEQ ID NO: 976430 - RNA, 24 nt, Human
uggauuuuuauggacucuuuauua

SEQ ID NO: 976431 - RNA, 19 nt, Human
uucuuugcccagaggcaca

SEQ ID NO: 976432 - RNA, 19 nt, Human
uuuggauuuuuauggacuc

SEQ ID NO: 976433 - RNA, 18 nt, Human
uuuuuuuuuuuuuuuuug

SEQ ID NO: 976434 - RNA, 25 nt, Human
uuuuuuuuuuuuuuuuuuggauuuu

SEQ ID NO: 976435 - RNA, 22 nt, Human
agaggaaaagaaaacuuaagag

SEQ ID NO: 976436 - RNA, 19 nt, Human
aggaaaagaaaacuuaaga

SEQ ID NO: 976437 - RNA, 21 nt, Human
aggaaaagaaaacuuaagagu

SEQ ID NO: 976438 - RNA, 20 nt, Human
auaaucuucucucuuucagu

SEQ ID NO: 976439 - RNA, 20 nt, Human
auaccuucuuucuuccuuua

SEQ ID NO: 976440 - RNA, 19 nt, Human
aucuucucgaaguuuuguu

SEQ ID NO: 976441 - RNA, 22 nt, Human
caucuugaucucccuggcuuca

SEQ ID NO: 976442 - RNA, 23 nt, Human
ccauugaugcugugacuuucuuu

SEQ ID NO: 976443 - RNA, 19 nt, Human
cgcgcuagccuccagcagc

SEQ ID NO: 976444 - RNA, 21 nt, Human
cggccccucuggagaggaaaa

SEQ ID NO: 976445 - RNA, 19 nt, Human
cuccagcagccgccgcgcc

SEQ ID NO: 976446 - RNA, 23 nt, Human
cuccagcagccgccgcgcccacc

SEQ ID NO: 976447 - RNA, 22 nt, Human
cucuggagaggaaaagaaaacu

SEQ ID NO: 976448 - RNA, 22 nt, Human
cugcuuguuuucucauccuuaa

SEQ ID NO: 976449 - RNA, 19 nt, Human
cuuaagauagcauuccacu

SEQ ID NO: 976450 - RNA, 20 nt, Human
gauguuugccagauucuuug

SEQ ID NO: 976451 - RNA, 23 nt, Human
gggucgcgcuagccuccagcagc

SEQ ID NO: 976452 - RNA, 20 nt, Human
guuuuguuaaaaccuccucc

SEQ ID NO: 976453 - RNA, 23 nt, Human
uaaaaccuccuccauugaugcug

SEQ ID NO: 976454 - RNA, 18 nt, Human
uauuagguaauucuugga

SEQ ID NO: 976455 - RNA, 24 nt, Human
ucucuuucaguuuguaauaaagau

SEQ ID NO: 976456 - RNA, 18 nt, Human
ugaaacugcuuguuuucu

SEQ ID NO: 976457 - RNA, 21 nt, Human
ugugauguuugccagauucuu

SEQ ID NO: 976458 - RNA, 24 nt, Human
uguuugauaaucuucucucuuuca

SEQ ID NO: 976459 - RNA, 24 nt, Human
uuaaaaccuccuccauugaugcug

SEQ ID NO: 976460 - RNA, 22 nt, Human
uucauuuguuugauaaucuucu

SEQ ID NO: 976461 - RNA, 22 nt, Human
uuuguuaaaaccuccuccauug

SEQ ID NO: 976462 - RNA, 19 nt, Human
acgagguggcggcggcggu

SEQ ID NO: 976463 - RNA, 23 nt, Human
aggagacgagguggcggcggcgg

SEQ ID NO: 976464 - RNA, 21 nt, Human
aggccggggcccgcgguccag

SEQ ID NO: 976465 - RNA, 19 nt, Human
aggcggggagaccuggggc

SEQ ID NO: 976466 - RNA, 23 nt, Human
cggggaggagacgagguggcggc

SEQ ID NO: 976467 - RNA, 25 nt, Human
gagguggcggcggcgguggcagcaa

SEQ ID NO: 976468 - RNA, 22 nt, Human
gagugaccccggccacgggccc

SEQ ID NO: 976469 - RNA, 20 nt, Human
gcggggagaccuggggcugg

SEQ ID NO: 976470 - RNA, 25 nt, Human
gcgguggcagcaguggcccccaggc

SEQ ID NO: 976471 - RNA, 24 nt, Human
gcugggcggggacggggaggagac

SEQ ID NO: 976472 - RNA, 21 nt, Human
ggcggcggggagugaccccgg

SEQ ID NO: 976473 - RNA, 22 nt, Human
gggcggcggggagugaccccgg

SEQ ID NO: 976474 - RNA, 24 nt, Human
gggcggcggggagugaccccggcc

SEQ ID NO: 976475 - RNA, 20 nt, Human
ggggcugggcggggacgggg

SEQ ID NO: 976476 - RNA, 22 nt, Human
guggcggcggcgguggcagcag

SEQ ID NO: 976477 - RNA, 20 nt, Human
uggcagcaguggcccccagg

SEQ ID NO: 976478 - RNA, 23 nt, Human
uggcggcggcgguggcagcagug

SEQ ID NO: 976479 - RNA, 24 nt, Human
uggcggcggcgguggcagcagugg

SEQ ID NO: 976480 - RNA, 23 nt, Human
ugggcggggacggggaggagacg

SEQ ID NO: 976481 - RNA, 20 nt, Human
uggggcugggcggggacggg

SEQ ID NO: 976482 - RNA, 22 nt, Human
aaagauguuucuagagccugaa

SEQ ID NO: 976483 - RNA, 20 nt, Human
aaccacaaauauauggcccu

SEQ ID NO: 976484 - RNA, 20 nt, Human
aauaccuaucucccuuacac

SEQ ID NO: 976485 - RNA, 19 nt, Human
aaugcagauggggauggag

SEQ ID NO: 976486 - RNA, 21 nt, Human
acaagucacugucuacacuua

SEQ ID NO: 976487 - RNA, 26 nt, Human
acauacacgcagcgcaguucagugua

SEQ ID NO: 976488 - RNA, 19 nt, Human
acuuuaggggcaccugaaa

SEQ ID NO: 976489 - RNA, 24 nt, Human
agaccaacuccaaauuguggaugu

SEQ ID NO: 976490 - RNA, 21 nt, Human
agagguagggaagggggaagu

SEQ ID NO: 976491 - RNA, 19 nt, Human
agggaagggggaagugagg

SEQ ID NO: 976492 - RNA, 19 nt, Human
agggaagggggaagugagg

SEQ ID NO: 976493 - RNA, 19 nt, Human
agguagggaagggggaagu

SEQ ID NO: 976494 - RNA, 21 nt, Human
auauggcccugcgccaaagac

SEQ ID NO: 976495 - RNA, 18 nt, Human
augcaucacuucacauuc

SEQ ID NO: 976496 - RNA, 18 nt, Human
auggcccugcgccaaaga

SEQ ID NO: 976497 - RNA, 20 nt, Human
caaauauauggcccugcgcc

SEQ ID NO: 976498 - RNA, 23 nt, Human
caauaugugcugucuuuccuaca

SEQ ID NO: 976499 - RNA, 19 nt, Human
caggucaaaauuccuacua

SEQ ID NO: 976500 - RNA, 18 nt, Human
caguucucucaauuguaa

SEQ ID NO: 976501 - RNA, 24 nt, Human
ccaaagacagcagauguucuuugg

SEQ ID NO: 976502 - RNA, 18 nt, Human
ccugaaaccacaaauaua

SEQ ID NO: 976503 - RNA, 23 nt, Human
ccugaagacuuccucuugagggu

SEQ ID NO: 976504 - RNA, 19 nt, Human
ccugcugagaccaacucca

SEQ ID NO: 976505 - RNA, 19 nt, Human
ccuggccugaauaucagaa

SEQ ID NO: 976506 - RNA, 27 nt, Human
ccuguaacaauaugugcugucuuuccu

SEQ ID NO: 976507 - RNA, 23 nt, Human
cgacagaagcaguggcuuacauu

SEQ ID NO: 976508 - RNA, 22 nt, Human
cgccaaagacagcagauguucu

SEQ ID NO: 976509 - RNA, 21 nt, Human
cuacuaaguugcauguuaugc

SEQ ID NO: 976510 - RNA, 22 nt, Human
cucaauaccuaucucccuuaca

SEQ ID NO: 976511 - RNA, 25 nt, Human
cugaaaccacaaauauauggccccu

SEQ ID NO: 976512 - RNA, 25 nt, Human
cugaaaccacaaauauauggcccug

SEQ ID NO: 976513 - RNA, 19 nt, Human
cugcaaugggguccugcug

SEQ ID NO: 976514 - RNA, 24 nt, Human
cugcugagaccaacuccaaauugu

SEQ ID NO: 976515 - RNA, 18 nt, Human
cuggccugaauaucagaa

SEQ ID NO: 976516 - RNA, 19 nt, Human
cuuuguaugagccuguaac

SEQ ID NO: 976517 - RNA, 24 nt, Human
gagguagggaagggggaagugagg

SEQ ID NO: 976518 - RNA, 21 nt, Human
gauggagguagagggcuuccc

SEQ ID NO: 976519 - RNA, 20 nt, Human
gcagauuuuuucucccaucu

SEQ ID NO: 976520 - RNA, 23 nt, Human
gcuccuauagacacuuuaggggc

SEQ ID NO: 976521 - RNA, 20 nt, Human
gggaagggggaagugagggu

SEQ ID NO: 976522 - RNA, 19 nt, Human
guacaagucacugucuaca

SEQ ID NO: 976523 - RNA, 23 nt, Human
gugcugucuuuccuacaacacag

SEQ ID NO: 976524 - RNA, 20 nt, Human
uaaaauaagagccaauuauc

SEQ ID NO: 976525 - RNA, 22 nt, Human
uaaaauaagagccaauuaucau

SEQ ID NO: 976526 - RNA, 23 nt, Human
uaaggagaaagagguagggaagg

SEQ ID NO: 976527 - RNA, 24 nt, Human
uacagaguggcucugcaagagaga

SEQ ID NO: 976528 - RNA, 25 nt, Human
ucacauucccacucucccuuucuca

SEQ ID NO: 976529 - RNA, 23 nt, Human
ucaguaaggagaaagagguaggg

SEQ ID NO: 976530 - RNA, 20 nt, Human
ucccuuacacauguguaagg

SEQ ID NO: 976531 - RNA, 21 nt, Human
uccuauagacacuuuaggggc

SEQ ID NO: 976532 - RNA, 21 nt, Human
ucuacuuaggaagguaagaac

SEQ ID NO: 976533 - RNA, 21 nt, Human
ucuagagccugaagacuuccu

SEQ ID NO: 976534 - RNA, 20 nt, Human
ucucaauaccuaucucccuu

SEQ ID NO: 976535 - RNA, 18 nt, Human
ucuguggguguccuggcc

SEQ ID NO: 976536 - RNA, 24 nt, Human
ugaaaccacaaauauauggcccug

SEQ ID NO: 976537 - RNA, 19 nt, Human
ugaaguacaaagguugacu

SEQ ID NO: 976538 - RNA, 20 nt, Human
ugagacuggaggaaaugaau

SEQ ID NO: 976539 - RNA, 21 nt, Human
ugauacacacacacaagcuug

SEQ ID NO: 976540 - RNA, 24 nt, Human
uggaggaaaugaaugcagaugggg

SEQ ID NO: 976541 - RNA, 20 nt, Human
ugggaugaaguacaaagguu

SEQ ID NO: 976542 - RNA, 18 nt, Human
uggggauggagguagagg

SEQ ID NO: 976543 - RNA, 18 nt, Human
ugugcugucuuuccuaca

SEQ ID NO: 976544 - RNA, 24 nt, Human
uuaguggucgugaauauuuuucuc

SEQ ID NO: 976545 - RNA, 20 nt, Human
uucaguguacaagucacugu

SEQ ID NO: 976546 - RNA, 20 nt, Human
acccaacugggcuagaaaug

SEQ ID NO: 976547 - RNA, 21 nt, Human
agaaaugaaguauaaagagaa

SEQ ID NO: 976548 - RNA, 18 nt, Human
agguggugguggcggccg

SEQ ID NO: 976549 - RNA, 24 nt, Human
caccugaaagaaacuucauacuug

SEQ ID NO: 976550 - RNA, 19 nt, Human
cagagcaagauuaugaaga

SEQ ID NO: 976551 - RNA, 21 nt, Human
cucagagcaagauuaugaaga

SEQ ID NO: 976552 - RNA, 21 nt, Human
cugagguggugguggcggccu

SEQ ID NO: 976553 - RNA, 20 nt, Human
gaacuaaaucuauacacagc

SEQ ID NO: 976554 - RNA, 24 nt, Human
uaacucauaaugaauuauaaaacu

SEQ ID NO: 976555 - RNA, 24 nt, Human
uauaaaacuuugauaguuacauug

SEQ ID NO: 976556 - RNA, 20 nt, Human
uccccaucucagagcaagau

SEQ ID NO: 976557 - RNA, 18 nt, Human
uguucuguuccccaucuc

SEQ ID NO: 976558 - RNA, 19 nt, Human
aaaguccccucgagugcac

SEQ ID NO: 976559 - RNA, 19 nt, Human
aacucuggcauggaaacau

SEQ ID NO: 976560 - RNA, 23 nt, Human
agcaggacaccggcaggggaaag

SEQ ID NO: 976561 - RNA, 21 nt, Human
aggaacagcaaggcaggcuuc

SEQ ID NO: 976562 - RNA, 24 nt, Human
aucacagaccaguaucuacuccaa

SEQ ID NO: 976563 - RNA, 18 nt, Human
caaaccagugcuacccag

SEQ ID NO: 976564 - RNA, 23 nt, Human
caaagucuuuuauuuaaaauuuu

SEQ ID NO: 976565 - RNA, 19 nt, Human
cagcgggcggacuacugga

SEQ ID NO: 976566 - RNA, 22 nt, Human
cccacacaaacucuggcaugga

SEQ ID NO: 976567 - RNA, 21 nt, Human
cgaaaacuauggcaucuuccc

SEQ ID NO: 976568 - RNA, 22 nt, Human
cgaaaacuauggcaucuuccca

SEQ ID NO: 976569 - RNA, 18 nt, Human
cgcgaugaccagcgggcg

SEQ ID NO: 976570 - RNA, 19 nt, Human
gagcaggacaccggcaggg

SEQ ID NO: 976571 - RNA, 21 nt, Human
gagcaggacaccggcagggga

SEQ ID NO: 976572 - RNA, 24 nt, Human
ggugcacaugcgcccgcccacaca

SEQ ID NO: 976573 - RNA, 20 nt, Human
ucacagaccaguaucuacca

SEQ ID NO: 976574 - RNA, 19 nt, Human
ucgagugcacucuguggug

SEQ ID NO: 976575 - RNA, 22 nt, Human
ucucuguaggcacuuuagaagu

SEQ ID NO: 976576 - RNA, 21 nt, Human
aaaaaaaaaaaaggaaccuca

SEQ ID NO: 976577 - RNA, 20 nt, Human
aaaaauggcagaaaauacau

SEQ ID NO: 976578 - RNA, 27 nt, Human
aaacagaaacagaagauuagaggccua

SEQ ID NO: 976579 - RNA, 22 nt, Human
aaacagaagauuagaggcccua

SEQ ID NO: 976580 - RNA, 21 nt, Human
aaagaacacuucagcccaaaa

SEQ ID NO: 976581 - RNA, 21 nt, Human
aaagcuaaugagaccccaccc

SEQ ID NO: 976582 - RNA, 20 nt, Human
aacccacuccucacucuccc

SEQ ID NO: 976583 - RNA, 23 nt, Human
aacccacuccucacucuccccag

SEQ ID NO: 976584 - RNA, 27 nt, Human
aacccugcucuucuccaccauccagac

SEQ ID NO: 976585 - RNA, 18 nt, Human
aagauuagaggccuaacu

SEQ ID NO: 976586 - RNA, 21 nt, Human
aagcaaacugaauggguggga

SEQ ID NO: 976587 - RNA, 24 nt, Human
aaggaguguaucuacugcuucucu

SEQ ID NO: 976588 - RNA, 20 nt, Human
acaaagaacacuucagccca

SEQ ID NO: 976589 - RNA, 19 nt, Human
acacugcaggaaccacuuc

SEQ ID NO: 976590 - RNA, 18 nt, Human
accaguuccuacauuccu

SEQ ID NO: 976591 - RNA, 21 nt, Human
acccacuccucacucucccca

SEQ ID NO: 976592 - RNA, 23 nt, Human
accccacuaccauaauaaaacag

SEQ ID NO: 976593 - RNA, 19 nt, Human
accccucuuccuccucuca

SEQ ID NO: 976594 - RNA, 18 nt, Human
acccuggguucacucagc

SEQ ID NO: 976595 - RNA, 20 nt, Human
agaagguagcuaaaggcaag

SEQ ID NO: 976596 - RNA, 21 nt, Human
agacaaaacucccugagucua

SEQ ID NO: 976597 - RNA, 21 nt, Human
agagcaccaaaggaaaaagac

SEQ ID NO: 976598 - RNA, 24 nt, Human
agauacaccaccacccuggguuca

SEQ ID NO: 976599 - RNA, 21 nt, Human
agauauugagggcuguaagcc

SEQ ID NO: 976600 - RNA, 27 nt, Human
agcuucacuccucugucugaggcccca

SEQ ID NO: 976601 - RNA, 22 nt, Human
aggaaaaagacuguccaaagaa

SEQ ID NO: 976602 - RNA, 24 nt, Human
aggaaagaugccccaaaacuuaaa

SEQ ID NO: 976603 - RNA, 19 nt, Human
aggagucucuaaccuuucc

SEQ ID NO: 976604 - RNA, 20 nt, Human
aggauguuuccuguugcaaa

SEQ ID NO: 976605 - RNA, 18 nt, Human
aggcacccccccagcccc

SEQ ID NO: 976606 - RNA, 18 nt, Human
aggggcuauggccagagg

SEQ ID NO: 976607 - RNA, 22 nt, Human
aguagagggaguccagccccca

SEQ ID NO: 976608 - RNA, 19 nt, Human
auaaaacaggauguuuccu

SEQ ID NO: 976609 - RNA, 22 nt, Human
aucauagcaacaugcaaacacc

SEQ ID NO: 976610 - RNA, 18 nt, Human
aucucacccaccuacccc

SEQ ID NO: 976611 - RNA, 24 nt, Human
auguauagagacauuuuugguugu

SEQ ID NO: 976612 - RNA, 24 nt, Human
caaagggcucuuucccugguguuu

SEQ ID NO: 976613 - RNA, 18 nt, Human
caacccacuccucacucu

SEQ ID NO: 976614 - RNA, 23 nt, Human
caacccacuccucacucucccca

SEQ ID NO: 976615 - RNA, 19 nt, Human
caagagagcaccaaaggaa

SEQ ID NO: 976616 - RNA, 22 nt, Human
cacaagguuaugucuuccucag

SEQ ID NO: 976617 - RNA, 23 nt, Human
caccaaaggaaaaagacugucca

SEQ ID NO: 976618 - RNA, 25 nt, Human
caccaccacccuggguucacucagc

SEQ ID NO: 976619 - RNA, 18 nt, Human
cacccccccagccccugc

SEQ ID NO: 976620 - RNA, 23 nt, Human
caccugagaaaacugaaagugcc

SEQ ID NO: 976621 - RNA, 21 nt, Human
cacuaccauaauaaaacagga

SEQ ID NO: 976622 - RNA, 18 nt, Human
cagauacaccaccacccu

SEQ ID NO: 976623 - RNA, 21 nt, Human
cagauacaccaccacccuggg

SEQ ID NO: 976624 - RNA, 18 nt, Human
caggaccagagagagagg

SEQ ID NO: 976625 - RNA, 21 nt, Human
caggagacaggaacucauucc

SEQ ID NO: 976626 - RNA, 19 nt, Human
caggugaagagcuaccucu

SEQ ID NO: 976627 - RNA, 22 nt, Human
cagugggaccuggucuucagac

SEQ ID NO: 976628 - RNA, 26 nt, Human
ccaauccuaccauacccuguucauau

SEQ ID NO: 976629 - RNA, 20 nt, Human
ccagaccccucuuccuccuc

SEQ ID NO: 976630 - RNA, 20 nt, Human
ccaggaaggaggagaagggc

SEQ ID NO: 976631 - RNA, 21 nt, Human
ccaggaaggaggagaagggca

SEQ ID NO: 976632 - RNA, 20 nt, Human
ccaggaggggcuauggccag

SEQ ID NO: 976633 - RNA, 19 nt, Human
cccacuccucacucucccc

SEQ ID NO: 976634 - RNA, 24 nt, Human
cccacuccucacucuccccagaua

SEQ ID NO: 976635 - RNA, 21 nt, Human
cccagaccaucauucaggaga

SEQ ID NO: 976636 - RNA, 20 nt, Human
ccccaaagggcucuuucccu

SEQ ID NO: 976637 - RNA, 23 nt, Human
ccccagauacaccaccacccugg

SEQ ID NO: 976638 - RNA, 22 nt, Human
ccgaagaucacggugaccagag

SEQ ID NO: 976639 - RNA, 22 nt, Human
ccuauuuaucucaccauccuca

SEQ ID NO: 976640 - RNA, 23 nt, Human
cgaagaacaccugagaaaacuga

SEQ ID NO: 976641 - RNA, 21 nt, Human
cuagagccucucccugcuccc

SEQ ID NO: 976642 - RNA, 21 nt, Human
cuaggagucucuaaccuuucc

SEQ ID NO: 976643 - RNA, 25 nt, Human
cuaguucugccgcauucuggguuuc

SEQ ID NO: 976644 - RNA, 18 nt, Human
cucaucugucuuguucug

SEQ ID NO: 976645 - RNA, 20 nt, Human
cuccccuuuccccaauccua

SEQ ID NO: 976646 - RNA, 19 nt, Human
cuccucugucugaggcccc

SEQ ID NO: 976647 - RNA, 21 nt, Human
cugaauuaaagaauuguuugg

SEQ ID NO: 976648 - RNA, 18 nt, Human
cugcaggaaccacuucuc

SEQ ID NO: 976649 - RNA, 18 nt, Human
cugccuuccuaauuaccc

SEQ ID NO: 976650 - RNA, 18 nt, Human
cugcuccuacguuguuuu

SEQ ID NO: 976651 - RNA, 22 nt, Human
cugcuucucucuccccuuuccc

SEQ ID NO: 976652 - RNA, 22 nt, Human
cugguucaaggagggaucuggu

SEQ ID NO: 976653 - RNA, 22 nt, Human
cuguugcaaagcuaaugagacc

SEQ ID NO: 976654 - RNA, 23 nt, Human
cuuaagacuccuaaacucacaga

SEQ ID NO: 976655 - RNA, 26 nt, Human
cuucacuccucugucugaggccccaa

SEQ ID NO: 976656 - RNA, 20 nt, Human
gaaaaagacuguccaaagaa

SEQ ID NO: 976657 - RNA, 22 nt, Human
gaaaaagacuguccaaagaaca

SEQ ID NO: 976658 - RNA, 20 nt, Human
gaccccacccuucuugucuc

SEQ ID NO: 976659 - RNA, 23 nt, Human
gacccugaaaaauggcagaaaau

SEQ ID NO: 976660 - RNA, 24 nt, Human
gagagcaccaaaggaaaaagacug

SEQ ID NO: 976661 - RNA, 20 nt, Human
gagggcaggaaagaugcccc

SEQ ID NO: 976662 - RNA, 20 nt, Human
gaggguuuccuaggcuucag

SEQ ID NO: 976663 - RNA, 19 nt, Human
gaggugggcaggcaggcac

SEQ ID NO: 976664 - RNA, 22 nt, Human
gaugaacaggaccagagagaga

SEQ ID NO: 976665 - RNA, 20 nt, Human
gcacccagaccaucauucag

SEQ ID NO: 976666 - RNA, 27 nt, Human
gcuucagcuuugauaaucucacccacc

SEQ ID NO: 976667 - RNA, 22 nt, Human
ggcacccccccagccccugcuu

SEQ ID NO: 976668 - RNA, 20 nt, Human
ggcuggaaacagaauggggg

SEQ ID NO: 976669 - RNA, 21 nt, Human
gggagguuggcagagggcagg

SEQ ID NO: 976670 - RNA, 21 nt, Human
guaaugcacaaaauaggaaac

SEQ ID NO: 976671 - RNA, 21 nt, Human
gucugaggccccaaagggcuc

SEQ ID NO: 976672 - RNA, 22 nt, Human
uaaacagaaacagaagauuaga

SEQ ID NO: 976673 - RNA, 29 nt, Human
uaaacagaaacagaagauuagaggcuguc

SEQ ID NO: 976674 - RNA, 23 nt, Human
uaauagggauagaguuaagggcg

SEQ ID NO: 976675 - RNA, 21 nt, Human
uacguuguuuucccauuuaaa

SEQ ID NO: 976676 - RNA, 19 nt, Human
uagaaugaggccgaagauc

SEQ ID NO: 976677 - RNA, 21 nt, Human
uagacccugaaaaauggcaga

SEQ ID NO: 976678 - RNA, 21 nt, Human
uagcuaaaggcaagagagcac

SEQ ID NO: 976679 - RNA, 24 nt, Human
uagcuaaaggcaagagagcaccaa

SEQ ID NO: 976680 - RNA, 18 nt, Human
uaggcagauagggaaaag

SEQ ID NO: 976681 - RNA, 25 nt, Human
uagggcacaaaaauagagcuuaaaa

SEQ ID NO: 976682 - RNA, 18 nt, Human
uauuuaaaaguccaacaa

SEQ ID NO: 976683 - RNA, 23 nt, Human
uauuuaaaaguccaacaacuuuu

SEQ ID NO: 976684 - RNA, 18 nt, Human
ucacagaugauuguuuuc

SEQ ID NO: 976685 - RNA, 19 nt, Human
ucacccaccuaccccauuu

SEQ ID NO: 976686 - RNA, 22 nt, Human
uccaccauccagacguucagcu

SEQ ID NO: 976687 - RNA, 24 nt, Human
uccaccauccagacguucagcuac

SEQ ID NO: 976688 - RNA, 21 nt, Human
uccccaauccuaccauacccu

SEQ ID NO: 976689 - RNA, 18 nt, Human
uccccagauacaccacca

SEQ ID NO: 976690 - RNA, 22 nt, Human
uccccagauacaccaccacccu

SEQ ID NO: 976691 - RNA, 31 nt, Human
uccccagauacaccaccacccuggguucacu

SEQ ID NO: 976692 - RNA, 24 nt, Human
ucccugguguuuggacaacccacu

SEQ ID NO: 976693 - RNA, 18 nt, Human
uccguggccgccagugug

SEQ ID NO: 976694 - RNA, 22 nt, Human
uccuagagaacuccuaucucag

SEQ ID NO: 976695 - RNA, 22 nt, Human
uccucaaugaucagaaguccac

SEQ ID NO: 976696 - RNA, 18 nt, Human
uccuguaaugcacaaaau

SEQ ID NO: 976697 - RNA, 18 nt, Human
ucggaacccugcucuucu

SEQ ID NO: 976698 - RNA, 27 nt, Human
ucuaggacuagggcacaaaaauagagc

SEQ ID NO: 976699 - RNA, 19 nt, Human
ucuccaggaggggcuaugg

SEQ ID NO: 976700 - RNA, 23 nt, Human
ucuccccagauacaccaccaccc

SEQ ID NO: 976701 - RNA, 20 nt, Human
ucucuaaccuuuccacccua

SEQ ID NO: 976702 - RNA, 21 nt, Human
ucuggguuucuuuccagaccc

SEQ ID NO: 976703 - RNA, 19 nt, Human
ugaaggucagugucucaga

SEQ ID NO: 976704 - RNA, 22 nt, Human
ugaauuaaagaauuguuuggag

SEQ ID NO: 976705 - RNA, 20 nt, Human
ugaucaguccugcugccuug

SEQ ID NO: 976706 - RNA, 22 nt, Human
ugcuccuacguuguuuucccau

SEQ ID NO: 976707 - RNA, 19 nt, Human
ugcugugaggaucuuaaga

SEQ ID NO: 976708 - RNA, 23 nt, Human
uggaaauuugaaaaaaaaaaaaa

SEQ ID NO: 976709 - RNA, 22 nt, Human
uggaaucccuggaaccuuuaac

SEQ ID NO: 976710 - RNA, 19 nt, Human
uggaaugucaucaggugaa

SEQ ID NO: 976711 - RNA, 23 nt, Human
uggcacccagaccaucauucagg

SEQ ID NO: 976712 - RNA, 21 nt, Human
uggcagagggcaggaaagaug

SEQ ID NO: 976713 - RNA, 23 nt, Human
ugggcuggaaacagaaugggggu

SEQ ID NO: 976714 - RNA, 20 nt, Human
uggguuucuuuccagacccc

SEQ ID NO: 976715 - RNA, 19 nt, Human
ugguguuagcagagagaua

SEQ ID NO: 976716 - RNA, 21 nt, Human
uguaaugcacaaaauaggaaa

SEQ ID NO: 976717 - RNA, 21 nt, Human
ugucaaaggcaucucgguugu

SEQ ID NO: 976718 - RNA, 18 nt, Human
ugucauaacuagaguggg

SEQ ID NO: 976719 - RNA, 21 nt, Human
ugugaaaccuuguucuagagc

SEQ ID NO: 976720 - RNA, 23 nt, Human
uguucuagagccucucccugcuc

SEQ ID NO: 976721 - RNA, 18 nt, Human
uuagacccugaaaaaugg

SEQ ID NO: 976722 - RNA, 21 nt, Human
uuaggcagauagggaaaagag

SEQ ID NO: 976723 - RNA, 19 nt, Human
uucaagauggcagaaccau

SEQ ID NO: 976724 - RNA, 21 nt, Human
uuccagguuccuagagaacuc

SEQ ID NO: 976725 - RNA, 23 nt, Human
uuccagguuccuagagaacuccu

SEQ ID NO: 976726 - RNA, 23 nt, Human
uuccuaggcuucagcgcucccuc

SEQ ID NO: 976727 - RNA, 25 nt, Human
uugcugggaagcugguaaacagaaa

SEQ ID NO: 976728 - RNA, 20 nt, Human
uuggacaacccacuccucac

SEQ ID NO: 976729 - RNA, 19 nt, Human
uuucagagcaaccagcuug

SEQ ID NO: 976730 - RNA, 23 nt, Human
uuuccacccuauccuguuaaccc

SEQ ID NO: 976731 - RNA, 19 nt, Human
uuuggacaacccacuccuc

SEQ ID NO: 976732 - RNA, 21 nt, Human
auacugcauuucaacuuuaaa

SEQ ID NO: 976733 - RNA, 21 nt, Human
ggccaaaggaugcagaaggau

SEQ ID NO: 976734 - RNA, 22 nt, Human
uaacaggaucguuuauaaaaca

SEQ ID NO: 976735 - RNA, 23 nt, Human
uauaaggugaagaaagcuuuuua

SEQ ID NO: 976736 - RNA, 18 nt, Human
ugaagaaagcuuuuuaac

SEQ ID NO: 976737 - RNA, 19 nt, Human
ugcagaaggauauauggug

SEQ ID NO: 976738 - RNA, 20 nt, Human
uuaaaauaaacaacaaaagc

SEQ ID NO: 976739 - RNA, 19 nt, Human
uucccagaguuuuuaugug

SEQ ID NO: 976740 - RNA, 18 nt, Human
aaaaaggucccaggccuc

SEQ ID NO: 976741 - RNA, 21 nt, Human
aaaaaugaggggacagaugug

SEQ ID NO: 976742 - RNA, 24 nt, Human
aaagaaaucccagagggaccccag

SEQ ID NO: 976743 - RNA, 25 nt, Human
aaggggcagcagaauaguuccagag

SEQ ID NO: 976744 - RNA, 22 nt, Human
acacgcacucacgcaugucccc

SEQ ID NO: 976745 - RNA, 22 nt, Human
acuccagacacauaaaaagggg

SEQ ID NO: 976746 - RNA, 21 nt, Human
agagaagcucuugggacucug

SEQ ID NO: 976747 - RNA, 18 nt, Human
agcacugcuacccugccu

SEQ ID NO: 976748 - RNA, 20 nt, Human
caacacagccauagaugggc

SEQ ID NO: 976749 - RNA, 28 nt, Human
cacacgcacucacgcauguccccgcgcg

SEQ ID NO: 976750 - RNA, 18 nt, Human
cacccaaaacaugaggau

SEQ ID NO: 976751 - RNA, 20 nt, Human
cacccaccacacgcacucag

SEQ ID NO: 976752 - RNA, 18 nt, Human
cagaauaguuccagagaa

SEQ ID NO: 976753 - RNA, 23 nt, Human
cagacaggcccgggcugggcuuc

SEQ ID NO: 976754 - RNA, 21 nt, Human
cagcagaauaguuccagagaa

SEQ ID NO: 976755 - RNA, 18 nt, Human
cagcagggcccccacccc

SEQ ID NO: 976756 - RNA, 21 nt, Human
cagcgaucuuaaaaagguccc

SEQ ID NO: 976757 - RNA, 23 nt, Human
ccccuuaccccaaaaggugggga

SEQ ID NO: 976758 - RNA, 24 nt, Human
ccccuuaccccaaaagguggggau

SEQ ID NO: 976759 - RNA, 18 nt, Human
ccggcggacugcaggcag

SEQ ID NO: 976760 - RNA, 18 nt, Human
ccuggcugggacgugagg

SEQ ID NO: 976761 - RNA, 22 nt, Human
cuccacccaccacacgcacuca

SEQ ID NO: 976762 - RNA, 21 nt, Human
cuggcuccacccaccacacgc

SEQ ID NO: 976763 - RNA, 23 nt, Human
cuggcuccacccaccacacgcac

SEQ ID NO: 976764 - RNA, 24 nt, Human
cuuaccccaaaagguggggaugcg

SEQ ID NO: 976765 - RNA, 19 nt, Human
gaacuggaagacgccggcg

SEQ ID NO: 976766 - RNA, 21 nt, Human
gacaaagaaaucccagaggga

SEQ ID NO: 976767 - RNA, 22 nt, Human
gaguauagugguccauaggucc

SEQ ID NO: 976768 - RNA, 18 nt, Human
gauaacagcucccagagg

SEQ ID NO: 976769 - RNA, 20 nt, Human
gcacuccccuuaccccaaaa

SEQ ID NO: 976770 - RNA, 23 nt, Human
gcagcacuccccuuaccccaaaa

SEQ ID NO: 976771 - RNA, 22 nt, Human
gcagggcccccaccccagauga

SEQ ID NO: 976772 - RNA, 19 nt, Human
gcccgggcugggcuugggg

SEQ ID NO: 976773 - RNA, 19 nt, Human
ggagccucgggugugcuca

SEQ ID NO: 976774 - RNA, 24 nt, Human
ggcgcgccaggaguuccuugugcu

SEQ ID NO: 976775 - RNA, 20 nt, Human
gggcucaggguugccagcag

SEQ ID NO: 976776 - RNA, 18 nt, Human
ggggacagaugugacaac

SEQ ID NO: 976777 - RNA, 18 nt, Human
uacccugccuccccgagu

SEQ ID NO: 976778 - RNA, 22 nt, Human
uaggucaugcgcuugcgguucc

SEQ ID NO: 976779 - RNA, 23 nt, Human
ucaggcccggcggacugcaggca

SEQ ID NO: 976780 - RNA, 23 nt, Human
ucccagacaggcccgggcugggc

SEQ ID NO: 976781 - RNA, 18 nt, Human
ucccccagcggcuccgca

SEQ ID NO: 976782 - RNA, 21 nt, Human
ucgggugugcucaggcccggc

SEQ ID NO: 976783 - RNA, 24 nt, Human
ucugacaagagggaaccuuggaca

SEQ ID NO: 976784 - RNA, 19 nt, Human
ugacaaagaaaucccagag

SEQ ID NO: 976785 - RNA, 22 nt, Human
ugacaaagaaaucccagaggga

SEQ ID NO: 976786 - RNA, 19 nt, Human
ugacaagagggaaccuugg

SEQ ID NO: 976787 - RNA, 21 nt, Human
ugaggaucccagggagucugu

SEQ ID NO: 976788 - RNA, 21 nt, Human
ugauuggggaacuccagacac

SEQ ID NO: 976789 - RNA, 21 nt, Human
ugcgcuugaccuugcggaucu

SEQ ID NO: 976790 - RNA, 20 nt, Human
uggcagggcagcacuccccu

SEQ ID NO: 976791 - RNA, 22 nt, Human
uggccccagcggcgcgccagga

SEQ ID NO: 976792 - RNA, 21 nt, Human
ugggagccucgggugugcuca

SEQ ID NO: 976793 - RNA, 20 nt, Human
ugggcuuggggauuauggca

SEQ ID NO: 976794 - RNA, 21 nt, Human
uuccagagaauugggggaucu

SEQ ID NO: 976795 - RNA, 22 nt, Human
uuccagggggauccuggcuggg

SEQ ID NO: 976796 - RNA, 21 nt, Human
aaccaguucugcuggcagaga

SEQ ID NO: 976797 - RNA, 19 nt, Human
agaguuagggugaggggga

SEQ ID NO: 976798 - RNA, 25 nt, Human
agauacauacaucucaaaaaaggca

SEQ ID NO: 976799 - RNA, 20 nt, Human
agcggagcugcuggacuagg

SEQ ID NO: 976800 - RNA, 22 nt, Human
agcugcuggacuagggugaaaa

SEQ ID NO: 976801 - RNA, 19 nt, Human
aggcaauaacgaaaacauc

SEQ ID NO: 976802 - RNA, 22 nt, Human
agggugagggggaaaaugguua

SEQ ID NO: 976803 - RNA, 18 nt, Human
aucacaagcacucucuga

SEQ ID NO: 976804 - RNA, 22 nt, Human
auucuccaauuugaaacuuuuc

SEQ ID NO: 976805 - RNA, 23 nt, Human
caaaaaaggcaauaacgaaaaca

SEQ ID NO: 976806 - RNA, 21 nt, Human
cagaacaaaaccaguucugcu

SEQ ID NO: 976807 - RNA, 23 nt, Human
cagaacaaaaccaguucugcugg

SEQ ID NO: 976808 - RNA, 25 nt, Human
cccauccuaauccacaaagacugcc

SEQ ID NO: 976809 - RNA, 18 nt, Human
cugaccgccgaggcugca

SEQ ID NO: 976810 - RNA, 22 nt, Human
cugcuggacuagggugaaaauu

SEQ ID NO: 976811 - RNA, 18 nt, Human
ggguguguguggugugug

SEQ ID NO: 976812 - RNA, 20 nt, Human
guguguggugugugugugua

SEQ ID NO: 976813 - RNA, 26 nt, Human
uaaacuggaaagcaaucaagucuuua

SEQ ID NO: 976814 - RNA, 18 nt, Human
uaaaugacuaugauacua

SEQ ID NO: 976815 - RNA, 22 nt, Human
uacgugaaaucacaagcacucu

SEQ ID NO: 976816 - RNA, 18 nt, Human
uagggugagggggaaaau

SEQ ID NO: 976817 - RNA, 31 nt, Human
uauauauguauacacacauauagauauaaca

SEQ ID NO: 976818 - RNA, 21 nt, Human
uauauguauacacacauauag

SEQ ID NO: 976819 - RNA, 24 nt, Human
uauauguauacacacauauagaua

SEQ ID NO: 976820 - RNA, 22 nt, Human
uauauguauacacacauauagg

SEQ ID NO: 976821 - RNA, 24 nt, Human
ucaaaaaaggcaauaacgaaaaca

SEQ ID NO: 976822 - RNA, 23 nt, Human
uccaccauccaagugucucuuuu

SEQ ID NO: 976823 - RNA, 20 nt, Human
ucucaaaaaaggcaauaacg

SEQ ID NO: 976824 - RNA, 23 nt, Human
ucuguacuauucagaacaaaacc

SEQ ID NO: 976825 - RNA, 25 nt, Human
ucuguguguauauauuauauaugua

SEQ ID NO: 976826 - RNA, 23 nt, Human
ugaaaucacaagcacucucugac

SEQ ID NO: 976827 - RNA, 25 nt, Human
ugaaaucacaagcacucucugaccg

SEQ ID NO: 976828 - RNA, 18 nt, Human
ugcauuguggcggcagaa

SEQ ID NO: 976829 - RNA, 24 nt, Human
uggcagagauuguggguucgcagg

SEQ ID NO: 976830 - RNA, 21 nt, Human
ugguguguggugugugugugu

SEQ ID NO: 976831 - RNA, 24 nt, Human
uguacacuuguaucuguguguaua

SEQ ID NO: 976832 - RNA, 22 nt, Human
ugugguguguggugugugugug

SEQ ID NO: 976833 - RNA, 20 nt, Human
ugugguguguguguguacac

SEQ ID NO: 976834 - RNA, 21 nt, Human
ugugguguguguguguacacu

SEQ ID NO: 976835 - RNA, 22 nt, Human
ugugguguguguguguacacuu

SEQ ID NO: 976836 - RNA, 22 nt, Human
ugugguguguguguguacacuu

SEQ ID NO: 976837 - RNA, 22 nt, Human
uguguacacuuguaucugugug

SEQ ID NO: 976838 - RNA, 25 nt, Human
uguguacacuuguaucuguguguau

SEQ ID NO: 976839 - RNA, 28 nt, Human
uguguacacuuguaucuguguguauaua

SEQ ID NO: 976840 - RNA, 18 nt, Human
uguguauauauuauauau

SEQ ID NO: 976841 - RNA, 18 nt, Human
uguguauauauuauauau

SEQ ID NO: 976842 - RNA, 19 nt, Human
uguguauauauuauauaug

SEQ ID NO: 976843 - RNA, 18 nt, Human
uguguggugugugugugu

SEQ ID NO: 976844 - RNA, 23 nt, Human
uguguguauauauuauauaugua

SEQ ID NO: 976845 - RNA, 21 nt, Human
uuagggugagggggaaaaugg

SEQ ID NO: 976846 - RNA, 22 nt, Human
auccucuccaugcccaccacug

SEQ ID NO: 976847 - RNA, 18 nt, Human
ccacuguucuccagcuga

SEQ ID NO: 976848 - RNA, 22 nt, Human
cccaccacuguucuccagcuga

SEQ ID NO: 976849 - RNA, 19 nt, Human
cuugaggugcuccuguggg

SEQ ID NO: 976850 - RNA, 20 nt, Human
ucauauccucuccaugccca

SEQ ID NO: 976851 - RNA, 18 nt, Human
ucaugucauauccucucc

SEQ ID NO: 976852 - RNA, 23 nt, Human
uccaugcccaccacuguucucca

SEQ ID NO: 976853 - RNA, 23 nt, Human
ucuccaugcccaccacuguucuc

SEQ ID NO: 976854 - RNA, 22 nt, Human
ugucauauccucuccaugccca

SEQ ID NO: 976855 - RNA, 23 nt, Human
uuuuuuuuucaguugggcuggaa

SEQ ID NO: 976856 - RNA, 20 nt, Human
uuuuuuuuuuuuucaguugg

SEQ ID NO: 976857 - RNA, 24 nt, Human
uuuuuuuuuuuuuuuucaguuggg

SEQ ID NO: 976858 - RNA, 22 nt, Human
uuuuuuuuuuuuuuuuuuucag

SEQ ID NO: 976859 - RNA, 20 nt, Human
aaaaccacaaugagauacca

SEQ ID NO: 976860 - RNA, 23 nt, Human
aaacaaacuaccugcacccaugc

SEQ ID NO: 976861 - RNA, 19 nt, Human
aaacauggaaucaaaccaa

SEQ ID NO: 976862 - RNA, 20 nt, Human
aaacuggaagccagucugga

SEQ ID NO: 976863 - RNA, 18 nt, Human
aaagauacaugcaugugu

SEQ ID NO: 976864 - RNA, 20 nt, Human
aaaugugguacauauaugcc

SEQ ID NO: 976865 - RNA, 19 nt, Human
aacaaugagaacacgugga

SEQ ID NO: 976866 - RNA, 25 nt, Human
aacagaggaagauaacaauaacaau

SEQ ID NO: 976867 - RNA, 19 nt, Human
aaccugcagguccugcaca

SEQ ID NO: 976868 - RNA, 20 nt, Human
acucaucucacuccccaucu

SEQ ID NO: 976869 - RNA, 27 nt, Human
acuuuacuggaaaaaauugagagugac

SEQ ID NO: 976870 - RNA, 18 nt, Human
agccacaguaguaaccag

SEQ ID NO: 976871 - RNA, 18 nt, Human
agggacauggaugaagcu

SEQ ID NO: 976872 - RNA, 20 nt, Human
auaccaucucaugccaguca

SEQ ID NO: 976873 - RNA, 22 nt, Human
augcagccauaaaaagaaauga

SEQ ID NO: 976874 - RNA, 24 nt, Human
augcagccauaaaaagaaaugaga

SEQ ID NO: 976875 - RNA, 25 nt, Human
caaaacggauggauauugugcauca

SEQ ID NO: 976876 - RNA, 22 nt, Human
caaacaaacuaccugcacccau

SEQ ID NO: 976877 - RNA, 18 nt, Human
cagaaacaacagaugcug

SEQ ID NO: 976878 - RNA, 24 nt, Human
cagcaaaguaacgcaggaacaaaa

SEQ ID NO: 976879 - RNA, 23 nt, Human
cauaugaaaaaaagcucaacacc

SEQ ID NO: 976880 - RNA, 22 nt, Human
ccuggaacucugaacucucaaa

SEQ ID NO: 976881 - RNA, 22 nt, Human
cgcaggaacaaaaguaaauacc

SEQ ID NO: 976882 - RNA, 21 nt, Human
cuaccugcacccaugcccuuu

SEQ ID NO: 976883 - RNA, 23 nt, Human
cucaaacaaacuaccugcaccca

SEQ ID NO: 976884 - RNA, 18 nt, Human
cuggaacucugaacucuc

SEQ ID NO: 976885 - RNA, 20 nt, Human
gaacaaaaguaaauaccaca

SEQ ID NO: 976886 - RNA, 22 nt, Human
gagaaaugcaaaucaaaaccac

SEQ ID NO: 976887 - RNA, 20 nt, Human
gagaugaacaaugagaacac

SEQ ID NO: 976888 - RNA, 23 nt, Human
gcaucaaaagagccaaagaugga

SEQ ID NO: 976889 - RNA, 24 nt, Human
gccaauuccugaaagaucuagaag

SEQ ID NO: 976890 - RNA, 21 nt, Human
gcguucuguucugggaagggc

SEQ ID NO: 976891 - RNA, 19 nt, Human
ggagaugaacaaugagaac

SEQ ID NO: 976892 - RNA, 21 nt, Human
gucagguacaggaacaguacu

SEQ ID NO: 976893 - RNA, 26 nt, Human
guggacuguugagggggcagggggag

SEQ ID NO: 976894 - RNA, 23 nt, Human
uaaaagguccccaauaggauuga

SEQ ID NO: 976895 - RNA, 22 nt, Human
uaaacugggaguucuagaaguu

SEQ ID NO: 976896 - RNA, 18 nt, Human
uaaagaaaaugugguaca

SEQ ID NO: 976897 - RNA, 25 nt, Human
uaaagaaaaugugguacauauaugc

SEQ ID NO: 976898 - RNA, 22 nt, Human
uaaauugguucaaccauugugg

SEQ ID NO: 976899 - RNA, 19 nt, Human
uaauggguugauaggugca

SEQ ID NO: 976900 - RNA, 20 nt, Human
uacaauagcaaaaacaugga

SEQ ID NO: 976901 - RNA, 23 nt, Human
uaccacauguucucacuugcaag

SEQ ID NO: 976902 - RNA, 26 nt, Human
uagcaaaaacauggaaucaaaccaaa

SEQ ID NO: 976903 - RNA, 24 nt, Human
uauaaagauacaugcauguguaug

SEQ ID NO: 976904 - RNA, 21 nt, Human
uauuaaaaaguccagaaacaa

SEQ ID NO: 976905 - RNA, 21 nt, Human
ucaaaguucugauugucuuca

SEQ ID NO: 976906 - RNA, 21 nt, Human
ucagagaaaugcaaaucaaaa

SEQ ID NO: 976907 - RNA, 23 nt, Human
ucagagaaaugcaaaucaaaacc

SEQ ID NO: 976908 - RNA, 22 nt, Human
ucagcaaaguaacgcaggaaca

SEQ ID NO: 976909 - RNA, 23 nt, Human
uccccaauaggauugagccacag

SEQ ID NO: 976910 - RNA, 24 nt, Human
uccugggaaaucucucaaacaaac

SEQ ID NO: 976911 - RNA, 21 nt, Human
ucuucucucuucccuucucuu

SEQ ID NO: 976912 - RNA, 20 nt, Human
ugaaaaaaagcucaacaccg

SEQ ID NO: 976913 - RNA, 24 nt, Human
ugaaagaucuagaaccagaaauac

SEQ ID NO: 976914 - RNA, 23 nt, Human
ugcacccaugcccuuuucccagg

SEQ ID NO: 976915 - RNA, 21 nt, Human
uggaaaaaauugagagugaca

SEQ ID NO: 976916 - RNA, 20 nt, Human
uggaauacuaugcagccaua

SEQ ID NO: 976917 - RNA, 21 nt, Human
uggaaucaaaccaaauaucca

SEQ ID NO: 976918 - RNA, 20 nt, Human
uggauaaagaaaauguggua

SEQ ID NO: 976919 - RNA, 19 nt, Human
ugggaagggcuaagaucuu

SEQ ID NO: 976920 - RNA, 25 nt, Human
ugggaagggcuaagaucuuggaaug

SEQ ID NO: 976921 - RNA, 18 nt, Human
uuaugcggccaacaaaca

SEQ ID NO: 976922 - RNA, 22 nt, Human
uucacugcagcacuauuuacaa

SEQ ID NO: 976923 - RNA, 24 nt, Human
uuuaaaaagaaaauuuguaagccu

SEQ ID NO: 976924 - RNA, 18 nt, Human
uuucccaggguuaguuuc

SEQ ID NO: 976925 - RNA, 21 nt, Human
aaaguuuuucccagcccaggc

SEQ ID NO: 976926 - RNA, 26 nt, Human
aacaaaaagcaacucuuuacagcacu

SEQ ID NO: 976927 - RNA, 25 nt, Human
aagcaacucuuuacagcacaaacua

SEQ ID NO: 976928 - RNA, 20 nt, Human
acaaaaagcaacucuuuaca

SEQ ID NO: 976929 - RNA, 21 nt, Human
acagggaaguccuuccuccca

SEQ ID NO: 976930 - RNA, 24 nt, Human
agagaggauagagaggccaaacag

SEQ ID NO: 976931 - RNA, 24 nt, Human
agaggaagagaggauagagaggcc

SEQ ID NO: 976932 - RNA, 24 nt, Human
aggaagcagggccaggugagagcc

SEQ ID NO: 976933 - RNA, 21 nt, Human
aggcaagagucugguuccaaa

SEQ ID NO: 976934 - RNA, 21 nt, Human
aggguggggcugaucaagggc

SEQ ID NO: 976935 - RNA, 22 nt, Human
caaaaagcaacucuuuacagca

SEQ ID NO: 976936 - RNA, 22 nt, Human
caagagucugguuccaaaguuu

SEQ ID NO: 976937 - RNA, 23 nt, Human
caagagucugguuccaaaguuuu

SEQ ID NO: 976938 - RNA, 21 nt, Human
caccaugggguagggacaggc

SEQ ID NO: 976939 - RNA, 19 nt, Human
cagagcgcgggccucuggg

SEQ ID NO: 976940 - RNA, 20 nt, Human
cagaggaaacaaaacuccaa

SEQ ID NO: 976941 - RNA, 26 nt, Human
cagcugagcuucuccuggcucugucu

SEQ ID NO: 976942 - RNA, 18 nt, Human
ccagcccaggccucugcc

SEQ ID NO: 976943 - RNA, 23 nt, Human
cccaaggguuuucugcuccuucc

SEQ ID NO: 976944 - RNA, 24 nt, Human
cccagcccaggccucugccuuggc

SEQ ID NO: 976945 - RNA, 25 nt, Human
ccccacuccucuuccuagcaccaug

SEQ ID NO: 976946 - RNA, 19 nt, Human
ccccaggggggucaccuuc

SEQ ID NO: 976947 - RNA, 24 nt, Human
ccuccaaacuccuaugcaggcagg

SEQ ID NO: 976948 - RNA, 18 nt, Human
ccuugggggugggggcug

SEQ ID NO: 976949 - RNA, 23 nt, Human
cgacccggugcucggagagcugg

SEQ ID NO: 976950 - RNA, 18 nt, Human
cugaggcacagugggccu

SEQ ID NO: 976951 - RNA, 21 nt, Human
cugguuccaaaguuuuuccca

SEQ ID NO: 976952 - RNA, 22 nt, Human
cuugggggugggggcugcggaa

SEQ ID NO: 976953 - RNA, 19 nt, Human
gaagcagggccaggugaga

SEQ ID NO: 976954 - RNA, 20 nt, Human
gacaggguuggggccuccag

SEQ ID NO: 976955 - RNA, 24 nt, Human
gccaggguggggcugaucaagggc

SEQ ID NO: 976956 - RNA, 18 nt, Human
gcuggugaccugcgcagg

SEQ ID NO: 976957 - RNA, 19 nt, Human
ggaagaggagcucgggagg

SEQ ID NO: 976958 - RNA, 18 nt, Human
ggugcucggagagcuggg

SEQ ID NO: 976959 - RNA, 18 nt, Human
gucucugaggcacagugg

SEQ ID NO: 976960 - RNA, 24 nt, Human
gucugcuggucuaggccagggugg

SEQ ID NO: 976961 - RNA, 27 nt, Human
uaaacaaaaagcaacucuuuacagcac

SEQ ID NO: 976962 - RNA, 19 nt, Human
uaaauaaacaaaaagcaac

SEQ ID NO: 976963 - RNA, 23 nt, Human
uaggccaggguggggcugaucaa

SEQ ID NO: 976964 - RNA, 23 nt, Human
uccccuccucuucacccaugcca

SEQ ID NO: 976965 - RNA, 22 nt, Human
ucggagagcuggggcucggccg

SEQ ID NO: 976966 - RNA, 21 nt, Human
ucuccuggcucugucugcugg

SEQ ID NO: 976967 - RNA, 24 nt, Human
ucuccuggcucugucugcuggucu

SEQ ID NO: 976968 - RNA, 24 nt, Human
ucucugaggcacagugggccuggg

SEQ ID NO: 976969 - RNA, 19 nt, Human
ugaacagaggaaacaaaac

SEQ ID NO: 976970 - RNA, 18 nt, Human
ugacaccaccccacuccu

SEQ ID NO: 976971 - RNA, 24 nt, Human
ugacaccaccccacuccucuuccu

SEQ ID NO: 976972 - RNA, 22 nt, Human
ugagcuucuccuggcucugucu

SEQ ID NO: 976973 - RNA, 23 nt, Human
ugccacagcauuaaauaaacaaa

SEQ ID NO: 976974 - RNA, 19 nt, Human
uggagcccuggucucugag

SEQ ID NO: 976975 - RNA, 18 nt, Human
uggcaagcaggaagcagg

SEQ ID NO: 976976 - RNA, 20 nt, Human
uggcaagcaggaagcagggc

SEQ ID NO: 976977 - RNA, 24 nt, Human
uggggcugaucaagggcagagagc

SEQ ID NO: 976978 - RNA, 21 nt, Human
uggucuaggccaggguggggc

SEQ ID NO: 976979 - RNA, 18 nt, Human
uucccagcccaggccucu

SEQ ID NO: 976980 - RNA, 24 nt, Human
uuccuccaaacuccuaugcaggca

SEQ ID NO: 976981 - RNA, 24 nt, Human
uuggagaaccuugggggugggggc

SEQ ID NO: 976982 - RNA, 23 nt, Human
uugggggugggggcugcggaaug

SEQ ID NO: 976983 - RNA, 21 nt, Human
uuggguggggccggguccgcc

SEQ ID NO: 976984 - RNA, 18 nt, Human
aaaacuauuaguaaccau

SEQ ID NO: 976985 - RNA, 22 nt, Human
aaacacagucacguggaaaugc

SEQ ID NO: 976986 - RNA, 22 nt, Human
aaaccaggacacggaaggaaga

SEQ ID NO: 976987 - RNA, 22 nt, Human
aagcuccacaagcucuuaguga

SEQ ID NO: 976988 - RNA, 21 nt, Human
aauauccaguccuacaguaau

SEQ ID NO: 976989 - RNA, 19 nt, Human
acaacuucaugacaucucu

SEQ ID NO: 976990 - RNA, 20 nt, Human
acacggaaggaagaacugga

SEQ ID NO: 976991 - RNA, 26 nt, Human
acaguaaagaacugaaaggucuacac

SEQ ID NO: 976992 - RNA, 18 nt, Human
acauuucuuuuguuguug

SEQ ID NO: 976993 - RNA, 21 nt, Human
accaccuucugguuucauuug

SEQ ID NO: 976994 - RNA, 24 nt, Human
accaccuucugguuucauuugacc

SEQ ID NO: 976995 - RNA, 24 nt, Human
accccaaaaauguugccugucagc

SEQ ID NO: 976996 - RNA, 20 nt, Human
acuagaaugcaggcaaaaag

SEQ ID NO: 976997 - RNA, 19 nt, Human
agaaaggagagccagcccg

SEQ ID NO: 976998 - RNA, 23 nt, Human
auaaaaccacagaaaggagagcc

SEQ ID NO: 976999 - RNA, 18 nt, Human
augggacaaaaggaaccg

SEQ ID NO: 977000 - RNA, 22 nt, Human
caaaauaauacaguauagcccc

SEQ ID NO: 977001 - RNA, 24 nt, Human
caaacuccguuaaugcuguugaag

SEQ ID NO: 977002 - RNA, 22 nt, Human
caagauagagaaugaagaccug

SEQ ID NO: 977003 - RNA, 23 nt, Human
cacacacaaaaguaaguuucaaa

SEQ ID NO: 977004 - RNA, 24 nt, Human
cacacacaaaaguaaguuucaaac

SEQ ID NO: 977005 - RNA, 27 nt, Human
cacacacacacaaaaguaaguuucaaa

SEQ ID NO: 977006 - RNA, 20 nt, Human
caccguguuggccaugugau

SEQ ID NO: 977007 - RNA, 21 nt, Human
caccguguuggccaugugauc

SEQ ID NO: 977008 - RNA, 25 nt, Human
cacugaaccagggcacugggacaac

SEQ ID NO: 977009 - RNA, 19 nt, Human
cagcaauaccucgacuuuu

SEQ ID NO: 977010 - RNA, 19 nt, Human
cagcagguuaauuuucuuc

SEQ ID NO: 977011 - RNA, 24 nt, Human
cagcucauuucugcagcguggcca

SEQ ID NO: 977012 - RNA, 22 nt, Human
caggaaauuauugugcaugugc

SEQ ID NO: 977013 - RNA, 18 nt, Human
caggagacacugaaccag

SEQ ID NO: 977014 - RNA, 22 nt, Human
caguaguacacauuucucuaug

SEQ ID NO: 977015 - RNA, 24 nt, Human
caguauuuacaagcauucuuauac

SEQ ID NO: 977016 - RNA, 18 nt, Human
cauaaagugaagugaaag

SEQ ID NO: 977017 - RNA, 21 nt, Human
caucgcucuuuucccauuucu

SEQ ID NO: 977018 - RNA, 20 nt, Human
caucuucaucucccaggccu

SEQ ID NO: 977019 - RNA, 25 nt, Human
caugucacccugaaugccagcaaua

SEQ ID NO: 977020 - RNA, 22 nt, Human
cauuuccuucccccuugugccc

SEQ ID NO: 977021 - RNA, 23 nt, Human
cauuuuaaaaacucaagccuggg

SEQ ID NO: 977022 - RNA, 25 nt, Human
ccaaagccacacacacacaaaagua

SEQ ID NO: 977023 - RNA, 19 nt, Human
cccaaaucauccaauacac

SEQ ID NO: 977024 - RNA, 18 nt, Human
cccacguaugagccaaac

SEQ ID NO: 977025 - RNA, 21 nt, Human
cccaggccuucuucugcagcc

SEQ ID NO: 977026 - RNA, 19 nt, Human
cccauuaaauaaaaccaca

SEQ ID NO: 977027 - RNA, 19 nt, Human
cccauuucuggaaucuucu

SEQ ID NO: 977028 - RNA, 22 nt, Human
ccucgcgcacggacgcugacuc

SEQ ID NO: 977029 - RNA, 26 nt, Human
cgccaugccuuucaugaaacggugcu

SEQ ID NO: 977030 - RNA, 21 nt, Human
cgggauagaaacacagucacg

SEQ ID NO: 977031 - RNA, 20 nt, Human
cuagguaccaaauuguggcu

SEQ ID NO: 977032 - RNA, 21 nt, Human
cucauagcccucaucauugcu

SEQ ID NO: 977033 - RNA, 19 nt, Human
cucuauaugaccgaauagc

SEQ ID NO: 977034 - RNA, 22 nt, Human
cucucagugcaaacgagcaauu

SEQ ID NO: 977035 - RNA, 19 nt, Human
cucuuuaaugcacuuggca

SEQ ID NO: 977036 - RNA, 22 nt, Human
cuggaagcuaugccuaaaguca

SEQ ID NO: 977037 - RNA, 22 nt, Human
cuguacacugucacaacccuuc

SEQ ID NO: 977038 - RNA, 19 nt, Human
cugugcugugagcccccag

SEQ ID NO: 977039 - RNA, 24 nt, Human
cuuccaaagccacacacacacaaa

SEQ ID NO: 977040 - RNA, 22 nt, Human
cuuuucaucuucaucucccagg

SEQ ID NO: 977041 - RNA, 20 nt, Human
gaaaccaaaccuacucacuc

SEQ ID NO: 977042 - RNA, 20 nt, Human
gaacacagcauucagucugu

SEQ ID NO: 977043 - RNA, 19 nt, Human
gaaguguggaggggggugg

SEQ ID NO: 977044 - RNA, 21 nt, Human
gacacugacagggaguuaagc

SEQ ID NO: 977045 - RNA, 23 nt, Human
gaccagccagacauuucuuuugu

SEQ ID NO: 977046 - RNA, 24 nt, Human
gaccugucauccacucaggagaca

SEQ ID NO: 977047 - RNA, 20 nt, Human
gaggggggugguagaaaggg

SEQ ID NO: 977048 - RNA, 22 nt, Human
gcuuccaaagccacacacacac

SEQ ID NO: 977049 - RNA, 20 nt, Human
ggagagccagcccggcucag

SEQ ID NO: 977050 - RNA, 21 nt, Human
ggaggggggugguagaaaggg

SEQ ID NO: 977051 - RNA, 24 nt, Human
ggaguuaagccauggagagggaag

SEQ ID NO: 977052 - RNA, 22 nt, Human
ggcaaaaaucugaucuaaugca

SEQ ID NO: 977053 - RNA, 18 nt, Human
gugcccuucuggguaguc

SEQ ID NO: 977054 - RNA, 20 nt, Human
guuugagacccuagguacca

SEQ ID NO: 977055 - RNA, 21 nt, Human
uaaaacugaacaagaaaccag

SEQ ID NO: 977056 - RNA, 21 nt, Human
uaagccauggagagggaagca

SEQ ID NO: 977057 - RNA, 21 nt, Human
uaagcugcucuaggggagggc

SEQ ID NO: 977058 - RNA, 24 nt, Human
uacaaaauuuucugcuauuuugcu

SEQ ID NO: 977059 - RNA, 24 nt, Human
uacacuaucauaaagugaagugaa

SEQ ID NO: 977060 - RNA, 19 nt, Human
uacacugucacaacccuuc

SEQ ID NO: 977061 - RNA, 27 nt, Human
uacaguaauauaguuagaaaaauaaaa

SEQ ID NO: 977062 - RNA, 21 nt, Human
uagaaaaauaaaaggcuuaaa

SEQ ID NO: 977063 - RNA, 19 nt, Human
uagaaacacagucacgugg

SEQ ID NO: 977064 - RNA, 25 nt, Human
uagaaugcaggcaaaaagucccuua

SEQ ID NO: 977065 - RNA, 19 nt, Human
uagcugagaccagccagac

SEQ ID NO: 977066 - RNA, 21 nt, Human
uagcugagaccagccagacau

SEQ ID NO: 977067 - RNA, 18 nt, Human
uagguucugugcugugag

SEQ ID NO: 977068 - RNA, 23 nt, Human
uaguaccaucaugucacccugaa

SEQ ID NO: 977069 - RNA, 24 nt, Human
uauauuacaguauuuacaagcauu

SEQ ID NO: 977070 - RNA, 21 nt, Human
uaugaacguacccuccacgug

SEQ ID NO: 977071 - RNA, 20 nt, Human
uauuucauaaguauaaguaa

SEQ ID NO: 977072 - RNA, 18 nt, Human
ucagacucuagcugagac

SEQ ID NO: 977073 - RNA, 19 nt, Human
ucagauacgcacacaugcu

SEQ ID NO: 977074 - RNA, 21 nt, Human
ucagcucuuccaagucugugc

SEQ ID NO: 977075 - RNA, 24 nt, Human
ucaguugaagagugucagcaggug

SEQ ID NO: 977076 - RNA, 23 nt, Human
ucaucgcucuuuucccauuucug

SEQ ID NO: 977077 - RNA, 21 nt, Human
uccaagcaacaacauuuaaaa

SEQ ID NO: 977078 - RNA, 19 nt, Human
uccaagucugugcuagauu

SEQ ID NO: 977079 - RNA, 23 nt, Human
uccacaagcucuuagugaauuac

SEQ ID NO: 977080 - RNA, 19 nt, Human
uccuuuguccugaaacucc

SEQ ID NO: 977081 - RNA, 23 nt, Human
ucgauacgaacacagcauucagu

SEQ ID NO: 977082 - RNA, 22 nt, Human
ucguggugcugacuacagacau

SEQ ID NO: 977083 - RNA, 21 nt, Human
ucuacaacuuuaacugugcca

SEQ ID NO: 977084 - RNA, 22 nt, Human
ucugcagauuguuucauaugaa

SEQ ID NO: 977085 - RNA, 22 nt, Human
ucugguuucauuugaaauccuu

SEQ ID NO: 977086 - RNA, 24 nt, Human
ugaacaagaaaccaggacacggaa

SEQ ID NO: 977087 - RNA, 21 nt, Human
ugaaccagggcacugggacaa

SEQ ID NO: 977088 - RNA, 18 nt, Human
ugacuacagacauguccu

SEQ ID NO: 977089 - RNA, 22 nt, Human
ugacuacagacauguccuaugg

SEQ ID NO: 977090 - RNA, 24 nt, Human
ugacuacagacauguccuauggcc

SEQ ID NO: 977091 - RNA, 21 nt, Human
ugagacauuugaggcauacaa

SEQ ID NO: 977092 - RNA, 19 nt, Human
ugagcagcacacaacuuca

SEQ ID NO: 977093 - RNA, 23 nt, Human
ugccaugugcccuuucuuacccc

SEQ ID NO: 977094 - RNA, 23 nt, Human
ugcccaaaucauccaauacacug

SEQ ID NO: 977095 - RNA, 20 nt, Human
ugccuugggagaguuaauuc

SEQ ID NO: 977096 - RNA, 18 nt, Human
ugcucaggccuggaggga

SEQ ID NO: 977097 - RNA, 19 nt, Human
ugcuuagggcugugcugac

SEQ ID NO: 977098 - RNA, 27 nt, Human
uggaaagccauuuuauuuuucucuaaa

SEQ ID NO: 977099 - RNA, 18 nt, Human
uggaaaugccaauaugac

SEQ ID NO: 977100 - RNA, 23 nt, Human
uggaacaaugugaugcggcaaaa

SEQ ID NO: 977101 - RNA, 21 nt, Human
uggagagggaagcacagguuu

SEQ ID NO: 977102 - RNA, 24 nt, Human
uggccaacagcugccacuguacac

SEQ ID NO: 977103 - RNA, 20 nt, Human
ugucagcaggugcuucuagg

SEQ ID NO: 977104 - RNA, 18 nt, Human
uguccugaaacucccaca

SEQ ID NO: 977105 - RNA, 19 nt, Human
uguucugugcugugguaag

SEQ ID NO: 977106 - RNA, 20 nt, Human
uuaagccauggagagggaag

SEQ ID NO: 977107 - RNA, 22 nt, Human
uucaaaccauaguccagugcuu

SEQ ID NO: 977108 - RNA, 19 nt, Human
uucaucuucaucucccagg

SEQ ID NO: 977109 - RNA, 23 nt, Human
uuccaaagccacacacacacaaa

SEQ ID NO: 977110 - RNA, 19 nt, Human
uugcuuuagcaaacagcaa

SEQ ID NO: 977111 - RNA, 31 nt, Human
uugcuuugugaaugugaaugaaagucuuauu

SEQ ID NO: 977112 - RNA, 18 nt, Human
uuuagcaaacagcaauaa

SEQ ID NO: 977113 - RNA, 23 nt, Human
uuucauaugaacguacccuccac

SEQ ID NO: 977114 - RNA, 23 nt, Human
uuucaucuucaucucccaggccu

SEQ ID NO: 977115 - RNA, 19 nt, Human
uuucugcuauuuugcuuua

SEQ ID NO: 977116 - RNA, 22 nt, Human
uuugagacccuagguaccaaag

SEQ ID NO: 977117 - RNA, 20 nt, Human
uuuucccauuucuggaaucu

SEQ ID NO: 977118 - RNA, 23 nt, Human
aaacagccucccccagggagggu

SEQ ID NO: 977119 - RNA, 19 nt, Human
aaagugcuggaauuacagg

SEQ ID NO: 977120 - RNA, 23 nt, Human
aacauuucaucauguuggccagg

SEQ ID NO: 977121 - RNA, 19 nt, Human
aagauacccuguccccacc

SEQ ID NO: 977122 - RNA, 21 nt, Human
aagauacccuguccccaccua

SEQ ID NO: 977123 - RNA, 26 nt, Human
aagcagggcacucugguccagcuggg

SEQ ID NO: 977124 - RNA, 26 nt, Human
aagugcuggaauuacaggccugaacc

SEQ ID NO: 977125 - RNA, 24 nt, Human
acaacauuucaucauguuggccag

SEQ ID NO: 977126 - RNA, 18 nt, Human
accacgccuggccagacc

SEQ ID NO: 977127 - RNA, 29 nt, Human
acccacccuguucccuccccuuccucccu

SEQ ID NO: 977128 - RNA, 19 nt, Human
agaagaaacagccuccccc

SEQ ID NO: 977129 - RNA, 18 nt, Human
agagcguccuagccugau

SEQ ID NO: 977130 - RNA, 22 nt, Human
agcucuggggccaggaaacagu

SEQ ID NO: 977131 - RNA, 25 nt, Human
aggugauccucccuccucggccucc

SEQ ID NO: 977132 - RNA, 19 nt, Human
auauauguauauauguaca

SEQ ID NO: 977133 - RNA, 18 nt, Human
aucauguuggccaggcug

SEQ ID NO: 977134 - RNA, 25 nt, Human
aucauguuggccaggcuggucucaa

SEQ ID NO: 977135 - RNA, 25 nt, Human
auguaucuauauauguauauaugua

SEQ ID NO: 977136 - RNA, 22 nt, Human
caaacaggugggggugccuccc

SEQ ID NO: 977137 - RNA, 24 nt, Human
caaagugcuggaauuacaggccug

SEQ ID NO: 977138 - RNA, 24 nt, Human
caacauuucaucauguuggccagg

SEQ ID NO: 977139 - RNA, 19 nt, Human
caaggaauccugagaagaa

SEQ ID NO: 977140 - RNA, 20 nt, Human
caccuagacguccacugggg

SEQ ID NO: 977141 - RNA, 19 nt, Human
cacucugguccagcuggga

SEQ ID NO: 977142 - RNA, 19 nt, Human
cacuggggaagggaaacug

SEQ ID NO: 977143 - RNA, 20 nt, Human
cagaggcaagcagggcacuc

SEQ ID NO: 977144 - RNA, 18 nt, Human
cagaugccucugcugccu

SEQ ID NO: 977145 - RNA, 24 nt, Human
caguagagacaacauuucaucaug

SEQ ID NO: 977146 - RNA, 24 nt, Human
caucauguuggccaggcuggucuc

SEQ ID NO: 977147 - RNA, 22 nt, Human
caucgccucccgcgcgccggac

SEQ ID NO: 977148 - RNA, 18 nt, Human
cauguuggccaggcuggu

SEQ ID NO: 977149 - RNA, 21 nt, Human
cauguuggccaggcuggucuc

SEQ ID NO: 977150 - RNA, 24 nt, Human
cauguuggccaggcuggucucaaa

SEQ ID NO: 977151 - RNA, 19 nt, Human
ccaaagugcuggaauuaca

SEQ ID NO: 977152 - RNA, 24 nt, Human
ccaaagugcuggaauuacaggccu

SEQ ID NO: 977153 - RNA, 22 nt, Human
ccacaaagggagagcagaggca

SEQ ID NO: 977154 - RNA, 19 nt, Human
ccccuuccucccuggcaag

SEQ ID NO: 977155 - RNA, 21 nt, Human
ccgcgcgccggacccgcgucc

SEQ ID NO: 977156 - RNA, 21 nt, Human
ccucccaggaggacccugccu

SEQ ID NO: 977157 - RNA, 20 nt, Human
ccucccuccucggccuccca

SEQ ID NO: 977158 - RNA, 18 nt, Human
ccugaccucaggugaucc

SEQ ID NO: 977159 - RNA, 18 nt, Human
ccugaccucaggugaucc

SEQ ID NO: 977160 - RNA, 21 nt, Human
ccuguucccuccccuuccucc

SEQ ID NO: 977161 - RNA, 21 nt, Human
cguccuagccugauacagggc

SEQ ID NO: 977162 - RNA, 18 nt, Human
cucagagcguccuagccu

SEQ ID NO: 977163 - RNA, 20 nt, Human
cucccgcgcgccggacccgc

SEQ ID NO: 977164 - RNA, 21 nt, Human
cucccuggcaaggaauccuga

SEQ ID NO: 977165 - RNA, 19 nt, Human
cugugccaggaucuagaac

SEQ ID NO: 977166 - RNA, 21 nt, Human
gaagaaacagccucccccagg

SEQ ID NO: 977167 - RNA, 19 nt, Human
gaccucaggugauccuccc

SEQ ID NO: 977168 - RNA, 24 nt, Human
gauuacagguuccugccacuauac

SEQ ID NO: 977169 - RNA, 20 nt, Human
gccuacucagagacuuccca

SEQ ID NO: 977170 - RNA, 20 nt, Human
gcggggccgucaucgccucc

SEQ ID NO: 977171 - RNA, 20 nt, Human
gcugccugaguccccacaaa

SEQ ID NO: 977172 - RNA, 23 nt, Human
gcuggucucaaacuccugaccuc

SEQ ID NO: 977173 - RNA, 22 nt, Human
ggaauccugagaagaaacagcc

SEQ ID NO: 977174 - RNA, 21 nt, Human
ggcaaggaauccugagaagaa

SEQ ID NO: 977175 - RNA, 24 nt, Human
ggcuggucucaaacuccugaccuc

SEQ ID NO: 977176 - RNA, 18 nt, Human
guagcugggauuacaggu

SEQ ID NO: 977177 - RNA, 19 nt, Human
gugccucccaggaggaccc

SEQ ID NO: 977178 - RNA, 24 nt, Human
uaauuuuugcauuuucaguagaga

SEQ ID NO: 977179 - RNA, 18 nt, Human
uauaaauguaucuauaua

SEQ ID NO: 977180 - RNA, 21 nt, Human
uauauagacuguguguauaua

SEQ ID NO: 977181 - RNA, 20 nt, Human
uauauauguauauauguaca

SEQ ID NO: 977182 - RNA, 24 nt, Human
uauguacaugcacagcucagagcg

SEQ ID NO: 977183 - RNA, 24 nt, Human
ucaguagagacaacauuucaucau

SEQ ID NO: 977184 - RNA, 24 nt, Human
ucccaaagugcuggaauuacaggc

SEQ ID NO: 977185 - RNA, 19 nt, Human
ucccagaugccucugcugc

SEQ ID NO: 977186 - RNA, 21 nt, Human
ucccgcgcgccggacccgcgg

SEQ ID NO: 977187 - RNA, 21 nt, Human
uccucggccucccaaagugcu

SEQ ID NO: 977188 - RNA, 22 nt, Human
uccuggaggccuggccaccugg

SEQ ID NO: 977189 - RNA, 23 nt, Human
ucuauauauguauauauguacau

SEQ ID NO: 977190 - RNA, 26 nt, Human
ugaacccaaaugagcucuggggccag

SEQ ID NO: 977191 - RNA, 18 nt, Human
ugaccucaggugauccuc

SEQ ID NO: 977192 - RNA, 20 nt, Human
ugaccucaggugauccuccc

SEQ ID NO: 977193 - RNA, 21 nt, Human
ugaccucaggugauccucccu

SEQ ID NO: 977194 - RNA, 24 nt, Human
ugaccucaggugauccucccuccu

SEQ ID NO: 977195 - RNA, 22 nt, Human
ugagaagaaacagccuccccca

SEQ ID NO: 977196 - RNA, 22 nt, Human
ugauccucccuccucggccucc

SEQ ID NO: 977197 - RNA, 18 nt, Human
ugccaggaucuagaaccu

SEQ ID NO: 977198 - RNA, 21 nt, Human
ugccuggugccuccuggaggc

SEQ ID NO: 977199 - RNA, 21 nt, Human
uggaauuacaggccugaacca

SEQ ID NO: 977200 - RNA, 24 nt, Human
uggaauuacaggccugaaccacca

SEQ ID NO: 977201 - RNA, 21 nt, Human
uggcaaggaauccugagaaga

SEQ ID NO: 977202 - RNA, 24 nt, Human
uggccaggcuggucucaaacuccu

SEQ ID NO: 977203 - RNA, 19 nt, Human
ugggauuacagguuccugc

SEQ ID NO: 977204 - RNA, 21 nt, Human
ugggauuacagguuccugcca

SEQ ID NO: 977205 - RNA, 22 nt, Human
ugggauuacagguuccugccac

SEQ ID NO: 977206 - RNA, 24 nt, Human
ugggauuacagguuccugccacua

SEQ ID NO: 977207 - RNA, 18 nt, Human
uguagcugggauuacagg

SEQ ID NO: 977208 - RNA, 18 nt, Human
uguagcugggauuacagg

SEQ ID NO: 977209 - RNA, 25 nt, Human
uguagcugggauuacagguuccugc

SEQ ID NO: 977210 - RNA, 23 nt, Human
uguauauauguacaugcacagcu

SEQ ID NO: 977211 - RNA, 19 nt, Human
uguguauauauuauaaaug

SEQ ID NO: 977212 - RNA, 21 nt, Human
uguguauauauuauaaaugua

SEQ ID NO: 977213 - RNA, 20 nt, Human
uguguguauauauuauaaau

SEQ ID NO: 977214 - RNA, 19 nt, Human
uugaagugcgccugaaccc

SEQ ID NO: 977215 - RNA, 23 nt, Human
uuucaucauguuggccaggcugu

SEQ ID NO: 977216 - RNA, 23 nt, Human
uuuucaguagagacaacauuuca

SEQ ID NO: 977217 - RNA, 22 nt, Human
aaacgagauuuccaaagucagg

SEQ ID NO: 977218 - RNA, 24 nt, Human
aauccccacaguaucaaacucaga

SEQ ID NO: 977219 - RNA, 23 nt, Human
acccugagagcggcggcgacagc

SEQ ID NO: 977220 - RNA, 21 nt, Human
auuucauuuucccuccccccg

SEQ ID NO: 977221 - RNA, 24 nt, Human
caaagggaacacagugacgcagca

SEQ ID NO: 977222 - RNA, 21 nt, Human
caacagaguaaaagcuccaca

SEQ ID NO: 977223 - RNA, 20 nt, Human
caaugcagucucuuccccuc

SEQ ID NO: 977224 - RNA, 22 nt, Human
cacaguaucaaacucagacagg

SEQ ID NO: 977225 - RNA, 19 nt, Human
caguaucaaacucagacag

SEQ ID NO: 977226 - RNA, 24 nt, Human
caguaucaaacucagacaggccaa

SEQ ID NO: 977227 - RNA, 19 nt, Human
cauacuguccgcaacaucc

SEQ ID NO: 977228 - RNA, 23 nt, Human
cauccgggaccugcgggaccgcc

SEQ ID NO: 977229 - RNA, 25 nt, Human
ccucacaacagaguaaaagcuccac

SEQ ID NO: 977230 - RNA, 21 nt, Human
ccugguggucaguggcagcaa

SEQ ID NO: 977231 - RNA, 20 nt, Human
cgccuaaacugaauccccac

SEQ ID NO: 977232 - RNA, 18 nt, Human
cugaauccccacaguauc

SEQ ID NO: 977233 - RNA, 21 nt, Human
cugguggucaguggcagcaac

SEQ ID NO: 977234 - RNA, 22 nt, Human
gucaguggcagcaacaguggcu

SEQ ID NO: 977235 - RNA, 18 nt, Human
ucacccugagagcggcgg

SEQ ID NO: 977236 - RNA, 20 nt, Human
ucagggggcaaagauuucug

SEQ ID NO: 977237 - RNA, 25 nt, Human
uccccgucccccugcgcuugccuca

SEQ ID NO: 977238 - RNA, 18 nt, Human
uccgaaguaccaccgcug

SEQ ID NO: 977239 - RNA, 21 nt, Human
uccgcaacauccgggaccugc

SEQ ID NO: 977240 - RNA, 18 nt, Human
ucuguucccucuucaccc

SEQ ID NO: 977241 - RNA, 25 nt, Human
ugcagacaggugucuccgaaguacc

SEQ ID NO: 977242 - RNA, 23 nt, Human
ugcugguccccgucccccugcgc

SEQ ID NO: 977243 - RNA, 23 nt, Human
uggucaguggcagcaacaguggc

SEQ ID NO: 977244 - RNA, 22 nt, Human
uuaaaagucuggggccacaaug

SEQ ID NO: 977245 - RNA, 18 nt, Human
uuaaacggagucuuacaa

SEQ ID NO: 977246 - RNA, 20 nt, Human
uuuucccuccccccguuucc

SEQ ID NO: 977247 - RNA, 23 nt, Human
agucccgccgcugcgcugccucc

SEQ ID NO: 977248 - RNA, 19 nt, Human
caaaagucaauuuaaaaag

SEQ ID NO: 977249 - RNA, 24 nt, Human
caaaagucaauuuaaaaagucgaa

SEQ ID NO: 977250 - RNA, 20 nt, Human
caguaccagcucauaaaaag

SEQ ID NO: 977251 - RNA, 18 nt, Human
cccgccgcugcgcugccu

SEQ ID NO: 977252 - RNA, 21 nt, Human
gaccggacaggcgcgggcggc

SEQ ID NO: 977253 - RNA, 18 nt, Human
gccgcugcgcugccuccg

SEQ ID NO: 977254 - RNA, 20 nt, Human
ggaccggacaggcgcgggcg

SEQ ID NO: 977255 - RNA, 22 nt, Human
ggaccggacaggcgcgggcggc

SEQ ID NO: 977256 - RNA, 26 nt, Human
ggcgcgggcggccgggcuacgacugg

SEQ ID NO: 977257 - RNA, 21 nt, Human
gucaauuuaaaaagucgaagu

SEQ ID NO: 977258 - RNA, 18 nt, Human
ucccgccgcugcgcugcc

SEQ ID NO: 977259 - RNA, 19 nt, Human
ucggcgggguaggcucgga

SEQ ID NO: 977260 - RNA, 20 nt, Human
uuguagaaaaucaaugacac

SEQ ID NO: 977261 - RNA, 24 nt, Human
uuuuuuuuuuuuuuuuuuacacag

SEQ ID NO: 977262 - RNA, 18 nt, Human
agccgcgccagcgcagcc

SEQ ID NO: 977263 - RNA, 21 nt, Human
aggagcagaaaggccgccaaa

SEQ ID NO: 977264 - RNA, 19 nt, Human
aggccgccaaaagccgcgc

SEQ ID NO: 977265 - RNA, 20 nt, Human
aggccgccaaaagccgcgcc

SEQ ID NO: 977266 - RNA, 18 nt, Human
caccugggccgcgaggag

SEQ ID NO: 977267 - RNA, 18 nt, Human
ccgccaccgcugccgcca

SEQ ID NO: 977268 - RNA, 19 nt, Human
ccggugcccgccgcaacca

SEQ ID NO: 977269 - RNA, 25 nt, Human
gcgaggagcagaaaggccgccaaaa

SEQ ID NO: 977270 - RNA, 19 nt, Human
aacaggacuggucaaaccc

SEQ ID NO: 977271 - RNA, 22 nt, Human
aacaugauuuuuauuuuuccgu

SEQ ID NO: 977272 - RNA, 21 nt, Human
acccagagccugcgucacccc

SEQ ID NO: 977273 - RNA, 23 nt, Human
acccugguuuucacacccuccau

SEQ ID NO: 977274 - RNA, 20 nt, Human
agaugccugggaacagaacg

SEQ ID NO: 977275 - RNA, 21 nt, Human
agccugcgucaccccacccug

SEQ ID NO: 977276 - RNA, 25 nt, Human
aggccuggaggcgagguaggagagu

SEQ ID NO: 977277 - RNA, 18 nt, Human
agggaaugaggaagaggu

SEQ ID NO: 977278 - RNA, 18 nt, Human
auccacauccuggagcag

SEQ ID NO: 977279 - RNA, 18 nt, Human
caccagguggcagaaggg

SEQ ID NO: 977280 - RNA, 21 nt, Human
caccagguggcagaagggaac

SEQ ID NO: 977281 - RNA, 20 nt, Human
cacccuccauccacauccuu

SEQ ID NO: 977282 - RNA, 18 nt, Human
cagaacaggacuggucaa

SEQ ID NO: 977283 - RNA, 21 nt, Human
cagcccaggacccagcugccu

SEQ ID NO: 977284 - RNA, 22 nt, Human
caggaaauauugagaacaccac

SEQ ID NO: 977285 - RNA, 26 nt, Human
caugacccagagccugcgucacccca

SEQ ID NO: 977286 - RNA, 20 nt, Human
ccaccuuacggguucagaau

SEQ ID NO: 977287 - RNA, 21 nt, Human
ccagcccaggacccagcugcc

SEQ ID NO: 977288 - RNA, 21 nt, Human
cccagcugccugcucucccua

SEQ ID NO: 977289 - RNA, 18 nt, Human
ccccaaagcugggguggg

SEQ ID NO: 977290 - RNA, 25 nt, Human
ccccacccugguuuucacacccucc

SEQ ID NO: 977291 - RNA, 18 nt, Human
cccccaaagcuggggugg

SEQ ID NO: 977292 - RNA, 19 nt, Human
ccguagcccugccccagcg

SEQ ID NO: 977293 - RNA, 23 nt, Human
cgggcaggaagaccgggugggag

SEQ ID NO: 977294 - RNA, 23 nt, Human
gaacaccaccuuacggguucaga

SEQ ID NO: 977295 - RNA, 19 nt, Human
gagaacaccaccuuacggg

SEQ ID NO: 977296 - RNA, 23 nt, Human
gaggagggaccagcccaguggcg

SEQ ID NO: 977297 - RNA, 18 nt, Human
gaguggaggagggaccag

SEQ ID NO: 977298 - RNA, 21 nt, Human
gccugggcugaugugucaccc

SEQ ID NO: 977299 - RNA, 22 nt, Human
gcuuuauaggggaggaguggag

SEQ ID NO: 977300 - RNA, 18 nt, Human
gggaacagaacggcugag

SEQ ID NO: 977301 - RNA, 19 nt, Human
gggcgaugugaggacuaag

SEQ ID NO: 977302 - RNA, 18 nt, Human
gggcgugggugccuggag

SEQ ID NO: 977303 - RNA, 21 nt, Human
gguucagaauaaaaccgaggg

SEQ ID NO: 977304 - RNA, 23 nt, Human
uacggguucagaauaaaaccgag

SEQ ID NO: 977305 - RNA, 23 nt, Human
uaguccuccagcccaggacccag

SEQ ID NO: 977306 - RNA, 20 nt, Human
uaucaugacccagagccugc

SEQ ID NO: 977307 - RNA, 25 nt, Human
ucacggggaaucagaggguggagag

SEQ ID NO: 977308 - RNA, 20 nt, Human
ugagucugggugccugggga

SEQ ID NO: 977309 - RNA, 20 nt, Human
ugaugugucaccccugaagg

SEQ ID NO: 977310 - RNA, 19 nt, Human
ugccuggagaugccuggga

SEQ ID NO: 977311 - RNA, 18 nt, Human
ugccugggaacagaacgg

SEQ ID NO: 977312 - RNA, 20 nt, Human
uggcagaagggaacacagua

SEQ ID NO: 977313 - RNA, 23 nt, Human
ugggcugagucugggugccuggg

SEQ ID NO: 977314 - RNA, 21 nt, Human
uggggaccccaggaggcuuua

SEQ ID NO: 977315 - RNA, 23 nt, Human
uggggaccccaggaggcuuuaua

SEQ ID NO: 977316 - RNA, 21 nt, Human
uggggugggcugagucugggu

SEQ ID NO: 977317 - RNA, 19 nt, Human
ugugucaccccugaaggug

SEQ ID NO: 977318 - RNA, 19 nt, Human
uuccugccgccggccacca

SEQ ID NO: 977319 - RNA, 19 nt, Human
aaaaacagccacaacuuga

SEQ ID NO: 977320 - RNA, 22 nt, Human
aaaacaaaaacaaaaacaaaaa

SEQ ID NO: 977321 - RNA, 23 nt, Human
aaaacaaaaacaaaaacaaaaaa

SEQ ID NO: 977322 - RNA, 20 nt, Human
aaaagcaccacaauuugugg

SEQ ID NO: 977323 - RNA, 24 nt, Human
aaaauauaucccccaugcuacuua

SEQ ID NO: 977324 - RNA, 18 nt, Human
aaacaaaaaacagccaca

SEQ ID NO: 977325 - RNA, 22 nt, Human
aaacaaaaacaaaaaacagcca

SEQ ID NO: 977326 - RNA, 23 nt, Human
aaacaaaaacaaaaaacagccac

SEQ ID NO: 977327 - RNA, 31 nt, Human
aaacaaaaacaaaaacaaaaaacagccacaa

SEQ ID NO: 977328 - RNA, 21 nt, Human
aaacagccacaacuugaaagc

SEQ ID NO: 977329 - RNA, 23 nt, Human
aaacaguugcuuuuuaaaaaacc

SEQ ID NO: 977330 - RNA, 27 nt, Human
aaagaaaaaauacacuuggcaucucca

SEQ ID NO: 977331 - RNA, 25 nt, Human
aaagaaaacaaaaacaaaaacaaaa

SEQ ID NO: 977332 - RNA, 22 nt, Human
aaagaagccagcgcaggggcgg

SEQ ID NO: 977333 - RNA, 23 nt, Human
aacaaaaacaaaaaacagccaca

SEQ ID NO: 977334 - RNA, 19 nt, Human
aagaagccagcgcaggggc

SEQ ID NO: 977335 - RNA, 23 nt, Human
aagaaggaagguggcugaguccu

SEQ ID NO: 977336 - RNA, 20 nt, Human
aagcauggggugaagaagga

SEQ ID NO: 977337 - RNA, 25 nt, Human
aagcccacggucuggcugacccuaa

SEQ ID NO: 977338 - RNA, 18 nt, Human
aaggauuugucuaugcuu

SEQ ID NO: 977339 - RNA, 25 nt, Human
acaaaaacaaaaacaaaaacaaaaa

SEQ ID NO: 977340 - RNA, 20 nt, Human
acagccacaacuugaaagcu

SEQ ID NO: 977341 - RNA, 19 nt, Human
agaaaaaauacacuuggca

SEQ ID NO: 977342 - RNA, 24 nt, Human
agaaaacaaaaacaaaaacaaaaa

SEQ ID NO: 977343 - RNA, 18 nt, Human
agaaagaaaaaauacacu

SEQ ID NO: 977344 - RNA, 23 nt, Human
agaaaucaugaagagccuucagc

SEQ ID NO: 977345 - RNA, 18 nt, Human
agcauggggugaagaagg

SEQ ID NO: 977346 - RNA, 19 nt, Human
aggaaagagaaaaauccau

SEQ ID NO: 977347 - RNA, 22 nt, Human
aggagaaagaaggagagggcag

SEQ ID NO: 977348 - RNA, 22 nt, Human
agggcagugguuaaaggaaaau

SEQ ID NO: 977349 - RNA, 22 nt, Human
aggggaagagaaggugggaaac

SEQ ID NO: 977350 - RNA, 22 nt, Human
agggggaaagaaccuugaagga

SEQ ID NO: 977351 - RNA, 22 nt, Human
auaaaauauacaaaaagcacca

SEQ ID NO: 977352 - RNA, 20 nt, Human
aucaacuugaguuauccaag

SEQ ID NO: 977353 - RNA, 25 nt, Human
caaaaaacagccacaacuugaaagc

SEQ ID NO: 977354 - RNA, 27 nt, Human
caaaaacaaaaacaaaaaacagccaca

SEQ ID NO: 977355 - RNA, 28 nt, Human
caaaaacaaaaacaaaaacaaaaaacca

SEQ ID NO: 977356 - RNA, 21 nt, Human
caaaaagcaccacaauuugug

SEQ ID NO: 977357 - RNA, 21 nt, Human
caaaacugagggggaaagaac

SEQ ID NO: 977358 - RNA, 18 nt, Human
caaagcaagcccacgguc

SEQ ID NO: 977359 - RNA, 18 nt, Human
caacaacaaaacugaggg

SEQ ID NO: 977360 - RNA, 19 nt, Human
caagcccacggucuggcug

SEQ ID NO: 977361 - RNA, 19 nt, Human
cagaacaaaaaggcuacac

SEQ ID NO: 977362 - RNA, 25 nt, Human
cagaacaaaaaggcuacacaaaagc

SEQ ID NO: 977363 - RNA, 23 nt, Human
cagccacaacuugaaagcuaaaa

SEQ ID NO: 977364 - RNA, 19 nt, Human
cagcuucccaguccacucu

SEQ ID NO: 977365 - RNA, 24 nt, Human
cauaaaauauacaaaaagcaccac

SEQ ID NO: 977366 - RNA, 20 nt, Human
cccaaagcaagcccacgguc

SEQ ID NO: 977367 - RNA, 26 nt, Human
cccaaucaaaacaacucuaaaucacu

SEQ ID NO: 977368 - RNA, 18 nt, Human
cuaaagaaaacaaaaaca

SEQ ID NO: 977369 - RNA, 22 nt, Human
cuacacaaaagcccacuggcuc

SEQ ID NO: 977370 - RNA, 18 nt, Human
cugcgcccucugcaaucc

SEQ ID NO: 977371 - RNA, 18 nt, Human
cuugcugaagaucaucca

SEQ ID NO: 977372 - RNA, 24 nt, Human
gaaaacaaaaacaaaaacaaaaac

SEQ ID NO: 977373 - RNA, 26 nt, Human
gacuuuugucuuaaaaauagucagaa

SEQ ID NO: 977374 - RNA, 18 nt, Human
gagagggcagugguuaaa

SEQ ID NO: 977375 - RNA, 21 nt, Human
gagcccaaagcaagcccacgg

SEQ ID NO: 977376 - RNA, 24 nt, Human
gagggccgaggagaaagaagccag

SEQ ID NO: 977377 - RNA, 22 nt, Human
gauagcccuaacuggagacaga

SEQ ID NO: 977378 - RNA, 21 nt, Human
gcagaacaaaaaggcuacaca

SEQ ID NO: 977379 - RNA, 24 nt, Human
gcagaacaaaaaggcuacacaaaa

SEQ ID NO: 977380 - RNA, 21 nt, Human
gcucuuguugaaagugggagc

SEQ ID NO: 977381 - RNA, 24 nt, Human
ggagguacaacccaccuccaaaaa

SEQ ID NO: 977382 - RNA, 22 nt, Human
ggcaaggaaaacacagaagaga

SEQ ID NO: 977383 - RNA, 19 nt, Human
ggccgaggagaaagaagcc

SEQ ID NO: 977384 - RNA, 26 nt, Human
gguuucugagaaaucaugaagagccu

SEQ ID NO: 977385 - RNA, 22 nt, Human
guaagacaacaacaaaacugag

SEQ ID NO: 977386 - RNA, 18 nt, Human
guggguguauguucaugu

SEQ ID NO: 977387 - RNA, 24 nt, Human
uaaaauauacaaaaagcaccacaa

SEQ ID NO: 977388 - RNA, 31 nt, Human
uaaagaaaacaaaaacaaaaacaaaaacaaa

SEQ ID NO: 977389 - RNA, 21 nt, Human
uaaaggaaaagcuggguucac

SEQ ID NO: 977390 - RNA, 18 nt, Human
uaagacaacaacaaaacu

SEQ ID NO: 977391 - RNA, 21 nt, Human
uaagacaacaacaaaacugag

SEQ ID NO: 977392 - RNA, 18 nt, Human
uacacaaaagcccacugg

SEQ ID NO: 977393 - RNA, 23 nt, Human
uacguuauagcaaaaaauauauc

SEQ ID NO: 977394 - RNA, 20 nt, Human
uagcaaaaaauauauccccc

SEQ ID NO: 977395 - RNA, 20 nt, Human
uagcccuaacuggagacaga

SEQ ID NO: 977396 - RNA, 22 nt, Human
uaugcuuuaaaggaaaagcugg

SEQ ID NO: 977397 - RNA, 25 nt, Human
uauuuuguuauauucaaacaugagu

SEQ ID NO: 977398 - RNA, 20 nt, Human
ucaacagucuuuugcaauaa

SEQ ID NO: 977399 - RNA, 25 nt, Human
ucaacagucuuuugcaauaaauacc

SEQ ID NO: 977400 - RNA, 21 nt, Human
ucacuguagucuggauguggg

SEQ ID NO: 977401 - RNA, 18 nt, Human
uccaugaguuagaccuug

SEQ ID NO: 977402 - RNA, 23 nt, Human
ucuaaaauuacauagaaagaaaa

SEQ ID NO: 977403 - RNA, 26 nt, Human
ucuaaagaaaacaaaaacaaaaacaa

SEQ ID NO: 977404 - RNA, 18 nt, Human
ucugaaauccuuuucgga

SEQ ID NO: 977405 - RNA, 24 nt, Human
ucugcauuauaguuaacauaugua

SEQ ID NO: 977406 - RNA, 25 nt, Human
ugaaggagaaagaaggagagggcag

SEQ ID NO: 977407 - RNA, 18 nt, Human
ugagggggaaagaaccuu

SEQ ID NO: 977408 - RNA, 23 nt, Human
ugcagaacaaaaaggcuacacaa

SEQ ID NO: 977409 - RNA, 27 nt, Human
ugcagaacaaaaaggcuacacaaaagc

SEQ ID NO: 977410 - RNA, 21 nt, Human
uggcaaucaguggaaaccugg

SEQ ID NO: 977411 - RNA, 20 nt, Human
uggcaucuccagaguaagac

SEQ ID NO: 977412 - RNA, 20 nt, Human
uggcaugcaucugaaauccu

SEQ ID NO: 977413 - RNA, 24 nt, Human
uggcugacccuaagcaaggauuug

SEQ ID NO: 977414 - RNA, 21 nt, Human
uggcugaguccuucacaaaua

SEQ ID NO: 977415 - RNA, 21 nt, Human
uggguguauguucauguacac

SEQ ID NO: 977416 - RNA, 21 nt, Human
uggugagaagcauggggugaa

SEQ ID NO: 977417 - RNA, 22 nt, Human
uuaaaaauagucagaauucaac

SEQ ID NO: 977418 - RNA, 21 nt, Human
uucaacagucuuuugcaauaa

SEQ ID NO: 977419 - RNA, 22 nt, Human
uuucccugcucccacgguaccc

SEQ ID NO: 977420 - RNA, 22 nt, Human
uuugucuuaaaaauagucagaa

SEQ ID NO: 977421 - RNA, 18 nt, Human
aaaaaaagagaauucgga

SEQ ID NO: 977422 - RNA, 21 nt, Human
aaacagcaaagacuaucccaa

SEQ ID NO: 977423 - RNA, 20 nt, Human
aagaaagaaaaaauccucau

SEQ ID NO: 977424 - RNA, 20 nt, Human
aagaggccgaagcgccaacg

SEQ ID NO: 977425 - RNA, 23 nt, Human
aagcauuucaccgcaaacagcaa

SEQ ID NO: 977426 - RNA, 18 nt, Human
accaacuuccgagcaauc

SEQ ID NO: 977427 - RNA, 23 nt, Human
agaaaaaauccucauuacuguaa

SEQ ID NO: 977428 - RNA, 20 nt, Human
agaaaauaaagguugaauuu

SEQ ID NO: 977429 - RNA, 24 nt, Human
auggacaaaaagcauuucaccgca

SEQ ID NO: 977430 - RNA, 22 nt, Human
caaacaaaaacuuugccuagga

SEQ ID NO: 977431 - RNA, 18 nt, Human
caccgcaaacagcaaaga

SEQ ID NO: 977432 - RNA, 26 nt, Human
caccgcaaacagcaaagacuauccca

SEQ ID NO: 977433 - RNA, 18 nt, Human
caucugaacuccgugauc

SEQ ID NO: 977434 - RNA, 19 nt, Human
caugggucaccaaguucug

SEQ ID NO: 977435 - RNA, 20 nt, Human
ccaacuuccgagcaaucggc

SEQ ID NO: 977436 - RNA, 22 nt, Human
ccgcaaacagcaaagacuaucc

SEQ ID NO: 977437 - RNA, 25 nt, Human
cgauuaacagugccaagauuauaac

SEQ ID NO: 977438 - RNA, 19 nt, Human
cggcgggagaaaaaaagag

SEQ ID NO: 977439 - RNA, 23 nt, Human
cucuggagaaaacaauggaaaaa

SEQ ID NO: 977440 - RNA, 22 nt, Human
cuguaaggcaaaauacaaucua

SEQ ID NO: 977441 - RNA, 19 nt, Human
cuuggauucucuucuuucu

SEQ ID NO: 977442 - RNA, 21 nt, Human
gaagcgccaacggcaaguccc

SEQ ID NO: 977443 - RNA, 18 nt, Human
ggagccagauuccccgcu

SEQ ID NO: 977444 - RNA, 19 nt, Human
guaaggcaaaauacaaucu

SEQ ID NO: 977445 - RNA, 22 nt, Human
uaaaaggggcaaaauuuguaag

SEQ ID NO: 977446 - RNA, 23 nt, Human
uaaacaauauguugaaaaaauua

SEQ ID NO: 977447 - RNA, 21 nt, Human
uaaauccagucucgaugcaaa

SEQ ID NO: 977448 - RNA, 23 nt, Human
uacaauauacaugaaguccaaag

SEQ ID NO: 977449 - RNA, 28 nt, Human
uauuuccucuuuuuucucaaugaacaag

SEQ ID NO: 977450 - RNA, 25 nt, Human
ucccuuggauucucuucuuucugcg

SEQ ID NO: 977451 - RNA, 25 nt, Human
uccucauuacuguaauauuccugau

SEQ ID NO: 977452 - RNA, 24 nt, Human
ucggagcuggagacgacuccccuu

SEQ ID NO: 977453 - RNA, 23 nt, Human
ucucauacuuugagcuccauuag

SEQ ID NO: 977454 - RNA, 19 nt, Human
ugccuaggagugucugugu

SEQ ID NO: 977455 - RNA, 25 nt, Human
uggcacaacuuguuuuucacaguug

SEQ ID NO: 977456 - RNA, 20 nt, Human
uguauuaaaaaaagaaagaa

SEQ ID NO: 977457 - RNA, 21 nt, Human
uucacaaacaaaaacuuugcc

SEQ ID NO: 977458 - RNA, 19 nt, Human
uucucaaugaacaagaggc

SEQ ID NO: 977459 - RNA, 19 nt, Human
uugaauuuuacuguaacug

SEQ ID NO: 977460 - RNA, 19 nt, Human
uuucacaguugcaaauauu

SEQ ID NO: 977461 - RNA, 22 nt, Human
uuugcagcaacuaucacauccu

SEQ ID NO: 977462 - RNA, 24 nt, Human
aaaaaaaaaucaaaacucugugga

SEQ ID NO: 977463 - RNA, 19 nt, Human
aaaaaccuuuccccuaccc

SEQ ID NO: 977464 - RNA, 20 nt, Human
aaaaacgaaaaacuaggaau

SEQ ID NO: 977465 - RNA, 22 nt, Human
aaaaccucugaccuugcugcag

SEQ ID NO: 977466 - RNA, 21 nt, Human
aaaaggaaacaaguuguuuua

SEQ ID NO: 977467 - RNA, 19 nt, Human
aaaauccaaggcaugccgg

SEQ ID NO: 977468 - RNA, 26 nt, Human
aaacaaaaguagaaauaaagggaccc

SEQ ID NO: 977469 - RNA, 25 nt, Human
aaaccaucuccagucccuucaguac

SEQ ID NO: 977470 - RNA, 21 nt, Human
aaaccucugaccuugcugcag

SEQ ID NO: 977471 - RNA, 18 nt, Human
aaacuggaaaugcuacgg

SEQ ID NO: 977472 - RNA, 25 nt, Human
aaagacaauggaaaagaggaagggg

SEQ ID NO: 977473 - RNA, 19 nt, Human
aaagugcaacuugccacug

SEQ ID NO: 977474 - RNA, 24 nt, Human
aaagugcuaagauuacaggcguga

SEQ ID NO: 977475 - RNA, 20 nt, Human
aaauaaaaguuuucagaacc

SEQ ID NO: 977476 - RNA, 21 nt, Human
aacaaacuggaaaugcuacgg

SEQ ID NO: 977477 - RNA, 21 nt, Human
aacaaguaccuacccacugga

SEQ ID NO: 977478 - RNA, 23 nt, Human
aacacuuugggagguugagcggg

SEQ ID NO: 977479 - RNA, 19 nt, Human
aaccagcguggccacagcg

SEQ ID NO: 977480 - RNA, 20 nt, Human
aaccagggcggcgcagacgg

SEQ ID NO: 977481 - RNA, 22 nt, Human
aacccuggaagaaccugaaaaa

SEQ ID NO: 977482 - RNA, 20 nt, Human
aaccuccaccucccggguuc

SEQ ID NO: 977483 - RNA, 23 nt, Human
aagaaaaauuuccccccaaacca

SEQ ID NO: 977484 - RNA, 19 nt, Human
aagaaacccaaacccagcc

SEQ ID NO: 977485 - RNA, 23 nt, Human
aagaaacccaaacccagccuggc

SEQ ID NO: 977486 - RNA, 18 nt, Human
aagaagaacaagcuagaa

SEQ ID NO: 977487 - RNA, 21 nt, Human
aagagaagaaacccaaaccca

SEQ ID NO: 977488 - RNA, 22 nt, Human
aagcaaaccaaaacccagaaaa

SEQ ID NO: 977489 - RNA, 18 nt, Human
aagcaaaccaagaagaac

SEQ ID NO: 977490 - RNA, 23 nt, Human
aagcaagaaccccacacaaaagc

SEQ ID NO: 977491 - RNA, 25 nt, Human
aagcaaggcaagacacugcacgcag

SEQ ID NO: 977492 - RNA, 18 nt, Human
aagcagaagaaguucuaa

SEQ ID NO: 977493 - RNA, 23 nt, Human
aagcagguugaaagcaaaccaag

SEQ ID NO: 977494 - RNA, 21 nt, Human
aagcgugaucauaagugaacc

SEQ ID NO: 977495 - RNA, 19 nt, Human
aaggaaaaaauaaguccuu

SEQ ID NO: 977496 - RNA, 20 nt, Human
aaggaaaaagcaaaccaaaa

SEQ ID NO: 977497 - RNA, 27 nt, Human
aaggaaaaagcaaaccaaaacccagaa

SEQ ID NO: 977498 - RNA, 22 nt, Human
aaggagaagaagguauagaaga

SEQ ID NO: 977499 - RNA, 20 nt, Human
aaguaccugcacgauacuau

SEQ ID NO: 977500 - RNA, 19 nt, Human
aaguagcugggacuacagg

SEQ ID NO: 977501 - RNA, 20 nt, Human
aaguagcugggacuacaggc

SEQ ID NO: 977502 - RNA, 25 nt, Human
aaguagcugggacuacaggcaccca

SEQ ID NO: 977503 - RNA, 18 nt, Human
aaguuuuugggcucaaag

SEQ ID NO: 977504 - RNA, 25 nt, Human
aauaaaaagugaaaaacuaugcaua

SEQ ID NO: 977505 - RNA, 23 nt, Human
aauaugacccucccuuccuccaa

SEQ ID NO: 977506 - RNA, 18 nt, Human
acacaaagcaagaacccc

SEQ ID NO: 977507 - RNA, 24 nt, Human
acacaacaaaauccaaggcaugcc

SEQ ID NO: 977508 - RNA, 21 nt, Human
acacauuuaaaaaagcagaaa

SEQ ID NO: 977509 - RNA, 21 nt, Human
acagcagaaaauggcaacgca

SEQ ID NO: 977510 - RNA, 21 nt, Human
acaggcacccaccaccacacc

SEQ ID NO: 977511 - RNA, 18 nt, Human
acaggcgugagcaccaua

SEQ ID NO: 977512 - RNA, 22 nt, Human
acaucuacuaaaacaaacaaac

SEQ ID NO: 977513 - RNA, 19 nt, Human
acauuuaaaaaagcagaaa

SEQ ID NO: 977514 - RNA, 21 nt, Human
accaaaacccagaaaaauccg

SEQ ID NO: 977515 - RNA, 21 nt, Human
accaaguuuuugggcucaaag

SEQ ID NO: 977516 - RNA, 27 nt, Human
accacacaaagcaagaaccccacacaa

SEQ ID NO: 977517 - RNA, 18 nt, Human
accacacccugccccugc

SEQ ID NO: 977518 - RNA, 18 nt, Human
accacagccucagacuca

SEQ ID NO: 977519 - RNA, 22 nt, Human
accauauuggccaggcuggucu

SEQ ID NO: 977520 - RNA, 24 nt, Human
accauauuggccaggcuggucuug

SEQ ID NO: 977521 - RNA, 21 nt, Human
acccaccuuggccucccaauc

SEQ ID NO: 977522 - RNA, 19 nt, Human
acccaggcuggagugcaau

SEQ ID NO: 977523 - RNA, 24 nt, Human
accucgugauccacccaccuuggc

SEQ ID NO: 977524 - RNA, 22 nt, Human
accugaggccugucccccauga

SEQ ID NO: 977525 - RNA, 24 nt, Human
accuggcuaauuuuuuuguauuuu

SEQ ID NO: 977526 - RNA, 18 nt, Human
acgggguuucacuauguu

SEQ ID NO: 977527 - RNA, 23 nt, Human
acgggguuucacuauguuggcca

SEQ ID NO: 977528 - RNA, 24 nt, Human
acgggguuucacuauguuggccag

SEQ ID NO: 977529 - RNA, 22 nt, Human
acuaaaacaaacaaacaaauaa

SEQ ID NO: 977530 - RNA, 24 nt, Human
acuauguuggccaggcuggucucg

SEQ ID NO: 977531 - RNA, 18 nt, Human
acucugucacccaggcug

SEQ ID NO: 977532 - RNA, 25 nt, Human
acucugucacccaggcuggagugua

SEQ ID NO: 977533 - RNA, 22 nt, Human
acuguaaccuccgccuccuggg

SEQ ID NO: 977534 - RNA, 21 nt, Human
acuuugggagguugagcgggg

SEQ ID NO: 977535 - RNA, 22 nt, Human
agaaacccaaacccagccuggc

SEQ ID NO: 977536 - RNA, 21 nt, Human
agaaccccacacaaaagcugg

SEQ ID NO: 977537 - RNA, 21 nt, Human
agaagaacaagcuagaacagg

SEQ ID NO: 977538 - RNA, 19 nt, Human
agaagagaagaaacccaaa

SEQ ID NO: 977539 - RNA, 20 nt, Human
agaaucagaagagaagaaac

SEQ ID NO: 977540 - RNA, 19 nt, Human
agacauccaucaagcaggu

SEQ ID NO: 977541 - RNA, 22 nt, Human
agacgccggucggaggaaccgg

SEQ ID NO: 977542 - RNA, 18 nt, Human
agagaaccagguuuccag

SEQ ID NO: 977543 - RNA, 18 nt, Human
agagccaaagacaaugga

SEQ ID NO: 977544 - RNA, 22 nt, Human
agagccccaagguccccacccc

SEQ ID NO: 977545 - RNA, 18 nt, Human
agaggaaggggggggcgg

SEQ ID NO: 977546 - RNA, 24 nt, Human
agauuacaggcgugagcaccauac

SEQ ID NO: 977547 - RNA, 22 nt, Human
agauucuccugccucagccucc

SEQ ID NO: 977548 - RNA, 26 nt, Human
agccaaacaggccauuggugacagga

SEQ ID NO: 977549 - RNA, 19 nt, Human
agccauuuccuucauagcc

SEQ ID NO: 977550 - RNA, 19 nt, Human
agcucuuccaagcucuucc

SEQ ID NO: 977551 - RNA, 22 nt, Human
agcugaaugccugugucucugg

SEQ ID NO: 977552 - RNA, 23 nt, Human
aggaaaaaauaaguccuugagaa

SEQ ID NO: 977553 - RNA, 26 nt, Human
aggaaaaagcaaaccaaaacccagaa

SEQ ID NO: 977554 - RNA, 23 nt, Human
aggaaacacacucagccagaagc

SEQ ID NO: 977555 - RNA, 18 nt, Human
aggaaggggggggcggag

SEQ ID NO: 977556 - RNA, 18 nt, Human
aggaaggggggggcggag

SEQ ID NO: 977557 - RNA, 18 nt, Human
aggacacguagugggcag

SEQ ID NO: 977558 - RNA, 23 nt, Human
aggacccugaaaaaaagccccaa

SEQ ID NO: 977559 - RNA, 19 nt, Human
aggagaagaagguauagaa

SEQ ID NO: 977560 - RNA, 28 nt, Human
aggcaagcgugaucauaagugaaccaga

SEQ ID NO: 977561 - RNA, 23 nt, Human
aggcagaaggaggaacgaggcuu

SEQ ID NO: 977562 - RNA, 25 nt, Human
aggcagaaggaggaacgaggggacc

SEQ ID NO: 977563 - RNA, 19 nt, Human
aggccacuuccucagauaa

SEQ ID NO: 977564 - RNA, 18 nt, Human
aggcuggagugcaguggc

SEQ ID NO: 977565 - RNA, 19 nt, Human
agggagaaggaggggcugg

SEQ ID NO: 977566 - RNA, 19 nt, Human
agggagggagggagaaggg

SEQ ID NO: 977567 - RNA, 22 nt, Human
agggaggggcccugggaaaagu

SEQ ID NO: 977568 - RNA, 25 nt, Human
agggaggggcccugggaaaaguucu

SEQ ID NO: 977569 - RNA, 19 nt, Human
aggggcagggggaaaaaag

SEQ ID NO: 977570 - RNA, 19 nt, Human
aguagcugggacuacaggc

SEQ ID NO: 977571 - RNA, 21 nt, Human
aguccagaaguuugagaccag

SEQ ID NO: 977572 - RNA, 23 nt, Human
agucugugacucaguaagaaccg

SEQ ID NO: 977573 - RNA, 24 nt, Human
agugcaauggugcggucucagcug

SEQ ID NO: 977574 - RNA, 21 nt, Human
agugcaguggcgcaaucaaag

SEQ ID NO: 977575 - RNA, 18 nt, Human
aguggcgcgaucuuggcu

SEQ ID NO: 977576 - RNA, 23 nt, Human
aguggcucacaccuguaauccca

SEQ ID NO: 977577 - RNA, 23 nt, Human
aguguaguggcgcgaucuuggcu

SEQ ID NO: 977578 - RNA, 24 nt, Human
aguguaguggcgcgaucuuggcuc

SEQ ID NO: 977579 - RNA, 23 nt, Human
auagccuggcagcuuugcuccug

SEQ ID NO: 977580 - RNA, 23 nt, Human
auauuggccaggcuggucuugaa

SEQ ID NO: 977581 - RNA, 19 nt, Human
aucauagcuaccuaccucg

SEQ ID NO: 977582 - RNA, 22 nt, Human
augcacuacugaguggcaaagu

SEQ ID NO: 977583 - RNA, 19 nt, Human
augggguuuaccauauugg

SEQ ID NO: 977584 - RNA, 23 nt, Human
augggguuuaccauauuggccag

SEQ ID NO: 977585 - RNA, 19 nt, Human
auuaaaaaaaaaaaaaaaa

SEQ ID NO: 977586 - RNA, 22 nt, Human
auuaaaaaaaaaaaaaaaauca

SEQ ID NO: 977587 - RNA, 20 nt, Human
caaaaggaaacaaguuguuu

SEQ ID NO: 977588 - RNA, 19 nt, Human
caaaauaaauauucuauac

SEQ ID NO: 977589 - RNA, 28 nt, Human
caaaccaaaacccagaaaaauccguguu

SEQ ID NO: 977590 - RNA, 28 nt, Human
caaaccaacggauagguuugaacaacga

SEQ ID NO: 977591 - RNA, 21 nt, Human
caaaccaagaagaacaagcua

SEQ ID NO: 977592 - RNA, 19 nt, Human
caaaccacacccugccccu

SEQ ID NO: 977593 - RNA, 24 nt, Human
caaagcaagaaccccacacaaaag

SEQ ID NO: 977594 - RNA, 23 nt, Human
caaaggcaugaaccagaaggcua

SEQ ID NO: 977595 - RNA, 24 nt, Human
caaagugcuaagauuacaggcgug

SEQ ID NO: 977596 - RNA, 19 nt, Human
caacaaaauccaaggcaug

SEQ ID NO: 977597 - RNA, 21 nt, Human
caacacagaaagaccccacau

SEQ ID NO: 977598 - RNA, 23 nt, Human
caacacuuugggagguugagcgg

SEQ ID NO: 977599 - RNA, 22 nt, Human
caagaucaccaaagugcaacuu

SEQ ID NO: 977600 - RNA, 21 nt, Human
caagccaguuuauccuucugu

SEQ ID NO: 977601 - RNA, 20 nt, Human
caagccgaggcaucguccag

SEQ ID NO: 977602 - RNA, 24 nt, Human
caaggcugggcacaguggcucaca

SEQ ID NO: 977603 - RNA, 23 nt, Human
caaguauguacacaaaaagucag

SEQ ID NO: 977604 - RNA, 20 nt, Human
caagugauucuucugccuca

SEQ ID NO: 977605 - RNA, 22 nt, Human
caagugauucuucugccucagc

SEQ ID NO: 977606 - RNA, 21 nt, Human
caaguuguuuuauuauuauuu

SEQ ID NO: 977607 - RNA, 23 nt, Human
cacaacaaaauccaaggcaugcc

SEQ ID NO: 977608 - RNA, 24 nt, Human
cacacaaagcaagaaccccacaca

SEQ ID NO: 977609 - RNA, 24 nt, Human
cacaccuguaaucccaacacuuug

SEQ ID NO: 977610 - RNA, 25 nt, Human
cacaggcaagccaguuuauccuucu

SEQ ID NO: 977611 - RNA, 22 nt, Human
caccaagaucaccaaagugcaa

SEQ ID NO: 977612 - RNA, 20 nt, Human
caccaugccuggcuauuuug

SEQ ID NO: 977613 - RNA, 18 nt, Human
cacccaccaccacaccug

SEQ ID NO: 977614 - RNA, 24 nt, Human
cacccaggcuggaguguaguggcg

SEQ ID NO: 977615 - RNA, 19 nt, Human
cacccccuuccugcucagg

SEQ ID NO: 977616 - RNA, 23 nt, Human
caccugccucagccucccaaagu

SEQ ID NO: 977617 - RNA, 19 nt, Human
caccuguaaucccaacacu

SEQ ID NO: 977618 - RNA, 24 nt, Human
caccuguaaucccaacacuuuggg

SEQ ID NO: 977619 - RNA, 23 nt, Human
cacgcaguuacccacagcagaaa

SEQ ID NO: 977620 - RNA, 19 nt, Human
cacuauacacaaaaggcua

SEQ ID NO: 977621 - RNA, 21 nt, Human
cacuauacacaaaaggcuaug

SEQ ID NO: 977622 - RNA, 21 nt, Human
cacuauguuggccaggcuggu

SEQ ID NO: 977623 - RNA, 24 nt, Human
cacuauguuggccaggcuggucuc

SEQ ID NO: 977624 - RNA, 18 nt, Human
cacucaugaccacugacc

SEQ ID NO: 977625 - RNA, 22 nt, Human
cacucugucacccaggcuggag

SEQ ID NO: 977626 - RNA, 23 nt, Human
cacucugucacccaggcuggagu

SEQ ID NO: 977627 - RNA, 21 nt, Human
cacuguaaccuccaccucccg

SEQ ID NO: 977628 - RNA, 23 nt, Human
cacuguaaccuccaccucccggg

SEQ ID NO: 977629 - RNA, 21 nt, Human
cagaacaaacuggaaaugcua

SEQ ID NO: 977630 - RNA, 25 nt, Human
cagaacacccccgagaguuaguuga

SEQ ID NO: 977631 - RNA, 19 nt, Human
cagaacccccaccuacccc

SEQ ID NO: 977632 - RNA, 21 nt, Human
cagaaucagaagagaagaaac

SEQ ID NO: 977633 - RNA, 23 nt, Human
cagagcacuggggcuucgacaca

SEQ ID NO: 977634 - RNA, 21 nt, Human
cagcacagaaggagaacagga

SEQ ID NO: 977635 - RNA, 30 nt, Human
cagcagaaucagaagagaagaaacccaaaa

SEQ ID NO: 977636 - RNA, 24 nt, Human
cagcagcagcgugaaggcgaggcu

SEQ ID NO: 977637 - RNA, 21 nt, Human
cagccacccuccaccuccccu

SEQ ID NO: 977638 - RNA, 18 nt, Human
cagccucaggaggcuaaa

SEQ ID NO: 977639 - RNA, 22 nt, Human
cagcggcaaccagggcggcgca

SEQ ID NO: 977640 - RNA, 21 nt, Human
cagcucaggcucuggccaugg

SEQ ID NO: 977641 - RNA, 23 nt, Human
cagcugcaguuuccggauaugug

SEQ ID NO: 977642 - RNA, 18 nt, Human
cagcuucuccuacccuuc

SEQ ID NO: 977643 - RNA, 18 nt, Human
caggaaacacacucagcc

SEQ ID NO: 977644 - RNA, 23 nt, Human
caggaaacacacucagccagaag

SEQ ID NO: 977645 - RNA, 20 nt, Human
caggaaacagcagcuccccu

SEQ ID NO: 977646 - RNA, 20 nt, Human
caggccuggaaguuggcccu

SEQ ID NO: 977647 - RNA, 21 nt, Human
cagggacaaagugggguggag

SEQ ID NO: 977648 - RNA, 21 nt, Human
cagggcucaaacccaguggcc

SEQ ID NO: 977649 - RNA, 20 nt, Human
caggggcagggggaaaaaag

SEQ ID NO: 977650 - RNA, 19 nt, Human
caguacacuucugauacau

SEQ ID NO: 977651 - RNA, 23 nt, Human
caguggcuccuaaauccauccug

SEQ ID NO: 977652 - RNA, 19 nt, Human
cauagcuaccuaccucgcu

SEQ ID NO: 977653 - RNA, 24 nt, Human
cauauuggccaggcuggucuugaa

SEQ ID NO: 977654 - RNA, 19 nt, Human
caucagggacaaagugggg

SEQ ID NO: 977655 - RNA, 25 nt, Human
caucugaggaaaaccaucuccaguc

SEQ ID NO: 977656 - RNA, 23 nt, Human
caugcacuacugaguggcaaagu

SEQ ID NO: 977657 - RNA, 27 nt, Human
cauuuaaaaaagcagaaaucguacagg

SEQ ID NO: 977658 - RNA, 19 nt, Human
ccaaaccacacccugcccc

SEQ ID NO: 977659 - RNA, 22 nt, Human
ccaaagugcuaagauuacaggc

SEQ ID NO: 977660 - RNA, 24 nt, Human
ccaaagugcuaagauuacaggcgu

SEQ ID NO: 977661 - RNA, 22 nt, Human
ccaagaagcugagaaaaacaau

SEQ ID NO: 977662 - RNA, 22 nt, Human
ccaaggcuggagugcaguggcg

SEQ ID NO: 977663 - RNA, 20 nt, Human
ccaagggucuucuuuaaagg

SEQ ID NO: 977664 - RNA, 24 nt, Human
ccaaguuuuugggcucaaagccac

SEQ ID NO: 977665 - RNA, 24 nt, Human
ccacccaccuuggccucccaaucu

SEQ ID NO: 977666 - RNA, 20 nt, Human
ccaccccugguuagggcugu

SEQ ID NO: 977667 - RNA, 24 nt, Human
ccaccucccggguucaagugauuc

SEQ ID NO: 977668 - RNA, 26 nt, Human
ccaccugccucagccucccaaagugc

SEQ ID NO: 977669 - RNA, 21 nt, Human
ccacugggucaaguuucccau

SEQ ID NO: 977670 - RNA, 21 nt, Human
ccagaaaaauccguguuuaca

SEQ ID NO: 977671 - RNA, 18 nt, Human
ccagcucuuccaagcucu

SEQ ID NO: 977672 - RNA, 24 nt, Human
ccaguucccagggugcucgcggaa

SEQ ID NO: 977673 - RNA, 25 nt, Human
ccauucuuaaaaguaggcaagcgug

SEQ ID NO: 977674 - RNA, 22 nt, Human
cccaaaccacacccugccccug

SEQ ID NO: 977675 - RNA, 22 nt, Human
cccaaacccagccuggcucagc

SEQ ID NO: 977676 - RNA, 23 nt, Human
cccaaguagcugggacuacaggc

SEQ ID NO: 977677 - RNA, 24 nt, Human
cccaaguagcugggacuacaggca

SEQ ID NO: 977678 - RNA, 19 nt, Human
cccagcucuuccaagcucu

SEQ ID NO: 977679 - RNA, 23 nt, Human
ccccaaaccacacccugccccug

SEQ ID NO: 977680 - RNA, 18 nt, Human
ccccacaugccugcuagg

SEQ ID NO: 977681 - RNA, 19 nt, Human
cccccaaaccacacccugc

SEQ ID NO: 977682 - RNA, 23 nt, Human
ccccugcuggggcuuccuaacac

SEQ ID NO: 977683 - RNA, 21 nt, Human
ccccuggaaaaaccuuucccc

SEQ ID NO: 977684 - RNA, 23 nt, Human
cccgaguagcugggacuacaggc

SEQ ID NO: 977685 - RNA, 24 nt, Human
cccgaguagcugggacuacaggcg

SEQ ID NO: 977686 - RNA, 22 nt, Human
cccggguucaagugauucuucu

SEQ ID NO: 977687 - RNA, 23 nt, Human
cccggguucaagugauucuucug

SEQ ID NO: 977688 - RNA, 20 nt, Human
cccuccaccuccccucuucc

SEQ ID NO: 977689 - RNA, 21 nt, Human
cccuccaccuccccucuucca

SEQ ID NO: 977690 - RNA, 18 nt, Human
cccuccgugccaugcagc

SEQ ID NO: 977691 - RNA, 23 nt, Human
ccuaugguuacaaucaacuuacu

SEQ ID NO: 977692 - RNA, 23 nt, Human
ccuccccucuuccauucuuaaaa

SEQ ID NO: 977693 - RNA, 21 nt, Human
ccucccggguucaagugauuc

SEQ ID NO: 977694 - RNA, 23 nt, Human
ccuccgccuccuggguucgagau

SEQ ID NO: 977695 - RNA, 22 nt, Human
ccuccuggguucgagauucucc

SEQ ID NO: 977696 - RNA, 22 nt, Human
ccucggauggcaucaguagccu

SEQ ID NO: 977697 - RNA, 22 nt, Human
ccugaaaaaguuuucaaggcug

SEQ ID NO: 977698 - RNA, 22 nt, Human
ccugaagccggggcagguuagc

SEQ ID NO: 977699 - RNA, 19 nt, Human
ccugaccucgugauccacc

SEQ ID NO: 977700 - RNA, 22 nt, Human
ccugaccucgugauccacccac

SEQ ID NO: 977701 - RNA, 21 nt, Human
ccugaccucgugauccaccug

SEQ ID NO: 977702 - RNA, 23 nt, Human
ccugccucagccucccaaguagc

SEQ ID NO: 977703 - RNA, 22 nt, Human
ccugcuaggcucucgcugccca

SEQ ID NO: 977704 - RNA, 18 nt, Human
ccuggcuauuuuguaguu

SEQ ID NO: 977705 - RNA, 20 nt, Human
ccuucaugugcccugggggu

SEQ ID NO: 977706 - RNA, 18 nt, Human
cgacugacaggcuccaca

SEQ ID NO: 977707 - RNA, 18 nt, Human
cgccgcuguacucgcaga

SEQ ID NO: 977708 - RNA, 25 nt, Human
cgccuccuggguucgagauucuccu

SEQ ID NO: 977709 - RNA, 21 nt, Human
cggacaacacagaaagacccc

SEQ ID NO: 977710 - RNA, 18 nt, Human
cggagaaacaggcuucua

SEQ ID NO: 977711 - RNA, 18 nt, Human
cggggaggcagaaggagg

SEQ ID NO: 977712 - RNA, 24 nt, Human
cgggguuucacuauguuggccagg

SEQ ID NO: 977713 - RNA, 20 nt, Human
cggguucaagugauucuucu

SEQ ID NO: 977714 - RNA, 21 nt, Human
cguccuggaucccaggugccc

SEQ ID NO: 977715 - RNA, 24 nt, Human
cgugauccaccugccucagccucc

SEQ ID NO: 977716 - RNA, 19 nt, Human
cgugcagaugugcacuauc

SEQ ID NO: 977717 - RNA, 20 nt, Human
cuaaaacaaacaaacaaaua

SEQ ID NO: 977718 - RNA, 21 nt, Human
cuaaaaccucugaccuugcug

SEQ ID NO: 977719 - RNA, 22 nt, Human
cuaaaaccucugaccuugcugc

SEQ ID NO: 977720 - RNA, 23 nt, Human
cucaaagccacacucaugaccac

SEQ ID NO: 977721 - RNA, 22 nt, Human
cucacaccuguaaucccaacac

SEQ ID NO: 977722 - RNA, 24 nt, Human
cucacaccuguaaucccaacacuu

SEQ ID NO: 977723 - RNA, 24 nt, Human
cucacucugucacccaggcuggag

SEQ ID NO: 977724 - RNA, 24 nt, Human
cucacuguaaccuccaccucccgg

SEQ ID NO: 977725 - RNA, 24 nt, Human
cucagccucccaaguagcugggac

SEQ ID NO: 977726 - RNA, 24 nt, Human
cucagccucccgaguagcugggac

SEQ ID NO: 977727 - RNA, 23 nt, Human
cucaggcucuggccaugggggau

SEQ ID NO: 977728 - RNA, 19 nt, Human
cucaugcacuuccaguuuc

SEQ ID NO: 977729 - RNA, 20 nt, Human
cucaugguggcccccaggcc

SEQ ID NO: 977730 - RNA, 18 nt, Human
cuccugaccucgugaucc

SEQ ID NO: 977731 - RNA, 24 nt, Human
cuccugaccucgugauccaccugc

SEQ ID NO: 977732 - RNA, 19 nt, Human
cuccuggguucgagauucu

SEQ ID NO: 977733 - RNA, 24 nt, Human
cugacuguaaccuccgccuccugg

SEQ ID NO: 977734 - RNA, 23 nt, Human
cugccucagccucccaaagugcu

SEQ ID NO: 977735 - RNA, 24 nt, Human
cugccucagccucccaaagugcua

SEQ ID NO: 977736 - RNA, 23 nt, Human
cugccucagccucccaaguagcu

SEQ ID NO: 977737 - RNA, 23 nt, Human
cugccucagccucccgaguagcu

SEQ ID NO: 977738 - RNA, 18 nt, Human
cugccuccccugcuaucc

SEQ ID NO: 977739 - RNA, 18 nt, Human
cugccuccccugcuaucc

SEQ ID NO: 977740 - RNA, 19 nt, Human
cugcugccucccucccagc

SEQ ID NO: 977741 - RNA, 18 nt, Human
cuggaaaaaccuuucccc

SEQ ID NO: 977742 - RNA, 19 nt, Human
cugggucccucaguggcuc

SEQ ID NO: 977743 - RNA, 21 nt, Human
cuguaaccuccaccucccggg

SEQ ID NO: 977744 - RNA, 21 nt, Human
cuguacggagaaacaggcuuc

SEQ ID NO: 977745 - RNA, 22 nt, Human
cuuccagcuucuccuacccuuc

SEQ ID NO: 977746 - RNA, 21 nt, Human
cuuccuggggguggccaaaag

SEQ ID NO: 977747 - RNA, 24 nt, Human
cuugcucugucacccaggcuggag

SEQ ID NO: 977748 - RNA, 21 nt, Human
cuuuccccuacccucucccca

SEQ ID NO: 977749 - RNA, 23 nt, Human
gaaaaagcaaaccaaaacccaga

SEQ ID NO: 977750 - RNA, 22 nt, Human
gaaaccacaaacauauaggaaa

SEQ ID NO: 977751 - RNA, 21 nt, Human
gaaccagguuuccaggcagag

SEQ ID NO: 977752 - RNA, 19 nt, Human
gaccacagccucagacuca

SEQ ID NO: 977753 - RNA, 23 nt, Human
gaccaccaagaucaccaaagugc

SEQ ID NO: 977754 - RNA, 20 nt, Human
gaccagcucaggcucuggcc

SEQ ID NO: 977755 - RNA, 20 nt, Human
gacccugaaaaaaagcccca

SEQ ID NO: 977756 - RNA, 21 nt, Human
gaccucgugauccacccaccu

SEQ ID NO: 977757 - RNA, 21 nt, Human
gaccucgugauccacccaccu

SEQ ID NO: 977758 - RNA, 24 nt, Human
gaccucgugauccacccaccuugg

SEQ ID NO: 977759 - RNA, 25 nt, Human
gaccucgugauccacccaccuuggc

SEQ ID NO: 977760 - RNA, 22 nt, Human
gaccucgugauccaccugccuc

SEQ ID NO: 977761 - RNA, 24 nt, Human
gaccucgugauccaccugccucag

SEQ ID NO: 977762 - RNA, 24 nt, Human
gacuacaggcgugcgccaccaugc

SEQ ID NO: 977763 - RNA, 24 nt, Human
gagauucuccugccucagccuccc

SEQ ID NO: 977764 - RNA, 18 nt, Human
gaggaaggggggggcgga

SEQ ID NO: 977765 - RNA, 20 nt, Human
gaguagcugggacuacaggc

SEQ ID NO: 977766 - RNA, 24 nt, Human
gaguagcugggacuacaggcgugc

SEQ ID NO: 977767 - RNA, 24 nt, Human
gaucacuugaguccagaaguuuga

SEQ ID NO: 977768 - RNA, 21 nt, Human
gauucuucugccucagccucc

SEQ ID NO: 977769 - RNA, 23 nt, Human
gcaauugaggaaccagcguggcc

SEQ ID NO: 977770 - RNA, 22 nt, Human
gcagaacacccccgagaguuag

SEQ ID NO: 977771 - RNA, 22 nt, Human
gcagaaucagaagagaagaaac

SEQ ID NO: 977772 - RNA, 21 nt, Human
gcaguggcgcaaucaaaguau

SEQ ID NO: 977773 - RNA, 20 nt, Human
gcaguuacccacagcagaaa

SEQ ID NO: 977774 - RNA, 21 nt, Human
gccagacacuuccugggacag

SEQ ID NO: 977775 - RNA, 18 nt, Human
gccccuggaaaaaccuuu

SEQ ID NO: 977776 - RNA, 20 nt, Human
gccgccgcuguacucgcaga

SEQ ID NO: 977777 - RNA, 18 nt, Human
gccuggaaguuggcccug

SEQ ID NO: 977778 - RNA, 20 nt, Human
gccuuugaggagcugcaggg

SEQ ID NO: 977779 - RNA, 21 nt, Human
gcgcgaucuuggcucacugua

SEQ ID NO: 977780 - RNA, 27 nt, Human
gcucugucacccaggcuggagugcaau

SEQ ID NO: 977781 - RNA, 19 nt, Human
gcuggagugcaguggcgca

SEQ ID NO: 977782 - RNA, 20 nt, Human
gcugggcacaguggcucaca

SEQ ID NO: 977783 - RNA, 23 nt, Human
gcuggucucgaacuccugaccuc

SEQ ID NO: 977784 - RNA, 23 nt, Human
gcuggucuugaacuccugaccuc

SEQ ID NO: 977785 - RNA, 20 nt, Human
gcuguccuuccagcuucucc

SEQ ID NO: 977786 - RNA, 22 nt, Human
gcuugucaaaggcaugaaccag

SEQ ID NO: 977787 - RNA, 18 nt, Human
ggaaaacaaaauaccaca

SEQ ID NO: 977788 - RNA, 23 nt, Human
ggaaaugggcuacagugaggggg

SEQ ID NO: 977789 - RNA, 25 nt, Human
ggaaugcuguccuuccagcuucucc

SEQ ID NO: 977790 - RNA, 21 nt, Human
ggacaacacagaaagacccca

SEQ ID NO: 977791 - RNA, 26 nt, Human
ggacacguagugggcaggcgagucug

SEQ ID NO: 977792 - RNA, 24 nt, Human
ggacuacaggcgugcgccaccaug

SEQ ID NO: 977793 - RNA, 20 nt, Human
ggagggagaaggaggggcug

SEQ ID NO: 977794 - RNA, 18 nt, Human
ggagggagggagggagaa

SEQ ID NO: 977795 - RNA, 19 nt, Human
ggagggagggagggagaag

SEQ ID NO: 977796 - RNA, 18 nt, Human
ggaggggcccugggaaaa

SEQ ID NO: 977797 - RNA, 18 nt, Human
ggaggggcugggaaggca

SEQ ID NO: 977798 - RNA, 20 nt, Human
ggaggggcugggaaggcauu

SEQ ID NO: 977799 - RNA, 23 nt, Human
ggaucacuugaguccagaaguuu

SEQ ID NO: 977800 - RNA, 20 nt, Human
ggccuggaaguuggcccugu

SEQ ID NO: 977801 - RNA, 24 nt, Human
ggcggagggagggagggagaagga

SEQ ID NO: 977802 - RNA, 24 nt, Human
ggcuggucucgaacuccugaccuc

SEQ ID NO: 977803 - RNA, 24 nt, Human
ggcuggucuugaacuccugaccuc

SEQ ID NO: 977804 - RNA, 27 nt, Human
gggaaaaaaggaaaaagcaaaccaaaa

SEQ ID NO: 977805 - RNA, 22 nt, Human
gggaggcagaaggaggaacgag

SEQ ID NO: 977806 - RNA, 24 nt, Human
gggagguugagcgggggaggauca

SEQ ID NO: 977807 - RNA, 21 nt, Human
gggauuggucuucacccccuu

SEQ ID NO: 977808 - RNA, 24 nt, Human
gggcacaguggcucacaccuguaa

SEQ ID NO: 977809 - RNA, 22 nt, Human
gggcagccagagcccccuagaa

SEQ ID NO: 977810 - RNA, 22 nt, Human
gggcccccucaucugaggaaaa

SEQ ID NO: 977811 - RNA, 19 nt, Human
gggcugagggcaugguggg

SEQ ID NO: 977812 - RNA, 24 nt, Human
ggggguagggagugggcagacuag

SEQ ID NO: 977813 - RNA, 21 nt, Human
gggguuuaccauauuggccag

SEQ ID NO: 977814 - RNA, 23 nt, Human
gggguuucacuauguuggccagg

SEQ ID NO: 977815 - RNA, 18 nt, Human
ggguagcucuucugacuc

SEQ ID NO: 977816 - RNA, 20 nt, Human
gggucacaagcaucgcccca

SEQ ID NO: 977817 - RNA, 24 nt, Human
gggugugugugugugugugugugg

SEQ ID NO: 977818 - RNA, 22 nt, Human
ggguucaagugauucuucugcc

SEQ ID NO: 977819 - RNA, 23 nt, Human
ggguucaagugauucuucugccu

SEQ ID NO: 977820 - RNA, 21 nt, Human
ggguuuaccauauuggccagg

SEQ ID NO: 977821 - RNA, 19 nt, Human
ggucucgaacuccugaccu

SEQ ID NO: 977822 - RNA, 19 nt, Human
ggucuugaacuccugaccu

SEQ ID NO: 977823 - RNA, 21 nt, Human
ggugugugugugugugugugu

SEQ ID NO: 977824 - RNA, 18 nt, Human
guagggaacagaaaccaa

SEQ ID NO: 977825 - RNA, 19 nt, Human
guccuuccagcuucuccua

SEQ ID NO: 977826 - RNA, 18 nt, Human
gugagcagcagaaucaga

SEQ ID NO: 977827 - RNA, 24 nt, Human
gugauccacccaccuuggccuccc

SEQ ID NO: 977828 - RNA, 24 nt, Human
gugauccaccugccucagccuccc

SEQ ID NO: 977829 - RNA, 24 nt, Human
gugauucuucugccucagccuccc

SEQ ID NO: 977830 - RNA, 23 nt, Human
gugcaguggcgcaaucaaaguau

SEQ ID NO: 977831 - RNA, 32 nt, Human
gugggguagggguguguguguguguguguggu

SEQ ID NO: 977832 - RNA, 21 nt, Human
gugugugugugugugugugag

SEQ ID NO: 977833 - RNA, 20 nt, Human
gugugugugugugugugugu

SEQ ID NO: 977834 - RNA, 21 nt, Human
gugugugugugugugugugug

SEQ ID NO: 977835 - RNA, 21 nt, Human
gugugugugugugugugugug

SEQ ID NO: 977836 - RNA, 21 nt, Human
guucgagauucuccugccuca

SEQ ID NO: 977837 - RNA, 21 nt, Human
uaaaagaaggccagccccagc

SEQ ID NO: 977838 - RNA, 23 nt, Human
uaaaaugaaagcagaacugcuua

SEQ ID NO: 977839 - RNA, 22 nt, Human
uaaagacgggguuucacuaugu

SEQ ID NO: 977840 - RNA, 21 nt, Human
uaacacgggcagccagagccc

SEQ ID NO: 977841 - RNA, 24 nt, Human
uaacacgggcagccagagcccccu

SEQ ID NO: 977842 - RNA, 20 nt, Human
uaagaaauuuggccaaaguc

SEQ ID NO: 977843 - RNA, 23 nt, Human
uaagauuacaggcgugagcacca

SEQ ID NO: 977844 - RNA, 24 nt, Human
uaagauuacaggcgugagcaccau

SEQ ID NO: 977845 - RNA, 19 nt, Human
uaagugaaccagacacaca

SEQ ID NO: 977846 - RNA, 18 nt, Human
uacacaaaaagucagggu

SEQ ID NO: 977847 - RNA, 20 nt, Human
uaccaaaggaccaaaggaag

SEQ ID NO: 977848 - RNA, 18 nt, Human
uaccacacaaagcaagaa

SEQ ID NO: 977849 - RNA, 18 nt, Human
uaccacacaaagcaagaa

SEQ ID NO: 977850 - RNA, 22 nt, Human
uaccacacaaagcaagaacccc

SEQ ID NO: 977851 - RNA, 21 nt, Human
uaccauauuggccaggcuggu

SEQ ID NO: 977852 - RNA, 24 nt, Human
uaccauauuggccaggcuggucuu

SEQ ID NO: 977853 - RNA, 27 nt, Human
uaccauauuggccaggcuggucuugaa

SEQ ID NO: 977854 - RNA, 22 nt, Human
uacccugguacucaguuaacaa

SEQ ID NO: 977855 - RNA, 23 nt, Human
uaccuaugguuacaaucaacuua

SEQ ID NO: 977856 - RNA, 19 nt, Human
uagagaugggguuuaccau

SEQ ID NO: 977857 - RNA, 24 nt, Human
uaguaaagacgggguuucacuaug

SEQ ID NO: 977858 - RNA, 22 nt, Human
uaguagagaugggguuuaccau

SEQ ID NO: 977859 - RNA, 22 nt, Human
uaguagagaugggguuuaccau

SEQ ID NO: 977860 - RNA, 23 nt, Human
uaguagagaugggguuuaccaua

SEQ ID NO: 977861 - RNA, 18 nt, Human
uaugacagugagcagcag

SEQ ID NO: 977862 - RNA, 21 nt, Human
uaugacccucccuuccuccaa

SEQ ID NO: 977863 - RNA, 18 nt, Human
uauguacacaaaaaguca

SEQ ID NO: 977864 - RNA, 24 nt, Human
uauguuggccaggcuggucucgaa

SEQ ID NO: 977865 - RNA, 19 nt, Human
uauuuuguaguuuaguaga

SEQ ID NO: 977866 - RNA, 21 nt, Human
uauuuuguaguuuaguagaga

SEQ ID NO: 977867 - RNA, 21 nt, Human
uauuuuguaguuuaguagaga

SEQ ID NO: 977868 - RNA, 23 nt, Human
ucaagaacauccauacauccggc

SEQ ID NO: 977869 - RNA, 21 nt, Human
ucaagcagguugaaagcaaac

SEQ ID NO: 977870 - RNA, 19 nt, Human
ucaagugauucuucugccu

SEQ ID NO: 977871 - RNA, 22 nt, Human
ucaccaaagugcaacuugccac

SEQ ID NO: 977872 - RNA, 18 nt, Human
ucacccaggcuggagugc

SEQ ID NO: 977873 - RNA, 24 nt, Human
ucacccaggcuggaguguaguggc

SEQ ID NO: 977874 - RNA, 25 nt, Human
ucacccccuuccugcucaggaaagc

SEQ ID NO: 977875 - RNA, 22 nt, Human
ucacuauguuggccaggcuggu

SEQ ID NO: 977876 - RNA, 24 nt, Human
ucacucugucacccaggcuggagu

SEQ ID NO: 977877 - RNA, 23 nt, Human
ucacuguaaccuccaccucccgg

SEQ ID NO: 977878 - RNA, 24 nt, Human
ucacuguaaccuccaccucccggg

SEQ ID NO: 977879 - RNA, 25 nt, Human
ucacuguaaccuccaccucccgggu

SEQ ID NO: 977880 - RNA, 21 nt, Human
ucagaagagaagaaacccaaa

SEQ ID NO: 977881 - RNA, 24 nt, Human
ucagagccccaagguccccacccc

SEQ ID NO: 977882 - RNA, 20 nt, Human
ucagccucaggaggcuaaaa

SEQ ID NO: 977883 - RNA, 20 nt, Human
ucagccucccaaguagcugg

SEQ ID NO: 977884 - RNA, 23 nt, Human
ucagccucccgaguagcugggac

SEQ ID NO: 977885 - RNA, 23 nt, Human
ucaguuaacaauuccucccaggc

SEQ ID NO: 977886 - RNA, 19 nt, Human
uccaagcucuuccgacucc

SEQ ID NO: 977887 - RNA, 24 nt, Human
ucccaaagugcuaagauuacaggc

SEQ ID NO: 977888 - RNA, 24 nt, Human
ucccaaguagcugggacuacaggc

SEQ ID NO: 977889 - RNA, 23 nt, Human
uccccccaaaccacacccugccc

SEQ ID NO: 977890 - RNA, 22 nt, Human
uccccuacccucuccccagcuc

SEQ ID NO: 977891 - RNA, 25 nt, Human
uccccuacccucuccccagcucuuc

SEQ ID NO: 977892 - RNA, 24 nt, Human
ucccgaguagcugggacuacaggc

SEQ ID NO: 977893 - RNA, 18 nt, Human
ucccggaggcaccucugu

SEQ ID NO: 977894 - RNA, 20 nt, Human
ucccggguucaagugauucu

SEQ ID NO: 977895 - RNA, 24 nt, Human
ucccggguucaagugauucuucug

SEQ ID NO: 977896 - RNA, 22 nt, Human
ucccugcgcuccacagcgccag

SEQ ID NO: 977897 - RNA, 22 nt, Human
uccuaaauccauccuguggcuc

SEQ ID NO: 977898 - RNA, 23 nt, Human
uccucuuguugauagggagggaa

SEQ ID NO: 977899 - RNA, 22 nt, Human
uccugaauccucaugguggccc

SEQ ID NO: 977900 - RNA, 19 nt, Human
uccuggaucccaggugccc

SEQ ID NO: 977901 - RNA, 22 nt, Human
uccuggguucgagauucuccug

SEQ ID NO: 977902 - RNA, 18 nt, Human
ucgccaaggcuggagugc

SEQ ID NO: 977903 - RNA, 20 nt, Human
ucgggccugcuggucuuggc

SEQ ID NO: 977904 - RNA, 21 nt, Human
ucuagcugggccucacucgag

SEQ ID NO: 977905 - RNA, 23 nt, Human
ucucacucugucacccaggcugg

SEQ ID NO: 977906 - RNA, 24 nt, Human
ucucacucugucacccaggcugga

SEQ ID NO: 977907 - RNA, 26 nt, Human
ucucacucugucacccaggcuggagu

SEQ ID NO: 977908 - RNA, 27 nt, Human
ucucacucugucacccaggcuggagug

SEQ ID NO: 977909 - RNA, 24 nt, Human
ucuccagucccuucaguacacuuc

SEQ ID NO: 977910 - RNA, 26 nt, Human
ucuccugccucagccucccaaguagc

SEQ ID NO: 977911 - RNA, 19 nt, Human
ucucgaacuccugaccucg

SEQ ID NO: 977912 - RNA, 23 nt, Human
ucucuggggaccagcucaggcuc

SEQ ID NO: 977913 - RNA, 19 nt, Human
ucugagugcugggucccuc

SEQ ID NO: 977914 - RNA, 24 nt, Human
ucugagugcugggucccucagugg

SEQ ID NO: 977915 - RNA, 24 nt, Human
ucugccaaugggaggugcugccuc

SEQ ID NO: 977916 - RNA, 24 nt, Human
ucugucacccaggcuggagugcaa

SEQ ID NO: 977917 - RNA, 24 nt, Human
ucugucacccaggcuggaguguag

SEQ ID NO: 977918 - RNA, 23 nt, Human
ucugugacucaguaagaaccgaa

SEQ ID NO: 977919 - RNA, 19 nt, Human
ucuguucucaguggcuccc

SEQ ID NO: 977920 - RNA, 20 nt, Human
ucuguuuuguuuuuuuuuug

SEQ ID NO: 977921 - RNA, 21 nt, Human
ucuuaaaaguaggcaagcgug

SEQ ID NO: 977922 - RNA, 19 nt, Human
ucuugaacuccugaccucg

SEQ ID NO: 977923 - RNA, 23 nt, Human
ucuugcucugucacccaggcugg

SEQ ID NO: 977924 - RNA, 24 nt, Human
ucuugcucugucacccaggcugga

SEQ ID NO: 977925 - RNA, 24 nt, Human
ucuuggacaagucauuaucuagcu

SEQ ID NO: 977926 - RNA, 19 nt, Human
ugaaaaaaagccccaaagu

SEQ ID NO: 977927 - RNA, 25 nt, Human
ugaaaaagaaaaauuuccccccaaa

SEQ ID NO: 977928 - RNA, 27 nt, Human
ugaaaaagaaaaauuuccccccaaacc

SEQ ID NO: 977929 - RNA, 24 nt, Human
ugaaauagaaauauuuaauugccc

SEQ ID NO: 977930 - RNA, 23 nt, Human
ugaaaucagcccuuccugggggu

SEQ ID NO: 977931 - RNA, 19 nt, Human
ugaaauguucaagaacauc

SEQ ID NO: 977932 - RNA, 19 nt, Human
ugaaccagaaggcuaguga

SEQ ID NO: 977933 - RNA, 18 nt, Human
ugaagaaagggagccaca

SEQ ID NO: 977934 - RNA, 20 nt, Human
ugaauccucaugguggcccc

SEQ ID NO: 977935 - RNA, 22 nt, Human
ugaaugccugugucucugggga

SEQ ID NO: 977936 - RNA, 18 nt, Human
ugacagugagcagcagaa

SEQ ID NO: 977937 - RNA, 24 nt, Human
ugacuguaaccuccgccuccuggg

SEQ ID NO: 977938 - RNA, 25 nt, Human
ugacuucaggcuccagccauuuccu

SEQ ID NO: 977939 - RNA, 22 nt, Human
ugagaacagcagcagcgugaag

SEQ ID NO: 977940 - RNA, 24 nt, Human
ugagaacagcagcagcgugaaggc

SEQ ID NO: 977941 - RNA, 22 nt, Human
ugagacggaaucuugcucuguc

SEQ ID NO: 977942 - RNA, 22 nt, Human
ugagacggagucucacucuguc

SEQ ID NO: 977943 - RNA, 23 nt, Human
ugaggaaccagcguggccacagc

SEQ ID NO: 977944 - RNA, 20 nt, Human
ugagggggaaaugaaguugg

SEQ ID NO: 977945 - RNA, 23 nt, Human
ugaguccuuuagcaccuugagag

SEQ ID NO: 977946 - RNA, 19 nt, Human
ugauagggagggaaauugu

SEQ ID NO: 977947 - RNA, 24 nt, Human
ugauccacccaccuuggccuccca

SEQ ID NO: 977948 - RNA, 21 nt, Human
ugcagaugcaauauuucacau

SEQ ID NO: 977949 - RNA, 22 nt, Human
ugcagccacccuccaccucccc

SEQ ID NO: 977950 - RNA, 23 nt, Human
ugcagucuucuuagaugucagaa

SEQ ID NO: 977951 - RNA, 23 nt, Human
ugcaugcaacaaguaccuaccca

SEQ ID NO: 977952 - RNA, 24 nt, Human
ugccaaugggaggugcugccucuc

SEQ ID NO: 977953 - RNA, 18 nt, Human
ugccaggaaauagggucu

SEQ ID NO: 977954 - RNA, 20 nt, Human
ugccaggaaauagggucucu

SEQ ID NO: 977955 - RNA, 23 nt, Human
ugccaggaaauagggucucuguc

SEQ ID NO: 977956 - RNA, 23 nt, Human
ugcccuagugaaucguacagugu

SEQ ID NO: 977957 - RNA, 19 nt, Human
ugcccugggggucacgucc

SEQ ID NO: 977958 - RNA, 24 nt, Human
ugccucagccucccaaagugcuaa

SEQ ID NO: 977959 - RNA, 24 nt, Human
ugccucagccucccaaguagcugg

SEQ ID NO: 977960 - RNA, 24 nt, Human
ugccucagccucccgaguagcugg

SEQ ID NO: 977961 - RNA, 24 nt, Human
ugccucaugcacuuccaguuucac

SEQ ID NO: 977962 - RNA, 23 nt, Human
ugcuaagauuacaggcgugagca

SEQ ID NO: 977963 - RNA, 24 nt, Human
ugcucugucacccaggcuggagug

SEQ ID NO: 977964 - RNA, 23 nt, Human
ugcugcccacgcccgccagacac

SEQ ID NO: 977965 - RNA, 21 nt, Human
ugcugggucccucaguggcuc

SEQ ID NO: 977966 - RNA, 19 nt, Human
uggaaaugggcuacaguga

SEQ ID NO: 977967 - RNA, 26 nt, Human
uggaagggagaagugcacugagcagu

SEQ ID NO: 977968 - RNA, 18 nt, Human
uggacucuuagagagcac

SEQ ID NO: 977969 - RNA, 26 nt, Human
uggagugaccauuaaaaaaaaaaaaa

SEQ ID NO: 977970 - RNA, 18 nt, Human
uggagugcaauggugcgg

SEQ ID NO: 977971 - RNA, 20 nt, Human
uggagugcaauggugcgguc

SEQ ID NO: 977972 - RNA, 23 nt, Human
uggagugcaauggugcggucuca

SEQ ID NO: 977973 - RNA, 24 nt, Human
uggagugcaauggugcggucucag

SEQ ID NO: 977974 - RNA, 18 nt, Human
uggagugcaguggcgcaa

SEQ ID NO: 977975 - RNA, 19 nt, Human
uggagugcaguggcgcaau

SEQ ID NO: 977976 - RNA, 21 nt, Human
uggagugcaguggcgcaauca

SEQ ID NO: 977977 - RNA, 20 nt, Human
uggcaaaguagggaacagaa

SEQ ID NO: 977978 - RNA, 23 nt, Human
uggcaucaguagccucccuuaca

SEQ ID NO: 977979 - RNA, 24 nt, Human
uggccaggcuggucucgaacuccu

SEQ ID NO: 977980 - RNA, 24 nt, Human
uggccaggcuggucuugaacuccu

SEQ ID NO: 977981 - RNA, 24 nt, Human
uggcgcgaucuuggcucacuguaa

SEQ ID NO: 977982 - RNA, 21 nt, Human
uggcucacaccuguaauccca

SEQ ID NO: 977983 - RNA, 21 nt, Human
uggcugcuuugcagaugacgc

SEQ ID NO: 977984 - RNA, 19 nt, Human
ugggaaaaguucugaggcc

SEQ ID NO: 977985 - RNA, 19 nt, Human
ugggacuacaggcacccac

SEQ ID NO: 977986 - RNA, 21 nt, Human
ugggacuacaggcacccacca

SEQ ID NO: 977987 - RNA, 24 nt, Human
ugggacuacaggcacccaccacca

SEQ ID NO: 977988 - RNA, 18 nt, Human
ugggacuacaggcgugcg

SEQ ID NO: 977989 - RNA, 21 nt, Human
ugggacuacaggcgugcgcca

SEQ ID NO: 977990 - RNA, 22 nt, Human
ugggacuacaggcgugcgccac

SEQ ID NO: 977991 - RNA, 24 nt, Human
ugggacuacaggcgugcgccacca

SEQ ID NO: 977992 - RNA, 25 nt, Human
ugggacuacaggcgugcgccaccau

SEQ ID NO: 977993 - RNA, 18 nt, Human
ugggagaaccaaggaugg

SEQ ID NO: 977994 - RNA, 22 nt, Human
ugggagggcuuugcuacccaag

SEQ ID NO: 977995 - RNA, 20 nt, Human
uggggaccagcucaggcucu

SEQ ID NO: 977996 - RNA, 23 nt, Human
uggggaggaaggaccagauacac

SEQ ID NO: 977997 - RNA, 19 nt, Human
ugggggucacguccugaau

SEQ ID NO: 977998 - RNA, 24 nt, Human
ugggguaggggugugugugugugu

SEQ ID NO: 977999 - RNA, 23 nt, Human
ugggguggaaaugggcuacagug

SEQ ID NO: 978000 - RNA, 18 nt, Human
ugggguggagugagaugg

SEQ ID NO: 978001 - RNA, 18 nt, Human
ugggguggagugagaugg

SEQ ID NO: 978002 - RNA, 23 nt, Human
ugggguuuaccauauuggccagg

SEQ ID NO: 978003 - RNA, 23 nt, Human
uggucgccaaggcuggagugcag

SEQ ID NO: 978004 - RNA, 18 nt, Human
uguacucgcagacgccgg

SEQ ID NO: 978005 - RNA, 20 nt, Human
uguacucgcagacgccgguc

SEQ ID NO: 978006 - RNA, 19 nt, Human
uguauacacagcuuaugua

SEQ ID NO: 978007 - RNA, 21 nt, Human
uguauuuuuaguaaagacggg

SEQ ID NO: 978008 - RNA, 20 nt, Human
ugucacccaggcuggagugc

SEQ ID NO: 978009 - RNA, 22 nt, Human
ugucagaagagaaccagguuuc

SEQ ID NO: 978010 - RNA, 26 nt, Human
ugucauugccuuaguuuauuuuuucu

SEQ ID NO: 978011 - RNA, 20 nt, Human
ugucccugccagccccagcc

SEQ ID NO: 978012 - RNA, 25 nt, Human
ugucccugccagccccagcuugcau

SEQ ID NO: 978013 - RNA, 18 nt, Human
uguggugggguggaaaug

SEQ ID NO: 978014 - RNA, 19 nt, Human
uguguauacacagcuuaug

SEQ ID NO: 978015 - RNA, 21 nt, Human
uguguauacacagcuuaugua

SEQ ID NO: 978016 - RNA, 23 nt, Human
uguguguauacacagcuuaugua

SEQ ID NO: 978017 - RNA, 18 nt, Human
uguguguguguauacaca

SEQ ID NO: 978018 - RNA, 18 nt, Human
uguguguguguguguaua

SEQ ID NO: 978019 - RNA, 19 nt, Human
uguguguguguguguauac

SEQ ID NO: 978020 - RNA, 22 nt, Human
uguguguguguguguauacaca

SEQ ID NO: 978021 - RNA, 18 nt, Human
ugugugugugugugugug

SEQ ID NO: 978022 - RNA, 18 nt, Human
ugugugugugugugugug

SEQ ID NO: 978023 - RNA, 18 nt, Human
ugugugugugugugugug

SEQ ID NO: 978024 - RNA, 18 nt, Human
ugugugugugugugugug

SEQ ID NO: 978025 - RNA, 18 nt, Human
ugugugugugugugugug

SEQ ID NO: 978026 - RNA, 18 nt, Human
ugugugugugugugugug

SEQ ID NO: 978027 - RNA, 18 nt, Human
ugugugugugugugugug

SEQ ID NO: 978028 - RNA, 18 nt, Human
ugugugugugugugugug

SEQ ID NO: 978029 - RNA, 18 nt, Human
ugugugugugugugugug

SEQ ID NO: 978030 - RNA, 18 nt, Human
ugugugugugugugugug

SEQ ID NO: 978031 - RNA, 18 nt, Human
ugugugugugugugugug

SEQ ID NO: 978032 - RNA, 22 nt, Human
uguguguguguguguguguaua

SEQ ID NO: 978033 - RNA, 21 nt, Human
ugugugugugugugugugugu

SEQ ID NO: 978034 - RNA, 21 nt, Human
ugugugugugugugugugugu

SEQ ID NO: 978035 - RNA, 21 nt, Human
ugugugugugugugugugugu

SEQ ID NO: 978036 - RNA, 21 nt, Human
ugugugugugugugugugugu

SEQ ID NO: 978037 - RNA, 21 nt, Human
ugugugugugugugugugugu

SEQ ID NO: 978038 - RNA, 21 nt, Human
ugugugugugugugugugugu

SEQ ID NO: 978039 - RNA, 21 nt, Human
ugugugugugugugugugugu

SEQ ID NO: 978040 - RNA, 21 nt, Human
ugugugugugugugugugugu

SEQ ID NO: 978041 - RNA, 21 nt, Human
ugugugugugugugugugugu

SEQ ID NO: 978042 - RNA, 21 nt, Human
ugugugugugugugugugugu

SEQ ID NO: 978043 - RNA, 21 nt, Human
ugugugugugugugugugugu

SEQ ID NO: 978044 - RNA, 21 nt, Human
ugugugugugugugugugugu

SEQ ID NO: 978045 - RNA, 21 nt, Human
ugugugugugugugugugugu

SEQ ID NO: 978046 - RNA, 21 nt, Human
ugugugugugugugugugugu

SEQ ID NO: 978047 - RNA, 21 nt, Human
ugugugugugugugugugugu

SEQ ID NO: 978048 - RNA, 21 nt, Human
ugugugugugugugugugugu

SEQ ID NO: 978049 - RNA, 21 nt, Human
ugugugugugugugugugugu

SEQ ID NO: 978050 - RNA, 21 nt, Human
ugugugugugugugugugugu

SEQ ID NO: 978051 - RNA, 21 nt, Human
ugugugugugugugugugugu

SEQ ID NO: 978052 - RNA, 22 nt, Human
ugugugugugugugugugugua

SEQ ID NO: 978053 - RNA, 22 nt, Human
ugugugugugugugugugugug

SEQ ID NO: 978054 - RNA, 22 nt, Human
ugugugugugugugugugugug

SEQ ID NO: 978055 - RNA, 22 nt, Human
ugugugugugugugugugugug

SEQ ID NO: 978056 - RNA, 22 nt, Human
ugugugugugugugugugugug

SEQ ID NO: 978057 - RNA, 22 nt, Human
ugugugugugugugugugugug

SEQ ID NO: 978058 - RNA, 22 nt, Human
ugugugugugugugugugugug

SEQ ID NO: 978059 - RNA, 22 nt, Human
ugugugugugugugugugugug

SEQ ID NO: 978060 - RNA, 24 nt, Human
uuaaaaaaaaaaaaaaaaucaaaa

SEQ ID NO: 978061 - RNA, 21 nt, Human
uuacauuaaagauacagacac

SEQ ID NO: 978062 - RNA, 21 nt, Human
uuaguaaagacgggguuucac

SEQ ID NO: 978063 - RNA, 24 nt, Human
uuaguaaagacgggguuucacuau

SEQ ID NO: 978064 - RNA, 18 nt, Human
uuaguagagaugggguuu

SEQ ID NO: 978065 - RNA, 23 nt, Human
uuaguagagaugggguuuaccau

SEQ ID NO: 978066 - RNA, 22 nt, Human
uucaaaaggccaauaaaauaaa

SEQ ID NO: 978067 - RNA, 21 nt, Human
uucaaaauaaauauucuauac

SEQ ID NO: 978068 - RNA, 23 nt, Human
uucaagugauucuucugccucag

SEQ ID NO: 978069 - RNA, 24 nt, Human
uucaagugauucuucugccucagc

SEQ ID NO: 978070 - RNA, 21 nt, Human
uucacaaacagaagaacucuu

SEQ ID NO: 978071 - RNA, 23 nt, Human
uucacacaaaccaacggauaggu

SEQ ID NO: 978072 - RNA, 29 nt, Human
uucaggacccugaaaaaaagccccaaagg

SEQ ID NO: 978073 - RNA, 22 nt, Human
uuccucggauggcaucaguagc

SEQ ID NO: 978074 - RNA, 20 nt, Human
uuccuuuucuucuugguuuu

SEQ ID NO: 978075 - RNA, 18 nt, Human
uucuacaccuuccccaag

SEQ ID NO: 978076 - RNA, 18 nt, Human
uugaaagcaaaccaagaa

SEQ ID NO: 978077 - RNA, 24 nt, Human
uugcucugucacccaggcuggagu

SEQ ID NO: 978078 - RNA, 21 nt, Human
uuggacaagucauuaucuagc

SEQ ID NO: 978079 - RNA, 26 nt, Human
uuggcccugucccugccagccccagc

SEQ ID NO: 978080 - RNA, 23 nt, Human
uuguauuuuuaguaaagacgggg

SEQ ID NO: 978081 - RNA, 21 nt, Human
uugugcccaucuuuucucugg

SEQ ID NO: 978082 - RNA, 24 nt, Human
uuuaguagagaugggguuuaccau

SEQ ID NO: 978083 - RNA, 24 nt, Human
uuucacuauguuggccaggcuggu

SEQ ID NO: 978084 - RNA, 22 nt, Human
uuucagaaccacugaagcuccu

SEQ ID NO: 978085 - RNA, 20 nt, Human
uuuguaacaugaaaccaagc

SEQ ID NO: 978086 - RNA, 22 nt, Human
uuuguaacaugaaaccaagcug

SEQ ID NO: 978087 - RNA, 18 nt, Human
uuugugcauugccaccug

SEQ ID NO: 978088 - RNA, 19 nt, Human
uuuuguaguuuaguagaga

SEQ ID NO: 978089 - RNA, 21 nt, Human
uuuuguauuuuuaguaaagac

SEQ ID NO: 978090 - RNA, 24 nt, Human
uuuuuaguaaagacgggguuucac

SEQ ID NO: 978091 - RNA, 19 nt, Human
aacaaaaccaaacagcuau

SEQ ID NO: 978092 - RNA, 19 nt, Human
aagcugccucaagauuagg

SEQ ID NO: 978093 - RNA, 19 nt, Human
aauucucaacucagaagcu

SEQ ID NO: 978094 - RNA, 25 nt, Human
auuuuuguuguuuauagucuuuaau

SEQ ID NO: 978095 - RNA, 23 nt, Human
caaaccgaccuaaggucaccccg

SEQ ID NO: 978096 - RNA, 20 nt, Human
caacucagaagcugccucaa

SEQ ID NO: 978097 - RNA, 23 nt, Human
cacagcucagccccuccccuccc

SEQ ID NO: 978098 - RNA, 24 nt, Human
cacagcucagccccuccccucccu

SEQ ID NO: 978099 - RNA, 18 nt, Human
ccccgcucuccucacagc

SEQ ID NO: 978100 - RNA, 21 nt, Human
ccggcucgcuuuggccccucc

SEQ ID NO: 978101 - RNA, 20 nt, Human
cgggcggcggcggggcccgg

SEQ ID NO: 978102 - RNA, 20 nt, Human
cucagccccuccccucccuc

SEQ ID NO: 978103 - RNA, 26 nt, Human
cucccacaaugcaccgggcgcggccg

SEQ ID NO: 978104 - RNA, 19 nt, Human
cuucaguuaauguaacagg

SEQ ID NO: 978105 - RNA, 18 nt, Human
gccugcgggagccggccg

SEQ ID NO: 978106 - RNA, 20 nt, Human
gcgccuggggccgggggcuc

SEQ ID NO: 978107 - RNA, 19 nt, Human
gcggggcccgggcgccugg

SEQ ID NO: 978108 - RNA, 21 nt, Human
ggcccgggcgccuggggccgg

SEQ ID NO: 978109 - RNA, 18 nt, Human
ggccgcgggccucccaca

SEQ ID NO: 978110 - RNA, 21 nt, Human
ggccgggggcucgccugccuc

SEQ ID NO: 978111 - RNA, 23 nt, Human
gggaaauagaucuauuuaaaaac

SEQ ID NO: 978112 - RNA, 18 nt, Human
guaacaggaaaaaaaggc

SEQ ID NO: 978113 - RNA, 18 nt, Human
uaaaaugccgcgccgcgc

SEQ ID NO: 978114 - RNA, 24 nt, Human
uaaaaugccgcgccgcgcgcgggc

SEQ ID NO: 978115 - RNA, 22 nt, Human
uaacaggaaaaaaaggcaaugg

SEQ ID NO: 978116 - RNA, 23 nt, Human
uaacaggaaaaaaaggcaaugga

SEQ ID NO: 978117 - RNA, 23 nt, Human
uacaaaccgaccuaaggucaccc

SEQ ID NO: 978118 - RNA, 19 nt, Human
uggccccuccgccuuccuc

SEQ ID NO: 978119 - RNA, 19 nt, Human
uguaacaggaaaaaaaggc

SEQ ID NO: 978120 - RNA, 24 nt, Human
uguagacacaaugagauuuuuguu

SEQ ID NO: 978121 - RNA, 18 nt, Human
uucuugggccccgcucuc

SEQ ID NO: 978122 - RNA, 22 nt, Human
uuuggccccuccgccuuccucc

SEQ ID NO: 978123 - RNA, 20 nt, Human
aaaauaaaaagacuagcagg

SEQ ID NO: 978124 - RNA, 23 nt, Human
aaaauggugauuuucagauuugu

SEQ ID NO: 978125 - RNA, 19 nt, Human
aaagugcuaggauuacagg

SEQ ID NO: 978126 - RNA, 24 nt, Human
aaagugcuaggauuacagguguga

SEQ ID NO: 978127 - RNA, 22 nt, Human
aacauuuuuuucuuagaugggg

SEQ ID NO: 978128 - RNA, 21 nt, Human
aaccagaauuugcgcacaucc

SEQ ID NO: 978129 - RNA, 22 nt, Human
aacccuacaaauccuugcaaaa

SEQ ID NO: 978130 - RNA, 19 nt, Human
aaccgccacugcugcuugg

SEQ ID NO: 978131 - RNA, 22 nt, Human
aagaaaauggaauaagaccaaa

SEQ ID NO: 978132 - RNA, 26 nt, Human
aagcaaaaaguugaaaaaggggaccc

SEQ ID NO: 978133 - RNA, 22 nt, Human
aagcaaagugagucaccuucgu

SEQ ID NO: 978134 - RNA, 24 nt, Human
aagcaaucugccugcuucagccuc

SEQ ID NO: 978135 - RNA, 20 nt, Human
aaguagcugggauugcaggc

SEQ ID NO: 978136 - RNA, 19 nt, Human
aaguaggugggauuauagg

SEQ ID NO: 978137 - RNA, 23 nt, Human
aagugcuuuaaaaaggggguggg

SEQ ID NO: 978138 - RNA, 19 nt, Human
aaguguugggauuacaggu

SEQ ID NO: 978139 - RNA, 19 nt, Human
aaucauggcucacugcagc

SEQ ID NO: 978140 - RNA, 19 nt, Human
aaucuucaugaauguggac

SEQ ID NO: 978141 - RNA, 20 nt, Human
aauuccugugccucagccuc

SEQ ID NO: 978142 - RNA, 22 nt, Human
acaaacauaucacagcugauga

SEQ ID NO: 978143 - RNA, 22 nt, Human
acagaagugugguuccuggaac

SEQ ID NO: 978144 - RNA, 24 nt, Human
accacaaccuccuucuuacuuuaa

SEQ ID NO: 978145 - RNA, 27 nt, Human
accacaaccuccuucuuacuuuaaccu

SEQ ID NO: 978146 - RNA, 22 nt, Human
accaggcgcaaggcaggcucug

SEQ ID NO: 978147 - RNA, 24 nt, Human
accauguuggccaggcuggucuug

SEQ ID NO: 978148 - RNA, 22 nt, Human
acccaggcuggagugcaggggu

SEQ ID NO: 978149 - RNA, 20 nt, Human
accccacccaccuccccgaa

SEQ ID NO: 978150 - RNA, 19 nt, Human
acccuagccccagaugcca

SEQ ID NO: 978151 - RNA, 18 nt, Human
acgggguuucaccauguu

SEQ ID NO: 978152 - RNA, 23 nt, Human
acgggguuucaccauguuggcca

SEQ ID NO: 978153 - RNA, 24 nt, Human
acgggguuucaccauguuggccag

SEQ ID NO: 978154 - RNA, 18 nt, Human
acucugucacccaggcug

SEQ ID NO: 978155 - RNA, 20 nt, Human
acugcagugcaaaagcuaug

SEQ ID NO: 978156 - RNA, 27 nt, Human
agaaaaaaauaaaaaauauguagacag

SEQ ID NO: 978157 - RNA, 19 nt, Human
agaaaguacagagguccug

SEQ ID NO: 978158 - RNA, 26 nt, Human
agaagaaaauggaauaagagggaccc

SEQ ID NO: 978159 - RNA, 22 nt, Human
agaauccuguuuuaaaauccuu

SEQ ID NO: 978160 - RNA, 24 nt, Human
agacaggcagacccuagccccaga

SEQ ID NO: 978161 - RNA, 19 nt, Human
agaccaaacccuugggaga

SEQ ID NO: 978162 - RNA, 22 nt, Human
agacccuagccccagaugccag

SEQ ID NO: 978163 - RNA, 22 nt, Human
agaguuccucugagggagcacu

SEQ ID NO: 978164 - RNA, 19 nt, Human
agccaccgcacucggccug

SEQ ID NO: 978165 - RNA, 18 nt, Human
agccagggucucacucug

SEQ ID NO: 978166 - RNA, 21 nt, Human
aggcgguggcagcggcggcgg

SEQ ID NO: 978167 - RNA, 25 nt, Human
aggcuggagugcaguggugugaucu

SEQ ID NO: 978168 - RNA, 19 nt, Human
agggggugggacguguuac

SEQ ID NO: 978169 - RNA, 21 nt, Human
aggugcccgccaccacgccca

SEQ ID NO: 978170 - RNA, 19 nt, Human
aguacuuuggggguuaugg

SEQ ID NO: 978171 - RNA, 20 nt, Human
agugcaguggcacaaucucg

SEQ ID NO: 978172 - RNA, 23 nt, Human
agugcaguggugugaucuuggcu

SEQ ID NO: 978173 - RNA, 24 nt, Human
agugcaguggugugaucuuggcuc

SEQ ID NO: 978174 - RNA, 24 nt, Human
auccaggcugcggagccagggcca

SEQ ID NO: 978175 - RNA, 24 nt, Human
aucgacucagaugaucaguuuugg

SEQ ID NO: 978176 - RNA, 18 nt, Human
augagguuucgccauguu

SEQ ID NO: 978177 - RNA, 24 nt, Human
augagguuucgccauguuggccag

SEQ ID NO: 978178 - RNA, 24 nt, Human
auggcucacugcagccuugaccuc

SEQ ID NO: 978179 - RNA, 20 nt, Human
auggcuggauucuucaaaca

SEQ ID NO: 978180 - RNA, 18 nt, Human
auugcauccucugccucu

SEQ ID NO: 978181 - RNA, 24 nt, Human
auuuuaguagagaugagguuucgc

SEQ ID NO: 978182 - RNA, 25 nt, Human
caaaaagacaaacugauccugggua

SEQ ID NO: 978183 - RNA, 24 nt, Human
caaacaacaacugcccauaacccu

SEQ ID NO: 978184 - RNA, 23 nt, Human
caaaggaaggauuagaagcaguu

SEQ ID NO: 978185 - RNA, 19 nt, Human
caaaggagcuagcuuaagc

SEQ ID NO: 978186 - RNA, 22 nt, Human
caagcgauucuccugccucagc

SEQ ID NO: 978187 - RNA, 22 nt, Human
caagugagccaccugccucagc

SEQ ID NO: 978188 - RNA, 24 nt, Human
cacagcugaugacaacacacccag

SEQ ID NO: 978189 - RNA, 18 nt, Human
cacaggagauuugucucu

SEQ ID NO: 978190 - RNA, 24 nt, Human
caccaugcccggcuaauuuuugua

SEQ ID NO: 978191 - RNA, 21 nt, Human
caccauguuggccaggcuggu

SEQ ID NO: 978192 - RNA, 22 nt, Human
caccauguuggccaggcugguc

SEQ ID NO: 978193 - RNA, 24 nt, Human
caccauguuggccaggcuggucuu

SEQ ID NO: 978194 - RNA, 21 nt, Human
caccccacccaccuccccgaa

SEQ ID NO: 978195 - RNA, 24 nt, Human
caccccacccaccuccccgaaacc

SEQ ID NO: 978196 - RNA, 25 nt, Human
cacuagaaaauucagcuaggcugaa

SEQ ID NO: 978197 - RNA, 23 nt, Human
cacucugucacccaggcuggagu

SEQ ID NO: 978198 - RNA, 24 nt, Human
cacucugucacccaggcuggagug

SEQ ID NO: 978199 - RNA, 21 nt, Human
cacugcaaccuccgccuccug

SEQ ID NO: 978200 - RNA, 23 nt, Human
cacugcaaccuccgccuccuggg

SEQ ID NO: 978201 - RNA, 22 nt, Human
cacugcagccuugaccucccag

SEQ ID NO: 978202 - RNA, 18 nt, Human
cacugccacugccccugc

SEQ ID NO: 978203 - RNA, 23 nt, Human
cacugccacugccccugccccuc

SEQ ID NO: 978204 - RNA, 20 nt, Human
cagccuugaccucccaggcu

SEQ ID NO: 978205 - RNA, 24 nt, Human
cagccuugaccucccaggcucaag

SEQ ID NO: 978206 - RNA, 20 nt, Human
caggugagccacugcgccca

SEQ ID NO: 978207 - RNA, 20 nt, Human
caguacuuuggggguuaugg

SEQ ID NO: 978208 - RNA, 24 nt, Human
caucaagaauaaaagagaacuagc

SEQ ID NO: 978209 - RNA, 21 nt, Human
caugacacaaacauagagccc

SEQ ID NO: 978210 - RNA, 20 nt, Human
cauggcucacugcagccuug

SEQ ID NO: 978211 - RNA, 24 nt, Human
cauguuggccagacuguucucgaa

SEQ ID NO: 978212 - RNA, 24 nt, Human
cauguuggccaggcuggucuugaa

SEQ ID NO: 978213 - RNA, 18 nt, Human
cauuuuuuucuuagaugg

SEQ ID NO: 978214 - RNA, 21 nt, Human
ccaaagugcuaggauuacagg

SEQ ID NO: 978215 - RNA, 24 nt, Human
ccaaagugcuaggauuacaggugu

SEQ ID NO: 978216 - RNA, 21 nt, Human
ccaaaguguugggauuacagg

SEQ ID NO: 978217 - RNA, 21 nt, Human
ccaaaguguugggauuacagg

SEQ ID NO: 978218 - RNA, 22 nt, Human
ccaaaguguugggauuacaggu

SEQ ID NO: 978219 - RNA, 21 nt, Human
ccaaguaggugggauuauagg

SEQ ID NO: 978220 - RNA, 21 nt, Human
ccaaguaggugggauuauagg

SEQ ID NO: 978221 - RNA, 18 nt, Human
ccaugggcacacauuuca

SEQ ID NO: 978222 - RNA, 22 nt, Human
cccaccaggagugcacaucacu

SEQ ID NO: 978223 - RNA, 19 nt, Human
cccagaccuagccagagac

SEQ ID NO: 978224 - RNA, 22 nt, Human
cccagccaugggcacacauuuc

SEQ ID NO: 978225 - RNA, 22 nt, Human
cccaggcucaagugauucuccc

SEQ ID NO: 978226 - RNA, 24 nt, Human
ccccauucacaaccccuuugggcu

SEQ ID NO: 978227 - RNA, 21 nt, Human
cccgccaccacgcccagcuaa

SEQ ID NO: 978228 - RNA, 22 nt, Human
cccuagccccagaugccagauu

SEQ ID NO: 978229 - RNA, 24 nt, Human
cccucugucgccaaggcuggagug

SEQ ID NO: 978230 - RNA, 20 nt, Human
ccgcagaggaccggucucgg

SEQ ID NO: 978231 - RNA, 24 nt, Human
ccucccaggcucaagugauucucc

SEQ ID NO: 978232 - RNA, 19 nt, Human
ccuccgccuccuggguuca

SEQ ID NO: 978233 - RNA, 24 nt, Human
ccuccuggguucaagcgauucucc

SEQ ID NO: 978234 - RNA, 21 nt, Human
ccucugccucuuggguucaag

SEQ ID NO: 978235 - RNA, 22 nt, Human
ccucuuggguucaagcaauucc

SEQ ID NO: 978236 - RNA, 22 nt, Human
ccugaaauguaaggcuaagugu

SEQ ID NO: 978237 - RNA, 23 nt, Human
ccugaccucaagugagccaccug

SEQ ID NO: 978238 - RNA, 24 nt, Human
ccugacguagcugggauuacaggc

SEQ ID NO: 978239 - RNA, 21 nt, Human
ccuggccucaagcaaucugcc

SEQ ID NO: 978240 - RNA, 23 nt, Human
ccuggccucaagcaaucugccug

SEQ ID NO: 978241 - RNA, 23 nt, Human
ccuggguucaagcgauucuccug

SEQ ID NO: 978242 - RNA, 20 nt, Human
cgcaccccacccaccucccc

SEQ ID NO: 978243 - RNA, 21 nt, Human
cgcaccccacccaccuccccg

SEQ ID NO: 978244 - RNA, 24 nt, Human
cgccaaggcuggagugcaguggug

SEQ ID NO: 978245 - RNA, 22 nt, Human
cgccauguuggccagacuguuc

SEQ ID NO: 978246 - RNA, 24 nt, Human
cgccauguuggccagacuguucuc

SEQ ID NO: 978247 - RNA, 27 nt, Human
cgccauguuggccagacuguucucgaa

SEQ ID NO: 978248 - RNA, 24 nt, Human
cggaucacuaggaaccagaaaucc

SEQ ID NO: 978249 - RNA, 24 nt, Human
cgggguuucaccauguuggccagg

SEQ ID NO: 978250 - RNA, 24 nt, Human
cucaaguagcugggauugcaggcu

SEQ ID NO: 978251 - RNA, 24 nt, Human
cucacucugucacccaggcuggag

SEQ ID NO: 978252 - RNA, 24 nt, Human
cucacugcaaccuccgccuccugg

SEQ ID NO: 978253 - RNA, 21 nt, Human
cucacugcagccuugaccucc

SEQ ID NO: 978254 - RNA, 24 nt, Human
cucagccucucaaguagcugggau

SEQ ID NO: 978255 - RNA, 19 nt, Human
cucaucccccugguuuuca

SEQ ID NO: 978256 - RNA, 24 nt, Human
cucauugcauccucugccucuugg

SEQ ID NO: 978257 - RNA, 23 nt, Human
cuccaagucccgcuccgcacccc

SEQ ID NO: 978258 - RNA, 19 nt, Human
cucccaggcucaagugauu

SEQ ID NO: 978259 - RNA, 25 nt, Human
cucccaggcucaagugauucuccca

SEQ ID NO: 978260 - RNA, 19 nt, Human
cuccccauucacaaccccu

SEQ ID NO: 978261 - RNA, 24 nt, Human
cucccucugucgccaaggcuggag

SEQ ID NO: 978262 - RNA, 23 nt, Human
cuccuggccucaagcaaucugcc

SEQ ID NO: 978263 - RNA, 21 nt, Human
cuccuggguucaagcgauucu

SEQ ID NO: 978264 - RNA, 21 nt, Human
cugacauuugaauuugcagug

SEQ ID NO: 978265 - RNA, 24 nt, Human
cugacguagcugggauuacaggca

SEQ ID NO: 978266 - RNA, 23 nt, Human
cugcaaccuccgccuccuggguu

SEQ ID NO: 978267 - RNA, 21 nt, Human
cugccacugccccugccccuc

SEQ ID NO: 978268 - RNA, 18 nt, Human
cugccccugccccucacc

SEQ ID NO: 978269 - RNA, 23 nt, Human
cugccucagccucccaaagugcu

SEQ ID NO: 978270 - RNA, 18 nt, Human
cugcggagccagggccag

SEQ ID NO: 978271 - RNA, 18 nt, Human
cugcuucagccucccaaa

SEQ ID NO: 978272 - RNA, 24 nt, Human
cugcuucagccucccaaaguguug

SEQ ID NO: 978273 - RNA, 18 nt, Human
cuggccucaagcaaucug

SEQ ID NO: 978274 - RNA, 19 nt, Human
cugggcacugagcauccac

SEQ ID NO: 978275 - RNA, 20 nt, Human
cuucaaagcccagcaccacc

SEQ ID NO: 978276 - RNA, 23 nt, Human
cuucaugcaagccaaaauaaaaa

SEQ ID NO: 978277 - RNA, 19 nt, Human
cuugcaaaacaacaguuac

SEQ ID NO: 978278 - RNA, 18 nt, Human
cuugcuguguugcccagg

SEQ ID NO: 978279 - RNA, 24 nt, Human
gaccucaagugagccaccugccuc

SEQ ID NO: 978280 - RNA, 21 nt, Human
gacguagcugggauuacaggc

SEQ ID NO: 978281 - RNA, 23 nt, Human
gacguagcugggauuacaggcau

SEQ ID NO: 978282 - RNA, 24 nt, Human
gacuacaggcaggcaccaccaugc

SEQ ID NO: 978283 - RNA, 24 nt, Human
gagacgggguuucaccauguuggc

SEQ ID NO: 978284 - RNA, 22 nt, Human
gagaggggaauggccugugugg

SEQ ID NO: 978285 - RNA, 18 nt, Human
gagguuucgccauguugg

SEQ ID NO: 978286 - RNA, 22 nt, Human
gagguuucgccauguuggccag

SEQ ID NO: 978287 - RNA, 20 nt, Human
gagucuugaaucaggcugug

SEQ ID NO: 978288 - RNA, 18 nt, Human
gauuacaggcaugugcca

SEQ ID NO: 978289 - RNA, 24 nt, Human
gauuacaggcaugugccaccaugc

SEQ ID NO: 978290 - RNA, 20 nt, Human
gauuacaggugagccacugc

SEQ ID NO: 978291 - RNA, 18 nt, Human
gauuacaggugugagcca

SEQ ID NO: 978292 - RNA, 22 nt, Human
gauuacaggugugagccaccgc

SEQ ID NO: 978293 - RNA, 23 nt, Human
gauuacaggugugagccaccgca

SEQ ID NO: 978294 - RNA, 22 nt, Human
gcaaccuccgccuccuggguuc

SEQ ID NO: 978295 - RNA, 24 nt, Human
gcaaucugccugcuucagccuccc

SEQ ID NO: 978296 - RNA, 23 nt, Human
gccaaggcuggagugcaguggug

SEQ ID NO: 978297 - RNA, 24 nt, Human
gccaaggcuggagugcaguggugu

SEQ ID NO: 978298 - RNA, 24 nt, Human
gccauguuggccagacuguucucg

SEQ ID NO: 978299 - RNA, 22 nt, Human
gccucagccucccaaagugcua

SEQ ID NO: 978300 - RNA, 26 nt, Human
gcgguggcagcggcggcggcugcucc

SEQ ID NO: 978301 - RNA, 19 nt, Human
gcuagagugcaguggcaca

SEQ ID NO: 978302 - RNA, 21 nt, Human
gcucaagugauucucccacac

SEQ ID NO: 978303 - RNA, 21 nt, Human
gcucacugcagccuugaccuc

SEQ ID NO: 978304 - RNA, 22 nt, Human
gcucacugcagccuugaccucc

SEQ ID NO: 978305 - RNA, 20 nt, Human
gcucugucacccaggcuaga

SEQ ID NO: 978306 - RNA, 19 nt, Human
gcuggagugcaggggugca

SEQ ID NO: 978307 - RNA, 19 nt, Human
ggaaaaccacuacucucac

SEQ ID NO: 978308 - RNA, 24 nt, Human
ggauuacaggcaugugccaccaug

SEQ ID NO: 978309 - RNA, 22 nt, Human
ggauuacaggugugagccaccg

SEQ ID NO: 978310 - RNA, 23 nt, Human
ggccucagccucucaaguagcug

SEQ ID NO: 978311 - RNA, 20 nt, Human
ggccuguaacaugacuuuca

SEQ ID NO: 978312 - RNA, 18 nt, Human
ggcgguggcagcggcggc

SEQ ID NO: 978313 - RNA, 23 nt, Human
ggcgguggcagcggcggcggcug

SEQ ID NO: 978314 - RNA, 22 nt, Human
ggcuggagugcaguggugugau

SEQ ID NO: 978315 - RNA, 24 nt, Human
ggcuggucuugaauuccugaccuc

SEQ ID NO: 978316 - RNA, 18 nt, Human
gggaauggccuguguggu

SEQ ID NO: 978317 - RNA, 23 nt, Human
gggacugaaaaaaaaaaucccug

SEQ ID NO: 978318 - RNA, 20 nt, Human
gggccuucacagagggcggg

SEQ ID NO: 978319 - RNA, 18 nt, Human
gggcggggcccucuccgc

SEQ ID NO: 978320 - RNA, 24 nt, Human
gggcggggcccucuccgcagagga

SEQ ID NO: 978321 - RNA, 23 nt, Human
gggguuucaccauguuggccagg

SEQ ID NO: 978322 - RNA, 22 nt, Human
gggucuugcuguguugcccagg

SEQ ID NO: 978323 - RNA, 19 nt, Human
ggucuugaauuccugaccu

SEQ ID NO: 978324 - RNA, 21 nt, Human
ggugagauuuagcaaaggaag

SEQ ID NO: 978325 - RNA, 23 nt, Human
guagagacgggguuucaccaugu

SEQ ID NO: 978326 - RNA, 18 nt, Human
guagcugggauuacaggc

SEQ ID NO: 978327 - RNA, 19 nt, Human
guagcugggauuacaggca

SEQ ID NO: 978328 - RNA, 20 nt, Human
guagcugggauuacaggcau

SEQ ID NO: 978329 - RNA, 22 nt, Human
guagcugggauuacaggcaugu

SEQ ID NO: 978330 - RNA, 18 nt, Human
guagcugggauugcaggc

SEQ ID NO: 978331 - RNA, 24 nt, Human
gugagccaccugccucagccuccc

SEQ ID NO: 978332 - RNA, 24 nt, Human
gugccucagccuccugacguagcu

SEQ ID NO: 978333 - RNA, 19 nt, Human
guggcagcggcggcggcug

SEQ ID NO: 978334 - RNA, 18 nt, Human
uaaauaggaacaugauaa

SEQ ID NO: 978335 - RNA, 21 nt, Human
uaacucauacucaagacauua

SEQ ID NO: 978336 - RNA, 22 nt, Human
uaagauggcugcugggcacuga

SEQ ID NO: 978337 - RNA, 22 nt, Human
uaaugugcacaaacauaucaca

SEQ ID NO: 978338 - RNA, 24 nt, Human
uaauuuuuguaauuuuaguagaga

SEQ ID NO: 978339 - RNA, 24 nt, Human
uaauuuuuugucuuuuuaguagag

SEQ ID NO: 978340 - RNA, 24 nt, Human
uacaaacagaaccaaggcgucuga

SEQ ID NO: 978341 - RNA, 21 nt, Human
uacacuguuuuuccauucugu

SEQ ID NO: 978342 - RNA, 23 nt, Human
uacaggcaggcaccaccaugccc

SEQ ID NO: 978343 - RNA, 23 nt, Human
uacaggcaugugccaccaugccc

SEQ ID NO: 978344 - RNA, 22 nt, Human
uacaggugagccacugcgccca

SEQ ID NO: 978345 - RNA, 21 nt, Human
uacaggugugagccaccgcac

SEQ ID NO: 978346 - RNA, 21 nt, Human
uacaggugugagccaccgcac

SEQ ID NO: 978347 - RNA, 22 nt, Human
uacaggugugagccaccgcacu

SEQ ID NO: 978348 - RNA, 19 nt, Human
uaccuccccauucacaacc

SEQ ID NO: 978349 - RNA, 24 nt, Human
uacuuuaaccuauacaugcuaaau

SEQ ID NO: 978350 - RNA, 19 nt, Human
uagaagcaguuuuuuacua

SEQ ID NO: 978351 - RNA, 20 nt, Human
uagaagcaguuuuuuacuau

SEQ ID NO: 978352 - RNA, 22 nt, Human
uagagacgggguuucaccaugu

SEQ ID NO: 978353 - RNA, 22 nt, Human
uagagaugagguuucgccaugu

SEQ ID NO: 978354 - RNA, 22 nt, Human
uagagcuugggaagaaccagaa

SEQ ID NO: 978355 - RNA, 23 nt, Human
uagagugcaguggcacaaucucg

SEQ ID NO: 978356 - RNA, 18 nt, Human
uaggauuacaggugugag

SEQ ID NO: 978357 - RNA, 19 nt, Human
uaggauuacaggugugagc

SEQ ID NO: 978358 - RNA, 22 nt, Human
uaggauuacaggugugagccac

SEQ ID NO: 978359 - RNA, 23 nt, Human
uaggauuacaggugugagccacc

SEQ ID NO: 978360 - RNA, 24 nt, Human
uaggauuacaggugugagccaccg

SEQ ID NO: 978361 - RNA, 26 nt, Human
uagggaggagggccagguaaguaucc

SEQ ID NO: 978362 - RNA, 19 nt, Human
uaggugcccgccaccacgc

SEQ ID NO: 978363 - RNA, 24 nt, Human
uaguagagacgggguuucaccaug

SEQ ID NO: 978364 - RNA, 24 nt, Human
uaguagagaugagguuucgccaug

SEQ ID NO: 978365 - RNA, 19 nt, Human
uaucaauuuggaaaaaggg

SEQ ID NO: 978366 - RNA, 23 nt, Human
uaucacagcugaugacaacacac

SEQ ID NO: 978367 - RNA, 21 nt, Human
uaucuucaaagcccagcacca

SEQ ID NO: 978368 - RNA, 22 nt, Human
uaugguaggaaacuagaugugc

SEQ ID NO: 978369 - RNA, 21 nt, Human
ucaaacaacaacugcccauaa

SEQ ID NO: 978370 - RNA, 19 nt, Human
ucaaagcccagcaccacca

SEQ ID NO: 978371 - RNA, 19 nt, Human
ucaagcgauucuccugccu

SEQ ID NO: 978372 - RNA, 23 nt, Human
ucaagugauucucccacacaggu

SEQ ID NO: 978373 - RNA, 18 nt, Human
ucacccaggcuggagugc

SEQ ID NO: 978374 - RNA, 21 nt, Human
ucacgugagauggccacagaa

SEQ ID NO: 978375 - RNA, 24 nt, Human
ucacucugucacccaggcuggagu

SEQ ID NO: 978376 - RNA, 23 nt, Human
ucacugcaaccuccgccuccugg

SEQ ID NO: 978377 - RNA, 24 nt, Human
ucacugcaaccuccgccuccuggg

SEQ ID NO: 978378 - RNA, 25 nt, Human
ucacugcaaccuccgccuccugggu

SEQ ID NO: 978379 - RNA, 27 nt, Human
ucacugcaaccuccgccuccuggguuc

SEQ ID NO: 978380 - RNA, 19 nt, Human
ucacugcagccuugaccuc

SEQ ID NO: 978381 - RNA, 23 nt, Human
ucacugcagccuugaccucccag

SEQ ID NO: 978382 - RNA, 24 nt, Human
ucacugcagccuugaccucccagg

SEQ ID NO: 978383 - RNA, 20 nt, Human
ucaugguuaaccgguaucug

SEQ ID NO: 978384 - RNA, 24 nt, Human
ucauugcauccucugccucuuggg

SEQ ID NO: 978385 - RNA, 23 nt, Human
uccauggaagccacucauccccc

SEQ ID NO: 978386 - RNA, 23 nt, Human
ucccaaagugcuaggauuacagg

SEQ ID NO: 978387 - RNA, 23 nt, Human
ucccaaaguguugggauuacagg

SEQ ID NO: 978388 - RNA, 21 nt, Human
ucccaggcucaagugauucuc

SEQ ID NO: 978389 - RNA, 23 nt, Human
ucccaggcucaagugauucuccc

SEQ ID NO: 978390 - RNA, 21 nt, Human
uccgcaccccacccaccuccc

SEQ ID NO: 978391 - RNA, 21 nt, Human
uccuggguucaagcgauucuc

SEQ ID NO: 978392 - RNA, 24 nt, Human
uccuggguucaagcgauucuccug

SEQ ID NO: 978393 - RNA, 26 nt, Human
uccuugguucuuucauucaucuuuuu

SEQ ID NO: 978394 - RNA, 18 nt, Human
ucgccaaggcuggagugc

SEQ ID NO: 978395 - RNA, 19 nt, Human
ucgccauguuggccagacu

SEQ ID NO: 978396 - RNA, 24 nt, Human
ucucaaguagcugggauugcaggc

SEQ ID NO: 978397 - RNA, 23 nt, Human
ucucacucugucacccaggcugg

SEQ ID NO: 978398 - RNA, 24 nt, Human
ucucacucugucacccaggcugga

SEQ ID NO: 978399 - RNA, 26 nt, Human
ucucacucugucacccaggcuggagu

SEQ ID NO: 978400 - RNA, 27 nt, Human
ucucacucugucacccaggcuggagug

SEQ ID NO: 978401 - RNA, 24 nt, Human
ucucccucugucgccaaggcugga

SEQ ID NO: 978402 - RNA, 21 nt, Human
ucucgaacuccuggccucaag

SEQ ID NO: 978403 - RNA, 24 nt, Human
ucugccucuuggguucaagcaauu

SEQ ID NO: 978404 - RNA, 26 nt, Human
ucuguaggcgguggcagcggcggcgg

SEQ ID NO: 978405 - RNA, 20 nt, Human
ucuguagguucugggacuga

SEQ ID NO: 978406 - RNA, 24 nt, Human
ucugucacccaggcuagagugcag

SEQ ID NO: 978407 - RNA, 24 nt, Human
ucugucacccaggcuggagugcag

SEQ ID NO: 978408 - RNA, 24 nt, Human
ucugucgccaaggcuggagugcag

SEQ ID NO: 978409 - RNA, 18 nt, Human
ucuugcuguguugcccag

SEQ ID NO: 978410 - RNA, 19 nt, Human
ucuugcuguguugcccagg

SEQ ID NO: 978411 - RNA, 22 nt, Human
ucuuggguucaagcaauuccug

SEQ ID NO: 978412 - RNA, 23 nt, Human
ugaaaaagcaaagugagucaccu

SEQ ID NO: 978413 - RNA, 21 nt, Human
ugaaaacagucaaaauagaaa

SEQ ID NO: 978414 - RNA, 27 nt, Human
ugaagguacagaaagaaagaaaggcca

SEQ ID NO: 978415 - RNA, 19 nt, Human
ugacacaaacauagagccc

SEQ ID NO: 978416 - RNA, 24 nt, Human
ugaccucaagugagccaccugccu

SEQ ID NO: 978417 - RNA, 24 nt, Human
ugacguagcugggauuacaggcau

SEQ ID NO: 978418 - RNA, 24 nt, Human
ugacuaaacauaacucauacucaa

SEQ ID NO: 978419 - RNA, 19 nt, Human
ugagauggccacagaagug

SEQ ID NO: 978420 - RNA, 22 nt, Human
ugagauggccacagaagugugg

SEQ ID NO: 978421 - RNA, 22 nt, Human
ugaggcaaugucuuucacguga

SEQ ID NO: 978422 - RNA, 23 nt, Human
ugagguuucgccauguuggccag

SEQ ID NO: 978423 - RNA, 18 nt, Human
ugaugauaccuaggauau

SEQ ID NO: 978424 - RNA, 21 nt, Human
ugcaggcugcauccgcaccca

SEQ ID NO: 978425 - RNA, 20 nt, Human
ugcagugacuucaugcaagc

SEQ ID NO: 978426 - RNA, 20 nt, Human
ugcauccucugccucuuggg

SEQ ID NO: 978427 - RNA, 23 nt, Human
ugcccauaacccuacaaauccuu

SEQ ID NO: 978428 - RNA, 24 nt, Human
ugcccggcuaauuuuuguaauuuu

SEQ ID NO: 978429 - RNA, 20 nt, Human
ugccucagccuaccaaguag

SEQ ID NO: 978430 - RNA, 24 nt, Human
ugccucagccucccaaagugcuag

SEQ ID NO: 978431 - RNA, 25 nt, Human
ugccucagccuccugacguagcugg

SEQ ID NO: 978432 - RNA, 24 nt, Human
ugcuaggauuacaggugugagcca

SEQ ID NO: 978433 - RNA, 24 nt, Human
ugcucugucacccaggcuagagug

SEQ ID NO: 978434 - RNA, 21 nt, Human
ugcuguguugcccaggcuacg

SEQ ID NO: 978435 - RNA, 24 nt, Human
ugcuguguugcccaggcuacgcuc

SEQ ID NO: 978436 - RNA, 24 nt, Human
ugcuucagccucccaaaguguugg

SEQ ID NO: 978437 - RNA, 25 nt, Human
uggaagccacucaucccccuggucg

SEQ ID NO: 978438 - RNA, 24 nt, Human
uggaauuuuaaaaaucaagaacuu

SEQ ID NO: 978439 - RNA, 21 nt, Human
uggagugcaggggugcaauca

SEQ ID NO: 978440 - RNA, 24 nt, Human
uggagugcaggggugcaaucaugg

SEQ ID NO: 978441 - RNA, 19 nt, Human
uggagugcaguggugugau

SEQ ID NO: 978442 - RNA, 23 nt, Human
uggagugcaguggugugaucuug

SEQ ID NO: 978443 - RNA, 24 nt, Human
uggagugcaguggugugaucuugg

SEQ ID NO: 978444 - RNA, 24 nt, Human
uggcacaaucucgucucacugcaa

SEQ ID NO: 978445 - RNA, 18 nt, Human
uggcagcggcggcggcug

SEQ ID NO: 978446 - RNA, 24 nt, Human
uggccagacuguucucgaacuccu

SEQ ID NO: 978447 - RNA, 24 nt, Human
uggccaggcuggucuugaauuccu

SEQ ID NO: 978448 - RNA, 25 nt, Human
uggccucaagcaaucugccugcuuc

SEQ ID NO: 978449 - RNA, 24 nt, Human
ugggacuacaggcaggcaccacca

SEQ ID NO: 978450 - RNA, 18 nt, Human
ugggauuacaggcaugug

SEQ ID NO: 978451 - RNA, 22 nt, Human
ugggauuacaggcaugugccac

SEQ ID NO: 978452 - RNA, 24 nt, Human
ugggauuacaggcaugugccacca

SEQ ID NO: 978453 - RNA, 20 nt, Human
ugggauuacaggugagccac

SEQ ID NO: 978454 - RNA, 21 nt, Human
ugggauuacaggugagccacu

SEQ ID NO: 978455 - RNA, 22 nt, Human
ugggauuacaggugagccacug

SEQ ID NO: 978456 - RNA, 21 nt, Human
ugggauuauaggugcccgcca

SEQ ID NO: 978457 - RNA, 22 nt, Human
ugggauuauaggugcccgccac

SEQ ID NO: 978458 - RNA, 24 nt, Human
ugggauuauaggugcccgccacca

SEQ ID NO: 978459 - RNA, 24 nt, Human
uggggguuauggagacuagaagcu

SEQ ID NO: 978460 - RNA, 24 nt, Human
uggggucuugcuguguugcccagg

SEQ ID NO: 978461 - RNA, 23 nt, Human
uggguucaagcgauucuccugcc

SEQ ID NO: 978462 - RNA, 24 nt, Human
uggguucaagcgauucuccugccu

SEQ ID NO: 978463 - RNA, 18 nt, Human
uguauuuauauauacuug

SEQ ID NO: 978464 - RNA, 21 nt, Human
ugucacccaggcuggagugca

SEQ ID NO: 978465 - RNA, 19 nt, Human
uguguaggaugcuucuguu

SEQ ID NO: 978466 - RNA, 22 nt, Human
uguguugcccaggcuacgcuca

SEQ ID NO: 978467 - RNA, 24 nt, Human
uguguugcccaggcuacgcucaaa

SEQ ID NO: 978468 - RNA, 24 nt, Human
uguucagaauuucucagaaaaaaa

SEQ ID NO: 978469 - RNA, 22 nt, Human
uguugcccaggcuacgcucaaa

SEQ ID NO: 978470 - RNA, 22 nt, Human
uuaaaaaacauuuuuuucuuag

SEQ ID NO: 978471 - RNA, 21 nt, Human
uuaaaguucucagaugcugac

SEQ ID NO: 978472 - RNA, 18 nt, Human
uuaaaugccgguacugac

SEQ ID NO: 978473 - RNA, 18 nt, Human
uuaguagagacgggguuu

SEQ ID NO: 978474 - RNA, 22 nt, Human
uuaguagagacgggguuucacc

SEQ ID NO: 978475 - RNA, 24 nt, Human
uuaguagagacgggguuucaccau

SEQ ID NO: 978476 - RNA, 18 nt, Human
uuaguagagaugagguuu

SEQ ID NO: 978477 - RNA, 22 nt, Human
uuaguagagaugagguuucgcc

SEQ ID NO: 978478 - RNA, 24 nt, Human
uuaguagagaugagguuucgccau

SEQ ID NO: 978479 - RNA, 22 nt, Human
uucaaacaacaacugcccauaa

SEQ ID NO: 978480 - RNA, 23 nt, Human
uucaagcaauuccugugccucag

SEQ ID NO: 978481 - RNA, 21 nt, Human
uucaagcgauucuccugccuc

SEQ ID NO: 978482 - RNA, 23 nt, Human
uucaagcgauucuccugccucag

SEQ ID NO: 978483 - RNA, 26 nt, Human
uucaagcgauucuccugccucagccu

SEQ ID NO: 978484 - RNA, 18 nt, Human
uuccuggcagcaccaggc

SEQ ID NO: 978485 - RNA, 22 nt, Human
uuccuggcagcaccaggcgcaa

SEQ ID NO: 978486 - RNA, 23 nt, Human
uucucagaugcugacagugacua

SEQ ID NO: 978487 - RNA, 24 nt, Human
uugaaggaaaaccacuacucucac

SEQ ID NO: 978488 - RNA, 22 nt, Human
uugagaaauuuagaugcaggcu

SEQ ID NO: 978489 - RNA, 19 nt, Human
uugagacacaguuuugcuc

SEQ ID NO: 978490 - RNA, 21 nt, Human
uugagacacaguuuugcucug

SEQ ID NO: 978491 - RNA, 24 nt, Human
uugcauccucugccucuuggguuc

SEQ ID NO: 978492 - RNA, 22 nt, Human
uugcucugucacccaggcuaga

SEQ ID NO: 978493 - RNA, 21 nt, Human
uugggaagaaccagaauuugc

SEQ ID NO: 978494 - RNA, 23 nt, Human
uugggauuacaggugagccacug

SEQ ID NO: 978495 - RNA, 26 nt, Human
uuuaaaggugagauuuagcaaaggaa

SEQ ID NO: 978496 - RNA, 24 nt, Human
uuucaccauguuggccaggcuggu

SEQ ID NO: 978497 - RNA, 22 nt, Human
uuucauucaucuuuuucuguuc

SEQ ID NO: 978498 - RNA, 21 nt, Human
uuucgccauguuggccagacu

SEQ ID NO: 978499 - RNA, 20 nt, Human
uuuguagagacagggucuau

SEQ ID NO: 978500 - RNA, 22 nt, Human
uuuguagagacagggucuaucu

SEQ ID NO: 978501 - RNA, 19 nt, Human
uuuugcucugucacccagg

SEQ ID NO: 978502 - RNA, 23 nt, Human
uuuugcucugucacccaggcuag

SEQ ID NO: 978503 - RNA, 24 nt, Human
uuuugcucugucacccaggcuaga

SEQ ID NO: 978504 - RNA, 20 nt, Human
uuuuguaauuuuaguagaga

SEQ ID NO: 978505 - RNA, 24 nt, Human
uuuuuaguagagacgggguuucac

SEQ ID NO: 978506 - RNA, 20 nt, Human
uuuuuguaauuuuaguagag

SEQ ID NO: 978507 - RNA, 21 nt, Human
uuuuugucuuuuuaguagaga

SEQ ID NO: 978508 - RNA, 24 nt, Human
uuuuuugucuuuuuaguagagacg

SEQ ID NO: 978509 - RNA, 22 nt, Human
uuuuuuuaaaagccaaaggagc

SEQ ID NO: 978510 - RNA, 22 nt, Human
agaaccccugaccaaagacaac

SEQ ID NO: 978511 - RNA, 19 nt, Human
agacagggguccccaggua

SEQ ID NO: 978512 - RNA, 23 nt, Human
auggcugaaaaucugucaagcac

SEQ ID NO: 978513 - RNA, 21 nt, Human
cacuuuggcucuuauugaucc

SEQ ID NO: 978514 - RNA, 21 nt, Human
cagccagcugauacugacauc

SEQ ID NO: 978515 - RNA, 24 nt, Human
cagguagacagaaccccugaccaa

SEQ ID NO: 978516 - RNA, 19 nt, Human
ccccagguagacagaaccc

SEQ ID NO: 978517 - RNA, 21 nt, Human
ccugccucacgcucccaagaa

SEQ ID NO: 978518 - RNA, 18 nt, Human
ccuuuauuuuuguuuuga

SEQ ID NO: 978519 - RNA, 20 nt, Human
cgcucaaaauuccacugccc

SEQ ID NO: 978520 - RNA, 22 nt, Human
cucagggccuccaggcagccag

SEQ ID NO: 978521 - RNA, 19 nt, Human
cuccaggcagccaguuuug

SEQ ID NO: 978522 - RNA, 23 nt, Human
gaacauggucauggcugaaaauc

SEQ ID NO: 978523 - RNA, 19 nt, Human
gcucagggccuccaggcag

SEQ ID NO: 978524 - RNA, 22 nt, Human
ggucauggcugaaaaucuguca

SEQ ID NO: 978525 - RNA, 23 nt, Human
ucccaagaaccugcuccugcagg

SEQ ID NO: 978526 - RNA, 20 nt, Human
uccccagguagacagaaccc

SEQ ID NO: 978527 - RNA, 23 nt, Human
uccccagguagacagaaccccug

SEQ ID NO: 978528 - RNA, 22 nt, Human
ucccuggugugcagacaggggu

SEQ ID NO: 978529 - RNA, 24 nt, Human
ucccuggugugcagacaggggucc

SEQ ID NO: 978530 - RNA, 21 nt, Human
uccugccucacgcucccaaga

SEQ ID NO: 978531 - RNA, 20 nt, Human
uccuuuuguaaaaaugggac

SEQ ID NO: 978532 - RNA, 23 nt, Human
ugaccaaagacaacaggaggcau

SEQ ID NO: 978533 - RNA, 21 nt, Human
uggcucagggccuccaggcag

SEQ ID NO: 978534 - RNA, 20 nt, Human
uuggcucuuauugaucccug

SEQ ID NO: 978535 - RNA, 23 nt, Human
uuuuuuuuuuuuuuuuuuccuuu

SEQ ID NO: 978536 - RNA, 24 nt, Human
uuuuuuuuuuuuuuuuuuccuuuu

SEQ ID NO: 978537 - RNA, 21 nt, Human
aaaaaucaaaguuugcaaaaa

SEQ ID NO: 978538 - RNA, 27 nt, Human
aaaccaguuuucaaauaguaaagccag

SEQ ID NO: 978539 - RNA, 20 nt, Human
aagaaauagguaaaagauua

SEQ ID NO: 978540 - RNA, 23 nt, Human
acacacacacacacacacacaca

SEQ ID NO: 978541 - RNA, 23 nt, Human
acacacacacacacacacgugug

SEQ ID NO: 978542 - RNA, 23 nt, Human
acacacacacacacacacgugug

SEQ ID NO: 978543 - RNA, 31 nt, Human
acaccuuacacacacacacacacacacacag

SEQ ID NO: 978544 - RNA, 31 nt, Human
agacaccuuacacacacacacacacacacag

SEQ ID NO: 978545 - RNA, 23 nt, Human
auaaaucuuugaaacaaguucag

SEQ ID NO: 978546 - RNA, 24 nt, Human
auauuccucauugccccaaaucag

SEQ ID NO: 978547 - RNA, 20 nt, Human
cacacacacacacacacaca

SEQ ID NO: 978548 - RNA, 20 nt, Human
cacacacacacacacacaca

SEQ ID NO: 978549 - RNA, 20 nt, Human
cacacacacacacacacaca

SEQ ID NO: 978550 - RNA, 22 nt, Human
cacacacacacacacacacaca

SEQ ID NO: 978551 - RNA, 26 nt, Human
cacacacacacacacacacacacacg

SEQ ID NO: 978552 - RNA, 26 nt, Human
cacacacacacacacacacacacgug

SEQ ID NO: 978553 - RNA, 26 nt, Human
cacacacacacacacacgugugcacg

SEQ ID NO: 978554 - RNA, 26 nt, Human
cacacacacacacacgugugcacgcc

SEQ ID NO: 978555 - RNA, 31 nt, Human
ccaaugacaaaaaacaauuuggccucuccuu

SEQ ID NO: 978556 - RNA, 19 nt, Human
ccgagcacuguuccgcgcc

SEQ ID NO: 978557 - RNA, 21 nt, Human
cuccuaaaauaagaacaugaa

SEQ ID NO: 978558 - RNA, 18 nt, Human
cugccaggagggaacacu

SEQ ID NO: 978559 - RNA, 22 nt, Human
gcacgccaaugacaaaaaacaa

SEQ ID NO: 978560 - RNA, 19 nt, Human
ggugugggcgccgggagag

SEQ ID NO: 978561 - RNA, 22 nt, Human
uaaaauaagaacaugaagaccc

SEQ ID NO: 978562 - RNA, 23 nt, Human
uaagaaauagguaaaagauuaua

SEQ ID NO: 978563 - RNA, 21 nt, Human
uaagaacaugaagacccuuaa

SEQ ID NO: 978564 - RNA, 31 nt, Human
uaagacaccuuacacacacacacacacacag

SEQ ID NO: 978565 - RNA, 20 nt, Human
uacacacacacacacacaca

SEQ ID NO: 978566 - RNA, 25 nt, Human
uacacacacacacacacacacacac

SEQ ID NO: 978567 - RNA, 21 nt, Human
uaugcaaaaguaugccuucaa

SEQ ID NO: 978568 - RNA, 21 nt, Human
ucaguauuuuuuuuauuucua

SEQ ID NO: 978569 - RNA, 19 nt, Human
ugauacacaaaccaguuuu

SEQ ID NO: 978570 - RNA, 18 nt, Human
ugauauaugauaugauac

SEQ ID NO: 978571 - RNA, 20 nt, Human
ugauaugauacacaaaccag

SEQ ID NO: 978572 - RNA, 21 nt, Human
ugauaugauacacaaaccagu

SEQ ID NO: 978573 - RNA, 18 nt, Human
ugcugccaggagggaaca

SEQ ID NO: 978574 - RNA, 21 nt, Human
agaagccauccaagaugagca

SEQ ID NO: 978575 - RNA, 24 nt, Human
agcccaucaugaguagcccacaug

SEQ ID NO: 978576 - RNA, 23 nt, Human
aggcauuuggucaccauuaccca

SEQ ID NO: 978577 - RNA, 19 nt, Human
aguagcccacaugguugcu

SEQ ID NO: 978578 - RNA, 22 nt, Human
caaggaacucuuuacaaggaua

SEQ ID NO: 978579 - RNA, 23 nt, Human
cacugcguuggcgcagcaaaaac

SEQ ID NO: 978580 - RNA, 22 nt, Human
cagcaaaaaccuuccucgugcc

SEQ ID NO: 978581 - RNA, 21 nt, Human
cugcaguuuuggcccagaagc

SEQ ID NO: 978582 - RNA, 22 nt, Human
guugcuguucaaagguacugaa

SEQ ID NO: 978583 - RNA, 19 nt, Human
uauucagaaaauaaaagua

SEQ ID NO: 978584 - RNA, 24 nt, Human
ucaccauuacccaucaaggaacuc

SEQ ID NO: 978585 - RNA, 27 nt, Human
ucaggccgggcgugagcggagccuucg

SEQ ID NO: 978586 - RNA, 20 nt, Human
ucccaaagaaucaagcccau

SEQ ID NO: 978587 - RNA, 24 nt, Human
ugcaguuuuggcccagaagccauc

SEQ ID NO: 978588 - RNA, 23 nt, Human
uggcccagaagccauccaagaug

SEQ ID NO: 978589 - RNA, 21 nt, Human
uucaaagguacugaaaaggga

SEQ ID NO: 978590 - RNA, 21 nt, Human
uuccaaguccuucgugcugcu

SEQ ID NO: 978591 - RNA, 23 nt, Human
uuggcgcagcaaaaaccuuccuc

SEQ ID NO: 978592 - RNA, 27 nt, Human
aaaaaaaaagauuuuuaaaaauaaaga

SEQ ID NO: 978593 - RNA, 20 nt, Human
aaaaacauggaaucaaccca

SEQ ID NO: 978594 - RNA, 24 nt, Human
aaaauagcaucuucaacuuagaug

SEQ ID NO: 978595 - RNA, 18 nt, Human
aaagauacaagcaugugu

SEQ ID NO: 978596 - RNA, 22 nt, Human
aacacaggaacagaaaaccaaa

SEQ ID NO: 978597 - RNA, 19 nt, Human
aaccugcacauccugcaca

SEQ ID NO: 978598 - RNA, 22 nt, Human
aagccauuauccucagcaaacu

SEQ ID NO: 978599 - RNA, 23 nt, Human
aaggcaggaggaucacuugaggc

SEQ ID NO: 978600 - RNA, 25 nt, Human
aaggcaggaggaucacuugaggcca

SEQ ID NO: 978601 - RNA, 23 nt, Human
aagucagucuccaauccugcugc

SEQ ID NO: 978602 - RNA, 18 nt, Human
acagcacuuugggaggcc

SEQ ID NO: 978603 - RNA, 22 nt, Human
acaggaacagaaaaccaaacac

SEQ ID NO: 978604 - RNA, 18 nt, Human
acagggaggggaacaacc

SEQ ID NO: 978605 - RNA, 24 nt, Human
acuguacuccugccugggcaacag

SEQ ID NO: 978606 - RNA, 25 nt, Human
acuguacuccugccugggcaacaga

SEQ ID NO: 978607 - RNA, 19 nt, Human
acuucacugauugcccaca

SEQ ID NO: 978608 - RNA, 20 nt, Human
agaaaaccaaacacugcaug

SEQ ID NO: 978609 - RNA, 20 nt, Human
agacugccauuggcucaucc

SEQ ID NO: 978610 - RNA, 24 nt, Human
agaucacuugagccugggaggcag

SEQ ID NO: 978611 - RNA, 23 nt, Human
agaugggaugagaauucaggugg

SEQ ID NO: 978612 - RNA, 25 nt, Human
agcaaaaacauggaaucaacccaaa

SEQ ID NO: 978613 - RNA, 18 nt, Human
agccagguguaauggugu

SEQ ID NO: 978614 - RNA, 21 nt, Human
agccagguguaaugguguguc

SEQ ID NO: 978615 - RNA, 20 nt, Human
aggagggcagaucacuugag

SEQ ID NO: 978616 - RNA, 18 nt, Human
aggcaggaggaucacuug

SEQ ID NO: 978617 - RNA, 20 nt, Human
aggcagugguugcagugagc

SEQ ID NO: 978618 - RNA, 21 nt, Human
aggcagugguugcagugagcu

SEQ ID NO: 978619 - RNA, 24 nt, Human
aggcagugguugcagugagcugag

SEQ ID NO: 978620 - RNA, 21 nt, Human
aggcugaggagggcagaucac

SEQ ID NO: 978621 - RNA, 20 nt, Human
aggggaacaacacacacugg

SEQ ID NO: 978622 - RNA, 18 nt, Human
auaaacuucacugauugc

SEQ ID NO: 978623 - RNA, 24 nt, Human
auggagcuagaagccauuauccuc

SEQ ID NO: 978624 - RNA, 18 nt, Human
augguacauacacaccac

SEQ ID NO: 978625 - RNA, 24 nt, Human
auggugugucccuguggucucagc

SEQ ID NO: 978626 - RNA, 18 nt, Human
auuggcucauccugcaua

SEQ ID NO: 978627 - RNA, 18 nt, Human
caaacuaacacaggaaca

SEQ ID NO: 978628 - RNA, 21 nt, Human
caacagagccagacccugucu

SEQ ID NO: 978629 - RNA, 18 nt, Human
caacagcaaaaacaugga

SEQ ID NO: 978630 - RNA, 28 nt, Human
caacagcaaaaacauggaaucaacccaa

SEQ ID NO: 978631 - RNA, 22 nt, Human
caacauagaaagaucccaucuc

SEQ ID NO: 978632 - RNA, 20 nt, Human
caaggcaggaggaucacuug

SEQ ID NO: 978633 - RNA, 24 nt, Human
cacaccuguaaucacagcacuuug

SEQ ID NO: 978634 - RNA, 27 nt, Human
cacagcacuuugggaggccaaggcagg

SEQ ID NO: 978635 - RNA, 19 nt, Human
cacaggaacagaaaaccaa

SEQ ID NO: 978636 - RNA, 20 nt, Human
cacaggaacagaaaaccaaa

SEQ ID NO: 978637 - RNA, 19 nt, Human
caccuguaaucacagcacu

SEQ ID NO: 978638 - RNA, 24 nt, Human
caccuguaaucacagcacuuuggg

SEQ ID NO: 978639 - RNA, 20 nt, Human
cacuguacuccugccugggc

SEQ ID NO: 978640 - RNA, 23 nt, Human
cacuguacuccugccugggcaac

SEQ ID NO: 978641 - RNA, 24 nt, Human
cacuguacuccugccugggcaaca

SEQ ID NO: 978642 - RNA, 24 nt, Human
cacuugaggccagccuaggcaaca

SEQ ID NO: 978643 - RNA, 18 nt, Human
cagaaaaccaaacacugc

SEQ ID NO: 978644 - RNA, 21 nt, Human
cagacuccccagguaucaccc

SEQ ID NO: 978645 - RNA, 24 nt, Human
cagcacuuugggaggccaaggcag

SEQ ID NO: 978646 - RNA, 25 nt, Human
cagcacuuugggaggccaaggcagg

SEQ ID NO: 978647 - RNA, 27 nt, Human
cauccugcacauguaucccagaacuua

SEQ ID NO: 978648 - RNA, 22 nt, Human
ccaaagccuucacccuaaacca

SEQ ID NO: 978649 - RNA, 21 nt, Human
ccaccugaggcagaacuucca

SEQ ID NO: 978650 - RNA, 20 nt, Human
ccacuguacuccugccuggg

SEQ ID NO: 978651 - RNA, 21 nt, Human
ccacuguacuccugccugggc

SEQ ID NO: 978652 - RNA, 24 nt, Human
ccacuguacuccugccugggcaac

SEQ ID NO: 978653 - RNA, 23 nt, Human
ccaggaaccgagaagagaaugac

SEQ ID NO: 978654 - RNA, 21 nt, Human
cccaucucuacuaaaauacaa

SEQ ID NO: 978655 - RNA, 22 nt, Human
ccccagcccgcagucacaaguc

SEQ ID NO: 978656 - RNA, 21 nt, Human
ccuacugggaaugccccccca

SEQ ID NO: 978657 - RNA, 19 nt, Human
ccucuggcuucacauuccu

SEQ ID NO: 978658 - RNA, 24 nt, Human
ccuguaaucacagcacuuugggag

SEQ ID NO: 978659 - RNA, 22 nt, Human
ccuguggucucagcuacuuagg

SEQ ID NO: 978660 - RNA, 19 nt, Human
cgaaaccucuggcuucaca

SEQ ID NO: 978661 - RNA, 18 nt, Human
cgagaagagaaugacccc

SEQ ID NO: 978662 - RNA, 18 nt, Human
cgagaagagaaugacccc

SEQ ID NO: 978663 - RNA, 21 nt, Human
cucacuugcccagggggugga

SEQ ID NO: 978664 - RNA, 21 nt, Human
cucuuugcauuuugcagaugc

SEQ ID NO: 978665 - RNA, 19 nt, Human
cuggauaaagaaaacaugg

SEQ ID NO: 978666 - RNA, 18 nt, Human
cuggcugggcaugguggu

SEQ ID NO: 978667 - RNA, 21 nt, Human
cuggggccuguuaggggggug

SEQ ID NO: 978668 - RNA, 22 nt, Human
cuuuuuggcuaugcccaccuga

SEQ ID NO: 978669 - RNA, 22 nt, Human
gaacagaaaaccaaacacugca

SEQ ID NO: 978670 - RNA, 19 nt, Human
gaucacuugaggccagccu

SEQ ID NO: 978671 - RNA, 21 nt, Human
gaucacuugaggccagccuag

SEQ ID NO: 978672 - RNA, 26 nt, Human
gaucacuugaggccagccuaggcaaa

SEQ ID NO: 978673 - RNA, 22 nt, Human
gauccaauuccccaggaaccga

SEQ ID NO: 978674 - RNA, 24 nt, Human
gccacuguacuccugccugggcaa

SEQ ID NO: 978675 - RNA, 20 nt, Human
ggauggagcuagaagccauu

SEQ ID NO: 978676 - RNA, 19 nt, Human
ggaugucacgaauccgaaa

SEQ ID NO: 978677 - RNA, 18 nt, Human
ggcagaucacuugagccu

SEQ ID NO: 978678 - RNA, 24 nt, Human
gggcauggugguucacaccuguaa

SEQ ID NO: 978679 - RNA, 21 nt, Human
ggggcuugguagagagggccc

SEQ ID NO: 978680 - RNA, 24 nt, Human
ggugguucacaccuguaaucacag

SEQ ID NO: 978681 - RNA, 24 nt, Human
guacuccugccugggcaacagagc

SEQ ID NO: 978682 - RNA, 21 nt, Human
gucacaagucagucuccaauc

SEQ ID NO: 978683 - RNA, 23 nt, Human
gugguucacaccuguaaucacag

SEQ ID NO: 978684 - RNA, 19 nt, Human
uaaaauacaacaauuagcc

SEQ ID NO: 978685 - RNA, 23 nt, Human
uacuccugccugggcaacagagc

SEQ ID NO: 978686 - RNA, 18 nt, Human
uacugggaaugccccccc

SEQ ID NO: 978687 - RNA, 20 nt, Human
uagccagcccccaucugaaa

SEQ ID NO: 978688 - RNA, 18 nt, Human
uagccccucagcugcacu

SEQ ID NO: 978689 - RNA, 24 nt, Human
uaggaggcugaggagggcagauca

SEQ ID NO: 978690 - RNA, 24 nt, Human
uagguuuuaacuggcugcucagug

SEQ ID NO: 978691 - RNA, 24 nt, Human
uaugagguaguucucuuugcauuu

SEQ ID NO: 978692 - RNA, 19 nt, Human
uaugcccaccugaggcaga

SEQ ID NO: 978693 - RNA, 20 nt, Human
uaugcccaccugaggcagaa

SEQ ID NO: 978694 - RNA, 24 nt, Human
ucacaagucagucuccaauccugc

SEQ ID NO: 978695 - RNA, 23 nt, Human
ucacaccuguaaucacagcacuu

SEQ ID NO: 978696 - RNA, 19 nt, Human
ucacccaaagccuucaccc

SEQ ID NO: 978697 - RNA, 25 nt, Human
ucacccaaagccuucacccuaaacc

SEQ ID NO: 978698 - RNA, 18 nt, Human
ucacccuaaaccacccug

SEQ ID NO: 978699 - RNA, 22 nt, Human
ucacuugagccugggaggcagu

SEQ ID NO: 978700 - RNA, 22 nt, Human
ucagcaaacuaacacaggaaca

SEQ ID NO: 978701 - RNA, 24 nt, Human
ucccuguggucucagcuacuuagg

SEQ ID NO: 978702 - RNA, 18 nt, Human
ucuugagacugccauugg

SEQ ID NO: 978703 - RNA, 24 nt, Human
ugaacaaugagaauacauggacac

SEQ ID NO: 978704 - RNA, 24 nt, Human
ugagccugggaggcagugguugca

SEQ ID NO: 978705 - RNA, 22 nt, Human
ugaucucugucuccagacuccc

SEQ ID NO: 978706 - RNA, 19 nt, Human
uggaaucaacccaaaugcc

SEQ ID NO: 978707 - RNA, 20 nt, Human
uggauaaagaaaacauggua

SEQ ID NO: 978708 - RNA, 24 nt, Human
ugggaggcagugguugcagugagc

SEQ ID NO: 978709 - RNA, 24 nt, Human
ugggaggccaaggcaggaggauca

SEQ ID NO: 978710 - RNA, 22 nt, Human
ugguacauacacaccacggaau

SEQ ID NO: 978711 - RNA, 21 nt, Human
uggugugucccuguggucuca

SEQ ID NO: 978712 - RNA, 19 nt, Human
ugguucacaccuguaauca

SEQ ID NO: 978713 - RNA, 24 nt, Human
ugguucacaccuguaaucacagca

SEQ ID NO: 978714 - RNA, 18 nt, Human
uguuaggggggugcggga

SEQ ID NO: 978715 - RNA, 21 nt, Human
uguucagaguuuuuauuaggg

SEQ ID NO: 978716 - RNA, 20 nt, Human
uucagaguuuuuauuagggc

SEQ ID NO: 978717 - RNA, 19 nt, Human
uucauuacauaaacuucac

SEQ ID NO: 978718 - RNA, 21 nt, Human
uuccacagguaaggugucgcc

SEQ ID NO: 978719 - RNA, 24 nt, Human
uugagccugggaggcagugguugc

SEQ ID NO: 978720 - RNA, 20 nt, Human
uugcagugagcugagauaau

SEQ ID NO: 978721 - RNA, 21 nt, Human
uugcagugagcugagauaaug

SEQ ID NO: 978722 - RNA, 23 nt, Human
uugcagugagcugagauaaugcc

SEQ ID NO: 978723 - RNA, 19 nt, Human
uuuuuggcuaugcccaccu

SEQ ID NO: 978724 - RNA, 22 nt, Human
aagggccccacacuaucucccu

SEQ ID NO: 978725 - RNA, 20 nt, Human
agggagguggggagguggag

SEQ ID NO: 978726 - RNA, 21 nt, Human
aggugaggggcgaagagcugg

SEQ ID NO: 978727 - RNA, 24 nt, Human
caacccucccccagucaucccacu

SEQ ID NO: 978728 - RNA, 19 nt, Human
caccccuccucuccuccac

SEQ ID NO: 978729 - RNA, 23 nt, Human
cacccugugcuugggugggcgcu

SEQ ID NO: 978730 - RNA, 21 nt, Human
cagaguuucaaagaggugagg

SEQ ID NO: 978731 - RNA, 18 nt, Human
cagggggcucuccucuuc

SEQ ID NO: 978732 - RNA, 21 nt, Human
cccacacuaucucccucagca

SEQ ID NO: 978733 - RNA, 20 nt, Human
cccuccucuccuccaccucc

SEQ ID NO: 978734 - RNA, 20 nt, Human
cccugcagcaacccuccccc

SEQ ID NO: 978735 - RNA, 21 nt, Human
cccugcagcaacccuccccca

SEQ ID NO: 978736 - RNA, 26 nt, Human
ccucaagggccccacacuaucucccu

SEQ ID NO: 978737 - RNA, 21 nt, Human
ccuccaccuccucccacucca

SEQ ID NO: 978738 - RNA, 20 nt, Human
ccucccacuccacccugugc

SEQ ID NO: 978739 - RNA, 21 nt, Human
ccucccccagucaucccacug

SEQ ID NO: 978740 - RNA, 20 nt, Human
ccucuccuccaccuccuccc

SEQ ID NO: 978741 - RNA, 21 nt, Human
cguccagaguuucaaagaggu

SEQ ID NO: 978742 - RNA, 19 nt, Human
cuccucccacuccacccug

SEQ ID NO: 978743 - RNA, 21 nt, Human
cuccucuccuccaccuccucc

SEQ ID NO: 978744 - RNA, 21 nt, Human
cuggacccagcacagacaccc

SEQ ID NO: 978745 - RNA, 22 nt, Human
cuggcaccccuccucuccucca

SEQ ID NO: 978746 - RNA, 18 nt, Human
cuuuaaugaaauugggga

SEQ ID NO: 978747 - RNA, 22 nt, Human
gacaggcuugggggcaagggag

SEQ ID NO: 978748 - RNA, 22 nt, Human
gagggagguggggagguggagc

SEQ ID NO: 978749 - RNA, 21 nt, Human
gcaccccuccucuccuccacc

SEQ ID NO: 978750 - RNA, 18 nt, Human
ggacacggggcagggcag

SEQ ID NO: 978751 - RNA, 23 nt, Human
ggcacaaacagaagggaggggca

SEQ ID NO: 978752 - RNA, 23 nt, Human
ggcaccccuccucuccuccaccu

SEQ ID NO: 978753 - RNA, 20 nt, Human
ggcagggcagggcagggggc

SEQ ID NO: 978754 - RNA, 23 nt, Human
ggcagggggcucuccucuucccu

SEQ ID NO: 978755 - RNA, 22 nt, Human
gggacaggcuugggggcaaggg

SEQ ID NO: 978756 - RNA, 23 nt, Human
gggagggagguggggagguggag

SEQ ID NO: 978757 - RNA, 21 nt, Human
gggaggggcacuggggacagg

SEQ ID NO: 978758 - RNA, 23 nt, Human
ggggagaggggcacaaacagaag

SEQ ID NO: 978759 - RNA, 20 nt, Human
ggggagggagguggggaggu

SEQ ID NO: 978760 - RNA, 20 nt, Human
guccagaguuucaaagaggu

SEQ ID NO: 978761 - RNA, 19 nt, Human
gugcuugggugggcgcugg

SEQ ID NO: 978762 - RNA, 19 nt, Human
uaaugaaauuggggagagg

SEQ ID NO: 978763 - RNA, 23 nt, Human
ucaagggccccacacuaucuccc

SEQ ID NO: 978764 - RNA, 24 nt, Human
ucaucccacugacgggggagggag

SEQ ID NO: 978765 - RNA, 19 nt, Human
uccagaguuucaaagaggu

SEQ ID NO: 978766 - RNA, 21 nt, Human
uccuccaccuccucccacucc

SEQ ID NO: 978767 - RNA, 26 nt, Human
ucuggcaccccuccucuccuccaccu

SEQ ID NO: 978768 - RNA, 18 nt, Human
ugcuugggugggcgcugg

SEQ ID NO: 978769 - RNA, 24 nt, Human
aagcauggauaucccugcucauac

SEQ ID NO: 978770 - RNA, 20 nt, Human
aaggcagcuccucuuccccc

SEQ ID NO: 978771 - RNA, 23 nt, Human
aagggcaucauagcugcagguga

SEQ ID NO: 978772 - RNA, 19 nt, Human
aauacccucccccauccuu

SEQ ID NO: 978773 - RNA, 20 nt, Human
acccccaaaggaagaauggg

SEQ ID NO: 978774 - RNA, 18 nt, Human
agcucaggagggagccgg

SEQ ID NO: 978775 - RNA, 23 nt, Human
agcuccucuucccccucaucccc

SEQ ID NO: 978776 - RNA, 19 nt, Human
aggcagcuccucuuccccc

SEQ ID NO: 978777 - RNA, 19 nt, Human
aggcagcuccucuuccccc

SEQ ID NO: 978778 - RNA, 18 nt, Human
auaugugugugugugugu

SEQ ID NO: 978779 - RNA, 23 nt, Human
auaugugugugugugugugugua

SEQ ID NO: 978780 - RNA, 19 nt, Human
augucccugucuguaaaca

SEQ ID NO: 978781 - RNA, 20 nt, Human
augugugugugugugugugu

SEQ ID NO: 978782 - RNA, 24 nt, Human
auguguguguguguguguguaugu

SEQ ID NO: 978783 - RNA, 21 nt, Human
caaaaggcagcuccucuuccc

SEQ ID NO: 978784 - RNA, 18 nt, Human
cagcuccucuucccccuc

SEQ ID NO: 978785 - RNA, 21 nt, Human
cagcuuccacaucauaccccc

SEQ ID NO: 978786 - RNA, 19 nt, Human
caggagggagccggggccu

SEQ ID NO: 978787 - RNA, 22 nt, Human
cauaagcauggauaucccugcu

SEQ ID NO: 978788 - RNA, 20 nt, Human
cauacccccaaaggaagaau

SEQ ID NO: 978789 - RNA, 23 nt, Human
cauccuuaacucuagaaccccgg

SEQ ID NO: 978790 - RNA, 19 nt, Human
ccacaucauacccccaaag

SEQ ID NO: 978791 - RNA, 19 nt, Human
ccauccuuaacucuagaac

SEQ ID NO: 978792 - RNA, 22 nt, Human
cccccaaaggaagaaugggggu

SEQ ID NO: 978793 - RNA, 18 nt, Human
ccucccccauccuuaacu

SEQ ID NO: 978794 - RNA, 22 nt, Human
ccucccccauccuuaacucuag

SEQ ID NO: 978795 - RNA, 23 nt, Human
ccuuaacucuagaaccccgguuu

SEQ ID NO: 978796 - RNA, 26 nt, Human
cucccccauccuuaacucuagaaccc

SEQ ID NO: 978797 - RNA, 24 nt, Human
cugaaaccagcuuccacaucauac

SEQ ID NO: 978798 - RNA, 23 nt, Human
cugaacacaacuggcucccuugg

SEQ ID NO: 978799 - RNA, 20 nt, Human
gacuucaagcauucuucaaa

SEQ ID NO: 978800 - RNA, 25 nt, Human
gcgcagcucaggagggagggaacgc

SEQ ID NO: 978801 - RNA, 22 nt, Human
gggccuccaaaaggcagcuccu

SEQ ID NO: 978802 - RNA, 23 nt, Human
gggcuccagcaaguggauaugug

SEQ ID NO: 978803 - RNA, 21 nt, Human
gggcugaaaccagcuuccaca

SEQ ID NO: 978804 - RNA, 22 nt, Human
guguguguguguauguguugug

SEQ ID NO: 978805 - RNA, 21 nt, Human
guguguguguguguguaugug

SEQ ID NO: 978806 - RNA, 20 nt, Human
uaaggcauauggugaggaca

SEQ ID NO: 978807 - RNA, 20 nt, Human
uacccccaaaggaagaaugg

SEQ ID NO: 978808 - RNA, 23 nt, Human
uacccccaaaggaagaauggggg

SEQ ID NO: 978809 - RNA, 18 nt, Human
uagaauggggauaaggca

SEQ ID NO: 978810 - RNA, 19 nt, Human
uagcugcaggugaaggggg

SEQ ID NO: 978811 - RNA, 18 nt, Human
uaugugugugugugugug

SEQ ID NO: 978812 - RNA, 24 nt, Human
ucuauaugugucucauuuguuccc

SEQ ID NO: 978813 - RNA, 21 nt, Human
ucuccaggccaggaagggccc

SEQ ID NO: 978814 - RNA, 19 nt, Human
ugaggagucagacugaggc

SEQ ID NO: 978815 - RNA, 25 nt, Human
ugaggagucagacugaggcaguaua

SEQ ID NO: 978816 - RNA, 19 nt, Human
ugcugaggggguuggggac

SEQ ID NO: 978817 - RNA, 21 nt, Human
uggcacggcgcagcucaggag

SEQ ID NO: 978818 - RNA, 18 nt, Human
uggggacaagccacaggg

SEQ ID NO: 978819 - RNA, 24 nt, Human
uggggaggaggugggaagcugugg

SEQ ID NO: 978820 - RNA, 25 nt, Human
ugugauaugugugugugugugugug

SEQ ID NO: 978821 - RNA, 19 nt, Human
uguguauguguugugugug

SEQ ID NO: 978822 - RNA, 24 nt, Human
uguguauguguuguguguguguaa

SEQ ID NO: 978823 - RNA, 21 nt, Human
ugugugaaaacugugauaugu

SEQ ID NO: 978824 - RNA, 22 nt, Human
uguguguauguguugugugugu

SEQ ID NO: 978825 - RNA, 23 nt, Human
uguguguauguguugugugugug

SEQ ID NO: 978826 - RNA, 22 nt, Human
uguguguguauguguugugugu

SEQ ID NO: 978827 - RNA, 22 nt, Human
uguguguguauguguugugugu

SEQ ID NO: 978828 - RNA, 22 nt, Human
ugugugugucugaacacaacug

SEQ ID NO: 978829 - RNA, 21 nt, Human
uguguguguguguguguaugu

SEQ ID NO: 978830 - RNA, 18 nt, Human
ugugugugugugugugug

SEQ ID NO: 978831 - RNA, 20 nt, Human
uguuguguguguguaaaagg

SEQ ID NO: 978832 - RNA, 21 nt, Human
uuaacucuagaaccccgguuu

SEQ ID NO: 978833 - RNA, 27 nt, Human
accaugcgcaccaccuuccgggccaca

SEQ ID NO: 978834 - RNA, 19 nt, Human
caacggcgcuccugagcaa

SEQ ID NO: 978835 - RNA, 20 nt, Human
caccaugcgcaccaccuucc

SEQ ID NO: 978836 - RNA, 24 nt, Human
caccaugcgcaccaccuuccgggc

SEQ ID NO: 978837 - RNA, 24 nt, Human
caccccguuuccaacggcgcuccu

SEQ ID NO: 978838 - RNA, 20 nt, Human
caccuuccgggccacacccc

SEQ ID NO: 978839 - RNA, 24 nt, Human
ccaugcgcaccaccuuccgggcca

SEQ ID NO: 978840 - RNA, 26 nt, Human
ccaugcgcaccaccuuccgggccaca

SEQ ID NO: 978841 - RNA, 18 nt, Human
ccccguuuccaacggcgc

SEQ ID NO: 978842 - RNA, 19 nt, Human
cuuucugccgcugcuccuc

SEQ ID NO: 978843 - RNA, 21 nt, Human
cuuucugccgcugcuccucgu

SEQ ID NO: 978844 - RNA, 21 nt, Human
ucaccaugcgcaccaccuucc

SEQ ID NO: 978845 - RNA, 23 nt, Human
aaaaagagccccaccaaacagaa

SEQ ID NO: 978846 - RNA, 22 nt, Human
aaaaccacaggagcuuucacug

SEQ ID NO: 978847 - RNA, 21 nt, Human
aagaagagguggucugcagag

SEQ ID NO: 978848 - RNA, 21 nt, Human
aagaagcaaaggggaguggag

SEQ ID NO: 978849 - RNA, 19 nt, Human
aagauggguugggggaaga

SEQ ID NO: 978850 - RNA, 23 nt, Human
aagucacaguuggaacaucuggg

SEQ ID NO: 978851 - RNA, 18 nt, Human
aaucacuuugucugcccc

SEQ ID NO: 978852 - RNA, 19 nt, Human
acagaagaguuaggaauca

SEQ ID NO: 978853 - RNA, 19 nt, Human
agaagaagagguggucugc

SEQ ID NO: 978854 - RNA, 23 nt, Human
agaagaagagguggucugcagag

SEQ ID NO: 978855 - RNA, 24 nt, Human
agagaugcugguuccagcugcagg

SEQ ID NO: 978856 - RNA, 21 nt, Human
agauggugaaggguguuucag

SEQ ID NO: 978857 - RNA, 20 nt, Human
agcucccagaagaagaggug

SEQ ID NO: 978858 - RNA, 18 nt, Human
aggcagagucuggugcua

SEQ ID NO: 978859 - RNA, 24 nt, Human
aggcucccccaagcaggacugcac

SEQ ID NO: 978860 - RNA, 23 nt, Human
agguggccggcaccagcuggagc

SEQ ID NO: 978861 - RNA, 19 nt, Human
agucaucacaagaggaggg

SEQ ID NO: 978862 - RNA, 22 nt, Human
auaaaaagagccccaccaaaca

SEQ ID NO: 978863 - RNA, 18 nt, Human
caacagucgaugacaggc

SEQ ID NO: 978864 - RNA, 24 nt, Human
caagaucgaaucacuuugucugcc

SEQ ID NO: 978865 - RNA, 21 nt, Human
caagguaggagcuguaggccc

SEQ ID NO: 978866 - RNA, 22 nt, Human
cacuccugcaaaguggaggcuc

SEQ ID NO: 978867 - RNA, 20 nt, Human
caggcccccaggguucuuca

SEQ ID NO: 978868 - RNA, 25 nt, Human
caggcccccaggguucuucacuccu

SEQ ID NO: 978869 - RNA, 18 nt, Human
cagggcaggacagggacc

SEQ ID NO: 978870 - RNA, 24 nt, Human
cccaagguaggagcuguaggcccc

SEQ ID NO: 978871 - RNA, 24 nt, Human
cccaccaaacagaagaguuaggaa

SEQ ID NO: 978872 - RNA, 20 nt, Human
cccaucaaggcgccagggag

SEQ ID NO: 978873 - RNA, 23 nt, Human
ccccuccugccuucccucuucuu

SEQ ID NO: 978874 - RNA, 19 nt, Human
ccuccugccuucccucuuc

SEQ ID NO: 978875 - RNA, 18 nt, Human
ccugccuucccucuucuu

SEQ ID NO: 978876 - RNA, 23 nt, Human
ccuucccucuucuuggggauccc

SEQ ID NO: 978877 - RNA, 19 nt, Human
cgaugacaggcugagguca

SEQ ID NO: 978878 - RNA, 22 nt, Human
cggcaccagcuggagcggcccc

SEQ ID NO: 978879 - RNA, 18 nt, Human
cuucacuccugcaaagug

SEQ ID NO: 978880 - RNA, 21 nt, Human
cuuuggccccucccccagucc

SEQ ID NO: 978881 - RNA, 21 nt, Human
gcaguaaguggacggggguac

SEQ ID NO: 978882 - RNA, 19 nt, Human
gccccuccugccuucccuc

SEQ ID NO: 978883 - RNA, 18 nt, Human
gcguuucuucuuuucuuu

SEQ ID NO: 978884 - RNA, 18 nt, Human
gcuacaggcccccagggu

SEQ ID NO: 978885 - RNA, 19 nt, Human
ggaagaggagauaccccau

SEQ ID NO: 978886 - RNA, 28 nt, Human
ggcaaagugaacuguagucaucacaaga

SEQ ID NO: 978887 - RNA, 18 nt, Human
ggcaccuaugaacuggug

SEQ ID NO: 978888 - RNA, 19 nt, Human
ggcguuucuucuuuucuuu

SEQ ID NO: 978889 - RNA, 23 nt, Human
gggaguggagguggccggcacca

SEQ ID NO: 978890 - RNA, 18 nt, Human
uaaaaagagccccaccaa

SEQ ID NO: 978891 - RNA, 25 nt, Human
uaaaaagagccccaccaaacagaag

SEQ ID NO: 978892 - RNA, 25 nt, Human
uaggaggaggaaggaucuuccaaau

SEQ ID NO: 978893 - RNA, 21 nt, Human
uagggacagcaagaagcaaag

SEQ ID NO: 978894 - RNA, 21 nt, Human
uccccauccgaccuuagggac

SEQ ID NO: 978895 - RNA, 22 nt, Human
ucccugcuuuggccccuccccc

SEQ ID NO: 978896 - RNA, 20 nt, Human
uccuggaggaggaagggagg

SEQ ID NO: 978897 - RNA, 27 nt, Human
ucucucccaggcaagggaaggaggggc

SEQ ID NO: 978898 - RNA, 18 nt, Human
ucugcagccccugagggc

SEQ ID NO: 978899 - RNA, 18 nt, Human
ucugugguggagacggca

SEQ ID NO: 978900 - RNA, 22 nt, Human
ugagcaaaaccacaggagcuuu

SEQ ID NO: 978901 - RNA, 22 nt, Human
ugagggcccaagguaggagcug

SEQ ID NO: 978902 - RNA, 25 nt, Human
ugcugguuccagcugcagggagggg

SEQ ID NO: 978903 - RNA, 23 nt, Human
ugcuuuggccccucccccagucc

SEQ ID NO: 978904 - RNA, 18 nt, Human
uggaaggugagcagaggc

SEQ ID NO: 978905 - RNA, 20 nt, Human
uggagguggccggcaccagc

SEQ ID NO: 978906 - RNA, 24 nt, Human
uggagguggccggcaccagcugga

SEQ ID NO: 978907 - RNA, 20 nt, Human
uggccccucccccagucccc

SEQ ID NO: 978908 - RNA, 22 nt, Human
uggcugagcaaaaccacaggag

SEQ ID NO: 978909 - RNA, 23 nt, Human
ugggggaauguucugggcucuuu

SEQ ID NO: 978910 - RNA, 18 nt, Human
uggguugggggaagagga

SEQ ID NO: 978911 - RNA, 25 nt, Human
ugucccugcuuuggccccuccccca

SEQ ID NO: 978912 - RNA, 23 nt, Human
ugucuagguaggcucucucccag

SEQ ID NO: 978913 - RNA, 23 nt, Human
uuaguccaggcccucgcggagca

SEQ ID NO: 978914 - RNA, 26 nt, Human
uuccucugcagccccugagggcccaa

SEQ ID NO: 978915 - RNA, 26 nt, Human
uuccucugcagccccugagggccccg

SEQ ID NO: 978916 - RNA, 19 nt, Human
uuccuggaggaggaaggga

SEQ ID NO: 978917 - RNA, 21 nt, Human
uucuuggggaucccaagaugg

SEQ ID NO: 978918 - RNA, 18 nt, Human
uuggaacaucugggggaa

SEQ ID NO: 978919 - RNA, 23 nt, Human
uugucugccccuggaaguuuagg

SEQ ID NO: 978920 - RNA, 20 nt, Human
aaaaaaccauuuagugccuu

SEQ ID NO: 978921 - RNA, 22 nt, Human
aaaagaauguucacuguagaaa

SEQ ID NO: 978922 - RNA, 19 nt, Human
aacauggugaaacccuguc

SEQ ID NO: 978923 - RNA, 20 nt, Human
aacauggugaaacccugucu

SEQ ID NO: 978924 - RNA, 21 nt, Human
aacauggugaaacccugucuc

SEQ ID NO: 978925 - RNA, 21 nt, Human
aacuggccuggaagccuugcc

SEQ ID NO: 978926 - RNA, 23 nt, Human
acagagggagauucugucucaaa

SEQ ID NO: 978927 - RNA, 24 nt, Human
acagagggagauucugucucaaaa

SEQ ID NO: 978928 - RNA, 18 nt, Human
acgugaaagaaagaauag

SEQ ID NO: 978929 - RNA, 22 nt, Human
acuccagccugggggacagagg

SEQ ID NO: 978930 - RNA, 18 nt, Human
acugcacuccagccuggg

SEQ ID NO: 978931 - RNA, 24 nt, Human
acugcacuccagccugggggacag

SEQ ID NO: 978932 - RNA, 22 nt, Human
agaccaggcgugguggcucaug

SEQ ID NO: 978933 - RNA, 24 nt, Human
agaccaggcgugguggcucaugcc

SEQ ID NO: 978934 - RNA, 24 nt, Human
agagcuugcagugagccgagaucg

SEQ ID NO: 978935 - RNA, 24 nt, Human
agccugggggacagagggagauuc

SEQ ID NO: 978936 - RNA, 21 nt, Human
aggcagagcuugcagugagcc

SEQ ID NO: 978937 - RNA, 24 nt, Human
aggcagagcuugcagugagccgag

SEQ ID NO: 978938 - RNA, 20 nt, Human
aggcagcucggugggagcgc

SEQ ID NO: 978939 - RNA, 24 nt, Human
aggcaggagaagggcgugaacccg

SEQ ID NO: 978940 - RNA, 25 nt, Human
aggcaggagaagggcgugaacccgg

SEQ ID NO: 978941 - RNA, 26 nt, Human
aggcagguggaucacgaggucaggag

SEQ ID NO: 978942 - RNA, 21 nt, Human
aggccgaggcagguggaucac

SEQ ID NO: 978943 - RNA, 24 nt, Human
aggcgcagaggcucugguuugucu

SEQ ID NO: 978944 - RNA, 24 nt, Human
aggcgugguggcucaugccuguca

SEQ ID NO: 978945 - RNA, 18 nt, Human
aggcugaggcaggagaag

SEQ ID NO: 978946 - RNA, 24 nt, Human
agguggaucacgaggucaggagau

SEQ ID NO: 978947 - RNA, 22 nt, Human
auccacucuccccacuccccaa

SEQ ID NO: 978948 - RNA, 25 nt, Human
auccuuuuuaaaaaguucauagaag

SEQ ID NO: 978949 - RNA, 24 nt, Human
aucgcaccacugcacuccagccug

SEQ ID NO: 978950 - RNA, 26 nt, Human
caccacugcacuccagccugggggac

SEQ ID NO: 978951 - RNA, 21 nt, Human
caccuguagucccagcuacuc

SEQ ID NO: 978952 - RNA, 24 nt, Human
caccuguagucccagcuacucggg

SEQ ID NO: 978953 - RNA, 18 nt, Human
cacugcacuccagccugg

SEQ ID NO: 978954 - RNA, 19 nt, Human
cacugcacuccagccuggg

SEQ ID NO: 978955 - RNA, 22 nt, Human
cacugcacuccagccuggggga

SEQ ID NO: 978956 - RNA, 24 nt, Human
cacugcacuccagccugggggaca

SEQ ID NO: 978957 - RNA, 20 nt, Human
cagaagaaaauaaauaucac

SEQ ID NO: 978958 - RNA, 25 nt, Human
cagcacuuuggggaggccgaggcag

SEQ ID NO: 978959 - RNA, 26 nt, Human
cagcacuuuggggaggccgaggcagg

SEQ ID NO: 978960 - RNA, 22 nt, Human
cagccugggggacagagggaga

SEQ ID NO: 978961 - RNA, 24 nt, Human
cagcuacucgggaggcugaggcag

SEQ ID NO: 978962 - RNA, 19 nt, Human
caggguccaggacagcaga

SEQ ID NO: 978963 - RNA, 24 nt, Human
cauccacucuccccacuccccaaa

SEQ ID NO: 978964 - RNA, 24 nt, Human
caugccugucaucccagcacuuug

SEQ ID NO: 978965 - RNA, 19 nt, Human
ccacugcacuccagccugg

SEQ ID NO: 978966 - RNA, 20 nt, Human
ccacugcacuccagccuggg

SEQ ID NO: 978967 - RNA, 22 nt, Human
ccacugcacuccagccuggggg

SEQ ID NO: 978968 - RNA, 24 nt, Human
ccacugcacuccagccugggggac

SEQ ID NO: 978969 - RNA, 25 nt, Human
ccacugcacuccagccugggggaca

SEQ ID NO: 978970 - RNA, 21 nt, Human
cccugcaggcaacccuuccug

SEQ ID NO: 978971 - RNA, 22 nt, Human
ccuccgggagcacugccagggg

SEQ ID NO: 978972 - RNA, 24 nt, Human
ccugcaggcaacccuuccugaccc

SEQ ID NO: 978973 - RNA, 22 nt, Human
ccuggcuaacauggugaaaccc

SEQ ID NO: 978974 - RNA, 22 nt, Human
ccuggcuaacauggugaaaccc

SEQ ID NO: 978975 - RNA, 24 nt, Human
ccuggcuaacauggugaaacccug

SEQ ID NO: 978976 - RNA, 21 nt, Human
ccuguagucccagcuacucgg

SEQ ID NO: 978977 - RNA, 22 nt, Human
ccugucaucccagcacuuuggg

SEQ ID NO: 978978 - RNA, 21 nt, Human
ccuuuuuaaaaaguucauaga

SEQ ID NO: 978979 - RNA, 24 nt, Human
cgagaccauccuggcuaacauggu

SEQ ID NO: 978980 - RNA, 24 nt, Human
cgaggcagguggaucacgagguca

SEQ ID NO: 978981 - RNA, 21 nt, Human
cgcaccacugcacuccagccu

SEQ ID NO: 978982 - RNA, 22 nt, Human
cuaguaacaaaaguaaaaaaga

SEQ ID NO: 978983 - RNA, 20 nt, Human
cuaguccauccacucucccc

SEQ ID NO: 978984 - RNA, 24 nt, Human
cucaugccugucaucccagcacuu

SEQ ID NO: 978985 - RNA, 28 nt, Human
cucugcccaggccuuccugggccccucc

SEQ ID NO: 978986 - RNA, 22 nt, Human
cuggccccgggaucauuuucca

SEQ ID NO: 978987 - RNA, 24 nt, Human
cuggcuaacauggugaaacccugu

SEQ ID NO: 978988 - RNA, 18 nt, Human
cugguuugucuguccugg

SEQ ID NO: 978989 - RNA, 19 nt, Human
cuugcagugagccgagauc

SEQ ID NO: 978990 - RNA, 21 nt, Human
cuugcagugagccgagaucgc

SEQ ID NO: 978991 - RNA, 20 nt, Human
gaacccgggaggcagagcuu

SEQ ID NO: 978992 - RNA, 23 nt, Human
gagaucgcaccacugcacuccag

SEQ ID NO: 978993 - RNA, 20 nt, Human
gcaccacugcacuccagccu

SEQ ID NO: 978994 - RNA, 20 nt, Human
gccgagaucgcaccacugca

SEQ ID NO: 978995 - RNA, 24 nt, Human
gcuaacauggugaaacccugucuc

SEQ ID NO: 978996 - RNA, 18 nt, Human
ggaaaaaaccauuuagug

SEQ ID NO: 978997 - RNA, 18 nt, Human
ggagcacugccaggggcc

SEQ ID NO: 978998 - RNA, 21 nt, Human
ggagggcaccuguagucccag

SEQ ID NO: 978999 - RNA, 18 nt, Human
ggcaacccuuccugaccc

SEQ ID NO: 979000 - RNA, 19 nt, Human
ggcaccuguagucccagcu

SEQ ID NO: 979001 - RNA, 20 nt, Human
ggcagcucggugggagcgcu

SEQ ID NO: 979002 - RNA, 25 nt, Human
ggccugggccaacuggccuggaagc

SEQ ID NO: 979003 - RNA, 21 nt, Human
ggcucaugccugucaucccag

SEQ ID NO: 979004 - RNA, 20 nt, Human
ggcugaggcaggagaagggc

SEQ ID NO: 979005 - RNA, 23 nt, Human
gggaggccgaggcagguggauca

SEQ ID NO: 979006 - RNA, 21 nt, Human
gggccccuccgggagcacugc

SEQ ID NO: 979007 - RNA, 24 nt, Human
ggggaggccgaggcagguggauca

SEQ ID NO: 979008 - RNA, 18 nt, Human
ggggccugggccaacugg

SEQ ID NO: 979009 - RNA, 24 nt, Human
gguggagggcaccuguagucccag

SEQ ID NO: 979010 - RNA, 24 nt, Human
gguggcucaugccugucaucccag

SEQ ID NO: 979011 - RNA, 19 nt, Human
gugaaagaaagaauagccc

SEQ ID NO: 979012 - RNA, 22 nt, Human
guggagggcaccuguaguccca

SEQ ID NO: 979013 - RNA, 22 nt, Human
uaacauggugaaacccugucuc

SEQ ID NO: 979014 - RNA, 24 nt, Human
uaacauggugaaacccugucucua

SEQ ID NO: 979015 - RNA, 23 nt, Human
uagaccaggcgugguggcucaug

SEQ ID NO: 979016 - RNA, 18 nt, Human
ucacgaggucaggagauc

SEQ ID NO: 979017 - RNA, 24 nt, Human
ucacgaggucaggagaucgagacc

SEQ ID NO: 979018 - RNA, 22 nt, Human
ucaugccugucaucccagcacu

SEQ ID NO: 979019 - RNA, 19 nt, Human
uccacucuccccacucccc

SEQ ID NO: 979020 - RNA, 22 nt, Human
uccauccacucuccccacuccc

SEQ ID NO: 979021 - RNA, 21 nt, Human
ucccuguggaggcgcagaggc

SEQ ID NO: 979022 - RNA, 23 nt, Human
ucgcaccacugcacuccagccug

SEQ ID NO: 979023 - RNA, 22 nt, Human
ucucuauuaaauauacaaaaaa

SEQ ID NO: 979024 - RNA, 22 nt, Human
ucugucucaaaaaaaaaaaaaa

SEQ ID NO: 979025 - RNA, 22 nt, Human
ugagccgagaucgcaccacugc

SEQ ID NO: 979026 - RNA, 24 nt, Human
ugaggcaggagaagggcgugaacc

SEQ ID NO: 979027 - RNA, 25 nt, Human
ugaggcaggagaagggcgugaaccc

SEQ ID NO: 979028 - RNA, 21 nt, Human
ugccaggggccugggccaacu

SEQ ID NO: 979029 - RNA, 21 nt, Human
uggagggcaccuguaguccca

SEQ ID NO: 979030 - RNA, 21 nt, Human
uggcucaugccugucauccca

SEQ ID NO: 979031 - RNA, 24 nt, Human
uggcucaugccugucaucccagca

SEQ ID NO: 979032 - RNA, 24 nt, Human
ugguggagggcaccuguaguccca

SEQ ID NO: 979033 - RNA, 24 nt, Human
ugguggcucaugccugucauccca

SEQ ID NO: 979034 - RNA, 23 nt, Human
uguagguuguuugcuauuucaga

SEQ ID NO: 979035 - RNA, 23 nt, Human
uucaaucuaguaacaaaaguaaa

SEQ ID NO: 979036 - RNA, 21 nt, Human
uuccugggccccuccgggagc

SEQ ID NO: 979037 - RNA, 18 nt, Human
uugcagugagccgagauc

SEQ ID NO: 979038 - RNA, 19 nt, Human
uugcagugagccgagaucg

SEQ ID NO: 979039 - RNA, 22 nt, Human
uugcagugagccgagaucgcac

SEQ ID NO: 979040 - RNA, 21 nt, Human
uuuaucagcaaacauguaggu

SEQ ID NO: 979041 - RNA, 20 nt, Human
uuugcacgugaaagaaagaa

SEQ ID NO: 979042 - RNA, 20 nt, Human
uuuggggaggccgaggcagg

SEQ ID NO: 979043 - RNA, 22 nt, Human
uuuuaaaaaguucauagaccag

SEQ ID NO: 979044 - RNA, 23 nt, Human
aaaaagaggcccagagcuguggg

SEQ ID NO: 979045 - RNA, 22 nt, Human
aaagaaaacgugaaaaggcaac

SEQ ID NO: 979046 - RNA, 26 nt, Human
aaaucaacuuuaaguaaagcagcugg

SEQ ID NO: 979047 - RNA, 22 nt, Human
aacgccauaaaaaaaaguuaaa

SEQ ID NO: 979048 - RNA, 21 nt, Human
aacgugaaaaggcaacaauaa

SEQ ID NO: 979049 - RNA, 19 nt, Human
aagaagcccccaucucccc

SEQ ID NO: 979050 - RNA, 24 nt, Human
aagaaggggaggcugagggaggac

SEQ ID NO: 979051 - RNA, 22 nt, Human
aagcagcugggaggagaggggg

SEQ ID NO: 979052 - RNA, 25 nt, Human
aagcagcugggaggagaggggggaa

SEQ ID NO: 979053 - RNA, 21 nt, Human
aagcugcucccacuucuucug

SEQ ID NO: 979054 - RNA, 18 nt, Human
aaggggaguuugggcagg

SEQ ID NO: 979055 - RNA, 18 nt, Human
aaguuacaguagcugcuc

SEQ ID NO: 979056 - RNA, 19 nt, Human
acacacacauaccccagag

SEQ ID NO: 979057 - RNA, 20 nt, Human
acacauaccccagagccacc

SEQ ID NO: 979058 - RNA, 21 nt, Human
acagcagugugaggaagaagc

SEQ ID NO: 979059 - RNA, 19 nt, Human
acccagaaucucccccaca

SEQ ID NO: 979060 - RNA, 24 nt, Human
accccaaacuggggcaagacagca

SEQ ID NO: 979061 - RNA, 22 nt, Human
acccugcucacugcaacuuggg

SEQ ID NO: 979062 - RNA, 19 nt, Human
acgcccucccaccccaacc

SEQ ID NO: 979063 - RNA, 24 nt, Human
agaccugagucccaagcuccccug

SEQ ID NO: 979064 - RNA, 21 nt, Human
agagggccccaacugcuuccu

SEQ ID NO: 979065 - RNA, 21 nt, Human
agcagcugggaggagaggggg

SEQ ID NO: 979066 - RNA, 24 nt, Human
agcuagucuccaggagaaagccca

SEQ ID NO: 979067 - RNA, 22 nt, Human
agcugcaugccugggacagcgc

SEQ ID NO: 979068 - RNA, 20 nt, Human
agcugcucacucccugggag

SEQ ID NO: 979069 - RNA, 19 nt, Human
aggagaggggggaagacaa

SEQ ID NO: 979070 - RNA, 20 nt, Human
aggagccccuggagguccaa

SEQ ID NO: 979071 - RNA, 19 nt, Human
aggcaggcaggcccauuuc

SEQ ID NO: 979072 - RNA, 21 nt, Human
aggccuguguguggggaggug

SEQ ID NO: 979073 - RNA, 23 nt, Human
aggcuggcaagagggccccaacu

SEQ ID NO: 979074 - RNA, 22 nt, Human
agggaaggggaguuugggcagg

SEQ ID NO: 979075 - RNA, 23 nt, Human
agggcucaguccuguggcugccc

SEQ ID NO: 979076 - RNA, 24 nt, Human
aggggcugggcaguuacagaccug

SEQ ID NO: 979077 - RNA, 22 nt, Human
agggggaggagggggguggggc

SEQ ID NO: 979078 - RNA, 19 nt, Human
agugaaacaagagcagaga

SEQ ID NO: 979079 - RNA, 28 nt, Human
caaacccagaaucucccccacacacugg

SEQ ID NO: 979080 - RNA, 20 nt, Human
caacuugggccccaggcagc

SEQ ID NO: 979081 - RNA, 20 nt, Human
cacacaacacacauuauaag

SEQ ID NO: 979082 - RNA, 23 nt, Human
cacacaacacacauuauaagcac

SEQ ID NO: 979083 - RNA, 24 nt, Human
cacacacacauaccccagagccac

SEQ ID NO: 979084 - RNA, 20 nt, Human
cacacacccacacacacaua

SEQ ID NO: 979085 - RNA, 24 nt, Human
cacacacccacacacacauacccc

SEQ ID NO: 979086 - RNA, 23 nt, Human
cacacauuauaagcacuuugccu

SEQ ID NO: 979087 - RNA, 23 nt, Human
cacacccacacacacauacccca

SEQ ID NO: 979088 - RNA, 24 nt, Human
cacacucacauucaagcacacaca

SEQ ID NO: 979089 - RNA, 18 nt, Human
cacagggcugaccugggg

SEQ ID NO: 979090 - RNA, 25 nt, Human
cacccacacacacauaccccagagc

SEQ ID NO: 979091 - RNA, 22 nt, Human
cacccauaagccccagcuaguc

SEQ ID NO: 979092 - RNA, 20 nt, Human
cacccccucccagaccccac

SEQ ID NO: 979093 - RNA, 21 nt, Human
cacccccucccagaccccacc

SEQ ID NO: 979094 - RNA, 21 nt, Human
cacccucaaggucuaccccaa

SEQ ID NO: 979095 - RNA, 19 nt, Human
cacccuccccaccccguug

SEQ ID NO: 979096 - RNA, 22 nt, Human
caccucaacucaucccugacac

SEQ ID NO: 979097 - RNA, 21 nt, Human
cacucaggcgcacacacccac

SEQ ID NO: 979098 - RNA, 19 nt, Human
cagacacagggcugaccug

SEQ ID NO: 979099 - RNA, 22 nt, Human
cagcaacagaaaugggaggugg

SEQ ID NO: 979100 - RNA, 23 nt, Human
cagcccuaaagggcaaaaagagg

SEQ ID NO: 979101 - RNA, 26 nt, Human
cagcgcccccuguccgucugcuaggg

SEQ ID NO: 979102 - RNA, 23 nt, Human
cagcuagucuccaggagaaagcc

SEQ ID NO: 979103 - RNA, 18 nt, Human
cagcugcaugccugggac

SEQ ID NO: 979104 - RNA, 25 nt, Human
caggagaaagcccagaaaggugacu

SEQ ID NO: 979105 - RNA, 22 nt, Human
caggguaaaagacccucccccc

SEQ ID NO: 979106 - RNA, 21 nt, Human
cauaaaaucuucccccauccc

SEQ ID NO: 979107 - RNA, 24 nt, Human
ccaaggccacgcucacacaacaca

SEQ ID NO: 979108 - RNA, 18 nt, Human
ccacgcucacacaacaca

SEQ ID NO: 979109 - RNA, 21 nt, Human
ccagccccacagaaggccugu

SEQ ID NO: 979110 - RNA, 21 nt, Human
cccacacacacauaccccaga

SEQ ID NO: 979111 - RNA, 25 nt, Human
cccacacacacauaccccagagcca

SEQ ID NO: 979112 - RNA, 19 nt, Human
cccacuucuucugaccccc

SEQ ID NO: 979113 - RNA, 20 nt, Human
cccacuucuucugaccccca

SEQ ID NO: 979114 - RNA, 24 nt, Human
cccagccccacagaaggccugugu

SEQ ID NO: 979115 - RNA, 19 nt, Human
cccaggggcccagccaguu

SEQ ID NO: 979116 - RNA, 23 nt, Human
cccagugcacaggcccagcuacu

SEQ ID NO: 979117 - RNA, 20 nt, Human
cccauaagccccagcuaguc

SEQ ID NO: 979118 - RNA, 23 nt, Human
cccauaagccccagcuagucucc

SEQ ID NO: 979119 - RNA, 25 nt, Human
cccauaagccccagcuagucuccaa

SEQ ID NO: 979120 - RNA, 25 nt, Human
ccccaaagggggaggaggggggugg

SEQ ID NO: 979121 - RNA, 18 nt, Human
ccccaggaaccugcccag

SEQ ID NO: 979122 - RNA, 20 nt, Human
cccccugaggggcagagcca

SEQ ID NO: 979123 - RNA, 23 nt, Human
ccccgccucccuccugcggcccg

SEQ ID NO: 979124 - RNA, 23 nt, Human
ccccuccagcaacagaaauggga

SEQ ID NO: 979125 - RNA, 18 nt, Human
ccccugaggggcagagcc

SEQ ID NO: 979126 - RNA, 22 nt, Human
ccccugaggggcagagccaggg

SEQ ID NO: 979127 - RNA, 20 nt, Human
ccccugcucucuggccccug

SEQ ID NO: 979128 - RNA, 20 nt, Human
cccggggccccugcacgccc

SEQ ID NO: 979129 - RNA, 23 nt, Human
cccuaugcuggcccacccucaag

SEQ ID NO: 979130 - RNA, 21 nt, Human
cccucccagaccccacccugc

SEQ ID NO: 979131 - RNA, 26 nt, Human
cccucccagaccccacccugcucacu

SEQ ID NO: 979132 - RNA, 21 nt, Human
cccuguggcccggguugcccc

SEQ ID NO: 979133 - RNA, 20 nt, Human
cccuguuucugaaaaagcuc

SEQ ID NO: 979134 - RNA, 20 nt, Human
ccgagacggcggguggaggg

SEQ ID NO: 979135 - RNA, 18 nt, Human
ccgcagccgccgccaucg

SEQ ID NO: 979136 - RNA, 24 nt, Human
ccgcagccgccgccaucggcuucc

SEQ ID NO: 979137 - RNA, 21 nt, Human
ccgcuaucgcugccgcggccg

SEQ ID NO: 979138 - RNA, 20 nt, Human
ccucccagaccccacccugc

SEQ ID NO: 979139 - RNA, 20 nt, Human
ccuccccgccucccuccugc

SEQ ID NO: 979140 - RNA, 28 nt, Human
ccugacgcccucccaccccaaccccgac

SEQ ID NO: 979141 - RNA, 19 nt, Human
ccugccucucacccccucc

SEQ ID NO: 979142 - RNA, 23 nt, Human
ccugccucucacccccucccaga

SEQ ID NO: 979143 - RNA, 26 nt, Human
cgcacacacccacacacacauacccc

SEQ ID NO: 979144 - RNA, 19 nt, Human
cgccaucggcuucccggcu

SEQ ID NO: 979145 - RNA, 18 nt, Human
cgcccccuguccgucugc

SEQ ID NO: 979146 - RNA, 22 nt, Human
cgcccgggccgaccugggcccu

SEQ ID NO: 979147 - RNA, 24 nt, Human
cgcccucccaccccaaccccgaca

SEQ ID NO: 979148 - RNA, 19 nt, Human
cgccucccuccugcggccc

SEQ ID NO: 979149 - RNA, 21 nt, Human
cgcgcgcagcgcccccugucc

SEQ ID NO: 979150 - RNA, 18 nt, Human
cgcugccgcggccgccgc

SEQ ID NO: 979151 - RNA, 19 nt, Human
cggcuucccggcucaaccc

SEQ ID NO: 979152 - RNA, 22 nt, Human
cguuggggaauggccugagggc

SEQ ID NO: 979153 - RNA, 24 nt, Human
cuagcaacagcccuaaagggcaaa

SEQ ID NO: 979154 - RNA, 23 nt, Human
cucccagaccccacccugcucac

SEQ ID NO: 979155 - RNA, 20 nt, Human
cuccccugcucucuggcccc

SEQ ID NO: 979156 - RNA, 22 nt, Human
cucucccuagcaacagcccuaa

SEQ ID NO: 979157 - RNA, 22 nt, Human
cugacacacgcauguccuccca

SEQ ID NO: 979158 - RNA, 19 nt, Human
cugccgcggccgccgcugc

SEQ ID NO: 979159 - RNA, 21 nt, Human
cugccugacgcccucccaccc

SEQ ID NO: 979160 - RNA, 19 nt, Human
cuggcccccugaggggcag

SEQ ID NO: 979161 - RNA, 21 nt, Human
cuggcggcggagggauccccc

SEQ ID NO: 979162 - RNA, 20 nt, Human
cuggggagccugagggcucc

SEQ ID NO: 979163 - RNA, 23 nt, Human
cuguccgucugcuagggcggcgc

SEQ ID NO: 979164 - RNA, 20 nt, Human
cuuggcaccccaaacugggg

SEQ ID NO: 979165 - RNA, 19 nt, Human
gaagacaagggggagaagg

SEQ ID NO: 979166 - RNA, 22 nt, Human
gacccagccugugacagacaca

SEQ ID NO: 979167 - RNA, 22 nt, Human
gaccuggggucagcaaggaggc

SEQ ID NO: 979168 - RNA, 24 nt, Human
gacgagaaaaacgccauaaaaaaa

SEQ ID NO: 979169 - RNA, 20 nt, Human
gagaagggaacgcugguggu

SEQ ID NO: 979170 - RNA, 19 nt, Human
gagaggggggaagacaagg

SEQ ID NO: 979171 - RNA, 21 nt, Human
gagcagagaaaaggggcuggg

SEQ ID NO: 979172 - RNA, 18 nt, Human
gaggagaggggggaagac

SEQ ID NO: 979173 - RNA, 18 nt, Human
gagggccccaacugcuuc

SEQ ID NO: 979174 - RNA, 21 nt, Human
gagucccaagcuccccugcuc

SEQ ID NO: 979175 - RNA, 23 nt, Human
gaugguggagugaaacaagagca

SEQ ID NO: 979176 - RNA, 24 nt, Human
gcaagacagcaaugaggguuagag

SEQ ID NO: 979177 - RNA, 22 nt, Human
gcaaggcagggcaggcggcccc

SEQ ID NO: 979178 - RNA, 21 nt, Human
gcacacacccacacacacaua

SEQ ID NO: 979179 - RNA, 23 nt, Human
gcacacacccacacacacauacc

SEQ ID NO: 979180 - RNA, 19 nt, Human
gcagcugcaugccugggac

SEQ ID NO: 979181 - RNA, 28 nt, Human
gcagggcaggcggccccaggaaccugcc

SEQ ID NO: 979182 - RNA, 25 nt, Human
gccacgcucacacaacacacauuau

SEQ ID NO: 979183 - RNA, 20 nt, Human
gcccgggccgaccugggccc

SEQ ID NO: 979184 - RNA, 18 nt, Human
gccgcugcgaacccgggg

SEQ ID NO: 979185 - RNA, 19 nt, Human
gccugugacagacacaggg

SEQ ID NO: 979186 - RNA, 24 nt, Human
gcgcccccuguccgucugcuaggg

SEQ ID NO: 979187 - RNA, 21 nt, Human
gcggccccaggaaccugccca

SEQ ID NO: 979188 - RNA, 19 nt, Human
gcugcaaugcccaugcgug

SEQ ID NO: 979189 - RNA, 21 nt, Human
ggacgggcagucagcgaggaa

SEQ ID NO: 979190 - RNA, 22 nt, Human
ggaggacagccccuccagcaac

SEQ ID NO: 979191 - RNA, 24 nt, Human
ggaggagaggggggaagacaaggg

SEQ ID NO: 979192 - RNA, 20 nt, Human
ggagguggggcgggaagaag

SEQ ID NO: 979193 - RNA, 19 nt, Human
ggcaggggcugcuggccgc

SEQ ID NO: 979194 - RNA, 23 nt, Human
ggcagucagcgaggaaucggagc

SEQ ID NO: 979195 - RNA, 25 nt, Human
ggcccagcuacucaggagcugaagg

SEQ ID NO: 979196 - RNA, 19 nt, Human
ggccccugauuugccaugc

SEQ ID NO: 979197 - RNA, 22 nt, Human
ggcgagggggucccaggaagga

SEQ ID NO: 979198 - RNA, 18 nt, Human
ggcucaguccuguggcug

SEQ ID NO: 979199 - RNA, 21 nt, Human
ggcucaguccuguggcugccc

SEQ ID NO: 979200 - RNA, 20 nt, Human
ggcuucccggcucaacccgg

SEQ ID NO: 979201 - RNA, 19 nt, Human
gggaagaaggggaggcuga

SEQ ID NO: 979202 - RNA, 22 nt, Human
gggaagaaggggaggcugaggg

SEQ ID NO: 979203 - RNA, 24 nt, Human
gggaaguagaaaccacugacauac

SEQ ID NO: 979204 - RNA, 21 nt, Human
gggaggcugagggaggacggg

SEQ ID NO: 979205 - RNA, 22 nt, Human
gggcaagacagcaaugaggguu

SEQ ID NO: 979206 - RNA, 21 nt, Human
gggcaggcggccccaggaacc

SEQ ID NO: 979207 - RNA, 20 nt, Human
gggcccagccaguucugggg

SEQ ID NO: 979208 - RNA, 21 nt, Human
ggggaauggccugagggcccc

SEQ ID NO: 979209 - RNA, 26 nt, Human
guccucccaaggccacgcucacacaa

SEQ ID NO: 979210 - RNA, 21 nt, Human
guccuguggcugcccguuccu

SEQ ID NO: 979211 - RNA, 27 nt, Human
gugcccagccccacagaaggccugugu

SEQ ID NO: 979212 - RNA, 23 nt, Human
guggagggggccgggaccacgcg

SEQ ID NO: 979213 - RNA, 23 nt, Human
guggagugaaacaagagcagaga

SEQ ID NO: 979214 - RNA, 25 nt, Human
uaaagggcaaaaagaggcccagagc

SEQ ID NO: 979215 - RNA, 22 nt, Human
uaacuaggcugugcauaaaauc

SEQ ID NO: 979216 - RNA, 21 nt, Human
uaagccccagcuagucuccag

SEQ ID NO: 979217 - RNA, 26 nt, Human
uaaguaaagcagcugggaggagaggg

SEQ ID NO: 979218 - RNA, 19 nt, Human
uaaguggugccaucccuug

SEQ ID NO: 979219 - RNA, 19 nt, Human
uaccccaaagggggaggag

SEQ ID NO: 979220 - RNA, 19 nt, Human
uaccccagagccaccgagg

SEQ ID NO: 979221 - RNA, 23 nt, Human
uauauuuauagauuuguuuucac

SEQ ID NO: 979222 - RNA, 21 nt, Human
ucaaaggucuccuccccaugg

SEQ ID NO: 979223 - RNA, 22 nt, Human
ucaaaggucuccuccccauggg

SEQ ID NO: 979224 - RNA, 22 nt, Human
ucacugcaacuugggccccagg

SEQ ID NO: 979225 - RNA, 22 nt, Human
ucccaggaaggaggacagcccc

SEQ ID NO: 979226 - RNA, 22 nt, Human
ucccaggaaggaggacagcccc

SEQ ID NO: 979227 - RNA, 22 nt, Human
uccccaggggcccagccaguuc

SEQ ID NO: 979228 - RNA, 18 nt, Human
ucccccggcuuucuccug

SEQ ID NO: 979229 - RNA, 19 nt, Human
ucccccggcuuucuccugg

SEQ ID NO: 979230 - RNA, 19 nt, Human
ucccccggggggcaggggc

SEQ ID NO: 979231 - RNA, 25 nt, Human
uccccgccucccuccugcggccccc

SEQ ID NO: 979232 - RNA, 21 nt, Human
uccccugcucucuggccccug

SEQ ID NO: 979233 - RNA, 18 nt, Human
ucccgcugcugcuagugc

SEQ ID NO: 979234 - RNA, 18 nt, Human
ucccucuucccucucccu

SEQ ID NO: 979235 - RNA, 18 nt, Human
uccuccccgccucccucc

SEQ ID NO: 979236 - RNA, 22 nt, Human
uccugccucucacccccuccca

SEQ ID NO: 979237 - RNA, 19 nt, Human
ucucccucuucccucuccc

SEQ ID NO: 979238 - RNA, 19 nt, Human
ucugacccccauuccugcc

SEQ ID NO: 979239 - RNA, 20 nt, Human
ucuggggagccugagggcuc

SEQ ID NO: 979240 - RNA, 22 nt, Human
ucuuuggcuggagugagagggc

SEQ ID NO: 979241 - RNA, 25 nt, Human
ugaaacaagagcagagaagggaggc

SEQ ID NO: 979242 - RNA, 18 nt, Human
ugaagggggagaggacag

SEQ ID NO: 979243 - RNA, 24 nt, Human
ugacccccauuccugccucucacc

SEQ ID NO: 979244 - RNA, 23 nt, Human
ugacgcccucccaccccaacccc

SEQ ID NO: 979245 - RNA, 21 nt, Human
ugacuuccaucuuggcacccc

SEQ ID NO: 979246 - RNA, 18 nt, Human
ugagagggcucaguccug

SEQ ID NO: 979247 - RNA, 18 nt, Human
ugagggaggacgggugga

SEQ ID NO: 979248 - RNA, 19 nt, Human
ugauacauuuauugaaaga

SEQ ID NO: 979249 - RNA, 22 nt, Human
ugauucacucacugggucugau

SEQ ID NO: 979250 - RNA, 22 nt, Human
ugcacaggcccagcuacucagg

SEQ ID NO: 979251 - RNA, 25 nt, Human
ugcauaaaaucuucccccaucccuu

SEQ ID NO: 979252 - RNA, 23 nt, Human
ugccaugccccagccuugaaagc

SEQ ID NO: 979253 - RNA, 18 nt, Human
ugccccagccuugaaagc

SEQ ID NO: 979254 - RNA, 20 nt, Human
ugccccaggccgcgcgcagc

SEQ ID NO: 979255 - RNA, 20 nt, Human
ugcccguuccuccuccccgc

SEQ ID NO: 979256 - RNA, 20 nt, Human
ugccucugccugacgcccuc

SEQ ID NO: 979257 - RNA, 19 nt, Human
ugccugauucacucacugg

SEQ ID NO: 979258 - RNA, 19 nt, Human
ugccugggacagcgcaagg

SEQ ID NO: 979259 - RNA, 23 nt, Human
uggaggcaggcaggcccauuucu

SEQ ID NO: 979260 - RNA, 19 nt, Human
uggagugaaacaagagcag

SEQ ID NO: 979261 - RNA, 21 nt, Human
uggcccacccucaaggucuac

SEQ ID NO: 979262 - RNA, 23 nt, Human
uggccccugauuugccaugcccc

SEQ ID NO: 979263 - RNA, 18 nt, Human
ugggacagcgcaaggcug

SEQ ID NO: 979264 - RNA, 18 nt, Human
ugggagguggggcgggaa

SEQ ID NO: 979265 - RNA, 24 nt, Human
ugggcaaacccagaaucuccccca

SEQ ID NO: 979266 - RNA, 19 nt, Human
ugggcaguuacagaccuga

SEQ ID NO: 979267 - RNA, 22 nt, Human
ugggccaucuguccagggcggc

SEQ ID NO: 979268 - RNA, 23 nt, Human
uggggcgggaagaaggggaggcu

SEQ ID NO: 979269 - RNA, 21 nt, Human
uggggucagcaaggaggcugg

SEQ ID NO: 979270 - RNA, 19 nt, Human
uggugguucccuccaaccc

SEQ ID NO: 979271 - RNA, 20 nt, Human
uguccagggcggcgggcgga

SEQ ID NO: 979272 - RNA, 18 nt, Human
ugugaggaagaagccccc

SEQ ID NO: 979273 - RNA, 19 nt, Human
uguguggggagguggggca

SEQ ID NO: 979274 - RNA, 29 nt, Human
uucccccaucccuucaccuaaucacagaa

SEQ ID NO: 979275 - RNA, 23 nt, Human
uuccugccccuguggcccggguu

SEQ ID NO: 979276 - RNA, 24 nt, Human
uuuauugaaagaguauuuuuuuuu

SEQ ID NO: 979277 - RNA, 27 nt, Human
uuucaccccacugcugcccuguuucug

SEQ ID NO: 979278 - RNA, 18 nt, Human
uuucuggcuccccuuugg

SEQ ID NO: 979279 - RNA, 19 nt, Human
uuuggcuggagugagaggg

SEQ ID NO: 979280 - RNA, 20 nt, Human
uuuggucucccucuucccuc

SEQ ID NO: 979281 - RNA, 18 nt, Human
aagcggcggcgaggaggc

SEQ ID NO: 979282 - RNA, 19 nt, Human
aagcggcggcgaggaggcu

SEQ ID NO: 979283 - RNA, 19 nt, Human
acccaguucgcaucuggaa

SEQ ID NO: 979284 - RNA, 19 nt, Human
acccugaaaccugcccagg

SEQ ID NO: 979285 - RNA, 21 nt, Human
acccugaaaccugcccaggcu

SEQ ID NO: 979286 - RNA, 21 nt, Human
acccugaaaccugcccaggcu

SEQ ID NO: 979287 - RNA, 18 nt, Human
accuccacccccugcccc

SEQ ID NO: 979288 - RNA, 19 nt, Human
accuccacccccugccccu

SEQ ID NO: 979289 - RNA, 22 nt, Human
agaagugcugcucuuucagaug

SEQ ID NO: 979290 - RNA, 22 nt, Human
agaagugcugcucuuucagaug

SEQ ID NO: 979291 - RNA, 19 nt, Human
agacugggcugggccagag

SEQ ID NO: 979292 - RNA, 19 nt, Human
agacugggcugggccagag

SEQ ID NO: 979293 - RNA, 18 nt, Human
agaggaagcggcggcgag

SEQ ID NO: 979294 - RNA, 20 nt, Human
aggcaguccccucggguggg

SEQ ID NO: 979295 - RNA, 21 nt, Human
caagcgucguccacaggccuu

SEQ ID NO: 979296 - RNA, 22 nt, Human
caauccaccggggaaaggccac

SEQ ID NO: 979297 - RNA, 22 nt, Human
caggccggugaccccaaccucc

SEQ ID NO: 979298 - RNA, 22 nt, Human
caggccggugaccccaaccucc

SEQ ID NO: 979299 - RNA, 20 nt, Human
ccaagcaggccggugacccc

SEQ ID NO: 979300 - RNA, 20 nt, Human
ccaagcaggccggugacccc

SEQ ID NO: 979301 - RNA, 18 nt, Human
ccacaggccuuggccagc

SEQ ID NO: 979302 - RNA, 18 nt, Human
ccacaggccuuggccagc

SEQ ID NO: 979303 - RNA, 21 nt, Human
cccacuggcacccugaaaccu

SEQ ID NO: 979304 - RNA, 21 nt, Human
cccacuggcacccugaaaccu

SEQ ID NO: 979305 - RNA, 21 nt, Human
ccccaaccuccacccccugcc

SEQ ID NO: 979306 - RNA, 21 nt, Human
ccccaaccuccacccccugcc

SEQ ID NO: 979307 - RNA, 23 nt, Human
ccccaaccuccacccccugcccc

SEQ ID NO: 979308 - RNA, 23 nt, Human
ccccaaccuccacccccugcccc

SEQ ID NO: 979309 - RNA, 23 nt, Human
cccgccccgcgccuucucgagag

SEQ ID NO: 979310 - RNA, 18 nt, Human
cccugaaaccugcccagg

SEQ ID NO: 979311 - RNA, 20 nt, Human
cgccgcgggcucgaccgccc

SEQ ID NO: 979312 - RNA, 20 nt, Human
cgccgcgggcucgaccgccc

SEQ ID NO: 979313 - RNA, 19 nt, Human
cggccggggcgcugcgcgg

SEQ ID NO: 979314 - RNA, 23 nt, Human
cggcggcgaggaggcuuccggcc

SEQ ID NO: 979315 - RNA, 24 nt, Human
cuuuaauagcugagaagugcugcu

SEQ ID NO: 979316 - RNA, 23 nt, Human
gagaagugcugcucuuucagaug

SEQ ID NO: 979317 - RNA, 21 nt, Human
gccaagcaggccggugacccc

SEQ ID NO: 979318 - RNA, 21 nt, Human
gccaagcaggccggugacccc

SEQ ID NO: 979319 - RNA, 24 nt, Human
gcccgccccgcgccuucucgagag

SEQ ID NO: 979320 - RNA, 26 nt, Human
gggccagagaccaauccaccggggaa

SEQ ID NO: 979321 - RNA, 25 nt, Human
gggccagagaccaauccacggggga

SEQ ID NO: 979322 - RNA, 21 nt, Human
gugaccccaaccuccaccccc

SEQ ID NO: 979323 - RNA, 21 nt, Human
gugaccccaaccuccaccccc

SEQ ID NO: 979324 - RNA, 22 nt, Human
gugaccccaaccuccacccccu

SEQ ID NO: 979325 - RNA, 19 nt, Human
uaggaccucgccaucuccc

SEQ ID NO: 979326 - RNA, 24 nt, Human
uccacaggccuuggccagcggggg

SEQ ID NO: 979327 - RNA, 24 nt, Human
uccacaggccuuggccagcggggg

SEQ ID NO: 979328 - RNA, 23 nt, Human
uccagggggccuuuaauagcuga

SEQ ID NO: 979329 - RNA, 23 nt, Human
uccagggggccuuuaauagcuga

SEQ ID NO: 979330 - RNA, 18 nt, Human
uccucuaggaccucgcca

SEQ ID NO: 979331 - RNA, 23 nt, Human
ucucugggucguucuuugguuac

SEQ ID NO: 979332 - RNA, 26 nt, Human
ucuuuuuuuuuuuuuucuauccaggg

SEQ ID NO: 979333 - RNA, 18 nt, Human
ugccaagcaggccgguga

SEQ ID NO: 979334 - RNA, 18 nt, Human
ugccaagcaggccgguga

SEQ ID NO: 979335 - RNA, 21 nt, Human
ugcccaggcugggccgcaagc

SEQ ID NO: 979336 - RNA, 21 nt, Human
ugcccaggcugggccgccagc

SEQ ID NO: 979337 - RNA, 18 nt, Human
uggaaggccaggcagucc

SEQ ID NO: 979338 - RNA, 18 nt, Human
uggccggcugggaagcgc

SEQ ID NO: 979339 - RNA, 21 nt, Human
ugggccagagaccaauccacc

SEQ ID NO: 979340 - RNA, 23 nt, Human
uuuaauagcugagaagugcugcu

SEQ ID NO: 979341 - RNA, 19 nt, Human
aaaauacacuuucccccca

SEQ ID NO: 979342 - RNA, 23 nt, Human
aaacagaagaaaaucuaaagcaa

SEQ ID NO: 979343 - RNA, 24 nt, Human
aaacauauaaugauuuccacaaaa

SEQ ID NO: 979344 - RNA, 23 nt, Human
aagaaagcugggagcagacagac

SEQ ID NO: 979345 - RNA, 21 nt, Human
aagacaccgcuaaagccgugg

SEQ ID NO: 979346 - RNA, 20 nt, Human
aagcaaacauauaaugauua

SEQ ID NO: 979347 - RNA, 24 nt, Human
aagcaaacauauaaugauuuccac

SEQ ID NO: 979348 - RNA, 25 nt, Human
aagcaagaaaaauacacuuuccccc

SEQ ID NO: 979349 - RNA, 19 nt, Human
aagcugggagcagacagac

SEQ ID NO: 979350 - RNA, 19 nt, Human
aaggaaagagugcaugaua

SEQ ID NO: 979351 - RNA, 21 nt, Human
aaggaaggaaaaagaaaagga

SEQ ID NO: 979352 - RNA, 19 nt, Human
acgucgucaacucccacca

SEQ ID NO: 979353 - RNA, 18 nt, Human
acuacugaccaggacugu

SEQ ID NO: 979354 - RNA, 23 nt, Human
acuuugaaguuuauuuuacagca

SEQ ID NO: 979355 - RNA, 21 nt, Human
agaagaaaaggaaagagugca

SEQ ID NO: 979356 - RNA, 25 nt, Human
agcaagaaaaauacacuuucccccc

SEQ ID NO: 979357 - RNA, 20 nt, Human
aggaaggaaaaagaaaagga

SEQ ID NO: 979358 - RNA, 18 nt, Human
agguaugaccccacaacc

SEQ ID NO: 979359 - RNA, 20 nt, Human
augauaagcaagaaaaauac

SEQ ID NO: 979360 - RNA, 18 nt, Human
augcaaugcuuggccuuc

SEQ ID NO: 979361 - RNA, 22 nt, Human
caaaagacaccgcuaaagccgu

SEQ ID NO: 979362 - RNA, 21 nt, Human
cacaacccaacuucccgaacu

SEQ ID NO: 979363 - RNA, 19 nt, Human
cacgucgucaacucccacc

SEQ ID NO: 979364 - RNA, 18 nt, Human
cagaagaaaaucuaaagc

SEQ ID NO: 979365 - RNA, 20 nt, Human
ccacaacccaacuucccgaa

SEQ ID NO: 979366 - RNA, 21 nt, Human
ccagcaccacgucgucaacuc

SEQ ID NO: 979367 - RNA, 22 nt, Human
cccaagaaagcugggagcagac

SEQ ID NO: 979368 - RNA, 21 nt, Human
cccacaacccaacuucccgaa

SEQ ID NO: 979369 - RNA, 27 nt, Human
cccacgccgucggaagaaacccaagaa

SEQ ID NO: 979370 - RNA, 25 nt, Human
ccguggcccugaggggccgggaauu

SEQ ID NO: 979371 - RNA, 23 nt, Human
cgaagaacucgcaaaagacaccg

SEQ ID NO: 979372 - RNA, 21 nt, Human
cgccgucggaagaaacccaag

SEQ ID NO: 979373 - RNA, 23 nt, Human
cggaagaaacccaagaaagcugg

SEQ ID NO: 979374 - RNA, 18 nt, Human
gaaaaagaaaaggagggg

SEQ ID NO: 979375 - RNA, 21 nt, Human
gaaggaaggaaaaagaaaagg

SEQ ID NO: 979376 - RNA, 26 nt, Human
gaaggaaggaaaaagaaaaggagggg

SEQ ID NO: 979377 - RNA, 21 nt, Human
gaccccacaacccaacuuccc

SEQ ID NO: 979378 - RNA, 18 nt, Human
gagaagaaaaggaaagag

SEQ ID NO: 979379 - RNA, 21 nt, Human
gagauaauuaaaaaccuuuaa

SEQ ID NO: 979380 - RNA, 20 nt, Human
gauggugaaaacagaagaaa

SEQ ID NO: 979381 - RNA, 19 nt, Human
ggcgagaagaaaaggaaag

SEQ ID NO: 979382 - RNA, 24 nt, Human
uaaagcaaacauauaaugauuucc

SEQ ID NO: 979383 - RNA, 20 nt, Human
uagcgaggccccacgccguc

SEQ ID NO: 979384 - RNA, 23 nt, Human
uagguauucaacugagucaguuu

SEQ ID NO: 979385 - RNA, 23 nt, Human
uaugaccccacaacccaacuucc

SEQ ID NO: 979386 - RNA, 22 nt, Human
ugaaaacagaagaaaaucuaaa

SEQ ID NO: 979387 - RNA, 19 nt, Human
ugaccccacaacccaacuu

SEQ ID NO: 979388 - RNA, 20 nt, Human
ugaccccacaacccaacuuc

SEQ ID NO: 979389 - RNA, 24 nt, Human
ugauaagcaagaaaaauacacuuu

SEQ ID NO: 979390 - RNA, 26 nt, Human
ugauaagcaagaaaaauacacuuucc

SEQ ID NO: 979391 - RNA, 19 nt, Human
uguuaugauggugaaaaca

SEQ ID NO: 979392 - RNA, 23 nt, Human
uuuccacaaaaaccauguauuuc

SEQ ID NO: 979393 - RNA, 20 nt, Human
uuucucccuuauauuaaagg

SEQ ID NO: 979394 - RNA, 21 nt, Human
aaaguacuuucugucccaaca

SEQ ID NO: 979395 - RNA, 21 nt, Human
aacuaauccauagcccuucug

SEQ ID NO: 979396 - RNA, 19 nt, Human
aagacagaaaaugggcagg

SEQ ID NO: 979397 - RNA, 23 nt, Human
acaccuugguuaauuaaagacag

SEQ ID NO: 979398 - RNA, 18 nt, Human
acaugccaaaauucauau

SEQ ID NO: 979399 - RNA, 18 nt, Human
agacagaaaaugggcagg

SEQ ID NO: 979400 - RNA, 18 nt, Human
agaguggaaaaguaaaga

SEQ ID NO: 979401 - RNA, 19 nt, Human
aguaaagagaagcaaggcc

SEQ ID NO: 979402 - RNA, 23 nt, Human
auaaggcaaagcauacuuguuag

SEQ ID NO: 979403 - RNA, 28 nt, Human
cacaacagcauacauuuuaugcuccaaa

SEQ ID NO: 979404 - RNA, 20 nt, Human
caguucaaacuaauccauag

SEQ ID NO: 979405 - RNA, 19 nt, Human
ccucuaagcuucugaacag

SEQ ID NO: 979406 - RNA, 22 nt, Human
ccucuaagcuucugaacagccc

SEQ ID NO: 979407 - RNA, 24 nt, Human
ccucuaagcuucugaacagcccac

SEQ ID NO: 979408 - RNA, 22 nt, Human
cucaacaagcugauacuacaaa

SEQ ID NO: 979409 - RNA, 21 nt, Human
cugaaaacauuugcaucccua

SEQ ID NO: 979410 - RNA, 27 nt, Human
cugauacuacaaaucccuuauauuaac

SEQ ID NO: 979411 - RNA, 21 nt, Human
gaaaaguaaagagaagcaagg

SEQ ID NO: 979412 - RNA, 25 nt, Human
ggaaaaguaaagagaagccgguacc

SEQ ID NO: 979413 - RNA, 23 nt, Human
gggcaggggugucacagaaguau

SEQ ID NO: 979414 - RNA, 20 nt, Human
gguuacauuuaauguucuuc

SEQ ID NO: 979415 - RNA, 19 nt, Human
uaaagacagaaaaugggca

SEQ ID NO: 979416 - RNA, 21 nt, Human
uaacaguugugacagucacac

SEQ ID NO: 979417 - RNA, 23 nt, Human
uaacugcugcuucugaucacuga

SEQ ID NO: 979418 - RNA, 22 nt, Human
uaaguacacgacaaagucuuca

SEQ ID NO: 979419 - RNA, 19 nt, Human
uacacaguauguauaacaa

SEQ ID NO: 979420 - RNA, 21 nt, Human
uacagauggaaaauauguagu

SEQ ID NO: 979421 - RNA, 20 nt, Human
uacauuuuaugcuccaaaau

SEQ ID NO: 979422 - RNA, 24 nt, Human
uagcccuucugagaaacuacagau

SEQ ID NO: 979423 - RNA, 21 nt, Human
uagucacaauuacuuucagau

SEQ ID NO: 979424 - RNA, 21 nt, Human
uaguuuacuggaaaacauaac

SEQ ID NO: 979425 - RNA, 25 nt, Human
uauaauugagacuacacugcuauac

SEQ ID NO: 979426 - RNA, 25 nt, Human
uauacaaaacauauuucaauguagu

SEQ ID NO: 979427 - RNA, 19 nt, Human
ucacagaaguaugcaagga

SEQ ID NO: 979428 - RNA, 23 nt, Human
ucagaacccggcccaacaaacua

SEQ ID NO: 979429 - RNA, 28 nt, Human
ucuccaguuucuaagacagaugcauuuc

SEQ ID NO: 979430 - RNA, 21 nt, Human
ugaaauacaaauauaauuauc

SEQ ID NO: 979431 - RNA, 23 nt, Human
ugacagucacaccuaacaccuug

SEQ ID NO: 979432 - RNA, 24 nt, Human
ugcuccaaaauacauggaucugac

SEQ ID NO: 979433 - RNA, 21 nt, Human
uggaaaaguaaagagaagcaa

SEQ ID NO: 979434 - RNA, 18 nt, Human
uguucaauuuccaaaagu

SEQ ID NO: 979435 - RNA, 20 nt, Human
uuuaaauguggaaauaaggc

SEQ ID NO: 979436 - RNA, 20 nt, Human
aaaaaaaaacaagaucuaga

SEQ ID NO: 979437 - RNA, 19 nt, Human
aaaaaagacaguagcuuaa

SEQ ID NO: 979438 - RNA, 21 nt, Human
aaaaaauaacgaaccaaccaa

SEQ ID NO: 979439 - RNA, 21 nt, Human
aaaacaaaacaaaacaagacc

SEQ ID NO: 979440 - RNA, 23 nt, Human
aaaacaaaacaagaccaacaaaa

SEQ ID NO: 979441 - RNA, 22 nt, Human
aaaacagcugaaaacccaaagu

SEQ ID NO: 979442 - RNA, 22 nt, Human
aaacaaaacaaaacaagaccaa

SEQ ID NO: 979443 - RNA, 25 nt, Human
aaacaaaacaaaacaagaccaacaa

SEQ ID NO: 979444 - RNA, 19 nt, Human
aaacaaaacaagaccaaca

SEQ ID NO: 979445 - RNA, 21 nt, Human
aaacaaaacaagaccaacaaa

SEQ ID NO: 979446 - RNA, 19 nt, Human
aaacagacaaugcccucag

SEQ ID NO: 979447 - RNA, 25 nt, Human
aaagaaucagaaucucaagaucuau

SEQ ID NO: 979448 - RNA, 18 nt, Human
aaagcaggggacuguuug

SEQ ID NO: 979449 - RNA, 18 nt, Human
aaauaaaacaaaacaacc

SEQ ID NO: 979450 - RNA, 23 nt, Human
aacaaaacaaaacaagaccaaca

SEQ ID NO: 979451 - RNA, 22 nt, Human
aacaaaacaaccaaccaaaaua

SEQ ID NO: 979452 - RNA, 18 nt, Human
aacaacagaaacagucca

SEQ ID NO: 979453 - RNA, 22 nt, Human
aacaacagaaacaguccaggaa

SEQ ID NO: 979454 - RNA, 27 nt, Human
aacaacagaaacaguccaggaagauga

SEQ ID NO: 979455 - RNA, 19 nt, Human
aacaagaccaacaaaaaaa

SEQ ID NO: 979456 - RNA, 19 nt, Human
aacaagaucuagaaacucu

SEQ ID NO: 979457 - RNA, 22 nt, Human
aacacagagaacaacagaaaca

SEQ ID NO: 979458 - RNA, 24 nt, Human
aaccaaaaaacaaaacaaaacaag

SEQ ID NO: 979459 - RNA, 22 nt, Human
aaccaaccaaccaaaaaacaaa

SEQ ID NO: 979460 - RNA, 19 nt, Human
aagaagcggcugugacccc

SEQ ID NO: 979461 - RNA, 20 nt, Human
aagacauacaggaaaggacu

SEQ ID NO: 979462 - RNA, 18 nt, Human
aagcaaacccaaaugaac

SEQ ID NO: 979463 - RNA, 24 nt, Human
aagcaaacccaaaugaacauguug

SEQ ID NO: 979464 - RNA, 23 nt, Human
aagcauuuccaaaaugaaguuac

SEQ ID NO: 979465 - RNA, 22 nt, Human
acaaaaaaaagugccaucccac

SEQ ID NO: 979466 - RNA, 26 nt, Human
acaaaacaaaacaagaccaacaaaaa

SEQ ID NO: 979467 - RNA, 19 nt, Human
acaagaccaacaaaaaaaa

SEQ ID NO: 979468 - RNA, 18 nt, Human
acccugaaaagggaagag

SEQ ID NO: 979469 - RNA, 20 nt, Human
accuggaagaucaagaucuc

SEQ ID NO: 979470 - RNA, 19 nt, Human
agaaaacagacaaugcccu

SEQ ID NO: 979471 - RNA, 20 nt, Human
agaaaacagacaaugcccuc

SEQ ID NO: 979472 - RNA, 26 nt, Human
agaacaacagaaacaguccaggaaga

SEQ ID NO: 979473 - RNA, 19 nt, Human
agaauuccuguaauuccac

SEQ ID NO: 979474 - RNA, 26 nt, Human
agagaacaacagaaacaguccaggaa

SEQ ID NO: 979475 - RNA, 19 nt, Human
agagcccaaccaaggccaa

SEQ ID NO: 979476 - RNA, 18 nt, Human
agcuguacaugaaagcag

SEQ ID NO: 979477 - RNA, 24 nt, Human
auacaaaaacaaaaaauaaaacaa

SEQ ID NO: 979478 - RNA, 23 nt, Human
augcagcccggacacagcaaguu

SEQ ID NO: 979479 - RNA, 24 nt, Human
auggcuguggggaucuccacaggg

SEQ ID NO: 979480 - RNA, 22 nt, Human
caaaaaaaagugccaucccacc

SEQ ID NO: 979481 - RNA, 24 nt, Human
caaaaaacaaaacaaaacaagacc

SEQ ID NO: 979482 - RNA, 22 nt, Human
caaaaaauaaaacaaaacaacc

SEQ ID NO: 979483 - RNA, 23 nt, Human
caaaacaaaacaagaccaacaaa

SEQ ID NO: 979484 - RNA, 25 nt, Human
caaaacaaccaaccaaaauaacucu

SEQ ID NO: 979485 - RNA, 24 nt, Human
caaagaaaacagacaaugcccuca

SEQ ID NO: 979486 - RNA, 19 nt, Human
caaccaaaaaacaaaacaa

SEQ ID NO: 979487 - RNA, 25 nt, Human
caaccaaaaaacaaaacaaaacaag

SEQ ID NO: 979488 - RNA, 26 nt, Human
caaccaaaaaacaaaacaaaacaaga

SEQ ID NO: 979489 - RNA, 23 nt, Human
caaccaaccaaaauaacucuggu

SEQ ID NO: 979490 - RNA, 24 nt, Human
caagaccaacaaaaaaaagugcca

SEQ ID NO: 979491 - RNA, 26 nt, Human
caagaccaacaaaaaaaagugccauc

SEQ ID NO: 979492 - RNA, 22 nt, Human
caccccuccccuugguucuuuc

SEQ ID NO: 979493 - RNA, 20 nt, Human
cacccugaaaagggaagagg

SEQ ID NO: 979494 - RNA, 21 nt, Human
cagagcccaaccaaggccaaa

SEQ ID NO: 979495 - RNA, 26 nt, Human
cagcugccuauuuccacaucuuucaa

SEQ ID NO: 979496 - RNA, 18 nt, Human
ccaaaaugaaguuacagg

SEQ ID NO: 979497 - RNA, 21 nt, Human
ccaaccaaaaaacaaaacaaa

SEQ ID NO: 979498 - RNA, 22 nt, Human
ccaaccaaccaaaaaacaaaac

SEQ ID NO: 979499 - RNA, 24 nt, Human
ccaaccaaccaaaaaacaaaacaa

SEQ ID NO: 979500 - RNA, 19 nt, Human
ccuggaagaucaagaucua

SEQ ID NO: 979501 - RNA, 19 nt, Human
cuggucuuaggguaauaga

SEQ ID NO: 979502 - RNA, 20 nt, Human
cuggucuuaggguaauagaa

SEQ ID NO: 979503 - RNA, 22 nt, Human
gaaaaagcuguacaugaaagca

SEQ ID NO: 979504 - RNA, 22 nt, Human
gaaaacccaaaguggauuagaa

SEQ ID NO: 979505 - RNA, 21 nt, Human
gaaaagggaagaggaaaaugc

SEQ ID NO: 979506 - RNA, 19 nt, Human
gauguaaaaacagcugaaa

SEQ ID NO: 979507 - RNA, 24 nt, Human
gcaaacccaaaugaacauguugga

SEQ ID NO: 979508 - RNA, 23 nt, Human
gcaggaaaaaaugugaacacaga

SEQ ID NO: 979509 - RNA, 20 nt, Human
gcauuuacaaagaaaacaga

SEQ ID NO: 979510 - RNA, 18 nt, Human
ggaaaggacuguuuauag

SEQ ID NO: 979511 - RNA, 22 nt, Human
ggaagagcuucacccugaaaag

SEQ ID NO: 979512 - RNA, 21 nt, Human
gggaaagcucugaaacccaga

SEQ ID NO: 979513 - RNA, 24 nt, Human
ggggacuguuuggaaaagaaucag

SEQ ID NO: 979514 - RNA, 26 nt, Human
gguaauagaagacauacaggaaagga

SEQ ID NO: 979515 - RNA, 23 nt, Human
guaaaaacagcugaaaacccaaa

SEQ ID NO: 979516 - RNA, 21 nt, Human
gucagugugugaucucugcug

SEQ ID NO: 979517 - RNA, 22 nt, Human
uaaaacaaaaaagccucaagua

SEQ ID NO: 979518 - RNA, 25 nt, Human
uaaaaugguacccaaauuugguguu

SEQ ID NO: 979519 - RNA, 22 nt, Human
uaagcaaacccaaaugaacaug

SEQ ID NO: 979520 - RNA, 23 nt, Human
uagaagauaauucaguucuaguc

SEQ ID NO: 979521 - RNA, 19 nt, Human
uauguagggaaauagcagc

SEQ ID NO: 979522 - RNA, 19 nt, Human
ucaacuguuaaaauagggc

SEQ ID NO: 979523 - RNA, 23 nt, Human
ucaaguugcaccucuguggcuuu

SEQ ID NO: 979524 - RNA, 25 nt, Human
ucaaucaugucaaaauuaugguuaa

SEQ ID NO: 979525 - RNA, 19 nt, Human
ucaguauuacuuacuggag

SEQ ID NO: 979526 - RNA, 21 nt, Human
ucauccugauccuuuaguuau

SEQ ID NO: 979527 - RNA, 20 nt, Human
uccaugcugaagaagcggcu

SEQ ID NO: 979528 - RNA, 23 nt, Human
uccccaaggcccacuugguccau

SEQ ID NO: 979529 - RNA, 21 nt, Human
uccuaaaaaaaaaauugcaaa

SEQ ID NO: 979530 - RNA, 20 nt, Human
uccuuugucacuguggugga

SEQ ID NO: 979531 - RNA, 23 nt, Human
ucgagaacgcugcaauccccaag

SEQ ID NO: 979532 - RNA, 21 nt, Human
ucuacaggaacaugucugauu

SEQ ID NO: 979533 - RNA, 22 nt, Human
ucugaaacccagaucuccguuc

SEQ ID NO: 979534 - RNA, 22 nt, Human
ucugcuguggugcugggcaggg

SEQ ID NO: 979535 - RNA, 19 nt, Human
ugaaagcaggggacuguuu

SEQ ID NO: 979536 - RNA, 21 nt, Human
ugagaaaaucagaaaggcaaa

SEQ ID NO: 979537 - RNA, 21 nt, Human
ugaguaaagugccagccaugg

SEQ ID NO: 979538 - RNA, 23 nt, Human
ugcaaugaguaaagugccagcca

SEQ ID NO: 979539 - RNA, 23 nt, Human
ugcuugaaggggaagggcggagg

SEQ ID NO: 979540 - RNA, 21 nt, Human
ugcuuuagauguaaaaacagc

SEQ ID NO: 979541 - RNA, 22 nt, Human
ugguggcuugcuagcagagccu

SEQ ID NO: 979542 - RNA, 25 nt, Human
ugugaacacagagaacaacagaaac

SEQ ID NO: 979543 - RNA, 19 nt, Human
ugugguggauaaaugacaa

SEQ ID NO: 979544 - RNA, 19 nt, Human
uuaagacccuuucccccuc

SEQ ID NO: 979545 - RNA, 21 nt, Human
uuccacaauugugauuuuacu

SEQ ID NO: 979546 - RNA, 19 nt, Human
uugcaaagucuuuucucaa

SEQ ID NO: 979547 - RNA, 20 nt, Human
uugcaccucuguggcuuucc

SEQ ID NO: 979548 - RNA, 23 nt, Human
uuuuccuuugucacuguggugga

SEQ ID NO: 979549 - RNA, 21 nt, Human
aaacaacaguaccucaaagca

SEQ ID NO: 979550 - RNA, 23 nt, Human
aaaccaaaacacuuuaauuuuua

SEQ ID NO: 979551 - RNA, 18 nt, Human
aaagaaugagagucaccg

SEQ ID NO: 979552 - RNA, 19 nt, Human
aaagaaugagagucaccgu

SEQ ID NO: 979553 - RNA, 20 nt, Human
aaagaggcuaauauaccucu

SEQ ID NO: 979554 - RNA, 21 nt, Human
aaagggaaaaucauuuucuca

SEQ ID NO: 979555 - RNA, 22 nt, Human
aaagucaaaaacgaggcaccuu

SEQ ID NO: 979556 - RNA, 19 nt, Human
aaauguuaauggacaaagu

SEQ ID NO: 979557 - RNA, 24 nt, Human
aacacguuucuccaauuuaaucua

SEQ ID NO: 979558 - RNA, 21 nt, Human
aacaguaccucaaagcaaaag

SEQ ID NO: 979559 - RNA, 23 nt, Human
aagaaacaaugcuuagagacaug

SEQ ID NO: 979560 - RNA, 18 nt, Human
aagaaugagagucaccgu

SEQ ID NO: 979561 - RNA, 20 nt, Human
aagacaaaagacuacccuuc

SEQ ID NO: 979562 - RNA, 19 nt, Human
aagcaaaauaaaggucuga

SEQ ID NO: 979563 - RNA, 20 nt, Human
aaugggacugcuaaauuaua

SEQ ID NO: 979564 - RNA, 21 nt, Human
acaacacuuguuagcuuuuca

SEQ ID NO: 979565 - RNA, 19 nt, Human
acaaccaagauugccugcc

SEQ ID NO: 979566 - RNA, 24 nt, Human
acaugcaacauaggcuacaaagca

SEQ ID NO: 979567 - RNA, 26 nt, Human
agacaaaagacuacccuuccccagga

SEQ ID NO: 979568 - RNA, 18 nt, Human
agaggaggcaacaugaca

SEQ ID NO: 979569 - RNA, 21 nt, Human
agaggcuaauauaccucuaua

SEQ ID NO: 979570 - RNA, 23 nt, Human
aggaucacagugcacaaaaagca

SEQ ID NO: 979571 - RNA, 27 nt, Human
aguuacaaaaccugccaaaacacaaag

SEQ ID NO: 979572 - RNA, 20 nt, Human
aucacagugcacaaaaagca

SEQ ID NO: 979573 - RNA, 18 nt, Human
aucuuauaacccagagcc

SEQ ID NO: 979574 - RNA, 22 nt, Human
auuuuagaaugagaaacauauc

SEQ ID NO: 979575 - RNA, 24 nt, Human
caaaaucacaaaugggacugcuaa

SEQ ID NO: 979576 - RNA, 21 nt, Human
caaagcacucaagacuuggua

SEQ ID NO: 979577 - RNA, 25 nt, Human
caaagcacucaagacuugguagcuu

SEQ ID NO: 979578 - RNA, 24 nt, Human
caagagauuuuucuucucuaaucc

SEQ ID NO: 979579 - RNA, 21 nt, Human
cacaaccaagauugccugccc

SEQ ID NO: 979580 - RNA, 22 nt, Human
caccguuuagguccaauguacu

SEQ ID NO: 979581 - RNA, 24 nt, Human
cacguaaagcuaccuauggaauga

SEQ ID NO: 979582 - RNA, 20 nt, Human
cagaaugaggccacaagauu

SEQ ID NO: 979583 - RNA, 21 nt, Human
ccacugcacugcaaauuguau

SEQ ID NO: 979584 - RNA, 23 nt, Human
cccaggaucacagugcacaaaaa

SEQ ID NO: 979585 - RNA, 18 nt, Human
ccuguuaaagaaugagag

SEQ ID NO: 979586 - RNA, 19 nt, Human
cuggaaaaaucagaaaaua

SEQ ID NO: 979587 - RNA, 23 nt, Human
cugugugcaaccugcaaagggaa

SEQ ID NO: 979588 - RNA, 24 nt, Human
cuugguagcuuuucugaaauuuga

SEQ ID NO: 979589 - RNA, 19 nt, Human
gaaaauauucacaaccaag

SEQ ID NO: 979590 - RNA, 18 nt, Human
gaaugaaugugaucacug

SEQ ID NO: 979591 - RNA, 19 nt, Human
ggaaaaucauuuucucaac

SEQ ID NO: 979592 - RNA, 18 nt, Human
guagcuuuucugaaauuu

SEQ ID NO: 979593 - RNA, 21 nt, Human
gucacacaacacaagaaacaa

SEQ ID NO: 979594 - RNA, 20 nt, Human
gucaguaaacuacuuagcug

SEQ ID NO: 979595 - RNA, 20 nt, Human
guuaaagaaugagagucacc

SEQ ID NO: 979596 - RNA, 20 nt, Human
uaaaaagacauucaauccag

SEQ ID NO: 979597 - RNA, 18 nt, Human
uaaaaauaugcaaaauca

SEQ ID NO: 979598 - RNA, 20 nt, Human
uaaaaauaugcaaaaucacu

SEQ ID NO: 979599 - RNA, 18 nt, Human
uaagacaacugcaagcac

SEQ ID NO: 979600 - RNA, 23 nt, Human
uacaaaaccugccaaaacacaaa

SEQ ID NO: 979601 - RNA, 19 nt, Human
uagcugaagacaaaagacu

SEQ ID NO: 979602 - RNA, 19 nt, Human
uaggcuacaaagcacucaa

SEQ ID NO: 979603 - RNA, 20 nt, Human
ucaaagcaaaauaaaggucc

SEQ ID NO: 979604 - RNA, 21 nt, Human
ucccuuuuguucagaaugagg

SEQ ID NO: 979605 - RNA, 22 nt, Human
ucuggaaaaaaaaaaaccaaaa

SEQ ID NO: 979606 - RNA, 19 nt, Human
ugaaaagacuguuauggaa

SEQ ID NO: 979607 - RNA, 21 nt, Human
ugacaugguacugagccauca

SEQ ID NO: 979608 - RNA, 26 nt, Human
ugacuucuaaagaggcuaauauaccu

SEQ ID NO: 979609 - RNA, 23 nt, Human
ugagaaacauaucuuuucuuccu

SEQ ID NO: 979610 - RNA, 19 nt, Human
ugagaaguauucugcccac

SEQ ID NO: 979611 - RNA, 19 nt, Human
ugcaaaaucacaaauggga

SEQ ID NO: 979612 - RNA, 20 nt, Human
ugcacaacuccuuggagcag

SEQ ID NO: 979613 - RNA, 18 nt, Human
ugccaaaacacaaagggg

SEQ ID NO: 979614 - RNA, 18 nt, Human
ugccaaaacacaaagggg

SEQ ID NO: 979615 - RNA, 24 nt, Human
ugccauauagagaaugacaucuua

SEQ ID NO: 979616 - RNA, 19 nt, Human
ugcccuugcuuucaagccu

SEQ ID NO: 979617 - RNA, 23 nt, Human
uggaaagacaaugaaaaagcuag

SEQ ID NO: 979618 - RNA, 27 nt, Human
uggaaagacaaugaaaaagcuaguaaa

SEQ ID NO: 979619 - RNA, 23 nt, Human
uggaaaguaacauuuacagggug

SEQ ID NO: 979620 - RNA, 21 nt, Human
uggaaugaaugugaucacugu

SEQ ID NO: 979621 - RNA, 19 nt, Human
ugggaacauuugcuagcuc

SEQ ID NO: 979622 - RNA, 19 nt, Human
uguuaaagaaugagagucc

SEQ ID NO: 979623 - RNA, 19 nt, Human
uguuaggacugggauucaa

SEQ ID NO: 979624 - RNA, 19 nt, Human
uguucagaaugaggccaca

SEQ ID NO: 979625 - RNA, 19 nt, Human
uuaaagaaugagagucacc

SEQ ID NO: 979626 - RNA, 19 nt, Human
uuacaaaaccugccaaaac

SEQ ID NO: 979627 - RNA, 19 nt, Human
uucuucauaaauaguuaca

SEQ ID NO: 979628 - RNA, 18 nt, Human
uugguuccaacuugauaa

SEQ ID NO: 979629 - RNA, 23 nt, Human
uuuccagaagaaaauggucaguu

SEQ ID NO: 979630 - RNA, 19 nt, Human
uuuuucuucucuaaucccu

SEQ ID NO: 979631 - RNA, 18 nt, Human
uuuuuuuuuuuuuuucug

SEQ ID NO: 979632 - RNA, 28 nt, Human
aaaaccuucuacuuuaacauuccuagaa

SEQ ID NO: 979633 - RNA, 18 nt, Human
aacuucuacccccaaccc

SEQ ID NO: 979634 - RNA, 22 nt, Human
aagaacuucuacccccaaccca

SEQ ID NO: 979635 - RNA, 20 nt, Human
aagcagaaauaugggaucug

SEQ ID NO: 979636 - RNA, 20 nt, Human
aagcuauauuaucccugaag

SEQ ID NO: 979637 - RNA, 23 nt, Human
accagggcaaaggaaagugacuu

SEQ ID NO: 979638 - RNA, 19 nt, Human
acuucuacccccaacccac

SEQ ID NO: 979639 - RNA, 27 nt, Human
agacaagaaaagauguauauggccuga

SEQ ID NO: 979640 - RNA, 20 nt, Human
aggaugccuggaaacacugc

SEQ ID NO: 979641 - RNA, 25 nt, Human
cauuuccuccuuuuauuagguccca

SEQ ID NO: 979642 - RNA, 18 nt, Human
ccacugcccaaggccugu

SEQ ID NO: 979643 - RNA, 19 nt, Human
ccagauguuacgacgucca

SEQ ID NO: 979644 - RNA, 19 nt, Human
ccagggcaaaggaaaguga

SEQ ID NO: 979645 - RNA, 19 nt, Human
ccccaacccacugcccaag

SEQ ID NO: 979646 - RNA, 20 nt, Human
ccccaacccacugcccaagg

SEQ ID NO: 979647 - RNA, 21 nt, Human
cccuugacuuuaaccaugccc

SEQ ID NO: 979648 - RNA, 19 nt, Human
cccuuuuucucucuccucc

SEQ ID NO: 979649 - RNA, 21 nt, Human
ccucagucccuaccuagcuuc

SEQ ID NO: 979650 - RNA, 18 nt, Human
ccuccucuuucuccuucc

SEQ ID NO: 979651 - RNA, 21 nt, Human
ccugaaguaccagggcaaagg

SEQ ID NO: 979652 - RNA, 19 nt, Human
ccugucccuagaacugugg

SEQ ID NO: 979653 - RNA, 21 nt, Human
ccuuccucucugcuccucuca

SEQ ID NO: 979654 - RNA, 24 nt, Human
ccuuccucucugcuccucucauca

SEQ ID NO: 979655 - RNA, 22 nt, Human
cuagaggagcuuuucccuugac

SEQ ID NO: 979656 - RNA, 23 nt, Human
cucagagaaggguuuuagaaaga

SEQ ID NO: 979657 - RNA, 18 nt, Human
cuccuuccucucugcucc

SEQ ID NO: 979658 - RNA, 20 nt, Human
cucuuucuccuuccucucug

SEQ ID NO: 979659 - RNA, 23 nt, Human
cuugacuuuaaccaugcccuggc

SEQ ID NO: 979660 - RNA, 21 nt, Human
gaaagugacuuucagaaguca

SEQ ID NO: 979661 - RNA, 19 nt, Human
gggaaacuauuacacaguc

SEQ ID NO: 979662 - RNA, 19 nt, Human
guccacaucugccaaaagu

SEQ ID NO: 979663 - RNA, 23 nt, Human
gugaggggaagcagaaauauggg

SEQ ID NO: 979664 - RNA, 19 nt, Human
uaaagcuauauuaucccug

SEQ ID NO: 979665 - RNA, 18 nt, Human
uaggucccaguuucagcu

SEQ ID NO: 979666 - RNA, 24 nt, Human
uauggccugaaguaccagggcaaa

SEQ ID NO: 979667 - RNA, 22 nt, Human
uauuuugugcccuuuuucucuc

SEQ ID NO: 979668 - RNA, 19 nt, Human
ucaauuggaaaaaaccuuc

SEQ ID NO: 979669 - RNA, 19 nt, Human
ucacccaccucagaguccu

SEQ ID NO: 979670 - RNA, 20 nt, Human
ucccuagaacugugggaaaa

SEQ ID NO: 979671 - RNA, 18 nt, Human
ucuaaaagugaggggaag

SEQ ID NO: 979672 - RNA, 21 nt, Human
ucucucagagaaggguuuuag

SEQ ID NO: 979673 - RNA, 23 nt, Human
ugaaagggaggauuauggagaca

SEQ ID NO: 979674 - RNA, 23 nt, Human
ugaggggaagcagaaauauggga

SEQ ID NO: 979675 - RNA, 18 nt, Human
ugccuggaaacacugcag

SEQ ID NO: 979676 - RNA, 23 nt, Human
uggcuccuggucugucccggccu

SEQ ID NO: 979677 - RNA, 20 nt, Human
uggcuccuggucugucccuc

SEQ ID NO: 979678 - RNA, 23 nt, Human
ugggaaaacauuuccuccuuuua

SEQ ID NO: 979679 - RNA, 18 nt, Human
ugggaucuguuuuauggu

SEQ ID NO: 979680 - RNA, 19 nt, Human
uguauauggccugaaguac

SEQ ID NO: 979681 - RNA, 23 nt, Human
uucuacuuuaacauuccuagaac

SEQ ID NO: 979682 - RNA, 24 nt, Human
uuucucucuccuccucuuucuccu

SEQ ID NO: 979683 - RNA, 22 nt, Human
acccccaccccucggccuaagc

SEQ ID NO: 979684 - RNA, 22 nt, Human
acucgcuccgucucccgcuacc

SEQ ID NO: 979685 - RNA, 21 nt, Human
ccccaccccucggccuaagcc

SEQ ID NO: 979686 - RNA, 21 nt, Human
cccccggcgcgacccccaccc

SEQ ID NO: 979687 - RNA, 19 nt, Human
ccgcggccgcuggacucgc

SEQ ID NO: 979688 - RNA, 18 nt, Human
ccuccgggucugcccgcg

SEQ ID NO: 979689 - RNA, 27 nt, Human
cggcccccggcgcgacccccaccccuu

SEQ ID NO: 979690 - RNA, 20 nt, Human
gacggcguggugcucuuucu

SEQ ID NO: 979691 - RNA, 20 nt, Human
ggcgcgacccccaccccucg

SEQ ID NO: 979692 - RNA, 18 nt, Human
ucucccgcuaccgcugcu

SEQ ID NO: 979693 - RNA, 18 nt, Human
ucucccgcuaccgcugcu

SEQ ID NO: 979694 - RNA, 24 nt, Human
ucucccgcuaccgcugcuaccacc

SEQ ID NO: 979695 - RNA, 20 nt, Human
uuuuuuuuuuuuuuugccuu

SEQ ID NO: 979696 - RNA, 22 nt, Human
uuuuuuuuuuuuuuugccuuaa

SEQ ID NO: 979697 - RNA, 24 nt, Human
aacagagugagacuccgugucaaa

SEQ ID NO: 979698 - RNA, 20 nt, Human
aacauggugaaacuccgucu

SEQ ID NO: 979699 - RNA, 21 nt, Human
aacauggugaaacuccgucuc

SEQ ID NO: 979700 - RNA, 26 nt, Human
aacccaaagcccggcagcgcaggccc

SEQ ID NO: 979701 - RNA, 20 nt, Human
aacuugcucccuuaaggcca

SEQ ID NO: 979702 - RNA, 20 nt, Human
aagaagccugguuccgcagc

SEQ ID NO: 979703 - RNA, 24 nt, Human
aagaccaaaggaucagacagagga

SEQ ID NO: 979704 - RNA, 21 nt, Human
aagcccaucuaaugguguccu

SEQ ID NO: 979705 - RNA, 24 nt, Human
aauacaauuaaaguagaaacacaa

SEQ ID NO: 979706 - RNA, 22 nt, Human
aaugcguuuauuucuccaguuu

SEQ ID NO: 979707 - RNA, 24 nt, Human
aauggcgugaacccaggaggcaga

SEQ ID NO: 979708 - RNA, 20 nt, Human
aaugguguccugaagacugu

SEQ ID NO: 979709 - RNA, 24 nt, Human
acagagugagacuccgugucaaaa

SEQ ID NO: 979710 - RNA, 19 nt, Human
acauggugaaacuccgucu

SEQ ID NO: 979711 - RNA, 24 nt, Human
acuccagccugggcaacagaguga

SEQ ID NO: 979712 - RNA, 24 nt, Human
acuccgucucuacuaaaaauacaa

SEQ ID NO: 979713 - RNA, 24 nt, Human
acugcacuccagccugggcaacag

SEQ ID NO: 979714 - RNA, 24 nt, Human
acugcacuccagccugggcaacag

SEQ ID NO: 979715 - RNA, 24 nt, Human
acuucagccugguagcaaagacca

SEQ ID NO: 979716 - RNA, 23 nt, Human
agagaaaaaaggcaagacuagga

SEQ ID NO: 979717 - RNA, 21 nt, Human
agagagcggcagaggcccaga

SEQ ID NO: 979718 - RNA, 24 nt, Human
agagccugcagugagccgagaucg

SEQ ID NO: 979719 - RNA, 20 nt, Human
agaggcccagaacccaaagc

SEQ ID NO: 979720 - RNA, 20 nt, Human
agagggugguuggcuacuac

SEQ ID NO: 979721 - RNA, 20 nt, Human
agcacugugggaggcugagg

SEQ ID NO: 979722 - RNA, 24 nt, Human
agccugggcaacagagugagacuc

SEQ ID NO: 979723 - RNA, 18 nt, Human
agccugguagcaaagacc

SEQ ID NO: 979724 - RNA, 19 nt, Human
agccugguagcaaagacca

SEQ ID NO: 979725 - RNA, 19 nt, Human
agcggcagaggcccagaac

SEQ ID NO: 979726 - RNA, 24 nt, Human
aggagggcggaucaugaggucagg

SEQ ID NO: 979727 - RNA, 18 nt, Human
aggcagagccugcaguga

SEQ ID NO: 979728 - RNA, 21 nt, Human
aggcagagccugcagugagcc

SEQ ID NO: 979729 - RNA, 24 nt, Human
aggcagagccugcagugagccgag

SEQ ID NO: 979730 - RNA, 24 nt, Human
aggcaggagaauggcgugaaccca

SEQ ID NO: 979731 - RNA, 27 nt, Human
aggcaggagaauggcgugaacccagga

SEQ ID NO: 979732 - RNA, 24 nt, Human
aggcgucguggugggcgccuguag

SEQ ID NO: 979733 - RNA, 22 nt, Human
agggaacggcagugggguggcu

SEQ ID NO: 979734 - RNA, 22 nt, Human
agggagaaguaguaaaggcucc

SEQ ID NO: 979735 - RNA, 24 nt, Human
aguggcucaugccucuaaucccag

SEQ ID NO: 979736 - RNA, 20 nt, Human
auaaaaccucccaaacaugu

SEQ ID NO: 979737 - RNA, 24 nt, Human
aucgugccacugcacuccagccug

SEQ ID NO: 979738 - RNA, 24 nt, Human
aucuauacaacagcuccaugaggc

SEQ ID NO: 979739 - RNA, 25 nt, Human
auggaucugggaucuauacaacagc

SEQ ID NO: 979740 - RNA, 18 nt, Human
cacagugggaaagucacc

SEQ ID NO: 979741 - RNA, 22 nt, Human
cacuccagccugggcaacagag

SEQ ID NO: 979742 - RNA, 24 nt, Human
cacuccagccugggcaacagagug

SEQ ID NO: 979743 - RNA, 19 nt, Human
cacugcacuccagccuggg

SEQ ID NO: 979744 - RNA, 21 nt, Human
cacugcacuccagccugggca

SEQ ID NO: 979745 - RNA, 22 nt, Human
cacugcacuccagccugggcaa

SEQ ID NO: 979746 - RNA, 23 nt, Human
cacugcacuccagccugggcaac

SEQ ID NO: 979747 - RNA, 24 nt, Human
cacugcacuccagccugggcaaca

SEQ ID NO: 979748 - RNA, 20 nt, Human
cacugcuauaagaugcagac

SEQ ID NO: 979749 - RNA, 23 nt, Human
cagaacaugaaugaaaccaggga

SEQ ID NO: 979750 - RNA, 22 nt, Human
cagagagcggcagaggcccaga

SEQ ID NO: 979751 - RNA, 23 nt, Human
cagaggcccagaacccaaagccc

SEQ ID NO: 979752 - RNA, 23 nt, Human
cagcacugugggaggcugaggag

SEQ ID NO: 979753 - RNA, 24 nt, Human
cagcacugugggaggcugaggagg

SEQ ID NO: 979754 - RNA, 22 nt, Human
cagcuccaugaggcaggacaau

SEQ ID NO: 979755 - RNA, 23 nt, Human
caguggcucgguccuccaagccc

SEQ ID NO: 979756 - RNA, 18 nt, Human
cauaaaaccucccaaaca

SEQ ID NO: 979757 - RNA, 22 nt, Human
caugccucuaaucccagcacug

SEQ ID NO: 979758 - RNA, 22 nt, Human
cauuugaagcuccuuucugccc

SEQ ID NO: 979759 - RNA, 21 nt, Human
ccaaaaggucuagacugccag

SEQ ID NO: 979760 - RNA, 22 nt, Human
ccaagccccaugggggccaggc

SEQ ID NO: 979761 - RNA, 20 nt, Human
ccacugcacuccagccuggg

SEQ ID NO: 979762 - RNA, 21 nt, Human
ccacugcacuccagccugggc

SEQ ID NO: 979763 - RNA, 23 nt, Human
ccacugcacuccagccugggcaa

SEQ ID NO: 979764 - RNA, 24 nt, Human
ccacugcacuccagccugggcaac

SEQ ID NO: 979765 - RNA, 18 nt, Human
ccauuucaguuuccucau

SEQ ID NO: 979766 - RNA, 19 nt, Human
cccaaacaugugagaaguu

SEQ ID NO: 979767 - RNA, 19 nt, Human
cccaaagcccggcagcgca

SEQ ID NO: 979768 - RNA, 19 nt, Human
cccagaacccaaagcccgg

SEQ ID NO: 979769 - RNA, 18 nt, Human
cccugucgugcuucccuc

SEQ ID NO: 979770 - RNA, 22 nt, Human
ccgcagcguccaauggcccagc

SEQ ID NO: 979771 - RNA, 20 nt, Human
ccuagcuaacauggugaaac

SEQ ID NO: 979772 - RNA, 23 nt, Human
ccuagcuaacauggugaaacucc

SEQ ID NO: 979773 - RNA, 24 nt, Human
ccuagcuaacauggugaaacuccg

SEQ ID NO: 979774 - RNA, 22 nt, Human
ccucuaugccucagacaggaac

SEQ ID NO: 979775 - RNA, 21 nt, Human
ccugccucuaugccucagaca

SEQ ID NO: 979776 - RNA, 22 nt, Human
ccugggcaacagagugagacuc

SEQ ID NO: 979777 - RNA, 19 nt, Human
ccuguagucccagcuacuc

SEQ ID NO: 979778 - RNA, 21 nt, Human
ccuguagucccagcuacucgg

SEQ ID NO: 979779 - RNA, 22 nt, Human
ccuguagucccagcuacucggg

SEQ ID NO: 979780 - RNA, 18 nt, Human
ccuuggauacugggcuca

SEQ ID NO: 979781 - RNA, 24 nt, Human
cgagaccauccuagcuaacauggu

SEQ ID NO: 979782 - RNA, 24 nt, Human
cgccuguagucccagcuacucggg

SEQ ID NO: 979783 - RNA, 21 nt, Human
cggcagugggguggcuugggc

SEQ ID NO: 979784 - RNA, 24 nt, Human
cguggugggcgccuguagucccag

SEQ ID NO: 979785 - RNA, 22 nt, Human
cgugucaaaaaaaaagaaauaa

SEQ ID NO: 979786 - RNA, 20 nt, Human
cguucccggcagcucagcac

SEQ ID NO: 979787 - RNA, 19 nt, Human
cucacacccuccucagaac

SEQ ID NO: 979788 - RNA, 23 nt, Human
cucaugccucuaaucccagcacu

SEQ ID NO: 979789 - RNA, 19 nt, Human
cuccucagaacaugaauga

SEQ ID NO: 979790 - RNA, 18 nt, Human
cucuaaucccagcacugu

SEQ ID NO: 979791 - RNA, 22 nt, Human
cugcagugagccgagaucgugc

SEQ ID NO: 979792 - RNA, 19 nt, Human
cuugcuccaggggccgggc

SEQ ID NO: 979793 - RNA, 19 nt, Human
gaaacuccgucucuacuaa

SEQ ID NO: 979794 - RNA, 18 nt, Human
gaacccaaagcccggcag

SEQ ID NO: 979795 - RNA, 23 nt, Human
gagaucgugccacugcacuccag

SEQ ID NO: 979796 - RNA, 21 nt, Human
gaggcccagaacccaaagccc

SEQ ID NO: 979797 - RNA, 25 nt, Human
gcaaaccucaggggaaggggaacgc

SEQ ID NO: 979798 - RNA, 24 nt, Human
gcacuccagccugggcaacagagu

SEQ ID NO: 979799 - RNA, 21 nt, Human
gcagaggcccagaacccaaag

SEQ ID NO: 979800 - RNA, 23 nt, Human
gcagcgcaggcccaguagcccgc

SEQ ID NO: 979801 - RNA, 22 nt, Human
gcaggagaauggcgugaaccca

SEQ ID NO: 979802 - RNA, 22 nt, Human
gccacugcacuccagccugggc

SEQ ID NO: 979803 - RNA, 24 nt, Human
gccacugcacuccagccugggcaa

SEQ ID NO: 979804 - RNA, 20 nt, Human
gccgagaucgugccacugca

SEQ ID NO: 979805 - RNA, 24 nt, Human
gcuaacauggugaaacuccgucuc

SEQ ID NO: 979806 - RNA, 18 nt, Human
gcugaauuacacccauuu

SEQ ID NO: 979807 - RNA, 22 nt, Human
gcugaggcaggagaauggcgug

SEQ ID NO: 979808 - RNA, 20 nt, Human
ggagaaguaguaaaggcucc

SEQ ID NO: 979809 - RNA, 23 nt, Human
ggagggcggaucaugaggucagg

SEQ ID NO: 979810 - RNA, 21 nt, Human
ggcagaggcccagaacccaaa

SEQ ID NO: 979811 - RNA, 23 nt, Human
ggccagagagcggcagaggccca

SEQ ID NO: 979812 - RNA, 21 nt, Human
ggccgggcgcaguggcucaug

SEQ ID NO: 979813 - RNA, 23 nt, Human
ggccgggcgcaguggcucaugcc

SEQ ID NO: 979814 - RNA, 23 nt, Human
ggcgcaguggcucaugccucuaa

SEQ ID NO: 979815 - RNA, 21 nt, Human
ggcggaucaugaggucaggag

SEQ ID NO: 979816 - RNA, 20 nt, Human
ggugagagucacauaaaggu

SEQ ID NO: 979817 - RNA, 22 nt, Human
guggugggcgccuguaguccca

SEQ ID NO: 979818 - RNA, 22 nt, Human
guuugucaaccuuguuucacuu

SEQ ID NO: 979819 - RNA, 21 nt, Human
uaaaggcucccuccucggccc

SEQ ID NO: 979820 - RNA, 22 nt, Human
uaacauggugaaacuccgucuc

SEQ ID NO: 979821 - RNA, 24 nt, Human
uaacauggugaaacuccgucucua

SEQ ID NO: 979822 - RNA, 22 nt, Human
uacaacagcuccaugaggcagg

SEQ ID NO: 979823 - RNA, 19 nt, Human
uagcaaagaccaaaggauc

SEQ ID NO: 979824 - RNA, 22 nt, Human
uagcaaagaccaaaggaucaga

SEQ ID NO: 979825 - RNA, 25 nt, Human
uagcaaagaccaaaggaucagacag

SEQ ID NO: 979826 - RNA, 22 nt, Human
uaucacagccauuugaagcucc

SEQ ID NO: 979827 - RNA, 21 nt, Human
uaugcgcagcauuuuuuuggc

SEQ ID NO: 979828 - RNA, 23 nt, Human
ucagcccugucgugcuucccuca

SEQ ID NO: 979829 - RNA, 22 nt, Human
ucagccugguagcaaagaccaa

SEQ ID NO: 979830 - RNA, 18 nt, Human
ucaugaggucaggagauc

SEQ ID NO: 979831 - RNA, 24 nt, Human
ucaugaggucaggagaucgagacc

SEQ ID NO: 979832 - RNA, 23 nt, Human
uccagccugggcaacagagugag

SEQ ID NO: 979833 - RNA, 24 nt, Human
uccagccugggcaacagagugaga

SEQ ID NO: 979834 - RNA, 23 nt, Human
uccuuggauacugggcucagcuc

SEQ ID NO: 979835 - RNA, 23 nt, Human
ucgugccacugcacuccagccug

SEQ ID NO: 979836 - RNA, 23 nt, Human
ucuagacugccagcagaggcccu

SEQ ID NO: 979837 - RNA, 18 nt, Human
ucuaugccucagacagga

SEQ ID NO: 979838 - RNA, 22 nt, Human
ucucuacuaaaaauacaaaaaa

SEQ ID NO: 979839 - RNA, 24 nt, Human
ugaaaauacaaacuaaagcucgca

SEQ ID NO: 979840 - RNA, 20 nt, Human
ugaagcuccuuucugcccaa

SEQ ID NO: 979841 - RNA, 23 nt, Human
ugaagcuccuuucugcccaaaag

SEQ ID NO: 979842 - RNA, 25 nt, Human
ugagccaggcgucguggugggcgcc

SEQ ID NO: 979843 - RNA, 22 nt, Human
ugagccgagaucgugccacugc

SEQ ID NO: 979844 - RNA, 24 nt, Human
ugaggagggcggaucaugagguca

SEQ ID NO: 979845 - RNA, 18 nt, Human
ugaggcaggacaaucaua

SEQ ID NO: 979846 - RNA, 20 nt, Human
ugaggcaggacaaucauaug

SEQ ID NO: 979847 - RNA, 23 nt, Human
ugaggcaggagaauggcgugaac

SEQ ID NO: 979848 - RNA, 24 nt, Human
ugaggcaggagaauggcgugaacc

SEQ ID NO: 979849 - RNA, 25 nt, Human
ugaggcaggagaauggcgugaaccc

SEQ ID NO: 979850 - RNA, 23 nt, Human
ugcaaugcucauuugacugggcc

SEQ ID NO: 979851 - RNA, 19 nt, Human
ugcacugaauuucucuugc

SEQ ID NO: 979852 - RNA, 24 nt, Human
ugccacugcacuccagccugggca

SEQ ID NO: 979853 - RNA, 20 nt, Human
ugccacuuagagaaaaaagg

SEQ ID NO: 979854 - RNA, 18 nt, Human
ugccaggaggucagaagg

SEQ ID NO: 979855 - RNA, 23 nt, Human
ugccaggaggucagaaggugagg

SEQ ID NO: 979856 - RNA, 24 nt, Human
ugccucuaaucccagcacuguggg

SEQ ID NO: 979857 - RNA, 21 nt, Human
ugcucagagagggaacggcag

SEQ ID NO: 979858 - RNA, 21 nt, Human
uggccucagcacaacaaccag

SEQ ID NO: 979859 - RNA, 21 nt, Human
uggcuacuacauggacaaagu

SEQ ID NO: 979860 - RNA, 21 nt, Human
uggcucaugccucuaauccca

SEQ ID NO: 979861 - RNA, 22 nt, Human
uggcucaugccucuaaucccag

SEQ ID NO: 979862 - RNA, 24 nt, Human
uggcucaugccucuaaucccagca

SEQ ID NO: 979863 - RNA, 22 nt, Human
ugggaaagcccaucuaauggug

SEQ ID NO: 979864 - RNA, 19 nt, Human
ugggaggcugaggagggcg

SEQ ID NO: 979865 - RNA, 24 nt, Human
ugggaggcugaggagggcggauca

SEQ ID NO: 979866 - RNA, 19 nt, Human
ugggaucuauacaacagcu

SEQ ID NO: 979867 - RNA, 21 nt, Human
uggugggcgccuguaguccca

SEQ ID NO: 979868 - RNA, 28 nt, Human
ugucaaaaaaaaagaaauaacuugcucc

SEQ ID NO: 979869 - RNA, 18 nt, Human
uuugaagcuccuuucugc

SEQ ID NO: 979870 - RNA, 22 nt, Human
aaaacccugacaaaaucagagg

SEQ ID NO: 979871 - RNA, 26 nt, Human
aaaagcauaaacaauuuauacgucaa

SEQ ID NO: 979872 - RNA, 19 nt, Human
aaaauaaacaacuugccaa

SEQ ID NO: 979873 - RNA, 22 nt, Human
aaaauggacagcacauuaaaua

SEQ ID NO: 979874 - RNA, 19 nt, Human
aaacaagggucaaagccag

SEQ ID NO: 979875 - RNA, 22 nt, Human
aaacacacaaacacacaaaaaa

SEQ ID NO: 979876 - RNA, 24 nt, Human
aaagugcugggauuacaggcguga

SEQ ID NO: 979877 - RNA, 18 nt, Human
aaauagaaaugaaguggc

SEQ ID NO: 979878 - RNA, 25 nt, Human
aaaugaccaucagcuaaacaagggu

SEQ ID NO: 979879 - RNA, 18 nt, Human
aacacaggcaaguccuuu

SEQ ID NO: 979880 - RNA, 20 nt, Human
aacugacccaacgcacagaa

SEQ ID NO: 979881 - RNA, 19 nt, Human
aagacuguuggcaugaguu

SEQ ID NO: 979882 - RNA, 19 nt, Human
aagcacccgacucuggaua

SEQ ID NO: 979883 - RNA, 20 nt, Human
aagggcuccagccagaaugu

SEQ ID NO: 979884 - RNA, 19 nt, Human
aagugcugggauuacaggc

SEQ ID NO: 979885 - RNA, 19 nt, Human
aagugcugggauuacaggc

SEQ ID NO: 979886 - RNA, 28 nt, Human
acaaacacacaaaaaaggcauauucccu

SEQ ID NO: 979887 - RNA, 30 nt, Human
acacaaacacacaaaaaaggcauauucccu

SEQ ID NO: 979888 - RNA, 24 nt, Human
acaccaccaagcgcugucucacgc

SEQ ID NO: 979889 - RNA, 21 nt, Human
acagcaccaaaaguaucacac

SEQ ID NO: 979890 - RNA, 20 nt, Human
acgggguuucuccauguugg

SEQ ID NO: 979891 - RNA, 21 nt, Human
acgggguuucuccauguuggu

SEQ ID NO: 979892 - RNA, 24 nt, Human
acgggguuucuccauguuggucag

SEQ ID NO: 979893 - RNA, 19 nt, Human
agaaaaaaacaaagcacca

SEQ ID NO: 979894 - RNA, 23 nt, Human
agaaaaacccugacaaaaucaga

SEQ ID NO: 979895 - RNA, 20 nt, Human
agaugcccucccacccaccc

SEQ ID NO: 979896 - RNA, 22 nt, Human
agcaccaaaaguaucacaccac

SEQ ID NO: 979897 - RNA, 21 nt, Human
aggcaaguccuuuaaucugug

SEQ ID NO: 979898 - RNA, 19 nt, Human
aggcgugaaccaccacgcc

SEQ ID NO: 979899 - RNA, 26 nt, Human
agggcuccagccagaaugucgacauc

SEQ ID NO: 979900 - RNA, 24 nt, Human
aggugauccgcccgcuucggccuc

SEQ ID NO: 979901 - RNA, 18 nt, Human
aguagcugggauuacagg

SEQ ID NO: 979902 - RNA, 22 nt, Human
auacacaacauucaagauauuc

SEQ ID NO: 979903 - RNA, 20 nt, Human
aucuuguccaccuuaauccc

SEQ ID NO: 979904 - RNA, 20 nt, Human
aucuuguccaccuuaauccc

SEQ ID NO: 979905 - RNA, 24 nt, Human
augggugaugagcuuuugcauacc

SEQ ID NO: 979906 - RNA, 22 nt, Human
auuuuguauuuuuaguagggac

SEQ ID NO: 979907 - RNA, 26 nt, Human
caaaaugacccccaaagcuagcuaga

SEQ ID NO: 979908 - RNA, 24 nt, Human
caaagugcugggauuacaggcgug

SEQ ID NO: 979909 - RNA, 19 nt, Human
caacccacacuacaacacu

SEQ ID NO: 979910 - RNA, 23 nt, Human
caauaggaagaagaaugagcguc

SEQ ID NO: 979911 - RNA, 21 nt, Human
cacaaacacacaaaaaaggca

SEQ ID NO: 979912 - RNA, 21 nt, Human
caccacaaccucugucuccug

SEQ ID NO: 979913 - RNA, 23 nt, Human
caccacaaccucugucuccuggg

SEQ ID NO: 979914 - RNA, 24 nt, Human
caccaccaagcgcugucucacgcc

SEQ ID NO: 979915 - RNA, 21 nt, Human
caccuuaaucccauucacaga

SEQ ID NO: 979916 - RNA, 19 nt, Human
cacugcaugaggaggaaaa

SEQ ID NO: 979917 - RNA, 22 nt, Human
cagcaccaaaaguaucacacca

SEQ ID NO: 979918 - RNA, 26 nt, Human
cagcacuuaaaaaaacacacaaacac

SEQ ID NO: 979919 - RNA, 18 nt, Human
caggaaaagaacacaauc

SEQ ID NO: 979920 - RNA, 24 nt, Human
caguuaaagaaaaguugacaaccc

SEQ ID NO: 979921 - RNA, 19 nt, Human
caugucuuccuuugcuucu

SEQ ID NO: 979922 - RNA, 22 nt, Human
ccaaagugcugggauuacaggc

SEQ ID NO: 979923 - RNA, 22 nt, Human
ccaaagugcugggauuacaggc

SEQ ID NO: 979924 - RNA, 24 nt, Human
ccaaagugcugggauuacaggcgu

SEQ ID NO: 979925 - RNA, 24 nt, Human
ccaaucccagaaaugaccaucagc

SEQ ID NO: 979926 - RNA, 21 nt, Human
ccacaaccucugucuccuggg

SEQ ID NO: 979927 - RNA, 23 nt, Human
ccacaaccucugucuccuggguu

SEQ ID NO: 979928 - RNA, 24 nt, Human
ccacaaccucugucuccuggguuc

SEQ ID NO: 979929 - RNA, 24 nt, Human
ccaccacaaccucugucuccuggg

SEQ ID NO: 979930 - RNA, 18 nt, Human
ccaguguuaaggguuuua

SEQ ID NO: 979931 - RNA, 19 nt, Human
ccauguuggucaggcuggu

SEQ ID NO: 979932 - RNA, 22 nt, Human
ccauguuggucaggcuggucuc

SEQ ID NO: 979933 - RNA, 23 nt, Human
ccauguuggucaggcuggucucg

SEQ ID NO: 979934 - RNA, 25 nt, Human
cccacacuacaacacugcaugagga

SEQ ID NO: 979935 - RNA, 24 nt, Human
cccaccacaaccucugucuccugg

SEQ ID NO: 979936 - RNA, 19 nt, Human
cccaucauaaagacuguug

SEQ ID NO: 979937 - RNA, 18 nt, Human
ccccuggaugaacacgcu

SEQ ID NO: 979938 - RNA, 18 nt, Human
ccccuggaugaacacgcu

SEQ ID NO: 979939 - RNA, 18 nt, Human
cccgaccucaggugaucc

SEQ ID NO: 979940 - RNA, 22 nt, Human
cccgaccucaggugauccgccc

SEQ ID NO: 979941 - RNA, 23 nt, Human
cccgaguagcugggauuacaggu

SEQ ID NO: 979942 - RNA, 24 nt, Human
cccgaguagcugggauuacaggua

SEQ ID NO: 979943 - RNA, 21 nt, Human
ccgaguagcugggauuacagg

SEQ ID NO: 979944 - RNA, 24 nt, Human
ccgaguagcugggauuacagguau

SEQ ID NO: 979945 - RNA, 24 nt, Human
ccuaucaacuuagaauugggcuua

SEQ ID NO: 979946 - RNA, 24 nt, Human
ccuccagauuuccucauaggggcu

SEQ ID NO: 979947 - RNA, 21 nt, Human
ccucccacccaccccaucgag

SEQ ID NO: 979948 - RNA, 24 nt, Human
ccugccucagguucccgaguagcu

SEQ ID NO: 979949 - RNA, 23 nt, Human
ccuggguucaagccauucuccug

SEQ ID NO: 979950 - RNA, 24 nt, Human
cgaccucaggugauccgcccgcuu

SEQ ID NO: 979951 - RNA, 18 nt, Human
cgagaucuguccuguccc

SEQ ID NO: 979952 - RNA, 24 nt, Human
cgggguuucuccauguuggucagg

SEQ ID NO: 979953 - RNA, 21 nt, Human
cucacaaauaacaagacaaau

SEQ ID NO: 979954 - RNA, 24 nt, Human
cuccaggggcugcaugugugucca

SEQ ID NO: 979955 - RNA, 24 nt, Human
cuccaggggcugcauguguguccu

SEQ ID NO: 979956 - RNA, 24 nt, Human
cuccauguuggucaggcuggucuc

SEQ ID NO: 979957 - RNA, 26 nt, Human
cucccgaccucaggugauccgcccgc

SEQ ID NO: 979958 - RNA, 28 nt, Human
cuggcuaauuuuguauuuuuaguaggga

SEQ ID NO: 979959 - RNA, 18 nt, Human
cugucucacgccaguggu

SEQ ID NO: 979960 - RNA, 21 nt, Human
cuguggccucucccgugggag

SEQ ID NO: 979961 - RNA, 24 nt, Human
cuuaaucccaucauaaagacuguu

SEQ ID NO: 979962 - RNA, 23 nt, Human
cuuauuuauuuauuuauuuauuu

SEQ ID NO: 979963 - RNA, 23 nt, Human
cuucccagagagcugccccuuuc

SEQ ID NO: 979964 - RNA, 20 nt, Human
cuugguaguucuuggaaauc

SEQ ID NO: 979965 - RNA, 22 nt, Human
gaaaaaaacaaagcaccaucaa

SEQ ID NO: 979966 - RNA, 24 nt, Human
gaacagguggacugugguguccuc

SEQ ID NO: 979967 - RNA, 22 nt, Human
gacaaaaugacccccaaagcua

SEQ ID NO: 979968 - RNA, 19 nt, Human
gaccaucagcuaaacaagg

SEQ ID NO: 979969 - RNA, 21 nt, Human
gaccucaggugauccgcccgc

SEQ ID NO: 979970 - RNA, 22 nt, Human
gaccucaggugauccgcccgcu

SEQ ID NO: 979971 - RNA, 24 nt, Human
gaccucaggugauccgcccgcuuc

SEQ ID NO: 979972 - RNA, 21 nt, Human
gacgggguuucuccauguugg

SEQ ID NO: 979973 - RNA, 22 nt, Human
gacgggguuucuccauguuggu

SEQ ID NO: 979974 - RNA, 21 nt, Human
gacugguauucaacacaggca

SEQ ID NO: 979975 - RNA, 25 nt, Human
gagaauguccuagaacaggacuggu

SEQ ID NO: 979976 - RNA, 24 nt, Human
gaguagcugggauuacagguaugc

SEQ ID NO: 979977 - RNA, 21 nt, Human
gauuacaggcgugaaccacca

SEQ ID NO: 979978 - RNA, 24 nt, Human
gauuacagguaugcaccaccauac

SEQ ID NO: 979979 - RNA, 23 nt, Human
gcacgcuucacaugcagacgugg

SEQ ID NO: 979980 - RNA, 23 nt, Human
gccucagguucccgaguagcugg

SEQ ID NO: 979981 - RNA, 23 nt, Human
gcuggucucgaacucccgaccuc

SEQ ID NO: 979982 - RNA, 18 nt, Human
ggaaguggccaucugugg

SEQ ID NO: 979983 - RNA, 19 nt, Human
ggagauguuuauccuuuuc

SEQ ID NO: 979984 - RNA, 19 nt, Human
ggauuacaggcgugaacca

SEQ ID NO: 979985 - RNA, 19 nt, Human
ggcugcauguguguccagc

SEQ ID NO: 979986 - RNA, 23 nt, Human
gggguuucuccauguuggucagg

SEQ ID NO: 979987 - RNA, 20 nt, Human
ggugcaauggugcgaucuug

SEQ ID NO: 979988 - RNA, 20 nt, Human
gguggcggcgcggggcucag

SEQ ID NO: 979989 - RNA, 19 nt, Human
guacuguacucacaaauaa

SEQ ID NO: 979990 - RNA, 18 nt, Human
guagcugggauuacaggu

SEQ ID NO: 979991 - RNA, 19 nt, Human
gucagaaaaaaacaaagca

SEQ ID NO: 979992 - RNA, 20 nt, Human
guggucaucgagguggauac

SEQ ID NO: 979993 - RNA, 23 nt, Human
uaaaaaaacacacaaacacacaa

SEQ ID NO: 979994 - RNA, 19 nt, Human
uaaaauaaacaacuugcca

SEQ ID NO: 979995 - RNA, 21 nt, Human
uaaaauaaacaacuugccaac

SEQ ID NO: 979996 - RNA, 19 nt, Human
uaacaccaaaaaucaugua

SEQ ID NO: 979997 - RNA, 23 nt, Human
uaacagaaacugacccaacgcac

SEQ ID NO: 979998 - RNA, 21 nt, Human
uaacgcguuugucaauuagca

SEQ ID NO: 979999 - RNA, 19 nt, Human
uaacugaaauugcuaacgc

SEQ ID NO: 980000 - RNA, 18 nt, Human
uaagagauuacaccaaaa

SEQ ID NO: 980001 - RNA, 19 nt, Human
uaagagauuacaccaaaag

SEQ ID NO: 980002 - RNA, 26 nt, Human
uaagagauuacaccaaaagcauaaac

SEQ ID NO: 980003 - RNA, 23 nt, Human
uaaguguccuuuucuuucagaaa

SEQ ID NO: 980004 - RNA, 25 nt, Human
uacaauacuauacacagcaccaaaa

SEQ ID NO: 980005 - RNA, 27 nt, Human
uacacagcaccaaaaguaucacaccac

SEQ ID NO: 980006 - RNA, 22 nt, Human
uacagguaugcaccaccauacc

SEQ ID NO: 980007 - RNA, 24 nt, Human
uaguagggacgggguuucuccaug

SEQ ID NO: 980008 - RNA, 24 nt, Human
uaucacaccaccaagcgcugucuc

SEQ ID NO: 980009 - RNA, 20 nt, Human
ucaauaaauagaaaugaagu

SEQ ID NO: 980010 - RNA, 22 nt, Human
ucacacagaauuuaaaugggau

SEQ ID NO: 980011 - RNA, 22 nt, Human
ucacaccaccaagcgcugucuc

SEQ ID NO: 980012 - RNA, 23 nt, Human
ucacucuuguugccuaggcucgg

SEQ ID NO: 980013 - RNA, 24 nt, Human
ucagcauuuauccaaagauuuuuu

SEQ ID NO: 980014 - RNA, 18 nt, Human
uccaggggcugcaugugu

SEQ ID NO: 980015 - RNA, 25 nt, Human
uccauagaaguagucagaaaaaaac

SEQ ID NO: 980016 - RNA, 24 nt, Human
ucccaaagugcugggauuacaggc

SEQ ID NO: 980017 - RNA, 24 nt, Human
ucccagagagcugccccuuuccuu

SEQ ID NO: 980018 - RNA, 23 nt, Human
ucccgaguagcugggauuacagg

SEQ ID NO: 980019 - RNA, 24 nt, Human
ucccgaguagcugggauuacaggu

SEQ ID NO: 980020 - RNA, 21 nt, Human
uccuggguucaagccauucuc

SEQ ID NO: 980021 - RNA, 24 nt, Human
uccuggguucaagccauucuccug

SEQ ID NO: 980022 - RNA, 20 nt, Human
uccuucagcaauaccgcugg

SEQ ID NO: 980023 - RNA, 20 nt, Human
ucuggaaguggccaucugug

SEQ ID NO: 980024 - RNA, 23 nt, Human
ucugucagcauuuauccaaagau

SEQ ID NO: 980025 - RNA, 18 nt, Human
ucuuggaaaucugucagc

SEQ ID NO: 980026 - RNA, 21 nt, Human
ugaaauugcuaacgcguuugu

SEQ ID NO: 980027 - RNA, 21 nt, Human
ugaacacgcuaccacaagggc

SEQ ID NO: 980028 - RNA, 18 nt, Human
ugaaccaccacgccaaga

SEQ ID NO: 980029 - RNA, 26 nt, Human
ugaagaaccaguuuauuaagagauua

SEQ ID NO: 980030 - RNA, 21 nt, Human
ugacaaaaugacccccaaagc

SEQ ID NO: 980031 - RNA, 24 nt, Human
ugacaaaaugacccccaaagcuag

SEQ ID NO: 980032 - RNA, 19 nt, Human
ugcaaauuaggucuaugaa

SEQ ID NO: 980033 - RNA, 19 nt, Human
ugcauguguguccagcugu

SEQ ID NO: 980034 - RNA, 23 nt, Human
ugcccccuauucacgccuacacg

SEQ ID NO: 980035 - RNA, 24 nt, Human
ugccuaggcucgggugcaauggug

SEQ ID NO: 980036 - RNA, 21 nt, Human
ugccucagguucccgaguagc

SEQ ID NO: 980037 - RNA, 24 nt, Human
ugccucagguucccgaguagcugg

SEQ ID NO: 980038 - RNA, 23 nt, Human
ugcugggauuacaggcgugaacc

SEQ ID NO: 980039 - RNA, 19 nt, Human
uggcaugaguucugaugua

SEQ ID NO: 980040 - RNA, 19 nt, Human
uggcgagagacaggcaaug

SEQ ID NO: 980041 - RNA, 19 nt, Human
ugggauuacaggcgugaac

SEQ ID NO: 980042 - RNA, 22 nt, Human
ugggauuacaggcgugaaccac

SEQ ID NO: 980043 - RNA, 23 nt, Human
ugggauuacaggcgugaaccacc

SEQ ID NO: 980044 - RNA, 24 nt, Human
ugggauuacaggcgugaaccacca

SEQ ID NO: 980045 - RNA, 24 nt, Human
ugggauuacaggcgugaaccacca

SEQ ID NO: 980046 - RNA, 21 nt, Human
ugggauuacagguaugcacca

SEQ ID NO: 980047 - RNA, 24 nt, Human
ugggauuacagguaugcaccacca

SEQ ID NO: 980048 - RNA, 23 nt, Human
uggucaggcuggucucgaacucc

SEQ ID NO: 980049 - RNA, 19 nt, Human
uggucucgaacucccgacc

SEQ ID NO: 980050 - RNA, 24 nt, Human
uggugcgaucuugccccaccacaa

SEQ ID NO: 980051 - RNA, 21 nt, Human
uguauuuuuaguagggacggg

SEQ ID NO: 980052 - RNA, 23 nt, Human
ugucacaauucaccagagcugcc

SEQ ID NO: 980053 - RNA, 25 nt, Human
ugucagaauuaauucaagcaaaaca

SEQ ID NO: 980054 - RNA, 19 nt, Human
ugucuccuggguucaagcc

SEQ ID NO: 980055 - RNA, 20 nt, Human
uguuuaacauuuucaguggg

SEQ ID NO: 980056 - RNA, 26 nt, Human
uuacuuuuaacuuuuaaaacaaaaca

SEQ ID NO: 980057 - RNA, 18 nt, Human
uuaguagggacgggguuu

SEQ ID NO: 980058 - RNA, 24 nt, Human
uuaguagggacgggguuucuccau

SEQ ID NO: 980059 - RNA, 19 nt, Human
uuauuuauuuauuuauuua

SEQ ID NO: 980060 - RNA, 25 nt, Human
uuauuuauuuauuuauuuauuuauu

SEQ ID NO: 980061 - RNA, 27 nt, Human
uuauuuauuuauuuauuuauuuuuuug

SEQ ID NO: 980062 - RNA, 21 nt, Human
uucaagccauucuccugccuc

SEQ ID NO: 980063 - RNA, 22 nt, Human
uucacucuuguugccuaggcuc

SEQ ID NO: 980064 - RNA, 19 nt, Human
uucauguuggccuaagcuu

SEQ ID NO: 980065 - RNA, 19 nt, Human
uucggccucccaaagugcu

SEQ ID NO: 980066 - RNA, 20 nt, Human
uugguaguucuuggaaaucu

SEQ ID NO: 980067 - RNA, 21 nt, Human
uuucuccauguuggucaggcu

SEQ ID NO: 980068 - RNA, 18 nt, Human
uuugaccuguucaauaaa

SEQ ID NO: 980069 - RNA, 22 nt, Human
uuugcuucuucacuggccuucc

SEQ ID NO: 980070 - RNA, 24 nt, Human
uuugucaauuagcaauuaagaacu

SEQ ID NO: 980071 - RNA, 19 nt, Human
uuuuaguccccgauugagu

SEQ ID NO: 980072 - RNA, 20 nt, Human
uuuuguauuuuuaguaggga

SEQ ID NO: 980073 - RNA, 22 nt, Human
uuuuuaguagggacgggguuuc

SEQ ID NO: 980074 - RNA, 21 nt, Human
aacucgacccacgauaggugg

SEQ ID NO: 980075 - RNA, 20 nt, Human
aaguagacuugaacauccca

SEQ ID NO: 980076 - RNA, 18 nt, Human
agcuuuauuucaaagcaa

SEQ ID NO: 980077 - RNA, 20 nt, Human
aggaaagaggacaccugggc

SEQ ID NO: 980078 - RNA, 18 nt, Human
ccaagcaacucgacccac

SEQ ID NO: 980079 - RNA, 18 nt, Human
ccaagcaacucgacccac

SEQ ID NO: 980080 - RNA, 24 nt, Human
cccacgauagguggggccgggguc

SEQ ID NO: 980081 - RNA, 19 nt, Human
ccggaaccacgaccgccaa

SEQ ID NO: 980082 - RNA, 22 nt, Human
cgaccgccaagcaacucgaccc

SEQ ID NO: 980083 - RNA, 22 nt, Human
cgauagguggggccuacgcucu

SEQ ID NO: 980084 - RNA, 19 nt, Human
gaaccacgaccgccaagca

SEQ ID NO: 980085 - RNA, 21 nt, Human
gcaaucugaaaacagcagucc

SEQ ID NO: 980086 - RNA, 21 nt, Human
gcuaaguuaguagcuuucuuc

SEQ ID NO: 980087 - RNA, 18 nt, Human
gcuuaauuauuuaaaaaa

SEQ ID NO: 980088 - RNA, 19 nt, Human
ggaaccacgaccgccaagc

SEQ ID NO: 980089 - RNA, 18 nt, Human
gugaugucuuuguuaucc

SEQ ID NO: 980090 - RNA, 24 nt, Human
uaggaaggagcacacagucgaccu

SEQ ID NO: 980091 - RNA, 22 nt, Human
ucaacuuauugagggauuugcu

SEQ ID NO: 980092 - RNA, 18 nt, Human
ugguaaagacccugucuc

SEQ ID NO: 980093 - RNA, 21 nt, Human
uuacuccucacgacagccaaa

SEQ ID NO: 980094 - RNA, 20 nt, Human
uuccugcccaacaccuacug

SEQ ID NO: 980095 - RNA, 21 nt, Human
uuuauagaaaaauaagcuuua

SEQ ID NO: 980096 - RNA, 23 nt, Human
aacccuccuuccuccagggaggc

SEQ ID NO: 980097 - RNA, 23 nt, Human
aacuagaccccuuaaagggccua

SEQ ID NO: 980098 - RNA, 25 nt, Human
acaaggaagaaaggucucucccuca

SEQ ID NO: 980099 - RNA, 20 nt, Human
agagagcgggguggcgggag

SEQ ID NO: 980100 - RNA, 21 nt, Human
aggcaccccuaacccuccuuc

SEQ ID NO: 980101 - RNA, 20 nt, Human
caauucugcucuuccaauaa

SEQ ID NO: 980102 - RNA, 24 nt, Human
caccccuaacccuccuuccuccag

SEQ ID NO: 980103 - RNA, 23 nt, Human
caucagugucuguggacguaguc

SEQ ID NO: 980104 - RNA, 20 nt, Human
ccagggccucgcaaacggca

SEQ ID NO: 980105 - RNA, 19 nt, Human
ccccuaacccuccuuccuc

SEQ ID NO: 980106 - RNA, 18 nt, Human
ccugaagagccugagaga

SEQ ID NO: 980107 - RNA, 20 nt, Human
cgcaaacggcaacuagaccc

SEQ ID NO: 980108 - RNA, 22 nt, Human
gaaacucaagacagagauccuc

SEQ ID NO: 980109 - RNA, 22 nt, Human
gcgggguggcgggagucggggg

SEQ ID NO: 980110 - RNA, 19 nt, Human
gcuucagcugauggggaag

SEQ ID NO: 980111 - RNA, 19 nt, Human
ggccugguaaguggagcug

SEQ ID NO: 980112 - RNA, 22 nt, Human
gggaaggagaaacucaagacag

SEQ ID NO: 980113 - RNA, 18 nt, Human
gggccucgcaaacggcaa

SEQ ID NO: 980114 - RNA, 18 nt, Human
uagaccccuuaaagggcc

SEQ ID NO: 980115 - RNA, 21 nt, Human
ucaacaaggaagaaaggucuc

SEQ ID NO: 980116 - RNA, 21 nt, Human
ucaauucugcucuuccaauac

SEQ ID NO: 980117 - RNA, 19 nt, Human
uccaauacuugaggauagg

SEQ ID NO: 980118 - RNA, 21 nt, Human
uccggcgccguacgggaggag

SEQ ID NO: 980119 - RNA, 24 nt, Human
ucugaagagugcuucagcugaugg

SEQ ID NO: 980120 - RNA, 23 nt, Human
ugaagagccugagagagcggggu

SEQ ID NO: 980121 - RNA, 23 nt, Human
ugaggauaggcaccccuaacccu

SEQ ID NO: 980122 - RNA, 22 nt, Human
ugcuucagcugauggggaagga

SEQ ID NO: 980123 - RNA, 19 nt, Human
ugguaaguggagcugggau

SEQ ID NO: 980124 - RNA, 19 nt, Human
ugucuguggacguagucuc

SEQ ID NO: 980125 - RNA, 18 nt, Human
uuuuuuuuuuuuuuuuug

SEQ ID NO: 980126 - RNA, 23 nt, Human
uuuuuuuuuuuuuuuuugacaug

SEQ ID NO: 980127 - RNA, 22 nt, Human
aaaaagacaaguuaaacaacaa

SEQ ID NO: 980128 - RNA, 25 nt, Human
aaacagaacaauacauucaaagaaa

SEQ ID NO: 980129 - RNA, 19 nt, Human
aacagaacaauacauucaa

SEQ ID NO: 980130 - RNA, 25 nt, Human
aagucguuuaaaaccuauuuaaaau

SEQ ID NO: 980131 - RNA, 19 nt, Human
aaucaucugaaauaacaca

SEQ ID NO: 980132 - RNA, 23 nt, Human
ccacagaagccgccgcacaggcu

SEQ ID NO: 980133 - RNA, 24 nt, Human
ccccgcaaacaaaagucguuuaaa

SEQ ID NO: 980134 - RNA, 18 nt, Human
cccgcaaacaaaagucgu

SEQ ID NO: 980135 - RNA, 18 nt, Human
cccgcaaacaaaagucgu

SEQ ID NO: 980136 - RNA, 23 nt, Human
ccgccgcacaggcucacaaacag

SEQ ID NO: 980137 - RNA, 21 nt, Human
ccggcccacagaagccgccgc

SEQ ID NO: 980138 - RNA, 21 nt, Human
cuaauacauucucauauuaca

SEQ ID NO: 980139 - RNA, 23 nt, Human
cucacaaacagcaacaacaacga

SEQ ID NO: 980140 - RNA, 20 nt, Human
gaccuaauucgguuuuccuu

SEQ ID NO: 980141 - RNA, 23 nt, Human
gccgcacaggcucacaaacagca

SEQ ID NO: 980142 - RNA, 19 nt, Human
uaaaagccccgcaaacaaa

SEQ ID NO: 980143 - RNA, 23 nt, Human
uaacaaaaagacaaguuaaacaa

SEQ ID NO: 980144 - RNA, 23 nt, Human
ucacaaacagcaacaacaacgac

SEQ ID NO: 980145 - RNA, 19 nt, Human
ugaaauaacacaaacagaa

SEQ ID NO: 980146 - RNA, 21 nt, Human
ugaaauaacacaaacagaaca

SEQ ID NO: 980147 - RNA, 27 nt, Human
ugcauaacaaaaagacaaguuaaacaa

SEQ ID NO: 980148 - RNA, 22 nt, Human
uguacuaauacauucucauauu

SEQ ID NO: 980149 - RNA, 19 nt, Human
uuuuuuuuuuuuuuuugcu

SEQ ID NO: 980150 - RNA, 18 nt, Human
uuuuuuuuuuuuuuuuug

SEQ ID NO: 980151 - RNA, 24 nt, Human
uuuuuuuuuuuuuuuuugcucuuu

SEQ ID NO: 980152 - RNA, 21 nt, Human
aaccgcgacgagaagcugguc

SEQ ID NO: 980153 - RNA, 23 nt, Human
accuggggcucagggcagccgcu

SEQ ID NO: 980154 - RNA, 20 nt, Human
agaagggacagaggaaaggg

SEQ ID NO: 980155 - RNA, 18 nt, Human
agagaaagaagggacaga

SEQ ID NO: 980156 - RNA, 21 nt, Human
agagaaagaagggacagagga

SEQ ID NO: 980157 - RNA, 22 nt, Human
agagcuccauggggcucugccc

SEQ ID NO: 980158 - RNA, 21 nt, Human
agaggaaaggggcugccccaa

SEQ ID NO: 980159 - RNA, 24 nt, Human
agccaggcucucguccucgcagcc

SEQ ID NO: 980160 - RNA, 20 nt, Human
agccgcuuccccacccagca

SEQ ID NO: 980161 - RNA, 20 nt, Human
aggaagggacagagaaagaa

SEQ ID NO: 980162 - RNA, 21 nt, Human
aggaagggacagagaaagaag

SEQ ID NO: 980163 - RNA, 23 nt, Human
aggcccaggcuggggcagcccug

SEQ ID NO: 980164 - RNA, 21 nt, Human
aggcucucguccucgcagccu

SEQ ID NO: 980165 - RNA, 19 nt, Human
aggcugcagaacguguggc

SEQ ID NO: 980166 - RNA, 19 nt, Human
agggacagagaaagaaggg

SEQ ID NO: 980167 - RNA, 22 nt, Human
caagaaggcaguuccacuggga

SEQ ID NO: 980168 - RNA, 23 nt, Human
caagagaggcccaggcuggggca

SEQ ID NO: 980169 - RNA, 21 nt, Human
cacagcagcagaggggcccua

SEQ ID NO: 980170 - RNA, 23 nt, Human
cagaaaggacugucccagccucg

SEQ ID NO: 980171 - RNA, 24 nt, Human
cagcaggggcugggccccacgcuc

SEQ ID NO: 980172 - RNA, 29 nt, Human
cagcccccgcugcgcgcuccgccagcccg

SEQ ID NO: 980173 - RNA, 25 nt, Human
cagccucgggagcaagagauggcuc

SEQ ID NO: 980174 - RNA, 21 nt, Human
cagcuguccucaucccugccc

SEQ ID NO: 980175 - RNA, 24 nt, Human
caggacgaagugccaggcccugcu

SEQ ID NO: 980176 - RNA, 20 nt, Human
caggcucggccccgccccac

SEQ ID NO: 980177 - RNA, 24 nt, Human
cagugcagucccagcaggggcugg

SEQ ID NO: 980178 - RNA, 19 nt, Human
ccacagaaaggacuguccc

SEQ ID NO: 980179 - RNA, 19 nt, Human
ccacccagcacagcagcag

SEQ ID NO: 980180 - RNA, 21 nt, Human
ccacccccaggcccgcccgca

SEQ ID NO: 980181 - RNA, 25 nt, Human
ccacgcucacacucgucuuccucuc

SEQ ID NO: 980182 - RNA, 18 nt, Human
ccaggcccgcccgcagug

SEQ ID NO: 980183 - RNA, 18 nt, Human
ccaggcuggggcagcccu

SEQ ID NO: 980184 - RNA, 24 nt, Human
cccagcuguccucaucccugccca

SEQ ID NO: 980185 - RNA, 25 nt, Human
cccaggcuggggcagcccugagagc

SEQ ID NO: 980186 - RNA, 25 nt, Human
ccccacccugggccucacgcacccc

SEQ ID NO: 980187 - RNA, 24 nt, Human
ccccgccccacccugggccucacg

SEQ ID NO: 980188 - RNA, 23 nt, Human
ccccgcugcgcgcuccgccagcc

SEQ ID NO: 980189 - RNA, 21 nt, Human
cccgccccacccugggccuca

SEQ ID NO: 980190 - RNA, 22 nt, Human
cccgcccgcagugcagucccag

SEQ ID NO: 980191 - RNA, 28 nt, Human
cccugcccacccccaggcccgcccgcag

SEQ ID NO: 980192 - RNA, 22 nt, Human
ccgcugcgcgcuccgccagccc

SEQ ID NO: 980193 - RNA, 28 nt, Human
ccgcugcgcgcuccgccagcccggcccu

SEQ ID NO: 980194 - RNA, 21 nt, Human
ccgugccagguguccaggugc

SEQ ID NO: 980195 - RNA, 23 nt, Human
ccucaucccugcccagcaggcug

SEQ ID NO: 980196 - RNA, 19 nt, Human
ccucccacaagaccugggg

SEQ ID NO: 980197 - RNA, 20 nt, Human
ccuccggacgggccucaucc

SEQ ID NO: 980198 - RNA, 19 nt, Human
ccugggggcagccaggguc

SEQ ID NO: 980199 - RNA, 21 nt, Human
cgaaccgcgacgagaagcugg

SEQ ID NO: 980200 - RNA, 22 nt, Human
cgugccagguguccaggugcac

SEQ ID NO: 980201 - RNA, 25 nt, Human
cuagagccacggcccgggcaucugc

SEQ ID NO: 980202 - RNA, 18 nt, Human
cucacacucgucuuccuc

SEQ ID NO: 980203 - RNA, 18 nt, Human
cucagggcagccgcuucc

SEQ ID NO: 980204 - RNA, 20 nt, Human
cucgcagccucccacaagac

SEQ ID NO: 980205 - RNA, 19 nt, Human
cucugcccugcccaccccc

SEQ ID NO: 980206 - RNA, 22 nt, Human
gaaagaagggacagaggaaagg

SEQ ID NO: 980207 - RNA, 22 nt, Human
gaagggacagagaaagaaggga

SEQ ID NO: 980208 - RNA, 20 nt, Human
gacagaggaaaggggcugcc

SEQ ID NO: 980209 - RNA, 24 nt, Human
gagaggcccaggcuggggcagccc

SEQ ID NO: 980210 - RNA, 22 nt, Human
gaguguggcuggaaggaaggga

SEQ ID NO: 980211 - RNA, 21 nt, Human
gccagcccggcccugacccac

SEQ ID NO: 980212 - RNA, 26 nt, Human
gccccagcccaagaaggcaguuccac

SEQ ID NO: 980213 - RNA, 26 nt, Human
gcccccacagaaaggacugucccagc

SEQ ID NO: 980214 - RNA, 22 nt, Human
gcccuugugguggaggaggccu

SEQ ID NO: 980215 - RNA, 21 nt, Human
gccugggggcagccagggucg

SEQ ID NO: 980216 - RNA, 21 nt, Human
ggaagggacagagaaagaagg

SEQ ID NO: 980217 - RNA, 26 nt, Human
ggccaugguggaaagaaucugcagcc

SEQ ID NO: 980218 - RNA, 27 nt, Human
ggcccaggcuggggcagcccugagagc

SEQ ID NO: 980219 - RNA, 23 nt, Human
gggcagccagggucgcagugagc

SEQ ID NO: 980220 - RNA, 24 nt, Human
gguggaaagaaucugcagcccccg

SEQ ID NO: 980221 - RNA, 22 nt, Human
gugguggaggaggccugggggc

SEQ ID NO: 980222 - RNA, 23 nt, Human
ucccacaagaccuggggcucagg

SEQ ID NO: 980223 - RNA, 23 nt, Human
ucccagacccagucgaaaucugc

SEQ ID NO: 980224 - RNA, 24 nt, Human
uccgggggcgucuggccauggugg

SEQ ID NO: 980225 - RNA, 24 nt, Human
ucuccgcagcggcagucccugccc

SEQ ID NO: 980226 - RNA, 19 nt, Human
ugccccagcccaagaaggc

SEQ ID NO: 980227 - RNA, 20 nt, Human
uggaaagaaucugcagcccc

SEQ ID NO: 980228 - RNA, 19 nt, Human
uggaggaggccugggggca

SEQ ID NO: 980229 - RNA, 23 nt, Human
uggccgaaccgcgacgagaagcu

SEQ ID NO: 980230 - RNA, 24 nt, Human
ugucacagcucagcaggguggcug

SEQ ID NO: 980231 - RNA, 18 nt, Human
aaacaggaaacaaacuug

SEQ ID NO: 980232 - RNA, 23 nt, Human
aaacaggaaacaaacuuguagaa

SEQ ID NO: 980233 - RNA, 22 nt, Human
aaacuuguagaagucuccuaaa

SEQ ID NO: 980234 - RNA, 21 nt, Human
aagccggaaggugucuccaca

SEQ ID NO: 980235 - RNA, 23 nt, Human
aagcgccuguucgggaagaaucc

SEQ ID NO: 980236 - RNA, 22 nt, Human
aaguggcacagaguccuaaaac

SEQ ID NO: 980237 - RNA, 24 nt, Human
acaauagaaagucuccugccuaaa

SEQ ID NO: 980238 - RNA, 22 nt, Human
accgggcugcggcaggggccca

SEQ ID NO: 980239 - RNA, 19 nt, Human
accuccacagccucuaccg

SEQ ID NO: 980240 - RNA, 19 nt, Human
acggggcugggaaccaggc

SEQ ID NO: 980241 - RNA, 24 nt, Human
acggggcugggaaccaggcuuccg

SEQ ID NO: 980242 - RNA, 19 nt, Human
agagguggcagcagcagug

SEQ ID NO: 980243 - RNA, 22 nt, Human
agaguccuaaaacggugugaca

SEQ ID NO: 980244 - RNA, 20 nt, Human
agcagcauuccugcgagagg

SEQ ID NO: 980245 - RNA, 23 nt, Human
aggaaggccccccaacccaggac

SEQ ID NO: 980246 - RNA, 19 nt, Human
aggcagugcugucuggggc

SEQ ID NO: 980247 - RNA, 19 nt, Human
aggcuuccggacgguagac

SEQ ID NO: 980248 - RNA, 21 nt, Human
agggcugccucgagggcagua

SEQ ID NO: 980249 - RNA, 27 nt, Human
aggggcacggcgucaggcuucccaagg

SEQ ID NO: 980250 - RNA, 18 nt, Human
aggugucugacuugggag

SEQ ID NO: 980251 - RNA, 20 nt, Human
augcccccaguucccccguu

SEQ ID NO: 980252 - RNA, 23 nt, Human
caaaccagucagacucaucuucc

SEQ ID NO: 980253 - RNA, 22 nt, Human
caagcugauaaauaaacagcac

SEQ ID NO: 980254 - RNA, 21 nt, Human
cacggggcugggaaccaggcu

SEQ ID NO: 980255 - RNA, 27 nt, Human
cacuccaggaaggccccccaacccagg

SEQ ID NO: 980256 - RNA, 19 nt, Human
cacugcacuguccacuugc

SEQ ID NO: 980257 - RNA, 22 nt, Human
cacuggcuaauuucucccuggc

SEQ ID NO: 980258 - RNA, 23 nt, Human
caggagggucgggcccugcggug

SEQ ID NO: 980259 - RNA, 19 nt, Human
caggauuuccaggaggugc

SEQ ID NO: 980260 - RNA, 23 nt, Human
ccaagcuccauaaaagagagggc

SEQ ID NO: 980261 - RNA, 23 nt, Human
ccacugcugugaugauuuccagu

SEQ ID NO: 980262 - RNA, 22 nt, Human
ccagagacccugacacuccagg

SEQ ID NO: 980263 - RNA, 23 nt, Human
ccaggcucucuguggcuccgaag

SEQ ID NO: 980264 - RNA, 22 nt, Human
cccagagacccugacacuccag

SEQ ID NO: 980265 - RNA, 22 nt, Human
ccccaguucccccguuagcacc

SEQ ID NO: 980266 - RNA, 22 nt, Human
cccccaguucccccguuagcac

SEQ ID NO: 980267 - RNA, 18 nt, Human
cccuggcaaggcguaugg

SEQ ID NO: 980268 - RNA, 22 nt, Human
ccgcugcaggccaccgcuaccu

SEQ ID NO: 980269 - RNA, 21 nt, Human
ccugacacuccaggaaggccc

SEQ ID NO: 980270 - RNA, 21 nt, Human
cgcccuggcaaggcguauggg

SEQ ID NO: 980271 - RNA, 22 nt, Human
cggggaggaggccgcugcaggc

SEQ ID NO: 980272 - RNA, 21 nt, Human
cuccccguagccaggaauggg

SEQ ID NO: 980273 - RNA, 25 nt, Human
cucccuggcccugucugcaacgggg

SEQ ID NO: 980274 - RNA, 22 nt, Human
cucgugggagccuccacucccc

SEQ ID NO: 980275 - RNA, 23 nt, Human
cucuccgcauuccucuuuuaaaa

SEQ ID NO: 980276 - RNA, 21 nt, Human
cugccgccgccgccucccccu

SEQ ID NO: 980277 - RNA, 20 nt, Human
cugcgguugggccuccuggg

SEQ ID NO: 980278 - RNA, 18 nt, Human
cuggcagguccuggacuc

SEQ ID NO: 980279 - RNA, 21 nt, Human
cuguggcuccgaaggaggugu

SEQ ID NO: 980280 - RNA, 22 nt, Human
gacaggagggucgggcccugcg

SEQ ID NO: 980281 - RNA, 18 nt, Human
gacugugaaugacaggag

SEQ ID NO: 980282 - RNA, 19 nt, Human
gaggaggccgcugcaggcc

SEQ ID NO: 980283 - RNA, 19 nt, Human
gaggggucugcugccgccg

SEQ ID NO: 980284 - RNA, 21 nt, Human
gcagcagcaguggcggcggag

SEQ ID NO: 980285 - RNA, 25 nt, Human
gccacggggcugggaaccaggcuuc

SEQ ID NO: 980286 - RNA, 24 nt, Human
gcccugucugcaacggggcacaca

SEQ ID NO: 980287 - RNA, 18 nt, Human
ggaggaagaggcagugcu

SEQ ID NO: 980288 - RNA, 18 nt, Human
ggcagcagcaguggcggc

SEQ ID NO: 980289 - RNA, 24 nt, Human
ggcagguccuggacucccuggaga

SEQ ID NO: 980290 - RNA, 18 nt, Human
ggcagugggguggggagg

SEQ ID NO: 980291 - RNA, 19 nt, Human
ggcagugggguggggagga

SEQ ID NO: 980292 - RNA, 21 nt, Human
gggaggaagaggcagugcugu

SEQ ID NO: 980293 - RNA, 22 nt, Human
gguccuggacucccuggagagg

SEQ ID NO: 980294 - RNA, 21 nt, Human
guccuggacucccuggagagg

SEQ ID NO: 980295 - RNA, 24 nt, Human
guggcagcagcaguggcggcggag

SEQ ID NO: 980296 - RNA, 20 nt, Human
guggcagcagcaguggcggg

SEQ ID NO: 980297 - RNA, 22 nt, Human
gugggguggggaggaagaggca

SEQ ID NO: 980298 - RNA, 23 nt, Human
uaaggaaacaggcucucugauca

SEQ ID NO: 980299 - RNA, 19 nt, Human
uaccgggcugcggcagggg

SEQ ID NO: 980300 - RNA, 18 nt, Human
uaccucgugggagccucc

SEQ ID NO: 980301 - RNA, 24 nt, Human
uagaaagucuccugccuaaauguu

SEQ ID NO: 980302 - RNA, 21 nt, Human
ucaguggcugggaaggggagc

SEQ ID NO: 980303 - RNA, 21 nt, Human
ucauucaucagucaaauucac

SEQ ID NO: 980304 - RNA, 22 nt, Human
uccacagccucuaccgggcugc

SEQ ID NO: 980305 - RNA, 19 nt, Human
uccacccuuccagucacaa

SEQ ID NO: 980306 - RNA, 21 nt, Human
uccaggaaggccccccaaccc

SEQ ID NO: 980307 - RNA, 21 nt, Human
ucccauauccacccuuccagu

SEQ ID NO: 980308 - RNA, 18 nt, Human
ucccugaagagagguguc

SEQ ID NO: 980309 - RNA, 21 nt, Human
ucccugaagagaggugucugg

SEQ ID NO: 980310 - RNA, 24 nt, Human
uccucuccgcauuccucuuuuaaa

SEQ ID NO: 980311 - RNA, 22 nt, Human
ucugcgguugggccuccuggga

SEQ ID NO: 980312 - RNA, 22 nt, Human
ucugcugccgccgccgccuccc

SEQ ID NO: 980313 - RNA, 22 nt, Human
ucugugcugcccaucaggcuug

SEQ ID NO: 980314 - RNA, 22 nt, Human
ucuguggcuccgaaggaggugu

SEQ ID NO: 980315 - RNA, 24 nt, Human
ucugugucugugcugcccaucagg

SEQ ID NO: 980316 - RNA, 18 nt, Human
ugaaugacaaacuuuauu

SEQ ID NO: 980317 - RNA, 20 nt, Human
ugaaugacaaacuuuauuaa

SEQ ID NO: 980318 - RNA, 24 nt, Human
ugacaaacuuuauuagaaacgcuc

SEQ ID NO: 980319 - RNA, 18 nt, Human
ugacuugggagggcugcc

SEQ ID NO: 980320 - RNA, 20 nt, Human
ugaguguccuggggagccag

SEQ ID NO: 980321 - RNA, 21 nt, Human
ugaguguccuggggagccagg

SEQ ID NO: 980322 - RNA, 22 nt, Human
ugaguguccuggggagccagga

SEQ ID NO: 980323 - RNA, 19 nt, Human
ugaguguccuggggagccg

SEQ ID NO: 980324 - RNA, 18 nt, Human
ugaguguccuggggagcg

SEQ ID NO: 980325 - RNA, 24 nt, Human
ugcacuggcuaauuucucccuggc

SEQ ID NO: 980326 - RNA, 21 nt, Human
ugccaugggacugugaaugac

SEQ ID NO: 980327 - RNA, 19 nt, Human
ugcccagagacccugacac

SEQ ID NO: 980328 - RNA, 19 nt, Human
ugccgcacccugaauggac

SEQ ID NO: 980329 - RNA, 22 nt, Human
ugcgguugggccuccugggaac

SEQ ID NO: 980330 - RNA, 22 nt, Human
uggcaagagaccuuucguuucc

SEQ ID NO: 980331 - RNA, 20 nt, Human
uggcugggaaggggagcacg

SEQ ID NO: 980332 - RNA, 19 nt, Human
ugggagccuccacuccccg

SEQ ID NO: 980333 - RNA, 21 nt, Human
ugggccuccugggaacagucu

SEQ ID NO: 980334 - RNA, 27 nt, Human
uggggaggaagaggcagugcugucugg

SEQ ID NO: 980335 - RNA, 18 nt, Human
uggggcaaaccagucaga

SEQ ID NO: 980336 - RNA, 21 nt, Human
uggggcucugauaucccacug

SEQ ID NO: 980337 - RNA, 19 nt, Human
ugggguggggaggaagagg

SEQ ID NO: 980338 - RNA, 22 nt, Human
ugguggcaggauuuccaggagg

SEQ ID NO: 980339 - RNA, 18 nt, Human
ugucugaaacauauaaga

SEQ ID NO: 980340 - RNA, 18 nt, Human
uguuuuauucauucucuu

SEQ ID NO: 980341 - RNA, 20 nt, Human
uugggugucacaaugccccc

SEQ ID NO: 980342 - RNA, 20 nt, Human
uuuccaaaguugguaccaca

SEQ ID NO: 980343 - RNA, 20 nt, Human
uuuuuuuuuuuugaaggacu

SEQ ID NO: 980344 - RNA, 21 nt, Human
uuuuuuuuuuuuuuuugaagg

SEQ ID NO: 980345 - RNA, 18 nt, Human
uuuuuuuuuuuuuuuuug

SEQ ID NO: 980346 - RNA, 21 nt, Human
aaagaguauuuuaauucuugu

SEQ ID NO: 980347 - RNA, 24 nt, Human
cuaacccgagcagcccagccacgc

SEQ ID NO: 980348 - RNA, 30 nt, Human
cuguaccaaaugauggccaaagaagaaucc

SEQ ID NO: 980349 - RNA, 20 nt, Human
uggaaaugagacuguaccaa

SEQ ID NO: 980350 - RNA, 25 nt, Human
aaacgugaaaaaaaggauggaauaa

SEQ ID NO: 980351 - RNA, 23 nt, Human
aaagucccuacuuauuucuacuu

SEQ ID NO: 980352 - RNA, 28 nt, Human
acauauacauacacacauaauuauuugc

SEQ ID NO: 980353 - RNA, 26 nt, Human
agagcaggaaauaaaaagggggaccc

SEQ ID NO: 980354 - RNA, 24 nt, Human
auaaagcagugauauacacagcac

SEQ ID NO: 980355 - RNA, 18 nt, Human
auguauguauguguauau

SEQ ID NO: 980356 - RNA, 24 nt, Human
auuuuauuccuauccaugauugca

SEQ ID NO: 980357 - RNA, 26 nt, Human
cacacauauacauacacacauaauua

SEQ ID NO: 980358 - RNA, 18 nt, Human
caggagcaacuuguaaua

SEQ ID NO: 980359 - RNA, 21 nt, Human
cagugauauacacagcacaaa

SEQ ID NO: 980360 - RNA, 23 nt, Human
ccacacauauacauacacacaua

SEQ ID NO: 980361 - RNA, 21 nt, Human
cccacacauauacauacacac

SEQ ID NO: 980362 - RNA, 24 nt, Human
cccacacauauacauacacacaua

SEQ ID NO: 980363 - RNA, 18 nt, Human
cccacugucacgcaccug

SEQ ID NO: 980364 - RNA, 18 nt, Human
cucccacugucacgcacc

SEQ ID NO: 980365 - RNA, 21 nt, Human
cucucaaauaagcgauuuuau

SEQ ID NO: 980366 - RNA, 23 nt, Human
cuugugccgagagcagcucccac

SEQ ID NO: 980367 - RNA, 21 nt, Human
gcuugugccgagagcagcucc

SEQ ID NO: 980368 - RNA, 18 nt, Human
ggagcaacuuguaauaau

SEQ ID NO: 980369 - RNA, 18 nt, Human
uaacaucugaguucaccu

SEQ ID NO: 980370 - RNA, 19 nt, Human
uacacagcacaaaauaguu

SEQ ID NO: 980371 - RNA, 23 nt, Human
uacaguacauucucuuucccaca

SEQ ID NO: 980372 - RNA, 27 nt, Human
uaguucugugaagggcugacucacugu

SEQ ID NO: 980373 - RNA, 24 nt, Human
uauguauguguauaugucuguaua

SEQ ID NO: 980374 - RNA, 20 nt, Human
uauguguauaugucuguaua

SEQ ID NO: 980375 - RNA, 20 nt, Human
uauguguauaugucuguaua

SEQ ID NO: 980376 - RNA, 22 nt, Human
uauguguauaugucuguauaac

SEQ ID NO: 980377 - RNA, 22 nt, Human
ucacauuuggacccgcuuucuu

SEQ ID NO: 980378 - RNA, 19 nt, Human
uccguaguaguucugugaa

SEQ ID NO: 980379 - RNA, 19 nt, Human
ugagauuccuuuguuuaac

SEQ ID NO: 980380 - RNA, 19 nt, Human
ugauauacacagcacaaaa

SEQ ID NO: 980381 - RNA, 23 nt, Human
ugauugcagacauuuacaaaacc

SEQ ID NO: 980382 - RNA, 22 nt, Human
ugccgagagcagcucccacugu

SEQ ID NO: 980383 - RNA, 23 nt, Human
ugccgagagcagcucccacuguc

SEQ ID NO: 980384 - RNA, 18 nt, Human
uguaaacgugaaaaaaag

SEQ ID NO: 980385 - RNA, 25 nt, Human
ugucuguauaacauacacauauaca

SEQ ID NO: 980386 - RNA, 18 nt, Human
uguuuaacuguacacugu

SEQ ID NO: 980387 - RNA, 26 nt, Human
uucccacacauauacauacacacaua

SEQ ID NO: 980388 - RNA, 23 nt, Human
agcugccccucgcucccggcccc

SEQ ID NO: 980389 - RNA, 19 nt, Human
auggaauaaaaaguuuggc

SEQ ID NO: 980390 - RNA, 24 nt, Human
cagggaagagggcgccgagccucg

SEQ ID NO: 980391 - RNA, 20 nt, Human
ccaggcgcuggcuccgcgcu

SEQ ID NO: 980392 - RNA, 19 nt, Human
ccccccaggcgcuggcucc

SEQ ID NO: 980393 - RNA, 30 nt, Human
ccccccaggcgcuggcuccgcgcucuuucc

SEQ ID NO: 980394 - RNA, 20 nt, Human
ccccucccucccccccaggc

SEQ ID NO: 980395 - RNA, 18 nt, Human
ccccucgcucccggcccc

SEQ ID NO: 980396 - RNA, 23 nt, Human
ccgccgccgccgccgccgccgcu

SEQ ID NO: 980397 - RNA, 27 nt, Human
ccgccgccgccgccgcuaccgcuccgg

SEQ ID NO: 980398 - RNA, 18 nt, Human
ccgcgcucuuuccagcug

SEQ ID NO: 980399 - RNA, 19 nt, Human
ccgcgcucuuuccagcugu

SEQ ID NO: 980400 - RNA, 21 nt, Human
ccucgccgccgccgccgccgc

SEQ ID NO: 980401 - RNA, 22 nt, Human
ccucgccgcgcuccccucccuc

SEQ ID NO: 980402 - RNA, 27 nt, Human
ccucgccgcgcuccccucccucccccc

SEQ ID NO: 980403 - RNA, 27 nt, Human
cgccgagccucgccgccgccgccgccg

SEQ ID NO: 980404 - RNA, 23 nt, Human
cgccgccgccgccgccgcuaccg

SEQ ID NO: 980405 - RNA, 21 nt, Human
cgcgcuccccucccucccccc

SEQ ID NO: 980406 - RNA, 24 nt, Human
cggcgcucgcucgcucucucgcuc

SEQ ID NO: 980407 - RNA, 22 nt, Human
cucgcucgcuggcgcucuccuc

SEQ ID NO: 980408 - RNA, 23 nt, Human
cucgcucgcuggcgcucuccucg

SEQ ID NO: 980409 - RNA, 18 nt, Human
cucgcuggcgcucuccuc

SEQ ID NO: 980410 - RNA, 19 nt, Human
cuggcgcucuccucgccgc

SEQ ID NO: 980411 - RNA, 20 nt, Human
gaaacuaaaauugggaaagg

SEQ ID NO: 980412 - RNA, 23 nt, Human
gcgcuggcuccgcgcucuuucca

SEQ ID NO: 980413 - RNA, 24 nt, Human
ggggcguggauggggugggagggg

SEQ ID NO: 980414 - RNA, 25 nt, Human
ucgccgccgccgccgccgccgccgg

SEQ ID NO: 980415 - RNA, 24 nt, Human
ucgccgccgccgccgccgccggcg

SEQ ID NO: 980416 - RNA, 18 nt, Human
uggggugggaggggguug

SEQ ID NO: 980417 - RNA, 19 nt, Human
uggggugggaggggguuga

SEQ ID NO: 980418 - RNA, 21 nt, Human
uggggugggaggggguugagg

SEQ ID NO: 980419 - RNA, 22 nt, Human
uggggugggaggggguugaggg

SEQ ID NO: 980420 - RNA, 24 nt, Human
uuuuuuuuuuuuuuguuuuaugga

SEQ ID NO: 980421 - RNA, 24 nt, Human
uuuuuuuuuuuuuuuuguuuuaug

SEQ ID NO: 980422 - RNA, 18 nt, Human
uuuuuuuuuuuuuuuuug

SEQ ID NO: 980423 - RNA, 24 nt, Human
uuuuuuuuuuuuuuuuuuuguuuu

SEQ ID NO: 980424 - RNA, 18 nt, Human
agagaggcccggggcugc

SEQ ID NO: 980425 - RNA, 21 nt, Human
aggcgggcacggcaggcaucg

SEQ ID NO: 980426 - RNA, 23 nt, Human
aggggcgcugggcagaagccuag

SEQ ID NO: 980427 - RNA, 22 nt, Human
auacagaaaagaacgucucuga

SEQ ID NO: 980428 - RNA, 23 nt, Human
caaauggcaggaaggguccauac

SEQ ID NO: 980429 - RNA, 24 nt, Human
caagccuugauuggccaggagucc

SEQ ID NO: 980430 - RNA, 24 nt, Human
cagaaaagaacgucucugaggucc

SEQ ID NO: 980431 - RNA, 22 nt, Human
cagcggcggcuccagcuccggc

SEQ ID NO: 980432 - RNA, 19 nt, Human
ccaggcgggcacggcaggc

SEQ ID NO: 980433 - RNA, 21 nt, Human
ccccaaagagccuuucucucu

SEQ ID NO: 980434 - RNA, 20 nt, Human
ccccccaaagagccuuucuc

SEQ ID NO: 980435 - RNA, 21 nt, Human
ccccgagccccaggcgggcac

SEQ ID NO: 980436 - RNA, 21 nt, Human
ccccucgcccugagcaggggc

SEQ ID NO: 980437 - RNA, 21 nt, Human
ccccugacguccuggggagag

SEQ ID NO: 980438 - RNA, 22 nt, Human
ccgcgggccgcgcuugccgucg

SEQ ID NO: 980439 - RNA, 23 nt, Human
ccucaccgccccgagccccaggc

SEQ ID NO: 980440 - RNA, 20 nt, Human
ccucccagcugggcaagccu

SEQ ID NO: 980441 - RNA, 18 nt, Human
cgccgccgccgccggggc

SEQ ID NO: 980442 - RNA, 20 nt, Human
cgccgcgggccgcgcuugcc

SEQ ID NO: 980443 - RNA, 30 nt, Human
cgcggcggcggcggcagcggcggcuccuuu

SEQ ID NO: 980444 - RNA, 22 nt, Human
cggccgcaggguggcuuuuuuu

SEQ ID NO: 980445 - RNA, 21 nt, Human
cggcggcagcggcggcuccag

SEQ ID NO: 980446 - RNA, 20 nt, Human
cuaggcccgcagagaggccc

SEQ ID NO: 980447 - RNA, 23 nt, Human
cuccacgccgccgccgccggggc

SEQ ID NO: 980448 - RNA, 21 nt, Human
gccccgagccccaggcgggca

SEQ ID NO: 980449 - RNA, 25 nt, Human
gcggcggcagcggcggcuccagcuc

SEQ ID NO: 980450 - RNA, 20 nt, Human
gcuccacgccgccgccgccg

SEQ ID NO: 980451 - RNA, 20 nt, Human
ggagaggggccccccaaaga

SEQ ID NO: 980452 - RNA, 21 nt, Human
ggccgcggcggcggcggcagc

SEQ ID NO: 980453 - RNA, 20 nt, Human
gggagaggggccccccaaag

SEQ ID NO: 980454 - RNA, 20 nt, Human
gggccccccaaagagccuuu

SEQ ID NO: 980455 - RNA, 22 nt, Human
uaccccgcgccccgggccucac

SEQ ID NO: 980456 - RNA, 18 nt, Human
ucaccgccccgagcccca

SEQ ID NO: 980457 - RNA, 25 nt, Human
uccacgccgccgccgccggggccca

SEQ ID NO: 980458 - RNA, 27 nt, Human
uccacgccgccgccgccggggcccaca

SEQ ID NO: 980459 - RNA, 21 nt, Human
uggcaggaaggguccauacag

SEQ ID NO: 980460 - RNA, 24 nt, Human
uuaauaaaaugguaagagucuuuc

SEQ ID NO: 980461 - RNA, 22 nt, Human
uuuuuuuuuuuuuuuuuaccaa

SEQ ID NO: 980462 - RNA, 20 nt, Human
aaaaaacaaacaccagcuua

SEQ ID NO: 980463 - RNA, 20 nt, Human
aaaaccaaaugggaaaccau

SEQ ID NO: 980464 - RNA, 22 nt, Human
aaacaucuccaucuaauaaaga

SEQ ID NO: 980465 - RNA, 25 nt, Human
aaccucauaaaauucuauccuacug

SEQ ID NO: 980466 - RNA, 20 nt, Human
aaccuccccaagaauuaaga

SEQ ID NO: 980467 - RNA, 21 nt, Human
aaccuccccaagaauuaagag

SEQ ID NO: 980468 - RNA, 22 nt, Human
aauagcaaagugccuaaguuuc

SEQ ID NO: 980469 - RNA, 19 nt, Human
aauuacauuugucuugggu

SEQ ID NO: 980470 - RNA, 20 nt, Human
acauauaaaaccaaauggga

SEQ ID NO: 980471 - RNA, 24 nt, Human
acauuguacacuguauacaguagc

SEQ ID NO: 980472 - RNA, 19 nt, Human
agacagaaaaagaaacagg

SEQ ID NO: 980473 - RNA, 23 nt, Human
agacagaaaaagaaacaucucca

SEQ ID NO: 980474 - RNA, 21 nt, Human
augaaaaauacugacauacaa

SEQ ID NO: 980475 - RNA, 24 nt, Human
augcaaaaaguaaaaguacauagu

SEQ ID NO: 980476 - RNA, 18 nt, Human
caacagaacaguuuuucu

SEQ ID NO: 980477 - RNA, 19 nt, Human
cagaaaaagaaacaucucc

SEQ ID NO: 980478 - RNA, 20 nt, Human
cagaaaaagaaacaucucca

SEQ ID NO: 980479 - RNA, 20 nt, Human
cagcaguggagggaaaaauc

SEQ ID NO: 980480 - RNA, 23 nt, Human
cauuuugaaaaaacaaacaccag

SEQ ID NO: 980481 - RNA, 18 nt, Human
ccaaaagaaaaauacuac

SEQ ID NO: 980482 - RNA, 19 nt, Human
gaacuaaaaucauuuuaug

SEQ ID NO: 980483 - RNA, 21 nt, Human
guaaagcaacaaggcuuacag

SEQ ID NO: 980484 - RNA, 20 nt, Human
guagcccagcucaacagcaa

SEQ ID NO: 980485 - RNA, 20 nt, Human
uaaaaccaaaugggaaacca

SEQ ID NO: 980486 - RNA, 22 nt, Human
uaaggcacauuuccaaaagaaa

SEQ ID NO: 980487 - RNA, 19 nt, Human
uagaagacagaaaaagaaa

SEQ ID NO: 980488 - RNA, 20 nt, Human
uagaagacagaaaaagaaac

SEQ ID NO: 980489 - RNA, 19 nt, Human
uauaaaaccaaaugggaaa

SEQ ID NO: 980490 - RNA, 23 nt, Human
uauuacacagcuaauaggaucca

SEQ ID NO: 980491 - RNA, 23 nt, Human
ugacauuaauuaacagcagugga

SEQ ID NO: 980492 - RNA, 24 nt, Human
ugcacaguaaauaccucauagagg

SEQ ID NO: 980493 - RNA, 21 nt, Human
uuagucuagaagacagaaaaa

SEQ ID NO: 980494 - RNA, 21 nt, Human
uuccaaaagaaaaauacuaca

SEQ ID NO: 980495 - RNA, 23 nt, Human
uuggguaaagcaacaaggcuuac

SEQ ID NO: 980496 - RNA, 22 nt, Human
aaccuucuccuccccaccaccc

SEQ ID NO: 980497 - RNA, 22 nt, Human
aaggaguuguggauccucuuca

SEQ ID NO: 980498 - RNA, 22 nt, Human
aaggaguuguggauccucuuca

SEQ ID NO: 980499 - RNA, 24 nt, Human
aagguaccuucagucccucuacca

SEQ ID NO: 980500 - RNA, 24 nt, Human
aagguaccuucagucccucuacca

SEQ ID NO: 980501 - RNA, 23 nt, Human
acggagcaccgcaaagcucugcc

SEQ ID NO: 980502 - RNA, 18 nt, Human
agaaaggacaaaaagaag

SEQ ID NO: 980503 - RNA, 18 nt, Human
agaaaggacaaaaagaag

SEQ ID NO: 980504 - RNA, 24 nt, Human
agaccucuggcaugucacuggucu

SEQ ID NO: 980505 - RNA, 20 nt, Human
agaggaaaugcagggcucuc

SEQ ID NO: 980506 - RNA, 22 nt, Human
agaggacaggaggugcagggag

SEQ ID NO: 980507 - RNA, 25 nt, Human
agauacuguaaggcuaugaaaaacu

SEQ ID NO: 980508 - RNA, 25 nt, Human
agauacuguaaggcuaugaaaaacu

SEQ ID NO: 980509 - RNA, 25 nt, Human
aggacaaaaagaagacuaucucugg

SEQ ID NO: 980510 - RNA, 19 nt, Human
aggaggugcagggaggggg

SEQ ID NO: 980511 - RNA, 22 nt, Human
aggcuguaggaggugaggcugu

SEQ ID NO: 980512 - RNA, 22 nt, Human
aggcuguaggaggugaggcugu

SEQ ID NO: 980513 - RNA, 18 nt, Human
agggagggggcgggggug

SEQ ID NO: 980514 - RNA, 20 nt, Human
agggagggggcggggguggg

SEQ ID NO: 980515 - RNA, 19 nt, Human
aggggugggaggugaggcu

SEQ ID NO: 980516 - RNA, 19 nt, Human
aggggugggaggugaggcu

SEQ ID NO: 980517 - RNA, 25 nt, Human
augccuacaaccuucuccuccccac

SEQ ID NO: 980518 - RNA, 28 nt, Human
cacccgggccuggcaccuccucgggggc

SEQ ID NO: 980519 - RNA, 27 nt, Human
cacggagcaccgcaaagcucugccuuc

SEQ ID NO: 980520 - RNA, 20 nt, Human
cacggccccuucccucaacc

SEQ ID NO: 980521 - RNA, 27 nt, Human
cagcagcaaagaccuggaccgguggag

SEQ ID NO: 980522 - RNA, 27 nt, Human
cagcagcaaagaccuggaccgguggag

SEQ ID NO: 980523 - RNA, 22 nt, Human
cagcuccaaggagggcuccaga

SEQ ID NO: 980524 - RNA, 25 nt, Human
caggacagccccacggagcaccgca

SEQ ID NO: 980525 - RNA, 19 nt, Human
cagggagggggcgggggug

SEQ ID NO: 980526 - RNA, 26 nt, Human
caugccuacaaccuucuccuccccac

SEQ ID NO: 980527 - RNA, 24 nt, Human
ccaaggaguuguggauccucuucu

SEQ ID NO: 980528 - RNA, 24 nt, Human
ccaaggaguuguggauccucuucu

SEQ ID NO: 980529 - RNA, 18 nt, Human
ccacggagcaccgcaaag

SEQ ID NO: 980530 - RNA, 21 nt, Human
ccacugucaugcacgcuggcc

SEQ ID NO: 980531 - RNA, 20 nt, Human
ccaugccuacaaccuucucc

SEQ ID NO: 980532 - RNA, 21 nt, Human
ccccaaagguaccuucagucc

SEQ ID NO: 980533 - RNA, 21 nt, Human
ccccaaagguaccuucagucc

SEQ ID NO: 980534 - RNA, 25 nt, Human
ccccaaagguaccuucagucccucu

SEQ ID NO: 980535 - RNA, 25 nt, Human
ccccaaagguaccuucagucccucu

SEQ ID NO: 980536 - RNA, 28 nt, Human
ccccaaagguaccuucagucccucuacc

SEQ ID NO: 980537 - RNA, 28 nt, Human
ccccaaagguaccuucagucccucuacc

SEQ ID NO: 980538 - RNA, 24 nt, Human
ccccacgggcguggaggcgccgcu

SEQ ID NO: 980539 - RNA, 23 nt, Human
cccgggccuggcaccuccucggg

SEQ ID NO: 980540 - RNA, 28 nt, Human
cccucuaccacaucccaguuagaaaguc

SEQ ID NO: 980541 - RNA, 28 nt, Human
cccucuaccacaucccaguuagaaaguc

SEQ ID NO: 980542 - RNA, 18 nt, Human
cccugcuccugcuccugg

SEQ ID NO: 980543 - RNA, 19 nt, Human
cccuucccucaaccccgcg

SEQ ID NO: 980544 - RNA, 19 nt, Human
cccuucccucaaccccgcg

SEQ ID NO: 980545 - RNA, 19 nt, Human
ccggaaccugggcguagag

SEQ ID NO: 980546 - RNA, 21 nt, Human
ccugcagucccaggacagccc

SEQ ID NO: 980547 - RNA, 26 nt, Human
ccugccccugcuccugcuccuggaag

SEQ ID NO: 980548 - RNA, 20 nt, Human
ccuucgcuggaccgccuggu

SEQ ID NO: 980549 - RNA, 21 nt, Human
cgaacggcucacugugaccaa

SEQ ID NO: 980550 - RNA, 20 nt, Human
cgcugcccgggggcgaacgg

SEQ ID NO: 980551 - RNA, 18 nt, Human
cggccccuucccucaacc

SEQ ID NO: 980552 - RNA, 19 nt, Human
cggccccuucccucaaccc

SEQ ID NO: 980553 - RNA, 22 nt, Human
cgggcguggaggcgccgcugcc

SEQ ID NO: 980554 - RNA, 23 nt, Human
cuccacugucaugcacgcuggcc

SEQ ID NO: 980555 - RNA, 21 nt, Human
cugagaggaaugugugcggca

SEQ ID NO: 980556 - RNA, 18 nt, Human
cugccccugccccugccc

SEQ ID NO: 980557 - RNA, 19 nt, Human
cugccccugccccugcccc

SEQ ID NO: 980558 - RNA, 19 nt, Human
cugccccugccccugcucc

SEQ ID NO: 980559 - RNA, 19 nt, Human
cugccccugcuccugcucc

SEQ ID NO: 980560 - RNA, 18 nt, Human
cugcccgggggcgaacgg

SEQ ID NO: 980561 - RNA, 24 nt, Human
cuggcaccgggcacggccccuucc

SEQ ID NO: 980562 - RNA, 24 nt, Human
cuggcaccgggcacggccccuucc

SEQ ID NO: 980563 - RNA, 21 nt, Human
cugugaccagggccauggagc

SEQ ID NO: 980564 - RNA, 23 nt, Human
gacaaaaagaagacuaucucugg

SEQ ID NO: 980565 - RNA, 20 nt, Human
gaccucaugaccccucggag

SEQ ID NO: 980566 - RNA, 20 nt, Human
gaggauccugccugccuuug

SEQ ID NO: 980567 - RNA, 20 nt, Human
gaggcccccuguccaccugc

SEQ ID NO: 980568 - RNA, 26 nt, Human
gauccugccugccuuugggggccacc

SEQ ID NO: 980569 - RNA, 27 nt, Human
gauccugccugccuuugggggccacca

SEQ ID NO: 980570 - RNA, 21 nt, Human
gcaugugugagggcucaggcc

SEQ ID NO: 980571 - RNA, 19 nt, Human
gccagcccuuccagccucc

SEQ ID NO: 980572 - RNA, 19 nt, Human
gccagcccuuccagccucc

SEQ ID NO: 980573 - RNA, 21 nt, Human
gcccugugaucuggcguggug

SEQ ID NO: 980574 - RNA, 21 nt, Human
gcccugugaucuggcguggug

SEQ ID NO: 980575 - RNA, 22 nt, Human
gccgcugcccgggggcgaacgg

SEQ ID NO: 980576 - RNA, 19 nt, Human
gcggagcugagaggaaugu

SEQ ID NO: 980577 - RNA, 18 nt, Human
gcuggccugucucaccac

SEQ ID NO: 980578 - RNA, 18 nt, Human
gcuggggccugaggaucc

SEQ ID NO: 980579 - RNA, 21 nt, Human
ggagucgacuccuucgcugga

SEQ ID NO: 980580 - RNA, 25 nt, Human
ggcagacaugggccugggacuuaag

SEQ ID NO: 980581 - RNA, 25 nt, Human
ggcagacaugggccugggacuuaag

SEQ ID NO: 980582 - RNA, 21 nt, Human
ggccuggcaccuccucggggg

SEQ ID NO: 980583 - RNA, 20 nt, Human
ggcguggaggcgccgcugcc

SEQ ID NO: 980584 - RNA, 20 nt, Human
ggcuggggccugaggauccu

SEQ ID NO: 980585 - RNA, 23 nt, Human
ggcuggggccugaggauccugcc

SEQ ID NO: 980586 - RNA, 23 nt, Human
ggcuggggccugaggauccugcc

SEQ ID NO: 980587 - RNA, 21 nt, Human
gggcggagcugagaggaaugu

SEQ ID NO: 980588 - RNA, 23 nt, Human
gggcgggggugggaggcgugacc

SEQ ID NO: 980589 - RNA, 19 nt, Human
gggcucucccugccccugc

SEQ ID NO: 980590 - RNA, 21 nt, Human
gggcugcagaggcucuucaug

SEQ ID NO: 980591 - RNA, 18 nt, Human
ggggcgggggugggaggc

SEQ ID NO: 980592 - RNA, 21 nt, Human
gugcagggagggggcgggggu

SEQ ID NO: 980593 - RNA, 20 nt, Human
guggagguggaugagggaag

SEQ ID NO: 980594 - RNA, 20 nt, Human
guggagguggaugagggaag

SEQ ID NO: 980595 - RNA, 23 nt, Human
uagccagaggccagaaaggacaa

SEQ ID NO: 980596 - RNA, 23 nt, Human
uagccagaggccagaaaggacaa

SEQ ID NO: 980597 - RNA, 19 nt, Human
uaugaaaaacugacuagcc

SEQ ID NO: 980598 - RNA, 19 nt, Human
uaugaaaaacugacuagcc

SEQ ID NO: 980599 - RNA, 24 nt, Human
ucacuggucucugaggugcucucc

SEQ ID NO: 980600 - RNA, 24 nt, Human
ucccucaaccccgcggacaguccu

SEQ ID NO: 980601 - RNA, 24 nt, Human
ucccucaaccccgcggacaguccu

SEQ ID NO: 980602 - RNA, 18 nt, Human
uccucgggggcggcccuu

SEQ ID NO: 980603 - RNA, 18 nt, Human
uccuggacccgcaggacc

SEQ ID NO: 980604 - RNA, 22 nt, Human
ucgcuggagucgacuccuucgc

SEQ ID NO: 980605 - RNA, 19 nt, Human
ucuucagugucaggggagc

SEQ ID NO: 980606 - RNA, 19 nt, Human
ucuucagugucaggggagc

SEQ ID NO: 980607 - RNA, 19 nt, Human
ugaaaaacugacuagccag

SEQ ID NO: 980608 - RNA, 19 nt, Human
ugaaaaacugacuagccag

SEQ ID NO: 980609 - RNA, 20 nt, Human
ugagaggaaugugugcggca

SEQ ID NO: 980610 - RNA, 26 nt, Human
ugaggcccccuguccaccugcuggcc

SEQ ID NO: 980611 - RNA, 19 nt, Human
ugcagggagggggcggggg

SEQ ID NO: 980612 - RNA, 21 nt, Human
ugccccugccccugccccugc

SEQ ID NO: 980613 - RNA, 23 nt, Human
ugccccugccccugccccugcuc

SEQ ID NO: 980614 - RNA, 20 nt, Human
ugccccugccccugcuccug

SEQ ID NO: 980615 - RNA, 23 nt, Human
ugccccugccccugcuccugcuc

SEQ ID NO: 980616 - RNA, 23 nt, Human
ugcccuggaggguaaccacugac

SEQ ID NO: 980617 - RNA, 23 nt, Human
ugccuacaaccuucuccucccca

SEQ ID NO: 980618 - RNA, 18 nt, Human
uggcaccgggcacggccc

SEQ ID NO: 980619 - RNA, 21 nt, Human
uggcccaggcucuucuuucgg

SEQ ID NO: 980620 - RNA, 22 nt, Human
uggcccaggcucuucuuucggg

SEQ ID NO: 980621 - RNA, 21 nt, Human
ugggaagagaagaccucuggc

SEQ ID NO: 980622 - RNA, 19 nt, Human
ugggaagggcugcagaggc

SEQ ID NO: 980623 - RNA, 21 nt, Human
ugggacuuaaggcuguaggag

SEQ ID NO: 980624 - RNA, 21 nt, Human
ugggacuuaaggcuguaggag

SEQ ID NO: 980625 - RNA, 18 nt, Human
uggucccagggccccacg

SEQ ID NO: 980626 - RNA, 19 nt, Human
uguagugacggguaugggg

SEQ ID NO: 980627 - RNA, 19 nt, Human
uguagugacggguaugggg

SEQ ID NO: 980628 - RNA, 18 nt, Human
ugucacaggaggucuggg

SEQ ID NO: 980629 - RNA, 18 nt, Human
ugucacaggaggucuggg

SEQ ID NO: 980630 - RNA, 23 nt, Human
ugugaccagggccauggagccag

SEQ ID NO: 980631 - RNA, 21 nt, Human
ugugggaagggcugcagaggc

SEQ ID NO: 980632 - RNA, 24 nt, Human
uucccucaaccccgcggacagucc

SEQ ID NO: 980633 - RNA, 24 nt, Human
uucccucaaccccgcggacagucc

SEQ ID NO: 980634 - RNA, 18 nt, Human
uugccuggccuggcuggu

SEQ ID NO: 980635 - RNA, 22 nt, Human
uugccuggccuggcugguucca

SEQ ID NO: 980636 - RNA, 22 nt, Human
uugccuggccuggcugguucca

SEQ ID NO: 980637 - RNA, 22 nt, Human
uugguccuugcaagcuguggga

SEQ ID NO: 980638 - RNA, 19 nt, Human
uuucucaguacaaagccag

SEQ ID NO: 980639 - RNA, 19 nt, Human
uuucucaguacaaagccag

SEQ ID NO: 980640 - RNA, 19 nt, Human
aaaaagcgcagcgagaaca

SEQ ID NO: 980641 - RNA, 23 nt, Human
aaaaauaaaaagcgcagcgagaa

SEQ ID NO: 980642 - RNA, 22 nt, Human
aaccaaaacacaaaacgaaaaa

SEQ ID NO: 980643 - RNA, 23 nt, Human
caaccaaaacacaaaacgaaaaa

SEQ ID NO: 980644 - RNA, 19 nt, Human
caagaaugagcuagaacgg

SEQ ID NO: 980645 - RNA, 22 nt, Human
ccagccugacgcagcaaaaggc

SEQ ID NO: 980646 - RNA, 18 nt, Human
ccucucuauggcaagagu

SEQ ID NO: 980647 - RNA, 24 nt, Human
cucccaggccacacgacugacagc

SEQ ID NO: 980648 - RNA, 22 nt, Human
gucuugacacgucugggguccc

SEQ ID NO: 980649 - RNA, 20 nt, Human
guuuaagggaaaucaagaug

SEQ ID NO: 980650 - RNA, 26 nt, Human
uaaaaagcgcagcgagaacagaggua

SEQ ID NO: 980651 - RNA, 26 nt, Human
uaaggggucgauccaaauccacagug

SEQ ID NO: 980652 - RNA, 23 nt, Human
uacucagcagugcuuggggcugu

SEQ ID NO: 980653 - RNA, 22 nt, Human
uauggcaagaguaggggaaaag

SEQ ID NO: 980654 - RNA, 19 nt, Human
ucaagauguaaggggucga

SEQ ID NO: 980655 - RNA, 23 nt, Human
ucccuggaacaagccuuggucau

SEQ ID NO: 980656 - RNA, 22 nt, Human
ugccaccaccaggacucuucug

SEQ ID NO: 980657 - RNA, 20 nt, Human
ugugcgccuaugugugcacg

SEQ ID NO: 980658 - RNA, 21 nt, Human
uuaaaagucuugacacgucug

SEQ ID NO: 980659 - RNA, 25 nt, Human
uucuucuccuccucucuauggcaag

SEQ ID NO: 980660 - RNA, 20 nt, Human
uucuugaagacacgguggga

SEQ ID NO: 980661 - RNA, 23 nt, Human
uuuuuuuuuuuugggacuacuca

SEQ ID NO: 980662 - RNA, 18 nt, Human
uuuuuuuuuuuuuuuuug

SEQ ID NO: 980663 - RNA, 26 nt, Human
uuuuuuuuuuuuuuuuuuuuuuuggg

SEQ ID NO: 980664 - RNA, 20 nt, Human
aaaaagaacucucacaaaaa

SEQ ID NO: 980665 - RNA, 24 nt, Human
aaaaagccaaagaauggcuuuacc

SEQ ID NO: 980666 - RNA, 23 nt, Human
aaacacccaaacccugcaugcac

SEQ ID NO: 980667 - RNA, 25 nt, Human
aaacaugccuagaucacuucagaac

SEQ ID NO: 980668 - RNA, 20 nt, Human
aaaccaaaauccaacagaac

SEQ ID NO: 980669 - RNA, 22 nt, Human
aaagaaaaaaaaaaaaaaagaa

SEQ ID NO: 980670 - RNA, 20 nt, Human
aaagcaaaacaaaauuaaac

SEQ ID NO: 980671 - RNA, 20 nt, Human
aacaaaguauccacaaauag

SEQ ID NO: 980672 - RNA, 19 nt, Human
aacacuucugugaccugcu

SEQ ID NO: 980673 - RNA, 19 nt, Human
aacagcaucugucuggggc

SEQ ID NO: 980674 - RNA, 20 nt, Human
aacaugccuagaucacuuca

SEQ ID NO: 980675 - RNA, 21 nt, Human
aacccucuccccacccugcca

SEQ ID NO: 980676 - RNA, 18 nt, Human
aaccugccuccuucagga

SEQ ID NO: 980677 - RNA, 22 nt, Human
aacuguuuuuauauauguacau

SEQ ID NO: 980678 - RNA, 27 nt, Human
aacuuccaggcaaacccucuccccacc

SEQ ID NO: 980679 - RNA, 18 nt, Human
aagaaaauauggccauua

SEQ ID NO: 980680 - RNA, 21 nt, Human
aagcaaaacaaaauuaaacaa

SEQ ID NO: 980681 - RNA, 26 nt, Human
aagcagaaagaaaaaaaaagggaccc

SEQ ID NO: 980682 - RNA, 23 nt, Human
aauaugggugucagaggaguuga

SEQ ID NO: 980683 - RNA, 21 nt, Human
aaucugcugcuucaggucagg

SEQ ID NO: 980684 - RNA, 22 nt, Human
acacacauacacacugaaaaac

SEQ ID NO: 980685 - RNA, 25 nt, Human
acacugcagagcacauuuuucuggc

SEQ ID NO: 980686 - RNA, 18 nt, Human
acagaacauaaaaaucaa

SEQ ID NO: 980687 - RNA, 20 nt, Human
acauauuacaccugccccuu

SEQ ID NO: 980688 - RNA, 27 nt, Human
accaucaacauauuguacagauuccua

SEQ ID NO: 980689 - RNA, 23 nt, Human
acggcagcaccagucaaaugccu

SEQ ID NO: 980690 - RNA, 18 nt, Human
acuacagccaccaucaac

SEQ ID NO: 980691 - RNA, 18 nt, Human
acugagcaacagcacagg

SEQ ID NO: 980692 - RNA, 24 nt, Human
acuguuuuuauauauguacauaug

SEQ ID NO: 980693 - RNA, 23 nt, Human
acuucugugaccugcuacaucuc

SEQ ID NO: 980694 - RNA, 23 nt, Human
agaaaaaaaaaaaaaaagaaaag

SEQ ID NO: 980695 - RNA, 18 nt, Human
agaggagagucuucugga

SEQ ID NO: 980696 - RNA, 21 nt, Human
agagugcuggaugggagggca

SEQ ID NO: 980697 - RNA, 24 nt, Human
agagugcuggaugggagggcagga

SEQ ID NO: 980698 - RNA, 22 nt, Human
agauaugccaagcaaaccaaaa

SEQ ID NO: 980699 - RNA, 18 nt, Human
agccaaaaaccugucucc

SEQ ID NO: 980700 - RNA, 19 nt, Human
agccugaggcacugagauc

SEQ ID NO: 980701 - RNA, 21 nt, Human
aggaagauuaaggaaggagau

SEQ ID NO: 980702 - RNA, 24 nt, Human
aggacucacaggacagccagggca

SEQ ID NO: 980703 - RNA, 18 nt, Human
aggagcuggugauuggaa

SEQ ID NO: 980704 - RNA, 18 nt, Human
aggcaggcaggcacuggg

SEQ ID NO: 980705 - RNA, 25 nt, Human
aucaaaaagcaaaacaaaauuaaac

SEQ ID NO: 980706 - RNA, 20 nt, Human
augaucccaaacauuuagaa

SEQ ID NO: 980707 - RNA, 25 nt, Human
auguuagaacaaguccuacaaaaca

SEQ ID NO: 980708 - RNA, 24 nt, Human
auuaaacacaguggaggggagaag

SEQ ID NO: 980709 - RNA, 23 nt, Human
auucugggagucugaaaaggcuu

SEQ ID NO: 980710 - RNA, 27 nt, Human
caaaaugagaagcagguggcagcugac

SEQ ID NO: 980711 - RNA, 23 nt, Human
caaacccugcaugcaccagaaac

SEQ ID NO: 980712 - RNA, 27 nt, Human
caacaguagcaaaacgacagcauccua

SEQ ID NO: 980713 - RNA, 18 nt, Human
caagccucuucaguuuca

SEQ ID NO: 980714 - RNA, 23 nt, Human
caaguggaacaucccaaccacca

SEQ ID NO: 980715 - RNA, 24 nt, Human
cacacaaauauccaggaaucacaa

SEQ ID NO: 980716 - RNA, 25 nt, Human
cacacugaaaaacacccaaacccug

SEQ ID NO: 980717 - RNA, 23 nt, Human
cacauacacacugaaaaacaccc

SEQ ID NO: 980718 - RNA, 25 nt, Human
cacaugcacauacacuccuccaaaa

SEQ ID NO: 980719 - RNA, 20 nt, Human
caccaucaaaaagcaaaacc

SEQ ID NO: 980720 - RNA, 21 nt, Human
cacccaaacccugcaugcacc

SEQ ID NO: 980721 - RNA, 19 nt, Human
caccuugcaauagcucuuc

SEQ ID NO: 980722 - RNA, 18 nt, Human
cacugaaaaacacccaaa

SEQ ID NO: 980723 - RNA, 24 nt, Human
cacugcagagcacauuuuucuggc

SEQ ID NO: 980724 - RNA, 20 nt, Human
cagaagcaccuugcaauagc

SEQ ID NO: 980725 - RNA, 21 nt, Human
cagacccagccuuggcuuccc

SEQ ID NO: 980726 - RNA, 20 nt, Human
cagcuuuaucuccaccccuc

SEQ ID NO: 980727 - RNA, 22 nt, Human
caggacacagacggaagucagc

SEQ ID NO: 980728 - RNA, 22 nt, Human
caguagcaaaacgacagcaucc

SEQ ID NO: 980729 - RNA, 24 nt, Human
cauacacacugaaaaacacccaaa

SEQ ID NO: 980730 - RNA, 24 nt, Human
caugacgucaagggaccccacacc

SEQ ID NO: 980731 - RNA, 23 nt, Human
ccaaaaaagccaaagaauggcuu

SEQ ID NO: 980732 - RNA, 22 nt, Human
ccacaaguggaugccacucucu

SEQ ID NO: 980733 - RNA, 21 nt, Human
ccagucacccuccauuuccag

SEQ ID NO: 980734 - RNA, 23 nt, Human
ccauucaccauuacaaccaucac

SEQ ID NO: 980735 - RNA, 21 nt, Human
ccccauacaccaaaacaucaa

SEQ ID NO: 980736 - RNA, 18 nt, Human
ccccuggcugaggccucc

SEQ ID NO: 980737 - RNA, 25 nt, Human
cccuccgaaucugcuuccuucccuc

SEQ ID NO: 980738 - RNA, 21 nt, Human
cccugcaugcaccagaaacag

SEQ ID NO: 980739 - RNA, 23 nt, Human
ccgacaagaugaugcacauuuua

SEQ ID NO: 980740 - RNA, 22 nt, Human
ccuacaaaacaaagcagaaaga

SEQ ID NO: 980741 - RNA, 21 nt, Human
ccucagagccugaggcacuga

SEQ ID NO: 980742 - RNA, 22 nt, Human
ccugucucaagccuccucagaa

SEQ ID NO: 980743 - RNA, 19 nt, Human
cgcaccuccccuggacacu

SEQ ID NO: 980744 - RNA, 21 nt, Human
cuacaaaacaaagcagaaaga

SEQ ID NO: 980745 - RNA, 24 nt, Human
cuaggagcuuccacucugggcaac

SEQ ID NO: 980746 - RNA, 21 nt, Human
cucacaggacagccagggcac

SEQ ID NO: 980747 - RNA, 18 nt, Human
cucacauauacuuccugg

SEQ ID NO: 980748 - RNA, 21 nt, Human
cucacauauacuuccuggcug

SEQ ID NO: 980749 - RNA, 24 nt, Human
cugaaaaacacccaaacccugcau

SEQ ID NO: 980750 - RNA, 25 nt, Human
cugaaaaacagcaauuugccuuuga

SEQ ID NO: 980751 - RNA, 22 nt, Human
cugccauaaguuccugcccuuc

SEQ ID NO: 980752 - RNA, 21 nt, Human
cugcgcaccuccccuggacac

SEQ ID NO: 980753 - RNA, 18 nt, Human
cugcggcuggaugaaggc

SEQ ID NO: 980754 - RNA, 23 nt, Human
cuuccaggcaaacccucucccca

SEQ ID NO: 980755 - RNA, 21 nt, Human
gaaaauuuuuuuuccccacag

SEQ ID NO: 980756 - RNA, 22 nt, Human
gaaacaguaaaaugaccaaaau

SEQ ID NO: 980757 - RNA, 20 nt, Human
gaacaaggaaauccauaacc

SEQ ID NO: 980758 - RNA, 21 nt, Human
gaacauuaaacacaguggagg

SEQ ID NO: 980759 - RNA, 25 nt, Human
gaagagcucuggaaauccauaaccc

SEQ ID NO: 980760 - RNA, 21 nt, Human
gaagggaaaacaaaguccaag

SEQ ID NO: 980761 - RNA, 18 nt, Human
gacacagacggcagcacc

SEQ ID NO: 980762 - RNA, 18 nt, Human
gagaagcagguggcagcu

SEQ ID NO: 980763 - RNA, 24 nt, Human
gagccagggccagucacccuccau

SEQ ID NO: 980764 - RNA, 18 nt, Human
gaggacacagacggcagc

SEQ ID NO: 980765 - RNA, 18 nt, Human
gcaaacccucuccccacc

SEQ ID NO: 980766 - RNA, 23 nt, Human
gcagccucuccacccccaacuuu

SEQ ID NO: 980767 - RNA, 21 nt, Human
gcucuggguaguuugcaaaau

SEQ ID NO: 980768 - RNA, 19 nt, Human
gcugcggcuggaugaaggc

SEQ ID NO: 980769 - RNA, 18 nt, Human
ggaacaucuccaaucccc

SEQ ID NO: 980770 - RNA, 23 nt, Human
ggagcaccugcuuuaauaaaaca

SEQ ID NO: 980771 - RNA, 23 nt, Human
ggcaacucacauauacuuccugg

SEQ ID NO: 980772 - RNA, 20 nt, Human
ggcccaaagaauuauucaag

SEQ ID NO: 980773 - RNA, 20 nt, Human
gggugucucugaggaaaaag

SEQ ID NO: 980774 - RNA, 22 nt, Human
gguuucuguccaaccugcuucc

SEQ ID NO: 980775 - RNA, 26 nt, Human
gugguuucuguccaaccugcuuccuu

SEQ ID NO: 980776 - RNA, 24 nt, Human
uaaaaauuuauucaaucuguaaca

SEQ ID NO: 980777 - RNA, 25 nt, Human
uaaaaguuugggguggcuuggggca

SEQ ID NO: 980778 - RNA, 18 nt, Human
uaaaugauaaaaaaagua

SEQ ID NO: 980779 - RNA, 18 nt, Human
uaacccaggaacacccaa

SEQ ID NO: 980780 - RNA, 18 nt, Human
uaacguggacaucaacga

SEQ ID NO: 980781 - RNA, 18 nt, Human
uaacuuccaggcaaaccc

SEQ ID NO: 980782 - RNA, 22 nt, Human
uaagacacaccaucacugagga

SEQ ID NO: 980783 - RNA, 19 nt, Human
uacacucuggaacaccgga

SEQ ID NO: 980784 - RNA, 20 nt, Human
uacauauuacaccugccccu

SEQ ID NO: 980785 - RNA, 23 nt, Human
uacccaacagcaucugucugggg

SEQ ID NO: 980786 - RNA, 20 nt, Human
uaccccauacaccaaaacau

SEQ ID NO: 980787 - RNA, 21 nt, Human
uaccccauacaccaaaacauc

SEQ ID NO: 980788 - RNA, 18 nt, Human
uaccucagagccugaggc

SEQ ID NO: 980789 - RNA, 22 nt, Human
uacucagucaauccucaguaac

SEQ ID NO: 980790 - RNA, 20 nt, Human
uagaacaaguccuacaaaac

SEQ ID NO: 980791 - RNA, 24 nt, Human
uagaucacuucagaacugaaaucc

SEQ ID NO: 980792 - RNA, 21 nt, Human
uauaaaaaggcagaaagacuu

SEQ ID NO: 980793 - RNA, 24 nt, Human
uauaaaagucugaagagaagacag

SEQ ID NO: 980794 - RNA, 24 nt, Human
uauauauguacauauguguacaca

SEQ ID NO: 980795 - RNA, 23 nt, Human
uauccaccaucaaaaagcaaaac

SEQ ID NO: 980796 - RNA, 21 nt, Human
uauguacauauguguacacau

SEQ ID NO: 980797 - RNA, 18 nt, Human
ucacaagggcugaccaug

SEQ ID NO: 980798 - RNA, 21 nt, Human
ucagaaggcccaaagaauuau

SEQ ID NO: 980799 - RNA, 23 nt, Human
ucagacccagccuuggcuuccac

SEQ ID NO: 980800 - RNA, 18 nt, Human
ucagaggagagucuucug

SEQ ID NO: 980801 - RNA, 21 nt, Human
ucagcuauguaaauaacccag

SEQ ID NO: 980802 - RNA, 20 nt, Human
ucauaccaccuaacaaaaca

SEQ ID NO: 980803 - RNA, 21 nt, Human
ucauuucuggugucuguguuu

SEQ ID NO: 980804 - RNA, 19 nt, Human
ucauuugggguccuguuuu

SEQ ID NO: 980805 - RNA, 22 nt, Human
uccaccaucaaaaagcaaaaca

SEQ ID NO: 980806 - RNA, 24 nt, Human
uccaccaucaaaaagcaaaacaaa

SEQ ID NO: 980807 - RNA, 21 nt, Human
uccccagcuuuaucuccaccc

SEQ ID NO: 980808 - RNA, 20 nt, Human
uccgaaucugcuuccuuccc

SEQ ID NO: 980809 - RNA, 24 nt, Human
uccucagaugaaacaggugaacac

SEQ ID NO: 980810 - RNA, 19 nt, Human
ucuccaaaaaucaagaaag

SEQ ID NO: 980811 - RNA, 23 nt, Human
ucuccaauccccagcuuuaucuc

SEQ ID NO: 980812 - RNA, 20 nt, Human
ucugcuuccuucccucaauu

SEQ ID NO: 980813 - RNA, 20 nt, Human
ucuggggccugugagcagag

SEQ ID NO: 980814 - RNA, 25 nt, Human
ucuguaacaagaacauugaaucugc

SEQ ID NO: 980815 - RNA, 21 nt, Human
ucuucaguuucaaugagaugc

SEQ ID NO: 980816 - RNA, 18 nt, Human
ugaaaaacacccaaaccc

SEQ ID NO: 980817 - RNA, 21 nt, Human
ugaaaaacacccaaacccugc

SEQ ID NO: 980818 - RNA, 28 nt, Human
ugaaaaacacccaaacccugcaugcacc

SEQ ID NO: 980819 - RNA, 24 nt, Human
ugaaaaacagcaauuugccuuuga

SEQ ID NO: 980820 - RNA, 20 nt, Human
ugaacaagacacuaagacag

SEQ ID NO: 980821 - RNA, 20 nt, Human
ugaaugacagauauucugua

SEQ ID NO: 980822 - RNA, 19 nt, Human
ugacgucaagggaccccac

SEQ ID NO: 980823 - RNA, 18 nt, Human
ugacugaaaaacagcaau

SEQ ID NO: 980824 - RNA, 20 nt, Human
ugagaugcagagguguuuca

SEQ ID NO: 980825 - RNA, 21 nt, Human
ugaggaaaaaguuacuaaugc

SEQ ID NO: 980826 - RNA, 22 nt, Human
ugaggaaaugacaacuauuucc

SEQ ID NO: 980827 - RNA, 27 nt, Human
ugaggacacagacggcagcuggagacc

SEQ ID NO: 980828 - RNA, 25 nt, Human
ugaggagagaugaauauuacgguac

SEQ ID NO: 980829 - RNA, 18 nt, Human
ugaggcacugagaucuuc

SEQ ID NO: 980830 - RNA, 20 nt, Human
ugaggcacugagaucuucag

SEQ ID NO: 980831 - RNA, 24 nt, Human
ugaggcacugagaucuucaggcug

SEQ ID NO: 980832 - RNA, 19 nt, Human
ugaucccaaacauuuagaa

SEQ ID NO: 980833 - RNA, 23 nt, Human
ugccaucugcccccaccaaacuc

SEQ ID NO: 980834 - RNA, 24 nt, Human
ugccucaggucuggaaaccaaacc

SEQ ID NO: 980835 - RNA, 22 nt, Human
ugcuuucuuaaaaaaagaacuc

SEQ ID NO: 980836 - RNA, 18 nt, Human
uggaaauccauaacccug

SEQ ID NO: 980837 - RNA, 20 nt, Human
uggacacugcucagcuaugu

SEQ ID NO: 980838 - RNA, 22 nt, Human
uggaugggagggcaggacacag

SEQ ID NO: 980839 - RNA, 25 nt, Human
uggcuuccacacaacuucacagcuc

SEQ ID NO: 980840 - RNA, 20 nt, Human
uggcuuggggcaaagguaac

SEQ ID NO: 980841 - RNA, 20 nt, Human
uggggaaggaaaauaaacug

SEQ ID NO: 980842 - RNA, 19 nt, Human
uggggacaacagcaugggg

SEQ ID NO: 980843 - RNA, 21 nt, Human
uggggacaacagcauggggaa

SEQ ID NO: 980844 - RNA, 24 nt, Human
uggggcacugagaaaaugaggcug

SEQ ID NO: 980845 - RNA, 22 nt, Human
ugguuuaaaaagagagagagag

SEQ ID NO: 980846 - RNA, 18 nt, Human
uguaacgauacacucugg

SEQ ID NO: 980847 - RNA, 20 nt, Human
uguaagaagcuacaagaggc

SEQ ID NO: 980848 - RNA, 19 nt, Human
uguacacaugcacauacac

SEQ ID NO: 980849 - RNA, 23 nt, Human
ugucagacccagccuuggcuucc

SEQ ID NO: 980850 - RNA, 24 nt, Human
ugucuuacuguaacgauacacucu

SEQ ID NO: 980851 - RNA, 20 nt, Human
uuaaacauauguaacaauuc

SEQ ID NO: 980852 - RNA, 22 nt, Human
uuaaagcaaagcggaaccugcc

SEQ ID NO: 980853 - RNA, 18 nt, Human
uuaguggguuuuguccca

SEQ ID NO: 980854 - RNA, 21 nt, Human
uucagggccaguuacccaguu

SEQ ID NO: 980855 - RNA, 18 nt, Human
uucuacauggaagagcuc

SEQ ID NO: 980856 - RNA, 21 nt, Human
uucuggcugaccuuuagcccc

SEQ ID NO: 980857 - RNA, 21 nt, Human
uugaaaauuuuuuuuccccac

SEQ ID NO: 980858 - RNA, 19 nt, Human
uuuuagcaagugguuucug

SEQ ID NO: 980859 - RNA, 18 nt, Human
aaaaagucugaccagcac

SEQ ID NO: 980860 - RNA, 18 nt, Human
acaacauuacaaauaauc

SEQ ID NO: 980861 - RNA, 21 nt, Human
aggacaaaaaccuugggucca

SEQ ID NO: 980862 - RNA, 27 nt, Human
aguaauaagaaucuacuucaaaagaaa

SEQ ID NO: 980863 - RNA, 23 nt, Human
agugaaggaaaggacaaaaaccu

SEQ ID NO: 980864 - RNA, 18 nt, Human
auggaaaccugggaaacc

SEQ ID NO: 980865 - RNA, 19 nt, Human
auuccacucauuaaaaaac

SEQ ID NO: 980866 - RNA, 22 nt, Human
caaaaaaagucugaccagcacc

SEQ ID NO: 980867 - RNA, 20 nt, Human
caauacauaaacugccucaa

SEQ ID NO: 980868 - RNA, 21 nt, Human
cacaaaugggaagcaucuuga

SEQ ID NO: 980869 - RNA, 23 nt, Human
cacaguaugacugaguaauaaga

SEQ ID NO: 980870 - RNA, 21 nt, Human
cagcaagguccgccgaggcuc

SEQ ID NO: 980871 - RNA, 22 nt, Human
cccucugcaucgcuuccucucg

SEQ ID NO: 980872 - RNA, 25 nt, Human
ccucucgcguuaaagagacagaggc

SEQ ID NO: 980873 - RNA, 20 nt, Human
cguuaguaaccaugcugcac

SEQ ID NO: 980874 - RNA, 22 nt, Human
cuccccccagaauauuuaggcu

SEQ ID NO: 980875 - RNA, 23 nt, Human
cugcaucgcuuccucucgcguua

SEQ ID NO: 980876 - RNA, 19 nt, Human
guacggaguccuccaggua

SEQ ID NO: 980877 - RNA, 23 nt, Human
guuaaccauaauagucccacagu

SEQ ID NO: 980878 - RNA, 24 nt, Human
guucuguuaaccauaauaguccca

SEQ ID NO: 980879 - RNA, 18 nt, Human
uaaaugagagaaucuaac

SEQ ID NO: 980880 - RNA, 23 nt, Human
uaagcauaaucaguuauggacag

SEQ ID NO: 980881 - RNA, 26 nt, Human
uaccaauaaaacagcauguucugaaa

SEQ ID NO: 980882 - RNA, 22 nt, Human
uaccccacuccccccagaauau

SEQ ID NO: 980883 - RNA, 24 nt, Human
uaccccacuccccccagaauauuu

SEQ ID NO: 980884 - RNA, 21 nt, Human
uauaccccacuccccccagaa

SEQ ID NO: 980885 - RNA, 21 nt, Human
uauuauaccccacucccccca

SEQ ID NO: 980886 - RNA, 20 nt, Human
uccacauggaaaccugggaa

SEQ ID NO: 980887 - RNA, 19 nt, Human
ucuaacaaaaaaagucuga

SEQ ID NO: 980888 - RNA, 23 nt, Human
ucuacuucaaaagaaaaaaaaaa

SEQ ID NO: 980889 - RNA, 24 nt, Human
ucuacuucaaaagaaaaaaaaaaa

SEQ ID NO: 980890 - RNA, 21 nt, Human
uggaaaccugggaaacccaau

SEQ ID NO: 980891 - RNA, 22 nt, Human
uucugauuuuaauauuagucug

SEQ ID NO: 980892 - RNA, 18 nt, Human
aaaaauaaagccagagac

SEQ ID NO: 980893 - RNA, 26 nt, Human
aaaaauaaagccagagacccuccccc

SEQ ID NO: 980894 - RNA, 18 nt, Human
aagccagagacccucccc

SEQ ID NO: 980895 - RNA, 21 nt, Human
aagccagagacccucccccaa

SEQ ID NO: 980896 - RNA, 24 nt, Human
acagcagaaaaauaaagccagaga

SEQ ID NO: 980897 - RNA, 22 nt, Human
acccucccccaaccccugguuu

SEQ ID NO: 980898 - RNA, 19 nt, Human
acgccgcgggcgggacggc

SEQ ID NO: 980899 - RNA, 23 nt, Human
acuuuaaaaaauauaaaauagga

SEQ ID NO: 980900 - RNA, 21 nt, Human
agagacccucccccaaccccu

SEQ ID NO: 980901 - RNA, 28 nt, Human
agagguaggaggugcgaguucagguccu

SEQ ID NO: 980902 - RNA, 24 nt, Human
agccagagacccucccccaacccc

SEQ ID NO: 980903 - RNA, 21 nt, Human
aggggccagccggaggggugg

SEQ ID NO: 980904 - RNA, 21 nt, Human
aggggucugcggccucgucuc

SEQ ID NO: 980905 - RNA, 24 nt, Human
aggggucugcggccucgucuccag

SEQ ID NO: 980906 - RNA, 22 nt, Human
agguaggaggugcgaguucagg

SEQ ID NO: 980907 - RNA, 22 nt, Human
auaaagccagagacccuccccc

SEQ ID NO: 980908 - RNA, 23 nt, Human
auaaagccagagacccuccccca

SEQ ID NO: 980909 - RNA, 21 nt, Human
caccaggagggggaggacccc

SEQ ID NO: 980910 - RNA, 23 nt, Human
cagcagaaaaauaaagccagaga

SEQ ID NO: 980911 - RNA, 25 nt, Human
cagcagaaaaauaaagccagagacc

SEQ ID NO: 980912 - RNA, 22 nt, Human
ccagagacccucccccaacccc

SEQ ID NO: 980913 - RNA, 23 nt, Human
ccaggccggggaggguacccaca

SEQ ID NO: 980914 - RNA, 21 nt, Human
cccccucaagaggugagaagg

SEQ ID NO: 980915 - RNA, 21 nt, Human
ccgcucccuccaacccaggcc

SEQ ID NO: 980916 - RNA, 21 nt, Human
ccggaggggugggccauagcg

SEQ ID NO: 980917 - RNA, 19 nt, Human
cgccucgccccuacaccca

SEQ ID NO: 980918 - RNA, 20 nt, Human
cgggcgggacggcggggggc

SEQ ID NO: 980919 - RNA, 25 nt, Human
cguccgggggugcgcuggcggcggg

SEQ ID NO: 980920 - RNA, 21 nt, Human
cuccggggcgcuccggggcgg

SEQ ID NO: 980921 - RNA, 18 nt, Human
cucgccccuacacccauc

SEQ ID NO: 980922 - RNA, 26 nt, Human
cuggcuccagauacaguuaagcugcu

SEQ ID NO: 980923 - RNA, 22 nt, Human
gagggggaggacccccucaaga

SEQ ID NO: 980924 - RNA, 26 nt, Human
gaggggugggccauagcguccggggg

SEQ ID NO: 980925 - RNA, 23 nt, Human
gcuacaacaaccagggggaccca

SEQ ID NO: 980926 - RNA, 19 nt, Human
gggagcaccaggaggggga

SEQ ID NO: 980927 - RNA, 22 nt, Human
gggggugcgcuggcggcggggc

SEQ ID NO: 980928 - RNA, 24 nt, Human
uaacacggcaucccaguuaaugcu

SEQ ID NO: 980929 - RNA, 22 nt, Human
uccaacccaggccggggagggu

SEQ ID NO: 980930 - RNA, 18 nt, Human
uccgcucccuccaaccca

SEQ ID NO: 980931 - RNA, 22 nt, Human
ucuccagccgagggcgggaggc

SEQ ID NO: 980932 - RNA, 18 nt, Human
ugguuugugcaaagauac

SEQ ID NO: 980933 - RNA, 20 nt, Human
uuccaggcaaguaauaacaa

SEQ ID NO: 980934 - RNA, 22 nt, Human
cgcggccuccgcacagcggccg

SEQ ID NO: 980935 - RNA, 21 nt, Human
cgcuaccgcaucccggggggc

SEQ ID NO: 980936 - RNA, 21 nt, Human
cuccgcacagcggccgcuacc

SEQ ID NO: 980937 - RNA, 20 nt, Human
gcagcugcuucgcggccucc

SEQ ID NO: 980938 - RNA, 19 nt, Human
ggccugcguccccucuccc

SEQ ID NO: 980939 - RNA, 20 nt, Human
gggcugcggagaggaaggcg

SEQ ID NO: 980940 - RNA, 23 nt, Human
aaaaagacauuuaaaaaauaggc

SEQ ID NO: 980941 - RNA, 23 nt, Human
aaaaaggaugcuucuauuaagga

SEQ ID NO: 980942 - RNA, 23 nt, Human
aaacagcagcaaaauacugaaac

SEQ ID NO: 980943 - RNA, 25 nt, Human
aacaaaaaaaccuacacacaacuga

SEQ ID NO: 980944 - RNA, 25 nt, Human
aacaaaacaaaaaaaccuacacaca

SEQ ID NO: 980945 - RNA, 23 nt, Human
aacacaauuuucacaaauguacu

SEQ ID NO: 980946 - RNA, 23 nt, Human
aagaugcgcauuaaacagcagca

SEQ ID NO: 980947 - RNA, 23 nt, Human
aauucuguaauuacaccuuacug

SEQ ID NO: 980948 - RNA, 21 nt, Human
acaaagaaaaacuucauccaa

SEQ ID NO: 980949 - RNA, 22 nt, Human
acaaagaaaaacuucauccaaa

SEQ ID NO: 980950 - RNA, 21 nt, Human
acaguaacaacaacaaaaugc

SEQ ID NO: 980951 - RNA, 23 nt, Human
acauacauacacacgcacacaca

SEQ ID NO: 980952 - RNA, 21 nt, Human
accaacugcucacauacauac

SEQ ID NO: 980953 - RNA, 19 nt, Human
agaaaaugucaaaaaggaa

SEQ ID NO: 980954 - RNA, 19 nt, Human
agcaacaauggacaacaca

SEQ ID NO: 980955 - RNA, 19 nt, Human
agcagaccccuggcaucug

SEQ ID NO: 980956 - RNA, 22 nt, Human
agcccaauuaaaaacucaaaca

SEQ ID NO: 980957 - RNA, 21 nt, Human
aggggagguuauacugaaaag

SEQ ID NO: 980958 - RNA, 18 nt, Human
aguaacaacaacaaaaug

SEQ ID NO: 980959 - RNA, 21 nt, Human
auagagcuuucucaaaaucaa

SEQ ID NO: 980960 - RNA, 23 nt, Human
auccaugcuuuaugaacacauua

SEQ ID NO: 980961 - RNA, 22 nt, Human
caaaaaaaccuacacacaacug

SEQ ID NO: 980962 - RNA, 20 nt, Human
caaaacaaaaaaaccuacac

SEQ ID NO: 980963 - RNA, 24 nt, Human
caaaacaaaaaaaccuacacacaa

SEQ ID NO: 980964 - RNA, 19 nt, Human
caaaacucccaaaagauua

SEQ ID NO: 980965 - RNA, 21 nt, Human
caaaauacugaaacaauucua

SEQ ID NO: 980966 - RNA, 22 nt, Human
caacaaaaugcugauuugugcc

SEQ ID NO: 980967 - RNA, 18 nt, Human
caacaagcaaaacuccca

SEQ ID NO: 980968 - RNA, 23 nt, Human
caacaagcaaaacucccaaaaga

SEQ ID NO: 980969 - RNA, 23 nt, Human
caacacaacacaauuuucacaaa

SEQ ID NO: 980970 - RNA, 21 nt, Human
cacaacacaauuuucacaaau

SEQ ID NO: 980971 - RNA, 21 nt, Human
cacaaguaggaguugccuucu

SEQ ID NO: 980972 - RNA, 22 nt, Human
cacuaauucccaucaggccgaa

SEQ ID NO: 980973 - RNA, 24 nt, Human
cacuccagagcuaccucuggguca

SEQ ID NO: 980974 - RNA, 22 nt, Human
cagcagcaaaauacugaaacaa

SEQ ID NO: 980975 - RNA, 20 nt, Human
cagugugguuuugcagcugc

SEQ ID NO: 980976 - RNA, 27 nt, Human
cauacacacgcacacacauagauuuua

SEQ ID NO: 980977 - RNA, 21 nt, Human
ccagucucaagcacuuaagaa

SEQ ID NO: 980978 - RNA, 21 nt, Human
cccuauuugcaaagugauuaa

SEQ ID NO: 980979 - RNA, 21 nt, Human
cgccacagacucugauugcuc

SEQ ID NO: 980980 - RNA, 20 nt, Human
cguuuuguuuuuuugucugu

SEQ ID NO: 980981 - RNA, 25 nt, Human
cucacauacauacacacgcacacac

SEQ ID NO: 980982 - RNA, 24 nt, Human
cucccaaaagauuagguaagaaaa

SEQ ID NO: 980983 - RNA, 23 nt, Human
cugaaaacauaguugguguagca

SEQ ID NO: 980984 - RNA, 22 nt, Human
cuguucucaaucuaugcuaaaa

SEQ ID NO: 980985 - RNA, 22 nt, Human
cuucagaagugggagggcugau

SEQ ID NO: 980986 - RNA, 24 nt, Human
ggaaaaaaucagaaaaugucaaaa

SEQ ID NO: 980987 - RNA, 22 nt, Human
ggagagaaaaauucucucucaa

SEQ ID NO: 980988 - RNA, 23 nt, Human
uaaacagcagcaaaauacugaaa

SEQ ID NO: 980989 - RNA, 19 nt, Human
uaaggcucucggcggcucg

SEQ ID NO: 980990 - RNA, 27 nt, Human
uaauacaguaacaacaacaaaaugcuu

SEQ ID NO: 980991 - RNA, 23 nt, Human
uacaccuuacuguaucaugcccu

SEQ ID NO: 980992 - RNA, 20 nt, Human
uacaguaacaacaacaaaau

SEQ ID NO: 980993 - RNA, 29 nt, Human
uacauacacacgcacacacauagauuuua

SEQ ID NO: 980994 - RNA, 22 nt, Human
uacauuaaacaaaaaaccaugc

SEQ ID NO: 980995 - RNA, 23 nt, Human
uaccagguauuccauaaaacucu

SEQ ID NO: 980996 - RNA, 19 nt, Human
uagcaaaugaauauaucaa

SEQ ID NO: 980997 - RNA, 22 nt, Human
uagcaaaugaauauaucaaaac

SEQ ID NO: 980998 - RNA, 21 nt, Human
uaggaguugccuucuauggug

SEQ ID NO: 980999 - RNA, 18 nt, Human
uauuacagauauagaguu

SEQ ID NO: 981000 - RNA, 22 nt, Human
uauuucguuuuguuuuuuuguc

SEQ ID NO: 981001 - RNA, 23 nt, Human
uauuuuacuucacccuccaucca

SEQ ID NO: 981002 - RNA, 20 nt, Human
ucaaaaaggaagagacaaca

SEQ ID NO: 981003 - RNA, 21 nt, Human
ucaaaacaaaacaaaaaaacc

SEQ ID NO: 981004 - RNA, 27 nt, Human
ucaaaacaaaacaaaaaaaccuacaca

SEQ ID NO: 981005 - RNA, 20 nt, Human
uccuugaagccacugggaag

SEQ ID NO: 981006 - RNA, 23 nt, Human
uccuugaagccacugggaaguuu

SEQ ID NO: 981007 - RNA, 19 nt, Human
ucgccacagacucugauug

SEQ ID NO: 981008 - RNA, 25 nt, Human
ucgggcgguaauggcguuacucuuc

SEQ ID NO: 981009 - RNA, 25 nt, Human
ucuaaaaucacuccagagcuaccuc

SEQ ID NO: 981010 - RNA, 21 nt, Human
ucuaugcuaaaaaaaaaaaau

SEQ ID NO: 981011 - RNA, 24 nt, Human
ugaaaaggagaaugaagaggucag

SEQ ID NO: 981012 - RNA, 26 nt, Human
ugaaacaauucuauugcuaaaaagca

SEQ ID NO: 981013 - RNA, 24 nt, Human
ugaacacauuauucucacacaucc

SEQ ID NO: 981014 - RNA, 23 nt, Human
ugaagaugcgcauuaaacagcag

SEQ ID NO: 981015 - RNA, 21 nt, Human
ugacaaauaauaaauucuaca

SEQ ID NO: 981016 - RNA, 22 nt, Human
ugagugaguaggucuaaaauca

SEQ ID NO: 981017 - RNA, 23 nt, Human
ugccagagagauccccaaauucc

SEQ ID NO: 981018 - RNA, 20 nt, Human
ugccaucaauugaaauuuga

SEQ ID NO: 981019 - RNA, 26 nt, Human
ugcucacauacauacacacgcacaca

SEQ ID NO: 981020 - RNA, 25 nt, Human
ugcucacauacauacacacgcacag

SEQ ID NO: 981021 - RNA, 25 nt, Human
ugcuugaacaaaccauguguggaag

SEQ ID NO: 981022 - RNA, 22 nt, Human
uggcguuacucuucauccgggu

SEQ ID NO: 981023 - RNA, 19 nt, Human
uggcucagauguuuaaaua

SEQ ID NO: 981024 - RNA, 21 nt, Human
ugugugggcaugagcauaggg

SEQ ID NO: 981025 - RNA, 20 nt, Human
uucguaaauucuguaauuac

SEQ ID NO: 981026 - RNA, 24 nt, Human
uuucguuuuguuuuuuugucugug

SEQ ID NO: 981027 - RNA, 20 nt, Human
uuucugcuaaauacuuacug

SEQ ID NO: 981028 - RNA, 20 nt, Human
uuuguuaaaaaaggggguag

SEQ ID NO: 981029 - RNA, 21 nt, Human
uuuguuaaaaaaggggguagg

SEQ ID NO: 981030 - RNA, 18 nt, Human
uuuugggggaaaaaauca

SEQ ID NO: 981031 - RNA, 19 nt, Human
aaaaaaagaacuuuuccac

SEQ ID NO: 981032 - RNA, 19 nt, Human
aaaaaacagccaauaaaca

SEQ ID NO: 981033 - RNA, 21 nt, Human
aaaaaugcugacaagcacuaa

SEQ ID NO: 981034 - RNA, 21 nt, Human
aaaacaccaagauuaaaaaca

SEQ ID NO: 981035 - RNA, 18 nt, Human
aaacaaauacugaauuac

SEQ ID NO: 981036 - RNA, 24 nt, Human
aaaugcaagagauugcucucagcu

SEQ ID NO: 981037 - RNA, 24 nt, Human
aacagccaauaaacaaauacugaa

SEQ ID NO: 981038 - RNA, 19 nt, Human
aaccaguuauuaacuuccu

SEQ ID NO: 981039 - RNA, 19 nt, Human
aaccugugaacuaaagagu

SEQ ID NO: 981040 - RNA, 23 nt, Human
aagaaaaaaaaaagagaaaaaaa

SEQ ID NO: 981041 - RNA, 19 nt, Human
aaguagcugagauuacagg

SEQ ID NO: 981042 - RNA, 25 nt, Human
aaguagcugagauuacaggcaccca

SEQ ID NO: 981043 - RNA, 18 nt, Human
aaguuauuuucuccucuu

SEQ ID NO: 981044 - RNA, 21 nt, Human
aauuccucacaguaaaguacu

SEQ ID NO: 981045 - RNA, 20 nt, Human
acaaugauuccugugucuua

SEQ ID NO: 981046 - RNA, 19 nt, Human
acacaaauuccaugccacc

SEQ ID NO: 981047 - RNA, 24 nt, Human
acagaacuuuuagacaagaguaga

SEQ ID NO: 981048 - RNA, 19 nt, Human
acaggcacccaccaucacg

SEQ ID NO: 981049 - RNA, 21 nt, Human
accacaggccacccauagaca

SEQ ID NO: 981050 - RNA, 18 nt, Human
acgggguuucaccauguu

SEQ ID NO: 981051 - RNA, 23 nt, Human
acgggguuucaccauguuggcca

SEQ ID NO: 981052 - RNA, 24 nt, Human
acgggguuucaccauguuggccag

SEQ ID NO: 981053 - RNA, 21 nt, Human
acuauauuaggaauauucggc

SEQ ID NO: 981054 - RNA, 20 nt, Human
acucauuuuccuacaaaucu

SEQ ID NO: 981055 - RNA, 19 nt, Human
acuuguaaacauuaagcuu

SEQ ID NO: 981056 - RNA, 24 nt, Human
agaaaaaaagaacuuuuccacaag

SEQ ID NO: 981057 - RNA, 29 nt, Human
agacaagaguagaggggaaaagggacccc

SEQ ID NO: 981058 - RNA, 22 nt, Human
agagaaaaaaagaacuuuucca

SEQ ID NO: 981059 - RNA, 18 nt, Human
agagguucuuucucuuac

SEQ ID NO: 981060 - RNA, 20 nt, Human
agccauacaguggaacagug

SEQ ID NO: 981061 - RNA, 22 nt, Human
aggccaaagccauacaguggaa

SEQ ID NO: 981062 - RNA, 19 nt, Human
aggcucuagacuauaaaaa

SEQ ID NO: 981063 - RNA, 22 nt, Human
aguucuccugcuucagccuccc

SEQ ID NO: 981064 - RNA, 24 nt, Human
auuuugguauuuuuaguagagacg

SEQ ID NO: 981065 - RNA, 19 nt, Human
caacaguaaagaaaacuuu

SEQ ID NO: 981066 - RNA, 24 nt, Human
cacaacaguaaacaaauuuugcuc

SEQ ID NO: 981067 - RNA, 25 nt, Human
cacaggccacccauagacacaaagc

SEQ ID NO: 981068 - RNA, 21 nt, Human
caccaaagaaaaguaaagaau

SEQ ID NO: 981069 - RNA, 23 nt, Human
caccaaagaaaaguaaagaauug

SEQ ID NO: 981070 - RNA, 18 nt, Human
caccaagauuaaaaacag

SEQ ID NO: 981071 - RNA, 21 nt, Human
caccauguuggccaggaguuc

SEQ ID NO: 981072 - RNA, 23 nt, Human
caccauguuggccaggaguucaa

SEQ ID NO: 981073 - RNA, 18 nt, Human
cacccaccaucacgccug

SEQ ID NO: 981074 - RNA, 22 nt, Human
cacggguaaaaaaaugcaagag

SEQ ID NO: 981075 - RNA, 21 nt, Human
cacugcaaccucugccuccug

SEQ ID NO: 981076 - RNA, 23 nt, Human
cacugcaaccucugccuccuggg

SEQ ID NO: 981077 - RNA, 20 nt, Human
cacuguauuauaccaagaau

SEQ ID NO: 981078 - RNA, 22 nt, Human
cagcuggaucccaagggcuaaa

SEQ ID NO: 981079 - RNA, 21 nt, Human
caggcacccaccaucacgccu

SEQ ID NO: 981080 - RNA, 22 nt, Human
caggcaguucuccugcuucagc

SEQ ID NO: 981081 - RNA, 19 nt, Human
caggccaaagccauacagu

SEQ ID NO: 981082 - RNA, 19 nt, Human
caggcgagaacagggaacg

SEQ ID NO: 981083 - RNA, 20 nt, Human
caguucuccugcuucagccu

SEQ ID NO: 981084 - RNA, 19 nt, Human
cauacaguggaacagugug

SEQ ID NO: 981085 - RNA, 22 nt, Human
caucacgccuggcuaauuuugg

SEQ ID NO: 981086 - RNA, 23 nt, Human
ccaaguagcugagauuacaggca

SEQ ID NO: 981087 - RNA, 24 nt, Human
ccacaagucucucuccucuaguug

SEQ ID NO: 981088 - RNA, 19 nt, Human
ccaucuauacagcacucca

SEQ ID NO: 981089 - RNA, 23 nt, Human
cccaacacauccgauagcaugga

SEQ ID NO: 981090 - RNA, 19 nt, Human
cccaaguagcugagauuac

SEQ ID NO: 981091 - RNA, 24 nt, Human
cccaaguagcugagauuacaggca

SEQ ID NO: 981092 - RNA, 18 nt, Human
ccccugggaagaggauuc

SEQ ID NO: 981093 - RNA, 21 nt, Human
ccucccuggccacucaggcca

SEQ ID NO: 981094 - RNA, 19 nt, Human
ccucugccuccuggguuca

SEQ ID NO: 981095 - RNA, 24 nt, Human
cgggguuucaccauguuggccagg

SEQ ID NO: 981096 - RNA, 23 nt, Human
cuaguuggaaaauuagagaaauc

SEQ ID NO: 981097 - RNA, 24 nt, Human
cucacugcaaccucugccuccugg

SEQ ID NO: 981098 - RNA, 18 nt, Human
cuccagggugugagaccc

SEQ ID NO: 981099 - RNA, 21 nt, Human
cucccaaguagcugagauuac

SEQ ID NO: 981100 - RNA, 21 nt, Human
cucccgaugaauaauuuuuau

SEQ ID NO: 981101 - RNA, 21 nt, Human
cuccuggguucaggcaguucu

SEQ ID NO: 981102 - RNA, 20 nt, Human
cugacaagcacuaaaaucac

SEQ ID NO: 981103 - RNA, 19 nt, Human
cugcaaccucugccuccug

SEQ ID NO: 981104 - RNA, 23 nt, Human
cugcaaccucugccuccuggguu

SEQ ID NO: 981105 - RNA, 24 nt, Human
cugcaaccucugccuccuggguuc

SEQ ID NO: 981106 - RNA, 23 nt, Human
cugcuucagccucccaaguagcu

SEQ ID NO: 981107 - RNA, 21 nt, Human
cuugcucacaaucaaugggaa

SEQ ID NO: 981108 - RNA, 20 nt, Human
cuuuuauuucaugggugcug

SEQ ID NO: 981109 - RNA, 22 nt, Human
gacagaucaaggaaacaaguua

SEQ ID NO: 981110 - RNA, 24 nt, Human
gagacgggguuucaccauguuggc

SEQ ID NO: 981111 - RNA, 22 nt, Human
gcaaccucugccuccuggguuc

SEQ ID NO: 981112 - RNA, 24 nt, Human
gcugauaccccuauuucaccaccu

SEQ ID NO: 981113 - RNA, 20 nt, Human
ggcugauaccccuauuucac

SEQ ID NO: 981114 - RNA, 18 nt, Human
gggcuaaagagauaaaua

SEQ ID NO: 981115 - RNA, 23 nt, Human
gggguuucaccauguuggccagg

SEQ ID NO: 981116 - RNA, 23 nt, Human
guagagacgggguuucaccaugu

SEQ ID NO: 981117 - RNA, 22 nt, Human
uaacuguaccuuacagugauau

SEQ ID NO: 981118 - RNA, 19 nt, Human
uaagaaaaaaaaaagagaa

SEQ ID NO: 981119 - RNA, 20 nt, Human
uaagacaaaaauucuacagc

SEQ ID NO: 981120 - RNA, 23 nt, Human
uaauuuugguauuuuuaguagag

SEQ ID NO: 981121 - RNA, 24 nt, Human
uaauuuugguauuuuuaguagaga

SEQ ID NO: 981122 - RNA, 18 nt, Human
uacacaaauuccaugcca

SEQ ID NO: 981123 - RNA, 22 nt, Human
uacagaaaguuggaaaacacca

SEQ ID NO: 981124 - RNA, 18 nt, Human
uacagcacauugcaagac

SEQ ID NO: 981125 - RNA, 20 nt, Human
uacuaccuuggcugcccuuc

SEQ ID NO: 981126 - RNA, 22 nt, Human
uagagacgggguuucaccaugu

SEQ ID NO: 981127 - RNA, 23 nt, Human
uagcugauauugcuaaagagcuu

SEQ ID NO: 981128 - RNA, 20 nt, Human
uaggaaaaauucacaacagu

SEQ ID NO: 981129 - RNA, 24 nt, Human
uaguagagacgggguuucaccaug

SEQ ID NO: 981130 - RNA, 26 nt, Human
uaguagagacgggguuucaccauguu

SEQ ID NO: 981131 - RNA, 21 nt, Human
uaguggacacugaugguuugu

SEQ ID NO: 981132 - RNA, 23 nt, Human
uauaauaaauaauaacagcucgg

SEQ ID NO: 981133 - RNA, 23 nt, Human
uauaauucucaguugcagaaaau

SEQ ID NO: 981134 - RNA, 22 nt, Human
uaugcacagaaauguaucuauu

SEQ ID NO: 981135 - RNA, 22 nt, Human
uauggucuggcuuuuuuuuuua

SEQ ID NO: 981136 - RNA, 22 nt, Human
uauuucaccaccucaucuaagc

SEQ ID NO: 981137 - RNA, 19 nt, Human
uauuucagaucacaaauuc

SEQ ID NO: 981138 - RNA, 25 nt, Human
uauuucaugggugcuggguaugugg

SEQ ID NO: 981139 - RNA, 22 nt, Human
ucaaaccaacauggcaggguca

SEQ ID NO: 981140 - RNA, 24 nt, Human
ucacugcaaccucugccuccuggg

SEQ ID NO: 981141 - RNA, 25 nt, Human
ucacugcaaccucugccuccugggu

SEQ ID NO: 981142 - RNA, 27 nt, Human
ucacugcaaccucugccuccuggguuc

SEQ ID NO: 981143 - RNA, 18 nt, Human
ucagccucccaaguagcu

SEQ ID NO: 981144 - RNA, 21 nt, Human
ucagccucccaaguagcugag

SEQ ID NO: 981145 - RNA, 24 nt, Human
ucccaaguagcugagauuacaggc

SEQ ID NO: 981146 - RNA, 18 nt, Human
ucccuggccacucaggcc

SEQ ID NO: 981147 - RNA, 21 nt, Human
uccuggguucaggcaguucuc

SEQ ID NO: 981148 - RNA, 24 nt, Human
uccuggguucaggcaguucuccug

SEQ ID NO: 981149 - RNA, 24 nt, Human
uccuuggagaguucucagaauugc

SEQ ID NO: 981150 - RNA, 21 nt, Human
ucucacccuugccacccaggc

SEQ ID NO: 981151 - RNA, 22 nt, Human
ucucacccuugccacccaggca

SEQ ID NO: 981152 - RNA, 18 nt, Human
ucugacagaucaaggaaa

SEQ ID NO: 981153 - RNA, 22 nt, Human
ucugacagaucaaggaaacaag

SEQ ID NO: 981154 - RNA, 23 nt, Human
ucugacagaucaaggaaacaagu

SEQ ID NO: 981155 - RNA, 25 nt, Human
ugaaauauaauucucaguugcagaa

SEQ ID NO: 981156 - RNA, 18 nt, Human
ugaaugacaacugcuauc

SEQ ID NO: 981157 - RNA, 19 nt, Human
ugagauuacaggcacccac

SEQ ID NO: 981158 - RNA, 21 nt, Human
ugagauuacaggcacccacca

SEQ ID NO: 981159 - RNA, 22 nt, Human
ugagauuacaggcacccaccau

SEQ ID NO: 981160 - RNA, 27 nt, Human
ugccaccagucaaacuauggucuggcc

SEQ ID NO: 981161 - RNA, 24 nt, Human
ugcuucagccucccaaguagcuga

SEQ ID NO: 981162 - RNA, 23 nt, Human
uggaaaacaccaagauuaaaaac

SEQ ID NO: 981163 - RNA, 23 nt, Human
ugggaaccugugaacuaaagagu

SEQ ID NO: 981164 - RNA, 24 nt, Human
ugguaacaaauaguggacacugau

SEQ ID NO: 981165 - RNA, 23 nt, Human
ugucaaaaaacagccaauaaaca

SEQ ID NO: 981166 - RNA, 21 nt, Human
ugucaauauucaggaaagagg

SEQ ID NO: 981167 - RNA, 28 nt, Human
uuacuaagucagauugaguaggucgcau

SEQ ID NO: 981168 - RNA, 18 nt, Human
uuaguagagacgggguuu

SEQ ID NO: 981169 - RNA, 22 nt, Human
uuaguagagacgggguuucacc

SEQ ID NO: 981170 - RNA, 24 nt, Human
uuaguagagacgggguuucaccau

SEQ ID NO: 981171 - RNA, 24 nt, Human
uucaauccccugggaagaggauuc

SEQ ID NO: 981172 - RNA, 24 nt, Human
uuccuuuggggugcugcuuguagg

SEQ ID NO: 981173 - RNA, 19 nt, Human
uuucaccauguuggccagg

SEQ ID NO: 981174 - RNA, 18 nt, Human
uuuccuacaaaucuucag

SEQ ID NO: 981175 - RNA, 24 nt, Human
uuuuuaguagagacgggguuucac

SEQ ID NO: 981176 - RNA, 23 nt, Human
uagaggguuuuucucaggggcuu

SEQ ID NO: 981177 - RNA, 20 nt, Human
uuucuagaggguuuuucuca

SEQ ID NO: 981178 - RNA, 21 nt, Human
acacccccgcacccccaugug

SEQ ID NO: 981179 - RNA, 19 nt, Human
accuacacccccgcacccc

SEQ ID NO: 981180 - RNA, 19 nt, Human
accuacacccccgcacccc

SEQ ID NO: 981181 - RNA, 25 nt, Human
agaaagggagggaagcggaagggaa

SEQ ID NO: 981182 - RNA, 18 nt, Human
agggaaaaagcgcaugug

SEQ ID NO: 981183 - RNA, 19 nt, Human
agggaugggcccaagucuc

SEQ ID NO: 981184 - RNA, 18 nt, Human
cacccacggcugguuggg

SEQ ID NO: 981185 - RNA, 20 nt, Human
caccuacacccccgcacccc

SEQ ID NO: 981186 - RNA, 21 nt, Human
cagcagcacgcggcagcuucg

SEQ ID NO: 981187 - RNA, 21 nt, Human
cagcgaguuuauugcagguuc

SEQ ID NO: 981188 - RNA, 21 nt, Human
cagcucccgggaucgcgggga

SEQ ID NO: 981189 - RNA, 21 nt, Human
cccccgcacccccaugugccc

SEQ ID NO: 981190 - RNA, 21 nt, Human
ccccgcacccccaugugccca

SEQ ID NO: 981191 - RNA, 19 nt, Human
ccccucuggucucgcccuc

SEQ ID NO: 981192 - RNA, 21 nt, Human
cccgggaucgcggggaacgug

SEQ ID NO: 981193 - RNA, 22 nt, Human
ccuccgcgcagaggcugagagu

SEQ ID NO: 981194 - RNA, 21 nt, Human
ccuggcccagugcccuuggcc

SEQ ID NO: 981195 - RNA, 23 nt, Human
cgcuuggcaccuacacccccgca

SEQ ID NO: 981196 - RNA, 23 nt, Human
cggccggacuccaaucucggguc

SEQ ID NO: 981197 - RNA, 23 nt, Human
cucccgggaucgcggggaacgug

SEQ ID NO: 981198 - RNA, 18 nt, Human
gaaucgcggaugcgcaug

SEQ ID NO: 981199 - RNA, 21 nt, Human
gcaccuacacccccgcacccc

SEQ ID NO: 981200 - RNA, 24 nt, Human
gcagcagcacgcggcagcuucgca

SEQ ID NO: 981201 - RNA, 24 nt, Human
gggaacguggauuccgaacaaggg

SEQ ID NO: 981202 - RNA, 28 nt, Human
ucccccgugggaagaaagggagggaagc

SEQ ID NO: 981203 - RNA, 22 nt, Human
ucccgggaucgcggggaacgug

SEQ ID NO: 981204 - RNA, 21 nt, Human
uccgcaaaugggggccaccgu

SEQ ID NO: 981205 - RNA, 22 nt, Human
ugcgcaugcgccuccagcuccc

SEQ ID NO: 981206 - RNA, 20 nt, Human
ugcucaagaaaugcaugacu

SEQ ID NO: 981207 - RNA, 22 nt, Human
ugcuuccguccccucuggucuc

SEQ ID NO: 981208 - RNA, 21 nt, Human
uggcccagugcccuuggcugc

SEQ ID NO: 981209 - RNA, 22 nt, Human
uggcugcaggaauggcuggaac

SEQ ID NO: 981210 - RNA, 18 nt, Human
ugggaagaaagggaggga

SEQ ID NO: 981211 - RNA, 23 nt, Human
uugcgcgugcgccgcccuggccc

SEQ ID NO: 981212 - RNA, 20 nt, Human
uuuuuuuuuuuuuuuuccau

SEQ ID NO: 981213 - RNA, 24 nt, Human
uuuuuuuuuuuuuuuuuuuccaug

SEQ ID NO: 981214 - RNA, 20 nt, Human
aaaauacaacagaaacacua

SEQ ID NO: 981215 - RNA, 20 nt, Human
aaacacucagaacugcccuc

SEQ ID NO: 981216 - RNA, 21 nt, Human
aaagcaguugggagaugccua

SEQ ID NO: 981217 - RNA, 20 nt, Human
aacaggaaacagagugaggg

SEQ ID NO: 981218 - RNA, 23 nt, Human
acuguugugaacacuugcuuuca

SEQ ID NO: 981219 - RNA, 21 nt, Human
aggaaacagagugaggggggc

SEQ ID NO: 981220 - RNA, 18 nt, Human
aucagugaaaacgcuaau

SEQ ID NO: 981221 - RNA, 24 nt, Human
caaaauacaacagaaacacuaaca

SEQ ID NO: 981222 - RNA, 23 nt, Human
cacuaacaucgaacucuuggcac

SEQ ID NO: 981223 - RNA, 19 nt, Human
caucagugaaaacgcuaau

SEQ ID NO: 981224 - RNA, 20 nt, Human
cauguguguguguuugugua

SEQ ID NO: 981225 - RNA, 22 nt, Human
cgcgcgcaugugugucugugug

SEQ ID NO: 981226 - RNA, 25 nt, Human
cgcgcgcgcgcaugugugucugugu

SEQ ID NO: 981227 - RNA, 23 nt, Human
cgcgcgcgcgcgcgcaugggucc

SEQ ID NO: 981228 - RNA, 24 nt, Human
cgcuaauaucuaacagaauggcac

SEQ ID NO: 981229 - RNA, 18 nt, Human
cucaucagugaaaacgcu

SEQ ID NO: 981230 - RNA, 21 nt, Human
cucugucucugauuuuggaag

SEQ ID NO: 981231 - RNA, 25 nt, Human
cugguacuuggugugugugugugug

SEQ ID NO: 981232 - RNA, 33 nt, Human; identical to SEQ ID NO: 379763

SEQ ID NO: 981233 - RNA, 24 nt, Human
gaacaggaaacagagugagggggg

SEQ ID NO: 981234 - RNA, 24 nt, Human
gaacucuuggcacacuaagaaaaa

SEQ ID NO: 981235 - RNA, 24 nt, Human
gacgauacuuguuuucugagguag

SEQ ID NO: 981236 - RNA, 22 nt, Human
ggagaugccuauacugguacuu

SEQ ID NO: 981237 - RNA, 19 nt, Human
gucuguguggcaugugugu

SEQ ID NO: 981238 - RNA, 23 nt, Human
gugugugugugugcgcgcgcgcg

SEQ ID NO: 981239 - RNA, 20 nt, Human
gugugugugugugugugugu

SEQ ID NO: 981240 - RNA, 21 nt, Human
gugugugugugugugugugug

SEQ ID NO: 981241 - RNA, 21 nt, Human
gugugugugugugugugugug

SEQ ID NO: 981242 - RNA, 21 nt, Human
gugugugugugugugugugug

SEQ ID NO: 981243 - RNA, 19 nt, Human
uaaacacucagaacugccc

SEQ ID NO: 981244 - RNA, 24 nt, Human
ugcgcgcgcgcgcgcgcaugugug

SEQ ID NO: 981245 - RNA, 25 nt, Human
uggauacacaaaccgaaauaugcau

SEQ ID NO: 981246 - RNA, 21 nt, Human
uggcagugacugauagagggg

SEQ ID NO: 981247 - RNA, 18 nt, Human
ugggaagagaggagggua

SEQ ID NO: 981248 - RNA, 21 nt, Human
ugggagaugccuauacuggua

SEQ ID NO: 981249 - RNA, 22 nt, Human
uggugugugugugugugugugu

SEQ ID NO: 981250 - RNA, 22 nt, Human
ugugcgcgcgcgcgcgcgcaug

SEQ ID NO: 981251 - RNA, 24 nt, Human
ugugcgcgcgcgcgcgcgcaugug

SEQ ID NO: 981252 - RNA, 19 nt, Human
ugugucuguguggcaugug

SEQ ID NO: 981253 - RNA, 24 nt, Human
ugugugcgcgcgcgcgcgcgcaug

SEQ ID NO: 981254 - RNA, 19 nt, Human
uguguggcaugugugugug

SEQ ID NO: 981255 - RNA, 25 nt, Human
ugugugucuguguggcaugugugug

SEQ ID NO: 981256 - RNA, 18 nt, Human
ugugugugugugugugcg

SEQ ID NO: 981257 - RNA, 18 nt, Human
ugugugugugugugugug

SEQ ID NO: 981258 - RNA, 18 nt, Human
ugugugugugugugugug

SEQ ID NO: 981259 - RNA, 18 nt, Human
ugugugugugugugugug

SEQ ID NO: 981260 - RNA, 18 nt, Human
ugugugugugugugugug

SEQ ID NO: 981261 - RNA, 18 nt, Human
ugugugugugugugugug

SEQ ID NO: 981262 - RNA, 18 nt, Human
ugugugugugugugugug

SEQ ID NO: 981263 - RNA, 18 nt, Human
ugugugugugugugugug

SEQ ID NO: 981264 - RNA, 18 nt, Human
ugugugugugugugugug

SEQ ID NO: 981265 - RNA, 21 nt, Human
ugugugugugugugugugugu

SEQ ID NO: 981266 - RNA, 21 nt, Human
ugugugugugugugugugugu

SEQ ID NO: 981267 - RNA, 21 nt, Human
ugugugugugugugugugugu

SEQ ID NO: 981268 - RNA, 21 nt, Human
ugugugugugugugugugugu

SEQ ID NO: 981269 - RNA, 21 nt, Human
ugugugugugugugugugugu

SEQ ID NO: 981270 - RNA, 21 nt, Human
ugugugugugugugugugugu

SEQ ID NO: 981271 - RNA, 21 nt, Human
ugugugugugugugugugugu

SEQ ID NO: 981272 - RNA, 21 nt, Human
ugugugugugugugugugugu

SEQ ID NO: 981273 - RNA, 21 nt, Human
ugugugugugugugugugugu

SEQ ID NO: 981274 - RNA, 21 nt, Human
ugugugugugugugugugugu

SEQ ID NO: 981275 - RNA, 21 nt, Human
ugugugugugugugugugugu

SEQ ID NO: 981276 - RNA, 21 nt, Human
ugugugugugugugugugugu

SEQ ID NO: 981277 - RNA, 21 nt, Human
ugugugugugugugugugugu

SEQ ID NO: 981278 - RNA, 21 nt, Human
ugugugugugugugugugugu

SEQ ID NO: 981279 - RNA, 22 nt, Human
ugugugugugugugugugugug

SEQ ID NO: 981280 - RNA, 22 nt, Human
ugugugugugugugugugugug

SEQ ID NO: 981281 - RNA, 22 nt, Human
ugugugugugugugugugugug

SEQ ID NO: 981282 - RNA, 22 nt, Human
ugugugugugugugugugugug

SEQ ID NO: 981283 - RNA, 24 nt, Human
uuggaagaaucgaaagaaucagag

SEQ ID NO: 981284 - RNA, 18 nt, Human
uuggugugugugugugug

SEQ ID NO: 981285 - RNA, 19 nt, Human
aaaaaacaucccuucacca

SEQ ID NO: 981286 - RNA, 26 nt, Human
aaaaaauccaaaaugauuaguaaaga

SEQ ID NO: 981287 - RNA, 21 nt, Human
aaaaagacaagucaaaaugca

SEQ ID NO: 981288 - RNA, 24 nt, Human
aaaaguacuaccuuauuucccuua

SEQ ID NO: 981289 - RNA, 19 nt, Human
aaacaccaaagggaauccc

SEQ ID NO: 981290 - RNA, 22 nt, Human
aacacaaacuuuauccucaaau

SEQ ID NO: 981291 - RNA, 23 nt, Human
aacuccacaaugaauaacugugg

SEQ ID NO: 981292 - RNA, 22 nt, Human
aacucuacacauuaacaaaaga

SEQ ID NO: 981293 - RNA, 27 nt, Human
aagaaaaagauaaagcauuuaaaaaga

SEQ ID NO: 981294 - RNA, 25 nt, Human
aagaaaaguaagggagaccgguacc

SEQ ID NO: 981295 - RNA, 23 nt, Human
aagaacacacaagcucaaaugca

SEQ ID NO: 981296 - RNA, 21 nt, Human
aagcaaacacagauuugggca

SEQ ID NO: 981297 - RNA, 23 nt, Human
aagcaaacacagauuugggcaau

SEQ ID NO: 981298 - RNA, 20 nt, Human
aagcaaaguacagaaggccc

SEQ ID NO: 981299 - RNA, 20 nt, Human
aagcagaaagcaaacacaga

SEQ ID NO: 981300 - RNA, 25 nt, Human
aagcagaaagcaaacacagauuugg

SEQ ID NO: 981301 - RNA, 21 nt, Human
aagcaugcuccaucagcauaa

SEQ ID NO: 981302 - RNA, 21 nt, Human
aagcauuuaaaaagacaaguc

SEQ ID NO: 981303 - RNA, 18 nt, Human
aauaaggaauccagaaga

SEQ ID NO: 981304 - RNA, 22 nt, Human
acacugguuuguauuauugcga

SEQ ID NO: 981305 - RNA, 23 nt, Human
acagcaaaggguuagaaccugaa

SEQ ID NO: 981306 - RNA, 18 nt, Human
acuaccuuauuucccuua

SEQ ID NO: 981307 - RNA, 22 nt, Human
acugaaauacggguggucccag

SEQ ID NO: 981308 - RNA, 22 nt, Human
acuggacaacaagagaacuaag

SEQ ID NO: 981309 - RNA, 20 nt, Human
agaaagcaaacacagauuug

SEQ ID NO: 981310 - RNA, 18 nt, Human
agaaagcaagcagaggug

SEQ ID NO: 981311 - RNA, 22 nt, Human
agaaagcaagcagaggugggga

SEQ ID NO: 981312 - RNA, 18 nt, Human
agaaggucagagguacac

SEQ ID NO: 981313 - RNA, 25 nt, Human
agaauggaagucuaacacuuaaaua

SEQ ID NO: 981314 - RNA, 22 nt, Human
agcagugaugaugccgguggaa

SEQ ID NO: 981315 - RNA, 25 nt, Human
aggaaagagaauuuuaagcauagaa

SEQ ID NO: 981316 - RNA, 22 nt, Human
aucccucuuuccaaugucuucu

SEQ ID NO: 981317 - RNA, 18 nt, Human
auguagcaagcagaaagc

SEQ ID NO: 981318 - RNA, 20 nt, Human
auugaaacacugguagaaag

SEQ ID NO: 981319 - RNA, 18 nt, Human
caaaaaaaacaucccuuc

SEQ ID NO: 981320 - RNA, 24 nt, Human
caaaaaaaacaucccuucaccaca

SEQ ID NO: 981321 - RNA, 18 nt, Human
caaagcaccccagcucuc

SEQ ID NO: 981322 - RNA, 21 nt, Human
caagacagaacagacuagaac

SEQ ID NO: 981323 - RNA, 26 nt, Human
caagacagaacagacuagaaccuccc

SEQ ID NO: 981324 - RNA, 25 nt, Human
caggaaccacauauccaaccuucag

SEQ ID NO: 981325 - RNA, 21 nt, Human
cagguacaaugccuauacuua

SEQ ID NO: 981326 - RNA, 20 nt, Human
caucaggaaccacauaucca

SEQ ID NO: 981327 - RNA, 22 nt, Human
caucaggaaccacauauccaac

SEQ ID NO: 981328 - RNA, 21 nt, Human
cauuuucuuuaucauuggagg

SEQ ID NO: 981329 - RNA, 23 nt, Human
ccacaguguaagauuuaagggca

SEQ ID NO: 981330 - RNA, 26 nt, Human
ccacauauccaacacaaacuuuaucc

SEQ ID NO: 981331 - RNA, 24 nt, Human
ccagaauggaagucuaacacuuaa

SEQ ID NO: 981332 - RNA, 21 nt, Human
ccagguccuacugaaauacgg

SEQ ID NO: 981333 - RNA, 21 nt, Human
cccggccgcuggcuccuccca

SEQ ID NO: 981334 - RNA, 24 nt, Human
cccuacaauuaccauauguauuac

SEQ ID NO: 981335 - RNA, 19 nt, Human
cccucuuuccaaugucuuc

SEQ ID NO: 981336 - RNA, 18 nt, Human
ccggccgcuggcuccucc

SEQ ID NO: 981337 - RNA, 21 nt, Human
ccgguggaaaaagccugucuu

SEQ ID NO: 981338 - RNA, 27 nt, Human
ccuucaccacaguguaagauuuaaggg

SEQ ID NO: 981339 - RNA, 22 nt, Human
cggccgcuggcuccucccaccc

SEQ ID NO: 981340 - RNA, 22 nt, Human
cuacacauuaacaaaagaacac

SEQ ID NO: 981341 - RNA, 20 nt, Human
cuuccaaucccuacccaggu

SEQ ID NO: 981342 - RNA, 24 nt, Human
gaaaaagccugucuuuagcucaag

SEQ ID NO: 981343 - RNA, 23 nt, Human
gaauuuacuucacugcuccuacc

SEQ ID NO: 981344 - RNA, 20 nt, Human
gagaaaggagaacucuacac

SEQ ID NO: 981345 - RNA, 23 nt, Human
gagguggugggcgaaacuggggg

SEQ ID NO: 981346 - RNA, 21 nt, Human
gauuaguaaagaaaaauauaa

SEQ ID NO: 981347 - RNA, 26 nt, Human
gcaagacagaacagacuagaaccucc

SEQ ID NO: 981348 - RNA, 22 nt, Human
gcaagcagaaagcaaacacaga

SEQ ID NO: 981349 - RNA, 19 nt, Human
gcugaauacaaagacaaug

SEQ ID NO: 981350 - RNA, 21 nt, Human
gcuggcucggcgugaccgcgc

SEQ ID NO: 981351 - RNA, 20 nt, Human
ggaaauaauaugaaaaacac

SEQ ID NO: 981352 - RNA, 22 nt, Human
ggaaauaauaugaaaaacacuu

SEQ ID NO: 981353 - RNA, 22 nt, Human
gggaaucccucuuuccaauguc

SEQ ID NO: 981354 - RNA, 29 nt, Human
gggagagggguagggauuaucuucaaagg

SEQ ID NO: 981355 - RNA, 19 nt, Human
guaaagaaaaauauaagaa

SEQ ID NO: 981356 - RNA, 21 nt, Human
gucagguacaaugccuauacu

SEQ ID NO: 981357 - RNA, 24 nt, Human
uaaaaagacaagucaaaaugcauc

SEQ ID NO: 981358 - RNA, 22 nt, Human
uaaaaagcaugcuccaucagca

SEQ ID NO: 981359 - RNA, 25 nt, Human
uaacaggcccuuuaaauuuguuuua

SEQ ID NO: 981360 - RNA, 18 nt, Human
uaacuuuuauuucacuca

SEQ ID NO: 981361 - RNA, 21 nt, Human
uaagagcugaauacaaagaca

SEQ ID NO: 981362 - RNA, 22 nt, Human
uaaguagaagaccaaacaccaa

SEQ ID NO: 981363 - RNA, 20 nt, Human
uaaguagaagaccaaacacu

SEQ ID NO: 981364 - RNA, 21 nt, Human
uagaagaccaaacaccaaagg

SEQ ID NO: 981365 - RNA, 25 nt, Human
uagcagugaugaugccgguggaaaa

SEQ ID NO: 981366 - RNA, 21 nt, Human
uauaaaaagaaaaguacuacc

SEQ ID NO: 981367 - RNA, 22 nt, Human
ucaaaugaguuauguuugccuc

SEQ ID NO: 981368 - RNA, 22 nt, Human
ucagaaaugugguauuuuagaa

SEQ ID NO: 981369 - RNA, 20 nt, Human
uccauagaauuuacuucacu

SEQ ID NO: 981370 - RNA, 22 nt, Human
uccccggccgcuggcuccuccc

SEQ ID NO: 981371 - RNA, 23 nt, Human
ucgagaaaggagaacucuacaca

SEQ ID NO: 981372 - RNA, 21 nt, Human
ucuuuaaagaaaaagauaaag

SEQ ID NO: 981373 - RNA, 18 nt, Human
ugaaacacugguagaaac

SEQ ID NO: 981374 - RNA, 25 nt, Human
ugaaugaauacccuaauggcaaacc

SEQ ID NO: 981375 - RNA, 18 nt, Human
ugaaugcacaacagaaaa

SEQ ID NO: 981376 - RNA, 19 nt, Human
ugaguguuuuuaaaggauu

SEQ ID NO: 981377 - RNA, 22 nt, Human
ugaguuaagccaaguacacacu

SEQ ID NO: 981378 - RNA, 21 nt, Human
ugaucuagguugcuuuuccuu

SEQ ID NO: 981379 - RNA, 20 nt, Human
ugccaaguacuuccaauccc

SEQ ID NO: 981380 - RNA, 18 nt, Human
ugccucgcacuaauaacu

SEQ ID NO: 981381 - RNA, 18 nt, Human
ugcugcugcccugccaag

SEQ ID NO: 981382 - RNA, 20 nt, Human
uggacaacaagagaacuaag

SEQ ID NO: 981383 - RNA, 19 nt, Human
uggaggggagggaaagaaa

SEQ ID NO: 981384 - RNA, 19 nt, Human
uggccaaguaagaaacuac

SEQ ID NO: 981385 - RNA, 21 nt, Human
uggugggcgaaacuggggggg

SEQ ID NO: 981386 - RNA, 20 nt, Human
uuaacaggcccuuuaaauuu

SEQ ID NO: 981387 - RNA, 20 nt, Human
uucuugaguuaagccaagua

SEQ ID NO: 981388 - RNA, 20 nt, Human
uugaaacacugguagaaacg

SEQ ID NO: 981389 - RNA, 19 nt, Human
uugaaugcacaacagaaaa

SEQ ID NO: 981390 - RNA, 20 nt, Human
uugcuuuuccuucagcaagg

SEQ ID NO: 981391 - RNA, 22 nt, Human
uuuacuucacugcuccuaccac

SEQ ID NO: 981392 - RNA, 22 nt, Human
uuuuuuuuuuuuuuuuuuucag

SEQ ID NO: 981393 - RNA, 23 nt, Human
aaauccaggcucuuuuuucuggg

SEQ ID NO: 981394 - RNA, 18 nt, Human
aagauuucacaacuguaa

SEQ ID NO: 981395 - RNA, 23 nt, Human
acccaucaccccauuuaauuaaa

SEQ ID NO: 981396 - RNA, 21 nt, Human
aggcaaggagaccauggcagc

SEQ ID NO: 981397 - RNA, 20 nt, Human
aucccuggccucaggaccua

SEQ ID NO: 981398 - RNA, 27 nt, Human
ggacuggaagaguguuuuugagccucu

SEQ ID NO: 981399 - RNA, 24 nt, Human
guagaguugucaaauagcuuaaag

SEQ ID NO: 981400 - RNA, 24 nt, Human
uaucaagaagcuuuuggacuggaa

SEQ ID NO: 981401 - RNA, 18 nt, Human
ucuguaaauccaggcucu

SEQ ID NO: 981402 - RNA, 21 nt, Human
ucuguagugaaguuaaguaau

SEQ ID NO: 981403 - RNA, 19 nt, Human
uggaagaguguuuuucagc

SEQ ID NO: 981404 - RNA, 22 nt, Human
uggccacccaucaccccauuua

SEQ ID NO: 981405 - RNA, 25 nt, Human
uucaagauuucacaacuguaaacuc

SEQ ID NO: 981406 - RNA, 20 nt, Human
aaaggagccaaaaugcggug

SEQ ID NO: 981407 - RNA, 20 nt, Human
aacaacccugugagguaggg

SEQ ID NO: 981408 - RNA, 20 nt, Human
aacaacccugugagguaggg

SEQ ID NO: 981409 - RNA, 25 nt, Human
aacagccccuguaaguagcccuggc

SEQ ID NO: 981410 - RNA, 18 nt, Human
aacuauccuggcuuaaaa

SEQ ID NO: 981411 - RNA, 18 nt, Human
aacuauccuggcuuaaaa

SEQ ID NO: 981412 - RNA, 18 nt, Human
aacugccaagccuacugc

SEQ ID NO: 981413 - RNA, 21 nt, Human
aacugccaagccuacugcuca

SEQ ID NO: 981414 - RNA, 21 nt, Human
aacugccaagccuacugcuca

SEQ ID NO: 981415 - RNA, 22 nt, Human
aagcaauccugcagagccgccc

SEQ ID NO: 981416 - RNA, 19 nt, Human
aagcauucucccacuggcc

SEQ ID NO: 981417 - RNA, 19 nt, Human
aagcauucucccacuggcc

SEQ ID NO: 981418 - RNA, 22 nt, Human
aagccuacugcucaugaccugu

SEQ ID NO: 981419 - RNA, 22 nt, Human
aagccuacugcucaugaccugu

SEQ ID NO: 981420 - RNA, 18 nt, Human
aaggagccaaaaugcggu

SEQ ID NO: 981421 - RNA, 18 nt, Human
aaggagccaaaaugcggu

SEQ ID NO: 981422 - RNA, 21 nt, Human
aauguuggauaacaagaaaga

SEQ ID NO: 981423 - RNA, 19 nt, Human
acacagagguguacauaua

SEQ ID NO: 981424 - RNA, 22 nt, Human
acacuguaacagauuaagagca

SEQ ID NO: 981425 - RNA, 20 nt, Human
acagaguucuccguaagcaa

SEQ ID NO: 981426 - RNA, 20 nt, Human
acagaguucuccguaagcaa

SEQ ID NO: 981427 - RNA, 25 nt, Human
acagcaccagagaacaaugugaugc

SEQ ID NO: 981428 - RNA, 25 nt, Human
acagcaccagagaacaaugugaugc

SEQ ID NO: 981429 - RNA, 25 nt, Human
acauugguaucucuccucaguugag

SEQ ID NO: 981430 - RNA, 18 nt, Human
acccugggcgccugggcc

SEQ ID NO: 981431 - RNA, 19 nt, Human
acccugggcgccugggccc

SEQ ID NO: 981432 - RNA, 19 nt, Human
acccugggcgccugggccc

SEQ ID NO: 981433 - RNA, 20 nt, Human
acuguauaaguucgcaaggc

SEQ ID NO: 981434 - RNA, 18 nt, Human
agaugugccaugcuuaug

SEQ ID NO: 981435 - RNA, 20 nt, Human
agccaaauuacagcaccaga

SEQ ID NO: 981436 - RNA, 20 nt, Human
agccaaauuacagcaccaga

SEQ ID NO: 981437 - RNA, 18 nt, Human
aggagcugggaggggaga

SEQ ID NO: 981438 - RNA, 21 nt, Human
aggagcugggaggggagaagg

SEQ ID NO: 981439 - RNA, 22 nt, Human
aggagcugggaggggagaagga

SEQ ID NO: 981440 - RNA, 22 nt, Human
aggaugcaggaagggcauggug

SEQ ID NO: 981441 - RNA, 22 nt, Human
aggaugcaggaagggcauggug

SEQ ID NO: 981442 - RNA, 19 nt, Human
aggcagaucagagaugguu

SEQ ID NO: 981443 - RNA, 26 nt, Human
aguaauaugcccuguccccugaaagg

SEQ ID NO: 981444 - RNA, 26 nt, Human
aguaauaugcccuguccccugaaagg

SEQ ID NO: 981445 - RNA, 18 nt, Human
auacccaugauuucagga

SEQ ID NO: 981446 - RNA, 18 nt, Human
auacccaugauuucagga

SEQ ID NO: 981447 - RNA, 20 nt, Human
augaaauacgggagagcuuc

SEQ ID NO: 981448 - RNA, 21 nt, Human
augaaauacgggagagcuuca

SEQ ID NO: 981449 - RNA, 21 nt, Human
augaaauacgggagagcuuca

SEQ ID NO: 981450 - RNA, 21 nt, Human
augaagaaaaaaggaagacaa

SEQ ID NO: 981451 - RNA, 23 nt, Human
augaccugugguuguuuuuaacu

SEQ ID NO: 981452 - RNA, 23 nt, Human
augcauuccugggcaggucggug

SEQ ID NO: 981453 - RNA, 23 nt, Human
augcauuccugggcaggucggug

SEQ ID NO: 981454 - RNA, 22 nt, Human
auggagcagcuggacauuagag

SEQ ID NO: 981455 - RNA, 22 nt, Human
auggagcagcuggacauuagag

SEQ ID NO: 981456 - RNA, 20 nt, Human
auuaucucugagcaucucgg

SEQ ID NO: 981457 - RNA, 20 nt, Human
auuaucucugagcaucucgg

SEQ ID NO: 981458 - RNA, 21 nt, Human
auuguuucuccugccuugagu

SEQ ID NO: 981459 - RNA, 23 nt, Human
caaacucauuuucccacuuccca

SEQ ID NO: 981460 - RNA, 23 nt, Human
caaacucauuuucccacuuccca

SEQ ID NO: 981461 - RNA, 19 nt, Human
caaauaaucuacacaaguc

SEQ ID NO: 981462 - RNA, 26 nt, Human
caacagccccuguaaguagcccuggc

SEQ ID NO: 981463 - RNA, 26 nt, Human
caacagccccuguaaguagcccuggc

SEQ ID NO: 981464 - RNA, 22 nt, Human
cacaacaacccugugagguagg

SEQ ID NO: 981465 - RNA, 22 nt, Human
cacaacaacccugugagguagg

SEQ ID NO: 981466 - RNA, 22 nt, Human
cacacacacacacagaggugua

SEQ ID NO: 981467 - RNA, 22 nt, Human
cacacacacacacagaggugua

SEQ ID NO: 981468 - RNA, 19 nt, Human
caccuucuauucguuucca

SEQ ID NO: 981469 - RNA, 25 nt, Human
cacuuccauucuaugaguauaucga

SEQ ID NO: 981470 - RNA, 22 nt, Human
cagaguucuccguaagcaaucc

SEQ ID NO: 981471 - RNA, 22 nt, Human
cagaguucuccguaagcaaucc

SEQ ID NO: 981472 - RNA, 22 nt, Human
cagcacagcuuuagcaaaaaua

SEQ ID NO: 981473 - RNA, 19 nt, Human
cagccugagcacaaccaug

SEQ ID NO: 981474 - RNA, 19 nt, Human
cagccugagcacaaccaug

SEQ ID NO: 981475 - RNA, 25 nt, Human
cagcuuuagcaaaaauacccaugau

SEQ ID NO: 981476 - RNA, 22 nt, Human
cagugcguggcucagccagaac

SEQ ID NO: 981477 - RNA, 20 nt, Human
caguggugaagaauuaccau

SEQ ID NO: 981478 - RNA, 22 nt, Human
cauggugaggagagaucagugg

SEQ ID NO: 981479 - RNA, 22 nt, Human
cauggugaggagagaucagugg

SEQ ID NO: 981480 - RNA, 26 nt, Human
caugucauaguauguaaguggcucuu

SEQ ID NO: 981481 - RNA, 24 nt, Human
cauucagccuagcuccugcagcca

SEQ ID NO: 981482 - RNA, 24 nt, Human
cauucagccuagcuccugcagcca

SEQ ID NO: 981483 - RNA, 22 nt, Human
ccaaaggagccaaaaugcggug

SEQ ID NO: 981484 - RNA, 22 nt, Human
ccagaacucaaaccuaggucuu

SEQ ID NO: 981485 - RNA, 18 nt, Human
ccaguacauugguaucuc

SEQ ID NO: 981486 - RNA, 25 nt, Human
cccaaguguaucuccuauauucugc

SEQ ID NO: 981487 - RNA, 24 nt, Human
ccccaacagccccuguaaguagcc

SEQ ID NO: 981488 - RNA, 24 nt, Human
ccccaacagccccuguaaguagcc

SEQ ID NO: 981489 - RNA, 19 nt, Human
cccgacccuccacuuggga

SEQ ID NO: 981490 - RNA, 19 nt, Human
cccgacccuccacuuggga

SEQ ID NO: 981491 - RNA, 18 nt, Human
ccgucucugugcagcugg

SEQ ID NO: 981492 - RNA, 21 nt, Human
ccuaggaauaacaauauucau

SEQ ID NO: 981493 - RNA, 21 nt, Human
ccuaggaauaacaauauucau

SEQ ID NO: 981494 - RNA, 19 nt, Human
ccuccaagccuucugcaua

SEQ ID NO: 981495 - RNA, 20 nt, Human
ccucccugucagccugagca

SEQ ID NO: 981496 - RNA, 20 nt, Human
ccucccugucagccugagca

SEQ ID NO: 981497 - RNA, 22 nt, Human
ccugcaggcaacucuuugguuu

SEQ ID NO: 981498 - RNA, 22 nt, Human
ccugcaggcaacucuuugguuu

SEQ ID NO: 981499 - RNA, 18 nt, Human
ccuguaaguagcccuggc

SEQ ID NO: 981500 - RNA, 18 nt, Human
ccuguaaguagcccuggc

SEQ ID NO: 981501 - RNA, 24 nt, Human
cgggagagcuucacauuacaccgu

SEQ ID NO: 981502 - RNA, 24 nt, Human
cgggagagcuucacauuacaccgu

SEQ ID NO: 981503 - RNA, 25 nt, Human
cucaggcugcauaggaguucugcuc

SEQ ID NO: 981504 - RNA, 25 nt, Human
cucaggcugcauaggaguucugcuc

SEQ ID NO: 981505 - RNA, 19 nt, Human
cucauuuucccacuuccca

SEQ ID NO: 981506 - RNA, 21 nt, Human
cucuguuccucgaaggagaac

SEQ ID NO: 981507 - RNA, 18 nt, Human
cugagcacaaccaugagg

SEQ ID NO: 981508 - RNA, 23 nt, Human
cugaggaugcccaggguuggggg

SEQ ID NO: 981509 - RNA, 20 nt, Human
cuggaaaagaccaaguggug

SEQ ID NO: 981510 - RNA, 23 nt, Human
cuggccaaacagaaaggcuaagc

SEQ ID NO: 981511 - RNA, 23 nt, Human
cuggccaaacagaaaggcuaagc

SEQ ID NO: 981512 - RNA, 18 nt, Human
cuguagaagagcaaaauc

SEQ ID NO: 981513 - RNA, 18 nt, Human
cuguagaagagcaaaauc

SEQ ID NO: 981514 - RNA, 18 nt, Human
cugugguuguuuuuaacu

SEQ ID NO: 981515 - RNA, 19 nt, Human
cuguguaacagauugcugc

SEQ ID NO: 981516 - RNA, 19 nt, Human
cuguguaacagauugcugc

SEQ ID NO: 981517 - RNA, 20 nt, Human
cuucacauuacacagagacc

SEQ ID NO: 981518 - RNA, 20 nt, Human
cuucacauuacacagagacc

SEQ ID NO: 981519 - RNA, 24 nt, Human
cuucaugcugaggacuuuggugcu

SEQ ID NO: 981520 - RNA, 21 nt, Human
cuuccuuuucacucuuugccc

SEQ ID NO: 981521 - RNA, 21 nt, Human
cuuccuuuucacucuuugccc

SEQ ID NO: 981522 - RNA, 21 nt, Human
cuugacuucaaccccaacagc

SEQ ID NO: 981523 - RNA, 21 nt, Human
cuugacuucaaccccaacagc

SEQ ID NO: 981524 - RNA, 19 nt, Human
gaacaaaggaagcuccuuu

SEQ ID NO: 981525 - RNA, 19 nt, Human
gaacaaaggaagcuccuuu

SEQ ID NO: 981526 - RNA, 18 nt, Human
gaagaaaaaaggaagaca

SEQ ID NO: 981527 - RNA, 26 nt, Human
gaagcuuuuucauaugcaaaaugcuu

SEQ ID NO: 981528 - RNA, 26 nt, Human
gaagcuuuuucauaugcaaaaugcuu

SEQ ID NO: 981529 - RNA, 20 nt, Human
gacccugggcgccugggccu

SEQ ID NO: 981530 - RNA, 20 nt, Human
gacccugggcgccugggccu

SEQ ID NO: 981531 - RNA, 21 nt, Human
gacuguauaaguucgcaaggc

SEQ ID NO: 981532 - RNA, 21 nt, Human
gacuguauaaguucgcaaggc

SEQ ID NO: 981533 - RNA, 24 nt, Human
gagcacaaccaugagguuacacac

SEQ ID NO: 981534 - RNA, 24 nt, Human
gagcacaaccaugagguuacacac

SEQ ID NO: 981535 - RNA, 20 nt, Human
gagcugggaggggagaagga

SEQ ID NO: 981536 - RNA, 20 nt, Human
gcaauccugcagagccgccc

SEQ ID NO: 981537 - RNA, 20 nt, Human
gcaauccugcagagccgccc

SEQ ID NO: 981538 - RNA, 26 nt, Human
gcacagcuuuagcaaaaagggaacgc

SEQ ID NO: 981539 - RNA, 19 nt, Human
gcuuauauuaucucugagc

SEQ ID NO: 981540 - RNA, 19 nt, Human
gcuuauauuaucucugagc

SEQ ID NO: 981541 - RNA, 18 nt, Human
ggaacugccugcuacuac

SEQ ID NO: 981542 - RNA, 18 nt, Human
ggaacugccugcuacuac

SEQ ID NO: 981543 - RNA, 20 nt, Human
ggaagacaauuucaucuaca

SEQ ID NO: 981544 - RNA, 20 nt, Human
ggaagacaauuucaucuaca

SEQ ID NO: 981545 - RNA, 23 nt, Human
ggacaggaaaccgggagucggga

SEQ ID NO: 981546 - RNA, 19 nt, Human
ggagagcuucacauuacac

SEQ ID NO: 981547 - RNA, 27 nt, Human
ggaggccucugccccgacccuccacuu

SEQ ID NO: 981548 - RNA, 27 nt, Human
ggaggccucugccccgacccuccacuu

SEQ ID NO: 981549 - RNA, 19 nt, Human
ggcaccagagucccagcac

SEQ ID NO: 981550 - RNA, 19 nt, Human
gggagucgggaauccuggg

SEQ ID NO: 981551 - RNA, 21 nt, Human
gggagucgggaauccugggau

SEQ ID NO: 981552 - RNA, 18 nt, Human
gguaaagggauagaaaag

SEQ ID NO: 981553 - RNA, 18 nt, Human
guccuuucucuaacgggu

SEQ ID NO: 981554 - RNA, 18 nt, Human
gugggugguugggggaag

SEQ ID NO: 981555 - RNA, 18 nt, Human
gugggugguugggggaag

SEQ ID NO: 981556 - RNA, 23 nt, Human
guucugcucauccuccucucccc

SEQ ID NO: 981557 - RNA, 23 nt, Human
guucugcucauccuccucucccc

SEQ ID NO: 981558 - RNA, 21 nt, Human
uaaaagugccuucccauguac

SEQ ID NO: 981559 - RNA, 22 nt, Human
uaaauaaccuuucagcaucuac

SEQ ID NO: 981560 - RNA, 23 nt, Human
uaaauuguuucuccugccuugag

SEQ ID NO: 981561 - RNA, 23 nt, Human
uaacagauuaagagcaccuucua

SEQ ID NO: 981562 - RNA, 19 nt, Human
uaacugccaagccuacugc

SEQ ID NO: 981563 - RNA, 24 nt, Human
uaagcugaaugaagaaaaaaggaa

SEQ ID NO: 981564 - RNA, 24 nt, Human
uaagcugaaugaagaaaaaaggaa

SEQ ID NO: 981565 - RNA, 25 nt, Human
uaaguggcucuuuaccagucaccca

SEQ ID NO: 981566 - RNA, 29 nt, Human
uacacacacacacacagagguguacauag

SEQ ID NO: 981567 - RNA, 29 nt, Human
uacacacacacacacagagguguacauag

SEQ ID NO: 981568 - RNA, 23 nt, Human
uaccagucacccaaguguaucuc

SEQ ID NO: 981569 - RNA, 19 nt, Human
uacugcucaugaccugugg

SEQ ID NO: 981570 - RNA, 19 nt, Human
uacugcucaugaccugugg

SEQ ID NO: 981571 - RNA, 24 nt, Human
uaucagccgucucugugcagcugg

SEQ ID NO: 981572 - RNA, 20 nt, Human
uauuaggguaaauauaucac

SEQ ID NO: 981573 - RNA, 20 nt, Human
uauuaggguaaauauaucac

SEQ ID NO: 981574 - RNA, 25 nt, Human
uauucugcuccucugaaaagauuua

SEQ ID NO: 981575 - RNA, 23 nt, Human
ucaaagccugaggaugcccaggg

SEQ ID NO: 981576 - RNA, 23 nt, Human
ucaaauccuguguauucuccuca

SEQ ID NO: 981577 - RNA, 21 nt, Human
ucacaggugaaaaaggucuga

SEQ ID NO: 981578 - RNA, 18 nt, Human
ucacucuuugcccucccu

SEQ ID NO: 981579 - RNA, 18 nt, Human
ucacucuuugcccucccu

SEQ ID NO: 981580 - RNA, 24 nt, Human
ucccugaccucaaagguaaaggga

SEQ ID NO: 981581 - RNA, 26 nt, Human
ucccugggaggcauucagccuagcuc

SEQ ID NO: 981582 - RNA, 26 nt, Human
ucccugggaggcauucagccuagcuc

SEQ ID NO: 981583 - RNA, 21 nt, Human
ucgcaggcgccaggagcuggg

SEQ ID NO: 981584 - RNA, 19 nt, Human
ucuacaguuguccuuuuug

SEQ ID NO: 981585 - RNA, 19 nt, Human
ucuacaguuguccuuuuug

SEQ ID NO: 981586 - RNA, 18 nt, Human
ucucuaacggguauggaa

SEQ ID NO: 981587 - RNA, 19 nt, Human
ucucugagcaucucggugg

SEQ ID NO: 981588 - RNA, 19 nt, Human
ucucugagcaucucggugg

SEQ ID NO: 981589 - RNA, 24 nt, Human
ucucugugcagcugggauaagggu

SEQ ID NO: 981590 - RNA, 24 nt, Human
ucugaaacaguccuugucuucaac

SEQ ID NO: 981591 - RNA, 24 nt, Human
ucugaaacaguccuugucuucaac

SEQ ID NO: 981592 - RNA, 22 nt, Human
ucugcucauccuccucucccca

SEQ ID NO: 981593 - RNA, 21 nt, Human
ucuucuggaggcuguuucugg

SEQ ID NO: 981594 - RNA, 21 nt, Human
ucuucuggaggcuguuucugg

SEQ ID NO: 981595 - RNA, 21 nt, Human
ugaagcaauguuggauaacaa

SEQ ID NO: 981596 - RNA, 21 nt, Human
ugaagcaauguuggauaacaa

SEQ ID NO: 981597 - RNA, 19 nt, Human
ugacuucaaccccaacagg

SEQ ID NO: 981598 - RNA, 19 nt, Human
ugacuucaaccccaacagg

SEQ ID NO: 981599 - RNA, 22 nt, Human
ugagaauggcuaucauugcugu

SEQ ID NO: 981600 - RNA, 22 nt, Human
ugagaauggcuaucauugcugu

SEQ ID NO: 981601 - RNA, 18 nt, Human
ugauuggcagguauaggg

SEQ ID NO: 981602 - RNA, 23 nt, Human
ugcaaaaugcuuuagcauauaug

SEQ ID NO: 981603 - RNA, 23 nt, Human
ugcaaaaugcuuuagcauauaug

SEQ ID NO: 981604 - RNA, 19 nt, Human
ugcagccaaauuacagcac

SEQ ID NO: 981605 - RNA, 19 nt, Human
ugcagccaaauuacagcac

SEQ ID NO: 981606 - RNA, 24 nt, Human
ugccccgacccuccacuugggaac

SEQ ID NO: 981607 - RNA, 24 nt, Human
ugccccgacccuccacuugggaac

SEQ ID NO: 981608 - RNA, 25 nt, Human
ugccuugagugccuguuuaaauaac

SEQ ID NO: 981609 - RNA, 27 nt, Human
ugcugcucucuguuccucccaucagug

SEQ ID NO: 981610 - RNA, 22 nt, Human
uggaggccucugccccgacccu

SEQ ID NO: 981611 - RNA, 22 nt, Human
uggaggccucugccccgacccu

SEQ ID NO: 981612 - RNA, 23 nt, Human
uggcuuauauuaucucugagcau

SEQ ID NO: 981613 - RNA, 24 nt, Human
ugggacccugggcgccugggccuu

SEQ ID NO: 981614 - RNA, 24 nt, Human
ugggacccugggcgccugggccuu

SEQ ID NO: 981615 - RNA, 20 nt, Human
ugggaggggagaaggacagg

SEQ ID NO: 981616 - RNA, 21 nt, Human
ugggaggggagaaggacagga

SEQ ID NO: 981617 - RNA, 21 nt, Human
uggguaaacagaaacaugaug

SEQ ID NO: 981618 - RNA, 18 nt, Human
uggguuagaaaacuggag

SEQ ID NO: 981619 - RNA, 18 nt, Human
uggguuagaaaacuggag

SEQ ID NO: 981620 - RNA, 18 nt, Human
ugguuucauuuucucugu

SEQ ID NO: 981621 - RNA, 21 nt, Human
uguaaguggcucuuuaccagu

SEQ ID NO: 981622 - RNA, 24 nt, Human
uguagaagagcaaaauccugcugg

SEQ ID NO: 981623 - RNA, 24 nt, Human
uguagaagagcaaaauccugcugg

SEQ ID NO: 981624 - RNA, 18 nt, Human
uguaucuccuauauucug

SEQ ID NO: 981625 - RNA, 19 nt, Human
uguccuuucucuaacgggu

SEQ ID NO: 981626 - RNA, 18 nt, Human
ugucugaaggacguaaaa

SEQ ID NO: 981627 - RNA, 18 nt, Human
uuagcaaaaauacccaug

SEQ ID NO: 981628 - RNA, 18 nt, Human
uuagcaaaaauacccaug

SEQ ID NO: 981629 - RNA, 19 nt, Human
uucauuguuuaauucuaaa

SEQ ID NO: 981630 - RNA, 22 nt, Human
uuccacagcucuaugaauugcu

SEQ ID NO: 981631 - RNA, 23 nt, Human
uuccagugcugaagaugaaagaa

SEQ ID NO: 981632 - RNA, 23 nt, Human
uucugcucauccuccucucccca

SEQ ID NO: 981633 - RNA, 23 nt, Human
uucugcucauccuccucucccca

SEQ ID NO: 981634 - RNA, 20 nt, Human
uugguggaggccucugcccc

SEQ ID NO: 981635 - RNA, 24 nt, Human
uuuaaauaaccuuucagcaucuac

SEQ ID NO: 981636 - RNA, 24 nt, Human
uuucucuguuccucgaaggagaac

SEQ ID NO: 981637 - RNA, 25 nt, Human
uuucugagguuuuuauuuaaaugca

SEQ ID NO: 981638 - RNA, 25 nt, Human
uuucugagguuuuuauuuaaaugca

SEQ ID NO: 981639 - RNA, 24 nt, Human
caagcaauaaaaguggucuccucc

SEQ ID NO: 981640 - RNA, 19 nt, Human
ccauccacccagacaagca

SEQ ID NO: 981641 - RNA, 22 nt, Human
cccauccacccagacaagcaau

SEQ ID NO: 981642 - RNA, 21 nt, Human
ccccauccacccagacaagca

SEQ ID NO: 981643 - RNA, 27 nt, Human
cccucagccccuccugccccauccacc

SEQ ID NO: 981644 - RNA, 19 nt, Human
cccugugcaugcuucugcu

SEQ ID NO: 981645 - RNA, 18 nt, Human
ccuccugccccauccacc

SEQ ID NO: 981646 - RNA, 23 nt, Human
ccuccugccccauccacccagac

SEQ ID NO: 981647 - RNA, 25 nt, Human
ccuccugccccauccacccagacaa

SEQ ID NO: 981648 - RNA, 18 nt, Human
gcuuucagccccagccuc

SEQ ID NO: 981649 - RNA, 20 nt, Human
uucugcuuucagccccagcc

SEQ ID NO: 981650 - RNA, 19 nt, Human
aaaggaagaagagccaaag

SEQ ID NO: 981651 - RNA, 19 nt, Human
acagaaacaacccccagau

SEQ ID NO: 981652 - RNA, 21 nt, Human
acagaaacaacccccagauca

SEQ ID NO: 981653 - RNA, 21 nt, Human
acccacagaaacaacccccag

SEQ ID NO: 981654 - RNA, 22 nt, Human
agaaacaacccccagaucagcc

SEQ ID NO: 981655 - RNA, 18 nt, Human
agagccaaagggucagag

SEQ ID NO: 981656 - RNA, 24 nt, Human
agaguacaaaggaagaagagccaa

SEQ ID NO: 981657 - RNA, 23 nt, Human
aucccuuccuuuccuuuuuccua

SEQ ID NO: 981658 - RNA, 22 nt, Human
caacccccagaucagccagaga

SEQ ID NO: 981659 - RNA, 24 nt, Human
caacccccagaucagccagagaga

SEQ ID NO: 981660 - RNA, 19 nt, Human
cacagaaacaacccccaga

SEQ ID NO: 981661 - RNA, 23 nt, Human
cacccacagaaacaacccccaga

SEQ ID NO: 981662 - RNA, 26 nt, Human
cagugaauucuuucucauuucacugu

SEQ ID NO: 981663 - RNA, 19 nt, Human
caguuacccaucauguagg

SEQ ID NO: 981664 - RNA, 18 nt, Human
caucauguagggcagaau

SEQ ID NO: 981665 - RNA, 23 nt, Human
caucauguagggcagaauggagc

SEQ ID NO: 981666 - RNA, 19 nt, Human
ccacagaaacaacccccag

SEQ ID NO: 981667 - RNA, 20 nt, Human
ccagagagaugagguauggc

SEQ ID NO: 981668 - RNA, 19 nt, Human
ccagugaauucuuucucau

SEQ ID NO: 981669 - RNA, 21 nt, Human
ccagugaauucuuucucauuu

SEQ ID NO: 981670 - RNA, 18 nt, Human
cccuuccuuuccuuuuuc

SEQ ID NO: 981671 - RNA, 19 nt, Human
ccuagaucgaaccaggaga

SEQ ID NO: 981672 - RNA, 20 nt, Human
ccugugucaggcacugggcu

SEQ ID NO: 981673 - RNA, 18 nt, Human
cucugugccaagcaccug

SEQ ID NO: 981674 - RNA, 20 nt, Human
cucugugccaagcaccuguc

SEQ ID NO: 981675 - RNA, 20 nt, Human
cugagugcuuaaaggacuuu

SEQ ID NO: 981676 - RNA, 19 nt, Human
cuucucugugccaagcacc

SEQ ID NO: 981677 - RNA, 24 nt, Human
gagcaggugccagcugaagaguac

SEQ ID NO: 981678 - RNA, 18 nt, Human
gaucacaguuacccauca

SEQ ID NO: 981679 - RNA, 26 nt, Human
guuugauaaacucccagugaauucuu

SEQ ID NO: 981680 - RNA, 22 nt, Human
uacccaucauguagggcagaau

SEQ ID NO: 981681 - RNA, 24 nt, Human
ucccuuccuuuccuuuuuccuaga

SEQ ID NO: 981682 - RNA, 22 nt, Human
ucugugccaagcaccugucagg

SEQ ID NO: 981683 - RNA, 20 nt, Human
ugauggcuggcaucucccgu

SEQ ID NO: 981684 - RNA, 18 nt, Human
ugcacaguuccuguguca

SEQ ID NO: 981685 - RNA, 21 nt, Human
uucacuguuuacuuuuaaauc

SEQ ID NO: 981686 - RNA, 18 nt, Human
uugcuccuucucugugcc

SEQ ID NO: 981687 - RNA, 18 nt, Human
uuuuuuuuuuuuuuuuug

SEQ ID NO: 981688 - RNA, 24 nt, Human
uuuuuuuuuuuuuuuuuugacuuu

SEQ ID NO: 981689 - RNA, 22 nt, Human
acaaaaucaaauacacagaucc

SEQ ID NO: 981690 - RNA, 20 nt, Human
acacagauccagcagaucca

SEQ ID NO: 981691 - RNA, 19 nt, Human
acagagcacuuccaaguca

SEQ ID NO: 981692 - RNA, 25 nt, Human
acagauccagcagauccagauaugu

SEQ ID NO: 981693 - RNA, 25 nt, Human
accaaaaugcaagaacacauucuuu

SEQ ID NO: 981694 - RNA, 21 nt, Human
accacaggacacuaagccuca

SEQ ID NO: 981695 - RNA, 18 nt, Human
accuccuagaaacuggag

SEQ ID NO: 981696 - RNA, 20 nt, Human
agagcacuuccaagucauau

SEQ ID NO: 981697 - RNA, 20 nt, Human
agcagauccagauaugugaa

SEQ ID NO: 981698 - RNA, 23 nt, Human
agcagauccagauaugugaacca

SEQ ID NO: 981699 - RNA, 21 nt, Human
aggggcuuuauuuuguuuagu

SEQ ID NO: 981700 - RNA, 23 nt, Human
auauauacauaucuauacaacca

SEQ ID NO: 981701 - RNA, 25 nt, Human
caacagcaacacaaaauguacucaa

SEQ ID NO: 981702 - RNA, 21 nt, Human
caacauaucucuuaaguaggu

SEQ ID NO: 981703 - RNA, 20 nt, Human
caagaacacauucuuuagga

SEQ ID NO: 981704 - RNA, 22 nt, Human
cacagauccagcagauccagau

SEQ ID NO: 981705 - RNA, 21 nt, Human
cacaggacacuaagccucagg

SEQ ID NO: 981706 - RNA, 25 nt, Human
cacuucagccuugaaauguggaccc

SEQ ID NO: 981707 - RNA, 18 nt, Human
cagauccagcagauccag

SEQ ID NO: 981708 - RNA, 21 nt, Human
cauucuuuaggagaaaggcag

SEQ ID NO: 981709 - RNA, 18 nt, Human
gucacauuuaaaguacaa

SEQ ID NO: 981710 - RNA, 26 nt, Human
uaaaugcaaagaggggcuuuauuuug

SEQ ID NO: 981711 - RNA, 19 nt, Human
uaaccgaagaaacugccaa

SEQ ID NO: 981712 - RNA, 23 nt, Human
uaagccucagguaccuaaauauc

SEQ ID NO: 981713 - RNA, 24 nt, Human
uaaguuaaaacagcuucuuuguuc

SEQ ID NO: 981714 - RNA, 19 nt, Human
uacacagauccagcagauc

SEQ ID NO: 981715 - RNA, 20 nt, Human
uaggaauaauuaaccgaaga

SEQ ID NO: 981716 - RNA, 19 nt, Human
uaggaugucaucuaucuua

SEQ ID NO: 981717 - RNA, 21 nt, Human
uagguuauuucaaccaaaaug

SEQ ID NO: 981718 - RNA, 22 nt, Human
uaucgaauguaaauuauuuuca

SEQ ID NO: 981719 - RNA, 18 nt, Human
uaugugaaccauauauac

SEQ ID NO: 981720 - RNA, 24 nt, Human
ucaaauacacagauccagcagauc

SEQ ID NO: 981721 - RNA, 22 nt, Human
ucaaugaauucggugagggucc

SEQ ID NO: 981722 - RNA, 23 nt, Human
ucaucuaucuuacaugcagaccc

SEQ ID NO: 981723 - RNA, 22 nt, Human
uccuagaaacuggagaauuacc

SEQ ID NO: 981724 - RNA, 21 nt, Human
ucucaggggcuaccuaucgcu

SEQ ID NO: 981725 - RNA, 19 nt, Human
ugaaacgguagaaauaggu

SEQ ID NO: 981726 - RNA, 21 nt, Human
ugaaacgguagaaauagguac

SEQ ID NO: 981727 - RNA, 25 nt, Human
ugagggucccacacccucaaauccu

SEQ ID NO: 981728 - RNA, 25 nt, Human
ugcaagaacacauucuuuaggagaa

SEQ ID NO: 981729 - RNA, 23 nt, Human
ugcucccacaacugggaacacau

SEQ ID NO: 981730 - RNA, 20 nt, Human
ugugaaccauauauacauaa

SEQ ID NO: 981731 - RNA, 20 nt, Human
uuauauauacacuauacacu

SEQ ID NO: 981732 - RNA, 21 nt, Human
uugaaauguggacccaaaaaa

SEQ ID NO: 981733 - RNA, 23 nt, Human
uuuccuguggaguuauagugaua

SEQ ID NO: 981734 - RNA, 19 nt, Human
aaaaaaagacugugacaga

SEQ ID NO: 981735 - RNA, 22 nt, Human
aaaaaaggugucagaccucuga

SEQ ID NO: 981736 - RNA, 19 nt, Human
aaaaaggugucagaccucu

SEQ ID NO: 981737 - RNA, 19 nt, Human
aaacguuugcccugccucc

SEQ ID NO: 981738 - RNA, 23 nt, Human
aacaaacauuuaucaaaugccag

SEQ ID NO: 981739 - RNA, 19 nt, Human
aacacggugaaaccucauc

SEQ ID NO: 981740 - RNA, 20 nt, Human
aacacggugaaaccucaucu

SEQ ID NO: 981741 - RNA, 21 nt, Human
aacacggugaaaccucaucuc

SEQ ID NO: 981742 - RNA, 21 nt, Human
aacaucuaaauccucacaucu

SEQ ID NO: 981743 - RNA, 19 nt, Human
aacccugggggugggcuga

SEQ ID NO: 981744 - RNA, 25 nt, Human
aagauacuaauccucacaucauuug

SEQ ID NO: 981745 - RNA, 25 nt, Human
aagcaaaaaaggugucagaccucug

SEQ ID NO: 981746 - RNA, 22 nt, Human
aagcaaaugcaacaaaugaaau

SEQ ID NO: 981747 - RNA, 24 nt, Human
aaggaaagaaacaauugaaaauau

SEQ ID NO: 981748 - RNA, 19 nt, Human
aaggagcacgaagaacagg

SEQ ID NO: 981749 - RNA, 18 nt, Human
aaggaugaggagagaugg

SEQ ID NO: 981750 - RNA, 22 nt, Human
aaucaauuuuuaaggaaacaga

SEQ ID NO: 981751 - RNA, 18 nt, Human
aaucgcuugaaccuggga

SEQ ID NO: 981752 - RNA, 24 nt, Human
aaucgcuugaaccugggaggcaga

SEQ ID NO: 981753 - RNA, 24 nt, Human
acagagcaagacuccaucucaaaa

SEQ ID NO: 981754 - RNA, 18 nt, Human
accaaggcaugaagcaac

SEQ ID NO: 981755 - RNA, 19 nt, Human
accauugcacuccagccug

SEQ ID NO: 981756 - RNA, 24 nt, Human
accucaucucuacuaaaaaugcaa

SEQ ID NO: 981757 - RNA, 24 nt, Human
accucgagaggccugaggcaagga

SEQ ID NO: 981758 - RNA, 25 nt, Human
acgaagaacaggcacggagcccaag

SEQ ID NO: 981759 - RNA, 18 nt, Human
acggagcccaaggaaugc

SEQ ID NO: 981760 - RNA, 23 nt, Human
acuaaauacagagcuaggcccag

SEQ ID NO: 981761 - RNA, 18 nt, Human
acugccuaaucgccacuu

SEQ ID NO: 981762 - RNA, 20 nt, Human
agaccaggugaaucucaagg

SEQ ID NO: 981763 - RNA, 18 nt, Human
agagguugcagugagucg

SEQ ID NO: 981764 - RNA, 24 nt, Human
agagguugcagugagucgaaauug

SEQ ID NO: 981765 - RNA, 20 nt, Human
agaucacuugaggucaggaa

SEQ ID NO: 981766 - RNA, 22 nt, Human
agaucacuugaggucaggaguu

SEQ ID NO: 981767 - RNA, 22 nt, Human
agccggaagacggggaggucug

SEQ ID NO: 981768 - RNA, 24 nt, Human
agccuaugacauaauuccagacca

SEQ ID NO: 981769 - RNA, 23 nt, Human
agccuggccaacacggugaaacc

SEQ ID NO: 981770 - RNA, 24 nt, Human
agccugggugacagagcaagacuc

SEQ ID NO: 981771 - RNA, 20 nt, Human
aggaaagaaacaauugaaaa

SEQ ID NO: 981772 - RNA, 22 nt, Human
aggaguuuugagaccagccugg

SEQ ID NO: 981773 - RNA, 19 nt, Human
aggcagagguugcagugag

SEQ ID NO: 981774 - RNA, 22 nt, Human
aggcagagguugcagugagucg

SEQ ID NO: 981775 - RNA, 22 nt, Human
aggcaggagaaucgcuugaacc

SEQ ID NO: 981776 - RNA, 24 nt, Human
aggcaggagaaucgcuugaaccug

SEQ ID NO: 981777 - RNA, 25 nt, Human
aggcgccaaucacaggguccugagg

SEQ ID NO: 981778 - RNA, 22 nt, Human
aggcgggcagaucacuugaggu

SEQ ID NO: 981779 - RNA, 23 nt, Human
aggcgggcagaucacuugagguc

SEQ ID NO: 981780 - RNA, 26 nt, Human
aggcgggcagaucacuugaggucagg

SEQ ID NO: 981781 - RNA, 24 nt, Human
aggugcaguggcucacgccuguaa

SEQ ID NO: 981782 - RNA, 24 nt, Human
aguggcucacgccuguaaucccag

SEQ ID NO: 981783 - RNA, 23 nt, Human
auaguuaagacaacaauugggga

SEQ ID NO: 981784 - RNA, 22 nt, Human
aucuaaauccucacaucucuac

SEQ ID NO: 981785 - RNA, 24 nt, Human
augucucuucaaguucaacaaaca

SEQ ID NO: 981786 - RNA, 19 nt, Human
auuccuugcacaggaccua

SEQ ID NO: 981787 - RNA, 24 nt, Human
auugcaccauugcacuccagccug

SEQ ID NO: 981788 - RNA, 21 nt, Human
auugcacuccagccuggguga

SEQ ID NO: 981789 - RNA, 24 nt, Human
auugcacuccagccugggugacag

SEQ ID NO: 981790 - RNA, 27 nt, Human
caaaugcaacaaaugaaauaugcacaa

SEQ ID NO: 981791 - RNA, 18 nt, Human
cacaaggcuguccuugga

SEQ ID NO: 981792 - RNA, 24 nt, Human
cacgccuguaaucccagcacuuug

SEQ ID NO: 981793 - RNA, 22 nt, Human
cacuccagccugggugacagag

SEQ ID NO: 981794 - RNA, 23 nt, Human
cacuccagccugggugacagagc

SEQ ID NO: 981795 - RNA, 20 nt, Human
cacuugaggucaggaguuuu

SEQ ID NO: 981796 - RNA, 24 nt, Human
cagaucacuugaggucaggaguuu

SEQ ID NO: 981797 - RNA, 22 nt, Human
cagcacuuugggagcccgaggc

SEQ ID NO: 981798 - RNA, 24 nt, Human
cagcacuuugggagcccgaggcgg

SEQ ID NO: 981799 - RNA, 18 nt, Human
caggcacggagcccaagg

SEQ ID NO: 981800 - RNA, 24 nt, Human
caggcacggagcccaaggaaugcc

SEQ ID NO: 981801 - RNA, 22 nt, Human
caucagaaaaucaaacuucagc

SEQ ID NO: 981802 - RNA, 19 nt, Human
cauccaucaccaaggcaug

SEQ ID NO: 981803 - RNA, 19 nt, Human
cauugcacuccagccuggg

SEQ ID NO: 981804 - RNA, 21 nt, Human
cauugcacuccagccugggug

SEQ ID NO: 981805 - RNA, 22 nt, Human
cauugcacuccagccuggguga

SEQ ID NO: 981806 - RNA, 20 nt, Human
cauuuaucaaaugccaggca

SEQ ID NO: 981807 - RNA, 19 nt, Human
cauuucauacauaacagcc

SEQ ID NO: 981808 - RNA, 20 nt, Human
ccagaccaggugaaucucaa

SEQ ID NO: 981809 - RNA, 20 nt, Human
ccauugcacuccagccuggg

SEQ ID NO: 981810 - RNA, 21 nt, Human
ccauugcacuccagccugggu

SEQ ID NO: 981811 - RNA, 21 nt, Human
ccauugcacuccagccugggu

SEQ ID NO: 981812 - RNA, 22 nt, Human
ccauugcacuccagccugggug

SEQ ID NO: 981813 - RNA, 23 nt, Human
ccauugcacuccagccuggguga

SEQ ID NO: 981814 - RNA, 23 nt, Human
ccauugcacuccagccuggguga

SEQ ID NO: 981815 - RNA, 24 nt, Human
ccauugcacuccagccugggugac

SEQ ID NO: 981816 - RNA, 25 nt, Human
ccauugcacuccagccugggugaca

SEQ ID NO: 981817 - RNA, 26 nt, Human
ccauugcacuccagccugggugacag

SEQ ID NO: 981818 - RNA, 21 nt, Human
ccgagacaaggagguaccaca

SEQ ID NO: 981819 - RNA, 22 nt, Human
ccucggucacgguccgccggcg

SEQ ID NO: 981820 - RNA, 24 nt, Human
ccuggccaacacggugaaaccuca

SEQ ID NO: 981821 - RNA, 25 nt, Human
ccugggaggcagagguugcagugag

SEQ ID NO: 981822 - RNA, 22 nt, Human
ccugggugacagagcaagacuc

SEQ ID NO: 981823 - RNA, 23 nt, Human
cgaaaggagcacgaagaacaggc

SEQ ID NO: 981824 - RNA, 20 nt, Human
cgagcagaaauaacaaaggc

SEQ ID NO: 981825 - RNA, 24 nt, Human
cgaggcgggcagaucacuugaggu

SEQ ID NO: 981826 - RNA, 26 nt, Human
cgaggcgggcagaucacuugagguca

SEQ ID NO: 981827 - RNA, 23 nt, Human
cgccuguaaucccagcacuuugg

SEQ ID NO: 981828 - RNA, 24 nt, Human
cgccuguaaucccagcacuuuggg

SEQ ID NO: 981829 - RNA, 18 nt, Human
cggaagacggggaggucu

SEQ ID NO: 981830 - RNA, 24 nt, Human
cgggcagaucacuugaggucagga

SEQ ID NO: 981831 - RNA, 22 nt, Human
cucacgccuguaaucccagcac

SEQ ID NO: 981832 - RNA, 24 nt, Human
cucacgccuguaaucccagcacuu

SEQ ID NO: 981833 - RNA, 22 nt, Human
cugcaacagaggccaggugcag

SEQ ID NO: 981834 - RNA, 23 nt, Human
cuggccaacacggugaaaccuca

SEQ ID NO: 981835 - RNA, 22 nt, Human
gaaagaaacaauugaaaauaug

SEQ ID NO: 981836 - RNA, 20 nt, Human
gaaauaacaaaggcaaaagg

SEQ ID NO: 981837 - RNA, 22 nt, Human
gaacuaaauucccauacggcca

SEQ ID NO: 981838 - RNA, 19 nt, Human
gaagaacaggcacggagcc

SEQ ID NO: 981839 - RNA, 23 nt, Human
gaagaacaggcacggagcccaag

SEQ ID NO: 981840 - RNA, 23 nt, Human
gagaaucgcuugaaccugggagg

SEQ ID NO: 981841 - RNA, 22 nt, Human
gaucacuugaggucaggaguuu

SEQ ID NO: 981842 - RNA, 24 nt, Human
gaucacuugaggucaggaguuuug

SEQ ID NO: 981843 - RNA, 25 nt, Human
gaucacuugaggucaggaguuuuga

SEQ ID NO: 981844 - RNA, 18 nt, Human
gcaaacagcuucacuucu

SEQ ID NO: 981845 - RNA, 24 nt, Human
gcacuccagccugggugacagagc

SEQ ID NO: 981846 - RNA, 22 nt, Human
gcacuuugggagcccgaggcgg

SEQ ID NO: 981847 - RNA, 23 nt, Human
gcagaucacuugaggucaggagu

SEQ ID NO: 981848 - RNA, 21 nt, Human
gcauuaaaggaguggucuaaa

SEQ ID NO: 981849 - RNA, 19 nt, Human
gccacuuucauuauaaaca

SEQ ID NO: 981850 - RNA, 18 nt, Human
gcccaguuuguauuguac

SEQ ID NO: 981851 - RNA, 21 nt, Human
gcccugccuccacauuuuaca

SEQ ID NO: 981852 - RNA, 19 nt, Human
gcuccaaaaggguaaggaa

SEQ ID NO: 981853 - RNA, 21 nt, Human
gcuccaaaaggguaaggaaga

SEQ ID NO: 981854 - RNA, 20 nt, Human
ggacagugcuuuggucugau

SEQ ID NO: 981855 - RNA, 21 nt, Human
ggaccuagcaaauaauuggua

SEQ ID NO: 981856 - RNA, 23 nt, Human
ggagaacauucgcaaaacucaag

SEQ ID NO: 981857 - RNA, 25 nt, Human
ggcagaucacuugaggucaggaguu

SEQ ID NO: 981858 - RNA, 20 nt, Human
gggaaccacuggucucaaaa

SEQ ID NO: 981859 - RNA, 24 nt, Human
gguggcaugugcguguaaucccag

SEQ ID NO: 981860 - RNA, 19 nt, Human
gucagaccucugaucuuau

SEQ ID NO: 981861 - RNA, 23 nt, Human
guccguggauuugggucagaggc

SEQ ID NO: 981862 - RNA, 20 nt, Human
guggaaaacuauaaaaacug

SEQ ID NO: 981863 - RNA, 20 nt, Human
guguuuagcuauuuccuguu

SEQ ID NO: 981864 - RNA, 21 nt, Human
uaacaugucuagucauaguua

SEQ ID NO: 981865 - RNA, 23 nt, Human
uaaccuaugaacucagaaacccu

SEQ ID NO: 981866 - RNA, 19 nt, Human
uaagaacaggagucaaauc

SEQ ID NO: 981867 - RNA, 21 nt, Human
uaagacugcaacagaggccag

SEQ ID NO: 981868 - RNA, 20 nt, Human
uacaguaucuuaaaacagua

SEQ ID NO: 981869 - RNA, 22 nt, Human
uagcugggugugguggcaugug

SEQ ID NO: 981870 - RNA, 18 nt, Human
uauguuuuaaaggcugcc

SEQ ID NO: 981871 - RNA, 22 nt, Human
uauuaguaauggguucccaaug

SEQ ID NO: 981872 - RNA, 21 nt, Human
uauuuuggucugcauuaaagg

SEQ ID NO: 981873 - RNA, 18 nt, Human
ucacaucauuugccuucu

SEQ ID NO: 981874 - RNA, 23 nt, Human
ucaggacaugauguaaaguugaa

SEQ ID NO: 981875 - RNA, 19 nt, Human
ucagguggcugaggcagga

SEQ ID NO: 981876 - RNA, 24 nt, Human
uccagccugggugacagagcaaga

SEQ ID NO: 981877 - RNA, 21 nt, Human
uccaucaccaaggcaugaagc

SEQ ID NO: 981878 - RNA, 18 nt, Human
ucccaaugaccugagcca

SEQ ID NO: 981879 - RNA, 25 nt, Human
ucccauacggccacuuuauggaaac

SEQ ID NO: 981880 - RNA, 25 nt, Human
uccgagcagaaauaacaaaggcaaa

SEQ ID NO: 981881 - RNA, 27 nt, Human
uccgagcagaaauaacaaagggaguuc

SEQ ID NO: 981882 - RNA, 18 nt, Human
ucgcuugaaccugggagg

SEQ ID NO: 981883 - RNA, 23 nt, Human
ucuagagaagaaaauaaauggau

SEQ ID NO: 981884 - RNA, 19 nt, Human
ucucaaaaauaaauaaaua

SEQ ID NO: 981885 - RNA, 21 nt, Human
ucucuacuaaaaaugcaaaaa

SEQ ID NO: 981886 - RNA, 22 nt, Human
ucugaucuuauaaauaagacac

SEQ ID NO: 981887 - RNA, 25 nt, Human
ucuggaauuaggaaaaaccgggguc

SEQ ID NO: 981888 - RNA, 19 nt, Human
ugaaaccucaucucuacua

SEQ ID NO: 981889 - RNA, 24 nt, Human
ugaaccugggaggcagagguugca

SEQ ID NO: 981890 - RNA, 22 nt, Human
ugaaggguggcuugguugugga

SEQ ID NO: 981891 - RNA, 23 nt, Human
ugaaucucaagauacuaauccuc

SEQ ID NO: 981892 - RNA, 22 nt, Human
ugaaugcuuuaucuuccuuaca

SEQ ID NO: 981893 - RNA, 21 nt, Human
ugacagaaaggguuuagagaa

SEQ ID NO: 981894 - RNA, 20 nt, Human
ugaccaagcaaaugcaacaa

SEQ ID NO: 981895 - RNA, 23 nt, Human
ugagaccagccuggccaacacgg

SEQ ID NO: 981896 - RNA, 24 nt, Human
ugagaccagccuggccaacacggu

SEQ ID NO: 981897 - RNA, 24 nt, Human
ugaggcaggagaaucgcuugaacc

SEQ ID NO: 981898 - RNA, 25 nt, Human
ugaggcaggagaaucgcuugaaccu

SEQ ID NO: 981899 - RNA, 24 nt, Human
ugagucaguacuccaacuuagugg

SEQ ID NO: 981900 - RNA, 18 nt, Human
ugauggaugaguaaccac

SEQ ID NO: 981901 - RNA, 31 nt, Human
ugcaacagaggccaggugcaguggcucacgg

SEQ ID NO: 981902 - RNA, 21 nt, Human
ugcaccauugcacuccagccu

SEQ ID NO: 981903 - RNA, 22 nt, Human
ugcacuccagccugggugacag

SEQ ID NO: 981904 - RNA, 24 nt, Human
ugcacuccagccugggugacagag

SEQ ID NO: 981905 - RNA, 25 nt, Human
ugcaucagaaaaucaaacuucagca

SEQ ID NO: 981906 - RNA, 22 nt, Human
ugcccaagucccuccagggguu

SEQ ID NO: 981907 - RNA, 20 nt, Human
ugcccgaaaggagcacgaag

SEQ ID NO: 981908 - RNA, 24 nt, Human
ugcguguaaucccagcuacucagg

SEQ ID NO: 981909 - RNA, 23 nt, Human
ugcuaaagaguuacaauuggcaa

SEQ ID NO: 981910 - RNA, 19 nt, Human
uggaaaacuauaaaaacug

SEQ ID NO: 981911 - RNA, 24 nt, Human
uggaugcaaaaguaaaaugcaacc

SEQ ID NO: 981912 - RNA, 22 nt, Human
uggcaugugcguguaaucccag

SEQ ID NO: 981913 - RNA, 22 nt, Human
uggcucacgccuguaaucccag

SEQ ID NO: 981914 - RNA, 24 nt, Human
uggcucacgccuguaaucccagca

SEQ ID NO: 981915 - RNA, 24 nt, Human
uggcugaggcaggagaaucgcuug

SEQ ID NO: 981916 - RNA, 24 nt, Human
ugggagcccgaggcgggcagauca

SEQ ID NO: 981917 - RNA, 24 nt, Human
ugggaggcagagguugcagugagu

SEQ ID NO: 981918 - RNA, 18 nt, Human
ugggugugguggcaugug

SEQ ID NO: 981919 - RNA, 24 nt, Human
ugguggcaugugcguguaauccca

SEQ ID NO: 981920 - RNA, 21 nt, Human
uguaaucccagcuacucaggu

SEQ ID NO: 981921 - RNA, 22 nt, Human
uguuuggugacguccaguuccu

SEQ ID NO: 981922 - RNA, 19 nt, Human
uuaauggacugcuguccuc

SEQ ID NO: 981923 - RNA, 19 nt, Human
uuagcugggugugguggca

SEQ ID NO: 981924 - RNA, 20 nt, Human
uuagcugggugugguggcau

SEQ ID NO: 981925 - RNA, 24 nt, Human
uuagcugggugugguggcaugugc

SEQ ID NO: 981926 - RNA, 22 nt, Human
uuagguauuaguaauggguucc

SEQ ID NO: 981927 - RNA, 19 nt, Human
uucaggacaugauguaaag

SEQ ID NO: 981928 - RNA, 22 nt, Human
uuccuuaugcuucaagcuccaa

SEQ ID NO: 981929 - RNA, 19 nt, Human
uucuccuguucaacagagg

SEQ ID NO: 981930 - RNA, 24 nt, Human
uugaaccugggaggcagagguugc

SEQ ID NO: 981931 - RNA, 23 nt, Human
uugcaccauugcacuccagccug

SEQ ID NO: 981932 - RNA, 22 nt, Human
uugcagugagucgaaauugcac

SEQ ID NO: 981933 - RNA, 19 nt, Human
uuucgcaaaguccguggau

SEQ ID NO: 981934 - RNA, 20 nt, Human
accucagcacccugagggcc

SEQ ID NO: 981935 - RNA, 18 nt, Human
agagacacaaccaccaug

SEQ ID NO: 981936 - RNA, 22 nt, Human
agcacccugagggccugaacuc

SEQ ID NO: 981937 - RNA, 20 nt, Human
auaaagagacacaaccacca

SEQ ID NO: 981938 - RNA, 19 nt, Human
caacggagcugcaauccua

SEQ ID NO: 981939 - RNA, 24 nt, Human
caacggagcugcaauccuaacccg

SEQ ID NO: 981940 - RNA, 20 nt, Human
cacaguauauaggccucuag

SEQ ID NO: 981941 - RNA, 18 nt, Human
cagaucacaucaaaaguu

SEQ ID NO: 981942 - RNA, 19 nt, Human
cagcaaaauaaucaagugc

SEQ ID NO: 981943 - RNA, 18 nt, Human
cagcacccugagggccug

SEQ ID NO: 981944 - RNA, 23 nt, Human
caggcauaaagagacacaaccac

SEQ ID NO: 981945 - RNA, 18 nt, Human
cauacaagcuaucacagu

SEQ ID NO: 981946 - RNA, 21 nt, Human
caucaaaaguuguuuuucccc

SEQ ID NO: 981947 - RNA, 28 nt, Human
ccgaccaucgaccuaguuuccccccaaa

SEQ ID NO: 981948 - RNA, 20 nt, Human
gcagguaaaucaaggaagaa

SEQ ID NO: 981949 - RNA, 25 nt, Human
gccucuagcucuaaauaauagaguu

SEQ ID NO: 981950 - RNA, 20 nt, Human
ggaaaaccucagcacccuga

SEQ ID NO: 981951 - RNA, 22 nt, Human
ggguggucgccgggggucgagg

SEQ ID NO: 981952 - RNA, 18 nt, Human
guaaauuuucuucagacu

SEQ ID NO: 981953 - RNA, 21 nt, Human
gucgccggggguucgggagcg

SEQ ID NO: 981954 - RNA, 23 nt, Human
gucuccgguguguuauucccgau

SEQ ID NO: 981955 - RNA, 21 nt, Human
guggucgccggggguucggga

SEQ ID NO: 981956 - RNA, 18 nt, Human
uaaaauaaccucaaaggc

SEQ ID NO: 981957 - RNA, 24 nt, Human
uagcucuaaauaauagaguuccuu

SEQ ID NO: 981958 - RNA, 18 nt, Human
ucaaaggcaauccucagc

SEQ ID NO: 981959 - RNA, 24 nt, Human
ucagcacccugagggccugaacuc

SEQ ID NO: 981960 - RNA, 23 nt, Human
uccagauuuguaaauuuucuuca

SEQ ID NO: 981961 - RNA, 22 nt, Human
ucccacaaaggaaaaccucagc

SEQ ID NO: 981962 - RNA, 21 nt, Human
ucugucacugcaaaaagggau

SEQ ID NO: 981963 - RNA, 24 nt, Human
ucuucugucacugcaaaaagggau

SEQ ID NO: 981964 - RNA, 24 nt, Human
ugauuaaaaaacaaaucagaucac

SEQ ID NO: 981965 - RNA, 22 nt, Human
ugcuguacaacucaaaacuuuu

SEQ ID NO: 981966 - RNA, 24 nt, Human
uucacaaugcagcaaaauaaucaa

SEQ ID NO: 981967 - RNA, 18 nt, Human
uuccccccaaaagucucc

SEQ ID NO: 981968 - RNA, 24 nt, Human
uucucccacaaaggaaaaccucag

SEQ ID NO: 981969 - RNA, 21 nt, Human
uuguuuuuccccauacaagcu

SEQ ID NO: 981970 - RNA, 18 nt, Human
aaaaguucugcuuauaag

SEQ ID NO: 981971 - RNA, 26 nt, Human
aaacaacauaggcaauacuuuugcac

SEQ ID NO: 981972 - RNA, 19 nt, Human
aaacagaaauccagcagag

SEQ ID NO: 981973 - RNA, 20 nt, Human
aaagccuuuugguauucacc

SEQ ID NO: 981974 - RNA, 21 nt, Human
aacaguacaauuaggacaauu

SEQ ID NO: 981975 - RNA, 23 nt, Human
aacugccccucaaugcacuugau

SEQ ID NO: 981976 - RNA, 30 nt, Human
aagcauuuaaauuuagaaugcuaaaaacag

SEQ ID NO: 981977 - RNA, 22 nt, Human
aaucuguacagaauuucacugu

SEQ ID NO: 981978 - RNA, 20 nt, Human
acaaagaaguacuccuuuca

SEQ ID NO: 981979 - RNA, 24 nt, Human
accuaugguuuuuggcuaccacag

SEQ ID NO: 981980 - RNA, 19 nt, Human
agaggaaauguacuguaac

SEQ ID NO: 981981 - RNA, 18 nt, Human
aggaaauguacuguaacc

SEQ ID NO: 981982 - RNA, 21 nt, Human
auccuuaacauuguuuucugg

SEQ ID NO: 981983 - RNA, 21 nt, Human
aucuguaccaaaugccucuuc

SEQ ID NO: 981984 - RNA, 24 nt, Human
augguggcuugccuucuuucuucu

SEQ ID NO: 981985 - RNA, 23 nt, Human
caaaucagaaaacaguacaauua

SEQ ID NO: 981986 - RNA, 18 nt, Human
caaucgccuuccccagca

SEQ ID NO: 981987 - RNA, 24 nt, Human
caggcaaacaaaacugccccucaa

SEQ ID NO: 981988 - RNA, 25 nt, Human
cagguuagaguaauauauaaaacag

SEQ ID NO: 981989 - RNA, 23 nt, Human
ccaacuaacagcgcauaaauaaa

SEQ ID NO: 981990 - RNA, 26 nt, Human
ccaaucgccuuccccagcaguucccc

SEQ ID NO: 981991 - RNA, 25 nt, Human
ccaucugaagauauucuuguauugc

SEQ ID NO: 981992 - RNA, 19 nt, Human
ccccagcaguucccccacc

SEQ ID NO: 981993 - RNA, 24 nt, Human
ccuuccccagcaguucccccacca

SEQ ID NO: 981994 - RNA, 26 nt, Human
cucagcaguucuaguuaaugcagugg

SEQ ID NO: 981995 - RNA, 18 nt, Human
cuuuugguauucacccau

SEQ ID NO: 981996 - RNA, 21 nt, Human
gaaaaaacuaaacaaacugcg

SEQ ID NO: 981997 - RNA, 20 nt, Human
gaaauaaucgauucaaaagc

SEQ ID NO: 981998 - RNA, 22 nt, Human
gaacaccucaaugucagaaaua

SEQ ID NO: 981999 - RNA, 18 nt, Human
gacaaaauacaguggcau

SEQ ID NO: 982000 - RNA, 19 nt, Human
gaugccaaucgccuucccc

SEQ ID NO: 982001 - RNA, 23 nt, Human
gauuucugacuaaaaacugaaag

SEQ ID NO: 982002 - RNA, 20 nt, Human
gcaaacaaaacugccccuca

SEQ ID NO: 982003 - RNA, 18 nt, Human
ggccucggaagggaugga

SEQ ID NO: 982004 - RNA, 22 nt, Human
uaaauacaaaucagaaaacagu

SEQ ID NO: 982005 - RNA, 24 nt, Human
uaaauguaagagaauucauaucug

SEQ ID NO: 982006 - RNA, 24 nt, Human
uaaccugaagacugcuugcaaaga

SEQ ID NO: 982007 - RNA, 24 nt, Human
uaagaaaaaacuaaacaaacugcg

SEQ ID NO: 982008 - RNA, 23 nt, Human
uaagaaaaacuguagcuuaucau

SEQ ID NO: 982009 - RNA, 20 nt, Human
uacaaaucagaaaacaguac

SEQ ID NO: 982010 - RNA, 18 nt, Human
uacaguggcauuacugga

SEQ ID NO: 982011 - RNA, 22 nt, Human
uaccucaagaacugagagacga

SEQ ID NO: 982012 - RNA, 19 nt, Human
uagaaaaugacuucaccac

SEQ ID NO: 982013 - RNA, 19 nt, Human
uagaaaaugacuucaccac

SEQ ID NO: 982014 - RNA, 22 nt, Human
uagaucccuauucccacacucu

SEQ ID NO: 982015 - RNA, 24 nt, Human
uaucccaucuaauuuacauacaga

SEQ ID NO: 982016 - RNA, 21 nt, Human
uauucccacacucuaauaagc

SEQ ID NO: 982017 - RNA, 19 nt, Human
uccccagcaguucccccac

SEQ ID NO: 982018 - RNA, 19 nt, Human
ucgaugccaaucgccuucc

SEQ ID NO: 982019 - RNA, 21 nt, Human
ucgaugccaaucgccuucccc

SEQ ID NO: 982020 - RNA, 22 nt, Human
ucuagcugccuaagccucgcaa

SEQ ID NO: 982021 - RNA, 22 nt, Human
ucuccacaauuacaauauuuaa

SEQ ID NO: 982022 - RNA, 24 nt, Human
ucugcaaacauacuacaauaagcu

SEQ ID NO: 982023 - RNA, 23 nt, Human
ugaaauaaucgauucaaaagcca

SEQ ID NO: 982024 - RNA, 20 nt, Human
ugacaauagauagauacaca

SEQ ID NO: 982025 - RNA, 21 nt, Human
ugagacugguuaccuucuggc

SEQ ID NO: 982026 - RNA, 24 nt, Human
ugcaaagacagauagauaaaacaa

SEQ ID NO: 982027 - RNA, 25 nt, Human
ugcaaagacagauagauaaaacaau

SEQ ID NO: 982028 - RNA, 23 nt, Human
ugcgcaauuauaaaaucagcacc

SEQ ID NO: 982029 - RNA, 22 nt, Human
uggcuugccuucuuuuggaagc

SEQ ID NO: 982030 - RNA, 18 nt, Human
uggggcgggggagaagca

SEQ ID NO: 982031 - RNA, 25 nt, Human
ugguaagcauaagcaugucauauuc

SEQ ID NO: 982032 - RNA, 24 nt, Human
uuuggagacaaaauacaguggcau

SEQ ID NO: 982033 - RNA, 26 nt, Human
uuuuauuuggagacaaaauacagugg

SEQ ID NO: 982034 - RNA, 22 nt, Human
uuuuuuuuuuuuaaaaaaaagc

SEQ ID NO: 982035 - RNA, 25 nt, Human
aaacaaugcccaacucuuuccccuc

SEQ ID NO: 982036 - RNA, 24 nt, Human
acuccaaacagaacaggaaaaagg

SEQ ID NO: 982037 - RNA, 21 nt, Human
agaacaggaaaaaggcaaggg

SEQ ID NO: 982038 - RNA, 20 nt, Human
agccucguguggccucaagc

SEQ ID NO: 982039 - RNA, 23 nt, Human
agcgcaaucccaacggcucgccc

SEQ ID NO: 982040 - RNA, 21 nt, Human
agguagggaguggagcugggg

SEQ ID NO: 982041 - RNA, 21 nt, Human
agguuagguuagaaaaacaau

SEQ ID NO: 982042 - RNA, 21 nt, Human
agguuuggaagugugcgagcu

SEQ ID NO: 982043 - RNA, 19 nt, Human
cagaagacacgcugugcgc

SEQ ID NO: 982044 - RNA, 21 nt, Human
ccagggcugaagccuggggga

SEQ ID NO: 982045 - RNA, 24 nt, Human
cgagguuuggaagugugcgagcug

SEQ ID NO: 982046 - RNA, 18 nt, Human
cguuugagucacgccgcu

SEQ ID NO: 982047 - RNA, 18 nt, Human
gacagggucucucggcuu

SEQ ID NO: 982048 - RNA, 27 nt, Human
gagguagggaguggagcuggggagggg

SEQ ID NO: 982049 - RNA, 21 nt, Human
ggaguggagcuggggaggggc

SEQ ID NO: 982050 - RNA, 18 nt, Human
gggaguggagcuggggag

SEQ ID NO: 982051 - RNA, 21 nt, Human
gggcuugggcacgcgggcggc

SEQ ID NO: 982052 - RNA, 19 nt, Human
gguagggaguggagcuggg

SEQ ID NO: 982053 - RNA, 23 nt, Human
gguagggaguggagcuggggagg

SEQ ID NO: 982054 - RNA, 21 nt, Human
uaggcugagaaagauguucca

SEQ ID NO: 982055 - RNA, 20 nt, Human
uagggaguggagcuggggag

SEQ ID NO: 982056 - RNA, 20 nt, Human
ucacauucuugagguaggga

SEQ ID NO: 982057 - RNA, 18 nt, Human
uccaaacagaacaggaaa

SEQ ID NO: 982058 - RNA, 26 nt, Human
uccaaacagaacaggaaaaaggcaag

SEQ ID NO: 982059 - RNA, 19 nt, Human
ucccaacggcucgcccagg

SEQ ID NO: 982060 - RNA, 23 nt, Human
uccugcccucucacgugggcuug

SEQ ID NO: 982061 - RNA, 20 nt, Human
ucuccacuccaaacagaaca

SEQ ID NO: 982062 - RNA, 21 nt, Human
ucuccacuccaaacagaacag

SEQ ID NO: 982063 - RNA, 22 nt, Human
ugagcgaaucauuaggacacaa

SEQ ID NO: 982064 - RNA, 19 nt, Human
ugagguagggaguggagcu

SEQ ID NO: 982065 - RNA, 21 nt, Human
ugcugcccuucuccacuccaa

SEQ ID NO: 982066 - RNA, 19 nt, Human
uggagcuggggaggggccc

SEQ ID NO: 982067 - RNA, 19 nt, Human
uggggaggggcccagaguc

SEQ ID NO: 982068 - RNA, 21 nt, Human
uuggaagugugcgagcugaug

SEQ ID NO: 982069 - RNA, 21 nt, Human
uuuuccaaauggucacauucu

SEQ ID NO: 982070 - RNA, 28 nt, Human
aaaaaaaaaccuuuuauggccuuguaga

SEQ ID NO: 982071 - RNA, 19 nt, Human
aaaaaaccuuuuauggccu

SEQ ID NO: 982072 - RNA, 24 nt, Human
aaaaacaaauggaccauaucuuca

SEQ ID NO: 982073 - RNA, 23 nt, Human
aaacaacacaccacuaaaaacac

SEQ ID NO: 982074 - RNA, 21 nt, Human
aaacacacuuaucauccaugc

SEQ ID NO: 982075 - RNA, 20 nt, Human
aagacaaugacauaaacuga

SEQ ID NO: 982076 - RNA, 23 nt, Human
aaggauaugcagcaucucugcac

SEQ ID NO: 982077 - RNA, 22 nt, Human
acaauacugcaaacacaaccgc

SEQ ID NO: 982078 - RNA, 24 nt, Human
accacauugcaggaagaaaaacaa

SEQ ID NO: 982079 - RNA, 21 nt, Human
accugcuauuauuccacaggc

SEQ ID NO: 982080 - RNA, 18 nt, Human
acugcacuccagccuggg

SEQ ID NO: 982081 - RNA, 18 nt, Human
acugcacuccagccuggg

SEQ ID NO: 982082 - RNA, 18 nt, Human
acugcacuccagccuggg

SEQ ID NO: 982083 - RNA, 19 nt, Human
acugcacuccagccugggu

SEQ ID NO: 982084 - RNA, 21 nt, Human
acugcacuccagccuggguga

SEQ ID NO: 982085 - RNA, 22 nt, Human
acugcacuccagccugggugac

SEQ ID NO: 982086 - RNA, 23 nt, Human
acugcacuccagccugggugaca

SEQ ID NO: 982087 - RNA, 24 nt, Human
acugcacuccagccugggugacag

SEQ ID NO: 982088 - RNA, 26 nt, Human
acugcacuccagccugggugacagag

SEQ ID NO: 982089 - RNA, 20 nt, Human
agaaaacaaucccuacuggu

SEQ ID NO: 982090 - RNA, 26 nt, Human
agagcagcuuuggauuuuuuuuaaau

SEQ ID NO: 982091 - RNA, 24 nt, Human
agcagcuuuggauuuuuuuuaaau

SEQ ID NO: 982092 - RNA, 20 nt, Human
agccugggugacagagcgag

SEQ ID NO: 982093 - RNA, 21 nt, Human
aggaagaaaaacaaauggacc

SEQ ID NO: 982094 - RNA, 20 nt, Human
agugagagcaaaagugacaa

SEQ ID NO: 982095 - RNA, 19 nt, Human
auacugcaaacacaaccgc

SEQ ID NO: 982096 - RNA, 22 nt, Human
auacugcuaauuuuuccacuua

SEQ ID NO: 982097 - RNA, 24 nt, Human
aucaugcuacugcacuccagccug

SEQ ID NO: 982098 - RNA, 21 nt, Human
aucccuacugguuuacuacca

SEQ ID NO: 982099 - RNA, 18 nt, Human
aucgagagcagcuuugga

SEQ ID NO: 982100 - RNA, 21 nt, Human
augggcguccucccaaggccu

SEQ ID NO: 982101 - RNA, 23 nt, Human
auuauuauucaacauaacaguga

SEQ ID NO: 982102 - RNA, 18 nt, Human
auucacacgcaaucccau

SEQ ID NO: 982103 - RNA, 21 nt, Human
caaacucacucugucgaucau

SEQ ID NO: 982104 - RNA, 23 nt, Human
caaauggaccauaucuucauuag

SEQ ID NO: 982105 - RNA, 24 nt, Human
caaccgcaauuuaaggagccaaaa

SEQ ID NO: 982106 - RNA, 24 nt, Human
caacgguacuugaaucaccucuuu

SEQ ID NO: 982107 - RNA, 26 nt, Human
cacaccacauugcaggaagaaaaaca

SEQ ID NO: 982108 - RNA, 27 nt, Human
cacaccacauugcaggaagaaaaacaa

SEQ ID NO: 982109 - RNA, 23 nt, Human
caccacauugcaggaagaaaaac

SEQ ID NO: 982110 - RNA, 25 nt, Human
caccacauugcaggaagaaaaacaa

SEQ ID NO: 982111 - RNA, 24 nt, Human
caccgcaccugcccggcucuugcc

SEQ ID NO: 982112 - RNA, 22 nt, Human
cacuccagccugggugacagag

SEQ ID NO: 982113 - RNA, 24 nt, Human
cacuccagccugggugacagagcg

SEQ ID NO: 982114 - RNA, 19 nt, Human
cagaaaacauuuuuguucc

SEQ ID NO: 982115 - RNA, 19 nt, Human
caggcggccgcuacggcca

SEQ ID NO: 982116 - RNA, 18 nt, Human
cauguaggaaagaaaaug

SEQ ID NO: 982117 - RNA, 23 nt, Human
ccaaaaagaaauaugcuggcaac

SEQ ID NO: 982118 - RNA, 23 nt, Human
ccaaacucucacaguuauauaga

SEQ ID NO: 982119 - RNA, 22 nt, Human
ccauuguuuuucccaaucugaa

SEQ ID NO: 982120 - RNA, 22 nt, Human
cccgccgggugacccgcggccg

SEQ ID NO: 982121 - RNA, 24 nt, Human
cccgccgggugacccgcggccgcg

SEQ ID NO: 982122 - RNA, 22 nt, Human
ccgccgggugacccgcggccgc

SEQ ID NO: 982123 - RNA, 19 nt, Human
ccgcgcuccugucccaacu

SEQ ID NO: 982124 - RNA, 23 nt, Human
ccggcuagccacgaagccgggga

SEQ ID NO: 982125 - RNA, 22 nt, Human
ccucccaaucuaucugucgccu

SEQ ID NO: 982126 - RNA, 24 nt, Human
ccuccgaccaugggcguccuccca

SEQ ID NO: 982127 - RNA, 18 nt, Human
ccugggugacagagcgag

SEQ ID NO: 982128 - RNA, 22 nt, Human
ccuuuaaaaaaacaaauauaga

SEQ ID NO: 982129 - RNA, 21 nt, Human
cgccgggugacccgcggccgc

SEQ ID NO: 982130 - RNA, 22 nt, Human
cgcuccugucccaacuuuucuc

SEQ ID NO: 982131 - RNA, 21 nt, Human
cggccuccgucccugcacuuc

SEQ ID NO: 982132 - RNA, 20 nt, Human
cuaaaugcuuacacacaaaa

SEQ ID NO: 982133 - RNA, 21 nt, Human
cuaaaugcuuuaucacacauc

SEQ ID NO: 982134 - RNA, 20 nt, Human
cuacugcacuccagccuggg

SEQ ID NO: 982135 - RNA, 21 nt, Human
cuacugcacuccagccugggu

SEQ ID NO: 982136 - RNA, 24 nt, Human
cuacugcacuccagccugggugac

SEQ ID NO: 982137 - RNA, 20 nt, Human
cuccugucccaacuuuucuc

SEQ ID NO: 982138 - RNA, 24 nt, Human
cugaauaauacacuuaugaaggcu

SEQ ID NO: 982139 - RNA, 23 nt, Human
cuggacugaaaaaaaaaaaaaaa

SEQ ID NO: 982140 - RNA, 18 nt, Human
cuuaugaaggcuuucaag

SEQ ID NO: 982141 - RNA, 19 nt, Human
cuucacaguuggcaugacu

SEQ ID NO: 982142 - RNA, 19 nt, Human
cuuuccagcgcuaggaccc

SEQ ID NO: 982143 - RNA, 22 nt, Human
gaaaaaggaacauauuuauaau

SEQ ID NO: 982144 - RNA, 22 nt, Human
gaauaaaaaacagaacaugaga

SEQ ID NO: 982145 - RNA, 23 nt, Human
gacccgcggccgcggcucccuag

SEQ ID NO: 982146 - RNA, 21 nt, Human
gaucaugcuacugcacuccag

SEQ ID NO: 982147 - RNA, 24 nt, Human
gcacuccagccugggugacagagc

SEQ ID NO: 982148 - RNA, 24 nt, Human
gccaccuuuccagcgcuaggaccc

SEQ ID NO: 982149 - RNA, 19 nt, Human
gcuacugcacuccagccug

SEQ ID NO: 982150 - RNA, 24 nt, Human
gcuacugcacuccagccuggguga

SEQ ID NO: 982151 - RNA, 24 nt, Human
gcuuagcaacgguacuugaaucac

SEQ ID NO: 982152 - RNA, 21 nt, Human
gcuucagaaaaacugcuucaa

SEQ ID NO: 982153 - RNA, 19 nt, Human
ggacugaaaaaaaaaaaaa

SEQ ID NO: 982154 - RNA, 20 nt, Human
gggcguccucccaaggccuu

SEQ ID NO: 982155 - RNA, 18 nt, Human
uaaaaaaacaacacacca

SEQ ID NO: 982156 - RNA, 22 nt, Human
uaaaaaaacaacacaccacuaa

SEQ ID NO: 982157 - RNA, 20 nt, Human
uaaaaaacagaacaugagaa

SEQ ID NO: 982158 - RNA, 24 nt, Human
uaaacuaacucaaaaugcaggcuu

SEQ ID NO: 982159 - RNA, 18 nt, Human
uaaauaccagagauacau

SEQ ID NO: 982160 - RNA, 21 nt, Human
uaagaaauuccauauauaugc

SEQ ID NO: 982161 - RNA, 20 nt, Human
uaagacaaaacuaacugaaa

SEQ ID NO: 982162 - RNA, 22 nt, Human
uaagacaaaacuaacugaaagc

SEQ ID NO: 982163 - RNA, 18 nt, Human
uaagacaaugacauaaac

SEQ ID NO: 982164 - RNA, 23 nt, Human
uaagacaaugacauaaacugagc

SEQ ID NO: 982165 - RNA, 21 nt, Human
uacugcacuccagccugggug

SEQ ID NO: 982166 - RNA, 23 nt, Human
uacugcacuccagccugggugac

SEQ ID NO: 982167 - RNA, 25 nt, Human
uacugcacuccagccugggugacag

SEQ ID NO: 982168 - RNA, 19 nt, Human
uaggaccccggcuagccac

SEQ ID NO: 982169 - RNA, 19 nt, Human
uaucacaaggacugaauaa

SEQ ID NO: 982170 - RNA, 22 nt, Human
uaucacacaucugcauuuacaa

SEQ ID NO: 982171 - RNA, 23 nt, Human
uaugcagcaucucugcacaccac

SEQ ID NO: 982172 - RNA, 22 nt, Human
uauguuuccauacauguaugua

SEQ ID NO: 982173 - RNA, 23 nt, Human
ucaaauucacacgcaaucccaua

SEQ ID NO: 982174 - RNA, 22 nt, Human
ucaauagccucccaaucuaucu

SEQ ID NO: 982175 - RNA, 24 nt, Human
ucacacgcaaucccauaaaaagga

SEQ ID NO: 982176 - RNA, 24 nt, Human
ucacagaaaacauuuuuguuccuu

SEQ ID NO: 982177 - RNA, 23 nt, Human
ucaugcuacugcacuccagccug

SEQ ID NO: 982178 - RNA, 18 nt, Human
uccagccugggugacaga

SEQ ID NO: 982179 - RNA, 22 nt, Human
uccagccugggugacagagcga

SEQ ID NO: 982180 - RNA, 23 nt, Human
uccagccugggugacagagcgag

SEQ ID NO: 982181 - RNA, 22 nt, Human
uccauacauguauguauuugca

SEQ ID NO: 982182 - RNA, 18 nt, Human
ucccggggcgagaucccu

SEQ ID NO: 982183 - RNA, 25 nt, Human
ucccuagaccgcuccgcuucggccu

SEQ ID NO: 982184 - RNA, 24 nt, Human
uccugucccaacuuuucucccggg

SEQ ID NO: 982185 - RNA, 21 nt, Human
ucucacaguuauauagaaucu

SEQ ID NO: 982186 - RNA, 21 nt, Human
ucugcacaccacauugcagga

SEQ ID NO: 982187 - RNA, 19 nt, Human
ugaaagcaucuuuaagcug

SEQ ID NO: 982188 - RNA, 23 nt, Human
ugaaauggauuuaguagaaagaa

SEQ ID NO: 982189 - RNA, 26 nt, Human
ugaauaaaaaacagaacaugagauau

SEQ ID NO: 982190 - RNA, 22 nt, Human
ugacccgcggccgcggcucccu

SEQ ID NO: 982191 - RNA, 21 nt, Human
ugagagcaaaagugacaauac

SEQ ID NO: 982192 - RNA, 23 nt, Human
uggcaugacuguuugggggacug

SEQ ID NO: 982193 - RNA, 19 nt, Human
ugggagaaaaaaaguaaga

SEQ ID NO: 982194 - RNA, 21 nt, Human
ugggcguccucccaaggccuu

SEQ ID NO: 982195 - RNA, 22 nt, Human
uguaggaaagaaaauguuuuuc

SEQ ID NO: 982196 - RNA, 23 nt, Human
uguccauuguuuuucccaaucug

SEQ ID NO: 982197 - RNA, 19 nt, Human
ugucccaacuuuucucccg

SEQ ID NO: 982198 - RNA, 26 nt, Human
ugucgcugccccugucccagacuuuu

SEQ ID NO: 982199 - RNA, 21 nt, Human
uguuccuuccagauugcucuu

SEQ ID NO: 982200 - RNA, 21 nt, Human
uucagugcucuuaugacauuu

SEQ ID NO: 982201 - RNA, 25 nt, Human
uuccucagggaauggaaauguuuug

SEQ ID NO: 982202 - RNA, 18 nt, Human
uuucccaaucugaauaug

SEQ ID NO: 982203 - RNA, 20 nt, Human
uuuuuuuuuuuuuuuuuugg

SEQ ID NO: 982204 - RNA, 22 nt, Human
aaaaacaaaaacucuggcccuc

SEQ ID NO: 982205 - RNA, 24 nt, Human
aaaacaaaaacaaaaacaaaaacu

SEQ ID NO: 982206 - RNA, 25 nt, Human
aaaacaaaaacaaaaacaaaaacuc

SEQ ID NO: 982207 - RNA, 23 nt, Human
aaacaaaaacaaaaacaaaaaca

SEQ ID NO: 982208 - RNA, 26 nt, Human
aaacaaaaacaaaaacaaaaacucug

SEQ ID NO: 982209 - RNA, 31 nt, Human
aaacaguagcaagcaggaaaacaaaaacaaa

SEQ ID NO: 982210 - RNA, 20 nt, Human
aaauucaugucccuggccag

SEQ ID NO: 982211 - RNA, 19 nt, Human
aacagagugaaacuccauc

SEQ ID NO: 982212 - RNA, 20 nt, Human
aacagagugaaacuccaucu

SEQ ID NO: 982213 - RNA, 21 nt, Human
aacagagugaaacuccaucuc

SEQ ID NO: 982214 - RNA, 25 nt, Human
aacaguagcaagcaggaaaacaaaa

SEQ ID NO: 982215 - RNA, 18 nt, Human
aagagcacucccaguagc

SEQ ID NO: 982216 - RNA, 20 nt, Human
aagagcacucccaguagccc

SEQ ID NO: 982217 - RNA, 23 nt, Human
aagcagcugggacugcucgaugc

SEQ ID NO: 982218 - RNA, 27 nt, Human
aaggaaccaguccggaggggcgcaggc

SEQ ID NO: 982219 - RNA, 25 nt, Human
acaaaaacaaaaacaaaaacaaaaa

SEQ ID NO: 982220 - RNA, 23 nt, Human
acacauccauccacaucccaaca

SEQ ID NO: 982221 - RNA, 18 nt, Human
acagcucaggcccagcag

SEQ ID NO: 982222 - RNA, 24 nt, Human
acaggcaacaagaaggucaaggaa

SEQ ID NO: 982223 - RNA, 24 nt, Human
acauagccaaguaucguucacacc

SEQ ID NO: 982224 - RNA, 22 nt, Human
accacaaaacaguagcaagcag

SEQ ID NO: 982225 - RNA, 18 nt, Human
accgcaacuccuucgcac

SEQ ID NO: 982226 - RNA, 22 nt, Human
acgagacagacagcucaggccc

SEQ ID NO: 982227 - RNA, 21 nt, Human
acgcacacacacacacacaua

SEQ ID NO: 982228 - RNA, 23 nt, Human
acgcacacacacacacacauauu

SEQ ID NO: 982229 - RNA, 21 nt, Human
acgcggcgugagcucucggag

SEQ ID NO: 982230 - RNA, 21 nt, Human
acgcggcgugagcucucggag

SEQ ID NO: 982231 - RNA, 21 nt, Human
agaagcgccagcaggcccccg

SEQ ID NO: 982232 - RNA, 19 nt, Human
agacagacagcucaggccc

SEQ ID NO: 982233 - RNA, 22 nt, Human
agacagacagcucaggcccagc

SEQ ID NO: 982234 - RNA, 20 nt, Human
agagcacucccaguagcccc

SEQ ID NO: 982235 - RNA, 23 nt, Human
agcaagcaggaaaacaaaaacaa

SEQ ID NO: 982236 - RNA, 22 nt, Human
agcagcugggacugcucgaugc

SEQ ID NO: 982237 - RNA, 19 nt, Human
agcgucccccuaaauggcc

SEQ ID NO: 982238 - RNA, 21 nt, Human
aggaaaacaaaaacaaaaaca

SEQ ID NO: 982239 - RNA, 23 nt, Human
aggaagaaaaacuuuuuagagga

SEQ ID NO: 982240 - RNA, 23 nt, Human
aggaggaggauuuaaaacuuggu

SEQ ID NO: 982241 - RNA, 19 nt, Human
aggaguucaagaccagccu

SEQ ID NO: 982242 - RNA, 22 nt, Human
aggcaacaagaaggucaaggaa

SEQ ID NO: 982243 - RNA, 19 nt, Human
aggcacuuaacauagccaa

SEQ ID NO: 982244 - RNA, 19 nt, Human
aggcagaggcauggccagg

SEQ ID NO: 982245 - RNA, 19 nt, Human
aggcagaggcauggccagg

SEQ ID NO: 982246 - RNA, 23 nt, Human
aggcggccgaggagaacgcggcg

SEQ ID NO: 982247 - RNA, 23 nt, Human
aggcggccgaggagaacgcggcg

SEQ ID NO: 982248 - RNA, 26 nt, Human
agggacucuucccugacuucugucag

SEQ ID NO: 982249 - RNA, 21 nt, Human
auaaaagcaaggugcggacaa

SEQ ID NO: 982250 - RNA, 24 nt, Human
auaagcaaaaccagcucggucaaa

SEQ ID NO: 982251 - RNA, 22 nt, Human
auagccaaguaucguucacacc

SEQ ID NO: 982252 - RNA, 22 nt, Human
augcacacauccauccacaucc

SEQ ID NO: 982253 - RNA, 25 nt, Human
caaaaacaaaaacaaaaacaaaaac

SEQ ID NO: 982254 - RNA, 26 nt, Human
caaaaacaaaaacaaaaacaaaaacu

SEQ ID NO: 982255 - RNA, 22 nt, Human
caaaaacaaaaacucuggcccu

SEQ ID NO: 982256 - RNA, 24 nt, Human
caaaacaguagcaagcaggaaaac

SEQ ID NO: 982257 - RNA, 21 nt, Human
caaauugcagcaugaccauaa

SEQ ID NO: 982258 - RNA, 20 nt, Human
caacaccacaaaacaguagc

SEQ ID NO: 982259 - RNA, 21 nt, Human
caagagcacucccaguagccc

SEQ ID NO: 982260 - RNA, 18 nt, Human
caagcaggaaaacaaaaa

SEQ ID NO: 982261 - RNA, 18 nt, Human
caaggaaccagucagccc

SEQ ID NO: 982262 - RNA, 18 nt, Human
caaggcagaggcauggcc

SEQ ID NO: 982263 - RNA, 18 nt, Human
caaggcagaggcauggcc

SEQ ID NO: 982264 - RNA, 19 nt, Human
cacaaaacaguagcaagca

SEQ ID NO: 982265 - RNA, 18 nt, Human
cacacacacacacacaua

SEQ ID NO: 982266 - RNA, 19 nt, Human
cacacauccauccacaucc

SEQ ID NO: 982267 - RNA, 26 nt, Human
cacacccauucacaucaugauuguua

SEQ ID NO: 982268 - RNA, 23 nt, Human
caccacaaaacaguagcaagcag

SEQ ID NO: 982269 - RNA, 21 nt, Human
cacuggggcagcuacuuccuu

SEQ ID NO: 982270 - RNA, 19 nt, Human
cacuugugcaugugugugc

SEQ ID NO: 982271 - RNA, 23 nt, Human
cacuuuuauuuuggcucugaaga

SEQ ID NO: 982272 - RNA, 22 nt, Human
cacuuuucaacaccacaaaaca

SEQ ID NO: 982273 - RNA, 26 nt, Human
cagaccccaagugcagaaucaaauug

SEQ ID NO: 982274 - RNA, 19 nt, Human
cagaggcauggccaggacg

SEQ ID NO: 982275 - RNA, 19 nt, Human
cagaggcauggccaggacg

SEQ ID NO: 982276 - RNA, 18 nt, Human
cagcaggcccccgccccg

SEQ ID NO: 982277 - RNA, 18 nt, Human
cagcaggcccccgccccg

SEQ ID NO: 982278 - RNA, 23 nt, Human
cagcaggcccccgccccgcgucc

SEQ ID NO: 982279 - RNA, 23 nt, Human
cagcaggcccccgccccgcgucc

SEQ ID NO: 982280 - RNA, 22 nt, Human
caggagccgccgcucaucuguu

SEQ ID NO: 982281 - RNA, 19 nt, Human
caugaccauaagcaaaacc

SEQ ID NO: 982282 - RNA, 22 nt, Human
ccagcccccauuccucugacuu

SEQ ID NO: 982283 - RNA, 18 nt, Human
ccagcgggcgcccggggc

SEQ ID NO: 982284 - RNA, 19 nt, Human
ccaggcacuccugggcccg

SEQ ID NO: 982285 - RNA, 21 nt, Human
ccaggcggccagcagccuccg

SEQ ID NO: 982286 - RNA, 19 nt, Human
ccccaagugcagaaucaaa

SEQ ID NO: 982287 - RNA, 18 nt, Human
ccccgcguccccgccagc

SEQ ID NO: 982288 - RNA, 18 nt, Human
ccccgcguccccgccagc

SEQ ID NO: 982289 - RNA, 19 nt, Human
ccccgcguccccgccagcc

SEQ ID NO: 982290 - RNA, 19 nt, Human
ccccgcguccccgccagcc

SEQ ID NO: 982291 - RNA, 19 nt, Human
ccccgcguccccgccagcc

SEQ ID NO: 982292 - RNA, 19 nt, Human
ccccgcguccccgccagcc

SEQ ID NO: 982293 - RNA, 22 nt, Human
cccgcagggcccgccgcgagcu

SEQ ID NO: 982294 - RNA, 22 nt, Human
cccgcagggcccgccgcgagcu

SEQ ID NO: 982295 - RNA, 21 nt, Human
cccggggccgggaugcagggc

SEQ ID NO: 982296 - RNA, 19 nt, Human
ccgcgccuuccgcgacugc

SEQ ID NO: 982297 - RNA, 20 nt, Human
ccgcggccaggagccgccgc

SEQ ID NO: 982298 - RNA, 22 nt, Human
ccgcggccaggagccgccgcuc

SEQ ID NO: 982299 - RNA, 20 nt, Human
ccgcguccccgccagccagg

SEQ ID NO: 982300 - RNA, 20 nt, Human
ccgcguccccgccagccagg

SEQ ID NO: 982301 - RNA, 20 nt, Human
ccggaggggcgcaggcggug

SEQ ID NO: 982302 - RNA, 21 nt, Human
ccuccagcgggcgcccggggc

SEQ ID NO: 982303 - RNA, 21 nt, Human
ccucccgcagggcccgccgcg

SEQ ID NO: 982304 - RNA, 21 nt, Human
ccucccgcagggcccgccgcg

SEQ ID NO: 982305 - RNA, 19 nt, Human
ccuccgcgggagcaugccg

SEQ ID NO: 982306 - RNA, 19 nt, Human
ccuccgcgggagcaugccg

SEQ ID NO: 982307 - RNA, 22 nt, Human
ccuccgcgggagcaugccgccu

SEQ ID NO: 982308 - RNA, 22 nt, Human
ccuccgcgggagcaugccgccu

SEQ ID NO: 982309 - RNA, 19 nt, Human
cgaugcaucucuccucuuc

SEQ ID NO: 982310 - RNA, 20 nt, Human
cgcacacacacacacacaua

SEQ ID NO: 982311 - RNA, 21 nt, Human
cgcacacacacacacacauau

SEQ ID NO: 982312 - RNA, 22 nt, Human
cgcacacacacacacacauauu

SEQ ID NO: 982313 - RNA, 20 nt, Human
cgccccgcguccccgccagc

SEQ ID NO: 982314 - RNA, 20 nt, Human
cgccccgcguccccgccagc

SEQ ID NO: 982315 - RNA, 25 nt, Human
cgcgcgccgcacgcgcaggcccgug

SEQ ID NO: 982316 - RNA, 25 nt, Human
cgcgcgccgcacgcgcaggcccgug

SEQ ID NO: 982317 - RNA, 23 nt, Human
cuccuucgcacuugugcaugugu

SEQ ID NO: 982318 - RNA, 18 nt, Human
cucuacuuaaaaaaaaaa

SEQ ID NO: 982319 - RNA, 22 nt, Human
cucugaagagaggaagaaaaac

SEQ ID NO: 982320 - RNA, 23 nt, Human
cugcucgaugcaucucuccucuu

SEQ ID NO: 982321 - RNA, 21 nt, Human
cuggcccucaagacuccagaa

SEQ ID NO: 982322 - RNA, 24 nt, Human
gaaaacaaaaacaaaaacaaaaac

SEQ ID NO: 982323 - RNA, 23 nt, Human
gaacaggcaacaagaaggucaag

SEQ ID NO: 982324 - RNA, 20 nt, Human
gaagcgccagcaggcccccg

SEQ ID NO: 982325 - RNA, 22 nt, Human
gaccauaagcaaaaccagcucg

SEQ ID NO: 982326 - RNA, 18 nt, Human
gacgcggagaaggcaaga

SEQ ID NO: 982327 - RNA, 24 nt, Human
gaggaagaaaaacuuuuuagagga

SEQ ID NO: 982328 - RNA, 18 nt, Human
gaugcaucucuccucuuc

SEQ ID NO: 982329 - RNA, 21 nt, Human
gcaagacauacacuggggcag

SEQ ID NO: 982330 - RNA, 26 nt, Human
gcaggaaaacaaaaacaaaaacaaaa

SEQ ID NO: 982331 - RNA, 27 nt, Human
gcaggaaaacaaaaacaaaaacaaaaa

SEQ ID NO: 982332 - RNA, 21 nt, Human
gcagggcccgccgcgagcuuc

SEQ ID NO: 982333 - RNA, 21 nt, Human
gcagggcccgccgcgagcuuc

SEQ ID NO: 982334 - RNA, 23 nt, Human
gcauggcccaggaguucaagacc

SEQ ID NO: 982335 - RNA, 22 nt, Human
gcccaggaguucaagaccagcc

SEQ ID NO: 982336 - RNA, 18 nt, Human
gcccccgccccgcguccc

SEQ ID NO: 982337 - RNA, 18 nt, Human
gcccccgccccgcguccc

SEQ ID NO: 982338 - RNA, 25 nt, Human
gcccgggcagcagaccagucagccc

SEQ ID NO: 982339 - RNA, 18 nt, Human
gccgauucacaggaaacu

SEQ ID NO: 982340 - RNA, 19 nt, Human
gcucgaugcaucucuccuc

SEQ ID NO: 982341 - RNA, 24 nt, Human
ggacucuucccugacuucugucag

SEQ ID NO: 982342 - RNA, 18 nt, Human
ggaguggcccagccccca

SEQ ID NO: 982343 - RNA, 19 nt, Human
ggcccagcagcacgcaagc

SEQ ID NO: 982344 - RNA, 18 nt, Human
ggccgaggagaacgcggc

SEQ ID NO: 982345 - RNA, 18 nt, Human
ggccgaggagaacgcggc

SEQ ID NO: 982346 - RNA, 18 nt, Human
ggcggccagcagccuccg

SEQ ID NO: 982347 - RNA, 18 nt, Human
gggagcaugccgccuccc

SEQ ID NO: 982348 - RNA, 18 nt, Human
gggagcaugccgccuccc

SEQ ID NO: 982349 - RNA, 20 nt, Human
gguccuggaaagaagaagua

SEQ ID NO: 982350 - RNA, 21 nt, Human
gugggauuuggaaugucagca

SEQ ID NO: 982351 - RNA, 29 nt, Human
gugugcgcucgcagacgcacacacacaca

SEQ ID NO: 982352 - RNA, 23 nt, Human
guuaggaaggaggcaaugaucca

SEQ ID NO: 982353 - RNA, 22 nt, Human
uaacauaaaccaaaucuccacu

SEQ ID NO: 982354 - RNA, 20 nt, Human
uaacccagggacucuucccu

SEQ ID NO: 982355 - RNA, 18 nt, Human
uaacuguacagacagacc

SEQ ID NO: 982356 - RNA, 22 nt, Human
uaacuguacagacagaccccaa

SEQ ID NO: 982357 - RNA, 20 nt, Human
uaagucagaacauggagcaa

SEQ ID NO: 982358 - RNA, 24 nt, Human
uaaugguaacauaaaccaaaucuc

SEQ ID NO: 982359 - RNA, 31 nt, Human
uagcaagcaggaaaacaaaaacaaaaacaaa

SEQ ID NO: 982360 - RNA, 19 nt, Human
uaucuaaaaggauuagucu

SEQ ID NO: 982361 - RNA, 21 nt, Human
ucacacccauucacaucauga

SEQ ID NO: 982362 - RNA, 26 nt, Human
ucacggucccgcggccaggagccgcc

SEQ ID NO: 982363 - RNA, 20 nt, Human
ucagagaagcaaauggaggu

SEQ ID NO: 982364 - RNA, 19 nt, Human
ucaggcccagcagcacgca

SEQ ID NO: 982365 - RNA, 20 nt, Human
uccaagggaguggcccagcc

SEQ ID NO: 982366 - RNA, 21 nt, Human
ucccacaaauguagccuucuu

SEQ ID NO: 982367 - RNA, 18 nt, Human
uccccuucuggccugagg

SEQ ID NO: 982368 - RNA, 21 nt, Human
uccucugaggggagagucggu

SEQ ID NO: 982369 - RNA, 23 nt, Human
ucgcacuugugcaugugugugcg

SEQ ID NO: 982370 - RNA, 21 nt, Human
ucuacuuaaaaaaaaaaaaaa

SEQ ID NO: 982371 - RNA, 24 nt, Human
ucuccucugaggggagagucgacu

SEQ ID NO: 982372 - RNA, 23 nt, Human
ucucuacuuaaaaaaaaaaaaaa

SEQ ID NO: 982373 - RNA, 18 nt, Human
ucugaagagaggaagaaa

SEQ ID NO: 982374 - RNA, 19 nt, Human
ucuuccaacaaugacgcgg

SEQ ID NO: 982375 - RNA, 19 nt, Human
ugaaaagcagcugggacug

SEQ ID NO: 982376 - RNA, 19 nt, Human
ugaacaguguaguucacuu

SEQ ID NO: 982377 - RNA, 21 nt, Human
ugaauauagaagaacuggccg

SEQ ID NO: 982378 - RNA, 19 nt, Human
ugacaacacucccacaaau

SEQ ID NO: 982379 - RNA, 25 nt, Human
ugacaacacucccacaaauguagcc

SEQ ID NO: 982380 - RNA, 22 nt, Human
ugagacagggcuagaagcaccu

SEQ ID NO: 982381 - RNA, 22 nt, Human
ugaguaacuguacagacagacc

SEQ ID NO: 982382 - RNA, 19 nt, Human
ugauaacggacugagacag

SEQ ID NO: 982383 - RNA, 21 nt, Human
ugcacacauccauccacaucc

SEQ ID NO: 982384 - RNA, 21 nt, Human
ugcagaaucaaauugcccuaa

SEQ ID NO: 982385 - RNA, 20 nt, Human
ugcgcgcgccgcacgcgcag

SEQ ID NO: 982386 - RNA, 20 nt, Human
ugcgcgcgccgcacgcgcag

SEQ ID NO: 982387 - RNA, 21 nt, Human
ugcgcgcgccgcacgcgcagg

SEQ ID NO: 982388 - RNA, 21 nt, Human
ugcgcgcgccgcacgcgcagg

SEQ ID NO: 982389 - RNA, 18 nt, Human
uggaaagaagaaguaaua

SEQ ID NO: 982390 - RNA, 20 nt, Human
uggaaugucagcagaggaaa

SEQ ID NO: 982391 - RNA, 19 nt, Human
uggaccuggagaacugaag

SEQ ID NO: 982392 - RNA, 19 nt, Human
uggcaugucccccuucuac

SEQ ID NO: 982393 - RNA, 21 nt, Human
uggccagaagcgccagcaggc

SEQ ID NO: 982394 - RNA, 21 nt, Human
uggccagaagcgccagcaggc

SEQ ID NO: 982395 - RNA, 20 nt, Human
uggccaggacggccgugcag

SEQ ID NO: 982396 - RNA, 20 nt, Human
uggccaggacggccgugcag

SEQ ID NO: 982397 - RNA, 22 nt, Human
uggcccaggaguucaagaccag

SEQ ID NO: 982398 - RNA, 20 nt, Human
uggccgauucacaggaaacu

SEQ ID NO: 982399 - RNA, 22 nt, Human
ugucacaguuaggagugaaauc

SEQ ID NO: 982400 - RNA, 22 nt, Human
ugucccuggccaggcauggccc

SEQ ID NO: 982401 - RNA, 22 nt, Human
ugugcaggcagggagggggaac

SEQ ID NO: 982402 - RNA, 19 nt, Human
ugugcaugugugugcgcuc

SEQ ID NO: 982403 - RNA, 25 nt, Human
ugugcgcucgcagacgcacacacac

SEQ ID NO: 982404 - RNA, 28 nt, Human
ugugugcgcucgcagacgcacacacaca

SEQ ID NO: 982405 - RNA, 19 nt, Human
uuagaggaacuuaauggua

SEQ ID NO: 982406 - RNA, 25 nt, Human
uuaugcacacauccauccacauccc

SEQ ID NO: 982407 - RNA, 23 nt, Human
uucaacaccacaaaacaguagca

SEQ ID NO: 982408 - RNA, 22 nt, Human
uucgcacuugugcaugugugug

SEQ ID NO: 982409 - RNA, 18 nt, Human
uuuuuuuuuuuuuuuuug

SEQ ID NO: 982410 - RNA, 20 nt, Human
uuuuuuuuuuuuuuuuuugg

SEQ ID NO: 982411 - RNA, 23 nt, Human
aaagaagaaauucagggcuugag

SEQ ID NO: 982412 - RNA, 19 nt, Human
aaagaagccacugcccuga

SEQ ID NO: 982413 - RNA, 23 nt, Human
aagaaaaagaggucuacuuccua

SEQ ID NO: 982414 - RNA, 20 nt, Human
aagaaagaaauggaguccua

SEQ ID NO: 982415 - RNA, 18 nt, Human
accccuauaccucccagc

SEQ ID NO: 982416 - RNA, 19 nt, Human
agaagccacugcccugagc

SEQ ID NO: 982417 - RNA, 18 nt, Human
agaguaggggaggagacu

SEQ ID NO: 982418 - RNA, 18 nt, Human
agcaggcagccuccagga

SEQ ID NO: 982419 - RNA, 18 nt, Human
aggaaaagaagaaauuca

SEQ ID NO: 982420 - RNA, 21 nt, Human
aggaaaagaagaaauucaggg

SEQ ID NO: 982421 - RNA, 27 nt, Human
aggaaagaagaaagcaaguuauccuag

SEQ ID NO: 982422 - RNA, 23 nt, Human
agggcuugagccaggaguaaagg

SEQ ID NO: 982423 - RNA, 18 nt, Human
auggcucagcaucuguuc

SEQ ID NO: 982424 - RNA, 22 nt, Human
auucagggcuugagccaggagu

SEQ ID NO: 982425 - RNA, 19 nt, Human
cacaugguaggcuaaggca

SEQ ID NO: 982426 - RNA, 21 nt, Human
cacaugguaggcuaaggcaga

SEQ ID NO: 982427 - RNA, 18 nt, Human
cauuuuaugggggaggaa

SEQ ID NO: 982428 - RNA, 19 nt, Human
ccccgcgcccuccaauggc

SEQ ID NO: 982429 - RNA, 19 nt, Human
ccccgcgcccuccaauggc

SEQ ID NO: 982430 - RNA, 18 nt, Human
ccccugcaggaaaagaag

SEQ ID NO: 982431 - RNA, 21 nt, Human
cccuccaauggcucuggucgc

SEQ ID NO: 982432 - RNA, 20 nt, Human
ccuccaggauccuauuuaga

SEQ ID NO: 982433 - RNA, 21 nt, Human
cucccagcacagcaggcagcc

SEQ ID NO: 982434 - RNA, 21 nt, Human
cuguacccauguuaugcuuuc

SEQ ID NO: 982435 - RNA, 19 nt, Human
cuuccauacuggaaagaag

SEQ ID NO: 982436 - RNA, 21 nt, Human
gacaugaaggaauggaagaaa

SEQ ID NO: 982437 - RNA, 20 nt, Human
gagcccuccaaguaccuguc

SEQ ID NO: 982438 - RNA, 18 nt, Human
gagucacacaggccugag

SEQ ID NO: 982439 - RNA, 22 nt, Human
gcccugagcccuccaaguaccu

SEQ ID NO: 982440 - RNA, 21 nt, Human
gccugcccccaggaccccuau

SEQ ID NO: 982441 - RNA, 20 nt, Human
ggcagaguaggggaggagac

SEQ ID NO: 982442 - RNA, 19 nt, Human
ucauuguuguccccucugu

SEQ ID NO: 982443 - RNA, 22 nt, Human
uccccgcgcccuccaauggcuc

SEQ ID NO: 982444 - RNA, 19 nt, Human
ugaaggaauggaagaaaga

SEQ ID NO: 982445 - RNA, 20 nt, Human
ugaaggaauggaagaaagaa

SEQ ID NO: 982446 - RNA, 21 nt, Human
ugcccugagcccuccaaguac

SEQ ID NO: 982447 - RNA, 21 nt, Human
ugcuccccaccaaggccaaug

SEQ ID NO: 982448 - RNA, 20 nt, Human
uggaagaaagaaauggaguc

SEQ ID NO: 982449 - RNA, 24 nt, Human
uggaagaaagaaauggaguccuau

SEQ ID NO: 982450 - RNA, 23 nt, Human
ugugucugugcuccccaccaagg

SEQ ID NO: 982451 - RNA, 22 nt, Human
uguuguccccucuguacccaug

SEQ ID NO: 982452 - RNA, 22 nt, Human
uuagccuaaccaacuauuaaaa

SEQ ID NO: 982453 - RNA, 26 nt, Human
uugcaguccccgcgcccuccaauggc

SEQ ID NO: 982454 - RNA, 18 nt, Human
aaaagggaggagggaaaa

SEQ ID NO: 982455 - RNA, 21 nt, Human
aaacccucacucaaaccggcg

SEQ ID NO: 982456 - RNA, 19 nt, Human
aaacgugggcaacagcauc

SEQ ID NO: 982457 - RNA, 22 nt, Human
aacacuguuuacacaaaugugu

SEQ ID NO: 982458 - RNA, 24 nt, Human
aacagcaucauagacuugaaugaa

SEQ ID NO: 982459 - RNA, 21 nt, Human
aaccccucuucucauccccac

SEQ ID NO: 982460 - RNA, 19 nt, Human
aagcagccaagcaaggacu

SEQ ID NO: 982461 - RNA, 30 nt, Human
aagcagccaagcaaggacuaauucagagcc

SEQ ID NO: 982462 - RNA, 18 nt, Human
aagcccaaggccaagcag

SEQ ID NO: 982463 - RNA, 19 nt, Human
acacaagcacaugcaugcc

SEQ ID NO: 982464 - RNA, 26 nt, Human
acacacacaagcacaugcaugccugc

SEQ ID NO: 982465 - RNA, 25 nt, Human
acacacacacacacaagcacaugca

SEQ ID NO: 982466 - RNA, 33 nt, Human
acacacacacacacacacaagcacaugcauggu

SEQ ID NO: 982467 - RNA, 33 nt, Human
acacacacacacacacacacacaagcacauggu

SEQ ID NO: 982468 - RNA, 22 nt, Human
acauagacccacacacucucuc

SEQ ID NO: 982469 - RNA, 26 nt, Human
accguccggcagccgggccggcucug

SEQ ID NO: 982470 - RNA, 21 nt, Human
acuccggagugaaacuucagc

SEQ ID NO: 982471 - RNA, 20 nt, Human
agacguuaccugucuccccu

SEQ ID NO: 982472 - RNA, 25 nt, Human
agagaggcaagcaaagaaggcugau

SEQ ID NO: 982473 - RNA, 21 nt, Human
agagggaggagcguguggggu

SEQ ID NO: 982474 - RNA, 26 nt, Human
agcaucauagacuugaaugaagccca

SEQ ID NO: 982475 - RNA, 26 nt, Human
agcccaaggccaagcagccaagcaag

SEQ ID NO: 982476 - RNA, 22 nt, Human
aggcaagaggaccaacccucca

SEQ ID NO: 982477 - RNA, 21 nt, Human
aggcaagcaaagaaggcuggg

SEQ ID NO: 982478 - RNA, 21 nt, Human
aucuuuucuaccucuuugucg

SEQ ID NO: 982479 - RNA, 20 nt, Human
auguguggucuuuguacaaa

SEQ ID NO: 982480 - RNA, 25 nt, Human
caaaaaaaccccucuucucaucccc

SEQ ID NO: 982481 - RNA, 26 nt, Human
caaaaaaaccccucuucucaucccca

SEQ ID NO: 982482 - RNA, 21 nt, Human
caagucccggggccccugucc

SEQ ID NO: 982483 - RNA, 20 nt, Human
cacacacacacacacacaca

SEQ ID NO: 982484 - RNA, 20 nt, Human
cacacacacacacacacaca

SEQ ID NO: 982485 - RNA, 22 nt, Human
cacacacacacacacacacaca

SEQ ID NO: 982486 - RNA, 19 nt, Human
cacagagagucuggagucc

SEQ ID NO: 982487 - RNA, 22 nt, Human
cacagccaguuacgcaacagcg

SEQ ID NO: 982488 - RNA, 22 nt, Human
cacaugcaugccugcaaaggug

SEQ ID NO: 982489 - RNA, 23 nt, Human
cacccaccauauccuagacccaa

SEQ ID NO: 982490 - RNA, 22 nt, Human
cacuccggagugaaacuucagc

SEQ ID NO: 982491 - RNA, 21 nt, Human
cagaacacagccaguuacgca

SEQ ID NO: 982492 - RNA, 22 nt, Human
cagaacacagccaguuacgcaa

SEQ ID NO: 982493 - RNA, 22 nt, Human
caggaaggagcggagagcagcg

SEQ ID NO: 982494 - RNA, 20 nt, Human
cauauuguuuccaaagagaa

SEQ ID NO: 982495 - RNA, 22 nt, Human
cauccccaccucccuucagaga

SEQ ID NO: 982496 - RNA, 25 nt, Human
caucucauucaaauagcugcugagc

SEQ ID NO: 982497 - RNA, 20 nt, Human
caugcacaaggacacacaca

SEQ ID NO: 982498 - RNA, 20 nt, Human
ccaagcagccaagcaaggac

SEQ ID NO: 982499 - RNA, 18 nt, Human
ccaaggccaagcagccaa

SEQ ID NO: 982500 - RNA, 22 nt, Human
ccacccaccauauccuagaccc

SEQ ID NO: 982501 - RNA, 18 nt, Human
ccaccgcugcugcagcca

SEQ ID NO: 982502 - RNA, 24 nt, Human
ccagaacacagccaguuacgcaac

SEQ ID NO: 982503 - RNA, 19 nt, Human
ccagcaggcccucggcggc

SEQ ID NO: 982504 - RNA, 23 nt, Human
cccaccauauccuagacccaauc

SEQ ID NO: 982505 - RNA, 19 nt, Human
ccccucuucucauccccac

SEQ ID NO: 982506 - RNA, 19 nt, Human
cccgcgccagcagcccucc

SEQ ID NO: 982507 - RNA, 23 nt, Human
cccuccaagucccggggccccug

SEQ ID NO: 982508 - RNA, 20 nt, Human
cccucccagccccgcuugcu

SEQ ID NO: 982509 - RNA, 21 nt, Human
cccucggcggcggcucccagg

SEQ ID NO: 982510 - RNA, 26 nt, Human
ccuagacccaaucuuuucuaccucuu

SEQ ID NO: 982511 - RNA, 21 nt, Human
ccucccagccccgcuugcucc

SEQ ID NO: 982512 - RNA, 23 nt, Human
cggcgccgggcgugggggcugcc

SEQ ID NO: 982513 - RNA, 18 nt, Human
cggcggcagcggcggcug

SEQ ID NO: 982514 - RNA, 20 nt, Human
cgggcggcgccgggcguggg

SEQ ID NO: 982515 - RNA, 21 nt, Human
cggggccccuguccacccacc

SEQ ID NO: 982516 - RNA, 23 nt, Human
cuacaggccuugccacagcagug

SEQ ID NO: 982517 - RNA, 22 nt, Human
cucauccccaccucccuucaga

SEQ ID NO: 982518 - RNA, 30 nt, Human
cucaugcacaaggacacacacacacacaca

SEQ ID NO: 982519 - RNA, 19 nt, Human
cuccaggccccaccuccag

SEQ ID NO: 982520 - RNA, 26 nt, Human
cugcgccccgcggcucucgcucccgg

SEQ ID NO: 982521 - RNA, 23 nt, Human
cuugccacagcagugaauauccu

SEQ ID NO: 982522 - RNA, 21 nt, Human
gaaaaugaacccccagccucc

SEQ ID NO: 982523 - RNA, 22 nt, Human
gaaaaugaacccccagccuccc

SEQ ID NO: 982524 - RNA, 19 nt, Human
gaaccggggcgggucagaa

SEQ ID NO: 982525 - RNA, 22 nt, Human
gaccauacacagccggcgagcc

SEQ ID NO: 982526 - RNA, 24 nt, Human
gaggcaagaggaccaacccuccaa

SEQ ID NO: 982527 - RNA, 18 nt, Human
gaugccaugaucugaaaa

SEQ ID NO: 982528 - RNA, 21 nt, Human
gauuugcagcuugucuuucac

SEQ ID NO: 982529 - RNA, 33 nt, Human
gcacaaggacacacacacacacacacacacagu

SEQ ID NO: 982530 - RNA, 19 nt, Human
gcagccaagcaaggacuaa

SEQ ID NO: 982531 - RNA, 20 nt, Human
gccaccgcugcugcagccac

SEQ ID NO: 982532 - RNA, 21 nt, Human
gccagcagcccucccagcccc

SEQ ID NO: 982533 - RNA, 22 nt, Human
gcccagacgcgcucucauaggg

SEQ ID NO: 982534 - RNA, 18 nt, Human
ggaaaucccaaaccuggg

SEQ ID NO: 982535 - RNA, 18 nt, Human
ggaugccaugaucugaaa

SEQ ID NO: 982536 - RNA, 18 nt, Human
ggccaccgcugcugcagc

SEQ ID NO: 982537 - RNA, 18 nt, Human
ggcggcggcagcggcggc

SEQ ID NO: 982538 - RNA, 24 nt, Human
ggcucuggaaaucccaaaccuggg

SEQ ID NO: 982539 - RNA, 19 nt, Human
gggaggagggaaaaguugg

SEQ ID NO: 982540 - RNA, 18 nt, Human
gggcggcgccgggcgugg

SEQ ID NO: 982541 - RNA, 25 nt, Human
uacaaaaaaaccccucuucucaucc

SEQ ID NO: 982542 - RNA, 19 nt, Human
uacauagacccacacacuc

SEQ ID NO: 982543 - RNA, 23 nt, Human
uaccugucuccccuccccuucug

SEQ ID NO: 982544 - RNA, 18 nt, Human
uaggguucacagagaguc

SEQ ID NO: 982545 - RNA, 18 nt, Human
ucaaaccagaucagcuuu

SEQ ID NO: 982546 - RNA, 22 nt, Human
ucacagagagucuggaguccac

SEQ ID NO: 982547 - RNA, 19 nt, Human
ucacugcaguuuuuuguuu

SEQ ID NO: 982548 - RNA, 23 nt, Human
ucagaaacccucacucaaaccgg

SEQ ID NO: 982549 - RNA, 18 nt, Human
ucagagcagcucagaaac

SEQ ID NO: 982550 - RNA, 19 nt, Human
ucauaggguucacagagag

SEQ ID NO: 982551 - RNA, 24 nt, Human
uccccuccccuucugaaucaucuc

SEQ ID NO: 982552 - RNA, 19 nt, Human
ucccggaaccggggcgggu

SEQ ID NO: 982553 - RNA, 19 nt, Human
ucccggccgggguuccugg

SEQ ID NO: 982554 - RNA, 24 nt, Human
ucccugccucgcccucagucgccc

SEQ ID NO: 982555 - RNA, 22 nt, Human
uccuagacccaaucuuuucuac

SEQ ID NO: 982556 - RNA, 20 nt, Human
ucgcucccggccgggguucc

SEQ ID NO: 982557 - RNA, 22 nt, Human
ucggcguugccgggaaaucccg

SEQ ID NO: 982558 - RNA, 19 nt, Human
ucuacaggccuugccacag

SEQ ID NO: 982559 - RNA, 23 nt, Human
ucucucucucuuaggagggcaaa

SEQ ID NO: 982560 - RNA, 23 nt, Human
ucucucugucucucucucuuagg

SEQ ID NO: 982561 - RNA, 23 nt, Human
ucucugucucucucucuuaggag

SEQ ID NO: 982562 - RNA, 18 nt, Human
ucuggcgcgugucaucuu

SEQ ID NO: 982563 - RNA, 18 nt, Human
ucugucucucugucucuc

SEQ ID NO: 982564 - RNA, 20 nt, Human
ucuuucucucucucugucuc

SEQ ID NO: 982565 - RNA, 18 nt, Human
ucuuuugagccccuucag

SEQ ID NO: 982566 - RNA, 20 nt, Human
ugaacccccagccucccuuc

SEQ ID NO: 982567 - RNA, 19 nt, Human
ugagcagaugaggggccca

SEQ ID NO: 982568 - RNA, 19 nt, Human
ugcacaaggacacacacac

SEQ ID NO: 982569 - RNA, 30 nt, Human
ugcacaaggacacacacacacacacacaca

SEQ ID NO: 982570 - RNA, 30 nt, Human
ugcacaaggacacacacacacacacacagu

SEQ ID NO: 982571 - RNA, 21 nt, Human
ugccacagcagugaauauccu

SEQ ID NO: 982572 - RNA, 27 nt, Human
ugccccugacugcgaguccuacagccu

SEQ ID NO: 982573 - RNA, 22 nt, Human
ugccucgcccucagucgccggc

SEQ ID NO: 982574 - RNA, 20 nt, Human
ugccugcagugacagaggcu

SEQ ID NO: 982575 - RNA, 22 nt, Human
ugcuccaggccccaccuccagc

SEQ ID NO: 982576 - RNA, 18 nt, Human
ugcugagcagaugagggg

SEQ ID NO: 982577 - RNA, 19 nt, Human
ugggagcaaggccucacca

SEQ ID NO: 982578 - RNA, 19 nt, Human
uggggccgcaccguccggc

SEQ ID NO: 982579 - RNA, 21 nt, Human
uguacaaaguacaaaaaaacc

SEQ ID NO: 982580 - RNA, 22 nt, Human
uguacaaaguacaaaaaaaccc

SEQ ID NO: 982581 - RNA, 23 nt, Human
uucacugcaguuuuuuguuuuug

SEQ ID NO: 982582 - RNA, 18 nt, Human
uuccaaagagaagcgugg

SEQ ID NO: 982583 - RNA, 20 nt, Human
uuccuggcggcggcggcagc

SEQ ID NO: 982584 - RNA, 21 nt, Human
uugaaugaagcccaaggccaa

SEQ ID NO: 982585 - RNA, 22 nt, Human
uuguacaaaguacaaaaaaacc

SEQ ID NO: 982586 - RNA, 23 nt, Human
uuugcagcuugucuuucacugca

SEQ ID NO: 982587 - RNA, 26 nt, Human
aaaaagacaaauacaggacuucaugg

SEQ ID NO: 982588 - RNA, 21 nt, Human
aaaacuccuagguacaucaga

SEQ ID NO: 982589 - RNA, 18 nt, Human
aagagacucugaucagca

SEQ ID NO: 982590 - RNA, 24 nt, Human
aaggaucaacaggucuuggucagc

SEQ ID NO: 982591 - RNA, 23 nt, Human
aaggggcuuggugacuggccucg

SEQ ID NO: 982592 - RNA, 18 nt, Human
acccuuaacaaucacggg

SEQ ID NO: 982593 - RNA, 22 nt, Human
agacauguuuaaaaaaagagaa

SEQ ID NO: 982594 - RNA, 21 nt, Human
agagagaagggauggggcucu

SEQ ID NO: 982595 - RNA, 21 nt, Human
agagagaagggauggggcucu

SEQ ID NO: 982596 - RNA, 18 nt, Human
agccuuaggaagggaagc

SEQ ID NO: 982597 - RNA, 22 nt, Human
agcuugguuccuucccacuucu

SEQ ID NO: 982598 - RNA, 22 nt, Human
aggaagggaagcaucacucagg

SEQ ID NO: 982599 - RNA, 20 nt, Human
aggaguucuuucucuccuac

SEQ ID NO: 982600 - RNA, 23 nt, Human
aggaucaacaggucuuggucagc

SEQ ID NO: 982601 - RNA, 24 nt, Human
agggcugggauucggaaggaucuc

SEQ ID NO: 982602 - RNA, 19 nt, Human
agguggccgcccgagcugg

SEQ ID NO: 982603 - RNA, 19 nt, Human
agguggccgcccgagcugg

SEQ ID NO: 982604 - RNA, 22 nt, Human
auaguaacagcaguaaauaaac

SEQ ID NO: 982605 - RNA, 24 nt, Human
auaguaacagcaguaaauaaacac

SEQ ID NO: 982606 - RNA, 18 nt, Human
auguccaugguuagacaa

SEQ ID NO: 982607 - RNA, 20 nt, Human
auucacaugagaguuccuac

SEQ ID NO: 982608 - RNA, 20 nt, Human
auucucaccuccaaccccgu

SEQ ID NO: 982609 - RNA, 23 nt, Human
auucuugucuuuagcuuuaaagg

SEQ ID NO: 982610 - RNA, 23 nt, Human
caaaacuccuagguacaucagaa

SEQ ID NO: 982611 - RNA, 24 nt, Human
caccuccaaccccguuggaggccc

SEQ ID NO: 982612 - RNA, 23 nt, Human
caccucuacccuaccugggauuc

SEQ ID NO: 982613 - RNA, 22 nt, Human
cacuuugaaaaacaggcagggg

SEQ ID NO: 982614 - RNA, 19 nt, Human
cagccuuuacaugcgacau

SEQ ID NO: 982615 - RNA, 19 nt, Human
cagcuguucuuagaaagca

SEQ ID NO: 982616 - RNA, 20 nt, Human
cagugaggccugugucagcu

SEQ ID NO: 982617 - RNA, 22 nt, Human
ccagggcugggauucggaagga

SEQ ID NO: 982618 - RNA, 19 nt, Human
cccaagagacucugaucag

SEQ ID NO: 982619 - RNA, 18 nt, Human
ccccagauccuggaggac

SEQ ID NO: 982620 - RNA, 18 nt, Human
ccccagauccuggaggac

SEQ ID NO: 982621 - RNA, 23 nt, Human
cccccuggccuuaguggaaacuc

SEQ ID NO: 982622 - RNA, 20 nt, Human
cccccuggccuuaguggaac

SEQ ID NO: 982623 - RNA, 21 nt, Human
cccguuggaggcccccuggcc

SEQ ID NO: 982624 - RNA, 24 nt, Human
cccuggccuuaguggaaacucauc

SEQ ID NO: 982625 - RNA, 19 nt, Human
ccgcccccgaaauaugacc

SEQ ID NO: 982626 - RNA, 20 nt, Human
ccuacauguaguaaaaagac

SEQ ID NO: 982627 - RNA, 22 nt, Human
ccuccaaccccguuggaggccc

SEQ ID NO: 982628 - RNA, 18 nt, Human
ccuguaucuggaagaaaa

SEQ ID NO: 982629 - RNA, 24 nt, Human
ccuuaguggaaacucaucuccuug

SEQ ID NO: 982630 - RNA, 18 nt, Human
cgccugcgcgcccggaag

SEQ ID NO: 982631 - RNA, 19 nt, Human
cuccaaccccguuggaggc

SEQ ID NO: 982632 - RNA, 19 nt, Human
cucccauagaauggauuac

SEQ ID NO: 982633 - RNA, 20 nt, Human
gaaauaugaccuacuugaaa

SEQ ID NO: 982634 - RNA, 21 nt, Human
gagagaagggucaccgcggca

SEQ ID NO: 982635 - RNA, 21 nt, Human
gagagaagggucaccgcggca

SEQ ID NO: 982636 - RNA, 19 nt, Human
gauucucaccuccaacccc

SEQ ID NO: 982637 - RNA, 21 nt, Human
gcaguaaauaaacacuuugaa

SEQ ID NO: 982638 - RNA, 21 nt, Human
ggauucggaaggaucucggca

SEQ ID NO: 982639 - RNA, 23 nt, Human
ggcagagagagaagggauggggc

SEQ ID NO: 982640 - RNA, 23 nt, Human
ggcagagagagaagggauggggc

SEQ ID NO: 982641 - RNA, 24 nt, Human
gggcuuggugacuggccucgguuc

SEQ ID NO: 982642 - RNA, 18 nt, Human
gguguccgaaaugguggc

SEQ ID NO: 982643 - RNA, 18 nt, Human
gguguccgaaaugguggc

SEQ ID NO: 982644 - RNA, 18 nt, Human
guagaaugccuauaccua

SEQ ID NO: 982645 - RNA, 20 nt, Human
guagaaugccuauaccuaca

SEQ ID NO: 982646 - RNA, 19 nt, Human
guaguaaaaagacaaauac

SEQ ID NO: 982647 - RNA, 19 nt, Human
uaaaaugggauaaauacuc

SEQ ID NO: 982648 - RNA, 20 nt, Human
uaaaaugggauaaauacuca

SEQ ID NO: 982649 - RNA, 26 nt, Human
uacaucagaaugcaaaauauaaaaug

SEQ ID NO: 982650 - RNA, 25 nt, Human
uacuacaguacucauucacaugaga

SEQ ID NO: 982651 - RNA, 24 nt, Human
uagaaugccuauaccuacauuggu

SEQ ID NO: 982652 - RNA, 24 nt, Human
uauucuugucuuuagcuuuaaagg

SEQ ID NO: 982653 - RNA, 24 nt, Human
ucaaaguauucuacacaguagaag

SEQ ID NO: 982654 - RNA, 22 nt, Human
ucauggucacuuuuuuugguug

SEQ ID NO: 982655 - RNA, 24 nt, Human
uccaugguuagacaauucaaggac

SEQ ID NO: 982656 - RNA, 18 nt, Human
ucuaaagccauuuccaaa

SEQ ID NO: 982657 - RNA, 18 nt, Human
ucuuagaaagcauuccau

SEQ ID NO: 982658 - RNA, 22 nt, Human
ugaaaaacaggcagguaucccc

SEQ ID NO: 982659 - RNA, 18 nt, Human
ugauauucuugucuuuag

SEQ ID NO: 982660 - RNA, 23 nt, Human
ugcauaaaaugggauaaauacuc

SEQ ID NO: 982661 - RNA, 19 nt, Human
ugcaucacugcucgaaagc

SEQ ID NO: 982662 - RNA, 18 nt, Human
ugcccaagagacucugau

SEQ ID NO: 982663 - RNA, 18 nt, Human
uggaagaaaauuaaguca

SEQ ID NO: 982664 - RNA, 20 nt, Human
ugucagcuugguuccuuccc

SEQ ID NO: 982665 - RNA, 20 nt, Human
uguccgaaaugguggcagag

SEQ ID NO: 982666 - RNA, 20 nt, Human
uguccgaaaugguggcagag

SEQ ID NO: 982667 - RNA, 18 nt, Human
uuaaacaccuagcuaccu

SEQ ID NO: 982668 - RNA, 19 nt, Human
uuacuacaguacucauuca

SEQ ID NO: 982669 - RNA, 18 nt, Human
uucaaaggguagaaugcc

SEQ ID NO: 982670 - RNA, 24 nt, Human
uucuaaagccauuuccaaaaaauc

SEQ ID NO: 982671 - RNA, 18 nt, Human
uuggaggcccccuggccu

SEQ ID NO: 982672 - RNA, 20 nt, Human
uugucugcgcacccgccccu

SEQ ID NO: 982673 - RNA, 23 nt, Human
uuuccaaaaaaucaauggcaaca

SEQ ID NO: 982674 - RNA, 25 nt, Human
aaaaaaagaaaaaucagccucaaag

SEQ ID NO: 982675 - RNA, 26 nt, Human
aaaaaagaaaaaucagccucaaagga

SEQ ID NO: 982676 - RNA, 24 nt, Human
aaaugacacuccucccuccacccu

SEQ ID NO: 982677 - RNA, 25 nt, Human
aagcacccccucggccccugccucc

SEQ ID NO: 982678 - RNA, 18 nt, Human
acacuccucccuccaccc

SEQ ID NO: 982679 - RNA, 18 nt, Human
acagagcggccgacaccc

SEQ ID NO: 982680 - RNA, 23 nt, Human
acagcaccagaggcugcugcacc

SEQ ID NO: 982681 - RNA, 25 nt, Human
accccugagaccccacggccccagg

SEQ ID NO: 982682 - RNA, 20 nt, Human
acuuaaaaaaaagaaaaauc

SEQ ID NO: 982683 - RNA, 27 nt, Human
agaaaugacacuccucccuccacccuc

SEQ ID NO: 982684 - RNA, 23 nt, Human
agaauccugcgugugacaucccc

SEQ ID NO: 982685 - RNA, 22 nt, Human
agcacccccucggccccugccu

SEQ ID NO: 982686 - RNA, 19 nt, Human
agcucugggggcccugccu

SEQ ID NO: 982687 - RNA, 21 nt, Human
aggggccacucccuuggacag

SEQ ID NO: 982688 - RNA, 24 nt, Human
auaagguuucccccaagugggcag

SEQ ID NO: 982689 - RNA, 23 nt, Human
caaggccccacacaagaaacuga

SEQ ID NO: 982690 - RNA, 18 nt, Human
cacccccucggccccugc

SEQ ID NO: 982691 - RNA, 24 nt, Human
caccucccccacaacagagcggcc

SEQ ID NO: 982692 - RNA, 19 nt, Human
cacuccucccuccacccuc

SEQ ID NO: 982693 - RNA, 25 nt, Human
cacuccucccuccacccucgccaag

SEQ ID NO: 982694 - RNA, 26 nt, Human
cacuguguggcccagcucugggggcu

SEQ ID NO: 982695 - RNA, 20 nt, Human
cagaauucaccaggcacccc

SEQ ID NO: 982696 - RNA, 22 nt, Human
cagcaccagaggcugcugcacc

SEQ ID NO: 982697 - RNA, 24 nt, Human
cagcaccagaggcugcugcaccag

SEQ ID NO: 982698 - RNA, 25 nt, Human
cagcaccagaggcugcugcaccaga

SEQ ID NO: 982699 - RNA, 20 nt, Human
caggaguccaugucaggcag

SEQ ID NO: 982700 - RNA, 22 nt, Human
ccacucuuccuuuuugcucgcc

SEQ ID NO: 982701 - RNA, 24 nt, Human
ccagcccagacaguacaauggcuc

SEQ ID NO: 982702 - RNA, 22 nt, Human
ccaggcaccccugagaccccac

SEQ ID NO: 982703 - RNA, 19 nt, Human
cccacacaagaaacugaau

SEQ ID NO: 982704 - RNA, 23 nt, Human
cccacagaauccugcgugugaca

SEQ ID NO: 982705 - RNA, 25 nt, Human
cccacagaauccugcgugugacauc

SEQ ID NO: 982706 - RNA, 18 nt, Human
cccacucuuccuuuuugc

SEQ ID NO: 982707 - RNA, 19 nt, Human
cccacucuuccuuuuugcu

SEQ ID NO: 982708 - RNA, 18 nt, Human
cccagcacccacugugug

SEQ ID NO: 982709 - RNA, 21 nt, Human
cccagcacccacuguguggcc

SEQ ID NO: 982710 - RNA, 18 nt, Human
ccccaagugggcaggagu

SEQ ID NO: 982711 - RNA, 21 nt, Human
ccccacggccccaggggucuc

SEQ ID NO: 982712 - RNA, 21 nt, Human
cccccaagugggcaggagucc

SEQ ID NO: 982713 - RNA, 23 nt, Human
cccccaagugggcaggaguccau

SEQ ID NO: 982714 - RNA, 24 nt, Human
cccccacaacagagcggccgacac

SEQ ID NO: 982715 - RNA, 22 nt, Human
cccccucggccccugccuccuc

SEQ ID NO: 982716 - RNA, 18 nt, Human
ccccuccuccucccacuc

SEQ ID NO: 982717 - RNA, 20 nt, Human
ccccuccuccucccacucuu

SEQ ID NO: 982718 - RNA, 19 nt, Human
ccccucggccccugccucc

SEQ ID NO: 982719 - RNA, 19 nt, Human
ccccucuuccuccuccucc

SEQ ID NO: 982720 - RNA, 22 nt, Human
ccccugagaccccacggcccca

SEQ ID NO: 982721 - RNA, 25 nt, Human
ccccugccuccucuccacccuucuc

SEQ ID NO: 982722 - RNA, 18 nt, Human
ccccuuggacuccucucc

SEQ ID NO: 982723 - RNA, 21 nt, Human
cccugccuugcccugccccuc

SEQ ID NO: 982724 - RNA, 19 nt, Human
ccguuccgcgaacacacac

SEQ ID NO: 982725 - RNA, 20 nt, Human
ccucacauggagaagccagg

SEQ ID NO: 982726 - RNA, 22 nt, Human
ccucccugguucaccuccccca

SEQ ID NO: 982727 - RNA, 22 nt, Human
ccuccucuuccuccuucgccgc

SEQ ID NO: 982728 - RNA, 24 nt, Human
ccuccucuuccuccuucgccgcuu

SEQ ID NO: 982729 - RNA, 19 nt, Human
ccucggccccugccuccuc

SEQ ID NO: 982730 - RNA, 19 nt, Human
ccugccuccucuccacccu

SEQ ID NO: 982731 - RNA, 23 nt, Human
ccuuugugcuccccucuuccucc

SEQ ID NO: 982732 - RNA, 26 nt, Human
cgaggcucuuuucucucucucuuuuc

SEQ ID NO: 982733 - RNA, 22 nt, Human
cgccaggacgcagcuuuaccaa

SEQ ID NO: 982734 - RNA, 26 nt, Human
cgccgcuuccccuccuccucccacuc

SEQ ID NO: 982735 - RNA, 18 nt, Human
cggccccugccuccucuc

SEQ ID NO: 982736 - RNA, 21 nt, Human
cuccccucuuccuccuccucc

SEQ ID NO: 982737 - RNA, 20 nt, Human
cuccucccuccacccucgcc

SEQ ID NO: 982738 - RNA, 24 nt, Human
cuccuguccuggaauccagccgcc

SEQ ID NO: 982739 - RNA, 21 nt, Human
cucucucucucucucucugcc

SEQ ID NO: 982740 - RNA, 19 nt, Human
cucugccuuuauuuguccc

SEQ ID NO: 982741 - RNA, 19 nt, Human
cugcgugugacaucccccc

SEQ ID NO: 982742 - RNA, 21 nt, Human
cuuccuuuuugcucgccuuuu

SEQ ID NO: 982743 - RNA, 20 nt, Human
cuucuuuccuuucccauccc

SEQ ID NO: 982744 - RNA, 20 nt, Human
cuuuauuuguccccuuggac

SEQ ID NO: 982745 - RNA, 23 nt, Human
gaccccacggccccaggggucuc

SEQ ID NO: 982746 - RNA, 18 nt, Human
gagaagccagguuuccag

SEQ ID NO: 982747 - RNA, 19 nt, Human
gauaacgaaauccuaaggg

SEQ ID NO: 982748 - RNA, 22 nt, Human
gcccagcacccacuguguggcc

SEQ ID NO: 982749 - RNA, 22 nt, Human
gcucuuuucucucucucuuuuc

SEQ ID NO: 982750 - RNA, 19 nt, Human
ggcgaggcccagcacccac

SEQ ID NO: 982751 - RNA, 23 nt, Human
gggccacucccuuggacaguguc

SEQ ID NO: 982752 - RNA, 22 nt, Human
ggggcgaggcccagcacccacu

SEQ ID NO: 982753 - RNA, 19 nt, Human
gggggcccugccuugcccu

SEQ ID NO: 982754 - RNA, 21 nt, Human
uaaaaaaaagaaaaaucagcc

SEQ ID NO: 982755 - RNA, 21 nt, Human
uaagugcagaauucaccaggc

SEQ ID NO: 982756 - RNA, 18 nt, Human
uagaacuuaaaaaaaaga

SEQ ID NO: 982757 - RNA, 18 nt, Human
uagauauaacuggauaaa

SEQ ID NO: 982758 - RNA, 22 nt, Human
ucaccaggcaccccugagaccc

SEQ ID NO: 982759 - RNA, 24 nt, Human
ucauaggggccacucccuuggaca

SEQ ID NO: 982760 - RNA, 20 nt, Human
uccacaguccccacagaauc

SEQ ID NO: 982761 - RNA, 19 nt, Human
ucccccacaacagagcggc

SEQ ID NO: 982762 - RNA, 24 nt, Human
ucccccccagcccagacaguacaa

SEQ ID NO: 982763 - RNA, 21 nt, Human
uccccucuuccuccuccuccu

SEQ ID NO: 982764 - RNA, 22 nt, Human
ucccugguucaccucccccaca

SEQ ID NO: 982765 - RNA, 19 nt, Human
ucccuuagagauuuucagc

SEQ ID NO: 982766 - RNA, 24 nt, Human
uccgcgaacacacaccucgaugaa

SEQ ID NO: 982767 - RNA, 18 nt, Human
uccuccuccuccucuucc

SEQ ID NO: 982768 - RNA, 22 nt, Human
uccuccucuuccuccuucgccg

SEQ ID NO: 982769 - RNA, 24 nt, Human
uccuuuuugcucgccuuuucccuu

SEQ ID NO: 982770 - RNA, 22 nt, Human
ucgccgcuuccccuccuccucc

SEQ ID NO: 982771 - RNA, 19 nt, Human
ucgccuuuucccuccuccu

SEQ ID NO: 982772 - RNA, 21 nt, Human
ucucucuuuucuuccucuccc

SEQ ID NO: 982773 - RNA, 21 nt, Human
ucuuccuccuccuccucuucc

SEQ ID NO: 982774 - RNA, 23 nt, Human
ucuuuucuuccucucccucucuc

SEQ ID NO: 982775 - RNA, 21 nt, Human
ugaaccgcaaggccccacaca

SEQ ID NO: 982776 - RNA, 25 nt, Human
ugaagcagugguuaaaauauaaacc

SEQ ID NO: 982777 - RNA, 27 nt, Human
ugagaccccacggccccaggggucucc

SEQ ID NO: 982778 - RNA, 18 nt, Human
ugcccugccccucccugg

SEQ ID NO: 982779 - RNA, 22 nt, Human
ugcccugccccucccugguuca

SEQ ID NO: 982780 - RNA, 18 nt, Human
uggaaucgccaggacgca

SEQ ID NO: 982781 - RNA, 18 nt, Human
uggauaaauaaaaaaagu

SEQ ID NO: 982782 - RNA, 22 nt, Human
uggcccagcucugggggcccug

SEQ ID NO: 982783 - RNA, 22 nt, Human
uguaaaaggucagcauuuccug

SEQ ID NO: 982784 - RNA, 25 nt, Human
uucaccaggcaccccugagacccca

SEQ ID NO: 982785 - RNA, 19 nt, Human
uuccuccuucgccgcuucc

SEQ ID NO: 982786 - RNA, 24 nt, Human
uugcccugccccucccugguucaa

SEQ ID NO: 982787 - RNA, 24 nt, Human
uuugcucgccuuuucccuccuccu

SEQ ID NO: 982788 - RNA, 18 nt, Human
uuuugcucgccuuuuccc

SEQ ID NO: 982789 - RNA, 18 nt, Human
uuuuuuuaaacccccuuu

SEQ ID NO: 982790 - RNA, 19 nt, Human
uuuuuuuuuuuuaaacccc

SEQ ID NO: 982791 - RNA, 20 nt, Human
cacacagcaaggggcgggag

SEQ ID NO: 982792 - RNA, 19 nt, Human
cagggccuggauugagccc

SEQ ID NO: 982793 - RNA, 21 nt, Human
ccuggauugagcccacacagc

SEQ ID NO: 982794 - RNA, 24 nt, Human
ggaaacauguuaacagggccugga

SEQ ID NO: 982795 - RNA, 26 nt, Human
uaacucccaauguuggguuucccucc

SEQ ID NO: 982796 - RNA, 28 nt, Human
uauuuuauuggagaugagcaggggaggc

SEQ ID NO: 982797 - RNA, 22 nt, Human
aaaagcuuuuggccacuugaga

SEQ ID NO: 982798 - RNA, 18 nt, Human
aagcaaagcgcucagugc

SEQ ID NO: 982799 - RNA, 20 nt, Human
accuggacugcugucugauc

SEQ ID NO: 982800 - RNA, 24 nt, Human
agccaaaaaaaaaaaaaauggucc

SEQ ID NO: 982801 - RNA, 22 nt, Human
caaaaaaaaaaaaaauggucca

SEQ ID NO: 982802 - RNA, 22 nt, Human
caacuaacccccaucaagugcc

SEQ ID NO: 982803 - RNA, 21 nt, Human
caagugccagacccucccagu

SEQ ID NO: 982804 - RNA, 24 nt, Human
cagcaaagcaguccauuuucccuu

SEQ ID NO: 982805 - RNA, 22 nt, Human
caggcaggcugccaagcaacua

SEQ ID NO: 982806 - RNA, 19 nt, Human
caggcugccaagcaacuaa

SEQ ID NO: 982807 - RNA, 19 nt, Human
ccaagcaacuaacccccau

SEQ ID NO: 982808 - RNA, 21 nt, Human
ccagccaaaaaaaaaaaaaaa

SEQ ID NO: 982809 - RNA, 27 nt, Human
cccagccaaaaaaaaaaaaaauggucc

SEQ ID NO: 982810 - RNA, 24 nt, Human
ccccaucaagugccagacccuccc

SEQ ID NO: 982811 - RNA, 23 nt, Human
cccgcgagcgccccguccgcuga

SEQ ID NO: 982812 - RNA, 21 nt, Human
ccucccaguguucugagaguc

SEQ ID NO: 982813 - RNA, 20 nt, Human
cucccaguguucugagaguc

SEQ ID NO: 982814 - RNA, 21 nt, Human
cuguuggcaagggaaggugaa

SEQ ID NO: 982815 - RNA, 18 nt, Human
gcgcucagugcauugggg

SEQ ID NO: 982816 - RNA, 19 nt, Human
ggaggauuugggcuggagc

SEQ ID NO: 982817 - RNA, 19 nt, Human
uaccuggugacaucauccu

SEQ ID NO: 982818 - RNA, 20 nt, Human
uaccuggugacaucauccug

SEQ ID NO: 982819 - RNA, 23 nt, Human
ucacuuuagcaucugggguagga

SEQ ID NO: 982820 - RNA, 22 nt, Human
ucuccaugcuaaacagccugcg

SEQ ID NO: 982821 - RNA, 28 nt, Human
ucucuacccagccaaaaaaaaaaaaaaa

SEQ ID NO: 982822 - RNA, 22 nt, Human
ucuguuggcaagggaaggugaa

SEQ ID NO: 982823 - RNA, 24 nt, Human
ugaagaagcaaagcgcucagugca

SEQ ID NO: 982824 - RNA, 18 nt, Human
ugacaagguggugauaca

SEQ ID NO: 982825 - RNA, 21 nt, Human
ugccagacccucccaguguuc

SEQ ID NO: 982826 - RNA, 22 nt, Human
ugccagacccucccaguguucu

SEQ ID NO: 982827 - RNA, 24 nt, Human
ugccuuugaccuggacugcugucu

SEQ ID NO: 982828 - RNA, 18 nt, Human
uggcaagggaaggugaag

SEQ ID NO: 982829 - RNA, 19 nt, Human
ugggguaggaugugccacc

SEQ ID NO: 982830 - RNA, 24 nt, Human
uuaccuggugacaucauccuguug

SEQ ID NO: 982831 - RNA, 22 nt, Human
uuugccuuugaccuggacugcu

SEQ ID NO: 982832 - RNA, 22 nt, Human
aaaaggccagcauaguacagug

SEQ ID NO: 982833 - RNA, 24 nt, Human
aaguaugaacaaaauuagaacugg

SEQ ID NO: 982834 - RNA, 24 nt, Human
aagugccaaaagcaaaaccaagga

SEQ ID NO: 982835 - RNA, 22 nt, Human
acaccugcccaggcuuccacag

SEQ ID NO: 982836 - RNA, 22 nt, Human
accccaucccacaaaauccaca

SEQ ID NO: 982837 - RNA, 19 nt, Human
agcuacacaacucaaagag

SEQ ID NO: 982838 - RNA, 22 nt, Human
aggggugggguagaaaagagga

SEQ ID NO: 982839 - RNA, 22 nt, Human
agguucuuucccacuccccacc

SEQ ID NO: 982840 - RNA, 23 nt, Human
agguucuuucccacuccccaccc

SEQ ID NO: 982841 - RNA, 24 nt, Human
agugccaaaagcaaaaccaaggaa

SEQ ID NO: 982842 - RNA, 21 nt, Human
auggacucuccccucuaccuc

SEQ ID NO: 982843 - RNA, 26 nt, Human
auggagcagggcuaacccauagagaa

SEQ ID NO: 982844 - RNA, 23 nt, Human
caaacaggaagccugcggcuuau

SEQ ID NO: 982845 - RNA, 21 nt, Human
cacaaaauccacaaucucaga

SEQ ID NO: 982846 - RNA, 20 nt, Human
cacagugcagccugccaggc

SEQ ID NO: 982847 - RNA, 21 nt, Human
cacccaggcagagccaggagc

SEQ ID NO: 982848 - RNA, 26 nt, Human
caccccaucccacaaaauccacaauc

SEQ ID NO: 982849 - RNA, 27 nt, Human
cagaaauacuaccacgacuucuacuau

SEQ ID NO: 982850 - RNA, 18 nt, Human
cagagaagugccaaaagc

SEQ ID NO: 982851 - RNA, 23 nt, Human
ccagaagccucugcuccauuuug

SEQ ID NO: 982852 - RNA, 22 nt, Human
ccaucccacaaaauccacaauc

SEQ ID NO: 982853 - RNA, 22 nt, Human
ccccaucccacaaaauccacaa

SEQ ID NO: 982854 - RNA, 19 nt, Human
ccucaccccaucccacaaa

SEQ ID NO: 982855 - RNA, 22 nt, Human
ccugccaggccagcagcaaacu

SEQ ID NO: 982856 - RNA, 23 nt, Human
ccuggcuauaguaaaugauccca

SEQ ID NO: 982857 - RNA, 20 nt, Human
cuaaaucucaguuagcuaaa

SEQ ID NO: 982858 - RNA, 21 nt, Human
cuaacuagugcuggcccagaa

SEQ ID NO: 982859 - RNA, 23 nt, Human
cucaaagagucaaaccagagcag

SEQ ID NO: 982860 - RNA, 28 nt, Human
cuccccucuaccucaccccaucccacaa

SEQ ID NO: 982861 - RNA, 24 nt, Human
cugccaggccagcagcaaacuaac

SEQ ID NO: 982862 - RNA, 18 nt, Human
cugcccaggcuuccacag

SEQ ID NO: 982863 - RNA, 20 nt, Human
cuguguggaauucugucuau

SEQ ID NO: 982864 - RNA, 21 nt, Human
cuuuggcuaaaaacaaaccuu

SEQ ID NO: 982865 - RNA, 27 nt, Human
cuuuucagacccacccaggcagagcca

SEQ ID NO: 982866 - RNA, 21 nt, Human
gaaucaaauguaagucaguau

SEQ ID NO: 982867 - RNA, 23 nt, Human
gacaugguggaaguacuuuuccu

SEQ ID NO: 982868 - RNA, 18 nt, Human
gacugcuccuuauggagc

SEQ ID NO: 982869 - RNA, 19 nt, Human
gacuguuccaaacucuccc

SEQ ID NO: 982870 - RNA, 21 nt, Human
gaggaaaaggccagcauagua

SEQ ID NO: 982871 - RNA, 22 nt, Human
gagucacagggagcugaggaua

SEQ ID NO: 982872 - RNA, 19 nt, Human
gcagccugccaggccagca

SEQ ID NO: 982873 - RNA, 18 nt, Human
gccccaggaaggccugcu

SEQ ID NO: 982874 - RNA, 22 nt, Human
gccugagcaguuccaacuaucc

SEQ ID NO: 982875 - RNA, 19 nt, Human
gcuggggccuuuuucuccc

SEQ ID NO: 982876 - RNA, 20 nt, Human
gcuuccccuucccaccauga

SEQ ID NO: 982877 - RNA, 19 nt, Human
gcuuuaaagaacuucaaca

SEQ ID NO: 982878 - RNA, 18 nt, Human
ggaaguacuuuuccuggc

SEQ ID NO: 982879 - RNA, 19 nt, Human
ggagcucccuacaagggcu

SEQ ID NO: 982880 - RNA, 19 nt, Human
ggagucacagggagcugag

SEQ ID NO: 982881 - RNA, 24 nt, Human
ggccugcuuagggaucuggaguca

SEQ ID NO: 982882 - RNA, 20 nt, Human
ggcuuauccagguggggaca

SEQ ID NO: 982883 - RNA, 23 nt, Human
ggucgguggggaggucccaaggu

SEQ ID NO: 982884 - RNA, 27 nt, Human
uaaaaaaggggcuaaugcuaaaucuca

SEQ ID NO: 982885 - RNA, 19 nt, Human
uaaagaacuucaacacagg

SEQ ID NO: 982886 - RNA, 18 nt, Human
uaacccauagaguagccc

SEQ ID NO: 982887 - RNA, 19 nt, Human
uaacccauagaguagcccu

SEQ ID NO: 982888 - RNA, 23 nt, Human
uaacuagugcuggcccagaagcc

SEQ ID NO: 982889 - RNA, 21 nt, Human
uacacaacucaaagagucaaa

SEQ ID NO: 982890 - RNA, 18 nt, Human
uagcacauggcagagccu

SEQ ID NO: 982891 - RNA, 24 nt, Human
uagcacauggcagagccuagaauc

SEQ ID NO: 982892 - RNA, 21 nt, Human
uagguguuucugacugcauuu

SEQ ID NO: 982893 - RNA, 19 nt, Human
uagguucuuucccacuccc

SEQ ID NO: 982894 - RNA, 18 nt, Human
ucaaucucacugccugau

SEQ ID NO: 982895 - RNA, 18 nt, Human
ucaaucucacugccugau

SEQ ID NO: 982896 - RNA, 19 nt, Human
ucaaucucacugccugaug

SEQ ID NO: 982897 - RNA, 18 nt, Human
ucaggccaggccccagga

SEQ ID NO: 982898 - RNA, 22 nt, Human
uccacaaucucagagcugugca

SEQ ID NO: 982899 - RNA, 20 nt, Human
ucccaagguuugaaguggga

SEQ ID NO: 982900 - RNA, 19 nt, Human
ucccacuccccacccagga

SEQ ID NO: 982901 - RNA, 26 nt, Human
ucccacuccccacccaggaguaagga

SEQ ID NO: 982902 - RNA, 22 nt, Human
ucuggguauugagguuucacua

SEQ ID NO: 982903 - RNA, 20 nt, Human
ugaacaaaauuagaacuggg

SEQ ID NO: 982904 - RNA, 22 nt, Human
ugacaugaaucaaauguaaguc

SEQ ID NO: 982905 - RNA, 19 nt, Human
ugaccccuuagagacuccu

SEQ ID NO: 982906 - RNA, 21 nt, Human
ugacucccaagcuacacaacu

SEQ ID NO: 982907 - RNA, 21 nt, Human
ugagccagaggaaaaggccag

SEQ ID NO: 982908 - RNA, 20 nt, Human
ugagccagaggaaaaggccg

SEQ ID NO: 982909 - RNA, 21 nt, Human
ugcagaagaaaccagaagcuu

SEQ ID NO: 982910 - RNA, 19 nt, Human
ugcauuugagggcuauuuu

SEQ ID NO: 982911 - RNA, 26 nt, Human
ugccagggacuguuccaaacucuccc

SEQ ID NO: 982912 - RNA, 19 nt, Human
ugccaugcucuccauagag

SEQ ID NO: 982913 - RNA, 27 nt, Human
ugccaugcucuccauagaggcaauaua

SEQ ID NO: 982914 - RNA, 21 nt, Human
ugcuuuggcuaaaaacaaacc

SEQ ID NO: 982915 - RNA, 23 nt, Human
uggagcagggcuaacccauagag

SEQ ID NO: 982916 - RNA, 21 nt, Human
ugggguagaaaagaggaagcu

SEQ ID NO: 982917 - RNA, 19 nt, Human
ugucuugcguauuuccuuc

SEQ ID NO: 982918 - RNA, 24 nt, Human
ugugcagaagaaaccagaagcuuc

SEQ ID NO: 982919 - RNA, 21 nt, Human
uucacuaagaauucuaggugu

SEQ ID NO: 982920 - RNA, 19 nt, Human
uucaggccaggccccagga

SEQ ID NO: 982921 - RNA, 25 nt, Human
uuccaggcccacagcugcagccugc

SEQ ID NO: 982922 - RNA, 23 nt, Human
uuucagacccacccaggcagagc

SEQ ID NO: 982923 - RNA, 19 nt, Human
uuuuccaggcccacagcug

SEQ ID NO: 982924 - RNA, 24 nt, Human
aaaaaaaaaaaaaaaaagguggga

SEQ ID NO: 982925 - RNA, 27 nt, Human
aaaaaaaaaaaaaaggugggaggguag

SEQ ID NO: 982926 - RNA, 21 nt, Human
aaaaaaaaaaaggugggaggg

SEQ ID NO: 982927 - RNA, 23 nt, Human
aaaaaaagguggggaguggaggg

SEQ ID NO: 982928 - RNA, 25 nt, Human
aaacugucucauuucaaugauuuuu

SEQ ID NO: 982929 - RNA, 27 nt, Human
aacaaaagcuacccuuauacaacccac

SEQ ID NO: 982930 - RNA, 23 nt, Human
aacaacaaaagcuacccuuauac

SEQ ID NO: 982931 - RNA, 20 nt, Human
aacagcuuucaacccugugu

SEQ ID NO: 982932 - RNA, 18 nt, Human
aacuaagcaacaagacag

SEQ ID NO: 982933 - RNA, 23 nt, Human
aaugcacaugcuccccugaaagg

SEQ ID NO: 982934 - RNA, 23 nt, Human
acaaagcagaaauaaauaggcag

SEQ ID NO: 982935 - RNA, 21 nt, Human
acaagaaauuuuugcaagccc

SEQ ID NO: 982936 - RNA, 21 nt, Human
acccuuuucaguucuuuaugc

SEQ ID NO: 982937 - RNA, 24 nt, Human
acuccagaacccuuuucaguucuu

SEQ ID NO: 982938 - RNA, 21 nt, Human
acugaaaacagcccacagucu

SEQ ID NO: 982939 - RNA, 19 nt, Human
agaugccacuugaacauga

SEQ ID NO: 982940 - RNA, 21 nt, Human
agccuccuccacucuaagcag

SEQ ID NO: 982941 - RNA, 22 nt, Human
agguggggaguggagggugggg

SEQ ID NO: 982942 - RNA, 18 nt, Human
agucacuuaaauaagcag

SEQ ID NO: 982943 - RNA, 21 nt, Human
aguuucaacucuuccacuugc

SEQ ID NO: 982944 - RNA, 23 nt, Human
auaaauaucagccaauauaaaua

SEQ ID NO: 982945 - RNA, 21 nt, Human
auaagcagaaacucccuagau

SEQ ID NO: 982946 - RNA, 23 nt, Human
auauacaucacugagaacaaagc

SEQ ID NO: 982947 - RNA, 21 nt, Human
caaaaaucagcacaaucccac

SEQ ID NO: 982948 - RNA, 23 nt, Human
caacaagacagcuuacacagcuc

SEQ ID NO: 982949 - RNA, 23 nt, Human
caacauaaagcaguaaauauccc

SEQ ID NO: 982950 - RNA, 25 nt, Human
caacauaaagcaguaaauaucccuu

SEQ ID NO: 982951 - RNA, 18 nt, Human
caauugccugaaucccca

SEQ ID NO: 982952 - RNA, 21 nt, Human
cacaacuuuuccccucuccaa

SEQ ID NO: 982953 - RNA, 19 nt, Human
caccaaccccagcucccgc

SEQ ID NO: 982954 - RNA, 21 nt, Human
cagcacaaucccacacaauaa

SEQ ID NO: 982955 - RNA, 19 nt, Human
cagcagugccggcccccag

SEQ ID NO: 982956 - RNA, 23 nt, Human
cagcagugggccuugcuaacagc

SEQ ID NO: 982957 - RNA, 19 nt, Human
cagcgccgccgccgcagca

SEQ ID NO: 982958 - RNA, 20 nt, Human
cagcgccgccgccgcagcag

SEQ ID NO: 982959 - RNA, 25 nt, Human
caguaaaucacagugaaagcccugg

SEQ ID NO: 982960 - RNA, 24 nt, Human
cauauacaucacugagaacaaagc

SEQ ID NO: 982961 - RNA, 23 nt, Human
cauccccccgcccccuccggccc

SEQ ID NO: 982962 - RNA, 19 nt, Human
cauuuuauaaacucuauac

SEQ ID NO: 982963 - RNA, 28 nt, Human
ccaaacaccaaccccagcucccgcgccu

SEQ ID NO: 982964 - RNA, 27 nt, Human
ccaaacauccaucugcauugcaguaac

SEQ ID NO: 982965 - RNA, 26 nt, Human
cccacagucucuuuggccagccuccu

SEQ ID NO: 982966 - RNA, 26 nt, Human
ccccauauccccccaccucggcuuaa

SEQ ID NO: 982967 - RNA, 19 nt, Human
ccccgcccccuccggcccg

SEQ ID NO: 982968 - RNA, 19 nt, Human
cccgcgccgccgccgccgc

SEQ ID NO: 982969 - RNA, 18 nt, Human
cccggcugcguucauugg

SEQ ID NO: 982970 - RNA, 21 nt, Human
ccgcccccgccgccucagaca

SEQ ID NO: 982971 - RNA, 21 nt, Human
ccgcccccuccggcccgcgcu

SEQ ID NO: 982972 - RNA, 18 nt, Human
ccgccgccgccgcggcgc

SEQ ID NO: 982973 - RNA, 23 nt, Human
ccgccggcgacuccuccggccgc

SEQ ID NO: 982974 - RNA, 22 nt, Human
ccgccucagacacgggcucccg

SEQ ID NO: 982975 - RNA, 18 nt, Human
ccgcgccgccgccgccgc

SEQ ID NO: 982976 - RNA, 18 nt, Human
ccgcgcuggucguaguac

SEQ ID NO: 982977 - RNA, 20 nt, Human
ccggcccccagcugguccug

SEQ ID NO: 982978 - RNA, 27 nt, Human
ccgguuauuuaaaaaaaaaaaaaaaaa

SEQ ID NO: 982979 - RNA, 26 nt, Human
ccugaauccccauauccccccaccuc

SEQ ID NO: 982980 - RNA, 21 nt, Human
ccuugcuaacagcuccuccca

SEQ ID NO: 982981 - RNA, 19 nt, Human
cgagaccgggauccgcugc

SEQ ID NO: 982982 - RNA, 19 nt, Human
cgccccggccgccugcagc

SEQ ID NO: 982983 - RNA, 18 nt, Human
cgccgccgccgccgcggc

SEQ ID NO: 982984 - RNA, 24 nt, Human
cgccgccgccgccgcggcgcaucc

SEQ ID NO: 982985 - RNA, 19 nt, Human
cgccugcagcucgccggcu

SEQ ID NO: 982986 - RNA, 21 nt, Human
cgcggcgcauccccccgcccc

SEQ ID NO: 982987 - RNA, 24 nt, Human
cgcugcucuggcgccgccaaacac

SEQ ID NO: 982988 - RNA, 21 nt, Human
cggcccccagcugguccugcu

SEQ ID NO: 982989 - RNA, 19 nt, Human
cggccgcccccgccgccuc

SEQ ID NO: 982990 - RNA, 21 nt, Human
cggccuccggagcucugaucc

SEQ ID NO: 982991 - RNA, 22 nt, Human
cggccuccggagcucugauccc

SEQ ID NO: 982992 - RNA, 21 nt, Human
cggcgcauccccccgcccccu

SEQ ID NO: 982993 - RNA, 23 nt, Human
cggugcacgacacccgcgcugcu

SEQ ID NO: 982994 - RNA, 19 nt, Human
cucgcacauucgcucgcau

SEQ ID NO: 982995 - RNA, 22 nt, Human
cucuaagcagcagugccggccc

SEQ ID NO: 982996 - RNA, 19 nt, Human
cugcggcgagaccgggauc

SEQ ID NO: 982997 - RNA, 24 nt, Human
cuguagcuuuccaaaacucaauaa

SEQ ID NO: 982998 - RNA, 23 nt, Human
cuuuaugcacaacuuuuccccuc

SEQ ID NO: 982999 - RNA, 21 nt, Human
cuuuuccacaguacacauuuu

SEQ ID NO: 983000 - RNA, 19 nt, Human
gaaaacaguccccuaucca

SEQ ID NO: 983001 - RNA, 19 nt, Human
gaaagcgcagcggcgcccc

SEQ ID NO: 983002 - RNA, 19 nt, Human
gaaauagaaggauaaaguu

SEQ ID NO: 983003 - RNA, 19 nt, Human
gaaauuuuugcaagcccau

SEQ ID NO: 983004 - RNA, 21 nt, Human
gaauccccauauccccccacc

SEQ ID NO: 983005 - RNA, 19 nt, Human
gagacaucaggaaauuguu

SEQ ID NO: 983006 - RNA, 24 nt, Human
gaugaaggcgccgaggagaagccg

SEQ ID NO: 983007 - RNA, 22 nt, Human
gcacaacuuuuccccucuccaa

SEQ ID NO: 983008 - RNA, 18 nt, Human
gcagcagccagccccacg

SEQ ID NO: 983009 - RNA, 19 nt, Human
gcagcggcgccccggccgc

SEQ ID NO: 983010 - RNA, 22 nt, Human
gccagccuggucccaucggcac

SEQ ID NO: 983011 - RNA, 21 nt, Human
gccgaggagaagccgggugaa

SEQ ID NO: 983012 - RNA, 22 nt, Human
gccuugcuaacagcuccuccca

SEQ ID NO: 983013 - RNA, 20 nt, Human
gcgccaccaccgccgccggg

SEQ ID NO: 983014 - RNA, 23 nt, Human
gcgccgccaaacaccaaccccag

SEQ ID NO: 983015 - RNA, 22 nt, Human
ggaaaacaguagugcaauuacg

SEQ ID NO: 983016 - RNA, 20 nt, Human
ggagcagcagugggccuugc

SEQ ID NO: 983017 - RNA, 19 nt, Human
gguccugcuccagagcucc

SEQ ID NO: 983018 - RNA, 21 nt, Human
gguuauuuaaaaaaaaaaaaa

SEQ ID NO: 983019 - RNA, 24 nt, Human
gucucuuuggccagccuccuccac

SEQ ID NO: 983020 - RNA, 19 nt, Human
uaaaaacccauuuugaucu

SEQ ID NO: 983021 - RNA, 21 nt, Human
uaaauaggcagaaaugacugu

SEQ ID NO: 983022 - RNA, 23 nt, Human
uaagcagaaacucccuagauguu

SEQ ID NO: 983023 - RNA, 19 nt, Human
uaagcagcagugccggccc

SEQ ID NO: 983024 - RNA, 18 nt, Human
uaaggaaaauauugcuuu

SEQ ID NO: 983025 - RNA, 22 nt, Human
uaucaacaaaaaucagcacaau

SEQ ID NO: 983026 - RNA, 23 nt, Human
uauuaucuuuuccacaguacaca

SEQ ID NO: 983027 - RNA, 18 nt, Human
ucaacaaaaaucagcaca

SEQ ID NO: 983028 - RNA, 19 nt, Human
ucagcacaaucccacacaa

SEQ ID NO: 983029 - RNA, 20 nt, Human
ucccacacaauaaugucuuc

SEQ ID NO: 983030 - RNA, 18 nt, Human
ucccgcgccgccgccgcc

SEQ ID NO: 983031 - RNA, 24 nt, Human
uccgccgggacgccucccuccccu

SEQ ID NO: 983032 - RNA, 25 nt, Human
uccgccgggacgccucccuccccuc

SEQ ID NO: 983033 - RNA, 27 nt, Human
ucgcacauucgcucgcauaccaauccc

SEQ ID NO: 983034 - RNA, 18 nt, Human
ucggcaccggcggccucc

SEQ ID NO: 983035 - RNA, 20 nt, Human
ugaaaacaguccccuaucca

SEQ ID NO: 983036 - RNA, 23 nt, Human
ugaauccccauauccccccaccu

SEQ ID NO: 983037 - RNA, 19 nt, Human
ugaaugaacacuccagaac

SEQ ID NO: 983038 - RNA, 23 nt, Human
ugaauuuacaaauguguauacug

SEQ ID NO: 983039 - RNA, 18 nt, Human
ugacugaaaacagcccac

SEQ ID NO: 983040 - RNA, 19 nt, Human
ugacugaaaacagcccaca

SEQ ID NO: 983041 - RNA, 22 nt, Human
ugcaaaacgcuauguucauuuc

SEQ ID NO: 983042 - RNA, 22 nt, Human
ugcggcgagaccgggauccgcu

SEQ ID NO: 983043 - RNA, 22 nt, Human
ugcuccagagcucccuucucac

SEQ ID NO: 983044 - RNA, 24 nt, Human
ugcugcggcgagaccgggauccgc

SEQ ID NO: 983045 - RNA, 19 nt, Human
uggagggugggggauaaua

SEQ ID NO: 983046 - RNA, 19 nt, Human
uggggaguggagggugggg

SEQ ID NO: 983047 - RNA, 20 nt, Human
uggggaguggaggguggggg

SEQ ID NO: 983048 - RNA, 21 nt, Human
uucaacccuguguuccucaac

SEQ ID NO: 983049 - RNA, 23 nt, Human
uuccuaaaauuaaaccaaaaaaa

SEQ ID NO: 983050 - RNA, 23 nt, Human
uuuaaaaaaaaaaaaaaaaaggu

SEQ ID NO: 983051 - RNA, 27 nt, Human
uuuaaaaaaaaaaaaaaaaagguggga

SEQ ID NO: 983052 - RNA, 20 nt, Human
uuuacauuucaaacuacaua

SEQ ID NO: 983053 - RNA, 24 nt, Human
uuucaacccuguguuccucaaccc

SEQ ID NO: 983054 - RNA, 23 nt, Human
uuugcaagcccaugcuggcuuac

SEQ ID NO: 983055 - RNA, 18 nt, Human
uuugcaguuauucaaagu

SEQ ID NO: 983056 - RNA, 20 nt, Human
uuugcaguuauucaaagugu

SEQ ID NO: 983057 - RNA, 20 nt, Human
uuuuuuuuuuuccagucugg

SEQ ID NO: 983058 - RNA, 19 nt, Human
aaacauacacaaaaauaca

SEQ ID NO: 983059 - RNA, 24 nt, Human
aaauauugagaauauuagugaacu

SEQ ID NO: 983060 - RNA, 18 nt, Human
aacuauauagcauaaaac

SEQ ID NO: 983061 - RNA, 19 nt, Human
aacucucacaaacauacac

SEQ ID NO: 983062 - RNA, 23 nt, Human
acacaauguugcuguauuacuaa

SEQ ID NO: 983063 - RNA, 23 nt, Human
acacacacacacacacacacaca

SEQ ID NO: 983064 - RNA, 23 nt, Human
acacacacacacacacacacaca

SEQ ID NO: 983065 - RNA, 23 nt, Human
acacacacacacacacacacaca

SEQ ID NO: 983066 - RNA, 23 nt, Human
acacacacacacacacacacaca

SEQ ID NO: 983067 - RNA, 23 nt, Human
acacacacacacacacacacaca

SEQ ID NO: 983068 - RNA, 23 nt, Human
acacacacacacacacacacaca

SEQ ID NO: 983069 - RNA, 23 nt, Human
acacacacacacacacacacaca

SEQ ID NO: 983070 - RNA, 21 nt, Human
acacuacuauucucccagaac

SEQ ID NO: 983071 - RNA, 19 nt, Human
acagaacccuuuuaacaag

SEQ ID NO: 983072 - RNA, 18 nt, Human
acccagguguuguuacac

SEQ ID NO: 983073 - RNA, 21 nt, Human
acucacacacauucacauaca

SEQ ID NO: 983074 - RNA, 20 nt, Human
acuuaggucccaguuuuuuc

SEQ ID NO: 983075 - RNA, 18 nt, Human
acuuaguacuguuaauga

SEQ ID NO: 983076 - RNA, 26 nt, Human
agaaaaaaaucuucguuaacuauaaa

SEQ ID NO: 983077 - RNA, 20 nt, Human
agaguugacccagguguugu

SEQ ID NO: 983078 - RNA, 23 nt, Human
aggaaaaugggguuuuaaauaga

SEQ ID NO: 983079 - RNA, 19 nt, Human
aggaacaucuaguuguuca

SEQ ID NO: 983080 - RNA, 24 nt, Human
agucauagggcugugaguuggguu

SEQ ID NO: 983081 - RNA, 25 nt, Human
aguuuuuucuuuuuuuuucuuuuuu

SEQ ID NO: 983082 - RNA, 30 nt, Human
auagaaaaaaaucuucguuaacuauaaacc

SEQ ID NO: 983083 - RNA, 21 nt, Human
augaaguaauacucuaaaagu

SEQ ID NO: 983084 - RNA, 23 nt, Human
caaagcauuuagcauuaaauauu

SEQ ID NO: 983085 - RNA, 31 nt, Human
cacaaauacacacacacacacacacacacag

SEQ ID NO: 983086 - RNA, 18 nt, Human
cacacacacacacacaca

SEQ ID NO: 983087 - RNA, 20 nt, Human
cacacacacacacacacaca

SEQ ID NO: 983088 - RNA, 20 nt, Human
cacacacacacacacacaca

SEQ ID NO: 983089 - RNA, 20 nt, Human
cacacacacacacacacaca

SEQ ID NO: 983090 - RNA, 20 nt, Human
cacacacacacacacacaca

SEQ ID NO: 983091 - RNA, 20 nt, Human
cacacacacacacacacaca

SEQ ID NO: 983092 - RNA, 20 nt, Human
cacacacacacacacacaca

SEQ ID NO: 983093 - RNA, 20 nt, Human
cacacacacacacacacaca

SEQ ID NO: 983094 - RNA, 20 nt, Human
cacacacacacacacacaca

SEQ ID NO: 983095 - RNA, 20 nt, Human
cacacacacacacacacaca

SEQ ID NO: 983096 - RNA, 20 nt, Human
cacacacacacacacacaca

SEQ ID NO: 983097 - RNA, 22 nt, Human
cacacacacacacacacacaca

SEQ ID NO: 983098 - RNA, 22 nt, Human
cacacacacacacacacacaca

SEQ ID NO: 983099 - RNA, 26 nt, Human
cacacacacacacacacacacacaca

SEQ ID NO: 983100 - RNA, 26 nt, Human
cacacacacacacacacacacacaca

SEQ ID NO: 983101 - RNA, 26 nt, Human
cacacacacacacacacacacacaca

SEQ ID NO: 983102 - RNA, 26 nt, Human
cacacacacacacacacacacacaca

SEQ ID NO: 983103 - RNA, 26 nt, Human
cacacacacacacacacacacacaca

SEQ ID NO: 983104 - RNA, 26 nt, Human
cacacacacacacacacacacacaca

SEQ ID NO: 983105 - RNA, 26 nt, Human
cacacacacacacacacacacacacg

SEQ ID NO: 983106 - RNA, 26 nt, Human
cacacacacacacacacacacacgug

SEQ ID NO: 983107 - RNA, 26 nt, Human
cacacacacacacacacacacgugug

SEQ ID NO: 983108 - RNA, 26 nt, Human
cacacacacacacacacacgugugua

SEQ ID NO: 983109 - RNA, 26 nt, Human
cacacacacacacacacguguguaug

SEQ ID NO: 983110 - RNA, 25 nt, Human
cacacacacacacacguguguaugu

SEQ ID NO: 983111 - RNA, 20 nt, Human
cacacacacacguguguaug

SEQ ID NO: 983112 - RNA, 22 nt, Human
cagaucccuuccacuuaguacu

SEQ ID NO: 983113 - RNA, 23 nt, Human
caguauacgacaguuuacaaaau

SEQ ID NO: 983114 - RNA, 21 nt, Human
cucacaaacauacacaaaaau

SEQ ID NO: 983115 - RNA, 23 nt, Human
cugucuguaucgcauaccaaaac

SEQ ID NO: 983116 - RNA, 20 nt, Human
gaaaacagaugucuucuguc

SEQ ID NO: 983117 - RNA, 21 nt, Human
gacccagguguuguuacacag

SEQ ID NO: 983118 - RNA, 33 nt, Human
gcacacaaauacacacacacacacacacacagu

SEQ ID NO: 983119 - RNA, 23 nt, Human
gguuggggauggaguagacauug

SEQ ID NO: 983120 - RNA, 20 nt, Human
uaaaagguuuuaggugaguu

SEQ ID NO: 983121 - RNA, 20 nt, Human
uaaagaaaaugucuaggaac

SEQ ID NO: 983122 - RNA, 18 nt, Human
uaaaugcaccaaccaaag

SEQ ID NO: 983123 - RNA, 18 nt, Human
uaacaaagaauuaugaug

SEQ ID NO: 983124 - RNA, 18 nt, Human
uaaccagaacagauuuuu

SEQ ID NO: 983125 - RNA, 22 nt, Human
uaaccagaacagauuuuuauua

SEQ ID NO: 983126 - RNA, 25 nt, Human
uacacacacacacacacacacacac

SEQ ID NO: 983127 - RNA, 23 nt, Human
uacacagugucugucauccuuag

SEQ ID NO: 983128 - RNA, 23 nt, Human
uacagccaagguuguuugaugcc

SEQ ID NO: 983129 - RNA, 22 nt, Human
uaccaaaacuauauagcauaaa

SEQ ID NO: 983130 - RNA, 21 nt, Human
uagaguugaccagaggcacac

SEQ ID NO: 983131 - RNA, 18 nt, Human
uagcaagguuuauaacca

SEQ ID NO: 983132 - RNA, 21 nt, Human
uagcauaaaacuugaaccaca

SEQ ID NO: 983133 - RNA, 22 nt, Human
uagcauuaaauauugagaauau

SEQ ID NO: 983134 - RNA, 24 nt, Human
uagcauuguagaugugaguucugg

SEQ ID NO: 983135 - RNA, 24 nt, Human
uaggucccaguuuuuucuuuuuuu

SEQ ID NO: 983136 - RNA, 24 nt, Human
uauauauguguaugugaauacaca

SEQ ID NO: 983137 - RNA, 22 nt, Human
uauguauuuuucauaagaaaag

SEQ ID NO: 983138 - RNA, 18 nt, Human
uauuccauacacuacuau

SEQ ID NO: 983139 - RNA, 19 nt, Human
uccauacacuacuauucuc

SEQ ID NO: 983140 - RNA, 24 nt, Human
uccuuagaguugaccagaggcaca

SEQ ID NO: 983141 - RNA, 22 nt, Human
ugaaaaaccagucuauaaccug

SEQ ID NO: 983142 - RNA, 22 nt, Human
ugaaaucauuguuuacaugcaa

SEQ ID NO: 983143 - RNA, 23 nt, Human
ugaauaaucauugugcaucucca

SEQ ID NO: 983144 - RNA, 19 nt, Human
ugaccagaggcacacaaau

SEQ ID NO: 983145 - RNA, 23 nt, Human
uggaguuuccaagaaauccacau

SEQ ID NO: 983146 - RNA, 20 nt, Human
uguuuacaugcaaauaugua

SEQ ID NO: 983147 - RNA, 24 nt, Human
uguuugccuuuguacauauauaua

SEQ ID NO: 983148 - RNA, 21 nt, Human
uuaugcauaugcuuuuuuccu

SEQ ID NO: 983149 - RNA, 19 nt, Human
uuccugaguuuuucaaagg

SEQ ID NO: 983150 - RNA, 25 nt, Human
uuggaaccauaaagaaaaugucuag

SEQ ID NO: 983151 - RNA, 18 nt, Human
uuggauacuuaaaugcac

SEQ ID NO: 983152 - RNA, 21 nt, Human
uuucuuuuuuuuuuuggcccu

SEQ ID NO: 983153 - RNA, 19 nt, Human
uuuuucuuuuuuuuuuugg

SEQ ID NO: 983154 - RNA, 18 nt, Human
aagaaagcagaagaaaag

SEQ ID NO: 983155 - RNA, 22 nt, Human
aagcagaagaaaagaugcagga

SEQ ID NO: 983156 - RNA, 21 nt, Human
accaaccugcuuccacuuuau

SEQ ID NO: 983157 - RNA, 22 nt, Human
acccccacucaguaaguccccu

SEQ ID NO: 983158 - RNA, 21 nt, Human
agggaagaaagcagaagaaaa

SEQ ID NO: 983159 - RNA, 23 nt, Human
auggguggugauuccaaugaggg

SEQ ID NO: 983160 - RNA, 22 nt, Human
caacccccacccacccccacuc

SEQ ID NO: 983161 - RNA, 25 nt, Human
caccaguuucccuuuucccaacccc

SEQ ID NO: 983162 - RNA, 21 nt, Human
cacuaugugagcucaacaguc

SEQ ID NO: 983163 - RNA, 24 nt, Human
caguaaguccccuugcccagguuu

SEQ ID NO: 983164 - RNA, 25 nt, Human
ccaaugagggaugggaaccucuuuc

SEQ ID NO: 983165 - RNA, 23 nt, Human
ccacccacccccacucaguaagu

SEQ ID NO: 983166 - RNA, 21 nt, Human
cccaacccccacccaccccca

SEQ ID NO: 983167 - RNA, 20 nt, Human
ccccacccacccccacucag

SEQ ID NO: 983168 - RNA, 19 nt, Human
cccccacccacccccacuc

SEQ ID NO: 983169 - RNA, 21 nt, Human
ccccgcuacccccaaguguaa

SEQ ID NO: 983170 - RNA, 20 nt, Human
ccugaccccgcuacccccaa

SEQ ID NO: 983171 - RNA, 22 nt, Human
cuuccaggagaugcgcuggggg

SEQ ID NO: 983172 - RNA, 21 nt, Human
gaaccucuuuccaaggcacaa

SEQ ID NO: 983173 - RNA, 19 nt, Human
ggaagaaagcagaagaaaa

SEQ ID NO: 983174 - RNA, 20 nt, Human
gggaagaaagcagaagaaaa

SEQ ID NO: 983175 - RNA, 18 nt, Human
uacaccaaccugcuucca

SEQ ID NO: 983176 - RNA, 18 nt, Human
ucccaacccccacccacc

SEQ ID NO: 983177 - RNA, 19 nt, Human
ucccaacccccacccaccc

SEQ ID NO: 983178 - RNA, 21 nt, Human
ucccaacccccacccaccccc

SEQ ID NO: 983179 - RNA, 20 nt, Human
ugcgcugggggcccagcgga

SEQ ID NO: 983180 - RNA, 19 nt, Human
ugucucagucauccucuuc

SEQ ID NO: 983181 - RNA, 19 nt, Human
uuccaggagaugcgcuggg

SEQ ID NO: 983182 - RNA, 18 nt, Human
uucccuuuucccaacccc

SEQ ID NO: 983183 - RNA, 19 nt, Human
uuuucccaacccccacccu

SEQ ID NO: 983184 - RNA, 19 nt, Human
aaaaacacaacagaaacca

SEQ ID NO: 983185 - RNA, 23 nt, Human
aaaaacacaacagaaaccaaauc

SEQ ID NO: 983186 - RNA, 18 nt, Human
aaaaagacauuaucaaac

SEQ ID NO: 983187 - RNA, 21 nt, Human
aaaagcugacaccuaaaccca

SEQ ID NO: 983188 - RNA, 24 nt, Human
aaacacaacagaaaccaaaucaag

SEQ ID NO: 983189 - RNA, 22 nt, Human
aaacaggauguagaauucaaag

SEQ ID NO: 983190 - RNA, 21 nt, Human
aaauauuuaaugcacugagcc

SEQ ID NO: 983191 - RNA, 19 nt, Human
aagaaacucagcagaaaca

SEQ ID NO: 983192 - RNA, 22 nt, Human
aagaaacucagcagaaacaggc

SEQ ID NO: 983193 - RNA, 22 nt, Human
aagaaagugaauacaaauaucu

SEQ ID NO: 983194 - RNA, 24 nt, Human
aagugaauacaaauaucuuuguac

SEQ ID NO: 983195 - RNA, 22 nt, Human
agacuaaaauuuugccaaaaac

SEQ ID NO: 983196 - RNA, 18 nt, Human
agagugugagagagaaca

SEQ ID NO: 983197 - RNA, 21 nt, Human
aggcaaaaacacaacagaaac

SEQ ID NO: 983198 - RNA, 24 nt, Human
aggcaaaaacacaacagaaaccaa

SEQ ID NO: 983199 - RNA, 19 nt, Human
aggugccaacaucucccuu

SEQ ID NO: 983200 - RNA, 23 nt, Human
aguaagaaaauauuuaaaaaaga

SEQ ID NO: 983201 - RNA, 27 nt, Human
augcagauauagauacacauaugaaua

SEQ ID NO: 983202 - RNA, 20 nt, Human
caaaaacacaacagaaacca

SEQ ID NO: 983203 - RNA, 19 nt, Human
caaauccaaagugaaaaag

SEQ ID NO: 983204 - RNA, 24 nt, Human
caagcauggggggaggugccagga

SEQ ID NO: 983205 - RNA, 23 nt, Human
caagguaaccagaguguugauca

SEQ ID NO: 983206 - RNA, 21 nt, Human
cacuuugggacaaaagcaaua

SEQ ID NO: 983207 - RNA, 25 nt, Human
cgcccccggcuccuagugccggucc

SEQ ID NO: 983208 - RNA, 20 nt, Human
cucaaaagcugacaccuaaa

SEQ ID NO: 983209 - RNA, 21 nt, Human
cuguaccuguuaaauauccug

SEQ ID NO: 983210 - RNA, 19 nt, Human
cuucaaacacccgcucucc

SEQ ID NO: 983211 - RNA, 22 nt, Human
gaaaaauuaccaccucucuuac

SEQ ID NO: 983212 - RNA, 23 nt, Human
gacaagcauggggggaggugcca

SEQ ID NO: 983213 - RNA, 21 nt, Human
gaugagggaagcagcucaaaa

SEQ ID NO: 983214 - RNA, 26 nt, Human
gcaaaaacacaacagaaaccaaauca

SEQ ID NO: 983215 - RNA, 21 nt, Human
gcacuuuuacuuggauuuuuu

SEQ ID NO: 983216 - RNA, 22 nt, Human
ggaagcagcucaaaagcugaca

SEQ ID NO: 983217 - RNA, 19 nt, Human
gguauagagugugagagag

SEQ ID NO: 983218 - RNA, 21 nt, Human
guaaauuuuuuauggacaaag

SEQ ID NO: 983219 - RNA, 18 nt, Human
uaaagaaagugaauacaa

SEQ ID NO: 983220 - RNA, 26 nt, Human
uacaacugaacuguucaauccuaauc

SEQ ID NO: 983221 - RNA, 21 nt, Human
uacugguuauccacuuccagu

SEQ ID NO: 983222 - RNA, 26 nt, Human
uagaugucuguuuagacuaaaauuuu

SEQ ID NO: 983223 - RNA, 24 nt, Human
uaggcaaaaacacaacaaccccgg

SEQ ID NO: 983224 - RNA, 24 nt, Human
uaggcaaaaacacaacagaaacca

SEQ ID NO: 983225 - RNA, 20 nt, Human
uauccugguuggcaacuuuu

SEQ ID NO: 983226 - RNA, 25 nt, Human
ucaauccuaaucaaauaaaacuauu

SEQ ID NO: 983227 - RNA, 22 nt, Human
uccacuuccaguacauguacca

SEQ ID NO: 983228 - RNA, 22 nt, Human
uccacuuccaguacauguacca

SEQ ID NO: 983229 - RNA, 22 nt, Human
uccgcggagccuucaaacaccc

SEQ ID NO: 983230 - RNA, 25 nt, Human
ucucucucucucugcucuaggggau

SEQ ID NO: 983231 - RNA, 24 nt, Human
ugauaagaaacucagcagaaacag

SEQ ID NO: 983232 - RNA, 21 nt, Human
ugaucagaucacacugauacc

SEQ ID NO: 983233 - RNA, 18 nt, Human
ugccaaaaacaaauccaa

SEQ ID NO: 983234 - RNA, 19 nt, Human
ugccaaaaacaaauccaaa

SEQ ID NO: 983235 - RNA, 24 nt, Human
uggccagagguccauaaauaauau

SEQ ID NO: 983236 - RNA, 20 nt, Human
uggggggaggugccaggaag

SEQ ID NO: 983237 - RNA, 21 nt, Human
uggucacuguggggcauagau

SEQ ID NO: 983238 - RNA, 25 nt, Human
uguaguuuuggcacuuuuacuugga

SEQ ID NO: 983239 - RNA, 19 nt, Human
ugugaugagggaagcagcu

SEQ ID NO: 983240 - RNA, 24 nt, Human
uguugaucagaucacacugauacc

SEQ ID NO: 983241 - RNA, 18 nt, Human
uucucauucuggagaaac

SEQ ID NO: 983242 - RNA, 24 nt, Human
uugaagagaaaaaaaauuaggguu

SEQ ID NO: 983243 - RNA, 22 nt, Human
uugccaaaaacaaauccaaagu

SEQ ID NO: 983244 - RNA, 19 nt, Human
uugggacaaaguaccuccu

SEQ ID NO: 983245 - RNA, 21 nt, Human
uuugccaaaaacaaauccaaa

SEQ ID NO: 983246 - RNA, 19 nt, Human
uuuggcacuuuuacuugga

SEQ ID NO: 983247 - RNA, 19 nt, Human
acaauuuuacuuuuuguca

SEQ ID NO: 983248 - RNA, 21 nt, Human
agacaagggccgacgguugug

SEQ ID NO: 983249 - RNA, 22 nt, Human
caagggccgacgguugugaccu

SEQ ID NO: 983250 - RNA, 21 nt, Human
cagggagcuccgaacguggca

SEQ ID NO: 983251 - RNA, 22 nt, Human
cccacgccgggggccgccacaa

SEQ ID NO: 983252 - RNA, 24 nt, Human
ccgacgguugugaccuggcuucuc

SEQ ID NO: 983253 - RNA, 19 nt, Human
cuccagggggccgcugucc

SEQ ID NO: 983254 - RNA, 19 nt, Human
cucccgggacugcccccuc

SEQ ID NO: 983255 - RNA, 21 nt, Human
cucccgggacugcccccucca

SEQ ID NO: 983256 - RNA, 22 nt, Human
ugaaaucauaacaugcuagcaa

SEQ ID NO: 983257 - RNA, 23 nt, Human
ugaccuggcuucucgugaaguga

SEQ ID NO: 983258 - RNA, 21 nt, Human
uggaaaagugcauuuacaaua

SEQ ID NO: 983259 - RNA, 18 nt, Human
aaccccgacccccaccac

SEQ ID NO: 983260 - RNA, 22 nt, Human
accccgacccccaccacacaca

SEQ ID NO: 983261 - RNA, 23 nt, Human
acugcaccaugccccccaacccc

SEQ ID NO: 983262 - RNA, 24 nt, Human
caccaugccccccaaccccgaccc

SEQ ID NO: 983263 - RNA, 22 nt, Human
caugccccccaaccccgacccc

SEQ ID NO: 983264 - RNA, 18 nt, Human
ccaaccccgacccccacc

SEQ ID NO: 983265 - RNA, 24 nt, Human
ccaaccccgacccccaccacacac

SEQ ID NO: 983266 - RNA, 26 nt, Human
cccaaccccgacccccaccacacaca

SEQ ID NO: 983267 - RNA, 28 nt, Human
cccaaccccgacccccaccacacacaac

SEQ ID NO: 983268 - RNA, 20 nt, Human
ccccaaccccgacccccacc

SEQ ID NO: 983269 - RNA, 21 nt, Human
ccccaccacacacaacggggc

SEQ ID NO: 983270 - RNA, 21 nt, Human
cccccaaccccgacccccacc

SEQ ID NO: 983271 - RNA, 23 nt, Human
cccccaaccccgacccccaccac

SEQ ID NO: 983272 - RNA, 18 nt, Human
ccccccaaccccgacccc

SEQ ID NO: 983273 - RNA, 19 nt, Human
ccccccaaccccgaccccc

SEQ ID NO: 983274 - RNA, 23 nt, Human
cugcaccaugccccccaaccccg

SEQ ID NO: 983275 - RNA, 20 nt, Human
gacugcaccaugccccccaa

SEQ ID NO: 983276 - RNA, 18 nt, Human
gccccccaaccccgaccc

SEQ ID NO: 983277 - RNA, 25 nt, Human
guuuacgugaaggccgacugcacca

SEQ ID NO: 983278 - RNA, 25 nt, Human
ugaaggccgacugcaccaugccccc

SEQ ID NO: 983279 - RNA, 19 nt, Human
ccucucagcucaugcugcc

SEQ ID NO: 983280 - RNA, 21 nt, Human
ccucucagcucaugcugccuc

SEQ ID NO: 983281 - RNA, 22 nt, Human
ccuuggccugcuccuuuucucc

SEQ ID NO: 983282 - RNA, 18 nt, Human
cgcccuuggccugcuccu

SEQ ID NO: 983283 - RNA, 20 nt, Human
gccugcuccuuuucucccca

SEQ ID NO: 983284 - RNA, 20 nt, Human
gccuuccuaucacccucuca

SEQ ID NO: 983285 - RNA, 19 nt, Human
ggagagcacuugccauugc

SEQ ID NO: 983286 - RNA, 24 nt, Human
ggccugcuccuuuucuccccaagg

SEQ ID NO: 983287 - RNA, 23 nt, Human
uccuaucacccucucagcucaug

SEQ ID NO: 983288 - RNA, 21 nt, Human
ugccucugagaggcagcucua

SEQ ID NO: 983289 - RNA, 21 nt, Human
uuggccugcuccuuuucuccc

SEQ ID NO: 983290 - RNA, 22 nt, Human
aagguggacagcggugccuucc

SEQ ID NO: 983291 - RNA, 19 nt, Human
acccaacccccaacccagc

SEQ ID NO: 983292 - RNA, 19 nt, Human
acugccuuccuucucuggc

SEQ ID NO: 983293 - RNA, 23 nt, Human
agauuucuagcacuuuaaagcuu

SEQ ID NO: 983294 - RNA, 23 nt, Human
aggaggauaaauggugcccaagg

SEQ ID NO: 983295 - RNA, 22 nt, Human
aggcugcccucuacagccccga

SEQ ID NO: 983296 - RNA, 23 nt, Human
agucgcacgacugucucagccuu

SEQ ID NO: 983297 - RNA, 21 nt, Human
agucuggccuggucuggccuc

SEQ ID NO: 983298 - RNA, 19 nt, Human
caacccagccugguccccu

SEQ ID NO: 983299 - RNA, 21 nt, Human
caacccccaacccagccuggu

SEQ ID NO: 983300 - RNA, 23 nt, Human
caacccccaacccagccuggucc

SEQ ID NO: 983301 - RNA, 19 nt, Human
cagcaccugcuccggguca

SEQ ID NO: 983302 - RNA, 24 nt, Human
cagccugguccccugacccucagu

SEQ ID NO: 983303 - RNA, 22 nt, Human
cagcggugccuuccugcugcuc

SEQ ID NO: 983304 - RNA, 22 nt, Human
caggaaugcccagugccucuga

SEQ ID NO: 983305 - RNA, 21 nt, Human
caucucauucccugggccgca

SEQ ID NO: 983306 - RNA, 19 nt, Human
ccacccaacccccaaccca

SEQ ID NO: 983307 - RNA, 24 nt, Human
ccagugccucugaggcugcccucu

SEQ ID NO: 983308 - RNA, 24 nt, Human
cccaacccagccugguccccugac

SEQ ID NO: 983309 - RNA, 27 nt, Human
cccaacccccaacccagccuggucccc

SEQ ID NO: 983310 - RNA, 20 nt, Human
ccccacccaacccccaaccc

SEQ ID NO: 983311 - RNA, 19 nt, Human
cccccaacccagccugguc

SEQ ID NO: 983312 - RNA, 21 nt, Human
cccgcgagcccguggcccagc

SEQ ID NO: 983313 - RNA, 20 nt, Human
cccguccagccccacccaac

SEQ ID NO: 983314 - RNA, 18 nt, Human
cccugggccgcaagaagc

SEQ ID NO: 983315 - RNA, 20 nt, Human
ccgaggcgcaugggccagca

SEQ ID NO: 983316 - RNA, 19 nt, Human
ccucguccccguccagccc

SEQ ID NO: 983317 - RNA, 19 nt, Human
ccuuccugcugcucuuccu

SEQ ID NO: 983318 - RNA, 21 nt, Human
cuggagucggagccggggucc

SEQ ID NO: 983319 - RNA, 22 nt, Human
cuggccaggccugcuguuccug

SEQ ID NO: 983320 - RNA, 18 nt, Human
cuggcuccacccuugacu

SEQ ID NO: 983321 - RNA, 18 nt, Human
cuuccugcucuugcuguc

SEQ ID NO: 983322 - RNA, 19 nt, Human
gaagcucuuucccgccucc

SEQ ID NO: 983323 - RNA, 23 nt, Human
gagugcccgcgagcccguggccc

SEQ ID NO: 983324 - RNA, 23 nt, Human
gcagggucacgcaacugccccgg

SEQ ID NO: 983325 - RNA, 19 nt, Human
gccccacccaacccccaac

SEQ ID NO: 983326 - RNA, 19 nt, Human
ggagagagaagaagcugau

SEQ ID NO: 983327 - RNA, 20 nt, Human
uacagccccgaggcgcaugg

SEQ ID NO: 983328 - RNA, 22 nt, Human
ucccgccuccucuccgcgccuc

SEQ ID NO: 983329 - RNA, 18 nt, Human
uccugcugcucuuccugc

SEQ ID NO: 983330 - RNA, 20 nt, Human
uccuuugggcuggccaggcc

SEQ ID NO: 983331 - RNA, 22 nt, Human
ucuccaguugccaugcuacucc

SEQ ID NO: 983332 - RNA, 20 nt, Human
ucucuggcuccacccuugac

SEQ ID NO: 983333 - RNA, 24 nt, Human
ucugaggcugcccucuacagcccc

SEQ ID NO: 983334 - RNA, 19 nt, Human
ucuggccucccagcagggu

SEQ ID NO: 983335 - RNA, 21 nt, Human
ucuucagagcuugggcuuuaa

SEQ ID NO: 983336 - RNA, 19 nt, Human
ugaaagaagcacauauggg

SEQ ID NO: 983337 - RNA, 22 nt, Human
ugaaagaagcacauauggggca

SEQ ID NO: 983338 - RNA, 26 nt, Human
ugacccucagucuggccuggucuggc

SEQ ID NO: 983339 - RNA, 19 nt, Human
ugcccaagguggacagcgg

SEQ ID NO: 983340 - RNA, 22 nt, Human
ugcccagagcuggagucggagc

SEQ ID NO: 983341 - RNA, 29 nt, Human
ugcccagugccucugaggcugcccucuac

SEQ ID NO: 983342 - RNA, 18 nt, Human
ugccuuccuucucuggcu

SEQ ID NO: 983343 - RNA, 18 nt, Human
ugcggccaguggggaccc

SEQ ID NO: 983344 - RNA, 19 nt, Human
uggccaggccugcuguucc

SEQ ID NO: 983345 - RNA, 22 nt, Human
uggccuggucuggccucccagc

SEQ ID NO: 983346 - RNA, 21 nt, Human
ugguccccugacccucagucu

SEQ ID NO: 983347 - RNA, 23 nt, Human
uguuuugaggcuucuuuaaaagu

SEQ ID NO: 983348 - RNA, 23 nt, Human
uugaggcuucuuuaaaaguuuau

SEQ ID NO: 983349 - RNA, 22 nt, Human
uugcggccaguggggacccucu

SEQ ID NO: 983350 - RNA, 20 nt, Human
uuuuuuuuuuuuuuuuuggu

SEQ ID NO: 983351 - RNA, 20 nt, Human
uuuuuuuuuuuuuuuuuugg

SEQ ID NO: 983352 - RNA, 24 nt, Human
acacacacuuucuccgagagcccu

SEQ ID NO: 983353 - RNA, 26 nt, Human
cacacuuuauuaagaaaggaauacac

SEQ ID NO: 983354 - RNA, 23 nt, Human
ccagcgucucucugcccuguggu

SEQ ID NO: 983355 - RNA, 18 nt, Human
ccugugguuguggagaac

SEQ ID NO: 983356 - RNA, 20 nt, Human
gagagcuggagguggagcca

SEQ ID NO: 983357 - RNA, 24 nt, Human
ucucaggcagaacacgcucugaga

SEQ ID NO: 983358 - RNA, 19 nt, Human
uggcgcccagcaggguggu

SEQ ID NO: 983359 - RNA, 19 nt, Human
ugucccgcuuuucccuuaa

SEQ ID NO: 983360 - RNA, 21 nt, Human
uguggagaacuggcgcccagc

SEQ ID NO: 983361 - RNA, 22 nt, Human
acaacagcacacugcaggggug

SEQ ID NO: 983362 - RNA, 19 nt, Human
accgcagccucuguucgcc

SEQ ID NO: 983363 - RNA, 21 nt, Human
accuggcaugugaggcccacg

SEQ ID NO: 983364 - RNA, 27 nt, Human
agaagacccaggcguagcucaugaggg

SEQ ID NO: 983365 - RNA, 20 nt, Human
agacccuccgccagcagccc

SEQ ID NO: 983366 - RNA, 23 nt, Human
aggaggaggcagagcugcccuga

SEQ ID NO: 983367 - RNA, 22 nt, Human
aggcagagcugcccugauaguu

SEQ ID NO: 983368 - RNA, 21 nt, Human
aggcgacggcgagggcggugc

SEQ ID NO: 983369 - RNA, 18 nt, Human
agggaggagggcaguggg

SEQ ID NO: 983370 - RNA, 27 nt, Human
caacaccacaaggcaaaucuauggcca

SEQ ID NO: 983371 - RNA, 21 nt, Human
cacgccggcggcuggagcccc

SEQ ID NO: 983372 - RNA, 19 nt, Human
cagaacaaaaacaaacgac

SEQ ID NO: 983373 - RNA, 20 nt, Human
caugggaggaggaggcagag

SEQ ID NO: 983374 - RNA, 28 nt, Human
cccggggaccccgggccucccagcccgc

SEQ ID NO: 983375 - RNA, 18 nt, Human
ccgcggagaggcgcggag

SEQ ID NO: 983376 - RNA, 20 nt, Human
ccucccagcccgcgaagcaa

SEQ ID NO: 983377 - RNA, 21 nt, Human
ccucccagcccgcgaagcaac

SEQ ID NO: 983378 - RNA, 24 nt, Human
ccucugggggcugcccuguugccu

SEQ ID NO: 983379 - RNA, 21 nt, Human
ccuguugccucuccccaccuc

SEQ ID NO: 983380 - RNA, 23 nt, Human
cucaauguucuaugaaaacuaac

SEQ ID NO: 983381 - RNA, 26 nt, Human
cucaugagggccacgccggcggcugg

SEQ ID NO: 983382 - RNA, 22 nt, Human
cucccagcccgcgaagcaacgg

SEQ ID NO: 983383 - RNA, 23 nt, Human
cugauccaacaccacaaggcaaa

SEQ ID NO: 983384 - RNA, 21 nt, Human
cugcaggcacgacauagcaca

SEQ ID NO: 983385 - RNA, 21 nt, Human
cugcagggguggaaggagacg

SEQ ID NO: 983386 - RNA, 23 nt, Human
gaagcaacggugguggcggcagc

SEQ ID NO: 983387 - RNA, 18 nt, Human
gacacaguaccugaucca

SEQ ID NO: 983388 - RNA, 19 nt, Human
gaggaggaggcagagcugc

SEQ ID NO: 983389 - RNA, 18 nt, Human
gaugacacaaguacuuau

SEQ ID NO: 983390 - RNA, 23 nt, Human
gccucagacccuccgccagcagc

SEQ ID NO: 983391 - RNA, 18 nt, Human
ggagagggaggagggcag

SEQ ID NO: 983392 - RNA, 22 nt, Human
ggagcucagaacaaaaacaaac

SEQ ID NO: 983393 - RNA, 18 nt, Human
ggaggaggaggcagagcu

SEQ ID NO: 983394 - RNA, 21 nt, Human
ggaggaggaggcagagcugcc

SEQ ID NO: 983395 - RNA, 22 nt, Human
ggugguggcggcagcgaccgga

SEQ ID NO: 983396 - RNA, 24 nt, Human
guugccucuccccaccucauggga

SEQ ID NO: 983397 - RNA, 22 nt, Human
uaugagcagacacaguaccugg

SEQ ID NO: 983398 - RNA, 20 nt, Human
uauggagcucagaacaaaaa

SEQ ID NO: 983399 - RNA, 24 nt, Human
ucaauuuucuuaaaaaacaaaaca

SEQ ID NO: 983400 - RNA, 24 nt, Human
ucaugggccccgggaggacagcgg

SEQ ID NO: 983401 - RNA, 24 nt, Human
ucccugcaggcacgacauagcaca

SEQ ID NO: 983402 - RNA, 24 nt, Human
ucuuauggagcucagaacaaaaac

SEQ ID NO: 983403 - RNA, 22 nt, Human
ugaccuggcaugugaggcccac

SEQ ID NO: 983404 - RNA, 24 nt, Human
ugagcagacacaguaccugaucca

SEQ ID NO: 983405 - RNA, 21 nt, Human
ugcugggccaggagagggagg

SEQ ID NO: 983406 - RNA, 21 nt, Human
uggaaggagacggugaccugg

SEQ ID NO: 983407 - RNA, 23 nt, Human
uggaaggagacggugaccuggug

SEQ ID NO: 983408 - RNA, 24 nt, Human
uggaaggagacggugaccugguga

SEQ ID NO: 983409 - RNA, 19 nt, Human
uuuuuuuuuuuuuuugucu

SEQ ID NO: 983410 - RNA, 24 nt, Human
uuuuuuuuuuuuuuuugucuccaa

SEQ ID NO: 983411 - RNA, 18 nt, Human
uuuuuuuuuuuuuuuuug

SEQ ID NO: 983412 - RNA, 19 nt, Human
uuuuuuuuuuuuuuuuugu

SEQ ID NO: 983413 - RNA, 19 nt, Human
aaacaagcgaugcugucag

SEQ ID NO: 983414 - RNA, 20 nt, Human
acaguagcucgccagccccc

SEQ ID NO: 983415 - RNA, 22 nt, Human
accaggcaggcuguucuugcuu

SEQ ID NO: 983416 - RNA, 24 nt, Human
agaauccauaaauuaaaacggcaa

SEQ ID NO: 983417 - RNA, 22 nt, Human
agcaacagcaggagcggaggga

SEQ ID NO: 983418 - RNA, 20 nt, Human
agccagagaggagcgccaga

SEQ ID NO: 983419 - RNA, 20 nt, Human
aggagcgccagagcccacag

SEQ ID NO: 983420 - RNA, 21 nt, Human
aggagcgccagagcccacagc

SEQ ID NO: 983421 - RNA, 22 nt, Human
aggaggcucccccgagccuggc

SEQ ID NO: 983422 - RNA, 19 nt, Human
aggcaagggaggcgcgggu

SEQ ID NO: 983423 - RNA, 19 nt, Human
aggcagaggcagagacaga

SEQ ID NO: 983424 - RNA, 19 nt, Human
agguagucgaagagcucac

SEQ ID NO: 983425 - RNA, 21 nt, Human
aggugcggcguggaggcggug

SEQ ID NO: 983426 - RNA, 22 nt, Human
caacagcaggagcggagggagg

SEQ ID NO: 983427 - RNA, 23 nt, Human
caccagguagucgaagagcucac

SEQ ID NO: 983428 - RNA, 19 nt, Human
cagagacagagagaaaaga

SEQ ID NO: 983429 - RNA, 24 nt, Human
cagcaacagcaggagcggagggag

SEQ ID NO: 983430 - RNA, 18 nt, Human
cagccgcugucagugcug

SEQ ID NO: 983431 - RNA, 19 nt, Human
cagcuuuaggacguggggg

SEQ ID NO: 983432 - RNA, 18 nt, Human
cauguuaacuuuucggga

SEQ ID NO: 983433 - RNA, 20 nt, Human
ccacaggccggccccaacgc

SEQ ID NO: 983434 - RNA, 19 nt, Human
ccagggaggcggggcacgg

SEQ ID NO: 983435 - RNA, 20 nt, Human
cccagcccagcggccuggcc

SEQ ID NO: 983436 - RNA, 20 nt, Human
cccagcggccuggccugcug

SEQ ID NO: 983437 - RNA, 22 nt, Human
ccccaacgccccuuuccuuucc

SEQ ID NO: 983438 - RNA, 19 nt, Human
ccccagaaggccaccaggc

SEQ ID NO: 983439 - RNA, 23 nt, Human
ccccagaaggccaccaggcaggc

SEQ ID NO: 983440 - RNA, 19 nt, Human
ccccagcccccccacugcc

SEQ ID NO: 983441 - RNA, 18 nt, Human
cccccgcgccccaccagc

SEQ ID NO: 983442 - RNA, 18 nt, Human
cccccgcgccccaccagc

SEQ ID NO: 983443 - RNA, 19 nt, Human
ccccgcgccccaccagcuc

SEQ ID NO: 983444 - RNA, 19 nt, Human
ccccuuuccuuuccuccca

SEQ ID NO: 983445 - RNA, 18 nt, Human
ccgcagcagcugccuucc

SEQ ID NO: 983446 - RNA, 24 nt, Human
ccgcgccccaccagcucuguccuc

SEQ ID NO: 983447 - RNA, 18 nt, Human
ccgggucggccgggcugg

SEQ ID NO: 983448 - RNA, 22 nt, Human
ccgugggcacuccgcuuggcgg

SEQ ID NO: 983449 - RNA, 22 nt, Human
ccucagagggcgcccuggcccc

SEQ ID NO: 983450 - RNA, 22 nt, Human
ccucccacgggccgugcggagc

SEQ ID NO: 983451 - RNA, 19 nt, Human
ccugaacagaggugcggag

SEQ ID NO: 983452 - RNA, 19 nt, Human
ccuggccccagaaggccac

SEQ ID NO: 983453 - RNA, 19 nt, Human
ccuggccccagccccccca

SEQ ID NO: 983454 - RNA, 22 nt, Human
cgaggcagccgcugucagugcu

SEQ ID NO: 983455 - RNA, 21 nt, Human
cgcagcccacaggccggcccc

SEQ ID NO: 983456 - RNA, 24 nt, Human
cgcagcccacaggccggccccaac

SEQ ID NO: 983457 - RNA, 21 nt, Human
cgccagagcccacagccgccc

SEQ ID NO: 983458 - RNA, 18 nt, Human
cgccccgucaucauuucc

SEQ ID NO: 983459 - RNA, 22 nt, Human
cggaggcggcgcggccagggag

SEQ ID NO: 983460 - RNA, 23 nt, Human
cggcagcaacagcaggagcggag

SEQ ID NO: 983461 - RNA, 22 nt, Human
cggggccagggccagcggccgc

SEQ ID NO: 983462 - RNA, 24 nt, Human
cucagagggcgcccuggccccagc

SEQ ID NO: 983463 - RNA, 21 nt, Human
cuccggggccagggccagcgg

SEQ ID NO: 983464 - RNA, 20 nt, Human
cugcccguucuucucgucac

SEQ ID NO: 983465 - RNA, 20 nt, Human
cuuuccucccaggcucugag

SEQ ID NO: 983466 - RNA, 20 nt, Human
cuuuucgggauaauuccugg

SEQ ID NO: 983467 - RNA, 20 nt, Human
gacacgcagacggcagggga

SEQ ID NO: 983468 - RNA, 19 nt, Human
gagcccacagccgccccag

SEQ ID NO: 983469 - RNA, 21 nt, Human
gcagccgcugucagugcugug

SEQ ID NO: 983470 - RNA, 19 nt, Human
gccagcccccccgcgcccc

SEQ ID NO: 983471 - RNA, 24 nt, Human
gccccaacgccccuuuccuuuccu

SEQ ID NO: 983472 - RNA, 18 nt, Human
gcccuggccccagccccc

SEQ ID NO: 983473 - RNA, 21 nt, Human
gcccuggccccagccccccca

SEQ ID NO: 983474 - RNA, 18 nt, Human
gccggccccaacgccccu

SEQ ID NO: 983475 - RNA, 26 nt, Human
gccggccccaacgccccuuuccuuuc

SEQ ID NO: 983476 - RNA, 23 nt, Human
gcgcagcccacaggccggcccca

SEQ ID NO: 983477 - RNA, 24 nt, Human
gcgcggccgcggguccacucgggg

SEQ ID NO: 983478 - RNA, 20 nt, Human
gcgggcggcgaggcagccgc

SEQ ID NO: 983479 - RNA, 20 nt, Human
ggagaauccauaaauuaaaa

SEQ ID NO: 983480 - RNA, 28 nt, Human
ggaggcggggcacgggccucccaagggg

SEQ ID NO: 983481 - RNA, 18 nt, Human
ggcaagggaggcgcgggu

SEQ ID NO: 983482 - RNA, 24 nt, Human
ggcagaggcagagacagagagaaa

SEQ ID NO: 983483 - RNA, 22 nt, Human
ggccccagaaggccaccaggca

SEQ ID NO: 983484 - RNA, 24 nt, Human
ggccugcugggaaggcucuggugc

SEQ ID NO: 983485 - RNA, 18 nt, Human
ggcggcgcggccagggag

SEQ ID NO: 983486 - RNA, 21 nt, Human
ggcggguccgcagcagcugcc

SEQ ID NO: 983487 - RNA, 20 nt, Human
ggcggugggcgggcccaucu

SEQ ID NO: 983488 - RNA, 24 nt, Human
ggcuggaggaggcucccccgagcc

SEQ ID NO: 983489 - RNA, 23 nt, Human
gggccagggccagcggccgcgga

SEQ ID NO: 983490 - RNA, 21 nt, Human
gggcgugcugggggccugggc

SEQ ID NO: 983491 - RNA, 23 nt, Human
gggggccugggccgccugcccgu

SEQ ID NO: 983492 - RNA, 23 nt, Human
guccacucggggcagggcgggcg

SEQ ID NO: 983493 - RNA, 19 nt, Human
gugggcgggcccaucuugg

SEQ ID NO: 983494 - RNA, 23 nt, Human
uaaauaacacugaucccagccca

SEQ ID NO: 983495 - RNA, 19 nt, Human
ucagagacaggcagaggca

SEQ ID NO: 983496 - RNA, 24 nt, Human
ucccagcccagcggccuggccugc

SEQ ID NO: 983497 - RNA, 21 nt, Human
ucccccgagccuggccuuccu

SEQ ID NO: 983498 - RNA, 24 nt, Human
ucccugaacagaggugcggagaau

SEQ ID NO: 983499 - RNA, 18 nt, Human
uccuggccccagaaggcc

SEQ ID NO: 983500 - RNA, 26 nt, Human
ucguccagcaggagguuuucagguug

SEQ ID NO: 983501 - RNA, 18 nt, Human
ucucguccagcaggaggu

SEQ ID NO: 983502 - RNA, 19 nt, Human
ucugcgaugcggauguugu

SEQ ID NO: 983503 - RNA, 19 nt, Human
ugaggcaagggaggcgcgg

SEQ ID NO: 983504 - RNA, 23 nt, Human
ugccggaagaacuuccgagccuc

SEQ ID NO: 983505 - RNA, 23 nt, Human
ugcggagaauccauaaauuaaaa

SEQ ID NO: 983506 - RNA, 23 nt, Human
ugcugggaaggcucuggugccgc

SEQ ID NO: 983507 - RNA, 20 nt, Human
ugcugggggccugggccgcc

SEQ ID NO: 983508 - RNA, 19 nt, Human
uggacggggcgcugggcug

SEQ ID NO: 983509 - RNA, 21 nt, Human
uggcagaaguccagcgcagag

SEQ ID NO: 983510 - RNA, 18 nt, Human
ugggcugggccucacugc

SEQ ID NO: 983511 - RNA, 21 nt, Human
uguccucagagggcgcccugg

SEQ ID NO: 983512 - RNA, 18 nt, Human
uguucuugcugagggguc

SEQ ID NO: 983513 - RNA, 24 nt, Human
aaaaaacacugucaagauggccau

SEQ ID NO: 983514 - RNA, 22 nt, Human
aaaaacagagaggaaauuagac

SEQ ID NO: 983515 - RNA, 21 nt, Human
aaaaauauccaaauauuccuu

SEQ ID NO: 983516 - RNA, 21 nt, Human
aaacacacaaaagaaaaaaca

SEQ ID NO: 983517 - RNA, 23 nt, Human
aaaggccuagcccauuugagaac

SEQ ID NO: 983518 - RNA, 23 nt, Human
aauaauuaaacacacaaaagaaa

SEQ ID NO: 983519 - RNA, 23 nt, Human
aaugaguuucuuuuuaaugguuu

SEQ ID NO: 983520 - RNA, 21 nt, Human
acaaagcaaaauagcauaaau

SEQ ID NO: 983521 - RNA, 21 nt, Human
acauaaagcccuucagugcug

SEQ ID NO: 983522 - RNA, 19 nt, Human
aggauuaaaaauauccaaa

SEQ ID NO: 983523 - RNA, 25 nt, Human
caaaaaaacaaaauuucaaagggua

SEQ ID NO: 983524 - RNA, 24 nt, Human
caagagaauacacuucuuuuguuc

SEQ ID NO: 983525 - RNA, 22 nt, Human
caccacagagggaaacucuggg

SEQ ID NO: 983526 - RNA, 20 nt, Human
cagaaacauccugugacaac

SEQ ID NO: 983527 - RNA, 23 nt, Human
cauaauaauuaaacacacaaaag

SEQ ID NO: 983528 - RNA, 24 nt, Human
cauugucacuuuuugaccucugcc

SEQ ID NO: 983529 - RNA, 23 nt, Human
ccaaacaucaaaaaucaaaaaaa

SEQ ID NO: 983530 - RNA, 18 nt, Human
ccuaaauauauauaguuc

SEQ ID NO: 983531 - RNA, 24 nt, Human
cgaaggccgaaaggaggaaaggag

SEQ ID NO: 983532 - RNA, 19 nt, Human
cggccggggacagagagag

SEQ ID NO: 983533 - RNA, 20 nt, Human
cuagugguuucuuggucucc

SEQ ID NO: 983534 - RNA, 18 nt, Human
cuccagaauaguuaaaaa

SEQ ID NO: 983535 - RNA, 21 nt, Human
cuccagaauaguuaaaaacag

SEQ ID NO: 983536 - RNA, 24 nt, Human
cuggucccaaugcaaucauauaaa

SEQ ID NO: 983537 - RNA, 23 nt, Human
cuguacaaugcaacaauagcuuu

SEQ ID NO: 983538 - RNA, 23 nt, Human
cuugaaaauccauuucauaacag

SEQ ID NO: 983539 - RNA, 21 nt, Human
gacggcgaaggccgaaaggag

SEQ ID NO: 983540 - RNA, 22 nt, Human
gcacagugaaauuuauuugucu

SEQ ID NO: 983541 - RNA, 19 nt, Human
ggcaccacagagggaaacu

SEQ ID NO: 983542 - RNA, 23 nt, Human
ggcauguaccauugucacuuuuu

SEQ ID NO: 983543 - RNA, 21 nt, Human
gggaaacucugggaacucgga

SEQ ID NO: 983544 - RNA, 22 nt, Human
guaugcagcugacagaacaaga

SEQ ID NO: 983545 - RNA, 20 nt, Human
uaaaaacagagaggaaauua

SEQ ID NO: 983546 - RNA, 24 nt, Human
uaaaacaugaaacaauauuaacaa

SEQ ID NO: 983547 - RNA, 18 nt, Human
uacacauaaaacaugaaa

SEQ ID NO: 983548 - RNA, 20 nt, Human
uacacauaauaauuaaacac

SEQ ID NO: 983549 - RNA, 26 nt, Human
uaccaaacaucaaaaaucaaaaaaac

SEQ ID NO: 983550 - RNA, 23 nt, Human
uagcauaaauaaauaaguuuacc

SEQ ID NO: 983551 - RNA, 20 nt, Human
uagggcaccacagagggaaa

SEQ ID NO: 983552 - RNA, 23 nt, Human
ucaacagaaacauccugugacaa

SEQ ID NO: 983553 - RNA, 23 nt, Human
ucaauauaaaaaaggccuagccc

SEQ ID NO: 983554 - RNA, 21 nt, Human
uccagaauaguuaaaaacaga

SEQ ID NO: 983555 - RNA, 25 nt, Human
ucuuugguuuuaaacacgauagauc

SEQ ID NO: 983556 - RNA, 22 nt, Human
ucuuuuguucuccucaucuuag

SEQ ID NO: 983557 - RNA, 23 nt, Human
ugaaacaauauuaacaaauuaca

SEQ ID NO: 983558 - RNA, 19 nt, Human
ugaaugcacagcagauaca

SEQ ID NO: 983559 - RNA, 24 nt, Human
ugacagaacaagagaauacacuuc

SEQ ID NO: 983560 - RNA, 24 nt, Human
uggcacagugaaauuuauuugucu

SEQ ID NO: 983561 - RNA, 25 nt, Human
uggcacagugaaauuuauuugucuu

SEQ ID NO: 983562 - RNA, 18 nt, Human
uguauuaaguuuuuauuu

SEQ ID NO: 983563 - RNA, 19 nt, Human
ugucaagauggccauaugu

SEQ ID NO: 983564 - RNA, 22 nt, Human
uuaaacacacaaaagaaaaaac

SEQ ID NO: 983565 - RNA, 19 nt, Human
uuaaucuuuuuuuuuucag

SEQ ID NO: 983566 - RNA, 21 nt, Human
uuaccuaaauauauauaguuc

SEQ ID NO: 983567 - RNA, 26 nt, Human
uucuuuuguucuccucaucuuagagu

SEQ ID NO: 983568 - RNA, 22 nt, Human
uuggucuccagaauaguuaaaa

SEQ ID NO: 983569 - RNA, 22 nt, Human
aaaaggacaaaauaggaccaca

SEQ ID NO: 983570 - RNA, 24 nt, Human
aaaaggacaaaauaggaccacaaa

SEQ ID NO: 983571 - RNA, 21 nt, Human
aaaauaaaguagaaucaaaga

SEQ ID NO: 983572 - RNA, 20 nt, Human
aacaaaagcaacuuuaaaaa

SEQ ID NO: 983573 - RNA, 23 nt, Human
aacaaaagcaacuuuaaaaaugu

SEQ ID NO: 983574 - RNA, 23 nt, Human
aagaaaaccaggccaaaaaggau

SEQ ID NO: 983575 - RNA, 19 nt, Human
acaugaaaaggacaaaaua

SEQ ID NO: 983576 - RNA, 21 nt, Human
acuuugagaaacuuccagaag

SEQ ID NO: 983577 - RNA, 25 nt, Human
agaaaagaaauaaccauuuagagaa

SEQ ID NO: 983578 - RNA, 27 nt, Human
agaaagaaaagaaauaaccauuuagag

SEQ ID NO: 983579 - RNA, 20 nt, Human
agacaugaaaaggacaaaau

SEQ ID NO: 983580 - RNA, 18 nt, Human
agaucucaguugaggagg

SEQ ID NO: 983581 - RNA, 19 nt, Human
agcaaaaauaaaaaugagu

SEQ ID NO: 983582 - RNA, 25 nt, Human
aggaagaaaaccaggccaaaaagga

SEQ ID NO: 983583 - RNA, 20 nt, Human
auugauuauuagagcaaauu

SEQ ID NO: 983584 - RNA, 20 nt, Human
caaaauaggaccacaaaacu

SEQ ID NO: 983585 - RNA, 18 nt, Human
caaguuggaaagaucuca

SEQ ID NO: 983586 - RNA, 20 nt, Human
cacuguuugaggaagaaaac

SEQ ID NO: 983587 - RNA, 21 nt, Human
cacuguuugaggaagaaaacc

SEQ ID NO: 983588 - RNA, 19 nt, Human
cagaaagaaaagaaauaac

SEQ ID NO: 983589 - RNA, 20 nt, Human
ccacuuuuuaaaaauaaagu

SEQ ID NO: 983590 - RNA, 23 nt, Human
cguaguggguuaugaaauccauu

SEQ ID NO: 983591 - RNA, 20 nt, Human
gacaaaauaggaccacaaaa

SEQ ID NO: 983592 - RNA, 20 nt, Human
gacaugaaaaggacaaaaua

SEQ ID NO: 983593 - RNA, 25 nt, Human
gagcugcagaaagaaaagaaauaac

SEQ ID NO: 983594 - RNA, 26 nt, Human
gaggaagaaaaccaggccaaaaagga

SEQ ID NO: 983595 - RNA, 20 nt, Human
gagugugugugugcgugugu

SEQ ID NO: 983596 - RNA, 25 nt, Human
ggaaagaucucaguugaggaggaag

SEQ ID NO: 983597 - RNA, 22 nt, Human
ggaaaucagagaaaagcuagca

SEQ ID NO: 983598 - RNA, 18 nt, Human
gugugugugugcgugugu

SEQ ID NO: 983599 - RNA, 20 nt, Human
uaaaacagcaucuuaucaaa

SEQ ID NO: 983600 - RNA, 25 nt, Human
uaaaacagcaucuuaucaaacugcg

SEQ ID NO: 983601 - RNA, 25 nt, Human
uaaaguagaaucaaagagauaauau

SEQ ID NO: 983602 - RNA, 22 nt, Human
uagaagcauccuguauagacug

SEQ ID NO: 983603 - RNA, 18 nt, Human
uaggaccacaaaacuggu

SEQ ID NO: 983604 - RNA, 22 nt, Human
uauauguauagagugugugugu

SEQ ID NO: 983605 - RNA, 21 nt, Human
uauguauagagugugugugug

SEQ ID NO: 983606 - RNA, 18 nt, Human
ucaguugaggaggaagaa

SEQ ID NO: 983607 - RNA, 19 nt, Human
uccuggaaaucagagaaaa

SEQ ID NO: 983608 - RNA, 22 nt, Human
ugaaaagcauggucuaaaacag

SEQ ID NO: 983609 - RNA, 22 nt, Human
ugaaaaggacaaaauaggacca

SEQ ID NO: 983610 - RNA, 23 nt, Human
ugagagcugcagaaagaaaagaa

SEQ ID NO: 983611 - RNA, 19 nt, Human
ugaggaagaaaaccaggcc

SEQ ID NO: 983612 - RNA, 24 nt, Human
ugaggaggaagaaaaauacacucu

SEQ ID NO: 983613 - RNA, 23 nt, Human
ugcaacaaaagcaacuuuaaaaa

SEQ ID NO: 983614 - RNA, 23 nt, Human
ugcagaaagaaaagaaauaacca

SEQ ID NO: 983615 - RNA, 19 nt, Human
uggcaaguuggaaagaucu

SEQ ID NO: 983616 - RNA, 19 nt, Human
uggcagcauuuuacuuaac

SEQ ID NO: 983617 - RNA, 22 nt, Human
ugugguuuuuaaaaaggcuuaa

SEQ ID NO: 983618 - RNA, 24 nt, Human
uuaaaaauaaaguagaaucaaaga

SEQ ID NO: 983619 - RNA, 20 nt, Human
uuccagaaguaauugggagu

SEQ ID NO: 983620 - RNA, 26 nt, Human
uuuuuauauugagcaaaaauaaaaau

SEQ ID NO: 983621 - RNA, 22 nt, Human
aaacagaacuauuaaacacaca

SEQ ID NO: 983622 - RNA, 20 nt, Human
aaacauccugcaucugggag

SEQ ID NO: 983623 - RNA, 25 nt, Human
aaacauccugcaucugggagaagga

SEQ ID NO: 983624 - RNA, 21 nt, Human
aaagauacacucuccacgccc

SEQ ID NO: 983625 - RNA, 31 nt, Human
aacuauuaaacacacacacacauacacacag

SEQ ID NO: 983626 - RNA, 24 nt, Human
aagagcuauagauccagggacagu

SEQ ID NO: 983627 - RNA, 21 nt, Human
aaggaagaaaguagagacggu

SEQ ID NO: 983628 - RNA, 18 nt, Human
aaggagcuccagaaagga

SEQ ID NO: 983629 - RNA, 23 nt, Human
acacacacacauacacacacaca

SEQ ID NO: 983630 - RNA, 23 nt, Human
acacacacacauauacacacaca

SEQ ID NO: 983631 - RNA, 23 nt, Human
acacacacauacacacacacaua

SEQ ID NO: 983632 - RNA, 19 nt, Human
acacucuccacgcccaccc

SEQ ID NO: 983633 - RNA, 18 nt, Human
accccaaaaaaagauaca

SEQ ID NO: 983634 - RNA, 25 nt, Human
accccaaaaaaagauacacucucca

SEQ ID NO: 983635 - RNA, 19 nt, Human
acugguugaaaacauccug

SEQ ID NO: 983636 - RNA, 19 nt, Human
agaagcugaaagagggguu

SEQ ID NO: 983637 - RNA, 22 nt, Human
agaaggaagaaaguagagacgg

SEQ ID NO: 983638 - RNA, 22 nt, Human
agcuucaaguauggugaggcac

SEQ ID NO: 983639 - RNA, 22 nt, Human
auacacacacacauauacacac

SEQ ID NO: 983640 - RNA, 31 nt, Human
auuaaacacacacacacauacacacacacag

SEQ ID NO: 983641 - RNA, 21 nt, Human
cacaacaucugggacgccccc

SEQ ID NO: 983642 - RNA, 22 nt, Human
cacacacacacauacacacaca

SEQ ID NO: 983643 - RNA, 24 nt, Human
cacacacacacauacacacacaca

SEQ ID NO: 983644 - RNA, 28 nt, Human
cacacacacacauacacacacacauaua

SEQ ID NO: 983645 - RNA, 28 nt, Human
cacacacauacacacacacauauacaca

SEQ ID NO: 983646 - RNA, 20 nt, Human
cacacaccccaaaaaaagag

SEQ ID NO: 983647 - RNA, 22 nt, Human
cacacauacacacacacauaua

SEQ ID NO: 983648 - RNA, 26 nt, Human
cacacauauacacacacaccccaaaa

SEQ ID NO: 983649 - RNA, 22 nt, Human
cacacauauacacacacacccu

SEQ ID NO: 983650 - RNA, 25 nt, Human
cacauacacacacacauauacacac

SEQ ID NO: 983651 - RNA, 18 nt, Human
cacauauacacacacacc

SEQ ID NO: 983652 - RNA, 22 nt, Human
cauauacacacacaccccaaaa

SEQ ID NO: 983653 - RNA, 19 nt, Human
caucugggacgcccccagc

SEQ ID NO: 983654 - RNA, 23 nt, Human
ccacagccuagagcugagacagg

SEQ ID NO: 983655 - RNA, 22 nt, Human
cccagccuaggagcuccaagcu

SEQ ID NO: 983656 - RNA, 18 nt, Human
ccccaaaaaaagauacac

SEQ ID NO: 983657 - RNA, 23 nt, Human
ccccaaaaaaagauacacucucc

SEQ ID NO: 983658 - RNA, 19 nt, Human
cccuuguccugggagcuuc

SEQ ID NO: 983659 - RNA, 25 nt, Human
ccuagagcugagacaggccgggguc

SEQ ID NO: 983660 - RNA, 23 nt, Human
ccucaggccaagggacggauucc

SEQ ID NO: 983661 - RNA, 27 nt, Human
cgcccccagccuaggagcuccaagcuc

SEQ ID NO: 983662 - RNA, 21 nt, Human
cuagagcugagacaggcucug

SEQ ID NO: 983663 - RNA, 21 nt, Human
cuagucucuuuagcucucagu

SEQ ID NO: 983664 - RNA, 19 nt, Human
gagaaaaggccccuggaug

SEQ ID NO: 983665 - RNA, 19 nt, Human
gcaccuccaacaccacaua

SEQ ID NO: 983666 - RNA, 24 nt, Human
gcaggucccuagaguuaaaggcac

SEQ ID NO: 983667 - RNA, 21 nt, Human
ggugaggcacaacuuuuauua

SEQ ID NO: 983668 - RNA, 18 nt, Human
guugaguuggcggcuugu

SEQ ID NO: 983669 - RNA, 19 nt, Human
uaagaaagagcuggcaacc

SEQ ID NO: 983670 - RNA, 23 nt, Human
uaaggcaaaaaccugcugggaag

SEQ ID NO: 983671 - RNA, 24 nt, Human
uaaucccucaauaacagggacuga

SEQ ID NO: 983672 - RNA, 18 nt, Human
uagaaggaagaaaguaga

SEQ ID NO: 983673 - RNA, 25 nt, Human
uauacacacacaccccaaaaaaaga

SEQ ID NO: 983674 - RNA, 18 nt, Human
ucaguugaguuggcggcu

SEQ ID NO: 983675 - RNA, 21 nt, Human
ugagguuuuucccuaaggucc

SEQ ID NO: 983676 - RNA, 18 nt, Human
ugaguuggcggcuugugu

SEQ ID NO: 983677 - RNA, 22 nt, Human
uggcaaccaaaguuggaggcug

SEQ ID NO: 983678 - RNA, 24 nt, Human
uguaguagaauaagaaagagcugg

SEQ ID NO: 983679 - RNA, 24 nt, Human
uuacaaacagaacuauuaaacaca

SEQ ID NO: 983680 - RNA, 23 nt, Human
uuccacaacaucugggacgcccc

SEQ ID NO: 983681 - RNA, 21 nt, Human
uugaaaacauccugcaucugg

SEQ ID NO: 983682 - RNA, 18 nt, Human
aaaaaccaaaaacacacg

SEQ ID NO: 983683 - RNA, 21 nt, Human
aaaaaccaaaaacacacgguu

SEQ ID NO: 983684 - RNA, 20 nt, Human
aaaauaauggcacaauaaua

SEQ ID NO: 983685 - RNA, 25 nt, Human
aaaccaaaaacacacgguuuauaau

SEQ ID NO: 983686 - RNA, 21 nt, Human
aaagaaacaaaccaaaaaugg

SEQ ID NO: 983687 - RNA, 25 nt, Human
aaagggcagacacagucuuuaauug

SEQ ID NO: 983688 - RNA, 19 nt, Human
aacaacuuucuagaaaacc

SEQ ID NO: 983689 - RNA, 21 nt, Human
aaccucagcaaaaguuaauau

SEQ ID NO: 983690 - RNA, 24 nt, Human
acccccuggccugcauuuacuucc

SEQ ID NO: 983691 - RNA, 23 nt, Human
accugaguucucuugguuauggg

SEQ ID NO: 983692 - RNA, 22 nt, Human
acuuagguaaaucaguuucuuu

SEQ ID NO: 983693 - RNA, 23 nt, Human
agaaaaaguauagaaauaaauga

SEQ ID NO: 983694 - RNA, 19 nt, Human
agcaaaacaguuauuuuga

SEQ ID NO: 983695 - RNA, 22 nt, Human
aggaaaggaaaauucuacucag

SEQ ID NO: 983696 - RNA, 19 nt, Human
aggcagaauggaccuuaau

SEQ ID NO: 983697 - RNA, 20 nt, Human
auacaauaaaacaccaaaag

SEQ ID NO: 983698 - RNA, 22 nt, Human
augaaacacuguggagcuaccc

SEQ ID NO: 983699 - RNA, 18 nt, Human
auguuaauuaaaggcagu

SEQ ID NO: 983700 - RNA, 21 nt, Human
auuccuuuuuaaagcagcaau

SEQ ID NO: 983701 - RNA, 24 nt, Human
caaaagacagauagcugcugcucc

SEQ ID NO: 983702 - RNA, 19 nt, Human
caaaguagcuuuccagaac

SEQ ID NO: 983703 - RNA, 21 nt, Human
caacaaaguagcuuuccagaa

SEQ ID NO: 983704 - RNA, 24 nt, Human
caacaaaguagcuuuccagaacua

SEQ ID NO: 983705 - RNA, 20 nt, Human
cacacgguuuauaauaaaac

SEQ ID NO: 983706 - RNA, 24 nt, Human
cacagcacacacaggcagaaugga

SEQ ID NO: 983707 - RNA, 18 nt, Human
caccaccaucuucaggag

SEQ ID NO: 983708 - RNA, 21 nt, Human
cagaaauaagugcacuucuaa

SEQ ID NO: 983709 - RNA, 18 nt, Human
cagcacacacaggcagaa

SEQ ID NO: 983710 - RNA, 23 nt, Human
cagcagcaacauuuauaaaagcu

SEQ ID NO: 983711 - RNA, 18 nt, Human
cagcucccuucuccccgc

SEQ ID NO: 983712 - RNA, 21 nt, Human
cagcucccuucuccccgcucc

SEQ ID NO: 983713 - RNA, 20 nt, Human
cauaagauuugcaguaaaac

SEQ ID NO: 983714 - RNA, 24 nt, Human
ccaaccaauuccuauaguagucuu

SEQ ID NO: 983715 - RNA, 20 nt, Human
ccaagcaagccuggugaugc

SEQ ID NO: 983716 - RNA, 22 nt, Human
ccaagugucucauauuuauauu

SEQ ID NO: 983717 - RNA, 24 nt, Human
ccagaacuacccuuccagugccaa

SEQ ID NO: 983718 - RNA, 24 nt, Human
ccauaaucaaauuaaaauaaugcc

SEQ ID NO: 983719 - RNA, 23 nt, Human
cccagcagcaacauuuauaaaag

SEQ ID NO: 983720 - RNA, 21 nt, Human
ccccaaagauugugaaucacu

SEQ ID NO: 983721 - RNA, 19 nt, Human
ccccgggaggugggacccg

SEQ ID NO: 983722 - RNA, 23 nt, Human
ccccuauccucucaucacaaccc

SEQ ID NO: 983723 - RNA, 19 nt, Human
cccgcccccgggagguggg

SEQ ID NO: 983724 - RNA, 19 nt, Human
cccgcuccgcccucgcccc

SEQ ID NO: 983725 - RNA, 21 nt, Human
cccugaacucucgcgagccuu

SEQ ID NO: 983726 - RNA, 20 nt, Human
cccuuuaauaagcugaccuc

SEQ ID NO: 983727 - RNA, 24 nt, Human
ccgcuccgcccucgccccgccccc

SEQ ID NO: 983728 - RNA, 18 nt, Human
ccggucgcgcccgcggcc

SEQ ID NO: 983729 - RNA, 18 nt, Human
ccucgccccgcccccggg

SEQ ID NO: 983730 - RNA, 19 nt, Human
ccucgccccgcccccggga

SEQ ID NO: 983731 - RNA, 19 nt, Human
cuaccugaguucucuuggu

SEQ ID NO: 983732 - RNA, 21 nt, Human
cuagacccauaagauuugcag

SEQ ID NO: 983733 - RNA, 22 nt, Human
cuccugaauugauuagaggugu

SEQ ID NO: 983734 - RNA, 22 nt, Human
cugcaguguuaccuacagguua

SEQ ID NO: 983735 - RNA, 21 nt, Human
gaucuuugguacauuuggagc

SEQ ID NO: 983736 - RNA, 18 nt, Human
gcacggaccgcagccggc

SEQ ID NO: 983737 - RNA, 19 nt, Human
gccacagcacacacaggca

SEQ ID NO: 983738 - RNA, 23 nt, Human
ggaacucaaaacaaaaaaugcuc

SEQ ID NO: 983739 - RNA, 24 nt, Human
ggagaaaaccccaaagauugugaa

SEQ ID NO: 983740 - RNA, 20 nt, Human
ggggaguugggggaaacagg

SEQ ID NO: 983741 - RNA, 24 nt, Human
guugacuagauaggguuuugucau

SEQ ID NO: 983742 - RNA, 24 nt, Human
guuuguuucauuaagauuuuucag

SEQ ID NO: 983743 - RNA, 18 nt, Human
uaaaaaguaaacuuaggu

SEQ ID NO: 983744 - RNA, 23 nt, Human
uaaagggcagacacagucuuuaa

SEQ ID NO: 983745 - RNA, 22 nt, Human
uaaauaaacacaacaggaaaau

SEQ ID NO: 983746 - RNA, 26 nt, Human
uaaaugaaacccuaucuuaggccuua

SEQ ID NO: 983747 - RNA, 21 nt, Human
uaacggaaacugccuccgguc

SEQ ID NO: 983748 - RNA, 21 nt, Human
uaagcuagaaaagauuauuua

SEQ ID NO: 983749 - RNA, 22 nt, Human
uaauacaaagguuuuuaauaaa

SEQ ID NO: 983750 - RNA, 22 nt, Human
uacucaaaaaauccagacuaga

SEQ ID NO: 983751 - RNA, 18 nt, Human
uaguagucccaagugucu

SEQ ID NO: 983752 - RNA, 21 nt, Human
uaucaaagaucugucaggucu

SEQ ID NO: 983753 - RNA, 24 nt, Human
uaugggaaauauauaauagagaaa

SEQ ID NO: 983754 - RNA, 23 nt, Human
ucaaaaaauccagacuagaaaaa

SEQ ID NO: 983755 - RNA, 18 nt, Human
ucacaagaaaaucaacuu

SEQ ID NO: 983756 - RNA, 22 nt, Human
ucaguguauuguuaucuacgcc

SEQ ID NO: 983757 - RNA, 23 nt, Human
uccaaaccaauagggcaauguuc

SEQ ID NO: 983758 - RNA, 19 nt, Human
uccauuaacaguuaugaca

SEQ ID NO: 983759 - RNA, 18 nt, Human
uccccgcuccgcccucgc

SEQ ID NO: 983760 - RNA, 21 nt, Human
uccccgcuccgcccucgcccc

SEQ ID NO: 983761 - RNA, 21 nt, Human
uccccuauccucucaucacaa

SEQ ID NO: 983762 - RNA, 19 nt, Human
uccgcacggaccgcagccg

SEQ ID NO: 983763 - RNA, 20 nt, Human
ucuacagauguccaaaccaa

SEQ ID NO: 983764 - RNA, 22 nt, Human
ugauauguaacaacuuucuaga

SEQ ID NO: 983765 - RNA, 18 nt, Human
ugauauguguuucuccug

SEQ ID NO: 983766 - RNA, 21 nt, Human
uggcacaauaauacaaguacu

SEQ ID NO: 983767 - RNA, 19 nt, Human
ugggggaguugggggaaac

SEQ ID NO: 983768 - RNA, 19 nt, Human
uggggugagaaaaucucau

SEQ ID NO: 983769 - RNA, 27 nt, Human
uuaacaaaaauaauaaaauauuaaaaa

SEQ ID NO: 983770 - RNA, 21 nt, Human
uuagagauuuacauaaaaaua

SEQ ID NO: 983771 - RNA, 23 nt, Human
uucuacaagcagccuucaugguc

SEQ ID NO: 983772 - RNA, 26 nt, Human
uucuauauacuuagaaaaaccaaaaa

SEQ ID NO: 983773 - RNA, 21 nt, Human
uugcaucaugaaucaaauucu

SEQ ID NO: 983774 - RNA, 20 nt, Human
uugguagccagggaccucua

SEQ ID NO: 983775 - RNA, 20 nt, Human
uuuucagaaauaagugcacu

SEQ ID NO: 983776 - RNA, 23 nt, Human
uuuuucauaaaaaucuaaaauau

SEQ ID NO: 983777 - RNA, 27 nt, Human
aaaacccuuccaauuuucacuccaccu

SEQ ID NO: 983778 - RNA, 26 nt, Human
aaacagacuaaaagaauaagcaucca

SEQ ID NO: 983779 - RNA, 25 nt, Human
aaauacuccaaagacagacccaaaa

SEQ ID NO: 983780 - RNA, 25 nt, Human
aacaacaaugaaaggagaaauaggc

SEQ ID NO: 983781 - RNA, 23 nt, Human
aauaacaacaaugaaaggagaaa

SEQ ID NO: 983782 - RNA, 24 nt, Human
aaugguaccauccugggagcccac

SEQ ID NO: 983783 - RNA, 23 nt, Human
accauccugggagcccaccuccu

SEQ ID NO: 983784 - RNA, 21 nt, Human
acuaaaagaauaagcauccaa

SEQ ID NO: 983785 - RNA, 19 nt, Human
agaaagagggaggguugaa

SEQ ID NO: 983786 - RNA, 21 nt, Human
agacagacccaaaacuuuuug

SEQ ID NO: 983787 - RNA, 22 nt, Human
agagaauaaagcagaacucgga

SEQ ID NO: 983788 - RNA, 27 nt, Human
aggaaaugggagugagggggugggagg

SEQ ID NO: 983789 - RNA, 24 nt, Human
aggagaaauaggcuucuggauaga

SEQ ID NO: 983790 - RNA, 21 nt, Human
agucagauuguaaauugguuu

SEQ ID NO: 983791 - RNA, 18 nt, Human
agugagggggugggagga

SEQ ID NO: 983792 - RNA, 23 nt, Human
aucaccuuuagaauaacaaaucc

SEQ ID NO: 983793 - RNA, 30 nt, Human
aucguuguguaaacaauagaauggaaugaa

SEQ ID NO: 983794 - RNA, 19 nt, Human
caccucccucucccaagag

SEQ ID NO: 983795 - RNA, 24 nt, Human
ccagaguaaagcagccucaggcac

SEQ ID NO: 983796 - RNA, 21 nt, Human
cccgcccgccgccgccgccgc

SEQ ID NO: 983797 - RNA, 19 nt, Human
cccgccgccgccgccgccg

SEQ ID NO: 983798 - RNA, 26 nt, Human
ccgcccgccgccgccgccgccgccgg

SEQ ID NO: 983799 - RNA, 18 nt, Human
ccgccgccgccgccgccg

SEQ ID NO: 983800 - RNA, 18 nt, Human
ccgccgccgccgccgccg

SEQ ID NO: 983801 - RNA, 18 nt, Human
ccgccgccgccgccgccg

SEQ ID NO: 983802 - RNA, 23 nt, Human
ccgccgccgccgccgccgccgcc

SEQ ID NO: 983803 - RNA, 24 nt, Human
ccgccgccgccgccgccgccgccg

SEQ ID NO: 983804 - RNA, 24 nt, Human
ccgccgccgccgccgccgccgccg

SEQ ID NO: 983805 - RNA, 24 nt, Human
ccgccgccgccgccgccgccgccg

SEQ ID NO: 983806 - RNA, 26 nt, Human
ccgccgccgccgccgccgccgccguc

SEQ ID NO: 983807 - RNA, 22 nt, Human
ccgccgccgccgccgccgccgu

SEQ ID NO: 983808 - RNA, 24 nt, Human
ccgccgccgccgccguccccgccg

SEQ ID NO: 983809 - RNA, 18 nt, Human
ccgccgccgccguccccg

SEQ ID NO: 983810 - RNA, 19 nt, Human
ccgccgccgccguccccgc

SEQ ID NO: 983811 - RNA, 23 nt, Human
ccgccgccguccccgccgaagcc

SEQ ID NO: 983812 - RNA, 22 nt, Human
ccgccguccccgccgaagccag

SEQ ID NO: 983813 - RNA, 21 nt, Human
ccucucggccggcgcacgccc

SEQ ID NO: 983814 - RNA, 23 nt, Human
cgccgccgccgccgccguccccg

SEQ ID NO: 983815 - RNA, 19 nt, Human
cuccaaagacagacccaaa

SEQ ID NO: 983816 - RNA, 18 nt, Human
gauugcuagagaauaaag

SEQ ID NO: 983817 - RNA, 18 nt, Human
ggaaaugggagugagggg

SEQ ID NO: 983818 - RNA, 20 nt, Human
ggaaaugggagugagggggu

SEQ ID NO: 983819 - RNA, 23 nt, Human
ggaggaaaugggcagaaagaggg

SEQ ID NO: 983820 - RNA, 22 nt, Human
ggaguagggguggcgguggggc

SEQ ID NO: 983821 - RNA, 22 nt, Human
gggggugggaggaaaugggcag

SEQ ID NO: 983822 - RNA, 19 nt, Human
ggggugggaggaaaugggc

SEQ ID NO: 983823 - RNA, 19 nt, Human
guauugauucuugaaccuu

SEQ ID NO: 983824 - RNA, 26 nt, Human
uaaaagaggcaguauugucagaugua

SEQ ID NO: 983825 - RNA, 19 nt, Human
uaaagcagaacucggagug

SEQ ID NO: 983826 - RNA, 22 nt, Human
uaaauaagaccaccugagugua

SEQ ID NO: 983827 - RNA, 23 nt, Human
uaacagaaauaacaacaaugaaa

SEQ ID NO: 983828 - RNA, 23 nt, Human
uaaggagagccaaaucagagaug

SEQ ID NO: 983829 - RNA, 21 nt, Human
uacuccaaagacagacccaaa

SEQ ID NO: 983830 - RNA, 18 nt, Human
uaggaaagagcaauggua

SEQ ID NO: 983831 - RNA, 22 nt, Human
uaggcuucuggauagaaaauuc

SEQ ID NO: 983832 - RNA, 19 nt, Human
uagggguggcgguggggca

SEQ ID NO: 983833 - RNA, 21 nt, Human
uauacagucaagcagggggcu

SEQ ID NO: 983834 - RNA, 22 nt, Human
uauuugcuuuuugaaguacauu

SEQ ID NO: 983835 - RNA, 20 nt, Human
uccccgccgaagccagcuag

SEQ ID NO: 983836 - RNA, 22 nt, Human
ucggccggcgcacgcccucccc

SEQ ID NO: 983837 - RNA, 18 nt, Human
ugaaaaauaaaauucaca

SEQ ID NO: 983838 - RNA, 22 nt, Human
ugaaaggagaaauaggcuucug

SEQ ID NO: 983839 - RNA, 22 nt, Human
ugagggggugggaggaaauggg

SEQ ID NO: 983840 - RNA, 21 nt, Human
ugcagcuguggcauuugcuug

SEQ ID NO: 983841 - RNA, 18 nt, Human
ugcggaggagagcaggag

SEQ ID NO: 983842 - RNA, 20 nt, Human
ugcggaggagagcaggagga

SEQ ID NO: 983843 - RNA, 24 nt, Human
ugggaggaaaugggcagaaagagg

SEQ ID NO: 983844 - RNA, 25 nt, Human
ugggaggaaaugggcagaaagaggg

SEQ ID NO: 983845 - RNA, 20 nt, Human
ugggcagaaagagggagggu

SEQ ID NO: 983846 - RNA, 21 nt, Human
ugggcagaaagagggaggguu

SEQ ID NO: 983847 - RNA, 27 nt, Human
uguguaaacaauagaauggaaugaaau

SEQ ID NO: 983848 - RNA, 26 nt, Human
uguugccaauaaauaagaccaccuga

SEQ ID NO: 983849 - RNA, 27 nt, Human
uuacauuaaauuguaugcaaauggcuc

SEQ ID NO: 983850 - RNA, 22 nt, Human
uucaaguaaaacucagauucug

SEQ ID NO: 983851 - RNA, 24 nt, Human
uucagauucuuuucacuuaaggga

SEQ ID NO: 983852 - RNA, 19 nt, Human
uugaagccggccucuucac

SEQ ID NO: 983853 - RNA, 24 nt, Human
uuugcaaggcaccucccucuccca

SEQ ID NO: 983854 - RNA, 25 nt, Human
uuuugcuaggaaaugggagugaggg

SEQ ID NO: 983855 - RNA, 20 nt, Human
aaagacagccucccccaccg

SEQ ID NO: 983856 - RNA, 19 nt, Human
aaccucuagaccaugcagc

SEQ ID NO: 983857 - RNA, 23 nt, Human
aacgaaacaaaaccaaaacccga

SEQ ID NO: 983858 - RNA, 24 nt, Human
aacgaaacaaaaccaaaacccgaa

SEQ ID NO: 983859 - RNA, 24 nt, Human
aagcaugaagcugggggcgggggu

SEQ ID NO: 983860 - RNA, 19 nt, Human
aagcugggggcgggggugg

SEQ ID NO: 983861 - RNA, 27 nt, Human
aaggaacucagcccagagggugugggc

SEQ ID NO: 983862 - RNA, 21 nt, Human
aaggcccaggguguccaccuc

SEQ ID NO: 983863 - RNA, 23 nt, Human
aagggaaagaaggaacucagccc

SEQ ID NO: 983864 - RNA, 23 nt, Human
aaguugagggcccuggcucuggg

SEQ ID NO: 983865 - RNA, 19 nt, Human
acaaaaccaaaacccgaac

SEQ ID NO: 983866 - RNA, 19 nt, Human
accaucaccccccuccccc

SEQ ID NO: 983867 - RNA, 23 nt, Human
acccagccgcgcccggccuggug

SEQ ID NO: 983868 - RNA, 21 nt, Human
accuuacccgcugcccuucca

SEQ ID NO: 983869 - RNA, 22 nt, Human
acuguccaugcugcccacaacc

SEQ ID NO: 983870 - RNA, 21 nt, Human
agagggcacaggaggggccag

SEQ ID NO: 983871 - RNA, 25 nt, Human
agaggugaacgaaacaaaaccaaaa

SEQ ID NO: 983872 - RNA, 19 nt, Human
agccucccccaccgccauc

SEQ ID NO: 983873 - RNA, 18 nt, Human
aggaauaucccagcccuc

SEQ ID NO: 983874 - RNA, 20 nt, Human
aggacccgugaucccacgcc

SEQ ID NO: 983875 - RNA, 19 nt, Human
aggauggaaguugagggcc

SEQ ID NO: 983876 - RNA, 19 nt, Human
aggcaccaucaccccccuc

SEQ ID NO: 983877 - RNA, 18 nt, Human
aggccuccacccacagcc

SEQ ID NO: 983878 - RNA, 22 nt, Human
aggcucccaggcaccaucaccc

SEQ ID NO: 983879 - RNA, 25 nt, Human
aggcuggagaggcgcaaguggcggc

SEQ ID NO: 983880 - RNA, 21 nt, Human
agggcagagggcacaggaggg

SEQ ID NO: 983881 - RNA, 20 nt, Human
aggguguuggggcuggcuug

SEQ ID NO: 983882 - RNA, 20 nt, Human
aucaccccccucccccgucg

SEQ ID NO: 983883 - RNA, 19 nt, Human
caaccacauuaaggaaagc

SEQ ID NO: 983884 - RNA, 22 nt, Human
caaccucuagaccaugcagccu

SEQ ID NO: 983885 - RNA, 18 nt, Human
cacacgcaggcucccagg

SEQ ID NO: 983886 - RNA, 22 nt, Human
cacagcccccucugggugccaa

SEQ ID NO: 983887 - RNA, 19 nt, Human
cacauuaaggaaagcugca

SEQ ID NO: 983888 - RNA, 20 nt, Human
cacauuaaggaaagcugcag

SEQ ID NO: 983889 - RNA, 26 nt, Human
caccaugaggaauaucccagcccuca

SEQ ID NO: 983890 - RNA, 18 nt, Human
caccgccaccucucucac

SEQ ID NO: 983891 - RNA, 19 nt, Human
caccgccaccucucucaca

SEQ ID NO: 983892 - RNA, 19 nt, Human
caccgccauccuccagcug

SEQ ID NO: 983893 - RNA, 22 nt, Human
cagcacuccaaagggcucuagg

SEQ ID NO: 983894 - RNA, 19 nt, Human
cagccucccccaccgccau

SEQ ID NO: 983895 - RNA, 21 nt, Human
cagccugcucaugggucccug

SEQ ID NO: 983896 - RNA, 20 nt, Human
cagccuuggguucccauccc

SEQ ID NO: 983897 - RNA, 21 nt, Human
cagcggucccacaaaaucccc

SEQ ID NO: 983898 - RNA, 19 nt, Human
caggaugggcgccgcccgu

SEQ ID NO: 983899 - RNA, 19 nt, Human
caggcccccaacugcaggc

SEQ ID NO: 983900 - RNA, 25 nt, Human
caggcucccaggcaccaucaccccc

SEQ ID NO: 983901 - RNA, 24 nt, Human
cauuaaggaaagcugcagccccca

SEQ ID NO: 983902 - RNA, 20 nt, Human
ccacagcccccucugggugc

SEQ ID NO: 983903 - RNA, 21 nt, Human
ccaccagggcagagggcacag

SEQ ID NO: 983904 - RNA, 22 nt, Human
ccagcagacucagggcaggccc

SEQ ID NO: 983905 - RNA, 22 nt, Human
cccaacugcaggcuuccaggaa

SEQ ID NO: 983906 - RNA, 25 nt, Human
cccacaaccucuagaccaugcagcc

SEQ ID NO: 983907 - RNA, 22 nt, Human
cccacccgccugccaguucaac

SEQ ID NO: 983908 - RNA, 22 nt, Human
cccccgggggacccagccgcgc

SEQ ID NO: 983909 - RNA, 30 nt, Human
cccccgggggacccagccgcgcccggccuu

SEQ ID NO: 983910 - RNA, 18 nt, Human
cccccgucgccccucccu

SEQ ID NO: 983911 - RNA, 20 nt, Human
cccccuggaaagacagcagg

SEQ ID NO: 983912 - RNA, 22 nt, Human
cccccuuggggcucccugagga

SEQ ID NO: 983913 - RNA, 19 nt, Human
ccccuggaaagacagcagg

SEQ ID NO: 983914 - RNA, 20 nt, Human
cccgcugcccuuccaacacc

SEQ ID NO: 983915 - RNA, 22 nt, Human
cccgcugcccuuccaacaccug

SEQ ID NO: 983916 - RNA, 18 nt, Human
cccuggguuuaccacggu

SEQ ID NO: 983917 - RNA, 18 nt, Human
ccggccaaggccucccgc

SEQ ID NO: 983918 - RNA, 20 nt, Human
ccguccuccaaggccagcac

SEQ ID NO: 983919 - RNA, 18 nt, Human
ccucccgcaggauggaag

SEQ ID NO: 983920 - RNA, 24 nt, Human
ccugcugaccccugagcccugcag

SEQ ID NO: 983921 - RNA, 24 nt, Human
ccugggccagaggcucuuuggaac

SEQ ID NO: 983922 - RNA, 20 nt, Human
ccuuggggcucccugaggag

SEQ ID NO: 983923 - RNA, 18 nt, Human
cgaaacaaaaccaaaacc

SEQ ID NO: 983924 - RNA, 19 nt, Human
cgaaacaaaaccaaaaccc

SEQ ID NO: 983925 - RNA, 21 nt, Human
cgccagguggucucagaggac

SEQ ID NO: 983926 - RNA, 18 nt, Human
cggcuggugcugcagugc

SEQ ID NO: 983927 - RNA, 21 nt, Human
cgggggugggggaggaggaac

SEQ ID NO: 983928 - RNA, 20 nt, Human
cucuagaccaugcagccugc

SEQ ID NO: 983929 - RNA, 20 nt, Human
cugcccugaccugcacgugc

SEQ ID NO: 983930 - RNA, 20 nt, Human
cuggagaggcgcaaguggcg

SEQ ID NO: 983931 - RNA, 19 nt, Human
cuggguccuaagagaacuc

SEQ ID NO: 983932 - RNA, 18 nt, Human
cuucccuuucugaguccc

SEQ ID NO: 983933 - RNA, 20 nt, Human
cuuucugagucccacaaaag

SEQ ID NO: 983934 - RNA, 22 nt, Human
gaaacaaaaccaaaacccgaac

SEQ ID NO: 983935 - RNA, 20 nt, Human
gaacgaaacaaaaccaaaac

SEQ ID NO: 983936 - RNA, 20 nt, Human
gaaggguguuggggcuggcu

SEQ ID NO: 983937 - RNA, 18 nt, Human
gacacuggcagugcccgg

SEQ ID NO: 983938 - RNA, 18 nt, Human
gagaagcaugaagcuggg

SEQ ID NO: 983939 - RNA, 21 nt, Human
gagagggagauggggcagugg

SEQ ID NO: 983940 - RNA, 20 nt, Human
gagcugcagacggcuggugc

SEQ ID NO: 983941 - RNA, 26 nt, Human
gaggggccugggccagaggcucuuug

SEQ ID NO: 983942 - RNA, 21 nt, Human
gaggugaacgaaacaaaacca

SEQ ID NO: 983943 - RNA, 18 nt, Human
gcagacggcuggugcugc

SEQ ID NO: 983944 - RNA, 18 nt, Human
gcccacuccccagcagac

SEQ ID NO: 983945 - RNA, 23 nt, Human
gcccacuccccagcagacucagg

SEQ ID NO: 983946 - RNA, 21 nt, Human
gcccccaacugcaggcuucca

SEQ ID NO: 983947 - RNA, 19 nt, Human
gcccucaguucugcuuccc

SEQ ID NO: 983948 - RNA, 20 nt, Human
gcccuggguuuaccacgguc

SEQ ID NO: 983949 - RNA, 25 nt, Human
gccuccacccacagcccccucuggg

SEQ ID NO: 983950 - RNA, 20 nt, Human
gccugcggaggcuggagagg

SEQ ID NO: 983951 - RNA, 18 nt, Human
ggagaagugggggaugcu

SEQ ID NO: 983952 - RNA, 18 nt, Human
ggccugggccagaggcuc

SEQ ID NO: 983953 - RNA, 27 nt, Human
ggcgggggugggggaggaggaacaaaa

SEQ ID NO: 983954 - RNA, 20 nt, Human
gggagagggagauggggcag

SEQ ID NO: 983955 - RNA, 18 nt, Human
gggagauggggcaguggg

SEQ ID NO: 983956 - RNA, 19 nt, Human
gggcacaggaggggccagc

SEQ ID NO: 983957 - RNA, 19 nt, Human
gggcaggagaggccuggag

SEQ ID NO: 983958 - RNA, 19 nt, Human
gggcccccgggggacccag

SEQ ID NO: 983959 - RNA, 18 nt, Human
gggcgggggugggggagg

SEQ ID NO: 983960 - RNA, 23 nt, Human
gggcugucuugguggggagaggg

SEQ ID NO: 983961 - RNA, 24 nt, Human
gggugugggcaggagaggccugga

SEQ ID NO: 983962 - RNA, 19 nt, Human
ggugccaagugggaagggu

SEQ ID NO: 983963 - RNA, 22 nt, Human
gguggggagagggagauggggc

SEQ ID NO: 983964 - RNA, 23 nt, Human
ggugugggcaggagaggccugga

SEQ ID NO: 983965 - RNA, 26 nt, Human
ggugugggcaggagaggccuggaguc

SEQ ID NO: 983966 - RNA, 23 nt, Human
gucgccccucccucauggggagc

SEQ ID NO: 983967 - RNA, 22 nt, Human
gugggucccugcugaccccuga

SEQ ID NO: 983968 - RNA, 25 nt, Human
gugguacaaagacagccucccccac

SEQ ID NO: 983969 - RNA, 24 nt, Human
uaagagaacucagccgcccccuuc

SEQ ID NO: 983970 - RNA, 23 nt, Human
uaucccagcccucaguucugcuu

SEQ ID NO: 983971 - RNA, 26 nt, Human
ucaccccccucccccgucgccccucc

SEQ ID NO: 983972 - RNA, 22 nt, Human
ucaccgccaccucucucacagg

SEQ ID NO: 983973 - RNA, 21 nt, Human
ucacgcccggcggcuccugca

SEQ ID NO: 983974 - RNA, 21 nt, Human
uccaccucacgccaggugguc

SEQ ID NO: 983975 - RNA, 18 nt, Human
ucccagcuggcugcuccu

SEQ ID NO: 983976 - RNA, 21 nt, Human
ucccccgucgccccucccuca

SEQ ID NO: 983977 - RNA, 21 nt, Human
ucccugaggaggacuuguggc

SEQ ID NO: 983978 - RNA, 22 nt, Human
ucccugggugugacucuggaag

SEQ ID NO: 983979 - RNA, 22 nt, Human
ucuugguggggagagggagaug

SEQ ID NO: 983980 - RNA, 22 nt, Human
ugaacgaaacaaaaccaaaacc

SEQ ID NO: 983981 - RNA, 19 nt, Human
ugaagcugggggcgggggu

SEQ ID NO: 983982 - RNA, 28 nt, Human
ugaccagacagcccagcguuguaaugac

SEQ ID NO: 983983 - RNA, 19 nt, Human
ugaucccacgccaccgccc

SEQ ID NO: 983984 - RNA, 19 nt, Human
ugcagacggcuggugcugc

SEQ ID NO: 983985 - RNA, 18 nt, Human
ugcauauuacaguaggcu

SEQ ID NO: 983986 - RNA, 19 nt, Human
ugcccacuccccagcagac

SEQ ID NO: 983987 - RNA, 24 nt, Human
ugcccacuccccagcagacucagg

SEQ ID NO: 983988 - RNA, 21 nt, Human
ugcccggccaaggccucccgc

SEQ ID NO: 983989 - RNA, 21 nt, Human
uggagaagugggggaugcugc

SEQ ID NO: 983990 - RNA, 23 nt, Human
uggagaagugggggaugcugcag

SEQ ID NO: 983991 - RNA, 22 nt, Human
uggagucaggccuccacccaca

SEQ ID NO: 983992 - RNA, 22 nt, Human
uggcagagaaugcccacucccc

SEQ ID NO: 983993 - RNA, 19 nt, Human
uggcagugcccggccaagg

SEQ ID NO: 983994 - RNA, 23 nt, Human
uggcagugcccggccaaggccuc

SEQ ID NO: 983995 - RNA, 20 nt, Human
ugggaaggguguuggggcug

SEQ ID NO: 983996 - RNA, 21 nt, Human
ugggaaggguguuggggcugg

SEQ ID NO: 983997 - RNA, 22 nt, Human
ugggcguccaagggaaagaagg

SEQ ID NO: 983998 - RNA, 19 nt, Human
uggggagagggagaugggg

SEQ ID NO: 983999 - RNA, 22 nt, Human
uggggagccccuucccccugga

SEQ ID NO: 984000 - RNA, 20 nt, Human
uucccuuucugagucccaca

SEQ ID NO: 984001 - RNA, 23 nt, Human
uucugcuucccuuucugaguccc

SEQ ID NO: 984002 - RNA, 18 nt, Human
aaacaccaaaagcagagg

SEQ ID NO: 984003 - RNA, 20 nt, Human
aacguggagcugcuggagcu

SEQ ID NO: 984004 - RNA, 21 nt, Human
aacguggagcugcuggagcug

SEQ ID NO: 984005 - RNA, 21 nt, Human
aacucucuccucuccccucuc

SEQ ID NO: 984006 - RNA, 27 nt, Human
aagcaacaccacugguacucacaaccc

SEQ ID NO: 984007 - RNA, 20 nt, Human
acaccaaaagcagaggaaac

SEQ ID NO: 984008 - RNA, 23 nt, Human
accccccuccccccaaaccccag

SEQ ID NO: 984009 - RNA, 26 nt, Human
acucucuccucuccccucucccaccc

SEQ ID NO: 984010 - RNA, 22 nt, Human
agagaugugaaaaucagaucug

SEQ ID NO: 984011 - RNA, 18 nt, Human
agccgcugccccacccag

SEQ ID NO: 984012 - RNA, 18 nt, Human
aguuagaagcgagcugcu

SEQ ID NO: 984013 - RNA, 24 nt, Human
auggugccuggaggcucaaugucc

SEQ ID NO: 984014 - RNA, 20 nt, Human
cacacacagaccucauccca

SEQ ID NO: 984015 - RNA, 24 nt, Human
caccaaaagcagaggaaacgcccc

SEQ ID NO: 984016 - RNA, 21 nt, Human
cacccaggacucuguccuuca

SEQ ID NO: 984017 - RNA, 20 nt, Human
caccccccuccccccaaacc

SEQ ID NO: 984018 - RNA, 21 nt, Human
caucccaccugcugcagggug

SEQ ID NO: 984019 - RNA, 18 nt, Human
ccaaacucucuccucucc

SEQ ID NO: 984020 - RNA, 19 nt, Human
ccaccccccuccccccaaa

SEQ ID NO: 984021 - RNA, 23 nt, Human
ccaccccccuccccccaaacccc

SEQ ID NO: 984022 - RNA, 26 nt, Human
cccaccccgucauuguuccccggaaa

SEQ ID NO: 984023 - RNA, 22 nt, Human
ccccccaaaccccagugcuggg

SEQ ID NO: 984024 - RNA, 20 nt, Human
ccccccuccccccaaacccc

SEQ ID NO: 984025 - RNA, 22 nt, Human
ccccccuccccccaaaccccag

SEQ ID NO: 984026 - RNA, 27 nt, Human
ccccccuccccccaaaccggguccuuc

SEQ ID NO: 984027 - RNA, 24 nt, Human
cccccuccccccaaaccccagugc

SEQ ID NO: 984028 - RNA, 21 nt, Human
ccugcagccgcugccccaccc

SEQ ID NO: 984029 - RNA, 24 nt, Human
ccuugaguucuucuccaucucccu

SEQ ID NO: 984030 - RNA, 23 nt, Human
ccuuggccaccccccucccccca

SEQ ID NO: 984031 - RNA, 18 nt, Human
cgccccuuggccaccccc

SEQ ID NO: 984032 - RNA, 23 nt, Human
cggcgggcgaggcugccuggaac

SEQ ID NO: 984033 - RNA, 23 nt, Human
cgggcgaggcugccuggaacgug

SEQ ID NO: 984034 - RNA, 21 nt, Human
cucaucccaccugcugcaggg

SEQ ID NO: 984035 - RNA, 21 nt, Human
cucuguccuucacccugaagu

SEQ ID NO: 984036 - RNA, 22 nt, Human
cuuggccaccccccucccccca

SEQ ID NO: 984037 - RNA, 22 nt, Human
gaaacgccccuuggccaccccc

SEQ ID NO: 984038 - RNA, 18 nt, Human
gagcgcagccggcgggcg

SEQ ID NO: 984039 - RNA, 18 nt, Human
gcgcagccggcgggcgag

SEQ ID NO: 984040 - RNA, 23 nt, Human
ggaaacgccccuuggccaccccc

SEQ ID NO: 984041 - RNA, 20 nt, Human
ggagcugcuggagcuguccg

SEQ ID NO: 984042 - RNA, 20 nt, Human
ggagcugcuggagcuguccg

SEQ ID NO: 984043 - RNA, 18 nt, Human
ggcaggguugcaaugucc

SEQ ID NO: 984044 - RNA, 23 nt, Human
ggcaggguugcaauguccuugag

SEQ ID NO: 984045 - RNA, 19 nt, Human
uacaaacaccaaaagcaga

SEQ ID NO: 984046 - RNA, 18 nt, Human
uagaagcgagcugcucuc

SEQ ID NO: 984047 - RNA, 23 nt, Human
ucacuggucaauucuuaacaugu

SEQ ID NO: 984048 - RNA, 19 nt, Human
uccagguagagaugugaaa

SEQ ID NO: 984049 - RNA, 21 nt, Human
ucccaccugcugcagggugga

SEQ ID NO: 984050 - RNA, 19 nt, Human
uccccggaaacaaauagga

SEQ ID NO: 984051 - RNA, 22 nt, Human
ucuguccuucacccugaaguuc

SEQ ID NO: 984052 - RNA, 21 nt, Human
ugaaaguuacagagugggucu

SEQ ID NO: 984053 - RNA, 22 nt, Human
ugaccuggaaaguucuuuggcc

SEQ ID NO: 984054 - RNA, 21 nt, Human
ugccuggaggcucaaugucca

SEQ ID NO: 984055 - RNA, 20 nt, Human
uggagcugcuggagcugucc

SEQ ID NO: 984056 - RNA, 22 nt, Human
uggcugaaucuagcugaaaguu

SEQ ID NO: 984057 - RNA, 27 nt, Human
ugggagcgcagccggcgggcgaggcug

SEQ ID NO: 984058 - RNA, 23 nt, Human
ugggucugucaccagcuugggac

SEQ ID NO: 984059 - RNA, 19 nt, Human
ugguucacacacacacaca

SEQ ID NO: 984060 - RNA, 18 nt, Human
uguacaaacaccaaaagc

SEQ ID NO: 984061 - RNA, 22 nt, Human
uuagaagcgagcugcucucuuc

SEQ ID NO: 984062 - RNA, 27 nt, Human
uucacacacacacacagaccucauccc

SEQ ID NO: 984063 - RNA, 21 nt, Human
uucuuaacauguacaaacacc

SEQ ID NO: 984064 - RNA, 25 nt, Human
uucuucuccaucucccuuucccaaa

SEQ ID NO: 984065 - RNA, 24 nt, Human
uuggccaccccccuccccccaaac

SEQ ID NO: 984066 - RNA, 18 nt, Human
uuuuuuuuuuuuggaguc

SEQ ID NO: 984067 - RNA, 18 nt, Human
uuuuuuuuuuuuuuuuug

SEQ ID NO: 984068 - RNA, 22 nt, Human
uuuuuuuuuuuuuuuuuggagu

SEQ ID NO: 984069 - RNA, 20 nt, Human
acaaagccuuguccagagaa

SEQ ID NO: 984070 - RNA, 19 nt, Human
acucagcuggggaccggga

SEQ ID NO: 984071 - RNA, 19 nt, Human
agacacgccccgcgccucc

SEQ ID NO: 984072 - RNA, 19 nt, Human
agcagggcagggcaggccu

SEQ ID NO: 984073 - RNA, 18 nt, Human
agccugggccacaugcuu

SEQ ID NO: 984074 - RNA, 19 nt, Human
agcgccagggaagcagcag

SEQ ID NO: 984075 - RNA, 21 nt, Human
augcugcccugggccccagcu

SEQ ID NO: 984076 - RNA, 21 nt, Human
cacacaaggaccaaaccagcu

SEQ ID NO: 984077 - RNA, 22 nt, Human
cacccagcucagcgcugggcac

SEQ ID NO: 984078 - RNA, 20 nt, Human
caccgugcacccagcucagc

SEQ ID NO: 984079 - RNA, 21 nt, Human
caccuccuccuccaagaggcc

SEQ ID NO: 984080 - RNA, 21 nt, Human
cacgccccgcgccuccgcgcg

SEQ ID NO: 984081 - RNA, 21 nt, Human
cagaugaacaccuccuccucc

SEQ ID NO: 984082 - RNA, 19 nt, Human
cagcaggcccugcuccuuc

SEQ ID NO: 984083 - RNA, 27 nt, Human
cagcaggcccugcuccuucccaugccc

SEQ ID NO: 984084 - RNA, 25 nt, Human
cagcagggcagggcaggccuggcuc

SEQ ID NO: 984085 - RNA, 18 nt, Human
cagccaggauccccaggu

SEQ ID NO: 984086 - RNA, 18 nt, Human
cagccuccugcagccucc

SEQ ID NO: 984087 - RNA, 19 nt, Human
cagcgccagggaagcagca

SEQ ID NO: 984088 - RNA, 23 nt, Human
caggaaggugggccagccaggau

SEQ ID NO: 984089 - RNA, 18 nt, Human
cagugggcccuacgcggc

SEQ ID NO: 984090 - RNA, 19 nt, Human
cagugggcccuacgcggcc

SEQ ID NO: 984091 - RNA, 20 nt, Human
ccagcagggcagggcaggcc

SEQ ID NO: 984092 - RNA, 19 nt, Human
ccaucccucuccaaucccc

SEQ ID NO: 984093 - RNA, 20 nt, Human
ccccaucccucuccaauccc

SEQ ID NO: 984094 - RNA, 19 nt, Human
ccccgcgccuccgcgcggc

SEQ ID NO: 984095 - RNA, 20 nt, Human
ccccgcgccuccgcgcggcg

SEQ ID NO: 984096 - RNA, 23 nt, Human
ccccgcgccuccgcgcggcgccc

SEQ ID NO: 984097 - RNA, 24 nt, Human
ccccgcgccuccgcgcggcgcccu

SEQ ID NO: 984098 - RNA, 26 nt, Human
cccgcagagcuuagagccugggccac

SEQ ID NO: 984099 - RNA, 18 nt, Human
cccgcgcggccacccgcg

SEQ ID NO: 984100 - RNA, 24 nt, Human
cccucacacaaggaccaaaccagc

SEQ ID NO: 984101 - RNA, 22 nt, Human
ccucacacaaggaccaaaccag

SEQ ID NO: 984102 - RNA, 25 nt, Human
ccugcagccuccauucaugggcucu

SEQ ID NO: 984103 - RNA, 22 nt, Human
cuccccaucccucuccaauccc

SEQ ID NO: 984104 - RNA, 20 nt, Human
cuccuucccaugcccaaucc

SEQ ID NO: 984105 - RNA, 22 nt, Human
cucucuguggugcagaugaaca

SEQ ID NO: 984106 - RNA, 20 nt, Human
cugcugcuuccggcuucacc

SEQ ID NO: 984107 - RNA, 21 nt, Human
cuggaaagucagccaaggcug

SEQ ID NO: 984108 - RNA, 23 nt, Human
cuugcaaaccucugguaagaagc

SEQ ID NO: 984109 - RNA, 18 nt, Human
gaccucuucuuggagcug

SEQ ID NO: 984110 - RNA, 18 nt, Human
gacugggcucuggaaagu

SEQ ID NO: 984111 - RNA, 21 nt, Human
gcacucagcuggggaccggga

SEQ ID NO: 984112 - RNA, 20 nt, Human
gcaggcccugcuccuuccca

SEQ ID NO: 984113 - RNA, 22 nt, Human
gcccuacgcggccccgcccucc

SEQ ID NO: 984114 - RNA, 19 nt, Human
gccuucccuucccucccca

SEQ ID NO: 984115 - RNA, 22 nt, Human
ggacaaagccuuguccagagaa

SEQ ID NO: 984116 - RNA, 21 nt, Human
ggagacacgccccgcgccucc

SEQ ID NO: 984117 - RNA, 23 nt, Human
ggcaggccuggcucuccuccugg

SEQ ID NO: 984118 - RNA, 23 nt, Human
ggcccugcuccuucccaugccca

SEQ ID NO: 984119 - RNA, 18 nt, Human
ggccuggcucuccuccug

SEQ ID NO: 984120 - RNA, 21 nt, Human
uagagccugggccacaugcuu

SEQ ID NO: 984121 - RNA, 21 nt, Human
ucagccuccugcagccuccau

SEQ ID NO: 984122 - RNA, 23 nt, Human
ucaugcugcccugggccccagcu

SEQ ID NO: 984123 - RNA, 18 nt, Human
uccccagguaacuucgcc

SEQ ID NO: 984124 - RNA, 25 nt, Human
uccccaucccucuccaauccccgca

SEQ ID NO: 984125 - RNA, 19 nt, Human
uccuggcugcugcuuccgg

SEQ ID NO: 984126 - RNA, 22 nt, Human
ucgccacagggaccucuucuug

SEQ ID NO: 984127 - RNA, 25 nt, Human
ucuccagucaggaagccagcagggc

SEQ ID NO: 984128 - RNA, 21 nt, Human
ucuguggguccugucucucca

SEQ ID NO: 984129 - RNA, 23 nt, Human
ugcaaaccucugguaagaagcac

SEQ ID NO: 984130 - RNA, 20 nt, Human
uggagcugccuucccuuccc

SEQ ID NO: 984131 - RNA, 18 nt, Human
uggugcagaugaacaccu

SEQ ID NO: 984132 - RNA, 20 nt, Human
ugucaggcuguuucuguggg

SEQ ID NO: 984133 - RNA, 22 nt, Human
uguccagagaaccacuguaggg

SEQ ID NO: 984134 - RNA, 21 nt, Human
uguggguccugucucuccagu

SEQ ID NO: 984135 - RNA, 21 nt, Human
uucccuccccaucccucucca

SEQ ID NO: 984136 - RNA, 20 nt, Human
uuguuagggccucaacucuc

SEQ ID NO: 984137 - RNA, 23 nt, Human
aagcuagagccagaaucaggaaa

SEQ ID NO: 984138 - RNA, 18 nt, Human
agaaucaggaaaaucugc

SEQ ID NO: 984139 - RNA, 22 nt, Human
cagaaucaggaaaaucugcuuc

SEQ ID NO: 984140 - RNA, 24 nt, Human
cccaccgccgcagcgaccuccgga

SEQ ID NO: 984141 - RNA, 23 nt, Human
ccccagacucccuggccaagccc

SEQ ID NO: 984142 - RNA, 20 nt, Human
cccuggccaagcccagcucc

SEQ ID NO: 984143 - RNA, 19 nt, Human
ccuccggaaccaacgagac

SEQ ID NO: 984144 - RNA, 22 nt, Human
ccuccggaaccaacgagacgag

SEQ ID NO: 984145 - RNA, 22 nt, Human
ccuuguccccagacucccuggc

SEQ ID NO: 984146 - RNA, 23 nt, Human
cuagagccagaaucaggaaaauc

SEQ ID NO: 984147 - RNA, 23 nt, Human
cucccuggccaagcccagcuccc

SEQ ID NO: 984148 - RNA, 20 nt, Human
uauuacacgacuaaaguuca

SEQ ID NO: 984149 - RNA, 19 nt, Human
uccccagacucccuggcca

SEQ ID NO: 984150 - RNA, 19 nt, Human
ucccuggccaagcccagcu

SEQ ID NO: 984151 - RNA, 18 nt, Human
uguccccagacucccugg

SEQ ID NO: 984152 - RNA, 24 nt, Human
uuccuuguccccagacucccuggc

SEQ ID NO: 984153 - RNA, 25 nt, Human
uuuuuuuucagguuugccacuggug

SEQ ID NO: 984154 - RNA, 23 nt, Human
uuuuuuuuuuuuuuuuuuucagg

SEQ ID NO: 984155 - RNA, 21 nt, Human
aaaaaaaaaaagcuuugagga

SEQ ID NO: 984156 - RNA, 24 nt, Human
aaaaagcuuugaggaaugagagag

SEQ ID NO: 984157 - RNA, 19 nt, Human
aaaaggcccaggccgggau

SEQ ID NO: 984158 - RNA, 23 nt, Human
aacccagcgccgcgcccugguau

SEQ ID NO: 984159 - RNA, 20 nt, Human
aagaacagaaaagaaacccc

SEQ ID NO: 984160 - RNA, 21 nt, Human
aagaacagaaaagaaacccca

SEQ ID NO: 984161 - RNA, 23 nt, Human
aaggugcugggcagccacgggcg

SEQ ID NO: 984162 - RNA, 20 nt, Human
acagaaaagaaaccccagga

SEQ ID NO: 984163 - RNA, 19 nt, Human
accccgccagcaccaagcc

SEQ ID NO: 984164 - RNA, 21 nt, Human
acgcagccccaccgcgccucc

SEQ ID NO: 984165 - RNA, 21 nt, Human
acgccugggccuccaccggcc

SEQ ID NO: 984166 - RNA, 25 nt, Human
acgcgccccgccuuccccagcaccc

SEQ ID NO: 984167 - RNA, 21 nt, Human
acucgcccggcccuuucuaca

SEQ ID NO: 984168 - RNA, 23 nt, Human
agcagcuggaccccgccagcacc

SEQ ID NO: 984169 - RNA, 18 nt, Human
agccaggaaaaaaaaaaa

SEQ ID NO: 984170 - RNA, 19 nt, Human
aggaaaggugucgccggcg

SEQ ID NO: 984171 - RNA, 23 nt, Human
aggccagggcagggcagggcaga

SEQ ID NO: 984172 - RNA, 21 nt, Human
agggcagggcagagcagagga

SEQ ID NO: 984173 - RNA, 18 nt, Human
agggccaccccugguguc

SEQ ID NO: 984174 - RNA, 19 nt, Human
agggcgcugcugcggucag

SEQ ID NO: 984175 - RNA, 24 nt, Human
aggguggggcuggcaugugggggc

SEQ ID NO: 984176 - RNA, 23 nt, Human
agucuacaucuggauuaacaggg

SEQ ID NO: 984177 - RNA, 18 nt, Human
auagugcaaacaggaaaa

SEQ ID NO: 984178 - RNA, 22 nt, Human
auggggugggggugccauagga

SEQ ID NO: 984179 - RNA, 28 nt, Human
caaaaagaaauagugcaaacaggaaaaa

SEQ ID NO: 984180 - RNA, 22 nt, Human
caacaguggaacccuucaucau

SEQ ID NO: 984181 - RNA, 22 nt, Human
caacauagaaugcaggcccccu

SEQ ID NO: 984182 - RNA, 19 nt, Human
caauggaaucgcugaaguu

SEQ ID NO: 984183 - RNA, 21 nt, Human
caccgagauaaaaggcccagg

SEQ ID NO: 984184 - RNA, 24 nt, Human
caccgcgccuccugcacguacgca

SEQ ID NO: 984185 - RNA, 20 nt, Human
cacgaaagggaugggguggg

SEQ ID NO: 984186 - RNA, 21 nt, Human
cacgugccuugguugcagagu

SEQ ID NO: 984187 - RNA, 20 nt, Human
cagcaccaagcccugggcag

SEQ ID NO: 984188 - RNA, 21 nt, Human
cagcacccagcuccgggcugc

SEQ ID NO: 984189 - RNA, 18 nt, Human
cagccaggaaaaaaaaaa

SEQ ID NO: 984190 - RNA, 21 nt, Human
cagccccccaguuugcagucu

SEQ ID NO: 984191 - RNA, 20 nt, Human
cagcuccgggcugcuuuccc

SEQ ID NO: 984192 - RNA, 18 nt, Human
cagggccaauguuacaaa

SEQ ID NO: 984193 - RNA, 18 nt, Human
ccaccccuggugucuccu

SEQ ID NO: 984194 - RNA, 24 nt, Human
cccaccaacauagaaugcaggccc

SEQ ID NO: 984195 - RNA, 21 nt, Human
cccagccaggaaaaaaaaaaa

SEQ ID NO: 984196 - RNA, 18 nt, Human
ccccagcacccagcuccg

SEQ ID NO: 984197 - RNA, 21 nt, Human
ccccccagccaggaaaaaaaa

SEQ ID NO: 984198 - RNA, 19 nt, Human
cccccuccuccacgcagcc

SEQ ID NO: 984199 - RNA, 19 nt, Human
ccccgccagcaccaagccc

SEQ ID NO: 984200 - RNA, 21 nt, Human
ccccgccuuccccagcaccca

SEQ ID NO: 984201 - RNA, 23 nt, Human
cccgccccccagccaggaaaaaa

SEQ ID NO: 984202 - RNA, 23 nt, Human
cccuacccaucccaggugcucaa

SEQ ID NO: 984203 - RNA, 24 nt, Human
cccuucccgccccccagccaggaa

SEQ ID NO: 984204 - RNA, 20 nt, Human
ccggaaugcacgugccuugg

SEQ ID NO: 984205 - RNA, 21 nt, Human
ccuccacgcagccccaccgcg

SEQ ID NO: 984206 - RNA, 19 nt, Human
ccugcgggaugggcggcuu

SEQ ID NO: 984207 - RNA, 19 nt, Human
ccuugcgcgcgcuccccgc

SEQ ID NO: 984208 - RNA, 19 nt, Human
cgaguaacacucgcccggc

SEQ ID NO: 984209 - RNA, 21 nt, Human
cgcagccccaccgcgccuccu

SEQ ID NO: 984210 - RNA, 24 nt, Human
cgcagggacgcaggggcacgggga

SEQ ID NO: 984211 - RNA, 22 nt, Human
cgcccggcccuuucuacagcgg

SEQ ID NO: 984212 - RNA, 21 nt, Human
cgccgggccagcuccgccucu

SEQ ID NO: 984213 - RNA, 20 nt, Human
cgcugaaguuucagagcaag

SEQ ID NO: 984214 - RNA, 19 nt, Human
cgcugcugcggucaguggc

SEQ ID NO: 984215 - RNA, 23 nt, Human
cggcagcaccgagauaaaaggcc

SEQ ID NO: 984216 - RNA, 20 nt, Human
cgggaguggcacgaaaggga

SEQ ID NO: 984217 - RNA, 25 nt, Human
cgggcugcuuucccaaguguggcaa

SEQ ID NO: 984218 - RNA, 19 nt, Human
cgugccuugguugcagagu

SEQ ID NO: 984219 - RNA, 21 nt, Human
cguggcccccuccuccacgca

SEQ ID NO: 984220 - RNA, 23 nt, Human
cuccugcacguacgcagcccccc

SEQ ID NO: 984221 - RNA, 29 nt, Human
cugaaguuucagagcaaggaggagauucg

SEQ ID NO: 984222 - RNA, 26 nt, Human
cugagggagggcgccggggcaggcca

SEQ ID NO: 984223 - RNA, 19 nt, Human
cugcgggaugggcggcuuc

SEQ ID NO: 984224 - RNA, 21 nt, Human
cuggaccccgccagcaccaag

SEQ ID NO: 984225 - RNA, 26 nt, Human
cuuauacacacugggguggggguggg

SEQ ID NO: 984226 - RNA, 20 nt, Human
cuugcgccuugagacucucc

SEQ ID NO: 984227 - RNA, 21 nt, Human
cuuugaggaaugagagagggu

SEQ ID NO: 984228 - RNA, 23 nt, Human
gaaaggcacaggcugaaugcagg

SEQ ID NO: 984229 - RNA, 18 nt, Human
gaacagaaaagaaacccc

SEQ ID NO: 984230 - RNA, 27 nt, Human
gagaugggucgaagaaggugcugggcc

SEQ ID NO: 984231 - RNA, 19 nt, Human
gcaacccagcgccgcgccc

SEQ ID NO: 984232 - RNA, 19 nt, Human
gcagagcagaggaggaggg

SEQ ID NO: 984233 - RNA, 20 nt, Human
gcccaggccgggaugaccgc

SEQ ID NO: 984234 - RNA, 24 nt, Human
gcccccuccuccacgcagccccac

SEQ ID NO: 984235 - RNA, 24 nt, Human
gccccgccuuccccagcacccagc

SEQ ID NO: 984236 - RNA, 20 nt, Human
gcgaguaacacucgcccggc

SEQ ID NO: 984237 - RNA, 24 nt, Human
gcgccuccugcacguacgcagccc

SEQ ID NO: 984238 - RNA, 21 nt, Human
gcgcgccgggccagcuccgcc

SEQ ID NO: 984239 - RNA, 23 nt, Human
gcguccggaccgacuggagggug

SEQ ID NO: 984240 - RNA, 18 nt, Human
ggaggagggauuggagca

SEQ ID NO: 984241 - RNA, 19 nt, Human
ggagggauuggagcagcug

SEQ ID NO: 984242 - RNA, 26 nt, Human
ggaggguggggcuggcaugugggggc

SEQ ID NO: 984243 - RNA, 24 nt, Human
gggacgggaguggcacgaaaggga

SEQ ID NO: 984244 - RNA, 24 nt, Human
gggauucccggcacuccuccgccc

SEQ ID NO: 984245 - RNA, 21 nt, Human
gggcagagcagaggaggaggg

SEQ ID NO: 984246 - RNA, 24 nt, Human
ggggcacggggauggucggccggg

SEQ ID NO: 984247 - RNA, 24 nt, Human
ggggcaggccagggcagggcaggg

SEQ ID NO: 984248 - RNA, 19 nt, Human
gggguggggacgggagugg

SEQ ID NO: 984249 - RNA, 19 nt, Human
ggggugggggugccauaga

SEQ ID NO: 984250 - RNA, 20 nt, Human
ggggugggggugccauagga

SEQ ID NO: 984251 - RNA, 20 nt, Human
gggguggggguggggacggg

SEQ ID NO: 984252 - RNA, 19 nt, Human
ggguggggguggggacggg

SEQ ID NO: 984253 - RNA, 24 nt, Human
guaacacucgcccggcccuuucua

SEQ ID NO: 984254 - RNA, 22 nt, Human
guggcaacccagcgccgcgccc

SEQ ID NO: 984255 - RNA, 22 nt, Human
uaaauaaauuuaagacauacaa

SEQ ID NO: 984256 - RNA, 21 nt, Human
ucacugaguggcaagcuacgu

SEQ ID NO: 984257 - RNA, 19 nt, Human
uccacgcagccccaccgcg

SEQ ID NO: 984258 - RNA, 20 nt, Human
uccacgcagccccaccgcgg

SEQ ID NO: 984259 - RNA, 18 nt, Human
uccccagcacccagcucc

SEQ ID NO: 984260 - RNA, 21 nt, Human
ucccccggcagcaccgagaua

SEQ ID NO: 984261 - RNA, 22 nt, Human
ucccccggcagcaccgagauaa

SEQ ID NO: 984262 - RNA, 26 nt, Human
uccgaaaagaacagaaaagaaacccc

SEQ ID NO: 984263 - RNA, 20 nt, Human
uccuccacgcagccccaccg

SEQ ID NO: 984264 - RNA, 21 nt, Human
ucuauguacaacacgauagaa

SEQ ID NO: 984265 - RNA, 19 nt, Human
ugaggagggccgggcacag

SEQ ID NO: 984266 - RNA, 22 nt, Human
ugcaaacaggaaaacugaugca

SEQ ID NO: 984267 - RNA, 24 nt, Human
ugcaggcccccucccaggagguuc

SEQ ID NO: 984268 - RNA, 21 nt, Human
uggcaugugggggcugggcgg

SEQ ID NO: 984269 - RNA, 23 nt, Human
uggcccccuacccaucccaggug

SEQ ID NO: 984270 - RNA, 21 nt, Human
uggcugagggugcucuguggg

SEQ ID NO: 984271 - RNA, 19 nt, Human
ugggccuccaccggcccaa

SEQ ID NO: 984272 - RNA, 19 nt, Human
ugggcggcuucuccuggcu

SEQ ID NO: 984273 - RNA, 22 nt, Human
uggggcuggcaugugggggcug

SEQ ID NO: 984274 - RNA, 24 nt, Human
uggggcuggcaugugggggcuggg

SEQ ID NO: 984275 - RNA, 26 nt, Human
uggggcuggcaugugggggcugggcg

SEQ ID NO: 984276 - RNA, 19 nt, Human
ugggggcugggcgggccuu

SEQ ID NO: 984277 - RNA, 18 nt, Human
uggggguggggacgggag

SEQ ID NO: 984278 - RNA, 24 nt, Human
uucagagcaaggaggagauucgaa

SEQ ID NO: 984279 - RNA, 23 nt, Human
uuccccagcacccagcuccgggc

SEQ ID NO: 984280 - RNA, 21 nt, Human
uucccgccccccagccaggaa

SEQ ID NO: 984281 - RNA, 22 nt, Human
uuccuugggcccucccaucucc

SEQ ID NO: 984282 - RNA, 18 nt, Human
uugcagagugagccccuc

SEQ ID NO: 984283 - RNA, 23 nt, Human
uugcagucugcccuucccgcccc

SEQ ID NO: 984284 - RNA, 24 nt, Human
uugcagucugcccuucccgccccc

SEQ ID NO: 984285 - RNA, 26 nt, Human
uugguuccauuucgguuaaguccacu

SEQ ID NO: 984286 - RNA, 24 nt, Human
uugguugcagagugagccccucgu

SEQ ID NO: 984287 - RNA, 20 nt, Human
aacauggcaaaaccccgucu

SEQ ID NO: 984288 - RNA, 21 nt, Human
aacauggcaaaaccccgucuc

SEQ ID NO: 984289 - RNA, 22 nt, Human
aacuaagaaucagugacugcau

SEQ ID NO: 984290 - RNA, 23 nt, Human
aagaagcaacaguugaggccagg

SEQ ID NO: 984291 - RNA, 25 nt, Human
aaucaaaaaguaggaaagauguuuc

SEQ ID NO: 984292 - RNA, 18 nt, Human
accucgcccgcucgcguc

SEQ ID NO: 984293 - RNA, 21 nt, Human
acucuauacauccuucacaaa

SEQ ID NO: 984294 - RNA, 18 nt, Human
acucuguguuacaacaaa

SEQ ID NO: 984295 - RNA, 20 nt, Human
acuuuuauuucccuagaaca

SEQ ID NO: 984296 - RNA, 18 nt, Human
agaaagcaggauaaaaag

SEQ ID NO: 984297 - RNA, 24 nt, Human
agcaccuugggaggcugaggcagg

SEQ ID NO: 984298 - RNA, 24 nt, Human
agccaggucaacauggcaaaaccc

SEQ ID NO: 984299 - RNA, 21 nt, Human
aggaguucgagaccagccagg

SEQ ID NO: 984300 - RNA, 24 nt, Human
aggcacaguggcucgugccuguaa

SEQ ID NO: 984301 - RNA, 18 nt, Human
aggcaggcggaucacuug

SEQ ID NO: 984302 - RNA, 21 nt, Human
aggcaggcggaucacuugcgu

SEQ ID NO: 984303 - RNA, 26 nt, Human
aggcaggcggaucacuugcguucagg

SEQ ID NO: 984304 - RNA, 19 nt, Human
aggccaggcacaguggcuc

SEQ ID NO: 984305 - RNA, 21 nt, Human
aggccaggcacaguggcucgu

SEQ ID NO: 984306 - RNA, 21 nt, Human
aggcugaggcaggcggaucac

SEQ ID NO: 984307 - RNA, 24 nt, Human
aggcugaggcaggcggaucacuug

SEQ ID NO: 984308 - RNA, 23 nt, Human
aguggcucgugccuguaauccca

SEQ ID NO: 984309 - RNA, 24 nt, Human
aguggcucgugccuguaaucccag

SEQ ID NO: 984310 - RNA, 24 nt, Human
aucacuugcguucaggaguucgag

SEQ ID NO: 984311 - RNA, 18 nt, Human
auccuuuccccucuuucu

SEQ ID NO: 984312 - RNA, 19 nt, Human
auuaaaaaaaauaacuaca

SEQ ID NO: 984313 - RNA, 20 nt, Human
caaaaaguaggaaagauguu

SEQ ID NO: 984314 - RNA, 20 nt, Human
caacaguugaggccaggcac

SEQ ID NO: 984315 - RNA, 22 nt, Human
caacaguugaggccaggcacag

SEQ ID NO: 984316 - RNA, 24 nt, Human
cagcaccuugggaggcugaggcag

SEQ ID NO: 984317 - RNA, 24 nt, Human
cagcaccuugggaggcugaggcag

SEQ ID NO: 984318 - RNA, 21 nt, Human
cagcggcggcggcugcggcgg

SEQ ID NO: 984319 - RNA, 23 nt, Human
caucaggaaccaggcaguacucu

SEQ ID NO: 984320 - RNA, 21 nt, Human
ccaccucgcccgcucgcgucu

SEQ ID NO: 984321 - RNA, 18 nt, Human
ccagccaggucaacaugg

SEQ ID NO: 984322 - RNA, 20 nt, Human
ccagcggcggcggcugcggc

SEQ ID NO: 984323 - RNA, 27 nt, Human
ccagcggcggcggcugcggcggcuuuu

SEQ ID NO: 984324 - RNA, 24 nt, Human
ccaggucaacauggcaaaaccccg

SEQ ID NO: 984325 - RNA, 23 nt, Human
cccaaauuaaagugcccuggggc

SEQ ID NO: 984326 - RNA, 19 nt, Human
ccgccgccgccaccucgcc

SEQ ID NO: 984327 - RNA, 21 nt, Human
ccgccgcgcucugcccgcgcc

SEQ ID NO: 984328 - RNA, 22 nt, Human
ccgccgcgcucugcccgcgccc

SEQ ID NO: 984329 - RNA, 19 nt, Human
ccgcgccgccgcgcucugc

SEQ ID NO: 984330 - RNA, 24 nt, Human
cggaucacuugcguucaggaguuc

SEQ ID NO: 984331 - RNA, 20 nt, Human
cgugccuguaaucccagcac

SEQ ID NO: 984332 - RNA, 24 nt, Human
cgugccuguaaucccagcaccuug

SEQ ID NO: 984333 - RNA, 23 nt, Human
cuccgccgccgccgccaccucgc

SEQ ID NO: 984334 - RNA, 24 nt, Human
cucgugccuguaaucccagcaccu

SEQ ID NO: 984335 - RNA, 21 nt, Human
cuuuuuccgauccuuuccccu

SEQ ID NO: 984336 - RNA, 23 nt, Human
gaacacaccuuuauaagaagcaa

SEQ ID NO: 984337 - RNA, 24 nt, Human
gaucacuugcguucaggaguucga

SEQ ID NO: 984338 - RNA, 18 nt, Human
gccgccgccgccaccucg

SEQ ID NO: 984339 - RNA, 22 nt, Human
gccgccgcgcucugcccgcgcc

SEQ ID NO: 984340 - RNA, 21 nt, Human
gccugaguccccugacagcuc

SEQ ID NO: 984341 - RNA, 23 nt, Human
ggaucacuugcguucaggaguuc

SEQ ID NO: 984342 - RNA, 21 nt, Human
gucaacauggcaaaaccccgu

SEQ ID NO: 984343 - RNA, 19 nt, Human
gugccuguaaucccagcac

SEQ ID NO: 984344 - RNA, 22 nt, Human
uaaguuauuuuccagaaaugag

SEQ ID NO: 984345 - RNA, 20 nt, Human
uacucuguguuacaacaaag

SEQ ID NO: 984346 - RNA, 18 nt, Human
uagaacagaagggcuggu

SEQ ID NO: 984347 - RNA, 19 nt, Human
uagcaaaugucugaaggcu

SEQ ID NO: 984348 - RNA, 24 nt, Human
ucacagaacugguuucuuuuuuuu

SEQ ID NO: 984349 - RNA, 19 nt, Human
ucccgcuccgccgccgccg

SEQ ID NO: 984350 - RNA, 22 nt, Human
uccucauaagccugaguccccu

SEQ ID NO: 984351 - RNA, 22 nt, Human
ucgugccuguaaucccagcacc

SEQ ID NO: 984352 - RNA, 23 nt, Human
ucuauaguauuuuagcuucuuuu

SEQ ID NO: 984353 - RNA, 24 nt, Human
ugaggcaggcggaucacuugcguu

SEQ ID NO: 984354 - RNA, 21 nt, Human
ugccuguaaucccagcaccuu

SEQ ID NO: 984355 - RNA, 23 nt, Human
ugccuguaaucccagcaccuugg

SEQ ID NO: 984356 - RNA, 23 nt, Human
ugccuguaaucccagcaccuugg

SEQ ID NO: 984357 - RNA, 24 nt, Human
ugccuguaaucccagcaccuuggg

SEQ ID NO: 984358 - RNA, 22 nt, Human
uggcucgugccuguaaucccag

SEQ ID NO: 984359 - RNA, 24 nt, Human
uggcucgugccuguaaucccagca

SEQ ID NO: 984360 - RNA, 18 nt, Human
ugggaggcugaggcaggc

SEQ ID NO: 984361 - RNA, 20 nt, Human
ugggaggcugaggcaggcgg

SEQ ID NO: 984362 - RNA, 24 nt, Human
ugggaggcugaggcaggcggauca

SEQ ID NO: 984363 - RNA, 25 nt, Human
uugggaggcugaggcaggcggauca

SEQ ID NO: 984364 - RNA, 22 nt, Human
aaaaaaauguucaguguagaaa

SEQ ID NO: 984365 - RNA, 24 nt, Human
aaaagcaaauaaaguauuuuccuu

SEQ ID NO: 984366 - RNA, 24 nt, Human
aaaauacuuugugauucucacuaa

SEQ ID NO: 984367 - RNA, 24 nt, Human
aagaacauacccaauuuuaacuaa

SEQ ID NO: 984368 - RNA, 20 nt, Human
aagcacacacauaguaaaca

SEQ ID NO: 984369 - RNA, 22 nt, Human
aaggguuuuaacaaaaccaaaa

SEQ ID NO: 984370 - RNA, 18 nt, Human
aauaacuggcucagauuu

SEQ ID NO: 984371 - RNA, 23 nt, Human
aauaauaaaguaaaugggaggaa

SEQ ID NO: 984372 - RNA, 22 nt, Human
acaaggguuuuaacaaaaccaa

SEQ ID NO: 984373 - RNA, 21 nt, Human
acccaauuuuaacuaaaaagu

SEQ ID NO: 984374 - RNA, 21 nt, Human
agaauaacaaaugagcaccau

SEQ ID NO: 984375 - RNA, 22 nt, Human
agcacugugacuaucacuuuuu

SEQ ID NO: 984376 - RNA, 21 nt, Human
aggugacgguggcggcccggg

SEQ ID NO: 984377 - RNA, 18 nt, Human
aguauauguauauauaca

SEQ ID NO: 984378 - RNA, 23 nt, Human
auaaauuucuaaacugagaugaa

SEQ ID NO: 984379 - RNA, 19 nt, Human
auauguguauauauacaca

SEQ ID NO: 984380 - RNA, 20 nt, Human
auauguguauauauacacaa

SEQ ID NO: 984381 - RNA, 25 nt, Human
aucaaguuaaaaaaaauguucagug

SEQ ID NO: 984382 - RNA, 20 nt, Human
caaaaacuaaaaugacugaa

SEQ ID NO: 984383 - RNA, 21 nt, Human
caaaagcaacauaauaaugaa

SEQ ID NO: 984384 - RNA, 19 nt, Human
caaagacugaaauuaucaa

SEQ ID NO: 984385 - RNA, 23 nt, Human
caacauaauaaugaaaaauucaa

SEQ ID NO: 984386 - RNA, 19 nt, Human
caacuagauaacuuagcac

SEQ ID NO: 984387 - RNA, 23 nt, Human
caaggguuuuaacaaaaccaaaa

SEQ ID NO: 984388 - RNA, 24 nt, Human
cacacauauguguauauauacaca

SEQ ID NO: 984389 - RNA, 18 nt, Human
cacauauguguauauaua

SEQ ID NO: 984390 - RNA, 22 nt, Human
cacaucguucaaaauuugcuac

SEQ ID NO: 984391 - RNA, 23 nt, Human
cacuucaacccccuauugcuugu

SEQ ID NO: 984392 - RNA, 26 nt, Human
cacuugcagguacaaagaugcagaga

SEQ ID NO: 984393 - RNA, 18 nt, Human
cagcggcagcggccgagg

SEQ ID NO: 984394 - RNA, 18 nt, Human
cauacacacauaugugua

SEQ ID NO: 984395 - RNA, 21 nt, Human
cccagaaugguuuaacuugac

SEQ ID NO: 984396 - RNA, 21 nt, Human
cccagaaugguuuaacuugac

SEQ ID NO: 984397 - RNA, 21 nt, Human
cccagaaugguuuaacuugac

SEQ ID NO: 984398 - RNA, 22 nt, Human
ccgaggugacgguggcggcccu

SEQ ID NO: 984399 - RNA, 20 nt, Human
ccuaggagccccgaagcggc

SEQ ID NO: 984400 - RNA, 18 nt, Human
ccuccuuuaauucugacu

SEQ ID NO: 984401 - RNA, 31 nt, Human
ccugacaaacugcauacacacauauguguag

SEQ ID NO: 984402 - RNA, 21 nt, Human
cgacagcggcagcggccgagg

SEQ ID NO: 984403 - RNA, 18 nt, Human
cucaaauaagacucuguu

SEQ ID NO: 984404 - RNA, 22 nt, Human
cugcauacacacauauguguau

SEQ ID NO: 984405 - RNA, 22 nt, Human
cuguaaagucuaucccuauucc

SEQ ID NO: 984406 - RNA, 20 nt, Human
cuucugagauucucuuucuu

SEQ ID NO: 984407 - RNA, 18 nt, Human
gaaagcauaaacaaugua

SEQ ID NO: 984408 - RNA, 24 nt, Human
gaggugacgguggcggcccggggc

SEQ ID NO: 984409 - RNA, 20 nt, Human
gauggcgacagcggcagcgg

SEQ ID NO: 984410 - RNA, 22 nt, Human
ggauggggaaacaaggcgaugg

SEQ ID NO: 984411 - RNA, 19 nt, Human
guauauguauauauacauc

SEQ ID NO: 984412 - RNA, 19 nt, Human
gugguuguuauuacaaucc

SEQ ID NO: 984413 - RNA, 23 nt, Human
guuaaucagaaauacuggcuacu

SEQ ID NO: 984414 - RNA, 19 nt, Human
uaaaacacaauuccaucaa

SEQ ID NO: 984415 - RNA, 21 nt, Human
uaaaacacaauuccaucaaga

SEQ ID NO: 984416 - RNA, 21 nt, Human
uaaaaugacagaacaaaggcg

SEQ ID NO: 984417 - RNA, 20 nt, Human
uaaacuggaaaacacuaugg

SEQ ID NO: 984418 - RNA, 19 nt, Human
uaaaguacaacagggauuc

SEQ ID NO: 984419 - RNA, 22 nt, Human
uaaauuucuaaacugagaugaa

SEQ ID NO: 984420 - RNA, 22 nt, Human
uaacuaaaaaguagugaaacag

SEQ ID NO: 984421 - RNA, 18 nt, Human
uaacugaaagaaaaugcu

SEQ ID NO: 984422 - RNA, 25 nt, Human
uaacugaaagaaaaugcucaagcac

SEQ ID NO: 984423 - RNA, 18 nt, Human
uaauaguagccaacuaga

SEQ ID NO: 984424 - RNA, 24 nt, Human
uacaauaauaaaguaaaugggagg

SEQ ID NO: 984425 - RNA, 20 nt, Human
uacaauaucaccaacugaaa

SEQ ID NO: 984426 - RNA, 25 nt, Human
uacaauaucaccaacugaaaguuuc

SEQ ID NO: 984427 - RNA, 27 nt, Human
uacaauaucaccaacugaaaguuucua

SEQ ID NO: 984428 - RNA, 19 nt, Human
uacuguguguuaaaugugu

SEQ ID NO: 984429 - RNA, 22 nt, Human
uagaauacaauaucaccaacug

SEQ ID NO: 984430 - RNA, 20 nt, Human
uauacaauauauguauauau

SEQ ID NO: 984431 - RNA, 24 nt, Human
uauauacacaaaaaaguauaugua

SEQ ID NO: 984432 - RNA, 23 nt, Human
uauauauuagcagcaaacuacuu

SEQ ID NO: 984433 - RNA, 23 nt, Human
uaucaccaacugaaaguuucuaa

SEQ ID NO: 984434 - RNA, 25 nt, Human
uauuaagaacauacccaauuuuaac

SEQ ID NO: 984435 - RNA, 22 nt, Human
uauuuaacucauucacaaaacu

SEQ ID NO: 984436 - RNA, 22 nt, Human
ucacuuuuuaaagaauuaaaau

SEQ ID NO: 984437 - RNA, 18 nt, Human
ucauuaagauguauggcu

SEQ ID NO: 984438 - RNA, 23 nt, Human
ucccaaaucccagaaugguuuaa

SEQ ID NO: 984439 - RNA, 22 nt, Human
ucuuuacaacaagcuuucacuu

SEQ ID NO: 984440 - RNA, 22 nt, Human
ugaaaaagguuuuuacaaaacu

SEQ ID NO: 984441 - RNA, 18 nt, Human
ugaaaaauaaagcaauac

SEQ ID NO: 984442 - RNA, 25 nt, Human
ugaaaaauaaagcaauacaucucaa

SEQ ID NO: 984443 - RNA, 25 nt, Human
ugaaaauucugaggccaaagagcug

SEQ ID NO: 984444 - RNA, 23 nt, Human
ugaaacaucuuuuuuacaccuuu

SEQ ID NO: 984445 - RNA, 25 nt, Human
ugaaacaucuuuuuuacaccuuuaa

SEQ ID NO: 984446 - RNA, 19 nt, Human
ugacgguggcggcccgggg

SEQ ID NO: 984447 - RNA, 18 nt, Human
ugacucagcuauaaguaa

SEQ ID NO: 984448 - RNA, 21 nt, Human
ugacucagcuauaaguaauau

SEQ ID NO: 984449 - RNA, 21 nt, Human
ugacuucauguaguuuccccc

SEQ ID NO: 984450 - RNA, 21 nt, Human
ugagaauaacaaaugagcacc

SEQ ID NO: 984451 - RNA, 20 nt, Human
ugagacacacaagacuauca

SEQ ID NO: 984452 - RNA, 23 nt, Human
ugagaugaagccaaaccucucau

SEQ ID NO: 984453 - RNA, 28 nt, Human
ugcauacacacauauguguauauuacau

SEQ ID NO: 984454 - RNA, 23 nt, Human
uggcgacagcggcagcggccgag

SEQ ID NO: 984455 - RNA, 28 nt, Human
uguauauauacacaaaaaaguauaugua

SEQ ID NO: 984456 - RNA, 19 nt, Human
ugucauaacuuucauuuuu

SEQ ID NO: 984457 - RNA, 23 nt, Human
uuaaaaaggagcuguuuuuuaaa

SEQ ID NO: 984458 - RNA, 25 nt, Human
uuaaaacacaauuccauccaccuag

SEQ ID NO: 984459 - RNA, 26 nt, Human
uuaagaacauacccaauuuuaacuaa

SEQ ID NO: 984460 - RNA, 23 nt, Human
uuaguccuuuauucugugauuug

SEQ ID NO: 984461 - RNA, 20 nt, Human
uuauuacagaaaucucacua

SEQ ID NO: 984462 - RNA, 22 nt, Human
uuccccauaaauuuaauuucca

SEQ ID NO: 984463 - RNA, 21 nt, Human
uugaauaaauuucuaaacuga

SEQ ID NO: 984464 - RNA, 25 nt, Human
uuguguguguguaaacucaauuuuu

SEQ ID NO: 984465 - RNA, 18 nt, Human
uuuuaacaauaaaacugu

SEQ ID NO: 984466 - RNA, 19 nt, Human
agcuugcagcaaccugaac

SEQ ID NO: 984467 - RNA, 23 nt, Human
cagcaaccugaacaaaccuuagu

SEQ ID NO: 984468 - RNA, 22 nt, Human
cguuuucuucuauucaguccca

SEQ ID NO: 984469 - RNA, 22 nt, Human
cuugcagcaaccugaacaaacc

SEQ ID NO: 984470 - RNA, 20 nt, Human
gggcaggacgagaugauucu

SEQ ID NO: 984471 - RNA, 18 nt, Human
uagaaggugaagaugaug

SEQ ID NO: 984472 - RNA, 19 nt, Human
uauacuucaacaaauguuc

SEQ ID NO: 984473 - RNA, 23 nt, Human
ucuucuguaucucuugugugcag

SEQ ID NO: 984474 - RNA, 19 nt, Human
ugcccuacuuacucaacag

SEQ ID NO: 984475 - RNA, 21 nt, Human
ugcccuacuuacucaacaggg

SEQ ID NO: 984476 - RNA, 22 nt, Human
uugaaacagaccucaggcucac

SEQ ID NO: 984477 - RNA, 20 nt, Human
uugaaacagaccucaggcuu

SEQ ID NO: 984478 - RNA, 21 nt, Human
aaaaaaaaaaaaagaagaaga

SEQ ID NO: 984479 - RNA, 19 nt, Human
aaaaaaaaaaagaagaaga

SEQ ID NO: 984480 - RNA, 23 nt, Human
aaaaaaaaaaagaagaagaagaa

SEQ ID NO: 984481 - RNA, 21 nt, Human
aaaaaaaaaagaagaagaaga

SEQ ID NO: 984482 - RNA, 19 nt, Human
aaaaaaaagaagaagaaga

SEQ ID NO: 984483 - RNA, 19 nt, Human
aaaaaaaagaagaagaaga

SEQ ID NO: 984484 - RNA, 18 nt, Human
aaaaaagaagaagaagaa

SEQ ID NO: 984485 - RNA, 19 nt, Human
aaaaaagaagaagaagaag

SEQ ID NO: 984486 - RNA, 18 nt, Human
aaaaagaagaagaagaag

SEQ ID NO: 984487 - RNA, 22 nt, Human
aaaaagcuacucuuggagcuca

SEQ ID NO: 984488 - RNA, 20 nt, Human
aaaacaaaaaccuuacaaaa

SEQ ID NO: 984489 - RNA, 25 nt, Human
aaaagaagaagaagaagagaaaaaa

SEQ ID NO: 984490 - RNA, 24 nt, Human
aaaauaucacauagugauaggaug

SEQ ID NO: 984491 - RNA, 18 nt, Human
aaacuauaaaauacucca

SEQ ID NO: 984492 - RNA, 21 nt, Human
aaacucgcaaacugaucaggg

SEQ ID NO: 984493 - RNA, 19 nt, Human
aaagaagaagaagaagaga

SEQ ID NO: 984494 - RNA, 25 nt, Human
aaagaccaacaaaaagugaaauaaa

SEQ ID NO: 984495 - RNA, 20 nt, Human
aaagacuuauaaaaacuaga

SEQ ID NO: 984496 - RNA, 24 nt, Human
aacaaaaagugaaauaaagggacc

SEQ ID NO: 984497 - RNA, 24 nt, Human
aaccccacuguuucauuuuaauac

SEQ ID NO: 984498 - RNA, 22 nt, Human
aaccgauaaacagaagaucacu

SEQ ID NO: 984499 - RNA, 22 nt, Human
aaccuuacaaaacucaucaaaa

SEQ ID NO: 984500 - RNA, 22 nt, Human
aacucgcaaacugaucagaaaa

SEQ ID NO: 984501 - RNA, 18 nt, Human
aagaagaagaagaagaga

SEQ ID NO: 984502 - RNA, 21 nt, Human
aagaagaagaagagaaaaaaa

SEQ ID NO: 984503 - RNA, 21 nt, Human
aagaagaagagaaaaaaaaaa

SEQ ID NO: 984504 - RNA, 22 nt, Human
aagaagaagagaaaaaaaaaac

SEQ ID NO: 984505 - RNA, 21 nt, Human
aagagcaccacauuccuaacc

SEQ ID NO: 984506 - RNA, 22 nt, Human
aagagcaccacauuccuaaccc

SEQ ID NO: 984507 - RNA, 24 nt, Human
aaugcuaaaauauuuuaaguuaaa

SEQ ID NO: 984508 - RNA, 22 nt, Human
acaaaauacaguaauuacaguu

SEQ ID NO: 984509 - RNA, 19 nt, Human
acacaaacaaaaucuuuag

SEQ ID NO: 984510 - RNA, 21 nt, Human
acagggauaacuagucaaaac

SEQ ID NO: 984511 - RNA, 24 nt, Human
agaaaaaaaaaacuuuuuugaaag

SEQ ID NO: 984512 - RNA, 21 nt, Human
aggcaaaagaaggaaagaaag

SEQ ID NO: 984513 - RNA, 21 nt, Human
aggcaaaagaaggaaagaaag

SEQ ID NO: 984514 - RNA, 20 nt, Human
aguaauuacaguuaacuuaa

SEQ ID NO: 984515 - RNA, 18 nt, Human
agugguuacagggcaacg

SEQ ID NO: 984516 - RNA, 20 nt, Human
auaaagaccaacaaaaagug

SEQ ID NO: 984517 - RNA, 22 nt, Human
caaaauacaguaauuacaguua

SEQ ID NO: 984518 - RNA, 23 nt, Human
caagagcaccacauuccuaaccc

SEQ ID NO: 984519 - RNA, 24 nt, Human
caagagcaccacauuccuaacccc

SEQ ID NO: 984520 - RNA, 31 nt, Human
cacacagaguccaaaaaaaaaaaaaaaaaaa

SEQ ID NO: 984521 - RNA, 23 nt, Human
cagaagaucacuaagagaugaaa

SEQ ID NO: 984522 - RNA, 20 nt, Human
cagagcagggagcugccggc

SEQ ID NO: 984523 - RNA, 24 nt, Human
cagauauacgcucaguucacaucc

SEQ ID NO: 984524 - RNA, 27 nt, Human
caggcagaucacauguaacgcacaggc

SEQ ID NO: 984525 - RNA, 19 nt, Human
caggcagaucacauguagu

SEQ ID NO: 984526 - RNA, 23 nt, Human
caggccacaaauacuggaguccu

SEQ ID NO: 984527 - RNA, 23 nt, Human
ccaaaaaaaaaaaaaaaaaaaaa

SEQ ID NO: 984528 - RNA, 19 nt, Human
ccacauuccuaaccccuaa

SEQ ID NO: 984529 - RNA, 22 nt, Human
ccccagauagccuucaccaggc

SEQ ID NO: 984530 - RNA, 19 nt, Human
ccgacagcugggggaaggg

SEQ ID NO: 984531 - RNA, 19 nt, Human
ccuaaccccuaaggcagca

SEQ ID NO: 984532 - RNA, 25 nt, Human
ccuaaccccuaaggcagcacacaga

SEQ ID NO: 984533 - RNA, 19 nt, Human
cggccggggcgcagggcga

SEQ ID NO: 984534 - RNA, 21 nt, Human
cuaaauauauaaaaagacuua

SEQ ID NO: 984535 - RNA, 19 nt, Human
cuuuuuuuuuuuuuuuuaa

SEQ ID NO: 984536 - RNA, 22 nt, Human
gaagaagaagaagagaaaaaaa

SEQ ID NO: 984537 - RNA, 19 nt, Human
gacccucuuucuguccaag

SEQ ID NO: 984538 - RNA, 23 nt, Human
gaucacuaagagaugaaaaaaag

SEQ ID NO: 984539 - RNA, 21 nt, Human
ggagaggggcggggaaggggu

SEQ ID NO: 984540 - RNA, 20 nt, Human
ggagaggguggccccgcgcu

SEQ ID NO: 984541 - RNA, 25 nt, Human
ggaguccuuuuuucuucuccucugg

SEQ ID NO: 984542 - RNA, 19 nt, Human
gggaagggccggagagggu

SEQ ID NO: 984543 - RNA, 22 nt, Human
gggauaacuagucaaaacacag

SEQ ID NO: 984544 - RNA, 21 nt, Human
gggcggaggccggccgggaga

SEQ ID NO: 984545 - RNA, 21 nt, Human
ggggaagggccggagagggug

SEQ ID NO: 984546 - RNA, 20 nt, Human
ggguggccccgcgcuggcug

SEQ ID NO: 984547 - RNA, 18 nt, Human
guaaaccaagauauauau

SEQ ID NO: 984548 - RNA, 21 nt, Human
uaaaacaaaaaccuuacaaaa

SEQ ID NO: 984549 - RNA, 22 nt, Human
uaaaacaaaaaccuuacaaaac

SEQ ID NO: 984550 - RNA, 18 nt, Human
uaaaagggaaucuguggc

SEQ ID NO: 984551 - RNA, 19 nt, Human
uaaaagggaaucuguggca

SEQ ID NO: 984552 - RNA, 21 nt, Human
uaaaauacuccauuuuuaguc

SEQ ID NO: 984553 - RNA, 23 nt, Human
uaaguuaaauuuucuuuuucuuu

SEQ ID NO: 984554 - RNA, 27 nt, Human
uacacuuaauaguccuugguuuaugaa

SEQ ID NO: 984555 - RNA, 22 nt, Human
uaugugaugaugaaaguuauuu

SEQ ID NO: 984556 - RNA, 22 nt, Human
uauuaggcaaaagaaggaaaga

SEQ ID NO: 984557 - RNA, 18 nt, Human
ucacuaagagaugaaaaa

SEQ ID NO: 984558 - RNA, 20 nt, Human
ucacuucccccaacaagagc

SEQ ID NO: 984559 - RNA, 18 nt, Human
ucaguaaccuuucugaug

SEQ ID NO: 984560 - RNA, 23 nt, Human
uccaaaaaaaaaaaaaaaaaaaa

SEQ ID NO: 984561 - RNA, 22 nt, Human
uccaaaauagauauacagguuc

SEQ ID NO: 984562 - RNA, 18 nt, Human
ucuuggagcucacuuccc

SEQ ID NO: 984563 - RNA, 18 nt, Human
ucuuuuuuuuuuuuuuuu

SEQ ID NO: 984564 - RNA, 18 nt, Human
ugaaauaaauaauaggcc

SEQ ID NO: 984565 - RNA, 25 nt, Human
ugacauuaagaugugauuuccacca

SEQ ID NO: 984566 - RNA, 20 nt, Human
ugauggcagugaugcagacc

SEQ ID NO: 984567 - RNA, 22 nt, Human
ugcaaauaaaacuuuacuccaa

SEQ ID NO: 984568 - RNA, 20 nt, Human
ugcagaaaaacuucaauaca

SEQ ID NO: 984569 - RNA, 21 nt, Human
uggaaggacuuagcugagcug

SEQ ID NO: 984570 - RNA, 20 nt, Human
uggaguacuaaaccccacug

SEQ ID NO: 984571 - RNA, 20 nt, Human
uggaguacuaaaccccacug

SEQ ID NO: 984572 - RNA, 18 nt, Human
uggcagugaugcagaccc

SEQ ID NO: 984573 - RNA, 19 nt, Human
uggcugcggggcggaggcc

SEQ ID NO: 984574 - RNA, 24 nt, Human
uggcuuaaagacaccuaaaaacag

SEQ ID NO: 984575 - RNA, 18 nt, Human
ugggucagagcagggagc

SEQ ID NO: 984576 - RNA, 21 nt, Human
uguauguuugcuaugugguac

SEQ ID NO: 984577 - RNA, 22 nt, Human
ugucauaucaguaaccuuucug

SEQ ID NO: 984578 - RNA, 23 nt, Human
uuaagcacaucuaaaaaaauaaa

SEQ ID NO: 984579 - RNA, 24 nt, Human
uuuaaguuaaauuuucuuuuucuu

SEQ ID NO: 984580 - RNA, 20 nt, Human
uuuuucuuugucccacaaaa

SEQ ID NO: 984581 - RNA, 27 nt, Human
uuuuuuuuuuuaaagcaaaauaaguuu

SEQ ID NO: 984582 - RNA, 18 nt, Human
caacuaaccaucuuucca

SEQ ID NO: 984583 - RNA, 24 nt, Human
cacggauggagaaggaaaccuguu

SEQ ID NO: 984584 - RNA, 20 nt, Human
cccggcgccuccugcggccg

SEQ ID NO: 984585 - RNA, 18 nt, Human
ccgcucccggcgccuccu

SEQ ID NO: 984586 - RNA, 21 nt, Human
ccggcgccuccugcggccgag

SEQ ID NO: 984587 - RNA, 22 nt, Human
cggcacgaggugggaaucuauc

SEQ ID NO: 984588 - RNA, 22 nt, Human
cggcuccgcucccggcgccucc

SEQ ID NO: 984589 - RNA, 30 nt, Human
cuccacggccgcccgagcuccgcgccgccu

SEQ ID NO: 984590 - RNA, 19 nt, Human
cuucccagcgcgcuccaug

SEQ ID NO: 984591 - RNA, 20 nt, Human
gaguuccuccacggccgccc

SEQ ID NO: 984592 - RNA, 21 nt, Human
gcgguggcggcccgggccggc

SEQ ID NO: 984593 - RNA, 19 nt, Human
uacugaagaaucaucggac

SEQ ID NO: 984594 - RNA, 25 nt, Human
uaucuuuacugaagaaucaucggac

SEQ ID NO: 984595 - RNA, 18 nt, Human
uccauggucugggauggg

SEQ ID NO: 984596 - RNA, 21 nt, Human
uccauggucugggaugggcgg

SEQ ID NO: 984597 - RNA, 19 nt, Human
uccccugugggcgcacgga

SEQ ID NO: 984598 - RNA, 20 nt, Human
ugccuggacugggagcgaga

SEQ ID NO: 984599 - RNA, 20 nt, Human
ugccuggacugggagcgaga

SEQ ID NO: 984600 - RNA, 24 nt, Human
ugggaugggcgguggcggcccggg

SEQ ID NO: 984601 - RNA, 24 nt, Human
uggucugggaugggcgguggcggc

SEQ ID NO: 984602 - RNA, 19 nt, Human
uuccuccacggccgcccga

SEQ ID NO: 984603 - RNA, 18 nt, Human
aaaaaucuuccugccuuc

SEQ ID NO: 984604 - RNA, 18 nt, Human
aaacagggaucauagaac

SEQ ID NO: 984605 - RNA, 24 nt, Human
aaaguguugggauuacaaguguga

SEQ ID NO: 984606 - RNA, 21 nt, Human
aacaacaacaacaacaacaaa

SEQ ID NO: 984607 - RNA, 22 nt, Human
aacaacaacaacaacaacaaga

SEQ ID NO: 984608 - RNA, 20 nt, Human
aacaacaacaacaacaagau

SEQ ID NO: 984609 - RNA, 27 nt, Human
aacagcucuauccuguuguucuuuuuu

SEQ ID NO: 984610 - RNA, 24 nt, Human
aaccacaagugaacaacaacaaca

SEQ ID NO: 984611 - RNA, 20 nt, Human
aacugggaagagcaagggcg

SEQ ID NO: 984612 - RNA, 23 nt, Human
aagaggaagcaaaauccacauaa

SEQ ID NO: 984613 - RNA, 21 nt, Human
aagcacuugcccuugaaaaca

SEQ ID NO: 984614 - RNA, 22 nt, Human
aagcagccgccagccgggaccc

SEQ ID NO: 984615 - RNA, 20 nt, Human
aagggcggggaaggagcuaa

SEQ ID NO: 984616 - RNA, 18 nt, Human
aagguagggggcagcccu

SEQ ID NO: 984617 - RNA, 18 nt, Human
aaguaacucuaucucaga

SEQ ID NO: 984618 - RNA, 24 nt, Human
aagucuaacaucacuauuugaaac

SEQ ID NO: 984619 - RNA, 24 nt, Human
aagugcaacagugcaaagaaacuu

SEQ ID NO: 984620 - RNA, 21 nt, Human
aaguguugggauuacaagugu

SEQ ID NO: 984621 - RNA, 26 nt, Human
aaguguugggauuacaagugugagcc

SEQ ID NO: 984622 - RNA, 23 nt, Human
aauaacagaaggagaacagaaga

SEQ ID NO: 984623 - RNA, 25 nt, Human
aauaacagaaggagaacagaagaaa

SEQ ID NO: 984624 - RNA, 19 nt, Human
acaacaacaacaacaacaa

SEQ ID NO: 984625 - RNA, 22 nt, Human
acaacaacaacaacaacaacaa

SEQ ID NO: 984626 - RNA, 23 nt, Human
acaacaacaacaacaacaacaag

SEQ ID NO: 984627 - RNA, 25 nt, Human
acaacaacaacaacaacaagauuaa

SEQ ID NO: 984628 - RNA, 22 nt, Human
acaguauuacagaacaaaagca

SEQ ID NO: 984629 - RNA, 21 nt, Human
acaucacuauuugaaaccagu

SEQ ID NO: 984630 - RNA, 22 nt, Human
accacauuaggauguuaacuca

SEQ ID NO: 984631 - RNA, 22 nt, Human
accaggaauguagaaccacaag

SEQ ID NO: 984632 - RNA, 19 nt, Human
accucuuuggcaacuacca

SEQ ID NO: 984633 - RNA, 19 nt, Human
agaaggagaacagaagaaa

SEQ ID NO: 984634 - RNA, 18 nt, Human
agaccaccuaggagaacu

SEQ ID NO: 984635 - RNA, 18 nt, Human
agcucagcgggagaacga

SEQ ID NO: 984636 - RNA, 24 nt, Human
agguuuauuaagaccaccuaggag

SEQ ID NO: 984637 - RNA, 20 nt, Human
aguaauuuuauugaaacauc

SEQ ID NO: 984638 - RNA, 24 nt, Human
aguguugggauuacaagugugagc

SEQ ID NO: 984639 - RNA, 21 nt, Human
augaagggcaaucagaauaca

SEQ ID NO: 984640 - RNA, 21 nt, Human
auguuaacucauaaaaacaua

SEQ ID NO: 984641 - RNA, 21 nt, Human
auugcacucagccaucucuac

SEQ ID NO: 984642 - RNA, 24 nt, Human
caaaguguugggauuacaagugug

SEQ ID NO: 984643 - RNA, 19 nt, Human
caaaugauguauccaaguc

SEQ ID NO: 984644 - RNA, 18 nt, Human
caacaacaacaacaacaa

SEQ ID NO: 984645 - RNA, 25 nt, Human
caacaacaacaacaacaacaagauu

SEQ ID NO: 984646 - RNA, 28 nt, Human
caacaaccacaggucacacaguauuuua

SEQ ID NO: 984647 - RNA, 21 nt, Human
caacuaccacaaauucuaggc

SEQ ID NO: 984648 - RNA, 21 nt, Human
caagggcggggaaggagcuaa

SEQ ID NO: 984649 - RNA, 24 nt, Human
cacuauuugaaaccaguguuauuu

SEQ ID NO: 984650 - RNA, 23 nt, Human
cagaacaaaagcauggucacuuu

SEQ ID NO: 984651 - RNA, 22 nt, Human
cagaauacaagaggaagcaaaa

SEQ ID NO: 984652 - RNA, 18 nt, Human
cagccgggacccgcaggc

SEQ ID NO: 984653 - RNA, 18 nt, Human
cauauuugcucuccauga

SEQ ID NO: 984654 - RNA, 23 nt, Human
cauucccaacaauuccuauuugc

SEQ ID NO: 984655 - RNA, 23 nt, Human
cauuuaaaauccaggccaaguuc

SEQ ID NO: 984656 - RNA, 18 nt, Human
ccaaaccaacccucaccu

SEQ ID NO: 984657 - RNA, 21 nt, Human
ccaaaguguugggauuacaag

SEQ ID NO: 984658 - RNA, 21 nt, Human
ccaaaguguugggauuacaag

SEQ ID NO: 984659 - RNA, 24 nt, Human
ccaaaguguugggauuacaagugu

SEQ ID NO: 984660 - RNA, 23 nt, Human
ccaaccucaaucuaucuuuaaaa

SEQ ID NO: 984661 - RNA, 24 nt, Human
ccacaagugaacaacaacaacaac

SEQ ID NO: 984662 - RNA, 24 nt, Human
ccuaaacaaauuauguucccuuua

SEQ ID NO: 984663 - RNA, 22 nt, Human
ccucccgccucagccuuccaaa

SEQ ID NO: 984664 - RNA, 23 nt, Human
ccucccgccucagccuuccaaag

SEQ ID NO: 984665 - RNA, 24 nt, Human
ccugccuucaaaugcccagcaacc

SEQ ID NO: 984666 - RNA, 19 nt, Human
cuaauucugccuuucuaug

SEQ ID NO: 984667 - RNA, 28 nt, Human
cucuuuggcaacuaccacaaauucuagg

SEQ ID NO: 984668 - RNA, 23 nt, Human
cugauccucccgccucagccuuc

SEQ ID NO: 984669 - RNA, 24 nt, Human
cugauccucccgccucagccuucc

SEQ ID NO: 984670 - RNA, 18 nt, Human
cugaucuugaacucuugg

SEQ ID NO: 984671 - RNA, 19 nt, Human
cugaucuugaacucuuggg

SEQ ID NO: 984672 - RNA, 20 nt, Human
cugguguccaguuuucuugg

SEQ ID NO: 984673 - RNA, 21 nt, Human
gaaaacagcucagcgggagaa

SEQ ID NO: 984674 - RNA, 21 nt, Human
gaagcagccgccagccgggac

SEQ ID NO: 984675 - RNA, 19 nt, Human
gacgaggagcugagaccug

SEQ ID NO: 984676 - RNA, 18 nt, Human
gauuacaagugugagcca

SEQ ID NO: 984677 - RNA, 22 nt, Human
gauuacaagugugagccauugc

SEQ ID NO: 984678 - RNA, 23 nt, Human
gauuacaagugugagccauugca

SEQ ID NO: 984679 - RNA, 22 nt, Human
gcagacaggugggagagggagc

SEQ ID NO: 984680 - RNA, 23 nt, Human
gccucagccuuccaaaguguugg

SEQ ID NO: 984681 - RNA, 20 nt, Human
gccuguggaaaagggaagug

SEQ ID NO: 984682 - RNA, 22 nt, Human
ggaauaauuuuaaaccaaccuc

SEQ ID NO: 984683 - RNA, 22 nt, Human
ggcaaucagaauacaagaggaa

SEQ ID NO: 984684 - RNA, 20 nt, Human
gggaaggagcuaaggcugcg

SEQ ID NO: 984685 - RNA, 22 nt, Human
gggucuugcuauacugcccagg

SEQ ID NO: 984686 - RNA, 19 nt, Human
guagaaccacaagugaaca

SEQ ID NO: 984687 - RNA, 20 nt, Human
guagccaaauccucuaauuc

SEQ ID NO: 984688 - RNA, 21 nt, Human
guagggggcagcccuuugaca

SEQ ID NO: 984689 - RNA, 20 nt, Human
uaaguuaauuccuaauuuga

SEQ ID NO: 984690 - RNA, 25 nt, Human
uaauguuaauuaaauuaacuuccuu

SEQ ID NO: 984691 - RNA, 20 nt, Human
uacaccgcucuccuaccgga

SEQ ID NO: 984692 - RNA, 19 nt, Human
uacaccuauuccgucucca

SEQ ID NO: 984693 - RNA, 22 nt, Human
uaccagaaaguaacucuaucuc

SEQ ID NO: 984694 - RNA, 21 nt, Human
uacugauccucccgccucagc

SEQ ID NO: 984695 - RNA, 20 nt, Human
uagaaccaaggaauuaucuc

SEQ ID NO: 984696 - RNA, 22 nt, Human
uagcagauaaugaaguaaacuu

SEQ ID NO: 984697 - RNA, 21 nt, Human
uagguuaagucuaacaucacu

SEQ ID NO: 984698 - RNA, 24 nt, Human
uauacugcccaggcugaucuugaa

SEQ ID NO: 984699 - RNA, 22 nt, Human
uaucucagaugcuaguaaaaag

SEQ ID NO: 984700 - RNA, 19 nt, Human
uauuauagaguuucugaca

SEQ ID NO: 984701 - RNA, 22 nt, Human
ucaaaauagauagagaauaggc

SEQ ID NO: 984702 - RNA, 23 nt, Human
ucaacaagcacuugcccuugaaa

SEQ ID NO: 984703 - RNA, 22 nt, Human
ucacuaaaggaugaaccaaagu

SEQ ID NO: 984704 - RNA, 22 nt, Human
ucacuuuauuuuacccaaaugc

SEQ ID NO: 984705 - RNA, 19 nt, Human
ucagauagagacuucucau

SEQ ID NO: 984706 - RNA, 21 nt, Human
ucagcgggagaacgaucggag

SEQ ID NO: 984707 - RNA, 23 nt, Human
uccaauauacuggguaccagaaa

SEQ ID NO: 984708 - RNA, 21 nt, Human
ucucaugacagcacauuaccu

SEQ ID NO: 984709 - RNA, 20 nt, Human
ucuccaaaccaacccucacc

SEQ ID NO: 984710 - RNA, 18 nt, Human
ucuccaugaucaccauua

SEQ ID NO: 984711 - RNA, 23 nt, Human
ucuugcuauacugcccaggcuga

SEQ ID NO: 984712 - RNA, 20 nt, Human
ugaacaacaacaacaacaac

SEQ ID NO: 984713 - RNA, 20 nt, Human
ugacagcacauuaccuaaua

SEQ ID NO: 984714 - RNA, 20 nt, Human
ugacgaggagcugagaccug

SEQ ID NO: 984715 - RNA, 21 nt, Human
ugacgaggagcugagaccugc

SEQ ID NO: 984716 - RNA, 23 nt, Human
ugagaaaucaauagaaucaauaa

SEQ ID NO: 984717 - RNA, 24 nt, Human
ugcccaggcugaucuugaacucuu

SEQ ID NO: 984718 - RNA, 21 nt, Human
ugccuucaaaugcccagcaac

SEQ ID NO: 984719 - RNA, 27 nt, Human
ugcuauacugcccaggcugaucuugaa

SEQ ID NO: 984720 - RNA, 21 nt, Human
uggaauuuucaguaaacacuu

SEQ ID NO: 984721 - RNA, 25 nt, Human
uggacaacauuuauauuacaagaca

SEQ ID NO: 984722 - RNA, 20 nt, Human
uggagauggggucuugcuau

SEQ ID NO: 984723 - RNA, 19 nt, Human
ugggauuacaagugugagc

SEQ ID NO: 984724 - RNA, 21 nt, Human
ugggauuacaagugugagcca

SEQ ID NO: 984725 - RNA, 21 nt, Human
ugggauuacaagugugagcca

SEQ ID NO: 984726 - RNA, 22 nt, Human
ugggauuacaagugugagccau

SEQ ID NO: 984727 - RNA, 24 nt, Human
ugggauuacaagugugagccauug

SEQ ID NO: 984728 - RNA, 24 nt, Human
uggggucuugcuauacugcccagg

SEQ ID NO: 984729 - RNA, 21 nt, Human
ugucauuugucaaaacaagaa

SEQ ID NO: 984730 - RNA, 22 nt, Human
uguccaguuuucuuggaagucu

SEQ ID NO: 984731 - RNA, 21 nt, Human
ugucuaaaacuaugcauggag

SEQ ID NO: 984732 - RNA, 23 nt, Human
uguucuaggccuguggaaaaggg

SEQ ID NO: 984733 - RNA, 24 nt, Human
uguugggauuacaagugugagcca

SEQ ID NO: 984734 - RNA, 20 nt, Human
uuaaaaaaaaaauggagaug

SEQ ID NO: 984735 - RNA, 22 nt, Human
uuaaaaaucuuccugccuucaa

SEQ ID NO: 984736 - RNA, 24 nt, Human
uuagaaauucaaauaaaaauguua

SEQ ID NO: 984737 - RNA, 22 nt, Human
uucaaggaaaggcagcuacacc

SEQ ID NO: 984738 - RNA, 18 nt, Human
uucaucauucaccaggaa

SEQ ID NO: 984739 - RNA, 19 nt, Human
uucaucauucaccaggaau

SEQ ID NO: 984740 - RNA, 19 nt, Human
uucuugugaucaguuuguu

SEQ ID NO: 984741 - RNA, 21 nt, Human
uuuaaaaaucuuccugccuuc

SEQ ID NO: 984742 - RNA, 21 nt, Human
uuuaaacccagauuaguaaca

SEQ ID NO: 984743 - RNA, 20 nt, Human
uuuuucuuuccuacaauguu

SEQ ID NO: 984744 - RNA, 21 nt, Human
aaggaaacaaagaaguaauca

SEQ ID NO: 984745 - RNA, 18 nt, Human
aaucauuuguugagagac

SEQ ID NO: 984746 - RNA, 21 nt, Human
agacagacaagaagccacaag

SEQ ID NO: 984747 - RNA, 23 nt, Human
agacagacaagaagccacaagga

SEQ ID NO: 984748 - RNA, 21 nt, Human
aggccugcugugccccugcug

SEQ ID NO: 984749 - RNA, 21 nt, Human
aggggcucuugaggccugcug

SEQ ID NO: 984750 - RNA, 22 nt, Human
aucuucccugaagcuaccgguu

SEQ ID NO: 984751 - RNA, 21 nt, Human
cacccacuccugcauucaguc

SEQ ID NO: 984752 - RNA, 19 nt, Human
ccugcugccaaggcagccu

SEQ ID NO: 984753 - RNA, 22 nt, Human
cuaccgggaugggaaaggucag

SEQ ID NO: 984754 - RNA, 24 nt, Human
cucgugcugggcccccguggcccu

SEQ ID NO: 984755 - RNA, 19 nt, Human
cugugccccugcugccaag

SEQ ID NO: 984756 - RNA, 19 nt, Human
cugugccccugcugccaag

SEQ ID NO: 984757 - RNA, 19 nt, Human
gagacguuauuaacuauga

SEQ ID NO: 984758 - RNA, 19 nt, Human
gcagccucaaguucaagga

SEQ ID NO: 984759 - RNA, 22 nt, Human
ggaugggaaaggucagugucuu

SEQ ID NO: 984760 - RNA, 18 nt, Human
gugcugggcccccguggc

SEQ ID NO: 984761 - RNA, 21 nt, Human
uaccaugcuccagcacuggaa

SEQ ID NO: 984762 - RNA, 22 nt, Human
ucagugucuuccuuugaacccu

SEQ ID NO: 984763 - RNA, 25 nt, Human
ucucgugcugggcccccguggcccc

SEQ ID NO: 984764 - RNA, 18 nt, Human
ugacucagacagacaaga

SEQ ID NO: 984765 - RNA, 18 nt, Human
ugaggccugcugugcccc

SEQ ID NO: 984766 - RNA, 23 nt, Human
uggggaauacgucugucugucug

SEQ ID NO: 984767 - RNA, 23 nt, Human
uguauucguugacucagacagac

SEQ ID NO: 984768 - RNA, 24 nt, Human
ugugaauuuucucuucuauaaucc

SEQ ID NO: 984769 - RNA, 24 nt, Human
uuaggggcucuugaggccugcugu

SEQ ID NO: 984770 - RNA, 21 nt, Human
uucaaggagcagcuaaucacc

SEQ ID NO: 984771 - RNA, 18 nt, Human
uucccugaagcuaccggg

SEQ ID NO: 984772 - RNA, 21 nt, Human
uuccuuugaacccugagacaa

SEQ ID NO: 984773 - RNA, 22 nt, Human
uuuuuuaaggggcuguaauuau

SEQ ID NO: 984774 - RNA, 18 nt, Human
uuuuuuuuuuuaaggggc

SEQ ID NO: 984775 - RNA, 19 nt, Human
uuuuuuuuuuuaaggggcu

SEQ ID NO: 984776 - RNA, 22 nt, Human
aaacacugaaacacaaaauucc

SEQ ID NO: 984777 - RNA, 25 nt, Human
acacacacacacacaugcacacccu

SEQ ID NO: 984778 - RNA, 19 nt, Human
acugaaacacaaaauucca

SEQ ID NO: 984779 - RNA, 22 nt, Human
agacauggggugucugccaugg

SEQ ID NO: 984780 - RNA, 18 nt, Human
agggguggggcugccugg

SEQ ID NO: 984781 - RNA, 19 nt, Human
agggguggggcugccuggg

SEQ ID NO: 984782 - RNA, 20 nt, Human
aggggugguggggguauugc

SEQ ID NO: 984783 - RNA, 20 nt, Human
cacacacacacacacacaca

SEQ ID NO: 984784 - RNA, 20 nt, Human
cacacacacacacacacaca

SEQ ID NO: 984785 - RNA, 20 nt, Human
cacacacacacacacacaca

SEQ ID NO: 984786 - RNA, 20 nt, Human
cacacacacacacacacaca

SEQ ID NO: 984787 - RNA, 22 nt, Human
cacacacacacacacacacaca

SEQ ID NO: 984788 - RNA, 22 nt, Human
cacacacacacacacacacaca

SEQ ID NO: 984789 - RNA, 22 nt, Human
cacacacacacacacacacaca

SEQ ID NO: 984790 - RNA, 26 nt, Human
cacacacacacacacacacacacaca

SEQ ID NO: 984791 - RNA, 26 nt, Human
cacacacacacacacacacacacaug

SEQ ID NO: 984792 - RNA, 26 nt, Human
cacacacacacacacacacacaugca

SEQ ID NO: 984793 - RNA, 26 nt, Human
cacacacacacacacacacaugcaca

SEQ ID NO: 984794 - RNA, 25 nt, Human
cacacacacacacacaugcacaccc

SEQ ID NO: 984795 - RNA, 24 nt, Human
cacacacacaugcacacccuccug

SEQ ID NO: 984796 - RNA, 23 nt, Human
cacacccuccugggacaugccac

SEQ ID NO: 984797 - RNA, 21 nt, Human
cacagaucuguggucucacgc

SEQ ID NO: 984798 - RNA, 22 nt, Human
cacccaagguggggguggaggg

SEQ ID NO: 984799 - RNA, 23 nt, Human
cagacacaaagggcucagguauc

SEQ ID NO: 984800 - RNA, 23 nt, Human
caugugccggcggcaugcauggu

SEQ ID NO: 984801 - RNA, 20 nt, Human
ccuccuccuccuccuagucc

SEQ ID NO: 984802 - RNA, 25 nt, Human
ccuggacacacacacacacacacag

SEQ ID NO: 984803 - RNA, 21 nt, Human
ccugggccucccuggauccuc

SEQ ID NO: 984804 - RNA, 23 nt, Human
cggcaugcauguuggugugcaug

SEQ ID NO: 984805 - RNA, 18 nt, Human
cucccuggauccucugag

SEQ ID NO: 984806 - RNA, 23 nt, Human
cuccuccuccuccuccuaguccu

SEQ ID NO: 984807 - RNA, 21 nt, Human
cuccugggacaugccacagcc

SEQ ID NO: 984808 - RNA, 19 nt, Human
cugccucugcugcugcucc

SEQ ID NO: 984809 - RNA, 20 nt, Human
cuguguguaccugggccucc

SEQ ID NO: 984810 - RNA, 18 nt, Human
gagggggugcucuggugc

SEQ ID NO: 984811 - RNA, 22 nt, Human
gcacgcacacacacuguucaca

SEQ ID NO: 984812 - RNA, 24 nt, Human
gcuccuccuccuccuccuaguccu

SEQ ID NO: 984813 - RNA, 18 nt, Human
gggagagagaaggguggg

SEQ ID NO: 984814 - RNA, 25 nt, Human
ggggauggagugaaagggguggugg

SEQ ID NO: 984815 - RNA, 24 nt, Human
ggggguggaggagggguggggcug

SEQ ID NO: 984816 - RNA, 21 nt, Human
gggguggaggagggguggggc

SEQ ID NO: 984817 - RNA, 20 nt, Human
ggguggaggagggguggggc

SEQ ID NO: 984818 - RNA, 23 nt, Human
gguccauggcccggugaggucca

SEQ ID NO: 984819 - RNA, 18 nt, Human
gucuacacaacagccccc

SEQ ID NO: 984820 - RNA, 20 nt, Human
gucugggagagagaagggug

SEQ ID NO: 984821 - RNA, 19 nt, Human
gugcucuggugcaucacac

SEQ ID NO: 984822 - RNA, 23 nt, Human
uagguucaaacacugaaacacaa

SEQ ID NO: 984823 - RNA, 21 nt, Human
ucacagaggacagagagggcg

SEQ ID NO: 984824 - RNA, 21 nt, Human
uccuccugccucugcugcugc

SEQ ID NO: 984825 - RNA, 31 nt, Human
ugcaucacacacaucacacgcacacgcacgg

SEQ ID NO: 984826 - RNA, 19 nt, Human
ugcauguuggugugcaugu

SEQ ID NO: 984827 - RNA, 18 nt, Human
ugcggggacggggggggg

SEQ ID NO: 984828 - RNA, 26 nt, Human
uggacacacacacacacacacacaca

SEQ ID NO: 984829 - RNA, 26 nt, Human
uggacacacacacacacacacacaca

SEQ ID NO: 984830 - RNA, 25 nt, Human
uggacacacacacacacacacacag

SEQ ID NO: 984831 - RNA, 20 nt, Human
uggaggagggguggggcugc

SEQ ID NO: 984832 - RNA, 20 nt, Human
ugggagagagaagggugggg

SEQ ID NO: 984833 - RNA, 22 nt, Human
ugggagagagaagggugggggg

SEQ ID NO: 984834 - RNA, 22 nt, Human
uggggguggagggggugcucug

SEQ ID NO: 984835 - RNA, 19 nt, Human
ugggguguccacacgucuc

SEQ ID NO: 984836 - RNA, 22 nt, Human
uguggucucacgcacgcacaca

SEQ ID NO: 984837 - RNA, 25 nt, Human
uguguccacagaucuguggucucac

SEQ ID NO: 984838 - RNA, 24 nt, Human
aaaaauacaaacaacaacaaaaac

SEQ ID NO: 984839 - RNA, 23 nt, Human
aaacaacaacaaaaaccuucaca

SEQ ID NO: 984840 - RNA, 21 nt, Human
aacagggaggaagaaagcugg

SEQ ID NO: 984841 - RNA, 23 nt, Human
aaccugccaagcucauuaaccga

SEQ ID NO: 984842 - RNA, 18 nt, Human
aagaaccugccaagcuca

SEQ ID NO: 984843 - RNA, 18 nt, Human
aagaauucagugagacaa

SEQ ID NO: 984844 - RNA, 22 nt, Human
aaggaaacaaaggaacgggucg

SEQ ID NO: 984845 - RNA, 18 nt, Human
aaggagacugccagagac

SEQ ID NO: 984846 - RNA, 21 nt, Human
aaguagccuuugcaaaggaag

SEQ ID NO: 984847 - RNA, 19 nt, Human
aauacaaacaacaacaaaa

SEQ ID NO: 984848 - RNA, 20 nt, Human
acaauuagaauacaucugga

SEQ ID NO: 984849 - RNA, 22 nt, Human
acaauuagaauacaucuggaac

SEQ ID NO: 984850 - RNA, 19 nt, Human
acacacacacuuaugugua

SEQ ID NO: 984851 - RNA, 26 nt, Human
acacagagaaaaaucaaaguugcccc

SEQ ID NO: 984852 - RNA, 22 nt, Human
acuccaugagguagaaaaauac

SEQ ID NO: 984853 - RNA, 19 nt, Human
agacugccagagaccagca

SEQ ID NO: 984854 - RNA, 25 nt, Human
agagcaaaggccuuuaguuauuuug

SEQ ID NO: 984855 - RNA, 24 nt, Human
agagcuuucccaagugcaaggcau

SEQ ID NO: 984856 - RNA, 19 nt, Human
agccucugguguuccccaa

SEQ ID NO: 984857 - RNA, 20 nt, Human
aggaagaaagcugggugggu

SEQ ID NO: 984858 - RNA, 21 nt, Human
aggcaccaggugggaaagggu

SEQ ID NO: 984859 - RNA, 24 nt, Human
aggcucuggggagaacucaggguc

SEQ ID NO: 984860 - RNA, 23 nt, Human
auccagaaaacaaguuucuugau

SEQ ID NO: 984861 - RNA, 23 nt, Human
augaaauauuuccagagcuuagg

SEQ ID NO: 984862 - RNA, 20 nt, Human
caaaaucaaggagacugcca

SEQ ID NO: 984863 - RNA, 20 nt, Human
caaaaucaaggagacugccg

SEQ ID NO: 984864 - RNA, 26 nt, Human
caaagcggaaaauauacaugguaccc

SEQ ID NO: 984865 - RNA, 22 nt, Human
caaaggaagcuaauggacagug

SEQ ID NO: 984866 - RNA, 21 nt, Human
caacaaacaggauuggcaucc

SEQ ID NO: 984867 - RNA, 20 nt, Human
cacauuuccacagugauuca

SEQ ID NO: 984868 - RNA, 24 nt, Human
cagacacuacacuugaagauuucc

SEQ ID NO: 984869 - RNA, 21 nt, Human
cagaguucucauuuuauucuc

SEQ ID NO: 984870 - RNA, 21 nt, Human
cagggcuagauuguuagcuga

SEQ ID NO: 984871 - RNA, 22 nt, Human
cauucucaucugaagacaaggg

SEQ ID NO: 984872 - RNA, 22 nt, Human
cccaacugacucagcccugcag

SEQ ID NO: 984873 - RNA, 19 nt, Human
ccccaggccucaaugucag

SEQ ID NO: 984874 - RNA, 24 nt, Human
cccccaagcugaacaacuaagagc

SEQ ID NO: 984875 - RNA, 18 nt, Human
ccgccgcgcccucgugcc

SEQ ID NO: 984876 - RNA, 18 nt, Human
ccugcagaugggacaucc

SEQ ID NO: 984877 - RNA, 20 nt, Human
ccuucuuguugccaaacuua

SEQ ID NO: 984878 - RNA, 18 nt, Human
cggcggcgggcggcggcc

SEQ ID NO: 984879 - RNA, 25 nt, Human
cucaucugaagacaaggguggccac

SEQ ID NO: 984880 - RNA, 26 nt, Human
cugacacacaacagggaggaagaaag

SEQ ID NO: 984881 - RNA, 18 nt, Human
cuuuuuuuuuuugagguc

SEQ ID NO: 984882 - RNA, 20 nt, Human
gagcccauccacugucugac

SEQ ID NO: 984883 - RNA, 19 nt, Human
gccccaagacaauagucuc

SEQ ID NO: 984884 - RNA, 19 nt, Human
ggaagaaagcugggugggu

SEQ ID NO: 984885 - RNA, 22 nt, Human
gggcaggaggaggcucugggga

SEQ ID NO: 984886 - RNA, 18 nt, Human
gguacuugagagcuggug

SEQ ID NO: 984887 - RNA, 18 nt, Human
gugagacaaagaaccugc

SEQ ID NO: 984888 - RNA, 21 nt, Human
guggggcaggaggaggcucug

SEQ ID NO: 984889 - RNA, 21 nt, Human
uaagcaaauguccuuuaccca

SEQ ID NO: 984890 - RNA, 26 nt, Human
uaagccccaggccucaaugucagagg

SEQ ID NO: 984891 - RNA, 22 nt, Human
uacaacacagagaaaaaucaaa

SEQ ID NO: 984892 - RNA, 21 nt, Human
uacacaauuagaauacaucug

SEQ ID NO: 984893 - RNA, 20 nt, Human
uacccaaaaucaaggagacu

SEQ ID NO: 984894 - RNA, 18 nt, Human
uagccucugguguucccc

SEQ ID NO: 984895 - RNA, 18 nt, Human
ucagaggagagcaaaggc

SEQ ID NO: 984896 - RNA, 22 nt, Human
ucaggaaggccauucagacucc

SEQ ID NO: 984897 - RNA, 20 nt, Human
ucauccagaaaacaaguuuc

SEQ ID NO: 984898 - RNA, 19 nt, Human
ucauccuggucccuccuug

SEQ ID NO: 984899 - RNA, 20 nt, Human
ucauuuuauucucccaguau

SEQ ID NO: 984900 - RNA, 21 nt, Human
uccaugagguagaaaaauaca

SEQ ID NO: 984901 - RNA, 24 nt, Human
uccaugauaagaauucagugagac

SEQ ID NO: 984902 - RNA, 19 nt, Human
ucccaagugcaaggcauaa

SEQ ID NO: 984903 - RNA, 19 nt, Human
uccccaacugacucagccc

SEQ ID NO: 984904 - RNA, 21 nt, Human
ucccucauguuuucaggacau

SEQ ID NO: 984905 - RNA, 20 nt, Human
ucugggagaauacuccauga

SEQ ID NO: 984906 - RNA, 21 nt, Human
ugaauacaccagugucaugaa

SEQ ID NO: 984907 - RNA, 23 nt, Human
ugacacacaacagggaggaagaa

SEQ ID NO: 984908 - RNA, 20 nt, Human
ugacaucauagccaugggca

SEQ ID NO: 984909 - RNA, 20 nt, Human
ugacucagcccugcagaugg

SEQ ID NO: 984910 - RNA, 18 nt, Human
ugagacaaagaaccugcc

SEQ ID NO: 984911 - RNA, 28 nt, Human
ugagagacuacaacacagagaaaaauca

SEQ ID NO: 984912 - RNA, 19 nt, Human
ugagugcuggauugugacc

SEQ ID NO: 984913 - RNA, 19 nt, Human
ugcagguaagcaaaugucc

SEQ ID NO: 984914 - RNA, 23 nt, Human
ugccccccaagcugaacaacuaa

SEQ ID NO: 984915 - RNA, 20 nt, Human
ugcuaagcagaaaaacuuaa

SEQ ID NO: 984916 - RNA, 18 nt, Human
ugguggggcaggaggagg

SEQ ID NO: 984917 - RNA, 20 nt, Human
ugucagaggagagcaaaggc

SEQ ID NO: 984918 - RNA, 22 nt, Human
ugucagaggagagcaaaggccu

SEQ ID NO: 984919 - RNA, 23 nt, Human
ugucagaggagagcaaaggccuu

SEQ ID NO: 984920 - RNA, 21 nt, Human
ugucaugaaauauuuccagag

SEQ ID NO: 984921 - RNA, 23 nt, Human
uguguacauacauuucauacaca

SEQ ID NO: 984922 - RNA, 18 nt, Human
uuacugagggauguucuc

SEQ ID NO: 984923 - RNA, 21 nt, Human
uuagcucacuccagaguucuc

SEQ ID NO: 984924 - RNA, 23 nt, Human
uuggccccaagacaauagucuca

SEQ ID NO: 984925 - RNA, 23 nt, Human
uuguugccaaacuuagaagaauc

SEQ ID NO: 984926 - RNA, 20 nt, Human
uuuacaucuaaaaaauacaa

SEQ ID NO: 984927 - RNA, 24 nt, Human
uuuccuagcggcugcugcugcugu

SEQ ID NO: 984928 - RNA, 20 nt, Human
aaucaggacagugcaggccu

SEQ ID NO: 984929 - RNA, 18 nt, Human
acacccccacgagccgcc

SEQ ID NO: 984930 - RNA, 21 nt, Human
acacccccacgagccgccaga

SEQ ID NO: 984931 - RNA, 23 nt, Human
acagucaaugggaaggcgccgac

SEQ ID NO: 984932 - RNA, 25 nt, Human
accccaacacccccacgagccgcca

SEQ ID NO: 984933 - RNA, 21 nt, Human
accccgcucacacucugacac

SEQ ID NO: 984934 - RNA, 19 nt, Human
agaagaacugucugcccuu

SEQ ID NO: 984935 - RNA, 18 nt, Human
agagaaggccaggcccug

SEQ ID NO: 984936 - RNA, 21 nt, Human
caagguuccacagguuggaau

SEQ ID NO: 984937 - RNA, 23 nt, Human
cacccccacgagccgccagaggc

SEQ ID NO: 984938 - RNA, 20 nt, Human
cacuccccucccucccccug

SEQ ID NO: 984939 - RNA, 25 nt, Human
caggcccuggguuccuggugcuccu

SEQ ID NO: 984940 - RNA, 18 nt, Human
cccagaagaacugucugc

SEQ ID NO: 984941 - RNA, 21 nt, Human
ccccaacacccccacgagccg

SEQ ID NO: 984942 - RNA, 23 nt, Human
ccccaacacccccacgagccgcc

SEQ ID NO: 984943 - RNA, 24 nt, Human
ccccacgagccgccagaggcuccu

SEQ ID NO: 984944 - RNA, 19 nt, Human
ccccagaagaacugucugc

SEQ ID NO: 984945 - RNA, 30 nt, Human
ccccgcucacacucugacacuccccucccu

SEQ ID NO: 984946 - RNA, 20 nt, Human
ccccggggaccccccaaggu

SEQ ID NO: 984947 - RNA, 24 nt, Human
ccccucccucccccugcggacccc

SEQ ID NO: 984948 - RNA, 21 nt, Human
cccucaaauuuggaauucccg

SEQ ID NO: 984949 - RNA, 22 nt, Human
ccgcccacagucaaugggaagg

SEQ ID NO: 984950 - RNA, 24 nt, Human
ccggccaaucaggacagugcagga

SEQ ID NO: 984951 - RNA, 22 nt, Human
ccugccccccaggcugcuggga

SEQ ID NO: 984952 - RNA, 19 nt, Human
cgccgaccccggggacccc

SEQ ID NO: 984953 - RNA, 20 nt, Human
cucacacucugacacucccc

SEQ ID NO: 984954 - RNA, 18 nt, Human
cugucugcccuucugcau

SEQ ID NO: 984955 - RNA, 22 nt, Human
gaaggccaggcccuggguuccu

SEQ ID NO: 984956 - RNA, 22 nt, Human
gcaggccucccccaggcauuga

SEQ ID NO: 984957 - RNA, 23 nt, Human
gcaggccucccccaggcauugag

SEQ ID NO: 984958 - RNA, 21 nt, Human
gcucucccuccccggcgccag

SEQ ID NO: 984959 - RNA, 19 nt, Human
ggaauucccguaccccgcu

SEQ ID NO: 984960 - RNA, 22 nt, Human
ggcugcugggagagaaggccag

SEQ ID NO: 984961 - RNA, 23 nt, Human
ucaggacagugcaggccuccccc

SEQ ID NO: 984962 - RNA, 18 nt, Human
ucccccugcggaccccaa

SEQ ID NO: 984963 - RNA, 23 nt, Human
ucccccugcggaccccaacaccc

SEQ ID NO: 984964 - RNA, 26 nt, Human
uccccggcgccagagccgggaggccc

SEQ ID NO: 984965 - RNA, 18 nt, Human
ucccucccccugcggacc

SEQ ID NO: 984966 - RNA, 21 nt, Human
ugaaugagcagcugccaaccc

SEQ ID NO: 984967 - RNA, 21 nt, Human
ugacacuccccucccuccccc

SEQ ID NO: 984968 - RNA, 19 nt, Human
ugaggaagggguccgacug

SEQ ID NO: 984969 - RNA, 28 nt, Human
ugcaggccucccccaggcauugaggccu

SEQ ID NO: 984970 - RNA, 19 nt, Human
ugggaaggcgccgaccccg

SEQ ID NO: 984971 - RNA, 18 nt, Human
uuggaauucccguacccc

SEQ ID NO: 984972 - RNA, 29 nt, Human
uuuuuuuuaugcucuuuuuuuguuuuuuu

SEQ ID NO: 984973 - RNA, 26 nt, Human
uuuuuuuuuuuuuuuuaugcucuuuu

SEQ ID NO: 984974 - RNA, 23 nt, Human
aaggggugggggaucaggggcag

SEQ ID NO: 984975 - RNA, 22 nt, Human
acaaccucccccacuggccccc

SEQ ID NO: 984976 - RNA, 19 nt, Human
agaggaagaaagaggucaa

SEQ ID NO: 984977 - RNA, 21 nt, Human
aggcaaggggugggggaucag

SEQ ID NO: 984978 - RNA, 23 nt, Human
aggcaaggggugggggaucaggg

SEQ ID NO: 984979 - RNA, 25 nt, Human
aggcaaggggugggggaucaggggc

SEQ ID NO: 984980 - RNA, 22 nt, Human
aggcagcugaagggcucagggc

SEQ ID NO: 984981 - RNA, 23 nt, Human
aggcagcugaagggcucagggcu

SEQ ID NO: 984982 - RNA, 20 nt, Human
aggggugggggaucaggggc

SEQ ID NO: 984983 - RNA, 23 nt, Human
augucagggguugugcaggcagc

SEQ ID NO: 984984 - RNA, 22 nt, Human
caaccucccccacuggccccca

SEQ ID NO: 984985 - RNA, 22 nt, Human
caaggggugggggaucaggggc

SEQ ID NO: 984986 - RNA, 23 nt, Human
caaggggugggggaucaggggca

SEQ ID NO: 984987 - RNA, 23 nt, Human
cacaggcucaguggcagcacugg

SEQ ID NO: 984988 - RNA, 18 nt, Human
cacauuuggcagauugag

SEQ ID NO: 984989 - RNA, 23 nt, Human
caccagcagccaaugucaggggu

SEQ ID NO: 984990 - RNA, 22 nt, Human
cagaguucaaaucuagaacccu

SEQ ID NO: 984991 - RNA, 21 nt, Human
cagcacauuuggcagauugag

SEQ ID NO: 984992 - RNA, 26 nt, Human
cagcuggccucugcucccuuccaguc

SEQ ID NO: 984993 - RNA, 21 nt, Human
cagucuugcuguaauugggag

SEQ ID NO: 984994 - RNA, 22 nt, Human
caguuccagggaaacagggccu

SEQ ID NO: 984995 - RNA, 19 nt, Human
ccagcuggccucugcuccc

SEQ ID NO: 984996 - RNA, 23 nt, Human
ccagggaaacagggccuuucucc

SEQ ID NO: 984997 - RNA, 18 nt, Human
cccccagcuggccucugc

SEQ ID NO: 984998 - RNA, 18 nt, Human
cccuuugcugccaacgcu

SEQ ID NO: 984999 - RNA, 22 nt, Human
cccuuugcugccaacgcuuccu

SEQ ID NO: 985000 - RNA, 25 nt, Human
ccucugcucccuuccagucacuuca

SEQ ID NO: 985001 - RNA, 21 nt, Human
ccugcacaggcucaguggcag

SEQ ID NO: 985002 - RNA, 18 nt, Human
cgggagaggcuggagagg

SEQ ID NO: 985003 - RNA, 26 nt, Human
cugcacaggcucaguggcagcacugg

SEQ ID NO: 985004 - RNA, 19 nt, Human
cuggcccccagcuggccuc

SEQ ID NO: 985005 - RNA, 26 nt, Human
cuguaauugggagaaaaccggggucc

SEQ ID NO: 985006 - RNA, 25 nt, Human
gcccccagcuggccucugcucccuu

SEQ ID NO: 985007 - RNA, 21 nt, Human
ggaaacaaccucccccacugg

SEQ ID NO: 985008 - RNA, 19 nt, Human
ggacaggguggccagaggc

SEQ ID NO: 985009 - RNA, 21 nt, Human
ggggugggggaucaggggcag

SEQ ID NO: 985010 - RNA, 21 nt, Human
gggugguggggggaggacagg

SEQ ID NO: 985011 - RNA, 19 nt, Human
ggugaaagaggaagaaaga

SEQ ID NO: 985012 - RNA, 20 nt, Human
ggugguggggggaggacagg

SEQ ID NO: 985013 - RNA, 19 nt, Human
guggaaacaaccuccccca

SEQ ID NO: 985014 - RNA, 19 nt, Human
guggccagaggcaaggggu

SEQ ID NO: 985015 - RNA, 20 nt, Human
uaagggcaucaucucccuuu

SEQ ID NO: 985016 - RNA, 21 nt, Human
uaggccugagggugguggggg

SEQ ID NO: 985017 - RNA, 26 nt, Human
ucacucacaggaagguggguaagggc

SEQ ID NO: 985018 - RNA, 23 nt, Human
ucagggcucccugccucacaugg

SEQ ID NO: 985019 - RNA, 21 nt, Human
ucaggggcaguggucauucuu

SEQ ID NO: 985020 - RNA, 27 nt, Human
ucaguggcagcacuggccacuugccuu

SEQ ID NO: 985021 - RNA, 18 nt, Human
ucauucuuagcaguucca

SEQ ID NO: 985022 - RNA, 24 nt, Human
ucccaaaccccaacagagugccuc

SEQ ID NO: 985023 - RNA, 23 nt, Human
ucccaaguacccugcacaggcuc

SEQ ID NO: 985024 - RNA, 23 nt, Human
ucccaaguacccugcacaggcuu

SEQ ID NO: 985025 - RNA, 21 nt, Human
uggaaacaaccucccccacug

SEQ ID NO: 985026 - RNA, 18 nt, Human
uggcagcacuggccacuu

SEQ ID NO: 985027 - RNA, 18 nt, Human
uggccagaggcaaggggu

SEQ ID NO: 985028 - RNA, 20 nt, Human
ugggaaaauuggucccuggg

SEQ ID NO: 985029 - RNA, 22 nt, Human
ugggaaaauuggucccuggggc

SEQ ID NO: 985030 - RNA, 22 nt, Human
ugggagaaaacgagcugcagca

SEQ ID NO: 985031 - RNA, 18 nt, Human
ugguggggggaggacagg

SEQ ID NO: 985032 - RNA, 20 nt, Human
ugugcaggcagcugaagggg

SEQ ID NO: 985033 - RNA, 19 nt, Human
uucacagcagaguucaaau

SEQ ID NO: 985034 - RNA, 20 nt, Human
uucacagcagaguucaaauc

SEQ ID NO: 985035 - RNA, 22 nt, Human
aaaacaccaguggagucuguaa

SEQ ID NO: 985036 - RNA, 19 nt, Human
aaacgaaacauacccagaa

SEQ ID NO: 985037 - RNA, 20 nt, Human
aacuguuucugagccuucug

SEQ ID NO: 985038 - RNA, 25 nt, Human
acagcaaugggaaacgaaacauacc

SEQ ID NO: 985039 - RNA, 18 nt, Human
acagggcgcccgugccuc

SEQ ID NO: 985040 - RNA, 20 nt, Human
accccgccuguucccgcagc

SEQ ID NO: 985041 - RNA, 22 nt, Human
accccgccuguucccgcagcug

SEQ ID NO: 985042 - RNA, 20 nt, Human
agaagaaaagagcugccaaa

SEQ ID NO: 985043 - RNA, 19 nt, Human
agccaggagugcagacauc

SEQ ID NO: 985044 - RNA, 22 nt, Human
caccuccuccgcgcacagggcg

SEQ ID NO: 985045 - RNA, 21 nt, Human
cacgugcucagcuucuccucc

SEQ ID NO: 985046 - RNA, 23 nt, Human
cagcaaugggaaacgaaacauac

SEQ ID NO: 985047 - RNA, 19 nt, Human
cagcagcuaguucuccucc

SEQ ID NO: 985048 - RNA, 23 nt, Human
cagcuucuccuccuccccucggu

SEQ ID NO: 985049 - RNA, 20 nt, Human
cauggaaugagcaacagcaa

SEQ ID NO: 985050 - RNA, 22 nt, Human
cauggggcuucuguuguccagc

SEQ ID NO: 985051 - RNA, 25 nt, Human
ccaguggagucuguaagucccuccu

SEQ ID NO: 985052 - RNA, 21 nt, Human
cccggccgccuucaccuccuc

SEQ ID NO: 985053 - RNA, 22 nt, Human
cccggccgccuucaccuccucc

SEQ ID NO: 985054 - RNA, 23 nt, Human
cccggccgccuucaccuccuccg

SEQ ID NO: 985055 - RNA, 21 nt, Human
cccgugccucccggucucccu

SEQ ID NO: 985056 - RNA, 23 nt, Human
cccgugccucccggucucccucc

SEQ ID NO: 985057 - RNA, 21 nt, Human
ccuccgcgcacagggcgcccg

SEQ ID NO: 985058 - RNA, 21 nt, Human
ccucuucccacuggcccuucc

SEQ ID NO: 985059 - RNA, 18 nt, Human
cgcugggauggaggagcc

SEQ ID NO: 985060 - RNA, 21 nt, Human
cuacagcaaugggaaacgaaa

SEQ ID NO: 985061 - RNA, 21 nt, Human
cucagcuucuccuccuccccu

SEQ ID NO: 985062 - RNA, 20 nt, Human
cucccuccgcccaccccgcc

SEQ ID NO: 985063 - RNA, 27 nt, Human
cuccgcccaccccgccuguucccgcag

SEQ ID NO: 985064 - RNA, 23 nt, Human
cuccucagcaaacgaggucccgg

SEQ ID NO: 985065 - RNA, 22 nt, Human
cugagccuucuguccucaauaa

SEQ ID NO: 985066 - RNA, 31 nt, Human
cuguaagucccuccucagcaaacgagguccu

SEQ ID NO: 985067 - RNA, 21 nt, Human
cuucuguuguccagcugcagc

SEQ ID NO: 985068 - RNA, 20 nt, Human
gagugcagacaucuauuucc

SEQ ID NO: 985069 - RNA, 18 nt, Human
gcaacagcaaaacaccag

SEQ ID NO: 985070 - RNA, 18 nt, Human
gcacggggaagggucuga

SEQ ID NO: 985071 - RNA, 19 nt, Human
gcugguccagcccucgugc

SEQ ID NO: 985072 - RNA, 19 nt, Human
ggaggaacucgcacccaga

SEQ ID NO: 985073 - RNA, 21 nt, Human
ggagucuguaagucccuccuc

SEQ ID NO: 985074 - RNA, 25 nt, Human
ggcaaugucacacgugcucagcuuc

SEQ ID NO: 985075 - RNA, 22 nt, Human
ggccccggccgccuucaccucc

SEQ ID NO: 985076 - RNA, 24 nt, Human
gggacagcggugcacugucugagc

SEQ ID NO: 985077 - RNA, 20 nt, Human
gggcacgcgcacaggccagg

SEQ ID NO: 985078 - RNA, 20 nt, Human
gggugaagccgagcagcggg

SEQ ID NO: 985079 - RNA, 20 nt, Human
ggugcacaggacggccgcug

SEQ ID NO: 985080 - RNA, 21 nt, Human
gucccggaaggcaaggcagca

SEQ ID NO: 985081 - RNA, 23 nt, Human
uaagaaaugcuacagcaauggga

SEQ ID NO: 985082 - RNA, 25 nt, Human
uacagcaaugggaaacgaaacauac

SEQ ID NO: 985083 - RNA, 22 nt, Human
ucacaaacuguuucugagccuu

SEQ ID NO: 985084 - RNA, 22 nt, Human
ucagugcagcaguauguuucca

SEQ ID NO: 985085 - RNA, 18 nt, Human
uccagcugcagccaggag

SEQ ID NO: 985086 - RNA, 20 nt, Human
uccaggauaggaaugugagu

SEQ ID NO: 985087 - RNA, 24 nt, Human
ucccggucucccuccgcccacccc

SEQ ID NO: 985088 - RNA, 20 nt, Human
ucuguaagucccuccucagc

SEQ ID NO: 985089 - RNA, 18 nt, Human
ucugucacaaacuguuuc

SEQ ID NO: 985090 - RNA, 22 nt, Human
ugccaaagaugcauggaaugag

SEQ ID NO: 985091 - RNA, 19 nt, Human
ugcccgcgccuuagucugg

SEQ ID NO: 985092 - RNA, 19 nt, Human
ugggugaagccgagcagcg

SEQ ID NO: 985093 - RNA, 22 nt, Human
ugucacaaacuguuucugagcc

SEQ ID NO: 985094 - RNA, 21 nt, Human
uguucccgcagcugcccgcgc

SEQ ID NO: 985095 - RNA, 19 nt, Human
uguuguccagcugcagcca

SEQ ID NO: 985096 - RNA, 19 nt, Human
uuccagcgcugggauggag

SEQ ID NO: 985097 - RNA, 23 nt, Human
uuccucuucccacuggcccuucc

SEQ ID NO: 985098 - RNA, 23 nt, Human
uuuuuuuuuuuuuuugaccugga

SEQ ID NO: 985099 - RNA, 18 nt, Human
uuuuuuuuuuuuuuuuug

SEQ ID NO: 985100 - RNA, 24 nt, Human
uuuuuuuuuuuuuuuuugaccugg

SEQ ID NO: 985101 - RNA, 18 nt, Human
aaaaaugacaaauccagu

SEQ ID NO: 985102 - RNA, 23 nt, Human
acaaauccaguaauaaucauaaa

SEQ ID NO: 985103 - RNA, 22 nt, Human
aguaauaaucauaaacaguucc

SEQ ID NO: 985104 - RNA, 22 nt, Human
caaaaaugacaaauccaguaau

SEQ ID NO: 985105 - RNA, 22 nt, Human
caccuuccacucccaaccuacu

SEQ ID NO: 985106 - RNA, 21 nt, Human
cagcaugagacuuuuagauau

SEQ ID NO: 985107 - RNA, 18 nt, Human
ccaccaccuuccacuccc

SEQ ID NO: 985108 - RNA, 23 nt, Human
ccaccaccuuccacucccaaccu

SEQ ID NO: 985109 - RNA, 18 nt, Human
cccacaugcggagcagga

SEQ ID NO: 985110 - RNA, 18 nt, Human
ccccacaugcggagcagg

SEQ ID NO: 985111 - RNA, 23 nt, Human
ccuuaagaaauguauuugaaaag

SEQ ID NO: 985112 - RNA, 26 nt, Human
ccuuuuuuuuuuuuuuuuuuuuuuuu

SEQ ID NO: 985113 - RNA, 21 nt, Human
gccaccaccuuccacucccaa

SEQ ID NO: 985114 - RNA, 24 nt, Human
ggagcaggagccaccaccuuccac

SEQ ID NO: 985115 - RNA, 21 nt, Human
uacacuuagaggaaacaauuc

SEQ ID NO: 985116 - RNA, 23 nt, Human
uagguggcugugaaaaauuaccc

SEQ ID NO: 985117 - RNA, 21 nt, Human
uauauuuauuuccucuuagaa

SEQ ID NO: 985118 - RNA, 22 nt, Human
uauuaguaagaaucucuaaacc

SEQ ID NO: 985119 - RNA, 20 nt, Human
uauuuuacacauaaacugaa

SEQ ID NO: 985120 - RNA, 21 nt, Human
uauuuuacacauaaacugaau

SEQ ID NO: 985121 - RNA, 20 nt, Human
uccaaaggugaaaaaauuuc

SEQ ID NO: 985122 - RNA, 24 nt, Human
uccccacaugcggagcaggagcug

SEQ ID NO: 985123 - RNA, 18 nt, Human
uccuuuuuuuuuuuuuuu

SEQ ID NO: 985124 - RNA, 21 nt, Human
ucuaauauauucuccuccaaa

SEQ ID NO: 985125 - RNA, 18 nt, Human
ucuacaaagcagcagcaa

SEQ ID NO: 985126 - RNA, 25 nt, Human
uggcaaaacaguacacacugugaaa

SEQ ID NO: 985127 - RNA, 21 nt, Human
uuaacauuucuucucaucauc

SEQ ID NO: 985128 - RNA, 19 nt, Human
uuuaaaaucauucuuuccc

SEQ ID NO: 985129 - RNA, 18 nt, Human
uuuacaguuuuuuacuuu

SEQ ID NO: 985130 - RNA, 25 nt, Human
uuuuuuuuuuuuuuuuuuaauuuuu

SEQ ID NO: 985131 - RNA, 26 nt, Human
aaaagaaaaagaacaauaacacagaa

SEQ ID NO: 985132 - RNA, 21 nt, Human
aacacuuuuuacauaaaacau

SEQ ID NO: 985133 - RNA, 23 nt, Human
aagaaaaagaacaauaacacaga

SEQ ID NO: 985134 - RNA, 24 nt, Human
acuguauuuuaacacuaaagaaaa

SEQ ID NO: 985135 - RNA, 23 nt, Human
acuuagaagaauauucugaggag

SEQ ID NO: 985136 - RNA, 24 nt, Human
agaauaaagcuuuaucuucguauu

SEQ ID NO: 985137 - RNA, 19 nt, Human
aggagaagcaaaaaagacu

SEQ ID NO: 985138 - RNA, 20 nt, Human
aggaguguuugaaagcucug

SEQ ID NO: 985139 - RNA, 23 nt, Human
auaacacagaacacaguauucuu

SEQ ID NO: 985140 - RNA, 25 nt, Human
auguauuuggugcugaagauaaacc

SEQ ID NO: 985141 - RNA, 24 nt, Human
auugcaaguuacguuuuguaggag

SEQ ID NO: 985142 - RNA, 21 nt, Human
caaaaaagacuggcugcgacg

SEQ ID NO: 985143 - RNA, 19 nt, Human
caaaguuacuucaucaaaa

SEQ ID NO: 985144 - RNA, 19 nt, Human
caacaauaauaaacuggca

SEQ ID NO: 985145 - RNA, 20 nt, Human
caccuucagccauccacugg

SEQ ID NO: 985146 - RNA, 22 nt, Human
cacuaaaaagaaaaagaacaau

SEQ ID NO: 985147 - RNA, 22 nt, Human
gaaaaagaacaauaacacagaa

SEQ ID NO: 985148 - RNA, 19 nt, Human
gaaagaaagaagauaacug

SEQ ID NO: 985149 - RNA, 20 nt, Human
gaagauaaacacuuuuuaca

SEQ ID NO: 985150 - RNA, 20 nt, Human
uaaguccuugguauauaugc

SEQ ID NO: 985151 - RNA, 24 nt, Human
uaugacagaaucaugaagacuugc

SEQ ID NO: 985152 - RNA, 23 nt, Human
uccaacaauaauaaacuggcaaa

SEQ ID NO: 985153 - RNA, 26 nt, Human
uccacacacuaaaaagaaaaagaaca

SEQ ID NO: 985154 - RNA, 18 nt, Human
ucugaggaguguuugaaa

SEQ ID NO: 985155 - RNA, 20 nt, Human
ugacagaaucaugaagacuu

SEQ ID NO: 985156 - RNA, 22 nt, Human
ugcgacgaaagaaagaagauaa

SEQ ID NO: 985157 - RNA, 19 nt, Human
uggugcugaagauaaacac

SEQ ID NO: 985158 - RNA, 20 nt, Human
uggugcugaagauaaacacu

SEQ ID NO: 985159 - RNA, 22 nt, Human
uuacuucaucaaaauacuuaga

SEQ ID NO: 985160 - RNA, 23 nt, Human
uuagaagaauauucugaggagug

SEQ ID NO: 985161 - RNA, 24 nt, Human
uuuuuuuuuuuuuuucauauuggg

SEQ ID NO: 985162 - RNA, 23 nt, Human
acagaagcaaacugcugcugggu

SEQ ID NO: 985163 - RNA, 18 nt, Human
cagcggcagcggcaaggg

SEQ ID NO: 985164 - RNA, 23 nt, Human
caggacaucuuccaccuuguuuu

SEQ ID NO: 985165 - RNA, 22 nt, Human
cugcuggguuacaugucuacgu

SEQ ID NO: 985166 - RNA, 20 nt, Human
uaauucaggacaucuuccac

SEQ ID NO: 985167 - RNA, 24 nt, Human
uaggcugauuaaucaguggacaac

SEQ ID NO: 985168 - RNA, 22 nt, Human
ucuguaauacaauguggugaaa

SEQ ID NO: 985169 - RNA, 24 nt, Human
ugcugcuggguuacaugucuacgu

SEQ ID NO: 985170 - RNA, 23 nt, Human
aaaaaaaaaacacauucaaauaa

SEQ ID NO: 985171 - RNA, 22 nt, Human
aaaaaaaaacacauucaaauaa

SEQ ID NO: 985172 - RNA, 22 nt, Human
aaaaucacaaauaaggcuucug

SEQ ID NO: 985173 - RNA, 20 nt, Human
aaacucggcacggggcagua

SEQ ID NO: 985174 - RNA, 23 nt, Human
acauauguuagaauuagaaaccu

SEQ ID NO: 985175 - RNA, 23 nt, Human
acggaaaaauggcuuucuuucuc

SEQ ID NO: 985176 - RNA, 23 nt, Human
aggaggcggaggaggagcagcgg

SEQ ID NO: 985177 - RNA, 20 nt, Human
aggaugaggaguaagagaga

SEQ ID NO: 985178 - RNA, 24 nt, Human
aggcaaaugguaaaaacacaugga

SEQ ID NO: 985179 - RNA, 23 nt, Human
aguaagagagaaacgaggagaga

SEQ ID NO: 985180 - RNA, 20 nt, Human
agugacagaaaaguaugaga

SEQ ID NO: 985181 - RNA, 26 nt, Human
auagaccacuccccaaagucugcaaa

SEQ ID NO: 985182 - RNA, 25 nt, Human
caaaaauggaagcuuccacucccaa

SEQ ID NO: 985183 - RNA, 25 nt, Human
cacaauuugaucuucaguguugucu

SEQ ID NO: 985184 - RNA, 21 nt, Human
cacggggcaguagggcgggcg

SEQ ID NO: 985185 - RNA, 25 nt, Human
caucauggaaaaaaaaaacacauuc

SEQ ID NO: 985186 - RNA, 23 nt, Human
ccaccaaaauucuuguaaaugaa

SEQ ID NO: 985187 - RNA, 24 nt, Human
cccaaaaucacaaauaaggcuucu

SEQ ID NO: 985188 - RNA, 20 nt, Human
ccccaaagucugcaaaacac

SEQ ID NO: 985189 - RNA, 19 nt, Human
cccccuccccuuuucuucc

SEQ ID NO: 985190 - RNA, 18 nt, Human
ccuuucccacaacaaaau

SEQ ID NO: 985191 - RNA, 23 nt, Human
cuaaacacaauuugaucuucagu

SEQ ID NO: 985192 - RNA, 19 nt, Human
cucccaaaaucacaaauaa

SEQ ID NO: 985193 - RNA, 19 nt, Human
cuugaaauaucuuaauaac

SEQ ID NO: 985194 - RNA, 18 nt, Human
ggaaggaggcggaggagg

SEQ ID NO: 985195 - RNA, 19 nt, Human
ggcaggcuuacagugacag

SEQ ID NO: 985196 - RNA, 19 nt, Human
ggcggaggaggagcagcgg

SEQ ID NO: 985197 - RNA, 19 nt, Human
gggaaggaggcggaggagg

SEQ ID NO: 985198 - RNA, 28 nt, Human
ggggcaguagggcgggcgcgggcagggg

SEQ ID NO: 985199 - RNA, 18 nt, Human
gugauucuugccuucccc

SEQ ID NO: 985200 - RNA, 21 nt, Human
uaaacaaaaauuuuauccaaa

SEQ ID NO: 985201 - RNA, 21 nt, Human
uaaggcaaaugguaaaaacac

SEQ ID NO: 985202 - RNA, 18 nt, Human
uaaggcuucugguuuucu

SEQ ID NO: 985203 - RNA, 26 nt, Human
uacagugacagaaaaguaugagaaca

SEQ ID NO: 985204 - RNA, 27 nt, Human
uaccaaaauuuaaacaaaaggacauac

SEQ ID NO: 985205 - RNA, 22 nt, Human
uagaccacuccccaaagucugc

SEQ ID NO: 985206 - RNA, 23 nt, Human
ucaggauucauuuuugacacaaa

SEQ ID NO: 985207 - RNA, 20 nt, Human
ucaucuugaaauaucuuaau

SEQ ID NO: 985208 - RNA, 22 nt, Human
uccacucccaaaaucacaaaua

SEQ ID NO: 985209 - RNA, 26 nt, Human
uccccaaagucugcaaaacacugccu

SEQ ID NO: 985210 - RNA, 20 nt, Human
uccccaaagucugcaaaacc

SEQ ID NO: 985211 - RNA, 23 nt, Human
ucuugccuucccccuccccuuuu

SEQ ID NO: 985212 - RNA, 19 nt, Human
ugacagaaaaguaugagaa

SEQ ID NO: 985213 - RNA, 18 nt, Human
uggaagcuuccacuccca

SEQ ID NO: 985214 - RNA, 20 nt, Human
ugggaggaugaggaguaaga

SEQ ID NO: 985215 - RNA, 21 nt, Human
uguaaaugaagcaggacuuga

SEQ ID NO: 985216 - RNA, 22 nt, Human
uuaaacaaaaauuuuauccaaa

SEQ ID NO: 985217 - RNA, 22 nt, Human
uuagaauuagaaaccuguaaaa

SEQ ID NO: 985218 - RNA, 21 nt, Human
uuagaugcccaccaaaauucu

SEQ ID NO: 985219 - RNA, 18 nt, Human
uucccccuccccuuuucu

SEQ ID NO: 985220 - RNA, 18 nt, Human
uugauuucaaauucuguc

SEQ ID NO: 985221 - RNA, 22 nt, Human
uuuguauagauaaaaaucuacc

SEQ ID NO: 985222 - RNA, 18 nt, Human
aaaaaaaccaaaaaccag

SEQ ID NO: 985223 - RNA, 22 nt, Human
aaaaaaaccaaaaaccaguuug

SEQ ID NO: 985224 - RNA, 23 nt, Human
aaaaaaccaaaaaccaguuuguu

SEQ ID NO: 985225 - RNA, 26 nt, Human
aacaaguuuuauuuaaauaaggguuu

SEQ ID NO: 985226 - RNA, 18 nt, Human
accccauccucuccucuc

SEQ ID NO: 985227 - RNA, 22 nt, Human
acugaaggggaaaaaaaaacca

SEQ ID NO: 985228 - RNA, 19 nt, Human
aggaaauccucacuuaagc

SEQ ID NO: 985229 - RNA, 21 nt, Human
aggggaaaaaaaaaccaaaaa

SEQ ID NO: 985230 - RNA, 19 nt, Human
agucagguuggagacacca

SEQ ID NO: 985231 - RNA, 20 nt, Human
aguuuuauuuaaauaagggu

SEQ ID NO: 985232 - RNA, 21 nt, Human
caagccagauguccuaucacc

SEQ ID NO: 985233 - RNA, 20 nt, Human
caaguuaaaagcggacccca

SEQ ID NO: 985234 - RNA, 23 nt, Human
caccaaaagcucccuucuaguag

SEQ ID NO: 985235 - RNA, 20 nt, Human
cagcauggcucuuuucaguu

SEQ ID NO: 985236 - RNA, 21 nt, Human
cagcuagcuacaugacugaug

SEQ ID NO: 985237 - RNA, 20 nt, Human
cauuauacaagcugugaggg

SEQ ID NO: 985238 - RNA, 20 nt, Human
ccaaguuaaaagcggacccc

SEQ ID NO: 985239 - RNA, 21 nt, Human
ccauccucuccucucagauuc

SEQ ID NO: 985240 - RNA, 25 nt, Human
ccccaaaugguuacauuauacaagc

SEQ ID NO: 985241 - RNA, 23 nt, Human
ccuuaccccauccucuccucuca

SEQ ID NO: 985242 - RNA, 19 nt, Human
cgagggggcucaaggggga

SEQ ID NO: 985243 - RNA, 18 nt, Human
cucacauucugauguuug

SEQ ID NO: 985244 - RNA, 23 nt, Human
cucucagauucaccgaggacugu

SEQ ID NO: 985245 - RNA, 24 nt, Human
cuuaccccauccucuccucucaga

SEQ ID NO: 985246 - RNA, 19 nt, Human
gaaaaaaaaaccaaaaacc

SEQ ID NO: 985247 - RNA, 23 nt, Human
gaaggcggcggcggcgguggcgg

SEQ ID NO: 985248 - RNA, 22 nt, Human
gcgagggggcucaagggggagg

SEQ ID NO: 985249 - RNA, 24 nt, Human
gcggaaggcggcggcggcgguggc

SEQ ID NO: 985250 - RNA, 19 nt, Human
gcggcggcgguggcgggag

SEQ ID NO: 985251 - RNA, 24 nt, Human
gcggcggcgguggcgggagaaggc

SEQ ID NO: 985252 - RNA, 22 nt, Human
gcucaagggggaggcugcugaa

SEQ ID NO: 985253 - RNA, 21 nt, Human
gcucugggcuuggcugaaaca

SEQ ID NO: 985254 - RNA, 21 nt, Human
gcugcuauuaaguugcaagcu

SEQ ID NO: 985255 - RNA, 20 nt, Human
ggagacaccaggggaucuac

SEQ ID NO: 985256 - RNA, 18 nt, Human
ggcggcggcggcgguggc

SEQ ID NO: 985257 - RNA, 19 nt, Human
gggaaaaaaaaaccaaaaa

SEQ ID NO: 985258 - RNA, 19 nt, Human
gggaagcgagggggcucaa

SEQ ID NO: 985259 - RNA, 22 nt, Human
gggagagcugaggagguuccgg

SEQ ID NO: 985260 - RNA, 18 nt, Human
guuucaggcuugacacug

SEQ ID NO: 985261 - RNA, 24 nt, Human
uagucagguuggagacaccagggg

SEQ ID NO: 985262 - RNA, 22 nt, Human
ucaccgaggacuguucaggugg

SEQ ID NO: 985263 - RNA, 21 nt, Human
ucucuuaggguagggaacucu

SEQ ID NO: 985264 - RNA, 19 nt, Human
ugacaagggagagaaggga

SEQ ID NO: 985265 - RNA, 20 nt, Human
ugacaagggagagaagggaa

SEQ ID NO: 985266 - RNA, 25 nt, Human
ugccuuaccccauccucuccucuca

SEQ ID NO: 985267 - RNA, 26 nt, Human
ugucuggucgaacagaccuuuguggc

SEQ ID NO: 985268 - RNA, 20 nt, Human
ugugagguuuuuaaaccugu

SEQ ID NO: 985269 - RNA, 24 nt, Human
uguggcaagccagauggcggcucu

SEQ ID NO: 985270 - RNA, 20 nt, Human
uuaggguagggaacucugca

SEQ ID NO: 985271 - RNA, 23 nt, Human
uucaagacuagacagcauggcuc

SEQ ID NO: 985272 - RNA, 22 nt, Human
uucaggcuugacacugccaggc

SEQ ID NO: 985273 - RNA, 20 nt, Human
uuuuuuuucugaaaacaagu

SEQ ID NO: 985274 - RNA, 23 nt, Human
uuuuuuuuuucugaaaacaaguu

SEQ ID NO: 985275 - RNA, 18 nt, Human
uuuuuuuuuuuuuuucug

SEQ ID NO: 985276 - RNA, 18 nt, Human
caauucauaacugcccuc

SEQ ID NO: 985277 - RNA, 24 nt, Human
uauaaauucauuugauugcccaaa

SEQ ID NO: 985278 - RNA, 20 nt, Human
aaaaaaaaaauuagccggga

SEQ ID NO: 985279 - RNA, 24 nt, Human
aaaaaaaauuaacuugaaccaaaa

SEQ ID NO: 985280 - RNA, 20 nt, Human
aaacccugcuggccagcaaa

SEQ ID NO: 985281 - RNA, 22 nt, Human
aaaccuacauuuauugaaaaug

SEQ ID NO: 985282 - RNA, 20 nt, Human
aacacggugaaaccucgucu

SEQ ID NO: 985283 - RNA, 21 nt, Human
aacacggugaaaccucgucuc

SEQ ID NO: 985284 - RNA, 21 nt, Human
aagaagucauuuuuuuuuuaa

SEQ ID NO: 985285 - RNA, 21 nt, Human
aagcagagcuugcagugagcc

SEQ ID NO: 985286 - RNA, 24 nt, Human
aagcagagcuugcagugagccgag

SEQ ID NO: 985287 - RNA, 24 nt, Human
aauggcgugaacccaggaagcaga

SEQ ID NO: 985288 - RNA, 24 nt, Human
aauguuaguguauuaucaugugag

SEQ ID NO: 985289 - RNA, 18 nt, Human
acacggugaaaccucguc

SEQ ID NO: 985290 - RNA, 19 nt, Human
acacggugaaaccucgucu

SEQ ID NO: 985291 - RNA, 22 nt, Human
acacuaccacacuauccagccc

SEQ ID NO: 985292 - RNA, 20 nt, Human
acagagcgagacuccgucuc

SEQ ID NO: 985293 - RNA, 23 nt, Human
acagagcgagacuccgucucaaa

SEQ ID NO: 985294 - RNA, 24 nt, Human
acagagcgagacuccgucucaaaa

SEQ ID NO: 985295 - RNA, 20 nt, Human
acagcagaggcggccacaaa

SEQ ID NO: 985296 - RNA, 21 nt, Human
accacacuaccacacuaucca

SEQ ID NO: 985297 - RNA, 19 nt, Human
accacacuauccagcccuc

SEQ ID NO: 985298 - RNA, 21 nt, Human
acccugcuggccagcaaacag

SEQ ID NO: 985299 - RNA, 24 nt, Human
accucgucucuacuaagaauacaa

SEQ ID NO: 985300 - RNA, 24 nt, Human
acugcacuccagccugggcgacag

SEQ ID NO: 985301 - RNA, 26 nt, Human
acugcacuccagccugggcgacagag

SEQ ID NO: 985302 - RNA, 21 nt, Human
agaauggacaaccaugugaag

SEQ ID NO: 985303 - RNA, 24 nt, Human
agagcuugcagugagccgagaucg

SEQ ID NO: 985304 - RNA, 23 nt, Human
agaggcggccacaaacccugcug

SEQ ID NO: 985305 - RNA, 23 nt, Human
agccgggagugguggugggcgcc

SEQ ID NO: 985306 - RNA, 24 nt, Human
agccugggcgacagagcgagacuc

SEQ ID NO: 985307 - RNA, 24 nt, Human
aggcggguggaucauggggucagg

SEQ ID NO: 985308 - RNA, 19 nt, Human
aggcugaggcaggggaaug

SEQ ID NO: 985309 - RNA, 20 nt, Human
aggcugaggcggguggauca

SEQ ID NO: 985310 - RNA, 22 nt, Human
aggcugaggcggguggaucaug

SEQ ID NO: 985311 - RNA, 24 nt, Human
aucgugccacugcacuccagccug

SEQ ID NO: 985312 - RNA, 22 nt, Human
auguuaguguauuaucauguga

SEQ ID NO: 985313 - RNA, 24 nt, Human
caaacacaguaaacuauucugaua

SEQ ID NO: 985314 - RNA, 18 nt, Human
caaacccugcuggccagc

SEQ ID NO: 985315 - RNA, 23 nt, Human
caaccaugugaagcagcucaggu

SEQ ID NO: 985316 - RNA, 23 nt, Human
cacacuaccacacuauccagccc

SEQ ID NO: 985317 - RNA, 24 nt, Human
cacacugcaaaccccuccacccac

SEQ ID NO: 985318 - RNA, 18 nt, Human
caccaccuugccuccagc

SEQ ID NO: 985319 - RNA, 27 nt, Human
caccccaaccagcaccaaggccucuac

SEQ ID NO: 985320 - RNA, 19 nt, Human
cacccugcugccugucacc

SEQ ID NO: 985321 - RNA, 21 nt, Human
cacccugcugccugucaccac

SEQ ID NO: 985322 - RNA, 24 nt, Human
cacccugcugccugucaccaccuu

SEQ ID NO: 985323 - RNA, 23 nt, Human
cacuccagccugggcgacagagc

SEQ ID NO: 985324 - RNA, 24 nt, Human
cacuccagccugggcgacagagcg

SEQ ID NO: 985325 - RNA, 27 nt, Human
cacugcaaaccccuccacccacccuca

SEQ ID NO: 985326 - RNA, 19 nt, Human
cacugcacuccagccuggg

SEQ ID NO: 985327 - RNA, 20 nt, Human
cacugcacuccagccugggc

SEQ ID NO: 985328 - RNA, 22 nt, Human
cacugcacuccagccugggcga

SEQ ID NO: 985329 - RNA, 23 nt, Human
cacugcacuccagccugggcgac

SEQ ID NO: 985330 - RNA, 24 nt, Human
cacugcacuccagccugggcgaca

SEQ ID NO: 985331 - RNA, 26 nt, Human
cacuggcaguuuccugaggaacugca

SEQ ID NO: 985332 - RNA, 21 nt, Human
cagaauggacaaccaugugaa

SEQ ID NO: 985333 - RNA, 18 nt, Human
cagcccccuccucaccag

SEQ ID NO: 985334 - RNA, 24 nt, Human
cagcuacucgggaggcugaggcag

SEQ ID NO: 985335 - RNA, 19 nt, Human
cagucagcauauggcugcg

SEQ ID NO: 985336 - RNA, 21 nt, Human
cauuuuuuuuuuaauugggaa

SEQ ID NO: 985337 - RNA, 20 nt, Human
ccacugcacuccagccuggg

SEQ ID NO: 985338 - RNA, 21 nt, Human
ccacugcacuccagccugggc

SEQ ID NO: 985339 - RNA, 21 nt, Human
ccacugcacuccagccugggc

SEQ ID NO: 985340 - RNA, 24 nt, Human
ccacugcacuccagccugggcgac

SEQ ID NO: 985341 - RNA, 21 nt, Human
cccauagucccagcuacucgg

SEQ ID NO: 985342 - RNA, 18 nt, Human
cccuccacccacccucaa

SEQ ID NO: 985343 - RNA, 21 nt, Human
cccuccacccacccucaacuc

SEQ ID NO: 985344 - RNA, 23 nt, Human
cccuccacccacccucaacucac

SEQ ID NO: 985345 - RNA, 22 nt, Human
ccucuagcacaggccugucugg

SEQ ID NO: 985346 - RNA, 23 nt, Human
ccugaggaacugcagcccccucc

SEQ ID NO: 985347 - RNA, 18 nt, Human
ccugcugccugucaccac

SEQ ID NO: 985348 - RNA, 21 nt, Human
ccuggcuaacacggugaaacc

SEQ ID NO: 985349 - RNA, 24 nt, Human
ccuggcuaacacggugaaaccucg

SEQ ID NO: 985350 - RNA, 22 nt, Human
ccugggcgacagagcgagacuc

SEQ ID NO: 985351 - RNA, 24 nt, Human
cgagaacauccuggcuaacacggu

SEQ ID NO: 985352 - RNA, 24 nt, Human
cgagaucgugccacugcacuccag

SEQ ID NO: 985353 - RNA, 22 nt, Human
cggguggaucauggggucagga

SEQ ID NO: 985354 - RNA, 18 nt, Human
cucaaaaaaaaaaaaaaa

SEQ ID NO: 985355 - RNA, 23 nt, Human
cuccagccuuuuaaaauaauuuu

SEQ ID NO: 985356 - RNA, 23 nt, Human
cuccaugucgccacccugcugcc

SEQ ID NO: 985357 - RNA, 19 nt, Human
cuccgucucaaaaaaaaaa

SEQ ID NO: 985358 - RNA, 25 nt, Human
cucuacuaagaauacaaaaaaaaaa

SEQ ID NO: 985359 - RNA, 20 nt, Human
cugcaaaccccuccacccac

SEQ ID NO: 985360 - RNA, 19 nt, Human
cugcagcccccuccucacc

SEQ ID NO: 985361 - RNA, 22 nt, Human
cugcaggccccaccccaaccag

SEQ ID NO: 985362 - RNA, 24 nt, Human
cugcugccugucaccaccuugccu

SEQ ID NO: 985363 - RNA, 26 nt, Human
cugcugccugucaccaccuugccucc

SEQ ID NO: 985364 - RNA, 18 nt, Human
cuggcuaacacggugaaa

SEQ ID NO: 985365 - RNA, 22 nt, Human
cuucagucagcauauggcugcg

SEQ ID NO: 985366 - RNA, 21 nt, Human
cuugaaccaaaacuuaaucug

SEQ ID NO: 985367 - RNA, 24 nt, Human
cuugcagugagccgagaucgugcc

SEQ ID NO: 985368 - RNA, 18 nt, Human
cuuuaagccccagaaugg

SEQ ID NO: 985369 - RNA, 19 nt, Human
gaaaccucgucucuacuaa

SEQ ID NO: 985370 - RNA, 18 nt, Human
gacuuuguccacuggcag

SEQ ID NO: 985371 - RNA, 18 nt, Human
gagcuugcagugagccga

SEQ ID NO: 985372 - RNA, 24 nt, Human
gcacuccagccugggcgacagagc

SEQ ID NO: 985373 - RNA, 23 nt, Human
gcaggucuaggcugaggcgggug

SEQ ID NO: 985374 - RNA, 24 nt, Human
gccacauucccacacugcaaaccc

SEQ ID NO: 985375 - RNA, 22 nt, Human
gccacugcacuccagccugggc

SEQ ID NO: 985376 - RNA, 24 nt, Human
gccacugcacuccagccugggcga

SEQ ID NO: 985377 - RNA, 23 nt, Human
gcccauagucccagcuacucggg

SEQ ID NO: 985378 - RNA, 20 nt, Human
gccgagaucgugccacugca

SEQ ID NO: 985379 - RNA, 19 nt, Human
gcuaacacggugaaaccuc

SEQ ID NO: 985380 - RNA, 24 nt, Human
ggguggaucauggggucaggagau

SEQ ID NO: 985381 - RNA, 24 nt, Human
uaacaaaccuacauuuauugaaaa

SEQ ID NO: 985382 - RNA, 24 nt, Human
uaacacggugaaaccucgucucua

SEQ ID NO: 985383 - RNA, 20 nt, Human
uaagaauacaaaaaaaaaaa

SEQ ID NO: 985384 - RNA, 20 nt, Human
uacuuggucuggucccaguu

SEQ ID NO: 985385 - RNA, 22 nt, Human
uagagugaauaagagcaaacac

SEQ ID NO: 985386 - RNA, 19 nt, Human
uaguagagugaauaagagc

SEQ ID NO: 985387 - RNA, 21 nt, Human
uauacuggguaauaaacuaaa

SEQ ID NO: 985388 - RNA, 20 nt, Human
ucaaaaaaaaaaaaaaaaaa

SEQ ID NO: 985389 - RNA, 21 nt, Human
ucaaaaaaaaaaaaaaaaaaa

SEQ ID NO: 985390 - RNA, 24 nt, Human
ucagcaggucuaggcugaggcggg

SEQ ID NO: 985391 - RNA, 20 nt, Human
ucaggucaacugcagggcca

SEQ ID NO: 985392 - RNA, 23 nt, Human
ucaguaacuaagacucugcaggc

SEQ ID NO: 985393 - RNA, 24 nt, Human
ucauggggucaggagaucgagaac

SEQ ID NO: 985394 - RNA, 20 nt, Human
uccaccacacuaccacacua

SEQ ID NO: 985395 - RNA, 21 nt, Human
uccaccacacuaccacacuau

SEQ ID NO: 985396 - RNA, 23 nt, Human
uccaccacacuaccacacuaucc

SEQ ID NO: 985397 - RNA, 25 nt, Human
uccacccacccucaacucacacaca

SEQ ID NO: 985398 - RNA, 18 nt, Human
uccacuggcaguuuccug

SEQ ID NO: 985399 - RNA, 19 nt, Human
uccacuggcaguuuccuga

SEQ ID NO: 985400 - RNA, 23 nt, Human
uccagccugggcgacagagcgag

SEQ ID NO: 985401 - RNA, 24 nt, Human
uccagccugggcgacagagcgaga

SEQ ID NO: 985402 - RNA, 20 nt, Human
ucccacacugcaaaccccuc

SEQ ID NO: 985403 - RNA, 23 nt, Human
ucccacacugcaaaccccuccac

SEQ ID NO: 985404 - RNA, 23 nt, Human
uccgucucaaaaaaaaaaaaaaa

SEQ ID NO: 985405 - RNA, 23 nt, Human
ucgugccacugcacuccagccug

SEQ ID NO: 985406 - RNA, 18 nt, Human
ucuauccaccacacuacc

SEQ ID NO: 985407 - RNA, 25 nt, Human
ucuccaugucgccacccugcugccu

SEQ ID NO: 985408 - RNA, 22 nt, Human
ucucuacuaagaauacaaaaaa

SEQ ID NO: 985409 - RNA, 19 nt, Human
ucugcaggccccaccccaa

SEQ ID NO: 985410 - RNA, 18 nt, Human
ugaagcagcucaggucaa

SEQ ID NO: 985411 - RNA, 21 nt, Human
ugaauaagagcaaacacagua

SEQ ID NO: 985412 - RNA, 22 nt, Human
ugagccgagaucgugccacugc

SEQ ID NO: 985413 - RNA, 25 nt, Human
ugaggaacugcagcccccuccucaa

SEQ ID NO: 985414 - RNA, 23 nt, Human
ugaggcaggggaauggcgugaac

SEQ ID NO: 985415 - RNA, 24 nt, Human
ugaggcaggggaauggcgugaacc

SEQ ID NO: 985416 - RNA, 25 nt, Human
ugaggcaggggaauggcgugaaccc

SEQ ID NO: 985417 - RNA, 22 nt, Human
ugaggcggguggaucauggggu

SEQ ID NO: 985418 - RNA, 24 nt, Human
ugaggcggguggaucaugggguca

SEQ ID NO: 985419 - RNA, 20 nt, Human
ugauuuauugagcuucccuc

SEQ ID NO: 985420 - RNA, 25 nt, Human
ugccuccagccuuuuaaaauaauuu

SEQ ID NO: 985421 - RNA, 27 nt, Human
ugccugucaccaccuugccuccagccu

SEQ ID NO: 985422 - RNA, 21 nt, Human
uggcaaugauaccaggauugu

SEQ ID NO: 985423 - RNA, 21 nt, Human
uguaagaaaucagagggcucu

SEQ ID NO: 985424 - RNA, 22 nt, Human
uguagaaaauguaaauaugaug

SEQ ID NO: 985425 - RNA, 22 nt, Human
uguuaugagaauuaaacuuuca

SEQ ID NO: 985426 - RNA, 24 nt, Human
uuagccgggagugguggugggcgc

SEQ ID NO: 985427 - RNA, 24 nt, Human
uugcaggccucccgacucagguuc

SEQ ID NO: 985428 - RNA, 21 nt, Human
uugcagugagccgagaucgug

SEQ ID NO: 985429 - RNA, 22 nt, Human
uugcagugagccgagaucgugc

SEQ ID NO: 985430 - RNA, 23 nt, Human
uuuauugagcuucccucucucca

SEQ ID NO: 985431 - RNA, 18 nt, Human
uuuuuuaguagagugaau

SEQ ID NO: 985432 - RNA, 22 nt, Human
uuuuuuuuuuuuuugcacugga

SEQ ID NO: 985433 - RNA, 23 nt, Human
uuuuuuuuuuuuuuuugcacugg

SEQ ID NO: 985434 - RNA, 22 nt, Human
uuuuuuuuuuuuuuuuugcacu

SEQ ID NO: 985435 - RNA, 25 nt, Human
uuuuuuuuuuuuuuuuuugcacugg

SEQ ID NO: 985436 - RNA, 20 nt, Human
uuuuuuuuuuuuuuuuuugg

SEQ ID NO: 985437 - RNA, 19 nt, Human
aaacaaaaacacaagcuuc

SEQ ID NO: 985438 - RNA, 19 nt, Human
aaacaaguguccagauucc

SEQ ID NO: 985439 - RNA, 19 nt, Human
aacugaaugauaaagaccc

SEQ ID NO: 985440 - RNA, 19 nt, Human
aagaagugaacuccgucag

SEQ ID NO: 985441 - RNA, 19 nt, Human
aagcagccucccucacaga

SEQ ID NO: 985442 - RNA, 21 nt, Human
aagcagccucccucacagaaa

SEQ ID NO: 985443 - RNA, 19 nt, Human
acagaaagcagccucccuc

SEQ ID NO: 985444 - RNA, 22 nt, Human
acagaaagcagccucccucaca

SEQ ID NO: 985445 - RNA, 21 nt, Human
acccaacucauccucuguucu

SEQ ID NO: 985446 - RNA, 21 nt, Human
accucaccuuuacucccucag

SEQ ID NO: 985447 - RNA, 21 nt, Human
acucccaccugccagccucac

SEQ ID NO: 985448 - RNA, 19 nt, Human
acuuuuggcuaguagacug

SEQ ID NO: 985449 - RNA, 26 nt, Human
agcaaggaauaaaugaaugcauacag

SEQ ID NO: 985450 - RNA, 22 nt, Human
aggcaaggugcugccgagccca

SEQ ID NO: 985451 - RNA, 20 nt, Human
aguugcauauauuacaggcu

SEQ ID NO: 985452 - RNA, 23 nt, Human
augacagacaaccccggucccca

SEQ ID NO: 985453 - RNA, 21 nt, Human
augcaagcaagcacagaagga

SEQ ID NO: 985454 - RNA, 24 nt, Human
caaacaaaaacacaagcuucucuc

SEQ ID NO: 985455 - RNA, 22 nt, Human
caaacugaaugauaaagacccg

SEQ ID NO: 985456 - RNA, 20 nt, Human
caagaacggagaccccuucc

SEQ ID NO: 985457 - RNA, 20 nt, Human
caagcaagcacagaaggauc

SEQ ID NO: 985458 - RNA, 23 nt, Human
cacagaaagcagccucccucaca

SEQ ID NO: 985459 - RNA, 21 nt, Human
cacgcuucuccccauuacaaa

SEQ ID NO: 985460 - RNA, 19 nt, Human
cagaaagcagccucccuca

SEQ ID NO: 985461 - RNA, 20 nt, Human
cagaaagcagccucccucac

SEQ ID NO: 985462 - RNA, 20 nt, Human
cagaaggaucauguguagug

SEQ ID NO: 985463 - RNA, 22 nt, Human
cagaauggcugugccuuagaua

SEQ ID NO: 985464 - RNA, 18 nt, Human
cagcaaggaauaaaugaa

SEQ ID NO: 985465 - RNA, 20 nt, Human
caucacacucccuccgcuca

SEQ ID NO: 985466 - RNA, 21 nt, Human
caugcgaugccacgugccacc

SEQ ID NO: 985467 - RNA, 22 nt, Human
cauuaguaggcuaucacuucag

SEQ ID NO: 985468 - RNA, 23 nt, Human
ccacauaaaugacagacaacccc

SEQ ID NO: 985469 - RNA, 25 nt, Human
ccccauuacaaacaaaaacacaagc

SEQ ID NO: 985470 - RNA, 23 nt, Human
ccccgcuguuucacacgcugcuu

SEQ ID NO: 985471 - RNA, 24 nt, Human
ccccuuggaaaugaacuuuuauuu

SEQ ID NO: 985472 - RNA, 20 nt, Human
cccgcacgcgcccgcgcccg

SEQ ID NO: 985473 - RNA, 22 nt, Human
cccgcacgcgcccgcgcccgcg

SEQ ID NO: 985474 - RNA, 26 nt, Human
cccggcucgcagcccgcacgcgcccg

SEQ ID NO: 985475 - RNA, 22 nt, Human
cccuccgcucacgccgcucuuc

SEQ ID NO: 985476 - RNA, 18 nt, Human
ccgccgccgccucccggc

SEQ ID NO: 985477 - RNA, 18 nt, Human
ccgccgccgccucccggc

SEQ ID NO: 985478 - RNA, 20 nt, Human
ccgccgccgccucccggcuc

SEQ ID NO: 985479 - RNA, 18 nt, Human
ccgccgccgucgccgucg

SEQ ID NO: 985480 - RNA, 24 nt, Human
ccgccgccgucgccgucgccgccg

SEQ ID NO: 985481 - RNA, 18 nt, Human
ccgccgucgccgucgccg

SEQ ID NO: 985482 - RNA, 24 nt, Human
ccgccgucgccgucgccgccgccg

SEQ ID NO: 985483 - RNA, 23 nt, Human
ccucaccaggcagacuucccuca

SEQ ID NO: 985484 - RNA, 20 nt, Human
ccuccugaccaccacuuugg

SEQ ID NO: 985485 - RNA, 19 nt, Human
cgcccgcgcccgcgcccgc

SEQ ID NO: 985486 - RNA, 19 nt, Human
cgggguuggcuggcuacug

SEQ ID NO: 985487 - RNA, 18 nt, Human
cucaccuuuacucccuca

SEQ ID NO: 985488 - RNA, 22 nt, Human
cucaccuuuacucccucagaua

SEQ ID NO: 985489 - RNA, 18 nt, Human
cucaguaacauccauaca

SEQ ID NO: 985490 - RNA, 21 nt, Human
cucgcaaaaugguccucccac

SEQ ID NO: 985491 - RNA, 24 nt, Human
cugccagccucaccaggcagacuu

SEQ ID NO: 985492 - RNA, 22 nt, Human
gaaauuucacagaaagcagccu

SEQ ID NO: 985493 - RNA, 24 nt, Human
gaagguucugaagaagugaacucc

SEQ ID NO: 985494 - RNA, 18 nt, Human
gacugcauuagacuccca

SEQ ID NO: 985495 - RNA, 19 nt, Human
gagaaaauuaggcagugaa

SEQ ID NO: 985496 - RNA, 19 nt, Human
gauuccccccaacagaccc

SEQ ID NO: 985497 - RNA, 24 nt, Human
gauuccccccaacagacccaacuc

SEQ ID NO: 985498 - RNA, 21 nt, Human
gcagcccgcacgcgcccgcgc

SEQ ID NO: 985499 - RNA, 22 nt, Human
gccgccgccgucgccgucgccg

SEQ ID NO: 985500 - RNA, 24 nt, Human
gccgucgccgucgccgccgccgcc

SEQ ID NO: 985501 - RNA, 25 nt, Human
gccgucgccgucgccgccgccgccu

SEQ ID NO: 985502 - RNA, 19 nt, Human
gccucccggcucgcagccc

SEQ ID NO: 985503 - RNA, 19 nt, Human
gccucccucacagaaacac

SEQ ID NO: 985504 - RNA, 24 nt, Human
ggaaucaucacacucccuccgcuc

SEQ ID NO: 985505 - RNA, 22 nt, Human
gugaaacagggcuacacucgca

SEQ ID NO: 985506 - RNA, 18 nt, Human
guggccgacucuccaccc

SEQ ID NO: 985507 - RNA, 25 nt, Human
uacacucgcaaaaugguccucccac

SEQ ID NO: 985508 - RNA, 18 nt, Human
uacagcaccaagaacgga

SEQ ID NO: 985509 - RNA, 20 nt, Human
ucaaauacagcaccaagaac

SEQ ID NO: 985510 - RNA, 19 nt, Human
uccagauuccccccaacag

SEQ ID NO: 985511 - RNA, 20 nt, Human
uccccauuacaaacaaaaac

SEQ ID NO: 985512 - RNA, 21 nt, Human
ucccucacagaaacacaggcu

SEQ ID NO: 985513 - RNA, 18 nt, Human
uccgagcgcaacucgguc

SEQ ID NO: 985514 - RNA, 24 nt, Human
uccgucagaauaaacaagugucca

SEQ ID NO: 985515 - RNA, 24 nt, Human
uccucccacggcugagcgccucag

SEQ ID NO: 985516 - RNA, 20 nt, Human
ucgccgucgccgccgccgcc

SEQ ID NO: 985517 - RNA, 26 nt, Human
ucgccgucgccgccgccgccucccgg

SEQ ID NO: 985518 - RNA, 22 nt, Human
ucuacacccguuucaaauacag

SEQ ID NO: 985519 - RNA, 23 nt, Human
ucuccccauuacaaacaaaaaca

SEQ ID NO: 985520 - RNA, 19 nt, Human
ugaagaagugaacuccguc

SEQ ID NO: 985521 - RNA, 21 nt, Human
ugaaugcauacaggacuuuug

SEQ ID NO: 985522 - RNA, 19 nt, Human
ugagguggacagacacgca

SEQ ID NO: 985523 - RNA, 22 nt, Human
ugagguggacagacacgcaggc

SEQ ID NO: 985524 - RNA, 19 nt, Human
ugccaccugccuggccacg

SEQ ID NO: 985525 - RNA, 19 nt, Human
uggaacugcaauguggaga

SEQ ID NO: 985526 - RNA, 19 nt, Human
uuccagugaaaagcucuau

SEQ ID NO: 985527 - RNA, 21 nt, Human
uuucacagaaagcagccuccc

SEQ ID NO: 985528 - RNA, 19 nt, Human
aaaccacacaagacacaaa

SEQ ID NO: 985529 - RNA, 22 nt, Human
aaagaaauauggcuuaugagaa

SEQ ID NO: 985530 - RNA, 19 nt, Human
aacacagugaaacccuguc

SEQ ID NO: 985531 - RNA, 20 nt, Human
aacacagugaaacccugucu

SEQ ID NO: 985532 - RNA, 21 nt, Human
aacacagugaaacccugucuc

SEQ ID NO: 985533 - RNA, 23 nt, Human
aagacacaaauagcauggugaca

SEQ ID NO: 985534 - RNA, 22 nt, Human
aagagacaggguuuugcuacau

SEQ ID NO: 985535 - RNA, 24 nt, Human
aagugauccacccgccucagccuc

SEQ ID NO: 985536 - RNA, 24 nt, Human
aauugcuugaacucuggaggugga

SEQ ID NO: 985537 - RNA, 20 nt, Human
acaaaccacacaagacacaa

SEQ ID NO: 985538 - RNA, 20 nt, Human
acagagugagacuccgcuuc

SEQ ID NO: 985539 - RNA, 25 nt, Human
acagagugagacuccgcuuccaaaa

SEQ ID NO: 985540 - RNA, 20 nt, Human
acaggguuuugcuacauugg

SEQ ID NO: 985541 - RNA, 24 nt, Human
acaggguuuugcuacauuggccag

SEQ ID NO: 985542 - RNA, 19 nt, Human
acauuggccaggcuggucu

SEQ ID NO: 985543 - RNA, 20 nt, Human
acauuggccaggcuggucuu

SEQ ID NO: 985544 - RNA, 22 nt, Human
accacugcacuccagccugggc

SEQ ID NO: 985545 - RNA, 22 nt, Human
acccgccucagccucccaaagu

SEQ ID NO: 985546 - RNA, 24 nt, Human
acccugucucuacuaaaaauacaa

SEQ ID NO: 985547 - RNA, 22 nt, Human
acccuguuuuaaaccaaaguua

SEQ ID NO: 985548 - RNA, 24 nt, Human
acuccagccugggcaacagaguga

SEQ ID NO: 985549 - RNA, 25 nt, Human
acuccgcuuccaaaaaauauuuaca

SEQ ID NO: 985550 - RNA, 24 nt, Human
acugcacuccagccugggcaacag

SEQ ID NO: 985551 - RNA, 24 nt, Human
acugcacuccagccugggcaacag

SEQ ID NO: 985552 - RNA, 19 nt, Human
agacagucaacaaucaaag

SEQ ID NO: 985553 - RNA, 21 nt, Human
agacggagacggggcgagaga

SEQ ID NO: 985554 - RNA, 24 nt, Human
agcacuuugggaggccgaggcagg

SEQ ID NO: 985555 - RNA, 22 nt, Human
agcccgucgucaucagugagga

SEQ ID NO: 985556 - RNA, 24 nt, Human
agccugggcaacagagugagacuc

SEQ ID NO: 985557 - RNA, 23 nt, Human
aggaaaucgagaccguccuggcc

SEQ ID NO: 985558 - RNA, 19 nt, Human
aggcagaucacuaggucag

SEQ ID NO: 985559 - RNA, 20 nt, Human
aggcaggcagaucacuaggu

SEQ ID NO: 985560 - RNA, 24 nt, Human
aggcaggcagaucacuaggucagg

SEQ ID NO: 985561 - RNA, 24 nt, Human
aggcuguggcaggagaauugcuug

SEQ ID NO: 985562 - RNA, 22 nt, Human
aggugagacaauuauuuuugaa

SEQ ID NO: 985563 - RNA, 19 nt, Human
agguggaggcugcagugag

SEQ ID NO: 985564 - RNA, 24 nt, Human
agguggaggcugcagugagccaag

SEQ ID NO: 985565 - RNA, 24 nt, Human
auugcaccacugcacuccagccug

SEQ ID NO: 985566 - RNA, 28 nt, Human
auugcaccacugcacuccagccugggca

SEQ ID NO: 985567 - RNA, 24 nt, Human
caacacagugaaacccugucucua

SEQ ID NO: 985568 - RNA, 24 nt, Human
caacagagugagacuccgcuucca

SEQ ID NO: 985569 - RNA, 24 nt, Human
caagacacaaauagcauggugaca

SEQ ID NO: 985570 - RNA, 23 nt, Human
cacccgccucagccucccaaagu

SEQ ID NO: 985571 - RNA, 19 nt, Human
cacccuguuuuaaaccaaa

SEQ ID NO: 985572 - RNA, 20 nt, Human
caccugcuugugaauuccug

SEQ ID NO: 985573 - RNA, 22 nt, Human
cacuccagccugggcaacagag

SEQ ID NO: 985574 - RNA, 22 nt, Human
cacuccagccugggcaacagag

SEQ ID NO: 985575 - RNA, 24 nt, Human
cacuccagccugggcaacagagug

SEQ ID NO: 985576 - RNA, 19 nt, Human
cacugcacuccagccuggg

SEQ ID NO: 985577 - RNA, 21 nt, Human
cacugcacuccagccugggca

SEQ ID NO: 985578 - RNA, 22 nt, Human
cacugcacuccagccugggcaa

SEQ ID NO: 985579 - RNA, 23 nt, Human
cacugcacuccagccugggcaac

SEQ ID NO: 985580 - RNA, 24 nt, Human
cacugcacuccagccugggcaaca

SEQ ID NO: 985581 - RNA, 23 nt, Human
cacuucaaaccauacugccucgc

SEQ ID NO: 985582 - RNA, 23 nt, Human
cagaucacuaggucaggaaaucg

SEQ ID NO: 985583 - RNA, 23 nt, Human
cagcaagacuuuaaagcacuuga

SEQ ID NO: 985584 - RNA, 24 nt, Human
cagcacuuugggaggccgaggcag

SEQ ID NO: 985585 - RNA, 25 nt, Human
cagcacuuugggaggccgaggcagg

SEQ ID NO: 985586 - RNA, 24 nt, Human
caggguuuugcuacauuggccagg

SEQ ID NO: 985587 - RNA, 19 nt, Human
cagucgucgccugcaggug

SEQ ID NO: 985588 - RNA, 18 nt, Human
caguuuuuacagcaagac

SEQ ID NO: 985589 - RNA, 22 nt, Human
cauuggccaggcuggucuugaa

SEQ ID NO: 985590 - RNA, 19 nt, Human
ccacccgccucagccuccc

SEQ ID NO: 985591 - RNA, 20 nt, Human
ccacugcacuccagccuggg

SEQ ID NO: 985592 - RNA, 20 nt, Human
ccacugcacuccagccuggg

SEQ ID NO: 985593 - RNA, 21 nt, Human
ccacugcacuccagccugggc

SEQ ID NO: 985594 - RNA, 23 nt, Human
ccacugcacuccagccugggcaa

SEQ ID NO: 985595 - RNA, 24 nt, Human
ccacugcacuccagccugggcaac

SEQ ID NO: 985596 - RNA, 23 nt, Human
ccagagggucccugcccgaccgg

SEQ ID NO: 985597 - RNA, 18 nt, Human
cccggccucaagugaucc

SEQ ID NO: 985598 - RNA, 22 nt, Human
cccggccucaagugauccaccc

SEQ ID NO: 985599 - RNA, 23 nt, Human
cccggccucaagugauccacccg

SEQ ID NO: 985600 - RNA, 22 nt, Human
ccucaagugauccacccgccuc

SEQ ID NO: 985601 - RNA, 24 nt, Human
ccucgcgccgccgccucaggccuc

SEQ ID NO: 985602 - RNA, 22 nt, Human
ccuggccaacacagugaaaccc

SEQ ID NO: 985603 - RNA, 24 nt, Human
ccuggccaacacagugaaacccug

SEQ ID NO: 985604 - RNA, 22 nt, Human
ccugggcaacagagugagacuc

SEQ ID NO: 985605 - RNA, 19 nt, Human
ccuguagucccagcuacuc

SEQ ID NO: 985606 - RNA, 21 nt, Human
ccuguagucccagcuacucag

SEQ ID NO: 985607 - RNA, 24 nt, Human
cgagaccguccuggccaacacagu

SEQ ID NO: 985608 - RNA, 21 nt, Human
cgagagacaaccugcacaugc

SEQ ID NO: 985609 - RNA, 24 nt, Human
cgaggcaggcagaucacuagguca

SEQ ID NO: 985610 - RNA, 24 nt, Human
cgccuguagucccagcuacucagg

SEQ ID NO: 985611 - RNA, 25 nt, Human
cgcuuccaaaaaauauuuacaaggg

SEQ ID NO: 985612 - RNA, 18 nt, Human
cuacucaggaggcugugg

SEQ ID NO: 985613 - RNA, 23 nt, Human
cucccggccucaagugauccacc

SEQ ID NO: 985614 - RNA, 22 nt, Human
cugcagugagccaagauugcac

SEQ ID NO: 985615 - RNA, 18 nt, Human
cugccucgcgccgccgcc

SEQ ID NO: 985616 - RNA, 18 nt, Human
cuggccaacacagugaaa

SEQ ID NO: 985617 - RNA, 20 nt, Human
cugggugugguggugugcgc

SEQ ID NO: 985618 - RNA, 21 nt, Human
cugggugugguggugugcgcc

SEQ ID NO: 985619 - RNA, 24 nt, Human
cuuaagcagcagcuccaacagccc

SEQ ID NO: 985620 - RNA, 22 nt, Human
cuuuucgagagagauucacccu

SEQ ID NO: 985621 - RNA, 19 nt, Human
gaaacccugucucuacuaa

SEQ ID NO: 985622 - RNA, 19 nt, Human
gacaggguuuugcuacauu

SEQ ID NO: 985623 - RNA, 23 nt, Human
gagacaauuauuuuugaaacuaa

SEQ ID NO: 985624 - RNA, 18 nt, Human
gaggcugcagugagccaa

SEQ ID NO: 985625 - RNA, 23 nt, Human
gaggcugcagugagccaagauug

SEQ ID NO: 985626 - RNA, 24 nt, Human
gaucacuaggucaggaaaucgaga

SEQ ID NO: 985627 - RNA, 24 nt, Human
gcacuccagccugggcaacagagu

SEQ ID NO: 985628 - RNA, 19 nt, Human
gcauagcaauggcagucug

SEQ ID NO: 985629 - RNA, 24 nt, Human
gccaacacagugaaacccugucuc

SEQ ID NO: 985630 - RNA, 23 nt, Human
gccuguagucccagcuacucagg

SEQ ID NO: 985631 - RNA, 23 nt, Human
gcuggucuugaacucccggccuc

SEQ ID NO: 985632 - RNA, 20 nt, Human
gcuugaacucuggaggugga

SEQ ID NO: 985633 - RNA, 22 nt, Human
ggaggcugcagugagccaagau

SEQ ID NO: 985634 - RNA, 24 nt, Human
ggaggcugcagugagccaagauug

SEQ ID NO: 985635 - RNA, 20 nt, Human
ggcaggagaauugcuugaac

SEQ ID NO: 985636 - RNA, 24 nt, Human
ggcuggucuugaacucccggccuc

SEQ ID NO: 985637 - RNA, 22 nt, Human
gugaauuccugcaacuauguaa

SEQ ID NO: 985638 - RNA, 24 nt, Human
gugauccacccgccucagccuccc

SEQ ID NO: 985639 - RNA, 24 nt, Human
guggcaggagaauugcuugaacuc

SEQ ID NO: 985640 - RNA, 18 nt, Human
guggugugcgccuguagu

SEQ ID NO: 985641 - RNA, 23 nt, Human
guggugugcgccuguagucccag

SEQ ID NO: 985642 - RNA, 23 nt, Human
uaaaagaaaaaucaauggcuuua

SEQ ID NO: 985643 - RNA, 24 nt, Human
uacauuggccaggcuggucuugaa

SEQ ID NO: 985644 - RNA, 18 nt, Human
uagaaacugggaaacuca

SEQ ID NO: 985645 - RNA, 25 nt, Human
ucaaaccauacugccucgcgccgcc

SEQ ID NO: 985646 - RNA, 20 nt, Human
ucacccuguuuuaaaccaaa

SEQ ID NO: 985647 - RNA, 24 nt, Human
ucacuaggucaggaaaucgagacc

SEQ ID NO: 985648 - RNA, 21 nt, Human
ucacuguggguggcugucucc

SEQ ID NO: 985649 - RNA, 21 nt, Human
uccacccgccucagccuccca

SEQ ID NO: 985650 - RNA, 23 nt, Human
uccagccugggcaacagagugag

SEQ ID NO: 985651 - RNA, 24 nt, Human
uccagccugggcaacagagugaga

SEQ ID NO: 985652 - RNA, 22 nt, Human
ucgcgccgccgccucaggccuc

SEQ ID NO: 985653 - RNA, 24 nt, Human
ucucacuguggguggcugucuccu

SEQ ID NO: 985654 - RNA, 22 nt, Human
ucucuacuaaaaauacaaaaaa

SEQ ID NO: 985655 - RNA, 18 nt, Human
ucuggagguggaggcugc

SEQ ID NO: 985656 - RNA, 22 nt, Human
ucuguagaaacugggaaacuca

SEQ ID NO: 985657 - RNA, 20 nt, Human
ucuguggugagggcuuaagc

SEQ ID NO: 985658 - RNA, 22 nt, Human
ugacaugcaaagaaauauggcu

SEQ ID NO: 985659 - RNA, 21 nt, Human
ugcaccacugcacuccagccu

SEQ ID NO: 985660 - RNA, 23 nt, Human
uggagguggaggcugcagugagc

SEQ ID NO: 985661 - RNA, 25 nt, Human
uggcaggagaauugcuugaacucug

SEQ ID NO: 985662 - RNA, 20 nt, Human
uggcagucuguagaaacugg

SEQ ID NO: 985663 - RNA, 24 nt, Human
uggccaacacagugaaacccuguc

SEQ ID NO: 985664 - RNA, 23 nt, Human
uggccaggcuggucuugaacucc

SEQ ID NO: 985665 - RNA, 20 nt, Human
ugggaggccgaggcaggcag

SEQ ID NO: 985666 - RNA, 24 nt, Human
ugggaggccgaggcaggcagauca

SEQ ID NO: 985667 - RNA, 24 nt, Human
ugguggugugcgccuguaguccca

SEQ ID NO: 985668 - RNA, 21 nt, Human
uggugugcgccuguaguccca

SEQ ID NO: 985669 - RNA, 24 nt, Human
uggugugcgccuguagucccagcu

SEQ ID NO: 985670 - RNA, 22 nt, Human
uuaucugggugugguggugugc

SEQ ID NO: 985671 - RNA, 21 nt, Human
uucacccuguuuuaaaccaaa

SEQ ID NO: 985672 - RNA, 23 nt, Human
uugcaccacugcacuccagccug

SEQ ID NO: 985673 - RNA, 31 nt, Human
uugcaccacugcacuccagccugggcaacaa

SEQ ID NO: 985674 - RNA, 24 nt, Human
uugcuugaacucuggagguggagg

SEQ ID NO: 985675 - RNA, 25 nt, Human
uugggaggccgaggcaggcagauca

SEQ ID NO: 985676 - RNA, 22 nt, Human
acccuuggaggcacugcugcgc

SEQ ID NO: 985677 - RNA, 18 nt, Human
caagaaaucaccuuaaua

SEQ ID NO: 985678 - RNA, 25 nt, Human
cacaagaaaucaccuuaauauaaca

SEQ ID NO: 985679 - RNA, 23 nt, Human
ccuuuccuguuguugcaggcacu

SEQ ID NO: 985680 - RNA, 20 nt, Human
cucugcuuuaagaacccuug

SEQ ID NO: 985681 - RNA, 19 nt, Human
uaagaacccuuggaggcac

SEQ ID NO: 985682 - RNA, 20 nt, Human
uuuuuuuuuuuuuugucaga

SEQ ID NO: 985683 - RNA, 20 nt, Human
uuuuuuuuuuuuuuugucag

SEQ ID NO: 985684 - RNA, 20 nt, Human
uuuuuuuuuuuuuuugucag

SEQ ID NO: 985685 - RNA, 19 nt, Human
uuuuuuuuuuuuuuuuugu

SEQ ID NO: 985686 - RNA, 27 nt, Human
uuuuuuuuuuuuuuuuuuuuuuugggg

SEQ ID NO: 985687 - RNA, 20 nt, Human
aaaucccucccaccccaccu

SEQ ID NO: 985688 - RNA, 24 nt, Human
aagaacaacagggagauagacgac

SEQ ID NO: 985689 - RNA, 24 nt, Human
aagcacacuacaaaggcugcaauc

SEQ ID NO: 985690 - RNA, 19 nt, Human
aagcagaggcaggaggugg

SEQ ID NO: 985691 - RNA, 22 nt, Human
aagcagaggcaggagguggaga

SEQ ID NO: 985692 - RNA, 22 nt, Human
aaguugaugggguuacugagcc

SEQ ID NO: 985693 - RNA, 26 nt, Human
acaaagccucaggauuucuucaaggg

SEQ ID NO: 985694 - RNA, 22 nt, Human
acaccagggccaccaaguugau

SEQ ID NO: 985695 - RNA, 19 nt, Human
accaacccaaaucccuccc

SEQ ID NO: 985696 - RNA, 19 nt, Human
acccaaaucccucccaccc

SEQ ID NO: 985697 - RNA, 18 nt, Human
agaaaaggaccuaccucc

SEQ ID NO: 985698 - RNA, 19 nt, Human
agaagaaaauagacaagca

SEQ ID NO: 985699 - RNA, 22 nt, Human
agaagaaaauagacaagcaggg

SEQ ID NO: 985700 - RNA, 18 nt, Human
agacaccagggccaccaa

SEQ ID NO: 985701 - RNA, 20 nt, Human
agccucuggaucagcacccu

SEQ ID NO: 985702 - RNA, 19 nt, Human
aggaagagccgugaagaga

SEQ ID NO: 985703 - RNA, 18 nt, Human
aggcacagaccugggcca

SEQ ID NO: 985704 - RNA, 19 nt, Human
aggcccaagggucuccagu

SEQ ID NO: 985705 - RNA, 18 nt, Human
aguuccagaacaagaaau

SEQ ID NO: 985706 - RNA, 21 nt, Human
aguucuguucauuuaguucca

SEQ ID NO: 985707 - RNA, 24 nt, Human
auaagcagaggcaggagguggaga

SEQ ID NO: 985708 - RNA, 22 nt, Human
caacccaaaucccucccacccc

SEQ ID NO: 985709 - RNA, 22 nt, Human
caagaaauaagcagaggcagga

SEQ ID NO: 985710 - RNA, 19 nt, Human
caaggagcacucuacaaag

SEQ ID NO: 985711 - RNA, 20 nt, Human
caccaacccaaaucccuccc

SEQ ID NO: 985712 - RNA, 26 nt, Human
caccaacccaaaucccucccacccca

SEQ ID NO: 985713 - RNA, 23 nt, Human
caccagggccaccaaguugaugg

SEQ ID NO: 985714 - RNA, 22 nt, Human
caccuuggccgaaaaaugggau

SEQ ID NO: 985715 - RNA, 19 nt, Human
cagggagauagacgaccac

SEQ ID NO: 985716 - RNA, 24 nt, Human
cauccuacucucuccucaauucca

SEQ ID NO: 985717 - RNA, 22 nt, Human
ccaccaacccaaaucccuccca

SEQ ID NO: 985718 - RNA, 25 nt, Human
ccagaacaagaaauaagcagaggca

SEQ ID NO: 985719 - RNA, 18 nt, Human
cccaaaucccucccaccc

SEQ ID NO: 985720 - RNA, 23 nt, Human
cccaagguccccuacuaggccgg

SEQ ID NO: 985721 - RNA, 24 nt, Human
cccaccccaccuguaguccaaaga

SEQ ID NO: 985722 - RNA, 26 nt, Human
cccuacuaggccggaggagaaaagga

SEQ ID NO: 985723 - RNA, 19 nt, Human
cccucccaccccaccugua

SEQ ID NO: 985724 - RNA, 21 nt, Human
ccucccaccccaccuguaguc

SEQ ID NO: 985725 - RNA, 20 nt, Human
cgccgaugggaagaacaacg

SEQ ID NO: 985726 - RNA, 22 nt, Human
cuccuacaggggcacaaacaag

SEQ ID NO: 985727 - RNA, 22 nt, Human
cuucaagggauacugcugugcc

SEQ ID NO: 985728 - RNA, 18 nt, Human
gaacaagaaauaagcaga

SEQ ID NO: 985729 - RNA, 21 nt, Human
gaacuuucucgagguucauau

SEQ ID NO: 985730 - RNA, 23 nt, Human
gaaggcacagaccugggccacgg

SEQ ID NO: 985731 - RNA, 22 nt, Human
gaccacagccugugcacccggu

SEQ ID NO: 985732 - RNA, 21 nt, Human
gugaagagaagaaaauagaca

SEQ ID NO: 985733 - RNA, 23 nt, Human
uaauccaccaacccaaaucccuc

SEQ ID NO: 985734 - RNA, 24 nt, Human
uagacaagcaggggagggaagaau

SEQ ID NO: 985735 - RNA, 21 nt, Human
ucauggccuucagaacuuucu

SEQ ID NO: 985736 - RNA, 26 nt, Human
uccaccaacccaaaucccucccaccc

SEQ ID NO: 985737 - RNA, 23 nt, Human
ucccaccccaccuguaguccaaa

SEQ ID NO: 985738 - RNA, 20 nt, Human
ucuccagugagugcuugaga

SEQ ID NO: 985739 - RNA, 19 nt, Human
ugagacagucaagagggag

SEQ ID NO: 985740 - RNA, 18 nt, Human
ugagccucuggaucagca

SEQ ID NO: 985741 - RNA, 22 nt, Human
ugagccucuggaucaggacccu

SEQ ID NO: 985742 - RNA, 24 nt, Human
ugauaggaagcaaggaagcacacu

SEQ ID NO: 985743 - RNA, 22 nt, Human
ugcugugccaggucucgagggc

SEQ ID NO: 985744 - RNA, 21 nt, Human
uggaagagggaggcaaggcag

SEQ ID NO: 985745 - RNA, 19 nt, Human
ugggaagaacaacagggag

SEQ ID NO: 985746 - RNA, 23 nt, Human
ugugagacaccagggccaccaag

SEQ ID NO: 985747 - RNA, 21 nt, Human
ugugcugcucucucaacaguc

SEQ ID NO: 985748 - RNA, 26 nt, Human
ugugcugcucucucaacagucagcug

SEQ ID NO: 985749 - RNA, 18 nt, Human
uuugaaguucuguucauu

SEQ ID NO: 985750 - RNA, 22 nt, Human
aaaaagcaaggugaaaagaaau

SEQ ID NO: 985751 - RNA, 20 nt, Human
aaaauucuuucacaacagcc

SEQ ID NO: 985752 - RNA, 18 nt, Human
aacagaauuuuacauaug

SEQ ID NO: 985753 - RNA, 22 nt, Human
aagcaacacaauuuccaaaacu

SEQ ID NO: 985754 - RNA, 20 nt, Human
aauugcugcaacuuuuacag

SEQ ID NO: 985755 - RNA, 25 nt, Human
acaaaauggagacauaaauuauguc

SEQ ID NO: 985756 - RNA, 21 nt, Human
acaacaaaauggagacauaaa

SEQ ID NO: 985757 - RNA, 18 nt, Human
accauaguugaaaaugcu

SEQ ID NO: 985758 - RNA, 24 nt, Human
agaaaaauucuuucacaacagcca

SEQ ID NO: 985759 - RNA, 22 nt, Human
aggacacuagccuaaacuaaaa

SEQ ID NO: 985760 - RNA, 23 nt, Human
aggcagaguguucuauuguuccu

SEQ ID NO: 985761 - RNA, 23 nt, Human
agguucuagcagaagaaacauuu

SEQ ID NO: 985762 - RNA, 25 nt, Human
augaaaaaaagcaaggugaaaagaa

SEQ ID NO: 985763 - RNA, 19 nt, Human
caacaaaaauaacaggccg

SEQ ID NO: 985764 - RNA, 23 nt, Human
caagcaaauuaaggaugaaaaaa

SEQ ID NO: 985765 - RNA, 18 nt, Human
caaguaacugauguagug

SEQ ID NO: 985766 - RNA, 18 nt, Human
cagauugcagcaaaugua

SEQ ID NO: 985767 - RNA, 19 nt, Human
cagccccaggaaauagcua

SEQ ID NO: 985768 - RNA, 21 nt, Human
ccaccucuaagaggcaggaca

SEQ ID NO: 985769 - RNA, 25 nt, Human
ccucuaagaggcaggacacuagccu

SEQ ID NO: 985770 - RNA, 22 nt, Human
ccugaaauuugaaacauaguac

SEQ ID NO: 985771 - RNA, 24 nt, Human
cuaacucuauuucuuaaaagcaac

SEQ ID NO: 985772 - RNA, 21 nt, Human
cuagccaauaaauugcugcaa

SEQ ID NO: 985773 - RNA, 19 nt, Human
cuccugaaacuuaaacucu

SEQ ID NO: 985774 - RNA, 20 nt, Human
cugacuagaauacagcaaua

SEQ ID NO: 985775 - RNA, 21 nt, Human
cuuaaacucugaauagcaaca

SEQ ID NO: 985776 - RNA, 22 nt, Human
cuuaaacucugaauagcaacag

SEQ ID NO: 985777 - RNA, 18 nt, Human
cuucuccuuuggcuugag

SEQ ID NO: 985778 - RNA, 23 nt, Human
gaaaaaaagcaaggugaaaagaa

SEQ ID NO: 985779 - RNA, 18 nt, Human
gaaaagaaauaggaaaaa

SEQ ID NO: 985780 - RNA, 22 nt, Human
gaacagguaugagguucuagca

SEQ ID NO: 985781 - RNA, 23 nt, Human
gaagaaacauuugcauaaaugug

SEQ ID NO: 985782 - RNA, 22 nt, Human
gauaaauggagaaugagaaaga

SEQ ID NO: 985783 - RNA, 24 nt, Human
ggcagaguguucuauuguuccugu

SEQ ID NO: 985784 - RNA, 20 nt, Human
gggcaaaagaaccuucagau

SEQ ID NO: 985785 - RNA, 24 nt, Human
gguaugagguucuagcagaagaaa

SEQ ID NO: 985786 - RNA, 21 nt, Human
ggugaaaagaaauaggaaaaa

SEQ ID NO: 985787 - RNA, 18 nt, Human
guuccuguuuucuccuga

SEQ ID NO: 985788 - RNA, 22 nt, Human
uaaaagcaacacaauuuccaaa

SEQ ID NO: 985789 - RNA, 20 nt, Human
uaacaggcagaguguucuau

SEQ ID NO: 985790 - RNA, 19 nt, Human
uacacaaugccaccucuaa

SEQ ID NO: 985791 - RNA, 23 nt, Human
uaugucauaacagaauuuuacau

SEQ ID NO: 985792 - RNA, 21 nt, Human
ucaaaaauuuucuaugacuag

SEQ ID NO: 985793 - RNA, 19 nt, Human
ucaaagcucagauuuacac

SEQ ID NO: 985794 - RNA, 27 nt, Human
ucaaagcucagauuuacacaaugccac

SEQ ID NO: 985795 - RNA, 21 nt, Human
ucuggucugacuagaauacag

SEQ ID NO: 985796 - RNA, 21 nt, Human
ucuguucuuacugucuucucc

SEQ ID NO: 985797 - RNA, 19 nt, Human
ugaaaaugcugacacaaau

SEQ ID NO: 985798 - RNA, 22 nt, Human
ugaauagcaacagauugcagca

SEQ ID NO: 985799 - RNA, 23 nt, Human
ugaugcagaauucuuaauggcac

SEQ ID NO: 985800 - RNA, 20 nt, Human
ugucuucuccuuuggcuuga

SEQ ID NO: 985801 - RNA, 22 nt, Human
uuauuuggcaauaauaaacuga

SEQ ID NO: 985802 - RNA, 19 nt, Human
uuccaaaacuuucuugcuc

SEQ ID NO: 985803 - RNA, 25 nt, Human
uucuaugacuagccaauaaauugcu

SEQ ID NO: 985804 - RNA, 21 nt, Human
uucuuucacaacagccaggaa

SEQ ID NO: 985805 - RNA, 21 nt, Human
uugacagaggaucucuuggua

SEQ ID NO: 985806 - RNA, 27 nt, Human
uuuuuuuuuuuuuuuuuuuuccugggg

SEQ ID NO: 985807 - RNA, 24 nt, Human
aaauggggaguacagcuucaucuc

SEQ ID NO: 985808 - RNA, 19 nt, Human
aacagguccuagccaauga

SEQ ID NO: 985809 - RNA, 18 nt, Human
aacugugggaggcagggu

SEQ ID NO: 985810 - RNA, 20 nt, Human
aagggagauggauggguccc

SEQ ID NO: 985811 - RNA, 22 nt, Human
aaguggaggccagagggcugag

SEQ ID NO: 985812 - RNA, 20 nt, Human
aaugauggggaaggcaggaa

SEQ ID NO: 985813 - RNA, 20 nt, Human
acaaaaaaaagagcaaacag

SEQ ID NO: 985814 - RNA, 30 nt, Human
acacacaugcacacgcacacgcacacacag

SEQ ID NO: 985815 - RNA, 21 nt, Human
acacagcuaagacaccaaacc

SEQ ID NO: 985816 - RNA, 22 nt, Human
acacaguccugcggagcugccu

SEQ ID NO: 985817 - RNA, 21 nt, Human
acacgcacacgcacacacagc

SEQ ID NO: 985818 - RNA, 20 nt, Human
acagaggcuauuguguggaa

SEQ ID NO: 985819 - RNA, 18 nt, Human
acagguagggagcauggg

SEQ ID NO: 985820 - RNA, 22 nt, Human
acaugcacacacauauguaagu

SEQ ID NO: 985821 - RNA, 18 nt, Human
acuacaacacgucacagc

SEQ ID NO: 985822 - RNA, 20 nt, Human
agagggaaugauggggaagg

SEQ ID NO: 985823 - RNA, 22 nt, Human
agagggcugagguuuauugcuu

SEQ ID NO: 985824 - RNA, 23 nt, Human
agcaugggagggcagcugugcua

SEQ ID NO: 985825 - RNA, 20 nt, Human
aggaaaguggaggccagagg

SEQ ID NO: 985826 - RNA, 18 nt, Human
aggaacugugggaggcag

SEQ ID NO: 985827 - RNA, 20 nt, Human
aggaacugugggaggcaggg

SEQ ID NO: 985828 - RNA, 21 nt, Human
aggaaggaguuguuggucuca

SEQ ID NO: 985829 - RNA, 28 nt, Human
aggagucccgggcgaggacggggguccc

SEQ ID NO: 985830 - RNA, 23 nt, Human
agggagcaugggagggcagcugu

SEQ ID NO: 985831 - RNA, 23 nt, Human
agggccccugcuuccugccucug

SEQ ID NO: 985832 - RNA, 21 nt, Human
aggggaaggggagccagauug

SEQ ID NO: 985833 - RNA, 19 nt, Human
agggggagaaggauggggc

SEQ ID NO: 985834 - RNA, 22 nt, Human
agggggagaaggauggggcuca

SEQ ID NO: 985835 - RNA, 20 nt, Human
aggucaggauggcagggcag

SEQ ID NO: 985836 - RNA, 25 nt, Human
aguauacauacacauucacacacag

SEQ ID NO: 985837 - RNA, 19 nt, Human
aguggaggccagagggcug

SEQ ID NO: 985838 - RNA, 18 nt, Human
aguguuacaaaaugggga

SEQ ID NO: 985839 - RNA, 26 nt, Human
aguucaguuggguggauggggaaggg

SEQ ID NO: 985840 - RNA, 19 nt, Human
auggcacaugcacacacau

SEQ ID NO: 985841 - RNA, 22 nt, Human
cacacagcuaagacaccaaaca

SEQ ID NO: 985842 - RNA, 21 nt, Human
cacaguccugcggagcugccu

SEQ ID NO: 985843 - RNA, 22 nt, Human
cacaugcacacacauauguaag

SEQ ID NO: 985844 - RNA, 20 nt, Human
caccaaagaaagcagccaca

SEQ ID NO: 985845 - RNA, 18 nt, Human
caccagagccccagcccc

SEQ ID NO: 985846 - RNA, 19 nt, Human
caccagagccccagccccu

SEQ ID NO: 985847 - RNA, 28 nt, Human
cacggggaguggggagugagggcucugg

SEQ ID NO: 985848 - RNA, 19 nt, Human
cacugcccaaccucucccc

SEQ ID NO: 985849 - RNA, 19 nt, Human
cacugggucuucuccaccu

SEQ ID NO: 985850 - RNA, 18 nt, Human
cagaaaccagauuagggg

SEQ ID NO: 985851 - RNA, 24 nt, Human
cagaggcuauuguguggaagggua

SEQ ID NO: 985852 - RNA, 18 nt, Human
cagcauguggggagugag

SEQ ID NO: 985853 - RNA, 25 nt, Human
cagcuucaucucaaaacugggauga

SEQ ID NO: 985854 - RNA, 25 nt, Human
cagggcacacacucauacacugggc

SEQ ID NO: 985855 - RNA, 19 nt, Human
cagggcagggaggggaagg

SEQ ID NO: 985856 - RNA, 21 nt, Human
caguuggguggauggggaagg

SEQ ID NO: 985857 - RNA, 22 nt, Human
cauacacauucacacacagucc

SEQ ID NO: 985858 - RNA, 26 nt, Human
cauacacauucacacacaguccugcg

SEQ ID NO: 985859 - RNA, 24 nt, Human
cauauuugcagcccaaauugagag

SEQ ID NO: 985860 - RNA, 26 nt, Human
caugcacacgcacacgcacacacagc

SEQ ID NO: 985861 - RNA, 26 nt, Human
cauuaggggucccucacucacugccc

SEQ ID NO: 985862 - RNA, 23 nt, Human
ccaaucccaaagcccuagagagg

SEQ ID NO: 985863 - RNA, 23 nt, Human
ccacaggguuggggcacuggacg

SEQ ID NO: 985864 - RNA, 18 nt, Human
ccagggccuaggcagagg

SEQ ID NO: 985865 - RNA, 22 nt, Human
ccauggucuacaccagagcccc

SEQ ID NO: 985866 - RNA, 22 nt, Human
cccauggcacaugcacacacau

SEQ ID NO: 985867 - RNA, 22 nt, Human
ccuagggcuccuccaucccagg

SEQ ID NO: 985868 - RNA, 19 nt, Human
ccuccaucccaggcucaac

SEQ ID NO: 985869 - RNA, 23 nt, Human
ccuccaucccaggcucaacacag

SEQ ID NO: 985870 - RNA, 21 nt, Human
ccugugcuguaguggguggag

SEQ ID NO: 985871 - RNA, 21 nt, Human
cucacagugugccugccaauc

SEQ ID NO: 985872 - RNA, 28 nt, Human
cucacugcccaaccucuccccacucaga

SEQ ID NO: 985873 - RNA, 19 nt, Human
cugccaggagggccccugc

SEQ ID NO: 985874 - RNA, 20 nt, Human
cugcuccccucccugugagg

SEQ ID NO: 985875 - RNA, 19 nt, Human
cugcuuccugccucugccc

SEQ ID NO: 985876 - RNA, 20 nt, Human
cugcuuccugccucugcccc

SEQ ID NO: 985877 - RNA, 20 nt, Human
cuuccugccucugccccagc

SEQ ID NO: 985878 - RNA, 21 nt, Human
gacagggggagcaggggaaug

SEQ ID NO: 985879 - RNA, 18 nt, Human
gagagcaagggagaugga

SEQ ID NO: 985880 - RNA, 19 nt, Human
gaggagggaaggagauggg

SEQ ID NO: 985881 - RNA, 21 nt, Human
gaggagggaaggagaugggcc

SEQ ID NO: 985882 - RNA, 19 nt, Human
gagggcacccgaggcccac

SEQ ID NO: 985883 - RNA, 21 nt, Human
gagggcugagguuuauugcuu

SEQ ID NO: 985884 - RNA, 21 nt, Human
gauuuguuuccguuuuauuuu

SEQ ID NO: 985885 - RNA, 21 nt, Human
gcggcagcggcgacugcuccc

SEQ ID NO: 985886 - RNA, 23 nt, Human
ggaaccccuggaacagggaagca

SEQ ID NO: 985887 - RNA, 18 nt, Human
ggaaggagaugggccuug

SEQ ID NO: 985888 - RNA, 21 nt, Human
ggacaguauagugauaccccc

SEQ ID NO: 985889 - RNA, 19 nt, Human
ggacgggggucccggccgc

SEQ ID NO: 985890 - RNA, 19 nt, Human
ggaggccagagggcugagg

SEQ ID NO: 985891 - RNA, 24 nt, Human
ggagggcaccaaagaaagcagcca

SEQ ID NO: 985892 - RNA, 22 nt, Human
ggagggcagcugugcuauuccc

SEQ ID NO: 985893 - RNA, 18 nt, Human
ggaggucaggauggcagg

SEQ ID NO: 985894 - RNA, 19 nt, Human
ggcagagggaaugaugggg

SEQ ID NO: 985895 - RNA, 19 nt, Human
gggaaggaaggaguuguug

SEQ ID NO: 985896 - RNA, 25 nt, Human
gggaaugauggggaaggcaggaagc

SEQ ID NO: 985897 - RNA, 22 nt, Human
gggagagugaccacaggguugg

SEQ ID NO: 985898 - RNA, 20 nt, Human
gggagugagggcucuggagg

SEQ ID NO: 985899 - RNA, 24 nt, Human
gggcacuggagaaggcagucuuuu

SEQ ID NO: 985900 - RNA, 24 nt, Human
gggcagggaggggaaggaaggagu

SEQ ID NO: 985901 - RNA, 19 nt, Human
gggcagugggaaaugggga

SEQ ID NO: 985902 - RNA, 19 nt, Human
ggggagagugaccacaggg

SEQ ID NO: 985903 - RNA, 21 nt, Human
ggggaggaacugugggaggca

SEQ ID NO: 985904 - RNA, 20 nt, Human
ggggaguggggagugagggc

SEQ ID NO: 985905 - RNA, 19 nt, Human
gggggucccggccgcgggc

SEQ ID NO: 985906 - RNA, 31 nt, Human
gggguuuacacacaugcacacgcacacgcag

SEQ ID NO: 985907 - RNA, 19 nt, Human
gguuucaccagggccuagg

SEQ ID NO: 985908 - RNA, 21 nt, Human
gucuucuccaccuccugcuuc

SEQ ID NO: 985909 - RNA, 21 nt, Human
guuacaaaauggggagaguga

SEQ ID NO: 985910 - RNA, 24 nt, Human
guuuacacacaugcacacgcacag

SEQ ID NO: 985911 - RNA, 19 nt, Human
uaaaaacuacaacacguca

SEQ ID NO: 985912 - RNA, 25 nt, Human
uacacacaugcacacgcacacgcac

SEQ ID NO: 985913 - RNA, 23 nt, Human
uacccaguucaguuggguggaug

SEQ ID NO: 985914 - RNA, 21 nt, Human
uaggcagagggaaugaugggg

SEQ ID NO: 985915 - RNA, 22 nt, Human
uaggggaggaacugugggaggc

SEQ ID NO: 985916 - RNA, 27 nt, Human
uaggggucccucacucacugcccaacc

SEQ ID NO: 985917 - RNA, 24 nt, Human
uauucuggaaccccuggaacaggg

SEQ ID NO: 985918 - RNA, 22 nt, Human
ucaaaaagaccccuccccacag

SEQ ID NO: 985919 - RNA, 21 nt, Human
ucacugcccaaccucucccca

SEQ ID NO: 985920 - RNA, 27 nt, Human
ucacugcccaaccucuccccacucaga

SEQ ID NO: 985921 - RNA, 20 nt, Human
ucaguuggguggauggggaa

SEQ ID NO: 985922 - RNA, 21 nt, Human
uccaacaggagaugugagagg

SEQ ID NO: 985923 - RNA, 24 nt, Human
uccacaagccucuggagaccuggu

SEQ ID NO: 985924 - RNA, 19 nt, Human
uccauggucuacaccagag

SEQ ID NO: 985925 - RNA, 20 nt, Human
ucccaaagcccuagagaccc

SEQ ID NO: 985926 - RNA, 22 nt, Human
ucccaaagcccuagagaccccu

SEQ ID NO: 985927 - RNA, 22 nt, Human
ucccaggcuggccuagggcucc

SEQ ID NO: 985928 - RNA, 19 nt, Human
uccccaggagagcaaggga

SEQ ID NO: 985929 - RNA, 20 nt, Human
ucccucacucacugcccacc

SEQ ID NO: 985930 - RNA, 21 nt, Human
ucccugcauuaggggucccuc

SEQ ID NO: 985931 - RNA, 20 nt, Human
ucccugugaggggacagguu

SEQ ID NO: 985932 - RNA, 22 nt, Human
ucuagguuccccggguaaggag

SEQ ID NO: 985933 - RNA, 20 nt, Human
ucuuccacaagccucuggag

SEQ ID NO: 985934 - RNA, 21 nt, Human
ugaggagggaaggagaugggc

SEQ ID NO: 985935 - RNA, 19 nt, Human
ugagggacaagggcacagg

SEQ ID NO: 985936 - RNA, 21 nt, Human
ugcaaagucaagggcaguggg

SEQ ID NO: 985937 - RNA, 20 nt, Human
ugcccacgggguuuacacac

SEQ ID NO: 985938 - RNA, 25 nt, Human
ugccccagcucuuugugcuuuuugg

SEQ ID NO: 985939 - RNA, 19 nt, Human
ugccucugccccagcucuu

SEQ ID NO: 985940 - RNA, 29 nt, Human
ugccugccaaucccaaagcccuagagacc

SEQ ID NO: 985941 - RNA, 19 nt, Human
ugcuuccugccucugcccc

SEQ ID NO: 985942 - RNA, 22 nt, Human
uggaugggucccucccaggggu

SEQ ID NO: 985943 - RNA, 24 nt, Human
uggcagggcagggaggggaaggaa

SEQ ID NO: 985944 - RNA, 20 nt, Human
uggggagugagggacaaggg

SEQ ID NO: 985945 - RNA, 21 nt, Human
uggggagugagggcucuggag

SEQ ID NO: 985946 - RNA, 23 nt, Human
ugggucuucuccaccuccugcuu

SEQ ID NO: 985947 - RNA, 22 nt, Human
ugguacaguguuacaaaauggg

SEQ ID NO: 985948 - RNA, 20 nt, Human
uguaaguauacauacacauu

SEQ ID NO: 985949 - RNA, 23 nt, Human
ugugcaaagucaagggcaguggg

SEQ ID NO: 985950 - RNA, 20 nt, Human
ugugcauccgcugaaauuac

SEQ ID NO: 985951 - RNA, 24 nt, Human
ugugggacucuuaucccaggcugg

SEQ ID NO: 985952 - RNA, 20 nt, Human
uguggggagugagggacaag

SEQ ID NO: 985953 - RNA, 23 nt, Human
uuacaaacaucuaaaaacuacaa

SEQ ID NO: 985954 - RNA, 18 nt, Human
uucacugggucuucucca

SEQ ID NO: 985955 - RNA, 22 nt, Human
uugcagcccaaauugagaggaa

SEQ ID NO: 985956 - RNA, 28 nt, Human
uugugugugcauccgcugaaauuacccu

SEQ ID NO: 985957 - RNA, 22 nt, Human
uuuugagcacagacaccaaaga

SEQ ID NO: 985958 - RNA, 20 nt, Human
uuuuuuguuauuuucacuuu

SEQ ID NO: 985959 - RNA, 22 nt, Human
aaaaagaaguggauggccagaa

SEQ ID NO: 985960 - RNA, 21 nt, Human
aaaaauauauacuucaagccc

SEQ ID NO: 985961 - RNA, 21 nt, Human
aaacaaaagaucaaaaaucag

SEQ ID NO: 985962 - RNA, 18 nt, Human
aaacauauugacagcuga

SEQ ID NO: 985963 - RNA, 23 nt, Human
aaaccaaauggaguuagccccca

SEQ ID NO: 985964 - RNA, 22 nt, Human
aagacgcauuuaucucagcagg

SEQ ID NO: 985965 - RNA, 18 nt, Human
aagcacugaagaaaaaca

SEQ ID NO: 985966 - RNA, 20 nt, Human
acacugguucccccccccuu

SEQ ID NO: 985967 - RNA, 21 nt, Human
acagagcaauaaauguuagua

SEQ ID NO: 985968 - RNA, 24 nt, Human
acuccaauggacucuguuucaaaa

SEQ ID NO: 985969 - RNA, 19 nt, Human
acuuccccaucccucccuc

SEQ ID NO: 985970 - RNA, 20 nt, Human
agacucacacaauucucuuu

SEQ ID NO: 985971 - RNA, 21 nt, Human
agaucagaguauccucaaugc

SEQ ID NO: 985972 - RNA, 20 nt, Human
agcacugaagauggugagcu

SEQ ID NO: 985973 - RNA, 21 nt, Human
aguuuuuuaagugguagcugc

SEQ ID NO: 985974 - RNA, 20 nt, Human
auaaaacacugagagaaaga

SEQ ID NO: 985975 - RNA, 23 nt, Human
augcauuucaguguccuggacaa

SEQ ID NO: 985976 - RNA, 20 nt, Human
auggaaagcaacuauuucca

SEQ ID NO: 985977 - RNA, 27 nt, Human
auguugcucaaauacuuggcuuucuag

SEQ ID NO: 985978 - RNA, 21 nt, Human
auucuguuuuaaauuuuugga

SEQ ID NO: 985979 - RNA, 21 nt, Human
cacaaagaaaagugccuggau

SEQ ID NO: 985980 - RNA, 18 nt, Human
cacauuguuuuuggguag

SEQ ID NO: 985981 - RNA, 18 nt, Human
caccugaguuacaaacau

SEQ ID NO: 985982 - RNA, 22 nt, Human
cacuacacucccuaacucccac

SEQ ID NO: 985983 - RNA, 21 nt, Human
cacugcaaaucaacucaaaca

SEQ ID NO: 985984 - RNA, 19 nt, Human
cacuguauucauauggaaa

SEQ ID NO: 985985 - RNA, 18 nt, Human
cagaaaguuaaauggcug

SEQ ID NO: 985986 - RNA, 25 nt, Human
cagaaauaaauauccuucuuaaaug

SEQ ID NO: 985987 - RNA, 22 nt, Human
cagaaugcuguacauugucccc

SEQ ID NO: 985988 - RNA, 19 nt, Human
cagcacuccaauguuaauc

SEQ ID NO: 985989 - RNA, 26 nt, Human
cagcacuccaauguuaauccaauuuu

SEQ ID NO: 985990 - RNA, 19 nt, Human
cauuucaguguccuggaca

SEQ ID NO: 985991 - RNA, 22 nt, Human
ccaaaauauggcuaaaaugcug

SEQ ID NO: 985992 - RNA, 20 nt, Human
ccaacagaaaguuaaauggc

SEQ ID NO: 985993 - RNA, 18 nt, Human
ccauugagagcacugcaa

SEQ ID NO: 985994 - RNA, 19 nt, Human
cccauugagagcacugcaa

SEQ ID NO: 985995 - RNA, 18 nt, Human
cccccaaaucagucaccu

SEQ ID NO: 985996 - RNA, 19 nt, Human
cccccaacccacaccccug

SEQ ID NO: 985997 - RNA, 18 nt, Human
cccuaacucccacuccaa

SEQ ID NO: 985998 - RNA, 22 nt, Human
ccuaacucccacuccaauggac

SEQ ID NO: 985999 - RNA, 18 nt, Human
ccugcaaaagucugcaga

SEQ ID NO: 986000 - RNA, 21 nt, Human
cuacaccugcacaaagaaaag

SEQ ID NO: 986001 - RNA, 23 nt, Human
cuaguucuugcaggcugauguuc

SEQ ID NO: 986002 - RNA, 18 nt, Human
cucaaugcuacuauguca

SEQ ID NO: 986003 - RNA, 20 nt, Human
cucaugagaccugaccaucu

SEQ ID NO: 986004 - RNA, 20 nt, Human
cucccaaaauauggcuaaaa

SEQ ID NO: 986005 - RNA, 19 nt, Human
cucccccaacccacacccc

SEQ ID NO: 986006 - RNA, 20 nt, Human
cucccccaacccacaccccu

SEQ ID NO: 986007 - RNA, 25 nt, Human
cucuuccaugcagucaagacuucag

SEQ ID NO: 986008 - RNA, 18 nt, Human
cugcagagcuuggcugca

SEQ ID NO: 986009 - RNA, 24 nt, Human
cuguacauugucccccagugaccu

SEQ ID NO: 986010 - RNA, 22 nt, Human
cuuccccaucccucccucaguc

SEQ ID NO: 986011 - RNA, 20 nt, Human
cuugaaguuaaacacgcagc

SEQ ID NO: 986012 - RNA, 20 nt, Human
gaaagcaacuauuuccaagc

SEQ ID NO: 986013 - RNA, 18 nt, Human
gaacaugaagugaaaaag

SEQ ID NO: 986014 - RNA, 21 nt, Human
gaacuguggcuacacuucccc

SEQ ID NO: 986015 - RNA, 21 nt, Human
gagcuuggcugcacccuuuac

SEQ ID NO: 986016 - RNA, 22 nt, Human
gagcuuucuggaggaaccuggg

SEQ ID NO: 986017 - RNA, 20 nt, Human
gaguuuguuaauucauccuc

SEQ ID NO: 986018 - RNA, 23 nt, Human
gcaaaacagaaauaaauauccuu

SEQ ID NO: 986019 - RNA, 18 nt, Human
gcaaagaguaccagaggc

SEQ ID NO: 986020 - RNA, 22 nt, Human
gcaaguuuuuuaagugguagcu

SEQ ID NO: 986021 - RNA, 23 nt, Human
gccacuguauucauauggaaagu

SEQ ID NO: 986022 - RNA, 25 nt, Human
ggaaagccucaucccuuuaacccuc

SEQ ID NO: 986023 - RNA, 22 nt, Human
ggacugggaagacuugaaguua

SEQ ID NO: 986024 - RNA, 19 nt, Human
ggcuauuucaauaaccauc

SEQ ID NO: 986025 - RNA, 20 nt, Human
guaguggcaaaguaaaaugc

SEQ ID NO: 986026 - RNA, 22 nt, Human
gugagcuugaguuucacaaguc

SEQ ID NO: 986027 - RNA, 23 nt, Human
uaaaaugccagcacugaagaugg

SEQ ID NO: 986028 - RNA, 22 nt, Human
uaaacuaggggucacaaaguca

SEQ ID NO: 986029 - RNA, 18 nt, Human
uaagaaguagcccgguac

SEQ ID NO: 986030 - RNA, 19 nt, Human
uaaguccuugcacuugacu

SEQ ID NO: 986031 - RNA, 18 nt, Human
uaccacuagaacaaacaa

SEQ ID NO: 986032 - RNA, 24 nt, Human
uaccagaggccacugaacacaucu

SEQ ID NO: 986033 - RNA, 19 nt, Human
ucagagucaauaugucuuc

SEQ ID NO: 986034 - RNA, 21 nt, Human
ucaguguccuggacaagauuc

SEQ ID NO: 986035 - RNA, 21 nt, Human
ucccagacucacacaauucuc

SEQ ID NO: 986036 - RNA, 25 nt, Human
ucccccaacccacaccccuguuuau

SEQ ID NO: 986037 - RNA, 24 nt, Human
ucccccagugaccugccacagaga

SEQ ID NO: 986038 - RNA, 18 nt, Human
uccccuccauugucagac

SEQ ID NO: 986039 - RNA, 20 nt, Human
ucgagccuuucauuauugac

SEQ ID NO: 986040 - RNA, 19 nt, Human
ucuauugcugaccuucauc

SEQ ID NO: 986041 - RNA, 20 nt, Human
ucucccuguacagaaaaaaa

SEQ ID NO: 986042 - RNA, 19 nt, Human
ucugcagagcuuggcugca

SEQ ID NO: 986043 - RNA, 19 nt, Human
ugaagaaaaacauauuugg

SEQ ID NO: 986044 - RNA, 22 nt, Human
ugaauagagcaaaacagaaaua

SEQ ID NO: 986045 - RNA, 18 nt, Human
ugcagauaccaguugugg

SEQ ID NO: 986046 - RNA, 18 nt, Human
ugcuugcauuucauuuga

SEQ ID NO: 986047 - RNA, 23 nt, Human
uggaaagccuaggagacauagga

SEQ ID NO: 986048 - RNA, 20 nt, Human
uggacucuguuucaaaagcu

SEQ ID NO: 986049 - RNA, 23 nt, Human
uggcaauauuugcagauaccagu

SEQ ID NO: 986050 - RNA, 19 nt, Human
uggugagcuugaguuucac

SEQ ID NO: 986051 - RNA, 21 nt, Human
ugucccgaagcuaucauagga

SEQ ID NO: 986052 - RNA, 19 nt, Human
uguccuaagcuccuccccc

SEQ ID NO: 986053 - RNA, 23 nt, Human
ugugaacagauuugcuaaacaaa

SEQ ID NO: 986054 - RNA, 24 nt, Human
uuaauucauccucccaacagaaag

SEQ ID NO: 986055 - RNA, 19 nt, Human
uuaccacuagaacaaacaa

SEQ ID NO: 986056 - RNA, 21 nt, Human
uuaccacuagaacaaacaaaa

SEQ ID NO: 986057 - RNA, 23 nt, Human
uucaaagcuggacuucaggaaac

SEQ ID NO: 986058 - RNA, 22 nt, Human
uugacagcugaagugggucccc

SEQ ID NO: 986059 - RNA, 21 nt, Human
uuguccuaagcuccuccccca

SEQ ID NO: 986060 - RNA, 21 nt, Human
uuucaauaaccaucauucauu

SEQ ID NO: 986061 - RNA, 22 nt, Human
uuuccugggaccucaaacacca

SEQ ID NO: 986062 - RNA, 23 nt, Human
aaaccagcagcaucacagcuuga

SEQ ID NO: 986063 - RNA, 20 nt, Human
aagcggaaaugaaaggccgc

SEQ ID NO: 986064 - RNA, 23 nt, Human
accagcagcaucacagcuugagc

SEQ ID NO: 986065 - RNA, 23 nt, Human
acccccuuguccuccccaccccc

SEQ ID NO: 986066 - RNA, 18 nt, Human
agccccuuacccaccccc

SEQ ID NO: 986067 - RNA, 25 nt, Human
cacagcuugagccccuuacccaccc

SEQ ID NO: 986068 - RNA, 21 nt, Human
cacccccuuguccuccccacc

SEQ ID NO: 986069 - RNA, 28 nt, Human
cacccccuuguccuccccaccccccacu

SEQ ID NO: 986070 - RNA, 19 nt, Human
cacuagagauaaaaccagc

SEQ ID NO: 986071 - RNA, 22 nt, Human
cacuagagauaaaaccagcagc

SEQ ID NO: 986072 - RNA, 21 nt, Human
ccacccccuuguccuccccac

SEQ ID NO: 986073 - RNA, 23 nt, Human
ccccuuguccuccccacccccca

SEQ ID NO: 986074 - RNA, 22 nt, Human
ccgcugcgcucgcgcgcggccc

SEQ ID NO: 986075 - RNA, 20 nt, Human
ccucccaccgcugcgcucgc

SEQ ID NO: 986076 - RNA, 19 nt, Human
ccuccccaccccccacucu

SEQ ID NO: 986077 - RNA, 21 nt, Human
ccuccccaccccccacucuuc

SEQ ID NO: 986078 - RNA, 24 nt, Human
ccuuacccacccccuuguccuccc

SEQ ID NO: 986079 - RNA, 20 nt, Human
ccuuguccuccccacccccc

SEQ ID NO: 986080 - RNA, 18 nt, Human
cgcgcggcccgcaccgga

SEQ ID NO: 986081 - RNA, 20 nt, Human
cucgaagcuuccgcucaugc

SEQ ID NO: 986082 - RNA, 19 nt, Human
gcucgcgcgcggcccgcac

SEQ ID NO: 986083 - RNA, 18 nt, Human
uccuccccaccccccacu

SEQ ID NO: 986084 - RNA, 23 nt, Human
uccuccccaccccccacucuucu

SEQ ID NO: 986085 - RNA, 21 nt, Human
ugagccccuuacccacccccu

SEQ ID NO: 986086 - RNA, 19 nt, Human
ugccucgaagcuuccgcuc

SEQ ID NO: 986087 - RNA, 22 nt, Human
uggugaggccaagccuggggcc

SEQ ID NO: 986088 - RNA, 24 nt, Human
aaaauaccuggcaagugaauaguu

SEQ ID NO: 986089 - RNA, 19 nt, Human
aaagugcugggauuacagg

SEQ ID NO: 986090 - RNA, 24 nt, Human
aaagugcugggauuacaggccuga

SEQ ID NO: 986091 - RNA, 19 nt, Human
aagugcugggauuacaggc

SEQ ID NO: 986092 - RNA, 19 nt, Human
aagugcugggauuacaggc

SEQ ID NO: 986093 - RNA, 26 nt, Human
aagugcugggauuacaggccugagcc

SEQ ID NO: 986094 - RNA, 19 nt, Human
aauugugugaugcuuauau

SEQ ID NO: 986095 - RNA, 22 nt, Human
acaggguuucacuauguuggca

SEQ ID NO: 986096 - RNA, 23 nt, Human
acaggguuucacuauguuggcaa

SEQ ID NO: 986097 - RNA, 24 nt, Human
acaggguuucacuauguuggcaag

SEQ ID NO: 986098 - RNA, 19 nt, Human
acccaggcuggagugcagu

SEQ ID NO: 986099 - RNA, 24 nt, Human
acuauguuggcaaggcuggucucg

SEQ ID NO: 986100 - RNA, 18 nt, Human
acucuaucacccaggcug

SEQ ID NO: 986101 - RNA, 25 nt, Human
acucuaucacccaggcuggagugca

SEQ ID NO: 986102 - RNA, 19 nt, Human
agcacugguugccuuugac

SEQ ID NO: 986103 - RNA, 25 nt, Human
aggcuggagugcaguggcgcgaucu

SEQ ID NO: 986104 - RNA, 21 nt, Human
agugcaguggcgcgaucucag

SEQ ID NO: 986105 - RNA, 23 nt, Human
agugcaguggcgcgaucucagcu

SEQ ID NO: 986106 - RNA, 24 nt, Human
agugcaguggcgcgaucucagcuc

SEQ ID NO: 986107 - RNA, 18 nt, Human
aucucacucuaucaccca

SEQ ID NO: 986108 - RNA, 24 nt, Human
caaagugcugggauuacaggccug

SEQ ID NO: 986109 - RNA, 20 nt, Human
caacuugaaaaaagaauaau

SEQ ID NO: 986110 - RNA, 24 nt, Human
caccaugcccggcuaauuuuugua

SEQ ID NO: 986111 - RNA, 24 nt, Human
cacccaggcuggagugcaguggcg

SEQ ID NO: 986112 - RNA, 24 nt, Human
caccucggccucccaaagugcugg

SEQ ID NO: 986113 - RNA, 19 nt, Human
cacgcauggccugcacagu

SEQ ID NO: 986114 - RNA, 24 nt, Human
cacuauguuggcaaggcuggucuc

SEQ ID NO: 986115 - RNA, 23 nt, Human
cacucuaucacccaggcuggagu

SEQ ID NO: 986116 - RNA, 24 nt, Human
cacucuaucacccaggcuggagug

SEQ ID NO: 986117 - RNA, 18 nt, Human
cagagaccgcagcgagca

SEQ ID NO: 986118 - RNA, 19 nt, Human
caggguuucacuauguugg

SEQ ID NO: 986119 - RNA, 24 nt, Human
caggguuucacuauguuggcaagg

SEQ ID NO: 986120 - RNA, 19 nt, Human
caggugccugccaccaugc

SEQ ID NO: 986121 - RNA, 23 nt, Human
caggugccugccaccaugcccgg

SEQ ID NO: 986122 - RNA, 19 nt, Human
ccaaagugcugggauuaca

SEQ ID NO: 986123 - RNA, 22 nt, Human
ccaaagugcugggauuacaggc

SEQ ID NO: 986124 - RNA, 24 nt, Human
ccaaagugcugggauuacaggccu

SEQ ID NO: 986125 - RNA, 19 nt, Human
ccccagagaccgcagcgag

SEQ ID NO: 986126 - RNA, 23 nt, Human
ccccagagaccgcagcgagcacu

SEQ ID NO: 986127 - RNA, 21 nt, Human
ccgccgccgcggucccgaucc

SEQ ID NO: 986128 - RNA, 19 nt, Human
ccucugccuccuggguuca

SEQ ID NO: 986129 - RNA, 19 nt, Human
cgcagcgagcacugguugc

SEQ ID NO: 986130 - RNA, 22 nt, Human
cuaguaccugggauuacaggug

SEQ ID NO: 986131 - RNA, 20 nt, Human
cucacucuaucacccaggcc

SEQ ID NO: 986132 - RNA, 18 nt, Human
cuccuggguucaaaagcc

SEQ ID NO: 986133 - RNA, 21 nt, Human
cuccuggguucaaaagccucc

SEQ ID NO: 986134 - RNA, 24 nt, Human
cucgcugcaaccucugccuccugg

SEQ ID NO: 986135 - RNA, 21 nt, Human
cugcaaccucugccuccuggg

SEQ ID NO: 986136 - RNA, 23 nt, Human
cugcaaccucugccuccuggguu

SEQ ID NO: 986137 - RNA, 24 nt, Human
cugcaaccucugccuccuggguuc

SEQ ID NO: 986138 - RNA, 24 nt, Human
gaccuccggugaucugcccaccuc

SEQ ID NO: 986139 - RNA, 21 nt, Human
gaggcaaguuucaacuugaaa

SEQ ID NO: 986140 - RNA, 18 nt, Human
gauuacaggccugagcca

SEQ ID NO: 986141 - RNA, 21 nt, Human
gauuacaggccugagccacca

SEQ ID NO: 986142 - RNA, 18 nt, Human
gauuacaggugccugcca

SEQ ID NO: 986143 - RNA, 24 nt, Human
gauuacaggugccugccaccaugc

SEQ ID NO: 986144 - RNA, 18 nt, Human
gauucaguaauugucaac

SEQ ID NO: 986145 - RNA, 22 nt, Human
gcccggcuaauuuuuguauuuu

SEQ ID NO: 986146 - RNA, 19 nt, Human
gcuggagugcaguggcgcg

SEQ ID NO: 986147 - RNA, 21 nt, Human
gcugggauuacaggccugagc

SEQ ID NO: 986148 - RNA, 23 nt, Human
gcuggucucgaacuccugaccuc

SEQ ID NO: 986149 - RNA, 19 nt, Human
ggauuacaggccugagcca

SEQ ID NO: 986150 - RNA, 24 nt, Human
ggcuggucucgaacuccugaccuc

SEQ ID NO: 986151 - RNA, 19 nt, Human
ggucucgaacuccugaccu

SEQ ID NO: 986152 - RNA, 21 nt, Human
guacagauauuuagaaaacca

SEQ ID NO: 986153 - RNA, 22 nt, Human
guagguacuuuaacacccucau

SEQ ID NO: 986154 - RNA, 24 nt, Human
gugaucugcccaccucggccuccc

SEQ ID NO: 986155 - RNA, 22 nt, Human
uaaagacaggguuucacuaugu

SEQ ID NO: 986156 - RNA, 28 nt, Human
uaaguagguacuuuaacacuguaaugac

SEQ ID NO: 986157 - RNA, 24 nt, Human
uaauuuuuguauuuuuaguaaaga

SEQ ID NO: 986158 - RNA, 19 nt, Human
uagaagaggcaaguuucaa

SEQ ID NO: 986159 - RNA, 24 nt, Human
uaguaaagacaggguuucacuaug

SEQ ID NO: 986160 - RNA, 20 nt, Human
uaguaccugggauuacaggu

SEQ ID NO: 986161 - RNA, 26 nt, Human
uaguaccugggauuacaggugccugc

SEQ ID NO: 986162 - RNA, 19 nt, Human
uauuuuaucuuuuggcuuu

SEQ ID NO: 986163 - RNA, 21 nt, Human
uauuuuaucuuuuggcuuuca

SEQ ID NO: 986164 - RNA, 23 nt, Human
ucaaaagccucccuaguaccugg

SEQ ID NO: 986165 - RNA, 22 nt, Human
ucaacuugaaaaaagaauaauu

SEQ ID NO: 986166 - RNA, 22 nt, Human
ucacccaggcuggagugcagug

SEQ ID NO: 986167 - RNA, 18 nt, Human
ucacuauguuggcaaggc

SEQ ID NO: 986168 - RNA, 22 nt, Human
ucacuauguuggcaaggcuggu

SEQ ID NO: 986169 - RNA, 24 nt, Human
ucacucuaucacccaggcuggagu

SEQ ID NO: 986170 - RNA, 24 nt, Human
uccacucugcgcgacucccaggga

SEQ ID NO: 986171 - RNA, 24 nt, Human
ucccaaagugcugggauuacaggc

SEQ ID NO: 986172 - RNA, 18 nt, Human
ucccgauccccagagacc

SEQ ID NO: 986173 - RNA, 24 nt, Human
ucccuaguaccugggauuacaggu

SEQ ID NO: 986174 - RNA, 25 nt, Human
ucccuaguaccugggauuacaggug

SEQ ID NO: 986175 - RNA, 24 nt, Human
ucgcugcaaccucugccuccuggg

SEQ ID NO: 986176 - RNA, 25 nt, Human
ucgcugcaaccucugccuccugggu

SEQ ID NO: 986177 - RNA, 18 nt, Human
ucggccucccaaagugcu

SEQ ID NO: 986178 - RNA, 24 nt, Human
ucuaucacccaggcuggagugcag

SEQ ID NO: 986179 - RNA, 23 nt, Human
ucucacucuaucacccaggcugg

SEQ ID NO: 986180 - RNA, 24 nt, Human
ucucacucuaucacccaggcugga

SEQ ID NO: 986181 - RNA, 26 nt, Human
ucucacucuaucacccaggcuggagu

SEQ ID NO: 986182 - RNA, 27 nt, Human
ucucacucuaucacccaggcuggagug

SEQ ID NO: 986183 - RNA, 21 nt, Human
ugaaaaaagaauaauuuugaa

SEQ ID NO: 986184 - RNA, 22 nt, Human
ugaccucauggaaaacagaacu

SEQ ID NO: 986185 - RNA, 20 nt, Human
ugaccuccggugaucugccc

SEQ ID NO: 986186 - RNA, 24 nt, Human
ugaucugcccaccucggccuccca

SEQ ID NO: 986187 - RNA, 22 nt, Human
ugcaguggcgcgaucucagcuc

SEQ ID NO: 986188 - RNA, 24 nt, Human
ugcccggcuaauuuuuguauuuuu

SEQ ID NO: 986189 - RNA, 25 nt, Human
ugccuccuggguucaaaagccuccc

SEQ ID NO: 986190 - RNA, 23 nt, Human
uggagugcaguggcgcgaucuca

SEQ ID NO: 986191 - RNA, 24 nt, Human
uggagugcaguggcgcgaucucag

SEQ ID NO: 986192 - RNA, 24 nt, Human
uggcaaggcuggucucgaacuccu

SEQ ID NO: 986193 - RNA, 24 nt, Human
uggcgcgaucucagcucgcugcaa

SEQ ID NO: 986194 - RNA, 18 nt, Human
ugggauuacaggccugag

SEQ ID NO: 986195 - RNA, 19 nt, Human
ugggauuacaggccugagc

SEQ ID NO: 986196 - RNA, 21 nt, Human
ugggauuacaggccugagcca

SEQ ID NO: 986197 - RNA, 22 nt, Human
ugggauuacaggccugagccac

SEQ ID NO: 986198 - RNA, 24 nt, Human
ugggauuacaggccugagccacca

SEQ ID NO: 986199 - RNA, 21 nt, Human
ugggauuacaggugccugcca

SEQ ID NO: 986200 - RNA, 22 nt, Human
ugggauuacaggugccugccac

SEQ ID NO: 986201 - RNA, 24 nt, Human
ugggauuacaggugccugccacca

SEQ ID NO: 986202 - RNA, 25 nt, Human
ugggauuacaggugccugccaccau

SEQ ID NO: 986203 - RNA, 23 nt, Human
uuaaaauggaauguggaguacag

SEQ ID NO: 986204 - RNA, 21 nt, Human
uuaguaaagacaggguuucac

SEQ ID NO: 986205 - RNA, 24 nt, Human
uuaguaaagacaggguuucacuau

SEQ ID NO: 986206 - RNA, 21 nt, Human
uuucacuauguuggcaaggcu

SEQ ID NO: 986207 - RNA, 24 nt, Human
uuuuuaguaaagacaggguuucac

SEQ ID NO: 986208 - RNA, 20 nt, Human
uuuuuguauuuuuaguaaag

SEQ ID NO: 986209 - RNA, 23 nt, Human
uuuuuguauuuuuaguaaagaca

SEQ ID NO: 986210 - RNA, 26 nt, Human
uuuuuuuuuuuugagacugaaucuca

SEQ ID NO: 986211 - RNA, 18 nt, Human
uuuuuuuuuuuuuuuuug

SEQ ID NO: 986212 - RNA, 21 nt, Human
ccaauucaauuaguucucuua

SEQ ID NO: 986213 - RNA, 20 nt, Human
gccuaaacaguccuaugaag

SEQ ID NO: 986214 - RNA, 25 nt, Human
gcuuuuccacccccacccccagauu

SEQ ID NO: 986215 - RNA, 26 nt, Human
uaaauaccaaaacguucaaacagagg

SEQ ID NO: 986216 - RNA, 19 nt, Human
uaccaaaacguucaaacag

SEQ ID NO: 986217 - RNA, 24 nt, Human
ucgcaguugcuuuuccacccccac

SEQ ID NO: 986218 - RNA, 22 nt, Human
ugcccaaugaaaacuugcucug

SEQ ID NO: 986219 - RNA, 22 nt, Human
ugcuuuuccacccccaccccca

SEQ ID NO: 986220 - RNA, 20 nt, Human
uguccggagguauuucaagg

SEQ ID NO: 986221 - RNA, 21 nt, Human
uuagguaaaaugauuucucuc

SEQ ID NO: 986222 - RNA, 23 nt, Human
uucaaggaugcugccaauucaau

SEQ ID NO: 986223 - RNA, 21 nt, Human
uuccacccccacccccagauc

SEQ ID NO: 986224 - RNA, 20 nt, Human
uuuuuuuuuuuuuuugugca

SEQ ID NO: 986225 - RNA, 19 nt, Human
uuuuuuuuuuuuuuuuugu

SEQ ID NO: 986226 - RNA, 20 nt, Human
uuuuuuuuuuuuuuuuuugg

SEQ ID NO: 986227 - RNA, 18 nt, Human
aaacauccaucaaacacc

SEQ ID NO: 986228 - RNA, 20 nt, Human
aacacucguggcacaaaaga

SEQ ID NO: 986229 - RNA, 22 nt, Human
aagagcagaauuaaauguaaua

SEQ ID NO: 986230 - RNA, 21 nt, Human
aaguuucuggcacucuugucu

SEQ ID NO: 986231 - RNA, 24 nt, Human
aauugcuuuucuacauaaccccau

SEQ ID NO: 986232 - RNA, 22 nt, Human
accccaugcugauggguuuuau

SEQ ID NO: 986233 - RNA, 18 nt, Human
agacaggaggcucaucuu

SEQ ID NO: 986234 - RNA, 19 nt, Human
aggaguuaguccuugacca

SEQ ID NO: 986235 - RNA, 23 nt, Human
agugcauaugugaggguuguugc

SEQ ID NO: 986236 - RNA, 18 nt, Human
agugcccaucccucuggc

SEQ ID NO: 986237 - RNA, 27 nt, Human
agugucaaaggcagugugguagagaga

SEQ ID NO: 986238 - RNA, 23 nt, Human
auaaaacauccaucaaacaccag

SEQ ID NO: 986239 - RNA, 22 nt, Human
aucaagagcagaauuaaaugua

SEQ ID NO: 986240 - RNA, 21 nt, Human
auguaauggaaauuggcuauc

SEQ ID NO: 986241 - RNA, 19 nt, Human
cacaugugccccucaaaaa

SEQ ID NO: 986242 - RNA, 20 nt, Human
cacucuugucugguuggaag

SEQ ID NO: 986243 - RNA, 21 nt, Human
cagcugcuccuucugcuucug

SEQ ID NO: 986244 - RNA, 24 nt, Human
cagggaaagugaaagacauaaaac

SEQ ID NO: 986245 - RNA, 22 nt, Human
caugagguaagaucuuugggaa

SEQ ID NO: 986246 - RNA, 20 nt, Human
ccacagguagacugucaagu

SEQ ID NO: 986247 - RNA, 20 nt, Human
cccggagcugggccaguucc

SEQ ID NO: 986248 - RNA, 18 nt, Human
ccugacaguuauaccaca

SEQ ID NO: 986249 - RNA, 21 nt, Human
ccugacaguuauaccacaggu

SEQ ID NO: 986250 - RNA, 18 nt, Human
cugcuccuucugcuucug

SEQ ID NO: 986251 - RNA, 22 nt, Human
cugucaaguugggaagagugaa

SEQ ID NO: 986252 - RNA, 18 nt, Human
cuuuuuuuuuuuaggagu

SEQ ID NO: 986253 - RNA, 19 nt, Human
gaccuguuucaccagcagg

SEQ ID NO: 986254 - RNA, 18 nt, Human
gaguugcuuuuuuuuuuu

SEQ ID NO: 986255 - RNA, 21 nt, Human
gccaguuccucugagagcugg

SEQ ID NO: 986256 - RNA, 25 nt, Human
gcuuaguuuuuuguuguuguuguuu

SEQ ID NO: 986257 - RNA, 20 nt, Human
ggaagagugaaucaauaacu

SEQ ID NO: 986258 - RNA, 24 nt, Human
gggccuuuacuuagguuagaaaua

SEQ ID NO: 986259 - RNA, 22 nt, Human
gucgccggcuuuccuggagaaa

SEQ ID NO: 986260 - RNA, 24 nt, Human
guguaagugcuuaaaauggaauaa

SEQ ID NO: 986261 - RNA, 21 nt, Human
uaaaacauccaucaaacacca

SEQ ID NO: 986262 - RNA, 20 nt, Human
uaaaauggaauaaauugcuu

SEQ ID NO: 986263 - RNA, 20 nt, Human
uaacacucguggcacaaaag

SEQ ID NO: 986264 - RNA, 31 nt, Human
uaaccagauaaaauuccuguuuuuucccaag

SEQ ID NO: 986265 - RNA, 18 nt, Human
uaaggcaagauuuaaauu

SEQ ID NO: 986266 - RNA, 18 nt, Human
uaaggcaagauuuaaauu

SEQ ID NO: 986267 - RNA, 19 nt, Human
uaaggcaagauuuaaauuu

SEQ ID NO: 986268 - RNA, 21 nt, Human
uagaagaguccuucagaugac

SEQ ID NO: 986269 - RNA, 21 nt, Human
uagaaucuuuuuaagcagguc

SEQ ID NO: 986270 - RNA, 24 nt, Human
uauaugggucagcauauccuugaa

SEQ ID NO: 986271 - RNA, 20 nt, Human
ucaagucuaguuguuuuaga

SEQ ID NO: 986272 - RNA, 22 nt, Human
ucagagguuuuauuuccccagu

SEQ ID NO: 986273 - RNA, 18 nt, Human
ucagccaguauuugcaac

SEQ ID NO: 986274 - RNA, 21 nt, Human
ucaguaucaacagcagaugaa

SEQ ID NO: 986275 - RNA, 19 nt, Human
uccccaguauguuuuucac

SEQ ID NO: 986276 - RNA, 19 nt, Human
uccuggagaaagugcccau

SEQ ID NO: 986277 - RNA, 19 nt, Human
ucugauaggcaucccggag

SEQ ID NO: 986278 - RNA, 21 nt, Human
ucugcuucugauaggcauccc

SEQ ID NO: 986279 - RNA, 24 nt, Human
ugaaagacauaaaacacugaauca

SEQ ID NO: 986280 - RNA, 19 nt, Human
ugaaauagaauccagcaaa

SEQ ID NO: 986281 - RNA, 24 nt, Human
ugaaauagaauccagcaaagaguu

SEQ ID NO: 986282 - RNA, 24 nt, Human
ugaguagaucauucugacccagaa

SEQ ID NO: 986283 - RNA, 21 nt, Human
ugauaagaguugcuuggacgc

SEQ ID NO: 986284 - RNA, 23 nt, Human
ugauaagaguugcuuuggacguc

SEQ ID NO: 986285 - RNA, 21 nt, Human
ugauccuuugcuaagaaguuu

SEQ ID NO: 986286 - RNA, 19 nt, Human
ugccuccggccaacucuag

SEQ ID NO: 986287 - RNA, 21 nt, Human
uggaagaguacauccaaaggg

SEQ ID NO: 986288 - RNA, 19 nt, Human
uggcuucuagaagaguccu

SEQ ID NO: 986289 - RNA, 22 nt, Human
uggcuucuagaagaguccuuca

SEQ ID NO: 986290 - RNA, 23 nt, Human
uggcuucuagaagaguccuucag

SEQ ID NO: 986291 - RNA, 19 nt, Human
ugggaaaaucugaauagcg

SEQ ID NO: 986292 - RNA, 21 nt, Human
ugggcagagagucgccggcuu

SEQ ID NO: 986293 - RNA, 22 nt, Human
uguaaacccauguaauggaaau

SEQ ID NO: 986294 - RNA, 22 nt, Human
uguucugccuccggccaacucu

SEQ ID NO: 986295 - RNA, 23 nt, Human
uguuguccauggucuuugacuau

SEQ ID NO: 986296 - RNA, 22 nt, Human
uuaaauuuggaaaaggugcuug

SEQ ID NO: 986297 - RNA, 20 nt, Human
uucaugagguaagaucuuug

SEQ ID NO: 986298 - RNA, 22 nt, Human
uucugccuccggccaacucuag

SEQ ID NO: 986299 - RNA, 19 nt, Human
uugaaggccucuaucacca

SEQ ID NO: 986300 - RNA, 22 nt, Human
uuuuuuuuuuaacuugggacca

SEQ ID NO: 986301 - RNA, 25 nt, Human
uuuuuuuuuuuuuuuuuaacuuggg

SEQ ID NO: 986302 - RNA, 20 nt, Human
aaaccuucuuguugucuguu

SEQ ID NO: 986303 - RNA, 21 nt, Human
aagcugccacaccgagggcuc

SEQ ID NO: 986304 - RNA, 21 nt, Human
aagcugccacaccgagggcuu

SEQ ID NO: 986305 - RNA, 22 nt, Human
aaggaaaacaagguaaaaagga

SEQ ID NO: 986306 - RNA, 20 nt, Human
aauuacagccaucuaauucc

SEQ ID NO: 986307 - RNA, 20 nt, Human
aucuaauuccucucccagca

SEQ ID NO: 986308 - RNA, 20 nt, Human
caccaugggaaagcugccca

SEQ ID NO: 986309 - RNA, 21 nt, Human
ccaaaaugaaagaacauuaga

SEQ ID NO: 986310 - RNA, 18 nt, Human
ccaaaggaaaacaaggua

SEQ ID NO: 986311 - RNA, 21 nt, Human
ccaccucugaagccauaauuu

SEQ ID NO: 986312 - RNA, 23 nt, Human
ccagcaccuugauggucaccaaa

SEQ ID NO: 986313 - RNA, 21 nt, Human
cuaauuccucucccagcaccu

SEQ ID NO: 986314 - RNA, 21 nt, Human
gagcagcaccaugggaaagcu

SEQ ID NO: 986315 - RNA, 18 nt, Human
ggaaaacaagguaaaaag

SEQ ID NO: 986316 - RNA, 20 nt, Human
ggaaaacaagguaaaaaggg

SEQ ID NO: 986317 - RNA, 22 nt, Human
uaaaacaucaugccccaaagga

SEQ ID NO: 986318 - RNA, 21 nt, Human
uaaagcugccacaccgagggc

SEQ ID NO: 986319 - RNA, 22 nt, Human
uaacuuugaauuacagccaucu

SEQ ID NO: 986320 - RNA, 19 nt, Human
uaauuccucucccagcacc

SEQ ID NO: 986321 - RNA, 25 nt, Human
ucccccgucacuguuuaucuuccac

SEQ ID NO: 986322 - RNA, 25 nt, Human
uccuuggcugugcacagaaugggcc

SEQ ID NO: 986323 - RNA, 25 nt, Human
ucuaaagcaaagguuaaaacaucau

SEQ ID NO: 986324 - RNA, 20 nt, Human
ucuuccaaaccuucuuguug

SEQ ID NO: 986325 - RNA, 24 nt, Human
ugaaagaacauuagaguacagaaa

SEQ ID NO: 986326 - RNA, 19 nt, Human
ugacauggugcuugggagg

SEQ ID NO: 986327 - RNA, 19 nt, Human
ugggaaagcugcccagaug

SEQ ID NO: 986328 - RNA, 24 nt, Human
ugguuggagcagcaccaugggaaa

SEQ ID NO: 986329 - RNA, 24 nt, Human
uguuuguucccccgucacuguuua

SEQ ID NO: 986330 - RNA, 23 nt, Human
uucagagucucaaaccagauuuc

SEQ ID NO: 986331 - RNA, 18 nt, Human
uucuccagguuucccgag

SEQ ID NO: 986332 - RNA, 22 nt, Human
uuggagcagcaccaugggaaag

SEQ ID NO: 986333 - RNA, 18 nt, Human
uuggagguccuuacucaa

SEQ ID NO: 986334 - RNA, 20 nt, Human
uuugcacacaugugaucugg

SEQ ID NO: 986335 - RNA, 20 nt, Human
aaaaacaucccuaucaaguc

SEQ ID NO: 986336 - RNA, 18 nt, Human
aaacaucccuaucaaguc

SEQ ID NO: 986337 - RNA, 23 nt, Human
aacaaaccagaauucacaaagug

SEQ ID NO: 986338 - RNA, 21 nt, Human
aacacaaucugaaagcugccc

SEQ ID NO: 986339 - RNA, 18 nt, Human
aaccccccgcccccaccc

SEQ ID NO: 986340 - RNA, 19 nt, Human
aaccccccgcccccacccc

SEQ ID NO: 986341 - RNA, 22 nt, Human
acacuaagucacucagauuggu

SEQ ID NO: 986342 - RNA, 22 nt, Human
accacugcucauugaccauacc

SEQ ID NO: 986343 - RNA, 23 nt, Human
accccccgcccccacccccgccg

SEQ ID NO: 986344 - RNA, 22 nt, Human
acugacauuuccagagaucccu

SEQ ID NO: 986345 - RNA, 26 nt, Human
agcccagaagaagucugcacaggucc

SEQ ID NO: 986346 - RNA, 20 nt, Human
agcugauuggaguaaaacug

SEQ ID NO: 986347 - RNA, 18 nt, Human
aggaacacaaucugaaag

SEQ ID NO: 986348 - RNA, 18 nt, Human
aggcaggugguguagcac

SEQ ID NO: 986349 - RNA, 23 nt, Human
agucaaaagcuccagcuaaaauc

SEQ ID NO: 986350 - RNA, 19 nt, Human
caaacaaaccagaauucac

SEQ ID NO: 986351 - RNA, 21 nt, Human
caaccccccgcccccaccccc

SEQ ID NO: 986352 - RNA, 24 nt, Human
caaccccccgcccccacccccgcc

SEQ ID NO: 986353 - RNA, 22 nt, Human
caagucgguaguuuggcauuua

SEQ ID NO: 986354 - RNA, 21 nt, Human
cauguccaucucaguugaaga

SEQ ID NO: 986355 - RNA, 26 nt, Human
cauuagucaaaagcuccagcuaaaau

SEQ ID NO: 986356 - RNA, 22 nt, Human
ccaaacaguuaaaacccaaagc

SEQ ID NO: 986357 - RNA, 21 nt, Human
ccacacagguucccugcuccu

SEQ ID NO: 986358 - RNA, 27 nt, Human
ccagagaucccuaaacuaaucaacuag

SEQ ID NO: 986359 - RNA, 23 nt, Human
cccacccccgccguggccaaaca

SEQ ID NO: 986360 - RNA, 22 nt, Human
ccccacccccgccguggccaaa

SEQ ID NO: 986361 - RNA, 20 nt, Human
ccccccgcccccacccccgc

SEQ ID NO: 986362 - RNA, 21 nt, Human
ccccccgcccccacccccgcc

SEQ ID NO: 986363 - RNA, 24 nt, Human
ccccccgcccccacccccgccgug

SEQ ID NO: 986364 - RNA, 26 nt, Human
ccccccgcccccacccccgccguggc

SEQ ID NO: 986365 - RNA, 20 nt, Human
cccccgcccccacccccgcc

SEQ ID NO: 986366 - RNA, 18 nt, Human
cccggggcaccugccaca

SEQ ID NO: 986367 - RNA, 23 nt, Human
cccgugcuggguaagcccagaag

SEQ ID NO: 986368 - RNA, 23 nt, Human
cccugcuccuggggaggaacaca

SEQ ID NO: 986369 - RNA, 19 nt, Human
cccugggcuccagggagcc

SEQ ID NO: 986370 - RNA, 20 nt, Human
cccugggcuccagggagccc

SEQ ID NO: 986371 - RNA, 21 nt, Human
ccguggccaaacaguuaaaac

SEQ ID NO: 986372 - RNA, 22 nt, Human
cgcccggccgaggggcaagggc

SEQ ID NO: 986373 - RNA, 28 nt, Human
cucauugaccauaccuacauuauaauaa

SEQ ID NO: 986374 - RNA, 23 nt, Human
cugaaagcugcccugggcuccag

SEQ ID NO: 986375 - RNA, 19 nt, Human
cugcacaggucccgggacc

SEQ ID NO: 986376 - RNA, 20 nt, Human
cuggguaagcccagaagaag

SEQ ID NO: 986377 - RNA, 18 nt, Human
gccccgcuugccuggcuc

SEQ ID NO: 986378 - RNA, 20 nt, Human
gcccugggcuccagggagcc

SEQ ID NO: 986379 - RNA, 19 nt, Human
ggaggaacacaaucugaaa

SEQ ID NO: 986380 - RNA, 18 nt, Human
gugcugggcacccuuggc

SEQ ID NO: 986381 - RNA, 23 nt, Human
guuuggcauuuacuuuacauuag

SEQ ID NO: 986382 - RNA, 24 nt, Human
uaaaaaauaugcacaaauaaccac

SEQ ID NO: 986383 - RNA, 19 nt, Human
uaaaacccaaagcaaagca

SEQ ID NO: 986384 - RNA, 21 nt, Human
uaaaacccaaagcaaagcauc

SEQ ID NO: 986385 - RNA, 20 nt, Human
uaaaagagcagagcuaggua

SEQ ID NO: 986386 - RNA, 19 nt, Human
uaaagcaauauaaaagagc

SEQ ID NO: 986387 - RNA, 18 nt, Human
uaacuuacaaaaacaucc

SEQ ID NO: 986388 - RNA, 24 nt, Human
uaagcccagaagaagucugcacag

SEQ ID NO: 986389 - RNA, 18 nt, Human
uacaaaaacaucccuauc

SEQ ID NO: 986390 - RNA, 22 nt, Human
uaccaaccccccgcccccaccc

SEQ ID NO: 986391 - RNA, 23 nt, Human
uaccaaccccccgcccccacccc

SEQ ID NO: 986392 - RNA, 19 nt, Human
ucaaaagcuccagcuaaaa

SEQ ID NO: 986393 - RNA, 18 nt, Human
ucaacuaguucugccaaa

SEQ ID NO: 986394 - RNA, 24 nt, Human
uccagagaucccuaaacuaaucaa

SEQ ID NO: 986395 - RNA, 24 nt, Human
uccgcccggccgaggggcaagggc

SEQ ID NO: 986396 - RNA, 23 nt, Human
ugaaagcugcccugggcuccagg

SEQ ID NO: 986397 - RNA, 18 nt, Human
ugcacaaauaaccacauc

SEQ ID NO: 986398 - RNA, 24 nt, Human
ugcacaaauaaccacauccaugca

SEQ ID NO: 986399 - RNA, 20 nt, Human
ugcccugggcuccagggagc

SEQ ID NO: 986400 - RNA, 19 nt, Human
ugcucgcuugcuucuauaa

SEQ ID NO: 986401 - RNA, 21 nt, Human
uggguaagcccagaagaaguc

SEQ ID NO: 986402 - RNA, 19 nt, Human
uuuguuuuuuaaugagaaa

SEQ ID NO: 986403 - RNA, 32 nt, Human
uuuuuuuuuuuucuggcuaauuuuguuuuuuu

SEQ ID NO: 986404 - RNA, 18 nt, Human
uuuuuuuuuuuuuuucug

SEQ ID NO: 986405 - RNA, 25 nt, Human
uuuuuuuuuuuuuuucuggcuaauu

SEQ ID NO: 986406 - RNA, 20 nt, Human
caccugagggcccgcccuuc

SEQ ID NO: 986407 - RNA, 19 nt, Human
cacugggaggugggagcca

SEQ ID NO: 986408 - RNA, 25 nt, Human
cggcaccugagaaggggccgccccc

SEQ ID NO: 986409 - RNA, 21 nt, Human
gaaucgcggucuccccuuuaa

SEQ ID NO: 986410 - RNA, 20 nt, Human
gcuucaggccagcccugggc

SEQ ID NO: 986411 - RNA, 18 nt, Human
ggaccuggaauggcagug

SEQ ID NO: 986412 - RNA, 21 nt, Human
ggaggugggagccagggugcu

SEQ ID NO: 986413 - RNA, 18 nt, Human
ggccacugggagguggga

SEQ ID NO: 986414 - RNA, 20 nt, Human
uaaggaccuggaauggcagu

SEQ ID NO: 986415 - RNA, 22 nt, Human
ucaggccagcccugggcuuggc

SEQ ID NO: 986416 - RNA, 18 nt, Human
uccuuuggggccacuggg

SEQ ID NO: 986417 - RNA, 22 nt, Human
uccuuuggggccacugggaggu

SEQ ID NO: 986418 - RNA, 23 nt, Human
uggaauggcagugcugagguuug

SEQ ID NO: 986419 - RNA, 18 nt, Human
ugggagccagggugcugg

SEQ ID NO: 986420 - RNA, 19 nt, Human
ugggagccagggugcuggg

SEQ ID NO: 986421 - RNA, 19 nt, Human
uuagaaucgcggucucccc

SEQ ID NO: 986422 - RNA, 21 nt, Human
aaaaaagacaaaaacauuuaa

SEQ ID NO: 986423 - RNA, 18 nt, Human
aaaaauuuuauucucugu

SEQ ID NO: 986424 - RNA, 20 nt, Human
aaaauaaauaaggcaauucc

SEQ ID NO: 986425 - RNA, 21 nt, Human
aaacccagaaacacuggccug

SEQ ID NO: 986426 - RNA, 18 nt, Human
aaagagguuauagggaaa

SEQ ID NO: 986427 - RNA, 20 nt, Human
aaauauauuuugguggcuga

SEQ ID NO: 986428 - RNA, 22 nt, Human
aacauauagacaagcaaaccca

SEQ ID NO: 986429 - RNA, 18 nt, Human
aacaugaacugaacagcc

SEQ ID NO: 986430 - RNA, 18 nt, Human
aaccacagaaugaaaucc

SEQ ID NO: 986431 - RNA, 18 nt, Human
aagcaacuuuggaggagc

SEQ ID NO: 986432 - RNA, 19 nt, Human
aagcuaagguuaagcuaac

SEQ ID NO: 986433 - RNA, 21 nt, Human
acaaaauaggcuacaagguca

SEQ ID NO: 986434 - RNA, 21 nt, Human
accagucugcgugaacugcac

SEQ ID NO: 986435 - RNA, 23 nt, Human
acccaucuugcucucucccccaa

SEQ ID NO: 986436 - RNA, 22 nt, Human
acgguguaugccaccggcuccc

SEQ ID NO: 986437 - RNA, 18 nt, Human
acugcagccuucaaagcu

SEQ ID NO: 986438 - RNA, 24 nt, Human
agacaaacauauagacaagcaaac

SEQ ID NO: 986439 - RNA, 25 nt, Human
agacaaacauauagacaagcaaacc

SEQ ID NO: 986440 - RNA, 19 nt, Human
agacaagcaaacccagaaa

SEQ ID NO: 986441 - RNA, 19 nt, Human
agacaagcaaacccagaaa

SEQ ID NO: 986442 - RNA, 21 nt, Human
agacaagcaaacccagaaaca

SEQ ID NO: 986443 - RNA, 24 nt, Human
agacaucccccagucacguaaggg

SEQ ID NO: 986444 - RNA, 21 nt, Human
agagaacagcaggaacaaaau

SEQ ID NO: 986445 - RNA, 19 nt, Human
agauacaacaggcgguaca

SEQ ID NO: 986446 - RNA, 23 nt, Human
agcaggaacaaaauaggcuacaa

SEQ ID NO: 986447 - RNA, 18 nt, Human
aggagcuuacuuuucccc

SEQ ID NO: 986448 - RNA, 20 nt, Human
agggaugacacuugaucacu

SEQ ID NO: 986449 - RNA, 22 nt, Human
auaaaacaaaagacaaaucucc

SEQ ID NO: 986450 - RNA, 22 nt, Human
aucagcuucuccaaggaaccca

SEQ ID NO: 986451 - RNA, 27 nt, Human
aucauauaaagcacguaaaugccacca

SEQ ID NO: 986452 - RNA, 19 nt, Human
aucugcuccaaauggauuc

SEQ ID NO: 986453 - RNA, 20 nt, Human
aucuugcucucucccccaaa

SEQ ID NO: 986454 - RNA, 21 nt, Human
augccaccggcucccucggga

SEQ ID NO: 986455 - RNA, 22 nt, Human
auguuagagaacagcaggaaca

SEQ ID NO: 986456 - RNA, 18 nt, Human
auuccagaccuuguaaca

SEQ ID NO: 986457 - RNA, 21 nt, Human
auuguccuuuuuuuuuuuuuu

SEQ ID NO: 986458 - RNA, 25 nt, Human
caaauaaaacaaaagacaaaucucc

SEQ ID NO: 986459 - RNA, 19 nt, Human
cacauagcacuuuccaucc

SEQ ID NO: 986460 - RNA, 19 nt, Human
caccaacggcauccugauc

SEQ ID NO: 986461 - RNA, 23 nt, Human
cagaaugaaaucccccaagaugg

SEQ ID NO: 986462 - RNA, 19 nt, Human
cagcaggaacaaaauaggc

SEQ ID NO: 986463 - RNA, 22 nt, Human
caggaagguucccauuccuuga

SEQ ID NO: 986464 - RNA, 19 nt, Human
caggacagcuacuaauggu

SEQ ID NO: 986465 - RNA, 18 nt, Human
caggagccuucagcuagu

SEQ ID NO: 986466 - RNA, 22 nt, Human
ccaaauccaaucuauguuguuc

SEQ ID NO: 986467 - RNA, 23 nt, Human
cccaauaaucuuugcagcuuucc

SEQ ID NO: 986468 - RNA, 18 nt, Human
cccacugcgggcgggggc

SEQ ID NO: 986469 - RNA, 21 nt, Human
cccccaaacucuguuaaggac

SEQ ID NO: 986470 - RNA, 21 nt, Human
cccccagucaacacaauucug

SEQ ID NO: 986471 - RNA, 24 nt, Human
ccccgcgcgcccgcaacuugccag

SEQ ID NO: 986472 - RNA, 21 nt, Human
cccgcgcgcccgcaacuugcc

SEQ ID NO: 986473 - RNA, 22 nt, Human
cccgcgcgcccgcaacuugcca

SEQ ID NO: 986474 - RNA, 19 nt, Human
ccgcgcgcccgcaacuugc

SEQ ID NO: 986475 - RNA, 20 nt, Human
ccggacagacgaggcugaaa

SEQ ID NO: 986476 - RNA, 21 nt, Human
cgaaacauuuaaaaaaccaca

SEQ ID NO: 986477 - RNA, 26 nt, Human
cuccaaauccaaucuauguuguucac

SEQ ID NO: 986478 - RNA, 21 nt, Human
cuccccaaaauguuauaccaa

SEQ ID NO: 986479 - RNA, 19 nt, Human
cugaucaccuaaacaccgc

SEQ ID NO: 986480 - RNA, 24 nt, Human
cuuuccaucccgaagcuccagccg

SEQ ID NO: 986481 - RNA, 18 nt, Human
gaagauggugauguaaaa

SEQ ID NO: 986482 - RNA, 20 nt, Human
gacaagcaaacccagaaaca

SEQ ID NO: 986483 - RNA, 21 nt, Human
gagaagauggugauguaaaag

SEQ ID NO: 986484 - RNA, 25 nt, Human
gcaaacccagaaacacuggccuggu

SEQ ID NO: 986485 - RNA, 23 nt, Human
gcauagcccaggcaagaugaucc

SEQ ID NO: 986486 - RNA, 23 nt, Human
gcuacuaauggucacaacgaccu

SEQ ID NO: 986487 - RNA, 18 nt, Human
ggacuaggcuugggguca

SEQ ID NO: 986488 - RNA, 21 nt, Human
guagcaucaaagacgaaacau

SEQ ID NO: 986489 - RNA, 27 nt, Human
uaaaaugcaaauaaaacaaaagacaaa

SEQ ID NO: 986490 - RNA, 18 nt, Human
uaagaagcccuggauggu

SEQ ID NO: 986491 - RNA, 21 nt, Human
uaagcuaacgguguaugccac

SEQ ID NO: 986492 - RNA, 21 nt, Human
uaagguuaagcuaacggugua

SEQ ID NO: 986493 - RNA, 20 nt, Human
uaauucaaucauuaaccaaa

SEQ ID NO: 986494 - RNA, 24 nt, Human
uacaggaauugcuuaagcugaugu

SEQ ID NO: 986495 - RNA, 24 nt, Human
uaccuacuaccaacuccaaaucca

SEQ ID NO: 986496 - RNA, 23 nt, Human
uagacaagcaaacccagaaacac

SEQ ID NO: 986497 - RNA, 20 nt, Human
uagcaucaaagacgaaacau

SEQ ID NO: 986498 - RNA, 25 nt, Human
uaggacagacaucccccagucacgu

SEQ ID NO: 986499 - RNA, 19 nt, Human
uaguaauugauagggcaug

SEQ ID NO: 986500 - RNA, 23 nt, Human
uauagacaagcaaacccagaaac

SEQ ID NO: 986501 - RNA, 24 nt, Human
uaucuguuuucaaauuuaucuccu

SEQ ID NO: 986502 - RNA, 25 nt, Human
uaugaaauuccagaugucuaauugg

SEQ ID NO: 986503 - RNA, 18 nt, Human
uauuuuaagaauaggcaa

SEQ ID NO: 986504 - RNA, 18 nt, Human
ucacggauuccuuuuuuu

SEQ ID NO: 986505 - RNA, 20 nt, Human
ucuaacaaugagaaucaaua

SEQ ID NO: 986506 - RNA, 22 nt, Human
ucuaagacauggcacaggagcc

SEQ ID NO: 986507 - RNA, 22 nt, Human
ucuauguuguucacuaaauuug

SEQ ID NO: 986508 - RNA, 20 nt, Human
ugaacugaacagccauuuaa

SEQ ID NO: 986509 - RNA, 22 nt, Human
ugaaguaccuaaaccagucugc

SEQ ID NO: 986510 - RNA, 21 nt, Human
ugaauaggugagaagugcugu

SEQ ID NO: 986511 - RNA, 21 nt, Human
ugaaugaauucuucaauuuca

SEQ ID NO: 986512 - RNA, 19 nt, Human
ugacagaugcacaaacguu

SEQ ID NO: 986513 - RNA, 23 nt, Human
ugacagugacaaugaaaacuaau

SEQ ID NO: 986514 - RNA, 19 nt, Human
ugaguaaccaucuuacuga

SEQ ID NO: 986515 - RNA, 20 nt, Human
ugccaccaacggcauccuga

SEQ ID NO: 986516 - RNA, 20 nt, Human
ugcccgcgacagcuccccgc

SEQ ID NO: 986517 - RNA, 22 nt, Human
ugcccgcgacagcuccccgcgc

SEQ ID NO: 986518 - RNA, 24 nt, Human
uggaacgaagagaaaaccuaaaaa

SEQ ID NO: 986519 - RNA, 23 nt, Human
uggauuccagaccuuguaacauu

SEQ ID NO: 986520 - RNA, 20 nt, Human
uggcugcuuccgacucugau

SEQ ID NO: 986521 - RNA, 23 nt, Human
uguacacacuuaaacaugaaggc

SEQ ID NO: 986522 - RNA, 25 nt, Human
uguccuuuuuuuuuuuuuuaagaga

SEQ ID NO: 986523 - RNA, 20 nt, Human
uguuacagagguaaaaauca

SEQ ID NO: 986524 - RNA, 20 nt, Human
uucaaauuuaucuccuuuuu

SEQ ID NO: 986525 - RNA, 24 nt, Human
uucacuacugaacuucuuauuaaa

SEQ ID NO: 986526 - RNA, 23 nt, Human
uugauagggcaugcaaugucuaa

SEQ ID NO: 986527 - RNA, 19 nt, Human
uuuuuuaagagaauucugg

SEQ ID NO: 986528 - RNA, 25 nt, Human
aaagugcugggauuuacaggcauga

SEQ ID NO: 986529 - RNA, 20 nt, Human
aagugcugggauuuacaggc

SEQ ID NO: 986530 - RNA, 20 nt, Human
agaauagcagggguggaggg

SEQ ID NO: 986531 - RNA, 23 nt, Human
agacaccacaaaguagcuuucuc

SEQ ID NO: 986532 - RNA, 18 nt, Human
agacauggcagaauagca

SEQ ID NO: 986533 - RNA, 22 nt, Human
agagagagggaaagacauggca

SEQ ID NO: 986534 - RNA, 23 nt, Human
aguuauuauuuuaauaaaugaga

SEQ ID NO: 986535 - RNA, 20 nt, Human
auguugcccaggcuggucuc

SEQ ID NO: 986536 - RNA, 25 nt, Human
caaagugcugggauuuacaggcaug

SEQ ID NO: 986537 - RNA, 23 nt, Human
caaggaagaucauuaaaaagaaa

SEQ ID NO: 986538 - RNA, 21 nt, Human
caccacaaaguagcuuucuca

SEQ ID NO: 986539 - RNA, 23 nt, Human
cagaauagcagggguggagggug

SEQ ID NO: 986540 - RNA, 18 nt, Human
cagcuaagaaaaaaggua

SEQ ID NO: 986541 - RNA, 20 nt, Human
caugccagcuaagaaaaaag

SEQ ID NO: 986542 - RNA, 23 nt, Human
ccaaagugcugggauuuacaggc

SEQ ID NO: 986543 - RNA, 25 nt, Human
ccaaagugcugggauuuacaggcau

SEQ ID NO: 986544 - RNA, 20 nt, Human
ccaaggaagaucauuaaaaa

SEQ ID NO: 986545 - RNA, 22 nt, Human
ccuauggugacaggaagacuca

SEQ ID NO: 986546 - RNA, 20 nt, Human
ccuggacucaagcaaucucc

SEQ ID NO: 986547 - RNA, 26 nt, Human
cucaagcaaucucccacuucaggcua

SEQ ID NO: 986548 - RNA, 20 nt, Human
cucccacuucaggcuaccaa

SEQ ID NO: 986549 - RNA, 22 nt, Human
cucccuuguuccuacuacauuu

SEQ ID NO: 986550 - RNA, 22 nt, Human
gcaugccagcuaagaaaaaagg

SEQ ID NO: 986551 - RNA, 20 nt, Human
gcuauguugcccaggcuggu

SEQ ID NO: 986552 - RNA, 24 nt, Human
guuuugcuauguugcccaggcugg

SEQ ID NO: 986553 - RNA, 24 nt, Human
uaaaggccacaauaauuucccaag

SEQ ID NO: 986554 - RNA, 24 nt, Human
uacaggcaugagccaccucuccca

SEQ ID NO: 986555 - RNA, 28 nt, Human
uacuauaauauuugcauacguaugugua

SEQ ID NO: 986556 - RNA, 22 nt, Human
uagaaauuaaauaaaggccaca

SEQ ID NO: 986557 - RNA, 22 nt, Human
uagagaugagguuuugcuaugu

SEQ ID NO: 986558 - RNA, 18 nt, Human
uauguguauauauguauu

SEQ ID NO: 986559 - RNA, 25 nt, Human
uauguugcccaggcuggucuccugg

SEQ ID NO: 986560 - RNA, 25 nt, Human
uauguugcccaggcuggucuccugg

SEQ ID NO: 986561 - RNA, 26 nt, Human
uauguugcccaggcuggucuccugga

SEQ ID NO: 986562 - RNA, 19 nt, Human
uccucauuuguucuaagcc

SEQ ID NO: 986563 - RNA, 18 nt, Human
ucuucucacucuuugucg

SEQ ID NO: 986564 - RNA, 24 nt, Human
ugagguuuugcuauguugcccagg

SEQ ID NO: 986565 - RNA, 18 nt, Human
ugcauacguauguguaua

SEQ ID NO: 986566 - RNA, 24 nt, Human
ugcauacguauguguauauaugua

SEQ ID NO: 986567 - RNA, 18 nt, Human
ugcccaggcuggucuccu

SEQ ID NO: 986568 - RNA, 24 nt, Human
ugcuauguugcccaggcuggucuc

SEQ ID NO: 986569 - RNA, 20 nt, Human
uggacucaagcaaucuccca

SEQ ID NO: 986570 - RNA, 24 nt, Human
uggucuccuggacucaagcaaucu

SEQ ID NO: 986571 - RNA, 21 nt, Human
uugcuauguugcccaggcugg

SEQ ID NO: 986572 - RNA, 23 nt, Human
uuugcauacguauguguauauau

SEQ ID NO: 986573 - RNA, 26 nt, Human
uuugcauacguauguguauauauuac

SEQ ID NO: 986574 - RNA, 19 nt, Human
uuuugcuauguugcccagg

SEQ ID NO: 986575 - RNA, 23 nt, Human
uuuugcuauguugcccaggcugg

SEQ ID NO: 986576 - RNA, 24 nt, Human
aaaaauauuauacuccuuggaccc

SEQ ID NO: 986577 - RNA, 19 nt, Human
aaaggauaccagagaagga

SEQ ID NO: 986578 - RNA, 24 nt, Human
aaagugcuaggauuccaggcauga

SEQ ID NO: 986579 - RNA, 21 nt, Human
aacacuaguaauagagauaag

SEQ ID NO: 986580 - RNA, 25 nt, Human
aagcaaagcaaacacaagaaaaaaa

SEQ ID NO: 986581 - RNA, 25 nt, Human
aagcaguccuccuaccucagccucc

SEQ ID NO: 986582 - RNA, 25 nt, Human
aagcaguccuccuaccucagccucc

SEQ ID NO: 986583 - RNA, 24 nt, Human
aaguaacuggggagggaggguggg

SEQ ID NO: 986584 - RNA, 18 nt, Human
accagagaaggaggugcu

SEQ ID NO: 986585 - RNA, 20 nt, Human
acccuacagucuccacacac

SEQ ID NO: 986586 - RNA, 19 nt, Human
acccuucugucuucugccu

SEQ ID NO: 986587 - RNA, 18 nt, Human
accuuuaugugcguccug

SEQ ID NO: 986588 - RNA, 23 nt, Human
acuauguugcucaggcuggucuc

SEQ ID NO: 986589 - RNA, 24 nt, Human
acuccuuggacccagauuaggagg

SEQ ID NO: 986590 - RNA, 23 nt, Human
agacagggucucacuauguugcu

SEQ ID NO: 986591 - RNA, 19 nt, Human
agcaaacacaagaaaaaaa

SEQ ID NO: 986592 - RNA, 21 nt, Human
agcacaaauccuaagucuccu

SEQ ID NO: 986593 - RNA, 18 nt, Human
agcugcucccuguccuuc

SEQ ID NO: 986594 - RNA, 24 nt, Human
aggaacgugggagaagccgguacc

SEQ ID NO: 986595 - RNA, 19 nt, Human
aggagacaguaauauuuua

SEQ ID NO: 986596 - RNA, 22 nt, Human
aggaggugcuucugacugcccu

SEQ ID NO: 986597 - RNA, 19 nt, Human
aggauagugaaaaauauag

SEQ ID NO: 986598 - RNA, 19 nt, Human
aggcaugaaccaccauacc

SEQ ID NO: 986599 - RNA, 21 nt, Human
agggacucaagaaacacugca

SEQ ID NO: 986600 - RNA, 24 nt, Human
auaacgguacaugucuauuuuggg

SEQ ID NO: 986601 - RNA, 26 nt, Human
augggcaacuggagauguacucacuu

SEQ ID NO: 986602 - RNA, 23 nt, Human
auguacucacuuaguuccuuaag

SEQ ID NO: 986603 - RNA, 21 nt, Human
caaaaagcaaagcaaacacaa

SEQ ID NO: 986604 - RNA, 25 nt, Human
caaagcaaacacaagaaaaaaaauc

SEQ ID NO: 986605 - RNA, 24 nt, Human
caaagugcuaggauuccaggcaug

SEQ ID NO: 986606 - RNA, 23 nt, Human
caacaugguguguggccaauuaa

SEQ ID NO: 986607 - RNA, 24 nt, Human
caacucccggccucaagcaguccu

SEQ ID NO: 986608 - RNA, 23 nt, Human
caagaaacacugcaaacaauuca

SEQ ID NO: 986609 - RNA, 27 nt, Human
caagcaguccuccuaccucagccuccc

SEQ ID NO: 986610 - RNA, 20 nt, Human
cacaaucagccccuguaguc

SEQ ID NO: 986611 - RNA, 24 nt, Human
cacuauguugcucaggcuggucuc

SEQ ID NO: 986612 - RNA, 20 nt, Human
cacuucauagccagcugggu

SEQ ID NO: 986613 - RNA, 23 nt, Human
cagcugaggaaaacaaacuuauu

SEQ ID NO: 986614 - RNA, 24 nt, Human
cagggucucacuauguugcucagg

SEQ ID NO: 986615 - RNA, 19 nt, Human
cauguacaccuuuaugugc

SEQ ID NO: 986616 - RNA, 24 nt, Human
ccaaagugcuaggauuccaggcau

SEQ ID NO: 986617 - RNA, 21 nt, Human
ccaggcaugaaccaccauacc

SEQ ID NO: 986618 - RNA, 20 nt, Human
cccggccucaagcaguccuc

SEQ ID NO: 986619 - RNA, 22 nt, Human
ccggccucaagcaguccuccua

SEQ ID NO: 986620 - RNA, 26 nt, Human
ccuccuaccucagccucccaaagugc

SEQ ID NO: 986621 - RNA, 18 nt, Human
ccugaagccugcacccuu

SEQ ID NO: 986622 - RNA, 19 nt, Human
ccugaagccugcacccuuc

SEQ ID NO: 986623 - RNA, 19 nt, Human
ccuuggacccagauuagga

SEQ ID NO: 986624 - RNA, 27 nt, Human
cguggaucuucucccugcucugugccu

SEQ ID NO: 986625 - RNA, 22 nt, Human
cuauauacauuccaacaauccu

SEQ ID NO: 986626 - RNA, 24 nt, Human
cucaagcaguccuccuaccucagc

SEQ ID NO: 986627 - RNA, 25 nt, Human
cucacccuacagucuccacacacau

SEQ ID NO: 986628 - RNA, 21 nt, Human
cucaggcuggucuccaacucc

SEQ ID NO: 986629 - RNA, 20 nt, Human
cucccggccucaagcagucc

SEQ ID NO: 986630 - RNA, 23 nt, Human
cucccugcucugugccuucugau

SEQ ID NO: 986631 - RNA, 18 nt, Human
cugacugcccuccuucca

SEQ ID NO: 986632 - RNA, 20 nt, Human
cugagccgugcaugccgcgc

SEQ ID NO: 986633 - RNA, 21 nt, Human
cugcacccuucugucuucugc

SEQ ID NO: 986634 - RNA, 22 nt, Human
cugcacccuucugucuucugcc

SEQ ID NO: 986635 - RNA, 19 nt, Human
cuguagucagucaguaaac

SEQ ID NO: 986636 - RNA, 23 nt, Human
cuuucaguaccauuauucacuuc

SEQ ID NO: 986637 - RNA, 25 nt, Human
gaaccaccauacccggccccauuua

SEQ ID NO: 986638 - RNA, 19 nt, Human
gacccucuuucuuacccac

SEQ ID NO: 986639 - RNA, 20 nt, Human
gagacagggucucacuaugu

SEQ ID NO: 986640 - RNA, 22 nt, Human
gagcguggaucuucucccugcu

SEQ ID NO: 986641 - RNA, 24 nt, Human
gauuccaggcaugaaccaccauac

SEQ ID NO: 986642 - RNA, 23 nt, Human
gcccuccuuccacuggagaaucc

SEQ ID NO: 986643 - RNA, 18 nt, Human
gcucugugccuucugaug

SEQ ID NO: 986644 - RNA, 23 nt, Human
gcuggucuccaacucccggccuc

SEQ ID NO: 986645 - RNA, 20 nt, Human
ggagcauccguuagaagaag

SEQ ID NO: 986646 - RNA, 18 nt, Human
ggaggacagcuguuaugu

SEQ ID NO: 986647 - RNA, 22 nt, Human
ggauuccaggcaugaaccacca

SEQ ID NO: 986648 - RNA, 22 nt, Human
ggcaaaggauaccagagaagga

SEQ ID NO: 986649 - RNA, 19 nt, Human
ggccucaagcaguccuccu

SEQ ID NO: 986650 - RNA, 18 nt, Human
ggggagggagggugggaa

SEQ ID NO: 986651 - RNA, 21 nt, Human
ggucuucagguuuacuuucag

SEQ ID NO: 986652 - RNA, 18 nt, Human
guaaaaacaucuggcaaa

SEQ ID NO: 986653 - RNA, 18 nt, Human
gucagacucagacuuaaa

SEQ ID NO: 986654 - RNA, 21 nt, Human
guuauguuacauaaaggcuga

SEQ ID NO: 986655 - RNA, 24 nt, Human
uaaaauagaucugagaaaggucuu

SEQ ID NO: 986656 - RNA, 19 nt, Human
uaaacauaucuccugcaua

SEQ ID NO: 986657 - RNA, 23 nt, Human
uaauagagauaaggcacuaccua

SEQ ID NO: 986658 - RNA, 24 nt, Human
uaccucagccucccaaagugcuag

SEQ ID NO: 986659 - RNA, 18 nt, Human
uacuguguacccucaaac

SEQ ID NO: 986660 - RNA, 18 nt, Human
uagaugauuuuucuugga

SEQ ID NO: 986661 - RNA, 23 nt, Human
uagccagcugggugacaacaugg

SEQ ID NO: 986662 - RNA, 21 nt, Human
uaggauagugaaaaauauagc

SEQ ID NO: 986663 - RNA, 24 nt, Human
uaggauuccaggcaugaaccacca

SEQ ID NO: 986664 - RNA, 23 nt, Human
uaguaauagagauaaggcacuac

SEQ ID NO: 986665 - RNA, 19 nt, Human
uauguugcucaggcugguc

SEQ ID NO: 986666 - RNA, 24 nt, Human
uauguugcucaggcuggucuccaa

SEQ ID NO: 986667 - RNA, 20 nt, Human
ucaaaccaggcaaguuuuuc

SEQ ID NO: 986668 - RNA, 25 nt, Human
ucacuuuccuggaucacucucaacu

SEQ ID NO: 986669 - RNA, 27 nt, Human
ucagacucagacuuaaaauagaucuga

SEQ ID NO: 986670 - RNA, 18 nt, Human
ucagccucccaaagugcu

SEQ ID NO: 986671 - RNA, 20 nt, Human
ucaugucgaauauuuuccau

SEQ ID NO: 986672 - RNA, 20 nt, Human
ucaugugguuucuccaggug

SEQ ID NO: 986673 - RNA, 25 nt, Human
uccaacaauccuccgaguaucuucu

SEQ ID NO: 986674 - RNA, 29 nt, Human
uccaggcaugaaccaccauacccggcccu

SEQ ID NO: 986675 - RNA, 24 nt, Human
ucccaaagugcuaggauuccaggc

SEQ ID NO: 986676 - RNA, 25 nt, Human
uccuuggacccagauuaggagguga

SEQ ID NO: 986677 - RNA, 25 nt, Human
ucgaauacaaauaguaaagugaagg

SEQ ID NO: 986678 - RNA, 23 nt, Human
ucucacuauguugcucaggcugg

SEQ ID NO: 986679 - RNA, 24 nt, Human
ucucacuauguugcucaggcuggu

SEQ ID NO: 986680 - RNA, 24 nt, Human
ucuccaacucccggccucaagcag

SEQ ID NO: 986681 - RNA, 23 nt, Human
ucugucuucugccugucagagca

SEQ ID NO: 986682 - RNA, 24 nt, Human
ugaaacaauagccauguacaccuu

SEQ ID NO: 986683 - RNA, 25 nt, Human
ugaaacaauagccauguacaccuuu

SEQ ID NO: 986684 - RNA, 18 nt, Human
ugacagaccagagcugcu

SEQ ID NO: 986685 - RNA, 22 nt, Human
ugagacagggucucacuauguu

SEQ ID NO: 986686 - RNA, 23 nt, Human
ugagacggcaaaggauaccagag

SEQ ID NO: 986687 - RNA, 23 nt, Human
ugagagaauagaauugcaaggaa

SEQ ID NO: 986688 - RNA, 21 nt, Human
ugagauugacagaccagagcu

SEQ ID NO: 986689 - RNA, 19 nt, Human
ugcuaggcauucucaggga

SEQ ID NO: 986690 - RNA, 21 nt, Human
ugcucaggcuggucuccaacu

SEQ ID NO: 986691 - RNA, 20 nt, Human
ugcucugugccuucugauga

SEQ ID NO: 986692 - RNA, 25 nt, Human
ugcugugaucuuuuuccgagcgugg

SEQ ID NO: 986693 - RNA, 26 nt, Human
ugcuucacuuuccuggaucacucuca

SEQ ID NO: 986694 - RNA, 23 nt, Human
ugggagaagcaguuguccucccg

SEQ ID NO: 986695 - RNA, 18 nt, Human
uggggagggaggguggga

SEQ ID NO: 986696 - RNA, 19 nt, Human
ugucaaaaagcaaagcaaa

SEQ ID NO: 986697 - RNA, 25 nt, Human
ugucaaaaagcaaagcaaacacaag

SEQ ID NO: 986698 - RNA, 23 nt, Human
uguuugauaucacugaucacugu

SEQ ID NO: 986699 - RNA, 19 nt, Human
uuaaaguuuacaagguaac

SEQ ID NO: 986700 - RNA, 25 nt, Human
uucacuuguuuuucugacaggcuuu

SEQ ID NO: 986701 - RNA, 23 nt, Human
uucaugucgaauauuuuccaugg

SEQ ID NO: 986702 - RNA, 21 nt, Human
uuccugauguuugauaucacu

SEQ ID NO: 986703 - RNA, 19 nt, Human
uugacucauuaaaaauauu

SEQ ID NO: 986704 - RNA, 19 nt, Human
uugcuuccuucacuuguuu

SEQ ID NO: 986705 - RNA, 21 nt, Human
uuggggugcuccuggauuuuu

SEQ ID NO: 986706 - RNA, 23 nt, Human
uuugauaucacugaucacugucu

SEQ ID NO: 986707 - RNA, 18 nt, Human
aaaaauguguaucauuuc

SEQ ID NO: 986708 - RNA, 25 nt, Human
aaaacagaaaaaaauauacaccuag

SEQ ID NO: 986709 - RNA, 25 nt, Human
aaaagcaucaaaaauaaggcaacag

SEQ ID NO: 986710 - RNA, 24 nt, Human
aaacaagaaugaauauuaagaaac

SEQ ID NO: 986711 - RNA, 19 nt, Human
aaacagcuuagugaaaaaa

SEQ ID NO: 986712 - RNA, 24 nt, Human
aaagauauacauucuuauauugac

SEQ ID NO: 986713 - RNA, 22 nt, Human
aacauauacuucauacagugua

SEQ ID NO: 986714 - RNA, 19 nt, Human
aagcaaaaugugaauaagc

SEQ ID NO: 986715 - RNA, 22 nt, Human
aagcagcaaaguuuuaaaccca

SEQ ID NO: 986716 - RNA, 19 nt, Human
acaguguauuucucccuuu

SEQ ID NO: 986717 - RNA, 22 nt, Human
acauggaaagcaaucuuaauuu

SEQ ID NO: 986718 - RNA, 21 nt, Human
accccugaacuuucaaauuua

SEQ ID NO: 986719 - RNA, 21 nt, Human
accugaaucccuguacaacaa

SEQ ID NO: 986720 - RNA, 19 nt, Human
acugcgugcgccgcgcccc

SEQ ID NO: 986721 - RNA, 21 nt, Human
acuuacaaagaggcugggucu

SEQ ID NO: 986722 - RNA, 22 nt, Human
agcaucaaaaauaaggcaacag

SEQ ID NO: 986723 - RNA, 24 nt, Human
agcaugagcaacaaaggacaggaa

SEQ ID NO: 986724 - RNA, 18 nt, Human
caaaaagauuaggaagca

SEQ ID NO: 986725 - RNA, 18 nt, Human
caaaaauaaggcaacagc

SEQ ID NO: 986726 - RNA, 24 nt, Human
caaaggacaggaaacaaauaucac

SEQ ID NO: 986727 - RNA, 19 nt, Human
cacuaagaguaaugcccau

SEQ ID NO: 986728 - RNA, 19 nt, Human
cacuuuggaaggcaaacag

SEQ ID NO: 986729 - RNA, 27 nt, Human
caucaaaaauaaggcaacagcaagaug

SEQ ID NO: 986730 - RNA, 24 nt, Human
cccaccaauauauugacaaagcca

SEQ ID NO: 986731 - RNA, 18 nt, Human
ccgcgcccccuucccugc

SEQ ID NO: 986732 - RNA, 18 nt, Human
ccgcgcccccuucccugc

SEQ ID NO: 986733 - RNA, 21 nt, Human
ccugaacuuucaaauuuacau

SEQ ID NO: 986734 - RNA, 21 nt, Human
cgcccccuucccugcgguuca

SEQ ID NO: 986735 - RNA, 20 nt, Human
cuuuggaaggcaaacagcuu

SEQ ID NO: 986736 - RNA, 21 nt, Human
gaaauuuccaaaucccugcuc

SEQ ID NO: 986737 - RNA, 23 nt, Human
gaagauacauguuaaggcuuaag

SEQ ID NO: 986738 - RNA, 21 nt, Human
gcaugagcaacaaaggacagg

SEQ ID NO: 986739 - RNA, 23 nt, Human
gccgcgcccccuucccugcgguu

SEQ ID NO: 986740 - RNA, 21 nt, Human
uaaacagcaugagcaacaaag

SEQ ID NO: 986741 - RNA, 26 nt, Human
uaaauuucaaacauggaaagcaaucu

SEQ ID NO: 986742 - RNA, 24 nt, Human
uaauagaccccugaacuuucaaau

SEQ ID NO: 986743 - RNA, 24 nt, Human
uacaacaaaaagauuaggaagcaa

SEQ ID NO: 986744 - RNA, 21 nt, Human
uagaaacaaauaaugcuucuc

SEQ ID NO: 986745 - RNA, 25 nt, Human
uagcaagccuauuaaaccacuagca

SEQ ID NO: 986746 - RNA, 19 nt, Human
ucaaaaauaaggcaacagc

SEQ ID NO: 986747 - RNA, 21 nt, Human
ucaaaauagcaacuucauuga

SEQ ID NO: 986748 - RNA, 22 nt, Human
ucaagguguuggcaacauguca

SEQ ID NO: 986749 - RNA, 22 nt, Human
ucaaugcuaaacucaaaauagc

SEQ ID NO: 986750 - RNA, 22 nt, Human
ucaugaauaaaagcaucaaaaa

SEQ ID NO: 986751 - RNA, 26 nt, Human
uccaaaucccugcucccaacacaauu

SEQ ID NO: 986752 - RNA, 18 nt, Human
ucccuguacaacaaaaag

SEQ ID NO: 986753 - RNA, 22 nt, Human
uccuacauauuuauguaaucaa

SEQ ID NO: 986754 - RNA, 22 nt, Human
ugaaugaagauacauguuaagg

SEQ ID NO: 986755 - RNA, 19 nt, Human
ugcccauacauauaaagau

SEQ ID NO: 986756 - RNA, 19 nt, Human
uggaaggcaaacagcuuag

SEQ ID NO: 986757 - RNA, 19 nt, Human
ugggucucagccugcacuu

SEQ ID NO: 986758 - RNA, 19 nt, Human
ugguaaauuucaaacaugg

SEQ ID NO: 986759 - RNA, 23 nt, Human
ugugcaaagacaauacacucauc

SEQ ID NO: 986760 - RNA, 20 nt, Human
uguuguaagaauaagaaacc

SEQ ID NO: 986761 - RNA, 19 nt, Human
uuagaaaaacagaaaaaaa

SEQ ID NO: 986762 - RNA, 22 nt, Human
uucaaacauggaaagcaaucuu

SEQ ID NO: 986763 - RNA, 21 nt, Human
uucauaauagaccccugaacu

SEQ ID NO: 986764 - RNA, 21 nt, Human
uucuaggaaaggcacaggcuu

SEQ ID NO: 986765 - RNA, 19 nt, Human
uucuugucaugaauaaaag

SEQ ID NO: 986766 - RNA, 19 nt, Human
aaagaagacccaggcccua

SEQ ID NO: 986767 - RNA, 22 nt, Human
aacagcccagccccucugcuuc

SEQ ID NO: 986768 - RNA, 24 nt, Human
aagcggcuuccugggacugcggga

SEQ ID NO: 986769 - RNA, 18 nt, Human
aagcucugccugcucucc

SEQ ID NO: 986770 - RNA, 21 nt, Human
aaggcccagcccgagagccuc

SEQ ID NO: 986771 - RNA, 22 nt, Human
aaggcgauggaucuugaagcca

SEQ ID NO: 986772 - RNA, 22 nt, Human
accauccugccuccaguccccu

SEQ ID NO: 986773 - RNA, 18 nt, Human
accccgugaucgagagcc

SEQ ID NO: 986774 - RNA, 22 nt, Human
acccugccucuccaucacccca

SEQ ID NO: 986775 - RNA, 19 nt, Human
acccuggggcccuggacac

SEQ ID NO: 986776 - RNA, 24 nt, Human
acucacuguuucucaaacacacca

SEQ ID NO: 986777 - RNA, 24 nt, Human
acugagcacaaggaccugggucug

SEQ ID NO: 986778 - RNA, 18 nt, Human
acugcacuccagccugaa

SEQ ID NO: 986779 - RNA, 19 nt, Human
acugcacuccagccugaag

SEQ ID NO: 986780 - RNA, 22 nt, Human
acugcacuccagccugaaggag

SEQ ID NO: 986781 - RNA, 21 nt, Human
acuugccccagaaucccccuc

SEQ ID NO: 986782 - RNA, 18 nt, Human
agaccugccugaggcauc

SEQ ID NO: 986783 - RNA, 18 nt, Human
agagaccaggauggguca

SEQ ID NO: 986784 - RNA, 18 nt, Human
agagaggggagagggcag

SEQ ID NO: 986785 - RNA, 19 nt, Human
agagccacgcccacuccuc

SEQ ID NO: 986786 - RNA, 21 nt, Human
agagggcagggggggagucag

SEQ ID NO: 986787 - RNA, 22 nt, Human
agagggcagggggggagucagu

SEQ ID NO: 986788 - RNA, 27 nt, Human
agaggggagagggcagggggggaguca

SEQ ID NO: 986789 - RNA, 24 nt, Human
agcaaguaacagaaaaccgcucaa

SEQ ID NO: 986790 - RNA, 19 nt, Human
agcaggagcagacccuggg

SEQ ID NO: 986791 - RNA, 18 nt, Human
agcccuuucuugccucca

SEQ ID NO: 986792 - RNA, 18 nt, Human
agcuagucuuccugaugc

SEQ ID NO: 986793 - RNA, 21 nt, Human
aggcaaagucuuaaacggcuc

SEQ ID NO: 986794 - RNA, 21 nt, Human
aggcaagaagcggcuuccugg

SEQ ID NO: 986795 - RNA, 24 nt, Human
agggagagaggggagagggcaggg

SEQ ID NO: 986796 - RNA, 20 nt, Human
agggggagggagagagggga

SEQ ID NO: 986797 - RNA, 25 nt, Human
agggggagggagagaggggagaggg

SEQ ID NO: 986798 - RNA, 21 nt, Human
auccuuucaaacucucuccca

SEQ ID NO: 986799 - RNA, 24 nt, Human
aucgcgccacugcacuccagccug

SEQ ID NO: 986800 - RNA, 18 nt, Human
auggagcugagaucgcgc

SEQ ID NO: 986801 - RNA, 19 nt, Human
caagcuggcugaagcaaca

SEQ ID NO: 986802 - RNA, 21 nt, Human
caaguaacagaaaaccgcuca

SEQ ID NO: 986803 - RNA, 25 nt, Human
cacaccaagcccuuucuugccuccc

SEQ ID NO: 986804 - RNA, 18 nt, Human
caccaugcggcccacucc

SEQ ID NO: 986805 - RNA, 19 nt, Human
caccccuccaaggcccagc

SEQ ID NO: 986806 - RNA, 19 nt, Human
caccccuccaaggcccagc

SEQ ID NO: 986807 - RNA, 19 nt, Human
caccccugccacccccagg

SEQ ID NO: 986808 - RNA, 21 nt, Human
cacccuggccuuccccggcuu

SEQ ID NO: 986809 - RNA, 19 nt, Human
caccgcacagccacugggu

SEQ ID NO: 986810 - RNA, 21 nt, Human
caccgcacagccacuggguua

SEQ ID NO: 986811 - RNA, 18 nt, Human
cacugcacuccagccuga

SEQ ID NO: 986812 - RNA, 19 nt, Human
cacugcacuccagccugaa

SEQ ID NO: 986813 - RNA, 25 nt, Human
cacugcacuccagccugaaggaguu

SEQ ID NO: 986814 - RNA, 19 nt, Human
cagaaccugagagggaggc

SEQ ID NO: 986815 - RNA, 20 nt, Human
cagagccacgcccacuccuc

SEQ ID NO: 986816 - RNA, 19 nt, Human
cagccaccugggcuguccu

SEQ ID NO: 986817 - RNA, 20 nt, Human
cagcccaccaagaccucugc

SEQ ID NO: 986818 - RNA, 22 nt, Human
cagcccaccaagaccucugcug

SEQ ID NO: 986819 - RNA, 19 nt, Human
cagggggggagucaguggc

SEQ ID NO: 986820 - RNA, 20 nt, Human
cagugggccugcaagggcau

SEQ ID NO: 986821 - RNA, 24 nt, Human
cauccugccuccaguccccugggc

SEQ ID NO: 986822 - RNA, 23 nt, Human
ccacacuugcguggcuuccucca

SEQ ID NO: 986823 - RNA, 21 nt, Human
ccaccaugcccuacucacugu

SEQ ID NO: 986824 - RNA, 21 nt, Human
ccaccccugccacccccaggc

SEQ ID NO: 986825 - RNA, 18 nt, Human
ccacugcacuccagccug

SEQ ID NO: 986826 - RNA, 19 nt, Human
ccacugcacuccagccuga

SEQ ID NO: 986827 - RNA, 20 nt, Human
ccacugcacuccagccugaa

SEQ ID NO: 986828 - RNA, 22 nt, Human
ccacugcacuccagccugaagg

SEQ ID NO: 986829 - RNA, 22 nt, Human
ccacugcacuccagccugaagg

SEQ ID NO: 986830 - RNA, 23 nt, Human
ccacugcacuccagccugaagga

SEQ ID NO: 986831 - RNA, 24 nt, Human
ccacugcacuccagccugaaggag

SEQ ID NO: 986832 - RNA, 25 nt, Human
ccacugcacuccagccugaaggagu

SEQ ID NO: 986833 - RNA, 20 nt, Human
ccaugugucuccuggcccug

SEQ ID NO: 986834 - RNA, 20 nt, Human
cccaaaauucuuucuccacu

SEQ ID NO: 986835 - RNA, 18 nt, Human
cccaagugcccuucagcu

SEQ ID NO: 986836 - RNA, 21 nt, Human
cccaccugcuggccuggguga

SEQ ID NO: 986837 - RNA, 22 nt, Human
cccacgagcccgacgcagggca

SEQ ID NO: 986838 - RNA, 19 nt, Human
cccagaaucccccucucag

SEQ ID NO: 986839 - RNA, 23 nt, Human
cccagccacagcugguccucagc

SEQ ID NO: 986840 - RNA, 24 nt, Human
cccaggcugagaccugccugaggc

SEQ ID NO: 986841 - RNA, 24 nt, Human
ccccaccccugccacccccaggcu

SEQ ID NO: 986842 - RNA, 23 nt, Human
ccccaccgagcagaugauacccc

SEQ ID NO: 986843 - RNA, 18 nt, Human
cccccaggcugagaccug

SEQ ID NO: 986844 - RNA, 22 nt, Human
cccccucuuccugccccaacuu

SEQ ID NO: 986845 - RNA, 22 nt, Human
ccccucguacuccaggccccug

SEQ ID NO: 986846 - RNA, 25 nt, Human
cccgcaagaaacuacuugccccaga

SEQ ID NO: 986847 - RNA, 20 nt, Human
cccgugaucgagagccgccu

SEQ ID NO: 986848 - RNA, 21 nt, Human
cccucagagcccccugagucc

SEQ ID NO: 986849 - RNA, 23 nt, Human
cccucagagcccccugaguccac

SEQ ID NO: 986850 - RNA, 19 nt, Human
cccugcccccacagcgauc

SEQ ID NO: 986851 - RNA, 21 nt, Human
ccgguccccaccacggcuguc

SEQ ID NO: 986852 - RNA, 22 nt, Human
ccuacucacuguuucucaaaca

SEQ ID NO: 986853 - RNA, 18 nt, Human
ccuccggggcaggggagc

SEQ ID NO: 986854 - RNA, 24 nt, Human
ccuccggggcaggggagcuagucu

SEQ ID NO: 986855 - RNA, 24 nt, Human
ccuccuuccuagccuggcauucag

SEQ ID NO: 986856 - RNA, 24 nt, Human
ccucugcugcaaucuggacagaga

SEQ ID NO: 986857 - RNA, 21 nt, Human
ccuggcccugggcugaccucc

SEQ ID NO: 986858 - RNA, 20 nt, Human
ccugggaaggcccuucgccc

SEQ ID NO: 986859 - RNA, 19 nt, Human
ccuggggcccuggacacag

SEQ ID NO: 986860 - RNA, 18 nt, Human
ccugggucuccauagcuc

SEQ ID NO: 986861 - RNA, 22 nt, Human
ccuuccacccuggccuuccccg

SEQ ID NO: 986862 - RNA, 26 nt, Human
ccuuccgcugccaccccuccaaggcc

SEQ ID NO: 986863 - RNA, 20 nt, Human
ccuucggccuccuacucacu

SEQ ID NO: 986864 - RNA, 20 nt, Human
ccuuggggcugggccauggc

SEQ ID NO: 986865 - RNA, 23 nt, Human
ccuuguccaccacaucuucgcag

SEQ ID NO: 986866 - RNA, 18 nt, Human
ccuuuuuccuucucugcc

SEQ ID NO: 986867 - RNA, 25 nt, Human
cgcccuuaaccccaucaggaagucc

SEQ ID NO: 986868 - RNA, 20 nt, Human
cgggaggagcaggguugagg

SEQ ID NO: 986869 - RNA, 21 nt, Human
cguguuaccccugcuggugcc

SEQ ID NO: 986870 - RNA, 22 nt, Human
cucccguaacuugcucauccuu

SEQ ID NO: 986871 - RNA, 26 nt, Human
cuccggggcaggggagcuagucuucc

SEQ ID NO: 986872 - RNA, 25 nt, Human
cucucugccccaccccugccacccc

SEQ ID NO: 986873 - RNA, 18 nt, Human
cucugcugcaaucuggac

SEQ ID NO: 986874 - RNA, 23 nt, Human
cugagcacaaggaccugggucug

SEQ ID NO: 986875 - RNA, 24 nt, Human
cugcaaagccuuguccagccaugu

SEQ ID NO: 986876 - RNA, 23 nt, Human
cugcagugggcugagaacugcau

SEQ ID NO: 986877 - RNA, 25 nt, Human
cugccaccccuccaaggcccagccc

SEQ ID NO: 986878 - RNA, 23 nt, Human
cugccugcucuccuccuacuggg

SEQ ID NO: 986879 - RNA, 25 nt, Human
cugccugcucuccuccuacuggggc

SEQ ID NO: 986880 - RNA, 22 nt, Human
cugcuucugggugggagccccc

SEQ ID NO: 986881 - RNA, 21 nt, Human
cuggaagcccccucuuccugc

SEQ ID NO: 986882 - RNA, 24 nt, Human
cuggacacagagccacgcccacuc

SEQ ID NO: 986883 - RNA, 20 nt, Human
cuggccuaccgggaggagca

SEQ ID NO: 986884 - RNA, 22 nt, Human
cuggcgucccucaagccgcccu

SEQ ID NO: 986885 - RNA, 24 nt, Human
cuggggacaggccauggugcaguc

SEQ ID NO: 986886 - RNA, 18 nt, Human
cuuaaccccaucaggaag

SEQ ID NO: 986887 - RNA, 21 nt, Human
cuugcucauccuucaggaccu

SEQ ID NO: 986888 - RNA, 19 nt, Human
gaagcccccucuuccugcc

SEQ ID NO: 986889 - RNA, 19 nt, Human
gaccugacucauuuucccu

SEQ ID NO: 986890 - RNA, 21 nt, Human
gagaccugccugaggcaucuu

SEQ ID NO: 986891 - RNA, 23 nt, Human
gagagccuccuuguccaccacau

SEQ ID NO: 986892 - RNA, 23 nt, Human
gagaucgcgccacugcacuccag

SEQ ID NO: 986893 - RNA, 19 nt, Human
gagcccccagggugccccu

SEQ ID NO: 986894 - RNA, 21 nt, Human
gagcugagaucgcgccacugc

SEQ ID NO: 986895 - RNA, 22 nt, Human
gagggcagggggggagucagug

SEQ ID NO: 986896 - RNA, 19 nt, Human
gaggguccaugcugucacc

SEQ ID NO: 986897 - RNA, 20 nt, Human
gcacuccagccugaaggagu

SEQ ID NO: 986898 - RNA, 18 nt, Human
gcagggcaugagaguucc

SEQ ID NO: 986899 - RNA, 19 nt, Human
gcccacucccguaacuugc

SEQ ID NO: 986900 - RNA, 19 nt, Human
gcccagccacagcuggucc

SEQ ID NO: 986901 - RNA, 24 nt, Human
gccccagaaucccccucucagauu

SEQ ID NO: 986902 - RNA, 23 nt, Human
gcccccugaguccacacagcugg

SEQ ID NO: 986903 - RNA, 20 nt, Human
gcccgacgcagggcaugaga

SEQ ID NO: 986904 - RNA, 23 nt, Human
gcccugggcugaccuccugcugu

SEQ ID NO: 986905 - RNA, 19 nt, Human
gcccuuucuugccuccaug

SEQ ID NO: 986906 - RNA, 22 nt, Human
gccuacccugccucuccaucac

SEQ ID NO: 986907 - RNA, 18 nt, Human
gccuaccgggaggagcag

SEQ ID NO: 986908 - RNA, 19 nt, Human
gccuuggggcugggccaug

SEQ ID NO: 986909 - RNA, 20 nt, Human
gcggcccacucccguaacuu

SEQ ID NO: 986910 - RNA, 18 nt, Human
gcucaggcugggcccgcu

SEQ ID NO: 986911 - RNA, 20 nt, Human
gcugagaucgcgccacugca

SEQ ID NO: 986912 - RNA, 22 nt, Human
ggaacaggggcagccagccuga

SEQ ID NO: 986913 - RNA, 23 nt, Human
ggagagaccauuaugagcccaag

SEQ ID NO: 986914 - RNA, 19 nt, Human
ggaggccccuggguaaggc

SEQ ID NO: 986915 - RNA, 21 nt, Human
ggagggagagaggggagaggg

SEQ ID NO: 986916 - RNA, 25 nt, Human
ggagggagagaggggagagggcagg

SEQ ID NO: 986917 - RNA, 20 nt, Human
ggcagggggggagucagugg

SEQ ID NO: 986918 - RNA, 20 nt, Human
ggccauaggguagacagccc

SEQ ID NO: 986919 - RNA, 24 nt, Human
ggcccuuccuguuucccuagcccu

SEQ ID NO: 986920 - RNA, 22 nt, Human
ggccgguaggcugcugcccggg

SEQ ID NO: 986921 - RNA, 19 nt, Human
ggccugggucuccauagcu

SEQ ID NO: 986922 - RNA, 21 nt, Human
gggaggccccuggguaaggcu

SEQ ID NO: 986923 - RNA, 23 nt, Human
ggggagggagagaggggagaggg

SEQ ID NO: 986924 - RNA, 19 nt, Human
ggguggccccaccgagcag

SEQ ID NO: 986925 - RNA, 21 nt, Human
gggugggagcccccagggugc

SEQ ID NO: 986926 - RNA, 20 nt, Human
gguaggcugcugcccgggcc

SEQ ID NO: 986927 - RNA, 21 nt, Human
ggucaugaggacucugccagg

SEQ ID NO: 986928 - RNA, 18 nt, Human
guaaccaaagacugaugc

SEQ ID NO: 986929 - RNA, 21 nt, Human
guccaugcugucaccuguggg

SEQ ID NO: 986930 - RNA, 22 nt, Human
gugguuccuucggccuccuacu

SEQ ID NO: 986931 - RNA, 20 nt, Human
guguuaccccugcuggugcc

SEQ ID NO: 986932 - RNA, 21 nt, Human
guguuaccccugcuggugccu

SEQ ID NO: 986933 - RNA, 18 nt, Human
uaaacggcucugacccca

SEQ ID NO: 986934 - RNA, 24 nt, Human
uaacaaaaagauaaagcauugcaa

SEQ ID NO: 986935 - RNA, 20 nt, Human
uaaccaaagacugaugccag

SEQ ID NO: 986936 - RNA, 24 nt, Human
uaagcuucugccaccaccaugccc

SEQ ID NO: 986937 - RNA, 19 nt, Human
uagcaaguaacagaaaacc

SEQ ID NO: 986938 - RNA, 21 nt, Human
uagcaaguaacagaaaaccgc

SEQ ID NO: 986939 - RNA, 19 nt, Human
uagcccagcucggcagcug

SEQ ID NO: 986940 - RNA, 18 nt, Human
uagccccuccucccccca

SEQ ID NO: 986941 - RNA, 19 nt, Human
ucagcccuucccagcacuc

SEQ ID NO: 986942 - RNA, 23 nt, Human
ucaggccaaggcgauggaucuug

SEQ ID NO: 986943 - RNA, 19 nt, Human
ucagucucaggcuccccuu

SEQ ID NO: 986944 - RNA, 20 nt, Human
ucaguucuuuuccugccccu

SEQ ID NO: 986945 - RNA, 20 nt, Human
uccacacagcugggcugcca

SEQ ID NO: 986946 - RNA, 18 nt, Human
uccacucccucaccaugc

SEQ ID NO: 986947 - RNA, 25 nt, Human
uccacucccucaccaugcggcccac

SEQ ID NO: 986948 - RNA, 19 nt, Human
uccaggccccugcccccac

SEQ ID NO: 986949 - RNA, 21 nt, Human
uccaguuggcauacccggucc

SEQ ID NO: 986950 - RNA, 18 nt, Human
ucccaggcugcaaagccu

SEQ ID NO: 986951 - RNA, 18 nt, Human
ucccaggucuggaauucc

SEQ ID NO: 986952 - RNA, 21 nt, Human
ucccaucaggccucagccacc

SEQ ID NO: 986953 - RNA, 20 nt, Human
ucccauggagcugagaucgc

SEQ ID NO: 986954 - RNA, 19 nt, Human
ucccucaagccgcccuucc

SEQ ID NO: 986955 - RNA, 21 nt, Human
ucccuggaagcccccucuucc

SEQ ID NO: 986956 - RNA, 21 nt, Human
ucccuggaagcccccucuucc

SEQ ID NO: 986957 - RNA, 18 nt, Human
uccgcugccaccccucca

SEQ ID NO: 986958 - RNA, 22 nt, Human
uccucagucucaggcuccccuu

SEQ ID NO: 986959 - RNA, 21 nt, Human
uccugccauugcucaggcugg

SEQ ID NO: 986960 - RNA, 21 nt, Human
uccugccauugcucaggcugg

SEQ ID NO: 986961 - RNA, 23 nt, Human
uccuuugguucaacuuguucugu

SEQ ID NO: 986962 - RNA, 19 nt, Human
uccuuuuuccuucucugcc

SEQ ID NO: 986963 - RNA, 18 nt, Human
ucggccuccuacucacug

SEQ ID NO: 986964 - RNA, 22 nt, Human
ucuauuugcuucuuuccagagg

SEQ ID NO: 986965 - RNA, 22 nt, Human
ucuccggccccgagaaaggccc

SEQ ID NO: 986966 - RNA, 18 nt, Human
ucugccaccaccaugccc

SEQ ID NO: 986967 - RNA, 19 nt, Human
ucugccagccacagcuccc

SEQ ID NO: 986968 - RNA, 22 nt, Human
ucugggccaggagaucuggagc

SEQ ID NO: 986969 - RNA, 21 nt, Human
ucugggugggagcccccaggg

SEQ ID NO: 986970 - RNA, 19 nt, Human
ucuuaaacggcucugaccc

SEQ ID NO: 986971 - RNA, 18 nt, Human
ucuucgcaggcacgugca

SEQ ID NO: 986972 - RNA, 22 nt, Human
ucuucguguuaccccugcuggu

SEQ ID NO: 986973 - RNA, 26 nt, Human
ucuuucuccacuuucccaggucugga

SEQ ID NO: 986974 - RNA, 22 nt, Human
ucuuuggaccucugguucuugc

SEQ ID NO: 986975 - RNA, 22 nt, Human
ugagaacacucacccgcaagaa

SEQ ID NO: 986976 - RNA, 23 nt, Human
ugagaacacucacccgcaagaaa

SEQ ID NO: 986977 - RNA, 19 nt, Human
ugagagggaggccccuggg

SEQ ID NO: 986978 - RNA, 22 nt, Human
ugagcucagcccuucccagcac

SEQ ID NO: 986979 - RNA, 19 nt, Human
ugcaaggcaccucaaggca

SEQ ID NO: 986980 - RNA, 21 nt, Human
ugcaguuccuuuugccuggaa

SEQ ID NO: 986981 - RNA, 22 nt, Human
ugccaaauguccauaaaggacu

SEQ ID NO: 986982 - RNA, 22 nt, Human
ugccccaacuuuauuuugguuc

SEQ ID NO: 986983 - RNA, 18 nt, Human
ugcccgggccuggucucu

SEQ ID NO: 986984 - RNA, 19 nt, Human
ugccuccaguccccugggc

SEQ ID NO: 986985 - RNA, 24 nt, Human
ugccuucuauuugcuucuuuccag

SEQ ID NO: 986986 - RNA, 21 nt, Human
ugcgcaggacugagcacaagg

SEQ ID NO: 986987 - RNA, 27 nt, Human
uggagcaccccacacagcugugacccc

SEQ ID NO: 986988 - RNA, 23 nt, Human
uggagcccugcugugguuccuuc

SEQ ID NO: 986989 - RNA, 22 nt, Human
uggccccaccgagcagaugaua

SEQ ID NO: 986990 - RNA, 20 nt, Human
uggcccugggcugaccuccu

SEQ ID NO: 986991 - RNA, 24 nt, Human
ugggcugccaucagcacugagcag

SEQ ID NO: 986992 - RNA, 23 nt, Human
uggggacaggccauggugcaguc

SEQ ID NO: 986993 - RNA, 21 nt, Human
uggguugaggccuuuaggaga

SEQ ID NO: 986994 - RNA, 21 nt, Human
ugucaaagaggcccuuccugu

SEQ ID NO: 986995 - RNA, 18 nt, Human
ugucagguagggaaagcc

SEQ ID NO: 986996 - RNA, 25 nt, Human
ugucagguagggaaagccaccaucc

SEQ ID NO: 986997 - RNA, 21 nt, Human
uucccuagcccucagagcccc

SEQ ID NO: 986998 - RNA, 20 nt, Human
uucccuucgucggcuaagcc

SEQ ID NO: 986999 - RNA, 18 nt, Human
uugccuccaugcuuuuac

SEQ ID NO: 987000 - RNA, 21 nt, Human
uugcucauccuucaggaccug

SEQ ID NO: 987001 - RNA, 22 nt, Human
uugguucuagaaucauuccagu

SEQ ID NO: 987002 - RNA, 20 nt, Human
uuguucuagccccuccuccc

SEQ ID NO: 987003 - RNA, 23 nt, Human
uuucuccacuuucccaggucugg

SEQ ID NO: 987004 - RNA, 27 nt, Human
aaaaaaaaggugaaaaauaggggaccc

SEQ ID NO: 987005 - RNA, 23 nt, Human
aaaaagcugaggccccagauuuc

SEQ ID NO: 987006 - RNA, 20 nt, Human
aaagaaaaaauaaugaccac

SEQ ID NO: 987007 - RNA, 23 nt, Human
aaagagcaaaacuccgucuaaaa

SEQ ID NO: 987008 - RNA, 25 nt, Human
aaagccaaauucuucuuugcaucca

SEQ ID NO: 987009 - RNA, 18 nt, Human
aacaaagagcaaaacucc

SEQ ID NO: 987010 - RNA, 21 nt, Human
aacaacagaacccaggaaucc

SEQ ID NO: 987011 - RNA, 26 nt, Human
aacaacagaacccaggaauccugguu

SEQ ID NO: 987012 - RNA, 19 nt, Human
aacauggugaaaccccauc

SEQ ID NO: 987013 - RNA, 20 nt, Human
aacauggugaaaccccaucu

SEQ ID NO: 987014 - RNA, 21 nt, Human
aacauggugaaaccccaucuc

SEQ ID NO: 987015 - RNA, 21 nt, Human
aacauggugaaaccccaucuc

SEQ ID NO: 987016 - RNA, 20 nt, Human
aaccaaagagaagaaaccag

SEQ ID NO: 987017 - RNA, 23 nt, Human
aaccaaagagaagaaaccaguau

SEQ ID NO: 987018 - RNA, 21 nt, Human
aacccagccaaugacucacag

SEQ ID NO: 987019 - RNA, 22 nt, Human
aaccucagugaugaagguuucc

SEQ ID NO: 987020 - RNA, 19 nt, Human
aagaagaagaaugaaagga

SEQ ID NO: 987021 - RNA, 26 nt, Human
aagagaagaaaccaguauggugaaga

SEQ ID NO: 987022 - RNA, 27 nt, Human
aagagaagaaaccaguauggugaagag

SEQ ID NO: 987023 - RNA, 22 nt, Human
aagagguggagucacagauuaa

SEQ ID NO: 987024 - RNA, 24 nt, Human
aagcacaaaauucaguccaagagc

SEQ ID NO: 987025 - RNA, 20 nt, Human
aaucagaacccagccaauga

SEQ ID NO: 987026 - RNA, 18 nt, Human
aaucgcuugaacuuggga

SEQ ID NO: 987027 - RNA, 24 nt, Human
aaucgcuugaacuugggaggcgga

SEQ ID NO: 987028 - RNA, 18 nt, Human
acagguuuugaacacuau

SEQ ID NO: 987029 - RNA, 22 nt, Human
accaguauggugaagagaucuc

SEQ ID NO: 987030 - RNA, 24 nt, Human
accccaucucuacuaaaaguacaa

SEQ ID NO: 987031 - RNA, 19 nt, Human
acuacaaugucucaugcau

SEQ ID NO: 987032 - RNA, 21 nt, Human
acucagcaaggcucauaauuu

SEQ ID NO: 987033 - RNA, 18 nt, Human
acugcacuccagccuggg

SEQ ID NO: 987034 - RNA, 23 nt, Human
acugcacuccagccugggcaaca

SEQ ID NO: 987035 - RNA, 26 nt, Human
acuggaacgcugagaagggaccgguc

SEQ ID NO: 987036 - RNA, 21 nt, Human
agaaaggagguugcagaggac

SEQ ID NO: 987037 - RNA, 19 nt, Human
agaaaugcucacuggcauc

SEQ ID NO: 987038 - RNA, 24 nt, Human
agaagaaaccaguauggugaagag

SEQ ID NO: 987039 - RNA, 19 nt, Human
agaagaagaagaaugaaag

SEQ ID NO: 987040 - RNA, 22 nt, Human
agaaucgcuugaacuugggagg

SEQ ID NO: 987041 - RNA, 21 nt, Human
agacaggagaaucgcuugaac

SEQ ID NO: 987042 - RNA, 24 nt, Human
agacaggagaaucgcuugaacuug

SEQ ID NO: 987043 - RNA, 22 nt, Human
agaccagccuggccaacauggu

SEQ ID NO: 987044 - RNA, 26 nt, Human
agagaagaaaccaguauggugaagag

SEQ ID NO: 987045 - RNA, 23 nt, Human
agagcagggggcuuaugaaaugc

SEQ ID NO: 987046 - RNA, 22 nt, Human
agccuggccaacauggugaaac

SEQ ID NO: 987047 - RNA, 24 nt, Human
agccuggccaacauggugaaaccc

SEQ ID NO: 987048 - RNA, 18 nt, Human
aggaauucaaaaccuagc

SEQ ID NO: 987049 - RNA, 24 nt, Human
aggcauguuggugggcaccuguaa

SEQ ID NO: 987050 - RNA, 21 nt, Human
aggccgaggaggguagaucac

SEQ ID NO: 987051 - RNA, 21 nt, Human
aggcggagguugcagugagcc

SEQ ID NO: 987052 - RNA, 24 nt, Human
aggcggagguugcagugagccgag

SEQ ID NO: 987053 - RNA, 24 nt, Human
aggcugagacaggagaaucgcuug

SEQ ID NO: 987054 - RNA, 21 nt, Human
agggaccggucuaucucagag

SEQ ID NO: 987055 - RNA, 18 nt, Human
agguugcagaggacgggu

SEQ ID NO: 987056 - RNA, 24 nt, Human
aguacuuugggaggccgaggaggg

SEQ ID NO: 987057 - RNA, 20 nt, Human
auaacagacaacucuccuuc

SEQ ID NO: 987058 - RNA, 24 nt, Human
aucgugccacugcacuccagccug

SEQ ID NO: 987059 - RNA, 18 nt, Human
auggugaagagaucucua

SEQ ID NO: 987060 - RNA, 24 nt, Human
auucaagugaaaacagacagaggg

SEQ ID NO: 987061 - RNA, 19 nt, Human
auugucuuucuucucuacc

SEQ ID NO: 987062 - RNA, 22 nt, Human
caacaacagaacccaggaaucc

SEQ ID NO: 987063 - RNA, 24 nt, Human
caacauggugaaaccccaucucua

SEQ ID NO: 987064 - RNA, 22 nt, Human
cacauacagugcuccacccucu

SEQ ID NO: 987065 - RNA, 18 nt, Human
caccuguaaucccagcua

SEQ ID NO: 987066 - RNA, 24 nt, Human
caccuguaaucccagcuacccagg

SEQ ID NO: 987067 - RNA, 25 nt, Human
cacuccagccugggcaacaaagagc

SEQ ID NO: 987068 - RNA, 18 nt, Human
cacugcacuccagccugg

SEQ ID NO: 987069 - RNA, 19 nt, Human
cacugcacuccagccuggg

SEQ ID NO: 987070 - RNA, 21 nt, Human
cacugcacuccagccugggca

SEQ ID NO: 987071 - RNA, 23 nt, Human
cacugcacuccagccugggcaac

SEQ ID NO: 987072 - RNA, 24 nt, Human
cacugcacuccagccugggcaaca

SEQ ID NO: 987073 - RNA, 22 nt, Human
cacuuggcaggggcuggccaac

SEQ ID NO: 987074 - RNA, 21 nt, Human
cagaacccagccaaugacuca

SEQ ID NO: 987075 - RNA, 26 nt, Human
cagaauccaugguucuggaaaugcca

SEQ ID NO: 987076 - RNA, 27 nt, Human
cagagagugccuacagguuuugaacac

SEQ ID NO: 987077 - RNA, 22 nt, Human
cagauuaaugagggcagacucc

SEQ ID NO: 987078 - RNA, 20 nt, Human
cagcauuggaacuggcugca

SEQ ID NO: 987079 - RNA, 20 nt, Human
caggccuguaaucccaguac

SEQ ID NO: 987080 - RNA, 24 nt, Human
caggccuguaaucccaguacuuug

SEQ ID NO: 987081 - RNA, 23 nt, Human
caguacuuugggaggccgaggag

SEQ ID NO: 987082 - RNA, 24 nt, Human
caguacuuugggaggccgaggagg

SEQ ID NO: 987083 - RNA, 22 nt, Human
caguauggugaagagaucucua

SEQ ID NO: 987084 - RNA, 23 nt, Human
cagugaacauaacagacaacucu

SEQ ID NO: 987085 - RNA, 21 nt, Human
caugagacagcuuuaucccag

SEQ ID NO: 987086 - RNA, 26 nt, Human
cauugagaacucagcuaggacuuuaa

SEQ ID NO: 987087 - RNA, 22 nt, Human
ccaaaaaaaagaagaagaagaa

SEQ ID NO: 987088 - RNA, 19 nt, Human
ccaaaggcagaauccaugg

SEQ ID NO: 987089 - RNA, 20 nt, Human
ccacugcacuccagccuggg

SEQ ID NO: 987090 - RNA, 21 nt, Human
ccacugcacuccagccugggc

SEQ ID NO: 987091 - RNA, 22 nt, Human
ccacugcacuccagccugggca

SEQ ID NO: 987092 - RNA, 23 nt, Human
ccacugcacuccagccugggcaa

SEQ ID NO: 987093 - RNA, 24 nt, Human
ccacugcacuccagccugggcaac

SEQ ID NO: 987094 - RNA, 19 nt, Human
ccagaguuuuaauauuaau

SEQ ID NO: 987095 - RNA, 23 nt, Human
ccagccuugcaaacacaucuguc

SEQ ID NO: 987096 - RNA, 18 nt, Human
cccaggacuccuuuacaa

SEQ ID NO: 987097 - RNA, 20 nt, Human
ccccccaaaaaaaagaagaa

SEQ ID NO: 987098 - RNA, 26 nt, Human
ccccccaaaaaaaagaagaagaagaa

SEQ ID NO: 987099 - RNA, 19 nt, Human
cccccccaaaaaaaagaag

SEQ ID NO: 987100 - RNA, 25 nt, Human
cccccccaaaaaaaagaagaagaaa

SEQ ID NO: 987101 - RNA, 19 nt, Human
cccccgccccgcccccccc

SEQ ID NO: 987102 - RNA, 21 nt, Human
ccccgccccgccccccccaaa

SEQ ID NO: 987103 - RNA, 20 nt, Human
cccgccccccccaaaaaaaa

SEQ ID NO: 987104 - RNA, 22 nt, Human
cccgccccgccccccccaaaaa

SEQ ID NO: 987105 - RNA, 22 nt, Human
cccgcucccggcgaggggcugg

SEQ ID NO: 987106 - RNA, 20 nt, Human
cccgggccgggcccgccucc

SEQ ID NO: 987107 - RNA, 23 nt, Human
cccuuacccaucuuguccagaaa

SEQ ID NO: 987108 - RNA, 23 nt, Human
ccuggccaacauggugaaacccc

SEQ ID NO: 987109 - RNA, 24 nt, Human
ccuggccaacauggugaaacccca

SEQ ID NO: 987110 - RNA, 21 nt, Human
ccuguaaucccagcuacccag

SEQ ID NO: 987111 - RNA, 24 nt, Human
ccuguaaucccagcuacccaggag

SEQ ID NO: 987112 - RNA, 24 nt, Human
cgagaucgugccacugcacuccag

SEQ ID NO: 987113 - RNA, 19 nt, Human
cgcagccgcucaccuuccc

SEQ ID NO: 987114 - RNA, 27 nt, Human
cgcccagcccaccugaaaggacaccuc

SEQ ID NO: 987115 - RNA, 22 nt, Human
cgccccgccccccccaaaaaaa

SEQ ID NO: 987116 - RNA, 21 nt, Human
cgcuugaacuugggaggcgga

SEQ ID NO: 987117 - RNA, 23 nt, Human
cuaaaacuuugagaucccucccc

SEQ ID NO: 987118 - RNA, 24 nt, Human
cucaggccuguaaucccaguacuu

SEQ ID NO: 987119 - RNA, 21 nt, Human
cuccacauacagugcuccacc

SEQ ID NO: 987120 - RNA, 24 nt, Human
cuccaggcgagcccaggaaucugc

SEQ ID NO: 987121 - RNA, 19 nt, Human
cuccuagcugauucucugu

SEQ ID NO: 987122 - RNA, 21 nt, Human
cugcaaaacacacacuuagca

SEQ ID NO: 987123 - RNA, 20 nt, Human
cugccgggugacugcccugc

SEQ ID NO: 987124 - RNA, 18 nt, Human
cugccuacucugccagcc

SEQ ID NO: 987125 - RNA, 18 nt, Human
cugccuacucugccagcc

SEQ ID NO: 987126 - RNA, 23 nt, Human
cuggccaacauggugaaacccca

SEQ ID NO: 987127 - RNA, 18 nt, Human
cugucuuagggcagugga

SEQ ID NO: 987128 - RNA, 23 nt, Human
cuuagcauuugacaacaggaaac

SEQ ID NO: 987129 - RNA, 24 nt, Human
cuuuuugggcauucucagcugcca

SEQ ID NO: 987130 - RNA, 20 nt, Human
gaagaaaccaguauggugaa

SEQ ID NO: 987131 - RNA, 21 nt, Human
gaauucaaaaccuagcugcug

SEQ ID NO: 987132 - RNA, 23 nt, Human
gagaucccucccccgccccgccc

SEQ ID NO: 987133 - RNA, 23 nt, Human
gagguugcagugagccgagaucg

SEQ ID NO: 987134 - RNA, 23 nt, Human
gaucaccugagaucuggaguuga

SEQ ID NO: 987135 - RNA, 26 nt, Human
gauuuucuauccccguagaaaucucc

SEQ ID NO: 987136 - RNA, 24 nt, Human
gccaacauggugaaaccccaucuc

SEQ ID NO: 987137 - RNA, 22 nt, Human
gccacugcacuccagccugggc

SEQ ID NO: 987138 - RNA, 24 nt, Human
gccacugcacuccagccugggcaa

SEQ ID NO: 987139 - RNA, 20 nt, Human
gcccagcccaccugaaauuc

SEQ ID NO: 987140 - RNA, 20 nt, Human
gccgagaucgugccacugca

SEQ ID NO: 987141 - RNA, 30 nt, Human
ggaauuucuccacauacagugcuccacccu

SEQ ID NO: 987142 - RNA, 20 nt, Human
ggagguugcagugagccgag

SEQ ID NO: 987143 - RNA, 22 nt, Human
ggagguugcagugagccgagau

SEQ ID NO: 987144 - RNA, 23 nt, Human
ggagguugcagugagccgagauc

SEQ ID NO: 987145 - RNA, 24 nt, Human
ggagguugcagugagccgagaucg

SEQ ID NO: 987146 - RNA, 19 nt, Human
ggagucacagauuaaugag

SEQ ID NO: 987147 - RNA, 21 nt, Human
ggauccgggcgagccagcagc

SEQ ID NO: 987148 - RNA, 19 nt, Human
ggcaccuguaaucccagcu

SEQ ID NO: 987149 - RNA, 19 nt, Human
ggccgggcgcgguggcuca

SEQ ID NO: 987150 - RNA, 23 nt, Human
ggccuguaaucccaguacuuugg

SEQ ID NO: 987151 - RNA, 24 nt, Human
ggccuguaaucccaguacuuuggg

SEQ ID NO: 987152 - RNA, 23 nt, Human
ggcgcgguggcucaggccuguaa

SEQ ID NO: 987153 - RNA, 21 nt, Human
ggcucaggccuguaaucccag

SEQ ID NO: 987154 - RNA, 23 nt, Human
gguggcucaggccuguaauccca

SEQ ID NO: 987155 - RNA, 24 nt, Human
gguggcucaggccuguaaucccag

SEQ ID NO: 987156 - RNA, 20 nt, Human
ggugggugugacaucuagca

SEQ ID NO: 987157 - RNA, 19 nt, Human
guggaauauuguagaagga

SEQ ID NO: 987158 - RNA, 23 nt, Human
guggcucaggccuguaaucccag

SEQ ID NO: 987159 - RNA, 24 nt, Human
guugcagugagccgagaucgugcc

SEQ ID NO: 987160 - RNA, 24 nt, Human
guuggugggcaccuguaaucccag

SEQ ID NO: 987161 - RNA, 18 nt, Human
uaaaaagcugaggcccca

SEQ ID NO: 987162 - RNA, 18 nt, Human
uaaaacaggcauaggaac

SEQ ID NO: 987163 - RNA, 21 nt, Human
uaaauuaaaaagcugaggccc

SEQ ID NO: 987164 - RNA, 23 nt, Human
uaacaagguaggaauucaaaacc

SEQ ID NO: 987165 - RNA, 23 nt, Human
uaacagacaacucuccuucaaaa

SEQ ID NO: 987166 - RNA, 23 nt, Human
uacagccacauuuuacccaggac

SEQ ID NO: 987167 - RNA, 22 nt, Human
uaccaagaagagaaugcugguc

SEQ ID NO: 987168 - RNA, 24 nt, Human
uagaaggaauuucuccacauacag

SEQ ID NO: 987169 - RNA, 27 nt, Human
uagaucaccugagaucuggaguugaag

SEQ ID NO: 987170 - RNA, 24 nt, Human
uagcaaucagaacccagccaauga

SEQ ID NO: 987171 - RNA, 21 nt, Human
uagccagagagugccuacagg

SEQ ID NO: 987172 - RNA, 20 nt, Human
uagcugcugguuauuuaccc

SEQ ID NO: 987173 - RNA, 22 nt, Human
uagcuugacugcuaagacaucc

SEQ ID NO: 987174 - RNA, 25 nt, Human
uaggccgggcgcgguggcucaggcc

SEQ ID NO: 987175 - RNA, 19 nt, Human
uagggcaguggauuagggu

SEQ ID NO: 987176 - RNA, 25 nt, Human
uauccacucagcaaggcucauaauu

SEQ ID NO: 987177 - RNA, 24 nt, Human
uauuuuuucuguuuuuucagagga

SEQ ID NO: 987178 - RNA, 20 nt, Human
ucaaaauguaucucauuucu

SEQ ID NO: 987179 - RNA, 22 nt, Human
ucaagugaaaacagacagaggg

SEQ ID NO: 987180 - RNA, 21 nt, Human
ucagaacccagccaaugacuc

SEQ ID NO: 987181 - RNA, 24 nt, Human
ucagaacccagccaaugacucaca

SEQ ID NO: 987182 - RNA, 22 nt, Human
ucaggccuguaaucccaguacu

SEQ ID NO: 987183 - RNA, 21 nt, Human
uccaaagugucacaccagaca

SEQ ID NO: 987184 - RNA, 18 nt, Human
uccaagagaaauggaccc

SEQ ID NO: 987185 - RNA, 21 nt, Human
uccaggauacuuucacuuccu

SEQ ID NO: 987186 - RNA, 21 nt, Human
uccaugauucccacauuuagc

SEQ ID NO: 987187 - RNA, 21 nt, Human
ucccccgccccgcccccccca

SEQ ID NO: 987188 - RNA, 19 nt, Human
uccccgggccgggcccgcc

SEQ ID NO: 987189 - RNA, 19 nt, Human
uccccgggccgggcccgcc

SEQ ID NO: 987190 - RNA, 26 nt, Human
uccccguagaaaucucugaagaaaga

SEQ ID NO: 987191 - RNA, 18 nt, Human
uccugcucugucuugcuu

SEQ ID NO: 987192 - RNA, 24 nt, Human
uccuucaauaacacagaugagcaa

SEQ ID NO: 987193 - RNA, 24 nt, Human
ucgcuugaacuugggaggcggagg

SEQ ID NO: 987194 - RNA, 23 nt, Human
ucgugccacugcacuccagccug

SEQ ID NO: 987195 - RNA, 25 nt, Human
ucuaagauguucuguggcggaaccu

SEQ ID NO: 987196 - RNA, 23 nt, Human
ucucagagucacuuuggugaugc

SEQ ID NO: 987197 - RNA, 21 nt, Human
ucucuacuaaaaguacaaaaa

SEQ ID NO: 987198 - RNA, 21 nt, Human
ucucugcaucuggccuaaccc

SEQ ID NO: 987199 - RNA, 21 nt, Human
ucuguaaucccugcuaaguga

SEQ ID NO: 987200 - RNA, 22 nt, Human
ucuuuuucugccuacucugcca

SEQ ID NO: 987201 - RNA, 23 nt, Human
ugaaaaauaggccgggcgcggug

SEQ ID NO: 987202 - RNA, 19 nt, Human
ugaaaccccaucucuacua

SEQ ID NO: 987203 - RNA, 20 nt, Human
ugaagaaagaaccagaucac

SEQ ID NO: 987204 - RNA, 22 nt, Human
ugaauauauauggagcacccau

SEQ ID NO: 987205 - RNA, 21 nt, Human
ugaccaaaugaugaugggugg

SEQ ID NO: 987206 - RNA, 19 nt, Human
ugagacagcuuuaucccag

SEQ ID NO: 987207 - RNA, 20 nt, Human
ugagacaggagaaucgcuug

SEQ ID NO: 987208 - RNA, 23 nt, Human
ugagacaggagaaucgcuugaac

SEQ ID NO: 987209 - RNA, 19 nt, Human
ugagagagccaucccagcc

SEQ ID NO: 987210 - RNA, 22 nt, Human
ugagccgagaucgugccacugc

SEQ ID NO: 987211 - RNA, 18 nt, Human
ugagguguccagcauugg

SEQ ID NO: 987212 - RNA, 18 nt, Human
ugaugaagguuuccaauu

SEQ ID NO: 987213 - RNA, 23 nt, Human
ugcugguggccucagaguuuguu

SEQ ID NO: 987214 - RNA, 26 nt, Human
ugcugguggccucagaguuuguuuuu

SEQ ID NO: 987215 - RNA, 19 nt, Human
uggaauauuguagaaggaa

SEQ ID NO: 987216 - RNA, 21 nt, Human
uggagcacccaugagacagcu

SEQ ID NO: 987217 - RNA, 18 nt, Human
uggaguugauaauucugg

SEQ ID NO: 987218 - RNA, 24 nt, Human
uggccaacauggugaaaccccauc

SEQ ID NO: 987219 - RNA, 22 nt, Human
uggcucaggccuguaaucccag

SEQ ID NO: 987220 - RNA, 24 nt, Human
uggcucaggccuguaaucccagua

SEQ ID NO: 987221 - RNA, 20 nt, Human
ugggaggccgaggaggguag

SEQ ID NO: 987222 - RNA, 24 nt, Human
ugggaggccgaggaggguagauca

SEQ ID NO: 987223 - RNA, 29 nt, Human
ugggaggcggagguugcagugacaacggu

SEQ ID NO: 987224 - RNA, 24 nt, Human
ugggaggcggagguugcagugagc

SEQ ID NO: 987225 - RNA, 21 nt, Human
ugggaucggggccccgcccag

SEQ ID NO: 987226 - RNA, 18 nt, Human
ugggugugacaucuagca

SEQ ID NO: 987227 - RNA, 21 nt, Human
uggugggcaccuguaauccca

SEQ ID NO: 987228 - RNA, 22 nt, Human
uggugggcaccuguaaucccag

SEQ ID NO: 987229 - RNA, 20 nt, Human
ugguuauuuacccauucaag

SEQ ID NO: 987230 - RNA, 22 nt, Human
ugguugagguguccagcauugg

SEQ ID NO: 987231 - RNA, 18 nt, Human
uguuagggauggucuccc

SEQ ID NO: 987232 - RNA, 24 nt, Human
uuagccaggcauguuggugggcac

SEQ ID NO: 987233 - RNA, 18 nt, Human
uuaguucaugacugcaaa

SEQ ID NO: 987234 - RNA, 20 nt, Human
uucgaccaggaauaccgacu

SEQ ID NO: 987235 - RNA, 24 nt, Human
uugaacuugggaggcggagguugc

SEQ ID NO: 987236 - RNA, 23 nt, Human
uugagaucccucccccgccccgc

SEQ ID NO: 987237 - RNA, 18 nt, Human
uugcagugagccgagauc

SEQ ID NO: 987238 - RNA, 21 nt, Human
uugcagugagccgagaucgug

SEQ ID NO: 987239 - RNA, 22 nt, Human
uugcagugagccgagaucgugc

SEQ ID NO: 987240 - RNA, 24 nt, Human
uuggaacuggcugcaccaugguuu

SEQ ID NO: 987241 - RNA, 23 nt, Human
uugggacuccaucaaggacugug

SEQ ID NO: 987242 - RNA, 19 nt, Human
uuuaauuuggauucuggaa

SEQ ID NO: 987243 - RNA, 23 nt, Human
aaaaugcagccgcagucccacca

SEQ ID NO: 987244 - RNA, 20 nt, Human
aaacaaaugugaucauuaac

SEQ ID NO: 987245 - RNA, 23 nt, Human
aaacaagaaacccucacaaccac

SEQ ID NO: 987246 - RNA, 22 nt, Human
aaagaucuaaaggaaacaagaa

SEQ ID NO: 987247 - RNA, 24 nt, Human
aacaauuuuuuuuuuccuaaacug

SEQ ID NO: 987248 - RNA, 26 nt, Human
aacugcuauuuggauuucaaaacucc

SEQ ID NO: 987249 - RNA, 22 nt, Human
aagaaacccucacaaccacuga

SEQ ID NO: 987250 - RNA, 19 nt, Human
aaggaaacaagaaacccuc

SEQ ID NO: 987251 - RNA, 22 nt, Human
acaaagauccuguuuucaaaca

SEQ ID NO: 987252 - RNA, 20 nt, Human
acaggugugugaacagauuu

SEQ ID NO: 987253 - RNA, 18 nt, Human
accagcagacccauaaaa

SEQ ID NO: 987254 - RNA, 18 nt, Human
acuggggucggggugggg

SEQ ID NO: 987255 - RNA, 19 nt, Human
agccccuuucuccccuucc

SEQ ID NO: 987256 - RNA, 18 nt, Human
agcuugcuggagacgcag

SEQ ID NO: 987257 - RNA, 23 nt, Human
aggcucuuccauggauucacccu

SEQ ID NO: 987258 - RNA, 18 nt, Human
aggugguuucggagaugg

SEQ ID NO: 987259 - RNA, 24 nt, Human
caaaaacaucaccuugggagacac

SEQ ID NO: 987260 - RNA, 22 nt, Human
caaaagacuaagacagaucuga

SEQ ID NO: 987261 - RNA, 24 nt, Human
caaagagaacauugcugaguccca

SEQ ID NO: 987262 - RNA, 21 nt, Human
caacacgggacugaggguccc

SEQ ID NO: 987263 - RNA, 19 nt, Human
caaccacugaaacaaacaa

SEQ ID NO: 987264 - RNA, 18 nt, Human
caacucccgagugcuccu

SEQ ID NO: 987265 - RNA, 22 nt, Human
caacuucugggcuuuccacccu

SEQ ID NO: 987266 - RNA, 20 nt, Human
caagaaacccucacaaccac

SEQ ID NO: 987267 - RNA, 21 nt, Human
cacaaccacugaaacaaacaa

SEQ ID NO: 987268 - RNA, 21 nt, Human
caccucacaaaggcucuucca

SEQ ID NO: 987269 - RNA, 18 nt, Human
cacgccuccuccuuuucc

SEQ ID NO: 987270 - RNA, 18 nt, Human
cacugugucgccacaagu

SEQ ID NO: 987271 - RNA, 21 nt, Human
cagaaccgccggucccuggcu

SEQ ID NO: 987272 - RNA, 18 nt, Human
cagcggugcagagccacu

SEQ ID NO: 987273 - RNA, 22 nt, Human
cagggcacugaaaaugcagccg

SEQ ID NO: 987274 - RNA, 23 nt, Human
caggguuguggagcuugcuggag

SEQ ID NO: 987275 - RNA, 21 nt, Human
ccaccucuuuccaaaaaacug

SEQ ID NO: 987276 - RNA, 22 nt, Human
ccacugagcaacucccgagugc

SEQ ID NO: 987277 - RNA, 21 nt, Human
ccauaaaaagugaaaaaccac

SEQ ID NO: 987278 - RNA, 19 nt, Human
ccauggauucaccccauuc

SEQ ID NO: 987279 - RNA, 18 nt, Human
ccccuuucuccccuuccc

SEQ ID NO: 987280 - RNA, 22 nt, Human
ccgcagucccaccacgccuccu

SEQ ID NO: 987281 - RNA, 19 nt, Human
ccgcugcugccgccacugc

SEQ ID NO: 987282 - RNA, 23 nt, Human
ccugguuuuagggguugguggga

SEQ ID NO: 987283 - RNA, 18 nt, Human
cgagugcuccuaggccca

SEQ ID NO: 987284 - RNA, 21 nt, Human
cgcagucccaccacgccuccu

SEQ ID NO: 987285 - RNA, 19 nt, Human
cgguugaacaagugcaaag

SEQ ID NO: 987286 - RNA, 19 nt, Human
cucacaaaggcucuuccau

SEQ ID NO: 987287 - RNA, 22 nt, Human
cucacaaaggcucuuccaugga

SEQ ID NO: 987288 - RNA, 20 nt, Human
cucccagaaccgccgguccc

SEQ ID NO: 987289 - RNA, 19 nt, Human
cuccuggaaccccggcguc

SEQ ID NO: 987290 - RNA, 19 nt, Human
cucggcccugccauccuaa

SEQ ID NO: 987291 - RNA, 20 nt, Human
cucuggcagccccuuucucc

SEQ ID NO: 987292 - RNA, 23 nt, Human
cugaaaaugcagccgcaguccca

SEQ ID NO: 987293 - RNA, 18 nt, Human
cuggagcagcgcgugggg

SEQ ID NO: 987294 - RNA, 18 nt, Human
cuggcagccccuuucucc

SEQ ID NO: 987295 - RNA, 22 nt, Human
cugggcuuuccacccuuugucu

SEQ ID NO: 987296 - RNA, 21 nt, Human
cugggguuauacaaacugaga

SEQ ID NO: 987297 - RNA, 24 nt, Human
cuguaccuuguauuuucuagaacc

SEQ ID NO: 987298 - RNA, 22 nt, Human
cuguucuugauuuuccacuguu

SEQ ID NO: 987299 - RNA, 21 nt, Human
cuuuauuggucgcugcuccuc

SEQ ID NO: 987300 - RNA, 19 nt, Human
gacacaaaagacuaagaca

SEQ ID NO: 987301 - RNA, 18 nt, Human
gagcuucaaagacuagua

SEQ ID NO: 987302 - RNA, 18 nt, Human
gaggugguuucggagaug

SEQ ID NO: 987303 - RNA, 19 nt, Human
gaggugguuucggagaugg

SEQ ID NO: 987304 - RNA, 18 nt, Human
gcacagcugcucccagaa

SEQ ID NO: 987305 - RNA, 19 nt, Human
gcagacccauaaaaaguga

SEQ ID NO: 987306 - RNA, 24 nt, Human
gcagcauuucagaaacucaaucca

SEQ ID NO: 987307 - RNA, 25 nt, Human
gcugaacugaaucauuccuaaagaa

SEQ ID NO: 987308 - RNA, 21 nt, Human
ggaaagccagcgaggaagggg

SEQ ID NO: 987309 - RNA, 22 nt, Human
ggagacacaaaagacuaagaca

SEQ ID NO: 987310 - RNA, 22 nt, Human
ggaggugguuucggagaugggc

SEQ ID NO: 987311 - RNA, 23 nt, Human
gggcuuuccacccuuugucuuuu

SEQ ID NO: 987312 - RNA, 21 nt, Human
uaacucaacagaaaugugcua

SEQ ID NO: 987313 - RNA, 21 nt, Human
uaagacacaggugugugaaca

SEQ ID NO: 987314 - RNA, 19 nt, Human
uaagacagaucugaccaca

SEQ ID NO: 987315 - RNA, 21 nt, Human
uacaacacagaauaguucaaa

SEQ ID NO: 987316 - RNA, 24 nt, Human
uagcagcucggcccugccauccua

SEQ ID NO: 987317 - RNA, 22 nt, Human
uaggcauuuuaaacagcagcuu

SEQ ID NO: 987318 - RNA, 23 nt, Human
uauagaacuaaaguuuaagauga

SEQ ID NO: 987319 - RNA, 20 nt, Human
uccaccucuuuccaaaaaac

SEQ ID NO: 987320 - RNA, 22 nt, Human
uccaccucuuuccaaaaaacug

SEQ ID NO: 987321 - RNA, 18 nt, Human
uccaugcgcuuacugggg

SEQ ID NO: 987322 - RNA, 20 nt, Human
uccauggauucaccccauuc

SEQ ID NO: 987323 - RNA, 18 nt, Human
ucccaccacgccuccucc

SEQ ID NO: 987324 - RNA, 19 nt, Human
ucccaccacgccuccuccu

SEQ ID NO: 987325 - RNA, 21 nt, Human
ucccagaaccgccggucccug

SEQ ID NO: 987326 - RNA, 24 nt, Human
ucccagcgugguuuauguccugcc

SEQ ID NO: 987327 - RNA, 20 nt, Human
ucccuggagcagcgcguggg

SEQ ID NO: 987328 - RNA, 21 nt, Human
uccuaaagaaagugacuaagu

SEQ ID NO: 987329 - RNA, 23 nt, Human
ucucaugguguuggaggugguuu

SEQ ID NO: 987330 - RNA, 23 nt, Human
ucuuacuuuacaaucaagauuau

SEQ ID NO: 987331 - RNA, 22 nt, Human
ugaaacaaacaacacugaagua

SEQ ID NO: 987332 - RNA, 18 nt, Human
ugaacaagugcaaagaga

SEQ ID NO: 987333 - RNA, 19 nt, Human
ugaacugaaucauuccuaa

SEQ ID NO: 987334 - RNA, 23 nt, Human
ugacuaaguucccaugaggaauc

SEQ ID NO: 987335 - RNA, 19 nt, Human
ugagucccauuuguguuau

SEQ ID NO: 987336 - RNA, 21 nt, Human
ugcagccgcagucccaccacg

SEQ ID NO: 987337 - RNA, 23 nt, Human
ugccucuugcaaguaguacacac

SEQ ID NO: 987338 - RNA, 20 nt, Human
uggauuucaaaacuccccau

SEQ ID NO: 987339 - RNA, 18 nt, Human
uggggucgggguggggga

SEQ ID NO: 987340 - RNA, 20 nt, Human
ugguguuggaggugguuucg

SEQ ID NO: 987341 - RNA, 21 nt, Human
uucaaagacuaguaauucacc

SEQ ID NO: 987342 - RNA, 21 nt, Human
uucagaaacucaauccaccuc

SEQ ID NO: 987343 - RNA, 28 nt, Human
uucauggggaaagccagcgaggaagggg

SEQ ID NO: 987344 - RNA, 18 nt, Human
uuuaagaugaauauuguc

SEQ ID NO: 987345 - RNA, 18 nt, Human
uuuccaaaaaacuguacc

SEQ ID NO: 987346 - RNA, 21 nt, Human
uuuucuagaaccaacuucugg

SEQ ID NO: 987347 - RNA, 22 nt, Human
aaaaauaauagcaacaaaugug

SEQ ID NO: 987348 - RNA, 19 nt, Human
aaaacacacaaaaaugaaa

SEQ ID NO: 987349 - RNA, 19 nt, Human
aaaggcagaguaguccaca

SEQ ID NO: 987350 - RNA, 19 nt, Human
aagaagcacaugcagauug

SEQ ID NO: 987351 - RNA, 18 nt, Human
aagcagcagcagaaauuc

SEQ ID NO: 987352 - RNA, 20 nt, Human
acacaugauggcaaacaaga

SEQ ID NO: 987353 - RNA, 19 nt, Human
acagagcuucagaccacaa

SEQ ID NO: 987354 - RNA, 25 nt, Human
agaaaaacaaucauauauaugcagg

SEQ ID NO: 987355 - RNA, 19 nt, Human
aggaagauuaaaacacaca

SEQ ID NO: 987356 - RNA, 18 nt, Human
aggaugcuguauuccuug

SEQ ID NO: 987357 - RNA, 23 nt, Human
aggcagaaaaacaccaguaguuu

SEQ ID NO: 987358 - RNA, 21 nt, Human
aggcagaguaguccacaugca

SEQ ID NO: 987359 - RNA, 19 nt, Human
agguuguguaggcacugug

SEQ ID NO: 987360 - RNA, 21 nt, Human
auacauaagaagaacaguaua

SEQ ID NO: 987361 - RNA, 21 nt, Human
aucagauuccaccgguuuagu

SEQ ID NO: 987362 - RNA, 24 nt, Human
auggcaaacaagaacauuuugcuu

SEQ ID NO: 987363 - RNA, 18 nt, Human
caaaacaagccaacaacu

SEQ ID NO: 987364 - RNA, 21 nt, Human
caacagagcuucagaccacaa

SEQ ID NO: 987365 - RNA, 18 nt, Human
caagaucagauuccaccg

SEQ ID NO: 987366 - RNA, 25 nt, Human
caaggguaccagacccucuuaacug

SEQ ID NO: 987367 - RNA, 25 nt, Human
cacaacagagcuucagaccacaaag

SEQ ID NO: 987368 - RNA, 24 nt, Human
cacucacucucugguccagucuua

SEQ ID NO: 987369 - RNA, 20 nt, Human
cacugcaggcugaaaaacua

SEQ ID NO: 987370 - RNA, 19 nt, Human
cagcacacucacucucugg

SEQ ID NO: 987371 - RNA, 19 nt, Human
caguggaggagccagugga

SEQ ID NO: 987372 - RNA, 19 nt, Human
caucaccuaccuccgaguc

SEQ ID NO: 987373 - RNA, 19 nt, Human
caucuggacagucaagauu

SEQ ID NO: 987374 - RNA, 18 nt, Human
ccaaggcaaaguuagaau

SEQ ID NO: 987375 - RNA, 23 nt, Human
ccagcccucggccuggcggugca

SEQ ID NO: 987376 - RNA, 20 nt, Human
ccuagcuuguucaaauaucu

SEQ ID NO: 987377 - RNA, 19 nt, Human
ccuaugguggcuuccagca

SEQ ID NO: 987378 - RNA, 23 nt, Human
ccuccgagucgcugccgggcagg

SEQ ID NO: 987379 - RNA, 18 nt, Human
cgcggcgcguuaccuucc

SEQ ID NO: 987380 - RNA, 22 nt, Human
cggcgcguuaccuucccccggg

SEQ ID NO: 987381 - RNA, 21 nt, Human
cucaaggcagaaaaacaccag

SEQ ID NO: 987382 - RNA, 22 nt, Human
cucaaggcagaaaaacaccagu

SEQ ID NO: 987383 - RNA, 20 nt, Human
cucagaauuauaaaauaaac

SEQ ID NO: 987384 - RNA, 24 nt, Human
cugaauuguaccuauggccagugg

SEQ ID NO: 987385 - RNA, 22 nt, Human
cugcaaccaggaagauuaaaac

SEQ ID NO: 987386 - RNA, 26 nt, Human
cugcaaccaggaagauuaaaacacac

SEQ ID NO: 987387 - RNA, 18 nt, Human
cugcaaggguaccagacc

SEQ ID NO: 987388 - RNA, 23 nt, Human
cugcaaggguaccagacccucuu

SEQ ID NO: 987389 - RNA, 18 nt, Human
cugcgacuuuuucccaca

SEQ ID NO: 987390 - RNA, 22 nt, Human
cuggcccccagcccucggccug

SEQ ID NO: 987391 - RNA, 24 nt, Human
cuguuuguuuucucaaggcagaaa

SEQ ID NO: 987392 - RNA, 20 nt, Human
gcagccccgggcgcggcgcg

SEQ ID NO: 987393 - RNA, 19 nt, Human
gcccccagcccucggccug

SEQ ID NO: 987394 - RNA, 19 nt, Human
gguccuuuuuuuuuuuuau

SEQ ID NO: 987395 - RNA, 20 nt, Human
gugaaacacaugauggcaaa

SEQ ID NO: 987396 - RNA, 23 nt, Human
gugaaacacaugauggcaaacaa

SEQ ID NO: 987397 - RNA, 19 nt, Human
guuuguuuucucaaggcag

SEQ ID NO: 987398 - RNA, 23 nt, Human
guuuguuuucucaaggcagaaaa

SEQ ID NO: 987399 - RNA, 22 nt, Human
uaaaaaaauaaacucauaaaaa

SEQ ID NO: 987400 - RNA, 18 nt, Human
uaaaaauacaggcuugag

SEQ ID NO: 987401 - RNA, 22 nt, Human
uaaaacacacaaaaaugaaaua

SEQ ID NO: 987402 - RNA, 18 nt, Human
uaaaggcagaguagucca

SEQ ID NO: 987403 - RNA, 21 nt, Human
uaacaauaccccauguuuaau

SEQ ID NO: 987404 - RNA, 23 nt, Human
uaacuguuuguuuucucaaggca

SEQ ID NO: 987405 - RNA, 24 nt, Human
uaagaaaaacaaucauauauaugc

SEQ ID NO: 987406 - RNA, 19 nt, Human
uaagugcucuuucccauga

SEQ ID NO: 987407 - RNA, 22 nt, Human
uaaguugaaaacauacuuuuau

SEQ ID NO: 987408 - RNA, 19 nt, Human
uacauuugaggcuuguuuu

SEQ ID NO: 987409 - RNA, 21 nt, Human
uagcaagauccuaagugcucu

SEQ ID NO: 987410 - RNA, 23 nt, Human
uagcaaggaguugaaccaaauac

SEQ ID NO: 987411 - RNA, 18 nt, Human
uauaguaaaguuauaaga

SEQ ID NO: 987412 - RNA, 23 nt, Human
ucaguggaggagccaguggaauu

SEQ ID NO: 987413 - RNA, 18 nt, Human
ucucagggcugaacaacu

SEQ ID NO: 987414 - RNA, 22 nt, Human
ucugcaccugucgucaauucau

SEQ ID NO: 987415 - RNA, 22 nt, Human
ugaacaacuaagacugcaacca

SEQ ID NO: 987416 - RNA, 19 nt, Human
ugaagcagcagcagaaauu

SEQ ID NO: 987417 - RNA, 22 nt, Human
ugaauuguaccuauggccagug

SEQ ID NO: 987418 - RNA, 23 nt, Human
ugagaaaauggauuaucagguug

SEQ ID NO: 987419 - RNA, 18 nt, Human
uggccaguggguggcacu

SEQ ID NO: 987420 - RNA, 18 nt, Human
uguaccuauggccagugg

SEQ ID NO: 987421 - RNA, 18 nt, Human
uguuuagugagcaugagg

SEQ ID NO: 987422 - RNA, 20 nt, Human
uguuuguuuucucaaggcag

SEQ ID NO: 987423 - RNA, 22 nt, Human
uguuuguuuucucaaggcagaa

SEQ ID NO: 987424 - RNA, 24 nt, Human
uguuuguuuucucaaggcagaaaa

SEQ ID NO: 987425 - RNA, 20 nt, Human
uuaaucuaugaacaaacaug

SEQ ID NO: 987426 - RNA, 21 nt, Human
uuaaucuaugaacaaacaugg

SEQ ID NO: 987427 - RNA, 23 nt, Human
uucuuaacaauaccccauguuua

SEQ ID NO: 987428 - RNA, 24 nt, Human
uucuuacaauugucagaaaacauu

SEQ ID NO: 987429 - RNA, 22 nt, Human
uugaaaauauaaauuauuuaga

SEQ ID NO: 987430 - RNA, 18 nt, Human
uuguccaccuacucagau

SEQ ID NO: 987431 - RNA, 24 nt, Human
uuuuccuagcuuguucaaauaucu

SEQ ID NO: 987432 - RNA, 21 nt, Human
aaccuggaaccuugaggccuu

SEQ ID NO: 987433 - RNA, 22 nt, Human
aagaggagauaacccaccagag

SEQ ID NO: 987434 - RNA, 21 nt, Human
acaucucaaagaggagauaac

SEQ ID NO: 987435 - RNA, 23 nt, Human
agauaccaauaggcgguuaagcc

SEQ ID NO: 987436 - RNA, 20 nt, Human
cacugcauggaccaagcgcu

SEQ ID NO: 987437 - RNA, 18 nt, Human
cacugcauggaccaagcu

SEQ ID NO: 987438 - RNA, 19 nt, Human
cagugccucacgccugcug

SEQ ID NO: 987439 - RNA, 18 nt, Human
caugaaaagcucagcccg

SEQ ID NO: 987440 - RNA, 23 nt, Human
ccagcaggggcaacgccucuucc

SEQ ID NO: 987441 - RNA, 25 nt, Human
cccugcaccugguucguagccccuc

SEQ ID NO: 987442 - RNA, 21 nt, Human
ccucuucccuccuuagaucca

SEQ ID NO: 987443 - RNA, 21 nt, Human
ggaccaagcgcucacgcccuu

SEQ ID NO: 987444 - RNA, 24 nt, Human
uaacccaccagaggcuuagguaac

SEQ ID NO: 987445 - RNA, 19 nt, Human
ucaaaggggucuccagcug

SEQ ID NO: 987446 - RNA, 20 nt, Human
uggaaccuugaggccuucau

SEQ ID NO: 987447 - RNA, 28 nt, Human
ugggacagggccgcagauggagacugcu

SEQ ID NO: 987448 - RNA, 19 nt, Human
uucguagccccucugcaga

SEQ ID NO: 987449 - RNA, 21 nt, Human
uuuauuaaaaucuggccauuu

SEQ ID NO: 987450 - RNA, 19 nt, Human
aaaaaguuguuuuaaaagc

SEQ ID NO: 987451 - RNA, 21 nt, Human
aaaacaaccagacaaggagag

SEQ ID NO: 987452 - RNA, 18 nt, Human
aaaacaggaacugaaagc

SEQ ID NO: 987453 - RNA, 18 nt, Human
aaaagaagaacaagucug

SEQ ID NO: 987454 - RNA, 21 nt, Human
aaaagagcaaguuacagcccg

SEQ ID NO: 987455 - RNA, 18 nt, Human
aaagaaaagcauuagacc

SEQ ID NO: 987456 - RNA, 22 nt, Human
aaagaaaagcauuagaccaaag

SEQ ID NO: 987457 - RNA, 20 nt, Human
aaaugcuuauucuugagacu

SEQ ID NO: 987458 - RNA, 22 nt, Human
aagaaaaaauggacucugaaaa

SEQ ID NO: 987459 - RNA, 21 nt, Human
aagaagaacaagucugcauca

SEQ ID NO: 987460 - RNA, 21 nt, Human
aagcagcuccauuauaagagu

SEQ ID NO: 987461 - RNA, 21 nt, Human
aagcaggaagucagaauaaca

SEQ ID NO: 987462 - RNA, 24 nt, Human
aagcaggaagucagaauaacaggg

SEQ ID NO: 987463 - RNA, 31 nt, Human
aauacauguuuguacacacacacacacagug

SEQ ID NO: 987464 - RNA, 23 nt, Human
acacacacacacacacacacaca

SEQ ID NO: 987465 - RNA, 23 nt, Human
acacacacacacacacacacaca

SEQ ID NO: 987466 - RNA, 23 nt, Human
acacacacacacacacacacaca

SEQ ID NO: 987467 - RNA, 23 nt, Human
acacacacacacacacacacaua

SEQ ID NO: 987468 - RNA, 23 nt, Human
acacacacacacacacacauaca

SEQ ID NO: 987469 - RNA, 23 nt, Human
acacacacacacacauacacaca

SEQ ID NO: 987470 - RNA, 25 nt, Human
acacacacacacacauacacacaua

SEQ ID NO: 987471 - RNA, 23 nt, Human
acacacacacauacacacauaca

SEQ ID NO: 987472 - RNA, 27 nt, Human
acacacacauacacacauacacacaua

SEQ ID NO: 987473 - RNA, 18 nt, Human
acacacauacacacauac

SEQ ID NO: 987474 - RNA, 23 nt, Human
acacaccccagacgcaaacacua

SEQ ID NO: 987475 - RNA, 24 nt, Human
acacauacacacauacacauuaaa

SEQ ID NO: 987476 - RNA, 23 nt, Human
acauacacacauacacacauaca

SEQ ID NO: 987477 - RNA, 22 nt, Human
accacuguggcugcccuuaauc

SEQ ID NO: 987478 - RNA, 23 nt, Human
accagaguugccuguaaucccag

SEQ ID NO: 987479 - RNA, 19 nt, Human
accccgcucgacggccgag

SEQ ID NO: 987480 - RNA, 22 nt, Human
acccugcuucccagagccuuaa

SEQ ID NO: 987481 - RNA, 18 nt, Human
acgcuuaugagaauagaa

SEQ ID NO: 987482 - RNA, 23 nt, Human
acuagauuauacacagaaacauu

SEQ ID NO: 987483 - RNA, 23 nt, Human
agacagaagauaaaaaggggacc

SEQ ID NO: 987484 - RNA, 24 nt, Human
agacagaugugguacaugaggaaa

SEQ ID NO: 987485 - RNA, 20 nt, Human
agaccaaagcaagguggaaa

SEQ ID NO: 987486 - RNA, 24 nt, Human
agcacuuugggaggcugaggcagg

SEQ ID NO: 987487 - RNA, 24 nt, Human
agccugggcaacacagggcgacuc

SEQ ID NO: 987488 - RNA, 19 nt, Human
aggaaaucaguuagcagcu

SEQ ID NO: 987489 - RNA, 23 nt, Human
aggaacugaaagcucaucaagca

SEQ ID NO: 987490 - RNA, 23 nt, Human
aggaguucaagaccagccugggc

SEQ ID NO: 987491 - RNA, 22 nt, Human
aggcaggaggaucucuugagcc

SEQ ID NO: 987492 - RNA, 23 nt, Human
aggcaggaggaucucuugagccu

SEQ ID NO: 987493 - RNA, 24 nt, Human
aggcaggaggaucucuugagccua

SEQ ID NO: 987494 - RNA, 24 nt, Human
aggcugaggcaggaggaucucuug

SEQ ID NO: 987495 - RNA, 18 nt, Human
agggagacucugucuaca

SEQ ID NO: 987496 - RNA, 29 nt, Human
agucaaaauacauuaucuaauuaaagugg

SEQ ID NO: 987497 - RNA, 22 nt, Human
agucucuucucuccucuccuuu

SEQ ID NO: 987498 - RNA, 33 nt, Human
auacauguuuguacacacacacacacacacagu

SEQ ID NO: 987499 - RNA, 20 nt, Human
auagcaaaaacaggaacuga

SEQ ID NO: 987500 - RNA, 22 nt, Human
auagcaaaaacaggaacugaaa

SEQ ID NO: 987501 - RNA, 21 nt, Human
augaaacuuagcucacuagac

SEQ ID NO: 987502 - RNA, 18 nt, Human
augagaauagaaagguca

SEQ ID NO: 987503 - RNA, 19 nt, Human
caaaaacaggaacugaaag

SEQ ID NO: 987504 - RNA, 22 nt, Human
caaaacaaccagacaaggagag

SEQ ID NO: 987505 - RNA, 26 nt, Human
caaaagcagcuccauuauaagagucc

SEQ ID NO: 987506 - RNA, 19 nt, Human
caaacacuaagacagaugu

SEQ ID NO: 987507 - RNA, 20 nt, Human
cacacacacacacacacaca

SEQ ID NO: 987508 - RNA, 20 nt, Human
cacacacacacacacacaca

SEQ ID NO: 987509 - RNA, 20 nt, Human
cacacacacacacacacaca

SEQ ID NO: 987510 - RNA, 20 nt, Human
cacacacacacacacacaca

SEQ ID NO: 987511 - RNA, 20 nt, Human
cacacacacacacacacaca

SEQ ID NO: 987512 - RNA, 20 nt, Human
cacacacacacacacacaca

SEQ ID NO: 987513 - RNA, 20 nt, Human
cacacacacacacacacaca

SEQ ID NO: 987514 - RNA, 22 nt, Human
cacacacacacacacacacaca

SEQ ID NO: 987515 - RNA, 22 nt, Human
cacacacacacacacacacaca

SEQ ID NO: 987516 - RNA, 22 nt, Human
cacacacacacacacacacaca

SEQ ID NO: 987517 - RNA, 22 nt, Human
cacacacacacacacacacaca

SEQ ID NO: 987518 - RNA, 26 nt, Human
cacacacacacacacacacacacaca

SEQ ID NO: 987519 - RNA, 26 nt, Human
cacacacacacacacacacacacaca

SEQ ID NO: 987520 - RNA, 26 nt, Human
cacacacacacacacacacacacaua

SEQ ID NO: 987521 - RNA, 22 nt, Human
cacacacacacacacacacaua

SEQ ID NO: 987522 - RNA, 26 nt, Human
cacacacacacacacacacauacaca

SEQ ID NO: 987523 - RNA, 20 nt, Human
cacacacacacacacacaua

SEQ ID NO: 987524 - RNA, 19 nt, Human
cacacacacacacacauac

SEQ ID NO: 987525 - RNA, 28 nt, Human
cacacacacacacacauacacacauaca

SEQ ID NO: 987526 - RNA, 28 nt, Human
cacacacacacauacacacauacacaca

SEQ ID NO: 987527 - RNA, 22 nt, Human
cacacacacauacacacauaca

SEQ ID NO: 987528 - RNA, 20 nt, Human
cacagggcgacucagucucu

SEQ ID NO: 987529 - RNA, 24 nt, Human
cagcacuuugggaggcugaggcag

SEQ ID NO: 987530 - RNA, 25 nt, Human
cagcacuuugggaggcugaggcagg

SEQ ID NO: 987531 - RNA, 23 nt, Human
cagucucuucucuccucuccuuu

SEQ ID NO: 987532 - RNA, 27 nt, Human
cagucucuucucuccucuccuuugaaa

SEQ ID NO: 987533 - RNA, 19 nt, Human
cauaagaaaaaauggacuc

SEQ ID NO: 987534 - RNA, 18 nt, Human
cauaaugagauuugcaga

SEQ ID NO: 987535 - RNA, 21 nt, Human
cauacauacaguagaaaccac

SEQ ID NO: 987536 - RNA, 22 nt, Human
cauuacaauugcaauccacacc

SEQ ID NO: 987537 - RNA, 22 nt, Human
cccagagccuuaaaacccagac

SEQ ID NO: 987538 - RNA, 23 nt, Human
ccccaacauuccugucuuuacua

SEQ ID NO: 987539 - RNA, 18 nt, Human
ccccagacgcaaacacua

SEQ ID NO: 987540 - RNA, 21 nt, Human
cccgggaucccaaguuaugcc

SEQ ID NO: 987541 - RNA, 24 nt, Human
cccucgccagggcuggaccugcag

SEQ ID NO: 987542 - RNA, 19 nt, Human
ccucucugcuauacacucc

SEQ ID NO: 987543 - RNA, 21 nt, Human
ccuuccauuacaauugcaauc

SEQ ID NO: 987544 - RNA, 26 nt, Human
cuagaaaaguuaaauuuaaaagccaa

SEQ ID NO: 987545 - RNA, 19 nt, Human
cuauacacuccuuccacac

SEQ ID NO: 987546 - RNA, 18 nt, Human
cucucacugggcauccuc

SEQ ID NO: 987547 - RNA, 18 nt, Human
cugaggcaggaggaucuc

SEQ ID NO: 987548 - RNA, 20 nt, Human
cuguuugauaacacacccca

SEQ ID NO: 987549 - RNA, 21 nt, Human
cuuagagcccuuaacaguccc

SEQ ID NO: 987550 - RNA, 24 nt, Human
cuucaaaacaaccagacaaggaga

SEQ ID NO: 987551 - RNA, 23 nt, Human
cuucccagagccuuaaaacccag

SEQ ID NO: 987552 - RNA, 24 nt, Human
gaaacugcuuaaaaacuagaaaag

SEQ ID NO: 987553 - RNA, 22 nt, Human
gacucuguugaaagggauuucc

SEQ ID NO: 987554 - RNA, 23 nt, Human
gagcccuuaacaguccccagccu

SEQ ID NO: 987555 - RNA, 19 nt, Human
gagcuaccagaguugccug

SEQ ID NO: 987556 - RNA, 20 nt, Human
gauaacacuuggcucuucug

SEQ ID NO: 987557 - RNA, 18 nt, Human
gcagaaaauucagcaugg

SEQ ID NO: 987558 - RNA, 18 nt, Human
gccucaacacacuacacc

SEQ ID NO: 987559 - RNA, 20 nt, Human
gccugggcaacacagggcga

SEQ ID NO: 987560 - RNA, 19 nt, Human
gccuguaaucccagcacuu

SEQ ID NO: 987561 - RNA, 28 nt, Human
ggaaacaauagcaaaaacaggaaccggu

SEQ ID NO: 987562 - RNA, 22 nt, Human
guaccagaagaugaaacuuagc

SEQ ID NO: 987563 - RNA, 23 nt, Human
gucucuucucuccucuccuuuga

SEQ ID NO: 987564 - RNA, 20 nt, Human
gugggaaacaaaagagcaag

SEQ ID NO: 987565 - RNA, 24 nt, Human
guugccuguaaucccagcacuuug

SEQ ID NO: 987566 - RNA, 24 nt, Human
uaaacuagauuauacacagaaaca

SEQ ID NO: 987567 - RNA, 20 nt, Human
uacacacacacacacacaca

SEQ ID NO: 987568 - RNA, 25 nt, Human
uacacacacacacacacacacacac

SEQ ID NO: 987569 - RNA, 22 nt, Human
uacacacauacacacauacaca

SEQ ID NO: 987570 - RNA, 24 nt, Human
uacacacauacacacauacacauu

SEQ ID NO: 987571 - RNA, 20 nt, Human
uacccucagucacucugguc

SEQ ID NO: 987572 - RNA, 23 nt, Human
uacuaaccaacccugcuucccag

SEQ ID NO: 987573 - RNA, 22 nt, Human
uagcaaaaacaggaacugaaag

SEQ ID NO: 987574 - RNA, 21 nt, Human
uagcaagacagaagauaaaaa

SEQ ID NO: 987575 - RNA, 18 nt, Human
ucaaaauacauuaucuaa

SEQ ID NO: 987576 - RNA, 19 nt, Human
ucaaaauacauuaucuaau

SEQ ID NO: 987577 - RNA, 25 nt, Human
ucacuagacccuucuuugaaaagcc

SEQ ID NO: 987578 - RNA, 19 nt, Human
ucagucucuucucuccucu

SEQ ID NO: 987579 - RNA, 18 nt, Human
ucccagagccuuaaaacc

SEQ ID NO: 987580 - RNA, 26 nt, Human
uccccaacauuccugucuuuacuguc

SEQ ID NO: 987581 - RNA, 23 nt, Human
ucccccaaaggucuaguaaagau

SEQ ID NO: 987582 - RNA, 24 nt, Human
uccucugagaucagcuagaagcuc

SEQ ID NO: 987583 - RNA, 21 nt, Human
uccuuccacacacaacuuugg

SEQ ID NO: 987584 - RNA, 23 nt, Human
ucucuugagccuaggaguucaag

SEQ ID NO: 987585 - RNA, 24 nt, Human
ucuugagccuaggaguucaagacc

SEQ ID NO: 987586 - RNA, 23 nt, Human
ugagccuaggaguucaagaccag

SEQ ID NO: 987587 - RNA, 20 nt, Human
ugaggcaggaggaucucuug

SEQ ID NO: 987588 - RNA, 24 nt, Human
ugaggcaggaggaucucuugagcc

SEQ ID NO: 987589 - RNA, 25 nt, Human
ugaggcaggaggaucucuugagccu

SEQ ID NO: 987590 - RNA, 18 nt, Human
ugauagcaagacagaaga

SEQ ID NO: 987591 - RNA, 24 nt, Human
ugcagaaaauucagcaugggcugg

SEQ ID NO: 987592 - RNA, 21 nt, Human
ugcccuuaauccagugugcuu

SEQ ID NO: 987593 - RNA, 23 nt, Human
ugccuguaaucccagcacuuugg

SEQ ID NO: 987594 - RNA, 23 nt, Human
ugccuguaaucccagcacuuugg

SEQ ID NO: 987595 - RNA, 24 nt, Human
ugccuguaaucccagcacuuuggg

SEQ ID NO: 987596 - RNA, 24 nt, Human
ugcucuugauuucuucacuuccuc

SEQ ID NO: 987597 - RNA, 21 nt, Human
ugcuuuucaaaagcagcucca

SEQ ID NO: 987598 - RNA, 25 nt, Human
uggaaaaagcuugggaauucuguua

SEQ ID NO: 987599 - RNA, 21 nt, Human
uggcucuucugguugacacag

SEQ ID NO: 987600 - RNA, 20 nt, Human
ugggaggcugaggcaggagg

SEQ ID NO: 987601 - RNA, 23 nt, Human
ugggaggcugaggcaggaggauc

SEQ ID NO: 987602 - RNA, 23 nt, Human
ugggauguagaccaugcucuguu

SEQ ID NO: 987603 - RNA, 25 nt, Human
uguacacacacacacacacacacac

SEQ ID NO: 987604 - RNA, 25 nt, Human
uguacacacacacacacacacacag

SEQ ID NO: 987605 - RNA, 25 nt, Human
ugucuacauucccuuagagcccuua

SEQ ID NO: 987606 - RNA, 21 nt, Human
uguggcugacuggccaacgcc

SEQ ID NO: 987607 - RNA, 21 nt, Human
uuacagcccgggaucccaagu

SEQ ID NO: 987608 - RNA, 19 nt, Human
uucccagagccuuaaaacc

SEQ ID NO: 987609 - RNA, 21 nt, Human
uucccagagccuuaaaaccca

SEQ ID NO: 987610 - RNA, 23 nt, Human
uuuacuaaccaacccugcuuccc

SEQ ID NO: 987611 - RNA, 23 nt, Human
uuuauuuuuucuuuuucuuuuuu

SEQ ID NO: 987612 - RNA, 22 nt, Human
uuucaaagaaaagcauuagacu

SEQ ID NO: 987613 - RNA, 24 nt, Human
uuugacaagugagaaagcuuuauu

SEQ ID NO: 987614 - RNA, 19 nt, Human
uuugcagaaaauacauguu

SEQ ID NO: 987615 - RNA, 24 nt, Human
uuuuucuucuacucuucuuucuuc

SEQ ID NO: 987616 - RNA, 23 nt, Human
uuuuuuuuuuuuuuuuugacaag

SEQ ID NO: 987617 - RNA, 27 nt, Human
uuuuuuuuuuuuuuuuuuuuuuugggg

SEQ ID NO: 987618 - RNA, 18 nt, Human
aaauccuccuaaccccuc

SEQ ID NO: 987619 - RNA, 24 nt, Human
aacccaccaauuccagacacauua

SEQ ID NO: 987620 - RNA, 18 nt, Human
acaaauggcuaaaggccc

SEQ ID NO: 987621 - RNA, 22 nt, Human
agagacaaauggcuaaaggccc

SEQ ID NO: 987622 - RNA, 18 nt, Human
agcaucaaaaccaagccu

SEQ ID NO: 987623 - RNA, 21 nt, Human
agcccagcccaguagcugcuc

SEQ ID NO: 987624 - RNA, 22 nt, Human
agccucuggaccagccauuccu

SEQ ID NO: 987625 - RNA, 24 nt, Human
aggcccuggcaccauuccuggaug

SEQ ID NO: 987626 - RNA, 22 nt, Human
agugguggaaauccaagaagga

SEQ ID NO: 987627 - RNA, 19 nt, Human
caagaccaagaacccacca

SEQ ID NO: 987628 - RNA, 25 nt, Human
cagaauccuuggcaggcagagcuuc

SEQ ID NO: 987629 - RNA, 21 nt, Human
cagcaagaccaagaacccacc

SEQ ID NO: 987630 - RNA, 21 nt, Human
caucugcgcacgcacgcacgg

SEQ ID NO: 987631 - RNA, 26 nt, Human
ccauuccuucucucucuccaaguccu

SEQ ID NO: 987632 - RNA, 21 nt, Human
cccagcagugaccagcugguc

SEQ ID NO: 987633 - RNA, 23 nt, Human
ccccaucugccacuggaaccaga

SEQ ID NO: 987634 - RNA, 19 nt, Human
ccccuaagcaggcuaaccu

SEQ ID NO: 987635 - RNA, 19 nt, Human
ccccucuggccagugcccc

SEQ ID NO: 987636 - RNA, 23 nt, Human
ccgcagcccagcccaguagcugc

SEQ ID NO: 987637 - RNA, 23 nt, Human
ccgugugggcuccuagcaggccc

SEQ ID NO: 987638 - RNA, 19 nt, Human
ccuacauuccagguacccc

SEQ ID NO: 987639 - RNA, 20 nt, Human
ccuucucucucuccaagucc

SEQ ID NO: 987640 - RNA, 20 nt, Human
cgcacgcacgcacggugcug

SEQ ID NO: 987641 - RNA, 23 nt, Human
cuagcccuuccccuaagcaggcu

SEQ ID NO: 987642 - RNA, 18 nt, Human
cuggucucagcuuccagc

SEQ ID NO: 987643 - RNA, 19 nt, Human
cuuccagugagagggagug

SEQ ID NO: 987644 - RNA, 24 nt, Human
cuucccagggccaggcagaauccu

SEQ ID NO: 987645 - RNA, 23 nt, Human
cuucucuucccagggccaggcag

SEQ ID NO: 987646 - RNA, 18 nt, Human
cuuggauuugggacugga

SEQ ID NO: 987647 - RNA, 24 nt, Human
gagcauggcuaaaacacuggguac

SEQ ID NO: 987648 - RNA, 23 nt, Human
gcagugaccagcuggucucagcu

SEQ ID NO: 987649 - RNA, 18 nt, Human
ggagaucaaccacuucca

SEQ ID NO: 987650 - RNA, 23 nt, Human
ggagugugaggagagacaaaugg

SEQ ID NO: 987651 - RNA, 20 nt, Human
ggguaucagguagggcuagc

SEQ ID NO: 987652 - RNA, 19 nt, Human
gguauuggaaggcugaugg

SEQ ID NO: 987653 - RNA, 20 nt, Human
guccugagucugaagaacuu

SEQ ID NO: 987654 - RNA, 21 nt, Human
guuucagggaagugguggaaa

SEQ ID NO: 987655 - RNA, 22 nt, Human
uaaaggcccuggcaccauuccu

SEQ ID NO: 987656 - RNA, 22 nt, Human
uaaccccucuggccagugcccc

SEQ ID NO: 987657 - RNA, 21 nt, Human
uacaugaacaucucuccccuu

SEQ ID NO: 987658 - RNA, 23 nt, Human
uagagugugguuaaagaaucuug

SEQ ID NO: 987659 - RNA, 24 nt, Human
uagagugugguuaaagaaucuugg

SEQ ID NO: 987660 - RNA, 18 nt, Human
uccaaauccuccuaaccc

SEQ ID NO: 987661 - RNA, 23 nt, Human
ucccuggagaucaaccacuucca

SEQ ID NO: 987662 - RNA, 25 nt, Human
ucucucucuccaaguccuuuuuccu

SEQ ID NO: 987663 - RNA, 21 nt, Human
ucucuucccagggccaggcag

SEQ ID NO: 987664 - RNA, 24 nt, Human
ucugaagaacuuuuagaguguggu

SEQ ID NO: 987665 - RNA, 23 nt, Human
ucuggccagugccccaucugcca

SEQ ID NO: 987666 - RNA, 18 nt, Human
ugaacaucucuccccuuc

SEQ ID NO: 987667 - RNA, 24 nt, Human
ugaagucagcaagaccaagaaccc

SEQ ID NO: 987668 - RNA, 25 nt, Human
ugccccaucugccacuggaaccagu

SEQ ID NO: 987669 - RNA, 19 nt, Human
uggcugugggcagcuuccg

SEQ ID NO: 987670 - RNA, 18 nt, Human
uguggaggucaggguugg

SEQ ID NO: 987671 - RNA, 19 nt, Human
ugugggcuccuagcaggcc

SEQ ID NO: 987672 - RNA, 24 nt, Human
uguuuaaaauacccuuaaaccugg

SEQ ID NO: 987673 - RNA, 18 nt, Human
uuaaaccugguauuggaa

SEQ ID NO: 987674 - RNA, 24 nt, Human
uuaaaccugguauuggaaggcuga

SEQ ID NO: 987675 - RNA, 22 nt, Human
uucagggaagugguggaaaucc

SEQ ID NO: 987676 - RNA, 19 nt, Human
uuccagguaccccuagccc

SEQ ID NO: 987677 - RNA, 25 nt, Human
uugaagucagcaagaccaagaaccc

SEQ ID NO: 987678 - RNA, 27 nt, Human
uugaagucagcaagaccaagaacccac

SEQ ID NO: 987679 - RNA, 22 nt, Human
uuggaaggcugaugaugcagca

SEQ ID NO: 987680 - RNA, 18 nt, Human
uuugaggcucuggugucu

SEQ ID NO: 987681 - RNA, 24 nt, Human
aaaaagcaccgcggccacaggccc

SEQ ID NO: 987682 - RNA, 19 nt, Human
aagcaccgcggccacaggc

SEQ ID NO: 987683 - RNA, 18 nt, Human
aagcggagaggucaccgu

SEQ ID NO: 987684 - RNA, 18 nt, Human
acagggcacagagucaga

SEQ ID NO: 987685 - RNA, 18 nt, Human
agacccuaggcagccgga

SEQ ID NO: 987686 - RNA, 22 nt, Human
agcuucccagacccuaggcagc

SEQ ID NO: 987687 - RNA, 18 nt, Human
aggagccccggagaggga

SEQ ID NO: 987688 - RNA, 19 nt, Human
aggagcgcgacgguggggg

SEQ ID NO: 987689 - RNA, 19 nt, Human
ccagacccuaggcagccgg

SEQ ID NO: 987690 - RNA, 20 nt, Human
cccacgagcucagggacagg

SEQ ID NO: 987691 - RNA, 21 nt, Human
ccgagcagcaagauucugagc

SEQ ID NO: 987692 - RNA, 21 nt, Human
gaacagcaaauguuuagagga

SEQ ID NO: 987693 - RNA, 21 nt, Human
gagcugggggaaaauuaaaaa

SEQ ID NO: 987694 - RNA, 18 nt, Human
gaggggugggagcaggag

SEQ ID NO: 987695 - RNA, 19 nt, Human
gauucugagcugggggaaa

SEQ ID NO: 987696 - RNA, 21 nt, Human
ggggaaaauuaaaaagcaccg

SEQ ID NO: 987697 - RNA, 22 nt, Human
ggggggccggaggggugggagc

SEQ ID NO: 987698 - RNA, 20 nt, Human
uagaauguauauucaaaaac

SEQ ID NO: 987699 - RNA, 21 nt, Human
ucccguugaguuguugcucuc

SEQ ID NO: 987700 - RNA, 18 nt, Human
uccuucgguuauuuuggc

SEQ ID NO: 987701 - RNA, 19 nt, Human
ucuggugaacggucuuucc

SEQ ID NO: 987702 - RNA, 23 nt, Human
ugcccgagcuucccagacccuag

SEQ ID NO: 987703 - RNA, 19 nt, Human
ugggggggccggaggggug

SEQ ID NO: 987704 - RNA, 20 nt, Human
ugggggggccggaggggugg

SEQ ID NO: 987705 - RNA, 24 nt, Human
ugggggggccggaggggugggagc

SEQ ID NO: 987706 - RNA, 19 nt, Human
uguuccacgggucaucuuc

SEQ ID NO: 987707 - RNA, 18 nt, Human
uuagaggagccaagucug

SEQ ID NO: 987708 - RNA, 23 nt, Human
uuggcagcagggcguaacccuuc

SEQ ID NO: 987709 - RNA, 22 nt, Human
uuucaugguuacagcauauaau

SEQ ID NO: 987710 - RNA, 25 nt, Human
uuuuuuuuuuuuuuuuuuuucaugg

SEQ ID NO: 987711 - RNA, 20 nt, Human
aaaaggugaauucgugaaau

SEQ ID NO: 987712 - RNA, 23 nt, Human
aaacacaagaugaaaaucaagca

SEQ ID NO: 987713 - RNA, 22 nt, Human
aaaccagacacaggaacuccaa

SEQ ID NO: 987714 - RNA, 25 nt, Human
aagaugaaaaucaagcagaaaaaga

SEQ ID NO: 987715 - RNA, 23 nt, Human
aagcaaaacacaagaugaaaauc

SEQ ID NO: 987716 - RNA, 26 nt, Human
aagcagaaaaagaaaauaagggaccc

SEQ ID NO: 987717 - RNA, 23 nt, Human
aagcagaaaaagaaaauaauaua

SEQ ID NO: 987718 - RNA, 20 nt, Human
aagcauuuuuaaaaggcugu

SEQ ID NO: 987719 - RNA, 24 nt, Human
aaguacugacaggcugcaaacacc

SEQ ID NO: 987720 - RNA, 22 nt, Human
aaugauaauacugaauuccaaa

SEQ ID NO: 987721 - RNA, 23 nt, Human
aauuuuuauuuaagaacugaaaa

SEQ ID NO: 987722 - RNA, 24 nt, Human
acacgacuucaucucaaaggauac

SEQ ID NO: 987723 - RNA, 19 nt, Human
acagugguucuuuaaaaug

SEQ ID NO: 987724 - RNA, 19 nt, Human
accagacacaggaacucca

SEQ ID NO: 987725 - RNA, 22 nt, Human
acuaacacaauuuacagacuuc

SEQ ID NO: 987726 - RNA, 21 nt, Human
acuuccaucugcagccuucau

SEQ ID NO: 987727 - RNA, 18 nt, Human
auaaccuuauuuugagac

SEQ ID NO: 987728 - RNA, 21 nt, Human
auccagaauacaacaggugac

SEQ ID NO: 987729 - RNA, 22 nt, Human
auccugaucugccucucuucca

SEQ ID NO: 987730 - RNA, 18 nt, Human
auucacauacauuuaucu

SEQ ID NO: 987731 - RNA, 23 nt, Human
auuuaguggcuuacgaccaacac

SEQ ID NO: 987732 - RNA, 21 nt, Human
cacaagaugaaaaucaagcag

SEQ ID NO: 987733 - RNA, 22 nt, Human
cacaguuacaaguucuggagac

SEQ ID NO: 987734 - RNA, 25 nt, Human
caccaguaacaaccugccuggagcc

SEQ ID NO: 987735 - RNA, 20 nt, Human
cagaauacaacaggugacua

SEQ ID NO: 987736 - RNA, 20 nt, Human
cagcuguucggcucucccgg

SEQ ID NO: 987737 - RNA, 20 nt, Human
caggcugcaaacaccaguaa

SEQ ID NO: 987738 - RNA, 23 nt, Human
cagugaacucucuucagcuguuc

SEQ ID NO: 987739 - RNA, 22 nt, Human
cauccugaucugccucucuucc

SEQ ID NO: 987740 - RNA, 18 nt, Human
cauuacucugggcaucac

SEQ ID NO: 987741 - RNA, 21 nt, Human
ccagcuucaagagacugucca

SEQ ID NO: 987742 - RNA, 22 nt, Human
ccaguaacaaccugccuggagc

SEQ ID NO: 987743 - RNA, 19 nt, Human
cccaugcuaaaaccacagu

SEQ ID NO: 987744 - RNA, 20 nt, Human
ccuaaacuuaacacaguggu

SEQ ID NO: 987745 - RNA, 21 nt, Human
cuagaaccuauuccaguacug

SEQ ID NO: 987746 - RNA, 21 nt, Human
cucaaauaaguccucccaugc

SEQ ID NO: 987747 - RNA, 23 nt, Human
cucacagauuaauaagagcaguu

SEQ ID NO: 987748 - RNA, 19 nt, Human
cucccaugcuaaaaccaca

SEQ ID NO: 987749 - RNA, 22 nt, Human
cucuuuugguaagaggcuggag

SEQ ID NO: 987750 - RNA, 22 nt, Human
cugcaaacaccaguaacaaccu

SEQ ID NO: 987751 - RNA, 24 nt, Human
gaaccgagccagggaccagugacc

SEQ ID NO: 987752 - RNA, 19 nt, Human
gagccuugaccuugaaaac

SEQ ID NO: 987753 - RNA, 18 nt, Human
gcacacccagauaaucca

SEQ ID NO: 987754 - RNA, 21 nt, Human
gcugcuauaacaaauuacugu

SEQ ID NO: 987755 - RNA, 24 nt, Human
gcuuacgaccaacacaaauuuauc

SEQ ID NO: 987756 - RNA, 23 nt, Human
ggaauaaacaggaaaaccagaca

SEQ ID NO: 987757 - RNA, 23 nt, Human
ggagacugggcgcaggauggggg

SEQ ID NO: 987758 - RNA, 21 nt, Human
ggaugggccauuacucugggc

SEQ ID NO: 987759 - RNA, 22 nt, Human
ggcuuacgaccaacacaagguu

SEQ ID NO: 987760 - RNA, 21 nt, Human
gggaauaaacaggaaaaccag

SEQ ID NO: 987761 - RNA, 23 nt, Human
gggaauaaacaggaaaaccagac

SEQ ID NO: 987762 - RNA, 20 nt, Human
gguggacacccggccgcugc

SEQ ID NO: 987763 - RNA, 19 nt, Human
guacugcaaguacugacag

SEQ ID NO: 987764 - RNA, 22 nt, Human
guuuaucauaaacauucacaua

SEQ ID NO: 987765 - RNA, 20 nt, Human
uaaaaagaaaucauagaaaa

SEQ ID NO: 987766 - RNA, 23 nt, Human
uaaagccucuuuugguaagaggc

SEQ ID NO: 987767 - RNA, 25 nt, Human
uaacagaugacuauaauauacuacc

SEQ ID NO: 987768 - RNA, 21 nt, Human
uaagguaguauuucucaaaua

SEQ ID NO: 987769 - RNA, 20 nt, Human
uaaguccucccaugcuaaaa

SEQ ID NO: 987770 - RNA, 18 nt, Human
uacaaaaacaaagcaaaa

SEQ ID NO: 987771 - RNA, 20 nt, Human
uagaaccuauuccaguacug

SEQ ID NO: 987772 - RNA, 18 nt, Human
uauuucacucuacuggaa

SEQ ID NO: 987773 - RNA, 20 nt, Human
uauuucacucuacuggaaua

SEQ ID NO: 987774 - RNA, 22 nt, Human
ucacauacuacugcccaggaau

SEQ ID NO: 987775 - RNA, 26 nt, Human
ucacuaccuggcaaugcuacaauuua

SEQ ID NO: 987776 - RNA, 22 nt, Human
ucccagcaacagcaagucaagu

SEQ ID NO: 987777 - RNA, 18 nt, Human
ucccagggcuggggaguc

SEQ ID NO: 987778 - RNA, 21 nt, Human
ucccagggcuggggagucggg

SEQ ID NO: 987779 - RNA, 18 nt, Human
uccucccagcaacagcaa

SEQ ID NO: 987780 - RNA, 18 nt, Human
ucuacuggaauaguccca

SEQ ID NO: 987781 - RNA, 21 nt, Human
ucugcagccuucauuccccuu

SEQ ID NO: 987782 - RNA, 20 nt, Human
ucugccucucuuccacuuuu

SEQ ID NO: 987783 - RNA, 18 nt, Human
ucuucauccaucauauuu

SEQ ID NO: 987784 - RNA, 28 nt, Human
ugaaauuuuaagauuguguauaacacau

SEQ ID NO: 987785 - RNA, 20 nt, Human
ugacgcgcagacacuagccu

SEQ ID NO: 987786 - RNA, 21 nt, Human
ugaucaauugggcacacccag

SEQ ID NO: 987787 - RNA, 23 nt, Human
ugccuggagccuugaccuugaaa

SEQ ID NO: 987788 - RNA, 25 nt, Human
ugccuggagccuugaccuugaaaac

SEQ ID NO: 987789 - RNA, 26 nt, Human
ugccuggagccuugaccuugaaaacc

SEQ ID NO: 987790 - RNA, 27 nt, Human
ugcuaaaaccacagugacgcgcagaca

SEQ ID NO: 987791 - RNA, 19 nt, Human
uggcagagcacguccucuc

SEQ ID NO: 987792 - RNA, 22 nt, Human
ugggcacacccagauaauccag

SEQ ID NO: 987793 - RNA, 19 nt, Human
uggggagucgggguuaggg

SEQ ID NO: 987794 - RNA, 20 nt, Human
uguucggcucucccggcuca

SEQ ID NO: 987795 - RNA, 22 nt, Human
uuaaaauguuuaaauauuuguc

SEQ ID NO: 987796 - RNA, 25 nt, Human
uuaaagccucuuuugguaagaggcu

SEQ ID NO: 987797 - RNA, 19 nt, Human
uuagaugcugaauauagac

SEQ ID NO: 987798 - RNA, 21 nt, Human
uugauuuuauuauguacaugg

SEQ ID NO: 987799 - RNA, 22 nt, Human
uuggcucaugaccuccccuucc

SEQ ID NO: 987800 - RNA, 23 nt, Human
uuggcucaugaccuccccuuccu

SEQ ID NO: 987801 - RNA, 21 nt, Human
uuguagguuaacaagucaaac

SEQ ID NO: 987802 - RNA, 18 nt, Human
uuucuggauauuucuuug

SEQ ID NO: 987803 - RNA, 18 nt, Human
acccaucccuuucccuug

SEQ ID NO: 987804 - RNA, 20 nt, Human
ccaccuucugaaggcaacuu

SEQ ID NO: 987805 - RNA, 19 nt, Human
ccaucccuuucccuugucc

SEQ ID NO: 987806 - RNA, 19 nt, Human
cugguaccagccuggggga

SEQ ID NO: 987807 - RNA, 22 nt, Human
ggggaugggaggagucccaugg

SEQ ID NO: 987808 - RNA, 20 nt, Human
gucccaggacugcaccagaa

SEQ ID NO: 987809 - RNA, 24 nt, Human
guccuugucccaggacugcaccag

SEQ ID NO: 987810 - RNA, 18 nt, Human
guuuguuucuagcuuccc

SEQ ID NO: 987811 - RNA, 22 nt, Human
uugucccaggacugcaccagaa

SEQ ID NO: 987812 - RNA, 24 nt, Human
uuuuuuuuuuuuuuuuuuacuuga

SEQ ID NO: 987813 - RNA, 20 nt, Human
aaaaacaaaaacaaaacaga

SEQ ID NO: 987814 - RNA, 23 nt, Human
aaaaacaaaaacaaaacagaaga

SEQ ID NO: 987815 - RNA, 18 nt, Human
aaaagagacaguguuagc

SEQ ID NO: 987816 - RNA, 18 nt, Human
aaaauacgaaccaugcca

SEQ ID NO: 987817 - RNA, 23 nt, Human
aaaaucccucccuacccugcaau

SEQ ID NO: 987818 - RNA, 23 nt, Human
aaaauguugacaaaguuuauaca

SEQ ID NO: 987819 - RNA, 21 nt, Human
aaaauuacaugggaaauggaa

SEQ ID NO: 987820 - RNA, 23 nt, Human
aaacaaaaacaaaacagaagaua

SEQ ID NO: 987821 - RNA, 24 nt, Human
aaacaaaacagaagauaaaacugg

SEQ ID NO: 987822 - RNA, 20 nt, Human
aaacagaagauaaaacuggg

SEQ ID NO: 987823 - RNA, 19 nt, Human
aaaugaaaugucacaagga

SEQ ID NO: 987824 - RNA, 20 nt, Human
aaaugcugauaauugcacuu

SEQ ID NO: 987825 - RNA, 27 nt, Human
aacaaagauggaaaauaaagaauacaa

SEQ ID NO: 987826 - RNA, 21 nt, Human
aacuuuagcuuaacuuaaaau

SEQ ID NO: 987827 - RNA, 19 nt, Human
aaguuuagacgucuuuacc

SEQ ID NO: 987828 - RNA, 23 nt, Human
acaaaaauagauacauauaaaua

SEQ ID NO: 987829 - RNA, 26 nt, Human
acaaucagacuaaaagcucuuucuga

SEQ ID NO: 987830 - RNA, 21 nt, Human
acacaguaauaacuccaaaac

SEQ ID NO: 987831 - RNA, 21 nt, Human
acaguacacaaaaauagauac

SEQ ID NO: 987832 - RNA, 19 nt, Human
accacacuaugaaaaugca

SEQ ID NO: 987833 - RNA, 21 nt, Human
acucacucuuuuccuuuucaa

SEQ ID NO: 987834 - RNA, 18 nt, Human
agaaaacaaagauggaaa

SEQ ID NO: 987835 - RNA, 20 nt, Human
agaauaaaucuacuguugaa

SEQ ID NO: 987836 - RNA, 23 nt, Human
agacgucuuuacccaauaauacc

SEQ ID NO: 987837 - RNA, 18 nt, Human
agaugccagugaugcacu

SEQ ID NO: 987838 - RNA, 20 nt, Human
aggcucagaccauuuaaauc

SEQ ID NO: 987839 - RNA, 22 nt, Human
auaaaaucagcuugaugcuuaa

SEQ ID NO: 987840 - RNA, 25 nt, Human
augaaggaaaaucccucccuaauuc

SEQ ID NO: 987841 - RNA, 20 nt, Human
augucacaaggaugaaggaa

SEQ ID NO: 987842 - RNA, 18 nt, Human
caaaaaaugcuuuaguac

SEQ ID NO: 987843 - RNA, 22 nt, Human
caaaacaucaugaugauaaaaa

SEQ ID NO: 987844 - RNA, 22 nt, Human
caaaauaucccagcuauauaau

SEQ ID NO: 987845 - RNA, 21 nt, Human
caaaugcaaaaacaaaguuaa

SEQ ID NO: 987846 - RNA, 18 nt, Human
caaggaugaaggaaaauc

SEQ ID NO: 987847 - RNA, 24 nt, Human
cacaagauugucaaaaagcggcag

SEQ ID NO: 987848 - RNA, 23 nt, Human
cacacaugucacuaaucuuacuu

SEQ ID NO: 987849 - RNA, 19 nt, Human
caccaauaagaagaaacca

SEQ ID NO: 987850 - RNA, 24 nt, Human
cacucuuuuccuuuucaaucaccu

SEQ ID NO: 987851 - RNA, 23 nt, Human
cacuugaaaaagucaucgacaga

SEQ ID NO: 987852 - RNA, 23 nt, Human
cacuuuguuaucuuuuccuuacu

SEQ ID NO: 987853 - RNA, 21 nt, Human
caggcuaaaagaauaaaucua

SEQ ID NO: 987854 - RNA, 24 nt, Human
cagguaaaaaugcaaaaaauugug

SEQ ID NO: 987855 - RNA, 23 nt, Human
cauauaaauauuaagaaugagga

SEQ ID NO: 987856 - RNA, 21 nt, Human
ccaauuugaaagauaggcaua

SEQ ID NO: 987857 - RNA, 24 nt, Human
ccauuuuccauguauaaaacucuc

SEQ ID NO: 987858 - RNA, 25 nt, Human
ccuccuaucacauaaguagagaauc

SEQ ID NO: 987859 - RNA, 23 nt, Human
ccugcaaucuuuaagcauaccca

SEQ ID NO: 987860 - RNA, 21 nt, Human
cuacaguacuuacuacauacc

SEQ ID NO: 987861 - RNA, 21 nt, Human
cuagauuuuaaaauguuaauu

SEQ ID NO: 987862 - RNA, 23 nt, Human
cuccucagcaaugcaaaacugua

SEQ ID NO: 987863 - RNA, 21 nt, Human
ggaaacaaucagacuaaaagc

SEQ ID NO: 987864 - RNA, 21 nt, Human
gggucugaagauggaauccca

SEQ ID NO: 987865 - RNA, 19 nt, Human
guucacucacucuuuuccu

SEQ ID NO: 987866 - RNA, 24 nt, Human
uaaaacuuuagcuuaacuuaaaau

SEQ ID NO: 987867 - RNA, 21 nt, Human
uaaaauacacaguaauaacuc

SEQ ID NO: 987868 - RNA, 18 nt, Human
uaaaauacgaaccaugcc

SEQ ID NO: 987869 - RNA, 21 nt, Human
uaaaguacuauggccaugaaa

SEQ ID NO: 987870 - RNA, 24 nt, Human
uaaauaucuaaauauaaacccaca

SEQ ID NO: 987871 - RNA, 22 nt, Human
uaaguuagacuagcaccagcca

SEQ ID NO: 987872 - RNA, 21 nt, Human
uacacaugaauuaaguuagac

SEQ ID NO: 987873 - RNA, 19 nt, Human
uaccacacuaugaaaaugc

SEQ ID NO: 987874 - RNA, 25 nt, Human
uacccuccauacaaauugucauagc

SEQ ID NO: 987875 - RNA, 18 nt, Human
uaggcauaggcucagacc

SEQ ID NO: 987876 - RNA, 21 nt, Human
uaucacauuacaauuugugca

SEQ ID NO: 987877 - RNA, 22 nt, Human
uaugugaugcaaagaggcaaug

SEQ ID NO: 987878 - RNA, 20 nt, Human
ucacaaggaugaaggaaaau

SEQ ID NO: 987879 - RNA, 21 nt, Human
ucacauuacaauuugugcaag

SEQ ID NO: 987880 - RNA, 21 nt, Human
ucaugaucacauccauuuguu

SEQ ID NO: 987881 - RNA, 22 nt, Human
uccauacaaauugucauagcca

SEQ ID NO: 987882 - RNA, 20 nt, Human
ucccauucgguguuggggaa

SEQ ID NO: 987883 - RNA, 23 nt, Human
ucuaaaauacacaguaauaacuc

SEQ ID NO: 987884 - RNA, 18 nt, Human
ucuagaaaugcuguccau

SEQ ID NO: 987885 - RNA, 21 nt, Human
ucugaagauggaaucccauuc

SEQ ID NO: 987886 - RNA, 24 nt, Human
ugaaaaacgagguaugugaugcaa

SEQ ID NO: 987887 - RNA, 24 nt, Human
ugaaaaacgagguaugugaugcaa

SEQ ID NO: 987888 - RNA, 21 nt, Human
ugaaauacugucagcacucuu

SEQ ID NO: 987889 - RNA, 20 nt, Human
ugaaaugucacaaggaugaa

SEQ ID NO: 987890 - RNA, 22 nt, Human
ugaauggacagguagauggaag

SEQ ID NO: 987891 - RNA, 19 nt, Human
ugacaucagguaaaaaugc

SEQ ID NO: 987892 - RNA, 21 nt, Human
ugaccaauaaaaucagcuuga

SEQ ID NO: 987893 - RNA, 25 nt, Human
ugaugauaaaaacaaaaacaaaaca

SEQ ID NO: 987894 - RNA, 19 nt, Human
ugccaggaaaaaaaaaugc

SEQ ID NO: 987895 - RNA, 19 nt, Human
uggaaucccauucgguguu

SEQ ID NO: 987896 - RNA, 20 nt, Human
uggcugggucugaagaugga

SEQ ID NO: 987897 - RNA, 21 nt, Human
uguaccaauaaugaauggaca

SEQ ID NO: 987898 - RNA, 20 nt, Human
ugucauagccaaaagaucaa

SEQ ID NO: 987899 - RNA, 22 nt, Human
ugucauguuuucaaguaauaca

SEQ ID NO: 987900 - RNA, 21 nt, Human
ugugaaaucacaagaguucaa

SEQ ID NO: 987901 - RNA, 23 nt, Human
ugugaaaucacaagaguucaaca

SEQ ID NO: 987902 - RNA, 22 nt, Human
uguuagagaggucacagcuaag

SEQ ID NO: 987903 - RNA, 22 nt, Human
uuaagugcaaaaauggaaaaaa

SEQ ID NO: 987904 - RNA, 22 nt, Human
uuacugaaaugaaaugucacaa

SEQ ID NO: 987905 - RNA, 23 nt, Human
uuacuuuucuaggaccucuucug

SEQ ID NO: 987906 - RNA, 21 nt, Human
uuaguaccuagaaagcuaugg

SEQ ID NO: 987907 - RNA, 22 nt, Human
uuauaagagugcauaguugucc

SEQ ID NO: 987908 - RNA, 23 nt, Human
uuauacagagauuacagacauac

SEQ ID NO: 987909 - RNA, 25 nt, Human
uuaugccaggaaaaaaaaaugcuga

SEQ ID NO: 987910 - RNA, 18 nt, Human
uugagggcaaaaucuguc

SEQ ID NO: 987911 - RNA, 20 nt, Human
uugcccccacaggacuacag

SEQ ID NO: 987912 - RNA, 22 nt, Human
uugcuaacucaauguucuaugu

SEQ ID NO: 987913 - RNA, 23 nt, Human
uuguccugauucaucugguaccu

SEQ ID NO: 987914 - RNA, 22 nt, Human
aaagagaucaccuucugacuuc

SEQ ID NO: 987915 - RNA, 24 nt, Human
aaagugcugggauuauaggcauga

SEQ ID NO: 987916 - RNA, 20 nt, Human
aaccuccaccucccugguuc

SEQ ID NO: 987917 - RNA, 24 nt, Human
aagcaauccgcccaucuuggccuc

SEQ ID NO: 987918 - RNA, 19 nt, Human
aaguagcugggauuacagg

SEQ ID NO: 987919 - RNA, 26 nt, Human
aaguagcugggauuacaggcgcacgc

SEQ ID NO: 987920 - RNA, 19 nt, Human
aagugcugggauuauaggc

SEQ ID NO: 987921 - RNA, 21 nt, Human
aagugcugggauuauaggcau

SEQ ID NO: 987922 - RNA, 21 nt, Human
acaguggcacaaucucggcuc

SEQ ID NO: 987923 - RNA, 24 nt, Human
accagguuggccagacuggucucg

SEQ ID NO: 987924 - RNA, 18 nt, Human
accugguuaauuuagggc

SEQ ID NO: 987925 - RNA, 23 nt, Human
acuggucucgaacuccugaccuc

SEQ ID NO: 987926 - RNA, 24 nt, Human
aggacagaaauacagugaaaaaaa

SEQ ID NO: 987927 - RNA, 20 nt, Human
aggcaugagccaccacgccc

SEQ ID NO: 987928 - RNA, 18 nt, Human
auccaauaugcuucaguc

SEQ ID NO: 987929 - RNA, 20 nt, Human
augaugggauuuagugccuu

SEQ ID NO: 987930 - RNA, 18 nt, Human
augggguuucaccagguu

SEQ ID NO: 987931 - RNA, 24 nt, Human
augggguuucaccagguuggccag

SEQ ID NO: 987932 - RNA, 24 nt, Human
caaagugcugggauuauaggcaug

SEQ ID NO: 987933 - RNA, 24 nt, Human
caccagguuggccagacuggucuc

SEQ ID NO: 987934 - RNA, 24 nt, Human
cacgccaccacgccuggcuaauuu

SEQ ID NO: 987935 - RNA, 23 nt, Human
cauuucauagcucccaguccacc

SEQ ID NO: 987936 - RNA, 24 nt, Human
ccaaagugcugggauuauaggcau

SEQ ID NO: 987937 - RNA, 22 nt, Human
ccaaguagcugggauuacaggc

SEQ ID NO: 987938 - RNA, 23 nt, Human
cccaaguagcugggauuacaggc

SEQ ID NO: 987939 - RNA, 23 nt, Human
cccaaguagcugggauuacaggc

SEQ ID NO: 987940 - RNA, 22 nt, Human
cccaucuuggccucccaaagug

SEQ ID NO: 987941 - RNA, 20 nt, Human
cccugguucaagcaauuccc

SEQ ID NO: 987942 - RNA, 23 nt, Human
cccugguucaagcaauuccccug

SEQ ID NO: 987943 - RNA, 26 nt, Human
ccuacaccauguucaacguccagaaa

SEQ ID NO: 987944 - RNA, 24 nt, Human
ccucaaugaugggauuuagugccu

SEQ ID NO: 987945 - RNA, 18 nt, Human
ccugaccucaagcaaucc

SEQ ID NO: 987946 - RNA, 23 nt, Human
ccugaccucaagcaauccgccca

SEQ ID NO: 987947 - RNA, 22 nt, Human
cuacuccuacaccauguucaac

SEQ ID NO: 987948 - RNA, 24 nt, Human
cucaagcaauccgcccaucuuggc

SEQ ID NO: 987949 - RNA, 25 nt, Human
cucacugcaaccuccaccucccugg

SEQ ID NO: 987950 - RNA, 28 nt, Human
cucccaguccacccuggaugugcauuuc

SEQ ID NO: 987951 - RNA, 23 nt, Human
cuccugaccucaagcaauccgcc

SEQ ID NO: 987952 - RNA, 24 nt, Human
cugcaaccuccaccucccugguuc

SEQ ID NO: 987953 - RNA, 24 nt, Human
cugguguacaguggcacaaucucu

SEQ ID NO: 987954 - RNA, 23 nt, Human
cuuccgucccuguugcuuuucua

SEQ ID NO: 987955 - RNA, 18 nt, Human
cuugaucuuggaccuucc

SEQ ID NO: 987956 - RNA, 23 nt, Human
gaacuccugaccucaagcaaucc

SEQ ID NO: 987957 - RNA, 23 nt, Human
gaccucaagcaauccgcccaucu

SEQ ID NO: 987958 - RNA, 20 nt, Human
gagaugggguuucaccaggu

SEQ ID NO: 987959 - RNA, 18 nt, Human
gauuacaggcgcacgcca

SEQ ID NO: 987960 - RNA, 21 nt, Human
gauuauaggcaugagccacca

SEQ ID NO: 987961 - RNA, 22 nt, Human
gauuauaggcaugagccaccac

SEQ ID NO: 987962 - RNA, 18 nt, Human
gcccuggagcauuuuuuu

SEQ ID NO: 987963 - RNA, 20 nt, Human
gcgucagccucccaaguagc

SEQ ID NO: 987964 - RNA, 22 nt, Human
gcgucagccucccaaguagcug

SEQ ID NO: 987965 - RNA, 25 nt, Human
gcucugucacccaggcugguguaca

SEQ ID NO: 987966 - RNA, 19 nt, Human
ggagcauuuaggaggugau

SEQ ID NO: 987967 - RNA, 19 nt, Human
ggauuauaggcaugagcca

SEQ ID NO: 987968 - RNA, 18 nt, Human
gggguuucaccagguugg

SEQ ID NO: 987969 - RNA, 22 nt, Human
gggguuucaccagguuggccag

SEQ ID NO: 987970 - RNA, 19 nt, Human
ggucucgaacuccugaccu

SEQ ID NO: 987971 - RNA, 20 nt, Human
ggucucgaacuccugaccuc

SEQ ID NO: 987972 - RNA, 24 nt, Human
guuuuagcagagaugggguuucac

SEQ ID NO: 987973 - RNA, 21 nt, Human
uaaauaaauccaauaugcuuc

SEQ ID NO: 987974 - RNA, 22 nt, Human
uaaguuaaagaacaguuauuca

SEQ ID NO: 987975 - RNA, 22 nt, Human
uacaggcgcacgccaccacgcc

SEQ ID NO: 987976 - RNA, 23 nt, Human
uagcagagaugggguuucaccag

SEQ ID NO: 987977 - RNA, 26 nt, Human
uagcagagaugggguuucaccagguu

SEQ ID NO: 987978 - RNA, 19 nt, Human
uaggaggacagaaauacag

SEQ ID NO: 987979 - RNA, 21 nt, Human
uaggaggacagaaauacagug

SEQ ID NO: 987980 - RNA, 19 nt, Human
ucacccaggcugguguaca

SEQ ID NO: 987981 - RNA, 19 nt, Human
ucacugcaaccuccaccuc

SEQ ID NO: 987982 - RNA, 24 nt, Human
ucacugcaaccuccaccucccugg

SEQ ID NO: 987983 - RNA, 24 nt, Human
ucacugcaaccuccaccucccugg

SEQ ID NO: 987984 - RNA, 25 nt, Human
ucacugcaaccuccaccucccuggu

SEQ ID NO: 987985 - RNA, 28 nt, Human
ucacugcaaccuccaccucccugguuca

SEQ ID NO: 987986 - RNA, 18 nt, Human
ucagccucccaaguagcu

SEQ ID NO: 987987 - RNA, 20 nt, Human
ucagccucccaaguagcugg

SEQ ID NO: 987988 - RNA, 24 nt, Human
ucauguugaagcuuaauccucagu

SEQ ID NO: 987989 - RNA, 24 nt, Human
ucccaaagugcugggauuauaggc

SEQ ID NO: 987990 - RNA, 24 nt, Human
ucccaaguagcugggauuacaggc

SEQ ID NO: 987991 - RNA, 19 nt, Human
ucccugguucaagcaauuc

SEQ ID NO: 987992 - RNA, 24 nt, Human
ucccugguucaagcaauuccccug

SEQ ID NO: 987993 - RNA, 22 nt, Human
ucccuuguaggaggacagaaau

SEQ ID NO: 987994 - RNA, 21 nt, Human
uccgcccaucuuggccuccca

SEQ ID NO: 987995 - RNA, 21 nt, Human
uccuuccgucccuguugcuuu

SEQ ID NO: 987996 - RNA, 24 nt, Human
ucuacuccuacaccauguucaacg

SEQ ID NO: 987997 - RNA, 18 nt, Human
ucuccuuccgucccuguu

SEQ ID NO: 987998 - RNA, 21 nt, Human
ucucgaacuccugaccucaag

SEQ ID NO: 987999 - RNA, 24 nt, Human
ucugucacccaggcugguguacag

SEQ ID NO: 988000 - RNA, 19 nt, Human
ucuugcucugucacccagg

SEQ ID NO: 988001 - RNA, 22 nt, Human
ucuugcucugucacccaggcug

SEQ ID NO: 988002 - RNA, 23 nt, Human
ucuugcucugucacccaggcugg

SEQ ID NO: 988003 - RNA, 24 nt, Human
ucuugcucugucacccaggcuggu

SEQ ID NO: 988004 - RNA, 26 nt, Human
ucuugcucugucacccaggcuggugu

SEQ ID NO: 988005 - RNA, 20 nt, Human
ucuuggccucccaaagugcu

SEQ ID NO: 988006 - RNA, 21 nt, Human
ugaagcuuaauccucagugca

SEQ ID NO: 988007 - RNA, 25 nt, Human
ugaccucaagcaauccgcccaucuu

SEQ ID NO: 988008 - RNA, 22 nt, Human
ugacugcuaugguuuggauguu

SEQ ID NO: 988009 - RNA, 23 nt, Human
ugagauaagagucuugcucuguc

SEQ ID NO: 988010 - RNA, 18 nt, Human
ugcauuucuugcaacauc

SEQ ID NO: 988011 - RNA, 24 nt, Human
ugcgucagccucccaaguagcugg

SEQ ID NO: 988012 - RNA, 22 nt, Human
ugcucugucacccaggcuggug

SEQ ID NO: 988013 - RNA, 22 nt, Human
uggagcauuuuuuuuuuuuuuu

SEQ ID NO: 988014 - RNA, 24 nt, Human
uggcacaaucucggcucacugcaa

SEQ ID NO: 988015 - RNA, 24 nt, Human
uggccagacuggucucgaacuccu

SEQ ID NO: 988016 - RNA, 22 nt, Human
ugggauuacaggcgcacgccac

SEQ ID NO: 988017 - RNA, 24 nt, Human
ugggauuacaggcgcacgccacca

SEQ ID NO: 988018 - RNA, 18 nt, Human
ugggauuauaggcaugag

SEQ ID NO: 988019 - RNA, 19 nt, Human
ugggauuauaggcaugagc

SEQ ID NO: 988020 - RNA, 22 nt, Human
ugggauuauaggcaugagccac

SEQ ID NO: 988021 - RNA, 23 nt, Human
ugggauuauaggcaugagccacc

SEQ ID NO: 988022 - RNA, 24 nt, Human
ugggauuauaggcaugagccacca

SEQ ID NO: 988023 - RNA, 19 nt, Human
ugggguuucaccagguugg

SEQ ID NO: 988024 - RNA, 21 nt, Human
uuacuucucauuuaaagcccu

SEQ ID NO: 988025 - RNA, 22 nt, Human
uuagaaaauuuuacuucucauu

SEQ ID NO: 988026 - RNA, 26 nt, Human
uuagacacaccaucucuguguuuguc

SEQ ID NO: 988027 - RNA, 18 nt, Human
uuagcagagaugggguuu

SEQ ID NO: 988028 - RNA, 22 nt, Human
uuagcagagaugggguuucacc

SEQ ID NO: 988029 - RNA, 23 nt, Human
uuagcagagaugggguuucacca

SEQ ID NO: 988030 - RNA, 18 nt, Human
uucaagcaauuccccugc

SEQ ID NO: 988031 - RNA, 24 nt, Human
uugcuuuucuacuccuacaccaug

SEQ ID NO: 988032 - RNA, 23 nt, Human
uuggauguuuguguccucuucaa

SEQ ID NO: 988033 - RNA, 21 nt, Human
uuucaccagguuggccagacu

SEQ ID NO: 988034 - RNA, 23 nt, Human
uuucauagcucccaguccacccu

SEQ ID NO: 988035 - RNA, 23 nt, Human
uuugaaaaauucuuaaaaagaaa

SEQ ID NO: 988036 - RNA, 18 nt, Human
uuuuguaguuuuagcaga

SEQ ID NO: 988037 - RNA, 25 nt, Human
uuuuuuuuuuuugagauaagagucu

SEQ ID NO: 988038 - RNA, 20 nt, Human
uuuuuuuuuuuuuuugagau

SEQ ID NO: 988039 - RNA, 21 nt, Human
aaucaaggggccucgauuuca

SEQ ID NO: 988040 - RNA, 20 nt, Human
agaaacaaucaaggggccuc

SEQ ID NO: 988041 - RNA, 23 nt, Human
aggauauuccacauacauuauca

SEQ ID NO: 988042 - RNA, 20 nt, Human
caauggcaggauauuccaca

SEQ ID NO: 988043 - RNA, 18 nt, Human
cccucugcagccauucug

SEQ ID NO: 988044 - RNA, 21 nt, Human
ccuuguggguagaagaggggu

SEQ ID NO: 988045 - RNA, 20 nt, Human
gaacccgaaagaucucagug

SEQ ID NO: 988046 - RNA, 18 nt, Human
gacuggaaaaucagucca

SEQ ID NO: 988047 - RNA, 21 nt, Human
gauauuccacauacauuauca

SEQ ID NO: 988048 - RNA, 20 nt, Human
ggacuggaaaaucaguccag

SEQ ID NO: 988049 - RNA, 24 nt, Human
ggccuguucaccccucugcagcca

SEQ ID NO: 988050 - RNA, 18 nt, Human
gggaaaggacuaggggug

SEQ ID NO: 988051 - RNA, 21 nt, Human
guaucacagcaccccaaauau

SEQ ID NO: 988052 - RNA, 20 nt, Human
gugcaggguguuucacagaa

SEQ ID NO: 988053 - RNA, 18 nt, Human
ucaguggggaaaggacua

SEQ ID NO: 988054 - RNA, 20 nt, Human
uguucaccccucugcagcca

SEQ ID NO: 988055 - RNA, 23 nt, Human
aaaaaccagaaacuugacgagca

SEQ ID NO: 988056 - RNA, 24 nt, Human
aaaaauaauugaaaaccuaaacaa

SEQ ID NO: 988057 - RNA, 24 nt, Human
aaauuugggaugaugaaaggaaag

SEQ ID NO: 988058 - RNA, 23 nt, Human
aacaaaauucaaaguuacagcug

SEQ ID NO: 988059 - RNA, 19 nt, Human
aacuguauaacccagagca

SEQ ID NO: 988060 - RNA, 21 nt, Human
aagccacaccaaucaucauaa

SEQ ID NO: 988061 - RNA, 26 nt, Human
aaggaaaaaaacugacccaaaaauau

SEQ ID NO: 988062 - RNA, 26 nt, Human
aaucagacccaccaagugguacagca

SEQ ID NO: 988063 - RNA, 18 nt, Human
acaggaacacaaacaucu

SEQ ID NO: 988064 - RNA, 21 nt, Human
accaaucuagcuuuacaaaga

SEQ ID NO: 988065 - RNA, 19 nt, Human
accaauguuaccugacuua

SEQ ID NO: 988066 - RNA, 19 nt, Human
accccccaccccgccccca

SEQ ID NO: 988067 - RNA, 21 nt, Human
acuccguccagaccccccacc

SEQ ID NO: 988068 - RNA, 18 nt, Human
agaagcggcggcuccucc

SEQ ID NO: 988069 - RNA, 20 nt, Human
agaccccccaccccgccccc

SEQ ID NO: 988070 - RNA, 23 nt, Human
agaccccccaccccgcccccacc

SEQ ID NO: 988071 - RNA, 19 nt, Human
agcacuccagcugaccccc

SEQ ID NO: 988072 - RNA, 22 nt, Human
agcaggaggacgcggaggcccg

SEQ ID NO: 988073 - RNA, 20 nt, Human
agccacgguggcacugaaca

SEQ ID NO: 988074 - RNA, 19 nt, Human
aggaauuaaauguaggcgu

SEQ ID NO: 988075 - RNA, 20 nt, Human
aggaauuaaauguaggcguu

SEQ ID NO: 988076 - RNA, 24 nt, Human
agucaacuuguacacaaaacuuag

SEQ ID NO: 988077 - RNA, 21 nt, Human
aucaucacugggaguuuuccu

SEQ ID NO: 988078 - RNA, 26 nt, Human
augccuguuacaagcaugaugcauug

SEQ ID NO: 988079 - RNA, 24 nt, Human
caaaaauaauugaaaaccuaaaca

SEQ ID NO: 988080 - RNA, 23 nt, Human
caaaauaaauaccccgccacuug

SEQ ID NO: 988081 - RNA, 19 nt, Human
caaaauagauuaucuaaca

SEQ ID NO: 988082 - RNA, 23 nt, Human
cacaucagguucagaaucagacc

SEQ ID NO: 988083 - RNA, 20 nt, Human
cacgcgcucagccgcgcgca

SEQ ID NO: 988084 - RNA, 19 nt, Human
cacugaaagccaacaaaau

SEQ ID NO: 988085 - RNA, 21 nt, Human
cagaccccccaccccgccccc

SEQ ID NO: 988086 - RNA, 21 nt, Human
cagagaaaaaccagaaacuug

SEQ ID NO: 988087 - RNA, 24 nt, Human
cagagcgaggucagaagcggcggc

SEQ ID NO: 988088 - RNA, 23 nt, Human
cagcacaguaacaacccauggaa

SEQ ID NO: 988089 - RNA, 22 nt, Human
cagccauaacaauuaaauuucu

SEQ ID NO: 988090 - RNA, 24 nt, Human
cagguucagaaucagacccaccaa

SEQ ID NO: 988091 - RNA, 19 nt, Human
cauaacacaaaaagaacag

SEQ ID NO: 988092 - RNA, 24 nt, Human
cauccauagaacuaaaauggauuu

SEQ ID NO: 988093 - RNA, 22 nt, Human
cauucuaacaaaacccuucugg

SEQ ID NO: 988094 - RNA, 24 nt, Human
cauuuucaauacuucaacuacuuu

SEQ ID NO: 988095 - RNA, 25 nt, Human
ccaaucaucauaacaaagacuaugc

SEQ ID NO: 988096 - RNA, 19 nt, Human
ccaccaaucuagcuuuaca

SEQ ID NO: 988097 - RNA, 20 nt, Human
ccacuugccacucaugcuuc

SEQ ID NO: 988098 - RNA, 23 nt, Human
ccagcugacccccccggcaguca

SEQ ID NO: 988099 - RNA, 19 nt, Human
ccccaccgcgucuaccaaa

SEQ ID NO: 988100 - RNA, 21 nt, Human
cccccaccccgcccccaccgc

SEQ ID NO: 988101 - RNA, 19 nt, Human
ccccccaccccgcccccac

SEQ ID NO: 988102 - RNA, 25 nt, Human
ccccgcccccaccgcgucuaccaaa

SEQ ID NO: 988103 - RNA, 21 nt, Human
cccuucaggccuugggaccua

SEQ ID NO: 988104 - RNA, 19 nt, Human
ccgccgccgccccugcccc

SEQ ID NO: 988105 - RNA, 20 nt, Human
ccgccgccgccccugcccgg

SEQ ID NO: 988106 - RNA, 18 nt, Human
ccgcgcgcaccggagcca

SEQ ID NO: 988107 - RNA, 18 nt, Human
ccucagggcggcgcgcag

SEQ ID NO: 988108 - RNA, 21 nt, Human
ccuucaggccuugggaccuag

SEQ ID NO: 988109 - RNA, 22 nt, Human
cgcacacagugcucucuccaca

SEQ ID NO: 988110 - RNA, 19 nt, Human
cgcggaggcccggagccgg

SEQ ID NO: 988111 - RNA, 18 nt, Human
cuauagaaagcaaggcua

SEQ ID NO: 988112 - RNA, 22 nt, Human
cuccguccagaccccccacccc

SEQ ID NO: 988113 - RNA, 24 nt, Human
cuccucagccgcagucgcgccgcc

SEQ ID NO: 988114 - RNA, 18 nt, Human
cucuauagaaagcaaggc

SEQ ID NO: 988115 - RNA, 20 nt, Human
cucuccacauggacucacug

SEQ ID NO: 988116 - RNA, 19 nt, Human
cuuugagggguuuuacaac

SEQ ID NO: 988117 - RNA, 20 nt, Human
gaagacaggcaaaagacuua

SEQ ID NO: 988118 - RNA, 23 nt, Human
gaccacugaaagccaacaaaauu

SEQ ID NO: 988119 - RNA, 22 nt, Human
gaccccccaccccgcccccacc

SEQ ID NO: 988120 - RNA, 23 nt, Human
gagcaggaggacgcggaggcccg

SEQ ID NO: 988121 - RNA, 20 nt, Human
gagccagagcgaggucagaa

SEQ ID NO: 988122 - RNA, 24 nt, Human
gagcgaggucagaagcggcggcuc

SEQ ID NO: 988123 - RNA, 25 nt, Human
gccagagcgaggucagaagcggcgg

SEQ ID NO: 988124 - RNA, 19 nt, Human
gccgcugcgcacacagugc

SEQ ID NO: 988125 - RNA, 18 nt, Human
gcucucuccacauggacu

SEQ ID NO: 988126 - RNA, 19 nt, Human
gcuuuugggaucaaaacug

SEQ ID NO: 988127 - RNA, 19 nt, Human
gggcgcuccucagggcggc

SEQ ID NO: 988128 - RNA, 21 nt, Human
guaaagugucuccccuacccc

SEQ ID NO: 988129 - RNA, 20 nt, Human
guccugccagcaggaucagc

SEQ ID NO: 988130 - RNA, 22 nt, Human
gugcaugcucuauagaaagcaa

SEQ ID NO: 988131 - RNA, 18 nt, Human
gugcugcugccgcugcgc

SEQ ID NO: 988132 - RNA, 21 nt, Human
guuguauaaaacaccaccaau

SEQ ID NO: 988133 - RNA, 23 nt, Human
uaaagccacaccaaucaucauaa

SEQ ID NO: 988134 - RNA, 21 nt, Human
uaaagugucuccccuaccccu

SEQ ID NO: 988135 - RNA, 22 nt, Human
uaaagugucuccccuaccccuc

SEQ ID NO: 988136 - RNA, 22 nt, Human
uaaauaaaagccugacaguuac

SEQ ID NO: 988137 - RNA, 19 nt, Human
uaaaugagagcagagaaaa

SEQ ID NO: 988138 - RNA, 25 nt, Human
uaagcugaguaaauaaguuguauaa

SEQ ID NO: 988139 - RNA, 23 nt, Human
uaagcuugauucagaaaccccua

SEQ ID NO: 988140 - RNA, 20 nt, Human
uacagcacaguaacaaccca

SEQ ID NO: 988141 - RNA, 21 nt, Human
uagagacuccguccagacccc

SEQ ID NO: 988142 - RNA, 22 nt, Human
uagcaugaccacugaaagccaa

SEQ ID NO: 988143 - RNA, 22 nt, Human
uagcuuuacaaagauuguguuu

SEQ ID NO: 988144 - RNA, 19 nt, Human
uaggccagauccaaagcca

SEQ ID NO: 988145 - RNA, 19 nt, Human
uaugccaauuuaggaauag

SEQ ID NO: 988146 - RNA, 22 nt, Human
uccagaccccccaccccgcccc

SEQ ID NO: 988147 - RNA, 19 nt, Human
uccguccagaccccccacc

SEQ ID NO: 988148 - RNA, 18 nt, Human
ucuauagaaagcaaggcu

SEQ ID NO: 988149 - RNA, 28 nt, Human
ucucaacaaagaucucaacgagucucaa

SEQ ID NO: 988150 - RNA, 20 nt, Human
ucucaagaagacaggcaaaa

SEQ ID NO: 988151 - RNA, 19 nt, Human
ucuccccuaccccuccugg

SEQ ID NO: 988152 - RNA, 19 nt, Human
ucugugcugcugccgcugc

SEQ ID NO: 988153 - RNA, 19 nt, Human
ugaaaggaaaggcaggacu

SEQ ID NO: 988154 - RNA, 22 nt, Human
ugaaauauuuccauccauagaa

SEQ ID NO: 988155 - RNA, 18 nt, Human
ugagagcagagaaaaacc

SEQ ID NO: 988156 - RNA, 21 nt, Human
ugaguaaauaaguuguauaaa

SEQ ID NO: 988157 - RNA, 25 nt, Human
uggaaagaacaucgagaaaugaagg

SEQ ID NO: 988158 - RNA, 24 nt, Human
ugggaugaugaaaggaaaggcagg

SEQ ID NO: 988159 - RNA, 18 nt, Human
uggguagguagcaugacc

SEQ ID NO: 988160 - RNA, 23 nt, Human
uggguagguagcaugaccacuga

SEQ ID NO: 988161 - RNA, 25 nt, Human
ugucuccccuaccccuccuggagau

SEQ ID NO: 988162 - RNA, 22 nt, Human
uuaaccacaggaacacaaacau

SEQ ID NO: 988163 - RNA, 21 nt, Human
uuccauaaaaaaauacuggua

SEQ ID NO: 988164 - RNA, 23 nt, Human
agcauuguucuccagcucuuuug

SEQ ID NO: 988165 - RNA, 18 nt, Human
aggucuccagcacguugc

SEQ ID NO: 988166 - RNA, 21 nt, Human
cauuguucuccagcucuuuug

SEQ ID NO: 988167 - RNA, 18 nt, Human
uaagaaaugaguucaauu

SEQ ID NO: 988168 - RNA, 19 nt, Human
uaagaaaugaguucaauug

SEQ ID NO: 988169 - RNA, 18 nt, Human
uccagcacguugccuagc

SEQ ID NO: 988170 - RNA, 19 nt, Human
uccagcacguugccuagca

SEQ ID NO: 988171 - RNA, 23 nt, Human
ugaguucaauugaacccauuuaa

SEQ ID NO: 988172 - RNA, 22 nt, Human
agacgagacuccucugaaguuc

SEQ ID NO: 988173 - RNA, 19 nt, Human
agacuggaagcugaaagau

SEQ ID NO: 988174 - RNA, 19 nt, Human
cugccuccuggucacuuug

SEQ ID NO: 988175 - RNA, 19 nt, Human
gaaguucuucucugccucc

SEQ ID NO: 988176 - RNA, 22 nt, Human
gacuggcaccaugauggucuca

SEQ ID NO: 988177 - RNA, 24 nt, Human
uaaaaauugcuuucuguuucuaga

SEQ ID NO: 988178 - RNA, 24 nt, Human
uaggagaaugggguccuagacugg

SEQ ID NO: 988179 - RNA, 19 nt, Human
ucugcagucccggacccuc

SEQ ID NO: 988180 - RNA, 18 nt, Human
ugaaagauacugcaauag

SEQ ID NO: 988181 - RNA, 22 nt, Human
ugaccauagcugccuaaaaauu

SEQ ID NO: 988182 - RNA, 23 nt, Human
uuaaagcccauuuuauuuugggu

SEQ ID NO: 988183 - RNA, 20 nt, Human
aaaacaguuugguuccaguu

SEQ ID NO: 988184 - RNA, 22 nt, Human
aaacaggcagauuaaaugaaca

SEQ ID NO: 988185 - RNA, 19 nt, Human
aaagggaccaggagguggg

SEQ ID NO: 988186 - RNA, 24 nt, Human
aaagugcugggauuacaggcguga

SEQ ID NO: 988187 - RNA, 20 nt, Human
aaauaacucugcacaaggca

SEQ ID NO: 988188 - RNA, 20 nt, Human
aacaacaucuguuuuucccu

SEQ ID NO: 988189 - RNA, 18 nt, Human
aacagguaaauccccaga

SEQ ID NO: 988190 - RNA, 21 nt, Human
aaccaaccauuagauuucuau

SEQ ID NO: 988191 - RNA, 24 nt, Human
aagaaaaccacuacgaaaggucac

SEQ ID NO: 988192 - RNA, 22 nt, Human
aagaccagaaccaauuagaaaa

SEQ ID NO: 988193 - RNA, 25 nt, Human
aagcaagaaaaccacuacgaauugc

SEQ ID NO: 988194 - RNA, 25 nt, Human
aagcuagcauuuguuucuugagaac

SEQ ID NO: 988195 - RNA, 24 nt, Human
aaggaggauugaaaaugugguucc

SEQ ID NO: 988196 - RNA, 19 nt, Human
aagugcugggauuacaggc

SEQ ID NO: 988197 - RNA, 19 nt, Human
aagugcugggauuacaggc

SEQ ID NO: 988198 - RNA, 26 nt, Human
aagugcugggauuacaggcgugagcc

SEQ ID NO: 988199 - RNA, 22 nt, Human
aauuagaaaguaggguugggcu

SEQ ID NO: 988200 - RNA, 22 nt, Human
acaugacauauccucucacucu

SEQ ID NO: 988201 - RNA, 22 nt, Human
acccgaacucuaccacacacgc

SEQ ID NO: 988202 - RNA, 23 nt, Human
accucggccucccaaagugcugg

SEQ ID NO: 988203 - RNA, 18 nt, Human
acgggguuucacuguguu

SEQ ID NO: 988204 - RNA, 19 nt, Human
acgggguuucacuguguua

SEQ ID NO: 988205 - RNA, 20 nt, Human
acgggguuucacuguguuag

SEQ ID NO: 988206 - RNA, 24 nt, Human
acgggguuucacuguguuagccag

SEQ ID NO: 988207 - RNA, 20 nt, Human
acugcaagcucugccucccg

SEQ ID NO: 988208 - RNA, 22 nt, Human
agaaaaagacauaaucuccaaa

SEQ ID NO: 988209 - RNA, 25 nt, Human
agaacuaauaaggaacuaaagauaa

SEQ ID NO: 988210 - RNA, 18 nt, Human
agacaggaaaguaaugug

SEQ ID NO: 988211 - RNA, 22 nt, Human
agagagauuuuaagagcaccau

SEQ ID NO: 988212 - RNA, 24 nt, Human
agcuggguaguucuggcucucuug

SEQ ID NO: 988213 - RNA, 27 nt, Human
aggaaaaggccaacuugacgcacaaaa

SEQ ID NO: 988214 - RNA, 22 nt, Human
aggaggcaagaacacuggggcu

SEQ ID NO: 988215 - RNA, 20 nt, Human
aggcguuuggagaugaaaga

SEQ ID NO: 988216 - RNA, 23 nt, Human
aggcguuuggagaugaaagaggg

SEQ ID NO: 988217 - RNA, 19 nt, Human
aguaauuuauucauucaca

SEQ ID NO: 988218 - RNA, 18 nt, Human
aguagcugggacuacagg

SEQ ID NO: 988219 - RNA, 18 nt, Human
agugcugggauuacaggc

SEQ ID NO: 988220 - RNA, 21 nt, Human
auaaagcacaaugucuaccuu

SEQ ID NO: 988221 - RNA, 21 nt, Human
auacagagcacgucuggcuga

SEQ ID NO: 988222 - RNA, 18 nt, Human
aucaucuguauucagcau

SEQ ID NO: 988223 - RNA, 23 nt, Human
auccgggaagagggugugggugg

SEQ ID NO: 988224 - RNA, 24 nt, Human
auuuuuguauuuuuaguagagacg

SEQ ID NO: 988225 - RNA, 19 nt, Human
caaaacaggcagauuaaau

SEQ ID NO: 988226 - RNA, 21 nt, Human
caaagccccaggauuuuggca

SEQ ID NO: 988227 - RNA, 24 nt, Human
caaagugcugggauuacaggcgug

SEQ ID NO: 988228 - RNA, 18 nt, Human
caaauaacucugcacaag

SEQ ID NO: 988229 - RNA, 22 nt, Human
caaauagccauacacaugaagc

SEQ ID NO: 988230 - RNA, 24 nt, Human
caacugacaugagagagauuuuaa

SEQ ID NO: 988231 - RNA, 21 nt, Human
caagcaaacuccagccaccca

SEQ ID NO: 988232 - RNA, 24 nt, Human
cacaagaguuaagcaccuaccuaa

SEQ ID NO: 988233 - RNA, 21 nt, Human
cacaaggcugucauggagcag

SEQ ID NO: 988234 - RNA, 24 nt, Human
caccacacccggcuaauuuuugua

SEQ ID NO: 988235 - RNA, 26 nt, Human
caccaccaaaucaguguguuuuuaau

SEQ ID NO: 988236 - RNA, 20 nt, Human
caccagcauuucuguaauga

SEQ ID NO: 988237 - RNA, 22 nt, Human
cacccaccucggccucccaaag

SEQ ID NO: 988238 - RNA, 23 nt, Human
cacccaccucggccucccaaagu

SEQ ID NO: 988239 - RNA, 22 nt, Human
cacccagauuggagugugcagu

SEQ ID NO: 988240 - RNA, 20 nt, Human
cacccuucuccugccucagc

SEQ ID NO: 988241 - RNA, 19 nt, Human
cacucaaaugaaaccacuc

SEQ ID NO: 988242 - RNA, 23 nt, Human
cacugcaagcucugccucccggg

SEQ ID NO: 988243 - RNA, 22 nt, Human
cacuggggcucaucuuggaggc

SEQ ID NO: 988244 - RNA, 18 nt, Human
cacuguguuagccaggau

SEQ ID NO: 988245 - RNA, 19 nt, Human
cacuguguuagccaggaug

SEQ ID NO: 988246 - RNA, 24 nt, Human
cacuguguuagccaggauggucuc

SEQ ID NO: 988247 - RNA, 20 nt, Human
cagccuccugaguagcuggg

SEQ ID NO: 988248 - RNA, 22 nt, Human
cagcugcagcaaaggcauggcu

SEQ ID NO: 988249 - RNA, 22 nt, Human
cagugaaggaggauugaaaaug

SEQ ID NO: 988250 - RNA, 19 nt, Human
caugaagcaaagcaacagc

SEQ ID NO: 988251 - RNA, 20 nt, Human
caugacccugagugugaaua

SEQ ID NO: 988252 - RNA, 19 nt, Human
caugucuuagcagugaaag

SEQ ID NO: 988253 - RNA, 22 nt, Human
ccaaagugcugggauuacaggc

SEQ ID NO: 988254 - RNA, 22 nt, Human
ccaaagugcugggauuacaggc

SEQ ID NO: 988255 - RNA, 24 nt, Human
ccaaagugcugggauuacaggcgu

SEQ ID NO: 988256 - RNA, 22 nt, Human
ccacacagaauuugccuaucac

SEQ ID NO: 988257 - RNA, 22 nt, Human
ccugaccucgugauccacccac

SEQ ID NO: 988258 - RNA, 23 nt, Human
ccugaguagcugggacuacaggu

SEQ ID NO: 988259 - RNA, 24 nt, Human
ccugaguagcugggacuacaggug

SEQ ID NO: 988260 - RNA, 24 nt, Human
ccugcacugcaggguggguaaagg

SEQ ID NO: 988261 - RNA, 23 nt, Human
ccugccucagccuccugaguagc

SEQ ID NO: 988262 - RNA, 25 nt, Human
cgaaggcacucaaaugaaaccaguc

SEQ ID NO: 988263 - RNA, 18 nt, Human
cgacaccacacccggcua

SEQ ID NO: 988264 - RNA, 24 nt, Human
cgggguuucacuguguuagccagg

SEQ ID NO: 988265 - RNA, 21 nt, Human
cgugcuaaaaaacccgaacuc

SEQ ID NO: 988266 - RNA, 23 nt, Human
cuaauuuuuguauuuuuaguaga

SEQ ID NO: 988267 - RNA, 24 nt, Human
cucacugcaagcucugccucccgg

SEQ ID NO: 988268 - RNA, 20 nt, Human
cucagacauucugauuuaau

SEQ ID NO: 988269 - RNA, 24 nt, Human
cucagccuccugaguagcugggac

SEQ ID NO: 988270 - RNA, 21 nt, Human
cucccggguucccacccuucu

SEQ ID NO: 988271 - RNA, 18 nt, Human
cuccugaccucgugaucc

SEQ ID NO: 988272 - RNA, 25 nt, Human
cuccugaccucgugauccacccacc

SEQ ID NO: 988273 - RNA, 23 nt, Human
cugccucagccuccugaguagcu

SEQ ID NO: 988274 - RNA, 19 nt, Human
cuggccaccacaagaguuc

SEQ ID NO: 988275 - RNA, 21 nt, Human
cuuuuuuuuuuuuuuuugagg

SEQ ID NO: 988276 - RNA, 21 nt, Human
gaaaagacaccaaccaaccau

SEQ ID NO: 988277 - RNA, 22 nt, Human
gaacaauguugaaauuguucuc

SEQ ID NO: 988278 - RNA, 21 nt, Human
gaccaggaggugggaggugac

SEQ ID NO: 988279 - RNA, 22 nt, Human
gaccucgugauccacccaccuc

SEQ ID NO: 988280 - RNA, 22 nt, Human
gaccucgugauccacccaccuc

SEQ ID NO: 988281 - RNA, 24 nt, Human
gaccucgugauccacccaccucgg

SEQ ID NO: 988282 - RNA, 24 nt, Human
gaccucgugauccacccaccucgg

SEQ ID NO: 988283 - RNA, 19 nt, Human
gaggcggagucucggucuu

SEQ ID NO: 988284 - RNA, 25 nt, Human
gaguagcugggacuacaggugcccg

SEQ ID NO: 988285 - RNA, 18 nt, Human
gauuacaggcgugagcca

SEQ ID NO: 988286 - RNA, 19 nt, Human
gauuacaggcgugagccac

SEQ ID NO: 988287 - RNA, 22 nt, Human
gauuacaggcgugagccacugc

SEQ ID NO: 988288 - RNA, 26 nt, Human
gcaaagccccaggauuuuggcaaaga

SEQ ID NO: 988289 - RNA, 21 nt, Human
gcaagaaaaccacuacgaauu

SEQ ID NO: 988290 - RNA, 20 nt, Human
gccuuaauauuauuuuuuga

SEQ ID NO: 988291 - RNA, 18 nt, Human
gcugaacaugugaaucau

SEQ ID NO: 988292 - RNA, 21 nt, Human
gcugaauacagagcacgucug

SEQ ID NO: 988293 - RNA, 21 nt, Human
gcuggcaaguuggugcuuguu

SEQ ID NO: 988294 - RNA, 19 nt, Human
ggaaugggcuuuucccagu

SEQ ID NO: 988295 - RNA, 19 nt, Human
ggauuccagcagaguucug

SEQ ID NO: 988296 - RNA, 23 nt, Human
gggguuucacuguguuagccagg

SEQ ID NO: 988297 - RNA, 20 nt, Human
ggucucgaucuccugaccuc

SEQ ID NO: 988298 - RNA, 23 nt, Human
guagagacgggguuucacugugu

SEQ ID NO: 988299 - RNA, 24 nt, Human
gugauccacccaccucggccuccc

SEQ ID NO: 988300 - RNA, 23 nt, Human
gugcaguggcacaaucucggcuc

SEQ ID NO: 988301 - RNA, 20 nt, Human
gugcuaaaaaacccgaacuc

SEQ ID NO: 988302 - RNA, 19 nt, Human
uaaaaaacccgaacucuac

SEQ ID NO: 988303 - RNA, 21 nt, Human
uaaaaaacccgaacucuacca

SEQ ID NO: 988304 - RNA, 21 nt, Human
uaaaguuuccuuuugggacua

SEQ ID NO: 988305 - RNA, 22 nt, Human
uaaauccccagaugaaaaagag

SEQ ID NO: 988306 - RNA, 25 nt, Human
uaaccucuccaaaaaagaccagaac

SEQ ID NO: 988307 - RNA, 24 nt, Human
uaagaaaaagacauaaucuccaaa

SEQ ID NO: 988308 - RNA, 28 nt, Human
uaagaaaaagacauaaucuccaaauaaa

SEQ ID NO: 988309 - RNA, 19 nt, Human
uaagcaagaaaaccacuac

SEQ ID NO: 988310 - RNA, 21 nt, Human
uaagcaagaaaaccacuacga

SEQ ID NO: 988311 - RNA, 24 nt, Human
uaauuuuuguauuuuuaguagaga

SEQ ID NO: 988312 - RNA, 20 nt, Human
uacacaugaagcaaagcaac

SEQ ID NO: 988313 - RNA, 19 nt, Human
uacaggcgugagccacugc

SEQ ID NO: 988314 - RNA, 23 nt, Human
uacaggcgugagccacugcgccc

SEQ ID NO: 988315 - RNA, 23 nt, Human
uacaggugcccgacaccacaccc

SEQ ID NO: 988316 - RNA, 22 nt, Human
uacauggcuggcaaguuggugc

SEQ ID NO: 988317 - RNA, 25 nt, Human
uagaaaaaggaaaaggccaacuuga

SEQ ID NO: 988318 - RNA, 21 nt, Human
uagccauacacaugaagcaaa

SEQ ID NO: 988319 - RNA, 21 nt, Human
uaggauuccagcagaguuccu

SEQ ID NO: 988320 - RNA, 21 nt, Human
uagguuucuucucugacaccu

SEQ ID NO: 988321 - RNA, 20 nt, Human
uaguagagacgggguuucac

SEQ ID NO: 988322 - RNA, 24 nt, Human
uaguagagacgggguuucacugug

SEQ ID NO: 988323 - RNA, 21 nt, Human
uauaaucauggggguggaggg

SEQ ID NO: 988324 - RNA, 22 nt, Human
uauaugcaugccaaauauugga

SEQ ID NO: 988325 - RNA, 19 nt, Human
uaucugaagacuugacugg

SEQ ID NO: 988326 - RNA, 20 nt, Human
ucaaggauaagcauacugca

SEQ ID NO: 988327 - RNA, 21 nt, Human
ucaaggauaagcauacugcaa

SEQ ID NO: 988328 - RNA, 18 nt, Human
ucacugcaagcucugccu

SEQ ID NO: 988329 - RNA, 18 nt, Human
ucacugcaagcucugccu

SEQ ID NO: 988330 - RNA, 24 nt, Human
ucacugcaagcucugccucccggg

SEQ ID NO: 988331 - RNA, 24 nt, Human
ucacuguguuagccaggauggucu

SEQ ID NO: 988332 - RNA, 23 nt, Human
ucagccuccugaguagcugggac

SEQ ID NO: 988333 - RNA, 23 nt, Human
ucagcugcagcaaaggcauggcu

SEQ ID NO: 988334 - RNA, 24 nt, Human
ucccaaagugcugggauuacaggc

SEQ ID NO: 988335 - RNA, 21 nt, Human
ucccggguucccacccuucuc

SEQ ID NO: 988336 - RNA, 24 nt, Human
ucccggguucccacccuucuccug

SEQ ID NO: 988337 - RNA, 24 nt, Human
uccugaguagcugggacuacaggu

SEQ ID NO: 988338 - RNA, 18 nt, Human
ucggccucccaaagugcu

SEQ ID NO: 988339 - RNA, 19 nt, Human
ucggucuuucacccagauu

SEQ ID NO: 988340 - RNA, 26 nt, Human
ucuaaccucuccaaaaaagaccagaa

SEQ ID NO: 988341 - RNA, 22 nt, Human
ucucacucuugguuaagcuuca

SEQ ID NO: 988342 - RNA, 21 nt, Human
ucuccaaaaaagaccagaacc

SEQ ID NO: 988343 - RNA, 25 nt, Human
ucuccaaaaaagaccagaaccaauu

SEQ ID NO: 988344 - RNA, 24 nt, Human
ucuccugccucagccuccugagua

SEQ ID NO: 988345 - RNA, 24 nt, Human
ucucggucuuucacccagauugga

SEQ ID NO: 988346 - RNA, 20 nt, Human
ucucuugaggucuuggucaa

SEQ ID NO: 988347 - RNA, 22 nt, Human
ucuuucuuucuuucuuucuuuc

SEQ ID NO: 988348 - RNA, 22 nt, Human
ucuuucuuucuuucuuucuuuc

SEQ ID NO: 988349 - RNA, 22 nt, Human
ucuuucuuucuuucuuucuuuu

SEQ ID NO: 988350 - RNA, 19 nt, Human
ugaaaagacaccaaccaac

SEQ ID NO: 988351 - RNA, 21 nt, Human
ugaaaagacaccaaccaacca

SEQ ID NO: 988352 - RNA, 25 nt, Human
ugaaaagacaccaaccaaccauuag

SEQ ID NO: 988353 - RNA, 25 nt, Human
ugaaagggaccaggaggugggaggu

SEQ ID NO: 988354 - RNA, 18 nt, Human
ugaacagguaaaucccca

SEQ ID NO: 988355 - RNA, 21 nt, Human
ugaacagguaaauccccagau

SEQ ID NO: 988356 - RNA, 22 nt, Human
ugaacaugacauauccucucac

SEQ ID NO: 988357 - RNA, 21 nt, Human
ugaagacuugacuggaggcug

SEQ ID NO: 988358 - RNA, 18 nt, Human
ugagaaagaacuuccaca

SEQ ID NO: 988359 - RNA, 22 nt, Human
ugagagagauuuuaagagcacc

SEQ ID NO: 988360 - RNA, 20 nt, Human
ugagaguguugaugccugug

SEQ ID NO: 988361 - RNA, 23 nt, Human
ugagugugaauaccuccuuaaau

SEQ ID NO: 988362 - RNA, 24 nt, Human
ugauccacccaccucggccuccca

SEQ ID NO: 988363 - RNA, 18 nt, Human
ugcagugccucuaccggc

SEQ ID NO: 988364 - RNA, 22 nt, Human
ugcaguggcacaaucucggcuc

SEQ ID NO: 988365 - RNA, 23 nt, Human
ugcaugacccugagugugaauac

SEQ ID NO: 988366 - RNA, 24 nt, Human
ugccucagccuccugaguagcugg

SEQ ID NO: 988367 - RNA, 21 nt, Human
ugccucccggguucccacccu

SEQ ID NO: 988368 - RNA, 22 nt, Human
ugccucuaccggccucucucug

SEQ ID NO: 988369 - RNA, 19 nt, Human
ugccuuggugucuucaugg

SEQ ID NO: 988370 - RNA, 20 nt, Human
ugccuuggugucuucauggc

SEQ ID NO: 988371 - RNA, 20 nt, Human
ugcuaaaaaacccgaacucu

SEQ ID NO: 988372 - RNA, 24 nt, Human
ugcuaaaaaacccgaacucuacca

SEQ ID NO: 988373 - RNA, 19 nt, Human
ugcugggaaaacaggucac

SEQ ID NO: 988374 - RNA, 24 nt, Human
ugcugggauuacaggcgugagcca

SEQ ID NO: 988375 - RNA, 23 nt, Human
uggaccuccccugcuuaucucac

SEQ ID NO: 988376 - RNA, 23 nt, Human
uggcaaaaggcacaaggcuguca

SEQ ID NO: 988377 - RNA, 21 nt, Human
uggcaaguuggugcuuguuag

SEQ ID NO: 988378 - RNA, 24 nt, Human
uggcacaaucucggcucacugcaa

SEQ ID NO: 988379 - RNA, 19 nt, Human
uggcaggagucugggcuga

SEQ ID NO: 988380 - RNA, 19 nt, Human
uggcugaagagcgacuaua

SEQ ID NO: 988381 - RNA, 20 nt, Human
ugggacuacaggugcccgac

SEQ ID NO: 988382 - RNA, 24 nt, Human
ugggacuacaggugcccgacacca

SEQ ID NO: 988383 - RNA, 18 nt, Human
ugggaggugacgcuggca

SEQ ID NO: 988384 - RNA, 18 nt, Human
ugggauuacaggcgugag

SEQ ID NO: 988385 - RNA, 19 nt, Human
ugggauuacaggcgugagc

SEQ ID NO: 988386 - RNA, 21 nt, Human
ugggauuacaggcgugagcca

SEQ ID NO: 988387 - RNA, 22 nt, Human
ugggauuacaggcgugagccac

SEQ ID NO: 988388 - RNA, 22 nt, Human
ugggauuacaggcgugagccac

SEQ ID NO: 988389 - RNA, 24 nt, Human
ugggauuacaggcgugagccacug

SEQ ID NO: 988390 - RNA, 26 nt, Human
ugggauuacaggcgugagccacugcg

SEQ ID NO: 988391 - RNA, 24 nt, Human
uggguaaaggauagaauugcaagc

SEQ ID NO: 988392 - RNA, 19 nt, Human
uggguggcuguguguacaa

SEQ ID NO: 988393 - RNA, 26 nt, Human
ugguaggagcaggguuaaccggaacg

SEQ ID NO: 988394 - RNA, 23 nt, Human
uguauaguuaucugucgcuaugu

SEQ ID NO: 988395 - RNA, 21 nt, Human
uguauuuuuaguagagacggg

SEQ ID NO: 988396 - RNA, 20 nt, Human
ugugcagugccucuaccggc

SEQ ID NO: 988397 - RNA, 22 nt, Human
ugugcaguggcacaaucucggc

SEQ ID NO: 988398 - RNA, 23 nt, Human
ugugcaguggcacaaucucggcu

SEQ ID NO: 988399 - RNA, 18 nt, Human
uguggguggguggguggc

SEQ ID NO: 988400 - RNA, 22 nt, Human
uguuagaaguucagaaauuuag

SEQ ID NO: 988401 - RNA, 20 nt, Human
uguuuagugaagccaaaagc

SEQ ID NO: 988402 - RNA, 27 nt, Human
uuaaaugaacagguaaauccccagaug

SEQ ID NO: 988403 - RNA, 24 nt, Human
uuaauccuggccucagguuacacu

SEQ ID NO: 988404 - RNA, 23 nt, Human
uuacaccagcauuucuguaauga

SEQ ID NO: 988405 - RNA, 18 nt, Human
uuaguagagacgggguuu

SEQ ID NO: 988406 - RNA, 21 nt, Human
uuaguagagacgggguuucac

SEQ ID NO: 988407 - RNA, 21 nt, Human
uuaguagagacgggguuucac

SEQ ID NO: 988408 - RNA, 24 nt, Human
uuaguagagacgggguuucacugu

SEQ ID NO: 988409 - RNA, 19 nt, Human
uuaucuaauaguguuagaa

SEQ ID NO: 988410 - RNA, 21 nt, Human
uucaagcaaacuccagccacc

SEQ ID NO: 988411 - RNA, 24 nt, Human
uucaagcaaacuccagccacccac

SEQ ID NO: 988412 - RNA, 21 nt, Human
uucacuguguuagccaggaug

SEQ ID NO: 988413 - RNA, 21 nt, Human
uucuuacaauaagcaagaaaa

SEQ ID NO: 988414 - RNA, 20 nt, Human
uugcaagcagaaauuguauu

SEQ ID NO: 988415 - RNA, 21 nt, Human
uugcaagcagaaauuguauuu

SEQ ID NO: 988416 - RNA, 24 nt, Human
uuggcaagcccccaggaaaugaaa

SEQ ID NO: 988417 - RNA, 20 nt, Human
uugguuccaguuugauggac

SEQ ID NO: 988418 - RNA, 19 nt, Human
uuguauugugucucuaacc

SEQ ID NO: 988419 - RNA, 23 nt, Human
uuguauuuuuaguagagacgggg

SEQ ID NO: 988420 - RNA, 23 nt, Human
uugugcagugccucuaccggccu

SEQ ID NO: 988421 - RNA, 23 nt, Human
uuguuuagugaagccaaaagccu

SEQ ID NO: 988422 - RNA, 19 nt, Human
uuucacuguguuagccagg

SEQ ID NO: 988423 - RNA, 23 nt, Human
uuuguaucuucuaggcuacuggg

SEQ ID NO: 988424 - RNA, 24 nt, Human
uuuuuaguagagacgggguuucac

SEQ ID NO: 988425 - RNA, 20 nt, Human
uuuuuguauuuuuaguagag

SEQ ID NO: 988426 - RNA, 18 nt, Human
uuuuuuuuuuugaggcgg

SEQ ID NO: 988427 - RNA, 23 nt, Human
aaaaaaccaaacuaggccaggcg

SEQ ID NO: 988428 - RNA, 23 nt, Human
aaaaacaaaacaaaaacaaauca

SEQ ID NO: 988429 - RNA, 24 nt, Human
aaaaagaaaagaagcaugaaaaga

SEQ ID NO: 988430 - RNA, 24 nt, Human
aaaaagaaaagaagcaugaaaaga

SEQ ID NO: 988431 - RNA, 26 nt, Human
aaaaagaaaagaagcaugaaaagaca

SEQ ID NO: 988432 - RNA, 22 nt, Human
aaaacaaaacaaaaacaaauca

SEQ ID NO: 988433 - RNA, 28 nt, Human
aaaagaaaagaagcaugaaaagacaaaa

SEQ ID NO: 988434 - RNA, 28 nt, Human
aaaagaaaagaagcaugaaaagacaaaa

SEQ ID NO: 988435 - RNA, 21 nt, Human
aaaagaagcaugaaaagacaa

SEQ ID NO: 988436 - RNA, 22 nt, Human
aaaauaaaucacacaacaaugu

SEQ ID NO: 988437 - RNA, 22 nt, Human
aaacaaaacaaaaacaaaucaa

SEQ ID NO: 988438 - RNA, 26 nt, Human
aaagaaaagaagcaugaaaagacaaa

SEQ ID NO: 988439 - RNA, 26 nt, Human
aaagaaaagaagcaugaaaagacaaa

SEQ ID NO: 988440 - RNA, 21 nt, Human
aaauaaaucacacaacaaugu

SEQ ID NO: 988441 - RNA, 24 nt, Human
aacaaaaacaaaucaaaucaaucg

SEQ ID NO: 988442 - RNA, 20 nt, Human
aacacggugaaaccccgucu

SEQ ID NO: 988443 - RNA, 21 nt, Human
aacacggugaaaccccgucuc

SEQ ID NO: 988444 - RNA, 19 nt, Human
aaccccaucucggggacca

SEQ ID NO: 988445 - RNA, 19 nt, Human
aagaagcaugaaaagacaa

SEQ ID NO: 988446 - RNA, 19 nt, Human
aagaagcaugaaaagacaa

SEQ ID NO: 988447 - RNA, 23 nt, Human
aagagcccaguucagugucuggc

SEQ ID NO: 988448 - RNA, 24 nt, Human
aauggcaugaaccugggaggcgga

SEQ ID NO: 988449 - RNA, 21 nt, Human
acaaaacaaaaacaaaucaaa

SEQ ID NO: 988450 - RNA, 21 nt, Human
acagcccggggcgggaggcgg

SEQ ID NO: 988451 - RNA, 21 nt, Human
acagccuccaaggccaccccc

SEQ ID NO: 988452 - RNA, 24 nt, Human
acagugcgagacucccucucaaaa

SEQ ID NO: 988453 - RNA, 21 nt, Human
acauacccgguggacuggcca

SEQ ID NO: 988454 - RNA, 31 nt, Human
accaaacuaggccaggcgcaguggcucacgg

SEQ ID NO: 988455 - RNA, 24 nt, Human
accccgucucuacuaaaaauacaa

SEQ ID NO: 988456 - RNA, 18 nt, Human
acugcacuccagccuggg

SEQ ID NO: 988457 - RNA, 24 nt, Human
acugcacuccagccugggugacag

SEQ ID NO: 988458 - RNA, 22 nt, Human
acuuuggggauaaaaagaaaag

SEQ ID NO: 988459 - RNA, 22 nt, Human
acuuuggggauaaaaagaaaag

SEQ ID NO: 988460 - RNA, 20 nt, Human
agaaaagaagcaugaaaaga

SEQ ID NO: 988461 - RNA, 20 nt, Human
agaaaagaagcaugaaaaga

SEQ ID NO: 988462 - RNA, 18 nt, Human
agaagcaugaaaagacaa

SEQ ID NO: 988463 - RNA, 19 nt, Human
agaaguccuugaaggggag

SEQ ID NO: 988464 - RNA, 22 nt, Human
agacagggguaggggauuaggg

SEQ ID NO: 988465 - RNA, 20 nt, Human
agcccagcagggcuuccugu

SEQ ID NO: 988466 - RNA, 18 nt, Human
agccuacuggaguuugcc

SEQ ID NO: 988467 - RNA, 24 nt, Human
agccugggugacagugcgagacuc

SEQ ID NO: 988468 - RNA, 23 nt, Human
agcugggcgugguggugggugcc

SEQ ID NO: 988469 - RNA, 18 nt, Human
aggagcugcggguaggag

SEQ ID NO: 988470 - RNA, 22 nt, Human
aggcaggagaauggcaugaacc

SEQ ID NO: 988471 - RNA, 24 nt, Human
aggcaggagaauggcaugaaccug

SEQ ID NO: 988472 - RNA, 21 nt, Human
aggccgaggcggguggaucac

SEQ ID NO: 988473 - RNA, 24 nt, Human
aggcgcaguggcucacgccuguaa

SEQ ID NO: 988474 - RNA, 24 nt, Human
aggcggagcuugcagugagccgag

SEQ ID NO: 988475 - RNA, 24 nt, Human
aggcggguggaucacgaggucagg

SEQ ID NO: 988476 - RNA, 19 nt, Human
aggcugaggcaggagaaug

SEQ ID NO: 988477 - RNA, 24 nt, Human
aguggcucacgccuguaaucccgg

SEQ ID NO: 988478 - RNA, 24 nt, Human
aucaugccacugcacuccagccug

SEQ ID NO: 988479 - RNA, 22 nt, Human
augccacugcacuccagccugg

SEQ ID NO: 988480 - RNA, 24 nt, Human
auggggauccuguggagcucccug

SEQ ID NO: 988481 - RNA, 22 nt, Human
caacugauucuccugccucagc

SEQ ID NO: 988482 - RNA, 22 nt, Human
cacagcagucacuuuauucuua

SEQ ID NO: 988483 - RNA, 20 nt, Human
cacagccuccaaggccaccc

SEQ ID NO: 988484 - RNA, 20 nt, Human
cacgccuguaaucccggcac

SEQ ID NO: 988485 - RNA, 24 nt, Human
cacgccuguaaucccggcacuuug

SEQ ID NO: 988486 - RNA, 20 nt, Human
cacuccagccugggugacag

SEQ ID NO: 988487 - RNA, 21 nt, Human
cacuccagccugggugacagu

SEQ ID NO: 988488 - RNA, 22 nt, Human
cacuccagccugggugacagug

SEQ ID NO: 988489 - RNA, 21 nt, Human
cacugcaaccuccgccuccca

SEQ ID NO: 988490 - RNA, 19 nt, Human
cacugcacuccagccuggg

SEQ ID NO: 988491 - RNA, 19 nt, Human
cacugcacuccagccuggg

SEQ ID NO: 988492 - RNA, 22 nt, Human
cacugcacuccagccuggguga

SEQ ID NO: 988493 - RNA, 23 nt, Human
cacugcacuccagccugggugac

SEQ ID NO: 988494 - RNA, 24 nt, Human
cacugcacuccagccugggugaca

SEQ ID NO: 988495 - RNA, 24 nt, Human
cacugcacuccagccugggugaca

SEQ ID NO: 988496 - RNA, 20 nt, Human
cagaaacgaaguccccucca

SEQ ID NO: 988497 - RNA, 19 nt, Human
cagcagggcuuccuguguc

SEQ ID NO: 988498 - RNA, 24 nt, Human
cagcuacucaggaggcugaggcag

SEQ ID NO: 988499 - RNA, 21 nt, Human
caugaaccugggaggcggagc

SEQ ID NO: 988500 - RNA, 20 nt, Human
ccacugcacuccagccuggg

SEQ ID NO: 988501 - RNA, 20 nt, Human
ccacugcacuccagccuggg

SEQ ID NO: 988502 - RNA, 21 nt, Human
ccacugcacuccagccugggu

SEQ ID NO: 988503 - RNA, 21 nt, Human
ccacugcacuccagccugggu

SEQ ID NO: 988504 - RNA, 23 nt, Human
ccacugcacuccagccuggguga

SEQ ID NO: 988505 - RNA, 24 nt, Human
ccacugcacuccagccugggugac

SEQ ID NO: 988506 - RNA, 18 nt, Human
ccaggagcugcggguagg

SEQ ID NO: 988507 - RNA, 25 nt, Human
ccccaggggccgcgggagggggcgg

SEQ ID NO: 988508 - RNA, 19 nt, Human
cccccgcccccucuaccuc

SEQ ID NO: 988509 - RNA, 24 nt, Human
cccccgcccccucuaccuccucgc

SEQ ID NO: 988510 - RNA, 23 nt, Human
cccccgggacugugcauccugcu

SEQ ID NO: 988511 - RNA, 21 nt, Human
ccccgcccccucuaccuccuc

SEQ ID NO: 988512 - RNA, 18 nt, Human
ccccggggcacagcccgg

SEQ ID NO: 988513 - RNA, 21 nt, Human
ccccggggcacagcccggggc

SEQ ID NO: 988514 - RNA, 18 nt, Human
cccgcccccucuaccucc

SEQ ID NO: 988515 - RNA, 20 nt, Human
cccgcccccucuaccuccuc

SEQ ID NO: 988516 - RNA, 24 nt, Human
cccucucaaaaaaaaacaaaacaa

SEQ ID NO: 988517 - RNA, 18 nt, Human
ccgccucccagguucaac

SEQ ID NO: 988518 - RNA, 24 nt, Human
ccgccucccagguucaacugauuc

SEQ ID NO: 988519 - RNA, 24 nt, Human
ccgggggugggaagaaggugggcc

SEQ ID NO: 988520 - RNA, 24 nt, Human
ccucccagguucaacugauucucc

SEQ ID NO: 988521 - RNA, 22 nt, Human
ccucccuuccccuccccuaggc

SEQ ID NO: 988522 - RNA, 21 nt, Human
ccuccuacggccccaggggcu

SEQ ID NO: 988523 - RNA, 23 nt, Human
ccuggcuaacacggugaaacccc

SEQ ID NO: 988524 - RNA, 24 nt, Human
ccuggcuaacacggugaaaccccg

SEQ ID NO: 988525 - RNA, 22 nt, Human
ccugggugacagugcgagacuc

SEQ ID NO: 988526 - RNA, 19 nt, Human
ccuguaguaucagcuacuc

SEQ ID NO: 988527 - RNA, 20 nt, Human
ccuugaaggggagacagggg

SEQ ID NO: 988528 - RNA, 23 nt, Human
cgacccccgcccccucuaccucc

SEQ ID NO: 988529 - RNA, 24 nt, Human
cgagaccauccuggcuaacacggu

SEQ ID NO: 988530 - RNA, 23 nt, Human
cgagacucccucucaaaaaaaaa

SEQ ID NO: 988531 - RNA, 19 nt, Human
cgcccccucuaccuccucg

SEQ ID NO: 988532 - RNA, 18 nt, Human
cgccuguaaucccggcac

SEQ ID NO: 988533 - RNA, 23 nt, Human
cgccuguaaucccggcacuuugg

SEQ ID NO: 988534 - RNA, 24 nt, Human
cgccuguaaucccggcacuuuggg

SEQ ID NO: 988535 - RNA, 24 nt, Human
cggcacuuugggaggccgaggcgg

SEQ ID NO: 988536 - RNA, 19 nt, Human
cguaaauuuuuuuucuuuu

SEQ ID NO: 988537 - RNA, 19 nt, Human
cguaaauuuuuuuucuuuu

SEQ ID NO: 988538 - RNA, 19 nt, Human
cgucaagagcccaguucag

SEQ ID NO: 988539 - RNA, 23 nt, Human
cuagcccagcagggcuuccugug

SEQ ID NO: 988540 - RNA, 22 nt, Human
cucacgccuguaaucccggcac

SEQ ID NO: 988541 - RNA, 24 nt, Human
cucacgccuguaaucccggcacuu

SEQ ID NO: 988542 - RNA, 24 nt, Human
cucacugcaaccuccgccucccag

SEQ ID NO: 988543 - RNA, 19 nt, Human
cuccaaccccaucucgggg

SEQ ID NO: 988544 - RNA, 19 nt, Human
cucccucucaaaaaaaaac

SEQ ID NO: 988545 - RNA, 21 nt, Human
cuccgcgcugcaguuagcccc

SEQ ID NO: 988546 - RNA, 18 nt, Human
cucuuguugcccaggcug

SEQ ID NO: 988547 - RNA, 23 nt, Human
cugauucuccugccucagccucc

SEQ ID NO: 988548 - RNA, 24 nt, Human
cugauucuccugccucagccuccc

SEQ ID NO: 988549 - RNA, 23 nt, Human
cugcaaccuccgccucccagguu

SEQ ID NO: 988550 - RNA, 24 nt, Human
cugcaaccuccgccucccagguuc

SEQ ID NO: 988551 - RNA, 23 nt, Human
cugcggccuccuacggccccagg

SEQ ID NO: 988552 - RNA, 18 nt, Human
cuggcuaacacggugaaa

SEQ ID NO: 988553 - RNA, 24 nt, Human
cuugcagugagccgagaucaugcc

SEQ ID NO: 988554 - RNA, 21 nt, Human
gacccccgcccccucuaccuc

SEQ ID NO: 988555 - RNA, 23 nt, Human
gagaucaugccacugcacuccag

SEQ ID NO: 988556 - RNA, 18 nt, Human
gagcgccaggagcugcgg

SEQ ID NO: 988557 - RNA, 21 nt, Human
gagcucccugggauguucuga

SEQ ID NO: 988558 - RNA, 18 nt, Human
gagcuugcagugagccga

SEQ ID NO: 988559 - RNA, 22 nt, Human
gagcuugcagugagccgagauc

SEQ ID NO: 988560 - RNA, 23 nt, Human
gaggcggguggaucacgagguca

SEQ ID NO: 988561 - RNA, 21 nt, Human
gaggggaagaggaagacccag

SEQ ID NO: 988562 - RNA, 24 nt, Human
gauuagggagugggggaugguaaa

SEQ ID NO: 988563 - RNA, 23 nt, Human
gcacuuugggaggccgaggcggg

SEQ ID NO: 988564 - RNA, 19 nt, Human
gccacugcacuccagccug

SEQ ID NO: 988565 - RNA, 24 nt, Human
gccacugcacuccagccuggguga

SEQ ID NO: 988566 - RNA, 20 nt, Human
gccgagaucaugccacugca

SEQ ID NO: 988567 - RNA, 20 nt, Human
gcgcaguggcucacgccugu

SEQ ID NO: 988568 - RNA, 24 nt, Human
gcuaacacggugaaaccccgucuc

SEQ ID NO: 988569 - RNA, 30 nt, Human
gcuggaaugcaauggugcagucucagcucc

SEQ ID NO: 988570 - RNA, 19 nt, Human
ggagacagggguaggggau

SEQ ID NO: 988571 - RNA, 18 nt, Human
ggagcuugcagugagccg

SEQ ID NO: 988572 - RNA, 24 nt, Human
ggagcuugcagugagccgagauca

SEQ ID NO: 988573 - RNA, 18 nt, Human
ggauuggaaagccuguug

SEQ ID NO: 988574 - RNA, 19 nt, Human
gggccgcgggagggggcgg

SEQ ID NO: 988575 - RNA, 21 nt, Human
gguaaagaggggaagaggaag

SEQ ID NO: 988576 - RNA, 19 nt, Human
gguaggggauuagggagug

SEQ ID NO: 988577 - RNA, 21 nt, Human
gguggaucacgaggucaggag

SEQ ID NO: 988578 - RNA, 21 nt, Human
guucagugucuggcacagaag

SEQ ID NO: 988579 - RNA, 25 nt, Human
uaaaaccccugaaaggugacuagcc

SEQ ID NO: 988580 - RNA, 20 nt, Human
uaaacuguacacuuaaaaau

SEQ ID NO: 988581 - RNA, 20 nt, Human
uaaacuguacacuuaaaaau

SEQ ID NO: 988582 - RNA, 22 nt, Human
uaacacggugaaaccccgucuc

SEQ ID NO: 988583 - RNA, 24 nt, Human
uaacacggugaaaccccgucucua

SEQ ID NO: 988584 - RNA, 20 nt, Human
uaggaggggcgagagaaagg

SEQ ID NO: 988585 - RNA, 20 nt, Human
uaggccucaggcuagcccag

SEQ ID NO: 988586 - RNA, 19 nt, Human
uagugcgacccccgccccc

SEQ ID NO: 988587 - RNA, 23 nt, Human
ucaaaaaaaaacaaaacaaaaac

SEQ ID NO: 988588 - RNA, 24 nt, Human
ucaaaaaaaaacaaaacaaaaaca

SEQ ID NO: 988589 - RNA, 25 nt, Human
ucaacugauucuccugccucagccu

SEQ ID NO: 988590 - RNA, 18 nt, Human
ucacgaggucaggagauc

SEQ ID NO: 988591 - RNA, 24 nt, Human
ucacgaggucaggagaucgagacc

SEQ ID NO: 988592 - RNA, 22 nt, Human
ucacgccuguaaucccggcacu

SEQ ID NO: 988593 - RNA, 22 nt, Human
ucacucuuguugcccaggcugg

SEQ ID NO: 988594 - RNA, 23 nt, Human
ucacucuuguugcccaggcugga

SEQ ID NO: 988595 - RNA, 19 nt, Human
ucacugcaaccuccgccuc

SEQ ID NO: 988596 - RNA, 24 nt, Human
ucacugcaaccuccgccucccagg

SEQ ID NO: 988597 - RNA, 25 nt, Human
ucacugcaaccuccgccucccaggu

SEQ ID NO: 988598 - RNA, 27 nt, Human
ucacugcaaccuccgccucccagguuc

SEQ ID NO: 988599 - RNA, 27 nt, Human
ucagcucacugcaaccuccgccuccca

SEQ ID NO: 988600 - RNA, 22 nt, Human
ucaggcgagccccggggcacag

SEQ ID NO: 988601 - RNA, 23 nt, Human
ucaugccacugcacuccagccug

SEQ ID NO: 988602 - RNA, 23 nt, Human
uccagccugggugacagugcgag

SEQ ID NO: 988603 - RNA, 24 nt, Human
uccagccugggugacagugcgaga

SEQ ID NO: 988604 - RNA, 21 nt, Human
ucccagguucaacugauucuc

SEQ ID NO: 988605 - RNA, 24 nt, Human
ucccagguucaacugauucuccug

SEQ ID NO: 988606 - RNA, 18 nt, Human
ucgcugcggccuccuacg

SEQ ID NO: 988607 - RNA, 25 nt, Human
ucucaaaaaaaaacaaaacaaaaac

SEQ ID NO: 988608 - RNA, 26 nt, Human
ucucaaaaaaaaacaaaacaaaaaca

SEQ ID NO: 988609 - RNA, 26 nt, Human
ucucaaaaaaaaacaaaacaaaaaca

SEQ ID NO: 988610 - RNA, 19 nt, Human
ucuccugccucagccuccc

SEQ ID NO: 988611 - RNA, 22 nt, Human
ucucuacuaaaaauacaaaaaa

SEQ ID NO: 988612 - RNA, 19 nt, Human
ucucuagggacacccuagu

SEQ ID NO: 988613 - RNA, 22 nt, Human
ucuuguugcccaggcuggaaug

SEQ ID NO: 988614 - RNA, 20 nt, Human
ucuuucagauuuucugugug

SEQ ID NO: 988615 - RNA, 20 nt, Human
ucuuucagauuuucugugug

SEQ ID NO: 988616 - RNA, 22 nt, Human
ugaaaagacaaaaaauaaauca

SEQ ID NO: 988617 - RNA, 22 nt, Human
ugaaaagacaaaaaauaaauca

SEQ ID NO: 988618 - RNA, 20 nt, Human
ugaaaggugacuagccgugg

SEQ ID NO: 988619 - RNA, 21 nt, Human
ugaaaggugacuagccguggc

SEQ ID NO: 988620 - RNA, 21 nt, Human
ugagaugcaguuucacucuug

SEQ ID NO: 988621 - RNA, 21 nt, Human
ugagaugcaguuucacucuug

SEQ ID NO: 988622 - RNA, 22 nt, Human
ugagccgagaucaugccacugc

SEQ ID NO: 988623 - RNA, 23 nt, Human
ugaggcaggagaauggcaugaac

SEQ ID NO: 988624 - RNA, 24 nt, Human
ugaggcaggagaauggcaugaacc

SEQ ID NO: 988625 - RNA, 25 nt, Human
ugaggcaggagaauggcaugaaccu

SEQ ID NO: 988626 - RNA, 20 nt, Human
ugauucuccugccucagccu

SEQ ID NO: 988627 - RNA, 20 nt, Human
ugcaguugacgcgggggcgg

SEQ ID NO: 988628 - RNA, 21 nt, Human
ugcccaggcuggaaugcaaug

SEQ ID NO: 988629 - RNA, 18 nt, Human
ugccucagccucccaugg

SEQ ID NO: 988630 - RNA, 22 nt, Human
ugccuguaguaucagcuacuca

SEQ ID NO: 988631 - RNA, 24 nt, Human
ugccuguaguaucagcuacucagg

SEQ ID NO: 988632 - RNA, 19 nt, Human
ugcggguaggaggggcgag

SEQ ID NO: 988633 - RNA, 20 nt, Human
uggcucacgccuguaauccc

SEQ ID NO: 988634 - RNA, 24 nt, Human
uggcucacgccuguaaucccggca

SEQ ID NO: 988635 - RNA, 19 nt, Human
ugggaagaaggugggccuc

SEQ ID NO: 988636 - RNA, 23 nt, Human
ugggaggccgaggcggguggauc

SEQ ID NO: 988637 - RNA, 24 nt, Human
ugggaggccgaggcggguggauca

SEQ ID NO: 988638 - RNA, 29 nt, Human
ugggaggcggagcuugcagugacaacggu

SEQ ID NO: 988639 - RNA, 24 nt, Human
ugggaggcggagcuugcagugagc

SEQ ID NO: 988640 - RNA, 22 nt, Human
uggggauaaaaagaaaagaagc

SEQ ID NO: 988641 - RNA, 22 nt, Human
uggggauaaaaagaaaagaagc

SEQ ID NO: 988642 - RNA, 18 nt, Human
uggggugcggguggucgg

SEQ ID NO: 988643 - RNA, 25 nt, Human
uggguaacacuacuaaacuguacac

SEQ ID NO: 988644 - RNA, 25 nt, Human
uggguaacacuacuaaacuguacac

SEQ ID NO: 988645 - RNA, 20 nt, Human
ugguaaagaggggaagagga

SEQ ID NO: 988646 - RNA, 24 nt, Human
uggugcagucucagcucacugcaa

SEQ ID NO: 988647 - RNA, 18 nt, Human
ugguggugggugccugua

SEQ ID NO: 988648 - RNA, 23 nt, Human
uguaugauucuuucagauuuucu

SEQ ID NO: 988649 - RNA, 23 nt, Human
uguaugauucuuucagauuuucu

SEQ ID NO: 988650 - RNA, 18 nt, Human
ugugagcaaccgccccgg

SEQ ID NO: 988651 - RNA, 18 nt, Human
uguggaaucagaauuugu

SEQ ID NO: 988652 - RNA, 22 nt, Human
uguugcccaggcuggaaugcaa

SEQ ID NO: 988653 - RNA, 24 nt, Human
uuagcugggcgugguggugggugc

SEQ ID NO: 988654 - RNA, 18 nt, Human
uuagggagugggggaugg

SEQ ID NO: 988655 - RNA, 18 nt, Human
uucaacugauucuccugc

SEQ ID NO: 988656 - RNA, 23 nt, Human
uucaacugauucuccugccucag

SEQ ID NO: 988657 - RNA, 24 nt, Human
uucacucuuguugcccaggcugga

SEQ ID NO: 988658 - RNA, 20 nt, Human
uugaaggggagacaggggua

SEQ ID NO: 988659 - RNA, 18 nt, Human
uugcagugagccgagauc

SEQ ID NO: 988660 - RNA, 20 nt, Human
uugcagugagccgagaucau

SEQ ID NO: 988661 - RNA, 21 nt, Human
uugcagugagccgagaucaug

SEQ ID NO: 988662 - RNA, 18 nt, Human
uugcccaggcuggaaugc

SEQ ID NO: 988663 - RNA, 19 nt, Human
uuggcggccgagaucuccg

SEQ ID NO: 988664 - RNA, 23 nt, Human
uuggcggccgagaucuccgcgcu

SEQ ID NO: 988665 - RNA, 23 nt, Human
uugggacauacccgguggacugg

SEQ ID NO: 988666 - RNA, 25 nt, Human
uugggaggccgaggcggguggauca

SEQ ID NO: 988667 - RNA, 24 nt, Human
uuucacucuuguugcccaggcugg

SEQ ID NO: 988668 - RNA, 18 nt, Human
uuuuucuuuuuuuuuuug

SEQ ID NO: 988669 - RNA, 18 nt, Human
uuuuucuuuuuuuuuuug

SEQ ID NO: 988670 - RNA, 19 nt, Human
uuuuuucuuuuuuuuuuug

SEQ ID NO: 988671 - RNA, 23 nt, Human
uuuuuucuuuuuuuuuuugagau

SEQ ID NO: 988672 - RNA, 21 nt, Human
uuuuuuuuuuuuuuaggugga

SEQ ID NO: 988673 - RNA, 21 nt, Human
uuuuuuuuuuuuuuuuuuagg

SEQ ID NO: 988674 - RNA, 21 nt, Human
aaaauaaaggcugaaaacuuu

SEQ ID NO: 988675 - RNA, 20 nt, Human
acccuaaaaucaaaggcaua

SEQ ID NO: 988676 - RNA, 23 nt, Human
caaaggcauaaaaauaaaggcug

SEQ ID NO: 988677 - RNA, 27 nt, Human
caaaggcauaaaaauaaaggcugaaaa

SEQ ID NO: 988678 - RNA, 23 nt, Human
caauaucacccuaaaaucaaagg

SEQ ID NO: 988679 - RNA, 24 nt, Human
caggcaauuacaugcaccaauauc

SEQ ID NO: 988680 - RNA, 22 nt, Human
cauaccuaacacauuaaauacu

SEQ ID NO: 988681 - RNA, 26 nt, Human
gcugaaaacuuuguguuucuccaucu

SEQ ID NO: 988682 - RNA, 18 nt, Human
uaaaaucaaaggcauaaa

SEQ ID NO: 988683 - RNA, 18 nt, Human
uaaaaucaaaggcauaaa

SEQ ID NO: 988684 - RNA, 20 nt, Human
uaacacauuaaauacuacuu

SEQ ID NO: 988685 - RNA, 24 nt, Human
uacuuuagaaaauauacaauuauu

SEQ ID NO: 988686 - RNA, 27 nt, Human
uacuuuauccuuuaaauagucaaaagu

SEQ ID NO: 988687 - RNA, 18 nt, Human
uaucacccuaaaaucaaa

SEQ ID NO: 988688 - RNA, 22 nt, Human
ucacccuaaaaucaaaggcaua

SEQ ID NO: 988689 - RNA, 22 nt, Human
uccccagaugguaauuuucgga

SEQ ID NO: 988690 - RNA, 21 nt, Human
uuauauaugguuuccccagau

SEQ ID NO: 988691 - RNA, 24 nt, Human
uuauguguggucauuaaaacccag

SEQ ID NO: 988692 - RNA, 22 nt, Human
cuauacauauauaugcaguauu

SEQ ID NO: 988693 - RNA, 28 nt, Human
gcgcagcuuccgggaaagggggaacgcc

SEQ ID NO: 988694 - RNA, 21 nt, Human
uaagcacacuugauauauaug

SEQ ID NO: 988695 - RNA, 21 nt, Human
uauacauauauaugcaguauu

SEQ ID NO: 988696 - RNA, 26 nt, Human
uaugugucagagucuauacauauaua

SEQ ID NO: 988697 - RNA, 28 nt, Human
uaugugucagagucuauacauauauaug

SEQ ID NO: 988698 - RNA, 19 nt, Human
ucaaaugaagcucaccugc

SEQ ID NO: 988699 - RNA, 23 nt, Human
uccacagccgggacccguuaccc

SEQ ID NO: 988700 - RNA, 21 nt, Human
uccagaaaguuucuauuucau

SEQ ID NO: 988701 - RNA, 21 nt, Human
uccagaaaguuucuauuucau

SEQ ID NO: 988702 - RNA, 25 nt, Human
uggagaagcuuccggccggaaacgc

SEQ ID NO: 988703 - RNA, 23 nt, Human
uuccacagccgggacccguuacc

SEQ ID NO: 988704 - RNA, 23 nt, Human
uuuccagaaaguuucuauuucau

SEQ ID NO: 988705 - RNA, 20 nt, Human
uuuucuaagcacacuugaua

SEQ ID NO: 988706 - RNA, 19 nt, Human
aaagcacauggaaaauuca

SEQ ID NO: 988707 - RNA, 22 nt, Human
aacaaaacaaaaaaacuuauaa

SEQ ID NO: 988708 - RNA, 21 nt, Human
aacauccaccaaaggcuuuca

SEQ ID NO: 988709 - RNA, 26 nt, Human
aaccucgcuccuucgacuagcuccua

SEQ ID NO: 988710 - RNA, 21 nt, Human
aagaguacuguagaaaagcca

SEQ ID NO: 988711 - RNA, 24 nt, Human
aagcacauggaaaauucagaaaua

SEQ ID NO: 988712 - RNA, 22 nt, Human
aagccacugucuuuucaguagu

SEQ ID NO: 988713 - RNA, 23 nt, Human
aagcuaccauccgccgacaucuu

SEQ ID NO: 988714 - RNA, 22 nt, Human
aauucuucacagaggacaaagc

SEQ ID NO: 988715 - RNA, 26 nt, Human
acagcggaugaaauaguuuauccaga

SEQ ID NO: 988716 - RNA, 21 nt, Human
agaaauaaaaacacaccacca

SEQ ID NO: 988717 - RNA, 21 nt, Human
agucuuuggcaccucacacuc

SEQ ID NO: 988718 - RNA, 23 nt, Human
auaauucuucacagaggacaaag

SEQ ID NO: 988719 - RNA, 18 nt, Human
auccuuuccccccucccu

SEQ ID NO: 988720 - RNA, 24 nt, Human
caaaacaaaaaaacuuauaauuua

SEQ ID NO: 988721 - RNA, 21 nt, Human
caagggcucgaagcuaccauc

SEQ ID NO: 988722 - RNA, 24 nt, Human
caccaccauauaaagaaaucaaaa

SEQ ID NO: 988723 - RNA, 21 nt, Human
caccauauaaagaaaucaaaa

SEQ ID NO: 988724 - RNA, 21 nt, Human
caccucacacucuccacuccc

SEQ ID NO: 988725 - RNA, 22 nt, Human
cacugucuuuucaguaguucca

SEQ ID NO: 988726 - RNA, 19 nt, Human
cauaacauccaccaaaggc

SEQ ID NO: 988727 - RNA, 22 nt, Human
caucuugauuugaaaauaauuu

SEQ ID NO: 988728 - RNA, 19 nt, Human
ccagaacuacaaaacacau

SEQ ID NO: 988729 - RNA, 23 nt, Human
ccagaacuacaaaacacauuuuc

SEQ ID NO: 988730 - RNA, 21 nt, Human
ccccccucccuuuuauaauuc

SEQ ID NO: 988731 - RNA, 19 nt, Human
cccgccucaaccucgcucc

SEQ ID NO: 988732 - RNA, 25 nt, Human
cccgccucaaccucgcuccuucgac

SEQ ID NO: 988733 - RNA, 20 nt, Human
ccucacacucuccacucccc

SEQ ID NO: 988734 - RNA, 23 nt, Human
cgccucaaccucgcuccuucgac

SEQ ID NO: 988735 - RNA, 20 nt, Human
cuaauuagaucccaacugua

SEQ ID NO: 988736 - RNA, 20 nt, Human
cuagucuuuggcaccucaca

SEQ ID NO: 988737 - RNA, 22 nt, Human
cuccccugcgguccccaaguca

SEQ ID NO: 988738 - RNA, 23 nt, Human
cucuccacuccccugcggucccc

SEQ ID NO: 988739 - RNA, 21 nt, Human
cuuuggcaccucacacucucc

SEQ ID NO: 988740 - RNA, 22 nt, Human
gaaaacaaaacaaaaaaacuua

SEQ ID NO: 988741 - RNA, 23 nt, Human
gaacagauauaaaaaauauucuu

SEQ ID NO: 988742 - RNA, 23 nt, Human
gccaaauugucuauuuccagguu

SEQ ID NO: 988743 - RNA, 21 nt, Human
gguugcaccacagauuuggca

SEQ ID NO: 988744 - RNA, 22 nt, Human
guuuuuaaaugcuuaugguaug

SEQ ID NO: 988745 - RNA, 28 nt, Human
uaaaaaagaauugcuuccccaaaucuca

SEQ ID NO: 988746 - RNA, 22 nt, Human
uaaacaaauauuaaagcacaug

SEQ ID NO: 988747 - RNA, 25 nt, Human
uaacauaaaucaaaugcuuagaacu

SEQ ID NO: 988748 - RNA, 23 nt, Human
uaauuagaucccaacuguauaaa

SEQ ID NO: 988749 - RNA, 21 nt, Human
uagaaauaauuuuggaaacag

SEQ ID NO: 988750 - RNA, 22 nt, Human
uauccagaacuacaaaacacau

SEQ ID NO: 988751 - RNA, 18 nt, Human
ucacacucuccacucccc

SEQ ID NO: 988752 - RNA, 19 nt, Human
ucacuggagauagugguug

SEQ ID NO: 988753 - RNA, 23 nt, Human
ucagaaauaaaaacacaccacca

SEQ ID NO: 988754 - RNA, 19 nt, Human
ucaguaguuccaaauggug

SEQ ID NO: 988755 - RNA, 24 nt, Human
uccccaagucacgucucgcagcug

SEQ ID NO: 988756 - RNA, 21 nt, Human
ucgcugcccgccucaaccucg

SEQ ID NO: 988757 - RNA, 21 nt, Human
ugcccaggugagcgaccugac

SEQ ID NO: 988758 - RNA, 23 nt, Human
uggaaaacaaaacaaaaaaacuu

SEQ ID NO: 988759 - RNA, 24 nt, Human
uggaaaacaaaacaaaaaaacuua

SEQ ID NO: 988760 - RNA, 19 nt, Human
ugucacagagaugcuccuc

SEQ ID NO: 988761 - RNA, 21 nt, Human
uucagaaauaaaaacacacca

SEQ ID NO: 988762 - RNA, 21 nt, Human
uuccccccucccuuuuauaau

SEQ ID NO: 988763 - RNA, 24 nt, Human
uuccuaauuagaucccaacuguau

SEQ ID NO: 988764 - RNA, 21 nt, Human
uucuuuguucauaaauucuga

SEQ ID NO: 988765 - RNA, 21 nt, Human
uuugccccauaacauccacca

SEQ ID NO: 988766 - RNA, 22 nt, Human
aaaaaaaauccugguucucugu

SEQ ID NO: 988767 - RNA, 22 nt, Human
aaaaagccacaccucugaaugg

SEQ ID NO: 988768 - RNA, 21 nt, Human
aacaauaauuaaaaaaaaucc

SEQ ID NO: 988769 - RNA, 21 nt, Human
aagccacaccucugaaugguc

SEQ ID NO: 988770 - RNA, 22 nt, Human
aaggauugcaacuggaggcuuu

SEQ ID NO: 988771 - RNA, 23 nt, Human
aauaacucuuuucagaaaacaga

SEQ ID NO: 988772 - RNA, 24 nt, Human
aaucugucacccgaaauuucccuu

SEQ ID NO: 988773 - RNA, 22 nt, Human
aaugagggcccaggagagaggg

SEQ ID NO: 988774 - RNA, 24 nt, Human
acccacccacccacuuccagaaac

SEQ ID NO: 988775 - RNA, 19 nt, Human
acgauuuguuucacaaagu

SEQ ID NO: 988776 - RNA, 24 nt, Human
acguggaaaaagccacaccucuga

SEQ ID NO: 988777 - RNA, 24 nt, Human
agacaggaaggugcucgcaugcgg

SEQ ID NO: 988778 - RNA, 18 nt, Human
agacguggaaaaagccac

SEQ ID NO: 988779 - RNA, 24 nt, Human
agcagagaaggugcccucugccag

SEQ ID NO: 988780 - RNA, 18 nt, Human
aggagaaaaagacgugga

SEQ ID NO: 988781 - RNA, 21 nt, Human
aggagaaaaagacguggaaaa

SEQ ID NO: 988782 - RNA, 22 nt, Human
agugaagggggaccugcccgga

SEQ ID NO: 988783 - RNA, 28 nt, Human
caaaaccagugccaggagucaaaccugg

SEQ ID NO: 988784 - RNA, 23 nt, Human
caccaucacugcaggagcccaaa

SEQ ID NO: 988785 - RNA, 24 nt, Human
cacucuaauucuugaucacucauc

SEQ ID NO: 988786 - RNA, 22 nt, Human
cagcucauugaaggauugcaac

SEQ ID NO: 988787 - RNA, 22 nt, Human
caggagagaggggaggaggggg

SEQ ID NO: 988788 - RNA, 19 nt, Human
cagggcacucuaauucuug

SEQ ID NO: 988789 - RNA, 22 nt, Human
cagugccaggagucaaaccuga

SEQ ID NO: 988790 - RNA, 21 nt, Human
caucauugccucucuccuguu

SEQ ID NO: 988791 - RNA, 21 nt, Human
ccaaguaucaaaaccagugcc

SEQ ID NO: 988792 - RNA, 19 nt, Human
ccacccacccacuuccaga

SEQ ID NO: 988793 - RNA, 19 nt, Human
ccaggaucaugcccucccc

SEQ ID NO: 988794 - RNA, 21 nt, Human
ccaggaucaugcccuccccuu

SEQ ID NO: 988795 - RNA, 25 nt, Human
ccaggaucaugcccuccccuuuccu

SEQ ID NO: 988796 - RNA, 22 nt, Human
ccaggcggcuccggcucccccc

SEQ ID NO: 988797 - RNA, 22 nt, Human
ccaguccguuccaacaaaguua

SEQ ID NO: 988798 - RNA, 18 nt, Human
cccaaccuuggccuucga

SEQ ID NO: 988799 - RNA, 21 nt, Human
cccaaccuuggccuucgacac

SEQ ID NO: 988800 - RNA, 22 nt, Human
cccaauacacugugcuaccaaa

SEQ ID NO: 988801 - RNA, 19 nt, Human
cccacccacccacuuccag

SEQ ID NO: 988802 - RNA, 21 nt, Human
cccacccacccacuuccagaa

SEQ ID NO: 988803 - RNA, 22 nt, Human
cccacccacccacuuccagaaa

SEQ ID NO: 988804 - RNA, 19 nt, Human
ccccaaccuuggccuucga

SEQ ID NO: 988805 - RNA, 19 nt, Human
ccccgccgccgccgccucc

SEQ ID NO: 988806 - RNA, 21 nt, Human
ccccgccgccgccgccuccgg

SEQ ID NO: 988807 - RNA, 22 nt, Human
ccccgccgccgccgccuccggg

SEQ ID NO: 988808 - RNA, 20 nt, Human
cccgaaauuucccuuucucc

SEQ ID NO: 988809 - RNA, 23 nt, Human
cccucuaaccaaaccuagccccc

SEQ ID NO: 988810 - RNA, 22 nt, Human
cccugcggcgccacuucuccug

SEQ ID NO: 988811 - RNA, 18 nt, Human
ccgccgccgccgccuccg

SEQ ID NO: 988812 - RNA, 18 nt, Human
ccgccgccuccgggaucg

SEQ ID NO: 988813 - RNA, 24 nt, Human
ccgccuccgggaucggguugcuuc

SEQ ID NO: 988814 - RNA, 20 nt, Human
ccgccuccgucgucucugcc

SEQ ID NO: 988815 - RNA, 21 nt, Human
ccucccaccugagggcuggac

SEQ ID NO: 988816 - RNA, 18 nt, Human
ccuccgucgucucugccg

SEQ ID NO: 988817 - RNA, 19 nt, Human
ccuccgucgucucugccgc

SEQ ID NO: 988818 - RNA, 19 nt, Human
ccucuaaccaaaccuagcc

SEQ ID NO: 988819 - RNA, 25 nt, Human
ccucugaauggucauucagaaauuc

SEQ ID NO: 988820 - RNA, 25 nt, Human
cgaggucacggcagagucuccauga

SEQ ID NO: 988821 - RNA, 24 nt, Human
cucaaucaaacccacccacccacu

SEQ ID NO: 988822 - RNA, 21 nt, Human
cuccugagggugcucuacagc

SEQ ID NO: 988823 - RNA, 20 nt, Human
cucuaaccaaaccuagcccc

SEQ ID NO: 988824 - RNA, 22 nt, Human
cucucuccuguuccccucccca

SEQ ID NO: 988825 - RNA, 18 nt, Human
cugcggcgccacuucucc

SEQ ID NO: 988826 - RNA, 20 nt, Human
gaaaaagccacaccucugaa

SEQ ID NO: 988827 - RNA, 20 nt, Human
gagaggggaggagggggcuc

SEQ ID NO: 988828 - RNA, 20 nt, Human
gagcaguucauugcaggaga

SEQ ID NO: 988829 - RNA, 22 nt, Human
gagcauaguuugauaugcgugc

SEQ ID NO: 988830 - RNA, 18 nt, Human
gcgugaccccugcggcgc

SEQ ID NO: 988831 - RNA, 21 nt, Human
ggaucggguugcuuccgccuc

SEQ ID NO: 988832 - RNA, 23 nt, Human
ggccuucgacacuggggggcugg

SEQ ID NO: 988833 - RNA, 23 nt, Human
guucucaaucaaacccacccacc

SEQ ID NO: 988834 - RNA, 19 nt, Human
uaacucuuuucagaaaaca

SEQ ID NO: 988835 - RNA, 24 nt, Human
uacacugugcuaccaaauucucug

SEQ ID NO: 988836 - RNA, 19 nt, Human
uaccaaauucucugaauuc

SEQ ID NO: 988837 - RNA, 25 nt, Human
ucaaacccacccacccacuuccaga

SEQ ID NO: 988838 - RNA, 20 nt, Human
ucaaucaaacccacccaccc

SEQ ID NO: 988839 - RNA, 23 nt, Human
ucagauggugaaaaugagagaca

SEQ ID NO: 988840 - RNA, 25 nt, Human
ucagauggugaaaaugagagacagg

SEQ ID NO: 988841 - RNA, 22 nt, Human
ucagccagggugaucaaucugu

SEQ ID NO: 988842 - RNA, 23 nt, Human
ucaugcccuccccuuuccucauu

SEQ ID NO: 988843 - RNA, 27 nt, Human
uccccccgccgccgccgccuccgggau

SEQ ID NO: 988844 - RNA, 18 nt, Human
ucccucugccaacaagga

SEQ ID NO: 988845 - RNA, 19 nt, Human
uccucauucccgccccaca

SEQ ID NO: 988846 - RNA, 22 nt, Human
uccuguuccccuccccaaccuu

SEQ ID NO: 988847 - RNA, 24 nt, Human
ucuacagccgcccucuaaccaaac

SEQ ID NO: 988848 - RNA, 22 nt, Human
ucuaucuuguuacuuauuacuc

SEQ ID NO: 988849 - RNA, 23 nt, Human
ucucaaucaaacccacccaccca

SEQ ID NO: 988850 - RNA, 23 nt, Human
ucucuccuguuccccuccccaac

SEQ ID NO: 988851 - RNA, 27 nt, Human
ucuguaauuacggaaaaggaaagacua

SEQ ID NO: 988852 - RNA, 21 nt, Human
ugaaagauuaaaagcagagaa

SEQ ID NO: 988853 - RNA, 21 nt, Human
ugcguacauacuuacgauuug

SEQ ID NO: 988854 - RNA, 21 nt, Human
ugcgugaccccugcggcgcca

SEQ ID NO: 988855 - RNA, 28 nt, Human
uggaaaaagccacaccucugaauggugg

SEQ ID NO: 988856 - RNA, 23 nt, Human
uucucugaauucccugaaccuca

SEQ ID NO: 988857 - RNA, 21 nt, Human
uuuuccacaaauuagaacuug

SEQ ID NO: 988858 - RNA, 18 nt, Human
uuuuuuuuuuuuuuuuug

SEQ ID NO: 988859 - RNA, 19 nt, Human
cacucacgagcucacacuc

SEQ ID NO: 988860 - RNA, 18 nt, Human
cggcggcgggggcggugg

SEQ ID NO: 988861 - RNA, 24 nt, Human
gcggcgggggcgguggcggcggcg

SEQ ID NO: 988862 - RNA, 23 nt, Human
ggcggcgggggcgguggcggcgg

SEQ ID NO: 988863 - RNA, 24 nt, Human
gggcgguggcggcggcgcccacuc

SEQ ID NO: 988864 - RNA, 22 nt, Human
uuacaaggaacgaaggggccac

SEQ ID NO: 988865 - RNA, 23 nt, Human
aaaacagguguguuuauauucuc

SEQ ID NO: 988866 - RNA, 26 nt, Human
aaacaaauacauccaaaaaggguuuc

SEQ ID NO: 988867 - RNA, 22 nt, Human
aaacagguguguuuauauucuc

SEQ ID NO: 988868 - RNA, 20 nt, Human
aaagaaacaaauacauccaa

SEQ ID NO: 988869 - RNA, 20 nt, Human
aacaagcuaauaugaucuga

SEQ ID NO: 988870 - RNA, 20 nt, Human
aaccuaggccuucugacuug

SEQ ID NO: 988871 - RNA, 20 nt, Human
aacugacccaaaacuaccug

SEQ ID NO: 988872 - RNA, 24 nt, Human
aagcucaaauuuuuauuaaccuug

SEQ ID NO: 988873 - RNA, 23 nt, Human
aaugaaugggaucuagaaaggga

SEQ ID NO: 988874 - RNA, 23 nt, Human
accaauugaacccucacaacagc

SEQ ID NO: 988875 - RNA, 21 nt, Human
acugaaaaacacuaaaacuga

SEQ ID NO: 988876 - RNA, 19 nt, Human
agaaacaaauacauccaaa

SEQ ID NO: 988877 - RNA, 20 nt, Human
agagaaacaagccuaugggg

SEQ ID NO: 988878 - RNA, 19 nt, Human
agaggagagcucgcgggcu

SEQ ID NO: 988879 - RNA, 21 nt, Human
agcauuuuacaauucugaaag

SEQ ID NO: 988880 - RNA, 24 nt, Human
aggcagaaaagugucucaaaaaca

SEQ ID NO: 988881 - RNA, 19 nt, Human
agggguaaaacccaacugc

SEQ ID NO: 988882 - RNA, 20 nt, Human
aggugcagaaaaugaauggg

SEQ ID NO: 988883 - RNA, 18 nt, Human
agguguguuuauauucuc

SEQ ID NO: 988884 - RNA, 18 nt, Human
aguauacugggcucaaaa

SEQ ID NO: 988885 - RNA, 20 nt, Human
agugaggagaacaaggcuaa

SEQ ID NO: 988886 - RNA, 22 nt, Human
agugaggagaacaaggcuaaga

SEQ ID NO: 988887 - RNA, 23 nt, Human
auagcaauggagagaaacaagcc

SEQ ID NO: 988888 - RNA, 23 nt, Human
caaaagcacaguaaagcuuaaca

SEQ ID NO: 988889 - RNA, 18 nt, Human
caaaaguauguugaacuu

SEQ ID NO: 988890 - RNA, 21 nt, Human
caagcagcagugaucaaaaca

SEQ ID NO: 988891 - RNA, 19 nt, Human
cacacaguugguaaaugau

SEQ ID NO: 988892 - RNA, 25 nt, Human
cacauauaccaauugaacccucaca

SEQ ID NO: 988893 - RNA, 20 nt, Human
caguauacugggcucaaaac

SEQ ID NO: 988894 - RNA, 21 nt, Human
cauaaaaacuaagggguaaaa

SEQ ID NO: 988895 - RNA, 22 nt, Human
cccaaaacuaccugucaaaagc

SEQ ID NO: 988896 - RNA, 20 nt, Human
ccucagcaacaagcuaauau

SEQ ID NO: 988897 - RNA, 21 nt, Human
cgaaaaauacugcagcuacau

SEQ ID NO: 988898 - RNA, 28 nt, Human
cgggcuccucgcucaggcuccaccccuu

SEQ ID NO: 988899 - RNA, 27 nt, Human
cucuccucuaaauccauccuuuccaaa

SEQ ID NO: 988900 - RNA, 24 nt, Human
cugugagguaggcaggguaggugu

SEQ ID NO: 988901 - RNA, 20 nt, Human
cuguuuugaggauccuuggc

SEQ ID NO: 988902 - RNA, 19 nt, Human
cuuacagucauauagcauu

SEQ ID NO: 988903 - RNA, 19 nt, Human
cuuacagucauauagcauu

SEQ ID NO: 988904 - RNA, 18 nt, Human
cuuguucuucagugguuu

SEQ ID NO: 988905 - RNA, 19 nt, Human
gaacaaaugcaauaauucc

SEQ ID NO: 988906 - RNA, 19 nt, Human
gaauauaacugacccaaaa

SEQ ID NO: 988907 - RNA, 20 nt, Human
ggaugaaccauuagugucuu

SEQ ID NO: 988908 - RNA, 23 nt, Human
ggcuguagaaucugaaacuuaaa

SEQ ID NO: 988909 - RNA, 20 nt, Human
gguaaaaaggaacacuuguu

SEQ ID NO: 988910 - RNA, 20 nt, Human
gugaaaaacagcaaaugcaa

SEQ ID NO: 988911 - RNA, 22 nt, Human
guugaguuuggaaguuaaggaa

SEQ ID NO: 988912 - RNA, 22 nt, Human
uaaaauuccagguauggccuuc

SEQ ID NO: 988913 - RNA, 18 nt, Human
uaaauccauccuuuccaa

SEQ ID NO: 988914 - RNA, 23 nt, Human
uaacaggcauaaaaacuaagggg

SEQ ID NO: 988915 - RNA, 20 nt, Human
uaagaaaaacaaaacaggug

SEQ ID NO: 988916 - RNA, 21 nt, Human
uacugcagcuacauuucaguc

SEQ ID NO: 988917 - RNA, 23 nt, Human
uagaaggcagaaaagugucucaa

SEQ ID NO: 988918 - RNA, 25 nt, Human
uauacugggcucaaaaccaacuuuc

SEQ ID NO: 988919 - RNA, 25 nt, Human
ucaaaagcuuugccaucuuucccaa

SEQ ID NO: 988920 - RNA, 22 nt, Human
ucaaguaauaauauccuaugcu

SEQ ID NO: 988921 - RNA, 23 nt, Human
ucgcgggcuccucgcucaggcuc

SEQ ID NO: 988922 - RNA, 18 nt, Human
ugaacccucacaacagcc

SEQ ID NO: 988923 - RNA, 19 nt, Human
ugaacccucacaacagccc

SEQ ID NO: 988924 - RNA, 20 nt, Human
ugaaguaaggucacacaguu

SEQ ID NO: 988925 - RNA, 23 nt, Human
ugaauauaacugacccaaaacua

SEQ ID NO: 988926 - RNA, 20 nt, Human
ugaaugggaucuagaaaggg

SEQ ID NO: 988927 - RNA, 24 nt, Human
ugacgaaaaauacugcagcuacau

SEQ ID NO: 988928 - RNA, 18 nt, Human
ugagguaggcaggguagg

SEQ ID NO: 988929 - RNA, 21 nt, Human
ugaguuuggaaguuaaggaag

SEQ ID NO: 988930 - RNA, 18 nt, Human
ugcagaaaaugaauggga

SEQ ID NO: 988931 - RNA, 23 nt, Human
ugccuagguccaguguaauuacu

SEQ ID NO: 988932 - RNA, 20 nt, Human
ugcuagugaggagaacaagg

SEQ ID NO: 988933 - RNA, 23 nt, Human
uggaaaacagggaaagguguuca

SEQ ID NO: 988934 - RNA, 21 nt, Human
uggaagaguuaucaacuugga

SEQ ID NO: 988935 - RNA, 23 nt, Human
ugucaaagauaaaucugcugacu

SEQ ID NO: 988936 - RNA, 18 nt, Human
uuaaagugaaucacgaaa

SEQ ID NO: 988937 - RNA, 22 nt, Human
uuaacugacgaaaaauacugca

SEQ ID NO: 988938 - RNA, 23 nt, Human
uucacauauaccaauugaacccu

SEQ ID NO: 988939 - RNA, 22 nt, Human
uuucacauauaccaauugaacc

SEQ ID NO: 988940 - RNA, 23 nt, Human
uuucagguuugauccugucuuau

SEQ ID NO: 988941 - RNA, 19 nt, Human
uuuuuuuuuuuuuuuuuaa

SEQ ID NO: 988942 - RNA, 19 nt, Human
aaacagcacaacucucugc

SEQ ID NO: 988943 - RNA, 19 nt, Human
aaacagcauaacucucugc

SEQ ID NO: 988944 - RNA, 22 nt, Human
aaagaacaucaugggcugucac

SEQ ID NO: 988945 - RNA, 22 nt, Human
aagaaugggagaaacagcacaa

SEQ ID NO: 988946 - RNA, 21 nt, Human
aagaaugggagaaacagcaua

SEQ ID NO: 988947 - RNA, 20 nt, Human
aaggacacguugaaguguuu

SEQ ID NO: 988948 - RNA, 23 nt, Human
acagagaccggaaagaacaucau

SEQ ID NO: 988949 - RNA, 19 nt, Human
acucuguuccuugcagucu

SEQ ID NO: 988950 - RNA, 22 nt, Human
acucuguuccuugcagucuguu

SEQ ID NO: 988951 - RNA, 20 nt, Human
agaguucuuuuacauccggu

SEQ ID NO: 988952 - RNA, 20 nt, Human
agaguucuuuuacauccggu

SEQ ID NO: 988953 - RNA, 18 nt, Human
agauagcacaagcuaugg

SEQ ID NO: 988954 - RNA, 24 nt, Human
agccagaguucuuuuacauccggu

SEQ ID NO: 988955 - RNA, 24 nt, Human
agccagaguucuuuuacauccggu

SEQ ID NO: 988956 - RNA, 21 nt, Human
agccagccagacacuggagag

SEQ ID NO: 988957 - RNA, 24 nt, Human
agugccccaggaagcaaggaacag

SEQ ID NO: 988958 - RNA, 20 nt, Human
aguucuuuacaagucucaua

SEQ ID NO: 988959 - RNA, 28 nt, Human
cacaaauccagguacacagagacuaucu

SEQ ID NO: 988960 - RNA, 22 nt, Human
cacauuaaaaaagcgaagauaa

SEQ ID NO: 988961 - RNA, 22 nt, Human
ccagaagacacggauuuauuca

SEQ ID NO: 988962 - RNA, 23 nt, Human
ccccaggaagcaaggaacagcag

SEQ ID NO: 988963 - RNA, 21 nt, Human
cucucugcuccuucuagucca

SEQ ID NO: 988964 - RNA, 21 nt, Human
cucucugcuccuucuagucca

SEQ ID NO: 988965 - RNA, 21 nt, Human
cuguuucuuucuucuauggug

SEQ ID NO: 988966 - RNA, 21 nt, Human
gaagcauuuuauugccuggac

SEQ ID NO: 988967 - RNA, 19 nt, Human
gacauuugaggccacauua

SEQ ID NO: 988968 - RNA, 21 nt, Human
ggacuuggcaaacagauggug

SEQ ID NO: 988969 - RNA, 19 nt, Human
ggagagagagagaccgagc

SEQ ID NO: 988970 - RNA, 19 nt, Human
ggagagagagagaccgagc

SEQ ID NO: 988971 - RNA, 18 nt, Human
ggagccagccagacacug

SEQ ID NO: 988972 - RNA, 24 nt, Human
gugccccaggaagcaaggaacagc

SEQ ID NO: 988973 - RNA, 18 nt, Human
guugaaguguuuuucaug

SEQ ID NO: 988974 - RNA, 19 nt, Human
uaauacauuuucauuaauc

SEQ ID NO: 988975 - RNA, 27 nt, Human
uauccucacugaggagggcuuuccaca

SEQ ID NO: 988976 - RNA, 22 nt, Human
ucacugcaaguucaaaacgugu

SEQ ID NO: 988977 - RNA, 20 nt, Human
ucaguuggagacauucugaa

SEQ ID NO: 988978 - RNA, 18 nt, Human
uccuucuaguccacuggg

SEQ ID NO: 988979 - RNA, 18 nt, Human
uccuucuaguccacuggg

SEQ ID NO: 988980 - RNA, 19 nt, Human
ucuguccuuggagggucuc

SEQ ID NO: 988981 - RNA, 19 nt, Human
ucuguccuuggagggucuc

SEQ ID NO: 988982 - RNA, 23 nt, Human
ucuguuccuugcagucuguuucu

SEQ ID NO: 988983 - RNA, 23 nt, Human
ugaaguguuuuucaugauuuuuu

SEQ ID NO: 988984 - RNA, 21 nt, Human
ugagagaguggaacuaugaca

SEQ ID NO: 988985 - RNA, 22 nt, Human
ugaguuaauauugauguaauac

SEQ ID NO: 988986 - RNA, 23 nt, Human
ugccuggacuuggcaaacagaug

SEQ ID NO: 988987 - RNA, 22 nt, Human
uggcaugacauuugaggccaca

SEQ ID NO: 988988 - RNA, 20 nt, Human
ugggagaaacagcacaacuc

SEQ ID NO: 988989 - RNA, 22 nt, Human
ugggagaaacagcacaacucuc

SEQ ID NO: 988990 - RNA, 20 nt, Human
ugggagaaacagcauaacuc

SEQ ID NO: 988991 - RNA, 22 nt, Human
ugggagaaacagcauaacucuc

SEQ ID NO: 988992 - RNA, 25 nt, Human
uucugagucaguuggagacauucug

SEQ ID NO: 988993 - RNA, 22 nt, Human
uugcacaaauccagguacacag

SEQ ID NO: 988994 - RNA, 18 nt, Human
uuuuuuuuuuuuuuuuug

SEQ ID NO: 988995 - RNA, 22 nt, Human
uuuuuuuuuuuuuuuuugccag

SEQ ID NO: 988996 - RNA, 20 nt, Human
aaaaaucuaaaguguuuaaa

SEQ ID NO: 988997 - RNA, 20 nt, Human
aaaacaaacuaaaaaaaccc

SEQ ID NO: 988998 - RNA, 20 nt, Human
aaacauuugacaucaccaaa

SEQ ID NO: 988999 - RNA, 25 nt, Human
aaacauuugacaucaccaaauucaa

SEQ ID NO: 989000 - RNA, 24 nt, Human
aaacuaaaaaaacccuagaaacau

SEQ ID NO: 989001 - RNA, 23 nt, Human
aaauagcugugaaacuagauuuu

SEQ ID NO: 989002 - RNA, 22 nt, Human
aauccagaaaaaaauucaaaua

SEQ ID NO: 989003 - RNA, 24 nt, Human
acacaguaaaaauuaaagccaugu

SEQ ID NO: 989004 - RNA, 23 nt, Human
acaggucucuucuccagguuaca

SEQ ID NO: 989005 - RNA, 18 nt, Human
acccuagaaacauuugac

SEQ ID NO: 989006 - RNA, 24 nt, Human
acuagauuuuccuauaaaugaucu

SEQ ID NO: 989007 - RNA, 24 nt, Human
acuauaaaggauggaguaaaugac

SEQ ID NO: 989008 - RNA, 24 nt, Human
acuucagaaaaauaaaaugaggaa

SEQ ID NO: 989009 - RNA, 26 nt, Human
agaaaaaaauucaaauagcugugaaa

SEQ ID NO: 989010 - RNA, 24 nt, Human
caaacuaaaaaaacccuagaaaca

SEQ ID NO: 989011 - RNA, 25 nt, Human
caaacuaaaaaaacccuagaaacau

SEQ ID NO: 989012 - RNA, 22 nt, Human
cacuucagaaaaauaaaaugag

SEQ ID NO: 989013 - RNA, 23 nt, Human
cauuugacaucaccaaauucaac

SEQ ID NO: 989014 - RNA, 21 nt, Human
cuguuuggaauuccagcagau

SEQ ID NO: 989015 - RNA, 24 nt, Human
gaaaaaaauucaaauagcugugaa

SEQ ID NO: 989016 - RNA, 22 nt, Human
gaaagaacagaaugaucuuuua

SEQ ID NO: 989017 - RNA, 26 nt, Human
gccuuuauuuuacuugaaaauaguuc

SEQ ID NO: 989018 - RNA, 22 nt, Human
ggaacuucuguuuggaauucca

SEQ ID NO: 989019 - RNA, 18 nt, Human
guagacuauuccucugua

SEQ ID NO: 989020 - RNA, 24 nt, Human
uaaaaacaaacuaaaaaaacccua

SEQ ID NO: 989021 - RNA, 22 nt, Human
uacaaucaaguauuuauaguau

SEQ ID NO: 989022 - RNA, 21 nt, Human
uagcacuguaaacaugaauac

SEQ ID NO: 989023 - RNA, 22 nt, Human
uagcacuguaaacaugaauaca

SEQ ID NO: 989024 - RNA, 25 nt, Human
uauggaacuucuguuuggaauucca

SEQ ID NO: 989025 - RNA, 24 nt, Human
uccagaaaaaaauucaaauagcug

SEQ ID NO: 989026 - RNA, 24 nt, Human
ucuguaaagaugaagacaguuacu

SEQ ID NO: 989027 - RNA, 18 nt, Human
ugaagacaguuacacagu

SEQ ID NO: 989028 - RNA, 26 nt, Human
ugacaggucucuucuccagguuacaa

SEQ ID NO: 989029 - RNA, 18 nt, Human
uggaacuucuguuuggaa

SEQ ID NO: 989030 - RNA, 18 nt, Human
uucaaagagaauaucacc

SEQ ID NO: 989031 - RNA, 25 nt, Human
uucaucauguagcuauacacacagu

SEQ ID NO: 989032 - RNA, 20 nt, Human
uuccucuguaaagaugaaga

SEQ ID NO: 989033 - RNA, 22 nt, Human
uucuucuuuuaggcuuauuucu

SEQ ID NO: 989034 - RNA, 21 nt, Human
uuuauguugucugcuauuuuc

SEQ ID NO: 989035 - RNA, 23 nt, Human
uuuauguugucugcuauuuucua

SEQ ID NO: 989036 - RNA, 22 nt, Human
aaaaaaaagauaaaggacaaga

SEQ ID NO: 989037 - RNA, 24 nt, Human
aagguccuucccuuguuuccccgg

SEQ ID NO: 989038 - RNA, 19 nt, Human
accaugguagggaggcggg

SEQ ID NO: 989039 - RNA, 19 nt, Human
accccaagaccccauccug

SEQ ID NO: 989040 - RNA, 24 nt, Human
accccauccugauccuuccugcca

SEQ ID NO: 989041 - RNA, 19 nt, Human
acggcacaggacgucagac

SEQ ID NO: 989042 - RNA, 18 nt, Human
agaccccuggcaccaugg

SEQ ID NO: 989043 - RNA, 20 nt, Human
agaggggcaaggagaccuuu

SEQ ID NO: 989044 - RNA, 22 nt, Human
aggcauccugaccccaagaccc

SEQ ID NO: 989045 - RNA, 18 nt, Human
agggagaggggcaaggag

SEQ ID NO: 989046 - RNA, 23 nt, Human
aggggagcuggagccuacaucuu

SEQ ID NO: 989047 - RNA, 25 nt, Human
aucccaauuaaaaaaaaaaaaaaaa

SEQ ID NO: 989048 - RNA, 19 nt, Human
cacaucucccuccuuuccu

SEQ ID NO: 989049 - RNA, 21 nt, Human
caccccugcccugcccagcuc

SEQ ID NO: 989050 - RNA, 22 nt, Human
cacccuuccccucccccagggg

SEQ ID NO: 989051 - RNA, 19 nt, Human
caccucuuccucggcuuuc

SEQ ID NO: 989052 - RNA, 18 nt, Human
cagcgccuccgcuuccgc

SEQ ID NO: 989053 - RNA, 19 nt, Human
cagcgccuccgcuuccgcc

SEQ ID NO: 989054 - RNA, 21 nt, Human
cagcugagaggggcucccacg

SEQ ID NO: 989055 - RNA, 18 nt, Human
caggcuccacccaccccu

SEQ ID NO: 989056 - RNA, 20 nt, Human
ccaagaccccauccugaucc

SEQ ID NO: 989057 - RNA, 23 nt, Human
ccaagguccuucccuuguuuccc

SEQ ID NO: 989058 - RNA, 26 nt, Human
ccacccaccccugcccugcccagcuc

SEQ ID NO: 989059 - RNA, 28 nt, Human
cccaauuaaaaaaaaaaaaaaaagauaa

SEQ ID NO: 989060 - RNA, 19 nt, Human
cccaccccugcccugccca

SEQ ID NO: 989061 - RNA, 24 nt, Human
cccaccccugcccugcccagcuca

SEQ ID NO: 989062 - RNA, 21 nt, Human
cccacgacugccccccaggcc

SEQ ID NO: 989063 - RNA, 18 nt, Human
cccagcccugaucccaau

SEQ ID NO: 989064 - RNA, 22 nt, Human
ccccacagcugagaggggcucc

SEQ ID NO: 989065 - RNA, 21 nt, Human
ccccagcgccuccgcuuccgc

SEQ ID NO: 989066 - RNA, 22 nt, Human
ccccagcgccuccgcuuccgcc

SEQ ID NO: 989067 - RNA, 24 nt, Human
ccccagcgccuccgcuuccgccug

SEQ ID NO: 989068 - RNA, 24 nt, Human
cccccaggccugggagcagccccc

SEQ ID NO: 989069 - RNA, 21 nt, Human
ccccccaggccugggagcagc

SEQ ID NO: 989070 - RNA, 26 nt, Human
ccccgccccagcccugauccgguucc

SEQ ID NO: 989071 - RNA, 18 nt, Human
ccccuugccaccucuucc

SEQ ID NO: 989072 - RNA, 20 nt, Human
cccuggaggggaggggguga

SEQ ID NO: 989073 - RNA, 18 nt, Human
cccugggggcccugagag

SEQ ID NO: 989074 - RNA, 21 nt, Human
ccucaggccccagaccugcuc

SEQ ID NO: 989075 - RNA, 20 nt, Human
ccuccuuuccuagguggcgg

SEQ ID NO: 989076 - RNA, 21 nt, Human
ccucggcuuucgcccuuccug

SEQ ID NO: 989077 - RNA, 18 nt, Human
ccugaggggcgggcccgg

SEQ ID NO: 989078 - RNA, 29 nt, Human
ccugaucccaauuaaaaaaaaaaaaaaag

SEQ ID NO: 989079 - RNA, 22 nt, Human
ccugauccuuccugccaguaag

SEQ ID NO: 989080 - RNA, 22 nt, Human
ccugcccugcccagcucaucug

SEQ ID NO: 989081 - RNA, 18 nt, Human
ccugggagcagccccuuc

SEQ ID NO: 989082 - RNA, 21 nt, Human
ccugggggcccugagaguggg

SEQ ID NO: 989083 - RNA, 18 nt, Human
cgccugggguccuccagc

SEQ ID NO: 989084 - RNA, 20 nt, Human
cggcacaggacgucagacag

SEQ ID NO: 989085 - RNA, 22 nt, Human
cuagacccacccuuccccuccc

SEQ ID NO: 989086 - RNA, 19 nt, Human
cuccagcucagugcccucc

SEQ ID NO: 989087 - RNA, 23 nt, Human
cucccacgacugccccccaggcc

SEQ ID NO: 989088 - RNA, 22 nt, Human
cucccugccucaggccccagac

SEQ ID NO: 989089 - RNA, 21 nt, Human
gacccacccuuccccuccccc

SEQ ID NO: 989090 - RNA, 23 nt, Human
gacccacccuuccccucccccag

SEQ ID NO: 989091 - RNA, 20 nt, Human
gaccucgcgguccaguccuc

SEQ ID NO: 989092 - RNA, 21 nt, Human
gagcagccccuuccaaggucc

SEQ ID NO: 989093 - RNA, 23 nt, Human
gcccugggccacuggccagcccc

SEQ ID NO: 989094 - RNA, 20 nt, Human
gcggcucugccaagcaggga

SEQ ID NO: 989095 - RNA, 20 nt, Human
gcuuccgccugggguccucc

SEQ ID NO: 989096 - RNA, 20 nt, Human
ggaggcggggcucccaggcc

SEQ ID NO: 989097 - RNA, 23 nt, Human
ggcaggucugagggccucacugu

SEQ ID NO: 989098 - RNA, 19 nt, Human
gggaagagacccaggcauc

SEQ ID NO: 989099 - RNA, 20 nt, Human
gggaagagacccaggcaucc

SEQ ID NO: 989100 - RNA, 18 nt, Human
ggggagggggugacaacc

SEQ ID NO: 989101 - RNA, 18 nt, Human
gggggcccugagaguggg

SEQ ID NO: 989102 - RNA, 21 nt, Human
guaugucuagacccacccuuc

SEQ ID NO: 989103 - RNA, 22 nt, Human
guggggccuggccugguagggg

SEQ ID NO: 989104 - RNA, 20 nt, Human
uagacccacccuuccccucc

SEQ ID NO: 989105 - RNA, 21 nt, Human
uaucugaacgggauggagacu

SEQ ID NO: 989106 - RNA, 22 nt, Human
uccacccaccccugcccugccc

SEQ ID NO: 989107 - RNA, 19 nt, Human
uccagcggcucugccaagc

SEQ ID NO: 989108 - RNA, 20 nt, Human
ucccacgacugccccccagg

SEQ ID NO: 989109 - RNA, 23 nt, Human
ucccccaggggacuagaugaaua

SEQ ID NO: 989110 - RNA, 20 nt, Human
uccccgccccagcccugauc

SEQ ID NO: 989111 - RNA, 20 nt, Human
uccccuggaggggagggggu

SEQ ID NO: 989112 - RNA, 20 nt, Human
uccccuugccaccucuuccu

SEQ ID NO: 989113 - RNA, 22 nt, Human
ucccugccucaggccccagacc

SEQ ID NO: 989114 - RNA, 18 nt, Human
uccuccagcggcucugcc

SEQ ID NO: 989115 - RNA, 22 nt, Human
uccucggcuuucgcccuuccug

SEQ ID NO: 989116 - RNA, 21 nt, Human
ucgagggcgacagcugccgaa

SEQ ID NO: 989117 - RNA, 19 nt, Human
ucgccaagcuggcccuggg

SEQ ID NO: 989118 - RNA, 23 nt, Human
ucgccaagcuggcccugggccac

SEQ ID NO: 989119 - RNA, 19 nt, Human
ugaauauuugacacgcaca

SEQ ID NO: 989120 - RNA, 19 nt, Human
ugacacgcacaucucccuc

SEQ ID NO: 989121 - RNA, 23 nt, Human
ugaccccaagaccccauccugau

SEQ ID NO: 989122 - RNA, 23 nt, Human
ugccucaggccccagaccugcuc

SEQ ID NO: 989123 - RNA, 19 nt, Human
ugggccacuggccagcccc

SEQ ID NO: 989124 - RNA, 21 nt, Human
ugggggcccugagaguggggc

SEQ ID NO: 989125 - RNA, 21 nt, Human
uggggucugaaccccgaauau

SEQ ID NO: 989126 - RNA, 21 nt, Human
uuccggauuucugauuguggg

SEQ ID NO: 989127 - RNA, 22 nt, Human
uugacacgcacaucucccuccu

SEQ ID NO: 989128 - RNA, 22 nt, Human
aaaaaauacaaauuccuaccau

SEQ ID NO: 989129 - RNA, 22 nt, Human
aagaagggggcucuccaagcac

SEQ ID NO: 989130 - RNA, 24 nt, Human
aauacaaauuccuaccauuaaacu

SEQ ID NO: 989131 - RNA, 22 nt, Human
ccuucuccacaguccuacgcug

SEQ ID NO: 989132 - RNA, 19 nt, Human
ccuugcccaccgcccuucu

SEQ ID NO: 989133 - RNA, 21 nt, Human
ccuugcccaccgcccuucucc

SEQ ID NO: 989134 - RNA, 25 nt, Human
ccuugcccaccgcccuucuccacag

SEQ ID NO: 989135 - RNA, 23 nt, Human
cuaccauuaaacuggcuugguug

SEQ ID NO: 989136 - RNA, 20 nt, Human
cuccuugcccaccgcccuuc

SEQ ID NO: 989137 - RNA, 31 nt, Human
cuccuugcccaccgcccuucuccacaguccc

SEQ ID NO: 989138 - RNA, 22 nt, Human
ggaguagcugugggggcuuggg

SEQ ID NO: 989139 - RNA, 22 nt, Human
ggggaagggugucguuucuuuc

SEQ ID NO: 989140 - RNA, 24 nt, Human
gucauguauucugaacaaaggcaa

SEQ ID NO: 989141 - RNA, 20 nt, Human
uagguuucuucccuguuccc

SEQ ID NO: 989142 - RNA, 18 nt, Human
uccacaguccuacgcugc

SEQ ID NO: 989143 - RNA, 20 nt, Human
ucuccaagcacaccuggcag

SEQ ID NO: 989144 - RNA, 21 nt, Human
ucuccacaguccuacgcugcu

SEQ ID NO: 989145 - RNA, 22 nt, Human
ucuccacaguccuacgcugcuu

SEQ ID NO: 989146 - RNA, 22 nt, Human
ugaacaaaggcaaaaaauacaa

SEQ ID NO: 989147 - RNA, 21 nt, Human
ugcccaccgcccuucuccaca

SEQ ID NO: 989148 - RNA, 24 nt, Human
uggaguagcugugggggcuugggg

SEQ ID NO: 989149 - RNA, 24 nt, Human
ugucguuucuuucuaguagucuca

SEQ ID NO: 989150 - RNA, 20 nt, Human
uuccuaccauuaaacuggcu

SEQ ID NO: 989151 - RNA, 21 nt, Human
uucuaguagucucaugucgcu

SEQ ID NO: 989152 - RNA, 18 nt, Human
uuguuguuuggguuggag

SEQ ID NO: 989153 - RNA, 18 nt, Human
agccuggaagagguggua

SEQ ID NO: 989154 - RNA, 23 nt, Human
ccaaagaccucccggacacccuu

SEQ ID NO: 989155 - RNA, 23 nt, Human
cccagaccgcgaugcccaaagac

SEQ ID NO: 989156 - RNA, 18 nt, Human
ccccggccugcucgaccu

SEQ ID NO: 989157 - RNA, 20 nt, Human
cccucagggcagagaaggcu

SEQ ID NO: 989158 - RNA, 19 nt, Human
ccucccggacacccccggc

SEQ ID NO: 989159 - RNA, 21 nt, Human
ccucccggacacccccggccu

SEQ ID NO: 989160 - RNA, 22 nt, Human
cgacccucagggcagagaaggc

SEQ ID NO: 989161 - RNA, 24 nt, Human
cucgaccuucgacccucagggccg

SEQ ID NO: 989162 - RNA, 18 nt, Human
gaccucccggacaccccc

SEQ ID NO: 989163 - RNA, 18 nt, Human
gucccaaccccagaccgc

SEQ ID NO: 989164 - RNA, 20 nt, Human
uacgcauuuuuuuucuuuau

SEQ ID NO: 989165 - RNA, 21 nt, Human
uagccaugcucauugaagcua

SEQ ID NO: 989166 - RNA, 21 nt, Human
ucccaggcgcuuacacguccc

SEQ ID NO: 989167 - RNA, 21 nt, Human
ucuuuauuggcagcccggagc

SEQ ID NO: 989168 - RNA, 20 nt, Human
ugcccaaagaccucccggac

SEQ ID NO: 989169 - RNA, 22 nt, Human
ugcccaaagaccucccggacac

SEQ ID NO: 989170 - RNA, 18 nt, Human
uggaagaggugguagcca

SEQ ID NO: 989171 - RNA, 20 nt, Human
aaaaaaaacacugggacaug

SEQ ID NO: 989172 - RNA, 23 nt, Human
aaaaaacacugggacaugccccc

SEQ ID NO: 989173 - RNA, 20 nt, Human
aaaaacaacaaaaaaaacac

SEQ ID NO: 989174 - RNA, 21 nt, Human
aaucaggacuggagaagggac

SEQ ID NO: 989175 - RNA, 19 nt, Human
acaacaaaaaaaacacugg

SEQ ID NO: 989176 - RNA, 19 nt, Human
acaacaaaaaaaacacugg

SEQ ID NO: 989177 - RNA, 23 nt, Human
aguaaucaggacuggagaaggga

SEQ ID NO: 989178 - RNA, 19 nt, Human
augguguugcaaucucucc

SEQ ID NO: 989179 - RNA, 18 nt, Human
caaaaaaaacacugggac

SEQ ID NO: 989180 - RNA, 18 nt, Human
caaaaaaaacacugggac

SEQ ID NO: 989181 - RNA, 19 nt, Human
caaaaaaaacacugggaca

SEQ ID NO: 989182 - RNA, 22 nt, Human
ccccggcugccgcugacgugau

SEQ ID NO: 989183 - RNA, 18 nt, Human
cccgcuuccuucucuccu

SEQ ID NO: 989184 - RNA, 22 nt, Human
cccgcuuccuucucuccuucca

SEQ ID NO: 989185 - RNA, 20 nt, Human
ccuucucuccuuccagcguc

SEQ ID NO: 989186 - RNA, 23 nt, Human
cugcgcacaggcuccuggcuccc

SEQ ID NO: 989187 - RNA, 21 nt, Human
cuucuugugcgccaccgucac

SEQ ID NO: 989188 - RNA, 22 nt, Human
gaugguguugcaaucucuccug

SEQ ID NO: 989189 - RNA, 20 nt, Human
gcacaggcuccuggcucccu

SEQ ID NO: 989190 - RNA, 20 nt, Human
gccugcgcacaggcuccugg

SEQ ID NO: 989191 - RNA, 22 nt, Human
gggcgggggcucucggaccccc

SEQ ID NO: 989192 - RNA, 19 nt, Human
ggggcggguuggggcgggg

SEQ ID NO: 989193 - RNA, 18 nt, Human
gggggcucucggaccccc

SEQ ID NO: 989194 - RNA, 26 nt, Human
guaaucaggacuggagaagggacgau

SEQ ID NO: 989195 - RNA, 24 nt, Human
uaaaaacaacaaaaaaaacacugg

SEQ ID NO: 989196 - RNA, 20 nt, Human
ucuacuugcuggcaagccgg

SEQ ID NO: 989197 - RNA, 18 nt, Human
ucucaguuaaggccugga

SEQ ID NO: 989198 - RNA, 20 nt, Human
ucuccuuccagcgucuucug

SEQ ID NO: 989199 - RNA, 24 nt, Human
ugagaagcacacuucccgcuuccu

SEQ ID NO: 989200 - RNA, 22 nt, Human
ugcaaguuggaguucguaagaa

SEQ ID NO: 989201 - RNA, 22 nt, Human
uggcaagccgguuuccucccug

SEQ ID NO: 989202 - RNA, 21 nt, Human
ugggaugguguugcaaucucu

SEQ ID NO: 989203 - RNA, 21 nt, Human
uggggcggguuggggcggggg

SEQ ID NO: 989204 - RNA, 21 nt, Human
uuaguaucuaaaaacaacaaa

SEQ ID NO: 989205 - RNA, 20 nt, Human
uucccgcuuccuucucuccu

SEQ ID NO: 989206 - RNA, 23 nt, Human
uugcuggcaagccgguuuccucc

SEQ ID NO: 989207 - RNA, 23 nt, Human
aaaaauaaaauacucauagcacc

SEQ ID NO: 989208 - RNA, 23 nt, Human
aagaaaaauaaaauacucauagc

SEQ ID NO: 989209 - RNA, 19 nt, Human
aagaacaucacaugugcaa

SEQ ID NO: 989210 - RNA, 19 nt, Human
aagaacaucacaugugcaa

SEQ ID NO: 989211 - RNA, 19 nt, Human
aagaacaucacaugugcaa

SEQ ID NO: 989212 - RNA, 19 nt, Human
aagaacaucacaugugcaa

SEQ ID NO: 989213 - RNA, 19 nt, Human
aagaacaucacaugugcaa

SEQ ID NO: 989214 - RNA, 18 nt, Human
aaguagcccaaccaaugg

SEQ ID NO: 989215 - RNA, 22 nt, Human
aauaauggcaacagaagaggaa

SEQ ID NO: 989216 - RNA, 26 nt, Human
accucacaauuccaggguauuuacug

SEQ ID NO: 989217 - RNA, 23 nt, Human
accugggguguuugcaguugguu

SEQ ID NO: 989218 - RNA, 21 nt, Human
acuaaguacagggaccaaaac

SEQ ID NO: 989219 - RNA, 18 nt, Human
acugguccgugccugacc

SEQ ID NO: 989220 - RNA, 20 nt, Human
acugguccgugccugaccuc

SEQ ID NO: 989221 - RNA, 20 nt, Human
agcaaggaugacuccgacau

SEQ ID NO: 989222 - RNA, 22 nt, Human
agccagacaagcgcugggaagg

SEQ ID NO: 989223 - RNA, 22 nt, Human
agcccaaccaauggcuuugcag

SEQ ID NO: 989224 - RNA, 20 nt, Human
agccucagagaaggaucagc

SEQ ID NO: 989225 - RNA, 18 nt, Human
aggcaggccacugaacca

SEQ ID NO: 989226 - RNA, 21 nt, Human
auaauggcaacagaagaggaa

SEQ ID NO: 989227 - RNA, 20 nt, Human
aucaccccucaccacuccac

SEQ ID NO: 989228 - RNA, 24 nt, Human
augaucuccaaggucuccccaggc

SEQ ID NO: 989229 - RNA, 21 nt, Human
auggcaacagaagaggaaguc

SEQ ID NO: 989230 - RNA, 20 nt, Human
caaaacauagcaagugcuca

SEQ ID NO: 989231 - RNA, 22 nt, Human
caaaacauagcaagugcucaag

SEQ ID NO: 989232 - RNA, 19 nt, Human
caaagcuucuuuuccuuag

SEQ ID NO: 989233 - RNA, 23 nt, Human
caacacuaaguacagggaccaaa

SEQ ID NO: 989234 - RNA, 21 nt, Human
caagcaaggaccugagccuca

SEQ ID NO: 989235 - RNA, 27 nt, Human
caagcaaggaccugagccucagagaag

SEQ ID NO: 989236 - RNA, 21 nt, Human
caagcgaugcugcagcaagga

SEQ ID NO: 989237 - RNA, 21 nt, Human
caagcgaugcugcagcaagga

SEQ ID NO: 989238 - RNA, 24 nt, Human
caagcgaugcugcagcaaggaaga

SEQ ID NO: 989239 - RNA, 22 nt, Human
caagcgaugcugcagcaaggau

SEQ ID NO: 989240 - RNA, 22 nt, Human
caagcgaugcugcagcaaggau

SEQ ID NO: 989241 - RNA, 20 nt, Human
cacagcccacaggugguccu

SEQ ID NO: 989242 - RNA, 25 nt, Human
cacauucuuagagcuauaccucaca

SEQ ID NO: 989243 - RNA, 20 nt, Human
cacugaaccacucugacccu

SEQ ID NO: 989244 - RNA, 20 nt, Human
cagcaaggaagacuccgacg

SEQ ID NO: 989245 - RNA, 18 nt, Human
cagcacacaaugucccag

SEQ ID NO: 989246 - RNA, 21 nt, Human
caggccacugaaccacucuga

SEQ ID NO: 989247 - RNA, 18 nt, Human
caggcccuuucucuccca

SEQ ID NO: 989248 - RNA, 19 nt, Human
cagggaccaaaacauagca

SEQ ID NO: 989249 - RNA, 19 nt, Human
caggggcugcugcccuccg

SEQ ID NO: 989250 - RNA, 21 nt, Human
cagugaucauuuuuaaccucu

SEQ ID NO: 989251 - RNA, 20 nt, Human
cagugggucugccagccaag

SEQ ID NO: 989252 - RNA, 21 nt, Human
cauguaguuuggggcacaucc

SEQ ID NO: 989253 - RNA, 19 nt, Human
ccacugaaccacucugacc

SEQ ID NO: 989254 - RNA, 21 nt, Human
ccagccaagggugaggaaggc

SEQ ID NO: 989255 - RNA, 19 nt, Human
cccacaggugguccuggcc

SEQ ID NO: 989256 - RNA, 21 nt, Human
cccacaggugguccuggcccu

SEQ ID NO: 989257 - RNA, 22 nt, Human
cccagggcugggccacuggucc

SEQ ID NO: 989258 - RNA, 23 nt, Human
ccccaaagcuucuuuuccuuaga

SEQ ID NO: 989259 - RNA, 19 nt, Human
ccucagagaaggaucagcu

SEQ ID NO: 989260 - RNA, 23 nt, Human
ccuccgcccagagccugacacac

SEQ ID NO: 989261 - RNA, 19 nt, Human
cuacugggcaguugggaga

SEQ ID NO: 989262 - RNA, 21 nt, Human
cugcagcaaggaagacuccga

SEQ ID NO: 989263 - RNA, 22 nt, Human
cugcagcaaggaugacuccgac

SEQ ID NO: 989264 - RNA, 22 nt, Human
cugcagcaaggaugacuccgac

SEQ ID NO: 989265 - RNA, 22 nt, Human
cugcagcaaggaugacuccgac

SEQ ID NO: 989266 - RNA, 22 nt, Human
cugcagcaaggaugacucugac

SEQ ID NO: 989267 - RNA, 18 nt, Human
cuggccaagaugaucucc

SEQ ID NO: 989268 - RNA, 25 nt, Human
gaaaaauaaaauacucauagcaccc

SEQ ID NO: 989269 - RNA, 20 nt, Human
gacccucuguuuccucaucu

SEQ ID NO: 989270 - RNA, 20 nt, Human
gagaaggaucagcuauagca

SEQ ID NO: 989271 - RNA, 22 nt, Human
gcaacagaagaggaagucugaa

SEQ ID NO: 989272 - RNA, 19 nt, Human
gccucagagaaggaucagc

SEQ ID NO: 989273 - RNA, 23 nt, Human
gccucugcucccaggggagggaa

SEQ ID NO: 989274 - RNA, 21 nt, Human
gcuuguuuacaugccaaagug

SEQ ID NO: 989275 - RNA, 18 nt, Human
ggaccugagccucagaga

SEQ ID NO: 989276 - RNA, 21 nt, Human
ggcuguggggaggggaggugg

SEQ ID NO: 989277 - RNA, 25 nt, Human
gggaaacugagggccagagagggga

SEQ ID NO: 989278 - RNA, 18 nt, Human
gggcugcugcccuccgcc

SEQ ID NO: 989279 - RNA, 24 nt, Human
gggcugcugcccuccgcccagagc

SEQ ID NO: 989280 - RNA, 19 nt, Human
gggcugggccacugguccg

SEQ ID NO: 989281 - RNA, 19 nt, Human
guccuggggagucacaccc

SEQ ID NO: 989282 - RNA, 21 nt, Human
gugaggaaggcuguggggagg

SEQ ID NO: 989283 - RNA, 20 nt, Human
gugaugggacacccagggcu

SEQ ID NO: 989284 - RNA, 21 nt, Human
gugaugggacacccagggcug

SEQ ID NO: 989285 - RNA, 27 nt, Human
guuccagguuacccuauaggacccccu

SEQ ID NO: 989286 - RNA, 22 nt, Human
uaaaauacucauagcacccuuc

SEQ ID NO: 989287 - RNA, 23 nt, Human
uaaaauacucauagcacccuucu

SEQ ID NO: 989288 - RNA, 24 nt, Human
uaaccucuggugaugauucuauug

SEQ ID NO: 989289 - RNA, 21 nt, Human
uaaguccuggcugauguucug

SEQ ID NO: 989290 - RNA, 18 nt, Human
uacaaggagaagccagac

SEQ ID NO: 989291 - RNA, 19 nt, Human
uacaaggagaagccagaca

SEQ ID NO: 989292 - RNA, 19 nt, Human
uacugggcaguugggagac

SEQ ID NO: 989293 - RNA, 23 nt, Human
uaucacaucaccccucaccacuc

SEQ ID NO: 989294 - RNA, 18 nt, Human
ucaagcaaggaccugagc

SEQ ID NO: 989295 - RNA, 18 nt, Human
ucacauguaguuuggggc

SEQ ID NO: 989296 - RNA, 19 nt, Human
ucaguuggacauaaacauc

SEQ ID NO: 989297 - RNA, 22 nt, Human
ucccugcugcuggggcauacaa

SEQ ID NO: 989298 - RNA, 23 nt, Human
ugaaagaaaaauaaaauacucau

SEQ ID NO: 989299 - RNA, 20 nt, Human
ugaugugguaaagggaccag

SEQ ID NO: 989300 - RNA, 18 nt, Human
ugccaaagugcucugugg

SEQ ID NO: 989301 - RNA, 20 nt, Human
ugccuaugaagaaguagccc

SEQ ID NO: 989302 - RNA, 19 nt, Human
ugcucuguggaagagguga

SEQ ID NO: 989303 - RNA, 18 nt, Human
ugcugggauggacauuac

SEQ ID NO: 989304 - RNA, 21 nt, Human
ugcuggggcauacaaggagaa

SEQ ID NO: 989305 - RNA, 20 nt, Human
uggcaacagaagaggaaguc

SEQ ID NO: 989306 - RNA, 18 nt, Human
ugggucugccagccaagg

SEQ ID NO: 989307 - RNA, 21 nt, Human
uguggggaggggagguggcca

SEQ ID NO: 989308 - RNA, 23 nt, Human
uuuugauuuccaccauuuacauu

SEQ ID NO: 989309 - RNA, 18 nt, Human
uuuuuuuuuuuuuuuuug

SEQ ID NO: 989310 - RNA, 23 nt, Human
uuuuuuuuuuuuuuuuuugauuu

SEQ ID NO: 989311 - RNA, 22 nt, Human
acauagcaguggucaaaaauaa

SEQ ID NO: 989312 - RNA, 18 nt, Human
agaaggaggggcggagag

SEQ ID NO: 989313 - RNA, 25 nt, Human
cauagcaguggucaaaaauaaugga

SEQ ID NO: 989314 - RNA, 20 nt, Human
cccaggauuuaaugcaaaaa

SEQ ID NO: 989315 - RNA, 24 nt, Human
ccccaggauuuaaugcaaaaaccc

SEQ ID NO: 989316 - RNA, 22 nt, Human
cuacuugaacacauagcagugg

SEQ ID NO: 989317 - RNA, 19 nt, Human
uaaaauggaccccaggauu

SEQ ID NO: 989318 - RNA, 24 nt, Human
uguaaaauggaccccaggauuuaa

SEQ ID NO: 989319 - RNA, 23 nt, Human
uuuuuuuuuuuuagaugaacuca

SEQ ID NO: 989320 - RNA, 20 nt, Human
aaaaugcugaaaacauacac

SEQ ID NO: 989321 - RNA, 22 nt, Human
aaagcccuggcgugguggcuca

SEQ ID NO: 989322 - RNA, 22 nt, Human
aaaugcugaaaacauacacagu

SEQ ID NO: 989323 - RNA, 19 nt, Human
aacauggcgaaaccccguc

SEQ ID NO: 989324 - RNA, 20 nt, Human
aacauggcgaaaccccgucu

SEQ ID NO: 989325 - RNA, 21 nt, Human
aacauggcgaaaccccgucuc

SEQ ID NO: 989326 - RNA, 22 nt, Human
aagcggguggaucaccugaggu

SEQ ID NO: 989327 - RNA, 26 nt, Human
aagcggguggaucaccugaggucagg

SEQ ID NO: 989328 - RNA, 21 nt, Human
acaaagcaauauaaucacccu

SEQ ID NO: 989329 - RNA, 22 nt, Human
accccgucucuacuaaaaauac

SEQ ID NO: 989330 - RNA, 23 nt, Human
acccuccuucccccuuacugcuu

SEQ ID NO: 989331 - RNA, 22 nt, Human
acgcugggggacggaguaagac

SEQ ID NO: 989332 - RNA, 24 nt, Human
acggaguaagacucagucucaaag

SEQ ID NO: 989333 - RNA, 22 nt, Human
agcaaaaaugcuuuaguguuau

SEQ ID NO: 989334 - RNA, 24 nt, Human
agcacuuugggaagcugaagcggg

SEQ ID NO: 989335 - RNA, 23 nt, Human
aucacccuccuucccccuuacug

SEQ ID NO: 989336 - RNA, 24 nt, Human
aucaccugaggucaggaguucgag

SEQ ID NO: 989337 - RNA, 25 nt, Human
caaagcaauauaaucacccuccuuc

SEQ ID NO: 989338 - RNA, 24 nt, Human
caacauggcgaaaccccgucucua

SEQ ID NO: 989339 - RNA, 23 nt, Human
caaguaucacaaaccauuacaaa

SEQ ID NO: 989340 - RNA, 20 nt, Human
cacccuccuucccccuuacu

SEQ ID NO: 989341 - RNA, 23 nt, Human
caccugaggucaggaguucgaga

SEQ ID NO: 989342 - RNA, 24 nt, Human
cacgccuguaaugccagcacuuug

SEQ ID NO: 989343 - RNA, 24 nt, Human
cagcacuuugggaagcugaagcgg

SEQ ID NO: 989344 - RNA, 20 nt, Human
cagcccggacaacauggcga

SEQ ID NO: 989345 - RNA, 22 nt, Human
cagcgcgccaccacgcuggggg

SEQ ID NO: 989346 - RNA, 19 nt, Human
caggaguucgagagcagcc

SEQ ID NO: 989347 - RNA, 20 nt, Human
cccuccuucccccuuacugc

SEQ ID NO: 989348 - RNA, 23 nt, Human
ccuccuucccccuuacugcuuca

SEQ ID NO: 989349 - RNA, 19 nt, Human
cgaaaauagcaaaaaugcu

SEQ ID NO: 989350 - RNA, 24 nt, Human
cgccuguaaugccagcacuuuggg

SEQ ID NO: 989351 - RNA, 24 nt, Human
cggguggaucaccugaggucagga

SEQ ID NO: 989352 - RNA, 19 nt, Human
cuagccuuaaaaugcugaa

SEQ ID NO: 989353 - RNA, 24 nt, Human
cucacgccuguaaugccagcacuu

SEQ ID NO: 989354 - RNA, 21 nt, Human
gaucaccugaggucaggaguu

SEQ ID NO: 989355 - RNA, 24 nt, Human
gaucaccugaggucaggaguucga

SEQ ID NO: 989356 - RNA, 21 nt, Human
gcccuggcgugguggcucacg

SEQ ID NO: 989357 - RNA, 20 nt, Human
gcgccaccacgcugggggac

SEQ ID NO: 989358 - RNA, 24 nt, Human
gcgccuguaaucccagcgcgccac

SEQ ID NO: 989359 - RNA, 22 nt, Human
ggaaaguauuugguaggaguga

SEQ ID NO: 989360 - RNA, 24 nt, Human
gguggcgcgcgccuguaaucccag

SEQ ID NO: 989361 - RNA, 24 nt, Human
gguggcucacgccuguaaugccag

SEQ ID NO: 989362 - RNA, 23 nt, Human
guggcgcgcgccuguaaucccag

SEQ ID NO: 989363 - RNA, 23 nt, Human
uagccuuaaaaugcugaaaacau

SEQ ID NO: 989364 - RNA, 22 nt, Human
uauuugguaggagugaagaaca

SEQ ID NO: 989365 - RNA, 27 nt, Human
ucacccuccuucccccuuacugcuuca

SEQ ID NO: 989366 - RNA, 20 nt, Human
ugaagcggguggaucaccug

SEQ ID NO: 989367 - RNA, 21 nt, Human
ugaagcggguggaucaccuga

SEQ ID NO: 989368 - RNA, 24 nt, Human
ugaagcggguggaucaccugaggu

SEQ ID NO: 989369 - RNA, 26 nt, Human
ugaagcggguggaucaccugagguca

SEQ ID NO: 989370 - RNA, 18 nt, Human
ugacgaaaauagcaaaaa

SEQ ID NO: 989371 - RNA, 24 nt, Human
uggaucaccugaggucaggaguuc

SEQ ID NO: 989372 - RNA, 21 nt, Human
uggcgcgcgccuguaauccca

SEQ ID NO: 989373 - RNA, 22 nt, Human
uggcgcgcgccuguaaucccag

SEQ ID NO: 989374 - RNA, 24 nt, Human
uggcgcgcgccuguaaucccagcg

SEQ ID NO: 989375 - RNA, 24 nt, Human
uggcgugguggcucacgccuguaa

SEQ ID NO: 989376 - RNA, 22 nt, Human
uggcucacgccuguaaugccag

SEQ ID NO: 989377 - RNA, 24 nt, Human
uggcucacgccuguaaugccagca

SEQ ID NO: 989378 - RNA, 24 nt, Human
ugggaagcugaagcggguggauca

SEQ ID NO: 989379 - RNA, 18 nt, Human
ugguaggagugaagaaca

SEQ ID NO: 989380 - RNA, 24 nt, Human
ugguggcgcgcgccuguaauccca

SEQ ID NO: 989381 - RNA, 18 nt, Human
ugguggcucacgccugua

SEQ ID NO: 989382 - RNA, 19 nt, Human
uucgcgugguggcgcgcgc

SEQ ID NO: 989383 - RNA, 22 nt, Human
uuugguaggagugaagaacaga

SEQ ID NO: 989384 - RNA, 25 nt, Human
agaauccaaaauaugagaucugccc

SEQ ID NO: 989385 - RNA, 22 nt, Human
caaaauaugagaucugcccgcg

SEQ ID NO: 989386 - RNA, 19 nt, Human
ccagcagcagccccuccag

SEQ ID NO: 989387 - RNA, 20 nt, Human
ccagcagcagccccuccagc

SEQ ID NO: 989388 - RNA, 24 nt, Human
cccgcggagacuccagguguuccc

SEQ ID NO: 989389 - RNA, 19 nt, Human
cuauuauguauaagccuag

SEQ ID NO: 989390 - RNA, 21 nt, Human
cuuuauuauugcuauuaugua

SEQ ID NO: 989391 - RNA, 20 nt, Human
gccuuuauuauugcuauuau

SEQ ID NO: 989392 - RNA, 18 nt, Human
gguguucccagcagcagc

SEQ ID NO: 989393 - RNA, 19 nt, Human
uaggacaaguuguaaaccc

SEQ ID NO: 989394 - RNA, 23 nt, Human
uauccagaauccaaaauaugaga

SEQ ID NO: 989395 - RNA, 19 nt, Human
ucaaagccuuuauuauugc

SEQ ID NO: 989396 - RNA, 21 nt, Human
uccaaaauaugagaucugccc

SEQ ID NO: 989397 - RNA, 21 nt, Human
uuuauuuccggugaaccccag

SEQ ID NO: 989398 - RNA, 19 nt, Human
aaauuaauaggaugaauga

SEQ ID NO: 989399 - RNA, 24 nt, Human
aacccuguuuuucccccacaguau

SEQ ID NO: 989400 - RNA, 18 nt, Human
aagaaaaacaaaaagaac

SEQ ID NO: 989401 - RNA, 21 nt, Human
acauacacccccuauuauaug

SEQ ID NO: 989402 - RNA, 19 nt, Human
acccuguuuuucccccaca

SEQ ID NO: 989403 - RNA, 21 nt, Human
accgacagaggcagccaaaaa

SEQ ID NO: 989404 - RNA, 18 nt, Human
acugcaagaaaaagaagc

SEQ ID NO: 989405 - RNA, 19 nt, Human
agaaucaaccccguaacaa

SEQ ID NO: 989406 - RNA, 23 nt, Human
agccccuucuaaaaagcucccau

SEQ ID NO: 989407 - RNA, 18 nt, Human
aggaggcaugaaagccaa

SEQ ID NO: 989408 - RNA, 23 nt, Human
aggcucauuuucccaaaucaaaa

SEQ ID NO: 989409 - RNA, 18 nt, Human
agugagagauucaucaag

SEQ ID NO: 989410 - RNA, 26 nt, Human
aguugauacuacucagagcaagauag

SEQ ID NO: 989411 - RNA, 20 nt, Human
aguugauuguagcacaacug

SEQ ID NO: 989412 - RNA, 21 nt, Human
aguuuaaacaaaauucacaca

SEQ ID NO: 989413 - RNA, 20 nt, Human
aucaucaucauccuucuucu

SEQ ID NO: 989414 - RNA, 21 nt, Human
aucauccuucuucuuuuucug

SEQ ID NO: 989415 - RNA, 22 nt, Human
auggaguuucaaccuuggccag

SEQ ID NO: 989416 - RNA, 24 nt, Human
auggcugguaccuccuccaaacac

SEQ ID NO: 989417 - RNA, 24 nt, Human
auuucagcagcuucuuuacagucu

SEQ ID NO: 989418 - RNA, 21 nt, Human
caaagcacuggaguucgguuu

SEQ ID NO: 989419 - RNA, 22 nt, Human
caaaggcaaaaagaugagucuc

SEQ ID NO: 989420 - RNA, 25 nt, Human
caaaggcaaaaagaugagucucuau

SEQ ID NO: 989421 - RNA, 23 nt, Human
caacaucacuccauuuuuuccac

SEQ ID NO: 989422 - RNA, 20 nt, Human
caaguaaaccugaaagaaaa

SEQ ID NO: 989423 - RNA, 21 nt, Human
caccuguguauuucacagaag

SEQ ID NO: 989424 - RNA, 22 nt, Human
cacucaugaagccagggaugac

SEQ ID NO: 989425 - RNA, 24 nt, Human
cagcaggauaaaaaacguaaaaca

SEQ ID NO: 989426 - RNA, 22 nt, Human
cagcauauuacauugccucugg

SEQ ID NO: 989427 - RNA, 18 nt, Human
cauguuccacaaaaaggu

SEQ ID NO: 989428 - RNA, 24 nt, Human
ccaacaacucuuugugcucaguga

SEQ ID NO: 989429 - RNA, 21 nt, Human
ccccuucuaaaaagcucccau

SEQ ID NO: 989430 - RNA, 23 nt, Human
cccuacccggacaccuccuuuuu

SEQ ID NO: 989431 - RNA, 18 nt, Human
ccgaccgccgccgcugcc

SEQ ID NO: 989432 - RNA, 19 nt, Human
ccgaccgccgccgcugccg

SEQ ID NO: 989433 - RNA, 19 nt, Human
ccgaccgccgccgcugccg

SEQ ID NO: 989434 - RNA, 19 nt, Human
ccgccgccaccaccaggcc

SEQ ID NO: 989435 - RNA, 23 nt, Human
ccgccgccaccaccaggccucgg

SEQ ID NO: 989436 - RNA, 23 nt, Human
ccgccgccaccaccaggccucgg

SEQ ID NO: 989437 - RNA, 18 nt, Human
ccgccgccgcugccguuc

SEQ ID NO: 989438 - RNA, 20 nt, Human
ccgccgccgcugccguuccg

SEQ ID NO: 989439 - RNA, 22 nt, Human
ccgcugccguuccguagcugcu

SEQ ID NO: 989440 - RNA, 26 nt, Human
ccuauggucagaaucaaccccguaac

SEQ ID NO: 989441 - RNA, 21 nt, Human
ccuccuaucuccucaucauca

SEQ ID NO: 989442 - RNA, 20 nt, Human
ccuccuuuuuccucguuguc

SEQ ID NO: 989443 - RNA, 23 nt, Human
ccucgggugucgccgcguugccc

SEQ ID NO: 989444 - RNA, 19 nt, Human
ccucuguuuccaccugugu

SEQ ID NO: 989445 - RNA, 18 nt, Human
ccugccaccagccuugcc

SEQ ID NO: 989446 - RNA, 24 nt, Human
ccugccaccagccuugcccucaau

SEQ ID NO: 989447 - RNA, 18 nt, Human
cgaccgccgccgcugccg

SEQ ID NO: 989448 - RNA, 23 nt, Human
cuacucagagcaagauaguacag

SEQ ID NO: 989449 - RNA, 22 nt, Human
cucaaaggcaaaaagaugaguc

SEQ ID NO: 989450 - RNA, 23 nt, Human
cucaaaggcaaaaagaugagucc

SEQ ID NO: 989451 - RNA, 24 nt, Human
cucccgccaccacccggcucgguc

SEQ ID NO: 989452 - RNA, 18 nt, Human
cugcaagaaaaagaagcu

SEQ ID NO: 989453 - RNA, 23 nt, Human
cugcaagaaaaagaagcuggucu

SEQ ID NO: 989454 - RNA, 23 nt, Human
cugcauuuuuuuucucuucuucu

SEQ ID NO: 989455 - RNA, 18 nt, Human
cuuauuugcucagaucuu

SEQ ID NO: 989456 - RNA, 25 nt, Human
cuuccaauaccuccauacaugucug

SEQ ID NO: 989457 - RNA, 19 nt, Human
gaacagaccgacagaggca

SEQ ID NO: 989458 - RNA, 20 nt, Human
gaguucgguuuguacuucuc

SEQ ID NO: 989459 - RNA, 21 nt, Human
gcauuuuuuuucucuucuucu

SEQ ID NO: 989460 - RNA, 22 nt, Human
gcguugcccuacccggacaccu

SEQ ID NO: 989461 - RNA, 19 nt, Human
ggacuaguguucuuuccca

SEQ ID NO: 989462 - RNA, 20 nt, Human
ggaguuucaaccuuggccag

SEQ ID NO: 989463 - RNA, 19 nt, Human
gugaauuuuggaaacacaa

SEQ ID NO: 989464 - RNA, 18 nt, Human
uaaaauggaugcugucga

SEQ ID NO: 989465 - RNA, 20 nt, Human
uaaagaaaaacaaaaagaaa

SEQ ID NO: 989466 - RNA, 23 nt, Human
uaacaaguuuggccaaacaaugc

SEQ ID NO: 989467 - RNA, 22 nt, Human
uaauaaaacauaacaaagcacu

SEQ ID NO: 989468 - RNA, 24 nt, Human
uagcagcuuuaauuuuuuaagaaa

SEQ ID NO: 989469 - RNA, 23 nt, Human
uagcucuuugucagacauguuug

SEQ ID NO: 989470 - RNA, 20 nt, Human
uagugauucacauugcauac

SEQ ID NO: 989471 - RNA, 21 nt, Human
uaugcugucugagauauagua

SEQ ID NO: 989472 - RNA, 25 nt, Human
uauuacauugccucuggcuugcacc

SEQ ID NO: 989473 - RNA, 18 nt, Human
uauuugaaggcaagaaca

SEQ ID NO: 989474 - RNA, 22 nt, Human
uauuugaaggcaagaacauuua

SEQ ID NO: 989475 - RNA, 23 nt, Human
ucaagagacccuuucuucucaaa

SEQ ID NO: 989476 - RNA, 20 nt, Human
uccacauaugaucuaagggu

SEQ ID NO: 989477 - RNA, 19 nt, Human
ucccaacaauaagaacuuc

SEQ ID NO: 989478 - RNA, 20 nt, Human
ucccccacuacgggucuccg

SEQ ID NO: 989479 - RNA, 23 nt, Human
ucccugacaccagcacuuagccc

SEQ ID NO: 989480 - RNA, 18 nt, Human
uccggcugcucccgcugc

SEQ ID NO: 989481 - RNA, 25 nt, Human
uccuucuucuuuuucugauuucucu

SEQ ID NO: 989482 - RNA, 22 nt, Human
ucuuuuuuccuuucucacuuaa

SEQ ID NO: 989483 - RNA, 23 nt, Human
ugaaagguuugcauuguuguuuu

SEQ ID NO: 989484 - RNA, 21 nt, Human
ugaauauucauucuaagacaa

SEQ ID NO: 989485 - RNA, 23 nt, Human
ugacaagaguagcuuaggacguc

SEQ ID NO: 989486 - RNA, 23 nt, Human
ugagaauauuaagccugaggcua

SEQ ID NO: 989487 - RNA, 21 nt, Human
ugcaagaaaaagaagcugguc

SEQ ID NO: 989488 - RNA, 19 nt, Human
ugccucuggcuugcaccuc

SEQ ID NO: 989489 - RNA, 23 nt, Human
ugcugcuuuucuuuuucugcauu

SEQ ID NO: 989490 - RNA, 26 nt, Human
ugcuucagccuugaauaucucgaucc

SEQ ID NO: 989491 - RNA, 23 nt, Human
ugcuuuguuagcuguaacagccu

SEQ ID NO: 989492 - RNA, 23 nt, Human
uggaaacacaagcguauugaaca

SEQ ID NO: 989493 - RNA, 26 nt, Human
ugguagucaggaguucugggaugacu

SEQ ID NO: 989494 - RNA, 26 nt, Human
uguaacugcaagaaaaagaagcuggu

SEQ ID NO: 989495 - RNA, 18 nt, Human
ugucuuuuuuccuuucuc

SEQ ID NO: 989496 - RNA, 20 nt, Human
ugugcucagugaaagaaucc

SEQ ID NO: 989497 - RNA, 27 nt, Human
uguuguagguuucucugggggugaccc

SEQ ID NO: 989498 - RNA, 20 nt, Human
uguuguuuuaguucuucaag

SEQ ID NO: 989499 - RNA, 20 nt, Human
uuagccccuucuaaaaagcu

SEQ ID NO: 989500 - RNA, 20 nt, Human
uucaaguuuuaguuaaaauu

SEQ ID NO: 989501 - RNA, 24 nt, Human
uucacacauacacccccuauuaua

SEQ ID NO: 989502 - RNA, 18 nt, Human
uucacagaagcccaacac

SEQ ID NO: 989503 - RNA, 18 nt, Human
uuccuuuuuucacucuug

SEQ ID NO: 989504 - RNA, 24 nt, Human
uucucugcugcuuuucuuuuucug

SEQ ID NO: 989505 - RNA, 26 nt, Human
uuucucuucuucuaucugggcuuucu

SEQ ID NO: 989506 - RNA, 23 nt, Human
uuuuuguuuuuuugccaucuguu

SEQ ID NO: 989507 - RNA, 23 nt, Human
aaagagcccggcgcaccggagcc

SEQ ID NO: 989508 - RNA, 21 nt, Human
aaccaauggcgacuagagagc

SEQ ID NO: 989509 - RNA, 19 nt, Human
acagagcugcaaccccaug

SEQ ID NO: 989510 - RNA, 21 nt, Human
accuuacaaccuaggacauca

SEQ ID NO: 989511 - RNA, 18 nt, Human
agaauauacucuaacaca

SEQ ID NO: 989512 - RNA, 21 nt, Human
agcacugcgguggcggcagca

SEQ ID NO: 989513 - RNA, 20 nt, Human
agcauccagucauagaaaug

SEQ ID NO: 989514 - RNA, 20 nt, Human
agcauccagucauagaaaug

SEQ ID NO: 989515 - RNA, 20 nt, Human
agcauccagucauagaaaug

SEQ ID NO: 989516 - RNA, 22 nt, Human
agcauccagucauagaaauggc

SEQ ID NO: 989517 - RNA, 22 nt, Human
agcauccagucauagaaauggc

SEQ ID NO: 989518 - RNA, 22 nt, Human
agcauccagucauagaaauggc

SEQ ID NO: 989519 - RNA, 23 nt, Human
agccgucuguggggaccagccuc

SEQ ID NO: 989520 - RNA, 23 nt, Human
agccgucuguggggaccagccuc

SEQ ID NO: 989521 - RNA, 25 nt, Human
aggcccggccgugcggcggccgaaa

SEQ ID NO: 989522 - RNA, 18 nt, Human
aguccugccccucgccuu

SEQ ID NO: 989523 - RNA, 20 nt, Human
aguccugccccucgccuucc

SEQ ID NO: 989524 - RNA, 19 nt, Human
caaccuaggacaucaaugc

SEQ ID NO: 989525 - RNA, 25 nt, Human
cagccucuuuagggagaaacaguuu

SEQ ID NO: 989526 - RNA, 31 nt, Human
cagccucuuuagggagaaacaguuuaugacu

SEQ ID NO: 989527 - RNA, 31 nt, Human; identical to SEQ ID NO: 989526

SEQ ID NO: 989528 - RNA, 23 nt, Human
caggagggcagccugugaggccc

SEQ ID NO: 989529 - RNA, 21 nt, Human
ccccacacugaggccacuguc

SEQ ID NO: 989530 - RNA, 21 nt, Human
cccggcgcaccggagcagccg

SEQ ID NO: 989531 - RNA, 23 nt, Human
cccggcgcaccggagcagccgcg

SEQ ID NO: 989532 - RNA, 19 nt, Human
cccugggccgccucugccc

SEQ ID NO: 989533 - RNA, 18 nt, Human
ccucgccuuccaggcuga

SEQ ID NO: 989534 - RNA, 24 nt, Human
ccuuagcaccuuacaaccuaggac

SEQ ID NO: 989535 - RNA, 18 nt, Human
cgcgugccgccccugggc

SEQ ID NO: 989536 - RNA, 19 nt, Human
cggcagcagcggagcuggg

SEQ ID NO: 989537 - RNA, 21 nt, Human
cggcagcagcggagcuggggu

SEQ ID NO: 989538 - RNA, 21 nt, Human
cggccgaaaagagcccggcgc

SEQ ID NO: 989539 - RNA, 19 nt, Human
cucagcauccagucauaga

SEQ ID NO: 989540 - RNA, 21 nt, Human
cucagcauccagucauagaag

SEQ ID NO: 989541 - RNA, 21 nt, Human
cucagcauccagucauagaag

SEQ ID NO: 989542 - RNA, 19 nt, Human
cuggcauuccccacacuga

SEQ ID NO: 989543 - RNA, 24 nt, Human
cuggccguguucugagccucucuc

SEQ ID NO: 989544 - RNA, 19 nt, Human
cuuagccucaccucauggc

SEQ ID NO: 989545 - RNA, 20 nt, Human
cuuagccucaccucauggcc

SEQ ID NO: 989546 - RNA, 20 nt, Human
cuuagccucaccucauggcc

SEQ ID NO: 989547 - RNA, 23 nt, Human
gaaacauauacacuccuguggcc

SEQ ID NO: 989548 - RNA, 20 nt, Human
gaacagagcugcaaccccau

SEQ ID NO: 989549 - RNA, 22 nt, Human
gagcacugcgguggcggcagca

SEQ ID NO: 989550 - RNA, 21 nt, Human
gaguccugccccucgccuucc

SEQ ID NO: 989551 - RNA, 24 nt, Human
gcaagccgucuguggggaccagcc

SEQ ID NO: 989552 - RNA, 24 nt, Human
gcaagccgucuguggggaccagcc

SEQ ID NO: 989553 - RNA, 24 nt, Human
gcaagccgucuguggggaccagcc

SEQ ID NO: 989554 - RNA, 23 nt, Human
gccucuuuagggagaaacaguuu

SEQ ID NO: 989555 - RNA, 18 nt, Human
gcuggcauuccccuuagc

SEQ ID NO: 989556 - RNA, 18 nt, Human
ggcagcagcggagcuggg

SEQ ID NO: 989557 - RNA, 19 nt, Human
ggccgaaaagagcccggcg

SEQ ID NO: 989558 - RNA, 26 nt, Human
ggccgaaaagagcccggcgcaccgga

SEQ ID NO: 989559 - RNA, 23 nt, Human
uacaaccuaggacaucaaugcca

SEQ ID NO: 989560 - RNA, 21 nt, Human
uaccuggccguguucugagcc

SEQ ID NO: 989561 - RNA, 19 nt, Human
uaggacaucaaugccacac

SEQ ID NO: 989562 - RNA, 21 nt, Human
ugaacagagcugcaaccccau

SEQ ID NO: 989563 - RNA, 21 nt, Human
ugccccgccgccgcggagucc

SEQ ID NO: 989564 - RNA, 28 nt, Human
ugcggcggccgaaaagagcccggcgcac

SEQ ID NO: 989565 - RNA, 20 nt, Human
uggaaaguuuagguaaccaa

SEQ ID NO: 989566 - RNA, 24 nt, Human
uggaaaguuuagguaaccaauggc

SEQ ID NO: 989567 - RNA, 22 nt, Human
uggaccucugaaccagcaggcu

SEQ ID NO: 989568 - RNA, 22 nt, Human
uggaccucugaaccagcaggcu

SEQ ID NO: 989569 - RNA, 22 nt, Human
uggaccucugaaccagcaggcu

SEQ ID NO: 989570 - RNA, 19 nt, Human
uggccugggacaaguuggu

SEQ ID NO: 989571 - RNA, 18 nt, Human
uggcggcagcagcggagc

SEQ ID NO: 989572 - RNA, 20 nt, Human
uggcggcagcagcggagcug

SEQ ID NO: 989573 - RNA, 23 nt, Human
uggcggcagcagcggagcugggg

SEQ ID NO: 989574 - RNA, 21 nt, Human
uggggaccagccucuuuaggg

SEQ ID NO: 989575 - RNA, 21 nt, Human
uggggaccagccucuuuaggg

SEQ ID NO: 989576 - RNA, 20 nt, Human
ugucuggggaguccugcccc

SEQ ID NO: 989577 - RNA, 24 nt, Human
uguggggaccagccucuuuaggga

SEQ ID NO: 989578 - RNA, 24 nt, Human
uguggggaccagccucuuuaggga

SEQ ID NO: 989579 - RNA, 19 nt, Human
uucauuucuucaaaaacug

SEQ ID NO: 989580 - RNA, 19 nt, Human
uucauuucuucaaaaacug

SEQ ID NO: 989581 - RNA, 20 nt, Human
uucuuuucuuuuuuucuaua

SEQ ID NO: 989582 - RNA, 26 nt, Human
aaaaaaaaaaaaaaaagcaaaacaaa

SEQ ID NO: 989583 - RNA, 25 nt, Human
aaaaaaaaaaaaauuagcagcuuaa

SEQ ID NO: 989584 - RNA, 25 nt, Human
aaaaaaaaaaagcaaaacaaaaaag

SEQ ID NO: 989585 - RNA, 27 nt, Human
aaaaaaaagcaaaacaaaaaaacaaaa

SEQ ID NO: 989586 - RNA, 23 nt, Human
aaaaaaauauaaacaagaaacug

SEQ ID NO: 989587 - RNA, 24 nt, Human
aaaaaacguagucacaaguaccac

SEQ ID NO: 989588 - RNA, 20 nt, Human
aaaaagcaaaacaaaaaaac

SEQ ID NO: 989589 - RNA, 19 nt, Human
aaaacaaaaccaacagagc

SEQ ID NO: 989590 - RNA, 25 nt, Human
aaaacaaacaaacaacaaaaaaccc

SEQ ID NO: 989591 - RNA, 23 nt, Human
aaaaccaacagagcauaauaccc

SEQ ID NO: 989592 - RNA, 22 nt, Human
aaaagaaaaaaaaaaaaaaaag

SEQ ID NO: 989593 - RNA, 21 nt, Human
aaaagcaaaacaaaaaaacaa

SEQ ID NO: 989594 - RNA, 20 nt, Human
aaaauucugaaucacugcua

SEQ ID NO: 989595 - RNA, 25 nt, Human
aaacaaaaaaacaaaaccaacagag

SEQ ID NO: 989596 - RNA, 18 nt, Human
aaacaaaaccaacagagc

SEQ ID NO: 989597 - RNA, 27 nt, Human
aaacaaaaccaacagagcauaauaccc

SEQ ID NO: 989598 - RNA, 19 nt, Human
aaacaaacaaacaacaaaa

SEQ ID NO: 989599 - RNA, 25 nt, Human
aaacaaacaaacaacaaaaaaccca

SEQ ID NO: 989600 - RNA, 20 nt, Human
aaacaaacaacaaaaaaccc

SEQ ID NO: 989601 - RNA, 24 nt, Human
aaacaaacaacaaaaaacccaaaa

SEQ ID NO: 989602 - RNA, 25 nt, Human
aaacaaacaacaaaaaacccaaaac

SEQ ID NO: 989603 - RNA, 21 nt, Human
aaacaaagcaaaacaaacaaa

SEQ ID NO: 989604 - RNA, 24 nt, Human
aaagcaaaacaaacaaacaacaaa

SEQ ID NO: 989605 - RNA, 22 nt, Human
aacaaaaaaacaaaaccaacag

SEQ ID NO: 989606 - RNA, 21 nt, Human
aacaaacaaacaacaaaaaac

SEQ ID NO: 989607 - RNA, 24 nt, Human
aacaaacaacaaaaaacccaaaac

SEQ ID NO: 989608 - RNA, 23 nt, Human
aacaacaaaaaacccaaaacuac

SEQ ID NO: 989609 - RNA, 21 nt, Human
aagcaaaacaaaaaaacaaaa

SEQ ID NO: 989610 - RNA, 19 nt, Human
aagcaaaacaaacaaacaa

SEQ ID NO: 989611 - RNA, 22 nt, Human
aagcaaaacaaacaaacaacaa

SEQ ID NO: 989612 - RNA, 23 nt, Human
aagccacaucaccaaaaaacaaa

SEQ ID NO: 989613 - RNA, 22 nt, Human
aauaacagaggucaaccacaga

SEQ ID NO: 989614 - RNA, 23 nt, Human
aaucucuuaaaaaacaaagcaaa

SEQ ID NO: 989615 - RNA, 22 nt, Human
aaucuucgagauauaaauuuga

SEQ ID NO: 989616 - RNA, 25 nt, Human
acaaaaccaacagagcauaauaccc

SEQ ID NO: 989617 - RNA, 18 nt, Human
acaaaaccaucgugaaug

SEQ ID NO: 989618 - RNA, 19 nt, Human
acaaacaacaaaaaaccca

SEQ ID NO: 989619 - RNA, 25 nt, Human
acaaagcaaaacaaacaaacaacaa

SEQ ID NO: 989620 - RNA, 26 nt, Human
acaaagcaaaacaaacaaacaacaaa

SEQ ID NO: 989621 - RNA, 27 nt, Human
acaaagcaaaacaaacaaacaacaaaa

SEQ ID NO: 989622 - RNA, 21 nt, Human
acaaaugcagaaucagagcag

SEQ ID NO: 989623 - RNA, 19 nt, Human
acaacaaaaaacccaaaac

SEQ ID NO: 989624 - RNA, 20 nt, Human
acaacacaggauauaaccca

SEQ ID NO: 989625 - RNA, 19 nt, Human
acaaggaaauuccccuccu

SEQ ID NO: 989626 - RNA, 21 nt, Human
accaaaaaacaaaaaagaaaa

SEQ ID NO: 989627 - RNA, 22 nt, Human
acucagcauauuagguuuccua

SEQ ID NO: 989628 - RNA, 24 nt, Human
agaaaaaaaaaaaaaaaagcaaaa

SEQ ID NO: 989629 - RNA, 20 nt, Human
agaaaacaacaugagagauu

SEQ ID NO: 989630 - RNA, 20 nt, Human
agaagguuagugcaauuaua

SEQ ID NO: 989631 - RNA, 18 nt, Human
agaauucacaagcuguga

SEQ ID NO: 989632 - RNA, 20 nt, Human
agcaaaacaaaaaaacaaaa

SEQ ID NO: 989633 - RNA, 26 nt, Human
agcaaaacaaaaaaacaaaaccaaca

SEQ ID NO: 989634 - RNA, 30 nt, Human
agcaaaacaaaaaaacaaaaccaacagagg

SEQ ID NO: 989635 - RNA, 23 nt, Human
agcaaaacaaacaaacaacaaaa

SEQ ID NO: 989636 - RNA, 25 nt, Human
agggaaaaaaagaauauaauccaug

SEQ ID NO: 989637 - RNA, 24 nt, Human
auaaaauguaccaaacaucuaccc

SEQ ID NO: 989638 - RNA, 25 nt, Human
augcaccaacugaauauaugcuccc

SEQ ID NO: 989639 - RNA, 18 nt, Human
auucaaaggggagaaaca

SEQ ID NO: 989640 - RNA, 25 nt, Human
auuuaauuuccaauucccccuucca

SEQ ID NO: 989641 - RNA, 21 nt, Human
auuuuaggggcacagcagauu

SEQ ID NO: 989642 - RNA, 19 nt, Human
caaaaaagaaaaaaaaaaa

SEQ ID NO: 989643 - RNA, 19 nt, Human
caaaacaaaaaaacaaaac

SEQ ID NO: 989644 - RNA, 21 nt, Human
caaaacaaaaaaacaaaacca

SEQ ID NO: 989645 - RNA, 21 nt, Human
caaacaacaaaaaacccaaaa

SEQ ID NO: 989646 - RNA, 24 nt, Human
caaacaacaaaaaacccaaaacua

SEQ ID NO: 989647 - RNA, 23 nt, Human
caacaaaaaacccaaaacuacgu

SEQ ID NO: 989648 - RNA, 20 nt, Human
caacacaggauauaacccau

SEQ ID NO: 989649 - RNA, 23 nt, Human
caaccacagauguggaccuccag

SEQ ID NO: 989650 - RNA, 24 nt, Human
caaccacagauguggaccuccagc

SEQ ID NO: 989651 - RNA, 23 nt, Human
caacugaauauaugcucugggag

SEQ ID NO: 989652 - RNA, 22 nt, Human
caagugccagauacucagcaua

SEQ ID NO: 989653 - RNA, 22 nt, Human
cacagaaugauggacacuucga

SEQ ID NO: 989654 - RNA, 24 nt, Human
cacaucaccaaaaaacaaaaaaga

SEQ ID NO: 989655 - RNA, 19 nt, Human
cagaggucaaccacagaug

SEQ ID NO: 989656 - RNA, 23 nt, Human
cagcaauaaaagcaggaauucaa

SEQ ID NO: 989657 - RNA, 20 nt, Human
caguacaugggucagggaca

SEQ ID NO: 989658 - RNA, 22 nt, Human
cauauaaacauggccucaugca

SEQ ID NO: 989659 - RNA, 24 nt, Human
ccaauucccccuuccacaacaugc

SEQ ID NO: 989660 - RNA, 19 nt, Human
ccaccgccuccaaccaccc

SEQ ID NO: 989661 - RNA, 22 nt, Human
ccaccgccuccaaccaccccca

SEQ ID NO: 989662 - RNA, 24 nt, Human
ccccuccucgccgccgccgccacu

SEQ ID NO: 989663 - RNA, 26 nt, Human
ccgccgccgccaccgccuccaaccac

SEQ ID NO: 989664 - RNA, 22 nt, Human
ccgccuccaaccacccccaaaa

SEQ ID NO: 989665 - RNA, 19 nt, Human
ccuacguaagucacagggu

SEQ ID NO: 989666 - RNA, 19 nt, Human
cgccaccgccuccaaccac

SEQ ID NO: 989667 - RNA, 23 nt, Human
cgccgccgccaccgccuccaacc

SEQ ID NO: 989668 - RNA, 18 nt, Human
cgugaaugacugccucuc

SEQ ID NO: 989669 - RNA, 21 nt, Human
cgugaaugacugccucucuug

SEQ ID NO: 989670 - RNA, 26 nt, Human
cuccucgccgccgccgccaccgccuc

SEQ ID NO: 989671 - RNA, 22 nt, Human
cucuuaaaaaacaaagcaaaac

SEQ ID NO: 989672 - RNA, 23 nt, Human
cucuucagaaaugacauaccugg

SEQ ID NO: 989673 - RNA, 18 nt, Human
cuggaaacgguggccucc

SEQ ID NO: 989674 - RNA, 22 nt, Human
cuuaaaccaugaggucacaaca

SEQ ID NO: 989675 - RNA, 24 nt, Human
gcaagaacaaacuacugcugcaag

SEQ ID NO: 989676 - RNA, 19 nt, Human
ggagccauaaaauguacca

SEQ ID NO: 989677 - RNA, 20 nt, Human
ggcuguaguggacuggccau

SEQ ID NO: 989678 - RNA, 20 nt, Human
gggaauggaggcacaaggaa

SEQ ID NO: 989679 - RNA, 21 nt, Human
gggaauggaggcacaaggaaa

SEQ ID NO: 989680 - RNA, 18 nt, Human
gugaacagaauucacaag

SEQ ID NO: 989681 - RNA, 18 nt, Human
gugcaacugaauauccgg

SEQ ID NO: 989682 - RNA, 18 nt, Human
guuaaucaugacaagccu

SEQ ID NO: 989683 - RNA, 23 nt, Human
uaaaaaacaaagcaaaacaaaca

SEQ ID NO: 989684 - RNA, 26 nt, Human
uaaaaaacaaagcaaaacaaacaaac

SEQ ID NO: 989685 - RNA, 22 nt, Human
uaaaaagagcuggcacaaaacc

SEQ ID NO: 989686 - RNA, 26 nt, Human
uaaaaggccucaaaauaauuagugac

SEQ ID NO: 989687 - RNA, 21 nt, Human
uaaaaucuucgagauauaaau

SEQ ID NO: 989688 - RNA, 25 nt, Human
uaaacaauaacagaggucaaccaca

SEQ ID NO: 989689 - RNA, 22 nt, Human
uaaaccaaaaacgaaauuuuaa

SEQ ID NO: 989690 - RNA, 23 nt, Human
uaagccacaucaccaaaaaacaa

SEQ ID NO: 989691 - RNA, 22 nt, Human
uaagguagcaaacauuuugcca

SEQ ID NO: 989692 - RNA, 22 nt, Human
uacacagaaugauggacacuuc

SEQ ID NO: 989693 - RNA, 23 nt, Human
uaccaauagcaaaugcuacccua

SEQ ID NO: 989694 - RNA, 20 nt, Human
uaccacaaaugcagaaucag

SEQ ID NO: 989695 - RNA, 22 nt, Human
uagcaaagcaacgaaugcugaa

SEQ ID NO: 989696 - RNA, 20 nt, Human
uauacacuguauguauauau

SEQ ID NO: 989697 - RNA, 19 nt, Human
uauaguagugauuacuaaa

SEQ ID NO: 989698 - RNA, 21 nt, Human
uauauacacuguauguauaua

SEQ ID NO: 989699 - RNA, 20 nt, Human
uauccaaaacuucuaaaugc

SEQ ID NO: 989700 - RNA, 27 nt, Human
ucaccaaaaaacaaaaaagaaaaaaaa

SEQ ID NO: 989701 - RNA, 23 nt, Human
ucauuugucuguauauguuacuc

SEQ ID NO: 989702 - RNA, 20 nt, Human
ucccaaaaaagaaacuauug

SEQ ID NO: 989703 - RNA, 18 nt, Human
ucgccgccgccgccaccg

SEQ ID NO: 989704 - RNA, 25 nt, Human
ucgccgccgccgccaccgccuccaa

SEQ ID NO: 989705 - RNA, 23 nt, Human
ucuaugguaauuaaaaaaaaagu

SEQ ID NO: 989706 - RNA, 22 nt, Human
ucucuguacauacaaacugcuc

SEQ ID NO: 989707 - RNA, 18 nt, Human
ucuuuuguuugagauugu

SEQ ID NO: 989708 - RNA, 20 nt, Human
ugaaaucaaucaaagcugca

SEQ ID NO: 989709 - RNA, 27 nt, Human
ugaacagaauucacaagcugugacaaa

SEQ ID NO: 989710 - RNA, 22 nt, Human
ugcaacugaauauccggucacc

SEQ ID NO: 989711 - RNA, 21 nt, Human
ugcuggaaacgguggccucca

SEQ ID NO: 989712 - RNA, 19 nt, Human
uggcagaaauaugucccaa

SEQ ID NO: 989713 - RNA, 18 nt, Human
uggcagugcauugaugug

SEQ ID NO: 989714 - RNA, 19 nt, Human
uggccaugguucaaguggg

SEQ ID NO: 989715 - RNA, 20 nt, Human
uggccuccaacgccgcuccc

SEQ ID NO: 989716 - RNA, 19 nt, Human
uguaaguccauuuucucug

SEQ ID NO: 989717 - RNA, 23 nt, Human
uguauaaagaaaacaacaugaga

SEQ ID NO: 989718 - RNA, 19 nt, Human
uuaagccacaucaccaaaa

SEQ ID NO: 989719 - RNA, 20 nt, Human
uugcuaagcucaacaauaag

SEQ ID NO: 989720 - RNA, 20 nt, Human
uuuaagaaaauacuugauau

SEQ ID NO: 989721 - RNA, 25 nt, Human
uuucacaauagugcacauuuuuacc

SEQ ID NO: 989722 - RNA, 24 nt, Human
aaaggugcucaguuagagauucua

SEQ ID NO: 989723 - RNA, 18 nt, Human
acacuguagccgugaaug

SEQ ID NO: 989724 - RNA, 20 nt, Human
agguagugcacacugugaca

SEQ ID NO: 989725 - RNA, 23 nt, Human
agguuuggaauaaaauccaaagg

SEQ ID NO: 989726 - RNA, 19 nt, Human
auaaaacacauuagcucaa

SEQ ID NO: 989727 - RNA, 23 nt, Human
auuauuguugguccaguuuuccu

SEQ ID NO: 989728 - RNA, 24 nt, Human
cacauuagcucaaaauggaaaaaa

SEQ ID NO: 989729 - RNA, 24 nt, Human
cccgccccggcccguugcuaggag

SEQ ID NO: 989730 - RNA, 24 nt, Human
cccgcgacaauaaauagacuagag

SEQ ID NO: 989731 - RNA, 24 nt, Human
cccguugcuaggagcccccgaggc

SEQ ID NO: 989732 - RNA, 24 nt, Human
ccggcccguugcuaggagcccccg

SEQ ID NO: 989733 - RNA, 19 nt, Human
ccuugcuuuguuguuccgg

SEQ ID NO: 989734 - RNA, 21 nt, Human
cggaugcgaaggagaagcugg

SEQ ID NO: 989735 - RNA, 18 nt, Human
cucaaaauggaaaaaaau

SEQ ID NO: 989736 - RNA, 24 nt, Human
cucaaaauggaaaaaaauaacaau

SEQ ID NO: 989737 - RNA, 20 nt, Human
cuuccuugcuuuguuguucc

SEQ ID NO: 989738 - RNA, 20 nt, Human
cuugcuuuguuguuccgggu

SEQ ID NO: 989739 - RNA, 24 nt, Human
cuuguaaacuuccuuuuauauuac

SEQ ID NO: 989740 - RNA, 18 nt, Human
gaauuacugcgaaaauaa

SEQ ID NO: 989741 - RNA, 22 nt, Human
gccccggcccguugcuaggagc

SEQ ID NO: 989742 - RNA, 21 nt, Human
gcgaaggagaagcuggaggac

SEQ ID NO: 989743 - RNA, 20 nt, Human
gcgaggcggccgcagcuucc

SEQ ID NO: 989744 - RNA, 20 nt, Human
gcucugcuuauggggacaug

SEQ ID NO: 989745 - RNA, 22 nt, Human
gcuggaggacaaggaugaggau

SEQ ID NO: 989746 - RNA, 18 nt, Human
ggaacucccgccccggcc

SEQ ID NO: 989747 - RNA, 19 nt, Human
gugcagcagguuuaaaagg

SEQ ID NO: 989748 - RNA, 20 nt, Human
uaaaacacauuagcucaaaa

SEQ ID NO: 989749 - RNA, 24 nt, Human
uaaaagcagcaauaucaugucuug

SEQ ID NO: 989750 - RNA, 22 nt, Human
uaaaaggugcucaguuagagau

SEQ ID NO: 989751 - RNA, 22 nt, Human
uacagcaagguuuggaauaaaa

SEQ ID NO: 989752 - RNA, 21 nt, Human
uagaauguccuuuuguaaaag

SEQ ID NO: 989753 - RNA, 24 nt, Human
uagcucaaaauggaaaaaaauaac

SEQ ID NO: 989754 - RNA, 22 nt, Human
uccccagucuccauggaacucc

SEQ ID NO: 989755 - RNA, 21 nt, Human
uccuugcuuuguuguuccggg

SEQ ID NO: 989756 - RNA, 19 nt, Human
ucuccauggaacucccgcc

SEQ ID NO: 989757 - RNA, 23 nt, Human
ucugcuuauggggacaugagaau

SEQ ID NO: 989758 - RNA, 20 nt, Human
ugaggaugagacgggcgcgc

SEQ ID NO: 989759 - RNA, 22 nt, Human
ugaggaugagacgggcgcgcuc

SEQ ID NO: 989760 - RNA, 22 nt, Human
ugcacauucaauugaaaaagau

SEQ ID NO: 989761 - RNA, 24 nt, Human
uggcugaggacgcggcggcagcgc

SEQ ID NO: 989762 - RNA, 18 nt, Human
ugggaagagggagcggug

SEQ ID NO: 989763 - RNA, 19 nt, Human
uguuguuccgggugcgagg

SEQ ID NO: 989764 - RNA, 23 nt, Human
uuccuugcuuuguuguuccgggu

SEQ ID NO: 989765 - RNA, 25 nt, Human
uuggaauaaaauccaaagggacuuu

SEQ ID NO: 989766 - RNA, 23 nt, Human
uuuuuuuuuuuuuuuuuaucuuu

SEQ ID NO: 989767 - RNA, 18 nt, Human
aacaaacuucugucaccu

SEQ ID NO: 989768 - RNA, 18 nt, Human
aacaggauaacagaggga

SEQ ID NO: 989769 - RNA, 23 nt, Human
aaccauugaagguuucugagcag

SEQ ID NO: 989770 - RNA, 19 nt, Human
aaccuccugagaucaagcg

SEQ ID NO: 989771 - RNA, 18 nt, Human
aagcagaagugugaaccu

SEQ ID NO: 989772 - RNA, 25 nt, Human
aagcgauccucuuaccuuggccucc

SEQ ID NO: 989773 - RNA, 19 nt, Human
aaguaguugggacuauagg

SEQ ID NO: 989774 - RNA, 23 nt, Human
acaaagcaggaagcaguggccuu

SEQ ID NO: 989775 - RNA, 19 nt, Human
acccaggcuggagugcaau

SEQ ID NO: 989776 - RNA, 19 nt, Human
acugcagccucaaccuccu

SEQ ID NO: 989777 - RNA, 22 nt, Human
agaaaaugguggagagaugcaa

SEQ ID NO: 989778 - RNA, 18 nt, Human
agaagaaaaugguggaga

SEQ ID NO: 989779 - RNA, 24 nt, Human
agacacacucacagguaacaaaaa

SEQ ID NO: 989780 - RNA, 22 nt, Human
agccucaaccuccugagaucaa

SEQ ID NO: 989781 - RNA, 24 nt, Human
agcuggucucgaacuccugaccuc

SEQ ID NO: 989782 - RNA, 25 nt, Human
agcuuuauucuuuuuguuaaccuua

SEQ ID NO: 989783 - RNA, 21 nt, Human
aggaagugaggcuuuccagaa

SEQ ID NO: 989784 - RNA, 22 nt, Human
aggauaacagagggaccuaagc

SEQ ID NO: 989785 - RNA, 20 nt, Human
aggauuccuuucuuucuuuc

SEQ ID NO: 989786 - RNA, 21 nt, Human
aggauuccuuucuuucuuucu

SEQ ID NO: 989787 - RNA, 21 nt, Human
aggcuuaaacuaccacaccca

SEQ ID NO: 989788 - RNA, 23 nt, Human
agggaccuaagcuggggaagugg

SEQ ID NO: 989789 - RNA, 18 nt, Human
agggcugagauuauaggc

SEQ ID NO: 989790 - RNA, 20 nt, Human
aggugagcucuauggcagag

SEQ ID NO: 989791 - RNA, 18 nt, Human
agugcagaagaaaauggu

SEQ ID NO: 989792 - RNA, 18 nt, Human
auaauucacugcagccuc

SEQ ID NO: 989793 - RNA, 18 nt, Human
aucauaauucacugcagc

SEQ ID NO: 989794 - RNA, 21 nt, Human
aucuaccacccaggcuggagu

SEQ ID NO: 989795 - RNA, 24 nt, Human
aucuaccacccaggcuggagugca

SEQ ID NO: 989796 - RNA, 21 nt, Human
augaauguucagagaacagag

SEQ ID NO: 989797 - RNA, 25 nt, Human
caaagacaagaaggcuaggccucac

SEQ ID NO: 989798 - RNA, 26 nt, Human
caaagcagaagugugaaccugagccc

SEQ ID NO: 989799 - RNA, 19 nt, Human
caaaugaucuaacuagcau

SEQ ID NO: 989800 - RNA, 22 nt, Human
caacaggauaacagagggaccu

SEQ ID NO: 989801 - RNA, 22 nt, Human
caaccuccugagaucaagcgau

SEQ ID NO: 989802 - RNA, 24 nt, Human
caaccuccugagaucaagcgaucc

SEQ ID NO: 989803 - RNA, 20 nt, Human
cacauacuuuccaggcuuca

SEQ ID NO: 989804 - RNA, 24 nt, Human
caccuccaccuccagcuaguggga

SEQ ID NO: 989805 - RNA, 20 nt, Human
cacuaaggcacaggcaaggu

SEQ ID NO: 989806 - RNA, 24 nt, Human
cacuuuguugcacaagcuggucuc

SEQ ID NO: 989807 - RNA, 19 nt, Human
cagaagaaaaugguggaga

SEQ ID NO: 989808 - RNA, 23 nt, Human
cagccucaaccuccugagaucaa

SEQ ID NO: 989809 - RNA, 21 nt, Human
caggccaccaugcccagcuaa

SEQ ID NO: 989810 - RNA, 24 nt, Human
cauccaaacugaacccucucccag

SEQ ID NO: 989811 - RNA, 22 nt, Human
cauccuggucucaaagcagaag

SEQ ID NO: 989812 - RNA, 18 nt, Human
ccacacauacuuuccagg

SEQ ID NO: 989813 - RNA, 23 nt, Human
ccugaccucaagcgauccucuua

SEQ ID NO: 989814 - RNA, 24 nt, Human
ccuugaucuaccacccaggcugga

SEQ ID NO: 989815 - RNA, 18 nt, Human
cuagcaucauccaaacug

SEQ ID NO: 989816 - RNA, 23 nt, Human
cuagcaucauccaaacugaaccc

SEQ ID NO: 989817 - RNA, 21 nt, Human
cucaaagcagaagugugaacc

SEQ ID NO: 989818 - RNA, 24 nt, Human
cucaagcgauccucuuaccuuggc

SEQ ID NO: 989819 - RNA, 18 nt, Human
cucacagguaacaaaaau

SEQ ID NO: 989820 - RNA, 26 nt, Human
cucacagguaacaaaaauacaaggca

SEQ ID NO: 989821 - RNA, 18 nt, Human
cuccacagaaaaggaagu

SEQ ID NO: 989822 - RNA, 23 nt, Human
cuccacagaaaaggaagugaggc

SEQ ID NO: 989823 - RNA, 18 nt, Human
cucccaguaugacuucug

SEQ ID NO: 989824 - RNA, 24 nt, Human
cucuaaguaguugggacuauaggc

SEQ ID NO: 989825 - RNA, 23 nt, Human
cugagcccuguggccacacauac

SEQ ID NO: 989826 - RNA, 22 nt, Human
gaaaaugggagugcagaagaaa

SEQ ID NO: 989827 - RNA, 27 nt, Human
gaaaaugguggagagaugccgguaccc

SEQ ID NO: 989828 - RNA, 19 nt, Human
gaggcaaaaacaacgggag

SEQ ID NO: 989829 - RNA, 26 nt, Human
gagggaccuaagcuggggaagugguu

SEQ ID NO: 989830 - RNA, 18 nt, Human
gaugguacuuaacaaacu

SEQ ID NO: 989831 - RNA, 23 nt, Human
gcacaagcuggucucgaacuccu

SEQ ID NO: 989832 - RNA, 22 nt, Human
gcucuauggcagaggcaaaaac

SEQ ID NO: 989833 - RNA, 24 nt, Human
ggacuauaggcacaggccaccaug

SEQ ID NO: 989834 - RNA, 20 nt, Human
ggcuuacaccccauccuggu

SEQ ID NO: 989835 - RNA, 20 nt, Human
gggagaacagcgagcagaga

SEQ ID NO: 989836 - RNA, 26 nt, Human
gguaauggugaaccauugaagguuuc

SEQ ID NO: 989837 - RNA, 19 nt, Human
ggucucgaacuccugaccu

SEQ ID NO: 989838 - RNA, 18 nt, Human
gugguuucaggccagaug

SEQ ID NO: 989839 - RNA, 21 nt, Human
uaacaaaaauacaaggcaaaa

SEQ ID NO: 989840 - RNA, 19 nt, Human
uaacagagggaccuaagcu

SEQ ID NO: 989841 - RNA, 23 nt, Human
uaacuagcaucauccaaacugaa

SEQ ID NO: 989842 - RNA, 19 nt, Human
uaaggcacaggcaagguau

SEQ ID NO: 989843 - RNA, 20 nt, Human
uaccacccaggcuggagugc

SEQ ID NO: 989844 - RNA, 22 nt, Human
uagagacaggcucucacuuugu

SEQ ID NO: 989845 - RNA, 19 nt, Human
ucacugcagccucaaccuc

SEQ ID NO: 989846 - RNA, 20 nt, Human
ucacugcagccucaaccucc

SEQ ID NO: 989847 - RNA, 22 nt, Human
ucacugcagccucaaccuccug

SEQ ID NO: 989848 - RNA, 24 nt, Human
ucagcagaucagauguuggaugca

SEQ ID NO: 989849 - RNA, 24 nt, Human
ucuaaguaguugggacuauaggca

SEQ ID NO: 989850 - RNA, 18 nt, Human
ucuaccacccaggcugga

SEQ ID NO: 989851 - RNA, 24 nt, Human
ucuaccacccaggcuggagugcaa

SEQ ID NO: 989852 - RNA, 28 nt, Human
ucuauggcagaggcaaaaaccggggucc

SEQ ID NO: 989853 - RNA, 23 nt, Human
ucucacuuuguugcacaagcugg

SEQ ID NO: 989854 - RNA, 21 nt, Human
ucucgaacuccugaccucaag

SEQ ID NO: 989855 - RNA, 22 nt, Human
ucuuucuuucuuucuuucuuuu

SEQ ID NO: 989856 - RNA, 24 nt, Human
ugaaccugagcccuguggccacac

SEQ ID NO: 989857 - RNA, 19 nt, Human
ugaagguuucugagcagag

SEQ ID NO: 989858 - RNA, 18 nt, Human
ugaccucaagcgauccuc

SEQ ID NO: 989859 - RNA, 21 nt, Human
ugaccucaagcgauccucuua

SEQ ID NO: 989860 - RNA, 22 nt, Human
ugagauuauaggcuuaaacuac

SEQ ID NO: 989861 - RNA, 22 nt, Human
ugaucuaacuagcaucauccaa

SEQ ID NO: 989862 - RNA, 24 nt, Human
ugaucuaccacccaggcuggagug

SEQ ID NO: 989863 - RNA, 20 nt, Human
uggcaagaauaagcugcaga

SEQ ID NO: 989864 - RNA, 21 nt, Human
uggcaagaauaagcugcagag

SEQ ID NO: 989865 - RNA, 18 nt, Human
uggcagaggcaaaaacaa

SEQ ID NO: 989866 - RNA, 19 nt, Human
uggcagaggcaaaaacaac

SEQ ID NO: 989867 - RNA, 24 nt, Human
ugggaagggagauuccacagucug

SEQ ID NO: 989868 - RNA, 21 nt, Human
ugggacuauaggcacaggcca

SEQ ID NO: 989869 - RNA, 22 nt, Human
ugggacuauaggcacaggccac

SEQ ID NO: 989870 - RNA, 24 nt, Human
ugggacuauaggcacaggccacca

SEQ ID NO: 989871 - RNA, 22 nt, Human
ugugcaaagaggcuccuaggau

SEQ ID NO: 989872 - RNA, 20 nt, Human
uguugcacaagcuggucucg

SEQ ID NO: 989873 - RNA, 20 nt, Human
uuccacagucugacucacua

SEQ ID NO: 989874 - RNA, 18 nt, Human
uucuuuuuuuucaaauga

SEQ ID NO: 989875 - RNA, 22 nt, Human
uuucagccaggcucugggaggu

SEQ ID NO: 989876 - RNA, 18 nt, Human
uuugagaauaagaggcag

SEQ ID NO: 989877 - RNA, 21 nt, Human
uuugccgagagccguuaccca

SEQ ID NO: 989878 - RNA, 22 nt, Human
uuuuuuuuuuuuuuuuuuucag

SEQ ID NO: 989879 - RNA, 21 nt, Human
aaaaacacacacccacacaca

SEQ ID NO: 989880 - RNA, 23 nt, Human
aaaauccuucuugagccccacuu

SEQ ID NO: 989881 - RNA, 19 nt, Human
aaacacacacccacacaca

SEQ ID NO: 989882 - RNA, 22 nt, Human
aaacacacacccacacacaacc

SEQ ID NO: 989883 - RNA, 24 nt, Human
aaagcuccuucaugcccaagacuu

SEQ ID NO: 989884 - RNA, 24 nt, Human
aaauccuucuugagccccacuucc

SEQ ID NO: 989885 - RNA, 23 nt, Human
aaccaaaagcaagacgcagcacc

SEQ ID NO: 989886 - RNA, 18 nt, Human
aagaaaaaacacacaccc

SEQ ID NO: 989887 - RNA, 20 nt, Human
aagacgcagcaccagguaaa

SEQ ID NO: 989888 - RNA, 23 nt, Human
acacaaccaccacaaacaauauc

SEQ ID NO: 989889 - RNA, 18 nt, Human
acacacccacacacaacc

SEQ ID NO: 989890 - RNA, 24 nt, Human
acacccacacacaaccaccacaaa

SEQ ID NO: 989891 - RNA, 20 nt, Human
acagagaagggccagaggga

SEQ ID NO: 989892 - RNA, 24 nt, Human
accccaaaauccuucuugagcccc

SEQ ID NO: 989893 - RNA, 24 nt, Human
agaaaaagaaaaaacacacaccca

SEQ ID NO: 989894 - RNA, 21 nt, Human
agacaaaaggaauauauccag

SEQ ID NO: 989895 - RNA, 19 nt, Human
agagaagggccagagggag

SEQ ID NO: 989896 - RNA, 18 nt, Human
agagggagcgggggccuu

SEQ ID NO: 989897 - RNA, 22 nt, Human
aggccagcuguccaaagucagg

SEQ ID NO: 989898 - RNA, 21 nt, Human
agggcagaggauggggcaagg

SEQ ID NO: 989899 - RNA, 23 nt, Human
agggggagcccaggccagcuguc

SEQ ID NO: 989900 - RNA, 20 nt, Human
agugaugaagacaaaaggaa

SEQ ID NO: 989901 - RNA, 24 nt, Human
caaaaagcuccuucaugcccaaga

SEQ ID NO: 989902 - RNA, 25 nt, Human
caaaaagcuccuucaugcccaagac

SEQ ID NO: 989903 - RNA, 23 nt, Human
caaccaccacaaacaauaucuug

SEQ ID NO: 989904 - RNA, 21 nt, Human
caaggggacaccccucucagg

SEQ ID NO: 989905 - RNA, 21 nt, Human
cacacaaccaccacaaacaau

SEQ ID NO: 989906 - RNA, 22 nt, Human
cacacacaaccaccacaaacaa

SEQ ID NO: 989907 - RNA, 23 nt, Human
cacacacaaccaccacaaacaau

SEQ ID NO: 989908 - RNA, 24 nt, Human
cacuagaugcaaaaagcuccuuca

SEQ ID NO: 989909 - RNA, 23 nt, Human
cagagaagggccagagggagcgg

SEQ ID NO: 989910 - RNA, 23 nt, Human
caggugaguccuuucccugaccc

SEQ ID NO: 989911 - RNA, 21 nt, Human
cagguuucaucgugggccagg

SEQ ID NO: 989912 - RNA, 22 nt, Human
cauucaaaaaaaauaaaaagaa

SEQ ID NO: 989913 - RNA, 23 nt, Human
ccacuagaugcaaaaagcuccuu

SEQ ID NO: 989914 - RNA, 21 nt, Human
ccagccccuuuucucugaucc

SEQ ID NO: 989915 - RNA, 27 nt, Human
cccaaaauccuucuugagccccacuuc

SEQ ID NO: 989916 - RNA, 21 nt, Human
cccacaccugaccccucccac

SEQ ID NO: 989917 - RNA, 24 nt, Human
cccacaccugaccccucccaccca

SEQ ID NO: 989918 - RNA, 21 nt, Human
cccacuuccccaaccaacuac

SEQ ID NO: 989919 - RNA, 25 nt, Human
cccaugucccacaccugaccccucc

SEQ ID NO: 989920 - RNA, 22 nt, Human
ccccauucaaaaaaaauaaaaa

SEQ ID NO: 989921 - RNA, 24 nt, Human
cccgccccuccgcgcgcgagaggg

SEQ ID NO: 989922 - RNA, 20 nt, Human
ccgucgaggacccgccccuc

SEQ ID NO: 989923 - RNA, 18 nt, Human
ccuccaaccuaauaacac

SEQ ID NO: 989924 - RNA, 24 nt, Human
ccuccaaccuaauaacacuguuuc

SEQ ID NO: 989925 - RNA, 22 nt, Human
ccucccacccacuagaugcaaa

SEQ ID NO: 989926 - RNA, 22 nt, Human
ccucucagguuucaucgugggc

SEQ ID NO: 989927 - RNA, 18 nt, Human
ccugaccccucccaccca

SEQ ID NO: 989928 - RNA, 21 nt, Human
cgcggcagcucucgggcuucc

SEQ ID NO: 989929 - RNA, 24 nt, Human
cgcggcagcucucgggcuuccucu

SEQ ID NO: 989930 - RNA, 23 nt, Human
cucccaugucccacaccugaccc

SEQ ID NO: 989931 - RNA, 25 nt, Human
cuguaguuagggcagaggauggggc

SEQ ID NO: 989932 - RNA, 22 nt, Human
gaaaaagaaaaaacacacaccc

SEQ ID NO: 989933 - RNA, 18 nt, Human
gaaaguggagucuccugc

SEQ ID NO: 989934 - RNA, 18 nt, Human
gaggauggggcaagggga

SEQ ID NO: 989935 - RNA, 21 nt, Human
gcagggagcagggggcggggg

SEQ ID NO: 989936 - RNA, 23 nt, Human
gccauuccccccuuuccagcccc

SEQ ID NO: 989937 - RNA, 22 nt, Human
ggcagggagcagggggcggggg

SEQ ID NO: 989938 - RNA, 20 nt, Human
ggcgggcuggcaccuucccg

SEQ ID NO: 989939 - RNA, 23 nt, Human
ggcgggggacccgagggccgggu

SEQ ID NO: 989940 - RNA, 19 nt, Human
gggcagggagcagggggcg

SEQ ID NO: 989941 - RNA, 21 nt, Human
gggccagagggagcgggggcc

SEQ ID NO: 989942 - RNA, 22 nt, Human
gggcgggcuggcaccuucccgu

SEQ ID NO: 989943 - RNA, 19 nt, Human
gggcugggaugggcaggga

SEQ ID NO: 989944 - RNA, 24 nt, Human
ggggacccgagggccggguggggg

SEQ ID NO: 989945 - RNA, 19 nt, Human
gucgaggacccgccccucc

SEQ ID NO: 989946 - RNA, 18 nt, Human
guucuuuuuggaucaggg

SEQ ID NO: 989947 - RNA, 19 nt, Human
uaaaaagaaagaaaaagaa

SEQ ID NO: 989948 - RNA, 23 nt, Human
uagccgucgaggacccgccccuc

SEQ ID NO: 989949 - RNA, 22 nt, Human
ucccacaccugaccccucccac

SEQ ID NO: 989950 - RNA, 23 nt, Human
ucccacaccugaccccucccacc

SEQ ID NO: 989951 - RNA, 26 nt, Human
ucccccauucaaaaaaaauaaaaaga

SEQ ID NO: 989952 - RNA, 21 nt, Human
ucccguagccgucgaggaccc

SEQ ID NO: 989953 - RNA, 18 nt, Human
ucccugacccuggcgggc

SEQ ID NO: 989954 - RNA, 22 nt, Human
ucuccagcuggaaaccaaaagc

SEQ ID NO: 989955 - RNA, 18 nt, Human
ucuccugcucccaugucc

SEQ ID NO: 989956 - RNA, 19 nt, Human
ugaaaguuacuguacaaag

SEQ ID NO: 989957 - RNA, 20 nt, Human
ugagcagggggagcccaggc

SEQ ID NO: 989958 - RNA, 18 nt, Human
ugaugaagacaaaaggaa

SEQ ID NO: 989959 - RNA, 20 nt, Human
uggcuucuacgcccucgucc

SEQ ID NO: 989960 - RNA, 24 nt, Human
ugggaugggcagggagcagggggc

SEQ ID NO: 989961 - RNA, 21 nt, Human
ugggcugggaugggcagggag

SEQ ID NO: 989962 - RNA, 23 nt, Human
ugucccacaccugaccccuccca

SEQ ID NO: 989963 - RNA, 23 nt, Human
uuacuguacaaaggaagaaagug

SEQ ID NO: 989964 - RNA, 19 nt, Human
uucccugacccuggcgggc

SEQ ID NO: 989965 - RNA, 27 nt, Human
uuuccagccccuuuucucuggggccgc

SEQ ID NO: 989966 - RNA, 23 nt, Human
uuucccaaauuagucgguguccu

SEQ ID NO: 989967 - RNA, 22 nt, Human
uuuuuuuuuuuuuuuuuaacag

SEQ ID NO: 989968 - RNA, 27 nt, Human
aaaaaaacccuuuaaaaauaccccuca

SEQ ID NO: 989969 - RNA, 18 nt, Human
aaaaauaccccucaggug

SEQ ID NO: 989970 - RNA, 21 nt, Human
aaacccucucaauaacucaua

SEQ ID NO: 989971 - RNA, 18 nt, Human
aacaauagacccaggucc

SEQ ID NO: 989972 - RNA, 21 nt, Human
aaccagauucucagcuccccu

SEQ ID NO: 989973 - RNA, 22 nt, Human
aacccuccacucccaucccacc

SEQ ID NO: 989974 - RNA, 18 nt, Human
aaggagugggccuccugc

SEQ ID NO: 989975 - RNA, 23 nt, Human
acacacacacacacacacacaca

SEQ ID NO: 989976 - RNA, 23 nt, Human
acacacacacacacacacacaca

SEQ ID NO: 989977 - RNA, 23 nt, Human
acacacacacacacacacacaca

SEQ ID NO: 989978 - RNA, 23 nt, Human
acacacacacacacacacacaca

SEQ ID NO: 989979 - RNA, 23 nt, Human
acacacacacacacacacacaca

SEQ ID NO: 989980 - RNA, 29 nt, Human
acacacacacacacacacacacacuggaa

SEQ ID NO: 989981 - RNA, 20 nt, Human
acucuaaggugugcacagag

SEQ ID NO: 989982 - RNA, 22 nt, Human
acucuccagaagucaaaggagu

SEQ ID NO: 989983 - RNA, 19 nt, Human
agacccagguccugcagcc

SEQ ID NO: 989984 - RNA, 20 nt, Human
agagaacuccccaccuggcc

SEQ ID NO: 989985 - RNA, 21 nt, Human
auacauacaugcucguguaua

SEQ ID NO: 989986 - RNA, 25 nt, Human
auacauacaugcucguguauacaca

SEQ ID NO: 989987 - RNA, 22 nt, Human
auagacccagguccugcagcca

SEQ ID NO: 989988 - RNA, 23 nt, Human
augaccucaguuguaugucagaa

SEQ ID NO: 989989 - RNA, 23 nt, Human
augucaagagaugucagauaaca

SEQ ID NO: 989990 - RNA, 19 nt, Human
caaagagaaggccaggaac

SEQ ID NO: 989991 - RNA, 22 nt, Human
caaauacauacaugcucgugua

SEQ ID NO: 989992 - RNA, 18 nt, Human
cacacacacacacacaca

SEQ ID NO: 989993 - RNA, 20 nt, Human
cacacacacacacacacaca

SEQ ID NO: 989994 - RNA, 20 nt, Human
cacacacacacacacacaca

SEQ ID NO: 989995 - RNA, 20 nt, Human
cacacacacacacacacaca

SEQ ID NO: 989996 - RNA, 20 nt, Human
cacacacacacacacacaca

SEQ ID NO: 989997 - RNA, 20 nt, Human
cacacacacacacacacaca

SEQ ID NO: 989998 - RNA, 20 nt, Human
cacacacacacacacacaca

SEQ ID NO: 989999 - RNA, 20 nt, Human
cacacacacacacacacaca

SEQ ID NO: 990000 - RNA, 20 nt, Human
cacacacacacacacacaca

SEQ ID NO: 990001 - RNA, 20 nt, Human
cacacacacacacacacaca

SEQ ID NO: 990002 - RNA, 20 nt, Human
cacacacacacacacacaca

SEQ ID NO: 990003 - RNA, 22 nt, Human
cacacacacacacacacacaca

SEQ ID NO: 990004 - RNA, 22 nt, Human
cacacacacacacacacacaca

SEQ ID NO: 990005 - RNA, 22 nt, Human
cacacacacacacacacacaca

SEQ ID NO: 990006 - RNA, 22 nt, Human
cacacacacacacacacacaca

SEQ ID NO: 990007 - RNA, 26 nt, Human
cacacacacacacacacacacacaca

SEQ ID NO: 990008 - RNA, 26 nt, Human
cacacacacacacacacacacacaca

SEQ ID NO: 990009 - RNA, 26 nt, Human
cacacacacacacacacacacacaca

SEQ ID NO: 990010 - RNA, 27 nt, Human
cacacacacacacacacacacacacug

SEQ ID NO: 990011 - RNA, 21 nt, Human
cacacacacacuggaauaccu

SEQ ID NO: 990012 - RNA, 18 nt, Human
cacagacucuccagaagu

SEQ ID NO: 990013 - RNA, 19 nt, Human
cacagaguccucacacccc

SEQ ID NO: 990014 - RNA, 22 nt, Human
cacuucuuagauaaauguggug

SEQ ID NO: 990015 - RNA, 24 nt, Human
ccacccacgggcaugucaagagau

SEQ ID NO: 990016 - RNA, 23 nt, Human
ccagcagugagaaucuuucccca

SEQ ID NO: 990017 - RNA, 21 nt, Human
cccacagagguuaauacugga

SEQ ID NO: 990018 - RNA, 24 nt, Human
cccacagagguuaauacuggagca

SEQ ID NO: 990019 - RNA, 23 nt, Human
cccacccacgggcaugucaagag

SEQ ID NO: 990020 - RNA, 25 nt, Human
ccccuugcaaagagaaggccaggaa

SEQ ID NO: 990021 - RNA, 26 nt, Human
cccuugcaaagagaaggccaggaacc

SEQ ID NO: 990022 - RNA, 20 nt, Human
ccucaggugacauuuagccc

SEQ ID NO: 990023 - RNA, 18 nt, Human
ccugcagccaaaaucacu

SEQ ID NO: 990024 - RNA, 23 nt, Human
ccugcagccaaaaucacuucuua

SEQ ID NO: 990025 - RNA, 21 nt, Human
cucacugagcagccagcugua

SEQ ID NO: 990026 - RNA, 25 nt, Human
cugcuaccaaaaccagauucucagc

SEQ ID NO: 990027 - RNA, 24 nt, Human
gagaacuccccaccuggccccuga

SEQ ID NO: 990028 - RNA, 22 nt, Human
gagaaucuucccaccccagcag

SEQ ID NO: 990029 - RNA, 19 nt, Human
gcgggcacagcacacaacg

SEQ ID NO: 990030 - RNA, 20 nt, Human
gcuccccuugcaaagagaag

SEQ ID NO: 990031 - RNA, 22 nt, Human
ggaaaaaaaaacccuuuaaaaa

SEQ ID NO: 990032 - RNA, 23 nt, Human
ggccacucacugagcagccagcu

SEQ ID NO: 990033 - RNA, 26 nt, Human
gggaaaaaaaaacccuuuaaaaauac

SEQ ID NO: 990034 - RNA, 20 nt, Human
gguuaauacuggagcaacac

SEQ ID NO: 990035 - RNA, 21 nt, Human
guagagugcaggccacccaca

SEQ ID NO: 990036 - RNA, 21 nt, Human
uaaaacccucucaauaacuca

SEQ ID NO: 990037 - RNA, 24 nt, Human
uaacaauagacccagguccugcag

SEQ ID NO: 990038 - RNA, 23 nt, Human
uacaaaaucugaaugaugacaga

SEQ ID NO: 990039 - RNA, 25 nt, Human
uacacacacacacacacacacacac

SEQ ID NO: 990040 - RNA, 18 nt, Human
uagagugcaggccaccca

SEQ ID NO: 990041 - RNA, 18 nt, Human
uagcccaugacccuuucc

SEQ ID NO: 990042 - RNA, 25 nt, Human
uauacacacacacacacacacacac

SEQ ID NO: 990043 - RNA, 23 nt, Human
uaucaaaguacacauuguggcuu

SEQ ID NO: 990044 - RNA, 22 nt, Human
ucaaaguacacauuguggcuua

SEQ ID NO: 990045 - RNA, 18 nt, Human
uccacucccaucccaccc

SEQ ID NO: 990046 - RNA, 21 nt, Human
ucccggggcuauggaggagac

SEQ ID NO: 990047 - RNA, 18 nt, Human
ucucacagacucuccaga

SEQ ID NO: 990048 - RNA, 22 nt, Human
ugaguaaaucaaccauuauaaa

SEQ ID NO: 990049 - RNA, 21 nt, Human
ugcaaagagaaggccaggaac

SEQ ID NO: 990050 - RNA, 21 nt, Human
ugcacagaguccucacacccc

SEQ ID NO: 990051 - RNA, 31 nt, Human
ugcucguguauacacacacacacacacacag

SEQ ID NO: 990052 - RNA, 19 nt, Human
ugguguuuuuuuuccuugu

SEQ ID NO: 990053 - RNA, 24 nt, Human
uguauacacacacacacacacaca

SEQ ID NO: 990054 - RNA, 19 nt, Human
ugucagaagauggaugcuc

SEQ ID NO: 990055 - RNA, 19 nt, Human
uucccuccucuugaaggga

SEQ ID NO: 990056 - RNA, 21 nt, Human
acgcugggcugcaggcccggc

SEQ ID NO: 990057 - RNA, 21 nt, Human
cccgccaccaccacugcagcc

SEQ ID NO: 990058 - RNA, 22 nt, Human
cccgccaccaccacugcagccg

SEQ ID NO: 990059 - RNA, 24 nt, Human
cccgccaccaccacugcagccgca

SEQ ID NO: 990060 - RNA, 24 nt, Human
ccgccaccaccacugcagccgcag

SEQ ID NO: 990061 - RNA, 21 nt, Human
ggcugcaggcccggcuggggg

SEQ ID NO: 990062 - RNA, 22 nt, Human
ggcugggggaacccucauucuu

SEQ ID NO: 990063 - RNA, 21 nt, Human
uucagaugagauccaugagga

SEQ ID NO: 990064 - RNA, 18 nt, Human
uuuuuuuuuuuuuuuuug

SEQ ID NO: 990065 - RNA, 23 nt, Human
uuuuuuuuuuuuuuuuuuguguu

SEQ ID NO: 990066 - RNA, 21 nt, Human
agccgggcaggaccccggccc

SEQ ID NO: 990067 - RNA, 22 nt, Human
agccgggcaggaccccggcccc

SEQ ID NO: 990068 - RNA, 19 nt, Human
aggcugcagcacaucuaca

SEQ ID NO: 990069 - RNA, 20 nt, Human
ccccgcgcccgucgcgcccg

SEQ ID NO: 990070 - RNA, 19 nt, Human
cccggccccggccgucgcc

SEQ ID NO: 990071 - RNA, 20 nt, Human
cccgucgcgcccgccuccgc

SEQ ID NO: 990072 - RNA, 24 nt, Human
ccgucgccaccucccacacccgcc

SEQ ID NO: 990073 - RNA, 21 nt, Human
ccgucgcgcccgccuccgcag

SEQ ID NO: 990074 - RNA, 20 nt, Human
ccucaggagcagcgaccccc

SEQ ID NO: 990075 - RNA, 23 nt, Human
ccucccacacccgccgcagccga

SEQ ID NO: 990076 - RNA, 23 nt, Human
cgacccccgcgcccgucgcgccc

SEQ ID NO: 990077 - RNA, 22 nt, Human
gacccccgcgcccgucgcgccc

SEQ ID NO: 990078 - RNA, 22 nt, Human
gcaaaaagaaacauuuaauaau

SEQ ID NO: 990079 - RNA, 19 nt, Human
ggcagaaaggugcaauccg

SEQ ID NO: 990080 - RNA, 22 nt, Human
ggccccggccgucgccaccucc

SEQ ID NO: 990081 - RNA, 22 nt, Human
gggaaagggcagaaaggugcaa

SEQ ID NO: 990082 - RNA, 20 nt, Human
gucgcgcccgccuccgcagc

SEQ ID NO: 990083 - RNA, 19 nt, Human
uccaggcaggcagguugag

SEQ ID NO: 990084 - RNA, 20 nt, Human
uccaggcaggcagguugagg

SEQ ID NO: 990085 - RNA, 26 nt, Human
uccgcagccgggcaggaccccggccc

SEQ ID NO: 990086 - RNA, 25 nt, Human
uccgcagccgggcaggaccgggguc

SEQ ID NO: 990087 - RNA, 18 nt, Human
ugagggggaaagggcaga

SEQ ID NO: 990088 - RNA, 19 nt, Human
ugagggggaaagggcagaa

SEQ ID NO: 990089 - RNA, 18 nt, Human
uuuggcaaaaagaaacau

SEQ ID NO: 990090 - RNA, 20 nt, Human
uuuuuuuuuuuuuuuuuugg

SEQ ID NO: 990091 - RNA, 24 nt, Human
uuuuuuuuuuuuuuuuuuguuuuu

SEQ ID NO: 990092 - RNA, 18 nt, Human
aacagggaauagcagaga

SEQ ID NO: 990093 - RNA, 21 nt, Human
aagcgauucucccaccucagc

SEQ ID NO: 990094 - RNA, 25 nt, Human
aagcgauucucccaccucagccucc

SEQ ID NO: 990095 - RNA, 24 nt, Human
aauagcagagaguuugggaagaga

SEQ ID NO: 990096 - RNA, 21 nt, Human
accacaauuacuuuugcagca

SEQ ID NO: 990097 - RNA, 24 nt, Human
acuucugggguuaagcgauucucc

SEQ ID NO: 990098 - RNA, 18 nt, Human
agagggauaugaucugga

SEQ ID NO: 990099 - RNA, 22 nt, Human
agauuacagccauaaaccaccg

SEQ ID NO: 990100 - RNA, 24 nt, Human
agcgauucucccaccucagccucc

SEQ ID NO: 990101 - RNA, 18 nt, Human
agcgcuuccucuuucuuc

SEQ ID NO: 990102 - RNA, 23 nt, Human
auaccaucccacucagacagagu

SEQ ID NO: 990103 - RNA, 20 nt, Human
aucaauacaaauucucagca

SEQ ID NO: 990104 - RNA, 18 nt, Human
auggaaguaauaucugcu

SEQ ID NO: 990105 - RNA, 22 nt, Human
caaaaguaacugcaaaaaccac

SEQ ID NO: 990106 - RNA, 20 nt, Human
caaagcaaacgucugccagc

SEQ ID NO: 990107 - RNA, 25 nt, Human
caccucagccucccagaguuugcag

SEQ ID NO: 990108 - RNA, 18 nt, Human
cacgugugacucggaggu

SEQ ID NO: 990109 - RNA, 19 nt, Human
ccagaugggagagaaggaa

SEQ ID NO: 990110 - RNA, 20 nt, Human
ccucaaaggcccccacagcc

SEQ ID NO: 990111 - RNA, 22 nt, Human
ccucaaaggcccccacagccag

SEQ ID NO: 990112 - RNA, 26 nt, Human
cucauaccaucccacucagacagagu

SEQ ID NO: 990113 - RNA, 18 nt, Human
cuuccucuuucuucuucc

SEQ ID NO: 990114 - RNA, 18 nt, Human
cuugcuguguugccuggg

SEQ ID NO: 990115 - RNA, 25 nt, Human
gagaauucuuccucuaacucauacc

SEQ ID NO: 990116 - RNA, 18 nt, Human
gaggugggggugggguaa

SEQ ID NO: 990117 - RNA, 23 nt, Human
gaugaggaaagaguagggaagaa

SEQ ID NO: 990118 - RNA, 24 nt, Human
gauuacagccauaaaccaccgugc

SEQ ID NO: 990119 - RNA, 24 nt, Human
gcagcaguagggccucgggggcag

SEQ ID NO: 990120 - RNA, 20 nt, Human
gcauuuuucaauuuggaaaa

SEQ ID NO: 990121 - RNA, 24 nt, Human
ggaauagcagagaguuugggaaga

SEQ ID NO: 990122 - RNA, 27 nt, Human
ggggcagcaguagggccucgggggcag

SEQ ID NO: 990123 - RNA, 21 nt, Human
gugaacagggaauagcagaga

SEQ ID NO: 990124 - RNA, 27 nt, Human
uaagcgauucucccaccucagccuccc

SEQ ID NO: 990125 - RNA, 24 nt, Human
uaauuugcaagagaauucuuccuc

SEQ ID NO: 990126 - RNA, 22 nt, Human
uagcagagaguuugggaagaga

SEQ ID NO: 990127 - RNA, 23 nt, Human
uauagagauggggucuugcugug

SEQ ID NO: 990128 - RNA, 24 nt, Human
uauagagauggggucuugcugugu

SEQ ID NO: 990129 - RNA, 25 nt, Human
ucaaagcaaacgucugccagcccac

SEQ ID NO: 990130 - RNA, 24 nt, Human
ucauucuccaauuaggcuccccca

SEQ ID NO: 990131 - RNA, 26 nt, Human
ucccccauuaaccaauuguuucuaau

SEQ ID NO: 990132 - RNA, 19 nt, Human
ucucccaccucagccuccc

SEQ ID NO: 990133 - RNA, 22 nt, Human
ucuggaguccucaaaggccccc

SEQ ID NO: 990134 - RNA, 18 nt, Human
ucuugcuguguugccugg

SEQ ID NO: 990135 - RNA, 22 nt, Human
ucuugcuguguugccugggcug

SEQ ID NO: 990136 - RNA, 24 nt, Human
ucuugcuguguugccugggcugga

SEQ ID NO: 990137 - RNA, 20 nt, Human
ugaacagggaauagcagaga

SEQ ID NO: 990138 - RNA, 21 nt, Human
ugacucggagguggggguggg

SEQ ID NO: 990139 - RNA, 22 nt, Human
ugcccagcccucugcaguuucu

SEQ ID NO: 990140 - RNA, 20 nt, Human
ugccugggcuggacucaaac

SEQ ID NO: 990141 - RNA, 19 nt, Human
ugcuguguugccugggcug

SEQ ID NO: 990142 - RNA, 24 nt, Human
ugggcuggacucaaacuucugggg

SEQ ID NO: 990143 - RNA, 24 nt, Human
ugggcuggacucaaacuucugggg

SEQ ID NO: 990144 - RNA, 19 nt, Human
uuauagagauggggucuug

SEQ ID NO: 990145 - RNA, 23 nt, Human
uuauagagauggggucuugcugu

SEQ ID NO: 990146 - RNA, 18 nt, Human
uuugcagcaaccuaauac

SEQ ID NO: 990147 - RNA, 18 nt, Human
uuuuuauagagauggggu

SEQ ID NO: 990148 - RNA, 19 nt, Human
uuuuuauagagaugggguc

SEQ ID NO: 990149 - RNA, 21 nt, Human
uuuuucuuuuuauagagaugg

SEQ ID NO: 990150 - RNA, 25 nt, Human
aaaaaaacaagauaaucugcuuugc

SEQ ID NO: 990151 - RNA, 20 nt, Human
aacuacagguauuaaauacu

SEQ ID NO: 990152 - RNA, 21 nt, Human
acuacagguauuaaauacuga

SEQ ID NO: 990153 - RNA, 18 nt, Human
caccgcagccgggucccc

SEQ ID NO: 990154 - RNA, 22 nt, Human
cagccaccgcagccgggucccc

SEQ ID NO: 990155 - RNA, 23 nt, Human
cuacagguauuaaauacugaaaa

SEQ ID NO: 990156 - RNA, 21 nt, Human
cuacuuugcuuccccaggaac

SEQ ID NO: 990157 - RNA, 21 nt, Human
cucgucagucccgcagccacc

SEQ ID NO: 990158 - RNA, 24 nt, Human
uagcaaacaaauuucaacuuugau

SEQ ID NO: 990159 - RNA, 22 nt, Human
uaugcaaaaaaacaagauaauc

SEQ ID NO: 990160 - RNA, 20 nt, Human
ucccgcagccaccgcagccg

SEQ ID NO: 990161 - RNA, 24 nt, Human
ugcauacaggcaacaugcuauaua

SEQ ID NO: 990162 - RNA, 23 nt, Human
uggcauauuuguuuauuucucag

SEQ ID NO: 990163 - RNA, 24 nt, Human
uggcauauuuguuuauuucucagu

SEQ ID NO: 990164 - RNA, 23 nt, Human
uuaaauacugaaaagaguuaaca

SEQ ID NO: 990165 - RNA, 18 nt, Human
uugcuuccccaggaacuu

SEQ ID NO: 990166 - RNA, 21 nt, Human
aggcaaaaucacagggccagc

SEQ ID NO: 990167 - RNA, 25 nt, Human
auuacaacuaggguguuuuuaaaaa

SEQ ID NO: 990168 - RNA, 22 nt, Human
caacuuugcaccaaguuaaagg

SEQ ID NO: 990169 - RNA, 19 nt, Human
cacaugacaccugcagaau

SEQ ID NO: 990170 - RNA, 22 nt, Human
cagcacaugacaccugcagaau

SEQ ID NO: 990171 - RNA, 25 nt, Human
ccaaguuaaagguucugguguccau

SEQ ID NO: 990172 - RNA, 22 nt, Human
ccaaugcaaaaauccccccaga

SEQ ID NO: 990173 - RNA, 23 nt, Human
ccagcggucgcagcucugucuuu

SEQ ID NO: 990174 - RNA, 21 nt, Human
ccccaacccgcauugacuuug

SEQ ID NO: 990175 - RNA, 20 nt, Human
gcaaaaauccccccagauuu

SEQ ID NO: 990176 - RNA, 22 nt, Human
gcaaaaauccccccagauuuua

SEQ ID NO: 990177 - RNA, 20 nt, Human
ggacaggaagucuggggugg

SEQ ID NO: 990178 - RNA, 24 nt, Human
gguaguggcugggugugggaggca

SEQ ID NO: 990179 - RNA, 21 nt, Human
uaguggcugggugugggaggc

SEQ ID NO: 990180 - RNA, 24 nt, Human
ugacuuugccaaugcaaaaauccc

SEQ ID NO: 990181 - RNA, 18 nt, Human
ugccaaugcaaaaauccc

SEQ ID NO: 990182 - RNA, 22 nt, Human
ugggaggcaaaaucacagggcc

SEQ ID NO: 990183 - RNA, 25 nt, Human
ugucccagcggucgcagcucugucu

SEQ ID NO: 990184 - RNA, 23 nt, Human
uuaaagguucugguguccauugg

SEQ ID NO: 990185 - RNA, 23 nt, Human
uucuccaagcugggagguagugg

SEQ ID NO: 990186 - RNA, 20 nt, Human
uucugaauucugagguguuc

SEQ ID NO: 990187 - RNA, 25 nt, Human
uuuuuuuuuuuuuuuuuuucuuuuu

SEQ ID NO: 990188 - RNA, 22 nt, Human
aaaaagaaauacacacagaaga

SEQ ID NO: 990189 - RNA, 19 nt, Human
aaaacaaaaagaaauacac

SEQ ID NO: 990190 - RNA, 25 nt, Human
aaaacaaaaagaaauacacacagaa

SEQ ID NO: 990191 - RNA, 22 nt, Human
aacaaaaagaaauacacacaga

SEQ ID NO: 990192 - RNA, 19 nt, Human
aaugcggggguugggagga

SEQ ID NO: 990193 - RNA, 24 nt, Human
acaaaaagaaauacacacagaaga

SEQ ID NO: 990194 - RNA, 18 nt, Human
acaggagacagaaagugc

SEQ ID NO: 990195 - RNA, 21 nt, Human
accacagcaccuacaggacga

SEQ ID NO: 990196 - RNA, 20 nt, Human
accauaaaaacaaaaagaaa

SEQ ID NO: 990197 - RNA, 23 nt, Human
acggacccaggugacaggagcca

SEQ ID NO: 990198 - RNA, 23 nt, Human
agaaagugcaagagagguaagag

SEQ ID NO: 990199 - RNA, 19 nt, Human
agaagaagcaugugaggug

SEQ ID NO: 990200 - RNA, 22 nt, Human
agaagagacaggagacagaaag

SEQ ID NO: 990201 - RNA, 27 nt, Human
agacagaaagugcaagagaggggaccc

SEQ ID NO: 990202 - RNA, 24 nt, Human
agacaggagacagaaagugcaaga

SEQ ID NO: 990203 - RNA, 19 nt, Human
agaggaccgcuuucuccac

SEQ ID NO: 990204 - RNA, 21 nt, Human
agcaccuacaggacgaauagc

SEQ ID NO: 990205 - RNA, 21 nt, Human
agccgcccgcgcccugcccgg

SEQ ID NO: 990206 - RNA, 19 nt, Human
aggacagaggacgaagaag

SEQ ID NO: 990207 - RNA, 22 nt, Human
aggacagaggacgaagaagaac

SEQ ID NO: 990208 - RNA, 22 nt, Human
agugcaagagagguaagagaga

SEQ ID NO: 990209 - RNA, 20 nt, Human
caaggacggggaggaacaca

SEQ ID NO: 990210 - RNA, 20 nt, Human
cacagcaccuacaggacgaa

SEQ ID NO: 990211 - RNA, 23 nt, Human
cagaggacagaggacgaagaaga

SEQ ID NO: 990212 - RNA, 19 nt, Human
caggaaaugucacaauggc

SEQ ID NO: 990213 - RNA, 24 nt, Human
caggagccagaccauggggcuggu

SEQ ID NO: 990214 - RNA, 18 nt, Human
ccgcgcccugcccggccc

SEQ ID NO: 990215 - RNA, 25 nt, Human
ccugccacucugggauugugaaggg

SEQ ID NO: 990216 - RNA, 18 nt, Human
cgcugaggaaguggcagg

SEQ ID NO: 990217 - RNA, 23 nt, Human
cggacccaggugacaggagccag

SEQ ID NO: 990218 - RNA, 27 nt, Human
cggggccgccgcucucggagccccuag

SEQ ID NO: 990219 - RNA, 26 nt, Human
cuccaaaaaccauaaaaacaaaaaga

SEQ ID NO: 990220 - RNA, 20 nt, Human
cucggagccccuagccgccc

SEQ ID NO: 990221 - RNA, 19 nt, Human
gacagaggacgaagaagaa

SEQ ID NO: 990222 - RNA, 24 nt, Human
gacgcugguggcagcaaaucaggc

SEQ ID NO: 990223 - RNA, 25 nt, Human
gcaggcaccuugagucccuuuaaau

SEQ ID NO: 990224 - RNA, 24 nt, Human
gccccuagccgcccgcgcccugcc

SEQ ID NO: 990225 - RNA, 19 nt, Human
ggaggaaaccauuucagag

SEQ ID NO: 990226 - RNA, 23 nt, Human
ggccgcgggccggggccgccgcu

SEQ ID NO: 990227 - RNA, 21 nt, Human
ggcggcaggggcgagaagaga

SEQ ID NO: 990228 - RNA, 25 nt, Human
uaccagccacuuuacagaacagucc

SEQ ID NO: 990229 - RNA, 23 nt, Human
uacugguuacaucuacaaacugu

SEQ ID NO: 990230 - RNA, 23 nt, Human
ucaggccaagaugucuucucaca

SEQ ID NO: 990231 - RNA, 30 nt, Human
uccaaaaaccauaaaaacaaaaagaaauag

SEQ ID NO: 990232 - RNA, 24 nt, Human
uccaccacagcaccuacaggacga

SEQ ID NO: 990233 - RNA, 22 nt, Human
uccauccaccacagcaccuaca

SEQ ID NO: 990234 - RNA, 19 nt, Human
ucgcugaggaaguggcagg

SEQ ID NO: 990235 - RNA, 22 nt, Human
ucgcugaggaaguggcaggcac

SEQ ID NO: 990236 - RNA, 18 nt, Human
ucgggcccacugagggag

SEQ ID NO: 990237 - RNA, 19 nt, Human
ucuccacugaaagcugggg

SEQ ID NO: 990238 - RNA, 22 nt, Human
ucugcccagguccauccaccac

SEQ ID NO: 990239 - RNA, 20 nt, Human
ucugggauugugaagggaug

SEQ ID NO: 990240 - RNA, 20 nt, Human
ucuucucacauggugauggc

SEQ ID NO: 990241 - RNA, 19 nt, Human
ugacaggagccagaccaug

SEQ ID NO: 990242 - RNA, 19 nt, Human
ugacaggagccagaccaug

SEQ ID NO: 990243 - RNA, 20 nt, Human
ugaggaaguggcaggcaccu

SEQ ID NO: 990244 - RNA, 21 nt, Human
ugaggugauggggaagggaac

SEQ ID NO: 990245 - RNA, 24 nt, Human
ugaggugauggggaagggaacagg

SEQ ID NO: 990246 - RNA, 18 nt, Human
ugcaagagagguaagaga

SEQ ID NO: 990247 - RNA, 18 nt, Human
ugcaagagagguaagaga

SEQ ID NO: 990248 - RNA, 19 nt, Human
ugcccagguccauccacca

SEQ ID NO: 990249 - RNA, 24 nt, Human
ugcggggguugggaggaaaccauu

SEQ ID NO: 990250 - RNA, 18 nt, Human
uggagucggggaagcugg

SEQ ID NO: 990251 - RNA, 19 nt, Human
uggcaggcaccuugagucc

SEQ ID NO: 990252 - RNA, 21 nt, Human
uggggaagggaacagggucuc

SEQ ID NO: 990253 - RNA, 21 nt, Human
uggguaacaggaaaugucaca

SEQ ID NO: 990254 - RNA, 18 nt, Human
ugugaaaauaaacaacug

SEQ ID NO: 990255 - RNA, 22 nt, Human
ugugacagccugcaggggucgg

SEQ ID NO: 990256 - RNA, 23 nt, Human
uguuaccagccacuuuacagaac

SEQ ID NO: 990257 - RNA, 25 nt, Human
uguuuuguuuuuuaaaaaagccuua

SEQ ID NO: 990258 - RNA, 23 nt, Human
uucucacauggugauggccucac

SEQ ID NO: 990259 - RNA, 22 nt, Human
uuguuguuuuguuuuguuuuuu

SEQ ID NO: 990260 - RNA, 18 nt, Human
uuuacagaacaguccaga

SEQ ID NO: 990261 - RNA, 22 nt, Human
uuuacagaacaguccagagugg

SEQ ID NO: 990262 - RNA, 24 nt, Human
uuuguuguuuuguuuuguuuuuua

SEQ ID NO: 990263 - RNA, 23 nt, Human
uuuucuuuuucuucugaaucauu

SEQ ID NO: 990264 - RNA, 19 nt, Human
uuuuuuguuguuuuguuuu

SEQ ID NO: 990265 - RNA, 18 nt, Human
uuuuuuuuuuuuuucuug

SEQ ID NO: 990266 - RNA, 19 nt, Human
uuuuuuuuuuuuuucuugc

SEQ ID NO: 990267 - RNA, 20 nt, Human
aaagcacaccuccccaccca

SEQ ID NO: 990268 - RNA, 19 nt, Human
aacacuuuccucauaucua

SEQ ID NO: 990269 - RNA, 24 nt, Human
aaccgccggccgggaugcagccuc

SEQ ID NO: 990270 - RNA, 22 nt, Human
acaggcacaaacacuuuccuca

SEQ ID NO: 990271 - RNA, 19 nt, Human
agcacaccuccccacccac

SEQ ID NO: 990272 - RNA, 21 nt, Human
cccgggccgcgccuccccaga

SEQ ID NO: 990273 - RNA, 23 nt, Human
cgaugagcuuugguuuaaggcuu

SEQ ID NO: 990274 - RNA, 22 nt, Human
cgcgaggcuccggaaccgccgg

SEQ ID NO: 990275 - RNA, 18 nt, Human
cggaaccgccggccggga

SEQ ID NO: 990276 - RNA, 23 nt, Human
cuaaagcacaccuccccacccac

SEQ ID NO: 990277 - RNA, 21 nt, Human
cuccagaaggcagaucucccu

SEQ ID NO: 990278 - RNA, 22 nt, Human
cucggauaucuguuucugauga

SEQ ID NO: 990279 - RNA, 20 nt, Human
gagcgucccgggccgcgccu

SEQ ID NO: 990280 - RNA, 25 nt, Human
ggaaaaagcaaacccauuucacaaa

SEQ ID NO: 990281 - RNA, 24 nt, Human
uaaagcacaccuccccacccacuc

SEQ ID NO: 990282 - RNA, 23 nt, Human
ucacauccauuacauuuauuaca

SEQ ID NO: 990283 - RNA, 20 nt, Human
uccccagacgcgaggcuccg

SEQ ID NO: 990284 - RNA, 22 nt, Human
ucuaaagcacaccuccccaccc

SEQ ID NO: 990285 - RNA, 23 nt, Human
ucuaaagcacaccuccccaccca

SEQ ID NO: 990286 - RNA, 24 nt, Human
ucucccgggaggacggcgcagucu

SEQ ID NO: 990287 - RNA, 18 nt, Human
ugagcuuugguuuaaggg

SEQ ID NO: 990288 - RNA, 24 nt, Human
ugguggucuucuaaugagaaaucu

SEQ ID NO: 990289 - RNA, 24 nt, Human
uguaggaaaagggaaaaagcaaac

SEQ ID NO: 990290 - RNA, 24 nt, Human
uucaucucagguuauuuuuuuaag

SEQ ID NO: 990291 - RNA, 25 nt, Human
aaaaaauaaaauuccuuacuuaaaa

SEQ ID NO: 990292 - RNA, 20 nt, Human
aaaguugcaacuaaaaccag

SEQ ID NO: 990293 - RNA, 22 nt, Human
aaauauaaaagguuuaccaacu

SEQ ID NO: 990294 - RNA, 19 nt, Human
aacaagaguacucuuucca

SEQ ID NO: 990295 - RNA, 18 nt, Human
aacuccagcaaucacaac

SEQ ID NO: 990296 - RNA, 26 nt, Human
aaguuuucuuucuggaucaauauacu

SEQ ID NO: 990297 - RNA, 19 nt, Human
acacacuuauaucacagaa

SEQ ID NO: 990298 - RNA, 19 nt, Human
acucacgagagaaaauaau

SEQ ID NO: 990299 - RNA, 21 nt, Human
agaaaaaagacaguaagaaaa

SEQ ID NO: 990300 - RNA, 20 nt, Human
aggcagcaggcuggauuuga

SEQ ID NO: 990301 - RNA, 20 nt, Human
auaaacacaauuccuagcuc

SEQ ID NO: 990302 - RNA, 19 nt, Human
auaaaguuugcaugaaccu

SEQ ID NO: 990303 - RNA, 19 nt, Human
auaauauaaggaaacaaga

SEQ ID NO: 990304 - RNA, 23 nt, Human
auaauauaaggaaacaagaguac

SEQ ID NO: 990305 - RNA, 22 nt, Human
caaagcaaguauuaugcuggca

SEQ ID NO: 990306 - RNA, 24 nt, Human
caacuuuauccuuucuuaauuuua

SEQ ID NO: 990307 - RNA, 23 nt, Human
caauuccuagcucacaggccaua

SEQ ID NO: 990308 - RNA, 21 nt, Human
cacacacuuauaucacagaac

SEQ ID NO: 990309 - RNA, 24 nt, Human
caggccauaaaaagcaggcagcag

SEQ ID NO: 990310 - RNA, 22 nt, Human
cccgaccccaaucucggagagc

SEQ ID NO: 990311 - RNA, 21 nt, Human
ccuccuggcaauacacaacuc

SEQ ID NO: 990312 - RNA, 24 nt, Human
ccuccuggcaauacacaacuccag

SEQ ID NO: 990313 - RNA, 27 nt, Human
cuaaacacaaaauaaaguuugcaugaa

SEQ ID NO: 990314 - RNA, 20 nt, Human
cuucagguauugagaccuaa

SEQ ID NO: 990315 - RNA, 22 nt, Human
gaacccgcgugcgacccuccgg

SEQ ID NO: 990316 - RNA, 24 nt, Human
gcaacauaaaauaauaugcauaaa

SEQ ID NO: 990317 - RNA, 24 nt, Human
ggcuucuacaauuuguaacaauuu

SEQ ID NO: 990318 - RNA, 24 nt, Human
uaaaaaaagggaaaagcuauagaa

SEQ ID NO: 990319 - RNA, 28 nt, Human
uaaaaagauacuaaauauaaaagguuua

SEQ ID NO: 990320 - RNA, 20 nt, Human
uaaaaagcaggcagcaggcu

SEQ ID NO: 990321 - RNA, 25 nt, Human
uaaaauaauaugcauaaaucuggca

SEQ ID NO: 990322 - RNA, 24 nt, Human
uaaacacaaaauaaaguuugcaug

SEQ ID NO: 990323 - RNA, 26 nt, Human
uaaacacaaaauaaaguuugcaugaa

SEQ ID NO: 990324 - RNA, 26 nt, Human
uaccuuugucaaagguaaaaugauuc

SEQ ID NO: 990325 - RNA, 24 nt, Human
uacguuaugcaaaguguuucaaau

SEQ ID NO: 990326 - RNA, 23 nt, Human
uaggaacuguaauuuaccuagaa

SEQ ID NO: 990327 - RNA, 24 nt, Human
uauagaacaaauguuucgucuuaa

SEQ ID NO: 990328 - RNA, 21 nt, Human
uaucacagaacaccguggcuu

SEQ ID NO: 990329 - RNA, 18 nt, Human
ucaauauacucacgagag

SEQ ID NO: 990330 - RNA, 21 nt, Human
ucacgagagaaaauaauucag

SEQ ID NO: 990331 - RNA, 24 nt, Human
ucacuuauauguacaaccaucaac

SEQ ID NO: 990332 - RNA, 22 nt, Human
ucagucccuuuuauacaaaguu

SEQ ID NO: 990333 - RNA, 24 nt, Human
ucauaaaagucuuuaaaaaaaaac

SEQ ID NO: 990334 - RNA, 18 nt, Human
ugaggcagugacccgacc

SEQ ID NO: 990335 - RNA, 20 nt, Human
uggcaauacacaacuccagc

SEQ ID NO: 990336 - RNA, 19 nt, Human
uggcagaaguccaugagcu

SEQ ID NO: 990337 - RNA, 26 nt, Human
uggcuucuacaauuuguaacaauuuu

SEQ ID NO: 990338 - RNA, 22 nt, Human
uguaacaauuuugaaaacgaaa

SEQ ID NO: 990339 - RNA, 22 nt, Human
uguuucaacaaacuuuauuuau

SEQ ID NO: 990340 - RNA, 20 nt, Human
uguuucgucuuaaaauauau

SEQ ID NO: 990341 - RNA, 24 nt, Human
uuaaaacacacauaauacaaguuu

SEQ ID NO: 990342 - RNA, 19 nt, Human
uucauagucugauuuaccu

SEQ ID NO: 990343 - RNA, 19 nt, Human
uuccaaagcaaguauuaug

SEQ ID NO: 990344 - RNA, 18 nt, Human
uuccagagacuuuggaga

SEQ ID NO: 990345 - RNA, 22 nt, Human
uucugccugcuuuaugaaaaac

SEQ ID NO: 990346 - RNA, 23 nt, Human
uugcaacuaaaaccagcaaucac

SEQ ID NO: 990347 - RNA, 24 nt, Human
uuuauaaauuucucagucccuuuu

SEQ ID NO: 990348 - RNA, 22 nt, Human
uuuccugugccuauccauugug

SEQ ID NO: 990349 - RNA, 18 nt, Human
aaacaccacaguuuguga

SEQ ID NO: 990350 - RNA, 19 nt, Human
aaacaccacaguuugugac

SEQ ID NO: 990351 - RNA, 21 nt, Human
aaagaaaguacaaaggauguc

SEQ ID NO: 990352 - RNA, 21 nt, Human
aaauuuuuagcacacagguuu

SEQ ID NO: 990353 - RNA, 22 nt, Human
aagauggcuucauccccaaaug

SEQ ID NO: 990354 - RNA, 18 nt, Human
aaguaaugaaugacucuu

SEQ ID NO: 990355 - RNA, 21 nt, Human
aauaaagaauuuaauguacag

SEQ ID NO: 990356 - RNA, 19 nt, Human
acuaauuauuaagauggcu

SEQ ID NO: 990357 - RNA, 23 nt, Human
aucuggaaaauuuuuagcacaca

SEQ ID NO: 990358 - RNA, 18 nt, Human
auuaacaguauuuauuga

SEQ ID NO: 990359 - RNA, 19 nt, Human
cagcagcacgugacucaga

SEQ ID NO: 990360 - RNA, 29 nt, Human
caguaaauucucucccauacaaaggucuu

SEQ ID NO: 990361 - RNA, 21 nt, Human
ccaauuaacaguauuuauuga

SEQ ID NO: 990362 - RNA, 21 nt, Human
ccaggcucaggucgguggucg

SEQ ID NO: 990363 - RNA, 19 nt, Human
cccgccgcccgcgcccucg

SEQ ID NO: 990364 - RNA, 24 nt, Human
ccgcccgcgcccucgacggccgcc

SEQ ID NO: 990365 - RNA, 25 nt, Human
ccgcccgcgcccucgacggccgccu

SEQ ID NO: 990366 - RNA, 23 nt, Human
ccucgacggccgccucgccgccu

SEQ ID NO: 990367 - RNA, 24 nt, Human
cgcccgcgcccucgacggccgccu

SEQ ID NO: 990368 - RNA, 18 nt, Human
cgccgcguccccgccgcc

SEQ ID NO: 990369 - RNA, 26 nt, Human
cgccgcguccccgccgcccgcgcccu

SEQ ID NO: 990370 - RNA, 20 nt, Human
cgguggucgugaagcucagc

SEQ ID NO: 990371 - RNA, 25 nt, Human
cguccccgccgcccgcgcccucgac

SEQ ID NO: 990372 - RNA, 19 nt, Human
cgugaagcucagccccggc

SEQ ID NO: 990373 - RNA, 19 nt, Human
cuacuggagucccgucagc

SEQ ID NO: 990374 - RNA, 18 nt, Human
cucaaagucccuacugga

SEQ ID NO: 990375 - RNA, 21 nt, Human
cucagccccggcucgcccagc

SEQ ID NO: 990376 - RNA, 21 nt, Human
cucgacggccgccucgccgcc

SEQ ID NO: 990377 - RNA, 20 nt, Human
gcgccgcguccccgccgccc

SEQ ID NO: 990378 - RNA, 23 nt, Human
uaaagccacucauugaaaaaccc

SEQ ID NO: 990379 - RNA, 19 nt, Human
uaacaguauuuauugaggg

SEQ ID NO: 990380 - RNA, 20 nt, Human
uacaaaaugugcucucaaag

SEQ ID NO: 990381 - RNA, 19 nt, Human
ucauguuaagaaaacauga

SEQ ID NO: 990382 - RNA, 19 nt, Human
uccugcacguugcaauaca

SEQ ID NO: 990383 - RNA, 21 nt, Human
ucgguggucgugaagcucagc

SEQ ID NO: 990384 - RNA, 23 nt, Human
ugaaaaacccaauuccaaacacc

SEQ ID NO: 990385 - RNA, 19 nt, Human
ugacucagagucaugacaa

SEQ ID NO: 990386 - RNA, 21 nt, Human
ugacucagagucaugacaagg

SEQ ID NO: 990387 - RNA, 20 nt, Human
ugagaaaaugcuuacuaauu

SEQ ID NO: 990388 - RNA, 21 nt, Human
uuacuaauuauuaagauggcu

SEQ ID NO: 990389 - RNA, 20 nt, Human
aaaaaaaaaauguguuuggu

SEQ ID NO: 990390 - RNA, 19 nt, Human
aaaaagaaacacagacaga

SEQ ID NO: 990391 - RNA, 19 nt, Human
aaaaaguauucucucccuc

SEQ ID NO: 990392 - RNA, 19 nt, Human
aaaaaguauucucucccuc

SEQ ID NO: 990393 - RNA, 27 nt, Human
aaaaaucaaaggucucaacucugagcu

SEQ ID NO: 990394 - RNA, 20 nt, Human
aaaacccuucgcucccuaga

SEQ ID NO: 990395 - RNA, 19 nt, Human
aaaaggccuugaaccagag

SEQ ID NO: 990396 - RNA, 22 nt, Human
aaacaccagaggccugcaucuu

SEQ ID NO: 990397 - RNA, 27 nt, Human
aaacagcaguccagcugccaaggaaca

SEQ ID NO: 990398 - RNA, 22 nt, Human
aaacagccgagaguucacacaa

SEQ ID NO: 990399 - RNA, 18 nt, Human
aaaccagccuugcauaga

SEQ ID NO: 990400 - RNA, 22 nt, Human
aaacugaaguggugagagccca

SEQ ID NO: 990401 - RNA, 22 nt, Human
aaacugaaguggugagagccca

SEQ ID NO: 990402 - RNA, 20 nt, Human
aaaguccaaaaagaaaggga

SEQ ID NO: 990403 - RNA, 18 nt, Human
aaauauucucccucuucc

SEQ ID NO: 990404 - RNA, 23 nt, Human
aaaucacuuaagcccaggaguuc

SEQ ID NO: 990405 - RNA, 22 nt, Human
aaaugcaagagauugcucagcu

SEQ ID NO: 990406 - RNA, 18 nt, Human
aacaaaaacaacuuuguu

SEQ ID NO: 990407 - RNA, 19 nt, Human
aacacggugaaacccuguc

SEQ ID NO: 990408 - RNA, 20 nt, Human
aacacggugaaacccugucu

SEQ ID NO: 990409 - RNA, 21 nt, Human
aacacggugaaacccugucuc

SEQ ID NO: 990410 - RNA, 20 nt, Human
aacauggugaaaccucgucu

SEQ ID NO: 990411 - RNA, 21 nt, Human
aacauggugaaaccucgucuc

SEQ ID NO: 990412 - RNA, 22 nt, Human
aaccaagaaguaucugagacag

SEQ ID NO: 990413 - RNA, 22 nt, Human
aaccaagaaguaucugagacag

SEQ ID NO: 990414 - RNA, 21 nt, Human
aaccagccuugcauagaaaau

SEQ ID NO: 990415 - RNA, 23 nt, Human
aacccccaacauacacacacccc

SEQ ID NO: 990416 - RNA, 23 nt, Human
aaccuggauccugcgcugcucgg

SEQ ID NO: 990417 - RNA, 22 nt, Human
aacuaugaagaaauuaccguac

SEQ ID NO: 990418 - RNA, 21 nt, Human
aacugaaguggugagagccca

SEQ ID NO: 990419 - RNA, 21 nt, Human
aacugaaguggugagagccca

SEQ ID NO: 990420 - RNA, 26 nt, Human
aagaaaguaaaggaauauagaauggc

SEQ ID NO: 990421 - RNA, 19 nt, Human
aagaaauuaccguaccuuu

SEQ ID NO: 990422 - RNA, 23 nt, Human
aagaaucacuugaacccgggagg

SEQ ID NO: 990423 - RNA, 29 nt, Human
aagaggcagcagagcugugcgugcgguaa

SEQ ID NO: 990424 - RNA, 24 nt, Human
aagcagguggaucacuuggucagg

SEQ ID NO: 990425 - RNA, 19 nt, Human
aagcguuccagggaagacc

SEQ ID NO: 990426 - RNA, 19 nt, Human
aaggaaaggaaaacuguau

SEQ ID NO: 990427 - RNA, 24 nt, Human
aaggggaugacuuggcuugaagga

SEQ ID NO: 990428 - RNA, 24 nt, Human
aaggggaugacuuggcuugaagga

SEQ ID NO: 990429 - RNA, 19 nt, Human
aaggugaccgggcguggug

SEQ ID NO: 990430 - RNA, 24 nt, Human
aaggugaccgggcgugguggcuca

SEQ ID NO: 990431 - RNA, 24 nt, Human
aagugaaagcaaguuuauuaagaa

SEQ ID NO: 990432 - RNA, 24 nt, Human
aagugaaagcaaguuuauuaagaa

SEQ ID NO: 990433 - RNA, 21 nt, Human
aauaaaauaacuguagucuua

SEQ ID NO: 990434 - RNA, 24 nt, Human
aaucacuuaagcccaggaguucga

SEQ ID NO: 990435 - RNA, 24 nt, Human
aaucacuuaagcccaggaguucga

SEQ ID NO: 990436 - RNA, 25 nt, Human
aaucacuuaagcccaggaguucgaa

SEQ ID NO: 990437 - RNA, 23 nt, Human
aaucacuugaacccgggagguga

SEQ ID NO: 990438 - RNA, 23 nt, Human
aaucccuacagcaagcuaagaaa

SEQ ID NO: 990439 - RNA, 21 nt, Human
aaucugcaauggcagcugcuc

SEQ ID NO: 990440 - RNA, 21 nt, Human
aaucugcaauggcagcugcuc

SEQ ID NO: 990441 - RNA, 18 nt, Human
acaaaggugaaggaaagg

SEQ ID NO: 990442 - RNA, 21 nt, Human
acaagcuguagagaaaagaaa

SEQ ID NO: 990443 - RNA, 20 nt, Human
acacaaaagggaaggacuaa

SEQ ID NO: 990444 - RNA, 24 nt, Human
acacacaccccuacacacaaugca

SEQ ID NO: 990445 - RNA, 24 nt, Human
acagagcaagacucagucucaaaa

SEQ ID NO: 990446 - RNA, 18 nt, Human
accaagaaccucccauuc

SEQ ID NO: 990447 - RNA, 18 nt, Human
accccuuuccucuucacu

SEQ ID NO: 990448 - RNA, 18 nt, Human
acccuaagagagggagag

SEQ ID NO: 990449 - RNA, 18 nt, Human
acccuaagagagggagag

SEQ ID NO: 990450 - RNA, 24 nt, Human
acccugucucuacuaaaaauacaa

SEQ ID NO: 990451 - RNA, 24 nt, Human
accucgucucuacuaaaaauacaa

SEQ ID NO: 990452 - RNA, 19 nt, Human
acucccucuuuccucucug

SEQ ID NO: 990453 - RNA, 23 nt, Human
acucccugauuucugcaagacca

SEQ ID NO: 990454 - RNA, 24 nt, Human
acucucugggcaaaaaaucaaagg

SEQ ID NO: 990455 - RNA, 24 nt, Human
acugcacucuggccuggcacagag

SEQ ID NO: 990456 - RNA, 18 nt, Human
acugcauuccagccugag

SEQ ID NO: 990457 - RNA, 24 nt, Human
acugcauuccagccugagugacag

SEQ ID NO: 990458 - RNA, 23 nt, Human
acuuguccccucgugugcuccca

SEQ ID NO: 990459 - RNA, 19 nt, Human
agaaaacaagguggaggca

SEQ ID NO: 990460 - RNA, 21 nt, Human
agaaaacaggacaaaggugac

SEQ ID NO: 990461 - RNA, 23 nt, Human
agaaaauaaaucacaagacauga

SEQ ID NO: 990462 - RNA, 21 nt, Human
agaaacacagacagauggaca

SEQ ID NO: 990463 - RNA, 18 nt, Human
agaaagagcacuggggca

SEQ ID NO: 990464 - RNA, 19 nt, Human
agaagucgaauugaaucca

SEQ ID NO: 990465 - RNA, 18 nt, Human
agacaagccacuuauucu

SEQ ID NO: 990466 - RNA, 18 nt, Human
agacaccaagaaccuccc

SEQ ID NO: 990467 - RNA, 22 nt, Human
agacagauggacaagagccaga

SEQ ID NO: 990468 - RNA, 25 nt, Human
agacaggagaaaucacuuaagccca

SEQ ID NO: 990469 - RNA, 22 nt, Human
agaccaggccagacaccaagaa

SEQ ID NO: 990470 - RNA, 21 nt, Human
agaccgauuaaagagaaguaa

SEQ ID NO: 990471 - RNA, 27 nt, Human
agagaagccagccuggggacagaggac

SEQ ID NO: 990472 - RNA, 28 nt, Human
agagaagccagccuggggacagaggaca

SEQ ID NO: 990473 - RNA, 18 nt, Human
agaggacagaggagaccc

SEQ ID NO: 990474 - RNA, 23 nt, Human
agagucuguguuucucagauggc

SEQ ID NO: 990475 - RNA, 24 nt, Human
agaguucacacaaaagggaaggac

SEQ ID NO: 990476 - RNA, 20 nt, Human
agcaaggucuuugugacgug

SEQ ID NO: 990477 - RNA, 20 nt, Human
agcaaggucuuugugacgug

SEQ ID NO: 990478 - RNA, 24 nt, Human
agcacuggggcaggaaaccuggau

SEQ ID NO: 990479 - RNA, 20 nt, Human
agcacuuugggaggccgaag

SEQ ID NO: 990480 - RNA, 24 nt, Human
agcacuuugggaggccgagguagg

SEQ ID NO: 990481 - RNA, 25 nt, Human
agcagcacagccccacaccaaccuu

SEQ ID NO: 990482 - RNA, 21 nt, Human
agcagugaggacaaccagaga

SEQ ID NO: 990483 - RNA, 21 nt, Human
agcagugaggacaaccagaga

SEQ ID NO: 990484 - RNA, 18 nt, Human
agccagacagccagcagc

SEQ ID NO: 990485 - RNA, 21 nt, Human
agccagacagccagcagccuc

SEQ ID NO: 990486 - RNA, 21 nt, Human
agccagagaacaccagagaca

SEQ ID NO: 990487 - RNA, 24 nt, Human
agccagcagccucuuuccagcccu

SEQ ID NO: 990488 - RNA, 24 nt, Human
agccugagugacagagcaagacuc

SEQ ID NO: 990489 - RNA, 20 nt, Human
agccuggcaugguggugggc

SEQ ID NO: 990490 - RNA, 23 nt, Human
agccuggccaacauggugaaacc

SEQ ID NO: 990491 - RNA, 23 nt, Human
agccuggccaacauggugaaacc

SEQ ID NO: 990492 - RNA, 25 nt, Human
agccuggccaacauggugaaaccuc

SEQ ID NO: 990493 - RNA, 22 nt, Human
agccugugcaauauagugggau

SEQ ID NO: 990494 - RNA, 20 nt, Human
agccuuguaaagcacagggc

SEQ ID NO: 990495 - RNA, 25 nt, Human
agccuuuaguguuugagggggcagc

SEQ ID NO: 990496 - RNA, 25 nt, Human
agccuuuaguguuugagggggcagc

SEQ ID NO: 990497 - RNA, 24 nt, Human
agcggcucacgccuguaaucccag

SEQ ID NO: 990498 - RNA, 24 nt, Human
agcugccaaggaacauuucauaua

SEQ ID NO: 990499 - RNA, 20 nt, Human
agcuuccugugcugcucuuu

SEQ ID NO: 990500 - RNA, 20 nt, Human
agcuuccugugcugcucuuu

SEQ ID NO: 990501 - RNA, 22 nt, Human
agcuuucuucugaguuuucacc

SEQ ID NO: 990502 - RNA, 22 nt, Human
aggaguucgaaaccagccuggu

SEQ ID NO: 990503 - RNA, 20 nt, Human
aggaguuugagaccagccug

SEQ ID NO: 990504 - RNA, 24 nt, Human
aggaucgcuugagcucaggaguuu

SEQ ID NO: 990505 - RNA, 18 nt, Human
aggcagaagaaucacuug

SEQ ID NO: 990506 - RNA, 24 nt, Human
aggcagaagaaucacuugaacccg

SEQ ID NO: 990507 - RNA, 22 nt, Human
aggcagcagagcugugcgugcg

SEQ ID NO: 990508 - RNA, 20 nt, Human
aggcaggaagccgugacagc

SEQ ID NO: 990509 - RNA, 19 nt, Human
aggcaggaggaucgcuuga

SEQ ID NO: 990510 - RNA, 23 nt, Human
aggcaggaggaucgcuugagcuc

SEQ ID NO: 990511 - RNA, 24 nt, Human
aggccaaggcaggaggaucgcuug

SEQ ID NO: 990512 - RNA, 19 nt, Human
aggccagacaccaagaacc

SEQ ID NO: 990513 - RNA, 21 nt, Human
aggccaggugcgguggcucgu

SEQ ID NO: 990514 - RNA, 21 nt, Human
aggccccgguuggcagaaaca

SEQ ID NO: 990515 - RNA, 21 nt, Human
aggccgagguaggcggaucac

SEQ ID NO: 990516 - RNA, 22 nt, Human
aggccucaaguccugauaacag

SEQ ID NO: 990517 - RNA, 25 nt, Human
aggccucaaguccugauaacagucu

SEQ ID NO: 990518 - RNA, 24 nt, Human
aggcggaucacgaggucaggagau

SEQ ID NO: 990519 - RNA, 24 nt, Human
aggcugaagugggaggaucucuug

SEQ ID NO: 990520 - RNA, 24 nt, Human
aggcugaggcagaagaaucacuug

SEQ ID NO: 990521 - RNA, 19 nt, Human
aggggccucuuccucugug

SEQ ID NO: 990522 - RNA, 24 nt, Human
agguaggcggaucacgaggucagg

SEQ ID NO: 990523 - RNA, 21 nt, Human
aggugaaggcugcagugagcc

SEQ ID NO: 990524 - RNA, 24 nt, Human
aggugaaggcugcagugagccgag

SEQ ID NO: 990525 - RNA, 24 nt, Human
aggugcgguggcucgugccuguaa

SEQ ID NO: 990526 - RNA, 24 nt, Human
agguggaucacuuggucaggaguu

SEQ ID NO: 990527 - RNA, 21 nt, Human
aguggcugccugguccccaca

SEQ ID NO: 990528 - RNA, 18 nt, Human
aguguuugagggggcagc

SEQ ID NO: 990529 - RNA, 18 nt, Human
aguguuugagggggcagc

SEQ ID NO: 990530 - RNA, 25 nt, Human
auaaacucuuuaaaacuggauucug

SEQ ID NO: 990531 - RNA, 21 nt, Human
auaaauuuuucuucaggaaaa

SEQ ID NO: 990532 - RNA, 26 nt, Human
auauaaaucaggcugggagugguggc

SEQ ID NO: 990533 - RNA, 21 nt, Human
aucacuuggucaggaguucaa

SEQ ID NO: 990534 - RNA, 24 nt, Human
aucauccaucaccccuucccacug

SEQ ID NO: 990535 - RNA, 19 nt, Human
auccuguccaggcucuucu

SEQ ID NO: 990536 - RNA, 24 nt, Human
aucgcgccacugcauuccagccug

SEQ ID NO: 990537 - RNA, 20 nt, Human
aucgcuugagcucaggaguu

SEQ ID NO: 990538 - RNA, 24 nt, Human
aucgcuugagcucaggaguuugag

SEQ ID NO: 990539 - RNA, 21 nt, Human
augcacgcauacacauacaca

SEQ ID NO: 990540 - RNA, 22 nt, Human
augcacgcauacacauacacag

SEQ ID NO: 990541 - RNA, 18 nt, Human
auggcagcugcucuuggc

SEQ ID NO: 990542 - RNA, 19 nt, Human
auucaucccccggaaaccu

SEQ ID NO: 990543 - RNA, 18 nt, Human
auuccacccugauuuaga

SEQ ID NO: 990544 - RNA, 19 nt, Human
auucugcuccucugugagu

SEQ ID NO: 990545 - RNA, 24 nt, Human
auugcaccacugcacucuggccug

SEQ ID NO: 990546 - RNA, 21 nt, Human
auuggcuuauccaacucuggc

SEQ ID NO: 990547 - RNA, 20 nt, Human
caaaaagaaacacagacaga

SEQ ID NO: 990548 - RNA, 28 nt, Human
caaacagcaguccagcugccaaggaaca

SEQ ID NO: 990549 - RNA, 18 nt, Human
caaagcagcccugagggc

SEQ ID NO: 990550 - RNA, 18 nt, Human
caaagcagcccugagggc

SEQ ID NO: 990551 - RNA, 23 nt, Human
caaauccuuggcuggagggaugc

SEQ ID NO: 990552 - RNA, 24 nt, Human
caacauggugaaaccucgucucua

SEQ ID NO: 990553 - RNA, 21 nt, Human
caaccacuucaucucacccua

SEQ ID NO: 990554 - RNA, 21 nt, Human
caaccacuucaucucacccua

SEQ ID NO: 990555 - RNA, 22 nt, Human
caagaaaaguuauacaagaaaa

SEQ ID NO: 990556 - RNA, 24 nt, Human
caagaccagccuggccaacauggu

SEQ ID NO: 990557 - RNA, 20 nt, Human
caagaccaggccagacacca

SEQ ID NO: 990558 - RNA, 21 nt, Human
caagacucagucucaaaaaaa

SEQ ID NO: 990559 - RNA, 21 nt, Human
caagcucagccaaggugggcc

SEQ ID NO: 990560 - RNA, 23 nt, Human
caagcuguagagaaaagaaaaca

SEQ ID NO: 990561 - RNA, 21 nt, Human
cacacaaaagggaaggacuaa

SEQ ID NO: 990562 - RNA, 21 nt, Human
cacaccuguagucucagcacc

SEQ ID NO: 990563 - RNA, 24 nt, Human
cacaccuguagucucagcaccgug

SEQ ID NO: 990564 - RNA, 23 nt, Human
cacagacagauggacaagagcca

SEQ ID NO: 990565 - RNA, 19 nt, Human
cacagauauuugaugcuca

SEQ ID NO: 990566 - RNA, 18 nt, Human
cacauacaugcaacauac

SEQ ID NO: 990567 - RNA, 22 nt, Human
cacauacaugcaacauacagcc

SEQ ID NO: 990568 - RNA, 20 nt, Human
cacauacucacgcauccuuu

SEQ ID NO: 990569 - RNA, 19 nt, Human
caccaagaaccucccauuc

SEQ ID NO: 990570 - RNA, 18 nt, Human
caccacugcacucuggcc

SEQ ID NO: 990571 - RNA, 18 nt, Human
caccagagcaagcucagc

SEQ ID NO: 990572 - RNA, 19 nt, Human
caccccagucccuccauca

SEQ ID NO: 990573 - RNA, 21 nt, Human
caccccagucccuccaucaaa

SEQ ID NO: 990574 - RNA, 20 nt, Human
caccuguaaucccagcuacu

SEQ ID NO: 990575 - RNA, 21 nt, Human
caccuguaaucccagcuacuu

SEQ ID NO: 990576 - RNA, 23 nt, Human
caccuguaaucccagcuacuugg

SEQ ID NO: 990577 - RNA, 24 nt, Human
caccuguaaucccagcuacuuggg

SEQ ID NO: 990578 - RNA, 21 nt, Human
caccuguagucucagcaccgu

SEQ ID NO: 990579 - RNA, 24 nt, Human
caccuguagucucagcaccguggg

SEQ ID NO: 990580 - RNA, 24 nt, Human
cacgccuguaaucccagcacuuug

SEQ ID NO: 990581 - RNA, 24 nt, Human
cacgccuguaaucccagcacuuug

SEQ ID NO: 990582 - RNA, 18 nt, Human
cacugcacucuggccugg

SEQ ID NO: 990583 - RNA, 20 nt, Human
cacugcacucuggccuggca

SEQ ID NO: 990584 - RNA, 22 nt, Human
cacugcacucuggccuggcaca

SEQ ID NO: 990585 - RNA, 23 nt, Human
cacugcacucuggccuggcacag

SEQ ID NO: 990586 - RNA, 19 nt, Human
cacugcauuccagccugag

SEQ ID NO: 990587 - RNA, 19 nt, Human
cacugcauuccagccugag

SEQ ID NO: 990588 - RNA, 21 nt, Human
cacugcauuccagccugagug

SEQ ID NO: 990589 - RNA, 24 nt, Human
cacugcauuccagccugagugaca

SEQ ID NO: 990590 - RNA, 25 nt, Human
cacugcauuccagccugagugacag

SEQ ID NO: 990591 - RNA, 22 nt, Human
cacuucaacucccugcugaggg

SEQ ID NO: 990592 - RNA, 24 nt, Human
cacuuguccccucgugugcuccca

SEQ ID NO: 990593 - RNA, 19 nt, Human
cagaaagagcacuggggca

SEQ ID NO: 990594 - RNA, 23 nt, Human
cagacagauggacaagagccaga

SEQ ID NO: 990595 - RNA, 19 nt, Human
cagaggaggcuggggagug

SEQ ID NO: 990596 - RNA, 21 nt, Human
cagauccagaggcgaaugaga

SEQ ID NO: 990597 - RNA, 21 nt, Human
cagauccagaggcgaaugaga

SEQ ID NO: 990598 - RNA, 21 nt, Human
cagauccagaggcgaaugaga

SEQ ID NO: 990599 - RNA, 18 nt, Human
cagcaagcuaagaaagga

SEQ ID NO: 990600 - RNA, 22 nt, Human
cagcacaauccaacaaggugcu

SEQ ID NO: 990601 - RNA, 25 nt, Human
cagcacagccccacaccaaccuuca

SEQ ID NO: 990602 - RNA, 24 nt, Human
cagcacuuugggaggccgaagcag

SEQ ID NO: 990603 - RNA, 26 nt, Human
cagcacuuugggaggccgaagcaggu

SEQ ID NO: 990604 - RNA, 21 nt, Human
cagcacuuugggaggccgagg

SEQ ID NO: 990605 - RNA, 28 nt, Human
cagcacuuugggaggccgagguaggcgg

SEQ ID NO: 990606 - RNA, 21 nt, Human
cagcagccucuuuccagcccu

SEQ ID NO: 990607 - RNA, 21 nt, Human
cagccagcagccucuuuccag

SEQ ID NO: 990608 - RNA, 21 nt, Human
cagccagcagccucuuuccag

SEQ ID NO: 990609 - RNA, 23 nt, Human
cagccagcagccucuuuccagcc

SEQ ID NO: 990610 - RNA, 18 nt, Human
cagcccugaaccagcccu

SEQ ID NO: 990611 - RNA, 19 nt, Human
cagcccugaguccaauucc

SEQ ID NO: 990612 - RNA, 19 nt, Human
cagccucuuuccagcccug

SEQ ID NO: 990613 - RNA, 21 nt, Human
cagccucuuuccagcccuguu

SEQ ID NO: 990614 - RNA, 24 nt, Human
cagcuacuugggaggcugaggcag

SEQ ID NO: 990615 - RNA, 23 nt, Human
cagggcccuggccccauuuuccu

SEQ ID NO: 990616 - RNA, 20 nt, Human
caggggaacaaccuauaauu

SEQ ID NO: 990617 - RNA, 22 nt, Human
cagguggaucacuuggucagga

SEQ ID NO: 990618 - RNA, 26 nt, Human
cauacacauacucacgcauccuuugc

SEQ ID NO: 990619 - RNA, 22 nt, Human
caucucucuuuuuggggucucc

SEQ ID NO: 990620 - RNA, 21 nt, Human
caucuuguaaaccaagaaguu

SEQ ID NO: 990621 - RNA, 18 nt, Human
caugaaacuggccucacc

SEQ ID NO: 990622 - RNA, 20 nt, Human
caugguccccucuccuugaa

SEQ ID NO: 990623 - RNA, 18 nt, Human
caugucuguagucuuagc

SEQ ID NO: 990624 - RNA, 23 nt, Human
cauuccagccugagugacagagc

SEQ ID NO: 990625 - RNA, 22 nt, Human
cauucugucuccaugccagagg

SEQ ID NO: 990626 - RNA, 25 nt, Human
ccaaaacccuucgcucccuagacca

SEQ ID NO: 990627 - RNA, 18 nt, Human
ccaagaaccucccauucg

SEQ ID NO: 990628 - RNA, 23 nt, Human
ccaaggugggccaagccaggccc

SEQ ID NO: 990629 - RNA, 21 nt, Human
ccaauucauccuguccaggcu

SEQ ID NO: 990630 - RNA, 21 nt, Human
ccaauuccacccugauuuaga

SEQ ID NO: 990631 - RNA, 19 nt, Human
ccacugcacucuggccugg

SEQ ID NO: 990632 - RNA, 19 nt, Human
ccacugcacucuggccugg

SEQ ID NO: 990633 - RNA, 20 nt, Human
ccacugcacucuggccuggc

SEQ ID NO: 990634 - RNA, 18 nt, Human
ccacugcauuccagccug

SEQ ID NO: 990635 - RNA, 20 nt, Human
ccacugcauuccagccugag

SEQ ID NO: 990636 - RNA, 20 nt, Human
ccacugcauuccagccugag

SEQ ID NO: 990637 - RNA, 20 nt, Human
ccacugcauuccagccugag

SEQ ID NO: 990638 - RNA, 21 nt, Human
ccacugcauuccagccugagu

SEQ ID NO: 990639 - RNA, 24 nt, Human
ccacugcauuccagccugagugac

SEQ ID NO: 990640 - RNA, 19 nt, Human
ccagagaacaccagagaca

SEQ ID NO: 990641 - RNA, 22 nt, Human
ccaggagguugagacuacagug

SEQ ID NO: 990642 - RNA, 18 nt, Human
ccauaguccugugacuug

SEQ ID NO: 990643 - RNA, 23 nt, Human
cccacacauaccuccuuacacag

SEQ ID NO: 990644 - RNA, 19 nt, Human
cccauggaaagaagucgaa

SEQ ID NO: 990645 - RNA, 19 nt, Human
cccccggaaaccucagccc

SEQ ID NO: 990646 - RNA, 19 nt, Human
ccccuauucaaaauggagu

SEQ ID NO: 990647 - RNA, 19 nt, Human
ccccuauucaaaauggagu

SEQ ID NO: 990648 - RNA, 22 nt, Human
ccccuuuccucuucacuguuga

SEQ ID NO: 990649 - RNA, 18 nt, Human
cccuccaucaaagaucug

SEQ ID NO: 990650 - RNA, 20 nt, Human
cccuccuucugccuuuuguc

SEQ ID NO: 990651 - RNA, 20 nt, Human
cccuccuucugccuuuuguc

SEQ ID NO: 990652 - RNA, 20 nt, Human
cccuccuucugccuuuuguc

SEQ ID NO: 990653 - RNA, 20 nt, Human
cccuccuucugccuuuuguc

SEQ ID NO: 990654 - RNA, 21 nt, Human
cccuccuucugccuuuuguca

SEQ ID NO: 990655 - RNA, 21 nt, Human
cccuccuucugccuuuuguca

SEQ ID NO: 990656 - RNA, 19 nt, Human
cccucuguccuccuccucc

SEQ ID NO: 990657 - RNA, 19 nt, Human
cccucuguccuccuccucc

SEQ ID NO: 990658 - RNA, 19 nt, Human
cccugagggcugcugguug

SEQ ID NO: 990659 - RNA, 19 nt, Human
cccugagggcugcugguug

SEQ ID NO: 990660 - RNA, 22 nt, Human
ccgggaggugaaggcugcagug

SEQ ID NO: 990661 - RNA, 27 nt, Human
ccuacacacaaugcacgcauacacaua

SEQ ID NO: 990662 - RNA, 23 nt, Human
ccuccuccuccucugguuguucc

SEQ ID NO: 990663 - RNA, 23 nt, Human
ccuccuccuccucugguuguucc

SEQ ID NO: 990664 - RNA, 21 nt, Human
ccuccugucucauccugugac

SEQ ID NO: 990665 - RNA, 21 nt, Human
ccuccugucucauccugugac

SEQ ID NO: 990666 - RNA, 22 nt, Human
ccucugaaaguagcauuggccu

SEQ ID NO: 990667 - RNA, 22 nt, Human
ccucugaaaguagcauuggccu

SEQ ID NO: 990668 - RNA, 25 nt, Human
ccucuguccuccuccuccucugguu

SEQ ID NO: 990669 - RNA, 22 nt, Human
ccucugugaguugagugaggau

SEQ ID NO: 990670 - RNA, 22 nt, Human
ccucuucccauucugcuccucu

SEQ ID NO: 990671 - RNA, 22 nt, Human
ccugagugacagagcaagacuc

SEQ ID NO: 990672 - RNA, 21 nt, Human
ccuggccaacauggugaaacc

SEQ ID NO: 990673 - RNA, 24 nt, Human
ccuggccaacauggugaaaccucg

SEQ ID NO: 990674 - RNA, 22 nt, Human
ccuggcuaacacggugaaaccc

SEQ ID NO: 990675 - RNA, 24 nt, Human
ccuggcuaacacggugaaacccug

SEQ ID NO: 990676 - RNA, 20 nt, Human
ccuguaaucccagcacuuug

SEQ ID NO: 990677 - RNA, 22 nt, Human
ccuguaaucccagcacuuuggg

SEQ ID NO: 990678 - RNA, 21 nt, Human
ccuguaaucccagcuacuugg

SEQ ID NO: 990679 - RNA, 22 nt, Human
ccugugacuugccagguucauc

SEQ ID NO: 990680 - RNA, 18 nt, Human
ccuguugccaaccacuuc

SEQ ID NO: 990681 - RNA, 18 nt, Human
ccuguugccaaccacuuc

SEQ ID NO: 990682 - RNA, 21 nt, Human
ccuucuaccacgagagaagcc

SEQ ID NO: 990683 - RNA, 22 nt, Human
ccuucuggaaucuucucccaca

SEQ ID NO: 990684 - RNA, 21 nt, Human
ccuuggacuuggccauccacu

SEQ ID NO: 990685 - RNA, 20 nt, Human
ccuuuguuuauccagugcaa

SEQ ID NO: 990686 - RNA, 21 nt, Human
cgaaaacagccgagaguucac

SEQ ID NO: 990687 - RNA, 21 nt, Human
cgaaaccagccuggucaauaa

SEQ ID NO: 990688 - RNA, 24 nt, Human
cgaagcagguggaucacuugguca

SEQ ID NO: 990689 - RNA, 24 nt, Human
cgagguaggcggaucacgagguca

SEQ ID NO: 990690 - RNA, 19 nt, Human
cgaucguuuaacagccauc

SEQ ID NO: 990691 - RNA, 18 nt, Human
cgccuguaaucccagcac

SEQ ID NO: 990692 - RNA, 23 nt, Human
cgccuguaaucccagcacuuugg

SEQ ID NO: 990693 - RNA, 24 nt, Human
cgccuguaaucccagcacuuuggg

SEQ ID NO: 990694 - RNA, 21 nt, Human
cggaaaccucagcccugaacc

SEQ ID NO: 990695 - RNA, 18 nt, Human
cggcauaaagaguacguc

SEQ ID NO: 990696 - RNA, 24 nt, Human
cggcucacgccuguaaucccagca

SEQ ID NO: 990697 - RNA, 20 nt, Human
cgugccuguaaucccagcac

SEQ ID NO: 990698 - RNA, 24 nt, Human
cgugccuguaaucccagcacuuug

SEQ ID NO: 990699 - RNA, 19 nt, Human
cuaacuccaaaguuaucaa

SEQ ID NO: 990700 - RNA, 21 nt, Human
cuaagaaaggaaaagguccau

SEQ ID NO: 990701 - RNA, 31 nt, Human
cuacacacaaugcacgcauacacauacacag

SEQ ID NO: 990702 - RNA, 18 nt, Human
cucaaaaaaaaaaaaaaa

SEQ ID NO: 990703 - RNA, 18 nt, Human
cucaaaaaaaaaaaaaaa

SEQ ID NO: 990704 - RNA, 19 nt, Human
cucacaccuguagucucag

SEQ ID NO: 990705 - RNA, 22 nt, Human
cucacgccuguaaucccagcac

SEQ ID NO: 990706 - RNA, 22 nt, Human
cucacgccuguaaucccagcac

SEQ ID NO: 990707 - RNA, 24 nt, Human
cucacgccuguaaucccagcacuu

SEQ ID NO: 990708 - RNA, 24 nt, Human
cucacgccuguaaucccagcacuu

SEQ ID NO: 990709 - RNA, 20 nt, Human
cucacuaaguccucuuccca

SEQ ID NO: 990710 - RNA, 20 nt, Human
cucacuaaguccucuuccca

SEQ ID NO: 990711 - RNA, 24 nt, Human
cucagucucaaaaaaaaaaaaaaa

SEQ ID NO: 990712 - RNA, 26 nt, Human
cucagucucaaaaaaaaaaaaaaaaa

SEQ ID NO: 990713 - RNA, 23 nt, Human
cuccagcagcacagccccacacc

SEQ ID NO: 990714 - RNA, 22 nt, Human
cuccaugccagaggucugugcc

SEQ ID NO: 990715 - RNA, 22 nt, Human
cucccacauggcacagauauuu

SEQ ID NO: 990716 - RNA, 24 nt, Human
cuccuaucugaugcacaguggcug

SEQ ID NO: 990717 - RNA, 18 nt, Human
cucggaugcacuuggcug

SEQ ID NO: 990718 - RNA, 23 nt, Human
cucgugccuguaaucccagcacu

SEQ ID NO: 990719 - RNA, 24 nt, Human
cucgugccuguaaucccagcacuu

SEQ ID NO: 990720 - RNA, 25 nt, Human
cucucugcuucauccacguccuuuc

SEQ ID NO: 990721 - RNA, 25 nt, Human
cucucugcuucauccacguccuuuc

SEQ ID NO: 990722 - RNA, 25 nt, Human
cucucugcuucauccacguccuuuc

SEQ ID NO: 990723 - RNA, 22 nt, Human
cucuguccuccuccuccucugg

SEQ ID NO: 990724 - RNA, 23 nt, Human
cucugugucaccucucccaaaca

SEQ ID NO: 990725 - RNA, 20 nt, Human
cucuuuccuuugcugcuuuc

SEQ ID NO: 990726 - RNA, 23 nt, Human
cucuuugacgugccaggccuggg

SEQ ID NO: 990727 - RNA, 21 nt, Human
cugaauggauagacauggacc

SEQ ID NO: 990728 - RNA, 22 nt, Human
cugacaauucagcaacuccagc

SEQ ID NO: 990729 - RNA, 22 nt, Human
cugacccuagcaccagagcaag

SEQ ID NO: 990730 - RNA, 23 nt, Human
cugaugcugaauggauagacaug

SEQ ID NO: 990731 - RNA, 20 nt, Human
cugcagugagccgagaucgc

SEQ ID NO: 990732 - RNA, 22 nt, Human
cugcagugagccgagaucgcgc

SEQ ID NO: 990733 - RNA, 20 nt, Human
cugcccggggcaggcuucaa

SEQ ID NO: 990734 - RNA, 22 nt, Human
cugccucugcacuuccaacccc

SEQ ID NO: 990735 - RNA, 20 nt, Human
cugcucuuuuuggggucucc

SEQ ID NO: 990736 - RNA, 18 nt, Human
cuggaacaaagaggcugc

SEQ ID NO: 990737 - RNA, 20 nt, Human
cuggaauaaaauccagauuu

SEQ ID NO: 990738 - RNA, 19 nt, Human
cuggagccucuuugacgug

SEQ ID NO: 990739 - RNA, 21 nt, Human
cuggauccugcgcugcucgga

SEQ ID NO: 990740 - RNA, 24 nt, Human
cuggauccugcgcugcucggaugc

SEQ ID NO: 990741 - RNA, 18 nt, Human
cuggcaugguggugggca

SEQ ID NO: 990742 - RNA, 18 nt, Human
cuggcuaacacggugaaa

SEQ ID NO: 990743 - RNA, 24 nt, Human
cuggcuaacacggugaaacccugu

SEQ ID NO: 990744 - RNA, 20 nt, Human
cuggggcaggaaaccuggau

SEQ ID NO: 990745 - RNA, 21 nt, Human
cuguaaucccagcuacuuggg

SEQ ID NO: 990746 - RNA, 25 nt, Human
cuguccaggcucuucuagagcagcu

SEQ ID NO: 990747 - RNA, 24 nt, Human
cuuaguagcccagcccugugguua

SEQ ID NO: 990748 - RNA, 19 nt, Human
cuucagggcccuggcccca

SEQ ID NO: 990749 - RNA, 19 nt, Human
cuuccaaccccaguggggu

SEQ ID NO: 990750 - RNA, 22 nt, Human
cuuccaguguaacucuuuuugg

SEQ ID NO: 990751 - RNA, 22 nt, Human
cuuccaguguaacucuuuuugg

SEQ ID NO: 990752 - RNA, 19 nt, Human
cuucuagagcagcuggucu

SEQ ID NO: 990753 - RNA, 21 nt, Human
cuucuguucagggauaaaaau

SEQ ID NO: 990754 - RNA, 23 nt, Human
cuugagcucaggaguuugagacc

SEQ ID NO: 990755 - RNA, 20 nt, Human
cuugccagguucaucaucca

SEQ ID NO: 990756 - RNA, 20 nt, Human
cuuggacuuggccauccacu

SEQ ID NO: 990757 - RNA, 20 nt, Human
gaaaacaugucccuugagcc

SEQ ID NO: 990758 - RNA, 19 nt, Human
gaaaccucgucucuacuaa

SEQ ID NO: 990759 - RNA, 24 nt, Human
gaaaucacuuaagcccaggaguuc

SEQ ID NO: 990760 - RNA, 20 nt, Human
gaaaugaaaacaagcuguag

SEQ ID NO: 990761 - RNA, 19 nt, Human
gaacacgcccauggaaaga

SEQ ID NO: 990762 - RNA, 23 nt, Human
gaagcagguggaucacuugguca

SEQ ID NO: 990763 - RNA, 24 nt, Human
gaaggcugcagugagccgagaucg

SEQ ID NO: 990764 - RNA, 18 nt, Human
gaaucugcaauggcagcu

SEQ ID NO: 990765 - RNA, 18 nt, Human
gaaucugcaauggcagcu

SEQ ID NO: 990766 - RNA, 25 nt, Human
gacaacgaaaacagccgagaguuca

SEQ ID NO: 990767 - RNA, 18 nt, Human
gacagagcaagacucagu

SEQ ID NO: 990768 - RNA, 21 nt, Human
gaccgggcgugguggcucacg

SEQ ID NO: 990769 - RNA, 24 nt, Human
gacuuucugggcaaaaaucaaagg

SEQ ID NO: 990770 - RNA, 24 nt, Human
gagagaagccagccuggggacaga

SEQ ID NO: 990771 - RNA, 23 nt, Human
gagaucgcgccacugcauuccag

SEQ ID NO: 990772 - RNA, 20 nt, Human
gagcaagacucagucucaaa

SEQ ID NO: 990773 - RNA, 19 nt, Human
gagcuguuuuuuuuuuuuu

SEQ ID NO: 990774 - RNA, 21 nt, Human
gagcuuucuucugaguuuuca

SEQ ID NO: 990775 - RNA, 26 nt, Human
gaggcgaaugagacaggcacgugccu

SEQ ID NO: 990776 - RNA, 26 nt, Human
gaggcgaaugagacaggcacgugccu

SEQ ID NO: 990777 - RNA, 26 nt, Human
gaggcgaaugagacaggcacgugccu

SEQ ID NO: 990778 - RNA, 19 nt, Human
gagggcagcuucuggaaca

SEQ ID NO: 990779 - RNA, 23 nt, Human
gagguaggcggaucacgagguca

SEQ ID NO: 990780 - RNA, 19 nt, Human
gagugaaguggagacauuc

SEQ ID NO: 990781 - RNA, 18 nt, Human
gaguucacacaaaaggga

SEQ ID NO: 990782 - RNA, 22 nt, Human
gaucacuuggucaggaguucaa

SEQ ID NO: 990783 - RNA, 24 nt, Human
gaucacuuggucaggaguucaaga

SEQ ID NO: 990784 - RNA, 24 nt, Human
gaucgcuugagcucaggaguuuga

SEQ ID NO: 990785 - RNA, 19 nt, Human
gcaacauacagccaagucc

SEQ ID NO: 990786 - RNA, 19 nt, Human
gcacguggaaggagaacca

SEQ ID NO: 990787 - RNA, 23 nt, Human
gcagaagaaucacuugaacccgg

SEQ ID NO: 990788 - RNA, 18 nt, Human
gcauccuuugcaaacacc

SEQ ID NO: 990789 - RNA, 24 nt, Human
gcauuccagccugagugacagagc

SEQ ID NO: 990790 - RNA, 24 nt, Human
gccaacauggugaaaccucgucuc

SEQ ID NO: 990791 - RNA, 21 nt, Human
gccacugcauuccagccugag

SEQ ID NO: 990792 - RNA, 23 nt, Human
gccagcagccucuuuccagcccu

SEQ ID NO: 990793 - RNA, 24 nt, Human
gcccaggagguugagacuacagug

SEQ ID NO: 990794 - RNA, 22 nt, Human
gcccaggaguucgaaaccagcc

SEQ ID NO: 990795 - RNA, 18 nt, Human
gcccccaacccccaacau

SEQ ID NO: 990796 - RNA, 19 nt, Human
gcccuggccccauuuuccu

SEQ ID NO: 990797 - RNA, 20 nt, Human
gcccuggccccauuuuccua

SEQ ID NO: 990798 - RNA, 20 nt, Human
gccgagaucgcgccacugca

SEQ ID NO: 990799 - RNA, 21 nt, Human
gccuggguuugaucuugagga

SEQ ID NO: 990800 - RNA, 22 nt, Human
gcgaaugagacaggcacgugcc

SEQ ID NO: 990801 - RNA, 22 nt, Human
gcgaaugagacaggcacgugcc

SEQ ID NO: 990802 - RNA, 22 nt, Human
gcgaaugagacaggcacgugcc

SEQ ID NO: 990803 - RNA, 24 nt, Human
gcuaacacggugaaacccugucuc

SEQ ID NO: 990804 - RNA, 21 nt, Human
gcuaagaaaggaaaaggucca

SEQ ID NO: 990805 - RNA, 26 nt, Human
gcucagcuucagcaaagagggaacgc

SEQ ID NO: 990806 - RNA, 21 nt, Human
gcugcagugagccgagaucgc

SEQ ID NO: 990807 - RNA, 22 nt, Human
gcugcucuuuuuggggucuccc

SEQ ID NO: 990808 - RNA, 19 nt, Human
gcugggugcagcggcucac

SEQ ID NO: 990809 - RNA, 18 nt, Human
ggaaaaaaggacgugacu

SEQ ID NO: 990810 - RNA, 21 nt, Human
ggaaaaaaggacgugacucga

SEQ ID NO: 990811 - RNA, 26 nt, Human
ggaaaugaaaacaagcuguagagaaa

SEQ ID NO: 990812 - RNA, 22 nt, Human
ggacuacaggcaagguauaaac

SEQ ID NO: 990813 - RNA, 22 nt, Human
ggacuacaggcaagguauaaac

SEQ ID NO: 990814 - RNA, 26 nt, Human
ggacuacaggcaagguauaaacuggu

SEQ ID NO: 990815 - RNA, 26 nt, Human
ggacuacaggcaagguauaaacuggu

SEQ ID NO: 990816 - RNA, 22 nt, Human
ggagaaaucacuuaagcccagg

SEQ ID NO: 990817 - RNA, 23 nt, Human
ggagagcuguuuuuuuuuuuuuu

SEQ ID NO: 990818 - RNA, 22 nt, Human
ggagugguggcucacaccugua

SEQ ID NO: 990819 - RNA, 24 nt, Human
ggauagaauguuaaacacauucuu

SEQ ID NO: 990820 - RNA, 22 nt, Human
ggauccugcgcugcucggaugc

SEQ ID NO: 990821 - RNA, 22 nt, Human
ggaucgcuugagcucaggaguu

SEQ ID NO: 990822 - RNA, 21 nt, Human
ggaugacuuggcuugaaggaa

SEQ ID NO: 990823 - RNA, 21 nt, Human
ggaugacuuggcuugaaggaa

SEQ ID NO: 990824 - RNA, 24 nt, Human
ggcaccuguaaucccagcuacuug

SEQ ID NO: 990825 - RNA, 23 nt, Human
ggcaugguggugggcaccuguaa

SEQ ID NO: 990826 - RNA, 23 nt, Human
ggcgugguggcucacgccuguaa

SEQ ID NO: 990827 - RNA, 21 nt, Human
ggcucacaccuguagucucag

SEQ ID NO: 990828 - RNA, 20 nt, Human
ggcucacgccuguaauccca

SEQ ID NO: 990829 - RNA, 23 nt, Human
ggcucacgccuguaaucccagca

SEQ ID NO: 990830 - RNA, 21 nt, Human
ggcucgugccuguaaucccag

SEQ ID NO: 990831 - RNA, 18 nt, Human
ggcugggugcagcggcuc

SEQ ID NO: 990832 - RNA, 19 nt, Human
gggacagaggacagaggaa

SEQ ID NO: 990833 - RNA, 19 nt, Human
gggacagaggacagaggag

SEQ ID NO: 990834 - RNA, 24 nt, Human
gggagugguggcucacaccuguag

SEQ ID NO: 990835 - RNA, 18 nt, Human
gggcaggaaaccuggauc

SEQ ID NO: 990836 - RNA, 19 nt, Human
ggggcaggaaaccuggauc

SEQ ID NO: 990837 - RNA, 21 nt, Human
ggguaacuuccugaugugucc

SEQ ID NO: 990838 - RNA, 21 nt, Human
ggguaacuuccugaugugucc

SEQ ID NO: 990839 - RNA, 24 nt, Human
gggugcagcggcucacgccuguaa

SEQ ID NO: 990840 - RNA, 24 nt, Human
gguggcucacaccuguagucucag

SEQ ID NO: 990841 - RNA, 24 nt, Human
gguggcucacgccuguaaucccag

SEQ ID NO: 990842 - RNA, 23 nt, Human
gguggcucgugccuguaauccca

SEQ ID NO: 990843 - RNA, 24 nt, Human
gguggcucgugccuguaaucccag

SEQ ID NO: 990844 - RNA, 24 nt, Human
gguggugggcaccuguaaucccag

SEQ ID NO: 990845 - RNA, 20 nt, Human
guaccuuuguuuauccagug

SEQ ID NO: 990846 - RNA, 20 nt, Human
guacuccaucguugccucuu

SEQ ID NO: 990847 - RNA, 24 nt, Human
guaguuaugaggccuggugcugug

SEQ ID NO: 990848 - RNA, 24 nt, Human
guccucuucccauucugcuccucu

SEQ ID NO: 990849 - RNA, 24 nt, Human
guccucuucccauucugcuccucu

SEQ ID NO: 990850 - RNA, 25 nt, Human
gucucccuccuucugccuuuuguca

SEQ ID NO: 990851 - RNA, 25 nt, Human
gucucccuccuucugccuuuuguca

SEQ ID NO: 990852 - RNA, 21 nt, Human
gugaaacccugucucuacuaa

SEQ ID NO: 990853 - RNA, 21 nt, Human
gugaaaccucgucucuacuaa

SEQ ID NO: 990854 - RNA, 19 nt, Human
gugccucucugcuucaucc

SEQ ID NO: 990855 - RNA, 19 nt, Human
gugccucucugcuucaucc

SEQ ID NO: 990856 - RNA, 19 nt, Human
gugccucucugcuucaucc

SEQ ID NO: 990857 - RNA, 19 nt, Human
gugccuguaaucccagcac

SEQ ID NO: 990858 - RNA, 20 nt, Human
gugcgguaaacaaacagcag

SEQ ID NO: 990859 - RNA, 24 nt, Human
gugcugcucuuuuuggggucuccc

SEQ ID NO: 990860 - RNA, 19 nt, Human
guggaucacuuggucagga

SEQ ID NO: 990861 - RNA, 23 nt, Human
guggaucacuuggucaggaguuc

SEQ ID NO: 990862 - RNA, 23 nt, Human
guggcucacaccuguagucucag

SEQ ID NO: 990863 - RNA, 23 nt, Human
guggugggcaccuguaaucccag

SEQ ID NO: 990864 - RNA, 25 nt, Human
guguuuauuuauuuauuuauuuauu

SEQ ID NO: 990865 - RNA, 20 nt, Human
uaaaaauacaaaaauuagcc

SEQ ID NO: 990866 - RNA, 21 nt, Human
uaaaaauacaaaaauuagccu

SEQ ID NO: 990867 - RNA, 21 nt, Human
uaaaauaacuguagucuuagc

SEQ ID NO: 990868 - RNA, 22 nt, Human
uaaaauacucugugucaccucu

SEQ ID NO: 990869 - RNA, 25 nt, Human
uaaacuaugaagaaauuaccguacc

SEQ ID NO: 990870 - RNA, 21 nt, Human
uaaaguccaaaaagaaaggga

SEQ ID NO: 990871 - RNA, 20 nt, Human
uaaagugaaagcaaguuuaa

SEQ ID NO: 990872 - RNA, 20 nt, Human
uaaagugaaagcaaguuuaa

SEQ ID NO: 990873 - RNA, 22 nt, Human
uaacacggugaaacccugucuc

SEQ ID NO: 990874 - RNA, 24 nt, Human
uaacacggugaaacccugucucua

SEQ ID NO: 990875 - RNA, 19 nt, Human
uaaccaagaggcagcagag

SEQ ID NO: 990876 - RNA, 22 nt, Human
uaaccaagaggcagcagagcug

SEQ ID NO: 990877 - RNA, 20 nt, Human
uaaccuguagaaaacaggac

SEQ ID NO: 990878 - RNA, 21 nt, Human
uaaccuguagaaaacaggaca

SEQ ID NO: 990879 - RNA, 18 nt, Human
uaacucagcaaacauuuc

SEQ ID NO: 990880 - RNA, 24 nt, Human
uaacuguagucuuagcugcuuggg

SEQ ID NO: 990881 - RNA, 21 nt, Human
uaagaaaggaaaagguccauu

SEQ ID NO: 990882 - RNA, 23 nt, Human
uaagaaaguaaaggaauauagaa

SEQ ID NO: 990883 - RNA, 23 nt, Human
uaagaaaguaaaggaauauagaa

SEQ ID NO: 990884 - RNA, 22 nt, Human
uaagaauaaaauaacuguaguc

SEQ ID NO: 990885 - RNA, 23 nt, Human
uaagcccaggaguucgaaaccag

SEQ ID NO: 990886 - RNA, 18 nt, Human
uaagcuuccugaugcuca

SEQ ID NO: 990887 - RNA, 19 nt, Human
uaagguagaaggaauuaaa

SEQ ID NO: 990888 - RNA, 19 nt, Human
uaagguagaaggaauuaaa

SEQ ID NO: 990889 - RNA, 19 nt, Human
uaagguagaaggaauuaaa

SEQ ID NO: 990890 - RNA, 19 nt, Human
uaagguagaaggaauuaaa

SEQ ID NO: 990891 - RNA, 18 nt, Human
uacacagguccauuauug

SEQ ID NO: 990892 - RNA, 19 nt, Human
uacaccugucugccucugc

SEQ ID NO: 990893 - RNA, 22 nt, Human
uacagugagccgugauugcacc

SEQ ID NO: 990894 - RNA, 24 nt, Human
uaccaggugccugauaaaugucag

SEQ ID NO: 990895 - RNA, 23 nt, Human
uaccugcuuauaaacaccagaau

SEQ ID NO: 990896 - RNA, 22 nt, Human
uaccuuuguuuauccagugcaa

SEQ ID NO: 990897 - RNA, 18 nt, Human
uacucugugucaccucuc

SEQ ID NO: 990898 - RNA, 24 nt, Human
uagaaaacaggacaaaggugaccg

SEQ ID NO: 990899 - RNA, 19 nt, Human
uagaaggaauuaaauuaug

SEQ ID NO: 990900 - RNA, 19 nt, Human
uagcucacugguguaacca

SEQ ID NO: 990901 - RNA, 18 nt, Human
uagcugcuugggaggcug

SEQ ID NO: 990902 - RNA, 21 nt, Human
uagcuggacucucugggcaaa

SEQ ID NO: 990903 - RNA, 22 nt, Human
uagcuggacuuucugggcaaaa

SEQ ID NO: 990904 - RNA, 19 nt, Human
uaguacaaaaggccuugaa

SEQ ID NO: 990905 - RNA, 22 nt, Human
uaguauguuagcuggacuuucu

SEQ ID NO: 990906 - RNA, 21 nt, Human
uagugggaucccaucucucuu

SEQ ID NO: 990907 - RNA, 27 nt, Human
uauagugggaucccaucucucuuuuug

SEQ ID NO: 990908 - RNA, 25 nt, Human
uauccaccagacuagauuccccagu

SEQ ID NO: 990909 - RNA, 22 nt, Human
uaucugaugcacaguggcugcc

SEQ ID NO: 990910 - RNA, 20 nt, Human
ucaaaauggagucacucuga

SEQ ID NO: 990911 - RNA, 20 nt, Human
ucaaaauggagucacucuga

SEQ ID NO: 990912 - RNA, 23 nt, Human
ucaaagaucugccuuaauaccaa

SEQ ID NO: 990913 - RNA, 20 nt, Human
ucaccacugcuguccccucu

SEQ ID NO: 990914 - RNA, 21 nt, Human
ucaccacugcuguccccucuu

SEQ ID NO: 990915 - RNA, 27 nt, Human
ucacccuaagagagggagagcuguuuu

SEQ ID NO: 990916 - RNA, 27 nt, Human
ucacccuaagagagggagagcuguuuu

SEQ ID NO: 990917 - RNA, 23 nt, Human
ucacgaggucaggagauggaguc

SEQ ID NO: 990918 - RNA, 18 nt, Human
ucacucacucagcaaaca

SEQ ID NO: 990919 - RNA, 24 nt, Human
ucacuuggucaggaguucaagacc

SEQ ID NO: 990920 - RNA, 24 nt, Human
ucagauggccauucccagcuuuug

SEQ ID NO: 990921 - RNA, 19 nt, Human
ucagcccaaaugugggaca

SEQ ID NO: 990922 - RNA, 24 nt, Human
ucaggcugggagugguggcucaca

SEQ ID NO: 990923 - RNA, 21 nt, Human
ucagggauaaaaauaagcccu

SEQ ID NO: 990924 - RNA, 23 nt, Human
ucagggcccuggccccauuuucc

SEQ ID NO: 990925 - RNA, 25 nt, Human
ucagucucaaaaaaaaaaaaaaaaa

SEQ ID NO: 990926 - RNA, 21 nt, Human
ucauucaucccccggaaaccu

SEQ ID NO: 990927 - RNA, 19 nt, Human
uccaaaaagaaagggagaa

SEQ ID NO: 990928 - RNA, 19 nt, Human
uccacuuaagauuaaaguc

SEQ ID NO: 990929 - RNA, 19 nt, Human
uccagccugagugacagag

SEQ ID NO: 990930 - RNA, 24 nt, Human
uccagccugagugacagagcaaga

SEQ ID NO: 990931 - RNA, 26 nt, Human
uccauaggcaaagcagcccugagggc

SEQ ID NO: 990932 - RNA, 26 nt, Human
uccauaggcaaagcagcccugagggc

SEQ ID NO: 990933 - RNA, 22 nt, Human
uccccagcuucuguuguaacuc

SEQ ID NO: 990934 - RNA, 22 nt, Human
uccccagcuucuguuguaacuc

SEQ ID NO: 990935 - RNA, 19 nt, Human
uccccucuuuggcuccaca

SEQ ID NO: 990936 - RNA, 19 nt, Human
ucccuaagcuuccugaugc

SEQ ID NO: 990937 - RNA, 20 nt, Human
ucccuacagcaagcuaagaa

SEQ ID NO: 990938 - RNA, 27 nt, Human
ucccuacagcaagcuaagaaaggaaaa

SEQ ID NO: 990939 - RNA, 18 nt, Human
ucccuagaccacugcucu

SEQ ID NO: 990940 - RNA, 18 nt, Human
ucccucuguccuccuccu

SEQ ID NO: 990941 - RNA, 18 nt, Human
ucccucuguccuccuccu

SEQ ID NO: 990942 - RNA, 21 nt, Human
ucccucuguccuccuccuccu

SEQ ID NO: 990943 - RNA, 20 nt, Human
ucccugcugaggguugaauc

SEQ ID NO: 990944 - RNA, 24 nt, Human
uccuccuccuccucugguuguucc

SEQ ID NO: 990945 - RNA, 22 nt, Human
uccucugguuguuccccagcac

SEQ ID NO: 990946 - RNA, 22 nt, Human
uccucugguuguuccccagcac

SEQ ID NO: 990947 - RNA, 23 nt, Human
uccucugugaguugagugaggau

SEQ ID NO: 990948 - RNA, 23 nt, Human
uccucugugaguugagugaggau

SEQ ID NO: 990949 - RNA, 23 nt, Human
uccuggaugcagcagauccagag

SEQ ID NO: 990950 - RNA, 23 nt, Human
uccuggaugcagcagauccagag

SEQ ID NO: 990951 - RNA, 23 nt, Human
uccuggaugcagcagauccagag

SEQ ID NO: 990952 - RNA, 19 nt, Human
uccuuggcuggagggaugc

SEQ ID NO: 990953 - RNA, 21 nt, Human
uccuuugcaaacaccagaggc

SEQ ID NO: 990954 - RNA, 23 nt, Human
ucgcgccacugcauuccagccug

SEQ ID NO: 990955 - RNA, 19 nt, Human
ucgcuugagcucaggaguu

SEQ ID NO: 990956 - RNA, 21 nt, Human
ucgcuugagcucaggaguuug

SEQ ID NO: 990957 - RNA, 23 nt, Human
ucggaugcacuuggcugugugac

SEQ ID NO: 990958 - RNA, 22 nt, Human
ucgugccuguaaucccagcacu

SEQ ID NO: 990959 - RNA, 19 nt, Human
ucuagagcagcuggucucc

SEQ ID NO: 990960 - RNA, 20 nt, Human
ucucacccuaagagagggag

SEQ ID NO: 990961 - RNA, 23 nt, Human
ucucagauggccauucccagcuu

SEQ ID NO: 990962 - RNA, 21 nt, Human
ucuccacaccccagucccucc

SEQ ID NO: 990963 - RNA, 20 nt, Human
ucucccacacauaccuccuu

SEQ ID NO: 990964 - RNA, 21 nt, Human
ucucccacacauaccuccuua

SEQ ID NO: 990965 - RNA, 20 nt, Human
ucucccuccuucugccuuuu

SEQ ID NO: 990966 - RNA, 20 nt, Human
ucucccuccuucugccuuuu

SEQ ID NO: 990967 - RNA, 20 nt, Human
ucucccuccuucugccuuuu

SEQ ID NO: 990968 - RNA, 20 nt, Human
ucucccuccuucugccuuuu

SEQ ID NO: 990969 - RNA, 21 nt, Human
ucucuacuaaaaauacaaaaa

SEQ ID NO: 990970 - RNA, 21 nt, Human
ucucuacuaaaaauacaaaaa

SEQ ID NO: 990971 - RNA, 23 nt, Human
ucucuacuaaaaauacaaaaauu

SEQ ID NO: 990972 - RNA, 22 nt, Human
ucucugggcaaaaaaucaaagg

SEQ ID NO: 990973 - RNA, 24 nt, Human
ucugagcuuucuucugaguuuuca

SEQ ID NO: 990974 - RNA, 19 nt, Human
ucugcacucucaccucccc

SEQ ID NO: 990975 - RNA, 19 nt, Human
ucugcacuuccaaccccag

SEQ ID NO: 990976 - RNA, 20 nt, Human
ucugcccccaacccccaaca

SEQ ID NO: 990977 - RNA, 18 nt, Human
ucuguagucuuagcugcu

SEQ ID NO: 990978 - RNA, 19 nt, Human
ucuguccuccuccuccucu

SEQ ID NO: 990979 - RNA, 21 nt, Human
ucuguccuccuccuccucucc

SEQ ID NO: 990980 - RNA, 21 nt, Human
ucuuccucugugucacucugg

SEQ ID NO: 990981 - RNA, 24 nt, Human
ucuucucccacacauaccuccuua

SEQ ID NO: 990982 - RNA, 18 nt, Human
ucuuguaaaccaagaagu

SEQ ID NO: 990983 - RNA, 18 nt, Human
ucuuguaaaccaagaagu

SEQ ID NO: 990984 - RNA, 22 nt, Human
ucuuugacgugccaggccuggg

SEQ ID NO: 990985 - RNA, 20 nt, Human
ucuuuggcuccacacacacu

SEQ ID NO: 990986 - RNA, 25 nt, Human
ugaaagcaaguuuauuaagaaagua

SEQ ID NO: 990987 - RNA, 25 nt, Human
ugaaagcaaguuuauuaagaaagua

SEQ ID NO: 990988 - RNA, 23 nt, Human
ugaagaaauuaccguaccuuugu

SEQ ID NO: 990989 - RNA, 18 nt, Human
ugaagcacaaucccuaca

SEQ ID NO: 990990 - RNA, 22 nt, Human
ugaagcacaaucccuacagcaa

SEQ ID NO: 990991 - RNA, 23 nt, Human
ugaagcguuccagggaagacccc

SEQ ID NO: 990992 - RNA, 21 nt, Human
ugaaggaaggaggggcucuuc

SEQ ID NO: 990993 - RNA, 21 nt, Human
ugaaggaaggaggggcucuuc

SEQ ID NO: 990994 - RNA, 18 nt, Human
ugaagugggaggaucucu

SEQ ID NO: 990995 - RNA, 24 nt, Human
ugaagugggaggaucucuugagcc

SEQ ID NO: 990996 - RNA, 21 nt, Human
ugaauggauagacauggacca

SEQ ID NO: 990997 - RNA, 21 nt, Human
ugacaauucagcaacuccagc

SEQ ID NO: 990998 - RNA, 24 nt, Human
ugacagcaccugcaguuuaccagc

SEQ ID NO: 990999 - RNA, 21 nt, Human
ugacccuagcaccagagcaag

SEQ ID NO: 991000 - RNA, 21 nt, Human
ugaccuuggacuuggccaucc

SEQ ID NO: 991001 - RNA, 19 nt, Human
ugacucgaaucugcaaugg

SEQ ID NO: 991002 - RNA, 19 nt, Human
ugacucgaaucugcaaugg

SEQ ID NO: 991003 - RNA, 22 nt, Human
ugacucgaaucugcaauggcag

SEQ ID NO: 991004 - RNA, 22 nt, Human
ugacucgaaucugcaauggcag

SEQ ID NO: 991005 - RNA, 19 nt, Human
ugacuugacacaugugggc

SEQ ID NO: 991006 - RNA, 25 nt, Human
ugagaagcugagacaggagaaauca

SEQ ID NO: 991007 - RNA, 25 nt, Human
ugagacaggagaaaucacuuaagcc

SEQ ID NO: 991008 - RNA, 19 nt, Human
ugagacaggcacgugccuc

SEQ ID NO: 991009 - RNA, 23 nt, Human
ugagaccagccugugcaauauag

SEQ ID NO: 991010 - RNA, 19 nt, Human
ugagauagcaugaaaacag

SEQ ID NO: 991011 - RNA, 25 nt, Human
ugagcccaggagguugagacuacag

SEQ ID NO: 991012 - RNA, 22 nt, Human
ugagccgagaucgcgccacugc

SEQ ID NO: 991013 - RNA, 20 nt, Human
ugaggcagaagaaucacuug

SEQ ID NO: 991014 - RNA, 24 nt, Human
ugaggcagaagaaucacuugaacc

SEQ ID NO: 991015 - RNA, 25 nt, Human
ugaggcagaagaaucacuugaaccc

SEQ ID NO: 991016 - RNA, 19 nt, Human
ugaggccaggugcgguggc

SEQ ID NO: 991017 - RNA, 24 nt, Human
ugaggccaggugcgguggcucgug

SEQ ID NO: 991018 - RNA, 18 nt, Human
ugaguuuuccaggaaagg

SEQ ID NO: 991019 - RNA, 19 nt, Human
ugaguuuuccaggaaaggg

SEQ ID NO: 991020 - RNA, 22 nt, Human
ugaugaaccagugcuggaagcu

SEQ ID NO: 991021 - RNA, 19 nt, Human
ugaugacaaagagacagcg

SEQ ID NO: 991022 - RNA, 20 nt, Human
ugaugcugaauggauagaca

SEQ ID NO: 991023 - RNA, 22 nt, Human
ugauugcaccacugcacucugg

SEQ ID NO: 991024 - RNA, 20 nt, Human
ugcaagagauugcucagcug

SEQ ID NO: 991025 - RNA, 21 nt, Human
ugcacgcauacacauacacau

SEQ ID NO: 991026 - RNA, 21 nt, Human
ugcagacaacgaaaacagccg

SEQ ID NO: 991027 - RNA, 20 nt, Human
ugcaucugauucagggcugu

SEQ ID NO: 991028 - RNA, 20 nt, Human
ugccaagguuaaggacaugu

SEQ ID NO: 991029 - RNA, 20 nt, Human
ugccaagguuaaggacaugu

SEQ ID NO: 991030 - RNA, 20 nt, Human
ugccucugcacuuccaaccc

SEQ ID NO: 991031 - RNA, 21 nt, Human
ugccucugcucugaaauauuu

SEQ ID NO: 991032 - RNA, 23 nt, Human
ugccuguaaucccagcacuuugg

SEQ ID NO: 991033 - RNA, 23 nt, Human
ugccuguaaucccagcacuuugg

SEQ ID NO: 991034 - RNA, 24 nt, Human
ugccuguaaucccagcacuuuggg

SEQ ID NO: 991035 - RNA, 20 nt, Human
ugcucggaugcacuuggcug

SEQ ID NO: 991036 - RNA, 20 nt, Human
ugcucggaugcacuuggcug

SEQ ID NO: 991037 - RNA, 23 nt, Human
ugcugccuugcaccugcugcaug

SEQ ID NO: 991038 - RNA, 22 nt, Human
ugcugcucuuuuuggggucucc

SEQ ID NO: 991039 - RNA, 21 nt, Human
ugcuggugggagugucuuuua

SEQ ID NO: 991040 - RNA, 21 nt, Human
ugcuggugggagugucuuuua

SEQ ID NO: 991041 - RNA, 21 nt, Human
ugcuucuaacucagcaaacau

SEQ ID NO: 991042 - RNA, 20 nt, Human
uggaaggagaaccaauucau

SEQ ID NO: 991043 - RNA, 20 nt, Human
uggaauaaaauccagauucc

SEQ ID NO: 991044 - RNA, 27 nt, Human
uggacaagagccagagaacaccagaga

SEQ ID NO: 991045 - RNA, 22 nt, Human
uggaucacuuggucaggaguuc

SEQ ID NO: 991046 - RNA, 19 nt, Human
uggcacagagggagauaac

SEQ ID NO: 991047 - RNA, 24 nt, Human
uggcagcugcucuuggcccagugu

SEQ ID NO: 991048 - RNA, 24 nt, Human
uggcagcugcucuuggcccagugu

SEQ ID NO: 991049 - RNA, 19 nt, Human
uggcaugguggugggcacc

SEQ ID NO: 991050 - RNA, 24 nt, Human
uggcaugguggugggcaccuguaa

SEQ ID NO: 991051 - RNA, 24 nt, Human
uggccaacauggugaaaccucguc

SEQ ID NO: 991052 - RNA, 21 nt, Human
uggcucacaccuguagucuca

SEQ ID NO: 991053 - RNA, 24 nt, Human
uggcucacaccuguagucucagca

SEQ ID NO: 991054 - RNA, 24 nt, Human
uggcucacgccuguaaucccagca

SEQ ID NO: 991055 - RNA, 20 nt, Human
uggcucacuugaaucaauuu

SEQ ID NO: 991056 - RNA, 22 nt, Human
uggcucgugccuguaaucccag

SEQ ID NO: 991057 - RNA, 24 nt, Human
uggcucgugccuguaaucccagca

SEQ ID NO: 991058 - RNA, 23 nt, Human
uggcugagggcagcuucuggaac

SEQ ID NO: 991059 - RNA, 19 nt, Human
uggcuggagggaugcaaga

SEQ ID NO: 991060 - RNA, 23 nt, Human
ugggaggccaaggcaggaggauc

SEQ ID NO: 991061 - RNA, 24 nt, Human
ugggaggccgaagcagguggauca

SEQ ID NO: 991062 - RNA, 19 nt, Human
ugggaggccgagguaggcg

SEQ ID NO: 991063 - RNA, 24 nt, Human
ugggaggccgagguaggcggauca

SEQ ID NO: 991064 - RNA, 18 nt, Human
ugggaggcugaaguggga

SEQ ID NO: 991065 - RNA, 19 nt, Human
ugggaggcugaagugggag

SEQ ID NO: 991066 - RNA, 24 nt, Human
ugggaggcugaggcagaagaauca

SEQ ID NO: 991067 - RNA, 24 nt, Human
ugggcugcagaaagagcacugggg

SEQ ID NO: 991068 - RNA, 20 nt, Human
ugggcugggugcagcggcuc

SEQ ID NO: 991069 - RNA, 20 nt, Human
uggggcaggaaaccuggauc

SEQ ID NO: 991070 - RNA, 20 nt, Human
uggggucucccuccuucugc

SEQ ID NO: 991071 - RNA, 20 nt, Human
uggggucucccuccuucugc

SEQ ID NO: 991072 - RNA, 20 nt, Human
uggggucucccuccuucugc

SEQ ID NO: 991073 - RNA, 20 nt, Human
uggggucucccuccuucugc

SEQ ID NO: 991074 - RNA, 22 nt, Human
uggggucucccuccuucugccu

SEQ ID NO: 991075 - RNA, 22 nt, Human
uggggucucccuccuucugccu

SEQ ID NO: 991076 - RNA, 22 nt, Human
uggggucucccuccuucugccu

SEQ ID NO: 991077 - RNA, 19 nt, Human
uggugagagcccaagggga

SEQ ID NO: 991078 - RNA, 19 nt, Human
uggugagagcccaagggga

SEQ ID NO: 991079 - RNA, 24 nt, Human
ugguggcucacaccuguagucuca

SEQ ID NO: 991080 - RNA, 24 nt, Human
ugguggcucacgccuguaauccca

SEQ ID NO: 991081 - RNA, 22 nt, Human
uggugggcaccuguaaucccag

SEQ ID NO: 991082 - RNA, 18 nt, Human
ugguggguuuugacuggc

SEQ ID NO: 991083 - RNA, 18 nt, Human
ugguggguuuugacuggc

SEQ ID NO: 991084 - RNA, 24 nt, Human
ugguggugggcaccuguaauccca

SEQ ID NO: 991085 - RNA, 22 nt, Human
ugguguaaccaagaggcagcag

SEQ ID NO: 991086 - RNA, 21 nt, Human
uguagaaaacaggacaaaggu

SEQ ID NO: 991087 - RNA, 22 nt, Human
uguagaaaacaggacaaaggug

SEQ ID NO: 991088 - RNA, 23 nt, Human
ugucaccuuucauuucuucaaua

SEQ ID NO: 991089 - RNA, 21 nt, Human
ugucucaggccucaaguccug

SEQ ID NO: 991090 - RNA, 24 nt, Human
ugucuguagucuuagcugcuuggg

SEQ ID NO: 991091 - RNA, 22 nt, Human
ugugccaggcaucuuacaaagg

SEQ ID NO: 991092 - RNA, 19 nt, Human
ugugcugauggaauugaug

SEQ ID NO: 991093 - RNA, 19 nt, Human
ugugcugauggaauugaug

SEQ ID NO: 991094 - RNA, 18 nt, Human
uguggcuugucauggagc

SEQ ID NO: 991095 - RNA, 23 nt, Human
uguguagcuggaaggugaacuga

SEQ ID NO: 991096 - RNA, 18 nt, Human
uguuccaaauugcugucc

SEQ ID NO: 991097 - RNA, 22 nt, Human
uguugccaaccacuucaucuca

SEQ ID NO: 991098 - RNA, 20 nt, Human
uguugcuuuuguacuucugu

SEQ ID NO: 991099 - RNA, 23 nt, Human
uguuugagggggcagcuuccugu

SEQ ID NO: 991100 - RNA, 23 nt, Human
uguuugagggggcagcuuccugu

SEQ ID NO: 991101 - RNA, 20 nt, Human
uuaaacacauucuuaaauug

SEQ ID NO: 991102 - RNA, 21 nt, Human
uuaguagcccagcccuguggu

SEQ ID NO: 991103 - RNA, 24 nt, Human
uuagucaauagcuggcaaaaagaa

SEQ ID NO: 991104 - RNA, 24 nt, Human
uuauuuauuuauuuauuuauuuuu

SEQ ID NO: 991105 - RNA, 20 nt, Human
uuauuuauuuauuuauuuuu

SEQ ID NO: 991106 - RNA, 20 nt, Human
uuauuuauuuauuuauuuuu

SEQ ID NO: 991107 - RNA, 22 nt, Human
uuauuuauuuauuuauuuuuca

SEQ ID NO: 991108 - RNA, 20 nt, Human
uucagggauaaaaauaagcc

SEQ ID NO: 991109 - RNA, 22 nt, Human
uucagggauaaaaauaagcccu

SEQ ID NO: 991110 - RNA, 22 nt, Human
uucaucacucacucagcaaaca

SEQ ID NO: 991111 - RNA, 20 nt, Human
uuccaggaaagggguggaca

SEQ ID NO: 991112 - RNA, 22 nt, Human
uuccucaaccccuuugcaccuc

SEQ ID NO: 991113 - RNA, 24 nt, Human
uuccuccaccacgucgucacucag

SEQ ID NO: 991114 - RNA, 26 nt, Human
uuccugauguguccaugucauuugua

SEQ ID NO: 991115 - RNA, 26 nt, Human
uuccugauguguccaugucauuugua

SEQ ID NO: 991116 - RNA, 19 nt, Human
uuccuugugaaaaguucuu

SEQ ID NO: 991117 - RNA, 23 nt, Human
uucgaaaccagccuggucaauaa

SEQ ID NO: 991118 - RNA, 20 nt, Human
uucuagagcagcuggucucc

SEQ ID NO: 991119 - RNA, 20 nt, Human
uucugucuccaugccagagg

SEQ ID NO: 991120 - RNA, 18 nt, Human
uugaaggaaggaggggcu

SEQ ID NO: 991121 - RNA, 18 nt, Human
uugaaggaaggaggggcu

SEQ ID NO: 991122 - RNA, 19 nt, Human
uugaucuugaggaauggug

SEQ ID NO: 991123 - RNA, 20 nt, Human
uugcagguguguagcuggaa

SEQ ID NO: 991124 - RNA, 24 nt, Human
uugcagguguguagcuggaaggug

SEQ ID NO: 991125 - RNA, 20 nt, Human
uugccaaccacuucaucuca

SEQ ID NO: 991126 - RNA, 21 nt, Human
uuggauuuggguucuggcacu

SEQ ID NO: 991127 - RNA, 25 nt, Human
uugggaggccgagguaggcggauca

SEQ ID NO: 991128 - RNA, 25 nt, Human
uugggaggcugaggcagaagaauca

SEQ ID NO: 991129 - RNA, 18 nt, Human
uugguggguuuugacugg

SEQ ID NO: 991130 - RNA, 18 nt, Human
uugguggguuuugacugg

SEQ ID NO: 991131 - RNA, 18 nt, Human
uuuaggagaaaaucagaa

SEQ ID NO: 991132 - RNA, 22 nt, Human
uuuccagcccuguuccuccacc

SEQ ID NO: 991133 - RNA, 21 nt, Human
uuuccuggcucacuugaauca

SEQ ID NO: 991134 - RNA, 21 nt, Human
uuucugggcaaaaaucaaagg

SEQ ID NO: 991135 - RNA, 20 nt, Human
uuuggcuccacacacacucu

SEQ ID NO: 991136 - RNA, 25 nt, Human
uuuggggucucccuccuucugccuu

SEQ ID NO: 991137 - RNA, 25 nt, Human
uuuggggucucccuccuucugccuu

SEQ ID NO: 991138 - RNA, 25 nt, Human
uuugucaccuuucauuucuucaaua

SEQ ID NO: 991139 - RNA, 25 nt, Human
uuugucaccuuucauuucuucaaua

SEQ ID NO: 991140 - RNA, 25 nt, Human
uuugucaccuuucauuucuucaaua

SEQ ID NO: 991141 - RNA, 25 nt, Human
uuugucaccuuucauuucuucaaua

SEQ ID NO: 991142 - RNA, 20 nt, Human
uuuuccacuuuacuuagcug

SEQ ID NO: 991143 - RNA, 27 nt, Human
uuuucgaucguuuaacagccauccauc

SEQ ID NO: 991144 - RNA, 18 nt, Human
uuuuuuuuuuuuuuuucg

SEQ ID NO: 991145 - RNA, 28 nt, Human
uuuuuuuuuuuuuuuuuccuuuuuuuua

SEQ ID NO: 991146 - RNA, 28 nt, Human
uuuuuuuuuuuuuuuuuccuuuuuuuua

SEQ ID NO: 991147 - RNA, 19 nt, Human
uuuuuuuuuuuuuuuuucg

SEQ ID NO: 991148 - RNA, 21 nt, Human
uuuuuuuuuuuuuuuuucgau

SEQ ID NO: 991149 - RNA, 18 nt, Human
uuuuuuuuuuuuuuuuug

SEQ ID NO: 991150 - RNA, 18 nt, Human
uuuuuuuuuuuuuuuuug

SEQ ID NO: 991151 - RNA, 18 nt, Human
uuuuuuuuuuuuuuuuug

SEQ ID NO: 991152 - RNA, 18 nt, Human
uuuuuuuuuuuuuuuuug

SEQ ID NO: 991153 - RNA, 20 nt, Human
uuuuuuuuuuuuuuuuuggu

SEQ ID NO: 991154 - RNA, 23 nt, Human
uuuuuuuuuuuuuuuuuggugag

SEQ ID NO: 991155 - RNA, 23 nt, Human
uuuuuuuuuuuuuuuuuuccuuu

SEQ ID NO: 991156 - RNA, 25 nt, Human
uuuuuuuuuuuuuuuuuuccuuuuu

SEQ ID NO: 991157 - RNA, 23 nt, Human
uuuuuuuuuuuuuuuuuuuaagg

SEQ ID NO: 991158 - RNA, 25 nt, Human
uuuuuuuuuuuuuuuuuuuuuaagg

SEQ ID NO: 991159 - RNA, 26 nt, Human
aaagaagagauuccauguuccgucgg

SEQ ID NO: 991160 - RNA, 24 nt, Human
aaagugcuaggaugacaggcguga

SEQ ID NO: 991161 - RNA, 22 nt, Human
aacauccauucauaagagugac

SEQ ID NO: 991162 - RNA, 18 nt, Human
acgggguuucaccauguu

SEQ ID NO: 991163 - RNA, 19 nt, Human
acgggguuucaccauguug

SEQ ID NO: 991164 - RNA, 22 nt, Human
acgggguuucaccauguugccc

SEQ ID NO: 991165 - RNA, 24 nt, Human
acgggguuucaccauguugcccgg

SEQ ID NO: 991166 - RNA, 23 nt, Human
acuccuuagccucccgaggagcu

SEQ ID NO: 991167 - RNA, 20 nt, Human
acuuuauuaggaauguuaau

SEQ ID NO: 991168 - RNA, 23 nt, Human
agcugugugcuccaacucugagg

SEQ ID NO: 991169 - RNA, 23 nt, Human
aggcgugagucaccgcgcccggc

SEQ ID NO: 991170 - RNA, 24 nt, Human
caaagugcuaggaugacaggcgug

SEQ ID NO: 991171 - RNA, 22 nt, Human
caagugauucagccgccucggc

SEQ ID NO: 991172 - RNA, 24 nt, Human
caccauguugcccgggcugaucuc

SEQ ID NO: 991173 - RNA, 27 nt, Human
caccauguugcccgggcugaucucaaa

SEQ ID NO: 991174 - RNA, 21 nt, Human
caggcauccaccaucacgcuc

SEQ ID NO: 991175 - RNA, 24 nt, Human
cauguugcccgggcugaucucaaa

SEQ ID NO: 991176 - RNA, 24 nt, Human
ccaaagugcuaggaugacaggcgu

SEQ ID NO: 991177 - RNA, 26 nt, Human
ccaacucugaggcgcacagaaccaac

SEQ ID NO: 991178 - RNA, 24 nt, Human
ccgaggagcuaggauuacaggcau

SEQ ID NO: 991179 - RNA, 23 nt, Human
ccgccucggccucccaaagugcu

SEQ ID NO: 991180 - RNA, 24 nt, Human
cgccucggccucccaaagugcuag

SEQ ID NO: 991181 - RNA, 24 nt, Human
cgggguuucaccauguugcccggg

SEQ ID NO: 991182 - RNA, 21 nt, Human
cucaagugauucagccgccuc

SEQ ID NO: 991183 - RNA, 22 nt, Human
gacgggguuucaccauguugcc

SEQ ID NO: 991184 - RNA, 23 nt, Human
gagacgggguuucaccauguugc

SEQ ID NO: 991185 - RNA, 22 nt, Human
gaugacaggcgugagucaccgc

SEQ ID NO: 991186 - RNA, 23 nt, Human
gcugaucucaaacuccuaaccuc

SEQ ID NO: 991187 - RNA, 18 nt, Human
gcugugugcuccaacucu

SEQ ID NO: 991188 - RNA, 18 nt, Human
ggacauccaguacaaaga

SEQ ID NO: 991189 - RNA, 19 nt, Human
ggauuacaggcauccacca

SEQ ID NO: 991190 - RNA, 23 nt, Human
gggguuucaccauguugcccggg

SEQ ID NO: 991191 - RNA, 22 nt, Human
ggguuucaccauguugcccggg

SEQ ID NO: 991192 - RNA, 21 nt, Human
guagagacgggguuucaccau

SEQ ID NO: 991193 - RNA, 22 nt, Human
guagagacgggguuucaccaug

SEQ ID NO: 991194 - RNA, 24 nt, Human
guuucaccauguugcccgggcuga

SEQ ID NO: 991195 - RNA, 24 nt, Human
uaaccucaagugauucagccgccu

SEQ ID NO: 991196 - RNA, 25 nt, Human
uaaccucaagugauucagccgccuc

SEQ ID NO: 991197 - RNA, 23 nt, Human
uaauuuuucuauuuuuguagaga

SEQ ID NO: 991198 - RNA, 21 nt, Human
uagagacgggguuucaccaug

SEQ ID NO: 991199 - RNA, 22 nt, Human
uagagacgggguuucaccaugu

SEQ ID NO: 991200 - RNA, 22 nt, Human
uagccucccgaggagcuaggau

SEQ ID NO: 991201 - RNA, 21 nt, Human
uaggauuacaggcauccacca

SEQ ID NO: 991202 - RNA, 22 nt, Human
uaggauuacaggcauccaccau

SEQ ID NO: 991203 - RNA, 24 nt, Human
ucccaaagugcuaggaugacaggc

SEQ ID NO: 991204 - RNA, 19 nt, Human
ucccgaggagcuaggauua

SEQ ID NO: 991205 - RNA, 23 nt, Human
ucccgaggagcuaggauuacagg

SEQ ID NO: 991206 - RNA, 24 nt, Human
ucccgaggagcuaggauuacaggc

SEQ ID NO: 991207 - RNA, 18 nt, Human
ucggccucccaaagugcu

SEQ ID NO: 991208 - RNA, 18 nt, Human
uggaaagauuuuguaagg

SEQ ID NO: 991209 - RNA, 21 nt, Human
uguaagggugcaaauaagacu

SEQ ID NO: 991210 - RNA, 24 nt, Human
uguagagacgggguuucaccaugu

SEQ ID NO: 991211 - RNA, 20 nt, Human
uguccauuaaaaguauaacc

SEQ ID NO: 991212 - RNA, 24 nt, Human
uuguagagacgggguuucaccaug

SEQ ID NO: 991213 - RNA, 21 nt, Human
uuucaccauguugcccgggcu

SEQ ID NO: 991214 - RNA, 24 nt, Human
uuuguagagacgggguuucaccau

SEQ ID NO: 991215 - RNA, 23 nt, Human
uuuuuguagagacgggguuucac

SEQ ID NO: 991216 - RNA, 25 nt, Human
uuuuuuuuuuuuuuuuuuuuuaagg

SEQ ID NO: 991217 - RNA, 22 nt, Human
aaaagcgcagggaaguuccgcc

SEQ ID NO: 991218 - RNA, 22 nt, Human
aacaguaaacaugauaaauuuc

SEQ ID NO: 991219 - RNA, 18 nt, Human
aacauuucagagacuuuc

SEQ ID NO: 991220 - RNA, 22 nt, Human
accguaaagaguauggucugaa

SEQ ID NO: 991221 - RNA, 25 nt, Human
accguaaagaguauggucugaaaag

SEQ ID NO: 991222 - RNA, 19 nt, Human
accuuuugcgacgcgccuc

SEQ ID NO: 991223 - RNA, 21 nt, Human
agcaccacuaccccucauggu

SEQ ID NO: 991224 - RNA, 21 nt, Human
agggcaaagaaggauuaaaaa

SEQ ID NO: 991225 - RNA, 23 nt, Human
auacagaaagucaugaaucuaau

SEQ ID NO: 991226 - RNA, 21 nt, Human
aucaaauuuuuuuuuauuuuu

SEQ ID NO: 991227 - RNA, 22 nt, Human
caaaagaaaagagugcacuuca

SEQ ID NO: 991228 - RNA, 21 nt, Human
caggagacuucuuccuggcua

SEQ ID NO: 991229 - RNA, 20 nt, Human
cccuagcaccacuaccccuc

SEQ ID NO: 991230 - RNA, 20 nt, Human
ccuauauugccuaaaaacga

SEQ ID NO: 991231 - RNA, 23 nt, Human
cuaauuccaaaagaaaagagugc

SEQ ID NO: 991232 - RNA, 21 nt, Human
cuaugccaguacugaaacucu

SEQ ID NO: 991233 - RNA, 21 nt, Human
gccaguacugaaacucuccca

SEQ ID NO: 991234 - RNA, 20 nt, Human
ggcacugaguucaaaaccag

SEQ ID NO: 991235 - RNA, 19 nt, Human
guacugaaacucucccaaa

SEQ ID NO: 991236 - RNA, 19 nt, Human
uaaaaagcaauauucuaca

SEQ ID NO: 991237 - RNA, 24 nt, Human
uaagacauccuauauugccuaaaa

SEQ ID NO: 991238 - RNA, 19 nt, Human
uaggagaaaggguuucaga

SEQ ID NO: 991239 - RNA, 24 nt, Human
uaggagaaaggguuucagaaagaa

SEQ ID NO: 991240 - RNA, 27 nt, Human
uauugccuaaaaacgaacauuucagag

SEQ ID NO: 991241 - RNA, 26 nt, Human
ucaaaaccagugaagguugccuucuc

SEQ ID NO: 991242 - RNA, 18 nt, Human
ucagaaagaauuuugaca

SEQ ID NO: 991243 - RNA, 22 nt, Human
ucagagacuuucuuaggcacug

SEQ ID NO: 991244 - RNA, 22 nt, Human
ucaggagacuucuuccuggcua

SEQ ID NO: 991245 - RNA, 19 nt, Human
ucucccuagcaccacuacc

SEQ ID NO: 991246 - RNA, 22 nt, Human
ugaaaagcgcagggaaguuccg

SEQ ID NO: 991247 - RNA, 23 nt, Human
ugaguucaaaaccagugaagguu

SEQ ID NO: 991248 - RNA, 18 nt, Human
ugauagcauaucagaucu

SEQ ID NO: 991249 - RNA, 21 nt, Human
ugccaguacugaaacucuccc

SEQ ID NO: 991250 - RNA, 18 nt, Human
uucuuugacaacugucuc

SEQ ID NO: 991251 - RNA, 22 nt, Human
aacagaaugacaaagaacccau

SEQ ID NO: 991252 - RNA, 21 nt, Human
acagaaugacaaagaacccau

SEQ ID NO: 991253 - RNA, 24 nt, Human
acuuaaaggcauauuaaagaaaaa

SEQ ID NO: 991254 - RNA, 24 nt, Human
agaaaaagacuuuuauacauagua

SEQ ID NO: 991255 - RNA, 21 nt, Human
aggcacauagaucucuuggcu

SEQ ID NO: 991256 - RNA, 23 nt, Human
agggcauuccaggcagcaggaaa

SEQ ID NO: 991257 - RNA, 20 nt, Human
aucucaacggacagaauagg

SEQ ID NO: 991258 - RNA, 22 nt, Human
caacggacagaauagguaacau

SEQ ID NO: 991259 - RNA, 25 nt, Human
cacaccaccacagugagccccgccg

SEQ ID NO: 991260 - RNA, 21 nt, Human
cauaguaacaaacugcaggua

SEQ ID NO: 991261 - RNA, 28 nt, Human
cccacucacaccaccacagugagccccg

SEQ ID NO: 991262 - RNA, 19 nt, Human
ccucccacucacaccacca

SEQ ID NO: 991263 - RNA, 19 nt, Human
ccuucggucuccauccucg

SEQ ID NO: 991264 - RNA, 20 nt, Human
cgccgccucccacucacacc

SEQ ID NO: 991265 - RNA, 19 nt, Human
cgcgccucaccccagcugc

SEQ ID NO: 991266 - RNA, 21 nt, Human
cucccacucacaccaccacag

SEQ ID NO: 991267 - RNA, 21 nt, Human
gacagaauagguaacauagaa

SEQ ID NO: 991268 - RNA, 18 nt, Human
gagccccgccggcggcgc

SEQ ID NO: 991269 - RNA, 22 nt, Human
gccgccucccacucacaccacc

SEQ ID NO: 991270 - RNA, 20 nt, Human
gccucgcgccucaccccagc

SEQ ID NO: 991271 - RNA, 22 nt, Human
gucgagugcgccgccucgcgcc

SEQ ID NO: 991272 - RNA, 21 nt, Human
uaacagaaugacaaagaaccc

SEQ ID NO: 991273 - RNA, 18 nt, Human
ugacaaagaacccaucag

SEQ ID NO: 991274 - RNA, 19 nt, Human
uuacucauuuuccagggua

SEQ ID NO: 991275 - RNA, 26 nt, Human
uuauacuaacagaaugacaaagaacc

SEQ ID NO: 991276 - RNA, 21 nt, Human
uuuauacauaguaacaaacug

SEQ ID NO: 991277 - RNA, 19 nt, Human
uuucugcuguacucuuuga

SEQ ID NO: 991278 - RNA, 19 nt, Human
uuuuuuuuuuuuuuuuguu

SEQ ID NO: 991279 - RNA, 22 nt, Human
uuuuuuuuuuuuuuuuguuagg

SEQ ID NO: 991280 - RNA, 18 nt, Human
aaaacaaaguuuguaagg

SEQ ID NO: 991281 - RNA, 18 nt, Human
aaaacagccagaacacau

SEQ ID NO: 991282 - RNA, 21 nt, Human
aaaaggccagcucagccaagc

SEQ ID NO: 991283 - RNA, 20 nt, Human
aaacaaaaagcuuuggaaac

SEQ ID NO: 991284 - RNA, 26 nt, Human
aauuaaaaauaauuuccucaccuagc

SEQ ID NO: 991285 - RNA, 25 nt, Human
accacaucuauacuucacaagcauc

SEQ ID NO: 991286 - RNA, 20 nt, Human
accgcagcucccgauaccga

SEQ ID NO: 991287 - RNA, 21 nt, Human
agaaaugcacaccuaguccuc

SEQ ID NO: 991288 - RNA, 20 nt, Human
agaaguccacaaaaaaggac

SEQ ID NO: 991289 - RNA, 20 nt, Human
agacacaugaaaaaaaucag

SEQ ID NO: 991290 - RNA, 21 nt, Human
agacacaugaaaaaaaucagg

SEQ ID NO: 991291 - RNA, 20 nt, Human
agagagaaguccacaaaaaa

SEQ ID NO: 991292 - RNA, 20 nt, Human
agaugcaguacaguugguga

SEQ ID NO: 991293 - RNA, 19 nt, Human
auagccaagaaagaaagaa

SEQ ID NO: 991294 - RNA, 25 nt, Human
auuaaaaauaauuuccucaccuagc

SEQ ID NO: 991295 - RNA, 23 nt, Human
auuaucguucaaaaacaaacacu

SEQ ID NO: 991296 - RNA, 19 nt, Human
auucuguaaacaaaaagcu

SEQ ID NO: 991297 - RNA, 24 nt, Human
caacgcugagagaucacugggaaa

SEQ ID NO: 991298 - RNA, 21 nt, Human
caagaaagaaagaauguacag

SEQ ID NO: 991299 - RNA, 20 nt, Human
cacugaaaagucuugccugc

SEQ ID NO: 991300 - RNA, 18 nt, Human
cacugaaacccaacuccc

SEQ ID NO: 991301 - RNA, 23 nt, Human
cacugcuacaaaaaauaaacaga

SEQ ID NO: 991302 - RNA, 19 nt, Human
cagcagaaucuuacaccgc

SEQ ID NO: 991303 - RNA, 20 nt, Human
cagcagaaucuuacaccgcu

SEQ ID NO: 991304 - RNA, 19 nt, Human
cagccaagcuuccuucugg

SEQ ID NO: 991305 - RNA, 21 nt, Human
cagcucagccaagcuuccuuc

SEQ ID NO: 991306 - RNA, 19 nt, Human
cagguccaaaauaaaguga

SEQ ID NO: 991307 - RNA, 24 nt, Human
caucaugaacugcguuccacaagg

SEQ ID NO: 991308 - RNA, 22 nt, Human
cauuccuauguuaaaaggccag

SEQ ID NO: 991309 - RNA, 22 nt, Human
ccacaaaaaaggacauguaaag

SEQ ID NO: 991310 - RNA, 18 nt, Human
ccacugaaacccaacucc

SEQ ID NO: 991311 - RNA, 22 nt, Human
ccagcgagaccagauguucuaa

SEQ ID NO: 991312 - RNA, 20 nt, Human
ccccacugaaacccaacucc

SEQ ID NO: 991313 - RNA, 22 nt, Human
ccccacugaaacccaacuccca

SEQ ID NO: 991314 - RNA, 21 nt, Human
ccggccggagccaccgcagcu

SEQ ID NO: 991315 - RNA, 19 nt, Human
cgacugaaagcucaguucu

SEQ ID NO: 991316 - RNA, 18 nt, Human
cggccggagccaccgcag

SEQ ID NO: 991317 - RNA, 25 nt, Human
cuacugcucuguggcacguuuccug

SEQ ID NO: 991318 - RNA, 19 nt, Human
cucagauuuuagucuaugg

SEQ ID NO: 991319 - RNA, 22 nt, Human
cucagccaagcuuccuucugga

SEQ ID NO: 991320 - RNA, 23 nt, Human
cuccaaagagagaaguccacaaa

SEQ ID NO: 991321 - RNA, 21 nt, Human
cugaaacccaacucccaaugc

SEQ ID NO: 991322 - RNA, 23 nt, Human
cugaaacccaacucccaaugcug

SEQ ID NO: 991323 - RNA, 20 nt, Human
gaaggucaaguuguugagac

SEQ ID NO: 991324 - RNA, 20 nt, Human
gauguacaaugcacauucug

SEQ ID NO: 991325 - RNA, 18 nt, Human
gccaggacaaccggccgg

SEQ ID NO: 991326 - RNA, 22 nt, Human
gcugagagaucacugggaaaaa

SEQ ID NO: 991327 - RNA, 21 nt, Human
ggaaaacaaaguuuguaaggg

SEQ ID NO: 991328 - RNA, 23 nt, Human
ggagaaaugcacaccuaguccuc

SEQ ID NO: 991329 - RNA, 19 nt, Human
ggguguggggugggggcgg

SEQ ID NO: 991330 - RNA, 27 nt, Human
guguggggugggggcgggcgggggggc

SEQ ID NO: 991331 - RNA, 18 nt, Human
guuaaaaaauucucagau

SEQ ID NO: 991332 - RNA, 22 nt, Human
guucucugagauuuuucagaau

SEQ ID NO: 991333 - RNA, 18 nt, Human
uaaacagauaguugugug

SEQ ID NO: 991334 - RNA, 23 nt, Human
uacacauauacaaaucucagaca

SEQ ID NO: 991335 - RNA, 21 nt, Human
uaccuggagccgacugaaagc

SEQ ID NO: 991336 - RNA, 21 nt, Human
uaccuuuagcauuaaacauuu

SEQ ID NO: 991337 - RNA, 24 nt, Human
uccacaaaaaaggacauguaaagg

SEQ ID NO: 991338 - RNA, 23 nt, Human
ucgagaucacagcagguccaaaa

SEQ ID NO: 991339 - RNA, 24 nt, Human
ucggccacugcuacaaaaaauaaa

SEQ ID NO: 991340 - RNA, 23 nt, Human
ucuaaguauagacaugccccacu

SEQ ID NO: 991341 - RNA, 21 nt, Human
ucuccaaagagagaaguccac

SEQ ID NO: 991342 - RNA, 22 nt, Human
ucugaauagccaagaaagaaag

SEQ ID NO: 991343 - RNA, 24 nt, Human
ucuguaaacaaaaagcuuuggaaa

SEQ ID NO: 991344 - RNA, 20 nt, Human
ugacucaugaaaaucuucau

SEQ ID NO: 991345 - RNA, 19 nt, Human
ugagaacacaagucaaaua

SEQ ID NO: 991346 - RNA, 21 nt, Human
ugagaacacaagucaaauaca

SEQ ID NO: 991347 - RNA, 26 nt, Human
ugagaacacaagucaaauacauuuaa

SEQ ID NO: 991348 - RNA, 18 nt, Human
ugcugagaacacaaguca

SEQ ID NO: 991349 - RNA, 18 nt, Human
ugggggcgggcggggggg

SEQ ID NO: 991350 - RNA, 25 nt, Human
uggggugggggcgggcgggggggcu

SEQ ID NO: 991351 - RNA, 26 nt, Human
uggggugggggcgggcgggggggcug

SEQ ID NO: 991352 - RNA, 24 nt, Human
uguacccaaccauucuauuuuucu

SEQ ID NO: 991353 - RNA, 18 nt, Human
uguggaaaagagaggaug

SEQ ID NO: 991354 - RNA, 21 nt, Human
uuccugaugaaaagcuaggag

SEQ ID NO: 991355 - RNA, 21 nt, Human
uuucuaaacuucuaaccugaa

SEQ ID NO: 991356 - RNA, 18 nt, Human
uuuguaaggguucaguuc

SEQ ID NO: 991357 - RNA, 19 nt, Human
aaacaagagcagagaggcc

SEQ ID NO: 991358 - RNA, 26 nt, Human
aaacagaaagcaguacauauacagag

SEQ ID NO: 991359 - RNA, 23 nt, Human
aaagugcugagggccaaacggga

SEQ ID NO: 991360 - RNA, 24 nt, Human
aacacagaggcaggguaagaggga

SEQ ID NO: 991361 - RNA, 20 nt, Human
aaccugggggagcuggagcu

SEQ ID NO: 991362 - RNA, 23 nt, Human
aagaggccggggugacuggagca

SEQ ID NO: 991363 - RNA, 23 nt, Human
aaggugugcugaaguggcaggag

SEQ ID NO: 991364 - RNA, 24 nt, Human
aaugagaaaacuggcagggaagga

SEQ ID NO: 991365 - RNA, 19 nt, Human
aauguggagugggggaaag

SEQ ID NO: 991366 - RNA, 19 nt, Human
acaaugcaacaaaacagaa

SEQ ID NO: 991367 - RNA, 20 nt, Human
acacaggcccugcuggcacu

SEQ ID NO: 991368 - RNA, 21 nt, Human
acagaaagcaguacauauaca

SEQ ID NO: 991369 - RNA, 18 nt, Human
accccuuuccugccccuc

SEQ ID NO: 991370 - RNA, 22 nt, Human
accuagcugcaacugugugcac

SEQ ID NO: 991371 - RNA, 23 nt, Human
acgcagcuccaggcccgcccucc

SEQ ID NO: 991372 - RNA, 22 nt, Human
acuagugcaagaaaguccuacu

SEQ ID NO: 991373 - RNA, 19 nt, Human
acuggagcagaagacccug

SEQ ID NO: 991374 - RNA, 21 nt, Human
acugggcaaggccuugggcug

SEQ ID NO: 991375 - RNA, 22 nt, Human
agagaggaugggagucuccaag

SEQ ID NO: 991376 - RNA, 24 nt, Human
agagaggaugggagucuccaaggg

SEQ ID NO: 991377 - RNA, 24 nt, Human
agagcuucuccccucugugccccc

SEQ ID NO: 991378 - RNA, 23 nt, Human
agcccccacuuccucccuuuuuu

SEQ ID NO: 991379 - RNA, 19 nt, Human
agcucucccuuccccaucc

SEQ ID NO: 991380 - RNA, 21 nt, Human
agcuggguaagggaggaaggg

SEQ ID NO: 991381 - RNA, 20 nt, Human
aggacacaggcccugcuggc

SEQ ID NO: 991382 - RNA, 19 nt, Human
aggcaggguaagagggagg

SEQ ID NO: 991383 - RNA, 22 nt, Human
aggcaggguaagagggagggca

SEQ ID NO: 991384 - RNA, 25 nt, Human
aggcuggggacggggacaggguggg

SEQ ID NO: 991385 - RNA, 22 nt, Human
aggguggugggguggauggggg

SEQ ID NO: 991386 - RNA, 19 nt, Human
aggugugcugaaguggcag

SEQ ID NO: 991387 - RNA, 20 nt, Human
aguccucuagccugacucaa

SEQ ID NO: 991388 - RNA, 20 nt, Human
caacaaaacagaaagcagua

SEQ ID NO: 991389 - RNA, 21 nt, Human
caaggccagcucucccuuccc

SEQ ID NO: 991390 - RNA, 19 nt, Human
cacacagcagaccagagca

SEQ ID NO: 991391 - RNA, 21 nt, Human
cacagcagaccagagcaaggc

SEQ ID NO: 991392 - RNA, 20 nt, Human
cacagcuuaacuggggcccc

SEQ ID NO: 991393 - RNA, 20 nt, Human
cacgcagcuccaggcccgcc

SEQ ID NO: 991394 - RNA, 18 nt, Human
cacuaaaggcucccuggc

SEQ ID NO: 991395 - RNA, 22 nt, Human
cacugggcaaggccuugggcug

SEQ ID NO: 991396 - RNA, 24 nt, Human
cagagcaaggcuaauggcucccaa

SEQ ID NO: 991397 - RNA, 19 nt, Human
cagaggcaggguaagaggg

SEQ ID NO: 991398 - RNA, 18 nt, Human
cagcccccacuuccuccc

SEQ ID NO: 991399 - RNA, 25 nt, Human
cagcccccacuuccucccuuuuuuu

SEQ ID NO: 991400 - RNA, 21 nt, Human
cagccuuuuguuuugaggccc

SEQ ID NO: 991401 - RNA, 20 nt, Human
cagcuccaggcccgcccucc

SEQ ID NO: 991402 - RNA, 21 nt, Human
cagcuccaggcccgcccuccc

SEQ ID NO: 991403 - RNA, 21 nt, Human
cagcugaaaagagcacucuag

SEQ ID NO: 991404 - RNA, 19 nt, Human
cagcuuaacuggggccccg

SEQ ID NO: 991405 - RNA, 19 nt, Human
caggacacaggcccugcug

SEQ ID NO: 991406 - RNA, 19 nt, Human
caggcccaaagugcugagg

SEQ ID NO: 991407 - RNA, 22 nt, Human
caguaacccauagagucaggga

SEQ ID NO: 991408 - RNA, 24 nt, Human
caugggaggagccccuccccccca

SEQ ID NO: 991409 - RNA, 24 nt, Human
cauucuguuggagcugcuuuuggg

SEQ ID NO: 991410 - RNA, 21 nt, Human
ccaagcaccugccccuuuacu

SEQ ID NO: 991411 - RNA, 22 nt, Human
ccacugggcaaggccuugggcu

SEQ ID NO: 991412 - RNA, 22 nt, Human
ccagcacucuuccccuccccag

SEQ ID NO: 991413 - RNA, 21 nt, Human
ccaggcccaaagugcugaggg

SEQ ID NO: 991414 - RNA, 20 nt, Human
cccaaagugcugagggccaa

SEQ ID NO: 991415 - RNA, 23 nt, Human
cccaaggccaagaucuccagggc

SEQ ID NO: 991416 - RNA, 23 nt, Human
cccacaaugcaacaaaacagaaa

SEQ ID NO: 991417 - RNA, 21 nt, Human
cccacacagcagaccagagca

SEQ ID NO: 991418 - RNA, 26 nt, Human
cccacacagcagaccagagcaaggcu

SEQ ID NO: 991419 - RNA, 18 nt, Human
cccagguggggcaaggug

SEQ ID NO: 991420 - RNA, 21 nt, Human
cccauagagucagggauggaa

SEQ ID NO: 991421 - RNA, 20 nt, Human
ccccaacccacacagcagac

SEQ ID NO: 991422 - RNA, 24 nt, Human
ccccaacccacacagcagaccaga

SEQ ID NO: 991423 - RNA, 20 nt, Human
ccccaaggccaagaucucca

SEQ ID NO: 991424 - RNA, 23 nt, Human
cccccacuuccucccuuuuuuug

SEQ ID NO: 991425 - RNA, 20 nt, Human
cccccgcccccaccuuaucc

SEQ ID NO: 991426 - RNA, 20 nt, Human
ccccucccccccaaccuggg

SEQ ID NO: 991427 - RNA, 19 nt, Human
ccccucugugccccccaac

SEQ ID NO: 991428 - RNA, 21 nt, Human
ccccuuuccccugccacuggg

SEQ ID NO: 991429 - RNA, 20 nt, Human
cccgcccccaccuuauccua

SEQ ID NO: 991430 - RNA, 21 nt, Human
cccgcccccaccuuauccuac

SEQ ID NO: 991431 - RNA, 19 nt, Human
cccucccccccaaccuggg

SEQ ID NO: 991432 - RNA, 19 nt, Human
cccuuuacuucccaguccc

SEQ ID NO: 991433 - RNA, 22 nt, Human
ccgcccccaccuuauccuacac

SEQ ID NO: 991434 - RNA, 22 nt, Human
ccuaccucaacacuuaucgccc

SEQ ID NO: 991435 - RNA, 19 nt, Human
ccucccccccaaccugggg

SEQ ID NO: 991436 - RNA, 23 nt, Human
ccucccuuuuuuugcuaagcccc

SEQ ID NO: 991437 - RNA, 19 nt, Human
ccucucccccuuccguauc

SEQ ID NO: 991438 - RNA, 19 nt, Human
ccucuccucucccccuucc

SEQ ID NO: 991439 - RNA, 19 nt, Human
ccucuccucucccccuucc

SEQ ID NO: 991440 - RNA, 21 nt, Human
ccugaggcccucuggccauuc

SEQ ID NO: 991441 - RNA, 19 nt, Human
ccugccacugggcaaggcc

SEQ ID NO: 991442 - RNA, 21 nt, Human
ccugugcucuuuccccagagg

SEQ ID NO: 991443 - RNA, 25 nt, Human
ccuuuuucuccuggaugaguuuugc

SEQ ID NO: 991444 - RNA, 22 nt, Human
cgcagcuccaggcccgcccucc

SEQ ID NO: 991445 - RNA, 19 nt, Human
cuagaaaggagccagcacu

SEQ ID NO: 991446 - RNA, 22 nt, Human
cucaacacuuaucgcccaucuc

SEQ ID NO: 991447 - RNA, 24 nt, Human
cuccaggcccgcccucccauucac

SEQ ID NO: 991448 - RNA, 25 nt, Human
cuccaggcccgcccucccauucacu

SEQ ID NO: 991449 - RNA, 24 nt, Human
cucccugaggcccucuggccauuc

SEQ ID NO: 991450 - RNA, 19 nt, Human
cucccuggccugucccagg

SEQ ID NO: 991451 - RNA, 25 nt, Human
cucuccucucccccuuccguaucuc

SEQ ID NO: 991452 - RNA, 20 nt, Human
cugcagggccaaggcugggu

SEQ ID NO: 991453 - RNA, 20 nt, Human
cuggugcuucacgugugaug

SEQ ID NO: 991454 - RNA, 20 nt, Human
cugugugcaccucaucuccc

SEQ ID NO: 991455 - RNA, 23 nt, Human
cuuugagguggagugaggugccc

SEQ ID NO: 991456 - RNA, 18 nt, Human
gaccaaggccagcucucc

SEQ ID NO: 991457 - RNA, 20 nt, Human
gagcacucuagggcaugggg

SEQ ID NO: 991458 - RNA, 23 nt, Human
gagcugaugucagugugguggag

SEQ ID NO: 991459 - RNA, 23 nt, Human
gaggucuguccucccucccuacu

SEQ ID NO: 991460 - RNA, 20 nt, Human
gaugcaggaguuagaaggca

SEQ ID NO: 991461 - RNA, 19 nt, Human
gcacuuggugagggggaag

SEQ ID NO: 991462 - RNA, 20 nt, Human
gccauugcacugucugccgu

SEQ ID NO: 991463 - RNA, 18 nt, Human
gcccaucuccccaaagcc

SEQ ID NO: 991464 - RNA, 20 nt, Human
gcccucccauucacucacua

SEQ ID NO: 991465 - RNA, 20 nt, Human
gccuugggcuggucugagcc

SEQ ID NO: 991466 - RNA, 18 nt, Human
gcucugggcaaugccacc

SEQ ID NO: 991467 - RNA, 23 nt, Human
gcugaaguggcaggagggccagu

SEQ ID NO: 991468 - RNA, 20 nt, Human
gcuuaagucccuccucccca

SEQ ID NO: 991469 - RNA, 18 nt, Human
ggagcccaagcaccugcc

SEQ ID NO: 991470 - RNA, 22 nt, Human
ggagugaggugccccuuucccc

SEQ ID NO: 991471 - RNA, 24 nt, Human
ggcagggcccagggguaggguugg

SEQ ID NO: 991472 - RNA, 22 nt, Human
ggccuugggcuggucugagcca

SEQ ID NO: 991473 - RNA, 22 nt, Human
ggcuaggacaagauaggggagu

SEQ ID NO: 991474 - RNA, 21 nt, Human
gggacggggacagggugggga

SEQ ID NO: 991475 - RNA, 25 nt, Human
gggacggggacaggguggggauagg

SEQ ID NO: 991476 - RNA, 22 nt, Human
gggaguauaaggaccugggcca

SEQ ID NO: 991477 - RNA, 19 nt, Human
gggcaaugccaccagguuc

SEQ ID NO: 991478 - RNA, 18 nt, Human
ggggaagagaggauggga

SEQ ID NO: 991479 - RNA, 19 nt, Human
ggggaagagaggaugggag

SEQ ID NO: 991480 - RNA, 21 nt, Human
ggggguccgggcuggagggaa

SEQ ID NO: 991481 - RNA, 20 nt, Human
gggguccgggcuggagggaa

SEQ ID NO: 991482 - RNA, 22 nt, Human
gggguggggguagguugggggg

SEQ ID NO: 991483 - RNA, 19 nt, Human
ggguggggguagguugggg

SEQ ID NO: 991484 - RNA, 25 nt, Human
ggguuaaacaagagcagagaggccu

SEQ ID NO: 991485 - RNA, 23 nt, Human
ggucugagccaggggucuccugg

SEQ ID NO: 991486 - RNA, 21 nt, Human
gguggugggguggaugggggc

SEQ ID NO: 991487 - RNA, 20 nt, Human
guaggcuggggacggggaca

SEQ ID NO: 991488 - RNA, 26 nt, Human
gugaauaccuuugguaggcuggggac

SEQ ID NO: 991489 - RNA, 22 nt, Human
gugaggugccccuuuccccugc

SEQ ID NO: 991490 - RNA, 20 nt, Human
gugauggucccagguggggc

SEQ ID NO: 991491 - RNA, 19 nt, Human
gugccccccaacauucccu

SEQ ID NO: 991492 - RNA, 20 nt, Human
uaagccccauagaugggagg

SEQ ID NO: 991493 - RNA, 23 nt, Human
uacagggugaagaggaguauggg

SEQ ID NO: 991494 - RNA, 21 nt, Human
uaccauuuauuucuuuauggg

SEQ ID NO: 991495 - RNA, 21 nt, Human
uagagucagggauggaaaggu

SEQ ID NO: 991496 - RNA, 23 nt, Human
uaggaacuagugcaagaaagucc

SEQ ID NO: 991497 - RNA, 20 nt, Human
uaggggaguauaaggaccug

SEQ ID NO: 991498 - RNA, 20 nt, Human
uagggugguggggcacagcc

SEQ ID NO: 991499 - RNA, 24 nt, Human
uaggguggugggguggaugggggc

SEQ ID NO: 991500 - RNA, 26 nt, Human
uaggguggugggguggaugggggcag

SEQ ID NO: 991501 - RNA, 19 nt, Human
uaucgcccaucuccccaaa

SEQ ID NO: 991502 - RNA, 22 nt, Human
ucacugauuuggggagcaguuc

SEQ ID NO: 991503 - RNA, 22 nt, Human
ucagugugguggaggucugucc

SEQ ID NO: 991504 - RNA, 25 nt, Human
uccagggcaagaguggcccuuggga

SEQ ID NO: 991505 - RNA, 23 nt, Human
ucccagucccuuuuccccuucug

SEQ ID NO: 991506 - RNA, 24 nt, Human
ucccaugggaggagccccuccccc

SEQ ID NO: 991507 - RNA, 20 nt, Human
uccccaacccacacagcaga

SEQ ID NO: 991508 - RNA, 21 nt, Human
uccccaacccacacagcagac

SEQ ID NO: 991509 - RNA, 25 nt, Human
uccccauccgcuucuugguuucacu

SEQ ID NO: 991510 - RNA, 25 nt, Human
ucccuaagcugaccaaggccagcuc

SEQ ID NO: 991511 - RNA, 18 nt, Human
ucccuccuccccauggag

SEQ ID NO: 991512 - RNA, 24 nt, Human
ucccugaggcccucuggccauucu

SEQ ID NO: 991513 - RNA, 19 nt, Human
ucccuggacuuucucuugc

SEQ ID NO: 991514 - RNA, 23 nt, Human
ucccuggggucagggcuuuuggc

SEQ ID NO: 991515 - RNA, 21 nt, Human
ucccuuuuccccuucugagga

SEQ ID NO: 991516 - RNA, 18 nt, Human
ucgagccuaccucaacac

SEQ ID NO: 991517 - RNA, 18 nt, Human
ucuccucuccucuccccc

SEQ ID NO: 991518 - RNA, 28 nt, Human
ucugccccacaaugcaacaaaacagaaa

SEQ ID NO: 991519 - RNA, 18 nt, Human
ucuggagagcucugggca

SEQ ID NO: 991520 - RNA, 18 nt, Human
ucugugaugggaggcagg

SEQ ID NO: 991521 - RNA, 21 nt, Human
ugacagcacauuaucuuuagu

SEQ ID NO: 991522 - RNA, 21 nt, Human
ugaccaaggccagcucucccu

SEQ ID NO: 991523 - RNA, 19 nt, Human
ugaccaggcccaaagugcu

SEQ ID NO: 991524 - RNA, 22 nt, Human
ugacuggagcagaagacccugc

SEQ ID NO: 991525 - RNA, 24 nt, Human
ugagcagccuccuucccugggguc

SEQ ID NO: 991526 - RNA, 21 nt, Human
ugagccaggggucuccugggc

SEQ ID NO: 991527 - RNA, 25 nt, Human
ugaugggaggcaggggcagccggag

SEQ ID NO: 991528 - RNA, 21 nt, Human
ugcaacugugugcaccucauc

SEQ ID NO: 991529 - RNA, 20 nt, Human
ugccccaaggccaagaucuc

SEQ ID NO: 991530 - RNA, 18 nt, Human
ugccccacaaugcaacaa

SEQ ID NO: 991531 - RNA, 19 nt, Human
ugccccuuuacuuauacau

SEQ ID NO: 991532 - RNA, 19 nt, Human
ugcccggcucugcugucug

SEQ ID NO: 991533 - RNA, 25 nt, Human
ugccuagggugguggggcacagcuu

SEQ ID NO: 991534 - RNA, 22 nt, Human
uggaaaggugugaauaccuuug

SEQ ID NO: 991535 - RNA, 22 nt, Human
uggaaaggugugaauaccuuug

SEQ ID NO: 991536 - RNA, 19 nt, Human
uggagcagaagacccugcu

SEQ ID NO: 991537 - RNA, 26 nt, Human
uggagcccaagcaccugccccgaggg

SEQ ID NO: 991538 - RNA, 18 nt, Human
uggaggccugggcuagga

SEQ ID NO: 991539 - RNA, 18 nt, Human
uggcagggaaggacuccc

SEQ ID NO: 991540 - RNA, 21 nt, Human
uggcagggaaggacuccccuc

SEQ ID NO: 991541 - RNA, 19 nt, Human
uggcaggggugggcauauc

SEQ ID NO: 991542 - RNA, 20 nt, Human
ugggaccuagccgaggccca

SEQ ID NO: 991543 - RNA, 19 nt, Human
ugggaggcaggggcagccg

SEQ ID NO: 991544 - RNA, 18 nt, Human
ugggauccccccuacucc

SEQ ID NO: 991545 - RNA, 24 nt, Human
ugggcaaggccuugggcuggucug

SEQ ID NO: 991546 - RNA, 21 nt, Human
ugggcuggucugagccagggg

SEQ ID NO: 991547 - RNA, 22 nt, Human
ugggcuggucugagccaggggu

SEQ ID NO: 991548 - RNA, 18 nt, Human
uggggacggggacagggu

SEQ ID NO: 991549 - RNA, 19 nt, Human
uggggacggggacagggug

SEQ ID NO: 991550 - RNA, 20 nt, Human
uguaggcagggcccaggggu

SEQ ID NO: 991551 - RNA, 24 nt, Human
ugucugugaugggaggcaggggca

SEQ ID NO: 991552 - RNA, 21 nt, Human
ugugaauaccuuugguaggcu

SEQ ID NO: 991553 - RNA, 19 nt, Human
uguguaggcagggcccagg

SEQ ID NO: 991554 - RNA, 21 nt, Human
uguuggagcugcuuuuggggu

SEQ ID NO: 991555 - RNA, 20 nt, Human
uuaucaucaagucuuaccau

SEQ ID NO: 991556 - RNA, 21 nt, Human
uucucgagccuaccucaacac

SEQ ID NO: 991557 - RNA, 24 nt, Human
uucuguaccccuuuccugccccuc

SEQ ID NO: 991558 - RNA, 18 nt, Human
uuucccccgcccccaccu

SEQ ID NO: 991559 - RNA, 23 nt, Human
uuucccccgcccccaccuuaucc

SEQ ID NO: 991560 - RNA, 19 nt, Human
cacacagaaccacuacgca

SEQ ID NO: 991561 - RNA, 24 nt, Human
ccacacagaaccacuacgcaagcu

SEQ ID NO: 991562 - RNA, 19 nt, Human
ccccaacuggagcuuccag

SEQ ID NO: 991563 - RNA, 23 nt, Human
cgggaugggagccuccuuacccc

SEQ ID NO: 991564 - RNA, 24 nt, Human
uaccccaacuggagcuuccagcuc

SEQ ID NO: 991565 - RNA, 26 nt, Human
ucagcgccacacagaaccacuacgca

SEQ ID NO: 991566 - RNA, 22 nt, Human
uuuuuuuuuuuuuuuacuguuu

SEQ ID NO: 991567 - RNA, 21 nt, Human
aaccagaagggucagaaaccc

SEQ ID NO: 991568 - RNA, 21 nt, Human
aacccugcccuccuccugcca

SEQ ID NO: 991569 - RNA, 21 nt, Human
acccaacccugcccuccuccu

SEQ ID NO: 991570 - RNA, 20 nt, Human
agaaaccagaagggucagaa

SEQ ID NO: 991571 - RNA, 23 nt, Human
auccucugcauuuauuccauuca

SEQ ID NO: 991572 - RNA, 21 nt, Human
caccaccuccuuucccgcuuc

SEQ ID NO: 991573 - RNA, 20 nt, Human
cacccaacccugcccuccuc

SEQ ID NO: 991574 - RNA, 24 nt, Human
cagaagggucagaaaccccuaggc

SEQ ID NO: 991575 - RNA, 23 nt, Human
cauuuauuccauucauuucucuc

SEQ ID NO: 991576 - RNA, 21 nt, Human
ccaacccugcccuccuccugc

SEQ ID NO: 991577 - RNA, 24 nt, Human
cccaacccugcccuccuccugcag

SEQ ID NO: 991578 - RNA, 18 nt, Human
cccugcccuccuccugca

SEQ ID NO: 991579 - RNA, 19 nt, Human
ccuccugcaguccuccaag

SEQ ID NO: 991580 - RNA, 22 nt, Human
ccuccuuucccgcuucgcucuc

SEQ ID NO: 991581 - RNA, 21 nt, Human
ccuuccauugcccacccaacc

SEQ ID NO: 991582 - RNA, 23 nt, Human
cuccuuucccgcuucgcucuucc

SEQ ID NO: 991583 - RNA, 18 nt, Human
cucuccgcgccccccgcu

SEQ ID NO: 991584 - RNA, 21 nt, Human
cucuccucccuccuuccauug

SEQ ID NO: 991585 - RNA, 20 nt, Human
cuucgcucuccgcgcccccc

SEQ ID NO: 991586 - RNA, 23 nt, Human
gaaaccagaagggucagaaaccc

SEQ ID NO: 991587 - RNA, 22 nt, Human
gacaccaccuccuuucccgcuu

SEQ ID NO: 991588 - RNA, 20 nt, Human
gcgccccccgcucugagcuc

SEQ ID NO: 991589 - RNA, 23 nt, Human
uauuccauucauuucucuccucc

SEQ ID NO: 991590 - RNA, 18 nt, Human
ucagaaaccccuaggccu

SEQ ID NO: 991591 - RNA, 21 nt, Human
ucauuucucuccucccuccuu

SEQ ID NO: 991592 - RNA, 20 nt, Human
uccauucauuucucuccucc

SEQ ID NO: 991593 - RNA, 26 nt, Human
uggcaccaccgguugcuaggcaacca

SEQ ID NO: 991594 - RNA, 22 nt, Human
uguucacagacaccaccuccuu

SEQ ID NO: 991595 - RNA, 18 nt, Human
uuuuuuuuuuuuuuuuug

SEQ ID NO: 991596 - RNA, 22 nt, Human
cacuauuuguaaaucucuccug

SEQ ID NO: 991597 - RNA, 20 nt, Human
cccggcgaggggcgggaagg

SEQ ID NO: 991598 - RNA, 22 nt, Human
gaaggggcugugggaggaaggg

SEQ ID NO: 991599 - RNA, 23 nt, Human
ggcgggaaggggcugugggagga

SEQ ID NO: 991600 - RNA, 20 nt, Human
ggcugugggaggaagggguc

SEQ ID NO: 991601 - RNA, 18 nt, Human
gguaucaaaaccacaccc

SEQ ID NO: 991602 - RNA, 23 nt, Human
uaacuuagggguaucaaaaccac

SEQ ID NO: 991603 - RNA, 19 nt, Human
ucaaaaccacacccggugg

SEQ ID NO: 991604 - RNA, 26 nt, Human
ucagccuuaacuuagggguaucaaaa

SEQ ID NO: 991605 - RNA, 22 nt, Human
ugacuauauuagcauucgguuc

SEQ ID NO: 991606 - RNA, 19 nt, Human
ugcugagacagugcucugg

SEQ ID NO: 991607 - RNA, 22 nt, Human
ugggaggaaggggucgcagccu

SEQ ID NO: 991608 - RNA, 20 nt, Human
uuuguaaaucucuccugucc

SEQ ID NO: 991609 - RNA, 23 nt, Human
agaaaaucccucauuucauccac

SEQ ID NO: 991610 - RNA, 22 nt, Human
aucccucauuucauccacaauc

SEQ ID NO: 991611 - RNA, 23 nt, Human
caagaaaaucccucauuucaucc

SEQ ID NO: 991612 - RNA, 23 nt, Human
ccauggggaaggcuuggccucca

SEQ ID NO: 991613 - RNA, 20 nt, Human
cccucauuucauccacaauc

SEQ ID NO: 991614 - RNA, 29 nt, Human
cuuggccuccacuguggccuuccuguuuu

SEQ ID NO: 991615 - RNA, 18 nt, Human
uuaaugugauaauggauu

SEQ ID NO: 991616 - RNA, 22 nt, Human
uuggccuccacuguggccuucc

SEQ ID NO: 991617 - RNA, 19 nt, Human
aaaaaaaaaaaaaaagagg

SEQ ID NO: 991618 - RNA, 22 nt, Human
aaaaaaaaaaagacuuaaagag

SEQ ID NO: 991619 - RNA, 19 nt, Human
aaaaagacuuaaagagcac

SEQ ID NO: 991620 - RNA, 20 nt, Human
aaaauaagcacugagucuug

SEQ ID NO: 991621 - RNA, 23 nt, Human
aaacacccauucuacacagauaa

SEQ ID NO: 991622 - RNA, 19 nt, Human
aaacagaaagacuaaaaac

SEQ ID NO: 991623 - RNA, 21 nt, Human
aaagaagccaaaccaaaacca

SEQ ID NO: 991624 - RNA, 25 nt, Human
aaagaagccaaaccaaaaccauuua

SEQ ID NO: 991625 - RNA, 22 nt, Human
aaccuuuguuuugugccauccu

SEQ ID NO: 991626 - RNA, 20 nt, Human
aacguggugaaaccccgucu

SEQ ID NO: 991627 - RNA, 21 nt, Human
aacguggugaaaccccgucuc

SEQ ID NO: 991628 - RNA, 25 nt, Human
aagaaggaaauauaaaauguuuaga

SEQ ID NO: 991629 - RNA, 18 nt, Human
aagaccagccuggccaac

SEQ ID NO: 991630 - RNA, 23 nt, Human
aagaucacgccacugcacuccag

SEQ ID NO: 991631 - RNA, 22 nt, Human
aaggggauuaaaaaaaaaaaga

SEQ ID NO: 991632 - RNA, 23 nt, Human
aaguaauccagagcugaaacuga

SEQ ID NO: 991633 - RNA, 24 nt, Human
aaucacuugaacccgggagacgga

SEQ ID NO: 991634 - RNA, 18 nt, Human
acaaaacagaucuguaga

SEQ ID NO: 991635 - RNA, 21 nt, Human
accccgucucuacuaaaacua

SEQ ID NO: 991636 - RNA, 18 nt, Human
acgccacugcacuccagc

SEQ ID NO: 991637 - RNA, 21 nt, Human
acgccacugcacuccagccug

SEQ ID NO: 991638 - RNA, 22 nt, Human
acggaaguugcagugagccaag

SEQ ID NO: 991639 - RNA, 28 nt, Human
acuccgucucaaaaaaaaaaaaaaaaaa

SEQ ID NO: 991640 - RNA, 18 nt, Human
acugcacuccagccuggg

SEQ ID NO: 991641 - RNA, 25 nt, Human
acugcacuccagccuggguaacaag

SEQ ID NO: 991642 - RNA, 22 nt, Human
agaaucacuugaacccgggaga

SEQ ID NO: 991643 - RNA, 24 nt, Human
agacggaaguugcagugagccaag

SEQ ID NO: 991644 - RNA, 21 nt, Human
agaguagccagccaucuuaaa

SEQ ID NO: 991645 - RNA, 19 nt, Human
agccaucuuaaaaaugccc

SEQ ID NO: 991646 - RNA, 22 nt, Human
agccuggccaacguggugaaac

SEQ ID NO: 991647 - RNA, 24 nt, Human
agccuggccaacguggugaaaccc

SEQ ID NO: 991648 - RNA, 18 nt, Human
aggcaggagaaucacuug

SEQ ID NO: 991649 - RNA, 24 nt, Human
aggcaggagaaucacuugaacccg

SEQ ID NO: 991650 - RNA, 24 nt, Human
aggcugaggcaggagaaucacuug

SEQ ID NO: 991651 - RNA, 21 nt, Human
aggggauuaaaaaaaaaaaga

SEQ ID NO: 991652 - RNA, 21 nt, Human
aguagccagccaucuuaaaaa

SEQ ID NO: 991653 - RNA, 18 nt, Human
agucaugguccauucagg

SEQ ID NO: 991654 - RNA, 24 nt, Human
aucacgccacugcacuccagccug

SEQ ID NO: 991655 - RNA, 18 nt, Human
aucccaucucuguccccu

SEQ ID NO: 991656 - RNA, 18 nt, Human
auccugaagacuugcaca

SEQ ID NO: 991657 - RNA, 18 nt, Human
auccugaagacuugcaca

SEQ ID NO: 991658 - RNA, 22 nt, Human
aucucuguccccugaaauuccc

SEQ ID NO: 991659 - RNA, 24 nt, Human
caacaaaucccaucucuguccccu

SEQ ID NO: 991660 - RNA, 24 nt, Human
caacguggugaaaccccgucucua

SEQ ID NO: 991661 - RNA, 24 nt, Human
caacugaaguaauccagagcugaa

SEQ ID NO: 991662 - RNA, 22 nt, Human
caaggcaggcaaauguuucucc

SEQ ID NO: 991663 - RNA, 21 nt, Human
cacagauaaaaaccuucacaa

SEQ ID NO: 991664 - RNA, 19 nt, Human
caccuauaaacccagcuac

SEQ ID NO: 991665 - RNA, 24 nt, Human
caccuauaaacccagcuacuuggg

SEQ ID NO: 991666 - RNA, 24 nt, Human
cacuccagccuggguaacaagagc

SEQ ID NO: 991667 - RNA, 19 nt, Human
cacugcacuccagccuggg

SEQ ID NO: 991668 - RNA, 19 nt, Human
cacugcacuccagccuggg

SEQ ID NO: 991669 - RNA, 22 nt, Human
cacugcacuccagccuggguaa

SEQ ID NO: 991670 - RNA, 23 nt, Human
cacugcacuccagccuggguaac

SEQ ID NO: 991671 - RNA, 24 nt, Human
cacugcacuccagccuggguaaca

SEQ ID NO: 991672 - RNA, 20 nt, Human
cagauaaaaaccuucacaaa

SEQ ID NO: 991673 - RNA, 24 nt, Human
cagcuacuugggaggcugaggcag

SEQ ID NO: 991674 - RNA, 18 nt, Human
caggaugcaacauauaua

SEQ ID NO: 991675 - RNA, 21 nt, Human
caguauaaaaaguacaaaaca

SEQ ID NO: 991676 - RNA, 18 nt, Human
ccacucagauguugucaa

SEQ ID NO: 991677 - RNA, 20 nt, Human
ccacugcacuccagccuggg

SEQ ID NO: 991678 - RNA, 20 nt, Human
ccacugcacuccagccuggg

SEQ ID NO: 991679 - RNA, 20 nt, Human
ccacugcacuccagccuggg

SEQ ID NO: 991680 - RNA, 21 nt, Human
ccacugcacuccagccugggu

SEQ ID NO: 991681 - RNA, 22 nt, Human
ccacugcacuccagccugggua

SEQ ID NO: 991682 - RNA, 24 nt, Human
ccacugcacuccagccuggguaac

SEQ ID NO: 991683 - RNA, 20 nt, Human
ccauccugaagacuugcaca

SEQ ID NO: 991684 - RNA, 21 nt, Human
cccccucaagcgcucccuccu

SEQ ID NO: 991685 - RNA, 22 nt, Human
ccccgucucuacuaaaacuaaa

SEQ ID NO: 991686 - RNA, 21 nt, Human
ccccugaaauuccccuaguuu

SEQ ID NO: 991687 - RNA, 23 nt, Human
cccucauuuugaaaagacugaac

SEQ ID NO: 991688 - RNA, 22 nt, Human
cccuucuacauaaaaaccucag

SEQ ID NO: 991689 - RNA, 24 nt, Human
ccucaaagacugugggagagccaa

SEQ ID NO: 991690 - RNA, 19 nt, Human
ccucaagcgcucccuccuc

SEQ ID NO: 991691 - RNA, 26 nt, Human
ccucaagcgcucccuccuccucaacu

SEQ ID NO: 991692 - RNA, 23 nt, Human
ccuggccaacguggugaaacccc

SEQ ID NO: 991693 - RNA, 24 nt, Human
ccuggccaacguggugaaaccccg

SEQ ID NO: 991694 - RNA, 26 nt, Human
cgccacugcacuccagccuggguaac

SEQ ID NO: 991695 - RNA, 18 nt, Human
cuacucuagaaauugucu

SEQ ID NO: 991696 - RNA, 25 nt, Human
cucaaaacagaaagacuaaaaacua

SEQ ID NO: 991697 - RNA, 25 nt, Human
cucaagcgcucccuccuccucaacu

SEQ ID NO: 991698 - RNA, 19 nt, Human
cuccgucucaaaaaaaaaa

SEQ ID NO: 991699 - RNA, 26 nt, Human
cucugguuuggguucaagugagaggc

SEQ ID NO: 991700 - RNA, 24 nt, Human
cuggcuucagaguuugugggagug

SEQ ID NO: 991701 - RNA, 21 nt, Human
gaaggggauuaaaaaaaaaaa

SEQ ID NO: 991702 - RNA, 18 nt, Human
gaaguugcagugagccaa

SEQ ID NO: 991703 - RNA, 19 nt, Human
gaaguugcagugagccaag

SEQ ID NO: 991704 - RNA, 25 nt, Human
gacuugccauuuccccaagaggagc

SEQ ID NO: 991705 - RNA, 22 nt, Human
gagggucauuuaagaccagccu

SEQ ID NO: 991706 - RNA, 22 nt, Human
gcaggagaaucacuugaacccg

SEQ ID NO: 991707 - RNA, 24 nt, Human
gccaacguggugaaaccccgucuc

SEQ ID NO: 991708 - RNA, 20 nt, Human
gccaagaucacgccacugca

SEQ ID NO: 991709 - RNA, 19 nt, Human
gccacugcacuccagccug

SEQ ID NO: 991710 - RNA, 21 nt, Human
gccacugcacuccagccuggg

SEQ ID NO: 991711 - RNA, 19 nt, Human
gcggagugcacgccaggcc

SEQ ID NO: 991712 - RNA, 23 nt, Human
gcugaaacugaauugugcagauu

SEQ ID NO: 991713 - RNA, 20 nt, Human
ggaaguugcagugagccaag

SEQ ID NO: 991714 - RNA, 24 nt, Human
ggaaguugcagugagccaagauca

SEQ ID NO: 991715 - RNA, 20 nt, Human
ggguucaagugagaggcuuu

SEQ ID NO: 991716 - RNA, 23 nt, Human
ggucaacugaaguaauccagagc

SEQ ID NO: 991717 - RNA, 19 nt, Human
guagcuuugugguuuuuca

SEQ ID NO: 991718 - RNA, 19 nt, Human
guuuggguucaagugagag

SEQ ID NO: 991719 - RNA, 23 nt, Human
guuuugugccauccugaagacuu

SEQ ID NO: 991720 - RNA, 23 nt, Human
uaaaaaaaaaaagacuuaaagag

SEQ ID NO: 991721 - RNA, 21 nt, Human
uaaaaaugccccaaccacugc

SEQ ID NO: 991722 - RNA, 22 nt, Human
uaaaagaagccaaaccaaaacc

SEQ ID NO: 991723 - RNA, 19 nt, Human
uaaacccagcuacuuggga

SEQ ID NO: 991724 - RNA, 25 nt, Human
uaaacccagcuacuugggaggcuga

SEQ ID NO: 991725 - RNA, 23 nt, Human
uaaagacuugccauuuccccaag

SEQ ID NO: 991726 - RNA, 23 nt, Human
uaaauaaauacagaaguagagau

SEQ ID NO: 991727 - RNA, 19 nt, Human
uaacacaaacaaaagucga

SEQ ID NO: 991728 - RNA, 18 nt, Human
uaagaaaugugccccaag

SEQ ID NO: 991729 - RNA, 23 nt, Human
uaauaggcuaaaacaagucaaac

SEQ ID NO: 991730 - RNA, 22 nt, Human
uacagagugaaagaaaauaaaa

SEQ ID NO: 991731 - RNA, 22 nt, Human
uacaguacauccuacaggcaaa

SEQ ID NO: 991732 - RNA, 23 nt, Human
uaggcuaaaacaagucaaacacc

SEQ ID NO: 991733 - RNA, 20 nt, Human
uaucauacaacaaaucccaa

SEQ ID NO: 991734 - RNA, 19 nt, Human
uaucucaauguucagaaag

SEQ ID NO: 991735 - RNA, 21 nt, Human
ucaaaaaaaaaaaaaaaaaaa

SEQ ID NO: 991736 - RNA, 23 nt, Human
ucaacccauucaaaacuacucua

SEQ ID NO: 991737 - RNA, 18 nt, Human
ucaacucacuguauaguc

SEQ ID NO: 991738 - RNA, 23 nt, Human
ucacgccacugcacuccagccug

SEQ ID NO: 991739 - RNA, 22 nt, Human
uccccaagaggagcuuugauuc

SEQ ID NO: 991740 - RNA, 21 nt, Human
ucccuccuccucaacugccuu

SEQ ID NO: 991741 - RNA, 23 nt, Human
uccgucucaaaaaaaaaaaaaaa

SEQ ID NO: 991742 - RNA, 18 nt, Human
uccucaacugccuugucu

SEQ ID NO: 991743 - RNA, 20 nt, Human
ucucuacuaaaacuaaaaaa

SEQ ID NO: 991744 - RNA, 19 nt, Human
ucuuaggauugaagagcuc

SEQ ID NO: 991745 - RNA, 23 nt, Human
ucuuaggucaauuagcuguccac

SEQ ID NO: 991746 - RNA, 20 nt, Human
ucuucugggcaauagucugg

SEQ ID NO: 991747 - RNA, 20 nt, Human
ugaggcaggagaaucacuug

SEQ ID NO: 991748 - RNA, 24 nt, Human
ugaggcaggagaaucacuugaacc

SEQ ID NO: 991749 - RNA, 25 nt, Human
ugaggcaggagaaucacuugaaccc

SEQ ID NO: 991750 - RNA, 22 nt, Human
ugcaacagaaagcucagucugu

SEQ ID NO: 991751 - RNA, 23 nt, Human
ugccuugucuagaaagauagucu

SEQ ID NO: 991752 - RNA, 22 nt, Human
uggaaggggaaaaagaagacug

SEQ ID NO: 991753 - RNA, 24 nt, Human
uggccaacguggugaaaccccguc

SEQ ID NO: 991754 - RNA, 19 nt, Human
ugggaggcugaggcaggag

SEQ ID NO: 991755 - RNA, 20 nt, Human
ugggaggcugaggcaggaga

SEQ ID NO: 991756 - RNA, 24 nt, Human
ugggaggcugaggcaggagaauca

SEQ ID NO: 991757 - RNA, 18 nt, Human
ugggggaaaucaacccau

SEQ ID NO: 991758 - RNA, 20 nt, Human
uggguucaagugagaggcuu

SEQ ID NO: 991759 - RNA, 21 nt, Human
uggucugaagucuuaggucaa

SEQ ID NO: 991760 - RNA, 24 nt, Human
uggugaaucagagacagggaucuu

SEQ ID NO: 991761 - RNA, 18 nt, Human
uguccccgaggugcggag

SEQ ID NO: 991762 - RNA, 19 nt, Human
uguccccugaaauuccccu

SEQ ID NO: 991763 - RNA, 19 nt, Human
uuaaaaaugccccaaccac

SEQ ID NO: 991764 - RNA, 19 nt, Human
uucaggguugaagcuguuu

SEQ ID NO: 991765 - RNA, 20 nt, Human
uuccaaaagaaggaaauaua

SEQ ID NO: 991766 - RNA, 22 nt, Human
uugaaaagacugaacuggcaau

SEQ ID NO: 991767 - RNA, 20 nt, Human
uugcagugagccaagaucac

SEQ ID NO: 991768 - RNA, 25 nt, Human
uugggaggcugaggcaggagaauca

SEQ ID NO: 991769 - RNA, 24 nt, Human
aagaacacaaaaacaauuuuuaua

SEQ ID NO: 991770 - RNA, 24 nt, Human
accugggcgaagucugucuccggc

SEQ ID NO: 991771 - RNA, 18 nt, Human
aggaaggacggggcgggg

SEQ ID NO: 991772 - RNA, 18 nt, Human
agugaccgcccgggaagg

SEQ ID NO: 991773 - RNA, 23 nt, Human
caccugggcgaagucugucuccg

SEQ ID NO: 991774 - RNA, 21 nt, Human
cccacggcugagccgcggccg

SEQ ID NO: 991775 - RNA, 21 nt, Human
ccccagccccgcguuagagcc

SEQ ID NO: 991776 - RNA, 25 nt, Human
cccccagccccgcguuagagcccac

SEQ ID NO: 991777 - RNA, 18 nt, Human
ccccuacuacccgucacc

SEQ ID NO: 991778 - RNA, 27 nt, Human
cccugacugccaaaucacauuccuucc

SEQ ID NO: 991779 - RNA, 20 nt, Human
ccggcccccagccccgcguu

SEQ ID NO: 991780 - RNA, 20 nt, Human
cggggcagcagggcccgacc

SEQ ID NO: 991781 - RNA, 20 nt, Human
cugguguggcggcaaggucc

SEQ ID NO: 991782 - RNA, 23 nt, Human
gaaggacggggcggggcagcagg

SEQ ID NO: 991783 - RNA, 21 nt, Human
gagcccacggcugagccgcgg

SEQ ID NO: 991784 - RNA, 22 nt, Human
gagccgcggccgccuucuuuag

SEQ ID NO: 991785 - RNA, 25 nt, Human
gcccccagccccgcguuagagccca

SEQ ID NO: 991786 - RNA, 19 nt, Human
gcgccgcucgugccgaauu

SEQ ID NO: 991787 - RNA, 18 nt, Human
gcggggcagcagggcccg

SEQ ID NO: 991788 - RNA, 24 nt, Human
ggaaggacggggcggggcagcagg

SEQ ID NO: 991789 - RNA, 20 nt, Human
ggaaggaggaaggacggggc

SEQ ID NO: 991790 - RNA, 22 nt, Human
ggcugguguggcggcaaggucc

SEQ ID NO: 991791 - RNA, 19 nt, Human
uaaacucuaaaagugagcc

SEQ ID NO: 991792 - RNA, 19 nt, Human
uccucagagacucugacuu

SEQ ID NO: 991793 - RNA, 19 nt, Human
ucuuuaggccgccagagcc

SEQ ID NO: 991794 - RNA, 22 nt, Human
ugaaguaaacucuaaaagugag

SEQ ID NO: 991795 - RNA, 20 nt, Human
uguggcggcaagguccgggg

SEQ ID NO: 991796 - RNA, 23 nt, Human
uuuuuuuuuuuuuuuuuaucuuu

SEQ ID NO: 991797 - RNA, 23 nt, Human
aaaaaaaaaaaucaacagaagca

SEQ ID NO: 991798 - RNA, 20 nt, Human
aaaaaaaaucaacagaagca

SEQ ID NO: 991799 - RNA, 18 nt, Human
aagaaaaggcaagagaca

SEQ ID NO: 991800 - RNA, 24 nt, Human
aagaggaggagacggcggcaaaga

SEQ ID NO: 991801 - RNA, 23 nt, Human
aagcaaaucagucccuguauaaa

SEQ ID NO: 991802 - RNA, 18 nt, Human
aagcaccccaauauucag

SEQ ID NO: 991803 - RNA, 22 nt, Human
acaaaaccagccccacucccaa

SEQ ID NO: 991804 - RNA, 19 nt, Human
acagggcagcugguagcuc

SEQ ID NO: 991805 - RNA, 22 nt, Human
acauguugauaaauacauagaa

SEQ ID NO: 991806 - RNA, 20 nt, Human
accagcgaagccaacagggc

SEQ ID NO: 991807 - RNA, 24 nt, Human
accaugcaguaagugcaaacagca

SEQ ID NO: 991808 - RNA, 18 nt, Human
acuuuuuucuucuuuuaa

SEQ ID NO: 991809 - RNA, 20 nt, Human
agaccugggguggggaaaga

SEQ ID NO: 991810 - RNA, 21 nt, Human
agacggcggcaaagagggagc

SEQ ID NO: 991811 - RNA, 24 nt, Human
agaggaggagacggcggcaaagag

SEQ ID NO: 991812 - RNA, 26 nt, Human
agcucagccuagaacuagacauccuc

SEQ ID NO: 991813 - RNA, 18 nt, Human
aggaagggaagcaaauca

SEQ ID NO: 991814 - RNA, 18 nt, Human
aggcaagagacagaccug

SEQ ID NO: 991815 - RNA, 27 nt, Human
aggcaagagacagaccuggggugggga

SEQ ID NO: 991816 - RNA, 24 nt, Human
agucugaaaaugucuugggaaagu

SEQ ID NO: 991817 - RNA, 19 nt, Human
auaaauaugaaaauagauu

SEQ ID NO: 991818 - RNA, 21 nt, Human
caacagggcagcugguagcuc

SEQ ID NO: 991819 - RNA, 18 nt, Human
caagaggaggagacggcg

SEQ ID NO: 991820 - RNA, 20 nt, Human
cacucccaaccacaagguug

SEQ ID NO: 991821 - RNA, 23 nt, Human
cacugggagcccagaaguugagc

SEQ ID NO: 991822 - RNA, 24 nt, Human
cacuuuuuucuucuuuuaagaagg

SEQ ID NO: 991823 - RNA, 18 nt, Human
cagaagccggcgacucag

SEQ ID NO: 991824 - RNA, 22 nt, Human
caggaaaaggucuuugaauagu

SEQ ID NO: 991825 - RNA, 23 nt, Human
cagucggggccgcuccccccgcc

SEQ ID NO: 991826 - RNA, 20 nt, Human
cauggccccacagucggggc

SEQ ID NO: 991827 - RNA, 22 nt, Human
ccagccccacucccaaccacaa

SEQ ID NO: 991828 - RNA, 24 nt, Human
cccaagaaaaggcaagagacagac

SEQ ID NO: 991829 - RNA, 23 nt, Human
cccacucccaaccacaagguuga

SEQ ID NO: 991830 - RNA, 21 nt, Human
ccccaagaaaaggcaagagac

SEQ ID NO: 991831 - RNA, 22 nt, Human
ccccaagaaaaggcaagagaca

SEQ ID NO: 991832 - RNA, 20 nt, Human
ccccaaggugaggcagggac

SEQ ID NO: 991833 - RNA, 23 nt, Human
cccuaacuaggaaggccucucac

SEQ ID NO: 991834 - RNA, 19 nt, Human
cccuagggccuacaaaacc

SEQ ID NO: 991835 - RNA, 22 nt, Human
cccuagggccuacaaaaccagc

SEQ ID NO: 991836 - RNA, 25 nt, Human
ccuacaaaaccagccccacucccaa

SEQ ID NO: 991837 - RNA, 18 nt, Human
ccucacagcucguuggug

SEQ ID NO: 991838 - RNA, 21 nt, Human
cucugguccuaucuggggaag

SEQ ID NO: 991839 - RNA, 27 nt, Human
cugggagcccagaaguugagccuggcc

SEQ ID NO: 991840 - RNA, 22 nt, Human
cuggggaaguacacuggagagg

SEQ ID NO: 991841 - RNA, 21 nt, Human
gaaggccucucacugcugccu

SEQ ID NO: 991842 - RNA, 19 nt, Human
gacucagcuaggcuagcgg

SEQ ID NO: 991843 - RNA, 21 nt, Human
gagggucuggugggaggcaga

SEQ ID NO: 991844 - RNA, 22 nt, Human
gccucccgucauacacagccaa

SEQ ID NO: 991845 - RNA, 21 nt, Human
gcggcggcggcgaacgaggag

SEQ ID NO: 991846 - RNA, 18 nt, Human
gcugccuugcuguccccu

SEQ ID NO: 991847 - RNA, 18 nt, Human
ggaaacagccaugaccau

SEQ ID NO: 991848 - RNA, 24 nt, Human
ggaggcagaccuccuugcuggauu

SEQ ID NO: 991849 - RNA, 23 nt, Human
ggcaagaggaggagacggcggca

SEQ ID NO: 991850 - RNA, 18 nt, Human
ggcacugggagcccagaa

SEQ ID NO: 991851 - RNA, 20 nt, Human
ggcggcggcgaacgaggaga

SEQ ID NO: 991852 - RNA, 20 nt, Human
gggaaagaaccgggguaaua

SEQ ID NO: 991853 - RNA, 18 nt, Human
gggaaguacacuggagag

SEQ ID NO: 991854 - RNA, 24 nt, Human
ggucuggugggaggcagaccuccu

SEQ ID NO: 991855 - RNA, 21 nt, Human
gguuugacacugaggcaggac

SEQ ID NO: 991856 - RNA, 21 nt, Human
uacaaaaaaaaaaaucaacag

SEQ ID NO: 991857 - RNA, 25 nt, Human
uacaaaaaaaaaaaucaacagaagc

SEQ ID NO: 991858 - RNA, 27 nt, Human
uacaaaaaaaaaaaucaacagaagcaa

SEQ ID NO: 991859 - RNA, 23 nt, Human
uacaaaaccagccccacucccaa

SEQ ID NO: 991860 - RNA, 28 nt, Human
uacaaaaccagccccacucccaaccaca

SEQ ID NO: 991861 - RNA, 20 nt, Human
uacacuggagagggucuggu

SEQ ID NO: 991862 - RNA, 22 nt, Human
uagaagcaggcccuagggccua

SEQ ID NO: 991863 - RNA, 31 nt, Human
uauaugccccaagaaaaggcaagagacagag

SEQ ID NO: 991864 - RNA, 18 nt, Human
ucacuuuuuucuucuuuu

SEQ ID NO: 991865 - RNA, 22 nt, Human
ucacuuuuuucuucuuuuaaga

SEQ ID NO: 991866 - RNA, 23 nt, Human
ucccaaagcuccagccauggcag

SEQ ID NO: 991867 - RNA, 23 nt, Human
uccccaaggugaggcagggacug

SEQ ID NO: 991868 - RNA, 24 nt, Human
ucccuguauaaaccauuuaaccaa

SEQ ID NO: 991869 - RNA, 25 nt, Human
ucguugguggcagcggcuccuuagc

SEQ ID NO: 991870 - RNA, 27 nt, Human
ugacacugaggcaggacugagcagcca

SEQ ID NO: 991871 - RNA, 20 nt, Human
ugagcagccagaggggugcc

SEQ ID NO: 991872 - RNA, 18 nt, Human
ugaggcagggacuaaacc

SEQ ID NO: 991873 - RNA, 18 nt, Human
ugcauagaaauguaguga

SEQ ID NO: 991874 - RNA, 19 nt, Human
ugccuugcuguccccuugc

SEQ ID NO: 991875 - RNA, 22 nt, Human
uggcaggaagggaagcaaauca

SEQ ID NO: 991876 - RNA, 18 nt, Human
ugggcacugggagcccag

SEQ ID NO: 991877 - RNA, 25 nt, Human
uggggaaagaaccgggguaauagcc

SEQ ID NO: 991878 - RNA, 27 nt, Human
uggugggaggcagaccuccuugcugga

SEQ ID NO: 991879 - RNA, 22 nt, Human
ugguuugacacugaggcaggac

SEQ ID NO: 991880 - RNA, 19 nt, Human
uguucccaaagcuccagcc

SEQ ID NO: 991881 - RNA, 23 nt, Human
aaaaacaaacagaagcccugaca

SEQ ID NO: 991882 - RNA, 22 nt, Human
aaacaaacagaagcccugacag

SEQ ID NO: 991883 - RNA, 19 nt, Human
aaacagaagcccugacagc

SEQ ID NO: 991884 - RNA, 18 nt, Human
agccugggcacaguggcu

SEQ ID NO: 991885 - RNA, 22 nt, Human
cacucugccuggugcccacagc

SEQ ID NO: 991886 - RNA, 23 nt, Human
cauacccccacacccgacagccg

SEQ ID NO: 991887 - RNA, 19 nt, Human
ccacacccgacagccggcg

SEQ ID NO: 991888 - RNA, 24 nt, Human
cccacccacagggucucccuggac

SEQ ID NO: 991889 - RNA, 20 nt, Human
ccccacacccgacagccggc

SEQ ID NO: 991890 - RNA, 20 nt, Human
cccccacacccgacagccgg

SEQ ID NO: 991891 - RNA, 19 nt, Human
cucccuggacuggcggggg

SEQ ID NO: 991892 - RNA, 18 nt, Human
gaagccgaguccuccggg

SEQ ID NO: 991893 - RNA, 20 nt, Human
gagcugccugagcuuccugc

SEQ ID NO: 991894 - RNA, 18 nt, Human
gggcaggggccugaccua

SEQ ID NO: 991895 - RNA, 22 nt, Human
ggggucaggcagugggcagggg

SEQ ID NO: 991896 - RNA, 18 nt, Human
ggggugggggucaggcag

SEQ ID NO: 991897 - RNA, 24 nt, Human
ggugggggucaggcagugggcagg

SEQ ID NO: 991898 - RNA, 20 nt, Human
gugcggcgggucggguuagc

SEQ ID NO: 991899 - RNA, 20 nt, Human
uaaaaaacaaacagaagccc

SEQ ID NO: 991900 - RNA, 22 nt, Human
uaaaaaacaaacagaagcccug

SEQ ID NO: 991901 - RNA, 28 nt, Human
ucucccuggacuggcggggggugggggu

SEQ ID NO: 991902 - RNA, 23 nt, Human
ugcauaguuuaaaaaacaaacag

SEQ ID NO: 991903 - RNA, 20 nt, Human
ugccugagcuuccugcuuag

SEQ ID NO: 991904 - RNA, 24 nt, Human
ugccugagcuuccugcuuaggggc

SEQ ID NO: 991905 - RNA, 19 nt, Human
ugccuggugcccacagccu

SEQ ID NO: 991906 - RNA, 21 nt, Human
ugcucugaccuggccugggug

SEQ ID NO: 991907 - RNA, 18 nt, Human
uggaggagcugccugagc

SEQ ID NO: 991908 - RNA, 22 nt, Human
ugggcaggggccugaccuaggc

SEQ ID NO: 991909 - RNA, 24 nt, Human
ugggggucaggcagugggcagggg

SEQ ID NO: 991910 - RNA, 22 nt, Human
uuuaaaaaacaaacagaagccc

SEQ ID NO: 991911 - RNA, 23 nt, Human
aaauguacccucaggcccucacc

SEQ ID NO: 991912 - RNA, 22 nt, Human
aaaugucuuuuuaaaaaacucc

SEQ ID NO: 991913 - RNA, 24 nt, Human
aaccaggcccacccccacccuucc

SEQ ID NO: 991914 - RNA, 21 nt, Human
aagaaucugucccccaccccc

SEQ ID NO: 991915 - RNA, 23 nt, Human
aagaauuaaggcuggggauuuug

SEQ ID NO: 991916 - RNA, 26 nt, Human
aagcgaacaugggcuucgcuccccca

SEQ ID NO: 991917 - RNA, 23 nt, Human
aauguuaaaacuaaaacugagcu

SEQ ID NO: 991918 - RNA, 20 nt, Human
accagagcuuggcggaagcc

SEQ ID NO: 991919 - RNA, 22 nt, Human
accagagcuuggcggaagccua

SEQ ID NO: 991920 - RNA, 20 nt, Human
acccagccccagccccaccu

SEQ ID NO: 991921 - RNA, 23 nt, Human
acccagccccagccccaccugac

SEQ ID NO: 991922 - RNA, 19 nt, Human
acccaguccagccacgugg

SEQ ID NO: 991923 - RNA, 20 nt, Human
accggucuggguccugaagc

SEQ ID NO: 991924 - RNA, 23 nt, Human
acgagaauggaggccacgacauc

SEQ ID NO: 991925 - RNA, 20 nt, Human
acgcagcaggcagaggaggg

SEQ ID NO: 991926 - RNA, 19 nt, Human
acgcgugcccaguacaagg

SEQ ID NO: 991927 - RNA, 24 nt, Human
acuagccaugcucaaaaaaaaaaa

SEQ ID NO: 991928 - RNA, 18 nt, Human
acucugguggguggaggg

SEQ ID NO: 991929 - RNA, 21 nt, Human
agaaaucaauuucaaccacca

SEQ ID NO: 991930 - RNA, 20 nt, Human
agaacagauacugcagggga

SEQ ID NO: 991931 - RNA, 19 nt, Human
agacagauccaaacccacu

SEQ ID NO: 991932 - RNA, 19 nt, Human
agaggagggggcggggggc

SEQ ID NO: 991933 - RNA, 21 nt, Human
agaggagggggcggggggccc

SEQ ID NO: 991934 - RNA, 22 nt, Human
agauacugcaggggaacaagcc

SEQ ID NO: 991935 - RNA, 27 nt, Human
agccacguggccaaucucagcagccuc

SEQ ID NO: 991936 - RNA, 21 nt, Human
agccccaccccccaccccccc

SEQ ID NO: 991937 - RNA, 18 nt, Human
aggaggcgguggcggcgg

SEQ ID NO: 991938 - RNA, 23 nt, Human
aggauaagugaagaggugaaagg

SEQ ID NO: 991939 - RNA, 23 nt, Human
aggcacgggcggcuccagcugga

SEQ ID NO: 991940 - RNA, 19 nt, Human
aggcagaggagggggcggg

SEQ ID NO: 991941 - RNA, 21 nt, Human
aggcagaggagggggcggggg

SEQ ID NO: 991942 - RNA, 24 nt, Human
aggcagaggagggggcggggggcc

SEQ ID NO: 991943 - RNA, 24 nt, Human
aggccagcuccccugggcuccuuc

SEQ ID NO: 991944 - RNA, 21 nt, Human
aggggaacaagccccaccccc

SEQ ID NO: 991945 - RNA, 19 nt, Human
auagaaaucuggcugcaga

SEQ ID NO: 991946 - RNA, 19 nt, Human
auccuguccacccagcccc

SEQ ID NO: 991947 - RNA, 24 nt, Human
auuagugaacuaagaacagcguca

SEQ ID NO: 991948 - RNA, 20 nt, Human
caaaaaaaaaaauauucuuc

SEQ ID NO: 991949 - RNA, 21 nt, Human
caagccccaccccccaccccc

SEQ ID NO: 991950 - RNA, 22 nt, Human
caagccccaccccccacccccc

SEQ ID NO: 991951 - RNA, 23 nt, Human
caagccccaccccccaccccccc

SEQ ID NO: 991952 - RNA, 25 nt, Human
caagccccaccccccaccccccccc

SEQ ID NO: 991953 - RNA, 18 nt, Human
cacacguggccaucaggu

SEQ ID NO: 991954 - RNA, 21 nt, Human
cacagccacaaaccgcuguuc

SEQ ID NO: 991955 - RNA, 25 nt, Human
cacccagccccagccccaccugacu

SEQ ID NO: 991956 - RNA, 18 nt, Human
cacccccacccuucccca

SEQ ID NO: 991957 - RNA, 21 nt, Human
caccccccaccccccccagcu

SEQ ID NO: 991958 - RNA, 18 nt, Human
caccccccauuuccagcu

SEQ ID NO: 991959 - RNA, 22 nt, Human
cagaguuucuggcaaagccaug

SEQ ID NO: 991960 - RNA, 19 nt, Human
cagcagccucccguggcca

SEQ ID NO: 991961 - RNA, 21 nt, Human
cagcagccucccguggccaag

SEQ ID NO: 991962 - RNA, 18 nt, Human
cagccaccgcgcugugcu

SEQ ID NO: 991963 - RNA, 21 nt, Human
cagcgguggcggcggcugggc

SEQ ID NO: 991964 - RNA, 19 nt, Human
cagcucuaagucaggaagc

SEQ ID NO: 991965 - RNA, 20 nt, Human
caggcccacccccacccuuc

SEQ ID NO: 991966 - RNA, 20 nt, Human
caggggaacaagccccaccc

SEQ ID NO: 991967 - RNA, 20 nt, Human
caguacaaggugucuggcug

SEQ ID NO: 991968 - RNA, 18 nt, Human
ccaccccccacccccccc

SEQ ID NO: 991969 - RNA, 18 nt, Human
ccagcugcugcucccagg

SEQ ID NO: 991970 - RNA, 18 nt, Human
ccagcuggaaggggcaga

SEQ ID NO: 991971 - RNA, 19 nt, Human
ccaguacaaggugucuggc

SEQ ID NO: 991972 - RNA, 24 nt, Human
ccaugcucaaaaaaaaaaauauuc

SEQ ID NO: 991973 - RNA, 20 nt, Human
ccauucgccacaucuggucc

SEQ ID NO: 991974 - RNA, 19 nt, Human
cccacccccacccuucccc

SEQ ID NO: 991975 - RNA, 21 nt, Human
cccacccccacccuuccccac

SEQ ID NO: 991976 - RNA, 19 nt, Human
cccaccccccacccccccc

SEQ ID NO: 991977 - RNA, 20 nt, Human
cccaccccccacccccccca

SEQ ID NO: 991978 - RNA, 20 nt, Human
ccccaccccccacccccccc

SEQ ID NO: 991979 - RNA, 20 nt, Human
ccccaccccccacccccccc

SEQ ID NO: 991980 - RNA, 22 nt, Human
ccccaccccccaccccccccag

SEQ ID NO: 991981 - RNA, 25 nt, Human
ccccaccccccaccccccccagcuc

SEQ ID NO: 991982 - RNA, 18 nt, Human
ccccaccccccccagcuc

SEQ ID NO: 991983 - RNA, 18 nt, Human
ccccagcugcugcuccca

SEQ ID NO: 991984 - RNA, 23 nt, Human
ccccaggccagcuccccugggcu

SEQ ID NO: 991985 - RNA, 23 nt, Human
cccccaccccccauuuccagcuc

SEQ ID NO: 991986 - RNA, 21 nt, Human
ccccccaccccccccagcucu

SEQ ID NO: 991987 - RNA, 22 nt, Human
ccccuggaggcacgggcggcuc

SEQ ID NO: 991988 - RNA, 23 nt, Human
ccccugggcuccuucccauggcu

SEQ ID NO: 991989 - RNA, 23 nt, Human
cccguggccaaggcacacguggc

SEQ ID NO: 991990 - RNA, 19 nt, Human
ccguaugguggccaagggc

SEQ ID NO: 991991 - RNA, 25 nt, Human
ccucacccaccuggaucugaugcgg

SEQ ID NO: 991992 - RNA, 18 nt, Human
ccuccugcccucacccac

SEQ ID NO: 991993 - RNA, 18 nt, Human
ccucuuggccccuggagg

SEQ ID NO: 991994 - RNA, 19 nt, Human
ccuguccacccagccccag

SEQ ID NO: 991995 - RNA, 18 nt, Human
cggcggcagcgguggcgg

SEQ ID NO: 991996 - RNA, 27 nt, Human
cggcggcggcagcgguggcggcggcug

SEQ ID NO: 991997 - RNA, 20 nt, Human
cggguuccacucuggugggu

SEQ ID NO: 991998 - RNA, 24 nt, Human
cguggccaaucucagcagccuccc

SEQ ID NO: 991999 - RNA, 22 nt, Human
cuaaaacugagcucuaggcuau

SEQ ID NO: 992000 - RNA, 18 nt, Human
cuaaagaaaggaaacgga

SEQ ID NO: 992001 - RNA, 21 nt, Human
cuaggaccacugggacugcuc

SEQ ID NO: 992002 - RNA, 24 nt, Human
cucaccuaccagagcaaauaucac

SEQ ID NO: 992003 - RNA, 19 nt, Human
cugauccuguccacccagc

SEQ ID NO: 992004 - RNA, 22 nt, Human
cugggcagaccuggccccucug

SEQ ID NO: 992005 - RNA, 22 nt, Human
cugggcuuucaagggaauccug

SEQ ID NO: 992006 - RNA, 18 nt, Human
gaacaagccccacccccc

SEQ ID NO: 992007 - RNA, 25 nt, Human
gaacaagccccaccccccacccccc

SEQ ID NO: 992008 - RNA, 21 nt, Human
gaacaugggcuucgcuccccc

SEQ ID NO: 992009 - RNA, 20 nt, Human
gaauggcagaccagagccgg

SEQ ID NO: 992010 - RNA, 19 nt, Human
gagcaugacuuccuauuuc

SEQ ID NO: 992011 - RNA, 20 nt, Human
gaggagggggcggggggccc

SEQ ID NO: 992012 - RNA, 18 nt, Human
gauccuguguagaaaagg

SEQ ID NO: 992013 - RNA, 23 nt, Human
gcagaccuggccccucugcccug

SEQ ID NO: 992014 - RNA, 18 nt, Human
gcagcaggcagaggaggg

SEQ ID NO: 992015 - RNA, 24 nt, Human
gcagcgguggcggcggcugggccc

SEQ ID NO: 992016 - RNA, 21 nt, Human
gcagcuuccccagcugcugcu

SEQ ID NO: 992017 - RNA, 23 nt, Human
gccagugugcagacccagccacc

SEQ ID NO: 992018 - RNA, 20 nt, Human
gcccacccccacccuucccc

SEQ ID NO: 992019 - RNA, 18 nt, Human
gccccgcucugaggaggc

SEQ ID NO: 992020 - RNA, 22 nt, Human
gccccuggaggcacgggcggcu

SEQ ID NO: 992021 - RNA, 18 nt, Human
gcccuggggagggccggg

SEQ ID NO: 992022 - RNA, 20 nt, Human
gcggcggcagcgguggcggc

SEQ ID NO: 992023 - RNA, 27 nt, Human
gcggcggcggagcucggcggcggcagc

SEQ ID NO: 992024 - RNA, 19 nt, Human
gcgguggcggcggcugggc

SEQ ID NO: 992025 - RNA, 19 nt, Human
gcucugaggaggcgguggc

SEQ ID NO: 992026 - RNA, 21 nt, Human
ggaacaagccccaccccccac

SEQ ID NO: 992027 - RNA, 18 nt, Human
ggacugcucacccugccu

SEQ ID NO: 992028 - RNA, 24 nt, Human
ggagaaauguacccucaggcccuc

SEQ ID NO: 992029 - RNA, 18 nt, Human
ggaggcgguggcggcggc

SEQ ID NO: 992030 - RNA, 19 nt, Human
ggcggcagcgguggcggcg

SEQ ID NO: 992031 - RNA, 18 nt, Human
ggcugccuccacgcagca

SEQ ID NO: 992032 - RNA, 18 nt, Human
gggcagauccacgcugcc

SEQ ID NO: 992033 - RNA, 21 nt, Human
gggcggggggcccuggggagg

SEQ ID NO: 992034 - RNA, 23 nt, Human
gggcggggggcccuggggagggc

SEQ ID NO: 992035 - RNA, 22 nt, Human
ggggcggggggcccuggggagg

SEQ ID NO: 992036 - RNA, 18 nt, Human
gucugacgcgugcccagu

SEQ ID NO: 992037 - RNA, 19 nt, Human
gugggcggcagcuucccca

SEQ ID NO: 992038 - RNA, 26 nt, Human
uaaauccacuagccaugcucaaaaaa

SEQ ID NO: 992039 - RNA, 21 nt, Human
uaacauggggcaaccaggccc

SEQ ID NO: 992040 - RNA, 26 nt, Human
uaagaacagcgucacgugguggccau

SEQ ID NO: 992041 - RNA, 20 nt, Human
uaaguuugacuccagcagug

SEQ ID NO: 992042 - RNA, 20 nt, Human
uacaguaccaggauggcugg

SEQ ID NO: 992043 - RNA, 24 nt, Human
uagcaagucagguaaaaaaauuuc

SEQ ID NO: 992044 - RNA, 23 nt, Human
uagccaugcucaaaaaaaaaaau

SEQ ID NO: 992045 - RNA, 24 nt, Human
ucacgugguggccaugccuggccu

SEQ ID NO: 992046 - RNA, 23 nt, Human
ucacucucggagcugggccacag

SEQ ID NO: 992047 - RNA, 22 nt, Human
ucagcagccucccguggccaag

SEQ ID NO: 992048 - RNA, 19 nt, Human
uccacccagccccagcccc

SEQ ID NO: 992049 - RNA, 18 nt, Human
uccacucuggugggugga

SEQ ID NO: 992050 - RNA, 23 nt, Human
uccagccacguggccaaucucag

SEQ ID NO: 992051 - RNA, 21 nt, Human
ucccagcacuucuacugauuc

SEQ ID NO: 992052 - RNA, 21 nt, Human
uccccagcugcugcucccagc

SEQ ID NO: 992053 - RNA, 22 nt, Human
ucccccaccccccauuuccagc

SEQ ID NO: 992054 - RNA, 21 nt, Human
ucgccacaucugguccgugcc

SEQ ID NO: 992055 - RNA, 21 nt, Human
ucggcggcggcggagcucggc

SEQ ID NO: 992056 - RNA, 20 nt, Human
ucugaggaggcgguggcggc

SEQ ID NO: 992057 - RNA, 25 nt, Human
ucugguccgugccagaucccugcac

SEQ ID NO: 992058 - RNA, 20 nt, Human
ucuucgggaccagagcuugg

SEQ ID NO: 992059 - RNA, 22 nt, Human
ugaagaggugaaaggccgauca

SEQ ID NO: 992060 - RNA, 21 nt, Human
ugacagcagugguaaacgcug

SEQ ID NO: 992061 - RNA, 18 nt, Human
ugacuuccuauuucagua

SEQ ID NO: 992062 - RNA, 18 nt, Human
ugcgcaguugcagcugcu

SEQ ID NO: 992063 - RNA, 18 nt, Human
ugcucggcggcggcggag

SEQ ID NO: 992064 - RNA, 18 nt, Human
uggcuaaagaaaggaaac

SEQ ID NO: 992065 - RNA, 18 nt, Human
ugggaagagcaugacuuc

SEQ ID NO: 992066 - RNA, 19 nt, Human
ugggcagauccacgcugcc

SEQ ID NO: 992067 - RNA, 18 nt, Human
uggguggagggugggaag

SEQ ID NO: 992068 - RNA, 21 nt, Human
ugguggguggagggugggaag

SEQ ID NO: 992069 - RNA, 19 nt, Human
ugucccugggacguaugcu

SEQ ID NO: 992070 - RNA, 21 nt, Human
uguuuuauaaaaaggaaaguu

SEQ ID NO: 992071 - RNA, 19 nt, Human
uuaaggcuggggauuuugc

SEQ ID NO: 992072 - RNA, 23 nt, Human
uucaaagugagguuacuguuucu

SEQ ID NO: 992073 - RNA, 21 nt, Human
uucaaccaccaucaaccccua

SEQ ID NO: 992074 - RNA, 20 nt, Human
uucagcaggagaaaaaagaa

SEQ ID NO: 992075 - RNA, 22 nt, Human
uucuagacagauccaaacccac

SEQ ID NO: 992076 - RNA, 21 nt, Human
uugcaguugcagguguucagc

SEQ ID NO: 992077 - RNA, 23 nt, Human
uugcaguugcagguguucagcug

SEQ ID NO: 992078 - RNA, 23 nt, Human
uuugcaguugcagguguucagcu

SEQ ID NO: 992079 - RNA, 24 nt, Human
aacaguacaagugaaauauuuaaa

SEQ ID NO: 992080 - RNA, 18 nt, Human
aagaagaugcaaaaauca

SEQ ID NO: 992081 - RNA, 22 nt, Human
acacuguuucauccaauaagcc

SEQ ID NO: 992082 - RNA, 18 nt, Human
agaaaugaucugccuggc

SEQ ID NO: 992083 - RNA, 20 nt, Human
agcuacuacagugaaccccc

SEQ ID NO: 992084 - RNA, 21 nt, Human
aggagaaaugaucugccuggc

SEQ ID NO: 992085 - RNA, 19 nt, Human
caagacaagaacaguuacc

SEQ ID NO: 992086 - RNA, 25 nt, Human
cacguggaacauuuucuggcguccg

SEQ ID NO: 992087 - RNA, 20 nt, Human
cagcaacaguacaagugaaa

SEQ ID NO: 992088 - RNA, 19 nt, Human
cauuguacaguacuugaca

SEQ ID NO: 992089 - RNA, 18 nt, Human
cuacagugaaccccacgc

SEQ ID NO: 992090 - RNA, 23 nt, Human
cuugacaauacauuucaacaaac

SEQ ID NO: 992091 - RNA, 23 nt, Human
gcaagacaagaacaguuaccuuc

SEQ ID NO: 992092 - RNA, 23 nt, Human
gccaggucaagcggaaguaaaac

SEQ ID NO: 992093 - RNA, 22 nt, Human
uaggaaucugaaacaaaacgaa

SEQ ID NO: 992094 - RNA, 19 nt, Human
ucaacaaacugaaaggcaa

SEQ ID NO: 992095 - RNA, 18 nt, Human
ucaggcccgcuccaagaa

SEQ ID NO: 992096 - RNA, 19 nt, Human
ucaugucauaguuuccaaa

SEQ ID NO: 992097 - RNA, 25 nt, Human
ucuaaaaagcuuaaaucauauuaaa

SEQ ID NO: 992098 - RNA, 22 nt, Human
ugaaaggcaaaccaguaaauca

SEQ ID NO: 992099 - RNA, 24 nt, Human
ugaucaaauccacaauuaauugaa

SEQ ID NO: 992100 - RNA, 20 nt, Human
uuucauuuuauucaauugug

SEQ ID NO: 992101 - RNA, 21 nt, Human
uuuuuuuuuuuuuuuuuauuu

SEQ ID NO: 992102 - RNA, 26 nt, Human
aagagaagauggaaaugaggggaccc

SEQ ID NO: 992103 - RNA, 25 nt, Human
aagagcuauuucuuaugcuguaccu

SEQ ID NO: 992104 - RNA, 24 nt, Human
aauggagaaaggcaaugaccaccu

SEQ ID NO: 992105 - RNA, 24 nt, Human
acagagcauaauugcauagcacca

SEQ ID NO: 992106 - RNA, 20 nt, Human
acuccguagucaaagaagaa

SEQ ID NO: 992107 - RNA, 22 nt, Human
acuuucugucucugggcuuucu

SEQ ID NO: 992108 - RNA, 23 nt, Human
agagcauaauugcauagcaccag

SEQ ID NO: 992109 - RNA, 22 nt, Human
caaacagcaccaaauuauaauc

SEQ ID NO: 992110 - RNA, 25 nt, Human
caaagcaacauaugaaacacagagc

SEQ ID NO: 992111 - RNA, 23 nt, Human
ccaaagcaacauaugaaacacag

SEQ ID NO: 992112 - RNA, 20 nt, Human
ccaaguugcugcuuuuaaaa

SEQ ID NO: 992113 - RNA, 23 nt, Human
cuuuaagaaaaaaaauaagccaa

SEQ ID NO: 992114 - RNA, 22 nt, Human
cuuucugucucugggcuuucug

SEQ ID NO: 992115 - RNA, 18 nt, Human
gcaacauaugaaacacag

SEQ ID NO: 992116 - RNA, 19 nt, Human
gcgaauucuucuguugcuu

SEQ ID NO: 992117 - RNA, 22 nt, Human
gugaaaguugaagagaagaugg

SEQ ID NO: 992118 - RNA, 20 nt, Human
uacuuucugucucugggcuu

SEQ ID NO: 992119 - RNA, 24 nt, Human
ucuguagcugaggccuugcagaac

SEQ ID NO: 992120 - RNA, 21 nt, Human
ucuucuguugcuucuaucagu

SEQ ID NO: 992121 - RNA, 21 nt, Human
ugaaaguugaagagaagaugg

SEQ ID NO: 992122 - RNA, 20 nt, Human
ugaacaacacauuccuuuaa

SEQ ID NO: 992123 - RNA, 24 nt, Human
ugaacaacacauuccuuuaagaaa

SEQ ID NO: 992124 - RNA, 24 nt, Human
ugaggccuugcagaacuuuccagg

SEQ ID NO: 992125 - RNA, 20 nt, Human
uggagaaaggcaaugaccac

SEQ ID NO: 992126 - RNA, 20 nt, Human
uuaacacuuugcagucauua

SEQ ID NO: 992127 - RNA, 21 nt, Human
uuaacacuuugcagucauuag

SEQ ID NO: 992128 - RNA, 20 nt, Human
aagcugccaccagagacuaa

SEQ ID NO: 992129 - RNA, 22 nt, Human
aauuauaucuggauccuuggug

SEQ ID NO: 992130 - RNA, 21 nt, Human
agaagcugccaccagagacua

SEQ ID NO: 992131 - RNA, 22 nt, Human
agagaacuccuuugccaggaaa

SEQ ID NO: 992132 - RNA, 20 nt, Human
aggaaagaacaucaacuugg

SEQ ID NO: 992133 - RNA, 22 nt, Human
caagucucugacugguucugga

SEQ ID NO: 992134 - RNA, 18 nt, Human
cccuagguuccacugcuc

SEQ ID NO: 992135 - RNA, 22 nt, Human
cccugugcaaaagcuagaacag

SEQ ID NO: 992136 - RNA, 18 nt, Human
ccgcuccuacaccagaac

SEQ ID NO: 992137 - RNA, 19 nt, Human
ccuacaccagaacccggaa

SEQ ID NO: 992138 - RNA, 21 nt, Human
ccucaugaccuggccugaugu

SEQ ID NO: 992139 - RNA, 23 nt, Human
ccucuuaggggcaagucucugac

SEQ ID NO: 992140 - RNA, 22 nt, Human
ccuugaaaucaucaggaacaag

SEQ ID NO: 992141 - RNA, 21 nt, Human
cucaguguuggcugagguaga

SEQ ID NO: 992142 - RNA, 21 nt, Human
cugcuauggaggaacuacaga

SEQ ID NO: 992143 - RNA, 24 nt, Human
cuucacaauacauggacauauuua

SEQ ID NO: 992144 - RNA, 20 nt, Human
cuucugcuacugacugaacu

SEQ ID NO: 992145 - RNA, 23 nt, Human
cuugaauuuuucugcucagauuu

SEQ ID NO: 992146 - RNA, 25 nt, Human
cuugaauuuuucugcucagauuuua

SEQ ID NO: 992147 - RNA, 24 nt, Human
gagaagacgccgcuccuacaccag

SEQ ID NO: 992148 - RNA, 21 nt, Human
gagugcuagaagucaggccuc

SEQ ID NO: 992149 - RNA, 19 nt, Human
gcuauggaggaacuacaga

SEQ ID NO: 992150 - RNA, 19 nt, Human
guggucccuagguuccacu

SEQ ID NO: 992151 - RNA, 21 nt, Human
uacaucccucuuaggggcaag

SEQ ID NO: 992152 - RNA, 21 nt, Human
uaccucuguccacugguuccc

SEQ ID NO: 992153 - RNA, 20 nt, Human
uagaagcugccaccagagac

SEQ ID NO: 992154 - RNA, 20 nt, Human
uagggcucaaacucaggagu

SEQ ID NO: 992155 - RNA, 21 nt, Human
ucaaacucaggagugcuagaa

SEQ ID NO: 992156 - RNA, 20 nt, Human
uccagcguaccaaauucagc

SEQ ID NO: 992157 - RNA, 22 nt, Human
uccaugauauccacuguccuug

SEQ ID NO: 992158 - RNA, 19 nt, Human
ucccuagguuccacugcuc

SEQ ID NO: 992159 - RNA, 21 nt, Human
uccuuggggcgcccaauucau

SEQ ID NO: 992160 - RNA, 18 nt, Human
ugaaaucaucaggaacaa

SEQ ID NO: 992161 - RNA, 19 nt, Human
ugacaaguaaaguggaaau

SEQ ID NO: 992162 - RNA, 18 nt, Human
ugacugaacucguuguga

SEQ ID NO: 992163 - RNA, 18 nt, Human
ugaguaaagaaguuaccc

SEQ ID NO: 992164 - RNA, 19 nt, Human
ugauauccacuguccuugg

SEQ ID NO: 992165 - RNA, 19 nt, Human
ugccaggaaagaacaucaa

SEQ ID NO: 992166 - RNA, 20 nt, Human
ugccaggaaagaacaucaac

SEQ ID NO: 992167 - RNA, 21 nt, Human
uggucccuagguuccacugcu

SEQ ID NO: 992168 - RNA, 23 nt, Human
ugugcaaaagcauuuaaaucaaa

SEQ ID NO: 992169 - RNA, 24 nt, Human
uuaaugcaucucuuaguuuuuucc

SEQ ID NO: 992170 - RNA, 19 nt, Human
uuucgggaagaaccagauu

SEQ ID NO: 992171 - RNA, 23 nt, Human
uuuuuauacuugaauuuuucugc

SEQ ID NO: 992172 - RNA, 20 nt, Human
agccguucgcaaaacuacuu

SEQ ID NO: 992173 - RNA, 18 nt, Human
ccggccacagcgauucuc

SEQ ID NO: 992174 - RNA, 19 nt, Human
ccggccacagcgauucucu

SEQ ID NO: 992175 - RNA, 19 nt, Human
ccuccggaagccccgggcc

SEQ ID NO: 992176 - RNA, 21 nt, Human
ccuccucgcggcuuaccgccu

SEQ ID NO: 992177 - RNA, 22 nt, Human
cgcaaaacuacuugucccauca

SEQ ID NO: 992178 - RNA, 18 nt, Human
cgccuagugccaggugcu

SEQ ID NO: 992179 - RNA, 18 nt, Human
cgugaguccuuuccuccu

SEQ ID NO: 992180 - RNA, 20 nt, Human
cuccgccuagugccaggugc

SEQ ID NO: 992181 - RNA, 19 nt, Human
cuucuugucucgacgcccc

SEQ ID NO: 992182 - RNA, 18 nt, Human
gaccucuucaaucaguag

SEQ ID NO: 992183 - RNA, 22 nt, Human
gccccgggccucagagcuuccg

SEQ ID NO: 992184 - RNA, 23 nt, Human
ggacgugaguccuuuccuccucg

SEQ ID NO: 992185 - RNA, 23 nt, Human
ucagcagccgaggacggcgggac

SEQ ID NO: 992186 - RNA, 19 nt, Human
uccacagcgggacgugagu

SEQ ID NO: 992187 - RNA, 23 nt, Human
ucguccggccacagcgauucucu

SEQ ID NO: 992188 - RNA, 23 nt, Human
acagaacagugagggugcaggga

SEQ ID NO: 992189 - RNA, 18 nt, Human
acagugagggugcaggga

SEQ ID NO: 992190 - RNA, 19 nt, Human
agagcaaggccucgggguc

SEQ ID NO: 992191 - RNA, 20 nt, Human
agagcaaggccucggggucu

SEQ ID NO: 992192 - RNA, 22 nt, Human
agaguggaggcccgcacgggag

SEQ ID NO: 992193 - RNA, 21 nt, Human
agggugcagggagcaaggacg

SEQ ID NO: 992194 - RNA, 18 nt, Human
agguagaaaaagugcaca

SEQ ID NO: 992195 - RNA, 19 nt, Human
caagcacaaacccagccuc

SEQ ID NO: 992196 - RNA, 20 nt, Human
ccuccgggggagagggcgag

SEQ ID NO: 992197 - RNA, 20 nt, Human
ccucggggucuggaggaccc

SEQ ID NO: 992198 - RNA, 18 nt, Human
cgggagggcgcggccucc

SEQ ID NO: 992199 - RNA, 21 nt, Human
cggggcucuccaguggguggg

SEQ ID NO: 992200 - RNA, 21 nt, Human
gccucccgcucugagagcaag

SEQ ID NO: 992201 - RNA, 26 nt, Human
gcuggaauugcaaggacccuccccca

SEQ ID NO: 992202 - RNA, 18 nt, Human
ggacccggcuuuuccggg

SEQ ID NO: 992203 - RNA, 20 nt, Human
gggcgcggccuccgggggag

SEQ ID NO: 992204 - RNA, 19 nt, Human
ggucuggaggacccggcuu

SEQ ID NO: 992205 - RNA, 21 nt, Human
ucgcuggaauugcaaggaccc

SEQ ID NO: 992206 - RNA, 21 nt, Human
ugagggugcagggagcaagga

SEQ ID NO: 992207 - RNA, 20 nt, Human
uuccgggagggcgcggccuc

SEQ ID NO: 992208 - RNA, 19 nt, Human
uuuuuuuuuuuagaggugg

SEQ ID NO: 992209 - RNA, 18 nt, Human
uuuuuuuuuuuuagaggu

SEQ ID NO: 992210 - RNA, 22 nt, Human
uuuuuuuuuuuuuuuuuagagg

SEQ ID NO: 992211 - RNA, 20 nt, Human
aaaaagaaaaaaaaaaaucc

SEQ ID NO: 992212 - RNA, 24 nt, Human
aaaaagaaaacaguuuagcaaaaa

SEQ ID NO: 992213 - RNA, 20 nt, Human
aaacaaacaaaaaacaaaaa

SEQ ID NO: 992214 - RNA, 23 nt, Human
aaacaaacaaaaaacaaaaaaca

SEQ ID NO: 992215 - RNA, 24 nt, Human
aaacaaacaaacaaacaaaaaaca

SEQ ID NO: 992216 - RNA, 23 nt, Human
aaaccaaacaccuuuugaucuua

SEQ ID NO: 992217 - RNA, 20 nt, Human
aaaccaaaccaaugauaaaa

SEQ ID NO: 992218 - RNA, 20 nt, Human
aaacggaaacccaggacagc

SEQ ID NO: 992219 - RNA, 24 nt, Human
aaagaggcugggcgugguggcuca

SEQ ID NO: 992220 - RNA, 26 nt, Human
aacaaacaaacaaaaaacaaaaaaca

SEQ ID NO: 992221 - RNA, 18 nt, Human
aaccagaauucagcagca

SEQ ID NO: 992222 - RNA, 19 nt, Human
aaccuuuucuccuugugcc

SEQ ID NO: 992223 - RNA, 20 nt, Human
aagauggugaaaccccgucu

SEQ ID NO: 992224 - RNA, 18 nt, Human
aagcagcagaagcagcag

SEQ ID NO: 992225 - RNA, 23 nt, Human
aaugauaaaacaaccauuuggaa

SEQ ID NO: 992226 - RNA, 22 nt, Human
aauugcuugaacccgggcugga

SEQ ID NO: 992227 - RNA, 25 nt, Human
acaaaaaacaaaacagcaaaagaaa

SEQ ID NO: 992228 - RNA, 22 nt, Human
acaaacaaacaaacaaaaaaca

SEQ ID NO: 992229 - RNA, 19 nt, Human
acagaaacagcacaggggc

SEQ ID NO: 992230 - RNA, 23 nt, Human
acagagcaugacucugucucaaa

SEQ ID NO: 992231 - RNA, 24 nt, Human
acagagcaugacucugucucaaaa

SEQ ID NO: 992232 - RNA, 18 nt, Human
accaaacccaagcagagu

SEQ ID NO: 992233 - RNA, 19 nt, Human
acccacccaaaaaaacuac

SEQ ID NO: 992234 - RNA, 18 nt, Human
accccgucucuacuaaaa

SEQ ID NO: 992235 - RNA, 19 nt, Human
acccgggcuggaguacagu

SEQ ID NO: 992236 - RNA, 23 nt, Human
acucagaaguuggggagccucug

SEQ ID NO: 992237 - RNA, 24 nt, Human
acugcacuccagcccgggugacag

SEQ ID NO: 992238 - RNA, 26 nt, Human
acugcacuccagcccgggugacagag

SEQ ID NO: 992239 - RNA, 18 nt, Human
acugcagagacuuagcug

SEQ ID NO: 992240 - RNA, 22 nt, Human
agaaaaaaaagaaaaaaaaaaa

SEQ ID NO: 992241 - RNA, 18 nt, Human
agagcaugacucugucuc

SEQ ID NO: 992242 - RNA, 18 nt, Human
agagggcacgggaggaag

SEQ ID NO: 992243 - RNA, 22 nt, Human
agcaaaaaucuaaacauucaac

SEQ ID NO: 992244 - RNA, 24 nt, Human
agcaaaaaucuaaacauucaacug

SEQ ID NO: 992245 - RNA, 24 nt, Human
agcaaaagaaaaaaugggggaaag

SEQ ID NO: 992246 - RNA, 20 nt, Human
agcaaugaaacagcaaaaga

SEQ ID NO: 992247 - RNA, 19 nt, Human
agcacaggggcagcuugga

SEQ ID NO: 992248 - RNA, 23 nt, Human
agccagacaugguggcgggugcc

SEQ ID NO: 992249 - RNA, 24 nt, Human
agccuggccaagauggugaaaccc

SEQ ID NO: 992250 - RNA, 27 nt, Human
aggaggcuucuaacccuuuuccagccc

SEQ ID NO: 992251 - RNA, 23 nt, Human
aggcaaauaauugcuugaacccg

SEQ ID NO: 992252 - RNA, 18 nt, Human
aggcaacacagagagccc

SEQ ID NO: 992253 - RNA, 24 nt, Human
aggcaacacagagagcccaggaaa

SEQ ID NO: 992254 - RNA, 18 nt, Human
aggcauccugcagcaguu

SEQ ID NO: 992255 - RNA, 23 nt, Human
aggcugaggcaaauaauugcuug

SEQ ID NO: 992256 - RNA, 21 nt, Human
agggaaaaacacuaaagaaaa

SEQ ID NO: 992257 - RNA, 23 nt, Human
aggucaggaguuccaagaccagc

SEQ ID NO: 992258 - RNA, 18 nt, Human
agugcaguggugccagcu

SEQ ID NO: 992259 - RNA, 20 nt, Human
aucgcaccacugcacuccag

SEQ ID NO: 992260 - RNA, 22 nt, Human
augcagugcacucucguucccc

SEQ ID NO: 992261 - RNA, 22 nt, Human
auggcuucagggaucuucccag

SEQ ID NO: 992262 - RNA, 24 nt, Human
augggccccucuaauccaaguugc

SEQ ID NO: 992263 - RNA, 24 nt, Human
auuaaaagaaaaaccaaacaccuu

SEQ ID NO: 992264 - RNA, 20 nt, Human
caaaaaaagggaaaaagaaa

SEQ ID NO: 992265 - RNA, 22 nt, Human
caaaaaacaaaaaacaaaacag

SEQ ID NO: 992266 - RNA, 23 nt, Human
caaaacggaaacccaggacagcu

SEQ ID NO: 992267 - RNA, 25 nt, Human
caaaacggaaacccaggacagcugg

SEQ ID NO: 992268 - RNA, 25 nt, Human
caaaagacaaaaaaguuauuuacag

SEQ ID NO: 992269 - RNA, 24 nt, Human
caaacaaacaaaaaacaaaaaaca

SEQ ID NO: 992270 - RNA, 27 nt, Human
caaacaaacaaaaaacaaaaaacaaaa

SEQ ID NO: 992271 - RNA, 20 nt, Human
caaacaaacaaacaaaaaac

SEQ ID NO: 992272 - RNA, 18 nt, Human
caaaccaaugauaaaaca

SEQ ID NO: 992273 - RNA, 19 nt, Human
caaaccacagcaaaaaaag

SEQ ID NO: 992274 - RNA, 24 nt, Human
caaccaaacccaagcagagucugc

SEQ ID NO: 992275 - RNA, 26 nt, Human
caaccaaacccaagcagagucugccc

SEQ ID NO: 992276 - RNA, 23 nt, Human
caaccauuuggaauuucacacua

SEQ ID NO: 992277 - RNA, 24 nt, Human
caagauggugaaaccccgucucua

SEQ ID NO: 992278 - RNA, 23 nt, Human
cacaccuggcuugacagaaacag

SEQ ID NO: 992279 - RNA, 21 nt, Human
cacagcaaaaaaagggaaaaa

SEQ ID NO: 992280 - RNA, 26 nt, Human
caccacugcacuccagcccgggugac

SEQ ID NO: 992281 - RNA, 22 nt, Human
cacccaaaaaaacuacaauaaa

SEQ ID NO: 992282 - RNA, 22 nt, Human
cacuccagcccgggugacagag

SEQ ID NO: 992283 - RNA, 22 nt, Human
cacucucguuccccacaccugg

SEQ ID NO: 992284 - RNA, 19 nt, Human
cacugcacuccagcccggg

SEQ ID NO: 992285 - RNA, 21 nt, Human
cacugcacuccagcccgggug

SEQ ID NO: 992286 - RNA, 23 nt, Human
cacugcacuccagcccgggugac

SEQ ID NO: 992287 - RNA, 24 nt, Human
cacugcacuccagcccgggugaca

SEQ ID NO: 992288 - RNA, 25 nt, Human
cacugcacuccagcccgggugacag

SEQ ID NO: 992289 - RNA, 18 nt, Human
cacugggcaggggcuucu

SEQ ID NO: 992290 - RNA, 19 nt, Human
cagaaacagcacaggggca

SEQ ID NO: 992291 - RNA, 21 nt, Human
cagagucagcagaggagaggg

SEQ ID NO: 992292 - RNA, 18 nt, Human
cagcaaaaaaagggaaaa

SEQ ID NO: 992293 - RNA, 19 nt, Human
cagcaaaagaggcugggcg

SEQ ID NO: 992294 - RNA, 20 nt, Human
cagcacaggggcagcuugga

SEQ ID NO: 992295 - RNA, 22 nt, Human
cagcagaagcagcagcaccaug

SEQ ID NO: 992296 - RNA, 25 nt, Human
cagcagcaccaugcuugucuccgau

SEQ ID NO: 992297 - RNA, 22 nt, Human
cagcaguggacaccauuccugc

SEQ ID NO: 992298 - RNA, 19 nt, Human
cagccccaccuucucugaa

SEQ ID NO: 992299 - RNA, 21 nt, Human
cauuuuacauaauggggaaau

SEQ ID NO: 992300 - RNA, 22 nt, Human
ccaaaacggaaacccaggacag

SEQ ID NO: 992301 - RNA, 25 nt, Human
ccacccaaaaaaacuacaauaaaaa

SEQ ID NO: 992302 - RNA, 20 nt, Human
ccacugcacuccagcccggg

SEQ ID NO: 992303 - RNA, 21 nt, Human
ccacugcacuccagcccgggu

SEQ ID NO: 992304 - RNA, 24 nt, Human
ccacugcacuccagcccgggugac

SEQ ID NO: 992305 - RNA, 25 nt, Human
ccacugcacuccagcccgggugaca

SEQ ID NO: 992306 - RNA, 21 nt, Human
ccagaguucccuacuacaggc

SEQ ID NO: 992307 - RNA, 23 nt, Human
ccagaguucccuacuacaggcau

SEQ ID NO: 992308 - RNA, 18 nt, Human
ccagcagauggcucacuu

SEQ ID NO: 992309 - RNA, 23 nt, Human
ccagugacacuacucaggacaaa

SEQ ID NO: 992310 - RNA, 19 nt, Human
ccauuccugcuuuccccaa

SEQ ID NO: 992311 - RNA, 20 nt, Human
cccaaaaaaacuacaauaaa

SEQ ID NO: 992312 - RNA, 18 nt, Human
cccaaaguuuccugccac

SEQ ID NO: 992313 - RNA, 21 nt, Human
cccagaaaguacagaacacau

SEQ ID NO: 992314 - RNA, 19 nt, Human
ccccaaaguuuccugccac

SEQ ID NO: 992315 - RNA, 24 nt, Human
ccccacccacccaaaaaaacuaca

SEQ ID NO: 992316 - RNA, 25 nt, Human
ccccacccacccaaaaaaacuacaa

SEQ ID NO: 992317 - RNA, 20 nt, Human
cccccacccacccaaaaaaa

SEQ ID NO: 992318 - RNA, 23 nt, Human
ccccgucucuacuaaaagccaga

SEQ ID NO: 992319 - RNA, 18 nt, Human
cccggccugacacucggc

SEQ ID NO: 992320 - RNA, 19 nt, Human
ccuauaaucccagcuacuc

SEQ ID NO: 992321 - RNA, 21 nt, Human
ccuauaaucccagcuacucgg

SEQ ID NO: 992322 - RNA, 22 nt, Human
ccuauaaucccagcuacucggg

SEQ ID NO: 992323 - RNA, 23 nt, Human
ccucaguggcagugguggguccu

SEQ ID NO: 992324 - RNA, 22 nt, Human
ccugaccagcagauggcucacu

SEQ ID NO: 992325 - RNA, 18 nt, Human
ccugagcccagcccagga

SEQ ID NO: 992326 - RNA, 23 nt, Human
ccuggccaagauggugaaacccc

SEQ ID NO: 992327 - RNA, 24 nt, Human
ccuggccaagauggugaaaccccg

SEQ ID NO: 992328 - RNA, 18 nt, Human
ccuucagcgauccguuca

SEQ ID NO: 992329 - RNA, 23 nt, Human
ccuugugccugaccuggugauuu

SEQ ID NO: 992330 - RNA, 21 nt, Human
cgcaccacugcacuccagccc

SEQ ID NO: 992331 - RNA, 21 nt, Human
cggcgcggggcgucccggcgg

SEQ ID NO: 992332 - RNA, 20 nt, Human
cgggaggcugaggcaaauaa

SEQ ID NO: 992333 - RNA, 21 nt, Human
cgggaggcugaggcaaauaau

SEQ ID NO: 992334 - RNA, 19 nt, Human
cgggcuggaguacagugag

SEQ ID NO: 992335 - RNA, 20 nt, Human
cucaaaaaaacaaacaaaca

SEQ ID NO: 992336 - RNA, 19 nt, Human
cucagugcacuggggggag

SEQ ID NO: 992337 - RNA, 23 nt, Human
cugagcccagcccaggaaaccag

SEQ ID NO: 992338 - RNA, 27 nt, Human
cugcagcaguugcaccagaccugggcu

SEQ ID NO: 992339 - RNA, 18 nt, Human
cugcccccugcuguggcu

SEQ ID NO: 992340 - RNA, 22 nt, Human
cugcggcagacaagccaaugcg

SEQ ID NO: 992341 - RNA, 22 nt, Human
cugcuguggcuuucuacccuuc

SEQ ID NO: 992342 - RNA, 21 nt, Human
cuguggcuuucuacccuucug

SEQ ID NO: 992343 - RNA, 22 nt, Human
cuuccuguugaagaccucugga

SEQ ID NO: 992344 - RNA, 22 nt, Human
gaaccaaaacggaaacccagga

SEQ ID NO: 992345 - RNA, 21 nt, Human
gaagaggcugggcaaauggca

SEQ ID NO: 992346 - RNA, 23 nt, Human
gaaggcaguuccuccgcagcagu

SEQ ID NO: 992347 - RNA, 20 nt, Human
gacugcccccugcuguggcu

SEQ ID NO: 992348 - RNA, 21 nt, Human
gcaacagaugggcgacucaga

SEQ ID NO: 992349 - RNA, 25 nt, Human
gcaaugaaacagcaaaagaggcugg

SEQ ID NO: 992350 - RNA, 20 nt, Human
gcaccacugcacuccagccc

SEQ ID NO: 992351 - RNA, 18 nt, Human
gcacgggaggaagaagcc

SEQ ID NO: 992352 - RNA, 24 nt, Human
gcacuccagcccgggugacagagc

SEQ ID NO: 992353 - RNA, 24 nt, Human
gccaagauggugaaaccccgucuc

SEQ ID NO: 992354 - RNA, 24 nt, Human
gcucacugacagggcugggaugga

SEQ ID NO: 992355 - RNA, 18 nt, Human
gcucccucaccacccucc

SEQ ID NO: 992356 - RNA, 20 nt, Human
gcugagaucgcaccacugca

SEQ ID NO: 992357 - RNA, 20 nt, Human
gcuggaacaaagguguccca

SEQ ID NO: 992358 - RNA, 25 nt, Human
gcuggaguacagugagcugagaucg

SEQ ID NO: 992359 - RNA, 19 nt, Human
gcugggcgugguggcucac

SEQ ID NO: 992360 - RNA, 20 nt, Human
gcuguggcuuucuacccuuc

SEQ ID NO: 992361 - RNA, 22 nt, Human
gcuguggcuuucuacccuucug

SEQ ID NO: 992362 - RNA, 21 nt, Human
gcuuaaaaaaacaaaaaaaaa

SEQ ID NO: 992363 - RNA, 23 nt, Human
gcuucuaacccuuuuccagcccc

SEQ ID NO: 992364 - RNA, 21 nt, Human
ggaguacagugagcugagauc

SEQ ID NO: 992365 - RNA, 22 nt, Human
ggaguacagugagcugagaucg

SEQ ID NO: 992366 - RNA, 20 nt, Human
ggccaagauggugaaacccc

SEQ ID NO: 992367 - RNA, 23 nt, Human
ggcccccaucacagugcaguggu

SEQ ID NO: 992368 - RNA, 20 nt, Human
ggcucacgaggucaggaguu

SEQ ID NO: 992369 - RNA, 18 nt, Human
ggcuggaguacagugagc

SEQ ID NO: 992370 - RNA, 22 nt, Human
ggcuggaguacagugagcugag

SEQ ID NO: 992371 - RNA, 23 nt, Human
ggcuucuaacccuuuuccagccc

SEQ ID NO: 992372 - RNA, 20 nt, Human
gggaaaugccaaccagaauu

SEQ ID NO: 992373 - RNA, 22 nt, Human
gggagcggggggcgccgggggc

SEQ ID NO: 992374 - RNA, 19 nt, Human
gggauggaagaggcugggc

SEQ ID NO: 992375 - RNA, 21 nt, Human
gggcaaaaguguucaagaaca

SEQ ID NO: 992376 - RNA, 20 nt, Human
gggcaaauggcagcaucagu

SEQ ID NO: 992377 - RNA, 18 nt, Human
gggcaggggcuucuguaa

SEQ ID NO: 992378 - RNA, 18 nt, Human
gggcugggauggaagagg

SEQ ID NO: 992379 - RNA, 24 nt, Human
gguggcgggugccuauaaucccag

SEQ ID NO: 992380 - RNA, 19 nt, Human
gguggcucacgaggucagg

SEQ ID NO: 992381 - RNA, 24 nt, Human
gguuguuuuuuuuuuuuuuucccu

SEQ ID NO: 992382 - RNA, 21 nt, Human
guaggaggugcugggagcuuc

SEQ ID NO: 992383 - RNA, 25 nt, Human
guuuacuucccccacccacccaaaa

SEQ ID NO: 992384 - RNA, 23 nt, Human
uaaaagaaaaaccaaacaccuuu

SEQ ID NO: 992385 - RNA, 18 nt, Human
uaaaagaauucaaaacug

SEQ ID NO: 992386 - RNA, 21 nt, Human
uaaaagccagacaugguggcg

SEQ ID NO: 992387 - RNA, 23 nt, Human
uacaauaaaaauuaaaagaaaaa

SEQ ID NO: 992388 - RNA, 19 nt, Human
uacaggcauccugcagcag

SEQ ID NO: 992389 - RNA, 24 nt, Human
uacccuucugugccugcggcagaa

SEQ ID NO: 992390 - RNA, 22 nt, Human
uagaaaguugagucagagucug

SEQ ID NO: 992391 - RNA, 26 nt, Human
uagaaaguugagucagagucugcugg

SEQ ID NO: 992392 - RNA, 20 nt, Human
uagcaaaaaucuaaacauuc

SEQ ID NO: 992393 - RNA, 21 nt, Human
uagcaauaaccuaggauuagu

SEQ ID NO: 992394 - RNA, 24 nt, Human
uauuuuggcuagcaauaaccuagg

SEQ ID NO: 992395 - RNA, 21 nt, Human
ucaagaacaaagggaaaaaca

SEQ ID NO: 992396 - RNA, 22 nt, Human
ucaagaacaaagggaaaaacac

SEQ ID NO: 992397 - RNA, 26 nt, Human
ucacacucccacagcaacagaugggc

SEQ ID NO: 992398 - RNA, 25 nt, Human
ucacgaggucaggaguuccaagacc

SEQ ID NO: 992399 - RNA, 20 nt, Human
ucacugggcaggggcuucug

SEQ ID NO: 992400 - RNA, 22 nt, Human
ucagcgauccguucacacuccc

SEQ ID NO: 992401 - RNA, 18 nt, Human
ucaggaaaacuaaaggcu

SEQ ID NO: 992402 - RNA, 22 nt, Human
ucagucuaguuuacuuccccca

SEQ ID NO: 992403 - RNA, 20 nt, Human
ucccaaguaggaggugcugg

SEQ ID NO: 992404 - RNA, 22 nt, Human
ucccagcggcuuucggguccac

SEQ ID NO: 992405 - RNA, 22 nt, Human
ucccggcggggagcggggggcg

SEQ ID NO: 992406 - RNA, 23 nt, Human
ucccuacuacaggcauccugcag

SEQ ID NO: 992407 - RNA, 20 nt, Human
uccuugugccugaccuggug

SEQ ID NO: 992408 - RNA, 22 nt, Human
ucgggaggcugaggcaaauaau

SEQ ID NO: 992409 - RNA, 20 nt, Human
ucucaaaaaaacaaacaaac

SEQ ID NO: 992410 - RNA, 24 nt, Human
ucucaaaaaaacaaacaaacaaac

SEQ ID NO: 992411 - RNA, 19 nt, Human
ucucuacuaaaagccagac

SEQ ID NO: 992412 - RNA, 21 nt, Human
ucugcccuacccaacacccca

SEQ ID NO: 992413 - RNA, 23 nt, Human
ugaaacaaagacaaucccagcug

SEQ ID NO: 992414 - RNA, 24 nt, Human
ugaaacagcaaaagaggcugggcg

SEQ ID NO: 992415 - RNA, 24 nt, Human
ugaaggcaguuccuccgcagcagu

SEQ ID NO: 992416 - RNA, 18 nt, Human
ugacaaaagacaaaaaag

SEQ ID NO: 992417 - RNA, 21 nt, Human
ugacaaaagacaaaaaaguua

SEQ ID NO: 992418 - RNA, 23 nt, Human
ugacauaugggccccucuaaucc

SEQ ID NO: 992419 - RNA, 24 nt, Human
ugagaucgcaccacugcacuccag

SEQ ID NO: 992420 - RNA, 22 nt, Human
ugagcugagaucgcaccacugc

SEQ ID NO: 992421 - RNA, 23 nt, Human
ugaggcaaauaauugcuugaacc

SEQ ID NO: 992422 - RNA, 23 nt, Human
ugaggcaaauaauugcuugaacc

SEQ ID NO: 992423 - RNA, 24 nt, Human
ugaggcaaauaauugcuugaaccc

SEQ ID NO: 992424 - RNA, 24 nt, Human
ugcagggcaaaaguguucaagaac

SEQ ID NO: 992425 - RNA, 23 nt, Human
ugccaccauugugggaaaagcug

SEQ ID NO: 992426 - RNA, 22 nt, Human
ugcccggccugacacucggccu

SEQ ID NO: 992427 - RNA, 24 nt, Human
ugccuauaaucccagcuacucggg

SEQ ID NO: 992428 - RNA, 21 nt, Human
ugcuuuccccaaaguuuccug

SEQ ID NO: 992429 - RNA, 18 nt, Human
uggaagaggcugggcaaa

SEQ ID NO: 992430 - RNA, 23 nt, Human
uggaggacuuccugaccagcaga

SEQ ID NO: 992431 - RNA, 19 nt, Human
uggcagcaucaguuaaccu

SEQ ID NO: 992432 - RNA, 21 nt, Human
uggcccagugacacuacucag

SEQ ID NO: 992433 - RNA, 24 nt, Human
uggcgggugccuauaaucccagcu

SEQ ID NO: 992434 - RNA, 22 nt, Human
uggcucacgaggucaggaguuc

SEQ ID NO: 992435 - RNA, 18 nt, Human
uggcuucagggaucuucc

SEQ ID NO: 992436 - RNA, 19 nt, Human
uggcuucagggaucuuccc

SEQ ID NO: 992437 - RNA, 21 nt, Human
ugggaaaagcugccucucugg

SEQ ID NO: 992438 - RNA, 21 nt, Human
ugggggaaagggaggagcaua

SEQ ID NO: 992439 - RNA, 21 nt, Human
ugguggcucacgaggucagga

SEQ ID NO: 992440 - RNA, 18 nt, Human
uguuuggcagugauccau

SEQ ID NO: 992441 - RNA, 22 nt, Human
uucaagaacaaagggaaaaaca

SEQ ID NO: 992442 - RNA, 19 nt, Human
uuccaagaccagccuggcc

SEQ ID NO: 992443 - RNA, 21 nt, Human
uucccagcggcuuucgggucc

SEQ ID NO: 992444 - RNA, 24 nt, Human
uuccugcuuuccccaaaguuuccu

SEQ ID NO: 992445 - RNA, 20 nt, Human
uugaucuuaucuuucucugc

SEQ ID NO: 992446 - RNA, 23 nt, Human
uugcucagugcacuggggggagg

SEQ ID NO: 992447 - RNA, 19 nt, Human
uugcuugaacccgggcugg

SEQ ID NO: 992448 - RNA, 22 nt, Human
uugcuugaacccgggcuggagu

SEQ ID NO: 992449 - RNA, 19 nt, Human
uuugacaaaagacaaaaaa

SEQ ID NO: 992450 - RNA, 24 nt, Human
uuuucuccuugugccugaccuggu

SEQ ID NO: 992451 - RNA, 18 nt, Human
uuuuuuuuuuuuucccug

SEQ ID NO: 992452 - RNA, 18 nt, Human
uuuuuuuuuuuuuuucug

SEQ ID NO: 992453 - RNA, 24 nt, Human
ugaacauaaacagguuuaccacag

SEQ ID NO: 992454 - RNA, 21 nt, Human
uuuuuuuuuuuuuugggguga

SEQ ID NO: 992455 - RNA, 22 nt, Human
uuuuuuuuuuuuuuuuuggggu

SEQ ID NO: 992456 - RNA, 22 nt, Human
acaaacagcuuugcuaacagag

SEQ ID NO: 992457 - RNA, 18 nt, Human
cugcaucgacuagcagca

SEQ ID NO: 992458 - RNA, 27 nt, Human
cuuaucguuacuguuguuuccgagaaa

SEQ ID NO: 992459 - RNA, 20 nt, Human
uuuuuuggggugaauaaaca

SEQ ID NO: 992460 - RNA, 18 nt, Human
uuuuuuuuuuuuuuuuug

SEQ ID NO: 992461 - RNA, 24 nt, Human
uuuuuuuuuuuuuuuuugggguga

SEQ ID NO: 992462 - RNA, 25 nt, Human
uuuuuuuuuuuuuuuuuuuuugggg

SEQ ID NO: 992463 - RNA, 21 nt, Human
aaaauaaucagaaaaucaaga

SEQ ID NO: 992464 - RNA, 21 nt, Human
aaacaaaucagcagggaggac

SEQ ID NO: 992465 - RNA, 20 nt, Human
aaacgagagcagcacaaucc

SEQ ID NO: 992466 - RNA, 24 nt, Human
aaagcccaaagcagcccccuaccu

SEQ ID NO: 992467 - RNA, 18 nt, Human
aagcagcccccuaccucu

SEQ ID NO: 992468 - RNA, 24 nt, Human
aagugcaggugcaaagcccaaagc

SEQ ID NO: 992469 - RNA, 19 nt, Human
aaguggaaguugauucacu

SEQ ID NO: 992470 - RNA, 21 nt, Human
aaugccacagucaaggaccaa

SEQ ID NO: 992471 - RNA, 26 nt, Human
accaaagugcaggugcaaagcccagu

SEQ ID NO: 992472 - RNA, 22 nt, Human
agcacaauccauuggugacguu

SEQ ID NO: 992473 - RNA, 19 nt, Human
agcucuuugcccauuggca

SEQ ID NO: 992474 - RNA, 19 nt, Human
auagcgcuuccgcccucua

SEQ ID NO: 992475 - RNA, 23 nt, Human
auggaagccaccagcauaaauaa

SEQ ID NO: 992476 - RNA, 20 nt, Human
caaggacaaaaaaaucaaag

SEQ ID NO: 992477 - RNA, 21 nt, Human
caccacagccacaacagucug

SEQ ID NO: 992478 - RNA, 19 nt, Human
cagagcccgggccccaggg

SEQ ID NO: 992479 - RNA, 18 nt, Human
cagaggaggaacggaugg

SEQ ID NO: 992480 - RNA, 23 nt, Human
cagcacaauccauuggugacguu

SEQ ID NO: 992481 - RNA, 22 nt, Human
cagcagcgcagccugcccaggc

SEQ ID NO: 992482 - RNA, 21 nt, Human
cagcauaaauaaagggaacac

SEQ ID NO: 992483 - RNA, 21 nt, Human
cagcccagacccgccacuaaa

SEQ ID NO: 992484 - RNA, 24 nt, Human
cagcgcagccugcccaaccccugg

SEQ ID NO: 992485 - RNA, 29 nt, Human
cauauuuauuuuaaaaaucugugauggga

SEQ ID NO: 992486 - RNA, 24 nt, Human
cccaaagcagcccccuaccucugc

SEQ ID NO: 992487 - RNA, 21 nt, Human
ccccccguuuuucguccccuc

SEQ ID NO: 992488 - RNA, 24 nt, Human
cccccuaccucugccagcccagac

SEQ ID NO: 992489 - RNA, 22 nt, Human
ccccucuccagucccgccccug

SEQ ID NO: 992490 - RNA, 18 nt, Human
cccgccacuaaauucuag

SEQ ID NO: 992491 - RNA, 20 nt, Human
ccgccaagacgaagggcggg

SEQ ID NO: 992492 - RNA, 21 nt, Human
ccgcugccgccaagacgaagg

SEQ ID NO: 992493 - RNA, 20 nt, Human
ccuacagagcccgggcccca

SEQ ID NO: 992494 - RNA, 26 nt, Human
cgcgagauccgcgcgcggggccccuc

SEQ ID NO: 992495 - RNA, 18 nt, Human
cucaaggacaaaaaaauc

SEQ ID NO: 992496 - RNA, 21 nt, Human
cucaaggacaaaaaaaucaaa

SEQ ID NO: 992497 - RNA, 21 nt, Human
cuccgccucguacuuccgaga

SEQ ID NO: 992498 - RNA, 23 nt, Human
cugcgcgcgucucucagucuccc

SEQ ID NO: 992499 - RNA, 18 nt, Human
cuggagcucccucgccuc

SEQ ID NO: 992500 - RNA, 19 nt, Human
cuggccccccguuuuucgu

SEQ ID NO: 992501 - RNA, 22 nt, Human
cuuccgagaccuuacaggcaga

SEQ ID NO: 992502 - RNA, 22 nt, Human
gccaccagcauaaauaaaggga

SEQ ID NO: 992503 - RNA, 21 nt, Human
gcggggccccucuccaguccc

SEQ ID NO: 992504 - RNA, 25 nt, Human
gcugaaacgagagcagcacaaucca

SEQ ID NO: 992505 - RNA, 21 nt, Human
ggcagcugcugaugucggcgc

SEQ ID NO: 992506 - RNA, 22 nt, Human
ggccccagggaggguggucagc

SEQ ID NO: 992507 - RNA, 22 nt, Human
gggaacacagaagaacaauguc

SEQ ID NO: 992508 - RNA, 26 nt, Human
gggaggcgagccucuucuuccugguu

SEQ ID NO: 992509 - RNA, 24 nt, Human
gguacaacuaaguggaaguugauu

SEQ ID NO: 992510 - RNA, 25 nt, Human
uaaaauaaucagaaaaucaagaaga

SEQ ID NO: 992511 - RNA, 19 nt, Human
uagggggcagcugcugaug

SEQ ID NO: 992512 - RNA, 20 nt, Human
uaguagaaaagcacuuccac

SEQ ID NO: 992513 - RNA, 18 nt, Human
ucagcagggaggacaagg

SEQ ID NO: 992514 - RNA, 24 nt, Human
uccccaucuucuaugucuucugua

SEQ ID NO: 992515 - RNA, 23 nt, Human
uccgcgcgcggggccccucucca

SEQ ID NO: 992516 - RNA, 22 nt, Human
ucguccccuccgccucguacuu

SEQ ID NO: 992517 - RNA, 22 nt, Human
ucucaagcuacauaaaauaauc

SEQ ID NO: 992518 - RNA, 22 nt, Human
ucucaugcuagacagguuagac

SEQ ID NO: 992519 - RNA, 21 nt, Human
ucuccaccacagccacaacag

SEQ ID NO: 992520 - RNA, 23 nt, Human
ucuccagucccgccccugcugcg

SEQ ID NO: 992521 - RNA, 20 nt, Human
ucucccgcugccgccaagac

SEQ ID NO: 992522 - RNA, 18 nt, Human
ucugugaugggacagugg

SEQ ID NO: 992523 - RNA, 22 nt, Human
ugaaacgagagcagcacaaucc

SEQ ID NO: 992524 - RNA, 25 nt, Human
ugaaacgagagcagcacaauccauu

SEQ ID NO: 992525 - RNA, 22 nt, Human
ugcagagagaaacagugcagag

SEQ ID NO: 992526 - RNA, 19 nt, Human
ugcccaggcugggaucucc

SEQ ID NO: 992527 - RNA, 24 nt, Human
ugcuguuuugguuugcugcugaag

SEQ ID NO: 992528 - RNA, 19 nt, Human
uggaagccaccagcauaaa

SEQ ID NO: 992529 - RNA, 20 nt, Human
uggaaguugauucacuuugu

SEQ ID NO: 992530 - RNA, 23 nt, Human
ugggaggcgagccucuucuuccu

SEQ ID NO: 992531 - RNA, 19 nt, Human
ugguuugcugcugaagucu

SEQ ID NO: 992532 - RNA, 25 nt, Human
uuagaaacaaaucagcagggaggac

SEQ ID NO: 992533 - RNA, 18 nt, Human
uuccccaucuucuauguc

SEQ ID NO: 992534 - RNA, 23 nt, Human
uucguccccuccgccucguacuu

SEQ ID NO: 992535 - RNA, 21 nt, Human
uuuuucguccccuccgccucg

SEQ ID NO: 992536 - RNA, 21 nt, Human
cuccuuuauugccacauucac

SEQ ID NO: 992537 - RNA, 24 nt, Human
gaucucuucuccuuuauugccacc

SEQ ID NO: 992538 - RNA, 19 nt, Human
gguaaaagcuaaagaaaau

SEQ ID NO: 992539 - RNA, 19 nt, Human
aaacaaaaaaaaacacagg

SEQ ID NO: 992540 - RNA, 25 nt, Human
aaacaaacaaauaaaaccuccaaaa

SEQ ID NO: 992541 - RNA, 25 nt, Human
aaacacccacagguguggaggggca

SEQ ID NO: 992542 - RNA, 18 nt, Human
aaaguacagaggcacacc

SEQ ID NO: 992543 - RNA, 24 nt, Human
aaagugcugggauuacaggcguga

SEQ ID NO: 992544 - RNA, 21 nt, Human
aacacacccguaagacacaga

SEQ ID NO: 992545 - RNA, 19 nt, Human
aacacagugaaaccccauc

SEQ ID NO: 992546 - RNA, 20 nt, Human
aacacagugaaaccccaucu

SEQ ID NO: 992547 - RNA, 20 nt, Human
aacacagugaaaccccaucu

SEQ ID NO: 992548 - RNA, 21 nt, Human
aacacagugaaaccccaucuc

SEQ ID NO: 992549 - RNA, 18 nt, Human
aacacagugaaagugucu

SEQ ID NO: 992550 - RNA, 19 nt, Human
aacacagugaaagugucuc

SEQ ID NO: 992551 - RNA, 18 nt, Human
aagaggaaggcuucuguc

SEQ ID NO: 992552 - RNA, 23 nt, Human
aagaucuuuuacuuuggugcucu

SEQ ID NO: 992553 - RNA, 25 nt, Human
aagcaauccucccaccucagccucc

SEQ ID NO: 992554 - RNA, 24 nt, Human
aagcauagucaucauugaaaucac

SEQ ID NO: 992555 - RNA, 20 nt, Human
aagcaugcaccacugcaucc

SEQ ID NO: 992556 - RNA, 25 nt, Human
aagcgauccucccgcuucagccucc

SEQ ID NO: 992557 - RNA, 18 nt, Human
aagggguuucaccauguu

SEQ ID NO: 992558 - RNA, 20 nt, Human
aagggguuucaccauguugg

SEQ ID NO: 992559 - RNA, 24 nt, Human
aagggguuucaccauguuggccag

SEQ ID NO: 992560 - RNA, 19 nt, Human
aaguagcugggauuauagg

SEQ ID NO: 992561 - RNA, 19 nt, Human
aagugcugggauuacaggc

SEQ ID NO: 992562 - RNA, 19 nt, Human
aagugcugggauuacaggc

SEQ ID NO: 992563 - RNA, 18 nt, Human
aaugucuggguguaaagc

SEQ ID NO: 992564 - RNA, 18 nt, Human
aauuacaagcaugcacca

SEQ ID NO: 992565 - RNA, 18 nt, Human
aauugccugaacccggga

SEQ ID NO: 992566 - RNA, 22 nt, Human
aauuuuguauuuuuaguagaga

SEQ ID NO: 992567 - RNA, 19 nt, Human
acaaaaaaaaacacaggga

SEQ ID NO: 992568 - RNA, 18 nt, Human
acaaaggcaaacaacaga

SEQ ID NO: 992569 - RNA, 22 nt, Human
acagagcaaggcugucucacaa

SEQ ID NO: 992570 - RNA, 21 nt, Human
acaggcacccaccaccacacc

SEQ ID NO: 992571 - RNA, 19 nt, Human
acagugaaaccccaucucc

SEQ ID NO: 992572 - RNA, 24 nt, Human
accauguuggccaggcugcucuug

SEQ ID NO: 992573 - RNA, 23 nt, Human
acccaggcuggagugcaguggug

SEQ ID NO: 992574 - RNA, 24 nt, Human
acccaggcuggagugcaguggugu

SEQ ID NO: 992575 - RNA, 22 nt, Human
acccguaagacacagaucgcuc

SEQ ID NO: 992576 - RNA, 19 nt, Human
accuuacccccaacccugu

SEQ ID NO: 992577 - RNA, 21 nt, Human
acguucauuuuuucuaacugg

SEQ ID NO: 992578 - RNA, 21 nt, Human
acucugaugaguugcacacua

SEQ ID NO: 992579 - RNA, 24 nt, Human
acugcacuccagccugggcaacag

SEQ ID NO: 992580 - RNA, 24 nt, Human
acugcacuccagccugggcaacag

SEQ ID NO: 992581 - RNA, 18 nt, Human
acuuugggccagaugcag

SEQ ID NO: 992582 - RNA, 19 nt, Human
agaaagaaguagacauagg

SEQ ID NO: 992583 - RNA, 22 nt, Human
agagguuuugcuuauggccagu

SEQ ID NO: 992584 - RNA, 25 nt, Human
agaucacuugaagucaggaguuuga

SEQ ID NO: 992585 - RNA, 24 nt, Human
agcaauucuugugccucagcuucc

SEQ ID NO: 992586 - RNA, 23 nt, Human
agcacagugguucacaccuguaa

SEQ ID NO: 992587 - RNA, 24 nt, Human
agcagcucaugccugcaaucccag

SEQ ID NO: 992588 - RNA, 19 nt, Human
agccaccacaccuggccua

SEQ ID NO: 992589 - RNA, 21 nt, Human
agccaggaguucaagaccagc

SEQ ID NO: 992590 - RNA, 24 nt, Human
agccuggccaacacagugaaaccc

SEQ ID NO: 992591 - RNA, 22 nt, Human
agccugggcagcauagugagac

SEQ ID NO: 992592 - RNA, 24 nt, Human
agccugggcagcauagugagaccc

SEQ ID NO: 992593 - RNA, 25 nt, Human
agccugggcagcauagugagacccu

SEQ ID NO: 992594 - RNA, 23 nt, Human
aggaguucaagaccagccugggc

SEQ ID NO: 992595 - RNA, 20 nt, Human
aggaguuugagaccagccug

SEQ ID NO: 992596 - RNA, 24 nt, Human
aggauagcuugaagccaggaguuc

SEQ ID NO: 992597 - RNA, 24 nt, Human
aggcaaacaacagauuaaaaagca

SEQ ID NO: 992598 - RNA, 24 nt, Human
aggcacagucgcucaugccuguaa

SEQ ID NO: 992599 - RNA, 18 nt, Human
aggcaggaggaucacuug

SEQ ID NO: 992600 - RNA, 24 nt, Human
aggccgagguugcagugagcugag

SEQ ID NO: 992601 - RNA, 26 nt, Human
aggcgggcagaucacuugaagucagg

SEQ ID NO: 992602 - RNA, 18 nt, Human
agggaccucugccuagga

SEQ ID NO: 992603 - RNA, 24 nt, Human
agggguuucaccauguuggccagg

SEQ ID NO: 992604 - RNA, 24 nt, Human
aggugaucugcccaccucagccuc

SEQ ID NO: 992605 - RNA, 19 nt, Human
aguacagaggcacaccacc

SEQ ID NO: 992606 - RNA, 23 nt, Human
agucgcucaugccuguaauccca

SEQ ID NO: 992607 - RNA, 24 nt, Human
agucgcucaugccuguaaucccag

SEQ ID NO: 992608 - RNA, 19 nt, Human
agugcaguggcaugaucuc

SEQ ID NO: 992609 - RNA, 21 nt, Human
agugcaguggcaugaucucag

SEQ ID NO: 992610 - RNA, 23 nt, Human
agugcaguggcaugaucucagcu

SEQ ID NO: 992611 - RNA, 20 nt, Human
agugcaguggugugaucaug

SEQ ID NO: 992612 - RNA, 23 nt, Human
agugcaguggugugaucauggcu

SEQ ID NO: 992613 - RNA, 24 nt, Human
agugcaguggugugaucauggcuc

SEQ ID NO: 992614 - RNA, 18 nt, Human
agugcugggauuacaggc

SEQ ID NO: 992615 - RNA, 24 nt, Human
aguggcaugaucucagcucacugc

SEQ ID NO: 992616 - RNA, 24 nt, Human
agugguucacaccuguaaucccag

SEQ ID NO: 992617 - RNA, 20 nt, Human
aucacuugaagucaggaguu

SEQ ID NO: 992618 - RNA, 24 nt, Human
aucacuugaagucaggaguuugag

SEQ ID NO: 992619 - RNA, 19 nt, Human
augccugcaaucccagcac

SEQ ID NO: 992620 - RNA, 19 nt, Human
augccuguaaucccagcac

SEQ ID NO: 992621 - RNA, 18 nt, Human
augggguuucgccauguu

SEQ ID NO: 992622 - RNA, 23 nt, Human
augggguuucgccauguuggcca

SEQ ID NO: 992623 - RNA, 24 nt, Human
augggguuucgccauguuggccag

SEQ ID NO: 992624 - RNA, 21 nt, Human
auguuuuagugcugcagaggu

SEQ ID NO: 992625 - RNA, 21 nt, Human
auucuccugccucagccuccc

SEQ ID NO: 992626 - RNA, 24 nt, Human
auuucgucacugcacuccagccug

SEQ ID NO: 992627 - RNA, 27 nt, Human
caaacaaauaaaaccuccaaaaacaaa

SEQ ID NO: 992628 - RNA, 18 nt, Human
caaaggccgcagggaccu

SEQ ID NO: 992629 - RNA, 24 nt, Human
caacagacaggccugggcaacaca

SEQ ID NO: 992630 - RNA, 22 nt, Human
caaccaauucuccugccucagc

SEQ ID NO: 992631 - RNA, 27 nt, Human
caagaaacaaauaaaaaaugggcugaa

SEQ ID NO: 992632 - RNA, 20 nt, Human
caagaccagccugggcagca

SEQ ID NO: 992633 - RNA, 18 nt, Human
caagcuaaacauccccuu

SEQ ID NO: 992634 - RNA, 20 nt, Human
caaggcaggaggaucacuug

SEQ ID NO: 992635 - RNA, 25 nt, Human
caaggcaggaggaucacuugaggcc

SEQ ID NO: 992636 - RNA, 24 nt, Human
caagguuucaccauguugcccagg

SEQ ID NO: 992637 - RNA, 23 nt, Human
caaguacccagagacgcaaaaua

SEQ ID NO: 992638 - RNA, 24 nt, Human
cacaccuguaaucccagcacuuug

SEQ ID NO: 992639 - RNA, 24 nt, Human
cacaucuguaaucccagcuacuug

SEQ ID NO: 992640 - RNA, 23 nt, Human
caccacaccuggccuaaaacucu

SEQ ID NO: 992641 - RNA, 26 nt, Human
caccacugcauccagaccgggugucc

SEQ ID NO: 992642 - RNA, 24 nt, Human
caccauguugcccaggcuggucuc

SEQ ID NO: 992643 - RNA, 27 nt, Human
caccauguugcccaggcuggucucaaa

SEQ ID NO: 992644 - RNA, 22 nt, Human
caccauguuggccaggcugcuc

SEQ ID NO: 992645 - RNA, 23 nt, Human
caccauguuggccaggcugcucu

SEQ ID NO: 992646 - RNA, 24 nt, Human
caccauguuggccaggcugcucuu

SEQ ID NO: 992647 - RNA, 31 nt, Human; identical to SEQ ID NO: 734034

SEQ ID NO: 992648 - RNA, 18 nt, Human
cacccaccaccacaccug

SEQ ID NO: 992649 - RNA, 21 nt, Human
cacccaggcuggagugcagug

SEQ ID NO: 992650 - RNA, 24 nt, Human
caccucagccucccaaagugcugg

SEQ ID NO: 992651 - RNA, 24 nt, Human
caccucagccucccaaguagcugg

SEQ ID NO: 992652 - RNA, 19 nt, Human
caccuguaaucccagcacu

SEQ ID NO: 992653 - RNA, 24 nt, Human
caccuguaaucccagcacuuuggg

SEQ ID NO: 992654 - RNA, 21 nt, Human
cacuauaccgccaugguucca

SEQ ID NO: 992655 - RNA, 23 nt, Human
cacuccagccugggcaacagagc

SEQ ID NO: 992656 - RNA, 24 nt, Human
cacucccuaaucucaaaccacucc

SEQ ID NO: 992657 - RNA, 23 nt, Human
cacucugucacccaggcuggagu

SEQ ID NO: 992658 - RNA, 24 nt, Human
cacucugucacccaggcuggagug

SEQ ID NO: 992659 - RNA, 18 nt, Human
cacugcacuccagccugg

SEQ ID NO: 992660 - RNA, 19 nt, Human
cacugcacuccagccuggg

SEQ ID NO: 992661 - RNA, 20 nt, Human
cacugcacuccagccugggc

SEQ ID NO: 992662 - RNA, 21 nt, Human
cacugcacuccagccugggca

SEQ ID NO: 992663 - RNA, 22 nt, Human
cacugcacuccagccugggcaa

SEQ ID NO: 992664 - RNA, 23 nt, Human
cacugcacuccagccugggcaac

SEQ ID NO: 992665 - RNA, 24 nt, Human
cacugcacuccagccugggcaaca

SEQ ID NO: 992666 - RNA, 26 nt, Human
cacugcacuccagccugggcaacaga

SEQ ID NO: 992667 - RNA, 21 nt, Human
cacuguaaccucugccuccug

SEQ ID NO: 992668 - RNA, 23 nt, Human
cacuguaaccucugccuccuggg

SEQ ID NO: 992669 - RNA, 21 nt, Human
cacuugaagucaggaguuuga

SEQ ID NO: 992670 - RNA, 23 nt, Human
cacuugaagucaggaguuugaga

SEQ ID NO: 992671 - RNA, 24 nt, Human
cagcacuuuagcaggccaaggcgg

SEQ ID NO: 992672 - RNA, 22 nt, Human
cagcacuuugggagauccaagg

SEQ ID NO: 992673 - RNA, 25 nt, Human
cagcacuuugggagauccaaggcag

SEQ ID NO: 992674 - RNA, 21 nt, Human
cagcaucucugccuauucugc

SEQ ID NO: 992675 - RNA, 25 nt, Human
cagccucgaccucccuggacucaag

SEQ ID NO: 992676 - RNA, 22 nt, Human
cagcuuccugaguagcugaaag

SEQ ID NO: 992677 - RNA, 19 nt, Human
caggguuaaauggauuaag

SEQ ID NO: 992678 - RNA, 20 nt, Human
caucugaacauagugugacc

SEQ ID NO: 992679 - RNA, 23 nt, Human
caucuguaaucccagcuacuugg

SEQ ID NO: 992680 - RNA, 19 nt, Human
caugccugcaaucccagca

SEQ ID NO: 992681 - RNA, 20 nt, Human
caugccuguaaucccagcac

SEQ ID NO: 992682 - RNA, 23 nt, Human
caugccuguaaucccagcacuuu

SEQ ID NO: 992683 - RNA, 18 nt, Human
caugucuggcuaauuuuu

SEQ ID NO: 992684 - RNA, 23 nt, Human
cauguugcccaggcuggucucaa

SEQ ID NO: 992685 - RNA, 24 nt, Human
cauguugcccaggcuggucucaaa

SEQ ID NO: 992686 - RNA, 24 nt, Human
cauguuggccagacuggucucgaa

SEQ ID NO: 992687 - RNA, 24 nt, Human
cauguuggccaggcugcucuugaa

SEQ ID NO: 992688 - RNA, 24 nt, Human
ccaaaaacaaaaaaaaacacaggg

SEQ ID NO: 992689 - RNA, 20 nt, Human
ccaaagugcugggauuacag

SEQ ID NO: 992690 - RNA, 22 nt, Human
ccaaagugcugggauuacaggc

SEQ ID NO: 992691 - RNA, 22 nt, Human
ccaaagugcugggauuacaggc

SEQ ID NO: 992692 - RNA, 24 nt, Human
ccaaagugcugggauuacaggcgu

SEQ ID NO: 992693 - RNA, 22 nt, Human
ccaagcagcugugauuacaggc

SEQ ID NO: 992694 - RNA, 20 nt, Human
ccacugccuucuggcuucug

SEQ ID NO: 992695 - RNA, 19 nt, Human
ccagacuguauacaucuau

SEQ ID NO: 992696 - RNA, 22 nt, Human
ccauguuggccagacuggucuc

SEQ ID NO: 992697 - RNA, 23 nt, Human
ccauguuggccagacuggucucg

SEQ ID NO: 992698 - RNA, 23 nt, Human
cccaacccugugcucccugaaac

SEQ ID NO: 992699 - RNA, 24 nt, Human
cccaagcgauccucccgcuucagc

SEQ ID NO: 992700 - RNA, 22 nt, Human
cccaaguagcugggauuauagg

SEQ ID NO: 992701 - RNA, 23 nt, Human
cccaaguagcugggauuauaggu

SEQ ID NO: 992702 - RNA, 24 nt, Human
cccaaguagcugggauuauaggug

SEQ ID NO: 992703 - RNA, 21 nt, Human
cccacaaccuuccagauuggg

SEQ ID NO: 992704 - RNA, 23 nt, Human
cccacagguguggaggggcaacc

SEQ ID NO: 992705 - RNA, 20 nt, Human
cccaccucagccucccaagu

SEQ ID NO: 992706 - RNA, 19 nt, Human
cccauucuuucucugcccu

SEQ ID NO: 992707 - RNA, 21 nt, Human
cccauucuuucucugcccugu

SEQ ID NO: 992708 - RNA, 19 nt, Human
cccccagcccgacacccau

SEQ ID NO: 992709 - RNA, 22 nt, Human
cccggcuggaaugcaguggcac

SEQ ID NO: 992710 - RNA, 24 nt, Human
ccgcuucagccucccaaagugcua

SEQ ID NO: 992711 - RNA, 24 nt, Human
ccuccuggguucaaccaauucucc

SEQ ID NO: 992712 - RNA, 19 nt, Human
ccucugccuccuggguuca

SEQ ID NO: 992713 - RNA, 24 nt, Human
ccugaccucaggugaucugcccac

SEQ ID NO: 992714 - RNA, 20 nt, Human
ccuggacucaagcaauccuc

SEQ ID NO: 992715 - RNA, 18 nt, Human
ccuggcauuaaggucagg

SEQ ID NO: 992716 - RNA, 24 nt, Human
ccuggccaacacagugaaacccca

SEQ ID NO: 992717 - RNA, 23 nt, Human
ccuggguucaaccaauucuccug

SEQ ID NO: 992718 - RNA, 22 nt, Human
ccuuuaguuuuguuugccaaaa

SEQ ID NO: 992719 - RNA, 24 nt, Human
cgagaccagcucggucacuaacuc

SEQ ID NO: 992720 - RNA, 27 nt, Human
cgcaucugcagacuauaccacccaagg

SEQ ID NO: 992721 - RNA, 24 nt, Human
cgccauguuggccagacuggucuc

SEQ ID NO: 992722 - RNA, 27 nt, Human
cgccauguuggccagacuggucucgaa

SEQ ID NO: 992723 - RNA, 21 nt, Human
cgggaggccgagguugcagug

SEQ ID NO: 992724 - RNA, 24 nt, Human
cgggaggccgagguugcagugagc

SEQ ID NO: 992725 - RNA, 28 nt, Human
cgggaggccgagguugcagugagcugag

SEQ ID NO: 992726 - RNA, 21 nt, Human
cuaaagcacagcacuuaauuc

SEQ ID NO: 992727 - RNA, 19 nt, Human
cucaaaagacccgcccacc

SEQ ID NO: 992728 - RNA, 24 nt, Human
cucaaaagacccgcccaccucugc

SEQ ID NO: 992729 - RNA, 21 nt, Human
cucaagcaauccucccaccuc

SEQ ID NO: 992730 - RNA, 24 nt, Human
cucaagcaauccucccaccucagc

SEQ ID NO: 992731 - RNA, 21 nt, Human
cucacugcagccucgaccucc

SEQ ID NO: 992732 - RNA, 24 nt, Human
cucacuguaaccucugccuccugg

SEQ ID NO: 992733 - RNA, 24 nt, Human
cucagccucccaaguagcugggau

SEQ ID NO: 992734 - RNA, 24 nt, Human
cucaugccugcaaucccagcacuu

SEQ ID NO: 992735 - RNA, 24 nt, Human
cucaugccuguaaucccagcacuu

SEQ ID NO: 992736 - RNA, 19 nt, Human
cucccagagucucuuccuu

SEQ ID NO: 992737 - RNA, 21 nt, Human
cuccuggguucaaccaauucu

SEQ ID NO: 992738 - RNA, 19 nt, Human
cucuauugccugggcugga

SEQ ID NO: 992739 - RNA, 24 nt, Human
cugcagccuccaccucccauguuc

SEQ ID NO: 992740 - RNA, 23 nt, Human
cugcagcuccuuuaagcacucug

SEQ ID NO: 992741 - RNA, 23 nt, Human
cugccucagccucccaagcagcu

SEQ ID NO: 992742 - RNA, 24 nt, Human
cuggagugcaguggcaugaucuca

SEQ ID NO: 992743 - RNA, 23 nt, Human
cuggccaacacagugaaacccca

SEQ ID NO: 992744 - RNA, 24 nt, Human
cuguaaccucugccuccuggguuc

SEQ ID NO: 992745 - RNA, 19 nt, Human
cuucugaccuucucuccac

SEQ ID NO: 992746 - RNA, 18 nt, Human
cuugaagccaggaguuca

SEQ ID NO: 992747 - RNA, 23 nt, Human
cuugaagucaggaguuugagacc

SEQ ID NO: 992748 - RNA, 25 nt, Human
gaaagaccugaccaucccccagccc

SEQ ID NO: 992749 - RNA, 19 nt, Human
gaagggguuucaccauguu

SEQ ID NO: 992750 - RNA, 22 nt, Human
gaagggguuucaccauguuggc

SEQ ID NO: 992751 - RNA, 20 nt, Human
gacacacacacaaaaauaua

SEQ ID NO: 992752 - RNA, 24 nt, Human
gaccucaggugaucugcccaccuc

SEQ ID NO: 992753 - RNA, 22 nt, Human
gagagaugggguuucgccaugu

SEQ ID NO: 992754 - RNA, 18 nt, Human
gagaugggguuucgccau

SEQ ID NO: 992755 - RNA, 24 nt, Human
gagaugggguuucgccauguuggc

SEQ ID NO: 992756 - RNA, 21 nt, Human
gagguugcagugagcugagau

SEQ ID NO: 992757 - RNA, 19 nt, Human
gagguugcagugagcuggc

SEQ ID NO: 992758 - RNA, 24 nt, Human
gaucacuugaagucaggaguuuga

SEQ ID NO: 992759 - RNA, 19 nt, Human
gaucacuugaggccaacag

SEQ ID NO: 992760 - RNA, 19 nt, Human
gaucauggcucacugcagc

SEQ ID NO: 992761 - RNA, 22 nt, Human
gaucucugcucacuguaaccuc

SEQ ID NO: 992762 - RNA, 18 nt, Human
gauuacaggcacccacca

SEQ ID NO: 992763 - RNA, 21 nt, Human
gauuacaggcacccaccacca

SEQ ID NO: 992764 - RNA, 18 nt, Human
gauuacaggcgugagcca

SEQ ID NO: 992765 - RNA, 21 nt, Human
gauuacaggcgugagccacca

SEQ ID NO: 992766 - RNA, 22 nt, Human
gauuacaggcgugagccaccac

SEQ ID NO: 992767 - RNA, 24 nt, Human
gcacuccagccugggcaacagagc

SEQ ID NO: 992768 - RNA, 22 nt, Human
gcagccuccaccucccauguuc

SEQ ID NO: 992769 - RNA, 27 nt, Human
gcagcgcuagaggaauuaaagacacac

SEQ ID NO: 992770 - RNA, 26 nt, Human
gcaucugcagacuauaccacccaagg

SEQ ID NO: 992771 - RNA, 22 nt, Human
gccuaaaacucuuuuuguuuug

SEQ ID NO: 992772 - RNA, 18 nt, Human
gccucagcuuccugagua

SEQ ID NO: 992773 - RNA, 18 nt, Human
gccugggcaacacaguga

SEQ ID NO: 992774 - RNA, 24 nt, Human
gccugggcuggagugcaguggcau

SEQ ID NO: 992775 - RNA, 24 nt, Human
gcgauccucccgcuucagccuccc

SEQ ID NO: 992776 - RNA, 21 nt, Human
gcucacugcagccucgaccuc

SEQ ID NO: 992777 - RNA, 20 nt, Human
gcucaugccuguaaucccag

SEQ ID NO: 992778 - RNA, 22 nt, Human
gcucaugccuguaaucccagca

SEQ ID NO: 992779 - RNA, 19 nt, Human
gcuccuuuaagcacucugg

SEQ ID NO: 992780 - RNA, 22 nt, Human
gcucucauucccauaaacccac

SEQ ID NO: 992781 - RNA, 25 nt, Human
gcuggaaugcaguggcacgaucucu

SEQ ID NO: 992782 - RNA, 19 nt, Human
gcuggagugcaguggcaug

SEQ ID NO: 992783 - RNA, 23 nt, Human
gcuucagccucccaaagugcuaa

SEQ ID NO: 992784 - RNA, 21 nt, Human
ggaucacuugaggccaacaga

SEQ ID NO: 992785 - RNA, 19 nt, Human
ggauuacaggcgugagcca

SEQ ID NO: 992786 - RNA, 24 nt, Human
ggauuauaggugcaugccaucaug

SEQ ID NO: 992787 - RNA, 25 nt, Human
ggcagaucacuugaagucaggaguu

SEQ ID NO: 992788 - RNA, 21 nt, Human
ggcgcacaucuguaaucccag

SEQ ID NO: 992789 - RNA, 24 nt, Human
ggcuggagugcaguggcaugaucu

SEQ ID NO: 992790 - RNA, 22 nt, Human
ggcuggagugcaguggugugau

SEQ ID NO: 992791 - RNA, 22 nt, Human
gggguuucaccauguuggccag

SEQ ID NO: 992792 - RNA, 23 nt, Human
gggguuucaccauguuggccagg

SEQ ID NO: 992793 - RNA, 22 nt, Human
gggguuucgccauguuggccag

SEQ ID NO: 992794 - RNA, 18 nt, Human
ggguguugcucaugauag

SEQ ID NO: 992795 - RNA, 22 nt, Human
gguccaauccuguuuacaaaua

SEQ ID NO: 992796 - RNA, 19 nt, Human
ggucucgaacuccugaccu

SEQ ID NO: 992797 - RNA, 20 nt, Human
ggucucgaacuccugaccuc

SEQ ID NO: 992798 - RNA, 21 nt, Human
guagagacaagguuucaccau

SEQ ID NO: 992799 - RNA, 26 nt, Human
guagagagagaugggguuucgccaug

SEQ ID NO: 992800 - RNA, 24 nt, Human
gucacugcacuccagccugggcaa

SEQ ID NO: 992801 - RNA, 24 nt, Human
gugaucugcccaccucagccuccc

SEQ ID NO: 992802 - RNA, 22 nt, Human
guguauacauaucuaaagcaca

SEQ ID NO: 992803 - RNA, 18 nt, Human
guguugaucagaaaauuc

SEQ ID NO: 992804 - RNA, 19 nt, Human
guugcagugagcugagauu

SEQ ID NO: 992805 - RNA, 20 nt, Human
guuuauggccagacucuggg

SEQ ID NO: 992806 - RNA, 24 nt, Human
guuucaccauguugcccaggcugg

SEQ ID NO: 992807 - RNA, 26 nt, Human
uaaaaacaaacaaauaaaaccuccaa

SEQ ID NO: 992808 - RNA, 21 nt, Human
uaaaauuacaagcaugcacca

SEQ ID NO: 992809 - RNA, 24 nt, Human
uaaaauuacaagcaugcaccacug

SEQ ID NO: 992810 - RNA, 24 nt, Human
uaaaauuacaagcaugcaccacug

SEQ ID NO: 992811 - RNA, 25 nt, Human
uaaacaaaugcuugaaggcagcaug

SEQ ID NO: 992812 - RNA, 19 nt, Human
uaaacccacaaccuuccag

SEQ ID NO: 992813 - RNA, 31 nt, Human
uaaacuccuuuaguuuuguuugccaaaaaag

SEQ ID NO: 992814 - RNA, 21 nt, Human
uaaagacacacacacaaaaau

SEQ ID NO: 992815 - RNA, 24 nt, Human
uaaauuuuguauuuuuaguagaga

SEQ ID NO: 992816 - RNA, 22 nt, Human
uaacugugucauagaaugauug

SEQ ID NO: 992817 - RNA, 22 nt, Human
uaagcgguuuuccgcccugggc

SEQ ID NO: 992818 - RNA, 20 nt, Human
uaaucuguaaccuuaccccc

SEQ ID NO: 992819 - RNA, 24 nt, Human
uaauuuucauauuuuuaguagaga

SEQ ID NO: 992820 - RNA, 22 nt, Human
uacaggcgugagccaccacacc

SEQ ID NO: 992821 - RNA, 22 nt, Human
uacaggcgugagccaccacacc

SEQ ID NO: 992822 - RNA, 23 nt, Human
uacaggcgugagccaccacaccu

SEQ ID NO: 992823 - RNA, 21 nt, Human
uaccuucugaccuucucucca

SEQ ID NO: 992824 - RNA, 22 nt, Human
uagagaagggguuucaccaugu

SEQ ID NO: 992825 - RNA, 22 nt, Human
uagagacaagguuucaccaugu

SEQ ID NO: 992826 - RNA, 24 nt, Human
uagcaggccaaggcgggcagauca

SEQ ID NO: 992827 - RNA, 23 nt, Human
uagcuugaagccaggaguucaag

SEQ ID NO: 992828 - RNA, 21 nt, Human
uaggagacuccauuuuguucu

SEQ ID NO: 992829 - RNA, 24 nt, Human
uaguagagaagggguuucaccaug

SEQ ID NO: 992830 - RNA, 28 nt, Human
uaguagagagagaugggguuucgccaug

SEQ ID NO: 992831 - RNA, 23 nt, Human
uagucugaaauauggccucgugg

SEQ ID NO: 992832 - RNA, 20 nt, Human
uauacaaaggcaaacaacag

SEQ ID NO: 992833 - RNA, 24 nt, Human
uaucacucugucacccaggcugga

SEQ ID NO: 992834 - RNA, 24 nt, Human
uauggccagacucuggggggcuug

SEQ ID NO: 992835 - RNA, 18 nt, Human
uauguguauacauaucua

SEQ ID NO: 992836 - RNA, 22 nt, Human
uauguguauacauaucuaaagc

SEQ ID NO: 992837 - RNA, 19 nt, Human
uauugccugggcuggagug

SEQ ID NO: 992838 - RNA, 20 nt, Human
uauugccugggcuggagugc

SEQ ID NO: 992839 - RNA, 20 nt, Human
ucaaaacauuuucacuguau

SEQ ID NO: 992840 - RNA, 25 nt, Human
ucaaccaauucuccugccucagccu

SEQ ID NO: 992841 - RNA, 23 nt, Human
ucacaccuguaaucccagcacuu

SEQ ID NO: 992842 - RNA, 24 nt, Human
ucacccaggcuggagugcaguggu

SEQ ID NO: 992843 - RNA, 20 nt, Human
ucacucugucacccaggcug

SEQ ID NO: 992844 - RNA, 22 nt, Human
ucacucugucacccaggcugga

SEQ ID NO: 992845 - RNA, 24 nt, Human
ucacucugucacccaggcuggagu

SEQ ID NO: 992846 - RNA, 20 nt, Human
ucacugcacuccagccuggg

SEQ ID NO: 992847 - RNA, 21 nt, Human
ucacugcacuccagccugggc

SEQ ID NO: 992848 - RNA, 24 nt, Human
ucacugcacuccagccugggcaac

SEQ ID NO: 992849 - RNA, 18 nt, Human
ucacugcagccuccaccu

SEQ ID NO: 992850 - RNA, 19 nt, Human
ucacugcagccuccaccuc

SEQ ID NO: 992851 - RNA, 22 nt, Human
ucacugcagccuccaccuccca

SEQ ID NO: 992852 - RNA, 27 nt, Human
ucacugcagccuccaccucccauguuc

SEQ ID NO: 992853 - RNA, 19 nt, Human
ucacugcagccucgaccuc

SEQ ID NO: 992854 - RNA, 24 nt, Human
ucacuguaaccucugccuccuggg

SEQ ID NO: 992855 - RNA, 25 nt, Human
ucacuguaaccucugccuccugggu

SEQ ID NO: 992856 - RNA, 22 nt, Human
ucacuguauguaggagccuagc

SEQ ID NO: 992857 - RNA, 18 nt, Human
ucagccucccaaagugcu

SEQ ID NO: 992858 - RNA, 22 nt, Human
ucagccucccaaagugcuaaaa

SEQ ID NO: 992859 - RNA, 20 nt, Human
ucagccucccaagcagcugg

SEQ ID NO: 992860 - RNA, 20 nt, Human
ucagccucccaaguagcugg

SEQ ID NO: 992861 - RNA, 22 nt, Human
ucagcuuccugaguagcugaaa

SEQ ID NO: 992862 - RNA, 22 nt, Human
ucaugccugcaaucccagcacu

SEQ ID NO: 992863 - RNA, 22 nt, Human
ucaugccuguaaucccagcacu

SEQ ID NO: 992864 - RNA, 22 nt, Human
ucauucccauaaacccacaacc

SEQ ID NO: 992865 - RNA, 21 nt, Human
uccaaaaacaaguuuguagag

SEQ ID NO: 992866 - RNA, 24 nt, Human
uccaaggcaggaggaucacuugag

SEQ ID NO: 992867 - RNA, 24 nt, Human
ucccaaagugcugggauuacaggc

SEQ ID NO: 992868 - RNA, 23 nt, Human
ucccaaguagcugggauuauagg

SEQ ID NO: 992869 - RNA, 24 nt, Human
ucccaaguagcugggauuauaggu

SEQ ID NO: 992870 - RNA, 20 nt, Human
ucccagcacuuuaggaugcc

SEQ ID NO: 992871 - RNA, 20 nt, Human
ucccauguuccagcaauucu

SEQ ID NO: 992872 - RNA, 24 nt, Human
ucccuggacucaagcaauccuccc

SEQ ID NO: 992873 - RNA, 25 nt, Human
ucccuggacucaagcaauccuccca

SEQ ID NO: 992874 - RNA, 19 nt, Human
uccugaacucaaaagaccc

SEQ ID NO: 992875 - RNA, 21 nt, Human
uccuggguucaaccaauucuc

SEQ ID NO: 992876 - RNA, 24 nt, Human
uccuggguucaaccaauucuccug

SEQ ID NO: 992877 - RNA, 22 nt, Human
uccuucuagauacucuuuuauu

SEQ ID NO: 992878 - RNA, 24 nt, Human
uccuuggcaucuggcucaugauaa

SEQ ID NO: 992879 - RNA, 22 nt, Human
ucgccauguuggccagacuggu

SEQ ID NO: 992880 - RNA, 24 nt, Human
ucgccauguuggccagacuggucu

SEQ ID NO: 992881 - RNA, 24 nt, Human
ucgcucaugccuguaaucccagca

SEQ ID NO: 992882 - RNA, 24 nt, Human
ucuauugccugggcuggagugcag

SEQ ID NO: 992883 - RNA, 21 nt, Human
ucucaaacucuugagcccaag

SEQ ID NO: 992884 - RNA, 19 nt, Human
ucucgaacuccugaccuca

SEQ ID NO: 992885 - RNA, 19 nt, Human
ucucgcaggagucgggauc

SEQ ID NO: 992886 - RNA, 24 nt, Human
ucucgcucucuuaccccggcugga

SEQ ID NO: 992887 - RNA, 21 nt, Human
ucugcccaccucagccuccca

SEQ ID NO: 992888 - RNA, 21 nt, Human
ucuguaaucccagcuacuugg

SEQ ID NO: 992889 - RNA, 18 nt, Human
ucuguaugcugaaugcug

SEQ ID NO: 992890 - RNA, 24 nt, Human
ucugucacccaggcuggagugcag

SEQ ID NO: 992891 - RNA, 23 nt, Human
ucugugacagcuucuugaucugu

SEQ ID NO: 992892 - RNA, 18 nt, Human
ucuuacucuauugccugg

SEQ ID NO: 992893 - RNA, 23 nt, Human
ucuuacucuauugccugggcugg

SEQ ID NO: 992894 - RNA, 24 nt, Human
ucuuacucuauugccugggcugga

SEQ ID NO: 992895 - RNA, 23 nt, Human
ucuugaacuccugaacucaaaag

SEQ ID NO: 992896 - RNA, 19 nt, Human
ucuugugccucagcuuccu

SEQ ID NO: 992897 - RNA, 19 nt, Human
ugaaaccccaucuccacua

SEQ ID NO: 992898 - RNA, 22 nt, Human
ugaaaccccaucuccacuaaaa

SEQ ID NO: 992899 - RNA, 24 nt, Human
ugaaaguacagaggcacaccacca

SEQ ID NO: 992900 - RNA, 23 nt, Human
ugaaaguacagaggcacaccagu

SEQ ID NO: 992901 - RNA, 19 nt, Human
ugaaaucacagagcuucca

SEQ ID NO: 992902 - RNA, 20 nt, Human
ugaaaucacagagcuuccaa

SEQ ID NO: 992903 - RNA, 18 nt, Human
ugaaggcagcaugcuccu

SEQ ID NO: 992904 - RNA, 18 nt, Human
ugaccucaggugaucugc

SEQ ID NO: 992905 - RNA, 21 nt, Human
ugaccucaggugaucugccca

SEQ ID NO: 992906 - RNA, 24 nt, Human
ugaccucaggugaucugcccaccu

SEQ ID NO: 992907 - RNA, 21 nt, Human
ugacugguugucccgcuuucc

SEQ ID NO: 992908 - RNA, 24 nt, Human
ugagacacaagaauugccugaacc

SEQ ID NO: 992909 - RNA, 18 nt, Human
ugagaccagccuggccaa

SEQ ID NO: 992910 - RNA, 24 nt, Human
ugagaccagccuggccaacacagu

SEQ ID NO: 992911 - RNA, 24 nt, Human
ugagagcccccaacagagauuuac

SEQ ID NO: 992912 - RNA, 18 nt, Human
ugagaugccguuaaucug

SEQ ID NO: 992913 - RNA, 18 nt, Human
ugagaugccguuaaucug

SEQ ID NO: 992914 - RNA, 21 nt, Human
ugagaugccguuaaucuguaa

SEQ ID NO: 992915 - RNA, 24 nt, Human
ugagauuucgucacugcacuccag

SEQ ID NO: 992916 - RNA, 22 nt, Human
ugagcugagauuucgucacugc

SEQ ID NO: 992917 - RNA, 20 nt, Human
ugaggugccacuauaccgcc

SEQ ID NO: 992918 - RNA, 24 nt, Human
ugaucugcccaccucagccuccca

SEQ ID NO: 992919 - RNA, 18 nt, Human
ugcaaaggccgcagggac

SEQ ID NO: 992920 - RNA, 19 nt, Human
ugcagagguuuugcuuaug

SEQ ID NO: 992921 - RNA, 22 nt, Human
ugcaguggcaugaucucagcuc

SEQ ID NO: 992922 - RNA, 23 nt, Human
ugcaguggugugaucauggcuca

SEQ ID NO: 992923 - RNA, 24 nt, Human
ugcccaggcuggucucaaacucuu

SEQ ID NO: 992924 - RNA, 28 nt, Human
ugcccaggcuggucucaaacucuugagc

SEQ ID NO: 992925 - RNA, 19 nt, Human
ugcccugugcaacucugau

SEQ ID NO: 992926 - RNA, 20 nt, Human
ugccguacuuaacauuucua

SEQ ID NO: 992927 - RNA, 25 nt, Human
ugccucagccucccaagcagcugug

SEQ ID NO: 992928 - RNA, 22 nt, Human
ugccucagcuuccugaguagcu

SEQ ID NO: 992929 - RNA, 24 nt, Human
ugccucagcuuccugaguagcuga

SEQ ID NO: 992930 - RNA, 18 nt, Human
ugccugggcuggagugca

SEQ ID NO: 992931 - RNA, 19 nt, Human
ugccugggcuggagugcag

SEQ ID NO: 992932 - RNA, 20 nt, Human
ugccugggcuggagugcagu

SEQ ID NO: 992933 - RNA, 21 nt, Human
ugccugggcuggagugcagug

SEQ ID NO: 992934 - RNA, 22 nt, Human
ugccugggcuggagugcagugg

SEQ ID NO: 992935 - RNA, 24 nt, Human
ugccugggcuggagugcaguggca

SEQ ID NO: 992936 - RNA, 18 nt, Human
ugcuaaaauuacaagcau

SEQ ID NO: 992937 - RNA, 24 nt, Human
ugcugggauuacaggcgugagcca

SEQ ID NO: 992938 - RNA, 26 nt, Human
uggaaggcugagacacaagaauugcc

SEQ ID NO: 992939 - RNA, 24 nt, Human
uggaaugcaguggcacgaucucug

SEQ ID NO: 992940 - RNA, 19 nt, Human
uggagugcaguggcaugau

SEQ ID NO: 992941 - RNA, 24 nt, Human
uggagugcaguggcaugaucucag

SEQ ID NO: 992942 - RNA, 19 nt, Human
uggagugcaguggugugau

SEQ ID NO: 992943 - RNA, 21 nt, Human
uggagugcaguggugugauca

SEQ ID NO: 992944 - RNA, 24 nt, Human
uggagugcaguggugugaucaugg

SEQ ID NO: 992945 - RNA, 24 nt, Human
uggcacgaucucugcucacuguaa

SEQ ID NO: 992946 - RNA, 23 nt, Human
uggcaugaucucagcucacugca

SEQ ID NO: 992947 - RNA, 24 nt, Human
uggccagacuggucucgaacuccu

SEQ ID NO: 992948 - RNA, 24 nt, Human
uggccaggcugcucuugaacuccu

SEQ ID NO: 992949 - RNA, 23 nt, Human
uggccaguuuuggggccaguuua

SEQ ID NO: 992950 - RNA, 22 nt, Human
uggcgcacaucuguaaucccag

SEQ ID NO: 992951 - RNA, 24 nt, Human
uggcucacugcagccucgaccucc

SEQ ID NO: 992952 - RNA, 19 nt, Human
ugggaaacaaagggauggg

SEQ ID NO: 992953 - RNA, 18 nt, Human
ugggauuacaggcgugag

SEQ ID NO: 992954 - RNA, 19 nt, Human
ugggauuacaggcgugagc

SEQ ID NO: 992955 - RNA, 22 nt, Human
ugggauuacaggcgugagccac

SEQ ID NO: 992956 - RNA, 23 nt, Human
ugggauuacaggcgugagccacc

SEQ ID NO: 992957 - RNA, 24 nt, Human
ugggauuacaggcgugagccacca

SEQ ID NO: 992958 - RNA, 19 nt, Human
ugggauuauaggugcaugc

SEQ ID NO: 992959 - RNA, 22 nt, Human
ugggauuauaggugcaugccau

SEQ ID NO: 992960 - RNA, 24 nt, Human
ugggauuauaggugcaugccauca

SEQ ID NO: 992961 - RNA, 21 nt, Human
uggggaaaagagagaucagau

SEQ ID NO: 992962 - RNA, 23 nt, Human
ugggguuucgccauguuggccag

SEQ ID NO: 992963 - RNA, 20 nt, Human
uggguucaaccaauucuccu

SEQ ID NO: 992964 - RNA, 24 nt, Human
ugguggcgcacaucuguaauccca

SEQ ID NO: 992965 - RNA, 24 nt, Human
uggugugaucauggcucacugcag

SEQ ID NO: 992966 - RNA, 21 nt, Human
ugguucacaccuguaauccca

SEQ ID NO: 992967 - RNA, 22 nt, Human
ugguucacaccuguaaucccag

SEQ ID NO: 992968 - RNA, 24 nt, Human
ugguucacaccuguaaucccagca

SEQ ID NO: 992969 - RNA, 19 nt, Human
ugucauagaaugauugcau

SEQ ID NO: 992970 - RNA, 23 nt, Human
ugucucugugucucuuuuccaag

SEQ ID NO: 992971 - RNA, 19 nt, Human
ugucucuuuuccaagucuc

SEQ ID NO: 992972 - RNA, 21 nt, Human
ugugacagcuucuugaucugu

SEQ ID NO: 992973 - RNA, 25 nt, Human
ugugcucccugaaacaugugcugug

SEQ ID NO: 992974 - RNA, 23 nt, Human
uguuacugugucuguguagaaag

SEQ ID NO: 992975 - RNA, 19 nt, Human
uguuuaugaugcagagacc

SEQ ID NO: 992976 - RNA, 24 nt, Human
uuacaagcaugcaccacugcaucc

SEQ ID NO: 992977 - RNA, 24 nt, Human
uuacucuauugccugggcuggagu

SEQ ID NO: 992978 - RNA, 18 nt, Human
uuaguagagaagggguuu

SEQ ID NO: 992979 - RNA, 22 nt, Human
uuaguagagaagggguuucacc

SEQ ID NO: 992980 - RNA, 24 nt, Human
uuaguagagaagggguuucaccau

SEQ ID NO: 992981 - RNA, 28 nt, Human
uuaguagagagagaugggguuucgccau

SEQ ID NO: 992982 - RNA, 18 nt, Human
uucaaccaauucuccugc

SEQ ID NO: 992983 - RNA, 22 nt, Human
uuccacugccuucuggcuucug

SEQ ID NO: 992984 - RNA, 19 nt, Human
uuccagcaauucuugugcc

SEQ ID NO: 992985 - RNA, 23 nt, Human
uuccagcaauucuugugccucag

SEQ ID NO: 992986 - RNA, 24 nt, Human
uucccauucuuucucugcccugug

SEQ ID NO: 992987 - RNA, 23 nt, Human
uucuugugccucagcuuccugag

SEQ ID NO: 992988 - RNA, 22 nt, Human
uugaagccaggaguucaagacc

SEQ ID NO: 992989 - RNA, 21 nt, Human
uugcagugagcugagauuucc

SEQ ID NO: 992990 - RNA, 21 nt, Human
uugcagugagcugagauuucg

SEQ ID NO: 992991 - RNA, 22 nt, Human
uugcagugagcugagauuucgu

SEQ ID NO: 992992 - RNA, 24 nt, Human
uugccugaacccgggaggccgagg

SEQ ID NO: 992993 - RNA, 24 nt, Human
uugccugggcuggagugcaguggc

SEQ ID NO: 992994 - RNA, 23 nt, Human
uuggaaggcugagacacaagaau

SEQ ID NO: 992995 - RNA, 24 nt, Human
uuggaaggcugagacacaagaauu

SEQ ID NO: 992996 - RNA, 22 nt, Human
uuggggccaguuuauggccaga

SEQ ID NO: 992997 - RNA, 23 nt, Human
uuguaaacuccuuuaguuuuguu

SEQ ID NO: 992998 - RNA, 24 nt, Human
uuguagagacaagguuucaccaug

SEQ ID NO: 992999 - RNA, 24 nt, Human
uuuaaggcauugagauguuuaugu

SEQ ID NO: 993000 - RNA, 23 nt, Human
uuucaccauguugcccaggcugg

SEQ ID NO: 993001 - RNA, 24 nt, Human
uuucaccauguugcccaggcuggu

SEQ ID NO: 993002 - RNA, 21 nt, Human
uuucaccauguuggccaggcu

SEQ ID NO: 993003 - RNA, 21 nt, Human
uuucgccauguuggccagacu

SEQ ID NO: 993004 - RNA, 24 nt, Human
uuugccguacuuaacauuucuacc

SEQ ID NO: 993005 - RNA, 24 nt, Human
uuuguagagacaagguuucaccau

SEQ ID NO: 993006 - RNA, 20 nt, Human
uuuucauauuuuuaguagag

SEQ ID NO: 993007 - RNA, 19 nt, Human
uuuuguauuuuuaguagag

SEQ ID NO: 993008 - RNA, 25 nt, Human
uuuuguuuguggcuuaagaaugccu

SEQ ID NO: 993009 - RNA, 24 nt, Human
uuuuuaguagagaagggguuucac

SEQ ID NO: 993010 - RNA, 28 nt, Human
uuuuuaguagagagagaugggguuucgc

SEQ ID NO: 993011 - RNA, 24 nt, Human
uuuuuuguagagacaagguuucac

SEQ ID NO: 993012 - RNA, 21 nt, Human
aaaaagcucagaauaaucaca

SEQ ID NO: 993013 - RNA, 21 nt, Human
agcccgcccucccuucuccag

SEQ ID NO: 993014 - RNA, 21 nt, Human
ccaggccaaaaagcucagaau

SEQ ID NO: 993015 - RNA, 23 nt, Human
cccgcccucccuucuccaggcca

SEQ ID NO: 993016 - RNA, 19 nt, Human
ccucauccuucuuuuggcc

SEQ ID NO: 993017 - RNA, 21 nt, Human
cuccaggccaaaaagcucaga

SEQ ID NO: 993018 - RNA, 19 nt, Human
cucccuucuccaggccaaa

SEQ ID NO: 993019 - RNA, 23 nt, Human
cuccucauccuucuuuuggccuu

SEQ ID NO: 993020 - RNA, 19 nt, Human
cuucuagcccgcccucccu

SEQ ID NO: 993021 - RNA, 19 nt, Human
ucuccaggccaaaaagcuc

SEQ ID NO: 993022 - RNA, 18 nt, Human
uguccuccucauccuucu

SEQ ID NO: 993023 - RNA, 23 nt, Human
uuuuuuggaugcaaaaauaaaua

SEQ ID NO: 993024 - RNA, 18 nt, Human
uuuuuuuuuuuuuuuuug

SEQ ID NO: 993025 - RNA, 18 nt, Human
uuuuuuuuuuuuuuuuug

SEQ ID NO: 993026 - RNA, 18 nt, Human
aaacccgcgccuccuccg

SEQ ID NO: 993027 - RNA, 18 nt, Human
aagaagaaacccgcgccu

SEQ ID NO: 993028 - RNA, 23 nt, Human
aagaggagaggggagguggcggg

SEQ ID NO: 993029 - RNA, 21 nt, Human
acucccccaagccgucuacug

SEQ ID NO: 993030 - RNA, 24 nt, Human
agacugaugugggagggggcggcc

SEQ ID NO: 993031 - RNA, 20 nt, Human
aggaagagggggcaggcggc

SEQ ID NO: 993032 - RNA, 20 nt, Human
aggcaccccuggaacaaggg

SEQ ID NO: 993033 - RNA, 23 nt, Human
agggcugggccaagguugggggu

SEQ ID NO: 993034 - RNA, 26 nt, Human
agguggcgggaggggggagcaggggc

SEQ ID NO: 993035 - RNA, 21 nt, Human
caagggggccacauggcgggg

SEQ ID NO: 993036 - RNA, 23 nt, Human
caagggucuggagacugaugugg

SEQ ID NO: 993037 - RNA, 25 nt, Human
cagaacuuccagauacuguccacac

SEQ ID NO: 993038 - RNA, 18 nt, Human
ccacacucccuccccugg

SEQ ID NO: 993039 - RNA, 20 nt, Human
ccagauacuguccacacucc

SEQ ID NO: 993040 - RNA, 18 nt, Human
ccagcgaguggguguccc

SEQ ID NO: 993041 - RNA, 18 nt, Human
cccaggagggaggguggg

SEQ ID NO: 993042 - RNA, 22 nt, Human
ccccuggggacgucuggguccg

SEQ ID NO: 993043 - RNA, 19 nt, Human
ccccugggucucugccucu

SEQ ID NO: 993044 - RNA, 21 nt, Human
cccugcuggguccgugucucc

SEQ ID NO: 993045 - RNA, 19 nt, Human
cccugggucucugccucuc

SEQ ID NO: 993046 - RNA, 20 nt, Human
ccgcggcucauccugccagg

SEQ ID NO: 993047 - RNA, 24 nt, Human
ccguccugaagcccucccuccucc

SEQ ID NO: 993048 - RNA, 18 nt, Human
ccgugucuccgcuccucg

SEQ ID NO: 993049 - RNA, 26 nt, Human
ccuccccugggcagaggagaggaggc

SEQ ID NO: 993050 - RNA, 24 nt, Human
ccucugaagccccaagggucugga

SEQ ID NO: 993051 - RNA, 27 nt, Human
ccugaagcccucccuccuccaucaagg

SEQ ID NO: 993052 - RNA, 19 nt, Human
cggaaaagaagaaacccgc

SEQ ID NO: 993053 - RNA, 20 nt, Human
cggccgagccccccucugcu

SEQ ID NO: 993054 - RNA, 24 nt, Human
cggccucugaagccccaagggucu

SEQ ID NO: 993055 - RNA, 25 nt, Human
cguccugaagcccucccuccuccaa

SEQ ID NO: 993056 - RNA, 24 nt, Human
cucccuccccugggcagaggagag

SEQ ID NO: 993057 - RNA, 19 nt, Human
cuccgaggagccuaggagc

SEQ ID NO: 993058 - RNA, 21 nt, Human
cuccuugaaggggcucaggca

SEQ ID NO: 993059 - RNA, 20 nt, Human
cugaagcccucccuccucca

SEQ ID NO: 993060 - RNA, 22 nt, Human
cugacgccccguccugaagccc

SEQ ID NO: 993061 - RNA, 22 nt, Human
cugggccaagguuggggguggg

SEQ ID NO: 993062 - RNA, 20 nt, Human
cuggguccgacauggcaggg

SEQ ID NO: 993063 - RNA, 26 nt, Human
cugucccguccucuccgggggccgcg

SEQ ID NO: 993064 - RNA, 23 nt, Human
cuguugcugcugaacuccagagc

SEQ ID NO: 993065 - RNA, 19 nt, Human
gacugaugugggagggggg

SEQ ID NO: 993066 - RNA, 18 nt, Human
gagccccccucugcuccc

SEQ ID NO: 993067 - RNA, 19 nt, Human
gagccuccgacucccccaa

SEQ ID NO: 993068 - RNA, 22 nt, Human
gagggccuggcgggaaccgggg

SEQ ID NO: 993069 - RNA, 21 nt, Human
gcauaggaagagggggcaggc

SEQ ID NO: 993070 - RNA, 18 nt, Human
gcgagugggugucccgag

SEQ ID NO: 993071 - RNA, 19 nt, Human
gcugggccaagguuggggg

SEQ ID NO: 993072 - RNA, 20 nt, Human
ggagaagaggagaggggagg

SEQ ID NO: 993073 - RNA, 24 nt, Human
ggagaggggagguggcgggagggg

SEQ ID NO: 993074 - RNA, 24 nt, Human
ggagcggccucugaagccccaagg

SEQ ID NO: 993075 - RNA, 24 nt, Human
ggagguggcgggaggggggagcag

SEQ ID NO: 993076 - RNA, 21 nt, Human
ggcaguggcggggcacgcagg

SEQ ID NO: 993077 - RNA, 23 nt, Human
ggcugggccaagguugggggugg

SEQ ID NO: 993078 - RNA, 19 nt, Human
gggaacaagaugggggugg

SEQ ID NO: 993079 - RNA, 18 nt, Human
gggcagaggagaggaggc

SEQ ID NO: 993080 - RNA, 19 nt, Human
gggcagccccaaaggcaca

SEQ ID NO: 993081 - RNA, 21 nt, Human
gggcucagggcugggccaagg

SEQ ID NO: 993082 - RNA, 24 nt, Human
gggggucccaggagggaggguggg

SEQ ID NO: 993083 - RNA, 24 nt, Human
gggguggggugucugccggggagc

SEQ ID NO: 993084 - RNA, 23 nt, Human
ggguuggggcuccuugaaggggc

SEQ ID NO: 993085 - RNA, 23 nt, Human
gguuggggcuccuugaaggggcu

SEQ ID NO: 993086 - RNA, 19 nt, Human
guccgugucuccgcuccuc

SEQ ID NO: 993087 - RNA, 20 nt, Human
guccugaagcccucccuccu

SEQ ID NO: 993088 - RNA, 23 nt, Human
gugaggggagaagaggagagggg

SEQ ID NO: 993089 - RNA, 20 nt, Human
gugggagggggcggccgagc

SEQ ID NO: 993090 - RNA, 24 nt, Human
guuuuuccugcugcuguugcugcc

SEQ ID NO: 993091 - RNA, 21 nt, Human
uaggagcggccucugaagccc

SEQ ID NO: 993092 - RNA, 25 nt, Human
ucagaggcugucccguccucuccgg

SEQ ID NO: 993093 - RNA, 21 nt, Human
ucagaguuuuuaauuauuauu

SEQ ID NO: 993094 - RNA, 18 nt, Human
uccacacucccuccccug

SEQ ID NO: 993095 - RNA, 22 nt, Human
uccacacucccuccccugggca

SEQ ID NO: 993096 - RNA, 19 nt, Human
uccccugggcagaggagag

SEQ ID NO: 993097 - RNA, 21 nt, Human
ucccuggggccuccuggccau

SEQ ID NO: 993098 - RNA, 24 nt, Human
ucccuggggcucagggcugggcca

SEQ ID NO: 993099 - RNA, 20 nt, Human
uccuccaucaaggcugggga

SEQ ID NO: 993100 - RNA, 19 nt, Human
uccugcugcuguugcugcu

SEQ ID NO: 993101 - RNA, 20 nt, Human
ucuccgaggaaaguuugcuc

SEQ ID NO: 993102 - RNA, 21 nt, Human
ucuggagacugaugugggagg

SEQ ID NO: 993103 - RNA, 20 nt, Human
ugaagccccaagggucugga

SEQ ID NO: 993104 - RNA, 19 nt, Human
ugacgcaaggccgggcagc

SEQ ID NO: 993105 - RNA, 21 nt, Human
ugaugugggagggggcggccg

SEQ ID NO: 993106 - RNA, 19 nt, Human
ugccggggagccuccgacu

SEQ ID NO: 993107 - RNA, 23 nt, Human
uggcgggaggggggagcaggggc

SEQ ID NO: 993108 - RNA, 19 nt, Human
ugggagggggcggccgagc

SEQ ID NO: 993109 - RNA, 22 nt, Human
ugggcagaggagaggaggcacc

SEQ ID NO: 993110 - RNA, 22 nt, Human
uggggaugaugaggagaugggg

SEQ ID NO: 993111 - RNA, 25 nt, Human
uggggguggggugucugcccccccg

SEQ ID NO: 993112 - RNA, 20 nt, Human
ugggugaggggagaagagga

SEQ ID NO: 993113 - RNA, 25 nt, Human
ugggugaggggagaagaggagaggg

SEQ ID NO: 993114 - RNA, 23 nt, Human
ugucccguccucuccgggggccg

SEQ ID NO: 993115 - RNA, 21 nt, Human
uguugcugcugaacuccagag

SEQ ID NO: 993116 - RNA, 23 nt, Human
uuaauaacaaccugaaucccaga

SEQ ID NO: 993117 - RNA, 18 nt, Human
uuacugagccuugaacuc

SEQ ID NO: 993118 - RNA, 21 nt, Human
uugcaaacucuggggccucgg

SEQ ID NO: 993119 - RNA, 26 nt, Human
uuuuccugcugcuguugcugcugaac

SEQ ID NO: 993120 - RNA, 25 nt, Human
uuuuuuuuuuuucuucagaguuuuu

SEQ ID NO: 993121 - RNA, 24 nt, Human
uuuuuuuuuuuuuuuuuucuucag

SEQ ID NO: 993122 - RNA, 25 nt, Human
aaccauuuccucaacuuuucuucug

SEQ ID NO: 993123 - RNA, 18 nt, Human
aagaguagcuuagaggag

SEQ ID NO: 993124 - RNA, 19 nt, Human
aagaguagcuuagaggagg

SEQ ID NO: 993125 - RNA, 20 nt, Human
aagaguagcuuagaggaggg

SEQ ID NO: 993126 - RNA, 18 nt, Human
acaccuugccaccccagg

SEQ ID NO: 993127 - RNA, 21 nt, Human
accucaaagcccgagagucuc

SEQ ID NO: 993128 - RNA, 26 nt, Human
accucggugacauuaaggccccgucg

SEQ ID NO: 993129 - RNA, 19 nt, Human
agaccccuagaaagcaggc

SEQ ID NO: 993130 - RNA, 23 nt, Human
agccuugagaaccugucucaaca

SEQ ID NO: 993131 - RNA, 20 nt, Human
aggagggggaagaaacaggc

SEQ ID NO: 993132 - RNA, 19 nt, Human
aggcagcgcuggagagaga

SEQ ID NO: 993133 - RNA, 19 nt, Human
aggcagcgcuggagagaga

SEQ ID NO: 993134 - RNA, 18 nt, Human
aggggggguggcaaggga

SEQ ID NO: 993135 - RNA, 23 nt, Human
agguaugcaucuuccccugagcc

SEQ ID NO: 993136 - RNA, 19 nt, Human
aguggacuccguuagaccc

SEQ ID NO: 993137 - RNA, 18 nt, Human
augaggggcacacugugu

SEQ ID NO: 993138 - RNA, 19 nt, Human
augcaucuuccccugagcc

SEQ ID NO: 993139 - RNA, 22 nt, Human
cacaggaggcacucuacccucu

SEQ ID NO: 993140 - RNA, 25 nt, Human
caccuugccaccccaggaggcuacu

SEQ ID NO: 993141 - RNA, 18 nt, Human
cacuaccggccagcggaa

SEQ ID NO: 993142 - RNA, 19 nt, Human
cagaguucccuuccccuuc

SEQ ID NO: 993143 - RNA, 26 nt, Human
cagcggaacuucaggucucaccucaa

SEQ ID NO: 993144 - RNA, 20 nt, Human
cagcuccuggggcgucaacu

SEQ ID NO: 993145 - RNA, 18 nt, Human
ccacugcugcugaugucc

SEQ ID NO: 993146 - RNA, 18 nt, Human
ccacugcugcugaugucc

SEQ ID NO: 993147 - RNA, 21 nt, Human
ccaggggagaggggcggccca

SEQ ID NO: 993148 - RNA, 18 nt, Human
ccccuaaacuuccacagg

SEQ ID NO: 993149 - RNA, 23 nt, Human
ccccucucuacaccuugccaccc

SEQ ID NO: 993150 - RNA, 19 nt, Human
ccccugagccuugagaacc

SEQ ID NO: 993151 - RNA, 18 nt, Human
cccucucuacaccuugcc

SEQ ID NO: 993152 - RNA, 20 nt, Human
ccuaaacuuccacaggaggc

SEQ ID NO: 993153 - RNA, 21 nt, Human
ccuaaacuuccacaggaggca

SEQ ID NO: 993154 - RNA, 20 nt, Human
ccucggugacauuaaggccc

SEQ ID NO: 993155 - RNA, 21 nt, Human
ccucucuacaccuugccaccc

SEQ ID NO: 993156 - RNA, 21 nt, Human
ccuuccacugcugcugauguc

SEQ ID NO: 993157 - RNA, 21 nt, Human
cggguguccuuucaacgcccc

SEQ ID NO: 993158 - RNA, 23 nt, Human
cuagaguucuaacagcgauuccc

SEQ ID NO: 993159 - RNA, 24 nt, Human
cuccaggucagggaacaaauuugc

SEQ ID NO: 993160 - RNA, 21 nt, Human
cucccuggaaaaacuuaugag

SEQ ID NO: 993161 - RNA, 21 nt, Human
cuggugcucagcuccuggggc

SEQ ID NO: 993162 - RNA, 21 nt, Human
cuuccacugcugcugaugucc

SEQ ID NO: 993163 - RNA, 23 nt, Human
gaagcagccagggagggcucaag

SEQ ID NO: 993164 - RNA, 18 nt, Human
gacggaugagcgagagga

SEQ ID NO: 993165 - RNA, 20 nt, Human
gagagucuccucgcgggacc

SEQ ID NO: 993166 - RNA, 19 nt, Human
gcacaguggcaaagucaga

SEQ ID NO: 993167 - RNA, 22 nt, Human
gccucuccucaucuucuaacuc

SEQ ID NO: 993168 - RNA, 20 nt, Human
gccuggugcucagcuccugg

SEQ ID NO: 993169 - RNA, 21 nt, Human
gccuggugcucagcuccuggg

SEQ ID NO: 993170 - RNA, 18 nt, Human
gcggggagggggcagcug

SEQ ID NO: 993171 - RNA, 24 nt, Human
gcggguguccuuucaacgcccccc

SEQ ID NO: 993172 - RNA, 19 nt, Human
ggaacaaauuugccccuaa

SEQ ID NO: 993173 - RNA, 19 nt, Human
ggcacagugggcccaggag

SEQ ID NO: 993174 - RNA, 21 nt, Human
gggagaggggcggcccacaga

SEQ ID NO: 993175 - RNA, 23 nt, Human
gggcggggagggggcagcuguug

SEQ ID NO: 993176 - RNA, 20 nt, Human
ggggagggggcagcuguugg

SEQ ID NO: 993177 - RNA, 19 nt, Human
guccuuucaacgccccccu

SEQ ID NO: 993178 - RNA, 20 nt, Human
gugcucagcuccuggggcgu

SEQ ID NO: 993179 - RNA, 23 nt, Human
uaacagcaagggaagagcauucu

SEQ ID NO: 993180 - RNA, 19 nt, Human
uacugcccuuuucucucua

SEQ ID NO: 993181 - RNA, 21 nt, Human
uagaaagcaggccggguagcg

SEQ ID NO: 993182 - RNA, 21 nt, Human
uagaauuucuagaguucuaac

SEQ ID NO: 993183 - RNA, 24 nt, Human
uagaauuucuagaguucuaacagc

SEQ ID NO: 993184 - RNA, 23 nt, Human
uagcggguguccuuucaacgccc

SEQ ID NO: 993185 - RNA, 22 nt, Human
ucaacuuuucuucuguuuccca

SEQ ID NO: 993186 - RNA, 25 nt, Human
uccacugcugcugauguccucaauu

SEQ ID NO: 993187 - RNA, 18 nt, Human
ucccaaggcagggaaauc

SEQ ID NO: 993188 - RNA, 22 nt, Human
ucccaaggcagggaaaucccug

SEQ ID NO: 993189 - RNA, 18 nt, Human
ucccacaucccaaggcag

SEQ ID NO: 993190 - RNA, 18 nt, Human
uccccugagccuugagaa

SEQ ID NO: 993191 - RNA, 19 nt, Human
uccuuucaacgccccccuc

SEQ ID NO: 993192 - RNA, 20 nt, Human
ucugacagugacaggucucc

SEQ ID NO: 993193 - RNA, 23 nt, Human
ucugacagugacaggucuccagu

SEQ ID NO: 993194 - RNA, 23 nt, Human
ugaauaacagcaagggaagagca

SEQ ID NO: 993195 - RNA, 26 nt, Human
ugccccuaaacuuccacaggaggcac

SEQ ID NO: 993196 - RNA, 24 nt, Human
ugcuacacuaccggccagcggaac

SEQ ID NO: 993197 - RNA, 18 nt, Human
uggagagagaggagucac

SEQ ID NO: 993198 - RNA, 19 nt, Human
uggagagagaggagucacu

SEQ ID NO: 993199 - RNA, 23 nt, Human
uggcaagggauuuuccugugcuu

SEQ ID NO: 993200 - RNA, 18 nt, Human
uggcagaaucaauggcau

SEQ ID NO: 993201 - RNA, 25 nt, Human
uggcaucgaccaagggagggggggu

SEQ ID NO: 993202 - RNA, 24 nt, Human
uuccccugagccuugagaaccugu

SEQ ID NO: 993203 - RNA, 18 nt, Human
uugcugaguucccaagga

SEQ ID NO: 993204 - RNA, 22 nt, Human
uuucuaacccucuccaggucag

SEQ ID NO: 993205 - RNA, 25 nt, Human
uuuugaggaaagccauauuugggua

SEQ ID NO: 993206 - RNA, 22 nt, Human
uuuuuugaggaaagccauauuu

SEQ ID NO: 993207 - RNA, 24 nt, Human
uuuuuuuuuuuuugaggaaagcca

SEQ ID NO: 993208 - RNA, 19 nt, Human
uuuuuuuuuuuuuugagga

SEQ ID NO: 993209 - RNA, 21 nt, Human
uuuuuuuuuuuuuuuuugagg

SEQ ID NO: 993210 - RNA, 19 nt, Human
aaaaaguucucuucagaaa

SEQ ID NO: 993211 - RNA, 19 nt, Human
acaacacacuuuccgcaug

SEQ ID NO: 993212 - RNA, 19 nt, Human
acacacacacuugucugcg

SEQ ID NO: 993213 - RNA, 21 nt, Human
acacacacacuugucugcgua

SEQ ID NO: 993214 - RNA, 20 nt, Human
acacgcugagacaaagaggg

SEQ ID NO: 993215 - RNA, 24 nt, Human
acagagaaaggacugcucucugaa

SEQ ID NO: 993216 - RNA, 23 nt, Human
acaggggagagcacagcccagug

SEQ ID NO: 993217 - RNA, 19 nt, Human
accccaagccuucccucuc

SEQ ID NO: 993218 - RNA, 24 nt, Human
agaaacuccucuuucccccaccuc

SEQ ID NO: 993219 - RNA, 19 nt, Human
agaaagacagcaggcacca

SEQ ID NO: 993220 - RNA, 24 nt, Human
agaaagacagcaggcaccaagaaa

SEQ ID NO: 993221 - RNA, 27 nt, Human
agaaaggacugcucucugaagggugaa

SEQ ID NO: 993222 - RNA, 20 nt, Human
agagccccuccgcaccucau

SEQ ID NO: 993223 - RNA, 24 nt, Human
agagccccuccgcaccucauucuu

SEQ ID NO: 993224 - RNA, 24 nt, Human
agcaggagggaggcagugcuugga

SEQ ID NO: 993225 - RNA, 27 nt, Human
agcagucgggugggggagaccggugcc

SEQ ID NO: 993226 - RNA, 22 nt, Human
agccccagcuaccacuacagcc

SEQ ID NO: 993227 - RNA, 21 nt, Human
aggcacugcuucuccuccccc

SEQ ID NO: 993228 - RNA, 21 nt, Human
aggcagccacaggcccugggg

SEQ ID NO: 993229 - RNA, 24 nt, Human
aggcagccacaggcccugggguga

SEQ ID NO: 993230 - RNA, 19 nt, Human
aggcagugcuuggaucagc

SEQ ID NO: 993231 - RNA, 20 nt, Human
agggaggucaacgugcuggc

SEQ ID NO: 993232 - RNA, 23 nt, Human
aggguggggugggggcuggaggu

SEQ ID NO: 993233 - RNA, 19 nt, Human
cacauaacacgcugagaca

SEQ ID NO: 993234 - RNA, 21 nt, Human
cacauaacacgcugagacaaa

SEQ ID NO: 993235 - RNA, 27 nt, Human
caccaagaagagagagcccccacccca

SEQ ID NO: 993236 - RNA, 24 nt, Human
caccaggcacugcacuugggcucc

SEQ ID NO: 993237 - RNA, 19 nt, Human
caccagugaggccagaucc

SEQ ID NO: 993238 - RNA, 25 nt, Human
caccuggacagagcaggagggaggc

SEQ ID NO: 993239 - RNA, 19 nt, Human
cacgcugagacaaagaggg

SEQ ID NO: 993240 - RNA, 18 nt, Human
cagcaaccuagagugucc

SEQ ID NO: 993241 - RNA, 18 nt, Human
cagcagcaccggagagcc

SEQ ID NO: 993242 - RNA, 19 nt, Human
cagcagcaccggagagccc

SEQ ID NO: 993243 - RNA, 22 nt, Human
cagcagcaccggagagccccuc

SEQ ID NO: 993244 - RNA, 18 nt, Human
cagccacaccuucuccgu

SEQ ID NO: 993245 - RNA, 22 nt, Human
cagccacaccuucuccgucuca

SEQ ID NO: 993246 - RNA, 28 nt, Human
cagcuaccacuacagcccccucccacuc

SEQ ID NO: 993247 - RNA, 21 nt, Human
caggcacugcacuugggcucc

SEQ ID NO: 993248 - RNA, 26 nt, Human
caggguagaagccaagagucuggcau

SEQ ID NO: 993249 - RNA, 18 nt, Human
cauccaggauggccccau

SEQ ID NO: 993250 - RNA, 20 nt, Human
caucggguaaacaggggaga

SEQ ID NO: 993251 - RNA, 22 nt, Human
ccacaccuucuccgucucauuc

SEQ ID NO: 993252 - RNA, 19 nt, Human
ccacauccaggauggcccc

SEQ ID NO: 993253 - RNA, 18 nt, Human
ccagaccacaugguguug

SEQ ID NO: 993254 - RNA, 19 nt, Human
ccagcaaccuagagugucc

SEQ ID NO: 993255 - RNA, 19 nt, Human
cccaauccuccccauggac

SEQ ID NO: 993256 - RNA, 23 nt, Human
cccacggugacacaggguagaag

SEQ ID NO: 993257 - RNA, 21 nt, Human
ccccaagccuucccucucaag

SEQ ID NO: 993258 - RNA, 22 nt, Human
ccccagcuaccacuacagcccc

SEQ ID NO: 993259 - RNA, 20 nt, Human
cccgagucguucuugggagc

SEQ ID NO: 993260 - RNA, 21 nt, Human
cccuccgcaccucauucuuaa

SEQ ID NO: 993261 - RNA, 26 nt, Human
cccuccgcaccucauucuuaagaacc

SEQ ID NO: 993262 - RNA, 19 nt, Human
cccuggggugagagggcug

SEQ ID NO: 993263 - RNA, 21 nt, Human
ccucuucugcugcaaucuguu

SEQ ID NO: 993264 - RNA, 21 nt, Human
cgcuaugagccaggcacaggg

SEQ ID NO: 993265 - RNA, 20 nt, Human
cucaacccagcccagcagca

SEQ ID NO: 993266 - RNA, 26 nt, Human
cucauccacauccaggauggccccau

SEQ ID NO: 993267 - RNA, 22 nt, Human
cucucugaagggugaagaugga

SEQ ID NO: 993268 - RNA, 22 nt, Human
cugcuucuccucccccaauccu

SEQ ID NO: 993269 - RNA, 21 nt, Human
cuggcuccaugcagugccagg

SEQ ID NO: 993270 - RNA, 21 nt, Human
cuucacacgcaccuuccccuc

SEQ ID NO: 993271 - RNA, 22 nt, Human
cuucagaaacuccucuuucccc

SEQ ID NO: 993272 - RNA, 27 nt, Human
cuucagaaacuccucuuucccccaccu

SEQ ID NO: 993273 - RNA, 22 nt, Human
gaaacuccucuuucccccaccu

SEQ ID NO: 993274 - RNA, 18 nt, Human
gacacgggcucaggacac

SEQ ID NO: 993275 - RNA, 21 nt, Human
gacccggcucuccucaccagc

SEQ ID NO: 993276 - RNA, 22 nt, Human
gagacagaggagcaaaaaguuc

SEQ ID NO: 993277 - RNA, 18 nt, Human
gagcacagcccagugagu

SEQ ID NO: 993278 - RNA, 20 nt, Human
gagcaggagggaggcagugc

SEQ ID NO: 993279 - RNA, 25 nt, Human
gaggguggggugggggcuggaggug

SEQ ID NO: 993280 - RNA, 21 nt, Human
gaugggagcagcaccaggcac

SEQ ID NO: 993281 - RNA, 25 nt, Human
gcacugcuucuccucccccaauccu

SEQ ID NO: 993282 - RNA, 22 nt, Human
gccaggcacaggggaaggcacu

SEQ ID NO: 993283 - RNA, 18 nt, Human
gcccaggcagccacaggc

SEQ ID NO: 993284 - RNA, 22 nt, Human
ggagagaaggggggcggcagau

SEQ ID NO: 993285 - RNA, 19 nt, Human
ggcccuggggugagagggc

SEQ ID NO: 993286 - RNA, 24 nt, Human
ggccucuucugcugcaaucuguuc

SEQ ID NO: 993287 - RNA, 22 nt, Human
ggcucuccucaccagcgucucc

SEQ ID NO: 993288 - RNA, 18 nt, Human
ggcuggaggugcggaugg

SEQ ID NO: 993289 - RNA, 25 nt, Human
gggagguuggaagaaugacacgggc

SEQ ID NO: 993290 - RNA, 21 nt, Human
gggccaagaaccagcaggcug

SEQ ID NO: 993291 - RNA, 18 nt, Human
gggggccaagaaccagca

SEQ ID NO: 993292 - RNA, 19 nt, Human
gggugggggcuggaggugc

SEQ ID NO: 993293 - RNA, 21 nt, Human
gguagaagccaagagucuggc

SEQ ID NO: 993294 - RNA, 22 nt, Human
gucaggguguuucccaugcaga

SEQ ID NO: 993295 - RNA, 23 nt, Human
gugcuuggaucagcccugaacug

SEQ ID NO: 993296 - RNA, 20 nt, Human
gugggggcugggaccuccag

SEQ ID NO: 993297 - RNA, 24 nt, Human
uaaauaggucauugcacauaacac

SEQ ID NO: 993298 - RNA, 18 nt, Human
uaagaaccuggacccggc

SEQ ID NO: 993299 - RNA, 27 nt, Human
uaaugagcaccggccaaaacuuccauc

SEQ ID NO: 993300 - RNA, 24 nt, Human
uagggugggggcugggaccuccag

SEQ ID NO: 993301 - RNA, 19 nt, Human
ucaccagcgucuccagcug

SEQ ID NO: 993302 - RNA, 22 nt, Human
ucaccagcgucuccagcugcac

SEQ ID NO: 993303 - RNA, 18 nt, Human
ucauacaggucuccucau

SEQ ID NO: 993304 - RNA, 23 nt, Human
uccacacacacacuugucugcgg

SEQ ID NO: 993305 - RNA, 24 nt, Human
uccacacacacacuugucugcgua

SEQ ID NO: 993306 - RNA, 25 nt, Human
uccacacacacacuugucugcguag

SEQ ID NO: 993307 - RNA, 24 nt, Human
uccaucuucaguuuuucugaucac

SEQ ID NO: 993308 - RNA, 19 nt, Human
uccccucaggcaaguugag

SEQ ID NO: 993309 - RNA, 19 nt, Human
uccgucucauuccaggccu

SEQ ID NO: 993310 - RNA, 18 nt, Human
uccucaaccccaagccuu

SEQ ID NO: 993311 - RNA, 20 nt, Human
uccucccccaauccucccca

SEQ ID NO: 993312 - RNA, 24 nt, Human
ugaacugcuguaguuggaaugggu

SEQ ID NO: 993313 - RNA, 21 nt, Human
ugaauccucauaacaacacac

SEQ ID NO: 993314 - RNA, 24 nt, Human
ugaauccucauaacaacacacuuu

SEQ ID NO: 993315 - RNA, 20 nt, Human
ugacagaagaaggucagggg

SEQ ID NO: 993316 - RNA, 20 nt, Human
ugacagaagaaggucagggu

SEQ ID NO: 993317 - RNA, 20 nt, Human
ugagacaaagaggguggggu

SEQ ID NO: 993318 - RNA, 24 nt, Human
ugagcuccucagauuugaguugac

SEQ ID NO: 993319 - RNA, 19 nt, Human
ugcccacggugacacaggg

SEQ ID NO: 993320 - RNA, 22 nt, Human
ugcugcaaucuguucuucuguu

SEQ ID NO: 993321 - RNA, 21 nt, Human
ugcuucuccucccccaauccu

SEQ ID NO: 993322 - RNA, 24 nt, Human
uggaagaaugacacgggcucagga

SEQ ID NO: 993323 - RNA, 22 nt, Human
uggaauggguuuaccuuaaaua

SEQ ID NO: 993324 - RNA, 19 nt, Human
ugggagaggugcccaggca

SEQ ID NO: 993325 - RNA, 26 nt, Human
ugggauaagugugugggggcagggag

SEQ ID NO: 993326 - RNA, 22 nt, Human
ugggggagaccggugccccacc

SEQ ID NO: 993327 - RNA, 18 nt, Human
uggggugagagggcugcc

SEQ ID NO: 993328 - RNA, 18 nt, Human
uggggugggggcuggagg

SEQ ID NO: 993329 - RNA, 23 nt, Human
uggggugggggcuggaggugcgg

SEQ ID NO: 993330 - RNA, 23 nt, Human
ugguccagcuucacacgcaccuu

SEQ ID NO: 993331 - RNA, 22 nt, Human
ugucccaguaggcaaccugucc

SEQ ID NO: 993332 - RNA, 19 nt, Human
ugucugggauaagugugug

SEQ ID NO: 993333 - RNA, 22 nt, Human
aaaaugaagaaaaagaagagga

SEQ ID NO: 993334 - RNA, 18 nt, Human
aaacccaggaaugaacag

SEQ ID NO: 993335 - RNA, 18 nt, Human
aaagaaaaugcccagagg

SEQ ID NO: 993336 - RNA, 21 nt, Human
aaaugaagaaaaagaagagga

SEQ ID NO: 993337 - RNA, 26 nt, Human
aacucuuugcauauaauuucagagaa

SEQ ID NO: 993338 - RNA, 27 nt, Human
aagaaaaagaagaggaugacgcagaga

SEQ ID NO: 993339 - RNA, 24 nt, Human
aagaaaaagcaaaaaugaagaaaa

SEQ ID NO: 993340 - RNA, 21 nt, Human
aagcaaaaacuaacaaacagc

SEQ ID NO: 993341 - RNA, 20 nt, Human
aagcgaagaaaaagcaaaaa

SEQ ID NO: 993342 - RNA, 21 nt, Human
aagcuuucuuuuaauauauac

SEQ ID NO: 993343 - RNA, 23 nt, Human
aaucuuuacaaccauuuuguggg

SEQ ID NO: 993344 - RNA, 19 nt, Human
aaugaagaaaaagaagagg

SEQ ID NO: 993345 - RNA, 25 nt, Human
agaaaaagcaaaaaugaagaaaaag

SEQ ID NO: 993346 - RNA, 28 nt, Human
agaaaaaugugugaugaagacccacaac

SEQ ID NO: 993347 - RNA, 24 nt, Human
agagaagaacucaagcgaagaaaa

SEQ ID NO: 993348 - RNA, 18 nt, Human
agcaaaaacuaacaaaca

SEQ ID NO: 993349 - RNA, 28 nt, Human
agcgaagaaaaagcaaaaaugaagaaaa

SEQ ID NO: 993350 - RNA, 24 nt, Human
caagcugguggaaaaagugguuca

SEQ ID NO: 993351 - RNA, 21 nt, Human
cacuaugccacauaucaugcc

SEQ ID NO: 993352 - RNA, 23 nt, Human
cacuucacucccuugauacagcc

SEQ ID NO: 993353 - RNA, 25 nt, Human
cacuucacucccuugauacagccca

SEQ ID NO: 993354 - RNA, 24 nt, Human
cagaauguaccaucuuccaugccu

SEQ ID NO: 993355 - RNA, 18 nt, Human
cagcccaagauagagcag

SEQ ID NO: 993356 - RNA, 26 nt, Human
caucucacacuuuaagagccucugug

SEQ ID NO: 993357 - RNA, 21 nt, Human
caugccuagagaugaaaccga

SEQ ID NO: 993358 - RNA, 19 nt, Human
ccaugccuagagaugaaac

SEQ ID NO: 993359 - RNA, 22 nt, Human
cuaccagaugucgauuugcacu

SEQ ID NO: 993360 - RNA, 25 nt, Human
cucuccaucucacacuuuaagagcc

SEQ ID NO: 993361 - RNA, 20 nt, Human
cuuccaugccuagagaugaa

SEQ ID NO: 993362 - RNA, 19 nt, Human
gaaagcacgggcaggcugu

SEQ ID NO: 993363 - RNA, 23 nt, Human
gaaagcacgggcaggcuguuaga

SEQ ID NO: 993364 - RNA, 21 nt, Human
gacccuacucuucggccccac

SEQ ID NO: 993365 - RNA, 21 nt, Human
gacgauacaaaugccaaugac

SEQ ID NO: 993366 - RNA, 19 nt, Human
gauacaguacaagcuuucu

SEQ ID NO: 993367 - RNA, 18 nt, Human
gcugcugccugggggcga

SEQ ID NO: 993368 - RNA, 21 nt, Human
gcuuggaaagcacgggcaggc

SEQ ID NO: 993369 - RNA, 30 nt, Human
ggaaugaacaguuuuuuuuuuuuuuuuuuu

SEQ ID NO: 993370 - RNA, 23 nt, Human
guuuuuuuuuuuuuuuuuuuggg

SEQ ID NO: 993371 - RNA, 23 nt, Human
uaaacagcaucuauuacaaucua

SEQ ID NO: 993372 - RNA, 21 nt, Human
uaaagcaaaaacuaacaaaca

SEQ ID NO: 993373 - RNA, 22 nt, Human
uaaagcaaaaacuaacaaacag

SEQ ID NO: 993374 - RNA, 20 nt, Human
uaacaaacagcugaaagaaa

SEQ ID NO: 993375 - RNA, 20 nt, Human
uacagaaugacgauacaaau

SEQ ID NO: 993376 - RNA, 19 nt, Human
uacugcacaaaacccagga

SEQ ID NO: 993377 - RNA, 23 nt, Human
uacugccaucgagggcucagaau

SEQ ID NO: 993378 - RNA, 20 nt, Human
uauacagaaaaaugugugau

SEQ ID NO: 993379 - RNA, 18 nt, Human
uccaugccuagagaugaa

SEQ ID NO: 993380 - RNA, 19 nt, Human
ucccugaagcgcagcgcuu

SEQ ID NO: 993381 - RNA, 25 nt, Human
ucuucggccccaccagcucuccauc

SEQ ID NO: 993382 - RNA, 23 nt, Human
ugaagacccacaacucuuugcau

SEQ ID NO: 993383 - RNA, 22 nt, Human
ugacgcagagaauuacagacuc

SEQ ID NO: 993384 - RNA, 22 nt, Human
ugcaauuuccacuuuaccacca

SEQ ID NO: 993385 - RNA, 22 nt, Human
ugcacaaaacccaggaaugaac

SEQ ID NO: 993386 - RNA, 20 nt, Human
ugccaucgagggcucagaau

SEQ ID NO: 993387 - RNA, 27 nt, Human
ugccccuaaaccacauuaaaauaacuu

SEQ ID NO: 993388 - RNA, 18 nt, Human
uggaaaggucuguuuaug

SEQ ID NO: 993389 - RNA, 25 nt, Human
uggauauaaacuaaguaauuuacag

SEQ ID NO: 993390 - RNA, 18 nt, Human
uggcagagaaaauaaaua

SEQ ID NO: 993391 - RNA, 24 nt, Human
uggccuuugaaaacuauuaaucac

SEQ ID NO: 993392 - RNA, 24 nt, Human
uguauacugcacaaaacccaggaa

SEQ ID NO: 993393 - RNA, 22 nt, Human
ugugggaaaauguauacugcac

SEQ ID NO: 993394 - RNA, 19 nt, Human
uucagagaagaacucaagc

SEQ ID NO: 993395 - RNA, 26 nt, Human
uucagagaagaacucaagcgaagaaa

SEQ ID NO: 993396 - RNA, 22 nt, Human
uugaucacacuaugccacauau

SEQ ID NO: 993397 - RNA, 22 nt, Human
uugccccuaaaccacauuaaaa

SEQ ID NO: 993398 - RNA, 19 nt, Human
uuuuuuuuuuuuuuuuugc

SEQ ID NO: 993399 - RNA, 21 nt, Human
uuuuuuuuuuuuuuuuugcaa

SEQ ID NO: 993400 - RNA, 23 nt, Human
aaaacaaaaaugcaaaaacaaag

SEQ ID NO: 993401 - RNA, 20 nt, Human
aaacaaaaaugcaaaaacaa

SEQ ID NO: 993402 - RNA, 24 nt, Human
aaagaagauaacucuagaaaaaga

SEQ ID NO: 993403 - RNA, 18 nt, Human
aacuuuuguuuuccaagg

SEQ ID NO: 993404 - RNA, 23 nt, Human
aagaaacugcaggcaaacuaaag

SEQ ID NO: 993405 - RNA, 21 nt, Human
aauaaagaagauaacucuaga

SEQ ID NO: 993406 - RNA, 27 nt, Human
aauaaagaagauaacucuagaaaaaga

SEQ ID NO: 993407 - RNA, 19 nt, Human
accuccacauccccaaaaa

SEQ ID NO: 993408 - RNA, 18 nt, Human
caaaacaaaaaugcaaaa

SEQ ID NO: 993409 - RNA, 21 nt, Human
cacaagaaacugcaggcaaac

SEQ ID NO: 993410 - RNA, 20 nt, Human
cacuauauaacagaauaaaa

SEQ ID NO: 993411 - RNA, 21 nt, Human
ccaauucuuugggcccucuua

SEQ ID NO: 993412 - RNA, 24 nt, Human
ccgccgccgccgcgcucagcgccg

SEQ ID NO: 993413 - RNA, 18 nt, Human
ccgccgcgcucagcgccg

SEQ ID NO: 993414 - RNA, 20 nt, Human
cgccgcucccgccgccgccg

SEQ ID NO: 993415 - RNA, 20 nt, Human
cgcucccgccgccgccgcgc

SEQ ID NO: 993416 - RNA, 18 nt, Human
cuaacccaggcggggccu

SEQ ID NO: 993417 - RNA, 22 nt, Human
cugccuguggccgaagcccuuu

SEQ ID NO: 993418 - RNA, 21 nt, Human
cuggaaagacuaggaauaaua

SEQ ID NO: 993419 - RNA, 30 nt, Human
cuggaaagacuaggaauaauaaagaagaua

SEQ ID NO: 993420 - RNA, 18 nt, Human
cuguggccgaagcccuuu

SEQ ID NO: 993421 - RNA, 24 nt, Human
cuucgugccaggcuguggggcuuc

SEQ ID NO: 993422 - RNA, 19 nt, Human
cuuuaagcccacguugugg

SEQ ID NO: 993423 - RNA, 19 nt, Human
gaccugccuguggccgaag

SEQ ID NO: 993424 - RNA, 22 nt, Human
gccgccgcgcucagcgccgucu

SEQ ID NO: 993425 - RNA, 24 nt, Human
ggcugcuaggcugcuggcugcuug

SEQ ID NO: 993426 - RNA, 20 nt, Human
uaaaacuuuuguuuuccaag

SEQ ID NO: 993427 - RNA, 19 nt, Human
uaaaguaacaaauaugcac

SEQ ID NO: 993428 - RNA, 22 nt, Human
uaacaaauaugcacacagauuc

SEQ ID NO: 993429 - RNA, 20 nt, Human
uaacaggacaacauuugucc

SEQ ID NO: 993430 - RNA, 23 nt, Human
uaauguuuauuuccuuccagccu

SEQ ID NO: 993431 - RNA, 24 nt, Human
uacaacaaaagaaauauugugcaa

SEQ ID NO: 993432 - RNA, 20 nt, Human
uagaagaaucacauugaaaa

SEQ ID NO: 993433 - RNA, 24 nt, Human
uagauauauuuaaucacuacaucc

SEQ ID NO: 993434 - RNA, 19 nt, Human
uauaaaguacaacaaaaga

SEQ ID NO: 993435 - RNA, 22 nt, Human
ucaaaacaaaaaugcaaaaaca

SEQ ID NO: 993436 - RNA, 18 nt, Human
uccacuauauaacagaau

SEQ ID NO: 993437 - RNA, 19 nt, Human
ucgugccaggcuguggggc

SEQ ID NO: 993438 - RNA, 24 nt, Human
ucuacccaacuaccuccacauccc

SEQ ID NO: 993439 - RNA, 22 nt, Human
ugaugucagaaaucuacaccca

SEQ ID NO: 993440 - RNA, 18 nt, Human
ugcuggcugcuuggccac

SEQ ID NO: 993441 - RNA, 22 nt, Human
uggucucaaguauaaacagcaa

SEQ ID NO: 993442 - RNA, 23 nt, Human
ugugauaagaaaugaaaccugcc

SEQ ID NO: 993443 - RNA, 21 nt, Human
ugugcaaauuguaagucacaa

SEQ ID NO: 993444 - RNA, 24 nt, Human
uucaaaacaaaaaugcaaaaacaa

SEQ ID NO: 993445 - RNA, 26 nt, Human
uucuaauaauuuuucuacccaacuac

SEQ ID NO: 993446 - RNA, 23 nt, Human
uucuuugggcccucuuagcaaua

SEQ ID NO: 993447 - RNA, 19 nt, Human
uuggucucaaguauaaaca

SEQ ID NO: 993448 - RNA, 26 nt, Human
aaaaaaaaaaaaaccaaaacaaaaaa

SEQ ID NO: 993449 - RNA, 24 nt, Human
aaaaaaaaaaccaaaacaaaaaaa

SEQ ID NO: 993450 - RNA, 24 nt, Human
aaccagcuccccgaucuuccccua

SEQ ID NO: 993451 - RNA, 23 nt, Human
accagcuccccgaucuuccccua

SEQ ID NO: 993452 - RNA, 19 nt, Human
agcuccccgaucuuccccu

SEQ ID NO: 993453 - RNA, 21 nt, Human
aucuuccccuaggccgccagu

SEQ ID NO: 993454 - RNA, 21 nt, Human
caaaaaaacuucugaaacugc

SEQ ID NO: 993455 - RNA, 22 nt, Human
ccaaaacaaaaaaacuucugaa

SEQ ID NO: 993456 - RNA, 21 nt, Human
ccagcuccccgaucuuccccu

SEQ ID NO: 993457 - RNA, 23 nt, Human
cccggagcuccugcggccggcac

SEQ ID NO: 993458 - RNA, 18 nt, Human
cccuaggccgccaagacc

SEQ ID NO: 993459 - RNA, 21 nt, Human
cccuaggccgccaagaccguu

SEQ ID NO: 993460 - RNA, 23 nt, Human
ccggccgggagcaacaaagcggc

SEQ ID NO: 993461 - RNA, 28 nt, Human
cgggagcaacaaagcggccgcggggcgu

SEQ ID NO: 993462 - RNA, 25 nt, Human
cgggcggcggcggcggcggcaaccc

SEQ ID NO: 993463 - RNA, 25 nt, Human
cuuuaaaaaaaaaaaaaccaaaaca

SEQ ID NO: 993464 - RNA, 29 nt, Human
cuuuaaaaaaaaaaaaaccaaaacaaaaa

SEQ ID NO: 993465 - RNA, 22 nt, Human
gcagcagcggccgcacgugggc

SEQ ID NO: 993466 - RNA, 20 nt, Human
gcggcggcggcaacccggag

SEQ ID NO: 993467 - RNA, 21 nt, Human
gcggcggcggcggcggcaacc

SEQ ID NO: 993468 - RNA, 22 nt, Human
ggcggcggcggcggcggcaacc

SEQ ID NO: 993469 - RNA, 19 nt, Human
gggagaggaauccaucagu

SEQ ID NO: 993470 - RNA, 25 nt, Human
gggcugcgggcggcggcggcggcgg

SEQ ID NO: 993471 - RNA, 23 nt, Human
uaaaaaaaaaaaaaccaaaacaa

SEQ ID NO: 993472 - RNA, 25 nt, Human
ucugaaacugcaaaagguccugaac

SEQ ID NO: 993473 - RNA, 22 nt, Human
ucuuuaaaaaaaaaaaaaccaa

SEQ ID NO: 993474 - RNA, 25 nt, Human
ugaggcagugggagaggaauccauc

SEQ ID NO: 993475 - RNA, 22 nt, Human
ugcaaaagguccugaacggggu

SEQ ID NO: 993476 - RNA, 26 nt, Human
uggaaagaggcuuuuuaaaaauccca

SEQ ID NO: 993477 - RNA, 23 nt, Human
uuaaaaaucccaugagugauguc

SEQ ID NO: 993478 - RNA, 22 nt, Human
aaacagcuguaaccaggcacgc

SEQ ID NO: 993479 - RNA, 24 nt, Human
agacauccccccacccgaccaggg

SEQ ID NO: 993480 - RNA, 18 nt, Human
aggagcccaaaggacuuu

SEQ ID NO: 993481 - RNA, 23 nt, Human
agguauccagacauccccccacc

SEQ ID NO: 993482 - RNA, 19 nt, Human
agugagggaccgaggggcg

SEQ ID NO: 993483 - RNA, 18 nt, Human
caaaauccucaccaagga

SEQ ID NO: 993484 - RNA, 18 nt, Human
caaagggaggaggagccu

SEQ ID NO: 993485 - RNA, 18 nt, Human
cacagaggagguauccag

SEQ ID NO: 993486 - RNA, 21 nt, Human
cacccgaccagggucaagagc

SEQ ID NO: 993487 - RNA, 22 nt, Human
cacucccgacgagcaccgcacu

SEQ ID NO: 993488 - RNA, 18 nt, Human
cagcggcaggagcccaaa

SEQ ID NO: 993489 - RNA, 19 nt, Human
ccccacccgaccaggguca

SEQ ID NO: 993490 - RNA, 21 nt, Human
cgccguguggccggagggaga

SEQ ID NO: 993491 - RNA, 18 nt, Human
cggccgcugcgcuauggc

SEQ ID NO: 993492 - RNA, 20 nt, Human
cuccucagacucccagaaau

SEQ ID NO: 993493 - RNA, 21 nt, Human
gaagugccagugagggaccga

SEQ ID NO: 993494 - RNA, 22 nt, Human
gacauccuucaggucaccuuua

SEQ ID NO: 993495 - RNA, 21 nt, Human
gcuggcagcggcaggagccca

SEQ ID NO: 993496 - RNA, 21 nt, Human
guacuccucagacucccagaa

SEQ ID NO: 993497 - RNA, 20 nt, Human
ucaaaauccucaccaaggac

SEQ ID NO: 993498 - RNA, 19 nt, Human
uccaucuuccaccuguagg

SEQ ID NO: 993499 - RNA, 18 nt, Human
ucccagaugguauucagc

SEQ ID NO: 993500 - RNA, 21 nt, Human
uggccaguucuuuccacagag

SEQ ID NO: 993501 - RNA, 19 nt, Human
uguauuuacagacuccagc

SEQ ID NO: 993502 - RNA, 22 nt, Human
uguggccggagggagaagugcc

SEQ ID NO: 993503 - RNA, 24 nt, Human
uguguauuuacagacuccagcagg

SEQ ID NO: 993504 - RNA, 22 nt, Human
uuuuuuuuuuuuuuuuugcauu

SEQ ID NO: 993505 - RNA, 25 nt, Human
uuuuuuuuuuuuuuuuuugcauuaa

SEQ ID NO: 993506 - RNA, 20 nt, Human
uuuuuuuuuuuuuuuuuugg

SEQ ID NO: 993507 - RNA, 23 nt, Human
aaacaaugacaauagcaacauca

SEQ ID NO: 993508 - RNA, 19 nt, Human
aaacccuccauuuguuuuc

SEQ ID NO: 993509 - RNA, 22 nt, Human
aagaagagggagagagaugggg

SEQ ID NO: 993510 - RNA, 19 nt, Human
aaggaccuggacagaggca

SEQ ID NO: 993511 - RNA, 23 nt, Human
aaugacaauagcaacaucaaaga

SEQ ID NO: 993512 - RNA, 18 nt, Human
accauaacagacacagaa

SEQ ID NO: 993513 - RNA, 21 nt, Human
agagggagagagauggggaac

SEQ ID NO: 993514 - RNA, 23 nt, Human
agagggagagagauggggaacgg

SEQ ID NO: 993515 - RNA, 23 nt, Human
aggaagaggaagguuuuuaccaa

SEQ ID NO: 993516 - RNA, 20 nt, Human
auauuguugugucucaggga

SEQ ID NO: 993517 - RNA, 20 nt, Human
caaaauguaacacagagaca

SEQ ID NO: 993518 - RNA, 18 nt, Human
caacgacgcggugcugcc

SEQ ID NO: 993519 - RNA, 22 nt, Human
caaugacaauagcaacaucaaa

SEQ ID NO: 993520 - RNA, 18 nt, Human
caauugcuggacucaggg

SEQ ID NO: 993521 - RNA, 22 nt, Human
cacacacaacauuaaguuccac

SEQ ID NO: 993522 - RNA, 19 nt, Human
caccccaaaacaaugacaa

SEQ ID NO: 993523 - RNA, 19 nt, Human
cagagacaccaagugagca

SEQ ID NO: 993524 - RNA, 22 nt, Human
cauagaucaccauaacagacac

SEQ ID NO: 993525 - RNA, 21 nt, Human
ccaaaauguaacacagagaca

SEQ ID NO: 993526 - RNA, 20 nt, Human
ccaagcagcgaguccagagc

SEQ ID NO: 993527 - RNA, 21 nt, Human
ccaggacacgcucccuuagga

SEQ ID NO: 993528 - RNA, 22 nt, Human
ccccaaaacaaugacaauagca

SEQ ID NO: 993529 - RNA, 22 nt, Human
cgccgcgaccgacaaaggaaag

SEQ ID NO: 993530 - RNA, 22 nt, Human
cgcuguauguggcaccccaaaa

SEQ ID NO: 993531 - RNA, 21 nt, Human
cgucaacgacgcggugcugcc

SEQ ID NO: 993532 - RNA, 19 nt, Human
gacaauagcaacaucaaag

SEQ ID NO: 993533 - RNA, 22 nt, Human
gcccaagaagagggagagagau

SEQ ID NO: 993534 - RNA, 19 nt, Human
ggacucagggcugccacaa

SEQ ID NO: 993535 - RNA, 18 nt, Human
ggaggucaaaagagauac

SEQ ID NO: 993536 - RNA, 18 nt, Human
gggaacggucugugggug

SEQ ID NO: 993537 - RNA, 18 nt, Human
gggaggcccaagaagagg

SEQ ID NO: 993538 - RNA, 21 nt, Human
uaaaagacgcuguauguggca

SEQ ID NO: 993539 - RNA, 22 nt, Human
uaaaagacgcuguauguggcac

SEQ ID NO: 993540 - RNA, 23 nt, Human
uaacacagagacaccaagugagc

SEQ ID NO: 993541 - RNA, 19 nt, Human
uaacagacacagaaaucau

SEQ ID NO: 993542 - RNA, 24 nt, Human
uaacagacacagaaaucaugaaaa

SEQ ID NO: 993543 - RNA, 22 nt, Human
uaauaaaacgagguaugccaua

SEQ ID NO: 993544 - RNA, 20 nt, Human
uauugcuaaaaaaugcugag

SEQ ID NO: 993545 - RNA, 23 nt, Human
ugacaauagcaacaucaaagaag

SEQ ID NO: 993546 - RNA, 19 nt, Human
ugcugccuuuuuuccgagc

SEQ ID NO: 993547 - RNA, 19 nt, Human
ugcuggacucagggcugcc

SEQ ID NO: 993548 - RNA, 19 nt, Human
ugcuggacucagggcugcc

SEQ ID NO: 993549 - RNA, 27 nt, Human
uggaggaagaggaagguuuuuaccaag

SEQ ID NO: 993550 - RNA, 24 nt, Human
uggcgccgcgaccgacaaaggaaa

SEQ ID NO: 993551 - RNA, 18 nt, Human
ugugucucagggaauagg

SEQ ID NO: 993552 - RNA, 24 nt, Human
uuaaaaauacuuuauugcuaaaaa

SEQ ID NO: 993553 - RNA, 20 nt, Human
auaccuuauauaauaaaaug

SEQ ID NO: 993554 - RNA, 18 nt, Human
uaaaaagcaguucucagg

SEQ ID NO: 993555 - RNA, 18 nt, Human
uaaaauguaucaggaaaa

SEQ ID NO: 993556 - RNA, 18 nt, Human
uaccuuauauaauaaaau

SEQ ID NO: 993557 - RNA, 22 nt, Human
aacacagccaccuguuccaaca

SEQ ID NO: 993558 - RNA, 19 nt, Human
acagagcuccuccaagcca

SEQ ID NO: 993559 - RNA, 22 nt, Human
acagagcuccuccaagccaugc

SEQ ID NO: 993560 - RNA, 22 nt, Human
acgcggucgccccgccagcgcc

SEQ ID NO: 993561 - RNA, 24 nt, Human
agagaugggagacuguguguauga

SEQ ID NO: 993562 - RNA, 21 nt, Human
agagcuccuccaagccaugcu

SEQ ID NO: 993563 - RNA, 25 nt, Human
agagcuccuccaagccaugcuggau

SEQ ID NO: 993564 - RNA, 19 nt, Human
agcagcaccguuacgcggu

SEQ ID NO: 993565 - RNA, 18 nt, Human
agccgcccucggccgggg

SEQ ID NO: 993566 - RNA, 19 nt, Human
agcuccuccaagccaugcu

SEQ ID NO: 993567 - RNA, 18 nt, Human
agcuuccaguagaggccg

SEQ ID NO: 993568 - RNA, 23 nt, Human
aggcagcuucggcgcagguagcg

SEQ ID NO: 993569 - RNA, 22 nt, Human
agggggaggggaggagagaugg

SEQ ID NO: 993570 - RNA, 23 nt, Human
cagccccccgccccggggucccc

SEQ ID NO: 993571 - RNA, 19 nt, Human
cagcgccagaaccagccgu

SEQ ID NO: 993572 - RNA, 21 nt, Human
cagcgccggccacagcccccc

SEQ ID NO: 993573 - RNA, 23 nt, Human
cagcggcuucagcuuguggcugc

SEQ ID NO: 993574 - RNA, 23 nt, Human
caugggccaggccucucuuccag

SEQ ID NO: 993575 - RNA, 21 nt, Human
ccagagcaggaacacagccac

SEQ ID NO: 993576 - RNA, 18 nt, Human
ccagccccgcagcagcgg

SEQ ID NO: 993577 - RNA, 20 nt, Human
cccagggggaggggaggagg

SEQ ID NO: 993578 - RNA, 22 nt, Human
cccccgccccgggguccccugc

SEQ ID NO: 993579 - RNA, 24 nt, Human
cccgggggcgcagccugcuccgga

SEQ ID NO: 993580 - RNA, 19 nt, Human
cccgggguccccugcgccc

SEQ ID NO: 993581 - RNA, 23 nt, Human
cccucggccgggggcggcggggc

SEQ ID NO: 993582 - RNA, 25 nt, Human
ccggggcgcggucgggcagggggcc

SEQ ID NO: 993583 - RNA, 18 nt, Human
ccguacaugugccugccc

SEQ ID NO: 993584 - RNA, 22 nt, Human
ccguggcgcuucugccagcgcc

SEQ ID NO: 993585 - RNA, 21 nt, Human
cgaccucucaccaacagagcu

SEQ ID NO: 993586 - RNA, 19 nt, Human
cgauagcagacaggaguuu

SEQ ID NO: 993587 - RNA, 19 nt, Human
cgccagcgccggccacagc

SEQ ID NO: 993588 - RNA, 21 nt, Human
cgccagcgccggccacagccc

SEQ ID NO: 993589 - RNA, 23 nt, Human
cgccagcgccggccacagccccc

SEQ ID NO: 993590 - RNA, 25 nt, Human
cgcggucgggcagggggccggcgcc

SEQ ID NO: 993591 - RNA, 25 nt, Human
cggccagcagcaccguuacgcgguc

SEQ ID NO: 993592 - RNA, 18 nt, Human
cgggcggcugagccaggc

SEQ ID NO: 993593 - RNA, 18 nt, Human
cgggcgggccgggcgcgg

SEQ ID NO: 993594 - RNA, 23 nt, Human
cggucagguuugcggccagcagc

SEQ ID NO: 993595 - RNA, 21 nt, Human
cguggcgcuucugccagcgcc

SEQ ID NO: 993596 - RNA, 19 nt, Human
cuccaagugcagcaggaga

SEQ ID NO: 993597 - RNA, 20 nt, Human
cuccuugacgggcgggccgg

SEQ ID NO: 993598 - RNA, 18 nt, Human
cugcugcaggcagcuucg

SEQ ID NO: 993599 - RNA, 18 nt, Human
cuggugcaggggcggagg

SEQ ID NO: 993600 - RNA, 19 nt, Human
cuguguguauguccccucc

SEQ ID NO: 993601 - RNA, 18 nt, Human
cuucugcugcaggcagcu

SEQ ID NO: 993602 - RNA, 19 nt, Human
gaacacagccaccuguucc

SEQ ID NO: 993603 - RNA, 25 nt, Human
gcagggcgaccucucaccaacagag

SEQ ID NO: 993604 - RNA, 19 nt, Human
gccacagccccccgccccg

SEQ ID NO: 993605 - RNA, 19 nt, Human
gccccgggguccccugcgc

SEQ ID NO: 993606 - RNA, 20 nt, Human
gcccgggggcgcagccugcu

SEQ ID NO: 993607 - RNA, 22 nt, Human
gccggcgccggagggcagcgcg

SEQ ID NO: 993608 - RNA, 22 nt, Human
gccgggggcggcggggccgggg

SEQ ID NO: 993609 - RNA, 21 nt, Human
gcggcggggccggggcgcggu

SEQ ID NO: 993610 - RNA, 24 nt, Human
gcggucgggcagggggccggcgcc

SEQ ID NO: 993611 - RNA, 21 nt, Human
gcucguccccguagccgcccu

SEQ ID NO: 993612 - RNA, 20 nt, Human
gcuugggcagggcggguggg

SEQ ID NO: 993613 - RNA, 19 nt, Human
ggcgcggucgggcaggggg

SEQ ID NO: 993614 - RNA, 19 nt, Human
ggcgggccgggcgcggggc

SEQ ID NO: 993615 - RNA, 24 nt, Human
ggcugggcggguccggcagccgcc

SEQ ID NO: 993616 - RNA, 19 nt, Human
ggcugggggcccggccucg

SEQ ID NO: 993617 - RNA, 20 nt, Human
ggcuugggcagggcgggugg

SEQ ID NO: 993618 - RNA, 19 nt, Human
ggggaggagagaugggaga

SEQ ID NO: 993619 - RNA, 25 nt, Human
guccccguagccgcccucggccggg

SEQ ID NO: 993620 - RNA, 20 nt, Human
guggcgcaggcugggcgggu

SEQ ID NO: 993621 - RNA, 23 nt, Human
uauguccccucccuccaagugca

SEQ ID NO: 993622 - RNA, 21 nt, Human
ugagaggagcaugggccaggc

SEQ ID NO: 993623 - RNA, 22 nt, Human
ugcaggggcggaggcccagccg

SEQ ID NO: 993624 - RNA, 19 nt, Human
ugccagugaggcagggcga

SEQ ID NO: 993625 - RNA, 19 nt, Human
ugcggugggccaccccagg

SEQ ID NO: 993626 - RNA, 20 nt, Human
uggcagcugggcuugggcag

SEQ ID NO: 993627 - RNA, 21 nt, Human
uggcagcugggcuugggcagg

SEQ ID NO: 993628 - RNA, 19 nt, Human
uggcgcaggcugggcgggu

SEQ ID NO: 993629 - RNA, 20 nt, Human
ugggcagggcgggugggccc

SEQ ID NO: 993630 - RNA, 25 nt, Human
ugggccaccagcagcacggccuucu

SEQ ID NO: 993631 - RNA, 18 nt, Human
ugguggcgcaggcugggc

SEQ ID NO: 993632 - RNA, 24 nt, Human
ugguugugguggcgcaggcugggc

SEQ ID NO: 993633 - RNA, 19 nt, Human
uguaugccccguacaugug

SEQ ID NO: 993634 - RNA, 20 nt, Human
ugugguggcgcaggcugggc

SEQ ID NO: 993635 - RNA, 24 nt, Human
uguuccaacaggcgcugugccuug

SEQ ID NO: 993636 - RNA, 22 nt, Human
uuccaacaggcgcugugccuug

SEQ ID NO: 993637 - RNA, 22 nt, Human
uuccuggaacccccuguaccca

SEQ ID NO: 993638 - RNA, 18 nt, Human
acacauacauacacacac

SEQ ID NO: 993639 - RNA, 24 nt, Human
acuuguuuauauauauauauauau

SEQ ID NO: 993640 - RNA, 28 nt, Human
auauacacauacauacacacacagucac

SEQ ID NO: 993641 - RNA, 19 nt, Human
auauauauauauauauaua

SEQ ID NO: 993642 - RNA, 19 nt, Human
auauauauauauauauaua

SEQ ID NO: 993643 - RNA, 19 nt, Human
auauauauauauauauaua

SEQ ID NO: 993644 - RNA, 19 nt, Human
auauauauauauauauaua

SEQ ID NO: 993645 - RNA, 19 nt, Human
auauauauauauauauaua

SEQ ID NO: 993646 - RNA, 19 nt, Human
auauauauauauauauaua

SEQ ID NO: 993647 - RNA, 19 nt, Human
auauauauauauauauaua

SEQ ID NO: 993648 - RNA, 19 nt, Human
auauauauauauauauaua

SEQ ID NO: 993649 - RNA, 19 nt, Human
auauauauauauauauaua

SEQ ID NO: 993650 - RNA, 19 nt, Human
auauauauauauauauaua

SEQ ID NO: 993651 - RNA, 19 nt, Human
auauauauauauauauaua

SEQ ID NO: 993652 - RNA, 19 nt, Human
auauauauauauauauaua

SEQ ID NO: 993653 - RNA, 27 nt, Human
aucuccuucuggccuccuaauccacug

SEQ ID NO: 993654 - RNA, 23 nt, Human
cacaaugcccacggagaccccaa

SEQ ID NO: 993655 - RNA, 19 nt, Human
cacuccgggaucuugaaga

SEQ ID NO: 993656 - RNA, 19 nt, Human
caggagacagcgcuaccac

SEQ ID NO: 993657 - RNA, 20 nt, Human
cccaacagggagcacguuua

SEQ ID NO: 993658 - RNA, 18 nt, Human
ccgccucccgagaggcuc

SEQ ID NO: 993659 - RNA, 23 nt, Human
cuucaccaggagacagcgcuacc

SEQ ID NO: 993660 - RNA, 18 nt, Human
gucacauuccagugugac

SEQ ID NO: 993661 - RNA, 19 nt, Human
uauauauauacacauacau

SEQ ID NO: 993662 - RNA, 18 nt, Human
uauauauauauauauaca

SEQ ID NO: 993663 - RNA, 19 nt, Human
uauauauauauauauauau

SEQ ID NO: 993664 - RNA, 19 nt, Human
uauauauauauauauauau

SEQ ID NO: 993665 - RNA, 19 nt, Human
uauauauauauauauauau

SEQ ID NO: 993666 - RNA, 19 nt, Human
uauauauauauauauauau

SEQ ID NO: 993667 - RNA, 19 nt, Human
uauauauauauauauauau

SEQ ID NO: 993668 - RNA, 19 nt, Human
uauauauauauauauauau

SEQ ID NO: 993669 - RNA, 19 nt, Human
uauauauauauauauauau

SEQ ID NO: 993670 - RNA, 19 nt, Human
uauauauauauauauauau

SEQ ID NO: 993671 - RNA, 23 nt, Human
uauauauauauauauauauauac

SEQ ID NO: 993672 - RNA, 19 nt, Human
uccgggaucuugaagacuc

SEQ ID NO: 993673 - RNA, 19 nt, Human
ugacaaauacuccuucacc

SEQ ID NO: 993674 - RNA, 21 nt, Human
uggccuccuaauccacugccu

SEQ ID NO: 993675 - RNA, 20 nt, Human
uguuuauauauauauauaua

SEQ ID NO: 993676 - RNA, 22 nt, Human
uguuuauauauauauauauaua

SEQ ID NO: 993677 - RNA, 21 nt, Human
uucacagaugacacccaacag

SEQ ID NO: 993678 - RNA, 19 nt, Human
uuuauauauauauauauau

SEQ ID NO: 993679 - RNA, 19 nt, Human
uuuauauauauauauauau

SEQ ID NO: 993680 - RNA, 20 nt, Human
acccuccuaagccccgggca

SEQ ID NO: 993681 - RNA, 22 nt, Human
accggaccgaggccgcuccaac

SEQ ID NO: 993682 - RNA, 26 nt, Human
accggugccacccuccuaagccccgg

SEQ ID NO: 993683 - RNA, 23 nt, Human
agaauaugaggcugacuugggca

SEQ ID NO: 993684 - RNA, 19 nt, Human
aggaaggcacagggcccca

SEQ ID NO: 993685 - RNA, 18 nt, Human
aggcaguacguacaugcg

SEQ ID NO: 993686 - RNA, 18 nt, Human
agggggcagggcgggggg

SEQ ID NO: 993687 - RNA, 19 nt, Human
cacacccccgagauccaag

SEQ ID NO: 993688 - RNA, 19 nt, Human
cacccccaacuccgaaguc

SEQ ID NO: 993689 - RNA, 20 nt, Human
cacccuccuaagccccgggc

SEQ ID NO: 993690 - RNA, 20 nt, Human
cagcaccggugccacccucc

SEQ ID NO: 993691 - RNA, 28 nt, Human
cagcuccuguggugucugaccacccccu

SEQ ID NO: 993692 - RNA, 22 nt, Human
ccagcaccggugccacccuccu

SEQ ID NO: 993693 - RNA, 20 nt, Human
cccaacuccgaaguccagac

SEQ ID NO: 993694 - RNA, 22 nt, Human
cccagcaccggugccacccucc

SEQ ID NO: 993695 - RNA, 24 nt, Human
ccccaaaggccugaaggaggugcc

SEQ ID NO: 993696 - RNA, 19 nt, Human
ccccacacccccgagaucc

SEQ ID NO: 993697 - RNA, 21 nt, Human
ccccacacccccgagauccaa

SEQ ID NO: 993698 - RNA, 18 nt, Human
cccccgagauccaagcug

SEQ ID NO: 993699 - RNA, 24 nt, Human
cccgugugucccagcaccggugcc

SEQ ID NO: 993700 - RNA, 18 nt, Human
ccgaaguccagacaagcu

SEQ ID NO: 993701 - RNA, 23 nt, Human
ccgagauccaagcugcacuggcu

SEQ ID NO: 993702 - RNA, 20 nt, Human
ccgcaggaggugacagcucc

SEQ ID NO: 993703 - RNA, 23 nt, Human
ccuguggugucugaccaccccca

SEQ ID NO: 993704 - RNA, 23 nt, Human
cgggcaggcaguacguacaugcg

SEQ ID NO: 993705 - RNA, 20 nt, Human
gaaaugaacaggguggggug

SEQ ID NO: 993706 - RNA, 23 nt, Human
gaaggaggugccacugggcugcc

SEQ ID NO: 993707 - RNA, 24 nt, Human
gcaguacguacaugcggaccccgc

SEQ ID NO: 993708 - RNA, 20 nt, Human
gcccagaauaugaggcugac

SEQ ID NO: 993709 - RNA, 21 nt, Human
ggacacagucccguguguccc

SEQ ID NO: 993710 - RNA, 19 nt, Human
ggcagggcgggggguggcg

SEQ ID NO: 993711 - RNA, 23 nt, Human
ggccugaaggaggugccacuggg

SEQ ID NO: 993712 - RNA, 24 nt, Human
ggcuggcagggggcagggcggggg

SEQ ID NO: 993713 - RNA, 19 nt, Human
gggccccacacccccgaga

SEQ ID NO: 993714 - RNA, 19 nt, Human
ggggguggcgaggacacag

SEQ ID NO: 993715 - RNA, 22 nt, Human
gucccgugugucccagcaccgg

SEQ ID NO: 993716 - RNA, 24 nt, Human
ucccagcaccggugccacccuccu

SEQ ID NO: 993717 - RNA, 23 nt, Human
uccuaagccccgggcaggcagua

SEQ ID NO: 993718 - RNA, 23 nt, Human
uggcagggggcagggcggggggu

SEQ ID NO: 993719 - RNA, 25 nt, Human
uggcagggggcagggcggggggugg

SEQ ID NO: 993720 - RNA, 20 nt, Human
uguccgcccagaauaugagg

SEQ ID NO: 993721 - RNA, 19 nt, Human
uuuuuuuuuuccguccucc

SEQ ID NO: 993722 - RNA, 21 nt, Human
uuuuuuuuuuuuuuuuuccgu

SEQ ID NO: 993723 - RNA, 27 nt, Human
uuuuuuuuuuuuuuuuuuuuuccgggg

SEQ ID NO: 993724 - RNA, 23 nt, Human
aaaaaaaaacaaggaugacagaa

SEQ ID NO: 993725 - RNA, 19 nt, Human
aaaacaaggaugacagaac

SEQ ID NO: 993726 - RNA, 28 nt, Human
aaauaccacaaggucaagucgaaaacac

SEQ ID NO: 993727 - RNA, 21 nt, Human
aacagcuuccugagugccuga

SEQ ID NO: 993728 - RNA, 23 nt, Human
aagaaaaauaccacaaggucaag

SEQ ID NO: 993729 - RNA, 18 nt, Human
aagcaaggcccuggugug

SEQ ID NO: 993730 - RNA, 21 nt, Human
aaggcuggaggcagagaagcc

SEQ ID NO: 993731 - RNA, 19 nt, Human
aagguagaacagcuuccug

SEQ ID NO: 993732 - RNA, 21 nt, Human
accccaaaggcuggaggcaga

SEQ ID NO: 993733 - RNA, 22 nt, Human
agagaagccaggcagcucccuc

SEQ ID NO: 993734 - RNA, 24 nt, Human
agagggccagcuguggucaggccu

SEQ ID NO: 993735 - RNA, 20 nt, Human
aggaaaaggcugggcugggc

SEQ ID NO: 993736 - RNA, 21 nt, Human
aggcagugugugccucucggc

SEQ ID NO: 993737 - RNA, 20 nt, Human
aggccaagaaaaauaccaca

SEQ ID NO: 993738 - RNA, 23 nt, Human
aggcccuggcagauguaaugagc

SEQ ID NO: 993739 - RNA, 21 nt, Human
aguccucuaacaacccugccu

SEQ ID NO: 993740 - RNA, 19 nt, Human
auccggggcuggcaucauc

SEQ ID NO: 993741 - RNA, 22 nt, Human
augggauuucacugcaucccag

SEQ ID NO: 993742 - RNA, 22 nt, Human
caagaaaaauaccacaagguca

SEQ ID NO: 993743 - RNA, 22 nt, Human
caagucgaaaacacgacauguu

SEQ ID NO: 993744 - RNA, 21 nt, Human
cacaacaccaaacaaccuaga

SEQ ID NO: 993745 - RNA, 21 nt, Human
cagaacacaaaacaagugaga

SEQ ID NO: 993746 - RNA, 18 nt, Human
cagagacacugucaccuc

SEQ ID NO: 993747 - RNA, 18 nt, Human
cagagagcagcccggauc

SEQ ID NO: 993748 - RNA, 23 nt, Human
cagcuuccugagugccugcagag

SEQ ID NO: 993749 - RNA, 22 nt, Human
caggacccuucacauguggccu

SEQ ID NO: 993750 - RNA, 21 nt, Human
caggagcagcaaaguguggcu

SEQ ID NO: 993751 - RNA, 21 nt, Human
cauccugucucccgaucugcu

SEQ ID NO: 993752 - RNA, 19 nt, Human
ccacagcaggacccuucac

SEQ ID NO: 993753 - RNA, 21 nt, Human
ccaguagcugcugugaccgag

SEQ ID NO: 993754 - RNA, 23 nt, Human
cccacaacaccaaacaaccuaga

SEQ ID NO: 993755 - RNA, 23 nt, Human
cccaucccccgcuucccugggag

SEQ ID NO: 993756 - RNA, 21 nt, Human
ccccucagcgacgucugaucu

SEQ ID NO: 993757 - RNA, 19 nt, Human
ccucucggccggcacagga

SEQ ID NO: 993758 - RNA, 22 nt, Human
ccucugugcccacaacaccaaa

SEQ ID NO: 993759 - RNA, 22 nt, Human
ccugaagcuuuguggagcugaa

SEQ ID NO: 993760 - RNA, 25 nt, Human
ccugagugccugcagagacacuguc

SEQ ID NO: 993761 - RNA, 24 nt, Human
cggauccggggcuggcaucauccu

SEQ ID NO: 993762 - RNA, 22 nt, Human
cucaagcucggccagguccagc

SEQ ID NO: 993763 - RNA, 21 nt, Human
cuggcacgggacguccucugu

SEQ ID NO: 993764 - RNA, 24 nt, Human
cugugcccacaacaccaaacaacc

SEQ ID NO: 993765 - RNA, 18 nt, Human
cuguggucaggccugaag

SEQ ID NO: 993766 - RNA, 23 nt, Human
cuucagauguuaucuuugggcca

SEQ ID NO: 993767 - RNA, 18 nt, Human
cuuggugaggaugacaca

SEQ ID NO: 993768 - RNA, 18 nt, Human
gagcagcccggauccggg

SEQ ID NO: 993769 - RNA, 19 nt, Human
gagggccagcuguggucag

SEQ ID NO: 993770 - RNA, 18 nt, Human
gagucaccaagaugacca

SEQ ID NO: 993771 - RNA, 18 nt, Human
gcacacaacuaggccaag

SEQ ID NO: 993772 - RNA, 28 nt, Human
gcagcccggauccggggcuggcaucauc

SEQ ID NO: 993773 - RNA, 18 nt, Human
gcaucauccuucccugca

SEQ ID NO: 993774 - RNA, 19 nt, Human
gccaguagcugcugugacc

SEQ ID NO: 993775 - RNA, 20 nt, Human
gcuggaggcagagaagccag

SEQ ID NO: 993776 - RNA, 20 nt, Human
gcuggaguccaggagcagca

SEQ ID NO: 993777 - RNA, 26 nt, Human
ggccacccggcacuauuuuuggaaua

SEQ ID NO: 993778 - RNA, 18 nt, Human
guccgccuugcccugccc

SEQ ID NO: 993779 - RNA, 21 nt, Human
uaggccaagaaaaauaccaca

SEQ ID NO: 993780 - RNA, 23 nt, Human
ucaccucugugcccacaacacca

SEQ ID NO: 993781 - RNA, 25 nt, Human
ucacugcaucccaggaaaaggcugg

SEQ ID NO: 993782 - RNA, 20 nt, Human
ucagcgccccaucccccgcu

SEQ ID NO: 993783 - RNA, 20 nt, Human
ucaguccgccuugcccugcc

SEQ ID NO: 993784 - RNA, 19 nt, Human
ucccucagaauaccaacga

SEQ ID NO: 993785 - RNA, 19 nt, Human
ucccugcaggcaauuacuc

SEQ ID NO: 993786 - RNA, 23 nt, Human
ucgaaaacacgacauguuaaaac

SEQ ID NO: 993787 - RNA, 19 nt, Human
ucugugcccacaacaccaa

SEQ ID NO: 993788 - RNA, 20 nt, Human
ucugugcccacaacaccaaa

SEQ ID NO: 993789 - RNA, 24 nt, Human
ugacagaacacaaaacaagugaga

SEQ ID NO: 993790 - RNA, 26 nt, Human
ugacagaacacaaaacaagugagaua

SEQ ID NO: 993791 - RNA, 19 nt, Human
ugacccuggagaacgagga

SEQ ID NO: 993792 - RNA, 20 nt, Human
ugagagaaucuggcacggga

SEQ ID NO: 993793 - RNA, 21 nt, Human
ugagagaaucuggcacgggac

SEQ ID NO: 993794 - RNA, 20 nt, Human
ugaggcaggcccuggcagau

SEQ ID NO: 993795 - RNA, 22 nt, Human
ugcauggaguuccaagguagaa

SEQ ID NO: 993796 - RNA, 18 nt, Human
ugcccugguauucgagac

SEQ ID NO: 993797 - RNA, 22 nt, Human
uggaggcagagaagccaggcag

SEQ ID NO: 993798 - RNA, 24 nt, Human
uggaguuccaagguagaacagcuu

SEQ ID NO: 993799 - RNA, 24 nt, Human
uggcacacaacuaggccaagaaaa

SEQ ID NO: 993800 - RNA, 21 nt, Human
uggcagauguaaugagcuugg

SEQ ID NO: 993801 - RNA, 22 nt, Human
ugggauuucacugcaucccagg

SEQ ID NO: 993802 - RNA, 21 nt, Human
ugugaaggcuggcuggagucc

SEQ ID NO: 993803 - RNA, 21 nt, Human
uguggcggugggggaggggag

SEQ ID NO: 993804 - RNA, 18 nt, Human
agcaccaacagacuugau

SEQ ID NO: 993805 - RNA, 26 nt, Human
cugacaauggguugauagccuucccc

SEQ ID NO: 993806 - RNA, 27 nt, Human
uccuuugcuucugucauucuccugggg

SEQ ID NO: 993807 - RNA, 20 nt, Human
uucaucuuuuacuuuuuagc

SEQ ID NO: 993808 - RNA, 22 nt, Human
aaguucauccaucaggacuucu

SEQ ID NO: 993809 - RNA, 18 nt, Human
acagucacaauugaagaa

SEQ ID NO: 993810 - RNA, 23 nt, Human
accuuugcuugaaugucuccaau

SEQ ID NO: 993811 - RNA, 18 nt, Human
aggcuggcgguuguuggg

SEQ ID NO: 993812 - RNA, 19 nt, Human
cacugaacaauaagaccuu

SEQ ID NO: 993813 - RNA, 19 nt, Human
cagaugguugaacauggug

SEQ ID NO: 993814 - RNA, 22 nt, Human
cauaaguugcuuuaaaauuaac

SEQ ID NO: 993815 - RNA, 24 nt, Human
caugacagaugguugaacauggug

SEQ ID NO: 993816 - RNA, 20 nt, Human
caugaguuuccuuucuguuc

SEQ ID NO: 993817 - RNA, 21 nt, Human
cgacaucaguacaaggcuggc

SEQ ID NO: 993818 - RNA, 20 nt, Human
cgaggaaaucuaaucccacg

SEQ ID NO: 993819 - RNA, 24 nt, Human
cucauuuccaauaaagcagcuguu

SEQ ID NO: 993820 - RNA, 26 nt, Human
cugguaaauagcaauuuuguuucucc

SEQ ID NO: 993821 - RNA, 24 nt, Human
cuucuauugugauuauuccuggua

SEQ ID NO: 993822 - RNA, 21 nt, Human
gaaaucuaaucccacgucccu

SEQ ID NO: 993823 - RNA, 18 nt, Human
gagggagggucagggucu

SEQ ID NO: 993824 - RNA, 21 nt, Human
ggaagcgaagcagugucaaca

SEQ ID NO: 993825 - RNA, 19 nt, Human
gggagggagggucaggguc

SEQ ID NO: 993826 - RNA, 21 nt, Human
guugcaucuuauuauuucacu

SEQ ID NO: 993827 - RNA, 21 nt, Human
ucaaaaguucauccaucagga

SEQ ID NO: 993828 - RNA, 19 nt, Human
ucuaaucccacgucccuaa

SEQ ID NO: 993829 - RNA, 19 nt, Human
ucuggacaggagccgcggc

SEQ ID NO: 993830 - RNA, 22 nt, Human
ucuucaagucuuggaugagacu

SEQ ID NO: 993831 - RNA, 18 nt, Human
ugaaucauaaggccucaa

SEQ ID NO: 993832 - RNA, 27 nt, Human
uggaugagacuguagagcggucuugug

SEQ ID NO: 993833 - RNA, 22 nt, Human
uggcaaucuuucaucaaaaguu

SEQ ID NO: 993834 - RNA, 19 nt, Human
ugggagcaguaaugucaag

SEQ ID NO: 993835 - RNA, 22 nt, Human
ugggagcaguaaugucaaguga

SEQ ID NO: 993836 - RNA, 19 nt, Human
ugggagggagggucagggu

SEQ ID NO: 993837 - RNA, 22 nt, Human
ugguggcuacugcuuucagggg

SEQ ID NO: 993838 - RNA, 21 nt, Human
ugucuccaauaaggccugauu

SEQ ID NO: 993839 - RNA, 18 nt, Human
uuaaacccuuagacgccg

SEQ ID NO: 993840 - RNA, 25 nt, Human
uuccugguaaauagcaauuuuguuu

SEQ ID NO: 993841 - RNA, 19 nt, Human
uuuccauuugccaaacagu

SEQ ID NO: 993842 - RNA, 18 nt, Human
uuuuuuuuuuuuuuuuug

SEQ ID NO: 993843 - RNA, 22 nt, Human
uccagaggggaaaauaagaaaa

SEQ ID NO: 993844 - RNA, 22 nt, Human
aaaccauucccugaacccucug

SEQ ID NO: 993845 - RNA, 21 nt, Human
aaacuacuacuucuagaugaa

SEQ ID NO: 993846 - RNA, 18 nt, Human
aagaagcaacucuguucc

SEQ ID NO: 993847 - RNA, 23 nt, Human
acuagaguacagagagcauuuua

SEQ ID NO: 993848 - RNA, 19 nt, Human
agaagggagcagggagagc

SEQ ID NO: 993849 - RNA, 20 nt, Human
aggaagaaacagguauggca

SEQ ID NO: 993850 - RNA, 23 nt, Human
aggcaggagacuagaguacagag

SEQ ID NO: 993851 - RNA, 18 nt, Human
agggaaggcaggcaaaga

SEQ ID NO: 993852 - RNA, 18 nt, Human
agguauggcaccguggcc

SEQ ID NO: 993853 - RNA, 26 nt, Human
aguggcacugggucgcucagcuuuaa

SEQ ID NO: 993854 - RNA, 24 nt, Human
aguucuaucacaaaggucuagaac

SEQ ID NO: 993855 - RNA, 19 nt, Human
caagcaauuccugagguga

SEQ ID NO: 993856 - RNA, 21 nt, Human
ccaauccugacucagacuacc

SEQ ID NO: 993857 - RNA, 26 nt, Human
ccuacuauccgaaaccauucccugaa

SEQ ID NO: 993858 - RNA, 24 nt, Human
ccucugaauucugaagcaugugga

SEQ ID NO: 993859 - RNA, 19 nt, Human
ccuggcccuaggagguaau

SEQ ID NO: 993860 - RNA, 21 nt, Human
cgaaaccauucccugaacccu

SEQ ID NO: 993861 - RNA, 23 nt, Human
cgaaaccauucccugaacccucu

SEQ ID NO: 993862 - RNA, 21 nt, Human
cuaccuaccuggcuuccuggc

SEQ ID NO: 993863 - RNA, 25 nt, Human
cuagaugaacacaggcucuugagga

SEQ ID NO: 993864 - RNA, 20 nt, Human
gaagcauguggauuucucag

SEQ ID NO: 993865 - RNA, 19 nt, Human
gaagggaaggcaggcaaag

SEQ ID NO: 993866 - RNA, 21 nt, Human
gagccugaguggagaagcuga

SEQ ID NO: 993867 - RNA, 18 nt, Human
gaggauaggaugaaggga

SEQ ID NO: 993868 - RNA, 23 nt, Human
gcagggagagccuacuauccgaa

SEQ ID NO: 993869 - RNA, 22 nt, Human
gcgaucugacucggcucccuuc

SEQ ID NO: 993870 - RNA, 18 nt, Human
gcucgggcuggaggagcc

SEQ ID NO: 993871 - RNA, 27 nt, Human
ggaggcuguugauccaauccugacuca

SEQ ID NO: 993872 - RNA, 21 nt, Human
guccauguaucaauccaagca

SEQ ID NO: 993873 - RNA, 21 nt, Human
gugagagcaagcaaagaggau

SEQ ID NO: 993874 - RNA, 20 nt, Human
uacuacuucuagaugaacac

SEQ ID NO: 993875 - RNA, 24 nt, Human
uacuugcagaacugaggaggcagg

SEQ ID NO: 993876 - RNA, 24 nt, Human
uaugagggaaaccagaaucaaacu

SEQ ID NO: 993877 - RNA, 22 nt, Human
uaugguaaugacggagcugcac

SEQ ID NO: 993878 - RNA, 21 nt, Human
ucacccggaugggugaggcuu

SEQ ID NO: 993879 - RNA, 18 nt, Human
ucaccuuuccuucccccu

SEQ ID NO: 993880 - RNA, 19 nt, Human
ucuucuggcucgggcugga

SEQ ID NO: 993881 - RNA, 20 nt, Human
ugaggaggcaggagacuaga

SEQ ID NO: 993882 - RNA, 18 nt, Human
uggacuuccacuucauuc

SEQ ID NO: 993883 - RNA, 23 nt, Human
uggcaacucccugucgcuccggu

SEQ ID NO: 993884 - RNA, 20 nt, Human
uguucuacccauccccuuuc

SEQ ID NO: 993885 - RNA, 23 nt, Human
uucccugaacccucugaauucug

SEQ ID NO: 993886 - RNA, 24 nt, Human
uucccugaacccucugaauucuga

SEQ ID NO: 993887 - RNA, 23 nt, Human
uuccugaggugagagcaagcaaa

SEQ ID NO: 993888 - RNA, 23 nt, Human
uucucagucuuguucuacccauc

SEQ ID NO: 993889 - RNA, 22 nt, Human
uuucugcuccuucccacucacc

SEQ ID NO: 993890 - RNA, 19 nt, Human
aacccacaggcaaagagga

SEQ ID NO: 993891 - RNA, 22 nt, Human
aacccacaggcaaagaggaaaa

SEQ ID NO: 993892 - RNA, 23 nt, Human
aaugacaauccugagagcugccc

SEQ ID NO: 993893 - RNA, 26 nt, Human
agacuggcuacuacucagcuccaggc

SEQ ID NO: 993894 - RNA, 18 nt, Human
agcccaccuggcuucauc

SEQ ID NO: 993895 - RNA, 18 nt, Human
aggaaggccaggccaggc

SEQ ID NO: 993896 - RNA, 19 nt, Human
aggcaaaagcgggaaaggc

SEQ ID NO: 993897 - RNA, 22 nt, Human
aggcaaaagcgggaaaggccug

SEQ ID NO: 993898 - RNA, 21 nt, Human
aggccagcaccccucgggaga

SEQ ID NO: 993899 - RNA, 22 nt, Human
aggccaggccaggccucuggga

SEQ ID NO: 993900 - RNA, 18 nt, Human
agggaugggagaagggaa

SEQ ID NO: 993901 - RNA, 21 nt, Human
agggaugggagaagggaagga

SEQ ID NO: 993902 - RNA, 19 nt, Human
aggggcagaggcacugcgg

SEQ ID NO: 993903 - RNA, 19 nt, Human
auuccagcauuuuuauuga

SEQ ID NO: 993904 - RNA, 20 nt, Human
caagagauagugguucccac

SEQ ID NO: 993905 - RNA, 24 nt, Human
cacgagggcuggggggcaggggcg

SEQ ID NO: 993906 - RNA, 18 nt, Human
cacuggccggagcgcccc

SEQ ID NO: 993907 - RNA, 22 nt, Human
cagaagccagauggggacagag

SEQ ID NO: 993908 - RNA, 23 nt, Human
cagaggcacugcgguguggacac

SEQ ID NO: 993909 - RNA, 21 nt, Human
cagcagaagccagauggggac

SEQ ID NO: 993910 - RNA, 20 nt, Human
cagcagggucggaccugagc

SEQ ID NO: 993911 - RNA, 22 nt, Human
cagcauuucccagcuuuugggg

SEQ ID NO: 993912 - RNA, 21 nt, Human
caggcccuuauuuccaauccu

SEQ ID NO: 993913 - RNA, 21 nt, Human
cagggaugggagaagggaagg

SEQ ID NO: 993914 - RNA, 21 nt, Human
cauuucccagcuuuugggggc

SEQ ID NO: 993915 - RNA, 25 nt, Human
ccccgcucggcccgcccccucauga

SEQ ID NO: 993916 - RNA, 22 nt, Human
ccgccccgcucggcccgccccc

SEQ ID NO: 993917 - RNA, 24 nt, Human
ccugagagcugcccugauagguga

SEQ ID NO: 993918 - RNA, 21 nt, Human
ccuguggucacagcagacugg

SEQ ID NO: 993919 - RNA, 21 nt, Human
cuccaaagaguacgauaaaaa

SEQ ID NO: 993920 - RNA, 18 nt, Human
cucugggaccagcuauag

SEQ ID NO: 993921 - RNA, 19 nt, Human
gacaauccugagagcugcc

SEQ ID NO: 993922 - RNA, 19 nt, Human
gacaauccugagagcugcc

SEQ ID NO: 993923 - RNA, 20 nt, Human
gcaaagaggaaaaugacaau

SEQ ID NO: 993924 - RNA, 20 nt, Human
gccagauggggacagagugu

SEQ ID NO: 993925 - RNA, 22 nt, Human
gguuuccacgguaaccaaagua

SEQ ID NO: 993926 - RNA, 26 nt, Human
uaagaaggcaaacccuggggaggcca

SEQ ID NO: 993927 - RNA, 22 nt, Human
uacagagaggcggcaggcagga

SEQ ID NO: 993928 - RNA, 24 nt, Human
uaguaaaagcuaaauucaaaagua

SEQ ID NO: 993929 - RNA, 23 nt, Human
ucacagcagacuggcuacuacuc

SEQ ID NO: 993930 - RNA, 22 nt, Human
uccacgguaaccaaaguaaggc

SEQ ID NO: 993931 - RNA, 19 nt, Human
ucccagaggccccaggcca

SEQ ID NO: 993932 - RNA, 19 nt, Human
ucccccgaggggcagaggc

SEQ ID NO: 993933 - RNA, 22 nt, Human
ucuccaaagaguacgauaaaaa

SEQ ID NO: 993934 - RNA, 24 nt, Human
ugagcuggggcccagcggucagca

SEQ ID NO: 993935 - RNA, 21 nt, Human
ugauaggugagccucgaaccu

SEQ ID NO: 993936 - RNA, 18 nt, Human
uggcuacuacucagcucc

SEQ ID NO: 993937 - RNA, 23 nt, Human
ugggagaagggaaggaaggccag

SEQ ID NO: 993938 - RNA, 18 nt, Human
uguggaaguggcguuacu

SEQ ID NO: 993939 - RNA, 18 nt, Human
uuacuguacagagaggcg

SEQ ID NO: 993940 - RNA, 27 nt, Human
uuuuuuuuuuuuuuuuuuuuuuugggg

SEQ ID NO: 993941 - RNA, 19 nt, Human
aaaaauugccaaacucucu

SEQ ID NO: 993942 - RNA, 18 nt, Human
aaaauucuccuuucuuuc

SEQ ID NO: 993943 - RNA, 23 nt, Human
aaacggaaugaaagaaaaaucug

SEQ ID NO: 993944 - RNA, 19 nt, Human
aagaaagaaauucaugguc

SEQ ID NO: 993945 - RNA, 21 nt, Human
aagaagauuuauaauagaaaa

SEQ ID NO: 993946 - RNA, 20 nt, Human
acaaauuuuaaggaagaggc

SEQ ID NO: 993947 - RNA, 19 nt, Human
acaacaauggaagaaagcc

SEQ ID NO: 993948 - RNA, 21 nt, Human
acaacaauggaagaaagccaa

SEQ ID NO: 993949 - RNA, 22 nt, Human
agaaaaagaaacaugguuuuug

SEQ ID NO: 993950 - RNA, 19 nt, Human
agccagccuaacgacggcg

SEQ ID NO: 993951 - RNA, 20 nt, Human
aggagaugucuuuuauuuca

SEQ ID NO: 993952 - RNA, 23 nt, Human
augaaggaaaaaaaaguggaaca

SEQ ID NO: 993953 - RNA, 25 nt, Human
caaaaaguuauacaagaaaaagaaa

SEQ ID NO: 993954 - RNA, 21 nt, Human
caaaucuuauauggauauucu

SEQ ID NO: 993955 - RNA, 18 nt, Human
cacuggcauuaagaaaac

SEQ ID NO: 993956 - RNA, 26 nt, Human
cagacacuuccacucagggccgucuc

SEQ ID NO: 993957 - RNA, 22 nt, Human
cagcuaaaaaucaauuuauguu

SEQ ID NO: 993958 - RNA, 26 nt, Human
caugaaggaaaaaaaaguggaacauu

SEQ ID NO: 993959 - RNA, 21 nt, Human
cauuaagaaaacccaagucuc

SEQ ID NO: 993960 - RNA, 19 nt, Human
ccaaacaaacagucuccau

SEQ ID NO: 993961 - RNA, 18 nt, Human
ccacuggagcuccuccuc

SEQ ID NO: 993962 - RNA, 19 nt, Human
cccgcugccgcugccgccg

SEQ ID NO: 993963 - RNA, 18 nt, Human
cccgcugccgcugccggg

SEQ ID NO: 993964 - RNA, 24 nt, Human
ccgccgccgccgccacuggagcuc

SEQ ID NO: 993965 - RNA, 20 nt, Human
ccgccgccgccgccacuggg

SEQ ID NO: 993966 - RNA, 18 nt, Human
ccgccgccgccgccgcca

SEQ ID NO: 993967 - RNA, 18 nt, Human
ccgcugccgccgccgccg

SEQ ID NO: 993968 - RNA, 18 nt, Human
ccgcugccgcugccgccg

SEQ ID NO: 993969 - RNA, 20 nt, Human
ccgcugccgcugccgccgcc

SEQ ID NO: 993970 - RNA, 24 nt, Human
ccgcugccgcugccgccgccgccg

SEQ ID NO: 993971 - RNA, 23 nt, Human
cgaggcuacagagccagccuaac

SEQ ID NO: 993972 - RNA, 18 nt, Human
cgccugcuggcgcugcug

SEQ ID NO: 993973 - RNA, 23 nt, Human
cucaaaaauucuccuuucuuucu

SEQ ID NO: 993974 - RNA, 26 nt, Human
cucaaaaauucuccuuucuuucucuc

SEQ ID NO: 993975 - RNA, 20 nt, Human
cugcccgcugccgcugccgc

SEQ ID NO: 993976 - RNA, 19 nt, Human
cugccgcugccgccgccgc

SEQ ID NO: 993977 - RNA, 19 nt, Human
cugguuuuaagaauuucua

SEQ ID NO: 993978 - RNA, 26 nt, Human
cuuaaucaggaaaaguagugaacacu

SEQ ID NO: 993979 - RNA, 23 nt, Human
gcccgcugccgcugccgccgccg

SEQ ID NO: 993980 - RNA, 20 nt, Human
gccgccgccgccgccgccac

SEQ ID NO: 993981 - RNA, 22 nt, Human
gccgcugccgccgccgccgccg

SEQ ID NO: 993982 - RNA, 23 nt, Human
gcgcugcuggagcugcugcccgc

SEQ ID NO: 993983 - RNA, 23 nt, Human
gcugaaaacaaaaaguuauacaa

SEQ ID NO: 993984 - RNA, 18 nt, Human
ggaaauacacauuucuga

SEQ ID NO: 993985 - RNA, 18 nt, Human
ggagcuccuccucucgcu

SEQ ID NO: 993986 - RNA, 24 nt, Human
gggcggcggggcguacagaagggc

SEQ ID NO: 993987 - RNA, 23 nt, Human
gguuuuuguuuugcaagauuuuu

SEQ ID NO: 993988 - RNA, 23 nt, Human
guggaaucacacacacacaaaug

SEQ ID NO: 993989 - RNA, 24 nt, Human
uaagaaaacccaagucucaaaaau

SEQ ID NO: 993990 - RNA, 20 nt, Human
uagaaaaaaguggcaaauug

SEQ ID NO: 993991 - RNA, 20 nt, Human
uauacaagaaaaagaaacau

SEQ ID NO: 993992 - RNA, 21 nt, Human
uauacaagaaaaagaaacaug

SEQ ID NO: 993993 - RNA, 24 nt, Human
uaucugaaaauugcacuaauacuu

SEQ ID NO: 993994 - RNA, 24 nt, Human
uauuguuaauuuucauacuuaaaa

SEQ ID NO: 993995 - RNA, 24 nt, Human
uccaaacggaaugaaagaaaaauc

SEQ ID NO: 993996 - RNA, 20 nt, Human
uccccauggugaacaaacau

SEQ ID NO: 993997 - RNA, 26 nt, Human
ucgcggcggcucccgcuuccaggguc

SEQ ID NO: 993998 - RNA, 19 nt, Human
ugagaacgagcucaugggc

SEQ ID NO: 993999 - RNA, 22 nt, Human
ugcuacaaaaacaacaauggaa

SEQ ID NO: 994000 - RNA, 20 nt, Human
ugcuguaaccacuaaaacaa

SEQ ID NO: 994001 - RNA, 19 nt, Human
uggaaucacacacacacaa

SEQ ID NO: 994002 - RNA, 22 nt, Human
uggaaucacacacacacaaaug

SEQ ID NO: 994003 - RNA, 21 nt, Human
ugucccgggguaagccgaggc

SEQ ID NO: 994004 - RNA, 19 nt, Human
ugugaaaugagcucacuga

SEQ ID NO: 994005 - RNA, 18 nt, Human
uguugcugaaaacaaaaa

SEQ ID NO: 994006 - RNA, 22 nt, Human
uuaauccuaaacauuacagggu

SEQ ID NO: 994007 - RNA, 23 nt, Human
uuaauccuaaacauuacagggua

SEQ ID NO: 994008 - RNA, 21 nt, Human
uuacaaccucuggauuaugga

SEQ ID NO: 994009 - RNA, 21 nt, Human
uucauggucacaaaauuuuaa

SEQ ID NO: 994010 - RNA, 19 nt, Human
uuccccagcacagaucccu

SEQ ID NO: 994011 - RNA, 21 nt, Human
uuucaaauguugcuguaacca

SEQ ID NO: 994012 - RNA, 24 nt, Human
uuuguaaacuuacucaugcaaaau

SEQ ID NO: 994013 - RNA, 22 nt, Human
uuuuaggagaugucuuuuauuu

SEQ ID NO: 994014 - RNA, 24 nt, Human
uuuuauuucagaauuaguucuuac

SEQ ID NO: 994015 - RNA, 25 nt, Human
uuuuuuuuuuuuuuuuuuuuuuagg

SEQ ID NO: 994016 - RNA, 18 nt, Human
aaaauacuugggccugcc

SEQ ID NO: 994017 - RNA, 19 nt, Human
aacccauuccuccucccug

SEQ ID NO: 994018 - RNA, 23 nt, Human
agaaacccguaucaucuuccaaa

SEQ ID NO: 994019 - RNA, 24 nt, Human
agaaggaaacaaaccaacugguua

SEQ ID NO: 994020 - RNA, 20 nt, Human
agcacagccuauuucuaaau

SEQ ID NO: 994021 - RNA, 24 nt, Human
agugaagaaaccagaguggugucu

SEQ ID NO: 994022 - RNA, 18 nt, Human
caugagguccaagccugu

SEQ ID NO: 994023 - RNA, 24 nt, Human
cauuccuccucccuggaaaaaaga

SEQ ID NO: 994024 - RNA, 19 nt, Human
cccauuccuccucccugga

SEQ ID NO: 994025 - RNA, 22 nt, Human
cccugaccaggagcgacagggc

SEQ ID NO: 994026 - RNA, 23 nt, Human
ccucaauacugaacacuagacac

SEQ ID NO: 994027 - RNA, 26 nt, Human
ccuccucccuggaaaaaagaaacccg

SEQ ID NO: 994028 - RNA, 18 nt, Human
ccugaguuaaggaagggg

SEQ ID NO: 994029 - RNA, 23 nt, Human
cgacagggcccccagugagaugg

SEQ ID NO: 994030 - RNA, 26 nt, Human
cuacccaacccauuccuccucccugg

SEQ ID NO: 994031 - RNA, 20 nt, Human
cucagaaggaaacaaaccaa

SEQ ID NO: 994032 - RNA, 19 nt, Human
cuggaaaacuuccucaccc

SEQ ID NO: 994033 - RNA, 22 nt, Human
cugguuaugccugggugguggc

SEQ ID NO: 994034 - RNA, 19 nt, Human
gcauggaagaugcccauug

SEQ ID NO: 994035 - RNA, 18 nt, Human
uaagcccugaccaggagc

SEQ ID NO: 994036 - RNA, 20 nt, Human
ucccuggagaaggcacugua

SEQ ID NO: 994037 - RNA, 19 nt, Human
ucugaaggaaccagacaga

SEQ ID NO: 994038 - RNA, 18 nt, Human
ucuuuucuuuugagaugc

SEQ ID NO: 994039 - RNA, 22 nt, Human
ucuuuucuuuugagaugcccgg

SEQ ID NO: 994040 - RNA, 20 nt, Human
ugaaugcagugaagaaaccg

SEQ ID NO: 994041 - RNA, 18 nt, Human
uggaaaacuuccucaccc

SEQ ID NO: 994042 - RNA, 19 nt, Human
ugggcugggggccuuugag

SEQ ID NO: 994043 - RNA, 20 nt, Human
ugggcugggggccuuugagu

SEQ ID NO: 994044 - RNA, 23 nt, Human
uuaaaaugugaauaacucaagua

SEQ ID NO: 994045 - RNA, 22 nt, Human
uuaaccugggauaucacagaaa

SEQ ID NO: 994046 - RNA, 20 nt, Human
uuacagcugacagcacagcc

SEQ ID NO: 994047 - RNA, 27 nt, Human
uucuuuguccucaauacugaacacuag

SEQ ID NO: 994048 - RNA, 22 nt, Human
uuugagaugcccggccugagca

SEQ ID NO: 994049 - RNA, 22 nt, Human
uuuuacagcugacagcacagcc

SEQ ID NO: 994050 - RNA, 24 nt, Human
aaagugcugggauuacagguguga

SEQ ID NO: 994051 - RNA, 20 nt, Human
aacaggcuucuuccaagcuc

SEQ ID NO: 994052 - RNA, 18 nt, Human
aagagcugggaggagugg

SEQ ID NO: 994053 - RNA, 18 nt, Human
aagugcugggauuacagg

SEQ ID NO: 994054 - RNA, 19 nt, Human
aagugcugggauuacaggu

SEQ ID NO: 994055 - RNA, 26 nt, Human
aagugcugggauuacaggugugagcc

SEQ ID NO: 994056 - RNA, 22 nt, Human
acagaagagcugggaggagugg

SEQ ID NO: 994057 - RNA, 21 nt, Human
acaggcugauauucagggaca

SEQ ID NO: 994058 - RNA, 18 nt, Human
accaugcccggcucauuu

SEQ ID NO: 994059 - RNA, 24 nt, Human
accauguuggccuggcuggucucg

SEQ ID NO: 994060 - RNA, 23 nt, Human
accggacgucccaggaacagcgg

SEQ ID NO: 994061 - RNA, 21 nt, Human
acgggguuucaccauguuggc

SEQ ID NO: 994062 - RNA, 22 nt, Human
acgggguuucaccauguuggcc

SEQ ID NO: 994063 - RNA, 24 nt, Human
acgggguuucaccauguuggccug

SEQ ID NO: 994064 - RNA, 25 nt, Human
acgggguuucaccauguuggccugg

SEQ ID NO: 994065 - RNA, 24 nt, Human
acucuugucccccaggcuggagug

SEQ ID NO: 994066 - RNA, 21 nt, Human
agaccagaaaucccaagucca

SEQ ID NO: 994067 - RNA, 24 nt, Human
agagauucucuugccucagccucc

SEQ ID NO: 994068 - RNA, 19 nt, Human
agccaccgcacccggccua

SEQ ID NO: 994069 - RNA, 23 nt, Human
agccaccgcacccggccuauauu

SEQ ID NO: 994070 - RNA, 22 nt, Human
agcucagagaggcugagagaug

SEQ ID NO: 994071 - RNA, 18 nt, Human
aggcccacuuagaccaga

SEQ ID NO: 994072 - RNA, 22 nt, Human
aggcuuaccacacaggccccag

SEQ ID NO: 994073 - RNA, 24 nt, Human
agguguuccgcccgccucagccuc

SEQ ID NO: 994074 - RNA, 23 nt, Human
agugcaauggcgcgaucuuggcu

SEQ ID NO: 994075 - RNA, 24 nt, Human
agugcaauggcgcgaucuuggcuc

SEQ ID NO: 994076 - RNA, 24 nt, Human
caaagugcugggauuacaggugug

SEQ ID NO: 994077 - RNA, 22 nt, Human
caagagauucucuugccucagc

SEQ ID NO: 994078 - RNA, 24 nt, Human
caagcucagagaggcugagagaug

SEQ ID NO: 994079 - RNA, 18 nt, Human
caccauguuggccuggcu

SEQ ID NO: 994080 - RNA, 24 nt, Human
caccauguuggccuggcuggucuc

SEQ ID NO: 994081 - RNA, 26 nt, Human
caccugaccucagguguuccgcccgc

SEQ ID NO: 994082 - RNA, 21 nt, Human
cagccuccuaacugggauaac

SEQ ID NO: 994083 - RNA, 18 nt, Human
cagguucaagagauucuc

SEQ ID NO: 994084 - RNA, 21 nt, Human
ccaaagugcugggauuacagg

SEQ ID NO: 994085 - RNA, 21 nt, Human
ccaaagugcugggauuacagg

SEQ ID NO: 994086 - RNA, 24 nt, Human
ccaaagugcugggauuacaggugu

SEQ ID NO: 994087 - RNA, 19 nt, Human
ccccaggcuggagugcaau

SEQ ID NO: 994088 - RNA, 21 nt, Human
ccccauccccaggaggcccac

SEQ ID NO: 994089 - RNA, 18 nt, Human
cccgcugaguccucuccu

SEQ ID NO: 994090 - RNA, 22 nt, Human
cccggguugaggacuccagagc

SEQ ID NO: 994091 - RNA, 26 nt, Human
ccgcccgccucagccucccaaagugc

SEQ ID NO: 994092 - RNA, 24 nt, Human
ccgccucagccucccaaagugcug

SEQ ID NO: 994093 - RNA, 20 nt, Human
ccugaccucagguguuccgg

SEQ ID NO: 994094 - RNA, 24 nt, Human
ccugauauuuaacaaggaaaaaaa

SEQ ID NO: 994095 - RNA, 20 nt, Human
ccugcuaccaugcccggcuc

SEQ ID NO: 994096 - RNA, 24 nt, Human
cgggguuucaccauguuggccugg

SEQ ID NO: 994097 - RNA, 21 nt, Human
cucagaacaggcuucuuccaa

SEQ ID NO: 994098 - RNA, 23 nt, Human
cucaguguaccaccccaucccca

SEQ ID NO: 994099 - RNA, 22 nt, Human
cucuugucccccaggcuggagu

SEQ ID NO: 994100 - RNA, 19 nt, Human
cugcaggggagaacuuucc

SEQ ID NO: 994101 - RNA, 24 nt, Human
cuugucccccaggcuggagugcaa

SEQ ID NO: 994102 - RNA, 24 nt, Human
gaccucagguguuccgcccgccuc

SEQ ID NO: 994103 - RNA, 18 nt, Human
gagacggggcccgcugag

SEQ ID NO: 994104 - RNA, 24 nt, Human
gagacgggguuucaccauguuggc

SEQ ID NO: 994105 - RNA, 18 nt, Human
gagccuuagcuucccaag

SEQ ID NO: 994106 - RNA, 20 nt, Human
gagccuuagcuucccaagug

SEQ ID NO: 994107 - RNA, 18 nt, Human
gauuacaggugugagcca

SEQ ID NO: 994108 - RNA, 22 nt, Human
gauuacaggugugagccaccgc

SEQ ID NO: 994109 - RNA, 23 nt, Human
gauuacaggugugagccaccgca

SEQ ID NO: 994110 - RNA, 22 nt, Human
gcaaccuccgccucucagguuc

SEQ ID NO: 994111 - RNA, 20 nt, Human
gccccaguaccuuucuacuc

SEQ ID NO: 994112 - RNA, 25 nt, Human
gcccggcucauuuuuuuuuguauuu

SEQ ID NO: 994113 - RNA, 23 nt, Human
gccucagccucccaaagugcugg

SEQ ID NO: 994114 - RNA, 19 nt, Human
gccuuagcuucccaagugg

SEQ ID NO: 994115 - RNA, 19 nt, Human
gcuggagugcaauggcgcg

SEQ ID NO: 994116 - RNA, 21 nt, Human
ggacaucgguguaaacaaaga

SEQ ID NO: 994117 - RNA, 22 nt, Human
ggcucagaagcucaguguacca

SEQ ID NO: 994118 - RNA, 23 nt, Human
gggguuucaccauguuggccugg

SEQ ID NO: 994119 - RNA, 23 nt, Human
guagagacgggguuucaccaugu

SEQ ID NO: 994120 - RNA, 24 nt, Human
guguuccgcccgccucagccuccc

SEQ ID NO: 994121 - RNA, 18 nt, Human
uaacagacaccugcuacc

SEQ ID NO: 994122 - RNA, 20 nt, Human
uaacagacaccugcuaccau

SEQ ID NO: 994123 - RNA, 23 nt, Human
uacaggugugagccaccgcaccc

SEQ ID NO: 994124 - RNA, 24 nt, Human
uaccaugcccggcucauuuuuuuu

SEQ ID NO: 994125 - RNA, 22 nt, Human
uagagacgggguuucaccaugu

SEQ ID NO: 994126 - RNA, 23 nt, Human
uagggugaggcucagaacaggcu

SEQ ID NO: 994127 - RNA, 24 nt, Human
uaguagagacgggguuucaccaug

SEQ ID NO: 994128 - RNA, 26 nt, Human
uaguagagacgggguuucaccauguu

SEQ ID NO: 994129 - RNA, 19 nt, Human
ucacugcaaccuccgccuc

SEQ ID NO: 994130 - RNA, 24 nt, Human
ucacugcaaccuccgccucucagg

SEQ ID NO: 994131 - RNA, 24 nt, Human
ucacugcaaccuccgccucucagg

SEQ ID NO: 994132 - RNA, 27 nt, Human
ucacugcaaccuccgccucucagguuc

SEQ ID NO: 994133 - RNA, 19 nt, Human
ucagagaggcugagagaug

SEQ ID NO: 994134 - RNA, 23 nt, Human
ucccaaagugcugggauuacagg

SEQ ID NO: 994135 - RNA, 18 nt, Human
ucccccaggcuggagugc

SEQ ID NO: 994136 - RNA, 21 nt, Human
uccgcccgccucagccuccca

SEQ ID NO: 994137 - RNA, 21 nt, Human
ucuacaaugaggcucagaagc

SEQ ID NO: 994138 - RNA, 25 nt, Human
ucuacucuacaaugaggcucagaag

SEQ ID NO: 994139 - RNA, 24 nt, Human
ucucacucuugucccccaggcugg

SEQ ID NO: 994140 - RNA, 25 nt, Human
ucucacucuugucccccaggcugga

SEQ ID NO: 994141 - RNA, 21 nt, Human
ucucagguucaagagauucuc

SEQ ID NO: 994142 - RNA, 24 nt, Human
ucucagguucaagagauucucuug

SEQ ID NO: 994143 - RNA, 18 nt, Human
ucuugucccccaggcugg

SEQ ID NO: 994144 - RNA, 18 nt, Human
ucuuuuuuuuuuuuuuug

SEQ ID NO: 994145 - RNA, 18 nt, Human
ugaccucagguguuccgc

SEQ ID NO: 994146 - RNA, 24 nt, Human
ugaccucagguguuccgcccgccu

SEQ ID NO: 994147 - RNA, 21 nt, Human
ugagagccuuagcuucccaag

SEQ ID NO: 994148 - RNA, 24 nt, Human
ugaggacuccagagcacagcugca

SEQ ID NO: 994149 - RNA, 21 nt, Human
ugcaggggagaacuuuccuga

SEQ ID NO: 994150 - RNA, 24 nt, Human
ugcugggauuacaggugugagcca

SEQ ID NO: 994151 - RNA, 23 nt, Human
uggagugcaauggcgcgaucuug

SEQ ID NO: 994152 - RNA, 24 nt, Human
uggagugcaauggcgcgaucuugg

SEQ ID NO: 994153 - RNA, 24 nt, Human
uggccuggcuggucucgaacaccu

SEQ ID NO: 994154 - RNA, 22 nt, Human
ugggauaacagacaccugcuac

SEQ ID NO: 994155 - RNA, 24 nt, Human
ugggauaacagacaccugcuacca

SEQ ID NO: 994156 - RNA, 18 nt, Human
ugggauuacaggugugag

SEQ ID NO: 994157 - RNA, 19 nt, Human
ugggauuacaggugugagc

SEQ ID NO: 994158 - RNA, 21 nt, Human
ugggauuacaggugugagcca

SEQ ID NO: 994159 - RNA, 22 nt, Human
ugggauuacaggugugagccac

SEQ ID NO: 994160 - RNA, 23 nt, Human
ugggauuacaggugugagccacc

SEQ ID NO: 994161 - RNA, 24 nt, Human
ugggauuacaggugugagccaccg

SEQ ID NO: 994162 - RNA, 21 nt, Human
ugggucaacugggugaugccc

SEQ ID NO: 994163 - RNA, 18 nt, Human
ugggugaugcccguuuug

SEQ ID NO: 994164 - RNA, 24 nt, Human
uguuccgcccgccucagccuccca

SEQ ID NO: 994165 - RNA, 19 nt, Human
uuagaccagaaaucccaag

SEQ ID NO: 994166 - RNA, 18 nt, Human
uuaguagagacgggguuu

SEQ ID NO: 994167 - RNA, 22 nt, Human
uuaguagagacgggguuucacc

SEQ ID NO: 994168 - RNA, 24 nt, Human
uuaguagagacgggguuucaccau

SEQ ID NO: 994169 - RNA, 21 nt, Human
uuauagagacggggcccgcug

SEQ ID NO: 994170 - RNA, 23 nt, Human
uucaagagauucucuugccucag

SEQ ID NO: 994171 - RNA, 24 nt, Human
uucuuuuuuuuuuuuuuugagacu

SEQ ID NO: 994172 - RNA, 23 nt, Human
uuguauuuuuaguagagacgggg

SEQ ID NO: 994173 - RNA, 21 nt, Human
uuucaccauguuggccuggcu

SEQ ID NO: 994174 - RNA, 18 nt, Human
uuugcaguugugggugaa

SEQ ID NO: 994175 - RNA, 24 nt, Human
uuuuuaguagagacgggguuucac

SEQ ID NO: 994176 - RNA, 21 nt, Human
uuuuuguauuuuuaguagaga

SEQ ID NO: 994177 - RNA, 21 nt, Human
uuuuuuguauuuuuaguagag

SEQ ID NO: 994178 - RNA, 24 nt, Human
uuuuuuguauuuuuaguagagacg

SEQ ID NO: 994179 - RNA, 24 nt, Human
uuuuuuuuguauuuuuaguagaga

SEQ ID NO: 994180 - RNA, 27 nt, Human
uuuuuuuuuuuuugagacuaagucuca

SEQ ID NO: 994181 - RNA, 21 nt, Human
uuuuuuuuuuuuuuuuugcag

SEQ ID NO: 994182 - RNA, 23 nt, Human
uuuuuuuuuuuuuuuuugcaguu

SEQ ID NO: 994183 - RNA, 20 nt, Human
uuuuuuuuuuuuuuuuuugg

SEQ ID NO: 994184 - RNA, 21 nt, Human
aaaacaaauggguacaagaca

SEQ ID NO: 994185 - RNA, 30 nt, Human
aaacaccaccagugcuucuugcccaaagcc

SEQ ID NO: 994186 - RNA, 22 nt, Human
aaagaaacaguuucuaaaugca

SEQ ID NO: 994187 - RNA, 18 nt, Human
aaagaccacccuaccucu

SEQ ID NO: 994188 - RNA, 21 nt, Human
aaccgcaguggucaaagcuuc

SEQ ID NO: 994189 - RNA, 20 nt, Human
aacugaugagaaccccaucu

SEQ ID NO: 994190 - RNA, 21 nt, Human
aacugaugagaaccccaucuu

SEQ ID NO: 994191 - RNA, 23 nt, Human
aagaaaauccucuccacagacca

SEQ ID NO: 994192 - RNA, 18 nt, Human
aagaacugaugagaaccc

SEQ ID NO: 994193 - RNA, 21 nt, Human
aagcagaauuacgguaacaac

SEQ ID NO: 994194 - RNA, 18 nt, Human
aagcagguuuucccuauu

SEQ ID NO: 994195 - RNA, 24 nt, Human
aagcagguuuucccuauucaauuu

SEQ ID NO: 994196 - RNA, 23 nt, Human
aagcauccaacgcuaaucacauu

SEQ ID NO: 994197 - RNA, 22 nt, Human
aaggcagaagcucaucuuucau

SEQ ID NO: 994198 - RNA, 22 nt, Human
aaugaucaucugguuucaccuu

SEQ ID NO: 994199 - RNA, 23 nt, Human
acaagacaucagcaacaaaaaaa

SEQ ID NO: 994200 - RNA, 19 nt, Human
acccaacucucaacucugc

SEQ ID NO: 994201 - RNA, 22 nt, Human
acccuggggugggagccacggg

SEQ ID NO: 994202 - RNA, 19 nt, Human
acugaaggcaacaacacaa

SEQ ID NO: 994203 - RNA, 26 nt, Human
acugggcuagugugggugugucucug

SEQ ID NO: 994204 - RNA, 22 nt, Human
acuguacuuuuccaccugaaag

SEQ ID NO: 994205 - RNA, 22 nt, Human
agaaaauccucuccacagacca

SEQ ID NO: 994206 - RNA, 22 nt, Human
agaacucgaucuacaaccccau

SEQ ID NO: 994207 - RNA, 18 nt, Human
agaauuacgguaacaacu

SEQ ID NO: 994208 - RNA, 24 nt, Human
agaccaaacaucuuuacuccccaa

SEQ ID NO: 994209 - RNA, 25 nt, Human
agaguucuuguuuccaaguuugggg

SEQ ID NO: 994210 - RNA, 24 nt, Human
agcccacaaaugccuucuacugaa

SEQ ID NO: 994211 - RNA, 21 nt, Human
aggcuuuuucuucaggagaga

SEQ ID NO: 994212 - RNA, 21 nt, Human
agugcccauggcugggucacu

SEQ ID NO: 994213 - RNA, 21 nt, Human
auaggcugcaaaacuugccaa

SEQ ID NO: 994214 - RNA, 22 nt, Human
augcagucccacaagcaucucu

SEQ ID NO: 994215 - RNA, 23 nt, Human
augcagucccacaagcaucucua

SEQ ID NO: 994216 - RNA, 21 nt, Human
caaaggcaccauuuccuguaa

SEQ ID NO: 994217 - RNA, 23 nt, Human
caaaggcaccauuuccuguaauu

SEQ ID NO: 994218 - RNA, 24 nt, Human
caacaaaaaaacacuaaaagauga

SEQ ID NO: 994219 - RNA, 24 nt, Human
caacuaaagagaaugguaaagcau

SEQ ID NO: 994220 - RNA, 18 nt, Human
caaguaaccaagaaaauc

SEQ ID NO: 994221 - RNA, 24 nt, Human
caagucccuguuugagacaaauaa

SEQ ID NO: 994222 - RNA, 19 nt, Human
cacaaugaguuggguagca

SEQ ID NO: 994223 - RNA, 18 nt, Human
cacucgccauucuuggca

SEQ ID NO: 994224 - RNA, 23 nt, Human
cacugcuuggcuaaccaaaguuu

SEQ ID NO: 994225 - RNA, 19 nt, Human
cagaaagcagguuuucccu

SEQ ID NO: 994226 - RNA, 20 nt, Human
cagcacaccggccagacccu

SEQ ID NO: 994227 - RNA, 23 nt, Human
cagcacaccggccagacccuggg

SEQ ID NO: 994228 - RNA, 23 nt, Human
cagcccaggaggugucugugccc

SEQ ID NO: 994229 - RNA, 22 nt, Human
caggagagaaggauauaaaggc

SEQ ID NO: 994230 - RNA, 19 nt, Human
caggagagacuaaccucac

SEQ ID NO: 994231 - RNA, 18 nt, Human
caggaggugucugugccc

SEQ ID NO: 994232 - RNA, 20 nt, Human
caggccgaggguagcggcag

SEQ ID NO: 994233 - RNA, 22 nt, Human
caggguuuugcccccaaacccu

SEQ ID NO: 994234 - RNA, 22 nt, Human
ccaacacccaugugccaccaag

SEQ ID NO: 994235 - RNA, 23 nt, Human
ccacugccacugggcuagugugg

SEQ ID NO: 994236 - RNA, 19 nt, Human
ccaggugcccagcagccgg

SEQ ID NO: 994237 - RNA, 23 nt, Human
cccagagaacagacacaggucau

SEQ ID NO: 994238 - RNA, 18 nt, Human
ccccaacacccaugugcc

SEQ ID NO: 994239 - RNA, 18 nt, Human
ccccaacacccaugugcc

SEQ ID NO: 994240 - RNA, 21 nt, Human
ccccaacacccaugugccacc

SEQ ID NO: 994241 - RNA, 24 nt, Human
ccccagcugccuagugcacuggug

SEQ ID NO: 994242 - RNA, 23 nt, Human
cccucuucacuuuaugcaguccc

SEQ ID NO: 994243 - RNA, 25 nt, Human
ccucacccaacucucaacucugcag

SEQ ID NO: 994244 - RNA, 22 nt, Human
ccuccuacaaugucccuuuaag

SEQ ID NO: 994245 - RNA, 21 nt, Human
ccuggggugggagccacgggc

SEQ ID NO: 994246 - RNA, 24 nt, Human
cgaggguagcggcaggcucugggc

SEQ ID NO: 994247 - RNA, 24 nt, Human
cgccccagcugccuagugcacugg

SEQ ID NO: 994248 - RNA, 20 nt, Human
cgugaugacugccucccuca

SEQ ID NO: 994249 - RNA, 23 nt, Human
cuaaagaccacccuaccucugau

SEQ ID NO: 994250 - RNA, 24 nt, Human
cuacaaccccauguaaaaaacaaa

SEQ ID NO: 994251 - RNA, 25 nt, Human
cucacucucauccaacaaccccuag

SEQ ID NO: 994252 - RNA, 20 nt, Human
cucccaugaaaaagcagaau

SEQ ID NO: 994253 - RNA, 21 nt, Human
cucucacuccaaacaugucua

SEQ ID NO: 994254 - RNA, 23 nt, Human
cucuccacagaccaacucuucag

SEQ ID NO: 994255 - RNA, 22 nt, Human
cugaaggcaacaacacaauuua

SEQ ID NO: 994256 - RNA, 23 nt, Human
cugaaggcaacaacacaauuuaa

SEQ ID NO: 994257 - RNA, 23 nt, Human
cugcugggcuccuuacaugggcc

SEQ ID NO: 994258 - RNA, 18 nt, Human
cugugcccacgaagccug

SEQ ID NO: 994259 - RNA, 19 nt, Human
cuucaaagguacugcuucc

SEQ ID NO: 994260 - RNA, 20 nt, Human
cuuucauucagucuauuugc

SEQ ID NO: 994261 - RNA, 19 nt, Human
gaaauuccaagugucuguu

SEQ ID NO: 994262 - RNA, 24 nt, Human
gaacuuguccaccaacuguguuuu

SEQ ID NO: 994263 - RNA, 21 nt, Human
gaagcucucccaggugcccuu

SEQ ID NO: 994264 - RNA, 20 nt, Human
gaaggcaacaacacaauuua

SEQ ID NO: 994265 - RNA, 22 nt, Human
gacaucagcaacaaaaaaacac

SEQ ID NO: 994266 - RNA, 24 nt, Human
gaccaaacaucuuuacuccccaaa

SEQ ID NO: 994267 - RNA, 20 nt, Human
gagagcuugucccauaaggg

SEQ ID NO: 994268 - RNA, 21 nt, Human
gcaagucuuugugcuaaagac

SEQ ID NO: 994269 - RNA, 18 nt, Human
gcagagaucucuucaaag

SEQ ID NO: 994270 - RNA, 18 nt, Human
gcaugcaagucuuugugc

SEQ ID NO: 994271 - RNA, 22 nt, Human
gcccacaaaugccuucuacuga

SEQ ID NO: 994272 - RNA, 20 nt, Human
gcccaggaggugucugugcc

SEQ ID NO: 994273 - RNA, 22 nt, Human
gcugccaucccacaucccccac

SEQ ID NO: 994274 - RNA, 21 nt, Human
gcuugguggugggcaggccga

SEQ ID NO: 994275 - RNA, 25 nt, Human
ggaaauugaggauuuaccauuuaga

SEQ ID NO: 994276 - RNA, 20 nt, Human
ggaaggugaggggcaccugu

SEQ ID NO: 994277 - RNA, 19 nt, Human
ggagaaagggcucugaaaa

SEQ ID NO: 994278 - RNA, 23 nt, Human
ggagagaaggauauaaaggcaga

SEQ ID NO: 994279 - RNA, 22 nt, Human
ggcacaaagggguuccagacgu

SEQ ID NO: 994280 - RNA, 24 nt, Human
ggccaguguguuauuccuucccaa

SEQ ID NO: 994281 - RNA, 21 nt, Human
ggccgaggguagcggcaggcu

SEQ ID NO: 994282 - RNA, 19 nt, Human
gggacagggagggcagaag

SEQ ID NO: 994283 - RNA, 21 nt, Human
gggcacucuggguguucugcc

SEQ ID NO: 994284 - RNA, 20 nt, Human
ggucuucuagcacugucacu

SEQ ID NO: 994285 - RNA, 22 nt, Human
gguuuucccuauucaauuucau

SEQ ID NO: 994286 - RNA, 21 nt, Human
guaaaaaacaaauggguacaa

SEQ ID NO: 994287 - RNA, 19 nt, Human
guaaaggaaagguccuaca

SEQ ID NO: 994288 - RNA, 18 nt, Human
gucaaagcuucaggcugu

SEQ ID NO: 994289 - RNA, 20 nt, Human
gugagcuguccugugacagg

SEQ ID NO: 994290 - RNA, 21 nt, Human
gugcagucuccacccgcguuu

SEQ ID NO: 994291 - RNA, 20 nt, Human
guggauguauauguuaaaag

SEQ ID NO: 994292 - RNA, 18 nt, Human
guggcagcagagagucgg

SEQ ID NO: 994293 - RNA, 26 nt, Human
gugggugugucucuguggcgucagcg

SEQ ID NO: 994294 - RNA, 21 nt, Human
guugcauuucaguccuaagca

SEQ ID NO: 994295 - RNA, 21 nt, Human
uaaaacuuuaaaagcauccuc

SEQ ID NO: 994296 - RNA, 22 nt, Human
uaaaaggagaaauuccaagugu

SEQ ID NO: 994297 - RNA, 24 nt, Human
uaaccaagaaaauccucuccacag

SEQ ID NO: 994298 - RNA, 24 nt, Human
uaaccaagaaaauccucuccacag

SEQ ID NO: 994299 - RNA, 21 nt, Human
uaagaauacaaaaauaggcug

SEQ ID NO: 994300 - RNA, 21 nt, Human
uacaugggcauucuugccuuu

SEQ ID NO: 994301 - RNA, 21 nt, Human
uacucacaagucccuguuuga

SEQ ID NO: 994302 - RNA, 19 nt, Human
uauauaaacacuaaaagga

SEQ ID NO: 994303 - RNA, 21 nt, Human
uauauguguguguguauauaa

SEQ ID NO: 994304 - RNA, 24 nt, Human
ucaaaagcaagaccucuccuggaa

SEQ ID NO: 994305 - RNA, 20 nt, Human
ucaaacucccaugaaaaagc

SEQ ID NO: 994306 - RNA, 20 nt, Human
ucaaagcuucaggcuguggc

SEQ ID NO: 994307 - RNA, 21 nt, Human
ucaaggauaagguccagagca

SEQ ID NO: 994308 - RNA, 18 nt, Human
ucacaaggaccagugaug

SEQ ID NO: 994309 - RNA, 22 nt, Human
ucagaaugaucaucugguuuca

SEQ ID NO: 994310 - RNA, 23 nt, Human
ucaguuguuugcagaaagcaggu

SEQ ID NO: 994311 - RNA, 28 nt, Human
uccaacacaggcuacucccccaacaccc

SEQ ID NO: 994312 - RNA, 21 nt, Human
ucccaggugcccagcagccgg

SEQ ID NO: 994313 - RNA, 25 nt, Human
uccccagagaacagacacaggucau

SEQ ID NO: 994314 - RNA, 24 nt, Human
ucccucuucacuuuaugcaguccc

SEQ ID NO: 994315 - RNA, 19 nt, Human
ucccuggguaggggagaag

SEQ ID NO: 994316 - RNA, 20 nt, Human
ucucagagcaaccggucuug

SEQ ID NO: 994317 - RNA, 23 nt, Human
ucucuggggucuucuagcacugu

SEQ ID NO: 994318 - RNA, 19 nt, Human
ucucugugcacgacuggcu

SEQ ID NO: 994319 - RNA, 22 nt, Human
ucugaacuauuuuauccauugg

SEQ ID NO: 994320 - RNA, 22 nt, Human
ucugcacguauauaaacacuaa

SEQ ID NO: 994321 - RNA, 23 nt, Human
ucugcagcccacaaaugccuucu

SEQ ID NO: 994322 - RNA, 18 nt, Human
ucuugcccaaagcccuug

SEQ ID NO: 994323 - RNA, 21 nt, Human
ugaaaaagcagaauuacggua

SEQ ID NO: 994324 - RNA, 19 nt, Human
ugaugagaaccccaucuug

SEQ ID NO: 994325 - RNA, 18 nt, Human
ugcaaaaccacagugagc

SEQ ID NO: 994326 - RNA, 21 nt, Human
ugcaugcagggcucuggaggu

SEQ ID NO: 994327 - RNA, 21 nt, Human
ugccaaguacucacaaguccc

SEQ ID NO: 994328 - RNA, 23 nt, Human
ugcuugguggugggcaggccgag

SEQ ID NO: 994329 - RNA, 19 nt, Human
uggaaggcagaaggggcca

SEQ ID NO: 994330 - RNA, 18 nt, Human
uggaaggugaggggcacc

SEQ ID NO: 994331 - RNA, 21 nt, Human
uggaaggugaggggcaccugu

SEQ ID NO: 994332 - RNA, 23 nt, Human
uggaaggugaggggcaccuguga

SEQ ID NO: 994333 - RNA, 23 nt, Human
uggaggugaggcacugggugguu

SEQ ID NO: 994334 - RNA, 21 nt, Human
uggcaauuccucaaagguuuu

SEQ ID NO: 994335 - RNA, 22 nt, Human
uggcacucugggaagcaggugg

SEQ ID NO: 994336 - RNA, 24 nt, Human
uggcugggucacuguagguccugc

SEQ ID NO: 994337 - RNA, 27 nt, Human
ugggaagcaggugguuuuuucgguuga

SEQ ID NO: 994338 - RNA, 22 nt, Human
ugggagccacgggcacucuggg

SEQ ID NO: 994339 - RNA, 21 nt, Human
ugggcuccuuacaugggcauu

SEQ ID NO: 994340 - RNA, 21 nt, Human
uggguagcaggagagaaggau

SEQ ID NO: 994341 - RNA, 18 nt, Human
uguauauauauauauaua

SEQ ID NO: 994342 - RNA, 23 nt, Human
uguauauauauauauauaaauua

SEQ ID NO: 994343 - RNA, 18 nt, Human
ugucacucugcccagccc

SEQ ID NO: 994344 - RNA, 22 nt, Human
uguccaccaacuguguuuugcu

SEQ ID NO: 994345 - RNA, 23 nt, Human
ugucugcgaggauucuggaagcu

SEQ ID NO: 994346 - RNA, 21 nt, Human
ugugcaaaaccacagugagcu

SEQ ID NO: 994347 - RNA, 18 nt, Human
uguguauauauauauaua

SEQ ID NO: 994348 - RNA, 20 nt, Human
uguguauauauauauauaua

SEQ ID NO: 994349 - RNA, 21 nt, Human
uguguauauauauauauauaa

SEQ ID NO: 994350 - RNA, 22 nt, Human
uguguauauauauauauauaaa

SEQ ID NO: 994351 - RNA, 24 nt, Human
uguguguauauauauauauauaac

SEQ ID NO: 994352 - RNA, 18 nt, Human
uguguguguauauauaua

SEQ ID NO: 994353 - RNA, 23 nt, Human
uguguguguguauauauauauau

SEQ ID NO: 994354 - RNA, 20 nt, Human
uguuaaaagcuugauucugu

SEQ ID NO: 994355 - RNA, 25 nt, Human
uguuugcagaaagcagguuuucccu

SEQ ID NO: 994356 - RNA, 20 nt, Human
uucaaaagcaagaccucucc

SEQ ID NO: 994357 - RNA, 18 nt, Human
uucaccacaaugaguugg

SEQ ID NO: 994358 - RNA, 21 nt, Human
uucacccuuacuaaugggcca

SEQ ID NO: 994359 - RNA, 26 nt, Human
uucagucuauuugcugccuuugacua

SEQ ID NO: 994360 - RNA, 22 nt, Human
uuccaagaagucaacaaauccc

SEQ ID NO: 994361 - RNA, 23 nt, Human
uucccaaaccauaggaggcucug

SEQ ID NO: 994362 - RNA, 21 nt, Human
uucuugcccaaagcccuugcc

SEQ ID NO: 994363 - RNA, 20 nt, Human
uucuuuuuccuucaccacaa

SEQ ID NO: 994364 - RNA, 21 nt, Human
uuggcucuuccacguggcagg

SEQ ID NO: 994365 - RNA, 22 nt, Human
uuuuucaguuguuugcagaaag

SEQ ID NO: 994366 - RNA, 18 nt, Human
caggcccacagaggcugg

SEQ ID NO: 994367 - RNA, 21 nt, Human
cccacagaggcuggaccucua

SEQ ID NO: 994368 - RNA, 19 nt, Human
cuaggcuuccagggggucc

SEQ ID NO: 994369 - RNA, 20 nt, Human
gagucuuagcuguggaucuc

SEQ ID NO: 994370 - RNA, 20 nt, Human
uugagguguugucaaaauca

SEQ ID NO: 994371 - RNA, 18 nt, Human
aaacagagcccucaguuc

SEQ ID NO: 994372 - RNA, 24 nt, Human
aaacuacagcuauuaagcugguag

SEQ ID NO: 994373 - RNA, 21 nt, Human
aaguauaguuaugauauagac

SEQ ID NO: 994374 - RNA, 20 nt, Human
aauaguguuuuccucaagua

SEQ ID NO: 994375 - RNA, 21 nt, Human
acuggagaagaaccaucccgg

SEQ ID NO: 994376 - RNA, 18 nt, Human
agcaaguaacaggaucug

SEQ ID NO: 994377 - RNA, 21 nt, Human
agccacagacuccucuaaccc

SEQ ID NO: 994378 - RNA, 20 nt, Human
aggaagaaaauuuaagacac

SEQ ID NO: 994379 - RNA, 19 nt, Human
auaguguuuuccucaagua

SEQ ID NO: 994380 - RNA, 21 nt, Human
cacaaacagagcccucaguuc

SEQ ID NO: 994381 - RNA, 24 nt, Human
cacaaacagagcccucaguucuga

SEQ ID NO: 994382 - RNA, 24 nt, Human
cacacgagcuggagucccaccacg

SEQ ID NO: 994383 - RNA, 22 nt, Human
cacagugcagggaaaacuacag

SEQ ID NO: 994384 - RNA, 23 nt, Human
cacuuauagccaaacuaucaagu

SEQ ID NO: 994385 - RNA, 21 nt, Human
cagcuguccccuggguucucc

SEQ ID NO: 994386 - RNA, 19 nt, Human
ccaucccggcggccuggca

SEQ ID NO: 994387 - RNA, 18 nt, Human
ccaugcaggcaggccugg

SEQ ID NO: 994388 - RNA, 22 nt, Human
ccgcguaggcgcgcagcuccgg

SEQ ID NO: 994389 - RNA, 18 nt, Human
ccggaccccgcuucugcu

SEQ ID NO: 994390 - RNA, 23 nt, Human
ccuaaagcuucaaaggaagaaaa

SEQ ID NO: 994391 - RNA, 21 nt, Human
cuccugcuccuacuccuccug

SEQ ID NO: 994392 - RNA, 20 nt, Human
gacacacgagcuggaguccc

SEQ ID NO: 994393 - RNA, 23 nt, Human
gacuccucuaacccagucccaca

SEQ ID NO: 994394 - RNA, 18 nt, Human
gcaggccugggagagucc

SEQ ID NO: 994395 - RNA, 21 nt, Human
gcuuuuggaaauaguguuuuc

SEQ ID NO: 994396 - RNA, 20 nt, Human
ggagaagaaccaucccggcg

SEQ ID NO: 994397 - RNA, 18 nt, Human
ggagucccaccacgucuc

SEQ ID NO: 994398 - RNA, 18 nt, Human
ggcaggaguggcuagucu

SEQ ID NO: 994399 - RNA, 19 nt, Human
uaacccagucccacaaaca

SEQ ID NO: 994400 - RNA, 21 nt, Human
uaacccagucccacaaacaga

SEQ ID NO: 994401 - RNA, 20 nt, Human
uccacugaagcaaguaacag

SEQ ID NO: 994402 - RNA, 22 nt, Human
uccaugaggacacacgagcugg

SEQ ID NO: 994403 - RNA, 20 nt, Human
uccccuggguucuccaugag

SEQ ID NO: 994404 - RNA, 20 nt, Human
uccccuggguucuccaugag

SEQ ID NO: 994405 - RNA, 23 nt, Human
uccccuggguucuccaugaggac

SEQ ID NO: 994406 - RNA, 21 nt, Human
uccugcuccuacuccuccugg

SEQ ID NO: 994407 - RNA, 18 nt, Human
ucugaacaaaaagccaca

SEQ ID NO: 994408 - RNA, 22 nt, Human
ucugcuccugcuccuacuccuc

SEQ ID NO: 994409 - RNA, 19 nt, Human
ugaaacaguccuugaaggc

SEQ ID NO: 994410 - RNA, 18 nt, Human
ugaggacacacgagcugg

SEQ ID NO: 994411 - RNA, 26 nt, Human
ugcaccagcuguccccuggguucucc

SEQ ID NO: 994412 - RNA, 21 nt, Human
ugccuugaaaagaugacacag

SEQ ID NO: 994413 - RNA, 24 nt, Human
ugcuccugcuccuacuccuccugg

SEQ ID NO: 994414 - RNA, 21 nt, Human
uggguucuccaugaggacaca

SEQ ID NO: 994415 - RNA, 20 nt, Human
uggguuuaaacaaacaacaa

SEQ ID NO: 994416 - RNA, 21 nt, Human
uucaaaggaagaaaauuuaag

SEQ ID NO: 994417 - RNA, 22 nt, Human
uucaaaggaagaaaauuuaaga

SEQ ID NO: 994418 - RNA, 20 nt, Human
uuggaaauaguguuuuccuc

SEQ ID NO: 994419 - RNA, 24 nt, Human
aaaaaaaaacaaaauaacaaaacu

SEQ ID NO: 994420 - RNA, 25 nt, Human
aaaaaaaaacaaaauaacaaaacuu

SEQ ID NO: 994421 - RNA, 19 nt, Human
aaccugaccccauccacac

SEQ ID NO: 994422 - RNA, 19 nt, Human
aagaaggaggcaggcucag

SEQ ID NO: 994423 - RNA, 19 nt, Human
aagcaaacagguaggaaac

SEQ ID NO: 994424 - RNA, 23 nt, Human
aagcaagaaggaggcaggcucag

SEQ ID NO: 994425 - RNA, 20 nt, Human
aagcuuaagaguaacagucu

SEQ ID NO: 994426 - RNA, 23 nt, Human
acaccaucacccccaaaaaaaaa

SEQ ID NO: 994427 - RNA, 21 nt, Human
accccauccacacaggaaaca

SEQ ID NO: 994428 - RNA, 24 nt, Human
acccccaaaaaaaaacaaaauaac

SEQ ID NO: 994429 - RNA, 25 nt, Human
agaaaagcccagucugggcuggguu

SEQ ID NO: 994430 - RNA, 19 nt, Human
agaaggaggcaggcucaga

SEQ ID NO: 994431 - RNA, 21 nt, Human
agaggagaggucaagggcuug

SEQ ID NO: 994432 - RNA, 19 nt, Human
agagggagggaggagacag

SEQ ID NO: 994433 - RNA, 21 nt, Human
agccccacccuccuuuccaga

SEQ ID NO: 994434 - RNA, 18 nt, Human
agcuugaggccccugagc

SEQ ID NO: 994435 - RNA, 21 nt, Human
agcuugaggccccugagcccc

SEQ ID NO: 994436 - RNA, 23 nt, Human
agcuugaggccccugagccccac

SEQ ID NO: 994437 - RNA, 19 nt, Human
aggaaacggaaaugagguu

SEQ ID NO: 994438 - RNA, 22 nt, Human
aggccagcugugccaggccccu

SEQ ID NO: 994439 - RNA, 23 nt, Human
aggccccugagccccacccuccu

SEQ ID NO: 994440 - RNA, 23 nt, Human
aggccccuggagggcaacagcuc

SEQ ID NO: 994441 - RNA, 19 nt, Human
agggaggagacagcugagg

SEQ ID NO: 994442 - RNA, 21 nt, Human
agggaggagacagcugagggg

SEQ ID NO: 994443 - RNA, 27 nt, Human
agguaggaaacggaaaugaggggaccc

SEQ ID NO: 994444 - RNA, 21 nt, Human
agguugggagugggggccagg

SEQ ID NO: 994445 - RNA, 22 nt, Human
aucacccccaaaaaaaaacaaa

SEQ ID NO: 994446 - RNA, 19 nt, Human
aucuucagcugaaauuggg

SEQ ID NO: 994447 - RNA, 24 nt, Human
caaguaggcacuguaauuucuucc

SEQ ID NO: 994448 - RNA, 18 nt, Human
cacaaccugaccccaucc

SEQ ID NO: 994449 - RNA, 19 nt, Human
cacagagcccagcuugagg

SEQ ID NO: 994450 - RNA, 21 nt, Human
caccaucacccccaaaaaaaa

SEQ ID NO: 994451 - RNA, 19 nt, Human
cacccccaaaaaaaaacaa

SEQ ID NO: 994452 - RNA, 21 nt, Human
cacggccccuccacuuccuuu

SEQ ID NO: 994453 - RNA, 20 nt, Human
cagucugggcuggguugggc

SEQ ID NO: 994454 - RNA, 23 nt, Human
caucaaugugaaaauuucucaaa

SEQ ID NO: 994455 - RNA, 23 nt, Human
ccaaggccagcugugccaggccc

SEQ ID NO: 994456 - RNA, 22 nt, Human
ccaucacccccaaaaaaaaaca

SEQ ID NO: 994457 - RNA, 21 nt, Human
cccacaaccugaccccaucca

SEQ ID NO: 994458 - RNA, 22 nt, Human
cccacaaccugaccccauccac

SEQ ID NO: 994459 - RNA, 19 nt, Human
ccccagaaaagcccagucu

SEQ ID NO: 994460 - RNA, 27 nt, Human
cccccaaaaaaaaacaaaauaacaaaa

SEQ ID NO: 994461 - RNA, 18 nt, Human
ccccugagccccacccuc

SEQ ID NO: 994462 - RNA, 20 nt, Human
ccccuggagggcaacagcuc

SEQ ID NO: 994463 - RNA, 19 nt, Human
cccugagcugccaaggugu

SEQ ID NO: 994464 - RNA, 23 nt, Human
ccuccgccugcugagaagcaaga

SEQ ID NO: 994465 - RNA, 21 nt, Human
cucagcuccccagaaaagccc

SEQ ID NO: 994466 - RNA, 24 nt, Human
cuccccagaaaagcccagucuggg

SEQ ID NO: 994467 - RNA, 24 nt, Human
cuccgcaucccacggccccuccac

SEQ ID NO: 994468 - RNA, 23 nt, Human
cucucuguuccgcuguccgggag

SEQ ID NO: 994469 - RNA, 21 nt, Human
cugaaauuggggccggggucc

SEQ ID NO: 994470 - RNA, 22 nt, Human
cuggggacccugagcugccaag

SEQ ID NO: 994471 - RNA, 24 nt, Human
cuggggcaagucgcuaucucuucu

SEQ ID NO: 994472 - RNA, 23 nt, Human
cugggguuggacuggggcaaguc

SEQ ID NO: 994473 - RNA, 21 nt, Human
cuuuccgccgcugccagcugc

SEQ ID NO: 994474 - RNA, 20 nt, Human
gagaagcaagaaggaggcag

SEQ ID NO: 994475 - RNA, 27 nt, Human
gaggcaggcucagagauguggccagaa

SEQ ID NO: 994476 - RNA, 23 nt, Human
gcacuguaauuucuuccaguccc

SEQ ID NO: 994477 - RNA, 18 nt, Human
gccccugagccccacccu

SEQ ID NO: 994478 - RNA, 20 nt, Human
gcuugaggccccugagcccc

SEQ ID NO: 994479 - RNA, 21 nt, Human
ggccuggcauggcccacaacc

SEQ ID NO: 994480 - RNA, 24 nt, Human
gggacuccuugcaguccuggugca

SEQ ID NO: 994481 - RNA, 23 nt, Human
gggcuggguugggcugauuggag

SEQ ID NO: 994482 - RNA, 18 nt, Human
gggggcccugaaucaguc

SEQ ID NO: 994483 - RNA, 22 nt, Human
gggggggaagcaaacagguagg

SEQ ID NO: 994484 - RNA, 18 nt, Human
gggucuggauagaggaga

SEQ ID NO: 994485 - RNA, 19 nt, Human
gguugggagugggggccag

SEQ ID NO: 994486 - RNA, 21 nt, Human
uaaacuccucagcuccccaga

SEQ ID NO: 994487 - RNA, 23 nt, Human
uaaacuccucagcuccccagaaa

SEQ ID NO: 994488 - RNA, 24 nt, Human
uaacagucuagagccaagguuggg

SEQ ID NO: 994489 - RNA, 19 nt, Human
uaagcuuuccgccgcugcc

SEQ ID NO: 994490 - RNA, 25 nt, Human
uaugaaaggauggaagaugaauacc

SEQ ID NO: 994491 - RNA, 18 nt, Human
uauucuaagaaaaagggg

SEQ ID NO: 994492 - RNA, 18 nt, Human
ucaacgcagcugacaggc

SEQ ID NO: 994493 - RNA, 20 nt, Human
ucacccccaaaaaaaaacaa

SEQ ID NO: 994494 - RNA, 19 nt, Human
uccacacaggaaacagcug

SEQ ID NO: 994495 - RNA, 19 nt, Human
uccagagggagggaggaga

SEQ ID NO: 994496 - RNA, 24 nt, Human
ucccacggccccuccacuuccuuu

SEQ ID NO: 994497 - RNA, 19 nt, Human
uccccagaaaagcccaguc

SEQ ID NO: 994498 - RNA, 18 nt, Human
uccgcaucccacggcccc

SEQ ID NO: 994499 - RNA, 24 nt, Human
uccgccugcugagaagcaagaagg

SEQ ID NO: 994500 - RNA, 20 nt, Human
uccucagcuccccagaaaag

SEQ ID NO: 994501 - RNA, 19 nt, Human
uccuggugcagcaauggca

SEQ ID NO: 994502 - RNA, 22 nt, Human
ucucuguuccgcuguccgggag

SEQ ID NO: 994503 - RNA, 22 nt, Human
ucugggaggugacggcuccucc

SEQ ID NO: 994504 - RNA, 23 nt, Human
ucuguuugucggcagcucucucu

SEQ ID NO: 994505 - RNA, 21 nt, Human
ugaaauuggggcagaugcugc

SEQ ID NO: 994506 - RNA, 23 nt, Human
ugaaauuggggcagaugcugcua

SEQ ID NO: 994507 - RNA, 19 nt, Human
ugagaagcaagaaggaggc

SEQ ID NO: 994508 - RNA, 20 nt, Human
ugagaagcaagaaggaggca

SEQ ID NO: 994509 - RNA, 22 nt, Human
ugagggggcccugaaucagucc

SEQ ID NO: 994510 - RNA, 21 nt, Human
ugccagcugcguucaggccgc

SEQ ID NO: 994511 - RNA, 23 nt, Human
uggaaaggcugaucuaagcuuuc

SEQ ID NO: 994512 - RNA, 19 nt, Human
ugggagugggggccaggcc

SEQ ID NO: 994513 - RNA, 19 nt, Human
uuuccaaguaggcacugua

SEQ ID NO: 994514 - RNA, 23 nt, Human
acuuccacauugcuguucuccau

SEQ ID NO: 994515 - RNA, 22 nt, Human
agaaagccuucuuuaaacaaaa

SEQ ID NO: 994516 - RNA, 23 nt, Human
aggcggccgcggcagcggaggcg

SEQ ID NO: 994517 - RNA, 21 nt, Human
aggcggccggcucggucugag

SEQ ID NO: 994518 - RNA, 23 nt, Human
agugcuuacaaaccauuugccac

SEQ ID NO: 994519 - RNA, 21 nt, Human
caaaccaccuguccagagcuu

SEQ ID NO: 994520 - RNA, 24 nt, Human
caaagugcuaccaggaggagaagu

SEQ ID NO: 994521 - RNA, 18 nt, Human
caaugaguaucugaaauc

SEQ ID NO: 994522 - RNA, 21 nt, Human
cacaaugggcaaacuugagcg

SEQ ID NO: 994523 - RNA, 18 nt, Human
cagaccuugacgcagccc

SEQ ID NO: 994524 - RNA, 19 nt, Human
cagcacacagcucucauga

SEQ ID NO: 994525 - RNA, 19 nt, Human
cagcugccgccccucgcgc

SEQ ID NO: 994526 - RNA, 21 nt, Human
caggucccaggaccugacccc

SEQ ID NO: 994527 - RNA, 18 nt, Human
caucagggagcaaucugc

SEQ ID NO: 994528 - RNA, 18 nt, Human
ccacauugcuguucucca

SEQ ID NO: 994529 - RNA, 19 nt, Human
ccaccuguccagagcuugg

SEQ ID NO: 994530 - RNA, 25 nt, Human
ccccacugcaagccacucuccaguu

SEQ ID NO: 994531 - RNA, 19 nt, Human
ccuugacgcagcccuuccc

SEQ ID NO: 994532 - RNA, 20 nt, Human
cggcaggaacgcgcggcggc

SEQ ID NO: 994533 - RNA, 19 nt, Human
cggggcugauggccagggc

SEQ ID NO: 994534 - RNA, 19 nt, Human
cugccgggccgcuccgcau

SEQ ID NO: 994535 - RNA, 20 nt, Human
cugcugcagcugccgccccu

SEQ ID NO: 994536 - RNA, 21 nt, Human
cugcugcagcugccgccccuc

SEQ ID NO: 994537 - RNA, 19 nt, Human
cuggguggcugauguccca

SEQ ID NO: 994538 - RNA, 19 nt, Human
cuguggccuucuuaucccc

SEQ ID NO: 994539 - RNA, 20 nt, Human
gccacucuccaguugggcag

SEQ ID NO: 994540 - RNA, 20 nt, Human
gcuuggugacaugcaaaacu

SEQ ID NO: 994541 - RNA, 22 nt, Human
ggacaaaguacuggcuuccccu

SEQ ID NO: 994542 - RNA, 22 nt, Human
ggagccgccaggucccaaaugg

SEQ ID NO: 994543 - RNA, 22 nt, Human
ggccagggcauagcaggcgggg

SEQ ID NO: 994544 - RNA, 22 nt, Human
ggccgcggcagcggaggcggcc

SEQ ID NO: 994545 - RNA, 23 nt, Human
ggcgggggccgaggaugucagcu

SEQ ID NO: 994546 - RNA, 20 nt, Human
gggaagugagguuaagaaag

SEQ ID NO: 994547 - RNA, 23 nt, Human
gggaugggggugaacaaaaagga

SEQ ID NO: 994548 - RNA, 22 nt, Human
gugcuuacaaaccauuugccac

SEQ ID NO: 994549 - RNA, 19 nt, Human
uaaguaugcuuauuccaug

SEQ ID NO: 994550 - RNA, 19 nt, Human
uaccaggaggagaagucca

SEQ ID NO: 994551 - RNA, 25 nt, Human
uaccaggaggagaaguccagucugc

SEQ ID NO: 994552 - RNA, 24 nt, Human
uccccacugcaagccacucuccag

SEQ ID NO: 994553 - RNA, 27 nt, Human
ucccggcccccgccgggucucgcguga

SEQ ID NO: 994554 - RNA, 18 nt, Human
ucgugcugcugcagcugc

SEQ ID NO: 994555 - RNA, 20 nt, Human
ugacgcagcccuucccaccc

SEQ ID NO: 994556 - RNA, 18 nt, Human
ugagguuaagaaagggga

SEQ ID NO: 994557 - RNA, 21 nt, Human
ugcaaugaguaucugaaaucc

SEQ ID NO: 994558 - RNA, 26 nt, Human
ugccacaaugggcaaacuugagcgac

SEQ ID NO: 994559 - RNA, 18 nt, Human
ugggaagugagguuaaga

SEQ ID NO: 994560 - RNA, 21 nt, Human
ugucccagaccuugacgcagc

SEQ ID NO: 994561 - RNA, 26 nt, Human
uguuagaaagccuucuuuaaacaaaa

SEQ ID NO: 994562 - RNA, 19 nt, Human
uuagaugcggggauggggg

SEQ ID NO: 994563 - RNA, 19 nt, Human
uuccaaguagacagcugaa

SEQ ID NO: 994564 - RNA, 22 nt, Human
uuggaaucggggcugauggcca

SEQ ID NO: 994565 - RNA, 19 nt, Human
aaaaaaaaaaaaaaaaaga

SEQ ID NO: 994566 - RNA, 19 nt, Human
aaaaaaaaaaaaaagaaaa

SEQ ID NO: 994567 - RNA, 19 nt, Human
aaaaaaaaaaagaaaaaga

SEQ ID NO: 994568 - RNA, 18 nt, Human
aaaacaaacacucaaaug

SEQ ID NO: 994569 - RNA, 23 nt, Human
aaaagaaaaagaaaacaaacacu

SEQ ID NO: 994570 - RNA, 22 nt, Human
aaacaaacacucaaaugcucuc

SEQ ID NO: 994571 - RNA, 19 nt, Human
aucaagcuacuuucuggga

SEQ ID NO: 994572 - RNA, 20 nt, Human
caacggcaccggcacccgcc

SEQ ID NO: 994573 - RNA, 19 nt, Human
ccaagauggcggccccucc

SEQ ID NO: 994574 - RNA, 21 nt, Human
cccgccuccgucauggcgggg

SEQ ID NO: 994575 - RNA, 24 nt, Human
cgacggcagcggcggcaacggcac

SEQ ID NO: 994576 - RNA, 20 nt, Human
cucaaaugcucucaaacuua

SEQ ID NO: 994577 - RNA, 24 nt, Human
cucccggauggcggcgugugauuc

SEQ ID NO: 994578 - RNA, 22 nt, Human
cuuccacugcuacuuuggacac

SEQ ID NO: 994579 - RNA, 23 nt, Human
gaccuggccgccgccgccgagcc

SEQ ID NO: 994580 - RNA, 21 nt, Human
gagacguggagagcugggacc

SEQ ID NO: 994581 - RNA, 18 nt, Human
gcagcggcggcaacggca

SEQ ID NO: 994582 - RNA, 20 nt, Human
ggccgccgccgccgagcccg

SEQ ID NO: 994583 - RNA, 23 nt, Human
gggcgagcgagagagcgagggcu

SEQ ID NO: 994584 - RNA, 18 nt, Human
gucauccuuccuucacug

SEQ ID NO: 994585 - RNA, 21 nt, Human
uaacaugguauuccuguuucu

SEQ ID NO: 994586 - RNA, 22 nt, Human
uauagucagaagugugcauuua

SEQ ID NO: 994587 - RNA, 26 nt, Human
uauucauuguccaugauccucucuca

SEQ ID NO: 994588 - RNA, 24 nt, Human
ucaaggggaugggggaggaaaccg

SEQ ID NO: 994589 - RNA, 19 nt, Human
uccaaacuuccacugcuac

SEQ ID NO: 994590 - RNA, 20 nt, Human
ucccugggccucccggaugg

SEQ ID NO: 994591 - RNA, 21 nt, Human
uccgucauggcgggggccgcg

SEQ ID NO: 994592 - RNA, 22 nt, Human
ugacacuaugaggaacuucagu

SEQ ID NO: 994593 - RNA, 20 nt, Human
ugcuacuuuggacacucauc

SEQ ID NO: 994594 - RNA, 20 nt, Human
uggagacguggagagcuggg

SEQ ID NO: 994595 - RNA, 18 nt, Human
uguccaugauccucucuc

SEQ ID NO: 994596 - RNA, 20 nt, Human
uucccugggccucccggaug

SEQ ID NO: 994597 - RNA, 22 nt, Human
uuguguaaaaaaaaaaaaaaaa

SEQ ID NO: 994598 - RNA, 19 nt, Human
aaacacuaacucuagugcc

SEQ ID NO: 994599 - RNA, 22 nt, Human
aaacaggagaccagacggagga

SEQ ID NO: 994600 - RNA, 20 nt, Human
aagaaaagaacaaguuuaaa

SEQ ID NO: 994601 - RNA, 22 nt, Human
aagcaagaaaauaaaagcaccu

SEQ ID NO: 994602 - RNA, 24 nt, Human
aagcaagaaaauaaaagcaccugg

SEQ ID NO: 994603 - RNA, 20 nt, Human
acaccauccccagcugagcc

SEQ ID NO: 994604 - RNA, 23 nt, Human
acaucucaguacucccacucaau

SEQ ID NO: 994605 - RNA, 24 nt, Human
accucauucuuuguccaauggcaa

SEQ ID NO: 994606 - RNA, 25 nt, Human
acucagagcagccacacacaguggc

SEQ ID NO: 994607 - RNA, 22 nt, Human
acuucaaauaaauuaaaaggga

SEQ ID NO: 994608 - RNA, 21 nt, Human
aucugaagcacugcaucaggg

SEQ ID NO: 994609 - RNA, 23 nt, Human
cacaguggccguugacgcuggaa

SEQ ID NO: 994610 - RNA, 20 nt, Human
cacugcaucagggacccccc

SEQ ID NO: 994611 - RNA, 22 nt, Human
cacugcaucagggaccccccug

SEQ ID NO: 994612 - RNA, 22 nt, Human
cagagcagccacacacaguggc

SEQ ID NO: 994613 - RNA, 24 nt, Human
cagcugagccuuugugcuacaagc

SEQ ID NO: 994614 - RNA, 20 nt, Human
ccaaacccgcugcugaacgc

SEQ ID NO: 994615 - RNA, 22 nt, Human
ccagacggaggagaaagcugca

SEQ ID NO: 994616 - RNA, 22 nt, Human
cccacacaucucaguacuccca

SEQ ID NO: 994617 - RNA, 20 nt, Human
ccccagcaaacucaaaguaa

SEQ ID NO: 994618 - RNA, 21 nt, Human
cccggggcggagccggggccu

SEQ ID NO: 994619 - RNA, 18 nt, Human
ccgccgccgccgccgcgc

SEQ ID NO: 994620 - RNA, 19 nt, Human
ccgccgcgcuccacgcucc

SEQ ID NO: 994621 - RNA, 21 nt, Human
ccgccgcgcuccacgcuccuc

SEQ ID NO: 994622 - RNA, 21 nt, Human
ccgcgcuccacgcuccucccg

SEQ ID NO: 994623 - RNA, 22 nt, Human
ccuaaacuuuauuaaaagaaaa

SEQ ID NO: 994624 - RNA, 21 nt, Human
ccuccgaagucaaacaccauc

SEQ ID NO: 994625 - RNA, 22 nt, Human
ccuccgaagucaaacaccaucc

SEQ ID NO: 994626 - RNA, 22 nt, Human
ccuccguugccuccuuugcagc

SEQ ID NO: 994627 - RNA, 19 nt, Human
cgccgcaaccccccgcccg

SEQ ID NO: 994628 - RNA, 19 nt, Human
cugcagucuucuaaccuca

SEQ ID NO: 994629 - RNA, 21 nt, Human
gcacugcaucagggacccccc

SEQ ID NO: 994630 - RNA, 22 nt, Human
gcccggggcggagccggggccu

SEQ ID NO: 994631 - RNA, 21 nt, Human
gccucuccugagcgccgcaac

SEQ ID NO: 994632 - RNA, 18 nt, Human
gccuuuuccuacaaggcc

SEQ ID NO: 994633 - RNA, 22 nt, Human
gcuccucccgggaggggccccg

SEQ ID NO: 994634 - RNA, 19 nt, Human
gcugccgccgccgccgccg

SEQ ID NO: 994635 - RNA, 18 nt, Human
ggcccggggcggagccgg

SEQ ID NO: 994636 - RNA, 24 nt, Human
ggcccggggcggagccggggccuc

SEQ ID NO: 994637 - RNA, 23 nt, Human
ggccuggccggagcugcccaagg

SEQ ID NO: 994638 - RNA, 20 nt, Human
gggccuuuuccuacaaggcc

SEQ ID NO: 994639 - RNA, 27 nt, Human
uaaaaaaauagcacuucaaauaaauua

SEQ ID NO: 994640 - RNA, 21 nt, Human
uaaaacacuaacucuagugcc

SEQ ID NO: 994641 - RNA, 22 nt, Human
uaaaagggacaaccgucaagug

SEQ ID NO: 994642 - RNA, 18 nt, Human
uaaauauagacacuggac

SEQ ID NO: 994643 - RNA, 20 nt, Human
uacagguuucaucagaucca

SEQ ID NO: 994644 - RNA, 19 nt, Human
uagagagacuccaagcugc

SEQ ID NO: 994645 - RNA, 20 nt, Human
uaugaccaaauguauucuuu

SEQ ID NO: 994646 - RNA, 21 nt, Human
uccaauggcaaaaacccacac

SEQ ID NO: 994647 - RNA, 21 nt, Human
ucccccugggcaggcccgggg

SEQ ID NO: 994648 - RNA, 19 nt, Human
uccccuaggagugccuuuc

SEQ ID NO: 994649 - RNA, 21 nt, Human
ucccuacugagaugagggaag

SEQ ID NO: 994650 - RNA, 18 nt, Human
uccugagcgccgcaaccc

SEQ ID NO: 994651 - RNA, 20 nt, Human
ugaacaguuuguggccuugg

SEQ ID NO: 994652 - RNA, 22 nt, Human
ugaggaucgugcaacuggugga

SEQ ID NO: 994653 - RNA, 23 nt, Human
ugccuccuuugcagcacugccau

SEQ ID NO: 994654 - RNA, 18 nt, Human
ugccucguacuugcuaau

SEQ ID NO: 994655 - RNA, 18 nt, Human
uggaaugaacauugccac

SEQ ID NO: 994656 - RNA, 18 nt, Human
uggcagagcagacugcuc

SEQ ID NO: 994657 - RNA, 20 nt, Human
uggccggagcugcccaaggu

SEQ ID NO: 994658 - RNA, 23 nt, Human
uggccggagcugcccaagguuuc

SEQ ID NO: 994659 - RNA, 22 nt, Human
uggcgcgcuucccccagcaaac

SEQ ID NO: 994660 - RNA, 19 nt, Human
uucacuuuaugaccaaaug

SEQ ID NO: 994661 - RNA, 24 nt, Human
uucacuuuaugaccaaauguauuc

SEQ ID NO: 994662 - RNA, 21 nt, Human
uucugcugccgccgccgccgc

SEQ ID NO: 994663 - RNA, 22 nt, Human
uugcagcacugccaucuaaacc

SEQ ID NO: 994664 - RNA, 23 nt, Human
uuggcagagcagacugcuccucc

SEQ ID NO: 994665 - RNA, 23 nt, Human
uuuccuacaaggccuggccggag

SEQ ID NO: 994666 - RNA, 22 nt, Human
aaaaaacggugaagagagcuga

SEQ ID NO: 994667 - RNA, 25 nt, Human
aaaaacggugaagagagccgguacc

SEQ ID NO: 994668 - RNA, 18 nt, Human
acucuggggaggggcagg

SEQ ID NO: 994669 - RNA, 19 nt, Human
acuuuggggagugcugggg

SEQ ID NO: 994670 - RNA, 24 nt, Human
acuuuggggagugcugggguuggg

SEQ ID NO: 994671 - RNA, 19 nt, Human
agcccagaaggcuuuggua

SEQ ID NO: 994672 - RNA, 18 nt, Human
agcugggggugggggaag

SEQ ID NO: 994673 - RNA, 24 nt, Human
aggcuguggggacuggcuggaagc

SEQ ID NO: 994674 - RNA, 23 nt, Human
aggggcaggcacuuggggggccc

SEQ ID NO: 994675 - RNA, 19 nt, Human
aggguggagugggcugggg

SEQ ID NO: 994676 - RNA, 20 nt, Human
aguggcacgcacagucucug

SEQ ID NO: 994677 - RNA, 23 nt, Human
caaaaaacggugaagagagcuga

SEQ ID NO: 994678 - RNA, 21 nt, Human
cacuugggguuggggagggga

SEQ ID NO: 994679 - RNA, 20 nt, Human
ccccgacagcccagaaggcu

SEQ ID NO: 994680 - RNA, 23 nt, Human
ccccgcccgccggcccgccgccc

SEQ ID NO: 994681 - RNA, 24 nt, Human
cccggcagauucagaucgagguac

SEQ ID NO: 994682 - RNA, 19 nt, Human
ccgccccgccgcuucucgg

SEQ ID NO: 994683 - RNA, 20 nt, Human
ccgcccgccggcccgccgcc

SEQ ID NO: 994684 - RNA, 21 nt, Human
ccgcccgccggcccgccgccc

SEQ ID NO: 994685 - RNA, 22 nt, Human
ccgccgccccgccgcuucucgg

SEQ ID NO: 994686 - RNA, 24 nt, Human
ccggcccgccgccccgccgcuucu

SEQ ID NO: 994687 - RNA, 22 nt, Human
ccuauggguagcuggggguggg

SEQ ID NO: 994688 - RNA, 22 nt, Human
cgccggcccgccgccccgccgc

SEQ ID NO: 994689 - RNA, 18 nt, Human
cugcgccccgcccgccgg

SEQ ID NO: 994690 - RNA, 22 nt, Human
cugcgcugccuggcucugcgcc

SEQ ID NO: 994691 - RNA, 26 nt, Human
cugcgcugccuggcucugcgccccgc

SEQ ID NO: 994692 - RNA, 19 nt, Human
cuggcucugcgccccgccc

SEQ ID NO: 994693 - RNA, 18 nt, Human
cuugggguuggggagggg

SEQ ID NO: 994694 - RNA, 22 nt, Human
cuuuggggagugcugggguugg

SEQ ID NO: 994695 - RNA, 20 nt, Human
gaaggcuuugguaguggcac

SEQ ID NO: 994696 - RNA, 21 nt, Human
gacugggcggggccaggcccu

SEQ ID NO: 994697 - RNA, 19 nt, Human
gcacuuggggggcccuagg

SEQ ID NO: 994698 - RNA, 20 nt, Human
gcacuuuggggagugcuggg

SEQ ID NO: 994699 - RNA, 21 nt, Human
gccccgcccgccggcccgccg

SEQ ID NO: 994700 - RNA, 21 nt, Human
gcccugggguuuggcaggcac

SEQ ID NO: 994701 - RNA, 20 nt, Human
ggcggggccaggcccugggg

SEQ ID NO: 994702 - RNA, 22 nt, Human
gggaggggcaggcacuuggggg

SEQ ID NO: 994703 - RNA, 25 nt, Human
ggggacaggggauguacugcggggg

SEQ ID NO: 994704 - RNA, 22 nt, Human
gggguugggcagguugggcccc

SEQ ID NO: 994705 - RNA, 24 nt, Human
ggguggagugggcuggggccccgg

SEQ ID NO: 994706 - RNA, 18 nt, Human
ggguuggggaggggacag

SEQ ID NO: 994707 - RNA, 20 nt, Human
guggagugggcuggggcccc

SEQ ID NO: 994708 - RNA, 23 nt, Human
guggcagcuucuuuucuccagcc

SEQ ID NO: 994709 - RNA, 23 nt, Human
uacucuggggaggggcaggcacu

SEQ ID NO: 994710 - RNA, 19 nt, Human
ugcgggacugggcggggcc

SEQ ID NO: 994711 - RNA, 21 nt, Human
uggcaggguggagugggcugg

SEQ ID NO: 994712 - RNA, 18 nt, Human
ugggccccgacagcccag

SEQ ID NO: 994713 - RNA, 20 nt, Human
ugggcuggggccccggcaga

SEQ ID NO: 994714 - RNA, 23 nt, Human
uggggacuggcuggaagcugcuu

SEQ ID NO: 994715 - RNA, 18 nt, Human
uggggaggggacagggga

SEQ ID NO: 994716 - RNA, 23 nt, Human
uggggaggggcaggcacuuggag

SEQ ID NO: 994717 - RNA, 22 nt, Human
uggggaggggcaggcacuuggg

SEQ ID NO: 994718 - RNA, 23 nt, Human
uggggaggggcaggcacuugggg

SEQ ID NO: 994719 - RNA, 25 nt, Human
uggggagugcugggguugaccacug

SEQ ID NO: 994720 - RNA, 19 nt, Human
ugggggugggggaagauag

SEQ ID NO: 994721 - RNA, 25 nt, Human
ugggguuuggcaggcacuuugggga

SEQ ID NO: 994722 - RNA, 21 nt, Human
uggguagcuggggguggggga

SEQ ID NO: 994723 - RNA, 23 nt, Human
ugguaguggcacgcacagucucu

SEQ ID NO: 994724 - RNA, 24 nt, Human
uugguaguggcacgcacagucucu

SEQ ID NO: 994725 - RNA, 19 nt, Human
uuuuuuuuuuuuuuuuugu

SEQ ID NO: 994726 - RNA, 22 nt, Human
uuuuuuuuuuuuuuuuuguagg

SEQ ID NO: 994727 - RNA, 25 nt, Human
aaagcgugcaaacaggggcgggaau

SEQ ID NO: 994728 - RNA, 18 nt, Human
aagagaaggaccaacaaa

SEQ ID NO: 994729 - RNA, 22 nt, Human
aaggagacgagcauuccacuga

SEQ ID NO: 994730 - RNA, 22 nt, Human
aaggagcuuacacacggaggca

SEQ ID NO: 994731 - RNA, 24 nt, Human
aagugcccagccucucaggaacac

SEQ ID NO: 994732 - RNA, 22 nt, Human
acaucacgaucaugcagccagu

SEQ ID NO: 994733 - RNA, 22 nt, Human
agacacggugaggcaugagggg

SEQ ID NO: 994734 - RNA, 19 nt, Human
agccagugccgacgggaca

SEQ ID NO: 994735 - RNA, 24 nt, Human
aggaagaagaauauucuaugacgu

SEQ ID NO: 994736 - RNA, 21 nt, Human
aggguccuggcagcucugagc

SEQ ID NO: 994737 - RNA, 24 nt, Human
cacaauaucauaaagagguccagg

SEQ ID NO: 994738 - RNA, 18 nt, Human
cacccgggagggaggugg

SEQ ID NO: 994739 - RNA, 23 nt, Human
cacccuggacgcuaaggagacga

SEQ ID NO: 994740 - RNA, 21 nt, Human
cacgaucaugcagccagugcc

SEQ ID NO: 994741 - RNA, 21 nt, Human
caggccuaagagaaggaccaa

SEQ ID NO: 994742 - RNA, 18 nt, Human
caguccaugaaacgugca

SEQ ID NO: 994743 - RNA, 21 nt, Human
cagucucauucucuccaaucu

SEQ ID NO: 994744 - RNA, 18 nt, Human
ccagugccgacgggacag

SEQ ID NO: 994745 - RNA, 21 nt, Human
ccaguucagccagggccaucc

SEQ ID NO: 994746 - RNA, 22 nt, Human
ccccuggggcucgccaucuggg

SEQ ID NO: 994747 - RNA, 21 nt, Human
ccccugggugagccagugcuc

SEQ ID NO: 994748 - RNA, 22 nt, Human
ccggaguccacacggguuugug

SEQ ID NO: 994749 - RNA, 19 nt, Human
ccugagucacccucccgga

SEQ ID NO: 994750 - RNA, 19 nt, Human
cgaucaugcagccagugcc

SEQ ID NO: 994751 - RNA, 22 nt, Human
cggcagaggaguuguggguagg

SEQ ID NO: 994752 - RNA, 21 nt, Human
cgggacagagaugugagaaca

SEQ ID NO: 994753 - RNA, 22 nt, Human
cucaucagucucauucucucca

SEQ ID NO: 994754 - RNA, 22 nt, Human
cuuccgucuucuccugagagga

SEQ ID NO: 994755 - RNA, 21 nt, Human
gaaacgugcaccccucucucc

SEQ ID NO: 994756 - RNA, 22 nt, Human
gacucugugugagcugaaacag

SEQ ID NO: 994757 - RNA, 21 nt, Human
guccaguucagccagggccau

SEQ ID NO: 994758 - RNA, 19 nt, Human
gucuucuccugagaggaag

SEQ ID NO: 994759 - RNA, 23 nt, Human
uaaaacauccuggaaucgcucau

SEQ ID NO: 994760 - RNA, 18 nt, Human
ucacccgggagggaggug

SEQ ID NO: 994761 - RNA, 22 nt, Human
ucacgaucaugcagccagugcc

SEQ ID NO: 994762 - RNA, 22 nt, Human
ucagaagauccccacuggcuug

SEQ ID NO: 994763 - RNA, 25 nt, Human
ucagucucauucucuccaaucuguc

SEQ ID NO: 994764 - RNA, 21 nt, Human
ucauaaagagguccaggagca

SEQ ID NO: 994765 - RNA, 19 nt, Human
ucauucucuccaaucuguc

SEQ ID NO: 994766 - RNA, 21 nt, Human
uccccuggggcucgccaucug

SEQ ID NO: 994767 - RNA, 23 nt, Human
ucugcaggguaaggagcccacag

SEQ ID NO: 994768 - RNA, 22 nt, Human
ugacaucacgaucaugcagcca

SEQ ID NO: 994769 - RNA, 21 nt, Human
ugagccagugcucaagacaug

SEQ ID NO: 994770 - RNA, 21 nt, Human
ugagcugaaacagccucugca

SEQ ID NO: 994771 - RNA, 21 nt, Human
ugcccagccucucaggaacac

SEQ ID NO: 994772 - RNA, 21 nt, Human
uggaaggaggaccugagucac

SEQ ID NO: 994773 - RNA, 20 nt, Human
uggaaucgcucaucagucuc

SEQ ID NO: 994774 - RNA, 20 nt, Human
ugucgaggcucuccagaagu

SEQ ID NO: 994775 - RNA, 20 nt, Human
uucagccagggccauccccu

SEQ ID NO: 994776 - RNA, 24 nt, Human
uuucuggcuuuuaugaaccauguc

SEQ ID NO: 994777 - RNA, 20 nt, Human
uuuucacccccugggugagc

SEQ ID NO: 994778 - RNA, 19 nt, Human
uuuucugggccacaaaaua

SEQ ID NO: 994779 - RNA, 18 nt, Human
aaaaacuaucaaggacaa

SEQ ID NO: 994780 - RNA, 19 nt, Human
aaaaagccauaaaacuauc

SEQ ID NO: 994781 - RNA, 23 nt, Human
aacucugcuaacucagaaucuua

SEQ ID NO: 994782 - RNA, 21 nt, Human
aagcagagaaguggaucagag

SEQ ID NO: 994783 - RNA, 21 nt, Human
acaaaugcuguucacuuucuc

SEQ ID NO: 994784 - RNA, 21 nt, Human
acaagaguuuccaaagacuug

SEQ ID NO: 994785 - RNA, 20 nt, Human
acuaaaaugcagauuccccg

SEQ ID NO: 994786 - RNA, 19 nt, Human
acuggagaaucguuaggac

SEQ ID NO: 994787 - RNA, 24 nt, Human
agaauacacuuuacguuacgccaa

SEQ ID NO: 994788 - RNA, 18 nt, Human
agagauaagaacugacuu

SEQ ID NO: 994789 - RNA, 18 nt, Human
agaguccaauaguucucu

SEQ ID NO: 994790 - RNA, 24 nt, Human
agccaacauagaaaauccaaccuc

SEQ ID NO: 994791 - RNA, 19 nt, Human
agcggugccuucucucccc

SEQ ID NO: 994792 - RNA, 21 nt, Human
agggugcggccuuucucagag

SEQ ID NO: 994793 - RNA, 24 nt, Human
caaaauacauggaauguuggcaca

SEQ ID NO: 994794 - RNA, 23 nt, Human
caacauagaaaauccaaccucuu

SEQ ID NO: 994795 - RNA, 20 nt, Human
caccugagaagcuacuaaaa

SEQ ID NO: 994796 - RNA, 20 nt, Human
cagauuccccgaccccaucc

SEQ ID NO: 994797 - RNA, 24 nt, Human
cagcgguccuuagcggugccuucu

SEQ ID NO: 994798 - RNA, 23 nt, Human
ccaauaguucucuuauguuuucu

SEQ ID NO: 994799 - RNA, 19 nt, Human
ccccucuucccuucgcucc

SEQ ID NO: 994800 - RNA, 18 nt, Human
cccucuucccuucgcucc

SEQ ID NO: 994801 - RNA, 18 nt, Human
cccuucgcuccugcugug

SEQ ID NO: 994802 - RNA, 19 nt, Human
ccgccggcuggcgccccug

SEQ ID NO: 994803 - RNA, 24 nt, Human
ccguugagugacagagauaagaac

SEQ ID NO: 994804 - RNA, 23 nt, Human
ccugagaagcuacuaaaaugcag

SEQ ID NO: 994805 - RNA, 21 nt, Human
cgaggagggggcgguggaaac

SEQ ID NO: 994806 - RNA, 19 nt, Human
cgccuggcggggccagcgg

SEQ ID NO: 994807 - RNA, 19 nt, Human
cuaaaaacauacccuuaca

SEQ ID NO: 994808 - RNA, 21 nt, Human
cuccccucuucccuucgcucc

SEQ ID NO: 994809 - RNA, 23 nt, Human
cuccugguauaauuuuauaauga

SEQ ID NO: 994810 - RNA, 21 nt, Human
cucgcgagaacgcgccccgag

SEQ ID NO: 994811 - RNA, 21 nt, Human
cucuucccuucgcuccugcug

SEQ ID NO: 994812 - RNA, 20 nt, Human
cugagcaucugaaucaccug

SEQ ID NO: 994813 - RNA, 23 nt, Human
cugcugugcgggaacuggagaau

SEQ ID NO: 994814 - RNA, 29 nt, Human
cuggagacgaccaucuuucucucagucag

SEQ ID NO: 994815 - RNA, 22 nt, Human
cuuaaaagaaaucuccugguag

SEQ ID NO: 994816 - RNA, 21 nt, Human
cuuauucauucagucccaaaa

SEQ ID NO: 994817 - RNA, 21 nt, Human
gaaauggggagggaggaggga

SEQ ID NO: 994818 - RNA, 21 nt, Human
gaauguuggcacaaaacugaa

SEQ ID NO: 994819 - RNA, 21 nt, Human
gaccccauccccuuagaguca

SEQ ID NO: 994820 - RNA, 19 nt, Human
gagaacgcgccccgagccc

SEQ ID NO: 994821 - RNA, 24 nt, Human
gaggaagcagagaaguggaucaga

SEQ ID NO: 994822 - RNA, 23 nt, Human
gccaauauucuauaaaaugaagg

SEQ ID NO: 994823 - RNA, 20 nt, Human
ggagggggcgguggaaaccu

SEQ ID NO: 994824 - RNA, 23 nt, Human
gggaggagggagagccaucaccu

SEQ ID NO: 994825 - RNA, 18 nt, Human
guggagcgaggagggggc

SEQ ID NO: 994826 - RNA, 18 nt, Human
guggagcgaggagggggc

SEQ ID NO: 994827 - RNA, 25 nt, Human
guuccuuuuaaaguuauuuuugauu

SEQ ID NO: 994828 - RNA, 22 nt, Human
uaaaagaugacaagaccgagac

SEQ ID NO: 994829 - RNA, 23 nt, Human
uaaaaugcagauuccccgacccc

SEQ ID NO: 994830 - RNA, 27 nt, Human
uaaaauuaucaaauggauaaaacauau

SEQ ID NO: 994831 - RNA, 22 nt, Human
uaaagaaugcuacaaaugccau

SEQ ID NO: 994832 - RNA, 21 nt, Human
uaacucagaaucuuaaaagaa

SEQ ID NO: 994833 - RNA, 19 nt, Human
uaacuguggaaaguacauc

SEQ ID NO: 994834 - RNA, 19 nt, Human
uagauuuaaagaaugcuac

SEQ ID NO: 994835 - RNA, 18 nt, Human
uagcggugccuucucucc

SEQ ID NO: 994836 - RNA, 20 nt, Human
uagucuaacaguaaaaagcc

SEQ ID NO: 994837 - RNA, 28 nt, Human
uauaaaaugaaggaccgaauauaacugc

SEQ ID NO: 994838 - RNA, 18 nt, Human
uauuucaugacauuccau

SEQ ID NO: 994839 - RNA, 18 nt, Human
ucacagcaaugccuccug

SEQ ID NO: 994840 - RNA, 19 nt, Human
ucacagcaaugccuccugg

SEQ ID NO: 994841 - RNA, 22 nt, Human
ucagccaacauagaaaauccaa

SEQ ID NO: 994842 - RNA, 21 nt, Human
ucuguggguuacucaaacuuc

SEQ ID NO: 994843 - RNA, 20 nt, Human
ugacagagauaagaacugac

SEQ ID NO: 994844 - RNA, 21 nt, Human
ugcaaaacuaguucaaagcaa

SEQ ID NO: 994845 - RNA, 26 nt, Human
ugccuucucuccccucuucccuucgc

SEQ ID NO: 994846 - RNA, 25 nt, Human
uggaaaaauaauuuagcuaaaccag

SEQ ID NO: 994847 - RNA, 18 nt, Human
uggcacaaaacugaagcu

SEQ ID NO: 994848 - RNA, 24 nt, Human
uggcacaaaacugaagcugcugua

SEQ ID NO: 994849 - RNA, 22 nt, Human
uggggagggaggagggagagcc

SEQ ID NO: 994850 - RNA, 21 nt, Human
uggggaggucggccgccuggc

SEQ ID NO: 994851 - RNA, 20 nt, Human
ugguauaauuuuauaaugaa

SEQ ID NO: 994852 - RNA, 20 nt, Human
uguaaaagaugacaagaccg

SEQ ID NO: 994853 - RNA, 21 nt, Human
uguaauccgccggcuggcgcc

SEQ ID NO: 994854 - RNA, 18 nt, Human
uguuggaguuucuuuguu

SEQ ID NO: 994855 - RNA, 23 nt, Human
uguuuccacaaaauaguuuugaa

SEQ ID NO: 994856 - RNA, 20 nt, Human
uuaaguguugagaaauaucu

SEQ ID NO: 994857 - RNA, 24 nt, Human
uuacgccaaugaaauggggaggga

SEQ ID NO: 994858 - RNA, 20 nt, Human
uuacuguaaaauuaucaaau

SEQ ID NO: 994859 - RNA, 21 nt, Human
uuagcggugccuucucucccc

SEQ ID NO: 994860 - RNA, 21 nt, Human
uuucacagcaaugccuccugg

SEQ ID NO: 994861 - RNA, 19 nt, Human
uuugcucauauucaaaaua

SEQ ID NO: 994862 - RNA, 25 nt, Human
aaacaggaaacaaauagaagggacc

SEQ ID NO: 994863 - RNA, 19 nt, Human
auuccuguccuucugccuc

SEQ ID NO: 994864 - RNA, 21 nt, Human
ccucauaugaaugaugaagau

SEQ ID NO: 994865 - RNA, 24 nt, Human
cucacaucuccuuuugauagccuu

SEQ ID NO: 994866 - RNA, 19 nt, Human
cuccacagauaggcauggu

SEQ ID NO: 994867 - RNA, 30 nt, Human
cucucucacaucuccuuuugauagccuuaa

SEQ ID NO: 994868 - RNA, 21 nt, Human
gacucaauacccucucucaca

SEQ ID NO: 994869 - RNA, 21 nt, Human
gcaugguguuagucauuaaaa

SEQ ID NO: 994870 - RNA, 23 nt, Human
ggaaacaaauagaauuauuccug

SEQ ID NO: 994871 - RNA, 20 nt, Human
ggccagacucaauacccucu

SEQ ID NO: 994872 - RNA, 18 nt, Human
uaaagguuguaucaaugu

SEQ ID NO: 994873 - RNA, 24 nt, Human
ucaauacccucucucacaucuccu

SEQ ID NO: 994874 - RNA, 25 nt, Human
ucaggccagacucaauacccucucu

SEQ ID NO: 994875 - RNA, 22 nt, Human
uccccaacuucccaaggacugu

SEQ ID NO: 994876 - RNA, 22 nt, Human
uccucauaugaaugaugaagau

SEQ ID NO: 994877 - RNA, 23 nt, Human
ugaaaaacaauuuccagguguga

SEQ ID NO: 994878 - RNA, 20 nt, Human
ugaucucagagcauuggcug

SEQ ID NO: 994879 - RNA, 22 nt, Human
ugaugaagaugagcucaaaacc

SEQ ID NO: 994880 - RNA, 21 nt, Human
ugccaugucuccguuguugag

SEQ ID NO: 994881 - RNA, 18 nt, Human
uguacaucccaacagugu

SEQ ID NO: 994882 - RNA, 23 nt, Human
uucaaaacaggaaacaaauagaa

SEQ ID NO: 994883 - RNA, 20 nt, Human
uucagguugguggcaaaagc

SEQ ID NO: 994884 - RNA, 18 nt, Human
uugccagcuucuccacag

SEQ ID NO: 994885 - RNA, 26 nt, Human
aaacagccaggccucuccuugguaac

SEQ ID NO: 994886 - RNA, 23 nt, Human
caguuguguuuugcaaagaaggg

SEQ ID NO: 994887 - RNA, 21 nt, Human
gaucagcuugagaugggccca

SEQ ID NO: 994888 - RNA, 20 nt, Human
ugaaauaugggcaaucucau

SEQ ID NO: 994889 - RNA, 21 nt, Human
ugagaugggcccaauagcauc

SEQ ID NO: 994890 - RNA, 19 nt, Human
aacuugcagcagcgcagaa

SEQ ID NO: 994891 - RNA, 20 nt, Human
acugaagugucaagagaacc

SEQ ID NO: 994892 - RNA, 22 nt, Human
agaaaugucauuccuuugcauc

SEQ ID NO: 994893 - RNA, 19 nt, Human
cagcgcagaaugguacccu

SEQ ID NO: 994894 - RNA, 23 nt, Human
cagcgcagaaugguacccucuau

SEQ ID NO: 994895 - RNA, 22 nt, Human
accuuaaaaggaugcaggaagc

SEQ ID NO: 994896 - RNA, 21 nt, Human
agauucagggacagcuccucu

SEQ ID NO: 994897 - RNA, 20 nt, Human
agcacuuugggaggccuagg

SEQ ID NO: 994898 - RNA, 20 nt, Human
agcgugguggcucacgcugg

SEQ ID NO: 994899 - RNA, 21 nt, Human
aggccuaggcggggggaucgc

SEQ ID NO: 994900 - RNA, 24 nt, Human
cacgcugguaaacccagcacuuug

SEQ ID NO: 994901 - RNA, 22 nt, Human
cagcacuuugggaggccuaggc

SEQ ID NO: 994902 - RNA, 24 nt, Human
cagcacuuugggaggccuaggcgg

SEQ ID NO: 994903 - RNA, 23 nt, Human
ccaagaugauagggaucugagga

SEQ ID NO: 994904 - RNA, 24 nt, Human
cucacgcugguaaacccagcacuu

SEQ ID NO: 994905 - RNA, 19 nt, Human
cugacuugcucugccccuc

SEQ ID NO: 994906 - RNA, 21 nt, Human
cugacuugcucugccccucug

SEQ ID NO: 994907 - RNA, 18 nt, Human
cuuaaaaggaugcaggaa

SEQ ID NO: 994908 - RNA, 18 nt, Human
cuuccugaaccucugggc

SEQ ID NO: 994909 - RNA, 18 nt, Human
cuugcucugccccucugu

SEQ ID NO: 994910 - RNA, 19 nt, Human
gaacagacuggggcacccc

SEQ ID NO: 994911 - RNA, 20 nt, Human
gaggaaggggcgccaaugcu

SEQ ID NO: 994912 - RNA, 19 nt, Human
gaugauagggaucugagga

SEQ ID NO: 994913 - RNA, 22 nt, Human
ggaagcccagcgugguggcuca

SEQ ID NO: 994914 - RNA, 19 nt, Human
gggaggccuaggcgggggg

SEQ ID NO: 994915 - RNA, 18 nt, Human
ggugauguggcagguggg

SEQ ID NO: 994916 - RNA, 24 nt, Human
gguggcucacgcugguaaacccag

SEQ ID NO: 994917 - RNA, 21 nt, Human
ucucaggcagacccucaggaa

SEQ ID NO: 994918 - RNA, 24 nt, Human
ugaaccucugggcuacuguuuccc

SEQ ID NO: 994919 - RNA, 21 nt, Human
ugcaggaagcccagcguggug

SEQ ID NO: 994920 - RNA, 28 nt, Human
ugcaggaagcccagcgugguggcucacg

SEQ ID NO: 994921 - RNA, 23 nt, Human
ugcucugccccucuguguccugg

SEQ ID NO: 994922 - RNA, 21 nt, Human
uggagauucagggacagcucc

SEQ ID NO: 994923 - RNA, 24 nt, Human
uggagauucagggacagcuccucu

SEQ ID NO: 994924 - RNA, 21 nt, Human
uggcucacgcugguaaaccca

SEQ ID NO: 994925 - RNA, 24 nt, Human
uggcucacgcugguaaacccagca

SEQ ID NO: 994926 - RNA, 23 nt, Human
ugggaggccuaggcggggggauc

SEQ ID NO: 994927 - RNA, 21 nt, Human
uuucccaagaugauagggauc

SEQ ID NO: 994928 - RNA, 24 nt, Human
aaagggaguauuacagagagaggc

SEQ ID NO: 994929 - RNA, 20 nt, Human
aagggaaggaaaccuggaca

SEQ ID NO: 994930 - RNA, 21 nt, Human
acaaggcagagacacagccuc

SEQ ID NO: 994931 - RNA, 20 nt, Human
acagguuggcuccagggaga

SEQ ID NO: 994932 - RNA, 20 nt, Human
acgcagggcuccccagcuuc

SEQ ID NO: 994933 - RNA, 23 nt, Human
acgggcagagaggagcaaaugca

SEQ ID NO: 994934 - RNA, 21 nt, Human
agacacagccucagauccccc

SEQ ID NO: 994935 - RNA, 22 nt, Human
agagggggccguggcacaggug

SEQ ID NO: 994936 - RNA, 22 nt, Human
agaggucucagcaguuggccuc

SEQ ID NO: 994937 - RNA, 24 nt, Human
agcggugggugccggcucccgcgc

SEQ ID NO: 994938 - RNA, 20 nt, Human
caaccacaugacaacucgcc

SEQ ID NO: 994939 - RNA, 25 nt, Human
cacagccucagaucccccgucaucu

SEQ ID NO: 994940 - RNA, 19 nt, Human
cagaucccccgucaucuuc

SEQ ID NO: 994941 - RNA, 24 nt, Human
cagcacugagaaaucacuuaaaac

SEQ ID NO: 994942 - RNA, 19 nt, Human
cagguuggcuccagggaga

SEQ ID NO: 994943 - RNA, 21 nt, Human
ccacugaauaagggggaugga

SEQ ID NO: 994944 - RNA, 21 nt, Human
ccaggcaaggccuugcuuccc

SEQ ID NO: 994945 - RNA, 23 nt, Human
cccagcggcggcuucagccccag

SEQ ID NO: 994946 - RNA, 21 nt, Human
cccccaggcuccggaucccug

SEQ ID NO: 994947 - RNA, 19 nt, Human
cccgaggucgcuacggccg

SEQ ID NO: 994948 - RNA, 20 nt, Human
cccucccuccuuugcguccc

SEQ ID NO: 994949 - RNA, 21 nt, Human
ccgccgucgccgccccuccag

SEQ ID NO: 994950 - RNA, 19 nt, Human
ccgucgccgccccuccagc

SEQ ID NO: 994951 - RNA, 21 nt, Human
ccuccagcggugggugccggc

SEQ ID NO: 994952 - RNA, 26 nt, Human
ccuccugcaagccgagaugccugcca

SEQ ID NO: 994953 - RNA, 19 nt, Human
ccucuaaagacaaggcaga

SEQ ID NO: 994954 - RNA, 24 nt, Human
cggcucccgcgccgcuuuuccccc

SEQ ID NO: 994955 - RNA, 23 nt, Human
cggcuucagccccagagggggcc

SEQ ID NO: 994956 - RNA, 21 nt, Human
cucagaucccccgucaucuuc

SEQ ID NO: 994957 - RNA, 18 nt, Human
cugaaguccucuaaagac

SEQ ID NO: 994958 - RNA, 24 nt, Human
cuggaacaaagacuaaggugcuac

SEQ ID NO: 994959 - RNA, 20 nt, Human
cuguugggcugacuccacgc

SEQ ID NO: 994960 - RNA, 23 nt, Human
cuucccucccuccuuugcguccc

SEQ ID NO: 994961 - RNA, 22 nt, Human
gaaggagagugguuucaccagc

SEQ ID NO: 994962 - RNA, 21 nt, Human
gacccagcggcggcuucagcc

SEQ ID NO: 994963 - RNA, 20 nt, Human
gagaggcuugggaaagggaa

SEQ ID NO: 994964 - RNA, 23 nt, Human
gccuagucagcaaggucggggag

SEQ ID NO: 994965 - RNA, 19 nt, Human
gcuuuucccccaggcuccg

SEQ ID NO: 994966 - RNA, 23 nt, Human
ggaaggagagugguuucaccagc

SEQ ID NO: 994967 - RNA, 21 nt, Human
gggucuggggcugcaggucug

SEQ ID NO: 994968 - RNA, 20 nt, Human
ggucuggggcugcaggucug

SEQ ID NO: 994969 - RNA, 20 nt, Human
uacagguuggcuccagggag

SEQ ID NO: 994970 - RNA, 19 nt, Human
ucccccaggcuccggaucc

SEQ ID NO: 994971 - RNA, 21 nt, Human
ucccuguguggcuccaggcgc

SEQ ID NO: 994972 - RNA, 24 nt, Human
ucgcuacggccgccgucgccgccc

SEQ ID NO: 994973 - RNA, 22 nt, Human
ucuaaagacaaggcagagacac

SEQ ID NO: 994974 - RNA, 23 nt, Human
ucuccuggaacaaagacuaaggu

SEQ ID NO: 994975 - RNA, 18 nt, Human
ucuuccacugaauaaggg

SEQ ID NO: 994976 - RNA, 24 nt, Human
ugacaacucgccaggcaaggccuu

SEQ ID NO: 994977 - RNA, 19 nt, Human
ugacuccacgcagggcucc

SEQ ID NO: 994978 - RNA, 20 nt, Human
ugcucagcucuccuggaaca

SEQ ID NO: 994979 - RNA, 26 nt, Human
ugcuucccucccuccuuugcguccca

SEQ ID NO: 994980 - RNA, 21 nt, Human
uggacaggcuuuucagcacug

SEQ ID NO: 994981 - RNA, 18 nt, Human
ugggccccagucuuggac

SEQ ID NO: 994982 - RNA, 18 nt, Human
aaaaagacagcugcuccu

SEQ ID NO: 994983 - RNA, 18 nt, Human
auucauaucauuuucccu

SEQ ID NO: 994984 - RNA, 22 nt, Human
cugcaauaugcucuggagcaac

SEQ ID NO: 994985 - RNA, 18 nt, Human
gauagguugaugcaucca

SEQ ID NO: 994986 - RNA, 19 nt, Human
uagguugaugcauccacag

SEQ ID NO: 994987 - RNA, 23 nt, Human
ucuguggucuagcuagccgagac

SEQ ID NO: 994988 - RNA, 21 nt, Human
ugccugcagagauuucucgug

SEQ ID NO: 994989 - RNA, 23 nt, Human
uugccugcagagauuucucgucg

SEQ ID NO: 994990 - RNA, 18 nt, Human
uuuaaauaucgcaaaggc

SEQ ID NO: 994991 - RNA, 18 nt, Human
uuugaguaaaaauacaca

SEQ ID NO: 994992 - RNA, 24 nt, Human
uuuuuuuuuuuuuuuuuuuuaacg

SEQ ID NO: 994993 - RNA, 18 nt, Human
aaaucaggaccaaaacua

SEQ ID NO: 994994 - RNA, 20 nt, Human
aagaaaaaucaggaccaaaa

SEQ ID NO: 994995 - RNA, 18 nt, Human
agagaagcugguaggaga

SEQ ID NO: 994996 - RNA, 19 nt, Human
agagaagcugguaggagag

SEQ ID NO: 994997 - RNA, 18 nt, Human
ccaaagggcaaaagggaa

SEQ ID NO: 994998 - RNA, 24 nt, Human
gaaggaaugcccaaagggcaaaaa

SEQ ID NO: 994999 - RNA, 19 nt, Human
ggcaugaagaaagggagag

SEQ ID NO: 995000 - RNA, 24 nt, Human
ucaaauauauaauccuuaugugau

SEQ ID NO: 995001 - RNA, 21 nt, Human
ugaagaaagggagagaacagc

SEQ ID NO: 995002 - RNA, 25 nt, Human
ugguaauuguaaaaagaaaaaucag

SEQ ID NO: 995003 - RNA, 22 nt, Human
uuuuuuuuuuuuuuuucuuuuu

SEQ ID NO: 995004 - RNA, 19 nt, Human
aaacucaaggcagucacaa

SEQ ID NO: 995005 - RNA, 19 nt, Human
aaggauuacuaggccaaua

SEQ ID NO: 995006 - RNA, 23 nt, Human
agagauaaaccaagccggccccc

SEQ ID NO: 995007 - RNA, 22 nt, Human
agagggaaggagggguggggag

SEQ ID NO: 995008 - RNA, 24 nt, Human
aggccgccagagauaaaccaagcc

SEQ ID NO: 995009 - RNA, 19 nt, Human
agggaaggaggggugggga

SEQ ID NO: 995010 - RNA, 22 nt, Human
agggaaggagggguggggaguc

SEQ ID NO: 995011 - RNA, 22 nt, Human
agggggucaagagggaaggagg

SEQ ID NO: 995012 - RNA, 19 nt, Human
augggggaaagguguaugg

SEQ ID NO: 995013 - RNA, 23 nt, Human
caaggcagucacaaaaacagguc

SEQ ID NO: 995014 - RNA, 26 nt, Human
gaucuuaugggggaaagguguauggg

SEQ ID NO: 995015 - RNA, 22 nt, Human
gggcaaucaaaccuaggggguc

SEQ ID NO: 995016 - RNA, 21 nt, Human
ucugaaggauuacuaggccaa

SEQ ID NO: 995017 - RNA, 22 nt, Human
ugagaacaaccaaauauauacu

SEQ ID NO: 995018 - RNA, 21 nt, Human
ugggggaaagguguaugggaa

SEQ ID NO: 995019 - RNA, 24 nt, Human
uuaugggggaaagguguaugggaa

SEQ ID NO: 995020 - RNA, 20 nt, Human
uuguuucggggaaagggcaa

SEQ ID NO: 995021 - RNA, 19 nt, Human
uuucggggaaagggcaauc

SEQ ID NO: 995022 - RNA, 19 nt, Human
ccugggcccuggcaggucu

SEQ ID NO: 995023 - RNA, 20 nt, Human
cuccugggcccuggcagguc

SEQ ID NO: 995024 - RNA, 18 nt, Human
ggcaggucuguaguggga

SEQ ID NO: 995025 - RNA, 18 nt, Human
gucgagcucuccugggcc

SEQ ID NO: 995026 - RNA, 23 nt, Human
ugggugggucgagcucuccuggg

SEQ ID NO: 995027 - RNA, 20 nt, Human
uggugugccugggugggucg

SEQ ID NO: 995028 - RNA, 21 nt, Human
uuuguaucugauuuuuuuucu

SEQ ID NO: 995029 - RNA, 21 nt, Human
aucuguccagggcuggaccag

SEQ ID NO: 995030 - RNA, 27 nt, Human
caggcgccucccccucgauacagcucc

SEQ ID NO: 995031 - RNA, 18 nt, Human
ccccgccgccgcccgggc

SEQ ID NO: 995032 - RNA, 20 nt, Human
cccgcgccgccggcccccgc

SEQ ID NO: 995033 - RNA, 22 nt, Human
ccgccggcccccgccgccgccc

SEQ ID NO: 995034 - RNA, 21 nt, Human
cggcccccgccgccgcccggg

SEQ ID NO: 995035 - RNA, 22 nt, Human
cgggcagccucugccgccuccg

SEQ ID NO: 995036 - RNA, 25 nt, Human
cuccgcgcucggcccggcgcuaccc

SEQ ID NO: 995037 - RNA, 21 nt, Human
cuguccagggcuggaccaggc

SEQ ID NO: 995038 - RNA, 19 nt, Human
gaccaggcgccucccccuc

SEQ ID NO: 995039 - RNA, 22 nt, Human
gagcagcagcuguccccaggcc

SEQ ID NO: 995040 - RNA, 21 nt, Human
gggcagccucugccgccuccg

SEQ ID NO: 995041 - RNA, 24 nt, Human
uccagggcuggaccaggcgccucc

SEQ ID NO: 995042 - RNA, 20 nt, Human
uccgcgcucggcccggcgcu

SEQ ID NO: 995043 - RNA, 23 nt, Human
uguccagggcuggaccaggcgcc

SEQ ID NO: 995044 - RNA, 20 nt, Human
uuuuuuuuuuuuaagagggu

SEQ ID NO: 995045 - RNA, 18 nt, Human
uuuuuuuuuuuuuaagag

SEQ ID NO: 995046 - RNA, 28 nt, Human
uuuuuuuuuuuuuuuuuuuuuaagaggg

SEQ ID NO: 995047 - RNA, 23 nt, Human
aagcaaggacagaaaucacagaa

SEQ ID NO: 995048 - RNA, 18 nt, Human
acccuccccaccugucuc

SEQ ID NO: 995049 - RNA, 20 nt, Human
aggaggcuaaggcuguuuug

SEQ ID NO: 995050 - RNA, 22 nt, Human
aggauguuggaggcuugggggu

SEQ ID NO: 995051 - RNA, 25 nt, Human
aggccuccagccagucccacagccc

SEQ ID NO: 995052 - RNA, 18 nt, Human
cacagcccccaggccagg

SEQ ID NO: 995053 - RNA, 22 nt, Human
caggccuccagccagucccaca

SEQ ID NO: 995054 - RNA, 22 nt, Human
ccagccagucccacagccccca

SEQ ID NO: 995055 - RNA, 23 nt, Human
ccaggacagggcacaaacguccc

SEQ ID NO: 995056 - RNA, 23 nt, Human
ccaguuccugauggaaagacagg

SEQ ID NO: 995057 - RNA, 24 nt, Human
ccccacccuccccaccugucucug

SEQ ID NO: 995058 - RNA, 18 nt, Human
ccccugaggcccagagcu

SEQ ID NO: 995059 - RNA, 19 nt, Human
ccccugaggcccagagcuc

SEQ ID NO: 995060 - RNA, 20 nt, Human
cccuacccccacccucccca

SEQ ID NO: 995061 - RNA, 19 nt, Human
ccuacccccacccucccca

SEQ ID NO: 995062 - RNA, 19 nt, Human
ccuacccccacccucccca

SEQ ID NO: 995063 - RNA, 28 nt, Human
ccuccaaauguaagcaaggacagaaauu

SEQ ID NO: 995064 - RNA, 21 nt, Human
ccuguccuccaaauguaagcc

SEQ ID NO: 995065 - RNA, 24 nt, Human
cgacucaugcguggucccuacccc

SEQ ID NO: 995066 - RNA, 24 nt, Human
cguggucccuacccccacccuccc

SEQ ID NO: 995067 - RNA, 23 nt, Human
cucaugcguggucccuaccccca

SEQ ID NO: 995068 - RNA, 24 nt, Human
cucaugcguggucccuacccccac

SEQ ID NO: 995069 - RNA, 23 nt, Human
cucccucagcugcagggucucac

SEQ ID NO: 995070 - RNA, 22 nt, Human
cucugacaacugacuuccuaaa

SEQ ID NO: 995071 - RNA, 22 nt, Human
cuuaccccugaggcccagagcu

SEQ ID NO: 995072 - RNA, 20 nt, Human
cuuuaaaaaguuaaaaagaa

SEQ ID NO: 995073 - RNA, 23 nt, Human
gaaaauaggagaccucggaaaga

SEQ ID NO: 995074 - RNA, 18 nt, Human
gaaaucacagaacugugg

SEQ ID NO: 995075 - RNA, 19 nt, Human
gcaacaaggaggcuaaggc

SEQ ID NO: 995076 - RNA, 21 nt, Human
ggaaagacaggauguuggagg

SEQ ID NO: 995077 - RNA, 24 nt, Human
ggccuccagccagucccacagccc

SEQ ID NO: 995078 - RNA, 23 nt, Human
ggcuugggggucaucccaaagag

SEQ ID NO: 995079 - RNA, 19 nt, Human
ggugcugaaaggcuggcuu

SEQ ID NO: 995080 - RNA, 23 nt, Human
uaaaaagaaaauaggagaccucg

SEQ ID NO: 995081 - RNA, 18 nt, Human
uaagagaagccaguuccu

SEQ ID NO: 995082 - RNA, 22 nt, Human
uaagagaagccaguuccugaug

SEQ ID NO: 995083 - RNA, 19 nt, Human
ucaugcguggucccuaccc

SEQ ID NO: 995084 - RNA, 19 nt, Human
ucccaaagaguugggcacu

SEQ ID NO: 995085 - RNA, 22 nt, Human
ucccacagcccccaggccaggc

SEQ ID NO: 995086 - RNA, 19 nt, Human
ucccuacccccacccuccc

SEQ ID NO: 995087 - RNA, 20 nt, Human
ucccuacccccacccucccc

SEQ ID NO: 995088 - RNA, 21 nt, Human
ucccuacccccacccucccca

SEQ ID NO: 995089 - RNA, 21 nt, Human
ucucugacaacugacuuccua

SEQ ID NO: 995090 - RNA, 23 nt, Human
ucugacaacugacuuccuaaaac

SEQ ID NO: 995091 - RNA, 19 nt, Human
ugacuuccuaaaacuccac

SEQ ID NO: 995092 - RNA, 24 nt, Human
ugaggcccagagcucuagacacag

SEQ ID NO: 995093 - RNA, 21 nt, Human
uuggcauaagagaagccaguu

SEQ ID NO: 995094 - RNA, 19 nt, Human
uuggccuuuggcucuuccc

SEQ ID NO: 995095 - RNA, 19 nt, Human
uuggcucuucccgggggcu

SEQ ID NO: 995096 - RNA, 18 nt, Human
uuuugugguggcacaguc

SEQ ID NO: 995097 - RNA, 24 nt, Human
aaagugcugggauuacaggcauga

SEQ ID NO: 995098 - RNA, 24 nt, Human
aaguaggugggacuacaggcaugc

SEQ ID NO: 995099 - RNA, 19 nt, Human
aagugcugggauuacaggc

SEQ ID NO: 995100 - RNA, 21 nt, Human
aagugcugggauuacaggcau

SEQ ID NO: 995101 - RNA, 26 nt, Human
aagugcugggauuacaggcaugagcc

SEQ ID NO: 995102 - RNA, 19 nt, Human
aaugcaguggcgugaucuc

SEQ ID NO: 995103 - RNA, 21 nt, Human
aaugcaguggcgugaucucag

SEQ ID NO: 995104 - RNA, 24 nt, Human
accauguuggccaggcuggucucg

SEQ ID NO: 995105 - RNA, 18 nt, Human
accggguuucaccauguu

SEQ ID NO: 995106 - RNA, 24 nt, Human
accggguuucaccauguuggccag

SEQ ID NO: 995107 - RNA, 21 nt, Human
acugcaaccucugccucccag

SEQ ID NO: 995108 - RNA, 22 nt, Human
acugcaaccucugccucccagg

SEQ ID NO: 995109 - RNA, 20 nt, Human
agcaauucuccugcuucagc

SEQ ID NO: 995110 - RNA, 21 nt, Human
aggcaugagccaccaugcccg

SEQ ID NO: 995111 - RNA, 22 nt, Human
aguagagaccggguuucaccau

SEQ ID NO: 995112 - RNA, 18 nt, Human
agugcugggauuacaggc

SEQ ID NO: 995113 - RNA, 24 nt, Human
aguggcgugaucucagcuuacugc

SEQ ID NO: 995114 - RNA, 24 nt, Human
caaagugcugggauuacaggcaug

SEQ ID NO: 995115 - RNA, 21 nt, Human
caaauuucuuauaccaaaaug

SEQ ID NO: 995116 - RNA, 20 nt, Human
caaccucugccucccagguu

SEQ ID NO: 995117 - RNA, 21 nt, Human
caccauguuggccaggcuggu

SEQ ID NO: 995118 - RNA, 24 nt, Human
caccauguuggccaggcuggucuc

SEQ ID NO: 995119 - RNA, 27 nt, Human
caccauguuggccaggcuggucucgaa

SEQ ID NO: 995120 - RNA, 24 nt, Human
cagaggcucuucuuggggcgguuc

SEQ ID NO: 995121 - RNA, 24 nt, Human
caugagccaccaugcccggccuau

SEQ ID NO: 995122 - RNA, 24 nt, Human
cauguuggccaggcuggucucgaa

SEQ ID NO: 995123 - RNA, 23 nt, Human
ccaaagugcugggauuacaggca

SEQ ID NO: 995124 - RNA, 24 nt, Human
ccaaagugcugggauuacaggcau

SEQ ID NO: 995125 - RNA, 24 nt, Human
cccaaagugcugggauuacaggca

SEQ ID NO: 995126 - RNA, 24 nt, Human
cccaaguaggugggacuacaggca

SEQ ID NO: 995127 - RNA, 23 nt, Human
cccagguucgagcaauucuccug

SEQ ID NO: 995128 - RNA, 24 nt, Human
ccccgcacauguuccagcagcccc

SEQ ID NO: 995129 - RNA, 24 nt, Human
cccgggccagaggcucuucuuggg

SEQ ID NO: 995130 - RNA, 21 nt, Human
ccgggccagaggcucuucuug

SEQ ID NO: 995131 - RNA, 24 nt, Human
ccucccagguucgagcaauucucc

SEQ ID NO: 995132 - RNA, 23 nt, Human
ccucgcucuccgcagggucugga

SEQ ID NO: 995133 - RNA, 22 nt, Human
cgcagggucuggauggcccccg

SEQ ID NO: 995134 - RNA, 24 nt, Human
cgcccucaaaccucggcgacgcuc

SEQ ID NO: 995135 - RNA, 22 nt, Human
cggguuucaccauguuggccag

SEQ ID NO: 995136 - RNA, 23 nt, Human
cggguuucaccauguuggccagg

SEQ ID NO: 995137 - RNA, 24 nt, Human
cugcaaccucugccucccagguuc

SEQ ID NO: 995138 - RNA, 24 nt, Human
cuggaaugcaguggcgugaucuca

SEQ ID NO: 995139 - RNA, 18 nt, Human
gauuacaggcaugagcca

SEQ ID NO: 995140 - RNA, 21 nt, Human
gauuacaggcaugagccacca

SEQ ID NO: 995141 - RNA, 24 nt, Human
gauuacaggcaugagccaccaugc

SEQ ID NO: 995142 - RNA, 22 nt, Human
gcaaccucugccucccagguuc

SEQ ID NO: 995143 - RNA, 20 nt, Human
gcccaggcuggaaugcagug

SEQ ID NO: 995144 - RNA, 24 nt, Human
gcccaggcuggaaugcaguggcgu

SEQ ID NO: 995145 - RNA, 21 nt, Human
gcgcgcaaaccugggaaggga

SEQ ID NO: 995146 - RNA, 25 nt, Human
gcucugucgcccaggcuggaaugca

SEQ ID NO: 995147 - RNA, 19 nt, Human
gcuggaaugcaguggcgug

SEQ ID NO: 995148 - RNA, 23 nt, Human
gcuggucucgaacuccuggccuc

SEQ ID NO: 995149 - RNA, 23 nt, Human
ggagucuugcucugucgcccagg

SEQ ID NO: 995150 - RNA, 24 nt, Human
ggauuacaggcaugagccaccaug

SEQ ID NO: 995151 - RNA, 22 nt, Human
ggcuggaaugcaguggcgugau

SEQ ID NO: 995152 - RNA, 24 nt, Human
ggcuggucucgaacuccuggccuc

SEQ ID NO: 995153 - RNA, 22 nt, Human
ggguuucaccauguuggccagg

SEQ ID NO: 995154 - RNA, 20 nt, Human
gguccggggaggcggcccuc

SEQ ID NO: 995155 - RNA, 24 nt, Human
gucuugcucugucgcccaggcugg

SEQ ID NO: 995156 - RNA, 24 nt, Human
uaauuuuugaauuuuuaguagaga

SEQ ID NO: 995157 - RNA, 23 nt, Human
uacaggcaugagccaccaugccc

SEQ ID NO: 995158 - RNA, 21 nt, Human
uacugcaaccucugccuccca

SEQ ID NO: 995159 - RNA, 23 nt, Human
uacugcaaccucugccucccagg

SEQ ID NO: 995160 - RNA, 22 nt, Human
uagagaccggguuucaccaugu

SEQ ID NO: 995161 - RNA, 24 nt, Human
uaguagagaccggguuucaccaug

SEQ ID NO: 995162 - RNA, 24 nt, Human
uauuuuauuuuugagauggagucu

SEQ ID NO: 995163 - RNA, 27 nt, Human
ucagcuuacugcaaccucugccuccca

SEQ ID NO: 995164 - RNA, 24 nt, Human
ucccaaagugcugggauuacaggc

SEQ ID NO: 995165 - RNA, 24 nt, Human
ucccaaguaggugggacuacaggc

SEQ ID NO: 995166 - RNA, 21 nt, Human
ucccagguucgagcaauucuc

SEQ ID NO: 995167 - RNA, 24 nt, Human
ucccagguucgagcaauucuccug

SEQ ID NO: 995168 - RNA, 20 nt, Human
uccuggccucccaaagugcu

SEQ ID NO: 995169 - RNA, 24 nt, Human
ucgcccaggcuggaaugcaguggc

SEQ ID NO: 995170 - RNA, 24 nt, Human
ucucgaacuccuggccucccaaag

SEQ ID NO: 995171 - RNA, 24 nt, Human
ucugucgcccaggcuggaaugcag

SEQ ID NO: 995172 - RNA, 22 nt, Human
ucuugcucugucgcccaggcug

SEQ ID NO: 995173 - RNA, 23 nt, Human
ucuugcucugucgcccaggcugg

SEQ ID NO: 995174 - RNA, 24 nt, Human
ucuugcucugucgcccaggcugga

SEQ ID NO: 995175 - RNA, 22 nt, Human
ugagauggagucuugcucuguc

SEQ ID NO: 995176 - RNA, 21 nt, Human
ugcaguggcgugaucucagcu

SEQ ID NO: 995177 - RNA, 24 nt, Human
ugcucugucgcccaggcuggaaug

SEQ ID NO: 995178 - RNA, 20 nt, Human
ugcuucagccucccaaguag

SEQ ID NO: 995179 - RNA, 19 nt, Human
uggaaugcaguggcgugau

SEQ ID NO: 995180 - RNA, 19 nt, Human
uggaaugcaguggcgugau

SEQ ID NO: 995181 - RNA, 24 nt, Human
uggaaugcaguggcgugaucucag

SEQ ID NO: 995182 - RNA, 23 nt, Human
uggagucuugcucugucgcccag

SEQ ID NO: 995183 - RNA, 24 nt, Human
uggagucuugcucugucgcccagg

SEQ ID NO: 995184 - RNA, 24 nt, Human
uggccaggcuggucucgaacuccu

SEQ ID NO: 995185 - RNA, 23 nt, Human
uggcccccgcgcgcaaaccuggg

SEQ ID NO: 995186 - RNA, 24 nt, Human
uggcgugaucucagcuuacugcaa

SEQ ID NO: 995187 - RNA, 21 nt, Human
ugggacuacaggcaugcccca

SEQ ID NO: 995188 - RNA, 18 nt, Human
ugggauuacaggcaugag

SEQ ID NO: 995189 - RNA, 22 nt, Human
ugggauuacaggcaugagccac

SEQ ID NO: 995190 - RNA, 23 nt, Human
ugggauuacaggcaugagccacc

SEQ ID NO: 995191 - RNA, 24 nt, Human
ugggauuacaggcaugagccacca

SEQ ID NO: 995192 - RNA, 25 nt, Human
ugggauuacaggcaugagccaccau

SEQ ID NO: 995193 - RNA, 21 nt, Human
ugggguucgcagaggggcgcc

SEQ ID NO: 995194 - RNA, 19 nt, Human
uuacugcaaccucugccuc

SEQ ID NO: 995195 - RNA, 24 nt, Human
uuacugcaaccucugccucccagg

SEQ ID NO: 995196 - RNA, 25 nt, Human
uuacugcaaccucugccucccaggu

SEQ ID NO: 995197 - RNA, 24 nt, Human
uuaguagagaccggguuucaccau

SEQ ID NO: 995198 - RNA, 24 nt, Human
uuucaccauguuggccaggcuggu

SEQ ID NO: 995199 - RNA, 24 nt, Human
uuuuuaguagagaccggguuucac

SEQ ID NO: 995200 - RNA, 20 nt, Human
uuuuugaauuuuuaguagag

SEQ ID NO: 995201 - RNA, 24 nt, Human
uuuuugagauggagucuugcucug

SEQ ID NO: 995202 - RNA, 23 nt, Human
uuuuuuuuuuuuuuuuuuauuuu

SEQ ID NO: 995203 - RNA, 19 nt, Human
aacccacacccaagaacuc

SEQ ID NO: 995204 - RNA, 22 nt, Human
aacugucggccccacgcucccc

SEQ ID NO: 995205 - RNA, 20 nt, Human
aauagauagaacccacaccc

SEQ ID NO: 995206 - RNA, 20 nt, Human
accuaaaauaauuaguauca

SEQ ID NO: 995207 - RNA, 21 nt, Human
accucacaagucucuaaaacc

SEQ ID NO: 995208 - RNA, 20 nt, Human
acucagagucccgccucucc

SEQ ID NO: 995209 - RNA, 19 nt, Human
acuuucucuuggggggggg

SEQ ID NO: 995210 - RNA, 24 nt, Human
agauagaacccacacccaagaacu

SEQ ID NO: 995211 - RNA, 23 nt, Human
agccagggugccagguguauuca

SEQ ID NO: 995212 - RNA, 21 nt, Human
aguagcuuuuuuucccccucu

SEQ ID NO: 995213 - RNA, 27 nt, Human
auaacaccaagaugaguuacauucaau

SEQ ID NO: 995214 - RNA, 20 nt, Human
auggaggaaaacauauuaca

SEQ ID NO: 995215 - RNA, 21 nt, Human
auuacauccuaaauaccacca

SEQ ID NO: 995216 - RNA, 25 nt, Human
auuugacucauucaaaucucccagg

SEQ ID NO: 995217 - RNA, 24 nt, Human
auuuguguggaagauaaaacacua

SEQ ID NO: 995218 - RNA, 19 nt, Human
caauagauagaacccacac

SEQ ID NO: 995219 - RNA, 25 nt, Human
cacaggccuagguaaaggacugucu

SEQ ID NO: 995220 - RNA, 21 nt, Human
cacgcuccccucccccagccc

SEQ ID NO: 995221 - RNA, 24 nt, Human
cauaugaaauucugguagccaggg

SEQ ID NO: 995222 - RNA, 21 nt, Human
caucucucucauagcugaggg

SEQ ID NO: 995223 - RNA, 21 nt, Human
caugaggaagagagcugcccc

SEQ ID NO: 995224 - RNA, 23 nt, Human
ccaaaauacacauuuggguagua

SEQ ID NO: 995225 - RNA, 19 nt, Human
cccacacccaagaacuccu

SEQ ID NO: 995226 - RNA, 22 nt, Human
ccucucguuaucucaugaggau

SEQ ID NO: 995227 - RNA, 21 nt, Human
ccuuucugcaauuaucccuca

SEQ ID NO: 995228 - RNA, 23 nt, Human
ccuuuugccuuuucacccccaaa

SEQ ID NO: 995229 - RNA, 19 nt, Human
cuaaaaccuuucugcaauu

SEQ ID NO: 995230 - RNA, 20 nt, Human
cuaaauaccaccaaauugcc

SEQ ID NO: 995231 - RNA, 21 nt, Human
cuacaugacauaugguuaugu

SEQ ID NO: 995232 - RNA, 23 nt, Human
cuaccaagcaauucuuacaaugu

SEQ ID NO: 995233 - RNA, 24 nt, Human
cucacaagucucuaaaaccuuucu

SEQ ID NO: 995234 - RNA, 21 nt, Human
cuccuuggggccuucaauaac

SEQ ID NO: 995235 - RNA, 18 nt, Human
cucucauagcugagggau

SEQ ID NO: 995236 - RNA, 25 nt, Human
gaacccacacccaagaacuccuugg

SEQ ID NO: 995237 - RNA, 19 nt, Human
gacuuuuccagaggcuaca

SEQ ID NO: 995238 - RNA, 20 nt, Human
gacuuuuggaaacuaagaug

SEQ ID NO: 995239 - RNA, 21 nt, Human
gagagucucgggaggcagccu

SEQ ID NO: 995240 - RNA, 20 nt, Human
gcaucuaucaugcugauuuc

SEQ ID NO: 995241 - RNA, 22 nt, Human
gccaaaauacacauuuggguag

SEQ ID NO: 995242 - RNA, 21 nt, Human
gccccacgcuccccuccccca

SEQ ID NO: 995243 - RNA, 22 nt, Human
gccccacgcuccccucccccag

SEQ ID NO: 995244 - RNA, 22 nt, Human
gcccuguguacuuucucuuggg

SEQ ID NO: 995245 - RNA, 18 nt, Human
ggaugugugcuucugugu

SEQ ID NO: 995246 - RNA, 22 nt, Human
gggaaaaaaaucguuaccucau

SEQ ID NO: 995247 - RNA, 23 nt, Human
gucccugagacccuuuucguggg

SEQ ID NO: 995248 - RNA, 21 nt, Human
gucggccccacgcuccccucc

SEQ ID NO: 995249 - RNA, 22 nt, Human
uaaaacaaguggauccauguua

SEQ ID NO: 995250 - RNA, 19 nt, Human
uaaauaccaccaaauugcc

SEQ ID NO: 995251 - RNA, 25 nt, Human
uaaauaccaccaaauugccaaaaua

SEQ ID NO: 995252 - RNA, 24 nt, Human
uaauaccuaaaauaauuaguauca

SEQ ID NO: 995253 - RNA, 22 nt, Human
uagaacccacacccaagaacuc

SEQ ID NO: 995254 - RNA, 24 nt, Human
uagaugucugacauuagauaacuc

SEQ ID NO: 995255 - RNA, 23 nt, Human
uagcagaaauggaggaaaacaua

SEQ ID NO: 995256 - RNA, 24 nt, Human
uccaagcaaggagagucucgggag

SEQ ID NO: 995257 - RNA, 23 nt, Human
uccacaggccuagguaaaggacu

SEQ ID NO: 995258 - RNA, 25 nt, Human
uccuaaauaccaccaaauugccaaa

SEQ ID NO: 995259 - RNA, 21 nt, Human
ucucaagguagucgcuagccc

SEQ ID NO: 995260 - RNA, 21 nt, Human
ugacacaauauuauucugccc

SEQ ID NO: 995261 - RNA, 20 nt, Human
ugacuuccuaauuuaacucc

SEQ ID NO: 995262 - RNA, 21 nt, Human
ugacuuccuaauuuaacuccu

SEQ ID NO: 995263 - RNA, 22 nt, Human
uguacuuucucuuggggggggg

SEQ ID NO: 995264 - RNA, 21 nt, Human
uucccaccuuaucccugagcu

SEQ ID NO: 995265 - RNA, 19 nt, Human
uuccuaucaauauggagau

SEQ ID NO: 995266 - RNA, 18 nt, Human
uuugugggaugggauaag

SEQ ID NO: 995267 - RNA, 20 nt, Human
acacaggacagaagccccuc

SEQ ID NO: 995268 - RNA, 23 nt, Human
agccaguaguggaggacggcgca

SEQ ID NO: 995269 - RNA, 24 nt, Human
caacacacaggacagaagccccuc

SEQ ID NO: 995270 - RNA, 18 nt, Human
cacaacacacaggacaga

SEQ ID NO: 995271 - RNA, 23 nt, Human
cacaacacacaggacagaagccc

SEQ ID NO: 995272 - RNA, 20 nt, Human
cagcgcccauaaaacccaag

SEQ ID NO: 995273 - RNA, 25 nt, Human
cagcgcccauaaaacccaagggaga

SEQ ID NO: 995274 - RNA, 25 nt, Human
caggacagaagccccucugggccgg

SEQ ID NO: 995275 - RNA, 20 nt, Human
ccacagcgcccauaaaaccc

SEQ ID NO: 995276 - RNA, 20 nt, Human
ccauccccucccacaacaca

SEQ ID NO: 995277 - RNA, 20 nt, Human
cccaagggagaauagaagag

SEQ ID NO: 995278 - RNA, 20 nt, Human
cccacagcgcccauaaaacc

SEQ ID NO: 995279 - RNA, 22 nt, Human
cccacagcgcccauaaaaccca

SEQ ID NO: 995280 - RNA, 25 nt, Human
cccauaaaacccaagggagaauaga

SEQ ID NO: 995281 - RNA, 20 nt, Human
ccccggcccacccgaggcuc

SEQ ID NO: 995282 - RNA, 18 nt, Human
ccccucccacaacacaca

SEQ ID NO: 995283 - RNA, 26 nt, Human
ccucccacaacacacaggacagaagc

SEQ ID NO: 995284 - RNA, 20 nt, Human
ccucccauccccucccacaa

SEQ ID NO: 995285 - RNA, 21 nt, Human
ccuucagggcccacagcgccc

SEQ ID NO: 995286 - RNA, 19 nt, Human
gacagaagccccucugggc

SEQ ID NO: 995287 - RNA, 23 nt, Human
gaggacggcgcagcaaccccggc

SEQ ID NO: 995288 - RNA, 18 nt, Human
gcgccucccauccccucc

SEQ ID NO: 995289 - RNA, 24 nt, Human
uacacgcacacucgaggggcgccu

SEQ ID NO: 995290 - RNA, 19 nt, Human
uagaagagacccccugaua

SEQ ID NO: 995291 - RNA, 23 nt, Human
uagccaguaguggaggacggcgc

SEQ ID NO: 995292 - RNA, 22 nt, Human
ucccacaacacacaggacagaa

SEQ ID NO: 995293 - RNA, 18 nt, Human
ugagggcacugggcccag

SEQ ID NO: 995294 - RNA, 20 nt, Human
uuuuuuuuuuucugggccuc

SEQ ID NO: 995295 - RNA, 18 nt, Human
uuuuuuuuuuuuuuucug

SEQ ID NO: 995296 - RNA, 26 nt, Human
uuuuuuuuuuuuuuuuuuuuucuggg

SEQ ID NO: 995297 - RNA, 19 nt, Human
aaagacucacacaggggca

SEQ ID NO: 995298 - RNA, 22 nt, Human
acauggccccucccuguauccc

SEQ ID NO: 995299 - RNA, 18 nt, Human
accucucuccucccccuc

SEQ ID NO: 995300 - RNA, 26 nt, Human
accucucuccucccccucaucccuca

SEQ ID NO: 995301 - RNA, 20 nt, Human
acuggcccagccuugacccc

SEQ ID NO: 995302 - RNA, 23 nt, Human
agcacaggaaaaaggugggacgg

SEQ ID NO: 995303 - RNA, 26 nt, Human
aggcuuccugcugcuucuagcagucu

SEQ ID NO: 995304 - RNA, 26 nt, Human
agggagaguggagaggguccugacuc

SEQ ID NO: 995305 - RNA, 25 nt, Human
aggggaguggagagggagaguggag

SEQ ID NO: 995306 - RNA, 19 nt, Human
aggggcagggaggggagag

SEQ ID NO: 995307 - RNA, 22 nt, Human
auaacagaaccuccuuggacca

SEQ ID NO: 995308 - RNA, 19 nt, Human
caagcccagcaagcuuggu

SEQ ID NO: 995309 - RNA, 24 nt, Human
caagcccagcaagcuugguuggaa

SEQ ID NO: 995310 - RNA, 19 nt, Human
caagcuugguuggaagaug

SEQ ID NO: 995311 - RNA, 23 nt, Human
cacacagggccagccacagccag

SEQ ID NO: 995312 - RNA, 24 nt, Human
caccucccagucacccucccuaaa

SEQ ID NO: 995313 - RNA, 22 nt, Human
cagcaagcuugguuggaagaug

SEQ ID NO: 995314 - RNA, 25 nt, Human
cagcuccuaccucucuccuccccuc

SEQ ID NO: 995315 - RNA, 20 nt, Human
caggagccucucagccaugg

SEQ ID NO: 995316 - RNA, 21 nt, Human
caggggcagggaggggagagg

SEQ ID NO: 995317 - RNA, 21 nt, Human
caguggguagugacuguuccu

SEQ ID NO: 995318 - RNA, 18 nt, Human
caucccucagcaaccacg

SEQ ID NO: 995319 - RNA, 21 nt, Human
caugaggcaguggugugcagu

SEQ ID NO: 995320 - RNA, 19 nt, Human
cauugagucucuagugaga

SEQ ID NO: 995321 - RNA, 21 nt, Human
ccacagcaugcccaaccaagu

SEQ ID NO: 995322 - RNA, 26 nt, Human
ccagcuccuaccucucuccucccccu

SEQ ID NO: 995323 - RNA, 24 nt, Human
cccacacagggccagccacagcca

SEQ ID NO: 995324 - RNA, 18 nt, Human
cccagccuugaccccauc

SEQ ID NO: 995325 - RNA, 29 nt, Human
cccagccuugaccccaucugccgguuccg

SEQ ID NO: 995326 - RNA, 18 nt, Human
ccccacacagggccagcc

SEQ ID NO: 995327 - RNA, 20 nt, Human
ccccacacagggccagccac

SEQ ID NO: 995328 - RNA, 18 nt, Human
ccucccagucacccuccc

SEQ ID NO: 995329 - RNA, 23 nt, Human
ccucccuaaaagacucacacagg

SEQ ID NO: 995330 - RNA, 22 nt, Human
ccucuagggaggcacuuagccc

SEQ ID NO: 995331 - RNA, 22 nt, Human
cuaaaagacucacacaggggca

SEQ ID NO: 995332 - RNA, 19 nt, Human
cuagagcacaggaaaaagg

SEQ ID NO: 995333 - RNA, 23 nt, Human
cuagcagucucuucaucuccagc

SEQ ID NO: 995334 - RNA, 22 nt, Human
cucccccucaucccucagcaac

SEQ ID NO: 995335 - RNA, 18 nt, Human
cuccuaccucucuccucc

SEQ ID NO: 995336 - RNA, 23 nt, Human
cuguuggcuggguggcuggccag

SEQ ID NO: 995337 - RNA, 21 nt, Human
gaggggagagggcagaagggc

SEQ ID NO: 995338 - RNA, 18 nt, Human
gccccaggaagcaugagg

SEQ ID NO: 995339 - RNA, 20 nt, Human
gcuccuaccucucuccuccc

SEQ ID NO: 995340 - RNA, 18 nt, Human
ggaggggagagggcagaa

SEQ ID NO: 995341 - RNA, 21 nt, Human
gucacccucccuaaaagacuc

SEQ ID NO: 995342 - RNA, 18 nt, Human
guguacccaccccacaca

SEQ ID NO: 995343 - RNA, 20 nt, Human
uagagcacaggaaaaaggug

SEQ ID NO: 995344 - RNA, 18 nt, Human
uagcagucucuucaucuc

SEQ ID NO: 995345 - RNA, 24 nt, Human
ucccucagcaaccacagcaugccc

SEQ ID NO: 995346 - RNA, 20 nt, Human
uccuagaccaacuccaaccc

SEQ ID NO: 995347 - RNA, 21 nt, Human
uccuagaccaacuccaaccuu

SEQ ID NO: 995348 - RNA, 26 nt, Human
uccuagaccaacuccaaccuucuugu

SEQ ID NO: 995349 - RNA, 26 nt, Human
ucgcacauggccccucccuguauccc

SEQ ID NO: 995350 - RNA, 19 nt, Human
ucucuccucccccucaucc

SEQ ID NO: 995351 - RNA, 20 nt, Human
ucuucugucauugagucucu

SEQ ID NO: 995352 - RNA, 26 nt, Human
ugaggucucccugguucgcacauggc

SEQ ID NO: 995353 - RNA, 21 nt, Human
ugagucucuagugagaaagag

SEQ ID NO: 995354 - RNA, 23 nt, Human
ugcaagcccagcaagcuugguug

SEQ ID NO: 995355 - RNA, 22 nt, Human
uggagagggagaguggagaggg

SEQ ID NO: 995356 - RNA, 19 nt, Human
uggagcugcuggaggcccc

SEQ ID NO: 995357 - RNA, 18 nt, Human
uggaggccccaggaagca

SEQ ID NO: 995358 - RNA, 18 nt, Human
uggugugcagugagacug

SEQ ID NO: 995359 - RNA, 21 nt, Human
uguccuagaccaacuccaacc

SEQ ID NO: 995360 - RNA, 23 nt, Human
uguccuagaccaacuccaaccuu

SEQ ID NO: 995361 - RNA, 22 nt, Human
uguuggcuggguggcuggccag

SEQ ID NO: 995362 - RNA, 19 nt, Human
uuguaaagccucagggucu

SEQ ID NO: 995363 - RNA, 24 nt, Human
uuuuuuuuuuuuuuuuuuuucaag

SEQ ID NO: 995364 - RNA, 19 nt, Human
ccacgagguguguuuuauu

SEQ ID NO: 995365 - RNA, 23 nt, Human
ccaucuugcagguggcucuuccu

SEQ ID NO: 995366 - RNA, 24 nt, Human
ccgauugggggggggucccuucag

SEQ ID NO: 995367 - RNA, 20 nt, Human
cgguggcaucggcgcggagu

SEQ ID NO: 995368 - RNA, 20 nt, Human
cuauaauaucccggggcaaa

SEQ ID NO: 995369 - RNA, 19 nt, Human
gcccgagauccuggugcuc

SEQ ID NO: 995370 - RNA, 21 nt, Human
gccgguggcaucggcgcggag

SEQ ID NO: 995371 - RNA, 20 nt, Human
guguccaucuugcagguggc

SEQ ID NO: 995372 - RNA, 24 nt, Human
uaauaucccggggcaaaccggaga

SEQ ID NO: 995373 - RNA, 19 nt, Human
uccaucuugcagguggcuc

SEQ ID NO: 995374 - RNA, 18 nt, Human
ucccggggcaaaccggag

SEQ ID NO: 995375 - RNA, 19 nt, Human
uugggggggggucccuuca

SEQ ID NO: 995376 - RNA, 24 nt, Human
uuuucuauaauaucccggggcaaa

SEQ ID NO: 995377 - RNA, 20 nt, Human
aaaaaacaagccuaaaauca

SEQ ID NO: 995378 - RNA, 23 nt, Human
aaaaaacaagccuaaaaucaaga

SEQ ID NO: 995379 - RNA, 20 nt, Human
aaagcugcaaaagcaugcaa

SEQ ID NO: 995380 - RNA, 20 nt, Human
aagcaauggaagcacccauc

SEQ ID NO: 995381 - RNA, 22 nt, Human
aagcaauggaagcacccaucau

SEQ ID NO: 995382 - RNA, 19 nt, Human
aaggaaacauuggcuaccu

SEQ ID NO: 995383 - RNA, 21 nt, Human
acaaaggucaucaauggugag

SEQ ID NO: 995384 - RNA, 26 nt, Human
caacuucaugaagauuaugaagcaau

SEQ ID NO: 995385 - RNA, 24 nt, Human
caagaacuacauacacaaagguca

SEQ ID NO: 995386 - RNA, 21 nt, Human
cuaaaaucucuacaaacacau

SEQ ID NO: 995387 - RNA, 20 nt, Human
gaaaugcaaauaaacuguga

SEQ ID NO: 995388 - RNA, 22 nt, Human
gaagauagccugaaagcuugaa

SEQ ID NO: 995389 - RNA, 21 nt, Human
gccuaaaaucucuacaaacac

SEQ ID NO: 995390 - RNA, 23 nt, Human
ggugagauuauugacagcaucug

SEQ ID NO: 995391 - RNA, 22 nt, Human
ucagguaaugucgaaaucugcu

SEQ ID NO: 995392 - RNA, 20 nt, Human
uccaguauaggaugcaagaa

SEQ ID NO: 995393 - RNA, 23 nt, Human
ugaaaagcugcaaaagcaugcaa

SEQ ID NO: 995394 - RNA, 24 nt, Human
ugacuagaagauagccugaaagcu

SEQ ID NO: 995395 - RNA, 21 nt, Human
uuacuacauuagaaaugcaaa

SEQ ID NO: 995396 - RNA, 20 nt, Human
uucgcggggcugagacccag

SEQ ID NO: 995397 - RNA, 22 nt, Human
aaaccaucacaaaaggccacau

SEQ ID NO: 995398 - RNA, 19 nt, Human
aaagaaguuccuggccucc

SEQ ID NO: 995399 - RNA, 23 nt, Human
aacacuguggcauuuuccccaga

SEQ ID NO: 995400 - RNA, 24 nt, Human
aacagaaaauaaaaccaucacaaa

SEQ ID NO: 995401 - RNA, 25 nt, Human
aagcacacagagaaacuguaagcca

SEQ ID NO: 995402 - RNA, 26 nt, Human
acaaagcacacagagaaacuguaagc

SEQ ID NO: 995403 - RNA, 22 nt, Human
acagacccccaaaauggcagcc

SEQ ID NO: 995404 - RNA, 18 nt, Human
acuggcuuuugcuguccc

SEQ ID NO: 995405 - RNA, 24 nt, Human
agaaaauaaaaccaucacaaaagg

SEQ ID NO: 995406 - RNA, 23 nt, Human
agagggccucgcugccaugagga

SEQ ID NO: 995407 - RNA, 22 nt, Human
agccaagacgaugaagcagucc

SEQ ID NO: 995408 - RNA, 24 nt, Human
agcucaugccccaacaacaaccag

SEQ ID NO: 995409 - RNA, 18 nt, Human
aggaggaaccuugggcug

SEQ ID NO: 995410 - RNA, 23 nt, Human
aggggagguggaauggcucuggc

SEQ ID NO: 995411 - RNA, 21 nt, Human
agggguucagaggauagcacc

SEQ ID NO: 995412 - RNA, 24 nt, Human
aucacaaauauuuucaggccauaa

SEQ ID NO: 995413 - RNA, 22 nt, Human
augcaauuccuucuuuccuggg

SEQ ID NO: 995414 - RNA, 21 nt, Human
augcugggggaggggaggugg

SEQ ID NO: 995415 - RNA, 25 nt, Human
caaagaguuacacgucuucccagua

SEQ ID NO: 995416 - RNA, 19 nt, Human
caaauaugacagcaaccac

SEQ ID NO: 995417 - RNA, 26 nt, Human
caacaccucuccgggccccgcgaucc

SEQ ID NO: 995418 - RNA, 23 nt, Human
caacagaaagagauuuccucaua

SEQ ID NO: 995419 - RNA, 20 nt, Human
caagcaguguauacacaagc

SEQ ID NO: 995420 - RNA, 21 nt, Human
cacaaaaaggacuagagcucc

SEQ ID NO: 995421 - RNA, 21 nt, Human
cacagccugacucaaagcaag

SEQ ID NO: 995422 - RNA, 21 nt, Human
caccaugaugacugacagcuc

SEQ ID NO: 995423 - RNA, 20 nt, Human
caccugggaacacucccggg

SEQ ID NO: 995424 - RNA, 19 nt, Human
cacucagaggcauuaacag

SEQ ID NO: 995425 - RNA, 19 nt, Human
cagaaagagauuuccucau

SEQ ID NO: 995426 - RNA, 22 nt, Human
cagacccccaaaauggcagccu

SEQ ID NO: 995427 - RNA, 18 nt, Human
cagcaaccacaaagcaca

SEQ ID NO: 995428 - RNA, 25 nt, Human
cagcaaccacaaagcacacagagaa

SEQ ID NO: 995429 - RNA, 20 nt, Human
cagccaagacgaugaagcag

SEQ ID NO: 995430 - RNA, 20 nt, Human
cagcuuguuuuucugucaau

SEQ ID NO: 995431 - RNA, 19 nt, Human
cauaaguacagacccccaa

SEQ ID NO: 995432 - RNA, 18 nt, Human
caugccccaacaacaacc

SEQ ID NO: 995433 - RNA, 25 nt, Human
ccaccugggaacacucccggguuac

SEQ ID NO: 995434 - RNA, 21 nt, Human
ccaggguaccaugggaugcag

SEQ ID NO: 995435 - RNA, 21 nt, Human
cccaaagaguuacacgucuuc

SEQ ID NO: 995436 - RNA, 19 nt, Human
ccccaacaacaaccagaaa

SEQ ID NO: 995437 - RNA, 22 nt, Human
ccccgcacaccuuccaagucca

SEQ ID NO: 995438 - RNA, 20 nt, Human
cccuccuuuuuuuuuuuucc

SEQ ID NO: 995439 - RNA, 22 nt, Human
cccuuuaaaaaggcagcugguu

SEQ ID NO: 995440 - RNA, 21 nt, Human
ccuucccuaucucaucuccaa

SEQ ID NO: 995441 - RNA, 25 nt, Human
ccuugagcuucuugcagagggccuc

SEQ ID NO: 995442 - RNA, 22 nt, Human
ccuugggcugaaucugacauca

SEQ ID NO: 995443 - RNA, 21 nt, Human
cguccauuuucccugagcuuc

SEQ ID NO: 995444 - RNA, 21 nt, Human
cucagaaucacaguccaugga

SEQ ID NO: 995445 - RNA, 20 nt, Human
cucagccaagacgaugaagc

SEQ ID NO: 995446 - RNA, 20 nt, Human
cuccaacaccucuccgggcc

SEQ ID NO: 995447 - RNA, 24 nt, Human
cugagagaugcugggggaggggag

SEQ ID NO: 995448 - RNA, 18 nt, Human
cuggcuuuugcuguccca

SEQ ID NO: 995449 - RNA, 22 nt, Human
cugggggaggggagguggaaug

SEQ ID NO: 995450 - RNA, 21 nt, Human
gaaaaaccaugaacuacaaac

SEQ ID NO: 995451 - RNA, 24 nt, Human
gaaaaacuuagggggcucuaaggg

SEQ ID NO: 995452 - RNA, 19 nt, Human
gaaaaugcauuuccccucc

SEQ ID NO: 995453 - RNA, 18 nt, Human
gaagaaauccaacaaaga

SEQ ID NO: 995454 - RNA, 20 nt, Human
gacuugugugucuuuucccu

SEQ ID NO: 995455 - RNA, 21 nt, Human
gagguggaauggcucuggcuu

SEQ ID NO: 995456 - RNA, 20 nt, Human
gaugcaauuccuucuuuccu

SEQ ID NO: 995457 - RNA, 21 nt, Human
gcaaauaugacagcaaccaca

SEQ ID NO: 995458 - RNA, 20 nt, Human
gcacaccuuccaaguccaaa

SEQ ID NO: 995459 - RNA, 20 nt, Human
gggggcucuaaggggaaagu

SEQ ID NO: 995460 - RNA, 24 nt, Human
uaacagaaaauaaaaccaucacaa

SEQ ID NO: 995461 - RNA, 19 nt, Human
uaucaaagaggccaauuua

SEQ ID NO: 995462 - RNA, 24 nt, Human
uaugacagcaaccacaaagcacac

SEQ ID NO: 995463 - RNA, 22 nt, Human
ucaacuuuaagagaauuagaug

SEQ ID NO: 995464 - RNA, 23 nt, Human
ucagaggcauuaacagaacacag

SEQ ID NO: 995465 - RNA, 19 nt, Human
ucagccaagacgaugaagc

SEQ ID NO: 995466 - RNA, 25 nt, Human
ucagccaagacgaugaagcaguccu

SEQ ID NO: 995467 - RNA, 21 nt, Human
ucagucucagcagccucagaa

SEQ ID NO: 995468 - RNA, 22 nt, Human
ucccaauaccaggguaccaugg

SEQ ID NO: 995469 - RNA, 21 nt, Human
ucccugagcuuccuugagcuu

SEQ ID NO: 995470 - RNA, 21 nt, Human
ucccugagcuuccuugagcuu

SEQ ID NO: 995471 - RNA, 23 nt, Human
ucccuguggucaggaacuugccc

SEQ ID NO: 995472 - RNA, 21 nt, Human
ucucagccaagacgaugaagc

SEQ ID NO: 995473 - RNA, 25 nt, Human
ucuccaacccacgcgacuugugugu

SEQ ID NO: 995474 - RNA, 20 nt, Human
ucuccugcucagacacccuu

SEQ ID NO: 995475 - RNA, 20 nt, Human
ugaauacguccauuuucccu

SEQ ID NO: 995476 - RNA, 21 nt, Human
ugaauuacacaaaaaggacua

SEQ ID NO: 995477 - RNA, 26 nt, Human
ugacagcaaccacaaagcacacagag

SEQ ID NO: 995478 - RNA, 22 nt, Human
ugaccauugccagucucauccc

SEQ ID NO: 995479 - RNA, 18 nt, Human
ugacucaaagcaaggaug

SEQ ID NO: 995480 - RNA, 19 nt, Human
ugagagaugcugggggagg

SEQ ID NO: 995481 - RNA, 26 nt, Human
ugaggaucuggcuucacaucucugag

SEQ ID NO: 995482 - RNA, 18 nt, Human
ugaguaaaggcuguguag

SEQ ID NO: 995483 - RNA, 21 nt, Human
ugccaugaggaucuggcuuca

SEQ ID NO: 995484 - RNA, 21 nt, Human
ugccccaacaacaaccagaaa

SEQ ID NO: 995485 - RNA, 23 nt, Human
ugccccaacaacaaccagaaaac

SEQ ID NO: 995486 - RNA, 25 nt, Human
ugccccaacaacaaccagaaaacag

SEQ ID NO: 995487 - RNA, 20 nt, Human
ugcuugguaggagaggagga

SEQ ID NO: 995488 - RNA, 24 nt, Human
uggaucacaaauauuuucaggcca

SEQ ID NO: 995489 - RNA, 18 nt, Human
uggcagccuuuaucucug

SEQ ID NO: 995490 - RNA, 20 nt, Human
uggcagccuuuaucucuggg

SEQ ID NO: 995491 - RNA, 24 nt, Human
uggcauuuuccccagagcugaaga

SEQ ID NO: 995492 - RNA, 21 nt, Human
uggcucuggcuucuccaaccc

SEQ ID NO: 995493 - RNA, 27 nt, Human
ugggaaaaacuuagggggcucuaaggg

SEQ ID NO: 995494 - RNA, 18 nt, Human
ugggggaggggagguggg

SEQ ID NO: 995495 - RNA, 25 nt, Human
uguggucaggaacuugcccacagcc

SEQ ID NO: 995496 - RNA, 21 nt, Human
uguuaacagaaaauaaaacca

SEQ ID NO: 995497 - RNA, 19 nt, Human
uguugcaguggcagcugag

SEQ ID NO: 995498 - RNA, 22 nt, Human
uugccagucucaucccugcucc

SEQ ID NO: 995499 - RNA, 24 nt, Human
uuucaggccauaaguacagacccc

SEQ ID NO: 995500 - RNA, 18 nt, Human
uuuuacuccucaguucaa

SEQ ID NO: 995501 - RNA, 22 nt, Human
aggaggaggggcucucgggggc

SEQ ID NO: 995502 - RNA, 21 nt, Human
agggcagcugccaaagguuuu

SEQ ID NO: 995503 - RNA, 22 nt, Human
aucucucuccccucuccccacc

SEQ ID NO: 995504 - RNA, 19 nt, Human
caccucucuuucucucucc

SEQ ID NO: 995505 - RNA, 18 nt, Human
cagcugcacugggaacug

SEQ ID NO: 995506 - RNA, 19 nt, Human
ccaccucucuuucucucuc

SEQ ID NO: 995507 - RNA, 23 nt, Human
ccaggaggaggggcucucggggg

SEQ ID NO: 995508 - RNA, 22 nt, Human
ccccuccucuccaucucucucc

SEQ ID NO: 995509 - RNA, 20 nt, Human
ccccucuccccaccucucuu

SEQ ID NO: 995510 - RNA, 18 nt, Human
ccccucugucucucucuc

SEQ ID NO: 995511 - RNA, 19 nt, Human
cccuccuccuuucccuccc

SEQ ID NO: 995512 - RNA, 19 nt, Human
cccucucucccucucuguc

SEQ ID NO: 995513 - RNA, 20 nt, Human
cccuuucugccuccucuguc

SEQ ID NO: 995514 - RNA, 24 nt, Human
ccuccugcucuaucucucucuguc

SEQ ID NO: 995515 - RNA, 18 nt, Human
ccucucuccuucucugcc

SEQ ID NO: 995516 - RNA, 18 nt, Human
ccucucuccuucucugcc

SEQ ID NO: 995517 - RNA, 22 nt, Human
ccucucugucucucugccucuc

SEQ ID NO: 995518 - RNA, 18 nt, Human
ccucucuuccccucuguc

SEQ ID NO: 995519 - RNA, 18 nt, Human
ccugucucuuuccuucuc

SEQ ID NO: 995520 - RNA, 21 nt, Human
ccuuucccucccugaccccca

SEQ ID NO: 995521 - RNA, 24 nt, Human
ccuuucugccuccucugucucucu

SEQ ID NO: 995522 - RNA, 20 nt, Human
cgggggcugugagcagcagg

SEQ ID NO: 995523 - RNA, 24 nt, Human
cucagagugccccgaccuccugcu

SEQ ID NO: 995524 - RNA, 25 nt, Human
cucauaucucucuccccucucccca

SEQ ID NO: 995525 - RNA, 26 nt, Human
cucauaucucucuccccucuccccac

SEQ ID NO: 995526 - RNA, 24 nt, Human
cuccccucuccccaccucucuuuc

SEQ ID NO: 995527 - RNA, 24 nt, Human
cucccuccuccuuucccucccuga

SEQ ID NO: 995528 - RNA, 20 nt, Human
cucuccccaccucucuuucu

SEQ ID NO: 995529 - RNA, 20 nt, Human
cucucucccucucugucucc

SEQ ID NO: 995530 - RNA, 22 nt, Human
cucugucuccucuguuucucuc

SEQ ID NO: 995531 - RNA, 18 nt, Human
cuuuccuucucugccucu

SEQ ID NO: 995532 - RNA, 18 nt, Human
gaacugggacucagagug

SEQ ID NO: 995533 - RNA, 18 nt, Human
gaccuacagcugcacugg

SEQ ID NO: 995534 - RNA, 22 nt, Human
gagcagcaggcacgaggacuuu

SEQ ID NO: 995535 - RNA, 21 nt, Human
gccccgaccuccugcucuauc

SEQ ID NO: 995536 - RNA, 24 nt, Human
uccaggaggaggggcucucggggg

SEQ ID NO: 995537 - RNA, 20 nt, Human
uccaucucucucccuccucc

SEQ ID NO: 995538 - RNA, 21 nt, Human
ucccucucucccucucugucu

SEQ ID NO: 995539 - RNA, 18 nt, Human
ucccucucugucuccucu

SEQ ID NO: 995540 - RNA, 18 nt, Human
ucccucugucucucucuc

SEQ ID NO: 995541 - RNA, 18 nt, Human
ucccuuucugccuccucu

SEQ ID NO: 995542 - RNA, 23 nt, Human
uccucugucucucucuccucaua

SEQ ID NO: 995543 - RNA, 21 nt, Human
ucuccccaccucucuuucucu

SEQ ID NO: 995544 - RNA, 19 nt, Human
ucuccccucuccccaccuc

SEQ ID NO: 995545 - RNA, 20 nt, Human
ucucccuccuccuuuccccc

SEQ ID NO: 995546 - RNA, 19 nt, Human
ucucucuccucauaucucu

SEQ ID NO: 995547 - RNA, 22 nt, Human
ucucucucucccucugucucuc

SEQ ID NO: 995548 - RNA, 19 nt, Human
ucugccuccucugucucuc

SEQ ID NO: 995549 - RNA, 18 nt, Human
ucugccucucuccuucuc

SEQ ID NO: 995550 - RNA, 21 nt, Human
ucugccugucucuuuccuucu

SEQ ID NO: 995551 - RNA, 20 nt, Human
ucugucccucucucccucuc

SEQ ID NO: 995552 - RNA, 19 nt, Human
ucugucuccucuguuucuc

SEQ ID NO: 995553 - RNA, 18 nt, Human
ucugucucucucucccuc

SEQ ID NO: 995554 - RNA, 20 nt, Human
ucugucucucucucccucuc

SEQ ID NO: 995555 - RNA, 26 nt, Human
ucugucucucucuccucauaucucuc

SEQ ID NO: 995556 - RNA, 20 nt, Human
ucugucucucugccucucuc

SEQ ID NO: 995557 - RNA, 22 nt, Human
ucuuuccuucucugccucuuuc

SEQ ID NO: 995558 - RNA, 20 nt, Human
ucuuucucucuccccuccuc

SEQ ID NO: 995559 - RNA, 18 nt, Human
ugacgaccuacagcugca

SEQ ID NO: 995560 - RNA, 21 nt, Human
ugccaaagguuuuauucucca

SEQ ID NO: 995561 - RNA, 23 nt, Human
ugccccgaccuccugcucuaucu

SEQ ID NO: 995562 - RNA, 22 nt, Human
ugggaacugggacucagagugc

SEQ ID NO: 995563 - RNA, 18 nt, Human
ugugagcagcaggcacga

SEQ ID NO: 995564 - RNA, 21 nt, Human
uucucucuccccuccucucca

SEQ ID NO: 995565 - RNA, 22 nt, Human
uuuuuuuuugaggaagggcagc

SEQ ID NO: 995566 - RNA, 22 nt, Human
uuuuuuuuuuuugaggaagggc

SEQ ID NO: 995567 - RNA, 19 nt, Human
uuuuuuuuuuuuuugagga

SEQ ID NO: 995568 - RNA, 21 nt, Human
uuuuuuuuuuuuuuuuugagg

SEQ ID NO: 995569 - RNA, 23 nt, Human
uuuuuuuuuuuuuuuuuuuuggg

SEQ ID NO: 995570 - RNA, 23 nt, Human
aacauacucuacaacauauaaga

SEQ ID NO: 995571 - RNA, 22 nt, Human
aacauauaagaaauuauuaaag

SEQ ID NO: 995572 - RNA, 18 nt, Human
agaguucuucccagccac

SEQ ID NO: 995573 - RNA, 20 nt, Human
agaguucuucccagccaccu

SEQ ID NO: 995574 - RNA, 19 nt, Human
caaaaaaaaaaacucaucc

SEQ ID NO: 995575 - RNA, 21 nt, Human
caaaaaaaaaaacucauccag

SEQ ID NO: 995576 - RNA, 26 nt, Human
cccccaaaucuuaugcugggaacaga

SEQ ID NO: 995577 - RNA, 19 nt, Human
cucauccagguucccccaa

SEQ ID NO: 995578 - RNA, 22 nt, Human
gaugcaaaaaaaaaaacucauc

SEQ ID NO: 995579 - RNA, 22 nt, Human
gcaaaaaaaaaaacucauccag

SEQ ID NO: 995580 - RNA, 23 nt, Human
uaaaaaaauacuugaaauuuauu

SEQ ID NO: 995581 - RNA, 28 nt, Human
ugcaaaaaaaaaaacucauccagguucc

SEQ ID NO: 995582 - RNA, 19 nt, Human
uguuggagaguucuuccca

SEQ ID NO: 995583 - RNA, 21 nt, Human
aaaaacagcugggggaggggc

SEQ ID NO: 995584 - RNA, 22 nt, Human
aaaaacagcugggggaggggca

SEQ ID NO: 995585 - RNA, 23 nt, Human
aaacgggggcugggauaaaagcu

SEQ ID NO: 995586 - RNA, 18 nt, Human
aaccagguugcugagcca

SEQ ID NO: 995587 - RNA, 21 nt, Human
aacccagcccagaaccuacaa

SEQ ID NO: 995588 - RNA, 20 nt, Human
aagcacuggcaccacaggga

SEQ ID NO: 995589 - RNA, 18 nt, Human
acaaagagcugaagaggc

SEQ ID NO: 995590 - RNA, 23 nt, Human
acagaaaccacugaaggcccaag

SEQ ID NO: 995591 - RNA, 23 nt, Human
agagcugaagaggcccuggguaa

SEQ ID NO: 995592 - RNA, 19 nt, Human
caaaaaacgggggcuggga

SEQ ID NO: 995593 - RNA, 25 nt, Human
caagauuagaacccagggacucacu

SEQ ID NO: 995594 - RNA, 19 nt, Human
cacaacccagcccagaacc

SEQ ID NO: 995595 - RNA, 20 nt, Human
cacaacccagcccagaaccu

SEQ ID NO: 995596 - RNA, 21 nt, Human
cacaacccagcccagaaccua

SEQ ID NO: 995597 - RNA, 23 nt, Human
cacaggccccuccccucugccaa

SEQ ID NO: 995598 - RNA, 18 nt, Human
caccgcaaguuccgcugc

SEQ ID NO: 995599 - RNA, 25 nt, Human
cacuggcaccacagggacacagaaa

SEQ ID NO: 995600 - RNA, 19 nt, Human
cagcaaaaaacgggggcug

SEQ ID NO: 995601 - RNA, 23 nt, Human
cagcagggccaggggcggggcuc

SEQ ID NO: 995602 - RNA, 19 nt, Human
cagcuccaccuccuccagg

SEQ ID NO: 995603 - RNA, 24 nt, Human
cagcuccccagucccccacaaccc

SEQ ID NO: 995604 - RNA, 19 nt, Human
cagcugcagcuccaccucc

SEQ ID NO: 995605 - RNA, 21 nt, Human
caggccccuccccucugccaa

SEQ ID NO: 995606 - RNA, 20 nt, Human
caugccugcacggccccaca

SEQ ID NO: 995607 - RNA, 20 nt, Human
ccaagucuucucccuaaagc

SEQ ID NO: 995608 - RNA, 21 nt, Human
ccacagggacacagaaaccac

SEQ ID NO: 995609 - RNA, 23 nt, Human
ccaccugccuccucacuggggca

SEQ ID NO: 995610 - RNA, 19 nt, Human
ccagaagcacuggcaccac

SEQ ID NO: 995611 - RNA, 18 nt, Human
ccaugccugcacggcccc

SEQ ID NO: 995612 - RNA, 22 nt, Human
cccaagauuagaacccagggac

SEQ ID NO: 995613 - RNA, 26 nt, Human
cccacaacccagcccagaaccuacaa

SEQ ID NO: 995614 - RNA, 26 nt, Human
cccaccaagucuucucccuaaagcuc

SEQ ID NO: 995615 - RNA, 23 nt, Human
cccagcugcagcuccaccuccuc

SEQ ID NO: 995616 - RNA, 19 nt, Human
ccccacaacccagcccaga

SEQ ID NO: 995617 - RNA, 24 nt, Human
ccccacaacccagcccagaaccua

SEQ ID NO: 995618 - RNA, 19 nt, Human
ccccaccaagucuucuccc

SEQ ID NO: 995619 - RNA, 21 nt, Human
cccccacaacccagcccagaa

SEQ ID NO: 995620 - RNA, 20 nt, Human
ccccccgacagccaccacgc

SEQ ID NO: 995621 - RNA, 19 nt, Human
cccccgacagccaccacgc

SEQ ID NO: 995622 - RNA, 18 nt, Human
ccccuccccucugccaag

SEQ ID NO: 995623 - RNA, 21 nt, Human
cccucugccaagcccagccuc

SEQ ID NO: 995624 - RNA, 18 nt, Human
ccgccggccccucacacc

SEQ ID NO: 995625 - RNA, 22 nt, Human
ccucacaccgcaaguuccgcug

SEQ ID NO: 995626 - RNA, 21 nt, Human
ccucccagggcagggccgcag

SEQ ID NO: 995627 - RNA, 20 nt, Human
ccugagaucuuggggcuggg

SEQ ID NO: 995628 - RNA, 20 nt, Human
ccuggaaagcagcaaaaaac

SEQ ID NO: 995629 - RNA, 24 nt, Human
ccuuccguaggcagagccauggau

SEQ ID NO: 995630 - RNA, 21 nt, Human
cucacagucccagcugcagcu

SEQ ID NO: 995631 - RNA, 21 nt, Human
cuccagccccaccaagucuuc

SEQ ID NO: 995632 - RNA, 21 nt, Human
cuccccagucccccacaaccc

SEQ ID NO: 995633 - RNA, 19 nt, Human
cuccgggccccgccggccc

SEQ ID NO: 995634 - RNA, 24 nt, Human
gcaaguuccgcugcuuccccgcgc

SEQ ID NO: 995635 - RNA, 18 nt, Human
gccccacauaaauaaccg

SEQ ID NO: 995636 - RNA, 18 nt, Human
gccugcacugcccagaag

SEQ ID NO: 995637 - RNA, 21 nt, Human
gccuugaaggcagaaggcccu

SEQ ID NO: 995638 - RNA, 23 nt, Human
gcuccagccccaccaagucuucu

SEQ ID NO: 995639 - RNA, 22 nt, Human
gcucccaccuccaggccuuggu

SEQ ID NO: 995640 - RNA, 18 nt, Human
gcugggcagggcuagggc

SEQ ID NO: 995641 - RNA, 18 nt, Human
gcugggccuggcagccgc

SEQ ID NO: 995642 - RNA, 23 nt, Human
ggaagccuucggaaccucccagg

SEQ ID NO: 995643 - RNA, 20 nt, Human
ggaccugcaggucacggggc

SEQ ID NO: 995644 - RNA, 23 nt, Human
ggaugggacaagccccauggggg

SEQ ID NO: 995645 - RNA, 22 nt, Human
ggcacaggccccuccccucugc

SEQ ID NO: 995646 - RNA, 19 nt, Human
ggcugggcagggcuagggc

SEQ ID NO: 995647 - RNA, 18 nt, Human
ggcugggcugggcagggc

SEQ ID NO: 995648 - RNA, 18 nt, Human
gggcacaggccccucccc

SEQ ID NO: 995649 - RNA, 23 nt, Human
gggcacaggccccuccccucugc

SEQ ID NO: 995650 - RNA, 21 nt, Human
gggcagacgcucccaccucca

SEQ ID NO: 995651 - RNA, 18 nt, Human
gggcucggagacuggcgg

SEQ ID NO: 995652 - RNA, 19 nt, Human
gggcugggccuggcagccg

SEQ ID NO: 995653 - RNA, 20 nt, Human
gucccagcugcagcuccacc

SEQ ID NO: 995654 - RNA, 25 nt, Human
uaaagcuccugagaucuuggggcug

SEQ ID NO: 995655 - RNA, 18 nt, Human
uaaauaagagaaacagga

SEQ ID NO: 995656 - RNA, 24 nt, Human
uagaagcccagcuccccagucccc

SEQ ID NO: 995657 - RNA, 24 nt, Human
ucaggccccugguggucgccggcc

SEQ ID NO: 995658 - RNA, 21 nt, Human
uccaggccuuggucuuugcug

SEQ ID NO: 995659 - RNA, 20 nt, Human
uccccgcgcgccccccgaca

SEQ ID NO: 995660 - RNA, 24 nt, Human
uccccgcgcgccccccgacagcca

SEQ ID NO: 995661 - RNA, 22 nt, Human
uccugagaucuuggggcugggc

SEQ ID NO: 995662 - RNA, 23 nt, Human
ugagccagaguggaagucagggc

SEQ ID NO: 995663 - RNA, 23 nt, Human
ugcauuaagccccuuccguaggc

SEQ ID NO: 995664 - RNA, 25 nt, Human
uggcaccacagggacacagaaacca

SEQ ID NO: 995665 - RNA, 21 nt, Human
ugggacaagccccaugggggc

SEQ ID NO: 995666 - RNA, 24 nt, Human
uggggaggggauugguagaagccc

SEQ ID NO: 995667 - RNA, 20 nt, Human
uggggcugggcugggcaggg

SEQ ID NO: 995668 - RNA, 23 nt, Human
uugaaggcagaaggcccuggaaa

SEQ ID NO: 995669 - RNA, 22 nt, Human
uugcugagccagaguggaaguc

SEQ ID NO: 995670 - RNA, 21 nt, Human
uugguagaagcccagcucccc

SEQ ID NO: 995671 - RNA, 19 nt, Human
uuuuuuuuuuuuuuuugca

SEQ ID NO: 995672 - RNA, 18 nt, Human
uuuuuuuuuuuuuuuuug

SEQ ID NO: 995673 - RNA, 19 nt, Human
uuuuuuuuuuuuuuuuugc

SEQ ID NO: 995674 - RNA, 23 nt, Human
aaaaaaagagagagagagaagga

SEQ ID NO: 995675 - RNA, 18 nt, Human
aaacaacaaaaaucagaa

SEQ ID NO: 995676 - RNA, 22 nt, Human
aaacaacaaaaaucagaaacag

SEQ ID NO: 995677 - RNA, 23 nt, Human
aaacaagacaucuuuuaaagcaa

SEQ ID NO: 995678 - RNA, 19 nt, Human
aaacacacacacacacccc

SEQ ID NO: 995679 - RNA, 19 nt, Human
aacaacaaaaaucagaaac

SEQ ID NO: 995680 - RNA, 27 nt, Human
aacaacaaaaaucagaaacagaagaaa

SEQ ID NO: 995681 - RNA, 26 nt, Human
aacaagacaucuuuuaaagcaaagcu

SEQ ID NO: 995682 - RNA, 22 nt, Human
aaccuggcaacugagcauuaga

SEQ ID NO: 995683 - RNA, 18 nt, Human
aagaacucaagcacuggc

SEQ ID NO: 995684 - RNA, 20 nt, Human
aagaaggcaaaauggagaaa

SEQ ID NO: 995685 - RNA, 24 nt, Human
aagugcagcaauguguuccagaac

SEQ ID NO: 995686 - RNA, 22 nt, Human
acaaaccccacccacacaaagg

SEQ ID NO: 995687 - RNA, 27 nt, Human
acaacaaaaaucagaaacagaagaaaa

SEQ ID NO: 995688 - RNA, 23 nt, Human
acacaaacacacacacacacccc

SEQ ID NO: 995689 - RNA, 24 nt, Human
acacacaaacacacacacacaccc

SEQ ID NO: 995690 - RNA, 25 nt, Human
acacacacacacaaacacacacaca

SEQ ID NO: 995691 - RNA, 26 nt, Human
acacacacacacacaaacacacacaa

SEQ ID NO: 995692 - RNA, 27 nt, Human
acacacacacacacacacaaacacaca

SEQ ID NO: 995693 - RNA, 29 nt, Human
acacacacacacacacacacaaacacaca

SEQ ID NO: 995694 - RNA, 23 nt, Human
acacacacacacacacacacaca

SEQ ID NO: 995695 - RNA, 23 nt, Human
acacacacacacacacacacaca

SEQ ID NO: 995696 - RNA, 23 nt, Human
acacacacacacacacacacaca

SEQ ID NO: 995697 - RNA, 23 nt, Human
acacacacacacacacacacaca

SEQ ID NO: 995698 - RNA, 24 nt, Human
acacacacacacacacacacacaa

SEQ ID NO: 995699 - RNA, 29 nt, Human
acacacacacacacacacacacaaacaca

SEQ ID NO: 995700 - RNA, 22 nt, Human
acacacacacacaccccaaaca

SEQ ID NO: 995701 - RNA, 23 nt, Human
acacacacacaccccaaacaaca

SEQ ID NO: 995702 - RNA, 18 nt, Human
acacugcauuuaugguaa

SEQ ID NO: 995703 - RNA, 24 nt, Human
accacuacccacaaaccccaccca

SEQ ID NO: 995704 - RNA, 23 nt, Human
agaagaaaauuaaaaaaccaccc

SEQ ID NO: 995705 - RNA, 23 nt, Human
agagagagagaaggagaaagaac

SEQ ID NO: 995706 - RNA, 20 nt, Human
auuacaguaacucaaugggg

SEQ ID NO: 995707 - RNA, 18 nt, Human
auuucacaacaguuacac

SEQ ID NO: 995708 - RNA, 21 nt, Human
caaaaaucagaaacagaagaa

SEQ ID NO: 995709 - RNA, 22 nt, Human
caaaauggagaaaauauggaac

SEQ ID NO: 995710 - RNA, 25 nt, Human
caaacacacacacacaccccaaaca

SEQ ID NO: 995711 - RNA, 25 nt, Human
caacaaaaaucagaaacagaagaaa

SEQ ID NO: 995712 - RNA, 21 nt, Human
cacaaaccccacccacacaaa

SEQ ID NO: 995713 - RNA, 20 nt, Human
cacacaaacacacacacaca

SEQ ID NO: 995714 - RNA, 23 nt, Human
cacacaaacacacacacacaccc

SEQ ID NO: 995715 - RNA, 21 nt, Human
cacacacaaacacacacacac

SEQ ID NO: 995716 - RNA, 25 nt, Human
cacacacaaacacacacacacaccc

SEQ ID NO: 995717 - RNA, 30 nt, Human
cacacacacacaaacacacacacacacccu

SEQ ID NO: 995718 - RNA, 28 nt, Human
cacacacacacacacaaacacacacaca

SEQ ID NO: 995719 - RNA, 20 nt, Human
cacacacacacacacacaca

SEQ ID NO: 995720 - RNA, 20 nt, Human
cacacacacacacacacaca

SEQ ID NO: 995721 - RNA, 20 nt, Human
cacacacacacacacacaca

SEQ ID NO: 995722 - RNA, 20 nt, Human
cacacacacacacacacaca

SEQ ID NO: 995723 - RNA, 20 nt, Human
cacacacacacacacacaca

SEQ ID NO: 995724 - RNA, 20 nt, Human
cacacacacacacacacaca

SEQ ID NO: 995725 - RNA, 20 nt, Human
cacacacacacacacacaca

SEQ ID NO: 995726 - RNA, 22 nt, Human
cacacacacacacacacacaca

SEQ ID NO: 995727 - RNA, 22 nt, Human
cacacacacacacacacacaca

SEQ ID NO: 995728 - RNA, 26 nt, Human
cacacacacacacacacacacacaca

SEQ ID NO: 995729 - RNA, 26 nt, Human
cacacacacacacacacacacacaca

SEQ ID NO: 995730 - RNA, 26 nt, Human
cacacacacacacacacacacacaca

SEQ ID NO: 995731 - RNA, 24 nt, Human
cacacacacacaccccaaacaaca

SEQ ID NO: 995732 - RNA, 20 nt, Human
cacacaccccaaacaacaaa

SEQ ID NO: 995733 - RNA, 27 nt, Human
cacaccccaaacaacaaaaaucagaaa

SEQ ID NO: 995734 - RNA, 21 nt, Human
cacacugcauuuaugguaagu

SEQ ID NO: 995735 - RNA, 24 nt, Human
caccaggaccaaggccuugagagc

SEQ ID NO: 995736 - RNA, 21 nt, Human
cacccacacaaagggagucca

SEQ ID NO: 995737 - RNA, 21 nt, Human
caccccaaacaacaaaaauca

SEQ ID NO: 995738 - RNA, 22 nt, Human
cacuacccacaaaccccaccca

SEQ ID NO: 995739 - RNA, 26 nt, Human
cagaagaguuauuuaaaaaaaaaaga

SEQ ID NO: 995740 - RNA, 23 nt, Human
cauaagaaggcaaaauggagaaa

SEQ ID NO: 995741 - RNA, 21 nt, Human
ccacuacccacaaaccccacc

SEQ ID NO: 995742 - RNA, 22 nt, Human
ccacuacccacaaaccccaccc

SEQ ID NO: 995743 - RNA, 23 nt, Human
ccacuacccacaaaccccaccca

SEQ ID NO: 995744 - RNA, 20 nt, Human
cccacaaaccccacccacac

SEQ ID NO: 995745 - RNA, 25 nt, Human
cccacacaaagggaguccacgccac

SEQ ID NO: 995746 - RNA, 22 nt, Human
ccuucaccacuacccacaaacc

SEQ ID NO: 995747 - RNA, 19 nt, Human
gaaccggcccacgcguccg

SEQ ID NO: 995748 - RNA, 20 nt, Human
gaacuuaaaaaacuuuagug

SEQ ID NO: 995749 - RNA, 21 nt, Human
gaauaugaacuauacaagaca

SEQ ID NO: 995750 - RNA, 21 nt, Human
gacaucuuuuaaagcaaagcu

SEQ ID NO: 995751 - RNA, 19 nt, Human
gagaaagaacucaagcacu

SEQ ID NO: 995752 - RNA, 19 nt, Human
gagagagagagaaggagaa

SEQ ID NO: 995753 - RNA, 20 nt, Human
gcauuacaguaacucaaugg

SEQ ID NO: 995754 - RNA, 21 nt, Human
ggagaaaauauggaacuuaaa

SEQ ID NO: 995755 - RNA, 31 nt, Human
guuaaacacacacacacacacacacacacag

SEQ ID NO: 995756 - RNA, 25 nt, Human
uaaaaaaaaaagagagagagagaaa

SEQ ID NO: 995757 - RNA, 22 nt, Human
uaaaaaaccacccugccacuaa

SEQ ID NO: 995758 - RNA, 24 nt, Human
uaaaguaauuggugaaggaauccc

SEQ ID NO: 995759 - RNA, 22 nt, Human
uaagaaggcaaaauggagaaaa

SEQ ID NO: 995760 - RNA, 20 nt, Human
uaagagccucacaauccagu

SEQ ID NO: 995761 - RNA, 23 nt, Human
uaaguaaauuuaaagugcacaga

SEQ ID NO: 995762 - RNA, 22 nt, Human
uacccacaaaccccacccacac

SEQ ID NO: 995763 - RNA, 18 nt, Human
ucagccaugaauaugaac

SEQ ID NO: 995764 - RNA, 23 nt, Human
uccugauggcuugaggauuucau

SEQ ID NO: 995765 - RNA, 24 nt, Human
ugcauuacaguaacucaauggggu

SEQ ID NO: 995766 - RNA, 20 nt, Human
uggaaagggcgccacuggca

SEQ ID NO: 995767 - RNA, 23 nt, Human
uggaaccuggcaacugagcauua

SEQ ID NO: 995768 - RNA, 19 nt, Human
uguggucaaguuucagcca

SEQ ID NO: 995769 - RNA, 27 nt, Human
uguuaaacacacacacacacacacaca

SEQ ID NO: 995770 - RNA, 27 nt, Human
uguuaaacacacacacacacacacaca

SEQ ID NO: 995771 - RNA, 19 nt, Human
uucaaguucuuugguggcc

SEQ ID NO: 995772 - RNA, 25 nt, Human
uucccagaagaguuauuuaaaaaaa

SEQ ID NO: 995773 - RNA, 23 nt, Human
uuuaagaaaauuuauaaaggaca

SEQ ID NO: 995774 - RNA, 22 nt, Human
uuuucugauaucgguccuucac

SEQ ID NO: 995775 - RNA, 26 nt, Human
aaaaaggaacuugaaaauaaaaagga

SEQ ID NO: 995776 - RNA, 21 nt, Human
aagauauccguaaaaucaaag

SEQ ID NO: 995777 - RNA, 24 nt, Human
aagaugccucuguuccugcacauu

SEQ ID NO: 995778 - RNA, 18 nt, Human
aauaaaaaggagggagga

SEQ ID NO: 995779 - RNA, 20 nt, Human
acccaggaagaugccucugu

SEQ ID NO: 995780 - RNA, 24 nt, Human
agguuccagucccucuaggaagcc

SEQ ID NO: 995781 - RNA, 18 nt, Human
auggggaacagaagcaag

SEQ ID NO: 995782 - RNA, 22 nt, Human
cacacacgcaagaauucggagc

SEQ ID NO: 995783 - RNA, 22 nt, Human
cacccucccucagccucaggag

SEQ ID NO: 995784 - RNA, 18 nt, Human
cacccuggucuuccaagc

SEQ ID NO: 995785 - RNA, 24 nt, Human
cacccuggucuuccaagcugggag

SEQ ID NO: 995786 - RNA, 20 nt, Human
cagcucuuggcugucuccag

SEQ ID NO: 995787 - RNA, 19 nt, Human
ccagucccucuaggaagcc

SEQ ID NO: 995788 - RNA, 25 nt, Human
cccucagccucaggagaauuagguu

SEQ ID NO: 995789 - RNA, 23 nt, Human
cccuccacccucccucagccuca

SEQ ID NO: 995790 - RNA, 21 nt, Human
ccuugagacccuccacccucc

SEQ ID NO: 995791 - RNA, 21 nt, Human
cgcaaggagaaauaaaaagga

SEQ ID NO: 995792 - RNA, 19 nt, Human
cgcccgucccccgccccuc

SEQ ID NO: 995793 - RNA, 30 nt, Human
cuguuagugcuccuggcacuccgucguggg

SEQ ID NO: 995794 - RNA, 21 nt, Human
cuugaaaauaaaaaggaggga

SEQ ID NO: 995795 - RNA, 18 nt, Human
gagccaaacccaggaaga

SEQ ID NO: 995796 - RNA, 18 nt, Human
gcgcccgucccccgcccc

SEQ ID NO: 995797 - RNA, 19 nt, Human
ggaaaagugaggaacgggg

SEQ ID NO: 995798 - RNA, 19 nt, Human
ggacccugccaacagcugu

SEQ ID NO: 995799 - RNA, 27 nt, Human
gggaaaagugaggaacggggagccggu

SEQ ID NO: 995800 - RNA, 24 nt, Human
gggaaugaaaagggaaaagugagg

SEQ ID NO: 995801 - RNA, 21 nt, Human
gggggugggaaugaaaaggga

SEQ ID NO: 995802 - RNA, 21 nt, Human
uacgggcaguggugcagaagg

SEQ ID NO: 995803 - RNA, 18 nt, Human
ugaaaauaaaaaggaggg

SEQ ID NO: 995804 - RNA, 24 nt, Human
uggcggggcggguaaggguacggg

SEQ ID NO: 995805 - RNA, 19 nt, Human
aaggaguuccuaaggauga

SEQ ID NO: 995806 - RNA, 21 nt, Human
aaggaguuccuaaggaugaug

SEQ ID NO: 995807 - RNA, 18 nt, Human
aaguggaacgucuacccc

SEQ ID NO: 995808 - RNA, 19 nt, Human
acugggcuggagcaggggc

SEQ ID NO: 995809 - RNA, 26 nt, Human
agaccaggucuccagcuccaccuggu

SEQ ID NO: 995810 - RNA, 18 nt, Human
aggcccuagagagaccag

SEQ ID NO: 995811 - RNA, 19 nt, Human
augauguauaguagcucuu

SEQ ID NO: 995812 - RNA, 22 nt, Human
augauguauaguagcucuuuuc

SEQ ID NO: 995813 - RNA, 22 nt, Human
cacaugguccaguguggccccu

SEQ ID NO: 995814 - RNA, 22 nt, Human
cacccacgauggcccuggacca

SEQ ID NO: 995815 - RNA, 22 nt, Human
cacccacgauggcccuggaccc

SEQ ID NO: 995816 - RNA, 21 nt, Human
cagaagccaaggagcauggga

SEQ ID NO: 995817 - RNA, 18 nt, Human
cagccuucagaagccaag

SEQ ID NO: 995818 - RNA, 23 nt, Human
caucaaauguccaugagugcaag

SEQ ID NO: 995819 - RNA, 25 nt, Human
ccaguguggccccuugauccucucu

SEQ ID NO: 995820 - RNA, 19 nt, Human
ccaugagugcaagagagca

SEQ ID NO: 995821 - RNA, 18 nt, Human
cccuggaccaaacgaagg

SEQ ID NO: 995822 - RNA, 19 nt, Human
ccucucuagcgcguagaag

SEQ ID NO: 995823 - RNA, 18 nt, Human
ccuggucaaggcggaagc

SEQ ID NO: 995824 - RNA, 23 nt, Human
cuaaggaugauggcacucuccuu

SEQ ID NO: 995825 - RNA, 22 nt, Human
cuagcgcguagaagcuuccucu

SEQ ID NO: 995826 - RNA, 21 nt, Human
cuagcggcaggugggaucucc

SEQ ID NO: 995827 - RNA, 18 nt, Human
cucuuuuccuccaagucc

SEQ ID NO: 995828 - RNA, 19 nt, Human
cuuggcccagccaaagggg

SEQ ID NO: 995829 - RNA, 19 nt, Human
gagcaugggagggaggaga

SEQ ID NO: 995830 - RNA, 23 nt, Human
gcccuagagagaccaggucucca

SEQ ID NO: 995831 - RNA, 22 nt, Human
gcccucagggaccuaggcuuuu

SEQ ID NO: 995832 - RNA, 22 nt, Human
ggaccuaggcuuuucaugcugg

SEQ ID NO: 995833 - RNA, 18 nt, Human
gggaaugugagaacuggg

SEQ ID NO: 995834 - RNA, 23 nt, Human
gggaggagacauuugccagugcc

SEQ ID NO: 995835 - RNA, 22 nt, Human
guugguaugggaaaaaacaaag

SEQ ID NO: 995836 - RNA, 24 nt, Human
uaggggaggguagaagcaguuggu

SEQ ID NO: 995837 - RNA, 24 nt, Human
uaguagcucuuuuccuccaagucc

SEQ ID NO: 995838 - RNA, 23 nt, Human
ucagccuucagaagccaaggagc

SEQ ID NO: 995839 - RNA, 22 nt, Human
uccaccuggucaaggcggaagc

SEQ ID NO: 995840 - RNA, 20 nt, Human
uccauacuaccagcaucaaa

SEQ ID NO: 995841 - RNA, 22 nt, Human
uccaucauccaggauggcugcc

SEQ ID NO: 995842 - RNA, 20 nt, Human
ucuccagcuccaccugguca

SEQ ID NO: 995843 - RNA, 18 nt, Human
uggccaggcccucaggga

SEQ ID NO: 995844 - RNA, 21 nt, Human
uggucaaggcggaagcggcga

SEQ ID NO: 995845 - RNA, 21 nt, Human
uguagugggcagacuagaucc

SEQ ID NO: 995846 - RNA, 22 nt, Human
uguggccaggcccucagggacc

SEQ ID NO: 995847 - RNA, 21 nt, Human
uuggcccagccaaaggggcuu

SEQ ID NO: 995848 - RNA, 27 nt, Human
uuuccuccaaguccucuuguuugagaa

SEQ ID NO: 995849 - RNA, 21 nt, Human
uuugccagugcccaacucugg

SEQ ID NO: 995850 - RNA, 18 nt, Human
aaagagagagaagagaag

SEQ ID NO: 995851 - RNA, 18 nt, Human
agaacuuggagugggggg

SEQ ID NO: 995852 - RNA, 20 nt, Human
agaagagaaggaaaaaaaga

SEQ ID NO: 995853 - RNA, 23 nt, Human
agacggagaccuggggugaggca

SEQ ID NO: 995854 - RNA, 21 nt, Human
agagcggggaggcagagaggu

SEQ ID NO: 995855 - RNA, 20 nt, Human
agagguaugagcuggggugg

SEQ ID NO: 995856 - RNA, 21 nt, Human
agagguggaggggacagaggc

SEQ ID NO: 995857 - RNA, 22 nt, Human
agccuggggcaugguggggcuc

SEQ ID NO: 995858 - RNA, 21 nt, Human
aggaaaagagagagaagagaa

SEQ ID NO: 995859 - RNA, 18 nt, Human
aggaagagagaacuugga

SEQ ID NO: 995860 - RNA, 22 nt, Human
aggaggagaggaagggacaaaa

SEQ ID NO: 995861 - RNA, 18 nt, Human
aggcagagagguaugagc

SEQ ID NO: 995862 - RNA, 22 nt, Human
aggcagagagguaugagcuggg

SEQ ID NO: 995863 - RNA, 23 nt, Human
aggcagagagguaugagcugggg

SEQ ID NO: 995864 - RNA, 21 nt, Human
agggaggcuggaggaggaagc

SEQ ID NO: 995865 - RNA, 23 nt, Human
aggggacagaggcugcagccugg

SEQ ID NO: 995866 - RNA, 20 nt, Human
agugggggggguaggaggag

SEQ ID NO: 995867 - RNA, 22 nt, Human
augggcacugccugagacugcc

SEQ ID NO: 995868 - RNA, 19 nt, Human
caaaaugucauuggucucu

SEQ ID NO: 995869 - RNA, 22 nt, Human
caacagccauauccucaacucu

SEQ ID NO: 995870 - RNA, 21 nt, Human
caacucuuaucuccuaacccc

SEQ ID NO: 995871 - RNA, 22 nt, Human
cacccauuauaaaaaucaaagg

SEQ ID NO: 995872 - RNA, 22 nt, Human
cagccuggggcaugguggggcu

SEQ ID NO: 995873 - RNA, 19 nt, Human
cauaaaugugccuccccag

SEQ ID NO: 995874 - RNA, 21 nt, Human
ccauauccucaacucuucaaa

SEQ ID NO: 995875 - RNA, 21 nt, Human
cccaacagccauauccucaac

SEQ ID NO: 995876 - RNA, 21 nt, Human
ccuugagagcggggaggcaga

SEQ ID NO: 995877 - RNA, 18 nt, Human
cuaaccccaaaguccuag

SEQ ID NO: 995878 - RNA, 22 nt, Human
cucaacucuucaaagauccucc

SEQ ID NO: 995879 - RNA, 24 nt, Human
cucagagguggaggggacagaggc

SEQ ID NO: 995880 - RNA, 18 nt, Human
cuccucagagguggaggg

SEQ ID NO: 995881 - RNA, 20 nt, Human
cugcagccuggggcauggug

SEQ ID NO: 995882 - RNA, 27 nt, Human
gaagguguggggggaguucggagggug

SEQ ID NO: 995883 - RNA, 24 nt, Human
gagaacuuggagugggggggguag

SEQ ID NO: 995884 - RNA, 23 nt, Human
gagaagagaaggaaaaaaagagu

SEQ ID NO: 995885 - RNA, 18 nt, Human
gccaguagguuuagcaga

SEQ ID NO: 995886 - RNA, 23 nt, Human
gccgucuccucacccagggaccc

SEQ ID NO: 995887 - RNA, 20 nt, Human
gcuggaggaggaagcagaga

SEQ ID NO: 995888 - RNA, 18 nt, Human
ggaagagagaacuuggag

SEQ ID NO: 995889 - RNA, 22 nt, Human
ggacaggaagagagaacuugga

SEQ ID NO: 995890 - RNA, 19 nt, Human
ggaggaggaagcagagagg

SEQ ID NO: 995891 - RNA, 20 nt, Human
ggaggcagagagguaugagc

SEQ ID NO: 995892 - RNA, 24 nt, Human
ggaggcuggaggaggaagcagaga

SEQ ID NO: 995893 - RNA, 24 nt, Human
gggagagggaaggaggagaggaag

SEQ ID NO: 995894 - RNA, 20 nt, Human
gggggguaggaggaggucaa

SEQ ID NO: 995895 - RNA, 25 nt, Human
gggggguaggaggaggucaagggag

SEQ ID NO: 995896 - RNA, 20 nt, Human
gguggggcuccagccgucuc

SEQ ID NO: 995897 - RNA, 19 nt, Human
gugccuccccagacgcucc

SEQ ID NO: 995898 - RNA, 23 nt, Human
guggcaaaaugucauuggucucu

SEQ ID NO: 995899 - RNA, 23 nt, Human
uaaaaaaugcuauaaauugguau

SEQ ID NO: 995900 - RNA, 20 nt, Human
uagcagagagaagucuccua

SEQ ID NO: 995901 - RNA, 18 nt, Human
uaggaggaggucaaggga

SEQ ID NO: 995902 - RNA, 24 nt, Human
uagugaugaaauccagggaaggga

SEQ ID NO: 995903 - RNA, 23 nt, Human
ucaacucuucaaagauccucccc

SEQ ID NO: 995904 - RNA, 27 nt, Human
ucccaacagccauauccucaacucuuc

SEQ ID NO: 995905 - RNA, 22 nt, Human
uccucacccagggaccccacag

SEQ ID NO: 995906 - RNA, 18 nt, Human
uccuugagagcggggagg

SEQ ID NO: 995907 - RNA, 20 nt, Human
ucuccuauuucuaacagagg

SEQ ID NO: 995908 - RNA, 19 nt, Human
ugagagcggggaggcagag

SEQ ID NO: 995909 - RNA, 18 nt, Human
ugccaggugggaagaacc

SEQ ID NO: 995910 - RNA, 18 nt, Human
ugggggggguaggaggag

SEQ ID NO: 995911 - RNA, 19 nt, Human
ugggggggguaggaggagg

SEQ ID NO: 995912 - RNA, 23 nt, Human
uggggugaggcagggauacaguc

SEQ ID NO: 995913 - RNA, 24 nt, Human
ugguaucaaaagaaaacccaaggg

SEQ ID NO: 995914 - RNA, 19 nt, Human
ugguggggcuccagccguc

SEQ ID NO: 995915 - RNA, 23 nt, Human
ugugccuccccagacgcuccuca

SEQ ID NO: 995916 - RNA, 21 nt, Human
ugugggacaggaagagagaac

SEQ ID NO: 995917 - RNA, 20 nt, Human
aaaaaaaucccaaaacaaaa

SEQ ID NO: 995918 - RNA, 23 nt, Human
aaaaaaucccaaaacaaaagaaa

SEQ ID NO: 995919 - RNA, 26 nt, Human
aaaaacaggaaauauuuagaaaacac

SEQ ID NO: 995920 - RNA, 21 nt, Human
aaaaagcacuucaagaucagg

SEQ ID NO: 995921 - RNA, 24 nt, Human
aaaaagcauucccaucauuauaaa

SEQ ID NO: 995922 - RNA, 23 nt, Human
aaacaaaagaaaaagcauuccca

SEQ ID NO: 995923 - RNA, 19 nt, Human
aaacguagaggccacugcu

SEQ ID NO: 995924 - RNA, 20 nt, Human
aacaggaaaaaauauacuua

SEQ ID NO: 995925 - RNA, 21 nt, Human
aaccaaguaaaaagaacagga

SEQ ID NO: 995926 - RNA, 22 nt, Human
aagaacacaguauuguauuagu

SEQ ID NO: 995927 - RNA, 21 nt, Human
aagcaauuccagauucacuca

SEQ ID NO: 995928 - RNA, 19 nt, Human
aagugaguaaagaucuuuc

SEQ ID NO: 995929 - RNA, 22 nt, Human
aauaaauacugggcuaguacaa

SEQ ID NO: 995930 - RNA, 22 nt, Human
acaaaagaaaaagcauucccau

SEQ ID NO: 995931 - RNA, 20 nt, Human
acaaagguaucacaaauuaa

SEQ ID NO: 995932 - RNA, 25 nt, Human
accaaguaaaaagaacaggaaaaaa

SEQ ID NO: 995933 - RNA, 19 nt, Human
acucccccuccccccaaaa

SEQ ID NO: 995934 - RNA, 21 nt, Human
agaaaauuuuccaacaugaaa

SEQ ID NO: 995935 - RNA, 20 nt, Human
agacagugauggggaauguc

SEQ ID NO: 995936 - RNA, 23 nt, Human
agcaacagcgccagcaaccggag

SEQ ID NO: 995937 - RNA, 24 nt, Human
agcaauaaaaccaaguaaaaagaa

SEQ ID NO: 995938 - RNA, 20 nt, Human
agcaccuguuucacugcacu

SEQ ID NO: 995939 - RNA, 23 nt, Human
agccagcaacagcgccagcaacc

SEQ ID NO: 995940 - RNA, 23 nt, Human
aggagcaggaagcaccuguuuca

SEQ ID NO: 995941 - RNA, 23 nt, Human
aguucuguugagggcauuacagu

SEQ ID NO: 995942 - RNA, 21 nt, Human
auacucccccuccccccaaaa

SEQ ID NO: 995943 - RNA, 25 nt, Human
auacucccccuccccccaaaacccc

SEQ ID NO: 995944 - RNA, 21 nt, Human
aucauuauaaaguaggcuauu

SEQ ID NO: 995945 - RNA, 22 nt, Human
augggcuacauaguugagagau

SEQ ID NO: 995946 - RNA, 21 nt, Human
auuacccuucccacccuggaa

SEQ ID NO: 995947 - RNA, 20 nt, Human
auuguaaacucauagaccac

SEQ ID NO: 995948 - RNA, 18 nt, Human
caaaaagcuaucugaaaa

SEQ ID NO: 995949 - RNA, 24 nt, Human
caaaaagcuaucugaaaaugcugc

SEQ ID NO: 995950 - RNA, 23 nt, Human
caaaacaaaagaaaaagcauucc

SEQ ID NO: 995951 - RNA, 22 nt, Human
caaaaccccaacuucccaacaa

SEQ ID NO: 995952 - RNA, 28 nt, Human
caacaaacaaaaagcuaucugaaaaugc

SEQ ID NO: 995953 - RNA, 20 nt, Human
caaggccccuccugccagcu

SEQ ID NO: 995954 - RNA, 25 nt, Human
caagucagaauguuaaacuucguuc

SEQ ID NO: 995955 - RNA, 21 nt, Human
cacagccagcaacagcgccag

SEQ ID NO: 995956 - RNA, 23 nt, Human
cacgcgcgccccucgcugggcuc

SEQ ID NO: 995957 - RNA, 24 nt, Human
cacuucaaaaaaaaaaaucccaaa

SEQ ID NO: 995958 - RNA, 21 nt, Human
cagaaacaacuccagaaaugc

SEQ ID NO: 995959 - RNA, 24 nt, Human
cagacugaauaaaacguaaaauaa

SEQ ID NO: 995960 - RNA, 20 nt, Human
cagcgccagcaaccggagca

SEQ ID NO: 995961 - RNA, 22 nt, Human
cagcuccguccagccccgggag

SEQ ID NO: 995962 - RNA, 23 nt, Human
cagggcccgggccgcuuggcucc

SEQ ID NO: 995963 - RNA, 26 nt, Human
ccaaaacaaaagaaaaagcauuccca

SEQ ID NO: 995964 - RNA, 18 nt, Human
ccaaaaccccaacuuccc

SEQ ID NO: 995965 - RNA, 24 nt, Human
ccaacaaacaaaaagcuaucugaa

SEQ ID NO: 995966 - RNA, 19 nt, Human
ccacagccagcaacagcgg

SEQ ID NO: 995967 - RNA, 21 nt, Human
ccaucggcaaauuaaaucuga

SEQ ID NO: 995968 - RNA, 24 nt, Human
ccaucggcaaauuaaaucugauaa

SEQ ID NO: 995969 - RNA, 21 nt, Human
cccaaaacaaaagaaaaagca

SEQ ID NO: 995970 - RNA, 24 nt, Human
cccaacuaacaacugaacauagcc

SEQ ID NO: 995971 - RNA, 24 nt, Human
cccaucauuauaaaguaggcuauu

SEQ ID NO: 995972 - RNA, 25 nt, Human
cccaucggcaaauuaaaucugauaa

SEQ ID NO: 995973 - RNA, 22 nt, Human
cccccaaaaccccaacuuccca

SEQ ID NO: 995974 - RNA, 23 nt, Human
cccccaaaaccccaacuucccaa

SEQ ID NO: 995975 - RNA, 25 nt, Human
cccccaaaaccccaacuucccaaca

SEQ ID NO: 995976 - RNA, 21 nt, Human
ccccccaaaaccccaacuucc

SEQ ID NO: 995977 - RNA, 20 nt, Human
cccccuccccccaaaacccc

SEQ ID NO: 995978 - RNA, 21 nt, Human
ccccgcgagcaggagggcgag

SEQ ID NO: 995979 - RNA, 19 nt, Human
ccccgggagcgcacgugac

SEQ ID NO: 995980 - RNA, 25 nt, Human
ccccucgcugggcucccugcccccc

SEQ ID NO: 995981 - RNA, 21 nt, Human
cccgcgcgugcgcaguggccg

SEQ ID NO: 995982 - RNA, 24 nt, Human
cccugccccccggcugccccgcgg

SEQ ID NO: 995983 - RNA, 18 nt, Human
cccuucccacccuggaaa

SEQ ID NO: 995984 - RNA, 19 nt, Human
ccgccgccacagccagcaa

SEQ ID NO: 995985 - RNA, 23 nt, Human
ccggcugccccgcggcggcggag

SEQ ID NO: 995986 - RNA, 19 nt, Human
ccuccccccaaaaccccaa

SEQ ID NO: 995987 - RNA, 22 nt, Human
ccuccccccaaaaccccaacuu

SEQ ID NO: 995988 - RNA, 23 nt, Human
ccuuuagauuuaagguaauuaga

SEQ ID NO: 995989 - RNA, 20 nt, Human
ccuuuugccacaggccugug

SEQ ID NO: 995990 - RNA, 18 nt, Human
cgcagucccauggccgcg

SEQ ID NO: 995991 - RNA, 18 nt, Human
cgccacagccagcaacag

SEQ ID NO: 995992 - RNA, 25 nt, Human
cguacuaauacucccccucccccca

SEQ ID NO: 995993 - RNA, 22 nt, Human
cuaauacucccccuccccccaa

SEQ ID NO: 995994 - RNA, 20 nt, Human
cucaggacaaggaacaugau

SEQ ID NO: 995995 - RNA, 18 nt, Human
cucgcugggcucccugcc

SEQ ID NO: 995996 - RNA, 23 nt, Human
cuggcacaaaaaguuaaauuuca

SEQ ID NO: 995997 - RNA, 24 nt, Human
cuuuauguacaaguuacugcaaag

SEQ ID NO: 995998 - RNA, 22 nt, Human
gaagacgcgcucagggcccggg

SEQ ID NO: 995999 - RNA, 18 nt, Human
gagauugccaagccauaa

SEQ ID NO: 996000 - RNA, 20 nt, Human
gagcacaggcguggucacca

SEQ ID NO: 996001 - RNA, 22 nt, Human
gcacuuugcucuaauuuucaca

SEQ ID NO: 996002 - RNA, 22 nt, Human
gcagaaaauuuuccaacaugaa

SEQ ID NO: 996003 - RNA, 23 nt, Human
gccccgcggcggcggaggcagcg

SEQ ID NO: 996004 - RNA, 19 nt, Human
gccccuccugccagcuccg

SEQ ID NO: 996005 - RNA, 21 nt, Human
gccugugggcaagaugauuuu

SEQ ID NO: 996006 - RNA, 21 nt, Human
gcugggcucccugccccccgg

SEQ ID NO: 996007 - RNA, 18 nt, Human
gcuuugaugauuuuaggu

SEQ ID NO: 996008 - RNA, 20 nt, Human
ggcggcggaggcagcgcgaa

SEQ ID NO: 996009 - RNA, 24 nt, Human
gugacgucgucccgcgcgugcgca

SEQ ID NO: 996010 - RNA, 25 nt, Human
uaaaacagauuuauauuacaaagca

SEQ ID NO: 996011 - RNA, 19 nt, Human
uaaaauaacacaguuugca

SEQ ID NO: 996012 - RNA, 21 nt, Human
uaaaucuucagcauauucaua

SEQ ID NO: 996013 - RNA, 24 nt, Human
uaagaauuaaaugaggguauggaa

SEQ ID NO: 996014 - RNA, 21 nt, Human
uaagcaaugguuuagauaaaa

SEQ ID NO: 996015 - RNA, 23 nt, Human
uaaucaggaccuaucauaguuag

SEQ ID NO: 996016 - RNA, 23 nt, Human
uaauggauguaugucucuguaac

SEQ ID NO: 996017 - RNA, 24 nt, Human
uaauuuacaucacagaaacaacuc

SEQ ID NO: 996018 - RNA, 19 nt, Human
uacaguuuuacaaaugaaa

SEQ ID NO: 996019 - RNA, 21 nt, Human
uacugggcuaguacaaaagcu

SEQ ID NO: 996020 - RNA, 23 nt, Human
uaguacagacaacccaguuuaac

SEQ ID NO: 996021 - RNA, 19 nt, Human
uauaaaaccuggaagcuua

SEQ ID NO: 996022 - RNA, 24 nt, Human
uauaaaguaggcuauuccaugcaa

SEQ ID NO: 996023 - RNA, 24 nt, Human
uaucaagucagaauguuaaacuuc

SEQ ID NO: 996024 - RNA, 24 nt, Human
uauucauucauggaaaaacacacu

SEQ ID NO: 996025 - RNA, 21 nt, Human
ucaaucuuucccaacuaacaa

SEQ ID NO: 996026 - RNA, 20 nt, Human
uccaacaugaaagcuagaaa

SEQ ID NO: 996027 - RNA, 22 nt, Human
uccaugaaaagaacacaauaau

SEQ ID NO: 996028 - RNA, 18 nt, Human
ucccaaaacaaaagaaaa

SEQ ID NO: 996029 - RNA, 18 nt, Human
ucccccuccccccaaaac

SEQ ID NO: 996030 - RNA, 21 nt, Human
ucccccuccccccaaaacccc

SEQ ID NO: 996031 - RNA, 22 nt, Human
ucccgcgcgugcgcaguggccg

SEQ ID NO: 996032 - RNA, 21 nt, Human
uccuggccgccgccacagcca

SEQ ID NO: 996033 - RNA, 21 nt, Human
ucuaaugacagauaaaggcuc

SEQ ID NO: 996034 - RNA, 19 nt, Human
ucucuguaacaagaugcuu

SEQ ID NO: 996035 - RNA, 25 nt, Human
ucucuguaacaagaugcuuaagcca

SEQ ID NO: 996036 - RNA, 22 nt, Human
ucugaaaaugcugccaugcuaa

SEQ ID NO: 996037 - RNA, 21 nt, Human
ugaaaaaauuuuguaaaccgc

SEQ ID NO: 996038 - RNA, 21 nt, Human
ugaagauggguauaauaguac

SEQ ID NO: 996039 - RNA, 19 nt, Human
ugauaacucaaucuuuccc

SEQ ID NO: 996040 - RNA, 19 nt, Human
uggccgggcaccggcuggg

SEQ ID NO: 996041 - RNA, 21 nt, Human
uguuucacugcacuugcccau

SEQ ID NO: 996042 - RNA, 20 nt, Human
uuaaagaacacaguauugua

SEQ ID NO: 996043 - RNA, 21 nt, Human
uucuuuaguaaucaggaccua

SEQ ID NO: 996044 - RNA, 20 nt, Human
uuuuccaacaugaaagcuag

SEQ ID NO: 996045 - RNA, 23 nt, Human
uuuuuuuuuuuuuuuuuuacaag

SEQ ID NO: 996046 - RNA, 20 nt, Human
auccagugcacaagcaguuc

SEQ ID NO: 996047 - RNA, 20 nt, Human
uggggccacauccagugcac

SEQ ID NO: 996048 - RNA, 18 nt, Human
aagaggcuggggugaggg

SEQ ID NO: 996049 - RNA, 21 nt, Human
aagcagcguuugccccagaac

SEQ ID NO: 996050 - RNA, 20 nt, Human
accccggagccuucgagccu

SEQ ID NO: 996051 - RNA, 19 nt, Human
acgaagcagcguuugcccc

SEQ ID NO: 996052 - RNA, 24 nt, Human
acgaagcagcguuugccccagaac

SEQ ID NO: 996053 - RNA, 19 nt, Human
acgcugggcacagaaggcc

SEQ ID NO: 996054 - RNA, 20 nt, Human
agaggcaggggggugggagg

SEQ ID NO: 996055 - RNA, 21 nt, Human
agaggcaggggggugggaggg

SEQ ID NO: 996056 - RNA, 18 nt, Human
aggaaucagggauauccu

SEQ ID NO: 996057 - RNA, 18 nt, Human
aggcaggggggugggagg

SEQ ID NO: 996058 - RNA, 19 nt, Human
aggcaggggggugggaggg

SEQ ID NO: 996059 - RNA, 21 nt, Human
aggcaggggggugggaggggc

SEQ ID NO: 996060 - RNA, 18 nt, Human
aggccaaaagggcaucua

SEQ ID NO: 996061 - RNA, 24 nt, Human
aggcuggggugagggugagcuggg

SEQ ID NO: 996062 - RNA, 21 nt, Human
caaggcccagggcaggugugc

SEQ ID NO: 996063 - RNA, 20 nt, Human
caaguacaaacgcugggcac

SEQ ID NO: 996064 - RNA, 22 nt, Human
cacgaagcagcguuugccccag

SEQ ID NO: 996065 - RNA, 27 nt, Human
cagagaggcagcccucagggcuccccc

SEQ ID NO: 996066 - RNA, 18 nt, Human
cagcguuugccccagaac

SEQ ID NO: 996067 - RNA, 18 nt, Human
cagcuuccaagaaacccc

SEQ ID NO: 996068 - RNA, 21 nt, Human
cagggcucccccacacccucc

SEQ ID NO: 996069 - RNA, 19 nt, Human
cauggcccuucagagaggc

SEQ ID NO: 996070 - RNA, 23 nt, Human
ccauggcccuucagagaggcagg

SEQ ID NO: 996071 - RNA, 18 nt, Human
cccacuguugggggaggc

SEQ ID NO: 996072 - RNA, 22 nt, Human
ccccagaacccagucaaggccc

SEQ ID NO: 996073 - RNA, 24 nt, Human
ccccagaacccagucaaggcccag

SEQ ID NO: 996074 - RNA, 25 nt, Human
ccucagggcucccccacacccuccu

SEQ ID NO: 996075 - RNA, 24 nt, Human
ccucgcucccucacaaaggccaaa

SEQ ID NO: 996076 - RNA, 22 nt, Human
ccuuagagggggcccuuggggg

SEQ ID NO: 996077 - RNA, 22 nt, Human
cgccccuuccucugggaucucc

SEQ ID NO: 996078 - RNA, 20 nt, Human
cuccuggggccugcacgggu

SEQ ID NO: 996079 - RNA, 20 nt, Human
cuggggugagggugagcugg

SEQ ID NO: 996080 - RNA, 22 nt, Human
cuuagagggggcccuuggggga

SEQ ID NO: 996081 - RNA, 18 nt, Human
gagagggccggggccagu

SEQ ID NO: 996082 - RNA, 21 nt, Human
gcaggggggugggaggggccg

SEQ ID NO: 996083 - RNA, 18 nt, Human
ggaagaggcuggggugag

SEQ ID NO: 996084 - RNA, 19 nt, Human
ggagcccaggaaucaggga

SEQ ID NO: 996085 - RNA, 20 nt, Human
ggaggaaaugggcccuugga

SEQ ID NO: 996086 - RNA, 19 nt, Human
ggaggcaaguacaaacgcu

SEQ ID NO: 996087 - RNA, 19 nt, Human
ggaguguguggcaggcccc

SEQ ID NO: 996088 - RNA, 24 nt, Human
ggcagagaggcagcccucagggcu

SEQ ID NO: 996089 - RNA, 18 nt, Human
ggcucccccacacccucc

SEQ ID NO: 996090 - RNA, 22 nt, Human
gggaggcaaguacaaacgcugg

SEQ ID NO: 996091 - RNA, 20 nt, Human
gggaguguguggcaggcccc

SEQ ID NO: 996092 - RNA, 21 nt, Human
gggaguguguggcaggccccu

SEQ ID NO: 996093 - RNA, 22 nt, Human
gggcaggugugcggagagggcc

SEQ ID NO: 996094 - RNA, 18 nt, Human
gggcaucuaggaggaaau

SEQ ID NO: 996095 - RNA, 24 nt, Human
gggccggggccagucgugggaaga

SEQ ID NO: 996096 - RNA, 19 nt, Human
gggcucccccacacccucc

SEQ ID NO: 996097 - RNA, 19 nt, Human
ggggaagaggcugggguga

SEQ ID NO: 996098 - RNA, 26 nt, Human
ggguggaggggagugagagccagcuu

SEQ ID NO: 996099 - RNA, 19 nt, Human
gggugggaggggccggugu

SEQ ID NO: 996100 - RNA, 20 nt, Human
guggggaagaggcuggggug

SEQ ID NO: 996101 - RNA, 19 nt, Human
uaccccggagccuucgagc

SEQ ID NO: 996102 - RNA, 20 nt, Human
ucagagaggcaggggggugg

SEQ ID NO: 996103 - RNA, 20 nt, Human
uccuaccucuagcugagggu

SEQ ID NO: 996104 - RNA, 23 nt, Human
ucgcucccucacaaaggccaaaa

SEQ ID NO: 996105 - RNA, 19 nt, Human
ucuaggaggaaaugggccc

SEQ ID NO: 996106 - RNA, 21 nt, Human
ugacuggcagagaggcagccc

SEQ ID NO: 996107 - RNA, 22 nt, Human
ugagcugggaguguguggcagg

SEQ ID NO: 996108 - RNA, 21 nt, Human
uggaggggagugagagccagc

SEQ ID NO: 996109 - RNA, 22 nt, Human
uggcagagaggcagcccucagg

SEQ ID NO: 996110 - RNA, 18 nt, Human
ugggaagagggugugagg

SEQ ID NO: 996111 - RNA, 19 nt, Human
ugggagcccaggaaucagg

SEQ ID NO: 996112 - RNA, 19 nt, Human
ugggcccuuggagccaggg

SEQ ID NO: 996113 - RNA, 23 nt, Human
uggggaagaggcuggggugaggg

SEQ ID NO: 996114 - RNA, 20 nt, Human
ugggggaggcagugaguuuu

SEQ ID NO: 996115 - RNA, 22 nt, Human
ugucacaggagcccagcagaag

SEQ ID NO: 996116 - RNA, 22 nt, Human
ugucuugugcccccgggggcca

SEQ ID NO: 996117 - RNA, 19 nt, Human
ugugcggagagggccgggg

SEQ ID NO: 996118 - RNA, 21 nt, Human
uguguggcaggccccugcggc

SEQ ID NO: 996119 - RNA, 22 nt, Human
aaagcggaccaaggcccgcgga

SEQ ID NO: 996120 - RNA, 23 nt, Human
aaaguccuuucccacccccuaac

SEQ ID NO: 996121 - RNA, 19 nt, Human
aaccacgacaacagcuagc

SEQ ID NO: 996122 - RNA, 24 nt, Human
aaguccuuucccacccccuaacgg

SEQ ID NO: 996123 - RNA, 19 nt, Human
caauaggcuuucugggguu

SEQ ID NO: 996124 - RNA, 18 nt, Human
cccgcccgcccuccucuc

SEQ ID NO: 996125 - RNA, 19 nt, Human
cccgcggacggcgcaacca

SEQ ID NO: 996126 - RNA, 22 nt, Human
cccuccucucgcagccgcagcc

SEQ ID NO: 996127 - RNA, 18 nt, Human
ccggacccuaaaggaccg

SEQ ID NO: 996128 - RNA, 23 nt, Human
ccucccgcgggcgcgcgcggagc

SEQ ID NO: 996129 - RNA, 28 nt, Human
ccuccgagcaaccacgacaacagcuagc

SEQ ID NO: 996130 - RNA, 20 nt, Human
cgaccuauggcaaaguccuu

SEQ ID NO: 996131 - RNA, 19 nt, Human
cgagaagaagccugcgucu

SEQ ID NO: 996132 - RNA, 21 nt, Human
cggaccaaggcccgcggacgg

SEQ ID NO: 996133 - RNA, 24 nt, Human
cgggcccggacccuaaaggaccgg

SEQ ID NO: 996134 - RNA, 24 nt, Human
cuaaaggaccgggcgguuccuccu

SEQ ID NO: 996135 - RNA, 24 nt, Human
cugcacacgugccuccgagcaacc

SEQ ID NO: 996136 - RNA, 18 nt, Human
gacaacagcuagccuccc

SEQ ID NO: 996137 - RNA, 19 nt, Human
gaccuauggcaaaguccuu

SEQ ID NO: 996138 - RNA, 18 nt, Human
ggcucugggagagagagg

SEQ ID NO: 996139 - RNA, 23 nt, Human
ucccgcccgcccuccucucgcag

SEQ ID NO: 996140 - RNA, 24 nt, Human
uggcaaaguccuuucccacccccu

SEQ ID NO: 996141 - RNA, 20 nt, Human
ugggaagacuaucuuuuuac

SEQ ID NO: 996142 - RNA, 23 nt, Human
uucccacccccuaacggaggcuc

SEQ ID NO: 996143 - RNA, 23 nt, Human
uuccccucgccgcuuccgggacu

SEQ ID NO: 996144 - RNA, 22 nt, Human
aaaaaaaaaaagaauccaaagg

SEQ ID NO: 996145 - RNA, 28 nt, Human
aaaagaauccaaaggcuaaacaugaugg

SEQ ID NO: 996146 - RNA, 18 nt, Human
aaaguggaaaaugugcag

SEQ ID NO: 996147 - RNA, 22 nt, Human
aacauggccaaaugcugcuccu

SEQ ID NO: 996148 - RNA, 21 nt, Human
aagaacauggccaaaugcugc

SEQ ID NO: 996149 - RNA, 24 nt, Human
aagccaacuccggaucacugccag

SEQ ID NO: 996150 - RNA, 19 nt, Human
acaaaagaacauggccaaa

SEQ ID NO: 996151 - RNA, 22 nt, Human
acagcauucuuacaguuugugc

SEQ ID NO: 996152 - RNA, 21 nt, Human
acugcuuucugacuggcuguu

SEQ ID NO: 996153 - RNA, 19 nt, Human
agaaaaaaaggggcggggg

SEQ ID NO: 996154 - RNA, 21 nt, Human
aggaauagaaggaaaaaaaaa

SEQ ID NO: 996155 - RNA, 18 nt, Human
agggcccguccugggugg

SEQ ID NO: 996156 - RNA, 21 nt, Human
aggggcggggggggggguugg

SEQ ID NO: 996157 - RNA, 27 nt, Human
auagaaaaacaaaagaacauggccaaa

SEQ ID NO: 996158 - RNA, 27 nt, Human
auuuuuuuuuuuuuuuuuaaacugggg

SEQ ID NO: 996159 - RNA, 24 nt, Human
caaaauggaaagccuauucaaagu

SEQ ID NO: 996160 - RNA, 24 nt, Human
caacaugaaaaaacuggugcaaca

SEQ ID NO: 996161 - RNA, 25 nt, Human
caacaugaaaaaacuggugcaacac

SEQ ID NO: 996162 - RNA, 19 nt, Human
caagaagguucaaagugag

SEQ ID NO: 996163 - RNA, 18 nt, Human
caccuuaacagcagaucc

SEQ ID NO: 996164 - RNA, 22 nt, Human
cacgauaccacaauaagguagg

SEQ ID NO: 996165 - RNA, 20 nt, Human
cagagaauagcuguucccac

SEQ ID NO: 996166 - RNA, 23 nt, Human
caggaaaaugcugaccccucuuu

SEQ ID NO: 996167 - RNA, 22 nt, Human
ccaaaacaaaauggaaagccua

SEQ ID NO: 996168 - RNA, 20 nt, Human
ccaggggcugagggccaugc

SEQ ID NO: 996169 - RNA, 23 nt, Human
cccauacugccgaugagacggag

SEQ ID NO: 996170 - RNA, 19 nt, Human
cccuggcugcaggcggcga

SEQ ID NO: 996171 - RNA, 24 nt, Human
cccuggcugcaggcggcgagcccc

SEQ ID NO: 996172 - RNA, 19 nt, Human
ccucgcgucugaggucccg

SEQ ID NO: 996173 - RNA, 19 nt, Human
cgacaagucacuuacaaca

SEQ ID NO: 996174 - RNA, 19 nt, Human
cgcacgccuccuaagaaca

SEQ ID NO: 996175 - RNA, 19 nt, Human
cgccuccuaagaacacccu

SEQ ID NO: 996176 - RNA, 21 nt, Human
cggucggugagucugcaucua

SEQ ID NO: 996177 - RNA, 21 nt, Human
cucaaaaaacaaacaaaaaaa

SEQ ID NO: 996178 - RNA, 26 nt, Human
cucuccguuauuuuguggcuguugau

SEQ ID NO: 996179 - RNA, 24 nt, Human
gaaaaacaaaagaacauggccaaa

SEQ ID NO: 996180 - RNA, 18 nt, Human
gaacauggccaaaugcug

SEQ ID NO: 996181 - RNA, 18 nt, Human
gaaggaaaaaaaaaaaaa

SEQ ID NO: 996182 - RNA, 23 nt, Human
gagcgcacgccuccuaagaacac

SEQ ID NO: 996183 - RNA, 20 nt, Human
gauccugaaguacugugguu

SEQ ID NO: 996184 - RNA, 22 nt, Human
gcagagaauagcuguucccaca

SEQ ID NO: 996185 - RNA, 22 nt, Human
gccacaguuuuucaaacugcag

SEQ ID NO: 996186 - RNA, 21 nt, Human
gcccguccuggguggcaggug

SEQ ID NO: 996187 - RNA, 22 nt, Human
gcuccuuuuucccagagauaga

SEQ ID NO: 996188 - RNA, 25 nt, Human
ggaaaaaaaaaaaaagaauccaaag

SEQ ID NO: 996189 - RNA, 18 nt, Human
ggacagcugccccccaua

SEQ ID NO: 996190 - RNA, 21 nt, Human
ggacaggaauagaaaaacaaa

SEQ ID NO: 996191 - RNA, 18 nt, Human
ggcugcaggcggcgagcc

SEQ ID NO: 996192 - RNA, 19 nt, Human
gggcugagggccaugcuuc

SEQ ID NO: 996193 - RNA, 21 nt, Human
ggggcggggggggggguuggg

SEQ ID NO: 996194 - RNA, 18 nt, Human
gggggggggguuggggag

SEQ ID NO: 996195 - RNA, 19 nt, Human
gucccggucggugagucug

SEQ ID NO: 996196 - RNA, 21 nt, Human
uaaaugauggaagaguaaaca

SEQ ID NO: 996197 - RNA, 21 nt, Human
uaagguaggcaacaucaaggc

SEQ ID NO: 996198 - RNA, 21 nt, Human
uaccacaauaagguaggcaac

SEQ ID NO: 996199 - RNA, 18 nt, Human
uagaaaaacaaaagaaca

SEQ ID NO: 996200 - RNA, 26 nt, Human
uagaaaaacaaaagaacauggccaaa

SEQ ID NO: 996201 - RNA, 23 nt, Human
uagaaggaaaaaaaaaaaaagaa

SEQ ID NO: 996202 - RNA, 22 nt, Human
uaguagagagcgcacgccuccu

SEQ ID NO: 996203 - RNA, 23 nt, Human
ucaaagugagaaccuccaaaaca

SEQ ID NO: 996204 - RNA, 20 nt, Human
ucccagagauagaaagcauc

SEQ ID NO: 996205 - RNA, 20 nt, Human
uccgacaagucacuuacaac

SEQ ID NO: 996206 - RNA, 21 nt, Human
uccgacaagucacuuacaaca

SEQ ID NO: 996207 - RNA, 20 nt, Human
uccuggguggcaggugggcu

SEQ ID NO: 996208 - RNA, 25 nt, Human
ucuuacaguuugugcuagaaucacu

SEQ ID NO: 996209 - RNA, 21 nt, Human
ucuuugauuugggacaggaau

SEQ ID NO: 996210 - RNA, 21 nt, Human
ugacugguuuuugcuguucug

SEQ ID NO: 996211 - RNA, 19 nt, Human
ugagaaccuccaaaacaaa

SEQ ID NO: 996212 - RNA, 18 nt, Human
ugcaaagggaaaagcuca

SEQ ID NO: 996213 - RNA, 18 nt, Human
ugccaggggcugagggcc

SEQ ID NO: 996214 - RNA, 23 nt, Human
ugcuauaacaggaaaaugcugac

SEQ ID NO: 996215 - RNA, 19 nt, Human
uggcugcaggcggcgagcc

SEQ ID NO: 996216 - RNA, 26 nt, Human
ugggguuuuucuuuuuuuccucuaag

SEQ ID NO: 996217 - RNA, 19 nt, Human
uguaguaucagugcuaaaa

SEQ ID NO: 996218 - RNA, 24 nt, Human
uucaaagugagaaccuccaaaaca

SEQ ID NO: 996219 - RNA, 18 nt, Human
uucaaguauucaaacuga

SEQ ID NO: 996220 - RNA, 19 nt, Human
uuggggaggaauagaagga

SEQ ID NO: 996221 - RNA, 22 nt, Human
uuuuacaacaugaaaaaacugg

SEQ ID NO: 996222 - RNA, 21 nt, Human
uuuuuuuuuuuuuuaaacugg

SEQ ID NO: 996223 - RNA, 21 nt, Human
aaaaacacaauaagcaacgua

SEQ ID NO: 996224 - RNA, 24 nt, Human
aaaauacaaacaacuuaauugcug

SEQ ID NO: 996225 - RNA, 18 nt, Human
aacuuacagguuucagcc

SEQ ID NO: 996226 - RNA, 18 nt, Human
aagaaaauauuuacauug

SEQ ID NO: 996227 - RNA, 19 nt, Human
acagcacaugauaugaaaa

SEQ ID NO: 996228 - RNA, 24 nt, Human
acauauacugugguuugauuugga

SEQ ID NO: 996229 - RNA, 23 nt, Human
agcacaugauaugaaaacuuaca

SEQ ID NO: 996230 - RNA, 21 nt, Human
aggggcgccgggacccagagc

SEQ ID NO: 996231 - RNA, 20 nt, Human
auaaaacagcauaaaaacac

SEQ ID NO: 996232 - RNA, 23 nt, Human
caacaccaacuuacagguuucag

SEQ ID NO: 996233 - RNA, 19 nt, Human
caacguagcaaugaauggu

SEQ ID NO: 996234 - RNA, 18 nt, Human
caccaguguuuacguuaa

SEQ ID NO: 996235 - RNA, 18 nt, Human
cacugcaguucuuauugc

SEQ ID NO: 996236 - RNA, 24 nt, Human
cagagcccgaggagcucgggagcc

SEQ ID NO: 996237 - RNA, 22 nt, Human
cauaaccaacaccaacuuacag

SEQ ID NO: 996238 - RNA, 21 nt, Human
cauuuuuguuuuaguuaagca

SEQ ID NO: 996239 - RNA, 22 nt, Human
cccuccuaugccacucuccuug

SEQ ID NO: 996240 - RNA, 18 nt, Human
ccgggacccgccuccucg

SEQ ID NO: 996241 - RNA, 23 nt, Human
ccuaucuaauagacacuugagag

SEQ ID NO: 996242 - RNA, 18 nt, Human
ccuccuaugccacucucc

SEQ ID NO: 996243 - RNA, 23 nt, Human
cgcggccggaggggcgccgggac

SEQ ID NO: 996244 - RNA, 23 nt, Human
cggccggaggggcgccgggaccc

SEQ ID NO: 996245 - RNA, 24 nt, Human
cgggacugggguucgccggggccg

SEQ ID NO: 996246 - RNA, 21 nt, Human
cggggccgggacccgccuccu

SEQ ID NO: 996247 - RNA, 22 nt, Human
gacacuugagaggaccguuuga

SEQ ID NO: 996248 - RNA, 22 nt, Human
ggaggggcgccgggacccagag

SEQ ID NO: 996249 - RNA, 18 nt, Human
ggcccggggccgggggcc

SEQ ID NO: 996250 - RNA, 20 nt, Human
ggccgggggccgggacuggg

SEQ ID NO: 996251 - RNA, 23 nt, Human
gggcccggggccgggggccggga

SEQ ID NO: 996252 - RNA, 20 nt, Human
gggcgcccggggguggcgcg

SEQ ID NO: 996253 - RNA, 18 nt, Human
gggggccgggacuggggu

SEQ ID NO: 996254 - RNA, 21 nt, Human
uaaaaaaggcaucacauaaaa

SEQ ID NO: 996255 - RNA, 23 nt, Human
uaaaaacaaagugauuuauaguc

SEQ ID NO: 996256 - RNA, 18 nt, Human
uacagcacaugauaugaa

SEQ ID NO: 996257 - RNA, 21 nt, Human
uagcaaugaaugguuuauguc

SEQ ID NO: 996258 - RNA, 23 nt, Human
uauuacaucauaauaaaaacucu

SEQ ID NO: 996259 - RNA, 20 nt, Human
ucaaaacacggaauauagua

SEQ ID NO: 996260 - RNA, 21 nt, Human
ucagguaguuacaacugugcu

SEQ ID NO: 996261 - RNA, 18 nt, Human
ucgccgccgcuagaucca

SEQ ID NO: 996262 - RNA, 19 nt, Human
ucgcggccggaggggcgcc

SEQ ID NO: 996263 - RNA, 21 nt, Human
ugaaauguguuuauucuauag

SEQ ID NO: 996264 - RNA, 18 nt, Human
ugaauaaauaaaaaaggc

SEQ ID NO: 996265 - RNA, 23 nt, Human
ugacaaaaaaaugccaucaacua

SEQ ID NO: 996266 - RNA, 22 nt, Human
ugacauaucauuuuauuugaaa

SEQ ID NO: 996267 - RNA, 22 nt, Human
uggcaaaagucugugauuuaca

SEQ ID NO: 996268 - RNA, 24 nt, Human
uggcaaaagucugugauuuacauu

SEQ ID NO: 996269 - RNA, 22 nt, Human
ugggcccggggccgggggccgg

SEQ ID NO: 996270 - RNA, 24 nt, Human
ugucaccaguguuuacguuaaagc

SEQ ID NO: 996271 - RNA, 19 nt, Human
aaaaaaaaaaagaaaaaga

SEQ ID NO: 996272 - RNA, 29 nt, Human
aaaaaaaaaagaaaaagaaauauaaaaga

SEQ ID NO: 996273 - RNA, 26 nt, Human
aaaaaaaucuggaacaauagaaacug

SEQ ID NO: 996274 - RNA, 25 nt, Human
aaaaaguucaugacccugcuccccg

SEQ ID NO: 996275 - RNA, 22 nt, Human
aaaaggacagcaaaccaaauac

SEQ ID NO: 996276 - RNA, 25 nt, Human
aaaaucccacccugccucucugccc

SEQ ID NO: 996277 - RNA, 18 nt, Human
aaacuaaaaucucuaaac

SEQ ID NO: 996278 - RNA, 19 nt, Human
aaaugcacucaacaccucc

SEQ ID NO: 996279 - RNA, 21 nt, Human
aacacacuugggugcuuugca

SEQ ID NO: 996280 - RNA, 20 nt, Human
aacauucugaauacaaaacc

SEQ ID NO: 996281 - RNA, 26 nt, Human
aaccaaauacacacacacacaccccu

SEQ ID NO: 996282 - RNA, 21 nt, Human
aagaaaaaaucuugaaaagaa

SEQ ID NO: 996283 - RNA, 20 nt, Human
aagcagggggcuauggacua

SEQ ID NO: 996284 - RNA, 24 nt, Human
aauauaaaacccaaaccaaccaaa

SEQ ID NO: 996285 - RNA, 26 nt, Human
aaucccacccugccucucugcccacc

SEQ ID NO: 996286 - RNA, 23 nt, Human
acaucauucuggacuaacaguuu

SEQ ID NO: 996287 - RNA, 19 nt, Human
accaguuccuucugcagug

SEQ ID NO: 996288 - RNA, 24 nt, Human
acccccagcccauuccccagccuc

SEQ ID NO: 996289 - RNA, 21 nt, Human
acccgcaccuucccgcgcccc

SEQ ID NO: 996290 - RNA, 21 nt, Human
acccugcucccuuggcuccug

SEQ ID NO: 996291 - RNA, 21 nt, Human
agaaaaaaaaaaaagaaaaag

SEQ ID NO: 996292 - RNA, 23 nt, Human
agaaaaaaaaaaaagaaaaagaa

SEQ ID NO: 996293 - RNA, 24 nt, Human
agacgguccugcccuccuggcccc

SEQ ID NO: 996294 - RNA, 19 nt, Human
agacugggcuggccccuga

SEQ ID NO: 996295 - RNA, 23 nt, Human
agagggaauggugggguggggcc

SEQ ID NO: 996296 - RNA, 21 nt, Human
agagggauagauagaggaugg

SEQ ID NO: 996297 - RNA, 18 nt, Human
agaguuggaggaacaagc

SEQ ID NO: 996298 - RNA, 21 nt, Human
agauggugcugggcugagaag

SEQ ID NO: 996299 - RNA, 28 nt, Human
agcacagggcacguguacagccuugggc

SEQ ID NO: 996300 - RNA, 19 nt, Human
aggaagggaggagcaggga

SEQ ID NO: 996301 - RNA, 24 nt, Human
aggaggaagggaggagcagggagc

SEQ ID NO: 996302 - RNA, 23 nt, Human
agggaguggggacuggggucaga

SEQ ID NO: 996303 - RNA, 19 nt, Human
agggauagauagaggaugg

SEQ ID NO: 996304 - RNA, 19 nt, Human
aggguggcccagacugggc

SEQ ID NO: 996305 - RNA, 22 nt, Human
agguaccaagaagcucucaacc

SEQ ID NO: 996306 - RNA, 24 nt, Human
aggugagcagcucccucugggcua

SEQ ID NO: 996307 - RNA, 25 nt, Human
agugugaaggaggaagggaggagca

SEQ ID NO: 996308 - RNA, 24 nt, Human
auaaaaaaaaguuuuccuacgaaa

SEQ ID NO: 996309 - RNA, 23 nt, Human
auucugaauacaaaacccuugau

SEQ ID NO: 996310 - RNA, 20 nt, Human
auugggacccugaugccaag

SEQ ID NO: 996311 - RNA, 20 nt, Human
caaagggguuggucuccccu

SEQ ID NO: 996312 - RNA, 23 nt, Human
caaauacacacacacacaccccu

SEQ ID NO: 996313 - RNA, 19 nt, Human
caacaacccgcaccuuccc

SEQ ID NO: 996314 - RNA, 24 nt, Human
caacauccagccuggggaagaagg

SEQ ID NO: 996315 - RNA, 22 nt, Human
caacauucugaauacaaaaccc

SEQ ID NO: 996316 - RNA, 18 nt, Human
caaccaaauaaaucacag

SEQ ID NO: 996317 - RNA, 23 nt, Human
caagccgaccugguguggguggg

SEQ ID NO: 996318 - RNA, 20 nt, Human
cacagacaucagcuccaggg

SEQ ID NO: 996319 - RNA, 25 nt, Human
caccacacacacugcccugcaaaag

SEQ ID NO: 996320 - RNA, 24 nt, Human
caccccucccuacccacaacaucc

SEQ ID NO: 996321 - RNA, 25 nt, Human
caccccucccuacccacaacaucca

SEQ ID NO: 996322 - RNA, 23 nt, Human
cacccugccucucugcccacccc

SEQ ID NO: 996323 - RNA, 21 nt, Human
cacggauccggcuuccccacc

SEQ ID NO: 996324 - RNA, 20 nt, Human
cacgggccagccucucccug

SEQ ID NO: 996325 - RNA, 18 nt, Human
cacuaacucuaaaauccc

SEQ ID NO: 996326 - RNA, 18 nt, Human
cacucauuaaagauguua

SEQ ID NO: 996327 - RNA, 22 nt, Human
cagacacuaacucuaaaauccc

SEQ ID NO: 996328 - RNA, 21 nt, Human
cagagaaucagcacagggcac

SEQ ID NO: 996329 - RNA, 19 nt, Human
cagaggcagugacacgggc

SEQ ID NO: 996330 - RNA, 22 nt, Human
cagcaacucccuguggcccagc

SEQ ID NO: 996331 - RNA, 21 nt, Human
cagcauccaaccuuucccaga

SEQ ID NO: 996332 - RNA, 19 nt, Human
cagccaacaacccgcaccu

SEQ ID NO: 996333 - RNA, 20 nt, Human
caggacaccacuccucgcag

SEQ ID NO: 996334 - RNA, 24 nt, Human
caggcuugccucaaugcccccuuc

SEQ ID NO: 996335 - RNA, 19 nt, Human
cagggcagugagaaggggu

SEQ ID NO: 996336 - RNA, 20 nt, Human
cagggcccggccgggacuac

SEQ ID NO: 996337 - RNA, 18 nt, Human
caucaagguccagugggg

SEQ ID NO: 996338 - RNA, 20 nt, Human
cauugccugccgggggaggu

SEQ ID NO: 996339 - RNA, 19 nt, Human
ccaaacuaagagaccccaa

SEQ ID NO: 996340 - RNA, 22 nt, Human
ccaaagucucaacuccaggcuc

SEQ ID NO: 996341 - RNA, 21 nt, Human
ccacuuugcaaagaagaaaaa

SEQ ID NO: 996342 - RNA, 24 nt, Human
cccagacugggcuggccccugaga

SEQ ID NO: 996343 - RNA, 26 nt, Human
cccauacacaucaauggccagggcca

SEQ ID NO: 996344 - RNA, 28 nt, Human
cccauacacaucaauggccagggccaug

SEQ ID NO: 996345 - RNA, 27 nt, Human
ccccaaagucucaacuccaggcucagg

SEQ ID NO: 996346 - RNA, 20 nt, Human
cccccagcccauuccccagc

SEQ ID NO: 996347 - RNA, 19 nt, Human
cccccgcacagacacuaac

SEQ ID NO: 996348 - RNA, 21 nt, Human
cccccgcacagacacuaacuc

SEQ ID NO: 996349 - RNA, 20 nt, Human
ccccgcacagacacuaacuc

SEQ ID NO: 996350 - RNA, 22 nt, Human
ccccgcgucgcccgagccacgg

SEQ ID NO: 996351 - RNA, 22 nt, Human
ccccucccuacccacaacaucc

SEQ ID NO: 996352 - RNA, 24 nt, Human
cccgcacagacacuaacucuaaaa

SEQ ID NO: 996353 - RNA, 20 nt, Human
cccgcaccuucccgcgcccc

SEQ ID NO: 996354 - RNA, 20 nt, Human
cccuacccacaacauccagc

SEQ ID NO: 996355 - RNA, 21 nt, Human
cccuccuggccccgcgucgcc

SEQ ID NO: 996356 - RNA, 21 nt, Human
cccugcgugaugcgucccucc

SEQ ID NO: 996357 - RNA, 20 nt, Human
cccugcuccccgggcuccuc

SEQ ID NO: 996358 - RNA, 22 nt, Human
ccgcacagacacuaacucuaaa

SEQ ID NO: 996359 - RNA, 24 nt, Human
ccgcacagacacuaacucuaaaau

SEQ ID NO: 996360 - RNA, 22 nt, Human
ccuagggagaaaacuagagaau

SEQ ID NO: 996361 - RNA, 20 nt, Human
ccuauucagguggcagggcc

SEQ ID NO: 996362 - RNA, 19 nt, Human
ccucacauauaaauaagga

SEQ ID NO: 996363 - RNA, 21 nt, Human
ccucccauuccgugccugggc

SEQ ID NO: 996364 - RNA, 18 nt, Human
ccuccgcccugcaggggc

SEQ ID NO: 996365 - RNA, 19 nt, Human
ccuccuggccccgcgucgc

SEQ ID NO: 996366 - RNA, 21 nt, Human
ccuccuggccccgcgucgccc

SEQ ID NO: 996367 - RNA, 22 nt, Human
ccuucugugcucgccggucgug

SEQ ID NO: 996368 - RNA, 18 nt, Human
ccuugggcuccaggcggc

SEQ ID NO: 996369 - RNA, 20 nt, Human
cgacccagaaucacauccag

SEQ ID NO: 996370 - RNA, 21 nt, Human
cgcgcaacggcagacgguaug

SEQ ID NO: 996371 - RNA, 22 nt, Human
cggcccgaagugagcaaaguca

SEQ ID NO: 996372 - RNA, 20 nt, Human
cggccgcggggcggcuucuc

SEQ ID NO: 996373 - RNA, 21 nt, Human
cggcuccccgucuuccccucc

SEQ ID NO: 996374 - RNA, 22 nt, Human
cgggagugcugaguccgucagg

SEQ ID NO: 996375 - RNA, 24 nt, Human
cgggcucggcagcggggggcccga

SEQ ID NO: 996376 - RNA, 24 nt, Human
cuaggagugugaaggaggaaggga

SEQ ID NO: 996377 - RNA, 24 nt, Human
cucaaugcccccuucccaucccua

SEQ ID NO: 996378 - RNA, 25 nt, Human
cucacauauaaauaaggacuugcga

SEQ ID NO: 996379 - RNA, 19 nt, Human
cuccccgggcuccucucca

SEQ ID NO: 996380 - RNA, 18 nt, Human
cuccucgcagcaucaagg

SEQ ID NO: 996381 - RNA, 19 nt, Human
cugcaguguuuuccucugg

SEQ ID NO: 996382 - RNA, 20 nt, Human
cugccucucugcccaccccc

SEQ ID NO: 996383 - RNA, 23 nt, Human
cugcucccuuggcuccuguccau

SEQ ID NO: 996384 - RNA, 24 nt, Human
cugggcccaagagcgcagcacugg

SEQ ID NO: 996385 - RNA, 18 nt, Human
cugugcucgccggucgug

SEQ ID NO: 996386 - RNA, 22 nt, Human
cuucugugcucgccggucguga

SEQ ID NO: 996387 - RNA, 26 nt, Human
cuuuccuuucucuuuucuguggucuu

SEQ ID NO: 996388 - RNA, 19 nt, Human
gaaacacacuugggugcuu

SEQ ID NO: 996389 - RNA, 18 nt, Human
gacagacugaacugggcc

SEQ ID NO: 996390 - RNA, 19 nt, Human
gagaaaaacacaucauucu

SEQ ID NO: 996391 - RNA, 21 nt, Human
gagcagcuccugugcccuucu

SEQ ID NO: 996392 - RNA, 18 nt, Human
gagccacggcuugccuca

SEQ ID NO: 996393 - RNA, 20 nt, Human
gaggaagggaggagcaggga

SEQ ID NO: 996394 - RNA, 20 nt, Human
gaggagggcuagaaggggau

SEQ ID NO: 996395 - RNA, 22 nt, Human
gagguagagcuggugccuacug

SEQ ID NO: 996396 - RNA, 22 nt, Human
gagugcgaggauagcuggguga

SEQ ID NO: 996397 - RNA, 21 nt, Human
gagugugaaggaggaagggag

SEQ ID NO: 996398 - RNA, 25 nt, Human
gauagauagaggauggggaaagggg

SEQ ID NO: 996399 - RNA, 19 nt, Human
gcagcaguucacaucugga

SEQ ID NO: 996400 - RNA, 19 nt, Human
gcaggagagcaagugcucu

SEQ ID NO: 996401 - RNA, 23 nt, Human
gccaaacaacaggaggguugaag

SEQ ID NO: 996402 - RNA, 18 nt, Human
gccagccccgcgccucag

SEQ ID NO: 996403 - RNA, 20 nt, Human
gccaggacauugccugccgg

SEQ ID NO: 996404 - RNA, 22 nt, Human
gccucagccaacaacccgcacc

SEQ ID NO: 996405 - RNA, 20 nt, Human
gcggagcagcuccugugccc

SEQ ID NO: 996406 - RNA, 22 nt, Human
gcggagcagcuccugugcccuu

SEQ ID NO: 996407 - RNA, 18 nt, Human
gcggcuucucccuccagg

SEQ ID NO: 996408 - RNA, 18 nt, Human
gcuccccgucuuccccuc

SEQ ID NO: 996409 - RNA, 18 nt, Human
gcugcagcucuuucuucc

SEQ ID NO: 996410 - RNA, 21 nt, Human
gcugcagcucuuucuucccua

SEQ ID NO: 996411 - RNA, 19 nt, Human
ggaacagauggugcugggc

SEQ ID NO: 996412 - RNA, 18 nt, Human
ggagaggaggcuggcagu

SEQ ID NO: 996413 - RNA, 19 nt, Human
ggagcagcuccugugcccu

SEQ ID NO: 996414 - RNA, 18 nt, Human
ggauggaguggguggggu

SEQ ID NO: 996415 - RNA, 23 nt, Human
ggaugggaggagggcuagaaggg

SEQ ID NO: 996416 - RNA, 20 nt, Human
ggcagacgguccugcccucc

SEQ ID NO: 996417 - RNA, 19 nt, Human
ggcagggcccgagaaggcc

SEQ ID NO: 996418 - RNA, 18 nt, Human
ggcccgagaaggccugcu

SEQ ID NO: 996419 - RNA, 20 nt, Human
gggaaaggggagaaaagguu

SEQ ID NO: 996420 - RNA, 18 nt, Human
gggacuggggucagaccu

SEQ ID NO: 996421 - RNA, 22 nt, Human
gggcacguguacagccuugggc

SEQ ID NO: 996422 - RNA, 20 nt, Human
gggccagggcccggccggga

SEQ ID NO: 996423 - RNA, 18 nt, Human
gggcccgagggcgggcgg

SEQ ID NO: 996424 - RNA, 27 nt, Human
gggcuaaggccaaacaacaggaggguu

SEQ ID NO: 996425 - RNA, 18 nt, Human
ggggcuuuggugcuuucu

SEQ ID NO: 996426 - RNA, 18 nt, Human
ggguggggugccaggggc

SEQ ID NO: 996427 - RNA, 24 nt, Human
gguccagugggguugggucagggc

SEQ ID NO: 996428 - RNA, 19 nt, Human
ggugggguggggccauagg

SEQ ID NO: 996429 - RNA, 19 nt, Human
gguugggucagggcaguga

SEQ ID NO: 996430 - RNA, 21 nt, Human
gucagggcagugagaaggggu

SEQ ID NO: 996431 - RNA, 19 nt, Human
guggucuugggugcuccug

SEQ ID NO: 996432 - RNA, 19 nt, Human
guggucuugggugcuccug

SEQ ID NO: 996433 - RNA, 19 nt, Human
guguggaugggaggagggc

SEQ ID NO: 996434 - RNA, 23 nt, Human
guguguguggaugggaggagggc

SEQ ID NO: 996435 - RNA, 18 nt, Human
guuuuauuucuccucuuu

SEQ ID NO: 996436 - RNA, 20 nt, Human
uaaaaucccacccugccucu

SEQ ID NO: 996437 - RNA, 21 nt, Human
uaaaaucccacccugccucuc

SEQ ID NO: 996438 - RNA, 20 nt, Human
uaaaauugaagcaaaaaugc

SEQ ID NO: 996439 - RNA, 21 nt, Human
uaaaauugaagcaaaaaugcc

SEQ ID NO: 996440 - RNA, 23 nt, Human
uaaacacaccaaugucccauucc

SEQ ID NO: 996441 - RNA, 25 nt, Human
uaaagaaaaaaguucaugacccugc

SEQ ID NO: 996442 - RNA, 20 nt, Human
uaagagaccccaaagucuca

SEQ ID NO: 996443 - RNA, 28 nt, Human
uacauguaagaaaaaaaaaaaagaaaaa

SEQ ID NO: 996444 - RNA, 18 nt, Human
uacauuuuucuuuuccuc

SEQ ID NO: 996445 - RNA, 27 nt, Human
uaccaagaagcucucaaccaggcaggg

SEQ ID NO: 996446 - RNA, 22 nt, Human
uacugcagggagaggaggcugg

SEQ ID NO: 996447 - RNA, 18 nt, Human
uagaaggggauguaaggc

SEQ ID NO: 996448 - RNA, 21 nt, Human
uaggggaacagauggugcugg

SEQ ID NO: 996449 - RNA, 22 nt, Human
ucaaaaacaaaacugcagaucc

SEQ ID NO: 996450 - RNA, 21 nt, Human
ucacaggccggugggcgagcg

SEQ ID NO: 996451 - RNA, 20 nt, Human
ucagcuccagggggagggug

SEQ ID NO: 996452 - RNA, 22 nt, Human
uccaaacuaagagaccccaaag

SEQ ID NO: 996453 - RNA, 19 nt, Human
uccaggcucagggcugccc

SEQ ID NO: 996454 - RNA, 21 nt, Human
uccaggcucagggcugccccc

SEQ ID NO: 996455 - RNA, 24 nt, Human
uccaggcuugccucaaugcccccu

SEQ ID NO: 996456 - RNA, 20 nt, Human
uccagggggagggugucaag

SEQ ID NO: 996457 - RNA, 21 nt, Human
uccagggggagggugucaagu

SEQ ID NO: 996458 - RNA, 21 nt, Human
ucccgggcgucgccgggccag

SEQ ID NO: 996459 - RNA, 18 nt, Human
ucccuacaugugagaaac

SEQ ID NO: 996460 - RNA, 22 nt, Human
ucccuggguaggauggaguggg

SEQ ID NO: 996461 - RNA, 18 nt, Human
uccugugcccuucugugc

SEQ ID NO: 996462 - RNA, 20 nt, Human
uccuucccgggcgucgccgg

SEQ ID NO: 996463 - RNA, 19 nt, Human
ucuaaaaucccacccugcc

SEQ ID NO: 996464 - RNA, 19 nt, Human
ucuaaaaucccacccugcc

SEQ ID NO: 996465 - RNA, 22 nt, Human
ucuccaggcuugccucaaugcc

SEQ ID NO: 996466 - RNA, 22 nt, Human
ucuccgcggcggcggggcgcuc

SEQ ID NO: 996467 - RNA, 21 nt, Human
ucucuaaacacaccaaugucc

SEQ ID NO: 996468 - RNA, 19 nt, Human
ucugcaguguuuuccucug

SEQ ID NO: 996469 - RNA, 20 nt, Human
ucugcaguguuuuccucugg

SEQ ID NO: 996470 - RNA, 25 nt, Human
ucugggcuaaggccaaaccgggguc

SEQ ID NO: 996471 - RNA, 18 nt, Human
ucuugggugcuccuggcc

SEQ ID NO: 996472 - RNA, 18 nt, Human
ugaaggaggaagggagga

SEQ ID NO: 996473 - RNA, 31 nt, Human
ugaaggaggaagggaggagcagggagcagcc

SEQ ID NO: 996474 - RNA, 19 nt, Human
ugagaaacaagccgaccug

SEQ ID NO: 996475 - RNA, 23 nt, Human
ugagaagggguggcaagagguac

SEQ ID NO: 996476 - RNA, 23 nt, Human
ugagacaagacagacugaacugg

SEQ ID NO: 996477 - RNA, 19 nt, Human
ugagcgcggggcggagguc

SEQ ID NO: 996478 - RNA, 21 nt, Human
ugagcgcggggcggaggucgc

SEQ ID NO: 996479 - RNA, 20 nt, Human
ugagggaaacaaaggguggc

SEQ ID NO: 996480 - RNA, 21 nt, Human
ugagguuggauggcuuugagu

SEQ ID NO: 996481 - RNA, 26 nt, Human
ugagugaaacacacuugggugcuuug

SEQ ID NO: 996482 - RNA, 22 nt, Human
ugcaaaaggacugccaauaccc

SEQ ID NO: 996483 - RNA, 25 nt, Human
ugcaaaaggacugccaauaccccca

SEQ ID NO: 996484 - RNA, 21 nt, Human
ugcagauuucuguuuuuguau

SEQ ID NO: 996485 - RNA, 20 nt, Human
ugcagggagaggaggcuggc

SEQ ID NO: 996486 - RNA, 23 nt, Human
ugccaauacccccagcccauucc

SEQ ID NO: 996487 - RNA, 22 nt, Human
ugccugggcuggaucuuuuuuc

SEQ ID NO: 996488 - RNA, 23 nt, Human
ugcugaguccgucaggacaccac

SEQ ID NO: 996489 - RNA, 22 nt, Human
ugcugggcugagaagccaggac

SEQ ID NO: 996490 - RNA, 23 nt, Human
uggaacaauagaaacuguacaga

SEQ ID NO: 996491 - RNA, 21 nt, Human
uggaguggguggggugccagg

SEQ ID NO: 996492 - RNA, 23 nt, Human
uggcagggcccgagaaggccugc

SEQ ID NO: 996493 - RNA, 22 nt, Human
uggcagugcuggccugggcugg

SEQ ID NO: 996494 - RNA, 24 nt, Human
uggccagggccaugaugauggucu

SEQ ID NO: 996495 - RNA, 18 nt, Human
uggcccagccugaaaggg

SEQ ID NO: 996496 - RNA, 26 nt, Human
uggccccacgggcagguaggggaacc

SEQ ID NO: 996497 - RNA, 18 nt, Human
ugggagccgaggaugagg

SEQ ID NO: 996498 - RNA, 23 nt, Human
ugggucagggcagugagaagggg

SEQ ID NO: 996499 - RNA, 24 nt, Human
ugggugggugccuguguguguggu

SEQ ID NO: 996500 - RNA, 20 nt, Human
uggucaaaaacaaaacugca

SEQ ID NO: 996501 - RNA, 19 nt, Human
uggugcugggcugagaagc

SEQ ID NO: 996502 - RNA, 20 nt, Human
uggugggguggggccauagg

SEQ ID NO: 996503 - RNA, 18 nt, Human
uguacauuuuucuuuucc

SEQ ID NO: 996504 - RNA, 19 nt, Human
ugucuugggcuaagccaca

SEQ ID NO: 996505 - RNA, 18 nt, Human
uguggaugggaggagggc

SEQ ID NO: 996506 - RNA, 19 nt, Human
ugugggagccgaggaugag

SEQ ID NO: 996507 - RNA, 20 nt, Human
uguggucuugggugcuccug

SEQ ID NO: 996508 - RNA, 21 nt, Human
uguggucuugggugcuccugg

SEQ ID NO: 996509 - RNA, 23 nt, Human
uugcacaacauucugaauacaaa

SEQ ID NO: 996510 - RNA, 21 nt, Human
uuuccucuuuuuuuuggccuu

SEQ ID NO: 996511 - RNA, 23 nt, Human
uuuccuucccgggcgucgccggg

SEQ ID NO: 996512 - RNA, 25 nt, Human
uuuggccuuuccuuucucuuuucug

SEQ ID NO: 996513 - RNA, 20 nt, Human
uuuguuuuguuuuuaaacua

SEQ ID NO: 996514 - RNA, 24 nt, Human
uuuuuuuuuuuucuuuuccucuuu

SEQ ID NO: 996515 - RNA, 25 nt, Human
uuuuuuuuuuuuuucuuuuccucuu

SEQ ID NO: 996516 - RNA, 19 nt, Human
aaaaaccacccccaaucga

SEQ ID NO: 996517 - RNA, 24 nt, Human
aaaauaaagcgcuugugaaaaaga

SEQ ID NO: 996518 - RNA, 25 nt, Human
aaacaggaaauaaagcauaaaauga

SEQ ID NO: 996519 - RNA, 21 nt, Human
aaacccagcucccaaacccac

SEQ ID NO: 996520 - RNA, 23 nt, Human
aaacccaggagcaggagcagcag

SEQ ID NO: 996521 - RNA, 19 nt, Human
aaagcuuuuacagggccac

SEQ ID NO: 996522 - RNA, 28 nt, Human
aaccggugcugguggccacaccugggcg

SEQ ID NO: 996523 - RNA, 24 nt, Human
aacuuccuccuucugcaucuucca

SEQ ID NO: 996524 - RNA, 26 nt, Human
aagcauaaaaugaaggaaaggggacc

SEQ ID NO: 996525 - RNA, 22 nt, Human
acaaacaccagacaugcaggug

SEQ ID NO: 996526 - RNA, 21 nt, Human
acaaucaaagaaaaaucugga

SEQ ID NO: 996527 - RNA, 19 nt, Human
acagagccacaugugcacg

SEQ ID NO: 996528 - RNA, 19 nt, Human
acagcucuauuccaauuac

SEQ ID NO: 996529 - RNA, 24 nt, Human
acaggcgggggcgggggagggugg

SEQ ID NO: 996530 - RNA, 20 nt, Human
accagacccaagcccugggc

SEQ ID NO: 996531 - RNA, 18 nt, Human
acccacugcagccucccc

SEQ ID NO: 996532 - RNA, 19 nt, Human
acccacuugugggcauucu

SEQ ID NO: 996533 - RNA, 19 nt, Human
accuccugcgcccccgccg

SEQ ID NO: 996534 - RNA, 19 nt, Human
acgcgccgggcgaccuccu

SEQ ID NO: 996535 - RNA, 21 nt, Human
acggaacauaccaucuagaac

SEQ ID NO: 996536 - RNA, 20 nt, Human
acggcagccuccggcgggcg

SEQ ID NO: 996537 - RNA, 25 nt, Human
agaccaggccaucugagacagggaa

SEQ ID NO: 996538 - RNA, 22 nt, Human
agaggagaggagggggagccuu

SEQ ID NO: 996539 - RNA, 18 nt, Human
agaggggagaggagagga

SEQ ID NO: 996540 - RNA, 22 nt, Human
agccaggccagaggccggcccc

SEQ ID NO: 996541 - RNA, 20 nt, Human
agccuggccaaccgugccag

SEQ ID NO: 996542 - RNA, 18 nt, Human
aggaaagaagaaucuuau

SEQ ID NO: 996543 - RNA, 23 nt, Human
aggaaauaaagcauaaaaugaag

SEQ ID NO: 996544 - RNA, 23 nt, Human
aggagggggagccuccggcgacc

SEQ ID NO: 996545 - RNA, 19 nt, Human
aggccuugcaaaaugugau

SEQ ID NO: 996546 - RNA, 20 nt, Human
aggcguaagaccaggccauc

SEQ ID NO: 996547 - RNA, 21 nt, Human
agggcgugaguuuucgucugg

SEQ ID NO: 996548 - RNA, 20 nt, Human
auaaagcgcuugugaaaaag

SEQ ID NO: 996549 - RNA, 25 nt, Human
aucaaagaaaaaucuggacaauggu

SEQ ID NO: 996550 - RNA, 22 nt, Human
aucaccucucaccccagccucg

SEQ ID NO: 996551 - RNA, 19 nt, Human
auccacaggaagcugcuca

SEQ ID NO: 996552 - RNA, 23 nt, Human
auggcaugcagauuauuuaaagu

SEQ ID NO: 996553 - RNA, 23 nt, Human
caaaggccuuuaggacccacagc

SEQ ID NO: 996554 - RNA, 24 nt, Human
caagacacuugaaccacaaacacc

SEQ ID NO: 996555 - RNA, 21 nt, Human
caagcccugggcaggggccag

SEQ ID NO: 996556 - RNA, 19 nt, Human
cacacccucucggaaucau

SEQ ID NO: 996557 - RNA, 19 nt, Human
cacacgggcugcucaaggg

SEQ ID NO: 996558 - RNA, 21 nt, Human
caccagacccaagcccugggc

SEQ ID NO: 996559 - RNA, 24 nt, Human
caccgaagcccccagcaaccggag

SEQ ID NO: 996560 - RNA, 23 nt, Human
caccgaagcccccagcacaguga

SEQ ID NO: 996561 - RNA, 18 nt, Human
caccucucaccccagccu

SEQ ID NO: 996562 - RNA, 18 nt, Human
cacgagaugggaggggag

SEQ ID NO: 996563 - RNA, 19 nt, Human
cacgggaaucuuguuggga

SEQ ID NO: 996564 - RNA, 19 nt, Human
cacgucccagggacaggag

SEQ ID NO: 996565 - RNA, 22 nt, Human
cacugugugggucccucgggcc

SEQ ID NO: 996566 - RNA, 24 nt, Human
cacuugaaccacaaacaccagaca

SEQ ID NO: 996567 - RNA, 18 nt, Human
cagacaccaggggccuaa

SEQ ID NO: 996568 - RNA, 24 nt, Human
cagcucccaaacccacugcagccu

SEQ ID NO: 996569 - RNA, 21 nt, Human
cagcugcucucuacagcaaga

SEQ ID NO: 996570 - RNA, 25 nt, Human
caggagagacggacggcagccuccg

SEQ ID NO: 996571 - RNA, 19 nt, Human
caggagcaggagcagcaga

SEQ ID NO: 996572 - RNA, 24 nt, Human
cagggccacgcucgccaggcuuuc

SEQ ID NO: 996573 - RNA, 22 nt, Human
caggggccuaaacccagcuccc

SEQ ID NO: 996574 - RNA, 18 nt, Human
cauaaaaugaaggaaaga

SEQ ID NO: 996575 - RNA, 21 nt, Human
caugucccucccccacggcca

SEQ ID NO: 996576 - RNA, 20 nt, Human
ccaacacccuggcagaagca

SEQ ID NO: 996577 - RNA, 22 nt, Human
ccacaccugggcgccuggacac

SEQ ID NO: 996578 - RNA, 19 nt, Human
ccacaugugcacgcgugug

SEQ ID NO: 996579 - RNA, 21 nt, Human
ccagcacgagaugggagggga

SEQ ID NO: 996580 - RNA, 22 nt, Human
ccaggccagaggccggccccac

SEQ ID NO: 996581 - RNA, 19 nt, Human
ccagggagcaucugcagag

SEQ ID NO: 996582 - RNA, 24 nt, Human
cccaagcccugggcaggggccagg

SEQ ID NO: 996583 - RNA, 26 nt, Human
cccacaugcacccaagaacaggugug

SEQ ID NO: 996584 - RNA, 20 nt, Human
cccacgcugaacccacgucc

SEQ ID NO: 996585 - RNA, 23 nt, Human
cccacgcugaacccacguccugg

SEQ ID NO: 996586 - RNA, 22 nt, Human
cccccacggccaccacacacuu

SEQ ID NO: 996587 - RNA, 23 nt, Human
cccccacggccaccacacacuuc

SEQ ID NO: 996588 - RNA, 23 nt, Human
cccccagcacagugaggccucug

SEQ ID NO: 996589 - RNA, 18 nt, Human
cccccgccccguccugga

SEQ ID NO: 996590 - RNA, 20 nt, Human
cccgccucagaaagcuuuua

SEQ ID NO: 996591 - RNA, 28 nt, Human
cccucagacaccaggggccuaaacccag

SEQ ID NO: 996592 - RNA, 21 nt, Human
ccgaaaacccacaugcaccca

SEQ ID NO: 996593 - RNA, 21 nt, Human
ccgaagcccccagcacaguga

SEQ ID NO: 996594 - RNA, 18 nt, Human
ccggagccccgccugagg

SEQ ID NO: 996595 - RNA, 20 nt, Human
ccggagccccgccugaggcu

SEQ ID NO: 996596 - RNA, 19 nt, Human
ccggccccacaccauccac

SEQ ID NO: 996597 - RNA, 20 nt, Human
ccucgcccacgcugaaccca

SEQ ID NO: 996598 - RNA, 24 nt, Human
ccucucaccccagccucgcaaggc

SEQ ID NO: 996599 - RNA, 19 nt, Human
ccugacaccuucauuccca

SEQ ID NO: 996600 - RNA, 23 nt, Human
ccugcgacggagacaguugucac

SEQ ID NO: 996601 - RNA, 20 nt, Human
ccugcgcccccgccggagcc

SEQ ID NO: 996602 - RNA, 23 nt, Human
ccuggaccgccaggaaccgaaaa

SEQ ID NO: 996603 - RNA, 23 nt, Human
cgaaaacccacaugcacccaaga

SEQ ID NO: 996604 - RNA, 20 nt, Human
cgacccgacagugacgcgcc

SEQ ID NO: 996605 - RNA, 18 nt, Human
cgccgggcgaccuccugc

SEQ ID NO: 996606 - RNA, 23 nt, Human
cgccgggucggcguguccaaaga

SEQ ID NO: 996607 - RNA, 22 nt, Human
cgccucagaaagcuuuuacagg

SEQ ID NO: 996608 - RNA, 23 nt, Human
cgccugaggcuccaagauggcac

SEQ ID NO: 996609 - RNA, 22 nt, Human
cgccuggacaccgaagccccca

SEQ ID NO: 996610 - RNA, 23 nt, Human
cgcuccaccaccuccaacacccu

SEQ ID NO: 996611 - RNA, 18 nt, Human
cggcaaaggguugcucuc

SEQ ID NO: 996612 - RNA, 23 nt, Human
cggcccccguggcucgccgaccc

SEQ ID NO: 996613 - RNA, 22 nt, Human
cuacagcaagagcauuuuccag

SEQ ID NO: 996614 - RNA, 21 nt, Human
cucaccccagccucgcaaggc

SEQ ID NO: 996615 - RNA, 25 nt, Human
cuccaacacccuggcagaagcagcu

SEQ ID NO: 996616 - RNA, 19 nt, Human
cuccaccaccuccaacacc

SEQ ID NO: 996617 - RNA, 18 nt, Human
cuccagguguggguucau

SEQ ID NO: 996618 - RNA, 19 nt, Human
cucccaaacccacugcagc

SEQ ID NO: 996619 - RNA, 23 nt, Human
cuccugcgcccccgccggagccu

SEQ ID NO: 996620 - RNA, 21 nt, Human
cucgccaggcuuuccucgccc

SEQ ID NO: 996621 - RNA, 21 nt, Human
cugaacccacguccugggcac

SEQ ID NO: 996622 - RNA, 22 nt, Human
cugacaccuucauucccaaugg

SEQ ID NO: 996623 - RNA, 21 nt, Human
cugcucaagggcuggcagcag

SEQ ID NO: 996624 - RNA, 18 nt, Human
cugcucucuacagcaaga

SEQ ID NO: 996625 - RNA, 24 nt, Human
cugcugaacaaauaccaugucuuu

SEQ ID NO: 996626 - RNA, 18 nt, Human
cuggacaguggccaggug

SEQ ID NO: 996627 - RNA, 25 nt, Human
cuucuacaguaagccacuucuacag

SEQ ID NO: 996628 - RNA, 24 nt, Human
cuucuacaguaagccuucaaacag

SEQ ID NO: 996629 - RNA, 21 nt, Human
cuugaaccacaaacaccagac

SEQ ID NO: 996630 - RNA, 22 nt, Human
cuugaaccacaaacaccagaca

SEQ ID NO: 996631 - RNA, 21 nt, Human
gacaccuucauucccaaugga

SEQ ID NO: 996632 - RNA, 19 nt, Human
gacaguggccaggugagcc

SEQ ID NO: 996633 - RNA, 21 nt, Human
gaccucauccacaccugacac

SEQ ID NO: 996634 - RNA, 19 nt, Human
gacgcgccgggcgaccucc

SEQ ID NO: 996635 - RNA, 22 nt, Human
gagaagagaagcucccugggag

SEQ ID NO: 996636 - RNA, 24 nt, Human
gagaaggagagacgcacgucccag

SEQ ID NO: 996637 - RNA, 19 nt, Human
gcaaggccugggcccucag

SEQ ID NO: 996638 - RNA, 22 nt, Human
gcagaagcagcugcucucuaca

SEQ ID NO: 996639 - RNA, 18 nt, Human
gccaccacacccucucgg

SEQ ID NO: 996640 - RNA, 22 nt, Human
gcccccacugugugggucccuc

SEQ ID NO: 996641 - RNA, 20 nt, Human
gcgcugagaccucccagcac

SEQ ID NO: 996642 - RNA, 18 nt, Human
gcucccaaacccacugca

SEQ ID NO: 996643 - RNA, 18 nt, Human
gcugccagcaugucccuc

SEQ ID NO: 996644 - RNA, 25 nt, Human
ggaaccgaaaacccacaugcaccca

SEQ ID NO: 996645 - RNA, 21 nt, Human
ggacaguggccaggugagcca

SEQ ID NO: 996646 - RNA, 22 nt, Human
ggagagcgcgcugagaccuccc

SEQ ID NO: 996647 - RNA, 20 nt, Human
ggagaggagaggagggggaa

SEQ ID NO: 996648 - RNA, 22 nt, Human
ggcaagggcgugaguuuucguc

SEQ ID NO: 996649 - RNA, 20 nt, Human
ggcggcaagcguggucaucg

SEQ ID NO: 996650 - RNA, 22 nt, Human
gggagggggcgacacgggugcu

SEQ ID NO: 996651 - RNA, 21 nt, Human
gggcgugaguuuucgucuggg

SEQ ID NO: 996652 - RNA, 21 nt, Human
ggggcgggggagggugggggu

SEQ ID NO: 996653 - RNA, 23 nt, Human
guggguucauucugccuucaggc

SEQ ID NO: 996654 - RNA, 20 nt, Human
uacaguaagccacuucuaca

SEQ ID NO: 996655 - RNA, 22 nt, Human
uaggagacacccacagagccac

SEQ ID NO: 996656 - RNA, 23 nt, Human
uaucaacaguauauuugacaaaa

SEQ ID NO: 996657 - RNA, 20 nt, Human
ucaaauuucugacugucaua

SEQ ID NO: 996658 - RNA, 22 nt, Human
ucaaauuucugacugucauaac

SEQ ID NO: 996659 - RNA, 22 nt, Human
ucagcucaccagacccaagccc

SEQ ID NO: 996660 - RNA, 19 nt, Human
ucaggccggagucugucac

SEQ ID NO: 996661 - RNA, 18 nt, Human
uccacaccugacacaggc

SEQ ID NO: 996662 - RNA, 22 nt, Human
uccacaggaagcugcucagcuc

SEQ ID NO: 996663 - RNA, 18 nt, Human
uccaccaccuccaacacc

SEQ ID NO: 996664 - RNA, 18 nt, Human
uccaccaccuccaacacc

SEQ ID NO: 996665 - RNA, 18 nt, Human
ucccagggacaggagagc

SEQ ID NO: 996666 - RNA, 22 nt, Human
uccggagccccgccugaggcuc

SEQ ID NO: 996667 - RNA, 19 nt, Human
uccuggaccgccaggaacc

SEQ ID NO: 996668 - RNA, 28 nt, Human
uccuggaccgccaggaaccgaaaacccc

SEQ ID NO: 996669 - RNA, 18 nt, Human
uccugggcacagcagcuc

SEQ ID NO: 996670 - RNA, 20 nt, Human
uccuguaggccaagaugcua

SEQ ID NO: 996671 - RNA, 22 nt, Human
uccuuggggagcgccgggucgg

SEQ ID NO: 996672 - RNA, 21 nt, Human
ucgccgacccgacagugacgc

SEQ ID NO: 996673 - RNA, 26 nt, Human
ucuacagcaagagcauuuuccagaac

SEQ ID NO: 996674 - RNA, 19 nt, Human
ugaaggaaagaagaaucuu

SEQ ID NO: 996675 - RNA, 24 nt, Human
ugagacagggaaucccaggggccc

SEQ ID NO: 996676 - RNA, 19 nt, Human
ugagccaggccagaggccg

SEQ ID NO: 996677 - RNA, 27 nt, Human
ugagcgccucccgccucagaaagcuuu

SEQ ID NO: 996678 - RNA, 20 nt, Human
ugaggcuccaagauggcaca

SEQ ID NO: 996679 - RNA, 23 nt, Human
ugagggagaaaaagacuaaaaug

SEQ ID NO: 996680 - RNA, 21 nt, Human
ugcaucacuugugagaagcuu

SEQ ID NO: 996681 - RNA, 23 nt, Human
ugccaggcccccuuccucacucc

SEQ ID NO: 996682 - RNA, 28 nt, Human
uggcagaagcagcugcucuccucccggg

SEQ ID NO: 996683 - RNA, 22 nt, Human
uggcagacaagccuguccuucu

SEQ ID NO: 996684 - RNA, 25 nt, Human
uggcagacaagccuguccuucugag

SEQ ID NO: 996685 - RNA, 23 nt, Human
uggcagucucacugcaccccagc

SEQ ID NO: 996686 - RNA, 18 nt, Human
uggccacaccugggcgcc

SEQ ID NO: 996687 - RNA, 24 nt, Human
ugggaggggagcccccgccccguc

SEQ ID NO: 996688 - RNA, 22 nt, Human
ugucccucccccacggccacca

SEQ ID NO: 996689 - RNA, 19 nt, Human
ugugggcauucucuuucug

SEQ ID NO: 996690 - RNA, 23 nt, Human
uucaaacccaggagcaggagcag

SEQ ID NO: 996691 - RNA, 18 nt, Human
uucaaaggaucaaaggcc

SEQ ID NO: 996692 - RNA, 20 nt, Human
uugcucucccuccagcgagg

SEQ ID NO: 996693 - RNA, 18 nt, Human
aaccaagaggugagcccc

SEQ ID NO: 996694 - RNA, 20 nt, Human
aagcagccagccagccagcc

SEQ ID NO: 996695 - RNA, 20 nt, Human
aagccacccccaaagcagcc

SEQ ID NO: 996696 - RNA, 18 nt, Human
acaaaaggcaccucuccc

SEQ ID NO: 996697 - RNA, 24 nt, Human
acaaaaggcaccucucccaguaca

SEQ ID NO: 996698 - RNA, 19 nt, Human
accagaggagggagggagg

SEQ ID NO: 996699 - RNA, 19 nt, Human
acccccaaagcagccuuaa

SEQ ID NO: 996700 - RNA, 24 nt, Human
agcaguggggaccugggcugcagg

SEQ ID NO: 996701 - RNA, 21 nt, Human
agccuggggcugaugagaucu

SEQ ID NO: 996702 - RNA, 24 nt, Human
aggaacagaggaaggauggagggc

SEQ ID NO: 996703 - RNA, 18 nt, Human
aggcagcggaggggcagu

SEQ ID NO: 996704 - RNA, 23 nt, Human
aggcagcggaggggcaguggggc

SEQ ID NO: 996705 - RNA, 18 nt, Human
aggguaucacucagugaa

SEQ ID NO: 996706 - RNA, 18 nt, Human
agugcuguggugcccggc

SEQ ID NO: 996707 - RNA, 21 nt, Human
aguggggaccugggcugcagg

SEQ ID NO: 996708 - RNA, 24 nt, Human
aucccacugccuccacacccccag

SEQ ID NO: 996709 - RNA, 21 nt, Human
augcagcagagcagggaaggg

SEQ ID NO: 996710 - RNA, 21 nt, Human
caaaaggcaccucucccagua

SEQ ID NO: 996711 - RNA, 20 nt, Human
caagcagccagccagccagc

SEQ ID NO: 996712 - RNA, 22 nt, Human
caccagaggagggagggagguc

SEQ ID NO: 996713 - RNA, 22 nt, Human
cacccuacccucaguggccagc

SEQ ID NO: 996714 - RNA, 23 nt, Human
caccuccacacccuacccucagu

SEQ ID NO: 996715 - RNA, 18 nt, Human
cacugcagcgcagaccug

SEQ ID NO: 996716 - RNA, 24 nt, Human
cacugcagcgcagaccuguccccc

SEQ ID NO: 996717 - RNA, 21 nt, Human
cagaauuuccacuguggccag

SEQ ID NO: 996718 - RNA, 18 nt, Human
cagcagagcagggaaggg

SEQ ID NO: 996719 - RNA, 19 nt, Human
cagcagagcagggaaggga

SEQ ID NO: 996720 - RNA, 20 nt, Human
cagccagccuguccuggggc

SEQ ID NO: 996721 - RNA, 22 nt, Human
cagugugggcucugaagggcuc

SEQ ID NO: 996722 - RNA, 19 nt, Human
caucccacugccuccacac

SEQ ID NO: 996723 - RNA, 20 nt, Human
caucccacugccuccacacc

SEQ ID NO: 996724 - RNA, 23 nt, Human
ccaaagcagccuuaacaccagag

SEQ ID NO: 996725 - RNA, 18 nt, Human
ccaaagccauggggcccc

SEQ ID NO: 996726 - RNA, 21 nt, Human
ccacacccccagccacagcug

SEQ ID NO: 996727 - RNA, 22 nt, Human
ccacccccaaagcagccuuaac

SEQ ID NO: 996728 - RNA, 25 nt, Human
ccacccccaaagcagccuuaacacc

SEQ ID NO: 996729 - RNA, 19 nt, Human
cccacugccuccacacccc

SEQ ID NO: 996730 - RNA, 21 nt, Human
cccacugccuccacaccccca

SEQ ID NO: 996731 - RNA, 18 nt, Human
cccagccacagcuggggc

SEQ ID NO: 996732 - RNA, 18 nt, Human
ccccaaagcagccuuaac

SEQ ID NO: 996733 - RNA, 19 nt, Human
ccgcugccaccaaccccgg

SEQ ID NO: 996734 - RNA, 24 nt, Human
ccggagcaggguaucacucaguga

SEQ ID NO: 996735 - RNA, 20 nt, Human
ccucaguggccagccaaagc

SEQ ID NO: 996736 - RNA, 21 nt, Human
cucaccugcagccuggggcuc

SEQ ID NO: 996737 - RNA, 20 nt, Human
cuccacacccccagccacag

SEQ ID NO: 996738 - RNA, 25 nt, Human
cuccacacccuacccucaguggcca

SEQ ID NO: 996739 - RNA, 22 nt, Human
cuccacaccuccacacccuacc

SEQ ID NO: 996740 - RNA, 24 nt, Human
cuccucagggggccuccacaccuc

SEQ ID NO: 996741 - RNA, 20 nt, Human
cucucccaguacaagaggau

SEQ ID NO: 996742 - RNA, 18 nt, Human
cugcagccuggggcugau

SEQ ID NO: 996743 - RNA, 21 nt, Human
cugccuccacacccccagcca

SEQ ID NO: 996744 - RNA, 21 nt, Human
cuucaaagaggaggaaaaggg

SEQ ID NO: 996745 - RNA, 29 nt, Human
cuucguaccugggccgccgcagcuccucc

SEQ ID NO: 996746 - RNA, 22 nt, Human
gaggaaaaggggguaacaagcc

SEQ ID NO: 996747 - RNA, 21 nt, Human
gaggagggagggaggucccag

SEQ ID NO: 996748 - RNA, 24 nt, Human
gaggagggagggaggucccagccu

SEQ ID NO: 996749 - RNA, 21 nt, Human
gaggggcaguggggcccagca

SEQ ID NO: 996750 - RNA, 20 nt, Human
gccacccccaaagcagccuu

SEQ ID NO: 996751 - RNA, 21 nt, Human
ggaggcagagcagccagaucc

SEQ ID NO: 996752 - RNA, 23 nt, Human
ggccagccaaagccauggggccc

SEQ ID NO: 996753 - RNA, 21 nt, Human
ggccagccuccagccaggccu

SEQ ID NO: 996754 - RNA, 20 nt, Human
ggucagcuggggugggaaag

SEQ ID NO: 996755 - RNA, 19 nt, Human
ggugugagagcagugggga

SEQ ID NO: 996756 - RNA, 20 nt, Human
uaacaagccacccccaaagc

SEQ ID NO: 996757 - RNA, 23 nt, Human
uaacaagccacccccaaagcagc

SEQ ID NO: 996758 - RNA, 21 nt, Human
uaagggugugagagcaguggg

SEQ ID NO: 996759 - RNA, 23 nt, Human
ucaucccacugccuccacacccc

SEQ ID NO: 996760 - RNA, 23 nt, Human
ucccccaguucaucccacugccu

SEQ ID NO: 996761 - RNA, 20 nt, Human
ucucgcccacugcgcgcaga

SEQ ID NO: 996762 - RNA, 20 nt, Human
ucugaagggcuccuuggggc

SEQ ID NO: 996763 - RNA, 23 nt, Human
uggcagugugggcucugaagggc

SEQ ID NO: 996764 - RNA, 21 nt, Human
uggggaccugggcugcagggu

SEQ ID NO: 996765 - RNA, 20 nt, Human
uggggugggaaaggaggcag

SEQ ID NO: 996766 - RNA, 23 nt, Human
uucaaagaggaggaaaagggggu

SEQ ID NO: 996767 - RNA, 23 nt, Human
uucucagcaaagucucauggucc

SEQ ID NO: 996768 - RNA, 23 nt, Human
uuuccacuguggccagccuccag

SEQ ID NO: 996769 - RNA, 19 nt, Human
agagucuagugaccuguuc

SEQ ID NO: 996770 - RNA, 20 nt, Human
agaguuggcaccuuugaugu

SEQ ID NO: 996771 - RNA, 20 nt, Human
aggaaggccugugaaacaug

SEQ ID NO: 996772 - RNA, 23 nt, Human
aggaaucaguguuauccuggaac

SEQ ID NO: 996773 - RNA, 22 nt, Human
auagcagaaaugugccaccaug

SEQ ID NO: 996774 - RNA, 22 nt, Human
auuugucaucaaauguacaacu

SEQ ID NO: 996775 - RNA, 24 nt, Human
caauguagagucuagugaccuguu

SEQ ID NO: 996776 - RNA, 24 nt, Human
ggacaccugaaauauaauuaaaug

SEQ ID NO: 996777 - RNA, 24 nt, Human
ggauuauaaagaagugcaaauuga

SEQ ID NO: 996778 - RNA, 19 nt, Human
uaagugaguauuuguucca

SEQ ID NO: 996779 - RNA, 19 nt, Human
uagcagaaaugugccacca

SEQ ID NO: 996780 - RNA, 22 nt, Human
uagcagaaaugugccaccaugg

SEQ ID NO: 996781 - RNA, 24 nt, Human
uaggaaggccugugaaacaugaca

SEQ ID NO: 996782 - RNA, 24 nt, Human
uauagcagaaaugugccaccaugg

SEQ ID NO: 996783 - RNA, 24 nt, Human
ucauuauagcagaaaugugccacc

SEQ ID NO: 996784 - RNA, 21 nt, Human
ucucacgcuguugucaggaau

SEQ ID NO: 996785 - RNA, 22 nt, Human
ugcaguaaaaagagaaaaaaag

SEQ ID NO: 996786 - RNA, 20 nt, Human
uuauucuauuuaaucuucau

SEQ ID NO: 996787 - RNA, 22 nt, Human
uuccaggcuucaaagcugcaca

SEQ ID NO: 996788 - RNA, 23 nt, Human
aaaaaaccaagucccugcccaga

SEQ ID NO: 996789 - RNA, 19 nt, Human
aaaccaagucccugcccag

SEQ ID NO: 996790 - RNA, 19 nt, Human
aaagaacuaugaagcccgg

SEQ ID NO: 996791 - RNA, 20 nt, Human
aaaggagggcccgaacagaa

SEQ ID NO: 996792 - RNA, 22 nt, Human
aagcuuuuuaaugcaacagcuu

SEQ ID NO: 996793 - RNA, 19 nt, Human
acagggugggaggccauca

SEQ ID NO: 996794 - RNA, 20 nt, Human
agaaggcacuggggcucaga

SEQ ID NO: 996795 - RNA, 18 nt, Human
agaaggcagcagcacaga

SEQ ID NO: 996796 - RNA, 21 nt, Human
agaugaacugcagugaguugg

SEQ ID NO: 996797 - RNA, 26 nt, Human
aggcagcagcacagagucaaggacaa

SEQ ID NO: 996798 - RNA, 19 nt, Human
aggcagggguuccaguugc

SEQ ID NO: 996799 - RNA, 18 nt, Human
agggauugaggagggggc

SEQ ID NO: 996800 - RNA, 20 nt, Human
aguuggggucuggggaagcu

SEQ ID NO: 996801 - RNA, 22 nt, Human
augaagcccggagaaggccacu

SEQ ID NO: 996802 - RNA, 22 nt, Human
auggcuucucuggguaaggucc

SEQ ID NO: 996803 - RNA, 19 nt, Human
caauucaaauuaacuucaa

SEQ ID NO: 996804 - RNA, 21 nt, Human
caccaaaggagggcccgaaca

SEQ ID NO: 996805 - RNA, 18 nt, Human
caccucuaggaggagcag

SEQ ID NO: 996806 - RNA, 21 nt, Human
cacgcuuagcucuagugggga

SEQ ID NO: 996807 - RNA, 22 nt, Human
cacugggcucuuuaaacagcuu

SEQ ID NO: 996808 - RNA, 19 nt, Human
cagcagcuguacaccugga

SEQ ID NO: 996809 - RNA, 24 nt, Human
caggagcucagguuguucagaaaa

SEQ ID NO: 996810 - RNA, 19 nt, Human
caggcugcuuuggaucagg

SEQ ID NO: 996811 - RNA, 18 nt, Human
cagggcagggacagcagc

SEQ ID NO: 996812 - RNA, 23 nt, Human
cccccuccuuccaccccggccca

SEQ ID NO: 996813 - RNA, 18 nt, Human
ccccucccaccucuagga

SEQ ID NO: 996814 - RNA, 21 nt, Human
ccccuccuuccaccccggccc

SEQ ID NO: 996815 - RNA, 23 nt, Human
cugaaaaggcauaaaugaaagca

SEQ ID NO: 996816 - RNA, 19 nt, Human
cugcagugaguuggggucu

SEQ ID NO: 996817 - RNA, 20 nt, Human
cugggggaauagggacagag

SEQ ID NO: 996818 - RNA, 19 nt, Human
gagcagguggcccauggcu

SEQ ID NO: 996819 - RNA, 18 nt, Human
gaucagcuagcugggcug

SEQ ID NO: 996820 - RNA, 20 nt, Human
gcaacaaccaugucuguguu

SEQ ID NO: 996821 - RNA, 21 nt, Human
uacagaguuccaggugcaaag

SEQ ID NO: 996822 - RNA, 19 nt, Human
uaggagacugugcaaggac

SEQ ID NO: 996823 - RNA, 21 nt, Human
ucaagggauugaggagggggc

SEQ ID NO: 996824 - RNA, 19 nt, Human
ucagagcucacuuggggca

SEQ ID NO: 996825 - RNA, 23 nt, Human
ucagggccuuagguuuauccccc

SEQ ID NO: 996826 - RNA, 19 nt, Human
ucuaggaggagcagccaca

SEQ ID NO: 996827 - RNA, 21 nt, Human
ucugccuucccaccaaaggag

SEQ ID NO: 996828 - RNA, 20 nt, Human
ugaaaaggcauaaaugaaag

SEQ ID NO: 996829 - RNA, 23 nt, Human
ugaccaaggaggccucuugcccc

SEQ ID NO: 996830 - RNA, 20 nt, Human
ugaguuuaauuugaacaagc

SEQ ID NO: 996831 - RNA, 21 nt, Human
ugcaaagcugaaaaggcauaa

SEQ ID NO: 996832 - RNA, 24 nt, Human
ugcccagaaagcauggacacugac

SEQ ID NO: 996833 - RNA, 23 nt, Human
uggagagacugcagcccuggaga

SEQ ID NO: 996834 - RNA, 24 nt, Human
uggccaggccggcgaguugggagc

SEQ ID NO: 996835 - RNA, 21 nt, Human
ugggagcuccuuccuuccucc

SEQ ID NO: 996836 - RNA, 18 nt, Human
ugggcucuuuaaacagcu

SEQ ID NO: 996837 - RNA, 23 nt, Human
ugggcucuuuaaacagcuuaggu

SEQ ID NO: 996838 - RNA, 21 nt, Human
ugucuguguuugacuacacug

SEQ ID NO: 996839 - RNA, 22 nt, Human
ugugaucagcuagcugggcugg

SEQ ID NO: 996840 - RNA, 25 nt, Human
ugugcaaggacaggacagggcaggg

SEQ ID NO: 996841 - RNA, 18 nt, Human
uuaauuugaacaagcaaa

SEQ ID NO: 996842 - RNA, 20 nt, Human
uuuuuuuuuuuuuuuuuugg

SEQ ID NO: 996843 - RNA, 22 nt, Human
aagggaggggggcucaggucuc

SEQ ID NO: 996844 - RNA, 19 nt, Human
agggaggggggcucagguc

SEQ ID NO: 996845 - RNA, 23 nt, Human
agguggagguggaaucggaaggg

SEQ ID NO: 996846 - RNA, 22 nt, Human
caaggggggagggaagggaggg

SEQ ID NO: 996847 - RNA, 23 nt, Human
caccccgugcgccacgcgcaacc

SEQ ID NO: 996848 - RNA, 20 nt, Human
cagaauccugcgugccccuc

SEQ ID NO: 996849 - RNA, 18 nt, Human
cagggggagguggaggug

SEQ ID NO: 996850 - RNA, 22 nt, Human
cccaaggggggagggaagggag

SEQ ID NO: 996851 - RNA, 22 nt, Human
cccacugggcaugcugccccug

SEQ ID NO: 996852 - RNA, 18 nt, Human
cccccaaggggggaggga

SEQ ID NO: 996853 - RNA, 23 nt, Human
ccccgugcgccacgcgcaaccga

SEQ ID NO: 996854 - RNA, 28 nt, Human
ccccucuguggcagggggagguggaggu

SEQ ID NO: 996855 - RNA, 20 nt, Human
ccccugcuacucagaauccc

SEQ ID NO: 996856 - RNA, 20 nt, Human
cccgaagcgccauucaguuc

SEQ ID NO: 996857 - RNA, 23 nt, Human
cccgggaccccaggcccacuggg

SEQ ID NO: 996858 - RNA, 21 nt, Human
cccgugcgccacgcgcaaccg

SEQ ID NO: 996859 - RNA, 24 nt, Human
cccucccgggaccccaggcccacu

SEQ ID NO: 996860 - RNA, 23 nt, Human
ccggggauggggaagcuccucuc

SEQ ID NO: 996861 - RNA, 26 nt, Human
ccucagcugcugggguggcggggucc

SEQ ID NO: 996862 - RNA, 21 nt, Human
ccucccgggaccccaggccca

SEQ ID NO: 996863 - RNA, 18 nt, Human
ccucugccccuggugcuc

SEQ ID NO: 996864 - RNA, 21 nt, Human
cgccugcucccggccugggcu

SEQ ID NO: 996865 - RNA, 23 nt, Human
cgcgcaaccgaacccgcugccgc

SEQ ID NO: 996866 - RNA, 23 nt, Human
cucagaaucccgaagcgccauuc

SEQ ID NO: 996867 - RNA, 21 nt, Human
cucccgggaccccaggcccac

SEQ ID NO: 996868 - RNA, 21 nt, Human
cugcccccucggggcgggccc

SEQ ID NO: 996869 - RNA, 18 nt, Human
cuggccgccucugccccu

SEQ ID NO: 996870 - RNA, 21 nt, Human
gaccggggauggggaagcucc

SEQ ID NO: 996871 - RNA, 19 nt, Human
gaggauggggacgccagga

SEQ ID NO: 996872 - RNA, 18 nt, Human
gagggaagggaggggggc

SEQ ID NO: 996873 - RNA, 18 nt, Human
gagguggagguggaggug

SEQ ID NO: 996874 - RNA, 22 nt, Human
gcgggcccaggcccuuuggagg

SEQ ID NO: 996875 - RNA, 20 nt, Human
gcucagaauccugcgugccc

SEQ ID NO: 996876 - RNA, 18 nt, Human
ggagggaagggagggggg

SEQ ID NO: 996877 - RNA, 22 nt, Human
ggagggaagggaggggggcuca

SEQ ID NO: 996878 - RNA, 19 nt, Human
ggcggcggcgccugcuccc

SEQ ID NO: 996879 - RNA, 23 nt, Human
ggcggcggcgccugcucccggcc

SEQ ID NO: 996880 - RNA, 20 nt, Human
gggaaaguggacggggcagg

SEQ ID NO: 996881 - RNA, 18 nt, Human
gggggagggaagggaggg

SEQ ID NO: 996882 - RNA, 20 nt, Human
guggaaggcgggggccagga

SEQ ID NO: 996883 - RNA, 19 nt, Human
uacucagaaucccgaagcg

SEQ ID NO: 996884 - RNA, 29 nt, Human
uauuuuuuguuguuuuuuguuuuuuuucu

SEQ ID NO: 996885 - RNA, 26 nt, Human
ucccaccccgugcgccacgcgcaacc

SEQ ID NO: 996886 - RNA, 27 nt, Human
ucccaccccgugcgccacgcgcaaccg

SEQ ID NO: 996887 - RNA, 18 nt, Human
uccccccccgacccccaa

SEQ ID NO: 996888 - RNA, 26 nt, Human
ucccgaagcgccauucaaccauuggg

SEQ ID NO: 996889 - RNA, 18 nt, Human
ucccgggaccccaggccc

SEQ ID NO: 996890 - RNA, 23 nt, Human
ucccgggaccccaggcccacugg

SEQ ID NO: 996891 - RNA, 18 nt, Human
ucgcugcccccucggggc

SEQ ID NO: 996892 - RNA, 19 nt, Human
ucgcuggcggcggcgccug

SEQ ID NO: 996893 - RNA, 24 nt, Human
ucgcuggcggcggcgccugcuccc

SEQ ID NO: 996894 - RNA, 22 nt, Human
ucuggccgccucugccccuggu

SEQ ID NO: 996895 - RNA, 21 nt, Human
uggaaggcgggggccaggagg

SEQ ID NO: 996896 - RNA, 24 nt, Human
uggagguggagguggaaucggaag

SEQ ID NO: 996897 - RNA, 23 nt, Human
ugggaaaguggacggggcagggu

SEQ ID NO: 996898 - RNA, 22 nt, Human
uggggaagcuccucucgcugcc

SEQ ID NO: 996899 - RNA, 21 nt, Human
uuguuguuuuuuguuuuuuuu

SEQ ID NO: 996900 - RNA, 22 nt, Human
uuuucuguaaaaugucccgguu

SEQ ID NO: 996901 - RNA, 20 nt, Human
uuuuuuuuuuuuuuucccac

SEQ ID NO: 996902 - RNA, 24 nt, Human
uuuuuuuuuuuuuuuuucccacgu

SEQ ID NO: 996903 - RNA, 19 nt, Human
aaaaagagggucagucugc

SEQ ID NO: 996904 - RNA, 19 nt, Human
aaaaagcacucuacauguc

SEQ ID NO: 996905 - RNA, 20 nt, Human
aaaagaaagauacagacaga

SEQ ID NO: 996906 - RNA, 25 nt, Human
aaaagaccccugaagaacacaaccc

SEQ ID NO: 996907 - RNA, 24 nt, Human
aaaagcugcaagacugcaaacuuc

SEQ ID NO: 996908 - RNA, 19 nt, Human
aacaccuagacaugaaaca

SEQ ID NO: 996909 - RNA, 25 nt, Human
aagaagggagaagaguagaagaaaa

SEQ ID NO: 996910 - RNA, 24 nt, Human
aauuuuacuuuaaucccccauuua

SEQ ID NO: 996911 - RNA, 19 nt, Human
acaaaaagcacucuacaug

SEQ ID NO: 996912 - RNA, 21 nt, Human
acaaaagaccccugaagaaca

SEQ ID NO: 996913 - RNA, 21 nt, Human
acaacaccacaaacagaaaua

SEQ ID NO: 996914 - RNA, 22 nt, Human
acaacaccacaaacagaaauac

SEQ ID NO: 996915 - RNA, 18 nt, Human
acaacccuucccucacca

SEQ ID NO: 996916 - RNA, 19 nt, Human
acugcaaacuuccuucaac

SEQ ID NO: 996917 - RNA, 23 nt, Human
agaaaauagucacagacaauuau

SEQ ID NO: 996918 - RNA, 20 nt, Human
agaaauacugauuuccacca

SEQ ID NO: 996919 - RNA, 19 nt, Human
agaacauaaucaacugcca

SEQ ID NO: 996920 - RNA, 18 nt, Human
agaguagaagaaaauguu

SEQ ID NO: 996921 - RNA, 24 nt, Human
agauacagacagaugcagcuuuca

SEQ ID NO: 996922 - RNA, 20 nt, Human
agaugcagcuuucagugcag

SEQ ID NO: 996923 - RNA, 23 nt, Human
agauguaacaaauaacaacacca

SEQ ID NO: 996924 - RNA, 24 nt, Human
agauguaacaaauaacaacaccac

SEQ ID NO: 996925 - RNA, 22 nt, Human
agcaucuucaaaaauaaguggc

SEQ ID NO: 996926 - RNA, 24 nt, Human
aggaagaccgagggagggaaggaa

SEQ ID NO: 996927 - RNA, 18 nt, Human
aggcuggagugcaguggc

SEQ ID NO: 996928 - RNA, 22 nt, Human
auauaucacacuuacucuaccu

SEQ ID NO: 996929 - RNA, 18 nt, Human
aucaacugccaacccccc

SEQ ID NO: 996930 - RNA, 18 nt, Human
aucaguuuuuauuugcau

SEQ ID NO: 996931 - RNA, 23 nt, Human
auggucuauaaaaguggaaaaug

SEQ ID NO: 996932 - RNA, 24 nt, Human
caaaagaaagauacagacagaugc

SEQ ID NO: 996933 - RNA, 21 nt, Human
caaaagaccccugaagaacac

SEQ ID NO: 996934 - RNA, 27 nt, Human
caaaauuccuuaagcacauguagccau

SEQ ID NO: 996935 - RNA, 19 nt, Human
caaauaacaacaccacaaa

SEQ ID NO: 996936 - RNA, 20 nt, Human
caacaccuagacaugaaaca

SEQ ID NO: 996937 - RNA, 22 nt, Human
caacagccacacccacaacacc

SEQ ID NO: 996938 - RNA, 25 nt, Human
caacccuucccucaccagaaaaauc

SEQ ID NO: 996939 - RNA, 21 nt, Human
cacaacaccuagacaugaaac

SEQ ID NO: 996940 - RNA, 24 nt, Human
cacaacaccuagacaugaaacaga

SEQ ID NO: 996941 - RNA, 22 nt, Human
cacauguagccauaguuaaagc

SEQ ID NO: 996942 - RNA, 24 nt, Human
cacauguccuucacgagaaauuuu

SEQ ID NO: 996943 - RNA, 24 nt, Human
cagccucgagcuccuggucucaag

SEQ ID NO: 996944 - RNA, 19 nt, Human
cauaaucaacugccaaccc

SEQ ID NO: 996945 - RNA, 24 nt, Human
caucuucaaaaauaaguggcucaa

SEQ ID NO: 996946 - RNA, 23 nt, Human
ccaaccccaagaugaaagaaggg

SEQ ID NO: 996947 - RNA, 22 nt, Human
ccacacccacaacaccuagaca

SEQ ID NO: 996948 - RNA, 19 nt, Human
ccacauguccuucacgaga

SEQ ID NO: 996949 - RNA, 21 nt, Human
ccaccaaguuucuaaaacugc

SEQ ID NO: 996950 - RNA, 24 nt, Human
ccagaaaaaucuagcauauaagca

SEQ ID NO: 996951 - RNA, 22 nt, Human
ccagaacauaaucaacugccaa

SEQ ID NO: 996952 - RNA, 24 nt, Human
cccacaacaccuagacaugaaaca

SEQ ID NO: 996953 - RNA, 24 nt, Human
cccaucauccaaaucaucuugaau

SEQ ID NO: 996954 - RNA, 19 nt, Human
cccccaucaauacucaguc

SEQ ID NO: 996955 - RNA, 23 nt, Human
cccccuuaaaaaaaaaaucaaca

SEQ ID NO: 996956 - RNA, 26 nt, Human
ccccugaagaacacaacccuucccuc

SEQ ID NO: 996957 - RNA, 23 nt, Human
ccccuuaaaaaaaaaaucaacaa

SEQ ID NO: 996958 - RNA, 25 nt, Human
ccucgagcuccuggucucaagccuc

SEQ ID NO: 996959 - RNA, 25 nt, Human
ccucuugccucagccucccuaguag

SEQ ID NO: 996960 - RNA, 21 nt, Human
cuauauugcccaggcuggagu

SEQ ID NO: 996961 - RNA, 22 nt, Human
cucuauccuacauuuuuaaaag

SEQ ID NO: 996962 - RNA, 26 nt, Human
cucuccccauccugaguauuucaaaa

SEQ ID NO: 996963 - RNA, 23 nt, Human
cugcagaaucagaggcauugugc

SEQ ID NO: 996964 - RNA, 20 nt, Human
cuucaacagccacacccaca

SEQ ID NO: 996965 - RNA, 20 nt, Human
cuuugucugguccacucccc

SEQ ID NO: 996966 - RNA, 21 nt, Human
gaaugacaguauagaauggca

SEQ ID NO: 996967 - RNA, 19 nt, Human
gcagcggucucaaacuucc

SEQ ID NO: 996968 - RNA, 26 nt, Human
gccacacccacaacaccuagacauga

SEQ ID NO: 996969 - RNA, 19 nt, Human
gcccaggcuggagugcagu

SEQ ID NO: 996970 - RNA, 24 nt, Human
gcuccuggucucaagccucuugcc

SEQ ID NO: 996971 - RNA, 22 nt, Human
gcuggagugcaguggcuauucg

SEQ ID NO: 996972 - RNA, 22 nt, Human
gggucuugcuauauugcccagg

SEQ ID NO: 996973 - RNA, 22 nt, Human
guaaauacagccaugcaaauaa

SEQ ID NO: 996974 - RNA, 22 nt, Human
guagaagaaaaugucaguguua

SEQ ID NO: 996975 - RNA, 20 nt, Human
uaaaaaaaaaaucaacaaau

SEQ ID NO: 996976 - RNA, 18 nt, Human
uaaaagcugcaagacugc

SEQ ID NO: 996977 - RNA, 19 nt, Human
uaacaaauaacaacaccac

SEQ ID NO: 996978 - RNA, 18 nt, Human
uaacaacaccacaaacag

SEQ ID NO: 996979 - RNA, 20 nt, Human
uaacaacaccacaaacagaa

SEQ ID NO: 996980 - RNA, 22 nt, Human
uaacaacaccacaaacagaaau

SEQ ID NO: 996981 - RNA, 25 nt, Human
uacuuacauuauucacacauauaua

SEQ ID NO: 996982 - RNA, 27 nt, Human
uaguagcugagacuauaaauaguauau

SEQ ID NO: 996983 - RNA, 18 nt, Human
uauauugcccaggcugga

SEQ ID NO: 996984 - RNA, 22 nt, Human
uauauugcccaggcuggagugc

SEQ ID NO: 996985 - RNA, 24 nt, Human
uauauugcccaggcuggagugcag

SEQ ID NO: 996986 - RNA, 20 nt, Human
uaucacacuuacucuaccuu

SEQ ID NO: 996987 - RNA, 22 nt, Human
uauuauagaaaauagucacaga

SEQ ID NO: 996988 - RNA, 19 nt, Human
uauugcccaggcuggagug

SEQ ID NO: 996989 - RNA, 18 nt, Human
uauuuugcaucugcauaa

SEQ ID NO: 996990 - RNA, 19 nt, Human
ucaacugccaaccccccuu

SEQ ID NO: 996991 - RNA, 23 nt, Human
ucaagguuagcucacuacaaaaa

SEQ ID NO: 996992 - RNA, 21 nt, Human
ucacacauauauagacggaau

SEQ ID NO: 996993 - RNA, 21 nt, Human
ucacagacaauuauaaacaca

SEQ ID NO: 996994 - RNA, 23 nt, Human
ucaccaaacagcgugcgaaggaa

SEQ ID NO: 996995 - RNA, 24 nt, Human
ucagugcaguuucaaacauuuuca

SEQ ID NO: 996996 - RNA, 23 nt, Human
ucauccagaacauaaucaacugc

SEQ ID NO: 996997 - RNA, 26 nt, Human
ucauccagaacauaaucaacugccaa

SEQ ID NO: 996998 - RNA, 24 nt, Human
uccaugagaauuuggaaugacagu

SEQ ID NO: 996999 - RNA, 20 nt, Human
uccuacauuuuuaaaagcuc

SEQ ID NO: 997000 - RNA, 24 nt, Human
uccucagcaucuucaaaaauaagu

SEQ ID NO: 997001 - RNA, 22 nt, Human
uccucugccaccgccucccugu

SEQ ID NO: 997002 - RNA, 18 nt, Human
uccuuaagcacauguagc

SEQ ID NO: 997003 - RNA, 22 nt, Human
uccuuagagaucaagguuagcu

SEQ ID NO: 997004 - RNA, 23 nt, Human
ucuugcuauauugcccaggcugg

SEQ ID NO: 997005 - RNA, 24 nt, Human
ucuugcuauauugcccaggcugga

SEQ ID NO: 997006 - RNA, 18 nt, Human
ugaaagaagggagaagag

SEQ ID NO: 997007 - RNA, 21 nt, Human
ugaaagaagggagaagaguaa

SEQ ID NO: 997008 - RNA, 22 nt, Human
ugaagaacacaacccuucccuc

SEQ ID NO: 997009 - RNA, 24 nt, Human
ugaagaccuggaccuggguaguua

SEQ ID NO: 997010 - RNA, 19 nt, Human
ugaauuauauuaacugcac

SEQ ID NO: 997011 - RNA, 24 nt, Human
ugcaaacuuccuucaacagccaca

SEQ ID NO: 997012 - RNA, 20 nt, Human
ugcaagaaaaucugcuguug

SEQ ID NO: 997013 - RNA, 21 nt, Human
ugcagcuuucagugcaguuuc

SEQ ID NO: 997014 - RNA, 19 nt, Human
ugcaugcugacaaugguuu

SEQ ID NO: 997015 - RNA, 18 nt, Human
ugcccaggcuggagugca

SEQ ID NO: 997016 - RNA, 21 nt, Human
ugcccaggcuggagugcagug

SEQ ID NO: 997017 - RNA, 22 nt, Human
ugcccaggcuggagugcagugg

SEQ ID NO: 997018 - RNA, 22 nt, Human
ugccucagccucccuaguagcu

SEQ ID NO: 997019 - RNA, 24 nt, Human
ugccucagccucccuaguagcuga

SEQ ID NO: 997020 - RNA, 25 nt, Human
ugcgaaggaagaccgagggagggaa

SEQ ID NO: 997021 - RNA, 24 nt, Human
ugcuauauugcccaggcuggagug

SEQ ID NO: 997022 - RNA, 25 nt, Human
ugcuauauugcccaggcuggagugc

SEQ ID NO: 997023 - RNA, 23 nt, Human
uggagugcaguggcuauucgcag

SEQ ID NO: 997024 - RNA, 22 nt, Human
uggcucaaaauuccuuaagcac

SEQ ID NO: 997025 - RNA, 21 nt, Human
uggcuccaagucuuacauccu

SEQ ID NO: 997026 - RNA, 24 nt, Human
uggggucuugcuauauugcccagg

SEQ ID NO: 997027 - RNA, 18 nt, Human
ugucugguccacuccccc

SEQ ID NO: 997028 - RNA, 24 nt, Human
uuaaaaaucccuuuaacauguucu

SEQ ID NO: 997029 - RNA, 25 nt, Human
uuaaauaaaccucuccccauccuga

SEQ ID NO: 997030 - RNA, 22 nt, Human
uuaagggguguaaaaaugcucc

SEQ ID NO: 997031 - RNA, 24 nt, Human
uuaauguaaauacagccaugcaaa

SEQ ID NO: 997032 - RNA, 22 nt, Human
uuacauacaagcaaucugcacu

SEQ ID NO: 997033 - RNA, 23 nt, Human
uuagcucacuacaaaaagcacuc

SEQ ID NO: 997034 - RNA, 24 nt, Human
uuagugaccuccucaauauuuucc

SEQ ID NO: 997035 - RNA, 23 nt, Human
uucacacauauauagacggaauc

SEQ ID NO: 997036 - RNA, 21 nt, Human
uugcacagggaauaaaagcug

SEQ ID NO: 997037 - RNA, 24 nt, Human
uugcccaggcuggagugcaguggc

SEQ ID NO: 997038 - RNA, 23 nt, Human
uugugcaugcugacaaugguuua

SEQ ID NO: 997039 - RNA, 27 nt, Human
accaaguguugucuuucuccuccaacu

SEQ ID NO: 997040 - RNA, 19 nt, Human
agauuggggaggcaagugg

SEQ ID NO: 997041 - RNA, 18 nt, Human
cagcgggggcuucuggga

SEQ ID NO: 997042 - RNA, 22 nt, Human
cucuuaauucuggaccaucacc

SEQ ID NO: 997043 - RNA, 18 nt, Human
ggaggcaaguggguguga

SEQ ID NO: 997044 - RNA, 19 nt, Human
gggaggcaaguggguguga

SEQ ID NO: 997045 - RNA, 22 nt, Human
ggggaacauugacagcgggggc

SEQ ID NO: 997046 - RNA, 23 nt, Human
uacacaggagcaagcagggugug

SEQ ID NO: 997047 - RNA, 21 nt, Human
uaucuggaacaauaugcaggg

SEQ ID NO: 997048 - RNA, 20 nt, Human
ucuggaccaucaccugauuc

SEQ ID NO: 997049 - RNA, 22 nt, Human
ugagcagcuuucauuuuuaucu

SEQ ID NO: 997050 - RNA, 24 nt, Human
aaaaaucagggaaaacaugaauaa

SEQ ID NO: 997051 - RNA, 20 nt, Human
accuugugcucaggcuccug

SEQ ID NO: 997052 - RNA, 19 nt, Human
acgcgcuggccgcagggcg

SEQ ID NO: 997053 - RNA, 18 nt, Human
acuacuugaggaccaaca

SEQ ID NO: 997054 - RNA, 21 nt, Human
agacauuuuaaagcaaaaucc

SEQ ID NO: 997055 - RNA, 19 nt, Human
agcagaauucuucagguac

SEQ ID NO: 997056 - RNA, 21 nt, Human
agcuuuaaaaaaacauuugga

SEQ ID NO: 997057 - RNA, 25 nt, Human
auaaaaaucagggaaaacaugaaua

SEQ ID NO: 997058 - RNA, 18 nt, Human
auacauauacauauauac

SEQ ID NO: 997059 - RNA, 19 nt, Human
auauacauauauacacaca

SEQ ID NO: 997060 - RNA, 26 nt, Human
cauauacauauauacacacauauuua

SEQ ID NO: 997061 - RNA, 23 nt, Human
cauauauacacacauauuuauag

SEQ ID NO: 997062 - RNA, 23 nt, Human
cauuaccuugcuaaaauuuccac

SEQ ID NO: 997063 - RNA, 24 nt, Human
ccacuaagcuacagcuucagauau

SEQ ID NO: 997064 - RNA, 20 nt, Human
ccucggggucuccgggcggc

SEQ ID NO: 997065 - RNA, 20 nt, Human
cuacccaaaucuaucacagu

SEQ ID NO: 997066 - RNA, 18 nt, Human
cuagcugaggaguuguau

SEQ ID NO: 997067 - RNA, 24 nt, Human
gagucgggggacgcgcuggccgca

SEQ ID NO: 997068 - RNA, 21 nt, Human
gccucggggucuccgggcggc

SEQ ID NO: 997069 - RNA, 19 nt, Human
ggaauucuuuuauggacuc

SEQ ID NO: 997070 - RNA, 18 nt, Human
gggcgguggcuggggucg

SEQ ID NO: 997071 - RNA, 21 nt, Human
gggcgguggcuggggucgggc

SEQ ID NO: 997072 - RNA, 18 nt, Human
guaacuuuuuauuaagaa

SEQ ID NO: 997073 - RNA, 18 nt, Human
uaaggcagacauuuuaaa

SEQ ID NO: 997074 - RNA, 23 nt, Human
uaaucugaagauauucuucugau

SEQ ID NO: 997075 - RNA, 21 nt, Human
uacaaacauacauauacauau

SEQ ID NO: 997076 - RNA, 19 nt, Human
uacacacauauuuauagcc

SEQ ID NO: 997077 - RNA, 20 nt, Human
uauugucacauuuuccaagu

SEQ ID NO: 997078 - RNA, 21 nt, Human
ucugaagauauucuucugauu

SEQ ID NO: 997079 - RNA, 20 nt, Human
ucuggacauuucugaacucg

SEQ ID NO: 997080 - RNA, 19 nt, Human
ucuuuuauggacucgagag

SEQ ID NO: 997081 - RNA, 22 nt, Human
ugaggaguuguauuuuguuguu

SEQ ID NO: 997082 - RNA, 18 nt, Human
uggcuggggucgggcgcc

SEQ ID NO: 997083 - RNA, 24 nt, Human
uguaaggcagacauuuuaaagcaa

SEQ ID NO: 997084 - RNA, 20 nt, Human
uuaaagcaaaauccauuacc

SEQ ID NO: 997085 - RNA, 18 nt, Human
uuggagccucggggucuc

SEQ ID NO: 997086 - RNA, 24 nt, Human
uuuguacaaacauacauauacaua

SEQ ID NO: 997087 - RNA, 19 nt, Human
aagcaaaaaccaaagaucu

SEQ ID NO: 997088 - RNA, 25 nt, Human
aagcaaaaaccaaagaucugaggag

SEQ ID NO: 997089 - RNA, 23 nt, Human
aagcauauuucauauuagaaaua

SEQ ID NO: 997090 - RNA, 26 nt, Human
aaguaccucuucaaaauugguccccu

SEQ ID NO: 997091 - RNA, 23 nt, Human
acaauuccaagugcuuauagcca

SEQ ID NO: 997092 - RNA, 18 nt, Human
agcaccaacacauacgcc

SEQ ID NO: 997093 - RNA, 23 nt, Human
auaaauuaaagcaaaaaccaaag

SEQ ID NO: 997094 - RNA, 19 nt, Human
caguauggaaaauacauuu

SEQ ID NO: 997095 - RNA, 21 nt, Human
caguccagagucucaccgccu

SEQ ID NO: 997096 - RNA, 20 nt, Human
ccaacacauacgcccggcag

SEQ ID NO: 997097 - RNA, 22 nt, Human
cccugcagcugccucuagcacc

SEQ ID NO: 997098 - RNA, 18 nt, Human
ccugcagcugccucuagc

SEQ ID NO: 997099 - RNA, 19 nt, Human
cucucaguccagagucuca

SEQ ID NO: 997100 - RNA, 20 nt, Human
uaaagcaaaaaccaaagauc

SEQ ID NO: 997101 - RNA, 20 nt, Human
uaacaagaaacuaugguccu

SEQ ID NO: 997102 - RNA, 27 nt, Human
uaacaagaaacuaugguccucaaauau

SEQ ID NO: 997103 - RNA, 27 nt, Human
uaagucagcaugagcaguaucaaagua

SEQ ID NO: 997104 - RNA, 22 nt, Human
uacaaauuaauaaauuuuaaac

SEQ ID NO: 997105 - RNA, 24 nt, Human
uacagaaaacccaguacaauucca

SEQ ID NO: 997106 - RNA, 20 nt, Human
uacgcaagccacacuucagc

SEQ ID NO: 997107 - RNA, 24 nt, Human
uaguuucuaaaacuuuacagaaaa

SEQ ID NO: 997108 - RNA, 24 nt, Human
uauuucauauuagaaauaguuauc

SEQ ID NO: 997109 - RNA, 18 nt, Human
ucaccgccuggaaggaaa

SEQ ID NO: 997110 - RNA, 24 nt, Human
ucaguagauccauuaaaauauaga

SEQ ID NO: 997111 - RNA, 23 nt, Human
ucgaacccuccuggcuuucaaaa

SEQ ID NO: 997112 - RNA, 21 nt, Human
ucugguacccaaaguguccuu

SEQ ID NO: 997113 - RNA, 19 nt, Human
ugaaagccacucucagucc

SEQ ID NO: 997114 - RNA, 23 nt, Human
ugaggagauccaagagaucaaga

SEQ ID NO: 997115 - RNA, 20 nt, Human
uggaaaauacauuuaauaaa

SEQ ID NO: 997116 - RNA, 19 nt, Human
uggaaggaaaggucggagg

SEQ ID NO: 997117 - RNA, 18 nt, Human
uggucccgagcggccccc

SEQ ID NO: 997118 - RNA, 18 nt, Human
uguaaccagagucugaag

SEQ ID NO: 997119 - RNA, 19 nt, Human
uguagcuaguuucuaaaac

SEQ ID NO: 997120 - RNA, 26 nt, Human
uuaaagcaaaaaccaaagaucugagg

SEQ ID NO: 997121 - RNA, 19 nt, Human
uucauauuagaaauaguua

SEQ ID NO: 997122 - RNA, 22 nt, Human
uuuuacugcuaguguuuuaagu

SEQ ID NO: 997123 - RNA, 18 nt, Human
uuuuuuuuuuuuuuucug

SEQ ID NO: 997124 - RNA, 18 nt, Human
uuuuuuuuuuuuuuucug

SEQ ID NO: 997125 - RNA, 21 nt, Human
aaaaagauucuauacccaaaa

SEQ ID NO: 997126 - RNA, 20 nt, Human
aaacaggcaaaaccccaaag

SEQ ID NO: 997127 - RNA, 20 nt, Human
aaacaggcaaaaccccaaag

SEQ ID NO: 997128 - RNA, 23 nt, Human
aaaccccaaagcggucuucaggg

SEQ ID NO: 997129 - RNA, 21 nt, Human
aacaagcaucucaccauggga

SEQ ID NO: 997130 - RNA, 23 nt, Human
aagaacgagacagagcaaaagga

SEQ ID NO: 997131 - RNA, 21 nt, Human
aagcaucucaccaugggaacc

SEQ ID NO: 997132 - RNA, 19 nt, Human
aaggccccaccccccccca

SEQ ID NO: 997133 - RNA, 20 nt, Human
aaucuugucuucucucgacc

SEQ ID NO: 997134 - RNA, 21 nt, Human
acccccccccacacacacaca

SEQ ID NO: 997135 - RNA, 24 nt, Human
acggagugagaccucuucucaaaa

SEQ ID NO: 997136 - RNA, 21 nt, Human
acgucccagggaucagggcag

SEQ ID NO: 997137 - RNA, 18 nt, Human
acugcacuccagcuugga

SEQ ID NO: 997138 - RNA, 24 nt, Human
acugcacuccagcuuggaugacgg

SEQ ID NO: 997139 - RNA, 18 nt, Human
agaaccacccagugcccc

SEQ ID NO: 997140 - RNA, 19 nt, Human
agaaccacccagugccccc

SEQ ID NO: 997141 - RNA, 18 nt, Human
agcggagguugcagugag

SEQ ID NO: 997142 - RNA, 23 nt, Human
agcggagguugcagugaguugag

SEQ ID NO: 997143 - RNA, 21 nt, Human
agcugggcacaguggcucaug

SEQ ID NO: 997144 - RNA, 24 nt, Human
agcuuggaugacggagugagaccu

SEQ ID NO: 997145 - RNA, 18 nt, Human
aggcaaaaccccaaagcg

SEQ ID NO: 997146 - RNA, 19 nt, Human
aggcaaggccucuggcgug

SEQ ID NO: 997147 - RNA, 22 nt, Human
aggcaugagaaucacucaaacc

SEQ ID NO: 997148 - RNA, 20 nt, Human
aggugcaaacaggcaaaacc

SEQ ID NO: 997149 - RNA, 23 nt, Human
aguggcucaugccuguaauccca

SEQ ID NO: 997150 - RNA, 24 nt, Human
aguggcucaugccuguaaucccag

SEQ ID NO: 997151 - RNA, 26 nt, Human
auccacgguugugaccauguauuacc

SEQ ID NO: 997152 - RNA, 24 nt, Human
augagaacacagugccccgcagcc

SEQ ID NO: 997153 - RNA, 24 nt, Human
auugcaccacugcacuccagcuug

SEQ ID NO: 997154 - RNA, 19 nt, Human
caagagugcucggcgggca

SEQ ID NO: 997155 - RNA, 22 nt, Human
cacccagugccccccagccugc

SEQ ID NO: 997156 - RNA, 19 nt, Human
cacccccccccacacacac

SEQ ID NO: 997157 - RNA, 24 nt, Human
cacccccccccacacacacacaca

SEQ ID NO: 997158 - RNA, 28 nt, Human
cacccccccccacacacacacacagguc

SEQ ID NO: 997159 - RNA, 22 nt, Human
caccuccagccccgauuuuaac

SEQ ID NO: 997160 - RNA, 22 nt, Human
cacuccagcuuggaugacggag

SEQ ID NO: 997161 - RNA, 22 nt, Human
cacuccagcuuggaugacggag

SEQ ID NO: 997162 - RNA, 24 nt, Human
cacuccagcuuggaugacggagug

SEQ ID NO: 997163 - RNA, 18 nt, Human
cacugcacuccagcuugg

SEQ ID NO: 997164 - RNA, 19 nt, Human
cacugcacuccagcuugga

SEQ ID NO: 997165 - RNA, 19 nt, Human
cacugcacuccagcuugga

SEQ ID NO: 997166 - RNA, 22 nt, Human
cacugcacuccagcuuggauga

SEQ ID NO: 997167 - RNA, 19 nt, Human
cagcccggugcugccacaa

SEQ ID NO: 997168 - RNA, 23 nt, Human
cauauuuauugccucacuguaaa

SEQ ID NO: 997169 - RNA, 19 nt, Human
caucauuuaagaucaucaa

SEQ ID NO: 997170 - RNA, 18 nt, Human
ccaaaagucuaaggugca

SEQ ID NO: 997171 - RNA, 20 nt, Human
ccacacacacacacagguca

SEQ ID NO: 997172 - RNA, 20 nt, Human
ccacccccccccacacacac

SEQ ID NO: 997173 - RNA, 21 nt, Human
ccacccccccccacacacaca

SEQ ID NO: 997174 - RNA, 19 nt, Human
ccacugcacuccagcuugg

SEQ ID NO: 997175 - RNA, 21 nt, Human
ccacugcacuccagcuuggau

SEQ ID NO: 997176 - RNA, 24 nt, Human
ccacugcacuccagcuuggaugac

SEQ ID NO: 997177 - RNA, 19 nt, Human
ccaggcgccccgcggccaa

SEQ ID NO: 997178 - RNA, 19 nt, Human
ccagggcuguauuagcagc

SEQ ID NO: 997179 - RNA, 23 nt, Human
cccaaaagucuaaggugcaaaca

SEQ ID NO: 997180 - RNA, 24 nt, Human
cccacacacacacacaggucagcu

SEQ ID NO: 997181 - RNA, 24 nt, Human
cccagcugggcacaguggcucaug

SEQ ID NO: 997182 - RNA, 24 nt, Human
cccagcugucuccuaccccaucug

SEQ ID NO: 997183 - RNA, 18 nt, Human
cccaugucauccuuccag

SEQ ID NO: 997184 - RNA, 27 nt, Human
ccccagccugcagcaagucccuggacu

SEQ ID NO: 997185 - RNA, 20 nt, Human
cccccacacacacacacagg

SEQ ID NO: 997186 - RNA, 21 nt, Human
cccccagccugcagcaagucc

SEQ ID NO: 997187 - RNA, 19 nt, Human
ccccccacacacacacaca

SEQ ID NO: 997188 - RNA, 28 nt, Human
ccccccacacacacacacaggucaggau

SEQ ID NO: 997189 - RNA, 25 nt, Human
cccgcagaagccacugagccaggcg

SEQ ID NO: 997190 - RNA, 19 nt, Human
ccgggagcggagguugcag

SEQ ID NO: 997191 - RNA, 21 nt, Human
ccucccagcugucuccuaccc

SEQ ID NO: 997192 - RNA, 19 nt, Human
ccuguaaucccagcuacuc

SEQ ID NO: 997193 - RNA, 21 nt, Human
ccuguaaucccagcuacucgg

SEQ ID NO: 997194 - RNA, 23 nt, Human
cgggagcggagguugcagugagu

SEQ ID NO: 997195 - RNA, 18 nt, Human
cuauaucccagcugggca

SEQ ID NO: 997196 - RNA, 21 nt, Human
cucaugccuguaaucccagcu

SEQ ID NO: 997197 - RNA, 21 nt, Human
cuccagcuuggaugacggagu

SEQ ID NO: 997198 - RNA, 21 nt, Human
cucuucucaaaaaaaagauuc

SEQ ID NO: 997199 - RNA, 23 nt, Human
cuuccagaacaagcacauccuag

SEQ ID NO: 997200 - RNA, 19 nt, Human
gaaggccccaccccccccc

SEQ ID NO: 997201 - RNA, 22 nt, Human
gaaggggauuuuuaaaaguuca

SEQ ID NO: 997202 - RNA, 24 nt, Human
gaccugccacuuuagacugaccuu

SEQ ID NO: 997203 - RNA, 24 nt, Human
gacggagugagaccucuucucaaa

SEQ ID NO: 997204 - RNA, 19 nt, Human
gagaaaaucuugucuucuc

SEQ ID NO: 997205 - RNA, 19 nt, Human
gagaaccacccagugcccc

SEQ ID NO: 997206 - RNA, 23 nt, Human
gagacagauacaaugauucacac

SEQ ID NO: 997207 - RNA, 20 nt, Human
gagcggagguugcagugagu

SEQ ID NO: 997208 - RNA, 24 nt, Human
gagguugcagugaguugaggauug

SEQ ID NO: 997209 - RNA, 24 nt, Human
gcacguuguugugucugcagcugu

SEQ ID NO: 997210 - RNA, 24 nt, Human
gcacuccagcuuggaugacggagu

SEQ ID NO: 997211 - RNA, 24 nt, Human
gccccacccccccccacacacaca

SEQ ID NO: 997212 - RNA, 18 nt, Human
gccccgcggccaagcggc

SEQ ID NO: 997213 - RNA, 19 nt, Human
gcuggaagcuaagucucac

SEQ ID NO: 997214 - RNA, 18 nt, Human
ggagguugcagugaguug

SEQ ID NO: 997215 - RNA, 20 nt, Human
ggagguugcagugaguugag

SEQ ID NO: 997216 - RNA, 25 nt, Human
ggagguugcagugaguugaggauug

SEQ ID NO: 997217 - RNA, 22 nt, Human
ggauugcaccacugcacuccag

SEQ ID NO: 997218 - RNA, 21 nt, Human
ggcuggaagcuaagucucacg

SEQ ID NO: 997219 - RNA, 23 nt, Human
gggaggcugaggcaugagaauca

SEQ ID NO: 997220 - RNA, 18 nt, Human
gggcacaguggcucaugc

SEQ ID NO: 997221 - RNA, 24 nt, Human
gggcacaguggcucaugccuguaa

SEQ ID NO: 997222 - RNA, 24 nt, Human
gguggcaaacauauuuauugccuc

SEQ ID NO: 997223 - RNA, 19 nt, Human
gugaaggccccaccccccc

SEQ ID NO: 997224 - RNA, 23 nt, Human
gugaaggccccacccccccccac

SEQ ID NO: 997225 - RNA, 26 nt, Human
uaaaauaagcaacguccuauacuucc

SEQ ID NO: 997226 - RNA, 22 nt, Human
uaaagaacgagacagagcaaaa

SEQ ID NO: 997227 - RNA, 23 nt, Human
uaagaguaucugagaaaggacua

SEQ ID NO: 997228 - RNA, 21 nt, Human
uaagcaacguccuauacuucc

SEQ ID NO: 997229 - RNA, 20 nt, Human
uaggauuucaaaugguucua

SEQ ID NO: 997230 - RNA, 20 nt, Human
ucacuguaaauagagaaaau

SEQ ID NO: 997231 - RNA, 20 nt, Human
ucaugccuguaaucccagcu

SEQ ID NO: 997232 - RNA, 24 nt, Human
uccagcuuggaugacggagugaga

SEQ ID NO: 997233 - RNA, 18 nt, Human
ucccagggaucagggcag

SEQ ID NO: 997234 - RNA, 19 nt, Human
ucccagggaucagggcagu

SEQ ID NO: 997235 - RNA, 21 nt, Human
ucccuggacuccuuuaguugu

SEQ ID NO: 997236 - RNA, 23 nt, Human
uccggucagacaccgucugcacc

SEQ ID NO: 997237 - RNA, 21 nt, Human
ucgaagcccgcagaagccacu

SEQ ID NO: 997238 - RNA, 25 nt, Human
ucgggaggcugaggcaugagaauca

SEQ ID NO: 997239 - RNA, 21 nt, Human
ucuaugauauaugguuggggg

SEQ ID NO: 997240 - RNA, 22 nt, Human
ucuucaggguucuucugaaagg

SEQ ID NO: 997241 - RNA, 21 nt, Human
ugagauauggcacaaggcagg

SEQ ID NO: 997242 - RNA, 21 nt, Human
ugagccaggcgccccgcggcc

SEQ ID NO: 997243 - RNA, 19 nt, Human
ugaggcaugagaaucacuc

SEQ ID NO: 997244 - RNA, 24 nt, Human
ugaggcaugagaaucacucaaacc

SEQ ID NO: 997245 - RNA, 20 nt, Human
ugaggcgcgggugcuguggg

SEQ ID NO: 997246 - RNA, 22 nt, Human
ugcaaacaggcaaaaccccaaa

SEQ ID NO: 997247 - RNA, 22 nt, Human
ugcaccacugcacuccagcuug

SEQ ID NO: 997248 - RNA, 18 nt, Human
ugcacguuguugugucug

SEQ ID NO: 997249 - RNA, 24 nt, Human
ugccuguaaucccagcuacucggg

SEQ ID NO: 997250 - RNA, 25 nt, Human
ugcuaaaugacaaaugcgcgcaaua

SEQ ID NO: 997251 - RNA, 21 nt, Human
uggcucaugccuguaauccca

SEQ ID NO: 997252 - RNA, 22 nt, Human
uggcucaugccuguaaucccag

SEQ ID NO: 997253 - RNA, 23 nt, Human
uguaaaaaaugcugcacguuguu

SEQ ID NO: 997254 - RNA, 23 nt, Human
uguguaaagaacgagacagagca

SEQ ID NO: 997255 - RNA, 19 nt, Human
ugugucugcagcugugcug

SEQ ID NO: 997256 - RNA, 23 nt, Human
uuaauucuaccauauuuuuaugu

SEQ ID NO: 997257 - RNA, 21 nt, Human
uuaggugaaggccccaccccc

SEQ ID NO: 997258 - RNA, 21 nt, Human
uucucaaaaaaaagauucuau

SEQ ID NO: 997259 - RNA, 23 nt, Human
uugcagugaguugaggauugcac

SEQ ID NO: 997260 - RNA, 19 nt, Human
uugcuaaaugacaaaugcg

SEQ ID NO: 997261 - RNA, 22 nt, Human
uuguguccuucccuuguuuuaa

SEQ ID NO: 997262 - RNA, 22 nt, Human
uuguucagucugggcccauguc

SEQ ID NO: 997263 - RNA, 22 nt, Human
uuguugugucugcagcugugcu

SEQ ID NO: 997264 - RNA, 21 nt, Human
aaacaucuaaaaccaggccca

SEQ ID NO: 997265 - RNA, 23 nt, Human
aagaaggcgauucgggaggccac

SEQ ID NO: 997266 - RNA, 22 nt, Human
aagcagagacagaggcucagag

SEQ ID NO: 997267 - RNA, 22 nt, Human
aagccaggcucagaacugccgg

SEQ ID NO: 997268 - RNA, 19 nt, Human
accggcuccagcuccugca

SEQ ID NO: 997269 - RNA, 19 nt, Human
accucaucccuuggcucca

SEQ ID NO: 997270 - RNA, 22 nt, Human
acgcagugccggacguggugcc

SEQ ID NO: 997271 - RNA, 26 nt, Human
acuaaaggacaagaacucuguuccua

SEQ ID NO: 997272 - RNA, 18 nt, Human
agaagccaucugcaggaa

SEQ ID NO: 997273 - RNA, 21 nt, Human
agacucagaugaggacuagcg

SEQ ID NO: 997274 - RNA, 26 nt, Human
agaggaagaaggcgauucgggaggcc

SEQ ID NO: 997275 - RNA, 24 nt, Human
agccggccccaaacccccaggggc

SEQ ID NO: 997276 - RNA, 21 nt, Human
agcugaguuuauuauacuugu

SEQ ID NO: 997277 - RNA, 24 nt, Human
aggcggagccaugcugccugagga

SEQ ID NO: 997278 - RNA, 21 nt, Human
aggcugcagggggaggucaag

SEQ ID NO: 997279 - RNA, 20 nt, Human
agguucuggggugaccaggg

SEQ ID NO: 997280 - RNA, 21 nt, Human
agguucuggggugaccagggg

SEQ ID NO: 997281 - RNA, 25 nt, Human
auaggaacauggcucagugcgggga

SEQ ID NO: 997282 - RNA, 21 nt, Human
caaagccaggcucagaacugc

SEQ ID NO: 997283 - RNA, 24 nt, Human
caacuccacugaaaacgcuccacu

SEQ ID NO: 997284 - RNA, 22 nt, Human
cacaaagcugggagugccaaag

SEQ ID NO: 997285 - RNA, 22 nt, Human
cacagccuggacaaccucaucc

SEQ ID NO: 997286 - RNA, 20 nt, Human
caccacaaaagagggaaaac

SEQ ID NO: 997287 - RNA, 23 nt, Human
cacugaaaacgcuccacuucccc

SEQ ID NO: 997288 - RNA, 21 nt, Human
cagaggcucagagaggcggag

SEQ ID NO: 997289 - RNA, 23 nt, Human
cagccuggacaaccucaucccuu

SEQ ID NO: 997290 - RNA, 23 nt, Human
cagcuccugcaggaggaucuccu

SEQ ID NO: 997291 - RNA, 22 nt, Human
ccacccguguugcuaaaaccau

SEQ ID NO: 997292 - RNA, 25 nt, Human
ccagcucguugagcacgcagugccg

SEQ ID NO: 997293 - RNA, 22 nt, Human
cccaaacccccaggggcaggag

SEQ ID NO: 997294 - RNA, 20 nt, Human
ccccuggguguggggugaag

SEQ ID NO: 997295 - RNA, 25 nt, Human
cccgaccaaggaggcaaggggcaag

SEQ ID NO: 997296 - RNA, 24 nt, Human
cccguguugcuaaaaccauggggg

SEQ ID NO: 997297 - RNA, 19 nt, Human
ccgacacuccguucaucuc

SEQ ID NO: 997298 - RNA, 19 nt, Human
ccggacguggugccgcugg

SEQ ID NO: 997299 - RNA, 25 nt, Human
ccggccccaaacccccaggggcagg

SEQ ID NO: 997300 - RNA, 20 nt, Human
ccuccaaugccaccugguug

SEQ ID NO: 997301 - RNA, 19 nt, Human
cgcggucccgccggcugcg

SEQ ID NO: 997302 - RNA, 18 nt, Human
cgcuccacuucccccucc

SEQ ID NO: 997303 - RNA, 19 nt, Human
cgggagggggcugcugagc

SEQ ID NO: 997304 - RNA, 18 nt, Human
cuaaaaccaugggggacc

SEQ ID NO: 997305 - RNA, 19 nt, Human
cuaaaaccaugggggaccc

SEQ ID NO: 997306 - RNA, 18 nt, Human
cucaacugacuuucccuc

SEQ ID NO: 997307 - RNA, 19 nt, Human
cucaucccuuggcuccagg

SEQ ID NO: 997308 - RNA, 18 nt, Human
cuccacuucccccuccau

SEQ ID NO: 997309 - RNA, 21 nt, Human
cuccaggcccagcugggccag

SEQ ID NO: 997310 - RNA, 25 nt, Human
cugaaaacgcuccacuucccccucc

SEQ ID NO: 997311 - RNA, 20 nt, Human
cugaacuuccaggaaggcau

SEQ ID NO: 997312 - RNA, 19 nt, Human
cugagcccagaauuugcug

SEQ ID NO: 997313 - RNA, 21 nt, Human
cugcagggggaggucaaggcu

SEQ ID NO: 997314 - RNA, 23 nt, Human
cugcugagccagacucacggugc

SEQ ID NO: 997315 - RNA, 20 nt, Human
cuucccccuccauggugucc

SEQ ID NO: 997316 - RNA, 27 nt, Human
gacccaggcugagacucagaugaggac

SEQ ID NO: 997317 - RNA, 18 nt, Human
gacccucgcuuccccgcu

SEQ ID NO: 997318 - RNA, 24 nt, Human
gacccucgcuuccccgcugccacc

SEQ ID NO: 997319 - RNA, 21 nt, Human
gagccaacuccacugaaaacg

SEQ ID NO: 997320 - RNA, 23 nt, Human
gaggacaccacucagagagucag

SEQ ID NO: 997321 - RNA, 20 nt, Human
gccaggcucagaacugccgg

SEQ ID NO: 997322 - RNA, 19 nt, Human
gcccgaguuugagaagcca

SEQ ID NO: 997323 - RNA, 19 nt, Human
gcuccacuucccccuccau

SEQ ID NO: 997324 - RNA, 18 nt, Human
ggacccucgcuuccccgc

SEQ ID NO: 997325 - RNA, 19 nt, Human
ggacguggugccgcuggag

SEQ ID NO: 997326 - RNA, 18 nt, Human
ggagaagccggccccaaa

SEQ ID NO: 997327 - RNA, 18 nt, Human
ggaggucaaggcucagug

SEQ ID NO: 997328 - RNA, 19 nt, Human
ggccacggucuugcagccg

SEQ ID NO: 997329 - RNA, 19 nt, Human
ggccccaaacccccagggg

SEQ ID NO: 997330 - RNA, 26 nt, Human
ggccccuggccuuuccugcauggccu

SEQ ID NO: 997331 - RNA, 19 nt, Human
ggcgcucuuccaugaugcc

SEQ ID NO: 997332 - RNA, 19 nt, Human
ggcggagccaugcugccug

SEQ ID NO: 997333 - RNA, 18 nt, Human
ggcucagugcggggagga

SEQ ID NO: 997334 - RNA, 18 nt, Human
gggagggggcugcugagc

SEQ ID NO: 997335 - RNA, 25 nt, Human
gggagugccaaagccaggcucagaa

SEQ ID NO: 997336 - RNA, 25 nt, Human
gggcaucauuauuggccccgcuguu

SEQ ID NO: 997337 - RNA, 19 nt, Human
ggggaggggacuuugugcu

SEQ ID NO: 997338 - RNA, 22 nt, Human
ggggaggucaaggcucagugag

SEQ ID NO: 997339 - RNA, 21 nt, Human
ggggugaagccgcccgggagg

SEQ ID NO: 997340 - RNA, 24 nt, Human
ggugccgcuggagcgggaggaagg

SEQ ID NO: 997341 - RNA, 20 nt, Human
ggugugggguggaggggagg

SEQ ID NO: 997342 - RNA, 21 nt, Human
ggugugggguggaggggagga

SEQ ID NO: 997343 - RNA, 21 nt, Human
gugccaaagccaggcucagaa

SEQ ID NO: 997344 - RNA, 18 nt, Human
guggccuagccgacacuc

SEQ ID NO: 997345 - RNA, 18 nt, Human
guggugcuguccagcaca

SEQ ID NO: 997346 - RNA, 23 nt, Human
uaaaaacaucuaaaaccaggccc

SEQ ID NO: 997347 - RNA, 23 nt, Human
uaaaaacaucuaaaaccaggccc

SEQ ID NO: 997348 - RNA, 19 nt, Human
uagcgcagggcaggauugg

SEQ ID NO: 997349 - RNA, 18 nt, Human
ucaaaaagacugagccca

SEQ ID NO: 997350 - RNA, 18 nt, Human
ucaggggcuguaaggcuc

SEQ ID NO: 997351 - RNA, 22 nt, Human
ucccaggccuguguccuccuca

SEQ ID NO: 997352 - RNA, 23 nt, Human
ucccucagccaccuucugggugu

SEQ ID NO: 997353 - RNA, 24 nt, Human
ucgcggucccgccggcugcgccac

SEQ ID NO: 997354 - RNA, 24 nt, Human
ugaaaacgcuccacuucccccucc

SEQ ID NO: 997355 - RNA, 18 nt, Human
ugacauaggaacauggcu

SEQ ID NO: 997356 - RNA, 19 nt, Human
ugaccagggguuucccugg

SEQ ID NO: 997357 - RNA, 22 nt, Human
ugagaagccaucugcaggaagg

SEQ ID NO: 997358 - RNA, 20 nt, Human
ugagaauguccaaagggaaa

SEQ ID NO: 997359 - RNA, 23 nt, Human
ugagguucuggggugaccagggg

SEQ ID NO: 997360 - RNA, 23 nt, Human
ugaguuauaauucacaguaagaa

SEQ ID NO: 997361 - RNA, 24 nt, Human
ugcccgaccaaggaggcaaggggc

SEQ ID NO: 997362 - RNA, 20 nt, Human
ugccgcuggagcgggaggaa

SEQ ID NO: 997363 - RNA, 19 nt, Human
uggagcgggaggaagggca

SEQ ID NO: 997364 - RNA, 24 nt, Human
uggagcgggaggaagggcaccacu

SEQ ID NO: 997365 - RNA, 19 nt, Human
uggccccuguaauucaccu

SEQ ID NO: 997366 - RNA, 19 nt, Human
uggccucaguucccucagc

SEQ ID NO: 997367 - RNA, 18 nt, Human
ugggguggaggggaggag

SEQ ID NO: 997368 - RNA, 25 nt, Human
uuaaaaacaucuaaaaccaggccca

SEQ ID NO: 997369 - RNA, 21 nt, Human
uuccuauuuuucccaggccug

SEQ ID NO: 997370 - RNA, 24 nt, Human
uuccugcauggccuggccaucagg

SEQ ID NO: 997371 - RNA, 21 nt, Human
uucuggaaacugagaaggcuc

SEQ ID NO: 997372 - RNA, 24 nt, Human
uugcagccguuggaggagaagagc

SEQ ID NO: 997373 - RNA, 25 nt, Human
uugcagccguuggaggagaagagcu

SEQ ID NO: 997374 - RNA, 21 nt, Human
uuggacccucgcuuccccgcu

SEQ ID NO: 997375 - RNA, 23 nt, Human
uuggcuccaggcccagcugggcc

SEQ ID NO: 997376 - RNA, 19 nt, Human
aaagagauuucuagccccc

SEQ ID NO: 997377 - RNA, 20 nt, Human
aacaacccuguggucaaaga

SEQ ID NO: 997378 - RNA, 18 nt, Human
aacucagagcaagagccu

SEQ ID NO: 997379 - RNA, 19 nt, Human
acgcugcuuacucaggaac

SEQ ID NO: 997380 - RNA, 27 nt, Human
acucagagcaagagccuucuccuacgg

SEQ ID NO: 997381 - RNA, 21 nt, Human
aguuugguuuaucaucacauc

SEQ ID NO: 997382 - RNA, 22 nt, Human
cagagccaugcucagggcacag

SEQ ID NO: 997383 - RNA, 23 nt, Human
cagcuuaccugucaacuacaggg

SEQ ID NO: 997384 - RNA, 21 nt, Human
cauaacucagagcaagagccu

SEQ ID NO: 997385 - RNA, 21 nt, Human
caugcucagggcacagauaga

SEQ ID NO: 997386 - RNA, 18 nt, Human
ccaaggugugcaagacga

SEQ ID NO: 997387 - RNA, 26 nt, Human
cccaacccugggaaggaugcccgaga

SEQ ID NO: 997388 - RNA, 19 nt, Human
cccccacgaggaacaaagc

SEQ ID NO: 997389 - RNA, 20 nt, Human
ccccuagagagggggaugga

SEQ ID NO: 997390 - RNA, 20 nt, Human
ccucugccccagccugaugc

SEQ ID NO: 997391 - RNA, 22 nt, Human
ccuguggucaaagacauggaag

SEQ ID NO: 997392 - RNA, 22 nt, Human
cuagagccugggcagcaacaac

SEQ ID NO: 997393 - RNA, 23 nt, Human
cuauuuguguaagacccaacccu

SEQ ID NO: 997394 - RNA, 21 nt, Human
cuccuuggcaccacaguccga

SEQ ID NO: 997395 - RNA, 22 nt, Human
cugcaaaucccacagucuguuc

SEQ ID NO: 997396 - RNA, 24 nt, Human
cuggaaagagauuucuagccccca

SEQ ID NO: 997397 - RNA, 24 nt, Human
gacaauagcuaugccucugccccc

SEQ ID NO: 997398 - RNA, 19 nt, Human
gagauuucuagcccccacg

SEQ ID NO: 997399 - RNA, 19 nt, Human
gcccccacgaggaacaaag

SEQ ID NO: 997400 - RNA, 21 nt, Human
gccugggguugggggauagcu

SEQ ID NO: 997401 - RNA, 18 nt, Human
ggaugggagucgagaugg

SEQ ID NO: 997402 - RNA, 18 nt, Human
ggcaugggaagugaugag

SEQ ID NO: 997403 - RNA, 23 nt, Human
gggcucugagaacacaugaagca

SEQ ID NO: 997404 - RNA, 21 nt, Human
uaacucagagcaagagccuuc

SEQ ID NO: 997405 - RNA, 23 nt, Human
uaacucagagcaagagccuucua

SEQ ID NO: 997406 - RNA, 21 nt, Human
uaauaaguuugguuuaucauc

SEQ ID NO: 997407 - RNA, 21 nt, Human
uaccagaccccugcuuagucc

SEQ ID NO: 997408 - RNA, 24 nt, Human
ucacuagcaagugcuaacauuugg

SEQ ID NO: 997409 - RNA, 18 nt, Human
ucagcagauagaugagac

SEQ ID NO: 997410 - RNA, 18 nt, Human
ucaucacaucaagauaaa

SEQ ID NO: 997411 - RNA, 22 nt, Human
uccaagagccccuagagagggg

SEQ ID NO: 997412 - RNA, 22 nt, Human
ucuagagugcaagguccaucca

SEQ ID NO: 997413 - RNA, 22 nt, Human
ucuagcccccacgaggaacaaa

SEQ ID NO: 997414 - RNA, 28 nt, Human
ucuagcccccacgaggaaccgggugucc

SEQ ID NO: 997415 - RNA, 21 nt, Human
ugcaagacgaccugggggcag

SEQ ID NO: 997416 - RNA, 25 nt, Human
uggaagaaacacucugcaaauccca

SEQ ID NO: 997417 - RNA, 27 nt, Human
uggaagaaacacucugcaaaucccacu

SEQ ID NO: 997418 - RNA, 20 nt, Human
ugggaaggaugcccgagaca

SEQ ID NO: 997419 - RNA, 24 nt, Human
ugggguugggggauagcuggggag

SEQ ID NO: 997420 - RNA, 19 nt, Human
uucacaaucuggaacugga

SEQ ID NO: 997421 - RNA, 20 nt, Human
uugacgaugaggaaauccuc

SEQ ID NO: 997422 - RNA, 20 nt, Human
uuuuuuuuuuuuuuuuuugg

SEQ ID NO: 997423 - RNA, 23 nt, Human
aaaaaaaaaagcucauaaaaugc

SEQ ID NO: 997424 - RNA, 19 nt, Human
aaaaaaacacacacgcaau

SEQ ID NO: 997425 - RNA, 25 nt, Human
aaaaaauuccccacccaaucaacca

SEQ ID NO: 997426 - RNA, 25 nt, Human
aaaaaauuccccacccaaucaacca

SEQ ID NO: 997427 - RNA, 23 nt, Human
aaaaauuccccacccaaucaacc

SEQ ID NO: 997428 - RNA, 23 nt, Human
aaaaauuccccacccaaucaacc

SEQ ID NO: 997429 - RNA, 22 nt, Human
aaaaugcaccacaacccaauua

SEQ ID NO: 997430 - RNA, 20 nt, Human
aaaaugcugacuaauguaua

SEQ ID NO: 997431 - RNA, 20 nt, Human
aaacaaugcuacacucauuu

SEQ ID NO: 997432 - RNA, 18 nt, Human
aaaugagaauaaugaaga

SEQ ID NO: 997433 - RNA, 18 nt, Human
aaaugagaauaaugaaga

SEQ ID NO: 997434 - RNA, 26 nt, Human
aacaaauaaauaaaggggaagucaaa

SEQ ID NO: 997435 - RNA, 21 nt, Human
aacacacaucuaaccucccca

SEQ ID NO: 997436 - RNA, 21 nt, Human
aacacacaucuaaccucccca

SEQ ID NO: 997437 - RNA, 28 nt, Human
aacccaaucacuuugcaucuuucugcaa

SEQ ID NO: 997438 - RNA, 28 nt, Human
aacccaaucacuuugcaucuuucugcaa

SEQ ID NO: 997439 - RNA, 19 nt, Human
aagaaacucauucacgaag

SEQ ID NO: 997440 - RNA, 20 nt, Human
aagaaacucauucacgaagc

SEQ ID NO: 997441 - RNA, 18 nt, Human
aagauaaauaauggaugg

SEQ ID NO: 997442 - RNA, 23 nt, Human
aagauagugucuaaauacacuga

SEQ ID NO: 997443 - RNA, 22 nt, Human
aagguucaguucugaacagcuc

SEQ ID NO: 997444 - RNA, 22 nt, Human
aaugcuaauguuaguguauaaa

SEQ ID NO: 997445 - RNA, 22 nt, Human
acaaaccaagagaaaccaacca

SEQ ID NO: 997446 - RNA, 23 nt, Human
acaaagcauaaaaaacuagcccc

SEQ ID NO: 997447 - RNA, 23 nt, Human
acaaagcauaaaaaacuagcccc

SEQ ID NO: 997448 - RNA, 18 nt, Human
acaccacauauuccagac

SEQ ID NO: 997449 - RNA, 18 nt, Human
acaccacauauuccagac

SEQ ID NO: 997450 - RNA, 19 nt, Human
acaggaacaguuugcaugg

SEQ ID NO: 997451 - RNA, 19 nt, Human
acaggaacaguuugcaugg

SEQ ID NO: 997452 - RNA, 20 nt, Human
accaaugcauggcccuauaa

SEQ ID NO: 997453 - RNA, 24 nt, Human
acgaagcacugcuuguguacacca

SEQ ID NO: 997454 - RNA, 24 nt, Human
acuaucuuaucucccaacucuggu

SEQ ID NO: 997455 - RNA, 26 nt, Human
acucauacacuccaagccugaaacaa

SEQ ID NO: 997456 - RNA, 26 nt, Human
acucauacacuccaagccugaaacaa

SEQ ID NO: 997457 - RNA, 21 nt, Human
acuuaaaaaaaaaaaaaacac

SEQ ID NO: 997458 - RNA, 19 nt, Human
acuuaaaaaaaaaaaaaca

SEQ ID NO: 997459 - RNA, 21 nt, Human
agaaaguccagccauaauucc

SEQ ID NO: 997460 - RNA, 23 nt, Human
agaagcagaaacaaugcugaaca

SEQ ID NO: 997461 - RNA, 23 nt, Human
agaagcagaaacaaugcugaaca

SEQ ID NO: 997462 - RNA, 21 nt, Human
agacacccccaaacacuguaa

SEQ ID NO: 997463 - RNA, 21 nt, Human
agagauuaucaaguacugguc

SEQ ID NO: 997464 - RNA, 18 nt, Human
agaggaaaucagucagag

SEQ ID NO: 997465 - RNA, 23 nt, Human
agcaccaacacugugaagaacag

SEQ ID NO: 997466 - RNA, 18 nt, Human
agcugccugccuuucaag

SEQ ID NO: 997467 - RNA, 18 nt, Human
agcugccugccuuucaag

SEQ ID NO: 997468 - RNA, 25 nt, Human
aggaagucgaaaacccaaucacuuu

SEQ ID NO: 997469 - RNA, 25 nt, Human
aggaagucgaaaacccaaucacuuu

SEQ ID NO: 997470 - RNA, 22 nt, Human
aggaggaagagaaguagcaagg

SEQ ID NO: 997471 - RNA, 22 nt, Human
aggaggaagagaaguagcaagg

SEQ ID NO: 997472 - RNA, 18 nt, Human
aggcaaaacagagcaaaa

SEQ ID NO: 997473 - RNA, 18 nt, Human
aggcaaaacagagcaaaa

SEQ ID NO: 997474 - RNA, 21 nt, Human
aggcaauuaaaaaaaaaaaaa

SEQ ID NO: 997475 - RNA, 21 nt, Human
agguacccagacggcaggcgc

SEQ ID NO: 997476 - RNA, 18 nt, Human
aguuacugaaaaaaaaug

SEQ ID NO: 997477 - RNA, 20 nt, Human
auaaaguguacagcugaccc

SEQ ID NO: 997478 - RNA, 23 nt, Human
auaauuuuaaaguaacauuacaa

SEQ ID NO: 997479 - RNA, 23 nt, Human
auaauuuuaaaguaacauuacaa

SEQ ID NO: 997480 - RNA, 18 nt, Human
aucaucaccagacagucc

SEQ ID NO: 997481 - RNA, 21 nt, Human
augcgaggugaggaguggaca

SEQ ID NO: 997482 - RNA, 26 nt, Human
caaaaaaaaaaaagcucauaaaaugc

SEQ ID NO: 997483 - RNA, 24 nt, Human
caaaaaaaguaaauguuaaaggca

SEQ ID NO: 997484 - RNA, 22 nt, Human
caaaaacaaacuuugagaaaca

SEQ ID NO: 997485 - RNA, 22 nt, Human
caaaaacaaacuuugagaaaca

SEQ ID NO: 997486 - RNA, 24 nt, Human
caaagaacagguguuaacacacaa

SEQ ID NO: 997487 - RNA, 25 nt, Human
caacaaauaaauaaaggggaaguca

SEQ ID NO: 997488 - RNA, 27 nt, Human
cacaaaccaagagaaaccaaccaacaa

SEQ ID NO: 997489 - RNA, 20 nt, Human
cacaaauaguaagagaaaac

SEQ ID NO: 997490 - RNA, 20 nt, Human
cacauuaagaaggcacaugu

SEQ ID NO: 997491 - RNA, 19 nt, Human
cacucauacacuccaagcc

SEQ ID NO: 997492 - RNA, 19 nt, Human
cacucauacacuccaagcc

SEQ ID NO: 997493 - RNA, 19 nt, Human
cacucuucacucagaugcc

SEQ ID NO: 997494 - RNA, 21 nt, Human
cagaaaccacaguaugauauu

SEQ ID NO: 997495 - RNA, 21 nt, Human
cagaaaccacaguaugauauu

SEQ ID NO: 997496 - RNA, 22 nt, Human
cagauuucagaagcagaaacaa

SEQ ID NO: 997497 - RNA, 22 nt, Human
cagauuucagaagcagaaacaa

SEQ ID NO: 997498 - RNA, 18 nt, Human
cagcaaaacccaucacaa

SEQ ID NO: 997499 - RNA, 27 nt, Human
cagcaaauaaauaaaggggaagucaaa

SEQ ID NO: 997500 - RNA, 18 nt, Human
caggagaugccuaacauc

SEQ ID NO: 997501 - RNA, 23 nt, Human
caggcaaaacagagcaaaacugg

SEQ ID NO: 997502 - RNA, 24 nt, Human
caggcaaaacagagcaaaacugga

SEQ ID NO: 997503 - RNA, 24 nt, Human
caggcaaaacagagcaaaacugga

SEQ ID NO: 997504 - RNA, 23 nt, Human
cauacacuccaagccugaaacac

SEQ ID NO: 997505 - RNA, 23 nt, Human
cauacacuccaagccugaaacac

SEQ ID NO: 997506 - RNA, 20 nt, Human
cauggcaacuaucaccuguu

SEQ ID NO: 997507 - RNA, 24 nt, Human
ccaaccuugaaaaaaagcccaacg

SEQ ID NO: 997508 - RNA, 24 nt, Human
ccaaccuugaaaaaaagcccaacg

SEQ ID NO: 997509 - RNA, 18 nt, Human
ccacgucaugcagucaca

SEQ ID NO: 997510 - RNA, 20 nt, Human
ccauaauuccauuauaucca

SEQ ID NO: 997511 - RNA, 25 nt, Human
cccaaccuugaaaaaaagcccaacg

SEQ ID NO: 997512 - RNA, 25 nt, Human
cccaaccuugaaaaaaagcccaacg

SEQ ID NO: 997513 - RNA, 18 nt, Human
ccccaccccaucaccaga

SEQ ID NO: 997514 - RNA, 24 nt, Human
ccccaccccaucaccagauucagu

SEQ ID NO: 997515 - RNA, 25 nt, Human
ccccaccccaucaccagauucagua

SEQ ID NO: 997516 - RNA, 22 nt, Human
cccccaggguucccugcaucaa

SEQ ID NO: 997517 - RNA, 23 nt, Human
cgaagcacugcuuguguacacca

SEQ ID NO: 997518 - RNA, 18 nt, Human
cggcugcgcugcaccucg

SEQ ID NO: 997519 - RNA, 25 nt, Human
cuacaacaccuguaaugucuguacc

SEQ ID NO: 997520 - RNA, 22 nt, Human
cuagguacaaagcauaaaaaac

SEQ ID NO: 997521 - RNA, 22 nt, Human
cucauacacuccaagccugaaa

SEQ ID NO: 997522 - RNA, 22 nt, Human
cucauacacuccaagccugaaa

SEQ ID NO: 997523 - RNA, 21 nt, Human
cucccaguacaaggagcaguc

SEQ ID NO: 997524 - RNA, 21 nt, Human
cucccaguacaaggagcaguc

SEQ ID NO: 997525 - RNA, 25 nt, Human
cucccaugcaaaggauacuguugca

SEQ ID NO: 997526 - RNA, 25 nt, Human
cucccaugcaaaggauacuguugca

SEQ ID NO: 997527 - RNA, 18 nt, Human
cuguauuguucagucugu

SEQ ID NO: 997528 - RNA, 26 nt, Human
cuuaaaaaaaaaaaaaacacacacgc

SEQ ID NO: 997529 - RNA, 25 nt, Human
cuuaaaaaaaaaaaaacacacacgc

SEQ ID NO: 997530 - RNA, 19 nt, Human
cuuaucucccaacucuggu

SEQ ID NO: 997531 - RNA, 24 nt, Human
gaaaaaccauacacacagaauaca

SEQ ID NO: 997532 - RNA, 21 nt, Human
gaaaacaaauacuaaaacuuc

SEQ ID NO: 997533 - RNA, 21 nt, Human
gaaaacaaauacuaaaacuuc

SEQ ID NO: 997534 - RNA, 19 nt, Human
gaagauaaauaauggaugg

SEQ ID NO: 997535 - RNA, 21 nt, Human
gacaucaucaccagacagucc

SEQ ID NO: 997536 - RNA, 20 nt, Human
gacucugugagggagguaaa

SEQ ID NO: 997537 - RNA, 19 nt, Human
gagaaacacauuaagaagg

SEQ ID NO: 997538 - RNA, 21 nt, Human
gccauaauuccauuauaucca

SEQ ID NO: 997539 - RNA, 19 nt, Human
gccccaccccaucaccaga

SEQ ID NO: 997540 - RNA, 19 nt, Human
gcugcgguggggccggcug

SEQ ID NO: 997541 - RNA, 25 nt, Human
ggagcgaggccggcucggcggggaa

SEQ ID NO: 997542 - RNA, 18 nt, Human
ggaguggacagaauuggc

SEQ ID NO: 997543 - RNA, 19 nt, Human
ggaguggacagaauuggcg

SEQ ID NO: 997544 - RNA, 18 nt, Human
ggauuggaaaaauguaua

SEQ ID NO: 997545 - RNA, 18 nt, Human
ggauuggaaaaauguaua

SEQ ID NO: 997546 - RNA, 21 nt, Human
ggcaaaacagagcaaaacugg

SEQ ID NO: 997547 - RNA, 19 nt, Human
ggccaguccaaguccuuuu

SEQ ID NO: 997548 - RNA, 18 nt, Human
ggcgggacugcugaggua

SEQ ID NO: 997549 - RNA, 18 nt, Human
gggacugcugagguagcu

SEQ ID NO: 997550 - RNA, 22 nt, Human
guggcagagaaagugccacggc

SEQ ID NO: 997551 - RNA, 18 nt, Human
guuugauuaugaaggcaa

SEQ ID NO: 997552 - RNA, 24 nt, Human
guuuucccacuaaucuauuuaaau

SEQ ID NO: 997553 - RNA, 24 nt, Human
guuuucccacuaaucuauuuaaau

SEQ ID NO: 997554 - RNA, 24 nt, Human
uaaaacaaaaaaugaaaagucacu

SEQ ID NO: 997555 - RNA, 18 nt, Human
uaaaacuucaggcaaaac

SEQ ID NO: 997556 - RNA, 18 nt, Human
uaaaacuucaggcaaaac

SEQ ID NO: 997557 - RNA, 18 nt, Human
uaaaaugcauuuuggcca

SEQ ID NO: 997558 - RNA, 22 nt, Human
uaaagacacccccaaacacugu

SEQ ID NO: 997559 - RNA, 19 nt, Human
uaaaguguacagcugaccc

SEQ ID NO: 997560 - RNA, 20 nt, Human
uaaaugcauugccacagaag

SEQ ID NO: 997561 - RNA, 20 nt, Human
uaaaugcauugccacagaag

SEQ ID NO: 997562 - RNA, 25 nt, Human
uaaccaguauuuaugggccuuauaa

SEQ ID NO: 997563 - RNA, 25 nt, Human
uaaccaguauuuaugggccuuauaa

SEQ ID NO: 997564 - RNA, 23 nt, Human
uaacucaugcccugccccuauaa

SEQ ID NO: 997565 - RNA, 19 nt, Human
uaauuggucucaaauuuca

SEQ ID NO: 997566 - RNA, 19 nt, Human
uaauuggucucaaauuuca

SEQ ID NO: 997567 - RNA, 21 nt, Human
uacaauacaaggcaauuaaaa

SEQ ID NO: 997568 - RNA, 20 nt, Human
uacaauagcaaaaaaaaaag

SEQ ID NO: 997569 - RNA, 19 nt, Human
uacacaaaucuguucaugu

SEQ ID NO: 997570 - RNA, 20 nt, Human
uacagugcaguacacaauua

SEQ ID NO: 997571 - RNA, 20 nt, Human
uacagugcaguacacaauua

SEQ ID NO: 997572 - RNA, 22 nt, Human
uacccagacggcaggcgcgggg

SEQ ID NO: 997573 - RNA, 22 nt, Human
uacuaaaacuucaggcaaaaca

SEQ ID NO: 997574 - RNA, 22 nt, Human
uacuaaaacuucaggcaaaaca

SEQ ID NO: 997575 - RNA, 20 nt, Human
uagaauccucacagugacuc

SEQ ID NO: 997576 - RNA, 22 nt, Human
uagacaacaaauaaauaaaggg

SEQ ID NO: 997577 - RNA, 22 nt, Human
uagacagcaaauaaauaaaggg

SEQ ID NO: 997578 - RNA, 23 nt, Human
uagcaaaaaaaaaagcucauaaa

SEQ ID NO: 997579 - RNA, 24 nt, Human
uagcaccaacacugugaagaacag

SEQ ID NO: 997580 - RNA, 21 nt, Human
uaguaagagaaaacaacuucu

SEQ ID NO: 997581 - RNA, 18 nt, Human
ucaauacuuacaugugcc

SEQ ID NO: 997582 - RNA, 19 nt, Human
ucaauacuuacaugugcca

SEQ ID NO: 997583 - RNA, 21 nt, Human
ucagaguuuuacauccugaag

SEQ ID NO: 997584 - RNA, 22 nt, Human
ucagaguuuuacauccugaaga

SEQ ID NO: 997585 - RNA, 21 nt, Human
ucagaugccaugaaagacauc

SEQ ID NO: 997586 - RNA, 18 nt, Human
uccaagccugaaacacac

SEQ ID NO: 997587 - RNA, 18 nt, Human
uccaagccugaaacacac

SEQ ID NO: 997588 - RNA, 19 nt, Human
uccaagccugaaacacaca

SEQ ID NO: 997589 - RNA, 19 nt, Human
uccaagccugaaacacaca

SEQ ID NO: 997590 - RNA, 22 nt, Human
ucccaaccuugaaaaaaagccc

SEQ ID NO: 997591 - RNA, 22 nt, Human
ucccaaccuugaaaaaaagccc

SEQ ID NO: 997592 - RNA, 24 nt, Human
ucgggucgugcgcccaggccggcc

SEQ ID NO: 997593 - RNA, 22 nt, Human
ucuaacucacuuugacaaaacu

SEQ ID NO: 997594 - RNA, 21 nt, Human
ucuaacucuuguucuaaagag

SEQ ID NO: 997595 - RNA, 23 nt, Human
ucuagguacaaagcauaaaaaac

SEQ ID NO: 997596 - RNA, 18 nt, Human
ucucccuaacucaugccc

SEQ ID NO: 997597 - RNA, 19 nt, Human
ucugaacagcuccacuuca

SEQ ID NO: 997598 - RNA, 21 nt, Human
ucugcaaaaaauuccccaccc

SEQ ID NO: 997599 - RNA, 21 nt, Human
ucugcaaaaaauuccccaccc

SEQ ID NO: 997600 - RNA, 25 nt, Human
ucuguucauguugccaaacaaaauc

SEQ ID NO: 997601 - RNA, 22 nt, Human
ucuucagucucccuaacucaug

SEQ ID NO: 997602 - RNA, 24 nt, Human
ugaaaaaaaaugugucgagaaaca

SEQ ID NO: 997603 - RNA, 20 nt, Human
ugaaaaaaagcccaacgaau

SEQ ID NO: 997604 - RNA, 20 nt, Human
ugaaaaaaagcccaacgaau

SEQ ID NO: 997605 - RNA, 23 nt, Human
ugaaaaaaagcccaacgaaugua

SEQ ID NO: 997606 - RNA, 23 nt, Human
ugaaaaaaagcccaacgaaugua

SEQ ID NO: 997607 - RNA, 19 nt, Human
ugaaaagcaagaagaguca

SEQ ID NO: 997608 - RNA, 19 nt, Human
ugaaaagcaagaagaguca

SEQ ID NO: 997609 - RNA, 22 nt, Human
ugaaaaugaaagaugccuauuc

SEQ ID NO: 997610 - RNA, 21 nt, Human
ugaaacacacaucuaaccucc

SEQ ID NO: 997611 - RNA, 21 nt, Human
ugaaacacacaucuaaccucc

SEQ ID NO: 997612 - RNA, 24 nt, Human
ugaaacacacaucuaaccucccca

SEQ ID NO: 997613 - RNA, 24 nt, Human
ugaaacacacaucuaaccucccca

SEQ ID NO: 997614 - RNA, 21 nt, Human
ugaagauacucuuccuugcuc

SEQ ID NO: 997615 - RNA, 21 nt, Human
ugaagauacucuuccuugcuc

SEQ ID NO: 997616 - RNA, 20 nt, Human
ugagaaaaaaaaacaaagcc

SEQ ID NO: 997617 - RNA, 24 nt, Human
ugaggaggaagagaaguagcaagg

SEQ ID NO: 997618 - RNA, 24 nt, Human
ugaggaggaagagaaguagcaagg

SEQ ID NO: 997619 - RNA, 20 nt, Human
ugcagaggagauggaaaaac

SEQ ID NO: 997620 - RNA, 24 nt, Human
ugccacggccccaccccaucacca

SEQ ID NO: 997621 - RNA, 21 nt, Human
ugcgaggugaggaguggacag

SEQ ID NO: 997622 - RNA, 20 nt, Human
ugcggaaaaaggaagugacu

SEQ ID NO: 997623 - RNA, 20 nt, Human
uggcccaaugguaccgacag

SEQ ID NO: 997624 - RNA, 21 nt, Human
uggugugguaaucccaaccuu

SEQ ID NO: 997625 - RNA, 21 nt, Human
uggugugguaaucccaaccuu

SEQ ID NO: 997626 - RNA, 18 nt, Human
uguaaauaucugucuucu

SEQ ID NO: 997627 - RNA, 18 nt, Human
uguaaauaucugucuucu

SEQ ID NO: 997628 - RNA, 18 nt, Human
ugucaacaaaaacaaacu

SEQ ID NO: 997629 - RNA, 18 nt, Human
ugucaacaaaaacaaacu

SEQ ID NO: 997630 - RNA, 21 nt, Human
ugucgagaaacacauuaagaa

SEQ ID NO: 997631 - RNA, 22 nt, Human
uguugcacauaaaagauauccu

SEQ ID NO: 997632 - RNA, 22 nt, Human
uguugcacauaaaagauauccu

SEQ ID NO: 997633 - RNA, 22 nt, Human
uguuugauuaugaaggcaacac

SEQ ID NO: 997634 - RNA, 25 nt, Human
uuaaggcaagacugagaguuuggcu

SEQ ID NO: 997635 - RNA, 25 nt, Human
uuaaggcaagacugagaguuuggcu

SEQ ID NO: 997636 - RNA, 20 nt, Human
uuacagacaugaauuuuucc

SEQ ID NO: 997637 - RNA, 21 nt, Human
uuacaugcaauguaugaaaaa

SEQ ID NO: 997638 - RNA, 22 nt, Human
uucaacuuaggugaaaagcaag

SEQ ID NO: 997639 - RNA, 24 nt, Human
uuccaaauauaaucucacaggucu

SEQ ID NO: 997640 - RNA, 18 nt, Human
uucgcugaaaguccccca

SEQ ID NO: 997641 - RNA, 22 nt, Human
uucuguguugugguuggccuug

SEQ ID NO: 997642 - RNA, 22 nt, Human
uucuguguugugguuggccuug

SEQ ID NO: 997643 - RNA, 18 nt, Human
uugagaaaaaaaaacaaa

SEQ ID NO: 997644 - RNA, 21 nt, Human
uugcagaggagauggaaaaac

SEQ ID NO: 997645 - RNA, 25 nt, Human
aaauguuagagguucaaaacacuuc

SEQ ID NO: 997646 - RNA, 19 nt, Human
aagacgcccacuggagaca

SEQ ID NO: 997647 - RNA, 21 nt, Human
aaggcaaaaaccuuuauucau

SEQ ID NO: 997648 - RNA, 26 nt, Human
acucucugcugucaucaucagcugau

SEQ ID NO: 997649 - RNA, 21 nt, Human
agaauagagccggggcccaag

SEQ ID NO: 997650 - RNA, 21 nt, Human
agggaagauuuagcuuuccaa

SEQ ID NO: 997651 - RNA, 19 nt, Human
cagaauagagccggggccc

SEQ ID NO: 997652 - RNA, 19 nt, Human
cagcccagaauagagccgg

SEQ ID NO: 997653 - RNA, 23 nt, Human
cccagaauagagccggggcccaa

SEQ ID NO: 997654 - RNA, 19 nt, Human
cccgcagaguuaggacagc

SEQ ID NO: 997655 - RNA, 22 nt, Human
cccgcagaguuaggacagcuca

SEQ ID NO: 997656 - RNA, 21 nt, Human
cccgcagcccagaauagagcc

SEQ ID NO: 997657 - RNA, 26 nt, Human
cccgcagcccagaauagagccggggc

SEQ ID NO: 997658 - RNA, 24 nt, Human
ccuccgaagauuaaaggaaagagc

SEQ ID NO: 997659 - RNA, 19 nt, Human
ccugccagcucucagaguc

SEQ ID NO: 997660 - RNA, 18 nt, Human
cugaaguuugauuuuggg

SEQ ID NO: 997661 - RNA, 26 nt, Human
gaauagagccggggcccaagacgccc

SEQ ID NO: 997662 - RNA, 24 nt, Human
gagccggggcccaagacgcccacu

SEQ ID NO: 997663 - RNA, 20 nt, Human
gcccugccacucucugcugu

SEQ ID NO: 997664 - RNA, 19 nt, Human
gcgagcccuucccaggccc

SEQ ID NO: 997665 - RNA, 18 nt, Human
uaagacaaggcaaaaacc

SEQ ID NO: 997666 - RNA, 19 nt, Human
uaagacaaggcaaaaaccu

SEQ ID NO: 997667 - RNA, 23 nt, Human
uaggacagcucauuuggcacccc

SEQ ID NO: 997668 - RNA, 21 nt, Human
uccuuggugguuaaaccugag

SEQ ID NO: 997669 - RNA, 18 nt, Human
ucuccugucuucucauuc

SEQ ID NO: 997670 - RNA, 18 nt, Human
ucuccugucuucucauuc

SEQ ID NO: 997671 - RNA, 22 nt, Human
ucuccugucuucucauucuucu

SEQ ID NO: 997672 - RNA, 18 nt, Human
ugaaacugaaguuugauu

SEQ ID NO: 997673 - RNA, 18 nt, Human
ugacuuuggguccucagc

SEQ ID NO: 997674 - RNA, 23 nt, Human
ugggaaguaaauguuagagguuc

SEQ ID NO: 997675 - RNA, 20 nt, Human
uggguccucagcccugccac

SEQ ID NO: 997676 - RNA, 23 nt, Human
uguuagagguucaaaacacuuaa

SEQ ID NO: 997677 - RNA, 23 nt, Human
uuggcacccggcgagcccuuccc

SEQ ID NO: 997678 - RNA, 19 nt, Human
aaaaccauaccaaggccau

SEQ ID NO: 997679 - RNA, 25 nt, Human
aaagaaaauaaacacagccuuagag

SEQ ID NO: 997680 - RNA, 23 nt, Human
aacacgcucaugagggcaaagga

SEQ ID NO: 997681 - RNA, 22 nt, Human
aagcggcgcuccuggggugcag

SEQ ID NO: 997682 - RNA, 22 nt, Human
aauagccauauaaaaaaugaga

SEQ ID NO: 997683 - RNA, 23 nt, Human
acacagccuuagagacccaugga

SEQ ID NO: 997684 - RNA, 25 nt, Human
acaguuauuaaaggcagaugacuuu

SEQ ID NO: 997685 - RNA, 27 nt, Human
agaaaauaaacacagccuuagagaccc

SEQ ID NO: 997686 - RNA, 22 nt, Human
agaaacagagacauagcaauau

SEQ ID NO: 997687 - RNA, 21 nt, Human
agaagcgguggaugaggcucc

SEQ ID NO: 997688 - RNA, 21 nt, Human
agacaagaauuugaaggcagc

SEQ ID NO: 997689 - RNA, 25 nt, Human
agagaaaaaauagccauauaaaaaa

SEQ ID NO: 997690 - RNA, 20 nt, Human
agaugucccacggagauucu

SEQ ID NO: 997691 - RNA, 20 nt, Human
aggaaaaaaaaaaguuuaaa

SEQ ID NO: 997692 - RNA, 25 nt, Human
aggaaaaaaaaaaguuuaaagaaaa

SEQ ID NO: 997693 - RNA, 23 nt, Human
aguacaaauaaaaccauaccaag

SEQ ID NO: 997694 - RNA, 19 nt, Human
caaaggaaaauauucucau

SEQ ID NO: 997695 - RNA, 20 nt, Human
caccaaaguacaaauaaaac

SEQ ID NO: 997696 - RNA, 24 nt, Human
cacgcucaugagggcaaaggaaaa

SEQ ID NO: 997697 - RNA, 19 nt, Human
cacuaagacccugaggccu

SEQ ID NO: 997698 - RNA, 23 nt, Human
cagacuugucuuaaauguuccau

SEQ ID NO: 997699 - RNA, 22 nt, Human
cagcagagaaaaaauagccaua

SEQ ID NO: 997700 - RNA, 21 nt, Human
cagcuauuauaaacacgcuca

SEQ ID NO: 997701 - RNA, 21 nt, Human
cagcucccagggucccauccc

SEQ ID NO: 997702 - RNA, 19 nt, Human
cagggucaggcccuuccgc

SEQ ID NO: 997703 - RNA, 18 nt, Human
cggugcauacugggaguu

SEQ ID NO: 997704 - RNA, 20 nt, Human
cuccuggggugcagaggauu

SEQ ID NO: 997705 - RNA, 23 nt, Human
cugcaguaauauugaugcuccag

SEQ ID NO: 997706 - RNA, 28 nt, Human
gaaaauaaacacagccuuagagacccag

SEQ ID NO: 997707 - RNA, 20 nt, Human
gagcccggggguccaagcgg

SEQ ID NO: 997708 - RNA, 18 nt, Human
gagggggcuucuugaggc

SEQ ID NO: 997709 - RNA, 18 nt, Human
gccugggaagcagccugg

SEQ ID NO: 997710 - RNA, 24 nt, Human
ggugcauacugggaguuguagucu

SEQ ID NO: 997711 - RNA, 25 nt, Human
uaaaaagcaggcaguagccaucucc

SEQ ID NO: 997712 - RNA, 24 nt, Human
uaaauacacaagauaaaaagcagg

SEQ ID NO: 997713 - RNA, 20 nt, Human
uacaaauaaaaccauaccaa

SEQ ID NO: 997714 - RNA, 19 nt, Human
uaccaaggccauauugcaa

SEQ ID NO: 997715 - RNA, 21 nt, Human
uagaaaaaaucaaauggagua

SEQ ID NO: 997716 - RNA, 19 nt, Human
uagccauauaaaaaaugag

SEQ ID NO: 997717 - RNA, 19 nt, Human
uagccaucuccaagauguu

SEQ ID NO: 997718 - RNA, 22 nt, Human
uauugagccugaggagaggaga

SEQ ID NO: 997719 - RNA, 24 nt, Human
uccaaucugaggagaggaaaaaaa

SEQ ID NO: 997720 - RNA, 21 nt, Human
uccagagagaugucccacgga

SEQ ID NO: 997721 - RNA, 18 nt, Human
uccauucuucaccuuaga

SEQ ID NO: 997722 - RNA, 18 nt, Human
ucccagggucccaucccc

SEQ ID NO: 997723 - RNA, 21 nt, Human
uccgugagaggcccgaccuag

SEQ ID NO: 997724 - RNA, 22 nt, Human
ucuauaguucagaaacagagac

SEQ ID NO: 997725 - RNA, 21 nt, Human
ugagaaaaggugagagauaga

SEQ ID NO: 997726 - RNA, 18 nt, Human
ugagagauagaaaaaauc

SEQ ID NO: 997727 - RNA, 18 nt, Human
ugaggcagugucuaucag

SEQ ID NO: 997728 - RNA, 22 nt, Human
ugaggccugggaagcagccugg

SEQ ID NO: 997729 - RNA, 24 nt, Human
ugcagaggauuugugacagccacg

SEQ ID NO: 997730 - RNA, 19 nt, Human
ugcaguacuuaaccugaaa

SEQ ID NO: 997731 - RNA, 21 nt, Human
ugcaguacuuaaccugaaaaa

SEQ ID NO: 997732 - RNA, 19 nt, Human
ugggaugacugagucugaa

SEQ ID NO: 997733 - RNA, 21 nt, Human
uggguggggucagagaagcgg

SEQ ID NO: 997734 - RNA, 21 nt, Human
ugugaaacaucagcagagaaa

SEQ ID NO: 997735 - RNA, 20 nt, Human
ugugacguuuucuccucuuu

SEQ ID NO: 997736 - RNA, 20 nt, Human
uguggaggccaugaaaggcg

SEQ ID NO: 997737 - RNA, 18 nt, Human
uuguaagaauggaaauaa

SEQ ID NO: 997738 - RNA, 22 nt, Human
uuguaagaauggaaauaaguuc

SEQ ID NO: 997739 - RNA, 27 nt, Human
aaaaaaaaaagaggaagaaugaccugg

SEQ ID NO: 997740 - RNA, 18 nt, Human
aagaaaaaacccccacac

SEQ ID NO: 997741 - RNA, 18 nt, Human
aagaaaaaacccccacac

SEQ ID NO: 997742 - RNA, 20 nt, Human
aagaaauagaaauuaauuca

SEQ ID NO: 997743 - RNA, 22 nt, Human
aaggggucaaacucacaaaauc

SEQ ID NO: 997744 - RNA, 19 nt, Human
aagugccggcgacgggaag

SEQ ID NO: 997745 - RNA, 21 nt, Human
aagugccggcgacgggaagcc

SEQ ID NO: 997746 - RNA, 24 nt, Human
acaacgguucugcaccaaaagaaa

SEQ ID NO: 997747 - RNA, 19 nt, Human
acucacaaaauccagugcc

SEQ ID NO: 997748 - RNA, 18 nt, Human
agaccccacugcacaacg

SEQ ID NO: 997749 - RNA, 23 nt, Human
aggaagaaugaccuggcagacag

SEQ ID NO: 997750 - RNA, 18 nt, Human
agggagcagucagcacca

SEQ ID NO: 997751 - RNA, 21 nt, Human
auauggaugguuuuuauaugg

SEQ ID NO: 997752 - RNA, 24 nt, Human
aucacuuuuaguuguaauguacac

SEQ ID NO: 997753 - RNA, 21 nt, Human
auuaaaaaaaaaagaggaaga

SEQ ID NO: 997754 - RNA, 22 nt, Human
caagauaggaauccaaugauuu

SEQ ID NO: 997755 - RNA, 22 nt, Human
cacaaaauccagugccuacaaa

SEQ ID NO: 997756 - RNA, 20 nt, Human
caccauccgggaggugcaag

SEQ ID NO: 997757 - RNA, 18 nt, Human
cacuauguacagaaagau

SEQ ID NO: 997758 - RNA, 19 nt, Human
cacugcacaacgguucugc

SEQ ID NO: 997759 - RNA, 22 nt, Human
cacugcacaacgguucugcacc

SEQ ID NO: 997760 - RNA, 30 nt, Human
cagcaccauccgggaggugcaagcagcggg

SEQ ID NO: 997761 - RNA, 20 nt, Human
cagccuccgcggcgcguccu

SEQ ID NO: 997762 - RNA, 21 nt, Human
cagcgggcgccgagccggggc

SEQ ID NO: 997763 - RNA, 19 nt, Human
cauccauggauuccucuuu

SEQ ID NO: 997764 - RNA, 27 nt, Human
cauucuuuccccaagaaaacuuuaagg

SEQ ID NO: 997765 - RNA, 25 nt, Human
ccaauuaaaaaaaaaagaggaagaa

SEQ ID NO: 997766 - RNA, 20 nt, Human
ccagugccuacaaaauacag

SEQ ID NO: 997767 - RNA, 23 nt, Human
ccccacacuuaaaaagucagggu

SEQ ID NO: 997768 - RNA, 22 nt, Human
cgaccccgaacagccuccgcgg

SEQ ID NO: 997769 - RNA, 19 nt, Human
cgggaggugcaagcagcgg

SEQ ID NO: 997770 - RNA, 23 nt, Human
cucccuuggcacaagauaggaau

SEQ ID NO: 997771 - RNA, 19 nt, Human
cucgaccccgaacagccuc

SEQ ID NO: 997772 - RNA, 19 nt, Human
cugcacaacgguucugcac

SEQ ID NO: 997773 - RNA, 25 nt, Human
cugcaccaaaagaaaaaugaggacc

SEQ ID NO: 997774 - RNA, 19 nt, Human
gaaaauuuguauuccuuaa

SEQ ID NO: 997775 - RNA, 19 nt, Human
gagaagaaaaaacccccac

SEQ ID NO: 997776 - RNA, 20 nt, Human
gccugccgggccggccgcgc

SEQ ID NO: 997777 - RNA, 19 nt, Human
ggaagagaagaaaaaaccc

SEQ ID NO: 997778 - RNA, 24 nt, Human
uaaaaacucccuuggcacaagaua

SEQ ID NO: 997779 - RNA, 22 nt, Human
uaaaacaccuaagugaugaagg

SEQ ID NO: 997780 - RNA, 22 nt, Human
uaagguaaacaucuuaaaacac

SEQ ID NO: 997781 - RNA, 18 nt, Human
ucagcaccauccgggagg

SEQ ID NO: 997782 - RNA, 25 nt, Human
uccucacgacucgccgccgccgccg

SEQ ID NO: 997783 - RNA, 20 nt, Human
ucgccgccgccgccgcuuag

SEQ ID NO: 997784 - RNA, 24 nt, Human
ugggaaccaaggguugguugguuu

SEQ ID NO: 997785 - RNA, 21 nt, Human
aaaauaacuggcaaucagaac

SEQ ID NO: 997786 - RNA, 22 nt, Human
aaaccaccagcauccccaccug

SEQ ID NO: 997787 - RNA, 18 nt, Human
aaaggcaccacggaagcu

SEQ ID NO: 997788 - RNA, 19 nt, Human
aagccaugaaauaauaaaa

SEQ ID NO: 997789 - RNA, 19 nt, Human
aagccccgaaggcgcccag

SEQ ID NO: 997790 - RNA, 27 nt, Human
acacucauacaagccaugaaauaauaa

SEQ ID NO: 997791 - RNA, 20 nt, Human
agaacccuaaagaaacacac

SEQ ID NO: 997792 - RNA, 19 nt, Human
agcggagggcacggcgccu

SEQ ID NO: 997793 - RNA, 19 nt, Human
auggccgccucuuccauga

SEQ ID NO: 997794 - RNA, 23 nt, Human
cagccucucucuccugccgcccc

SEQ ID NO: 997795 - RNA, 24 nt, Human
caggggaggccgcugcuucuugca

SEQ ID NO: 997796 - RNA, 26 nt, Human
cauacaagccaugaaauaauaaaaca

SEQ ID NO: 997797 - RNA, 23 nt, Human
caugacgggcaccuguguaggcc

SEQ ID NO: 997798 - RNA, 21 nt, Human
caugucaaaccaccagcaucc

SEQ ID NO: 997799 - RNA, 21 nt, Human
ccaccagcauccccaccugaa

SEQ ID NO: 997800 - RNA, 22 nt, Human
ccacgcgcuggacccgacccuc

SEQ ID NO: 997801 - RNA, 22 nt, Human
cccacgcgcuggacccgacccu

SEQ ID NO: 997802 - RNA, 18 nt, Human
ccccgaaggcgcccagcu

SEQ ID NO: 997803 - RNA, 22 nt, Human
ccggcagcaaaggcaccacgga

SEQ ID NO: 997804 - RNA, 21 nt, Human
cgaagugaagaaugacaaucc

SEQ ID NO: 997805 - RNA, 24 nt, Human
cgccccugcugggacggcagcccg

SEQ ID NO: 997806 - RNA, 20 nt, Human
cucccugaagcaccagcagc

SEQ ID NO: 997807 - RNA, 18 nt, Human
cugaaaggucccugugga

SEQ ID NO: 997808 - RNA, 18 nt, Human
cugaaugccccggaaguc

SEQ ID NO: 997809 - RNA, 21 nt, Human
cuguguaggccagccucucuc

SEQ ID NO: 997810 - RNA, 19 nt, Human
gaagcaccagcagcuguuc

SEQ ID NO: 997811 - RNA, 20 nt, Human
gcaggcccuggucaggccug

SEQ ID NO: 997812 - RNA, 22 nt, Human
gcuggacccgacccucagaagc

SEQ ID NO: 997813 - RNA, 22 nt, Human
ggcaaucagaacccuaaagaaa

SEQ ID NO: 997814 - RNA, 21 nt, Human
ggcagcaaaggcaccacggaa

SEQ ID NO: 997815 - RNA, 19 nt, Human
guccccaagggcugccggc

SEQ ID NO: 997816 - RNA, 18 nt, Human
uaaaacacagucaagguu

SEQ ID NO: 997817 - RNA, 22 nt, Human
uaaagaaacacacccagucaca

SEQ ID NO: 997818 - RNA, 25 nt, Human
uacaagccaugaaauaauaaaacac

SEQ ID NO: 997819 - RNA, 19 nt, Human
ucaagccccgaaggcgccc

SEQ ID NO: 997820 - RNA, 24 nt, Human
ucagaagcucaagccccgaaggcg

SEQ ID NO: 997821 - RNA, 23 nt, Human
ucuccugccgccccugcugggac

SEQ ID NO: 997822 - RNA, 21 nt, Human
ugaaauaauaaaacacaguca

SEQ ID NO: 997823 - RNA, 19 nt, Human
ugaagaaugacaaucccau

SEQ ID NO: 997824 - RNA, 18 nt, Human
ugaagcaccagcagcugu

SEQ ID NO: 997825 - RNA, 19 nt, Human
ugcaggcccuggucaggcc

SEQ ID NO: 997826 - RNA, 28 nt, Human
uggcaaucagaacccuaaagaaacacac

SEQ ID NO: 997827 - RNA, 18 nt, Human
uggccgccucuuccauga

SEQ ID NO: 997828 - RNA, 18 nt, Human
ugguccccaagggcugcc

SEQ ID NO: 997829 - RNA, 22 nt, Human
ugucugaaaggucccuguggag

SEQ ID NO: 997830 - RNA, 19 nt, Human
ugugcaggcccuggucagg

SEQ ID NO: 997831 - RNA, 23 nt, Human
aaaaaaggaaauauuauagaaga

SEQ ID NO: 997832 - RNA, 21 nt, Human
aaaauauguaccuuauaccaa

SEQ ID NO: 997833 - RNA, 21 nt, Human
aaacaauaauaaaacaaucac

SEQ ID NO: 997834 - RNA, 18 nt, Human
aaagcuaaauaaaagcac

SEQ ID NO: 997835 - RNA, 22 nt, Human
aacaccuguggcuuuuaaaauu

SEQ ID NO: 997836 - RNA, 23 nt, Human
aacuggcauuccagaucuggagc

SEQ ID NO: 997837 - RNA, 18 nt, Human
aagaaguagacuaguuca

SEQ ID NO: 997838 - RNA, 20 nt, Human
aagcaggaaaacaacuauga

SEQ ID NO: 997839 - RNA, 20 nt, Human
aagcaggaaaacaacuauga

SEQ ID NO: 997840 - RNA, 24 nt, Human
aaguaaaucuagccaugcuuuuaa

SEQ ID NO: 997841 - RNA, 28 nt, Human
aaguaggagacagguucuaaggucgacc

SEQ ID NO: 997842 - RNA, 23 nt, Human
aaguauagguagaugucuagaaa

SEQ ID NO: 997843 - RNA, 23 nt, Human
acaguagauuacuuuguuucuua

SEQ ID NO: 997844 - RNA, 21 nt, Human
accuucauccacucaccccac

SEQ ID NO: 997845 - RNA, 21 nt, Human
agaaagacagacuucuacaga

SEQ ID NO: 997846 - RNA, 21 nt, Human
agaagacaaaggucaaacugg

SEQ ID NO: 997847 - RNA, 22 nt, Human
agacuucuacagauccacuccu

SEQ ID NO: 997848 - RNA, 23 nt, Human
agauucaaagaggggaaaaaaag

SEQ ID NO: 997849 - RNA, 18 nt, Human
agccacccccaauaccca

SEQ ID NO: 997850 - RNA, 23 nt, Human
aguaaaucuagccaugcuuuuaa

SEQ ID NO: 997851 - RNA, 19 nt, Human
agugucaaacacaagagga

SEQ ID NO: 997852 - RNA, 23 nt, Human
auuauagcauuuuuauuuuccaa

SEQ ID NO: 997853 - RNA, 27 nt, Human
caacaaugguuccccuaaugugauuga

SEQ ID NO: 997854 - RNA, 21 nt, Human
caacauuguaggccauaauca

SEQ ID NO: 997855 - RNA, 19 nt, Human
caaugcauguugacaagau

SEQ ID NO: 997856 - RNA, 20 nt, Human
caccuucauccacucacccc

SEQ ID NO: 997857 - RNA, 24 nt, Human
caggaacuguuucuggcauuucua

SEQ ID NO: 997858 - RNA, 21 nt, Human
cauaauaaauauugagaccua

SEQ ID NO: 997859 - RNA, 24 nt, Human
cauuguaggccauaaucauauaca

SEQ ID NO: 997860 - RNA, 19 nt, Human
cauuuggcauaaacaauaa

SEQ ID NO: 997861 - RNA, 23 nt, Human
ccaauacccaccuucauccacuc

SEQ ID NO: 997862 - RNA, 19 nt, Human
ccacaaacuccauaaauug

SEQ ID NO: 997863 - RNA, 18 nt, Human
ccacccccaauacccacc

SEQ ID NO: 997864 - RNA, 21 nt, Human
ccacuggucucauaauaaaua

SEQ ID NO: 997865 - RNA, 23 nt, Human
ccagcccgccgccucguguccuc

SEQ ID NO: 997866 - RNA, 22 nt, Human
cccacaaacuccauaaauugac

SEQ ID NO: 997867 - RNA, 23 nt, Human
cccaccuucauccacucacccca

SEQ ID NO: 997868 - RNA, 21 nt, Human
cccacuugccacccccauuuc

SEQ ID NO: 997869 - RNA, 24 nt, Human
ccccaauacccaccuucauccacu

SEQ ID NO: 997870 - RNA, 20 nt, Human
ccuauacuacugauagaugg

SEQ ID NO: 997871 - RNA, 22 nt, Human
ccuauacuacugauagauggaa

SEQ ID NO: 997872 - RNA, 19 nt, Human
ccucugcagcacccccgcc

SEQ ID NO: 997873 - RNA, 18 nt, Human
ccugcagcccgucccggc

SEQ ID NO: 997874 - RNA, 23 nt, Human
cgccgcgccgcgcagagcuccuc

SEQ ID NO: 997875 - RNA, 22 nt, Human
cgccugcagcccgucccggcuc

SEQ ID NO: 997876 - RNA, 22 nt, Human
cuacagauccacuccucugaga

SEQ ID NO: 997877 - RNA, 22 nt, Human
cucaccccacuugccaccccca

SEQ ID NO: 997878 - RNA, 19 nt, Human
cucagcccugacauucagu

SEQ ID NO: 997879 - RNA, 23 nt, Human
cugcagcacccccgccugcagcc

SEQ ID NO: 997880 - RNA, 24 nt, Human
cuuucacagccacccccaauaccc

SEQ ID NO: 997881 - RNA, 25 nt, Human
gaaaacaacuaugacaaucuguagc

SEQ ID NO: 997882 - RNA, 18 nt, Human
gaaagacagacuucuaca

SEQ ID NO: 997883 - RNA, 20 nt, Human
gacuccaguugauucgguac

SEQ ID NO: 997884 - RNA, 21 nt, Human
gcauaaacaauaauaaaacaa

SEQ ID NO: 997885 - RNA, 18 nt, Human
ggcagaaaagagacuuga

SEQ ID NO: 997886 - RNA, 22 nt, Human
ggguagcagaacaaagguagga

SEQ ID NO: 997887 - RNA, 24 nt, Human
guccucugcagcacccccgccugc

SEQ ID NO: 997888 - RNA, 19 nt, Human
gugaucaaaagaauauguu

SEQ ID NO: 997889 - RNA, 23 nt, Human
guuaaaaaaaaauuuuuuuuuuu

SEQ ID NO: 997890 - RNA, 19 nt, Human
guuccacucucaagucacc

SEQ ID NO: 997891 - RNA, 20 nt, Human
uaaaaaaugcuuuaggucac

SEQ ID NO: 997892 - RNA, 20 nt, Human
uaaaagcacaucugguagaa

SEQ ID NO: 997893 - RNA, 24 nt, Human
uaaaauuuuaaccuggugaaaaau

SEQ ID NO: 997894 - RNA, 23 nt, Human
uaaagcaggaaaacaacuaugac

SEQ ID NO: 997895 - RNA, 22 nt, Human
uaagaaguagacuaguucauag

SEQ ID NO: 997896 - RNA, 18 nt, Human
uaauuacuauguuucuca

SEQ ID NO: 997897 - RNA, 22 nt, Human
uacaacaagcuguuuccagacc

SEQ ID NO: 997898 - RNA, 23 nt, Human
uacccaccuucauccacucaccc

SEQ ID NO: 997899 - RNA, 22 nt, Human
uaguuaagaaucaaauauacag

SEQ ID NO: 997900 - RNA, 20 nt, Human
uauguaccuuauaccaaaac

SEQ ID NO: 997901 - RNA, 20 nt, Human
uauuuucuucuacacuugag

SEQ ID NO: 997902 - RNA, 20 nt, Human
ucauaguucaaccuacugaa

SEQ ID NO: 997903 - RNA, 26 nt, Human
ucauccacucaccccacuugccaccc

SEQ ID NO: 997904 - RNA, 23 nt, Human
uccaaaauauuuuuuguagcuag

SEQ ID NO: 997905 - RNA, 25 nt, Human
uccaauacuauacaaaaaauagacu

SEQ ID NO: 997906 - RNA, 19 nt, Human
ucccaagaauagaggugaa

SEQ ID NO: 997907 - RNA, 22 nt, Human
ucugcagcacccccgccugcag

SEQ ID NO: 997908 - RNA, 21 nt, Human
ugaaaaguuaguagcagggca

SEQ ID NO: 997909 - RNA, 21 nt, Human
ugaaaugguuacugucacaaa

SEQ ID NO: 997910 - RNA, 23 nt, Human
ugaagacaacaaugguuccccua

SEQ ID NO: 997911 - RNA, 19 nt, Human
ugauucuccauuauuuucu

SEQ ID NO: 997912 - RNA, 25 nt, Human
ugcccuauuucccacaaacuccaua

SEQ ID NO: 997913 - RNA, 25 nt, Human
uggcagcauguuauuuuauaacugg

SEQ ID NO: 997914 - RNA, 21 nt, Human
uggcauuccagaucuggagca

SEQ ID NO: 997915 - RNA, 21 nt, Human
uguaaagcaggaaaacaacua

SEQ ID NO: 997916 - RNA, 22 nt, Human
uguuucuggcauuucuacuaau

SEQ ID NO: 997917 - RNA, 24 nt, Human
uuaagaaguagacuaguucauaga

SEQ ID NO: 997918 - RNA, 21 nt, Human
uuccagaucuggagcaauuuu

SEQ ID NO: 997919 - RNA, 19 nt, Human
uucuaaauccauccucacc

SEQ ID NO: 997920 - RNA, 18 nt, Human
uuuaccagcuucuagauc

SEQ ID NO: 997921 - RNA, 20 nt, Human
uuucccacaaacuccauaaa

SEQ ID NO: 997922 - RNA, 18 nt, Human
uuuuaagcauagacucca

SEQ ID NO: 997923 - RNA, 18 nt, Human
aagcaaaaaucaaagcaa

SEQ ID NO: 997924 - RNA, 21 nt, Human
aaggaggccaagcaaaaauca

SEQ ID NO: 997925 - RNA, 21 nt, Human
acacagacaggaauuaugacc

SEQ ID NO: 997926 - RNA, 23 nt, Human
acacagacaggaauuaugaccag

SEQ ID NO: 997927 - RNA, 21 nt, Human
agaacgcagcuggccccgccg

SEQ ID NO: 997928 - RNA, 21 nt, Human
agagaucacaaguaguuggau

SEQ ID NO: 997929 - RNA, 19 nt, Human
aggcagagaugggcugggu

SEQ ID NO: 997930 - RNA, 23 nt, Human
aggcagccgccacuagccgcuuc

SEQ ID NO: 997931 - RNA, 22 nt, Human
aggccaagcaaaaaucaaagca

SEQ ID NO: 997932 - RNA, 21 nt, Human
aguggccgguuucuggaugca

SEQ ID NO: 997933 - RNA, 24 nt, Human
augggcuggguaguggccgguuuc

SEQ ID NO: 997934 - RNA, 26 nt, Human
caacacaaauacaaauggaaaucauu

SEQ ID NO: 997935 - RNA, 26 nt, Human
caggcagccgccacuagccgcuucug

SEQ ID NO: 997936 - RNA, 19 nt, Human
caucauaaaggaggccaag

SEQ ID NO: 997937 - RNA, 19 nt, Human
cauccuguugaucugcuga

SEQ ID NO: 997938 - RNA, 19 nt, Human
ccaagcaaaaaucaaagca

SEQ ID NO: 997939 - RNA, 18 nt, Human
ccccgccgcucgcuccca

SEQ ID NO: 997940 - RNA, 19 nt, Human
cgcgugucgcgagcgcugc

SEQ ID NO: 997941 - RNA, 18 nt, Human
gagcgcugcgcggagggg

SEQ ID NO: 997942 - RNA, 19 nt, Human
gcagauggcagcugcgccc

SEQ ID NO: 997943 - RNA, 20 nt, Human
ggaaaucauuaaacuuucug

SEQ ID NO: 997944 - RNA, 19 nt, Human
ggccccgccgcucgcuccc

SEQ ID NO: 997945 - RNA, 24 nt, Human
ggguuggggacgcaggcagccgcc

SEQ ID NO: 997946 - RNA, 24 nt, Human
uaacaaugucaaggccuggguuuu

SEQ ID NO: 997947 - RNA, 21 nt, Human
uaauugcugaaauuaacauac

SEQ ID NO: 997948 - RNA, 21 nt, Human
uaugaauacugaaaugugaug

SEQ ID NO: 997949 - RNA, 18 nt, Human
ucaacacaaauacaaaug

SEQ ID NO: 997950 - RNA, 25 nt, Human
ucaacacaaauacaaauggaaauca

SEQ ID NO: 997951 - RNA, 20 nt, Human
ucccagagcagauggcagcu

SEQ ID NO: 997952 - RNA, 25 nt, Human
ugaacugaaagggacuguucauuca

SEQ ID NO: 997953 - RNA, 22 nt, Human
ugaagagcuccauccuguugaa

SEQ ID NO: 997954 - RNA, 24 nt, Human
ugaagagcuccauccuguugaucu

SEQ ID NO: 997955 - RNA, 21 nt, Human
ugauguaggugagagagauca

SEQ ID NO: 997956 - RNA, 23 nt, Human
uggcugacuucgagcugagggcu

SEQ ID NO: 997957 - RNA, 21 nt, Human
uggggacgcaggcagccgcca

SEQ ID NO: 997958 - RNA, 21 nt, Human
ugucaaggccuggguuuuucc

SEQ ID NO: 997959 - RNA, 22 nt, Human
ugugacagucaucuaugaauac

SEQ ID NO: 997960 - RNA, 18 nt, Human
aaaccacaauuuauuauc

SEQ ID NO: 997961 - RNA, 25 nt, Human
auagcucuauuucaaucauuuucac

SEQ ID NO: 997962 - RNA, 19 nt, Human
ccucuggguucacuccuga

SEQ ID NO: 997963 - RNA, 23 nt, Human
cuuccauauaguguuccauugca

SEQ ID NO: 997964 - RNA, 24 nt, Human
ucuccaggucuugggcacguucuc

SEQ ID NO: 997965 - RNA, 27 nt, Human
ugccucuggguucacuccugauaauuc

SEQ ID NO: 997966 - RNA, 22 nt, Human
uucacuuccauauaguguucca

SEQ ID NO: 997967 - RNA, 19 nt, Human
aacaaagccacccccucag

SEQ ID NO: 997968 - RNA, 19 nt, Human
aaggaaagccugggccaug

SEQ ID NO: 997969 - RNA, 22 nt, Human
acacaggucacgacccaauccc

SEQ ID NO: 997970 - RNA, 21 nt, Human
acccuccccacccacugcagc

SEQ ID NO: 997971 - RNA, 22 nt, Human
agcuguguggccugggccacug

SEQ ID NO: 997972 - RNA, 19 nt, Human
aggaaagccugggccaugu

SEQ ID NO: 997973 - RNA, 24 nt, Human
aggaggccaaagcaccauggggau

SEQ ID NO: 997974 - RNA, 21 nt, Human
aggggauugggagccccaggg

SEQ ID NO: 997975 - RNA, 22 nt, Human
agggugcccucagccaaccuug

SEQ ID NO: 997976 - RNA, 19 nt, Human
aguaugagagcagguggga

SEQ ID NO: 997977 - RNA, 23 nt, Human
agugagagcagagauggcaaagg

SEQ ID NO: 997978 - RNA, 24 nt, Human
agugagagcagagauggcaaaggg

SEQ ID NO: 997979 - RNA, 20 nt, Human
caagggugcagagaaggagg

SEQ ID NO: 997980 - RNA, 25 nt, Human
caccccuguaaaccacccuccccac

SEQ ID NO: 997981 - RNA, 21 nt, Human
cacccuccccacccacugcag

SEQ ID NO: 997982 - RNA, 25 nt, Human
cacccuccccacccacugcagcuca

SEQ ID NO: 997983 - RNA, 23 nt, Human
cagcagccagcccugggggagug

SEQ ID NO: 997984 - RNA, 23 nt, Human
cagccaaccuugccaagcauggc

SEQ ID NO: 997985 - RNA, 23 nt, Human
cagcccugcccucgugccaaggg

SEQ ID NO: 997986 - RNA, 19 nt, Human
ccagggagguggggccucc

SEQ ID NO: 997987 - RNA, 20 nt, Human
cccagugagagcagagaugg

SEQ ID NO: 997988 - RNA, 22 nt, Human
ccccagggagguggggccucca

SEQ ID NO: 997989 - RNA, 22 nt, Human
ccccuguaaaccacccucccca

SEQ ID NO: 997990 - RNA, 20 nt, Human
ccgcccagugagcugugugg

SEQ ID NO: 997991 - RNA, 18 nt, Human
ccucagcuaagcaucucc

SEQ ID NO: 997992 - RNA, 20 nt, Human
ccuccccuggggacucuggg

SEQ ID NO: 997993 - RNA, 26 nt, Human
ccugggacucccaggggaaaaucaga

SEQ ID NO: 997994 - RNA, 18 nt, Human
ccugggccacuguccucc

SEQ ID NO: 997995 - RNA, 22 nt, Human
ccuggggacucugggccugcug

SEQ ID NO: 997996 - RNA, 20 nt, Human
ccuguaaaccacccucccca

SEQ ID NO: 997997 - RNA, 21 nt, Human
ccuguaaaccacccuccccac

SEQ ID NO: 997998 - RNA, 24 nt, Human
cgaccugcaaauagucuaacaaag

SEQ ID NO: 997999 - RNA, 20 nt, Human
cuccacacaggucacgaccc

SEQ ID NO: 998000 - RNA, 23 nt, Human
cucucuggccuguccuccacagg

SEQ ID NO: 998001 - RNA, 26 nt, Human
cuuuuuuuuuuuuuuuuugcuccuuu

SEQ ID NO: 998002 - RNA, 20 nt, Human
cuuuuuuuuuuuuuuuuugg

SEQ ID NO: 998003 - RNA, 22 nt, Human
gaaaauauacacacuucagucc

SEQ ID NO: 998004 - RNA, 19 nt, Human
gagagcagagauggcaaag

SEQ ID NO: 998005 - RNA, 20 nt, Human
gagagccagcccugcccucg

SEQ ID NO: 998006 - RNA, 23 nt, Human
gaggggcugcacagagcaccccu

SEQ ID NO: 998007 - RNA, 19 nt, Human
gcaccauggggaugggaug

SEQ ID NO: 998008 - RNA, 24 nt, Human
gccacccccucagcuaagcaucuc

SEQ ID NO: 998009 - RNA, 19 nt, Human
ggaaggggaggaggguccc

SEQ ID NO: 998010 - RNA, 19 nt, Human
ggagccccagggagguggg

SEQ ID NO: 998011 - RNA, 19 nt, Human
ggagguggggccuccagac

SEQ ID NO: 998012 - RNA, 25 nt, Human
ggauggaggcauugggagagccagc

SEQ ID NO: 998013 - RNA, 20 nt, Human
ggcccagucccccaucucag

SEQ ID NO: 998014 - RNA, 23 nt, Human
gggagccccagggagguggggcc

SEQ ID NO: 998015 - RNA, 19 nt, Human
gggauugggagccccaggg

SEQ ID NO: 998016 - RNA, 22 nt, Human
ggggaugggauggaggcauugg

SEQ ID NO: 998017 - RNA, 20 nt, Human
ggugcccucagccaaccuug

SEQ ID NO: 998018 - RNA, 20 nt, Human
uaaaaaauagaucaagaaaa

SEQ ID NO: 998019 - RNA, 18 nt, Human
uaacaaagccacccccuc

SEQ ID NO: 998020 - RNA, 22 nt, Human
uacugcccacagaacgucccuu

SEQ ID NO: 998021 - RNA, 20 nt, Human
uagaucaagaaaauauacac

SEQ ID NO: 998022 - RNA, 22 nt, Human
ucacgacccaaucccccaggca

SEQ ID NO: 998023 - RNA, 21 nt, Human
ucagaggggcugcacagagca

SEQ ID NO: 998024 - RNA, 23 nt, Human
ucauggugggaacagggccacac

SEQ ID NO: 998025 - RNA, 18 nt, Human
uccacacaggucacgacc

SEQ ID NO: 998026 - RNA, 19 nt, Human
uccacaggcccuggcagcu

SEQ ID NO: 998027 - RNA, 21 nt, Human
uccccagugagagcagagauu

SEQ ID NO: 998028 - RNA, 21 nt, Human
uccccuggaccugggacuccc

SEQ ID NO: 998029 - RNA, 21 nt, Human
uccccuggggacucugggccu

SEQ ID NO: 998030 - RNA, 22 nt, Human
uccuccuuccccuggaccuggg

SEQ ID NO: 998031 - RNA, 18 nt, Human
ugagagcaggugggaagg

SEQ ID NO: 998032 - RNA, 20 nt, Human
ugagagcaggugggaagggg

SEQ ID NO: 998033 - RNA, 19 nt, Human
ugagagccgcccagugagc

SEQ ID NO: 998034 - RNA, 22 nt, Human
ugccaagggugcagagaaggag

SEQ ID NO: 998035 - RNA, 24 nt, Human
ugcuccuuuuccuuuuuauuaaaa

SEQ ID NO: 998036 - RNA, 21 nt, Human
uggaaggaaagccugggccau

SEQ ID NO: 998037 - RNA, 20 nt, Human
uggaggcauugggagagcca

SEQ ID NO: 998038 - RNA, 18 nt, Human
ugggaacagggccacaca

SEQ ID NO: 998039 - RNA, 23 nt, Human
ugggaacagggccacacagggcu

SEQ ID NO: 998040 - RNA, 23 nt, Human
uggggacucugggccugcuggcc

SEQ ID NO: 998041 - RNA, 21 nt, Human
uuccccuggaccugggacucc

SEQ ID NO: 998042 - RNA, 18 nt, Human
uuuuuugcuccuuuuccu

SEQ ID NO: 998043 - RNA, 23 nt, Human
uuuuuugcuccuuuuccuuuuua

SEQ ID NO: 998044 - RNA, 19 nt, Human
uuuuuuuuuuuuuuuugcu

SEQ ID NO: 998045 - RNA, 18 nt, Human
agagggagggggcggagc

SEQ ID NO: 998046 - RNA, 18 nt, Human
agaugggagaaucacuug

SEQ ID NO: 998047 - RNA, 26 nt, Human
agaugggagaaucacuugaauaccug

SEQ ID NO: 998048 - RNA, 22 nt, Human
agcuacucaggagaccgagaug

SEQ ID NO: 998049 - RNA, 22 nt, Human
agggagagggagggggcggagc

SEQ ID NO: 998050 - RNA, 24 nt, Human
caccuguagucccagcuacucagg

SEQ ID NO: 998051 - RNA, 24 nt, Human
caggagaccgagaugggagaauca

SEQ ID NO: 998052 - RNA, 21 nt, Human
ccuguagucccagcuacucag

SEQ ID NO: 998053 - RNA, 22 nt, Human
ggaauaaauaguaacuuauuua

SEQ ID NO: 998054 - RNA, 20 nt, Human
ggagagggagggggcggagc

SEQ ID NO: 998055 - RNA, 24 nt, Human
ggcggagcggaauaaauaguaacu

SEQ ID NO: 998056 - RNA, 24 nt, Human
gggcuuaguggcaugcaccuguag

SEQ ID NO: 998057 - RNA, 21 nt, Human
uaagaaaugcacuuggauucc

SEQ ID NO: 998058 - RNA, 24 nt, Human
uaguggcaugcaccuguaguccca

SEQ ID NO: 998059 - RNA, 22 nt, Human
uggcaugcaccuguagucccag

SEQ ID NO: 998060 - RNA, 21 nt, Human
uuguuucgugugcuuuuaaau

SEQ ID NO: 998061 - RNA, 23 nt, Human
uuuuuuuuuuuguuucgugugcu

SEQ ID NO: 998062 - RNA, 18 nt, Human
uuuuuuuuuuuuuguuuc

SEQ ID NO: 998063 - RNA, 18 nt, Human
uuuuuuuuuuuuuuuuug

SEQ ID NO: 998064 - RNA, 22 nt, Human
uuuuuuuuuuuuuuuuuuguuu

SEQ ID NO: 998065 - RNA, 22 nt, Human
aaaaagcaaguccuucaaccua

SEQ ID NO: 998066 - RNA, 23 nt, Human
aaaagagauaggcaggagauaua

SEQ ID NO: 998067 - RNA, 26 nt, Human
aacacuuccccgagcagauccugcca

SEQ ID NO: 998068 - RNA, 23 nt, Human
acuuccccgagcagauccugcca

SEQ ID NO: 998069 - RNA, 20 nt, Human
acuuuggaaugcaaaagaga

SEQ ID NO: 998070 - RNA, 22 nt, Human
aggcaggagauauaacgagguu

SEQ ID NO: 998071 - RNA, 20 nt, Human
auccugccagauuugguuca

SEQ ID NO: 998072 - RNA, 24 nt, Human
caaaaauacgcugcccaaaaagca

SEQ ID NO: 998073 - RNA, 22 nt, Human
caaaagagauaggcaggagaua

SEQ ID NO: 998074 - RNA, 28 nt, Human
caaaagaugcaugcaacauuucgacauu

SEQ ID NO: 998075 - RNA, 19 nt, Human
caaagaaaaaaucuuagac

SEQ ID NO: 998076 - RNA, 22 nt, Human
caacuaaaguucucugucuccu

SEQ ID NO: 998077 - RNA, 24 nt, Human
caccuccaaaaauacgcugcccaa

SEQ ID NO: 998078 - RNA, 19 nt, Human
ccgagcagauccugccaga

SEQ ID NO: 998079 - RNA, 22 nt, Human
ccuccaaaaauacgcugcccaa

SEQ ID NO: 998080 - RNA, 22 nt, Human
gccuuggucuucugcuguuuga

SEQ ID NO: 998081 - RNA, 25 nt, Human
ggaaaacacuuccccgagcagaucc

SEQ ID NO: 998082 - RNA, 19 nt, Human
gggaagccacuaauagaaa

SEQ ID NO: 998083 - RNA, 19 nt, Human
uaaaguucucugucuccuc

SEQ ID NO: 998084 - RNA, 19 nt, Human
uccccgagcagauccugcc

SEQ ID NO: 998085 - RNA, 20 nt, Human
ucuccucacgcagcagaggc

SEQ ID NO: 998086 - RNA, 23 nt, Human
aaacaauguaaugauucgguaaa

SEQ ID NO: 998087 - RNA, 18 nt, Human
aaccauaggggcugggag

SEQ ID NO: 998088 - RNA, 19 nt, Human
aaccugcgauugacagaaa

SEQ ID NO: 998089 - RNA, 21 nt, Human
aauagaacuucuugcuuaaaa

SEQ ID NO: 998090 - RNA, 21 nt, Human
agaaaaacucugaaaccugaa

SEQ ID NO: 998091 - RNA, 22 nt, Human
agagaacugcacggagugaaau

SEQ ID NO: 998092 - RNA, 18 nt, Human
aggaguuagaaauaaagc

SEQ ID NO: 998093 - RNA, 19 nt, Human
auagaacuucuugcuuaaa

SEQ ID NO: 998094 - RNA, 20 nt, Human
auagaacuucuugcuuaaaa

SEQ ID NO: 998095 - RNA, 25 nt, Human
cacaaaaauauccccgcagcucaua

SEQ ID NO: 998096 - RNA, 23 nt, Human
caccagaaagcagcauuggccuc

SEQ ID NO: 998097 - RNA, 18 nt, Human
cagaaaaaauuuucucau

SEQ ID NO: 998098 - RNA, 25 nt, Human
cagaauaauucugagcugccaguga

SEQ ID NO: 998099 - RNA, 21 nt, Human
cagcccggggugagagcgcgg

SEQ ID NO: 998100 - RNA, 22 nt, Human
cagucuugcuuugguucacacu

SEQ ID NO: 998101 - RNA, 24 nt, Human
cauuaaauagaacuucuugcuuaa

SEQ ID NO: 998102 - RNA, 25 nt, Human
cccaguuaaccacucauuuuggaag

SEQ ID NO: 998103 - RNA, 20 nt, Human
ccccgccgccccagcgcucc

SEQ ID NO: 998104 - RNA, 25 nt, Human
cccugaauaaccacugacgagguuu

SEQ ID NO: 998105 - RNA, 22 nt, Human
ccgccgcccgagagccggcucc

SEQ ID NO: 998106 - RNA, 21 nt, Human
cgccccagcgcucccgcaugg

SEQ ID NO: 998107 - RNA, 21 nt, Human
cuuguauuuguuuacuuauuu

SEQ ID NO: 998108 - RNA, 21 nt, Human
cuugugagcuuaagguuugcc

SEQ ID NO: 998109 - RNA, 24 nt, Human
gacccuuugccucuuuauuucuuc

SEQ ID NO: 998110 - RNA, 19 nt, Human
gagcacucaaaauuacuug

SEQ ID NO: 998111 - RNA, 23 nt, Human
gccccagcgcucccgcauggcac

SEQ ID NO: 998112 - RNA, 22 nt, Human
gccccgccgccccagcgcuccc

SEQ ID NO: 998113 - RNA, 19 nt, Human
gcucuaaaaaaacuuguca

SEQ ID NO: 998114 - RNA, 21 nt, Human
gggaaggaaacuucagcgccg

SEQ ID NO: 998115 - RNA, 19 nt, Human
uaaucaaauaaccugcgau

SEQ ID NO: 998116 - RNA, 18 nt, Human
uaauuuuuuuuccaccag

SEQ ID NO: 998117 - RNA, 21 nt, Human
uacaagaucuauaaaaugcuc

SEQ ID NO: 998118 - RNA, 19 nt, Human
uagaaauaaagccagccaa

SEQ ID NO: 998119 - RNA, 23 nt, Human
uagaaauaaagccagccaacuuu

SEQ ID NO: 998120 - RNA, 23 nt, Human
uagaaccaggccuuuaaaaggcc

SEQ ID NO: 998121 - RNA, 22 nt, Human
uaggaacuguaggaaagguuuu

SEQ ID NO: 998122 - RNA, 25 nt, Human
uauucuacagcuguagaagaaauca

SEQ ID NO: 998123 - RNA, 25 nt, Human
ucagaaaguguugguacguuguuca

SEQ ID NO: 998124 - RNA, 18 nt, Human
ucccaugaaaugcccagg

SEQ ID NO: 998125 - RNA, 23 nt, Human
ucccgcauggcacggggcgccag

SEQ ID NO: 998126 - RNA, 22 nt, Human
ucucuuaaugcacagguucugg

SEQ ID NO: 998127 - RNA, 18 nt, Human
ugacagaaaaaauuuucu

SEQ ID NO: 998128 - RNA, 18 nt, Human
ugauauacaugacaucuc

SEQ ID NO: 998129 - RNA, 19 nt, Human
ugcucagacccugaauaac

SEQ ID NO: 998130 - RNA, 21 nt, Human
uggcugccuccuuuuaguaaa

SEQ ID NO: 998131 - RNA, 18 nt, Human
uuagucaaaacaauguaa

SEQ ID NO: 998132 - RNA, 21 nt, Human
uucuucagaaugaccuucuga

SEQ ID NO: 998133 - RNA, 24 nt, Human
uuuuuuuuuuuuuuuuuucccaug

SEQ ID NO: 998134 - RNA, 23 nt, Human
aagcacccaggggucuaggaaug

SEQ ID NO: 998135 - RNA, 22 nt, Human
aagcacccgaagacccucggcc

SEQ ID NO: 998136 - RNA, 24 nt, Human
acacaaggccauccacuuccacgg

SEQ ID NO: 998137 - RNA, 23 nt, Human
acccccgcgaacaaagccccaac

SEQ ID NO: 998138 - RNA, 20 nt, Human
agcugugacccccgcgaaca

SEQ ID NO: 998139 - RNA, 19 nt, Human
aggacagcaagggcagcuu

SEQ ID NO: 998140 - RNA, 25 nt, Human
aggggccagaggggagaaccaagcu

SEQ ID NO: 998141 - RNA, 19 nt, Human
agguggcacagaccagagc

SEQ ID NO: 998142 - RNA, 19 nt, Human
agugucccccacccagggc

SEQ ID NO: 998143 - RNA, 18 nt, Human
caacggucgcagcgcgcc

SEQ ID NO: 998144 - RNA, 24 nt, Human
cacagcccuuggcuaagaccgucu

SEQ ID NO: 998145 - RNA, 21 nt, Human
cacccgaagacccucggccaa

SEQ ID NO: 998146 - RNA, 20 nt, Human
cacccucccaagcgcccaag

SEQ ID NO: 998147 - RNA, 26 nt, Human
caggaggcccuucuccuggagcagcc

SEQ ID NO: 998148 - RNA, 22 nt, Human
caggggucuaggaaugcucccc

SEQ ID NO: 998149 - RNA, 21 nt, Human
ccaaugccaccacagcccuug

SEQ ID NO: 998150 - RNA, 21 nt, Human
ccacagccagccuggccaagg

SEQ ID NO: 998151 - RNA, 24 nt, Human
ccacccagggccucucccuucacu

SEQ ID NO: 998152 - RNA, 19 nt, Human
cccacacaguggucugagc

SEQ ID NO: 998153 - RNA, 22 nt, Human
cccacagccagccuggccaagg

SEQ ID NO: 998154 - RNA, 19 nt, Human
cccacuuguacagugagac

SEQ ID NO: 998155 - RNA, 19 nt, Human
ccccaacccccagacaccg

SEQ ID NO: 998156 - RNA, 24 nt, Human
cccgcaggcugugcugugcaccuc

SEQ ID NO: 998157 - RNA, 19 nt, Human
cccuucacugcacaggaca

SEQ ID NO: 998158 - RNA, 19 nt, Human
ccucccacacaguggucug

SEQ ID NO: 998159 - RNA, 28 nt, Human
ccucccacacaguggucugagcagaggc

SEQ ID NO: 998160 - RNA, 22 nt, Human
cgaagacccucggccaaugcca

SEQ ID NO: 998161 - RNA, 18 nt, Human
cgugagccggcugugccu

SEQ ID NO: 998162 - RNA, 18 nt, Human
cucccacucugagugucc

SEQ ID NO: 998163 - RNA, 25 nt, Human
cugagugucccccacccagggccuc

SEQ ID NO: 998164 - RNA, 18 nt, Human
cugcucagccuuccuugc

SEQ ID NO: 998165 - RNA, 24 nt, Human
cugugccuggcugcccccaacccc

SEQ ID NO: 998166 - RNA, 21 nt, Human
gaacuuggcugcaggccgaca

SEQ ID NO: 998167 - RNA, 21 nt, Human
gacacccucccaagcgcccaa

SEQ ID NO: 998168 - RNA, 19 nt, Human
gaccagacccucccacagc

SEQ ID NO: 998169 - RNA, 24 nt, Human
gccgacacccucccaagcgcccaa

SEQ ID NO: 998170 - RNA, 24 nt, Human
gcucccacucugagugucccccac

SEQ ID NO: 998171 - RNA, 21 nt, Human
gcugcccccaacccccagaca

SEQ ID NO: 998172 - RNA, 21 nt, Human
ggccagaggggagaaccaagc

SEQ ID NO: 998173 - RNA, 22 nt, Human
gggaagcacccgaagacccucg

SEQ ID NO: 998174 - RNA, 21 nt, Human
guggccccuccgugagccggc

SEQ ID NO: 998175 - RNA, 19 nt, Human
uaagaccgucugccaagcc

SEQ ID NO: 998176 - RNA, 22 nt, Human
uaggaaugcucccccuucucuc

SEQ ID NO: 998177 - RNA, 24 nt, Human
uccacugugcuccugcuacaugga

SEQ ID NO: 998178 - RNA, 20 nt, Human
ucccaagcgcccaagcgcgg

SEQ ID NO: 998179 - RNA, 23 nt, Human
ucccaagcgcccaagcgcggccc

SEQ ID NO: 998180 - RNA, 18 nt, Human
ucccccgugacagugaac

SEQ ID NO: 998181 - RNA, 18 nt, Human
ucccccuucucuccaggg

SEQ ID NO: 998182 - RNA, 26 nt, Human
uccgugagccggcugugccuggcugc

SEQ ID NO: 998183 - RNA, 24 nt, Human
ucugugcagacaagcacccagggg

SEQ ID NO: 998184 - RNA, 22 nt, Human
ugaaugguuuaauaacucuguc

SEQ ID NO: 998185 - RNA, 18 nt, Human
ugcucuggccagcaggag

SEQ ID NO: 998186 - RNA, 19 nt, Human
ugcugggaugugcucccac

SEQ ID NO: 998187 - RNA, 21 nt, Human
uggcaagcucucacacuuuac

SEQ ID NO: 998188 - RNA, 21 nt, Human
ugggaccagacccucccacag

SEQ ID NO: 998189 - RNA, 22 nt, Human
ugggaccagacccucccacagc

SEQ ID NO: 998190 - RNA, 20 nt, Human
ugggcacugcugggaugugc

SEQ ID NO: 998191 - RNA, 19 nt, Human
uguacagugagacccuggc

SEQ ID NO: 998192 - RNA, 19 nt, Human
ugugguggccccuccguuc

SEQ ID NO: 998193 - RNA, 22 nt, Human
ugugguggccccuccguucaaa

SEQ ID NO: 998194 - RNA, 24 nt, Human
uugaaugguuuaauaacucugucu

SEQ ID NO: 998195 - RNA, 18 nt, Human
uuuuuuuuuuuuuuuuug

SEQ ID NO: 998196 - RNA, 20 nt, Human
aaaaagacagggucaaauga

SEQ ID NO: 998197 - RNA, 22 nt, Human
aaacaaaauugcacucuugaaa

SEQ ID NO: 998198 - RNA, 22 nt, Human
aaacaaaauugcacucuugaaa

SEQ ID NO: 998199 - RNA, 22 nt, Human
aaacaaauuauuaaaacagaga

SEQ ID NO: 998200 - RNA, 21 nt, Human
aaacaagcagcacccccaagg

SEQ ID NO: 998201 - RNA, 21 nt, Human
aaacagugaguugagaaaaug

SEQ ID NO: 998202 - RNA, 22 nt, Human
aaacauugcaagaccucaaaac

SEQ ID NO: 998203 - RNA, 19 nt, Human
aaacgcaggcucugcuugg

SEQ ID NO: 998204 - RNA, 22 nt, Human
aaacggaaaacagaacuauggu

SEQ ID NO: 998205 - RNA, 18 nt, Human
aaaguacugagcagcucu

SEQ ID NO: 998206 - RNA, 23 nt, Human
aaagugugugacauaggccaucc

SEQ ID NO: 998207 - RNA, 22 nt, Human
aaaugaaaaugaaaaccuucuc

SEQ ID NO: 998208 - RNA, 19 nt, Human
aacacacaucugcaagucc

SEQ ID NO: 998209 - RNA, 19 nt, Human
aacccagaggggaggaaac

SEQ ID NO: 998210 - RNA, 21 nt, Human
aacccagaggggaggaaacgg

SEQ ID NO: 998211 - RNA, 23 nt, Human
aagcagcggaggcuccagaagcc

SEQ ID NO: 998212 - RNA, 21 nt, Human
aaggauaaauaauucuucaga

SEQ ID NO: 998213 - RNA, 21 nt, Human
aaggauaaauaauucuucaga

SEQ ID NO: 998214 - RNA, 23 nt, Human
aaggggugguggaauggggcugc

SEQ ID NO: 998215 - RNA, 21 nt, Human
aaucccaaccuggccgccugu

SEQ ID NO: 998216 - RNA, 18 nt, Human
aaucccccagaggaguug

SEQ ID NO: 998217 - RNA, 18 nt, Human
aaucccccagaggaguug

SEQ ID NO: 998218 - RNA, 24 nt, Human
acaaacaaauuauuaaaacagaga

SEQ ID NO: 998219 - RNA, 18 nt, Human
acaagcagcacccccaag

SEQ ID NO: 998220 - RNA, 21 nt, Human
acaagcagcacccccaagcac

SEQ ID NO: 998221 - RNA, 19 nt, Human
acaagcccuagaaccagag

SEQ ID NO: 998222 - RNA, 23 nt, Human
acagugcagcaggagaaaugaaa

SEQ ID NO: 998223 - RNA, 21 nt, Human
accccggcucgcgcacgcggc

SEQ ID NO: 998224 - RNA, 18 nt, Human
acccugcuagaaaggccc

SEQ ID NO: 998225 - RNA, 22 nt, Human
acccugcuagaaaggcccuacu

SEQ ID NO: 998226 - RNA, 20 nt, Human
acgugugugugugugugugu

SEQ ID NO: 998227 - RNA, 20 nt, Human
acgugugugugugugugugu

SEQ ID NO: 998228 - RNA, 22 nt, Human
acucuugaauuuuagaaagaag

SEQ ID NO: 998229 - RNA, 19 nt, Human
agaaacacaaaaacauugc

SEQ ID NO: 998230 - RNA, 22 nt, Human
agaaacacaccugcgggccucc

SEQ ID NO: 998231 - RNA, 23 nt, Human
agacagacuagacacagugcagc

SEQ ID NO: 998232 - RNA, 18 nt, Human
agacaguaaacagugagu

SEQ ID NO: 998233 - RNA, 21 nt, Human
agagagaccauggccccaggc

SEQ ID NO: 998234 - RNA, 18 nt, Human
agagcccuucugacacac

SEQ ID NO: 998235 - RNA, 23 nt, Human
agaggcaccggcagagaagaggc

SEQ ID NO: 998236 - RNA, 21 nt, Human
agaggcaggagaagcugccug

SEQ ID NO: 998237 - RNA, 20 nt, Human
agauuaaaaagacaggguca

SEQ ID NO: 998238 - RNA, 21 nt, Human
agcgcgugacacaggccaucc

SEQ ID NO: 998239 - RNA, 24 nt, Human
aggaagaaaaaucauguuucuuuu

SEQ ID NO: 998240 - RNA, 24 nt, Human
aggaagaaaaaucauguuucuuuu

SEQ ID NO: 998241 - RNA, 20 nt, Human
aggagaaaggagggagaggc

SEQ ID NO: 998242 - RNA, 25 nt, Human
aggcagcuggcugucccaggggcug

SEQ ID NO: 998243 - RNA, 19 nt, Human
aggcaggagaagcugccug

SEQ ID NO: 998244 - RNA, 23 nt, Human
aggcaggagaagcugccugagca

SEQ ID NO: 998245 - RNA, 20 nt, Human
aggcaggagaagcugccugg

SEQ ID NO: 998246 - RNA, 22 nt, Human
aggccccgugggucccccacuu

SEQ ID NO: 998247 - RNA, 22 nt, Human
aggccuuaaaaauagacaauau

SEQ ID NO: 998248 - RNA, 26 nt, Human
aggcuccagaagccgacgguggagcc

SEQ ID NO: 998249 - RNA, 25 nt, Human
aggcuccaggcuucuaaucacaguu

SEQ ID NO: 998250 - RNA, 24 nt, Human
aggggagaaaggaggugucagccc

SEQ ID NO: 998251 - RNA, 23 nt, Human
agucauugaauuugcuguuggag

SEQ ID NO: 998252 - RNA, 23 nt, Human
agugggagcccuggcagguggug

SEQ ID NO: 998253 - RNA, 19 nt, Human
auauguuuuccaccuuaau

SEQ ID NO: 998254 - RNA, 19 nt, Human
auauguuuuccaccuuaau

SEQ ID NO: 998255 - RNA, 21 nt, Human
aucacugcccaaggggccacu

SEQ ID NO: 998256 - RNA, 27 nt, Human
auccccacguguguguguguguguggu

SEQ ID NO: 998257 - RNA, 21 nt, Human
augaccccgcugcggacagaa

SEQ ID NO: 998258 - RNA, 18 nt, Human
auggccccaggcuggccc

SEQ ID NO: 998259 - RNA, 21 nt, Human
auggggcagaauccaaacacc

SEQ ID NO: 998260 - RNA, 21 nt, Human
auggggcagggaaggagaaag

SEQ ID NO: 998261 - RNA, 24 nt, Human
caaaacacaaauaaauaccaaaua

SEQ ID NO: 998262 - RNA, 25 nt, Human
caaaacacaaauaaauaccaaauaa

SEQ ID NO: 998263 - RNA, 23 nt, Human
caaauaaauaccaaauaaaacca

SEQ ID NO: 998264 - RNA, 19 nt, Human
caaccaaacacaaagacaa

SEQ ID NO: 998265 - RNA, 24 nt, Human
caagaagggcacggggauggggca

SEQ ID NO: 998266 - RNA, 20 nt, Human
cacaaagacaaagcgcguga

SEQ ID NO: 998267 - RNA, 25 nt, Human
cacaaauuacccccaguagagggag

SEQ ID NO: 998268 - RNA, 21 nt, Human
cacacccucacugagccaccc

SEQ ID NO: 998269 - RNA, 18 nt, Human
cacagaccuucuccuaca

SEQ ID NO: 998270 - RNA, 19 nt, Human
cacagcauccaugagcgag

SEQ ID NO: 998271 - RNA, 18 nt, Human
cacaggccaagaagggca

SEQ ID NO: 998272 - RNA, 23 nt, Human
caccgagcugggccacacggggu

SEQ ID NO: 998273 - RNA, 18 nt, Human
caccucacagauacaaaa

SEQ ID NO: 998274 - RNA, 21 nt, Human
cacgucugcccugccaccgca

SEQ ID NO: 998275 - RNA, 20 nt, Human
cacgugugugugugugugug

SEQ ID NO: 998276 - RNA, 20 nt, Human
cacgugugugugugugugug

SEQ ID NO: 998277 - RNA, 18 nt, Human
cacugagccacccaaccc

SEQ ID NO: 998278 - RNA, 18 nt, Human
cagaacagagaccccgau

SEQ ID NO: 998279 - RNA, 22 nt, Human
cagaaccgaacagaggcaccgg

SEQ ID NO: 998280 - RNA, 18 nt, Human
cagaagccgacgguggag

SEQ ID NO: 998281 - RNA, 25 nt, Human
cagcaacagagagcucguccgaaca

SEQ ID NO: 998282 - RNA, 19 nt, Human
cagcagucacccgcccacc

SEQ ID NO: 998283 - RNA, 26 nt, Human
cagcaucagccuggacgaggcagcaa

SEQ ID NO: 998284 - RNA, 20 nt, Human
cagcgccaagugagggugcc

SEQ ID NO: 998285 - RNA, 21 nt, Human
cagcuguugggaucaguguac

SEQ ID NO: 998286 - RNA, 18 nt, Human
caggacccaaaucacugg

SEQ ID NO: 998287 - RNA, 22 nt, Human
caggagccccaguaugccacac

SEQ ID NO: 998288 - RNA, 21 nt, Human
caggaucagguggaaaaugcc

SEQ ID NO: 998289 - RNA, 18 nt, Human
caggcccccgagcagcgg

SEQ ID NO: 998290 - RNA, 20 nt, Human
caggcuccgcgggacaagcc

SEQ ID NO: 998291 - RNA, 18 nt, Human
cagggagcagcccgagcc

SEQ ID NO: 998292 - RNA, 19 nt, Human
cagggugggaccaggccgu

SEQ ID NO: 998293 - RNA, 21 nt, Human
cauaucaucacggacacaccc

SEQ ID NO: 998294 - RNA, 18 nt, Human
cauggagaccgaaggccg

SEQ ID NO: 998295 - RNA, 25 nt, Human
caugggacacguggccccuggccca

SEQ ID NO: 998296 - RNA, 22 nt, Human
ccaaaucacuggucacaaaauc

SEQ ID NO: 998297 - RNA, 20 nt, Human
ccaagcacacagugugcgcc

SEQ ID NO: 998298 - RNA, 20 nt, Human
ccacaggccaagaagggcac

SEQ ID NO: 998299 - RNA, 18 nt, Human
ccacugggccucagcugc

SEQ ID NO: 998300 - RNA, 19 nt, Human
ccagagcacggcgagcuga

SEQ ID NO: 998301 - RNA, 21 nt, Human
ccagccccgagacggccgagg

SEQ ID NO: 998302 - RNA, 23 nt, Human
ccagccccgagacggccgagggg

SEQ ID NO: 998303 - RNA, 20 nt, Human
ccagcuauccccacgugugu

SEQ ID NO: 998304 - RNA, 20 nt, Human
ccagcuauccccacgugugu

SEQ ID NO: 998305 - RNA, 20 nt, Human
ccaugggacacguggccccu

SEQ ID NO: 998306 - RNA, 20 nt, Human
cccaaggggccacugggccu

SEQ ID NO: 998307 - RNA, 18 nt, Human
cccaggccgaggguggag

SEQ ID NO: 998308 - RNA, 20 nt, Human
cccagggugacugaggaccc

SEQ ID NO: 998309 - RNA, 19 nt, Human
cccauccagacuccccuuc

SEQ ID NO: 998310 - RNA, 21 nt, Human
ccccacucucccuagcucucc

SEQ ID NO: 998311 - RNA, 21 nt, Human
ccccacucucccuagcucucc

SEQ ID NO: 998312 - RNA, 19 nt, Human
ccccaugacggggggcggg

SEQ ID NO: 998313 - RNA, 18 nt, Human
cccccacucucccuagcu

SEQ ID NO: 998314 - RNA, 18 nt, Human
cccccauaucaucacgga

SEQ ID NO: 998315 - RNA, 20 nt, Human
ccccgagacggccgaggcuu

SEQ ID NO: 998316 - RNA, 19 nt, Human
ccccguggccacccuuccc

SEQ ID NO: 998317 - RNA, 21 nt, Human
ccccucagcaggugcagaggu

SEQ ID NO: 998318 - RNA, 22 nt, Human
cccgagccacgguguccugaag

SEQ ID NO: 998319 - RNA, 19 nt, Human
cccgcacaccugccagccc

SEQ ID NO: 998320 - RNA, 21 nt, Human
cccgcacaccugccagccccg

SEQ ID NO: 998321 - RNA, 18 nt, Human
cccucagcaggugcagag

SEQ ID NO: 998322 - RNA, 22 nt, Human
ccggcugggcugcaaccccggc

SEQ ID NO: 998323 - RNA, 18 nt, Human
ccuccagcccagcugggg

SEQ ID NO: 998324 - RNA, 19 nt, Human
ccuccagcccagcuggggc

SEQ ID NO: 998325 - RNA, 25 nt, Human
ccuggcagguggugggccugugggg

SEQ ID NO: 998326 - RNA, 21 nt, Human
ccuguggggcccgggcugagg

SEQ ID NO: 998327 - RNA, 21 nt, Human
ccuucugccgcuuccuccguc

SEQ ID NO: 998328 - RNA, 21 nt, Human
ccuucugccgcuuccuccguc

SEQ ID NO: 998329 - RNA, 25 nt, Human
ccuugggcugacaaggaaugacccc

SEQ ID NO: 998330 - RNA, 19 nt, Human
cgcgcacgcggcggccgcg

SEQ ID NO: 998331 - RNA, 21 nt, Human
cgcgguccgucgccgcucggc

SEQ ID NO: 998332 - RNA, 18 nt, Human
cggcacgcguccgccuuc

SEQ ID NO: 998333 - RNA, 21 nt, Human
cgucgacacugcccuccacac

SEQ ID NO: 998334 - RNA, 24 nt, Human
cguucugcuccccgggcugcccca

SEQ ID NO: 998335 - RNA, 20 nt, Human
cuagucccaaagccaggccc

SEQ ID NO: 998336 - RNA, 19 nt, Human
cucacagauacaaaagcaa

SEQ ID NO: 998337 - RNA, 19 nt, Human
cucacucaggcucccucca

SEQ ID NO: 998338 - RNA, 20 nt, Human
cucagaacagagaccccgau

SEQ ID NO: 998339 - RNA, 19 nt, Human
cuccagaagccgacggugg

SEQ ID NO: 998340 - RNA, 24 nt, Human
cuccagaagccgacgguggagccu

SEQ ID NO: 998341 - RNA, 24 nt, Human
cucugcuuggccaccggggccucc

SEQ ID NO: 998342 - RNA, 22 nt, Human
cugaagaaacugcuccugugcg

SEQ ID NO: 998343 - RNA, 21 nt, Human
cugaagaaacugcuccugugg

SEQ ID NO: 998344 - RNA, 19 nt, Human
cuggagcaggcugacgugg

SEQ ID NO: 998345 - RNA, 25 nt, Human
cuucuccuacaggcauuucuuacag

SEQ ID NO: 998346 - RNA, 20 nt, Human
cuuucaaaaaaaagaccuag

SEQ ID NO: 998347 - RNA, 21 nt, Human
gaacaguuugggccacaaaga

SEQ ID NO: 998348 - RNA, 20 nt, Human
gaagagccggcggccgccgc

SEQ ID NO: 998349 - RNA, 21 nt, Human
gaaggggugguggaauggggc

SEQ ID NO: 998350 - RNA, 18 nt, Human
gacacagugcagcaggag

SEQ ID NO: 998351 - RNA, 22 nt, Human
gaccccgcugcggacagaaugg

SEQ ID NO: 998352 - RNA, 22 nt, Human
gagcagcucuguccugcuggga

SEQ ID NO: 998353 - RNA, 21 nt, Human
gagcgguacagcgauccugga

SEQ ID NO: 998354 - RNA, 23 nt, Human
gaggcagcuggcugucccagggg

SEQ ID NO: 998355 - RNA, 21 nt, Human
gcaacagagagcucguccgaa

SEQ ID NO: 998356 - RNA, 19 nt, Human
gcagagacugcucugggga

SEQ ID NO: 998357 - RNA, 20 nt, Human
gcagggggcaggcuccaggc

SEQ ID NO: 998358 - RNA, 21 nt, Human
gccaggccccguggguccccc

SEQ ID NO: 998359 - RNA, 20 nt, Human
gcccagggugacugaggacc

SEQ ID NO: 998360 - RNA, 18 nt, Human
gcccguuggucagccugg

SEQ ID NO: 998361 - RNA, 21 nt, Human
gcccguuggucagccugggca

SEQ ID NO: 998362 - RNA, 21 nt, Human
gcccuuguagagacaaagauu

SEQ ID NO: 998363 - RNA, 20 nt, Human
gcugccccaugacggggggc

SEQ ID NO: 998364 - RNA, 19 nt, Human
ggaaugaccccgcugcgga

SEQ ID NO: 998365 - RNA, 19 nt, Human
ggagucugggagggccggg

SEQ ID NO: 998366 - RNA, 24 nt, Human
ggaucaguguacuccccggcccuc

SEQ ID NO: 998367 - RNA, 24 nt, Human
ggcagcaauaaugaccagguagcc

SEQ ID NO: 998368 - RNA, 18 nt, Human
ggcaggcccccgagcagc

SEQ ID NO: 998369 - RNA, 19 nt, Human
ggcauuucuuacagaaauc

SEQ ID NO: 998370 - RNA, 20 nt, Human
ggccgccgcggcugccgccg

SEQ ID NO: 998371 - RNA, 21 nt, Human
ggccuuaaaaauagacaauau

SEQ ID NO: 998372 - RNA, 24 nt, Human
ggcgucccgccaggagcgucugcc

SEQ ID NO: 998373 - RNA, 18 nt, Human
ggcugcggcuugcacgug

SEQ ID NO: 998374 - RNA, 18 nt, Human
gggagaaaggagguguca

SEQ ID NO: 998375 - RNA, 18 nt, Human
gggcccccucuguccacc

SEQ ID NO: 998376 - RNA, 26 nt, Human
gggcugccccaugacggggggcgggg

SEQ ID NO: 998377 - RNA, 18 nt, Human
ggggaagagccggcggcc

SEQ ID NO: 998378 - RNA, 19 nt, Human
ggggugcagggggcaggcu

SEQ ID NO: 998379 - RNA, 19 nt, Human
ggucugggaggcagcuggc

SEQ ID NO: 998380 - RNA, 21 nt, Human
gguggaaaaugcccuugcagu

SEQ ID NO: 998381 - RNA, 18 nt, Human
guaacagaaccgaacaga

SEQ ID NO: 998382 - RNA, 19 nt, Human
gugcagaggugucugaggg

SEQ ID NO: 998383 - RNA, 19 nt, Human
gugggccuguggggcccgg

SEQ ID NO: 998384 - RNA, 22 nt, Human
guggucacaagagccagugccc

SEQ ID NO: 998385 - RNA, 24 nt, Human
guguguguguguuuuuuugguguu

SEQ ID NO: 998386 - RNA, 24 nt, Human
guguguguguguuuuuuugguguu

SEQ ID NO: 998387 - RNA, 23 nt, Human
guucugcuucgggcugugggggu

SEQ ID NO: 998388 - RNA, 19 nt, Human
guuuuccaauuaagucauu

SEQ ID NO: 998389 - RNA, 23 nt, Human
uaacaugcugacauguccagcua

SEQ ID NO: 998390 - RNA, 23 nt, Human
uaacaugcugacauguccagcua

SEQ ID NO: 998391 - RNA, 27 nt, Human
uaacaugcugacauguccagcuauccc

SEQ ID NO: 998392 - RNA, 27 nt, Human
uaacaugcugacauguccagcuauccc

SEQ ID NO: 998393 - RNA, 24 nt, Human
uaacucacaguaacaacaugauua

SEQ ID NO: 998394 - RNA, 21 nt, Human
uacaauaaacaaaacuagaaa

SEQ ID NO: 998395 - RNA, 18 nt, Human
uacagaaaucaccggaca

SEQ ID NO: 998396 - RNA, 19 nt, Human
uacagaaaucaccggacau

SEQ ID NO: 998397 - RNA, 22 nt, Human
uacagcucugccagagcccuuc

SEQ ID NO: 998398 - RNA, 23 nt, Human
uacuucagggucuucugacaaac

SEQ ID NO: 998399 - RNA, 23 nt, Human
uagcaucagaaacacaaaaacau

SEQ ID NO: 998400 - RNA, 20 nt, Human
uagcucuccuucugcagucu

SEQ ID NO: 998401 - RNA, 28 nt, Human
uaucacaagugauaaccaguguuugaag

SEQ ID NO: 998402 - RNA, 18 nt, Human
uauccacuaugacuuuaa

SEQ ID NO: 998403 - RNA, 21 nt, Human
uauucucuuuccuaucacaag

SEQ ID NO: 998404 - RNA, 21 nt, Human
uauuuuagggugaaaacaauu

SEQ ID NO: 998405 - RNA, 18 nt, Human
ucacagauacaaaagcaa

SEQ ID NO: 998406 - RNA, 21 nt, Human
ucacgcguggcuccucccgcc

SEQ ID NO: 998407 - RNA, 21 nt, Human
ucacgcguggcuccucccgcc

SEQ ID NO: 998408 - RNA, 21 nt, Human
ucacucguggggccuagagau

SEQ ID NO: 998409 - RNA, 19 nt, Human
ucacugagccacccaaccc

SEQ ID NO: 998410 - RNA, 21 nt, Human
ucagaaacacaaaaacauugc

SEQ ID NO: 998411 - RNA, 18 nt, Human
ucagcaggugcagaggug

SEQ ID NO: 998412 - RNA, 22 nt, Human
ucaugcuugauggcuccuagaa

SEQ ID NO: 998413 - RNA, 23 nt, Human
uccacacccucacugagccaccc

SEQ ID NO: 998414 - RNA, 21 nt, Human
uccacccgcacagggaacaca

SEQ ID NO: 998415 - RNA, 22 nt, Human
uccaccuccccagcuacuuauc

SEQ ID NO: 998416 - RNA, 19 nt, Human
uccaggccuucgcccaggg

SEQ ID NO: 998417 - RNA, 23 nt, Human
ucccaggggcugugccuagaacu

SEQ ID NO: 998418 - RNA, 20 nt, Human
uccccacgugugugugugug

SEQ ID NO: 998419 - RNA, 20 nt, Human
uccccacgugugugugugug

SEQ ID NO: 998420 - RNA, 20 nt, Human
ucccuagcucuccuucugca

SEQ ID NO: 998421 - RNA, 20 nt, Human
ucccucagcagucacccgcc

SEQ ID NO: 998422 - RNA, 18 nt, Human
ucccugaugccaccgugc

SEQ ID NO: 998423 - RNA, 24 nt, Human
uccgaaguauccacuaugacuuua

SEQ ID NO: 998424 - RNA, 19 nt, Human
uccgcgggacaagcccuag

SEQ ID NO: 998425 - RNA, 22 nt, Human
uccucaggccaauccuccccgu

SEQ ID NO: 998426 - RNA, 23 nt, Human
ucuagaacaguuugggccacaaa

SEQ ID NO: 998427 - RNA, 22 nt, Human
ucuagcucugcaggcuccgcgg

SEQ ID NO: 998428 - RNA, 21 nt, Human
ucucgcgguccgucgccgcuc

SEQ ID NO: 998429 - RNA, 18 nt, Human
ucugccagagcccuucug

SEQ ID NO: 998430 - RNA, 20 nt, Human
ucugccgcuuccuccgucuc

SEQ ID NO: 998431 - RNA, 20 nt, Human
ucugccgcuuccuccgucuc

SEQ ID NO: 998432 - RNA, 21 nt, Human
ucugcuaaauccaccucccca

SEQ ID NO: 998433 - RNA, 21 nt, Human
ucugcuaaauccaccucccca

SEQ ID NO: 998434 - RNA, 25 nt, Human
ucugugggacccucaggugggcccc

SEQ ID NO: 998435 - RNA, 19 nt, Human
ucuuuguuuuuggguaaca

SEQ ID NO: 998436 - RNA, 20 nt, Human
ugaaaaugaaaaccuucucu

SEQ ID NO: 998437 - RNA, 20 nt, Human
ugaaaaugaaaaccuucucu

SEQ ID NO: 998438 - RNA, 22 nt, Human
ugaaacaaaauugcacucuuga

SEQ ID NO: 998439 - RNA, 23 nt, Human
ugaaacaaaauugcacucuugaa

SEQ ID NO: 998440 - RNA, 23 nt, Human
ugaaacaaaauugcacucuugaa

SEQ ID NO: 998441 - RNA, 22 nt, Human
ugacaaacaaauuauuaaaaca

SEQ ID NO: 998442 - RNA, 21 nt, Human
ugacacaaaucccaaccuggc

SEQ ID NO: 998443 - RNA, 20 nt, Human
ugacauggagaccgaaggcc

SEQ ID NO: 998444 - RNA, 22 nt, Human
ugaccagguagccugccgacac

SEQ ID NO: 998445 - RNA, 22 nt, Human
ugacugaggacccuggagcagg

SEQ ID NO: 998446 - RNA, 18 nt, Human
ugagaaaaugccaucugg

SEQ ID NO: 998447 - RNA, 21 nt, Human
ugagaaaaugccaucugggca

SEQ ID NO: 998448 - RNA, 24 nt, Human
ugagcaaggggcccgcaaggggag

SEQ ID NO: 998449 - RNA, 21 nt, Human
ugagcagcucuguccugcugg

SEQ ID NO: 998450 - RNA, 21 nt, Human
ugagccacccaacccugcuag

SEQ ID NO: 998451 - RNA, 19 nt, Human
ugagcgcgaggaccucagu

SEQ ID NO: 998452 - RNA, 19 nt, Human
ugagcgcgaggaccucagu

SEQ ID NO: 998453 - RNA, 18 nt, Human
ugcagagagaccauggcc

SEQ ID NO: 998454 - RNA, 21 nt, Human
ugcagagagaccauggcccca

SEQ ID NO: 998455 - RNA, 26 nt, Human
ugcagcaagaugacgggauggagaaa

SEQ ID NO: 998456 - RNA, 18 nt, Human
ugccagagcccuucugac

SEQ ID NO: 998457 - RNA, 19 nt, Human
ugcccaggccgagggugga

SEQ ID NO: 998458 - RNA, 21 nt, Human
ugcccaggccgaggguggagc

SEQ ID NO: 998459 - RNA, 22 nt, Human
ugccugggaagggcuacuggag

SEQ ID NO: 998460 - RNA, 23 nt, Human
ugcuagaaaggcccuacucccag

SEQ ID NO: 998461 - RNA, 21 nt, Human
ugcucgaggcgaggggagagg

SEQ ID NO: 998462 - RNA, 19 nt, Human
ugcuguuggaggguaucuu

SEQ ID NO: 998463 - RNA, 19 nt, Human
uggaaugcucagaggguuc

SEQ ID NO: 998464 - RNA, 20 nt, Human
uggagaaacacaccugcggg

SEQ ID NO: 998465 - RNA, 20 nt, Human
uggcacugccacccuacugg

SEQ ID NO: 998466 - RNA, 18 nt, Human
ugggaagggcuacuggag

SEQ ID NO: 998467 - RNA, 19 nt, Human
ugggcugcaaccccggcuc

SEQ ID NO: 998468 - RNA, 26 nt, Human
uggggcagaauccaaacaccuacagg

SEQ ID NO: 998469 - RNA, 25 nt, Human
uggggcagggaaggagaaaggaggg

SEQ ID NO: 998470 - RNA, 21 nt, Human
ugguaaacaagcagcaccccc

SEQ ID NO: 998471 - RNA, 21 nt, Human
ugguggaauggggcugcaaug

SEQ ID NO: 998472 - RNA, 20 nt, Human
ugguggagagaaaagucugg

SEQ ID NO: 998473 - RNA, 19 nt, Human
uggugggccuguggggccc

SEQ ID NO: 998474 - RNA, 24 nt, Human
uggugggccuguggggcccgggcu

SEQ ID NO: 998475 - RNA, 18 nt, Human
ugucggggcucacucagg

SEQ ID NO: 998476 - RNA, 19 nt, Human
ugucggggcucacucaggc

SEQ ID NO: 998477 - RNA, 22 nt, Human
uguggucacaagagccagugcc

SEQ ID NO: 998478 - RNA, 22 nt, Human
uguguuuuccaauuaagucauu

SEQ ID NO: 998479 - RNA, 21 nt, Human
uguuccacaccugccucccuc

SEQ ID NO: 998480 - RNA, 22 nt, Human
uguuccacaccugccucccuca

SEQ ID NO: 998481 - RNA, 23 nt, Human
uguugaguacaugagaggaagac

SEQ ID NO: 998482 - RNA, 23 nt, Human
uguuuuguuacgaaggugacggg

SEQ ID NO: 998483 - RNA, 24 nt, Human
uuaaaacagagaccagaugaggcu

SEQ ID NO: 998484 - RNA, 21 nt, Human
uuaaaacaggcagauuaaaaa

SEQ ID NO: 998485 - RNA, 24 nt, Human
uuaaaacaggcagauuaaaaagac

SEQ ID NO: 998486 - RNA, 22 nt, Human
uuacuagaccaagauguugcau

SEQ ID NO: 998487 - RNA, 21 nt, Human
uucacaagacagacuagacac

SEQ ID NO: 998488 - RNA, 23 nt, Human
uucagagugaaguguggcuaguc

SEQ ID NO: 998489 - RNA, 23 nt, Human
uucagagugaaguguggcuaguc

SEQ ID NO: 998490 - RNA, 18 nt, Human
uucaugcuugauggcucc

SEQ ID NO: 998491 - RNA, 21 nt, Human
uuccuccgucucacaaggucc

SEQ ID NO: 998492 - RNA, 21 nt, Human
uuccuccgucucacaaggucc

SEQ ID NO: 998493 - RNA, 23 nt, Human
uugaaggauaaauaauucuucag

SEQ ID NO: 998494 - RNA, 23 nt, Human
uugaaggauaaauaauucuucag

SEQ ID NO: 998495 - RNA, 25 nt, Human
uugcaaacggaaaacagaacuaugg

SEQ ID NO: 998496 - RNA, 18 nt, Human
uugcagugagcugcuggc

SEQ ID NO: 998497 - RNA, 18 nt, Human
uuggacugucaagaugug

SEQ ID NO: 998498 - RNA, 18 nt, Human
uuggccaccggggccucc

SEQ ID NO: 998499 - RNA, 23 nt, Human
uuuaaaacaggcagauuaaaaag

SEQ ID NO: 998500 - RNA, 25 nt, Human
uuuagcauauauguuuuccaccuua

SEQ ID NO: 998501 - RNA, 25 nt, Human
uuuagcauauauguuuuccaccuua

SEQ ID NO: 998502 - RNA, 24 nt, Human
uuugaaacaaaauugcacucuuga

SEQ ID NO: 998503 - RNA, 24 nt, Human
aaaaaaucagaucucaagacagac

SEQ ID NO: 998504 - RNA, 24 nt, Human
caaagcccagagaacucucaucca

SEQ ID NO: 998505 - RNA, 25 nt, Human
caaaggcaccaggcagcacacgaau

SEQ ID NO: 998506 - RNA, 19 nt, Human
caacagcagcacggaugaa

SEQ ID NO: 998507 - RNA, 20 nt, Human
caccacugccauugccauug

SEQ ID NO: 998508 - RNA, 24 nt, Human
caccagggcacacaucauggccag

SEQ ID NO: 998509 - RNA, 22 nt, Human
cagcagaagcagcugacggggg

SEQ ID NO: 998510 - RNA, 21 nt, Human
cagggagaaggugacacggcg

SEQ ID NO: 998511 - RNA, 19 nt, Human
cauacuuauguguguagaa

SEQ ID NO: 998512 - RNA, 19 nt, Human
caugucugcccuacccaag

SEQ ID NO: 998513 - RNA, 23 nt, Human
ccaccugcacucagcugaggauc

SEQ ID NO: 998514 - RNA, 21 nt, Human
cccaagaccuguuccccacag

SEQ ID NO: 998515 - RNA, 22 nt, Human
cccaucguccuuuccccucgaa

SEQ ID NO: 998516 - RNA, 19 nt, Human
ccccaauucccacccccuu

SEQ ID NO: 998517 - RNA, 21 nt, Human
ccccaucguccuuuccccucg

SEQ ID NO: 998518 - RNA, 25 nt, Human
cccucgaaccccaccugcacucagc

SEQ ID NO: 998519 - RNA, 22 nt, Human
cccuuucucccuccccaauucc

SEQ ID NO: 998520 - RNA, 21 nt, Human
ccugagcaggcaccucagucc

SEQ ID NO: 998521 - RNA, 20 nt, Human
ccugcagcuccugccguugc

SEQ ID NO: 998522 - RNA, 22 nt, Human
ccugcagcuuguaaccauacuu

SEQ ID NO: 998523 - RNA, 25 nt, Human
cuacccuuucucccuccccaauucc

SEQ ID NO: 998524 - RNA, 18 nt, Human
cucccuccccaauuccca

SEQ ID NO: 998525 - RNA, 20 nt, Human
cuccuggcacuaaggaaaua

SEQ ID NO: 998526 - RNA, 25 nt, Human
cucuccaaguucagccagugccuga

SEQ ID NO: 998527 - RNA, 19 nt, Human
cugauagcuccuccagcuc

SEQ ID NO: 998528 - RNA, 18 nt, Human
cuuggccuuggccuccug

SEQ ID NO: 998529 - RNA, 22 nt, Human
gagaacucucauccagggagcc

SEQ ID NO: 998530 - RNA, 22 nt, Human
gagcggccggcacgggcgagcg

SEQ ID NO: 998531 - RNA, 22 nt, Human
gccccacagcccgcgccucgcu

SEQ ID NO: 998532 - RNA, 23 nt, Human
gcuuggccuuggccuccuguagc

SEQ ID NO: 998533 - RNA, 20 nt, Human
ggagccccgccacgugccuu

SEQ ID NO: 998534 - RNA, 22 nt, Human
ggcacgcggcggccccacagcc

SEQ ID NO: 998535 - RNA, 24 nt, Human
ggccagauguggcuucacacucuc

SEQ ID NO: 998536 - RNA, 23 nt, Human
ggcugggggagggaggauggggu

SEQ ID NO: 998537 - RNA, 22 nt, Human
gguccggcccccucuccaaguu

SEQ ID NO: 998538 - RNA, 20 nt, Human
gguuuagccagcccaggguc

SEQ ID NO: 998539 - RNA, 18 nt, Human
gugagaggugugugcccu

SEQ ID NO: 998540 - RNA, 23 nt, Human
gugcuugcagccggagucuuuga

SEQ ID NO: 998541 - RNA, 24 nt, Human
guuuccagcccuucaugaccccaa

SEQ ID NO: 998542 - RNA, 22 nt, Human
uaacagaaccuaggcagcagaa

SEQ ID NO: 998543 - RNA, 19 nt, Human
uaaccaaagcccagagaac

SEQ ID NO: 998544 - RNA, 20 nt, Human
uagagugugaccggcaccaa

SEQ ID NO: 998545 - RNA, 23 nt, Human
uagguaaagggggaaaaaaucag

SEQ ID NO: 998546 - RNA, 24 nt, Human
ucacacucuccuccacaugccgug

SEQ ID NO: 998547 - RNA, 22 nt, Human
ucaguccguguagagugugacc

SEQ ID NO: 998548 - RNA, 21 nt, Human
uccccaauucccacccccuua

SEQ ID NO: 998549 - RNA, 22 nt, Human
uccccaauucccacccccuuau

SEQ ID NO: 998550 - RNA, 18 nt, Human
uccccugcugugcccucc

SEQ ID NO: 998551 - RNA, 19 nt, Human
uccuggugggagaugaacu

SEQ ID NO: 998552 - RNA, 22 nt, Human
ucugcccuacccaagaagggag

SEQ ID NO: 998553 - RNA, 22 nt, Human
ugaagcacucaagguugggcuu

SEQ ID NO: 998554 - RNA, 24 nt, Human
ugaagcacucaagguugggcuugg

SEQ ID NO: 998555 - RNA, 20 nt, Human
ugagcacgccaucacugccc

SEQ ID NO: 998556 - RNA, 19 nt, Human
ugccugacugaggucaugc

SEQ ID NO: 998557 - RNA, 21 nt, Human
ugcugugcccuccuggcacua

SEQ ID NO: 998558 - RNA, 24 nt, Human
uggcugggggagggaggauggggu

SEQ ID NO: 998559 - RNA, 18 nt, Human
ugggggagggaggauggg

SEQ ID NO: 998560 - RNA, 22 nt, Human
ugggggagggaggaugggguaa

SEQ ID NO: 998561 - RNA, 19 nt, Human
ugggguaacagaaccuagg

SEQ ID NO: 998562 - RNA, 18 nt, Human
uguguagaaggcugggcu

SEQ ID NO: 998563 - RNA, 19 nt, Human
uucccacccccuuauggcu

SEQ ID NO: 998564 - RNA, 20 nt, Human
uugccauugaggaaugcaga

SEQ ID NO: 998565 - RNA, 21 nt, Human
aacaaagagguauacuaacug

SEQ ID NO: 998566 - RNA, 22 nt, Human
aaccaggagggcagggcucccc

SEQ ID NO: 998567 - RNA, 18 nt, Human
aagaaaguacaacaaaga

SEQ ID NO: 998568 - RNA, 21 nt, Human
aagcccaagaaaguacaacaa

SEQ ID NO: 998569 - RNA, 25 nt, Human
aaguacaacaaagagguauacuaac

SEQ ID NO: 998570 - RNA, 24 nt, Human
acuugauuaucacuugcucguucu

SEQ ID NO: 998571 - RNA, 21 nt, Human
agagcaaaagcccaagaaagu

SEQ ID NO: 998572 - RNA, 19 nt, Human
agcaaaagcccaagaaagu

SEQ ID NO: 998573 - RNA, 18 nt, Human
auucaacagacauguuua

SEQ ID NO: 998574 - RNA, 24 nt, Human
caaccgcacgacuccgcucagcca

SEQ ID NO: 998575 - RNA, 21 nt, Human
cacugcgcgccgagacgaggc

SEQ ID NO: 998576 - RNA, 19 nt, Human
cacuguuuucuccagguag

SEQ ID NO: 998577 - RNA, 22 nt, Human
cagagcaaaagcccaagaaagu

SEQ ID NO: 998578 - RNA, 18 nt, Human
caggagggcagggcuccc

SEQ ID NO: 998579 - RNA, 24 nt, Human
cagguuaaaaaaaugagaacucaa

SEQ ID NO: 998580 - RNA, 23 nt, Human
caugccacaggcacuucaggccu

SEQ ID NO: 998581 - RNA, 18 nt, Human
ccaagccccagcugcgga

SEQ ID NO: 998582 - RNA, 21 nt, Human
ccaagccccagcugcggacgc

SEQ ID NO: 998583 - RNA, 19 nt, Human
ccagagcaaaagcccaaga

SEQ ID NO: 998584 - RNA, 20 nt, Human
ccagagcaaaagcccaagaa

SEQ ID NO: 998585 - RNA, 23 nt, Human
cccaggaaaaaacugccucagau

SEQ ID NO: 998586 - RNA, 21 nt, Human
ccccaccaaccgcacgacucc

SEQ ID NO: 998587 - RNA, 21 nt, Human
cccgcaggccaagccccagcu

SEQ ID NO: 998588 - RNA, 23 nt, Human
ccucucuaacaacacucacuagu

SEQ ID NO: 998589 - RNA, 20 nt, Human
ccucugaaaucuauaacagg

SEQ ID NO: 998590 - RNA, 20 nt, Human
ccugaauauccuuaguaaca

SEQ ID NO: 998591 - RNA, 19 nt, Human
ccuggaggaaaaacugggg

SEQ ID NO: 998592 - RNA, 19 nt, Human
cgagggcacuagcacaagg

SEQ ID NO: 998593 - RNA, 22 nt, Human
cggggaggccgaaccaggaggg

SEQ ID NO: 998594 - RNA, 20 nt, Human
cucucuaacaacacucacua

SEQ ID NO: 998595 - RNA, 21 nt, Human
cucuugagucuggacuuucug

SEQ ID NO: 998596 - RNA, 24 nt, Human
cuuucugacaauaaaauacaccag

SEQ ID NO: 998597 - RNA, 19 nt, Human
gcaacaugccacaggcacu

SEQ ID NO: 998598 - RNA, 19 nt, Human
gcccgcaggccaagcccca

SEQ ID NO: 998599 - RNA, 21 nt, Human
gcccgcaggccaagccccagc

SEQ ID NO: 998600 - RNA, 19 nt, Human
gcugcaacaugccacaggc

SEQ ID NO: 998601 - RNA, 22 nt, Human
gcugcugcaacaugccacaggc

SEQ ID NO: 998602 - RNA, 20 nt, Human
ggacacagacacugcgcgcc

SEQ ID NO: 998603 - RNA, 21 nt, Human
gggcucccccaccaaccgcac

SEQ ID NO: 998604 - RNA, 24 nt, Human
uaaaauacaccagagcaaaagccc

SEQ ID NO: 998605 - RNA, 24 nt, Human
uaaacaaguauuauucaacagaca

SEQ ID NO: 998606 - RNA, 22 nt, Human
uaacagguuaaaaaaaugagaa

SEQ ID NO: 998607 - RNA, 24 nt, Human
uacaacaaagagguauacuaacug

SEQ ID NO: 998608 - RNA, 23 nt, Human
uauaacagguuaaaaaaaugaga

SEQ ID NO: 998609 - RNA, 22 nt, Human
ucaacagacauguuuacacuaa

SEQ ID NO: 998610 - RNA, 19 nt, Human
ucccaggaaaaaacugccu

SEQ ID NO: 998611 - RNA, 20 nt, Human
ucccaggaaaaaacugccuc

SEQ ID NO: 998612 - RNA, 23 nt, Human
ucccugaauauccuuaguaacaa

SEQ ID NO: 998613 - RNA, 18 nt, Human
ucuuuuuuuuuuuuuuuu

SEQ ID NO: 998614 - RNA, 18 nt, Human
ugaaaaagcauggaacgu

SEQ ID NO: 998615 - RNA, 18 nt, Human
ugacaauaaaauacacca

SEQ ID NO: 998616 - RNA, 23 nt, Human
ugagaacagggcaaggaaaggca

SEQ ID NO: 998617 - RNA, 26 nt, Human
ugggagccuucgccaccuucgcuggc

SEQ ID NO: 998618 - RNA, 18 nt, Human
uguggauucccaggaaaa

SEQ ID NO: 998619 - RNA, 23 nt, Human
uucugacaauaaaauacaccaga

SEQ ID NO: 998620 - RNA, 18 nt, Human
uuguuuuugagcaaguga

SEQ ID NO: 998621 - RNA, 20 nt, Human
uuuucuccagguaguuguuu

SEQ ID NO: 998622 - RNA, 22 nt, Human
uuuuuuuuuuuuuuuucuuuuu

SEQ ID NO: 998623 - RNA, 23 nt, Human
aaaauaccuucacagcaacaucu

SEQ ID NO: 998624 - RNA, 23 nt, Human
aagagagacuggagaagguggug

SEQ ID NO: 998625 - RNA, 21 nt, Human
acaaaauaccuucacagcaac

SEQ ID NO: 998626 - RNA, 22 nt, Human
acuuuauuuucaucaccauggg

SEQ ID NO: 998627 - RNA, 21 nt, Human
agaaggugguggucuccuugc

SEQ ID NO: 998628 - RNA, 22 nt, Human
agaaggugguggucuccuugcc

SEQ ID NO: 998629 - RNA, 22 nt, Human
auuccucagguuuuuuugaagc

SEQ ID NO: 998630 - RNA, 27 nt, Human
caacugauuguaaauguugaucacauc

SEQ ID NO: 998631 - RNA, 24 nt, Human
caaguugacacauaguacuagcca

SEQ ID NO: 998632 - RNA, 21 nt, Human
caucuagacuacuguuugacc

SEQ ID NO: 998633 - RNA, 23 nt, Human
cccuuguggucccgcuauggcuc

SEQ ID NO: 998634 - RNA, 23 nt, Human
ccucuggagacuuuucagauaga

SEQ ID NO: 998635 - RNA, 19 nt, Human
ccuugcccuuguggucccg

SEQ ID NO: 998636 - RNA, 20 nt, Human
ccuuguggucccgcuauggc

SEQ ID NO: 998637 - RNA, 25 nt, Human
cgaaaagagacuggagaaaguggug

SEQ ID NO: 998638 - RNA, 24 nt, Human
cugauuguaaauguugaucacauc

SEQ ID NO: 998639 - RNA, 21 nt, Human
uagacaaguugacacauagua

SEQ ID NO: 998640 - RNA, 19 nt, Human
ucacauggggcauacccuu

SEQ ID NO: 998641 - RNA, 18 nt, Human
ugaccacacagcugagca

SEQ ID NO: 998642 - RNA, 24 nt, Human
ugcccgggaauuacuggcuguccg

SEQ ID NO: 998643 - RNA, 21 nt, Human
uggagaaggugguggucuccu

SEQ ID NO: 998644 - RNA, 18 nt, Human
uggcccacuccauuccuc

SEQ ID NO: 998645 - RNA, 20 nt, Human
uggcuggauaguguuggccc

SEQ ID NO: 998646 - RNA, 21 nt, Human
ugggguuagaccucuggagac

SEQ ID NO: 998647 - RNA, 20 nt, Human
uguccgaaaagagacuggag

SEQ ID NO: 998648 - RNA, 20 nt, Human
uguccgaagagagacuggag

SEQ ID NO: 998649 - RNA, 21 nt, Human
uuauuuucaucaccauggggc

SEQ ID NO: 998650 - RNA, 18 nt, Human
uucacuuuauuuucauca

SEQ ID NO: 998651 - RNA, 23 nt, Human
uucauuuuauuucccucacaugg

SEQ ID NO: 998652 - RNA, 21 nt, Human
uuccucagguuuuuuugaagc

SEQ ID NO: 998653 - RNA, 21 nt, Human
uugcccgggaauuacuggcug

SEQ ID NO: 998654 - RNA, 18 nt, Human
accuggacaggugaacuc

SEQ ID NO: 998655 - RNA, 18 nt, Human
agcaugguggucaucugc

SEQ ID NO: 998656 - RNA, 23 nt, Human
cagcagcgaggaguccuuguugc

SEQ ID NO: 998657 - RNA, 20 nt, Human
cggccuggggccccgcccac

SEQ ID NO: 998658 - RNA, 21 nt, Human
cuacuggcugaucugcggcgc

SEQ ID NO: 998659 - RNA, 22 nt, Human
cucagaaagaacucggaguucc

SEQ ID NO: 998660 - RNA, 23 nt, Human
cuggucagcagcgaggaguccuu

SEQ ID NO: 998661 - RNA, 18 nt, Human
gaucugcggcgccggcgc

SEQ ID NO: 998662 - RNA, 18 nt, Human
gcugacacagagcauggu

SEQ ID NO: 998663 - RNA, 26 nt, Human
ggacaggugaacucuuguauguuucu

SEQ ID NO: 998664 - RNA, 22 nt, Human
guuucuguuuuggggauuuuua

SEQ ID NO: 998665 - RNA, 19 nt, Human
uagggguuuuccauguaca

SEQ ID NO: 998666 - RNA, 18 nt, Human
ucauuccauguacauuca

SEQ ID NO: 998667 - RNA, 21 nt, Human
ugaucugcggcgccggcgccc

SEQ ID NO: 998668 - RNA, 23 nt, Human
uggcugaucugcggcgccggcgc

SEQ ID NO: 998669 - RNA, 19 nt, Human
uguugcguauggacggaag

SEQ ID NO: 998670 - RNA, 18 nt, Human
uuccauguacauucauag

SEQ ID NO: 998671 - RNA, 20 nt, Human
aaaaaaaaaaaaaaaaagga

SEQ ID NO: 998672 - RNA, 21 nt, Human
aaaaaaaaaaaaaaaaaggag

SEQ ID NO: 998673 - RNA, 21 nt, Human
aaaaggagggggcuuuuaaaa

SEQ ID NO: 998674 - RNA, 21 nt, Human
aaacaaaaauccaagcaucgc

SEQ ID NO: 998675 - RNA, 21 nt, Human
aaagaacacccgcagcaccac

SEQ ID NO: 998676 - RNA, 19 nt, Human
aaccagcccgaaccucgcu

SEQ ID NO: 998677 - RNA, 19 nt, Human
aaugagaaaaacagcuaaa

SEQ ID NO: 998678 - RNA, 19 nt, Human
agcugggccugaccccugg

SEQ ID NO: 998679 - RNA, 19 nt, Human
aggaaacaaaaauccaagc

SEQ ID NO: 998680 - RNA, 22 nt, Human
aguacaaucugugcggcuggug

SEQ ID NO: 998681 - RNA, 20 nt, Human
auaggaaacaaaaauccaag

SEQ ID NO: 998682 - RNA, 23 nt, Human
auaggaaacaaaaauccaagcau

SEQ ID NO: 998683 - RNA, 23 nt, Human
aucuucuugagguuccucuguua

SEQ ID NO: 998684 - RNA, 18 nt, Human
caaaagaacacccgcagc

SEQ ID NO: 998685 - RNA, 21 nt, Human
caaaagaacacccgcagcacc

SEQ ID NO: 998686 - RNA, 23 nt, Human
caaauuagucaucuuagcuccaa

SEQ ID NO: 998687 - RNA, 25 nt, Human
caacggaacaaccagcccgaaccuc

SEQ ID NO: 998688 - RNA, 18 nt, Human
caccccacacaccaacaa

SEQ ID NO: 998689 - RNA, 21 nt, Human
cagcucgcaacggaacaacca

SEQ ID NO: 998690 - RNA, 22 nt, Human
cagcucgcaacggaacaaccag

SEQ ID NO: 998691 - RNA, 21 nt, Human
cagcugcagcucgcaacggaa

SEQ ID NO: 998692 - RNA, 28 nt, Human
ccaacaaaugagaaaaacagcuaaagcc

SEQ ID NO: 998693 - RNA, 25 nt, Human
ccagccaucuucccagcgccucucu

SEQ ID NO: 998694 - RNA, 19 nt, Human
cccaaaagaacacccgcag

SEQ ID NO: 998695 - RNA, 22 nt, Human
cccaaaagaacacccgcagcac

SEQ ID NO: 998696 - RNA, 24 nt, Human
cccacacaccaacaaaugagaaaa

SEQ ID NO: 998697 - RNA, 24 nt, Human
cccacacaccaacaaaugagaaaa

SEQ ID NO: 998698 - RNA, 22 nt, Human
cccauggccagccuccucuguc

SEQ ID NO: 998699 - RNA, 24 nt, Human
ccccaaaagaacacccgcagcacc

SEQ ID NO: 998700 - RNA, 25 nt, Human
ccccaaaagaacacccgcagcacca

SEQ ID NO: 998701 - RNA, 22 nt, Human
ccccaccccacacaccaacaaa

SEQ ID NO: 998702 - RNA, 20 nt, Human
cccccaccccacacaccaac

SEQ ID NO: 998703 - RNA, 23 nt, Human
cccccaccccacacaccaacaaa

SEQ ID NO: 998704 - RNA, 25 nt, Human
ccccugcccccaccccacacacccc

SEQ ID NO: 998705 - RNA, 21 nt, Human
ccccugggccccauggccagc

SEQ ID NO: 998706 - RNA, 19 nt, Human
cccgaaccucgcucgugcc

SEQ ID NO: 998707 - RNA, 26 nt, Human
cccgcagcaccacuggcuucuucacu

SEQ ID NO: 998708 - RNA, 20 nt, Human
cccugggccccauggccagc

SEQ ID NO: 998709 - RNA, 23 nt, Human
cccugggccccauggccagccuc

SEQ ID NO: 998710 - RNA, 18 nt, Human
ccuaaaaaaagaaaaaaa

SEQ ID NO: 998711 - RNA, 25 nt, Human
ccuaaaaaaagaaaaaaaaaaaaaa

SEQ ID NO: 998712 - RNA, 19 nt, Human
ccuaaaaaaagaaaaaaag

SEQ ID NO: 998713 - RNA, 22 nt, Human
ccuaccccugcccccaccccac

SEQ ID NO: 998714 - RNA, 23 nt, Human
cgcaacggaacaaccagcccgaa

SEQ ID NO: 998715 - RNA, 23 nt, Human
cuaauauuacuacauaugccuaa

SEQ ID NO: 998716 - RNA, 25 nt, Human
cuaccccugcccccaccccacacac

SEQ ID NO: 998717 - RNA, 18 nt, Human
cucuguuaagcuccucac

SEQ ID NO: 998718 - RNA, 22 nt, Human
cuucugggccuaccacagagau

SEQ ID NO: 998719 - RNA, 20 nt, Human
gaaacaaaaauccaagcauc

SEQ ID NO: 998720 - RNA, 22 nt, Human
gcaacggaacaaccagcccgaa

SEQ ID NO: 998721 - RNA, 24 nt, Human
gcaacggaacaaccagcccgaacc

SEQ ID NO: 998722 - RNA, 23 nt, Human
gccuaaaaaaagaaaaaaaaaaa

SEQ ID NO: 998723 - RNA, 21 nt, Human
gcuccaaaugaaaugaaauua

SEQ ID NO: 998724 - RNA, 21 nt, Human
ggaaacaaaaauccaagcauc

SEQ ID NO: 998725 - RNA, 22 nt, Human
ggaacaaccagcccgaaccucg

SEQ ID NO: 998726 - RNA, 21 nt, Human
uaagcuccucaccagccaucu

SEQ ID NO: 998727 - RNA, 22 nt, Human
uacuggaucccagacacuaccc

SEQ ID NO: 998728 - RNA, 21 nt, Human
ucaaaguuucccaaauuaaau

SEQ ID NO: 998729 - RNA, 27 nt, Human
ucaggacaggggaaaagagaucgaaaa

SEQ ID NO: 998730 - RNA, 22 nt, Human
ucccaaauuaaauguuucuaau

SEQ ID NO: 998731 - RNA, 18 nt, Human
ucccagacacuaccccaa

SEQ ID NO: 998732 - RNA, 21 nt, Human
ucccgcccuaccccugccccc

SEQ ID NO: 998733 - RNA, 18 nt, Human
ucuccccugggcaggaau

SEQ ID NO: 998734 - RNA, 31 nt, Human
ucuccccugggcaggaaucccgucaaggguu

SEQ ID NO: 998735 - RNA, 21 nt, Human
ucugugcggcugguggggggu

SEQ ID NO: 998736 - RNA, 23 nt, Human
ugaaaugaaauuagaacaaaacu

SEQ ID NO: 998737 - RNA, 21 nt, Human
ugaagagaggaucacuuuuca

SEQ ID NO: 998738 - RNA, 22 nt, Human
ugcccccaccccacacaccaac

SEQ ID NO: 998739 - RNA, 25 nt, Human
ugcccccaccccacacaccaacaaa

SEQ ID NO: 998740 - RNA, 23 nt, Human
ugcggcugguggggggugggggu

SEQ ID NO: 998741 - RNA, 19 nt, Human
uggaucccagacacuaccc

SEQ ID NO: 998742 - RNA, 21 nt, Human
ugggccccauggccagccucc

SEQ ID NO: 998743 - RNA, 22 nt, Human
ugggccccauggccaggacccu

SEQ ID NO: 998744 - RNA, 18 nt, Human
ugguggggggugggggua

SEQ ID NO: 998745 - RNA, 19 nt, Human
uggugggggguggggguag

SEQ ID NO: 998746 - RNA, 22 nt, Human
uuugaacaaugauucaacucgu

SEQ ID NO: 998747 - RNA, 18 nt, Human
accaaaauacaaacccca

SEQ ID NO: 998748 - RNA, 24 nt, Human
accaaaauacaaaccccaucaaag

SEQ ID NO: 998749 - RNA, 20 nt, Human
acuugagggaaaaaaacaau

SEQ ID NO: 998750 - RNA, 26 nt, Human
acuuuauuuugcuuuaaaaaaacaau

SEQ ID NO: 998751 - RNA, 27 nt, Human
agggaaaaaauacuugagggaaaaaaa

SEQ ID NO: 998752 - RNA, 22 nt, Human
cagauaaauaaucuucuucaca

SEQ ID NO: 998753 - RNA, 18 nt, Human
ccagacagcaggugucag

SEQ ID NO: 998754 - RNA, 24 nt, Human
cccggaauugggaggcuguggggc

SEQ ID NO: 998755 - RNA, 22 nt, Human
cggaaggggccagacagcaggu

SEQ ID NO: 998756 - RNA, 23 nt, Human
cggaaggggccagacagcaggug

SEQ ID NO: 998757 - RNA, 18 nt, Human
cggcugcagcuucaggcc

SEQ ID NO: 998758 - RNA, 22 nt, Human
cugcagcuucaggccggaaggg

SEQ ID NO: 998759 - RNA, 23 nt, Human
gaaaaaaacaaugguauaacaug

SEQ ID NO: 998760 - RNA, 21 nt, Human
gagggaaaaaaacaaugguau

SEQ ID NO: 998761 - RNA, 20 nt, Human
gcagcuucaggccggaaggg

SEQ ID NO: 998762 - RNA, 23 nt, Human
guaaaaaucacaauguaaaaaua

SEQ ID NO: 998763 - RNA, 25 nt, Human
uaaccaaaauacaaaccccaucaaa

SEQ ID NO: 998764 - RNA, 22 nt, Human
uagcauuaaaaaaaguuaauau

SEQ ID NO: 998765 - RNA, 22 nt, Human
ugggaggcuguggggccucagc

SEQ ID NO: 998766 - RNA, 18 nt, Human
ugguauaacauguguaaa

SEQ ID NO: 998767 - RNA, 21 nt, Human
uucacagggaaaaaauacuug

SEQ ID NO: 998768 - RNA, 28 nt, Human
uucacagggaaaaaauacuugagggaaa

SEQ ID NO: 998769 - RNA, 21 nt, Human
aggaacuugaggugggugaug

SEQ ID NO: 998770 - RNA, 20 nt, Human
agggagggcaggaucuccgu

SEQ ID NO: 998771 - RNA, 21 nt, Human
cacgaugcugcuggucuggcu

SEQ ID NO: 998772 - RNA, 19 nt, Human
cgagaugggcagcuugggc

SEQ ID NO: 998773 - RNA, 22 nt, Human
cgaugcugcuggucuggcuggg

SEQ ID NO: 998774 - RNA, 21 nt, Human
cgccacggccgacacacgguc

SEQ ID NO: 998775 - RNA, 19 nt, Human
uacggcacuucucgcucac

SEQ ID NO: 998776 - RNA, 18 nt, Human
ugcugcuggucuggcugg

SEQ ID NO: 998777 - RNA, 23 nt, Human
ugcuggaagauguuguucacggg

SEQ ID NO: 998778 - RNA, 21 nt, Human
ugcuggucuggcuggacgcgc

SEQ ID NO: 998779 - RNA, 19 nt, Human
caccuucggcccggaauuc

SEQ ID NO: 998780 - RNA, 23 nt, Human
caggcaccuucggcccggggagg

SEQ ID NO: 998781 - RNA, 19 nt, Human
ccggggggcaggagcuggg

SEQ ID NO: 998782 - RNA, 22 nt, Human
gagcuggggccaggugaggaga

SEQ ID NO: 998783 - RNA, 20 nt, Human
ggcaggagcuggggccaggu

SEQ ID NO: 998784 - RNA, 20 nt, Human
ugacugaaugagcaagccca

SEQ ID NO: 998785 - RNA, 25 nt, Human
ugacugaaugagcaagcccaggcac

SEQ ID NO: 998786 - RNA, 20 nt, Human
ugacugugacugaaugagca

SEQ ID NO: 998787 - RNA, 18 nt, Human
ugagcaagcccaggcacc

SEQ ID NO: 998788 - RNA, 18 nt, Human
aaaaggaaaagaaauagg

SEQ ID NO: 998789 - RNA, 24 nt, Human
aaacaaacccaaaaggacugaaac

SEQ ID NO: 998790 - RNA, 18 nt, Human
aaaccaaacccaaaagga

SEQ ID NO: 998791 - RNA, 18 nt, Human
aaagaaaagaaauaggau

SEQ ID NO: 998792 - RNA, 19 nt, Human
aaaggaaaagaaauaggau

SEQ ID NO: 998793 - RNA, 21 nt, Human
aaagguaaauaaaccaaaccc

SEQ ID NO: 998794 - RNA, 22 nt, Human
aaagguaaauaaaccaaaccca

SEQ ID NO: 998795 - RNA, 23 nt, Human
aaauauuccaacaccaagaacuc

SEQ ID NO: 998796 - RNA, 18 nt, Human
aagcgaccuguuugagga

SEQ ID NO: 998797 - RNA, 22 nt, Human
acaccaagaacucccgagaagc

SEQ ID NO: 998798 - RNA, 20 nt, Human
acccugagaagcugagagaa

SEQ ID NO: 998799 - RNA, 21 nt, Human
acccugagaagcugagagaaa

SEQ ID NO: 998800 - RNA, 23 nt, Human
acccugagaagcugagagaaaag

SEQ ID NO: 998801 - RNA, 23 nt, Human
acccugagaagcugagagaaaag

SEQ ID NO: 998802 - RNA, 21 nt, Human
accuugaccuccgcagauggc

SEQ ID NO: 998803 - RNA, 21 nt, Human
accuugaccuccgcagauggc

SEQ ID NO: 998804 - RNA, 19 nt, Human
agaggaggccugguccugu

SEQ ID NO: 998805 - RNA, 20 nt, Human
agcaggcaguccagguuucc

SEQ ID NO: 998806 - RNA, 24 nt, Human
auuccccccaaccccccacaaaaa

SEQ ID NO: 998807 - RNA, 27 nt, Human
caaaaggacugaaacccugagaagcug

SEQ ID NO: 998808 - RNA, 27 nt, Human
caaaaggacugaaacccugagaagcug

SEQ ID NO: 998809 - RNA, 23 nt, Human
caaacaccugggugaaagagucc

SEQ ID NO: 998810 - RNA, 23 nt, Human
cacaaaaccauaaaaaagguaaa

SEQ ID NO: 998811 - RNA, 23 nt, Human
cacaaaaccauaaaaaagguaaa

SEQ ID NO: 998812 - RNA, 19 nt, Human
cauugcuccccauccucgc

SEQ ID NO: 998813 - RNA, 22 nt, Human
ccaaucaugcugcuuucaugcu

SEQ ID NO: 998814 - RNA, 24 nt, Human
ccaauuauuuauucccccaacccc

SEQ ID NO: 998815 - RNA, 19 nt, Human
ccacagccagggccuuggc

SEQ ID NO: 998816 - RNA, 19 nt, Human
ccacagccagggccuuggc

SEQ ID NO: 998817 - RNA, 24 nt, Human
ccagccacaaaaccauaaaaaagg

SEQ ID NO: 998818 - RNA, 24 nt, Human
ccagccacaaaaccauaaaaaagg

SEQ ID NO: 998819 - RNA, 18 nt, Human
cccaaccccccacaaaaa

SEQ ID NO: 998820 - RNA, 18 nt, Human
cccaaccccccacaaaaa

SEQ ID NO: 998821 - RNA, 18 nt, Human
ccccccaaccccccacaa

SEQ ID NO: 998822 - RNA, 19 nt, Human
ccccccaaccccccacaaa

SEQ ID NO: 998823 - RNA, 24 nt, Human
ccccccaaccccccacaaaaacaa

SEQ ID NO: 998824 - RNA, 25 nt, Human
ccccccaaccccccacaaaaacaaa

SEQ ID NO: 998825 - RNA, 25 nt, Human
cgucuucuuccuucagcauucucca

SEQ ID NO: 998826 - RNA, 25 nt, Human
cgucuucuuccuucagcauucucca

SEQ ID NO: 998827 - RNA, 24 nt, Human
cucacaccuugaccuccgcagaug

SEQ ID NO: 998828 - RNA, 24 nt, Human
cucacaccuugaccuccgcagaug

SEQ ID NO: 998829 - RNA, 26 nt, Human
cucacaccuugaccuccgcagauggc

SEQ ID NO: 998830 - RNA, 19 nt, Human
cuccacagccagggccuug

SEQ ID NO: 998831 - RNA, 19 nt, Human
cuccacagccagggccuug

SEQ ID NO: 998832 - RNA, 19 nt, Human
cuccacggcugacaugucu

SEQ ID NO: 998833 - RNA, 19 nt, Human
cuccacggcugacaugucu

SEQ ID NO: 998834 - RNA, 20 nt, Human
cucgcuggccugggaguagg

SEQ ID NO: 998835 - RNA, 20 nt, Human
cuggguccggaucucgcugg

SEQ ID NO: 998836 - RNA, 21 nt, Human
cuuguacaguugcuggucacc

SEQ ID NO: 998837 - RNA, 20 nt, Human
cuuucaugcugcuggacagg

SEQ ID NO: 998838 - RNA, 20 nt, Human
cuuucaugcugcuggacagg

SEQ ID NO: 998839 - RNA, 23 nt, Human
gaguugggggccugguucugggg

SEQ ID NO: 998840 - RNA, 23 nt, Human
gaguugggggccugguucugggg

SEQ ID NO: 998841 - RNA, 27 nt, Human
ggagacgucgcucacaccuugaccucc

SEQ ID NO: 998842 - RNA, 27 nt, Human
ggagacgucgcucacaccuugaccucc

SEQ ID NO: 998843 - RNA, 19 nt, Human
ggaggccguggguuuucac

SEQ ID NO: 998844 - RNA, 24 nt, Human
ggccaaucaugcugcuuucaugcu

SEQ ID NO: 998845 - RNA, 24 nt, Human
ggccaaucaugcugcuuucaugcu

SEQ ID NO: 998846 - RNA, 19 nt, Human
ggcugaguugggggccugg

SEQ ID NO: 998847 - RNA, 19 nt, Human
ggcugaguugggggccugg

SEQ ID NO: 998848 - RNA, 19 nt, Human
gguuggcaaacaccugggu

SEQ ID NO: 998849 - RNA, 23 nt, Human
uaaaaaagguaaauaaaccaacu

SEQ ID NO: 998850 - RNA, 19 nt, Human
uaaaacaaacccaaaagga

SEQ ID NO: 998851 - RNA, 21 nt, Human
uaaaaugaccacuuuuaaaac

SEQ ID NO: 998852 - RNA, 23 nt, Human
uaaaccaaacccaaaaggacuga

SEQ ID NO: 998853 - RNA, 24 nt, Human
uauucccccaaccccccacaaaaa

SEQ ID NO: 998854 - RNA, 24 nt, Human
uauucccccaaccccccacaaaaa

SEQ ID NO: 998855 - RNA, 19 nt, Human
uauuuauucccccaacccc

SEQ ID NO: 998856 - RNA, 23 nt, Human
ucacccaugcugucugccuuggu

SEQ ID NO: 998857 - RNA, 19 nt, Human
ucagugggcucagcccgcu

SEQ ID NO: 998858 - RNA, 22 nt, Human
ucaugcugcuggacagguggga

SEQ ID NO: 998859 - RNA, 22 nt, Human
ucaugcugcuggacagguggga

SEQ ID NO: 998860 - RNA, 21 nt, Human
uccaacaccaagaacucccga

SEQ ID NO: 998861 - RNA, 23 nt, Human
uccaacaccaagaacucccgaga

SEQ ID NO: 998862 - RNA, 22 nt, Human
uccagcuuguguaagacaccgc

SEQ ID NO: 998863 - RNA, 19 nt, Human
ucccccaaccccccacaaa

SEQ ID NO: 998864 - RNA, 19 nt, Human
ucccccaaccccccacaaa

SEQ ID NO: 998865 - RNA, 24 nt, Human
ucccccaaccccccacaaaaacaa

SEQ ID NO: 998866 - RNA, 24 nt, Human
ucccccaaccccccacaaaaacaa

SEQ ID NO: 998867 - RNA, 25 nt, Human
ucccccaaccccccacaaaaacaaa

SEQ ID NO: 998868 - RNA, 25 nt, Human
ucccccaaccccccacaaaaacaaa

SEQ ID NO: 998869 - RNA, 24 nt, Human
ucguccugcuucugcgucuucuuc

SEQ ID NO: 998870 - RNA, 24 nt, Human
ucguccugcuucugcgucuucuuc

SEQ ID NO: 998871 - RNA, 22 nt, Human
ucuaaaccugaauaaaaugacc

SEQ ID NO: 998872 - RNA, 21 nt, Human
ucucgcuggccugggaguagg

SEQ ID NO: 998873 - RNA, 22 nt, Human
ucucuaagugacacacagggcu

SEQ ID NO: 998874 - RNA, 20 nt, Human
ucugcgucuucuuccuucag

SEQ ID NO: 998875 - RNA, 20 nt, Human
ucugcgucuucuuccuucag

SEQ ID NO: 998876 - RNA, 18 nt, Human
ugaaacccugagaagcug

SEQ ID NO: 998877 - RNA, 18 nt, Human
ugaaacccugagaagcug

SEQ ID NO: 998878 - RNA, 18 nt, Human
ugaaucuuucagggucgu

SEQ ID NO: 998879 - RNA, 18 nt, Human
ugaaucuuucagggucgu

SEQ ID NO: 998880 - RNA, 19 nt, Human
ugagaagcugagagaaaag

SEQ ID NO: 998881 - RNA, 19 nt, Human
ugagaagcugagagaaaag

SEQ ID NO: 998882 - RNA, 21 nt, Human
ugagaagcugagagaaaagug

SEQ ID NO: 998883 - RNA, 21 nt, Human
ugagaagcugagagaaaagug

SEQ ID NO: 998884 - RNA, 22 nt, Human
ugagaagcugagagaaaagugu

SEQ ID NO: 998885 - RNA, 18 nt, Human
ugagauggggggcgagca

SEQ ID NO: 998886 - RNA, 19 nt, Human
ugagauggggggcgagcag

SEQ ID NO: 998887 - RNA, 19 nt, Human
ugagauggggggcgagcag

SEQ ID NO: 998888 - RNA, 19 nt, Human
ugaguugggggccugguuc

SEQ ID NO: 998889 - RNA, 19 nt, Human
ugaguugggggccugguuc

SEQ ID NO: 998890 - RNA, 24 nt, Human
ugaguugggggccugguucugggg

SEQ ID NO: 998891 - RNA, 24 nt, Human
ugaguugggggccugguucugggg

SEQ ID NO: 998892 - RNA, 19 nt, Human
ugccuugguugugaacguc

SEQ ID NO: 998893 - RNA, 19 nt, Human
ugccuugguugugaacguc

SEQ ID NO: 998894 - RNA, 24 nt, Human
uggagccagguguuccuguuggcc

SEQ ID NO: 998895 - RNA, 24 nt, Human
uggagccagguguuccuguuggcc

SEQ ID NO: 998896 - RNA, 23 nt, Human
uggaggccguggguuuucacugu

SEQ ID NO: 998897 - RNA, 24 nt, Human
uggaggccguggguuuucacuguc

SEQ ID NO: 998898 - RNA, 20 nt, Human
uggcugaguugggggccugg

SEQ ID NO: 998899 - RNA, 20 nt, Human
uggcugaguugggggccugg

SEQ ID NO: 998900 - RNA, 24 nt, Human
uggcuggagccagguguuccuguu

SEQ ID NO: 998901 - RNA, 24 nt, Human
uggcuggagccagguguuccuguu

SEQ ID NO: 998902 - RNA, 19 nt, Human
uggggggugagaugggggg

SEQ ID NO: 998903 - RNA, 19 nt, Human
uggggggugagaugggggg

SEQ ID NO: 998904 - RNA, 18 nt, Human
uggucuuguacaguugcu

SEQ ID NO: 998905 - RNA, 19 nt, Human
ugguugugaacguccagcc

SEQ ID NO: 998906 - RNA, 19 nt, Human
ugguugugaacguccagcc

SEQ ID NO: 998907 - RNA, 18 nt, Human
uguguaagacaccgcugg

SEQ ID NO: 998908 - RNA, 20 nt, Human
uuaaaacagguaguuuaaaa

SEQ ID NO: 998909 - RNA, 18 nt, Human
uuccaacaccaagaacuc

SEQ ID NO: 998910 - RNA, 21 nt, Human
uuccccccaaccccccacaaa

SEQ ID NO: 998911 - RNA, 21 nt, Human
uugcauugcuccccauccucg

SEQ ID NO: 998912 - RNA, 21 nt, Human
uuggggggugagauggggggc

SEQ ID NO: 998913 - RNA, 21 nt, Human
uuggggggugagauggggggc

SEQ ID NO: 998914 - RNA, 20 nt, Human
uuggucuuguacaguugcug

SEQ ID NO: 998915 - RNA, 21 nt, Human
aaagcuuuucugggccucuuc

SEQ ID NO: 998916 - RNA, 21 nt, Human
aaagcuuuucugggccucuuc

SEQ ID NO: 998917 - RNA, 19 nt, Human
aaaugacccaucauaagac

SEQ ID NO: 998918 - RNA, 19 nt, Human
aaaugacccaucauaagac

SEQ ID NO: 998919 - RNA, 21 nt, Human
aacccauggcccuccugcccu

SEQ ID NO: 998920 - RNA, 21 nt, Human
aagaacuguacaagggggagg

SEQ ID NO: 998921 - RNA, 21 nt, Human
aagaacuguacaagggggagg

SEQ ID NO: 998922 - RNA, 20 nt, Human
aagccuuccaggaugcacac

SEQ ID NO: 998923 - RNA, 26 nt, Human
aagcuuagccaggagccacaccaccc

SEQ ID NO: 998924 - RNA, 26 nt, Human
aagcuuagccaggagccacaccaccc

SEQ ID NO: 998925 - RNA, 18 nt, Human
aaggaccagggcaguggu

SEQ ID NO: 998926 - RNA, 18 nt, Human
aaggaccagggcaguggu

SEQ ID NO: 998927 - RNA, 18 nt, Human
aaggaccagggcaguggu

SEQ ID NO: 998928 - RNA, 21 nt, Human
aaggugaccuguugcugcaga

SEQ ID NO: 998929 - RNA, 19 nt, Human
aaguucuuuguauugugcc

SEQ ID NO: 998930 - RNA, 20 nt, Human
acacacacuggaaccugggc

SEQ ID NO: 998931 - RNA, 21 nt, Human
acaccaagcuuagccaggagc

SEQ ID NO: 998932 - RNA, 21 nt, Human
acacccacuccccugcucccg

SEQ ID NO: 998933 - RNA, 21 nt, Human
acacccacuccccugcucccg

SEQ ID NO: 998934 - RNA, 21 nt, Human
acacccacuccccugcucccg

SEQ ID NO: 998935 - RNA, 28 nt, Human
acacuggaacccuuugguagagugcuga

SEQ ID NO: 998936 - RNA, 18 nt, Human
acacuggaaccugggcaa

SEQ ID NO: 998937 - RNA, 18 nt, Human
acagcagcagcaggaggc

SEQ ID NO: 998938 - RNA, 19 nt, Human
acagcagcagcaggaggcc

SEQ ID NO: 998939 - RNA, 19 nt, Human
accaccauccguucccccc

SEQ ID NO: 998940 - RNA, 19 nt, Human
accaccauccguucccccc

SEQ ID NO: 998941 - RNA, 19 nt, Human
accaccauccguucccccc

SEQ ID NO: 998942 - RNA, 22 nt, Human
accaccauccguucccccccac

SEQ ID NO: 998943 - RNA, 22 nt, Human
accaccauccguucccccccac

SEQ ID NO: 998944 - RNA, 22 nt, Human
accaccauccguucccccccac

SEQ ID NO: 998945 - RNA, 22 nt, Human
accccagaggccuuccaagauc

SEQ ID NO: 998946 - RNA, 21 nt, Human
acuccuuuguaggaaaagaug

SEQ ID NO: 998947 - RNA, 21 nt, Human
acuccuuuguaggaaaagaug

SEQ ID NO: 998948 - RNA, 20 nt, Human
agaagccuuccaggaugcac

SEQ ID NO: 998949 - RNA, 19 nt, Human
agagcugaggugccagcug

SEQ ID NO: 998950 - RNA, 19 nt, Human
agagcugaggugccagcug

SEQ ID NO: 998951 - RNA, 18 nt, Human
agagggugaggugguuuc

SEQ ID NO: 998952 - RNA, 21 nt, Human
agcaaccccccuuagggcuga

SEQ ID NO: 998953 - RNA, 18 nt, Human
agcagcagcaggaggcag

SEQ ID NO: 998954 - RNA, 22 nt, Human
agcaggcaggcaggcaggcagu

SEQ ID NO: 998955 - RNA, 22 nt, Human
agcaggcaggcaggcaggcagu

SEQ ID NO: 998956 - RNA, 22 nt, Human
agcaggcaggcaggcaggcagu

SEQ ID NO: 998957 - RNA, 21 nt, Human
agccaagguacugccaaaccc

SEQ ID NO: 998958 - RNA, 21 nt, Human
agccaagguacugccaaaccc

SEQ ID NO: 998959 - RNA, 18 nt, Human
agcgcacuguccgccucu

SEQ ID NO: 998960 - RNA, 18 nt, Human
agcgcacuguccgccucu

SEQ ID NO: 998961 - RNA, 18 nt, Human
agcugaggugccagcugg

SEQ ID NO: 998962 - RNA, 18 nt, Human
agcugaggugccagcugg

SEQ ID NO: 998963 - RNA, 19 nt, Human
aggaagcccucggaugagc

SEQ ID NO: 998964 - RNA, 19 nt, Human
aggaagcccucggaugagc

SEQ ID NO: 998965 - RNA, 20 nt, Human
aggagacucagaacuacuac

SEQ ID NO: 998966 - RNA, 20 nt, Human
aggagacucagaacuacuac

SEQ ID NO: 998967 - RNA, 22 nt, Human
aggagguggcaaaggcuuaggg

SEQ ID NO: 998968 - RNA, 22 nt, Human
aggagguggcaaaggcuuaggg

SEQ ID NO: 998969 - RNA, 19 nt, Human
aggcagcuggaaggaccag

SEQ ID NO: 998970 - RNA, 19 nt, Human
aggcagcuggaaggaccag

SEQ ID NO: 998971 - RNA, 19 nt, Human
aggcagcuggaaggaccag

SEQ ID NO: 998972 - RNA, 19 nt, Human
aggcaggaaguuggagagg

SEQ ID NO: 998973 - RNA, 18 nt, Human
aggcaggcaggcaguagu

SEQ ID NO: 998974 - RNA, 18 nt, Human
aggcaggcaggcaguagu

SEQ ID NO: 998975 - RNA, 18 nt, Human
agggacaggaagaaggau

SEQ ID NO: 998976 - RNA, 18 nt, Human
agggacaggaagaaggau

SEQ ID NO: 998977 - RNA, 18 nt, Human
agggacaggaagaaggau

SEQ ID NO: 998978 - RNA, 21 nt, Human
agggcaguggugccagaccag

SEQ ID NO: 998979 - RNA, 18 nt, Human
agguggcaaaggcuuagg

SEQ ID NO: 998980 - RNA, 18 nt, Human
agguggcaaaggcuuagg

SEQ ID NO: 998981 - RNA, 21 nt, Human
agugacaggcagcuggaagga

SEQ ID NO: 998982 - RNA, 21 nt, Human
agugacaggcagcuggaagga

SEQ ID NO: 998983 - RNA, 21 nt, Human
agugacaggcagcuggaagga

SEQ ID NO: 998984 - RNA, 19 nt, Human
aucacuggacacgucccga

SEQ ID NO: 998985 - RNA, 23 nt, Human
aucauaagaaccugugguccuga

SEQ ID NO: 998986 - RNA, 23 nt, Human
aucauaagaaccugugguccuga

SEQ ID NO: 998987 - RNA, 22 nt, Human
augacucaggacaauuccacag

SEQ ID NO: 998988 - RNA, 22 nt, Human
augacucaggacaauuccacag

SEQ ID NO: 998989 - RNA, 24 nt, Human
augcccaccugugggucccaguuu

SEQ ID NO: 998990 - RNA, 24 nt, Human
augcccaccugugggucccaguuu

SEQ ID NO: 998991 - RNA, 19 nt, Human
auggaaccuugaguguuug

SEQ ID NO: 998992 - RNA, 19 nt, Human
auggaaccuugaguguuug

SEQ ID NO: 998993 - RNA, 23 nt, Human
auggaaccuugaguguuugaucu

SEQ ID NO: 998994 - RNA, 23 nt, Human
auggaaccuugaguguuugaucu

SEQ ID NO: 998995 - RNA, 21 nt, Human
auuuuuugacaugccaucuaa

SEQ ID NO: 998996 - RNA, 18 nt, Human
caaaauggaaccuugagu

SEQ ID NO: 998997 - RNA, 25 nt, Human
caaacugaugcaggaccuccacgca

SEQ ID NO: 998998 - RNA, 25 nt, Human
caaacugaugcaggaccuccacgca

SEQ ID NO: 998999 - RNA, 19 nt, Human
caaagcaaugacucaggac

SEQ ID NO: 999000 - RNA, 19 nt, Human
caaagcaaugacucaggac

SEQ ID NO: 999001 - RNA, 19 nt, Human
caaagcaaugacucaggac

SEQ ID NO: 999002 - RNA, 18 nt, Human
caaggccagccaguucuc

SEQ ID NO: 999003 - RNA, 18 nt, Human
caaggccagccaguucuc

SEQ ID NO: 999004 - RNA, 22 nt, Human
cacaccaagcuuagccaggagc

SEQ ID NO: 999005 - RNA, 23 nt, Human
cacaccaccucuuguuccagcug

SEQ ID NO: 999006 - RNA, 23 nt, Human
cacaccaccucuuguuccagcug

SEQ ID NO: 999007 - RNA, 24 nt, Human
cacagaggucauccagggcugccu

SEQ ID NO: 999008 - RNA, 22 nt, Human
caccaccauccguuccccccca

SEQ ID NO: 999009 - RNA, 22 nt, Human
caccaccauccguuccccccca

SEQ ID NO: 999010 - RNA, 22 nt, Human
caccaccauccguuccccccca

SEQ ID NO: 999011 - RNA, 19 nt, Human
caccauguggcuggacacu

SEQ ID NO: 999012 - RNA, 19 nt, Human
caccauguggcuggacacu

SEQ ID NO: 999013 - RNA, 19 nt, Human
caccauguggcuggacacu

SEQ ID NO: 999014 - RNA, 19 nt, Human
caccauguggcuggacacu

SEQ ID NO: 999015 - RNA, 20 nt, Human
caccauguggcuggacacuc

SEQ ID NO: 999016 - RNA, 20 nt, Human
caccauguggcuggacacuc

SEQ ID NO: 999017 - RNA, 20 nt, Human
caccauguggcuggacacuc

SEQ ID NO: 999018 - RNA, 20 nt, Human
caccauguggcuggacacuc

SEQ ID NO: 999019 - RNA, 26 nt, Human
caccauguggcuggacacucagggcu

SEQ ID NO: 999020 - RNA, 26 nt, Human
caccauguggcuggacacucagggcu

SEQ ID NO: 999021 - RNA, 26 nt, Human
caccauguggcuggacacucagggcu

SEQ ID NO: 999022 - RNA, 26 nt, Human
caccauguggcuggacacucagggcu

SEQ ID NO: 999023 - RNA, 18 nt, Human
caccccucccacuccgcc

SEQ ID NO: 999024 - RNA, 18 nt, Human
caccccucccacuccgcc

SEQ ID NO: 999025 - RNA, 18 nt, Human
caccccucccacuccgcc

SEQ ID NO: 999026 - RNA, 21 nt, Human
caccccucccacuccgccaaa

SEQ ID NO: 999027 - RNA, 23 nt, Human
cacucaggguccggguccugcuc

SEQ ID NO: 999028 - RNA, 23 nt, Human
cacucaggguccggguccugcuc

SEQ ID NO: 999029 - RNA, 23 nt, Human
cacucaggguccggguccugcuc

SEQ ID NO: 999030 - RNA, 21 nt, Human
cagagaagccuuccaggaugc

SEQ ID NO: 999031 - RNA, 18 nt, Human
cagaggccuuccaagauc

SEQ ID NO: 999032 - RNA, 20 nt, Human
cagcagcagaaucugccccc

SEQ ID NO: 999033 - RNA, 19 nt, Human
cagcagcagcaggaggcag

SEQ ID NO: 999034 - RNA, 21 nt, Human
cagcagcagcaggaggcagcc

SEQ ID NO: 999035 - RNA, 21 nt, Human
cagcagcagcaggaggcagcc

SEQ ID NO: 999036 - RNA, 22 nt, Human
cagcagcaggaggcagccuucu

SEQ ID NO: 999037 - RNA, 22 nt, Human
cagcagcaggaggcagccuucu

SEQ ID NO: 999038 - RNA, 18 nt, Human
cagccaguucucugggca

SEQ ID NO: 999039 - RNA, 24 nt, Human
cagccuucugagugggaacagagc

SEQ ID NO: 999040 - RNA, 24 nt, Human
cagccuucugagugggaacagagc

SEQ ID NO: 999041 - RNA, 18 nt, Human
caggaaacaaggccagcc

SEQ ID NO: 999042 - RNA, 18 nt, Human
caggaaacaaggccagcc

SEQ ID NO: 999043 - RNA, 18 nt, Human
caggaaacaaggccagcc

SEQ ID NO: 999044 - RNA, 20 nt, Human
caggacaauuccacaggcaa

SEQ ID NO: 999045 - RNA, 20 nt, Human
caggacaauuccacaggcaa

SEQ ID NO: 999046 - RNA, 20 nt, Human
caggacaauuccacaggcaa

SEQ ID NO: 999047 - RNA, 18 nt, Human
caggagccacaccaccuc

SEQ ID NO: 999048 - RNA, 18 nt, Human
caggagccacaccaccuc

SEQ ID NO: 999049 - RNA, 22 nt, Human
caggagccacaccaccucuugu

SEQ ID NO: 999050 - RNA, 22 nt, Human
caggagccacaccaccucuugu

SEQ ID NO: 999051 - RNA, 26 nt, Human
caggagccacaccaccucuuguucca

SEQ ID NO: 999052 - RNA, 26 nt, Human
caggagccacaccaccucuuguucca

SEQ ID NO: 999053 - RNA, 21 nt, Human
cagggacaggaagaaggaucc

SEQ ID NO: 999054 - RNA, 21 nt, Human
cagggacaggaagaaggaucc

SEQ ID NO: 999055 - RNA, 19 nt, Human
cagggcugccucuucacag

SEQ ID NO: 999056 - RNA, 19 nt, Human
cagggcugccucuucacag

SEQ ID NO: 999057 - RNA, 19 nt, Human
cagggcugccucuucacag

SEQ ID NO: 999058 - RNA, 21 nt, Human
caggggugucucugggcugag

SEQ ID NO: 999059 - RNA, 21 nt, Human
caggggugucucugggcugag

SEQ ID NO: 999060 - RNA, 21 nt, Human
caggguccggguccugcucca

SEQ ID NO: 999061 - RNA, 21 nt, Human
caggguccggguccugcucca

SEQ ID NO: 999062 - RNA, 21 nt, Human
caggguccggguccugcucca

SEQ ID NO: 999063 - RNA, 30 nt, Human
ccaaacagaucagacucaggaaacaaggcc

SEQ ID NO: 999064 - RNA, 30 nt, Human; identical to SEQ ID NO: 999063

SEQ ID NO: 999065 - RNA, 30 nt, Human; identical to SEQ ID NO: 999063

SEQ ID NO: 999066 - RNA, 19 nt, Human
ccaagagccaccuccuucc

SEQ ID NO: 999067 - RNA, 19 nt, Human
ccaagagccaccuccuucc

SEQ ID NO: 999068 - RNA, 19 nt, Human
ccaagagccaccuccuucc

SEQ ID NO: 999069 - RNA, 22 nt, Human
ccaccccucccacuccgccaaa

SEQ ID NO: 999070 - RNA, 22 nt, Human
ccaccccucccacuccgccaaa

SEQ ID NO: 999071 - RNA, 18 nt, Human
ccaccuccacauuacacu

SEQ ID NO: 999072 - RNA, 18 nt, Human
ccaggcuccuguuuccuu

SEQ ID NO: 999073 - RNA, 22 nt, Human
ccagggacaggaagaaggaucc

SEQ ID NO: 999074 - RNA, 23 nt, Human
cccacuccccugcucccggggga

SEQ ID NO: 999075 - RNA, 23 nt, Human
cccacuccccugcucccggggga

SEQ ID NO: 999076 - RNA, 23 nt, Human
cccacuccccugcucccggggga

SEQ ID NO: 999077 - RNA, 21 nt, Human
cccauggccccagcccaaagc

SEQ ID NO: 999078 - RNA, 21 nt, Human
cccauggccccagcccaaagc

SEQ ID NO: 999079 - RNA, 21 nt, Human
cccauggccccagcccaaagc

SEQ ID NO: 999080 - RNA, 20 nt, Human
cccccccacacccacucccc

SEQ ID NO: 999081 - RNA, 20 nt, Human
cccccccacacccacucccc

SEQ ID NO: 999082 - RNA, 20 nt, Human
cccccccacacccacucccc

SEQ ID NO: 999083 - RNA, 22 nt, Human
cccccugcccuccgcacuguca

SEQ ID NO: 999084 - RNA, 22 nt, Human
cccccugcccuccgcacuguca

SEQ ID NO: 999085 - RNA, 18 nt, Human
ccccgggcccgcuugcuc

SEQ ID NO: 999086 - RNA, 22 nt, Human
ccccucccacuccgccaaacag

SEQ ID NO: 999087 - RNA, 22 nt, Human
ccccucccacuccgccaaacag

SEQ ID NO: 999088 - RNA, 22 nt, Human
ccccucccacuccgccaaacag

SEQ ID NO: 999089 - RNA, 23 nt, Human
cccugccacacaaugguuucuuc

SEQ ID NO: 999090 - RNA, 19 nt, Human
ccggguccugcuccacccc

SEQ ID NO: 999091 - RNA, 20 nt, Human
ccggugcccggcggcgggcc

SEQ ID NO: 999092 - RNA, 19 nt, Human
ccuacaggcccacgugagc

SEQ ID NO: 999093 - RNA, 19 nt, Human
ccuacaggcccacgugagc

SEQ ID NO: 999094 - RNA, 19 nt, Human
ccuacaggcccacgugagc

SEQ ID NO: 999095 - RNA, 19 nt, Human
ccucggggucuuccacauc

SEQ ID NO: 999096 - RNA, 19 nt, Human
ccucggggucuuccacauc

SEQ ID NO: 999097 - RNA, 19 nt, Human
ccucggggucuuccacauc

SEQ ID NO: 999098 - RNA, 18 nt, Human
ccugcuccaccccuccca

SEQ ID NO: 999099 - RNA, 18 nt, Human
ccugcuccaccccuccca

SEQ ID NO: 999100 - RNA, 18 nt, Human
ccugcuccaccccuccca

SEQ ID NO: 999101 - RNA, 18 nt, Human
ccuuuuccuugucacuga

SEQ ID NO: 999102 - RNA, 23 nt, Human
cgccgggggcucgcuccgccucu

SEQ ID NO: 999103 - RNA, 25 nt, Human
cgcggccggacauuggcucagggcc

SEQ ID NO: 999104 - RNA, 18 nt, Human
cgcuccgccucuugcugc

SEQ ID NO: 999105 - RNA, 23 nt, Human
cggaugagcaugcugacccccgg

SEQ ID NO: 999106 - RNA, 23 nt, Human
cggaugagcaugcugacccccgg

SEQ ID NO: 999107 - RNA, 30 nt, Human
cggcuaauuucaccaaaaccuuaaggcacc

SEQ ID NO: 999108 - RNA, 30 nt, Human; identical to SEQ ID NO: 999107

SEQ ID NO: 999109 - RNA, 18 nt, Human
cggggcagcggcugcgga

SEQ ID NO: 999110 - RNA, 22 nt, Human
cggggucuuccacaucgguuuc

SEQ ID NO: 999111 - RNA, 22 nt, Human
cggggucuuccacaucgguuuc

SEQ ID NO: 999112 - RNA, 22 nt, Human
cggggucuuccacaucgguuuc

SEQ ID NO: 999113 - RNA, 19 nt, Human
cggguccugcuccaccccu

SEQ ID NO: 999114 - RNA, 19 nt, Human
cggguccugcuccaccccu

SEQ ID NO: 999115 - RNA, 19 nt, Human
cggguccugcuccaccccu

SEQ ID NO: 999116 - RNA, 20 nt, Human
cgucaggguccggggcagcg

SEQ ID NO: 999117 - RNA, 23 nt, Human
cucaaggcagaucaguuaccaug

SEQ ID NO: 999118 - RNA, 23 nt, Human
cucaaggcagaucaguuaccaug

SEQ ID NO: 999119 - RNA, 23 nt, Human
cucaaggcagaucaguuaccaug

SEQ ID NO: 999120 - RNA, 24 nt, Human
cucaccaccauccguuccccccca

SEQ ID NO: 999121 - RNA, 24 nt, Human
cucaccaccauccguuccccccca

SEQ ID NO: 999122 - RNA, 24 nt, Human
cucaccaccauccguuccccccca

SEQ ID NO: 999123 - RNA, 23 nt, Human
cucagaacuacuacucaggaggu

SEQ ID NO: 999124 - RNA, 23 nt, Human
cucagaacuacuacucaggaggu

SEQ ID NO: 999125 - RNA, 22 nt, Human
cucagggcugagagggaaaaug

SEQ ID NO: 999126 - RNA, 22 nt, Human
cucagggcugagagggaaaaug

SEQ ID NO: 999127 - RNA, 22 nt, Human
cuccacauuacacuggcaguug

SEQ ID NO: 999128 - RNA, 22 nt, Human
cuccacauuacacuggcaguug

SEQ ID NO: 999129 - RNA, 19 nt, Human
cucccggucuuacacacuu

SEQ ID NO: 999130 - RNA, 18 nt, Human
cugccuggucugucccuc

SEQ ID NO: 999131 - RNA, 18 nt, Human
cugccuggucugucccuc

SEQ ID NO: 999132 - RNA, 18 nt, Human
cugccuggucugucccuc

SEQ ID NO: 999133 - RNA, 22 nt, Human
cugcuccaccccucccacuccg

SEQ ID NO: 999134 - RNA, 24 nt, Human
cuggaaccugggcaagaaaucaca

SEQ ID NO: 999135 - RNA, 19 nt, Human
cuggagccauugugucucc

SEQ ID NO: 999136 - RNA, 19 nt, Human
cuggagccauugugucucc

SEQ ID NO: 999137 - RNA, 20 nt, Human
cuguuuccuuccccagcagc

SEQ ID NO: 999138 - RNA, 20 nt, Human
cuuccccagcagcagaaucu

SEQ ID NO: 999139 - RNA, 19 nt, Human
cuucugcgauaggccgugc

SEQ ID NO: 999140 - RNA, 19 nt, Human
cuucugcgauaggccgugc

SEQ ID NO: 999141 - RNA, 23 nt, Human
gaacacacacuggaacccuuugg

SEQ ID NO: 999142 - RNA, 22 nt, Human
gaccuuaugaucacuggacacg

SEQ ID NO: 999143 - RNA, 21 nt, Human
gaggugccagcuggucguggu

SEQ ID NO: 999144 - RNA, 21 nt, Human
gaggugccagcuggucguggu

SEQ ID NO: 999145 - RNA, 23 nt, Human
gagugggaacagagcugaggugc

SEQ ID NO: 999146 - RNA, 23 nt, Human
gagugggaacagagcugaggugc

SEQ ID NO: 999147 - RNA, 29 nt, Human
gcacggcuccaggaagcuggccgccuacg

SEQ ID NO: 999148 - RNA, 29 nt, Human
gcacggcuccaggaagcuggccgccuacg

SEQ ID NO: 999149 - RNA, 19 nt, Human
gcagcuggaaggaccaggg

SEQ ID NO: 999150 - RNA, 19 nt, Human
gcagcuggaaggaccaggg

SEQ ID NO: 999151 - RNA, 19 nt, Human
gcagcuggaaggaccaggg

SEQ ID NO: 999152 - RNA, 20 nt, Human
gcaggaccuccacgcagugc

SEQ ID NO: 999153 - RNA, 20 nt, Human
gcaggaccuccacgcagugc

SEQ ID NO: 999154 - RNA, 22 nt, Human
gcaggaggaaugugucggugag

SEQ ID NO: 999155 - RNA, 20 nt, Human
gcaggggggugccagcagga

SEQ ID NO: 999156 - RNA, 20 nt, Human
gcaggggggugccagcagga

SEQ ID NO: 999157 - RNA, 18 nt, Human
gcaguggugccagaccag

SEQ ID NO: 999158 - RNA, 18 nt, Human
gcaguggugccagaccag

SEQ ID NO: 999159 - RNA, 24 nt, Human
gccaucccauugugggggccacac

SEQ ID NO: 999160 - RNA, 24 nt, Human
gcucagggccugugacgcgagggu

SEQ ID NO: 999161 - RNA, 20 nt, Human
gcucucgcuggcagcagugg

SEQ ID NO: 999162 - RNA, 20 nt, Human
gcucucgcuggcagcagugg

SEQ ID NO: 999163 - RNA, 20 nt, Human
gcucucgcuggcagcagugg

SEQ ID NO: 999164 - RNA, 19 nt, Human
gcugccucuucacaguccg

SEQ ID NO: 999165 - RNA, 19 nt, Human
gcugccucuucacaguccg

SEQ ID NO: 999166 - RNA, 18 nt, Human
gcuggaaggaccagggca

SEQ ID NO: 999167 - RNA, 18 nt, Human
gcuggaaggaccagggca

SEQ ID NO: 999168 - RNA, 18 nt, Human
gcuggaaggaccagggca

SEQ ID NO: 999169 - RNA, 22 nt, Human
ggaacacacacuggaaccuggg

SEQ ID NO: 999170 - RNA, 19 nt, Human
ggaugagggggugggcugg

SEQ ID NO: 999171 - RNA, 21 nt, Human
ggccccuccccuagugccccc

SEQ ID NO: 999172 - RNA, 24 nt, Human
ggccggggcgaggcgccgggggcu

SEQ ID NO: 999173 - RNA, 18 nt, Human
ggcugcaggggggugcca

SEQ ID NO: 999174 - RNA, 18 nt, Human
ggcugcaggggggugcca

SEQ ID NO: 999175 - RNA, 18 nt, Human
ggcugcggagaagccccg

SEQ ID NO: 999176 - RNA, 24 nt, Human
gggaacccauggcccuccugcccu

SEQ ID NO: 999177 - RNA, 19 nt, Human
gggaggaaaugcacggcuc

SEQ ID NO: 999178 - RNA, 19 nt, Human
gggaggaaaugcacggcuc

SEQ ID NO: 999179 - RNA, 21 nt, Human
gggcugccucuucacaguccg

SEQ ID NO: 999180 - RNA, 24 nt, Human
ggggcucugcacaccaagcuuagc

SEQ ID NO: 999181 - RNA, 24 nt, Human
ggggcucugcacaccaagcuuagc

SEQ ID NO: 999182 - RNA, 20 nt, Human
gggggugccagcaggagacu

SEQ ID NO: 999183 - RNA, 20 nt, Human
gggggugccagcaggagacu

SEQ ID NO: 999184 - RNA, 22 nt, Human
ggugccagcuggucgugguccg

SEQ ID NO: 999185 - RNA, 22 nt, Human
ggugccagcuggucgugguccg

SEQ ID NO: 999186 - RNA, 20 nt, Human
ggugcugaagaaugcuaagu

SEQ ID NO: 999187 - RNA, 24 nt, Human
guaagccgaugaagaacuguacaa

SEQ ID NO: 999188 - RNA, 24 nt, Human
guaagccgaugaagaacuguacaa

SEQ ID NO: 999189 - RNA, 19 nt, Human
guccugcuccaccccuccc

SEQ ID NO: 999190 - RNA, 19 nt, Human
guccugcuccaccccuccc

SEQ ID NO: 999191 - RNA, 19 nt, Human
guccugcuccaccccuccc

SEQ ID NO: 999192 - RNA, 18 nt, Human
gugacugggggcaagggg

SEQ ID NO: 999193 - RNA, 18 nt, Human
gugacugggggcaagggg

SEQ ID NO: 999194 - RNA, 19 nt, Human
gugacugggggcaaggggc

SEQ ID NO: 999195 - RNA, 19 nt, Human
gugacugggggcaaggggc

SEQ ID NO: 999196 - RNA, 22 nt, Human
uaagccgaugaagaacuguaca

SEQ ID NO: 999197 - RNA, 20 nt, Human
uaaggaaaggaguggugcug

SEQ ID NO: 999198 - RNA, 20 nt, Human
uaaggaaaggaguggugcug

SEQ ID NO: 999199 - RNA, 22 nt, Human
uaaggaaaggaguggugcuggu

SEQ ID NO: 999200 - RNA, 22 nt, Human
uaaggaaaggaguggugcuggu

SEQ ID NO: 999201 - RNA, 24 nt, Human
uacaagggggaggaaaugcacggc

SEQ ID NO: 999202 - RNA, 24 nt, Human
uacaagggggaggaaaugcacggc

SEQ ID NO: 999203 - RNA, 24 nt, Human
uacacacugcugggagccccugcu

SEQ ID NO: 999204 - RNA, 27 nt, Human
uacacacugcugggagccccugcugcg

SEQ ID NO: 999205 - RNA, 27 nt, Human
uacacacugcugggagccccugcugcg

SEQ ID NO: 999206 - RNA, 21 nt, Human
uacacuggcaguuggagccag

SEQ ID NO: 999207 - RNA, 21 nt, Human
uacacuggcaguuggagccag

SEQ ID NO: 999208 - RNA, 22 nt, Human
uacauguacagcagcagcagga

SEQ ID NO: 999209 - RNA, 22 nt, Human
uacauguacagcagcagcagga

SEQ ID NO: 999210 - RNA, 20 nt, Human
uaccauggggacgggcucaa

SEQ ID NO: 999211 - RNA, 20 nt, Human
uaccauggggacgggcucaa

SEQ ID NO: 999212 - RNA, 24 nt, Human
uaccauggggacgggcucagcaac

SEQ ID NO: 999213 - RNA, 24 nt, Human
uaccauggggacgggcucagcaac

SEQ ID NO: 999214 - RNA, 24 nt, Human
uaccauggggacgggcucagcaac

SEQ ID NO: 999215 - RNA, 19 nt, Human
uaccccagagcucacgcag

SEQ ID NO: 999216 - RNA, 20 nt, Human
uacuggaugagggggugggc

SEQ ID NO: 999217 - RNA, 24 nt, Human
uagccaggagccacaccaccucuu

SEQ ID NO: 999218 - RNA, 24 nt, Human
uagccaggagccacaccaccucuu

SEQ ID NO: 999219 - RNA, 24 nt, Human
ucaggccgugaugugauguacaug

SEQ ID NO: 999220 - RNA, 24 nt, Human
ucaggccgugaugugauguacaug

SEQ ID NO: 999221 - RNA, 21 nt, Human
ucauaccagugacaggcagcu

SEQ ID NO: 999222 - RNA, 21 nt, Human
ucauaccagugacaggcagcu

SEQ ID NO: 999223 - RNA, 21 nt, Human
ucauaccagugacaggcagcu

SEQ ID NO: 999224 - RNA, 23 nt, Human
uccacgcagugcaucaugaagag

SEQ ID NO: 999225 - RNA, 23 nt, Human
uccacgcagugcaucaugaagag

SEQ ID NO: 999226 - RNA, 24 nt, Human
uccagugaaugccagguucugugc

SEQ ID NO: 999227 - RNA, 24 nt, Human
uccagugaaugccagguucugugc

SEQ ID NO: 999228 - RNA, 20 nt, Human
ucccauggccccagcccaaa

SEQ ID NO: 999229 - RNA, 20 nt, Human
ucccauggccccagcccaaa

SEQ ID NO: 999230 - RNA, 20 nt, Human
ucccauggccccagcccaaa

SEQ ID NO: 999231 - RNA, 22 nt, Human
uccccaggugcuccgcuucucu

SEQ ID NO: 999232 - RNA, 24 nt, Human
uccccaggugcuccgcuucucuua

SEQ ID NO: 999233 - RNA, 26 nt, Human
uccgcggcacagaggucauccagggc

SEQ ID NO: 999234 - RNA, 26 nt, Human
uccgcggcacagaggucauccagggc

SEQ ID NO: 999235 - RNA, 26 nt, Human
uccgcggcacagaggucauccagggc

SEQ ID NO: 999236 - RNA, 22 nt, Human
uccgggcaaccagauucagucc

SEQ ID NO: 999237 - RNA, 22 nt, Human
uccgggcaaccagauucagucc

SEQ ID NO: 999238 - RNA, 18 nt, Human
uccggggcagcggcugcg

SEQ ID NO: 999239 - RNA, 20 nt, Human
uccggguccugcuccacccc

SEQ ID NO: 999240 - RNA, 20 nt, Human
uccggguccugcuccacccc

SEQ ID NO: 999241 - RNA, 19 nt, Human
ucgcuccgccucuugcugc

SEQ ID NO: 999242 - RNA, 24 nt, Human
ucucaccaccauccguuccccccc

SEQ ID NO: 999243 - RNA, 24 nt, Human
ucucaccaccauccguuccccccc

SEQ ID NO: 999244 - RNA, 24 nt, Human
ucucaccaccauccguuccccccc

SEQ ID NO: 999245 - RNA, 25 nt, Human
ucuccaucacgugagcacucauucc

SEQ ID NO: 999246 - RNA, 25 nt, Human
ucuccaucacgugagcacucauucc

SEQ ID NO: 999247 - RNA, 24 nt, Human
ucucugucuccagcugucaacaaa

SEQ ID NO: 999248 - RNA, 24 nt, Human
ucucugucuccagcugucaacaaa

SEQ ID NO: 999249 - RNA, 24 nt, Human
ucugaccaccuccacauuacacug

SEQ ID NO: 999250 - RNA, 18 nt, Human
ucugcugggucuccauca

SEQ ID NO: 999251 - RNA, 18 nt, Human
ucugcugggucuccauca

SEQ ID NO: 999252 - RNA, 26 nt, Human
ucuggagcuuuguccuuaacucuuga

SEQ ID NO: 999253 - RNA, 26 nt, Human
ucuggagcuuuguccuuaacucuuga

SEQ ID NO: 999254 - RNA, 21 nt, Human
ucugggcugaggcacuuuggc

SEQ ID NO: 999255 - RNA, 21 nt, Human
ucugggcugaggcacuuuggc

SEQ ID NO: 999256 - RNA, 18 nt, Human
ucugucaggccgugaugg

SEQ ID NO: 999257 - RNA, 19 nt, Human
ucugucaggccgugaugug

SEQ ID NO: 999258 - RNA, 20 nt, Human
ugacaguaauagggagacga

SEQ ID NO: 999259 - RNA, 22 nt, Human
ugaccaccuccacauuacacug

SEQ ID NO: 999260 - RNA, 18 nt, Human
ugacccccggcaucaccu

SEQ ID NO: 999261 - RNA, 18 nt, Human
ugacccccggcaucaccu

SEQ ID NO: 999262 - RNA, 21 nt, Human
ugacucaggacaauuccacag

SEQ ID NO: 999263 - RNA, 26 nt, Human
ugacucggccccuccccuagugcccc

SEQ ID NO: 999264 - RNA, 18 nt, Human
ugacugggggcaaggggc

SEQ ID NO: 999265 - RNA, 18 nt, Human
ugacugggggcaaggggc

SEQ ID NO: 999266 - RNA, 19 nt, Human
ugagagggaaaaugaccca

SEQ ID NO: 999267 - RNA, 19 nt, Human
ugagagggaaaaugaccca

SEQ ID NO: 999268 - RNA, 20 nt, Human
ugagccaggcccgcccugcu

SEQ ID NO: 999269 - RNA, 20 nt, Human
ugagccaggcccgcccugcu

SEQ ID NO: 999270 - RNA, 20 nt, Human
ugagccaggcccgcccugcu

SEQ ID NO: 999271 - RNA, 21 nt, Human
ugcaggaccuccacgcagugc

SEQ ID NO: 999272 - RNA, 21 nt, Human
ugcaggaccuccacgcagugc

SEQ ID NO: 999273 - RNA, 20 nt, Human
ugccagcuggucgugguccg

SEQ ID NO: 999274 - RNA, 20 nt, Human
ugccagcuggucgugguccg

SEQ ID NO: 999275 - RNA, 20 nt, Human
ugcccaccugugggucccag

SEQ ID NO: 999276 - RNA, 21 nt, Human
ugcccggcggcgggccggggc

SEQ ID NO: 999277 - RNA, 19 nt, Human
ugccuggucugucccucuc

SEQ ID NO: 999278 - RNA, 19 nt, Human
ugccuggucugucccucuc

SEQ ID NO: 999279 - RNA, 19 nt, Human
ugccuggucugucccucuc

SEQ ID NO: 999280 - RNA, 20 nt, Human
ugcggcucugggcaagaaau

SEQ ID NO: 999281 - RNA, 21 nt, Human
ugcugggagccccugcugcgg

SEQ ID NO: 999282 - RNA, 21 nt, Human
ugcugggagccccugcugcgg

SEQ ID NO: 999283 - RNA, 21 nt, Human
ugcugggagccccugcugcgg

SEQ ID NO: 999284 - RNA, 24 nt, Human
uggaccuuaugaucacuggacacg

SEQ ID NO: 999285 - RNA, 18 nt, Human
uggcaaaggcuuagggau

SEQ ID NO: 999286 - RNA, 18 nt, Human
uggcaaaggcuuagggau

SEQ ID NO: 999287 - RNA, 19 nt, Human
uggcagcacuuggaacaca

SEQ ID NO: 999288 - RNA, 19 nt, Human
uggcagcacuuggaacaca

SEQ ID NO: 999289 - RNA, 19 nt, Human
uggcagcaguggcgggaag

SEQ ID NO: 999290 - RNA, 19 nt, Human
uggcagggguggggaaggg

SEQ ID NO: 999291 - RNA, 19 nt, Human
uggcagggguggggaaggg

SEQ ID NO: 999292 - RNA, 23 nt, Human
uggcagggguggggaagggacau

SEQ ID NO: 999293 - RNA, 23 nt, Human
uggcagggguggggaagggacau

SEQ ID NO: 999294 - RNA, 19 nt, Human
uggcgggaagugaaacuug

SEQ ID NO: 999295 - RNA, 21 nt, Human
uggcucagggccugugacgcg

SEQ ID NO: 999296 - RNA, 19 nt, Human
uggcugcaggggggugcca

SEQ ID NO: 999297 - RNA, 19 nt, Human
uggcugcaggggggugcca

SEQ ID NO: 999298 - RNA, 22 nt, Human
ugggaacagagcugaggugcca

SEQ ID NO: 999299 - RNA, 23 nt, Human
ugggaacagagcugaggugccag

SEQ ID NO: 999300 - RNA, 22 nt, Human
ugguggcacaaugcaccggggc

SEQ ID NO: 999301 - RNA, 22 nt, Human
ugguggcacaaugcaccggggc

SEQ ID NO: 999302 - RNA, 22 nt, Human
ugguggcacaaugcaccggggc

SEQ ID NO: 999303 - RNA, 21 nt, Human
ugguuuaggccugggccaaga

SEQ ID NO: 999304 - RNA, 21 nt, Human
ugguuuaggccugggccaaga

SEQ ID NO: 999305 - RNA, 21 nt, Human
ugguuuaggccugggccaaga

SEQ ID NO: 999306 - RNA, 20 nt, Human
uguaggaaaagauguuuuuc

SEQ ID NO: 999307 - RNA, 20 nt, Human
uguaggaaaagauguuuuuc

SEQ ID NO: 999308 - RNA, 20 nt, Human
uguggcuggacacucagggc

SEQ ID NO: 999309 - RNA, 20 nt, Human
uguggcuggacacucagggc

SEQ ID NO: 999310 - RNA, 20 nt, Human
uguggcuggacacucagggc

SEQ ID NO: 999311 - RNA, 20 nt, Human
uguggcuggacacucagggc

SEQ ID NO: 999312 - RNA, 21 nt, Human
uguggcuggacacucagggcc

SEQ ID NO: 999313 - RNA, 21 nt, Human
uguggcuggacacucagggcc

SEQ ID NO: 999314 - RNA, 21 nt, Human
uguggcuggacacucagggcc

SEQ ID NO: 999315 - RNA, 21 nt, Human
uguggcuggacacucagggcc

SEQ ID NO: 999316 - RNA, 22 nt, Human
ugugucuccaaggccacucugu

SEQ ID NO: 999317 - RNA, 22 nt, Human
ugugucuccaaggccacucugu

SEQ ID NO: 999318 - RNA, 18 nt, Human
uucacaugacucggcccc

SEQ ID NO: 999319 - RNA, 21 nt, Human
uucucuguuccucuagaacgg

SEQ ID NO: 999320 - RNA, 24 nt, Human
uuguuuuauggagucaccucucag

SEQ ID NO: 999321 - RNA, 24 nt, Human
uuguuuuauggagucaccucucag

SEQ ID NO: 999322 - RNA, 18 nt, Human
uuucccaggcuuuccugg

SEQ ID NO: 999323 - RNA, 18 nt, Human
uuucccaggcuuuccugg

SEQ ID NO: 999324 - RNA, 18 nt, Human
uuucccaggcuuuccugg

SEQ ID NO: 999325 - RNA, 20 nt, Human
uuugguagagugcugaggga

SEQ ID NO: 999326 - RNA, 19 nt, Human
uuuuuuuuuuuuauggggc

SEQ ID NO: 999327 - RNA, 24 nt, Human
uuuuuuuuuuuuuuuuuuuauggg

SEQ ID NO: 999328 - RNA, 26 nt, Human
uuuuuuuuuuuuuuuuuuuuaugggg

SEQ ID NO: 999329 - RNA, 24 nt, Human
aaacuguccgagcgagaggcacaa

SEQ ID NO: 999330 - RNA, 23 nt, Human
aaggggccaaaggucccugccua

SEQ ID NO: 999331 - RNA, 21 nt, Human
acccaauggucaggcuccgga

SEQ ID NO: 999332 - RNA, 19 nt, Human
acccucgaggaaggggcag

SEQ ID NO: 999333 - RNA, 19 nt, Human
acggagcugcugccacccc

SEQ ID NO: 999334 - RNA, 19 nt, Human
acggagcugcugccacccc

SEQ ID NO: 999335 - RNA, 18 nt, Human
acucuaggaucuccaagc

SEQ ID NO: 999336 - RNA, 21 nt, Human
acugaccggcuuccugggcuu

SEQ ID NO: 999337 - RNA, 21 nt, Human
acugaccggcuuccugggcuu

SEQ ID NO: 999338 - RNA, 18 nt, Human
agacuuggagaaaagcca

SEQ ID NO: 999339 - RNA, 21 nt, Human
agagcucccccagcaaggccu

SEQ ID NO: 999340 - RNA, 18 nt, Human
agccaagauuagcuggug

SEQ ID NO: 999341 - RNA, 22 nt, Human
agcuagacucaugacggagcug

SEQ ID NO: 999342 - RNA, 22 nt, Human
agcuagacucaugacggagcug

SEQ ID NO: 999343 - RNA, 22 nt, Human
aggugucagcaacugccaugac

SEQ ID NO: 999344 - RNA, 22 nt, Human
aggugucagcaacugccaugac

SEQ ID NO: 999345 - RNA, 23 nt, Human
aggugucagcaacugccaugacc

SEQ ID NO: 999346 - RNA, 23 nt, Human
aggugucagcaacugccaugacc

SEQ ID NO: 999347 - RNA, 24 nt, Human
agugcuccaucaggcucgagcaac

SEQ ID NO: 999348 - RNA, 23 nt, Human
aucacggaauccuugagccaagg

SEQ ID NO: 999349 - RNA, 18 nt, Human
auccacucuaggaucucc

SEQ ID NO: 999350 - RNA, 22 nt, Human
auccauccucggccaacucgau

SEQ ID NO: 999351 - RNA, 22 nt, Human
auccauccucggccaacucgau

SEQ ID NO: 999352 - RNA, 22 nt, Human
auccauccucggccaacucgau

SEQ ID NO: 999353 - RNA, 22 nt, Human
caaaaugaacaucacggaaucc

SEQ ID NO: 999354 - RNA, 23 nt, Human
caacugccaugaccacuugcagc

SEQ ID NO: 999355 - RNA, 23 nt, Human
caacugccaugaccacuugcagc

SEQ ID NO: 999356 - RNA, 23 nt, Human
cagcagcaucccugaucgagggg

SEQ ID NO: 999357 - RNA, 22 nt, Human
cagcggccgcagcccgcccccc

SEQ ID NO: 999358 - RNA, 22 nt, Human
cagcggccgcagcccgcccccc

SEQ ID NO: 999359 - RNA, 22 nt, Human
caggugggggcuagagaagagc

SEQ ID NO: 999360 - RNA, 23 nt, Human
ccaccccagcagaucugcucgcc

SEQ ID NO: 999361 - RNA, 23 nt, Human
ccaccccagcagaucugcucgcc

SEQ ID NO: 999362 - RNA, 20 nt, Human
cccgaacaccuccacagccg

SEQ ID NO: 999363 - RNA, 22 nt, Human
cccgaacaccuccacagccgcc

SEQ ID NO: 999364 - RNA, 19 nt, Human
cccgcagcagccccuugcu

SEQ ID NO: 999365 - RNA, 20 nt, Human
cccgcagcagccccuugcuc

SEQ ID NO: 999366 - RNA, 22 nt, Human
cccgucugucucucccucccca

SEQ ID NO: 999367 - RNA, 20 nt, Human
cccugguguccucgaagugc

SEQ ID NO: 999368 - RNA, 21 nt, Human
ccgaacaccuccacagccgcc

SEQ ID NO: 999369 - RNA, 22 nt, Human
ccuccucggacuuggcagaggc

SEQ ID NO: 999370 - RNA, 21 nt, Human
ccugcagugagggccagaccc

SEQ ID NO: 999371 - RNA, 27 nt, Human
ccugcagugagggccagaccggggucc

SEQ ID NO: 999372 - RNA, 22 nt, Human
ccuucagcuucccgaacaccuc

SEQ ID NO: 999373 - RNA, 23 nt, Human
cgccacacaggcugcucuaggcg

SEQ ID NO: 999374 - RNA, 20 nt, Human
cgcccagcucgucgucguag

SEQ ID NO: 999375 - RNA, 19 nt, Human
cggccgcagccagcguccu

SEQ ID NO: 999376 - RNA, 19 nt, Human
cgguacucugaggggcugc

SEQ ID NO: 999377 - RNA, 19 nt, Human
cgucgccgccacggccgca

SEQ ID NO: 999378 - RNA, 27 nt, Human
cuccacagccgcccuggacacgcugcu

SEQ ID NO: 999379 - RNA, 22 nt, Human
cucccuccccaaaggggccaaa

SEQ ID NO: 999380 - RNA, 24 nt, Human
cucccugguguccucgaagugcuc

SEQ ID NO: 999381 - RNA, 27 nt, Human
cucgaagugcuccaucaggcucgagca

SEQ ID NO: 999382 - RNA, 24 nt, Human
cucgagcaacuggagcacccaaug

SEQ ID NO: 999383 - RNA, 20 nt, Human
cucuguugggaccccuuuca

SEQ ID NO: 999384 - RNA, 26 nt, Human
cugaagacuuucuauuucuccauuag

SEQ ID NO: 999385 - RNA, 26 nt, Human
cugaagacuuucuauuucuccauuag

SEQ ID NO: 999386 - RNA, 19 nt, Human
cugaccggcuuccugggcu

SEQ ID NO: 999387 - RNA, 19 nt, Human
cugaccggcuuccugggcu

SEQ ID NO: 999388 - RNA, 21 nt, Human
cuucagcuucccgaacaccuc

SEQ ID NO: 999389 - RNA, 24 nt, Human
gacuuucuauuucuccauuaguuc

SEQ ID NO: 999390 - RNA, 24 nt, Human
gacuuucuauuucuccauuaguuc

SEQ ID NO: 999391 - RNA, 19 nt, Human
gcaaguccucaaacugucc

SEQ ID NO: 999392 - RNA, 21 nt, Human
gcagcacucuccugcagcugc

SEQ ID NO: 999393 - RNA, 20 nt, Human
gcaucagcucguggcccagc

SEQ ID NO: 999394 - RNA, 22 nt, Human
gccacacaggcugcucuaggcg

SEQ ID NO: 999395 - RNA, 25 nt, Human
gccuugcugcuucuucacggucucc

SEQ ID NO: 999396 - RNA, 25 nt, Human
gccuugcugcuucuucacggucucc

SEQ ID NO: 999397 - RNA, 19 nt, Human
gggcagaguugcgcacgug

SEQ ID NO: 999398 - RNA, 19 nt, Human
ggggccgcacggguggagg

SEQ ID NO: 999399 - RNA, 22 nt, Human
gguuggccucuggggauuuggc

SEQ ID NO: 999400 - RNA, 22 nt, Human
guccaugaaguguagcugcuuc

SEQ ID NO: 999401 - RNA, 18 nt, Human
gucguagacuuggagaaa

SEQ ID NO: 999402 - RNA, 21 nt, Human
gucgucgccgccacggccgca

SEQ ID NO: 999403 - RNA, 21 nt, Human
ucacggucuccacggccuucg

SEQ ID NO: 999404 - RNA, 19 nt, Human
ucagagguuggaaggcucg

SEQ ID NO: 999405 - RNA, 25 nt, Human
uccccaaaggggccaaaggucccug

SEQ ID NO: 999406 - RNA, 22 nt, Human
ucccgaacaccuccacagccgc

SEQ ID NO: 999407 - RNA, 28 nt, Human
ucccgaacaccuccacagccgcccugga

SEQ ID NO: 999408 - RNA, 22 nt, Human
ucccuccccaaaggggccaaaa

SEQ ID NO: 999409 - RNA, 23 nt, Human
uccuucagcuucccgaacaccuc

SEQ ID NO: 999410 - RNA, 20 nt, Human
ucgccgccacggccgcagcc

SEQ ID NO: 999411 - RNA, 22 nt, Human
ucgccgccacggccgcagccag

SEQ ID NO: 999412 - RNA, 20 nt, Human
ucgccuugcugcuucuucac

SEQ ID NO: 999413 - RNA, 20 nt, Human
ucgccuugcugcuucuucac

SEQ ID NO: 999414 - RNA, 20 nt, Human
ucugucucucccuccccaaa

SEQ ID NO: 999415 - RNA, 19 nt, Human
ucuguugggaccccuuuca

SEQ ID NO: 999416 - RNA, 23 nt, Human
ucuuuggcucugugauauacaga

SEQ ID NO: 999417 - RNA, 19 nt, Human
ugaauugucuuuggcucug

SEQ ID NO: 999418 - RNA, 18 nt, Human
ugaggacuggggcgggca

SEQ ID NO: 999419 - RNA, 20 nt, Human
ugaggaggggcugcaugucc

SEQ ID NO: 999420 - RNA, 23 nt, Human
ugaggaggggcugcauguccagg

SEQ ID NO: 999421 - RNA, 24 nt, Human
ugcaggugggggcuagagaagagc

SEQ ID NO: 999422 - RNA, 21 nt, Human
ugccuagagcacaacgugggg

SEQ ID NO: 999423 - RNA, 21 nt, Human
ugccuagagcacaacgugggg

SEQ ID NO: 999424 - RNA, 21 nt, Human
ugccuagagcacaacgugggg

SEQ ID NO: 999425 - RNA, 20 nt, Human
ugcguggccuggaugauggg

SEQ ID NO: 999426 - RNA, 22 nt, Human
ugcucuaggcggccuuuaauca

SEQ ID NO: 999427 - RNA, 22 nt, Human
ugcucuaggcggccuuuaauca

SEQ ID NO: 999428 - RNA, 21 nt, Human
uggcagaggcacuggcccacu

SEQ ID NO: 999429 - RNA, 21 nt, Human
ugggggcuagagaagagcucc

SEQ ID NO: 999430 - RNA, 20 nt, Human
uguugaggaggggcugcaug

SEQ ID NO: 999431 - RNA, 22 nt, Human
uucacggucuccacggccuucg

SEQ ID NO: 999432 - RNA, 19 nt, Human
uuggaaggcucggagccuc

SEQ ID NO: 999433 - RNA, 23 nt, Human
uuuuuuuuuuagaaaccaaggcu

SEQ ID NO: 999434 - RNA, 18 nt, Human
aaagagacuauaagaacc

SEQ ID NO: 999435 - RNA, 22 nt, Human
aaccaaguauggcaauacagga

SEQ ID NO: 999436 - RNA, 22 nt, Human
aaggaaccauggcuuguuugag

SEQ ID NO: 999437 - RNA, 23 nt, Human
aaggaaccauggcuuguuugagu

SEQ ID NO: 999438 - RNA, 22 nt, Human
aauacuaaaaccaaguauggca

SEQ ID NO: 999439 - RNA, 18 nt, Human
acugccugagaggacucc

SEQ ID NO: 999440 - RNA, 20 nt, Human
agagaagacaguccaccgcg

SEQ ID NO: 999441 - RNA, 19 nt, Human
aucauugcacagagaagac

SEQ ID NO: 999442 - RNA, 19 nt, Human
caucaaggaaccauggcuu

SEQ ID NO: 999443 - RNA, 18 nt, Human
cccacuucccaaacacca

SEQ ID NO: 999444 - RNA, 18 nt, Human
cgaauccucaucugcgac

SEQ ID NO: 999445 - RNA, 23 nt, Human
cuucccaaacaccacuaggucga

SEQ ID NO: 999446 - RNA, 18 nt, Human
ggcuccugaauaucuccc

SEQ ID NO: 999447 - RNA, 21 nt, Human
ggguagguucucccacuuccc

SEQ ID NO: 999448 - RNA, 22 nt, Human
uaaaaagagacuauaagaaccu

SEQ ID NO: 999449 - RNA, 22 nt, Human
uaaaaccaaguauggcaauaca

SEQ ID NO: 999450 - RNA, 21 nt, Human
uagguucucccacuucccaaa

SEQ ID NO: 999451 - RNA, 20 nt, Human
ucaucaaggaaccauggcuu

SEQ ID NO: 999452 - RNA, 21 nt, Human
ucaucugcgacuuuguguuuc

SEQ ID NO: 999453 - RNA, 23 nt, Human
uccaccgcgcagcgcugacuauc

SEQ ID NO: 999454 - RNA, 18 nt, Human
uccagaguccagaggggu

SEQ ID NO: 999455 - RNA, 19 nt, Human
ucccaaacaccacuagguc

SEQ ID NO: 999456 - RNA, 25 nt, Human
uccgaagagcuucuuccagaguccu

SEQ ID NO: 999457 - RNA, 20 nt, Human
ucucccacuucccaaacacc

SEQ ID NO: 999458 - RNA, 21 nt, Human
ugaauaucucccaggaguccc

SEQ ID NO: 999459 - RNA, 18 nt, Human
ugguuugggugcuuugca

SEQ ID NO: 999460 - RNA, 24 nt, Human
uguguuuccucuuuuugccauggu

SEQ ID NO: 999461 - RNA, 21 nt, Human
uguuucaggguuuugcauggu

SEQ ID NO: 999462 - RNA, 19 nt, Human
uucuguggcgagcugggaa

SEQ ID NO: 999463 - RNA, 26 nt, Human
uugcuaagucaacgucugaacagugu

SEQ ID NO: 999464 - RNA, 21 nt, Human
uuguuuguuugucaucaagga

SEQ ID NO: 999465 - RNA, 22 nt, Human
uuguuuguuugucaucaaggaa

SEQ ID NO: 999466 - RNA, 19 nt, Human
uuuccucuuuuugccaugg

SEQ ID NO: 999467 - RNA, 23 nt, Human
uuugcauuuucccaacugccuga

SEQ ID NO: 999468 - RNA, 18 nt, Human
aaacccagggccggacag

SEQ ID NO: 999469 - RNA, 28 nt, Human
aaacccagggccggacaggaggcgagga

SEQ ID NO: 999470 - RNA, 19 nt, Human
aaagugcugggauuacagg

SEQ ID NO: 999471 - RNA, 20 nt, Human
aaagugcugggauuacaggc

SEQ ID NO: 999472 - RNA, 22 nt, Human
aaagugcugggauuacaggcgg

SEQ ID NO: 999473 - RNA, 24 nt, Human
aaagugcugggauuacaggcggga

SEQ ID NO: 999474 - RNA, 24 nt, Human
aagaaaaccagccuacccuucaag

SEQ ID NO: 999475 - RNA, 19 nt, Human
aagcugacuuaggaugcaa

SEQ ID NO: 999476 - RNA, 18 nt, Human
aagugcugggauuacagg

SEQ ID NO: 999477 - RNA, 19 nt, Human
aagugcugggauuacaggc

SEQ ID NO: 999478 - RNA, 26 nt, Human
aagugcugggauuacaggcgggagcc

SEQ ID NO: 999479 - RNA, 21 nt, Human
acauggcagggcugagcugau

SEQ ID NO: 999480 - RNA, 18 nt, Human
acccugagcaaugcuucc

SEQ ID NO: 999481 - RNA, 21 nt, Human
accugggauuauaggcaugcg

SEQ ID NO: 999482 - RNA, 18 nt, Human
acugccguugguggccug

SEQ ID NO: 999483 - RNA, 26 nt, Human
agaacacccggggcacacacggggca

SEQ ID NO: 999484 - RNA, 21 nt, Human
agagaccgaggaugagaaagu

SEQ ID NO: 999485 - RNA, 21 nt, Human
agccaauggcagcgaaugacg

SEQ ID NO: 999486 - RNA, 23 nt, Human
agccaccgcgccgggccaucuua

SEQ ID NO: 999487 - RNA, 21 nt, Human
aggcccaggugugagcagcag

SEQ ID NO: 999488 - RNA, 25 nt, Human
aggcuggagugcaguggcacaaucu

SEQ ID NO: 999489 - RNA, 21 nt, Human
agguucaagugauucuccugc

SEQ ID NO: 999490 - RNA, 22 nt, Human
agguucaagugauucuccugcc

SEQ ID NO: 999491 - RNA, 23 nt, Human
agguucaagugauucuccugccu

SEQ ID NO: 999492 - RNA, 21 nt, Human
aguaccugggauuauaggcau

SEQ ID NO: 999493 - RNA, 24 nt, Human
agugauucuccugccucagccucc

SEQ ID NO: 999494 - RNA, 20 nt, Human
agugcaguggcacaaucuug

SEQ ID NO: 999495 - RNA, 24 nt, Human
agugcaguggcacaaucuuggcuc

SEQ ID NO: 999496 - RNA, 18 nt, Human
agugcugggauuacaggc

SEQ ID NO: 999497 - RNA, 21 nt, Human
auccgcccgccucggccuccc

SEQ ID NO: 999498 - RNA, 18 nt, Human
aucugaguagguguaaga

SEQ ID NO: 999499 - RNA, 26 nt, Human
caaagugcugggauuacaggcgggag

SEQ ID NO: 999500 - RNA, 21 nt, Human
caacagaacaaaacccccgcc

SEQ ID NO: 999501 - RNA, 24 nt, Human
caacagaacaaaacccccgccgcg

SEQ ID NO: 999502 - RNA, 22 nt, Human
caagugauucuccugccucagc

SEQ ID NO: 999503 - RNA, 24 nt, Human
caaugggccagcuucagaaccauc

SEQ ID NO: 999504 - RNA, 18 nt, Human
cacccggggcacacacgg

SEQ ID NO: 999505 - RNA, 18 nt, Human
cacgacaaggacaaggca

SEQ ID NO: 999506 - RNA, 25 nt, Human
cacuccucccccagaaagccagggg

SEQ ID NO: 999507 - RNA, 18 nt, Human
cacugcaaccucugccuc

SEQ ID NO: 999508 - RNA, 21 nt, Human
cacugcaaccucugccuccca

SEQ ID NO: 999509 - RNA, 20 nt, Human
cagaacaaaacccccgccgc

SEQ ID NO: 999510 - RNA, 20 nt, Human
cagaacaaaacccccgccgc

SEQ ID NO: 999511 - RNA, 20 nt, Human
cagaaggacugccguuggug

SEQ ID NO: 999512 - RNA, 22 nt, Human
cagaaggacugccguugguggc

SEQ ID NO: 999513 - RNA, 20 nt, Human
cagcagggccaccaggccuc

SEQ ID NO: 999514 - RNA, 20 nt, Human
cagcaucuuggcccucacag

SEQ ID NO: 999515 - RNA, 22 nt, Human
cagcccccucugcccuuggccc

SEQ ID NO: 999516 - RNA, 21 nt, Human
cagccuacccuucaagcugac

SEQ ID NO: 999517 - RNA, 20 nt, Human
cagccuccugaguaccuggg

SEQ ID NO: 999518 - RNA, 19 nt, Human
cagccucucagaaccccau

SEQ ID NO: 999519 - RNA, 22 nt, Human
cagcggccuggccugggaaagg

SEQ ID NO: 999520 - RNA, 21 nt, Human
cagggaccuggucuauggccu

SEQ ID NO: 999521 - RNA, 19 nt, Human
ccaaagugcugggauuaca

SEQ ID NO: 999522 - RNA, 22 nt, Human
ccaaagugcugggauuacaggc

SEQ ID NO: 999523 - RNA, 23 nt, Human
ccaaagugcugggauuacaggcg

SEQ ID NO: 999524 - RNA, 19 nt, Human
ccacacuccuaccccaaac

SEQ ID NO: 999525 - RNA, 20 nt, Human
ccacuccucccccagaaagc

SEQ ID NO: 999526 - RNA, 21 nt, Human
ccaggggggaaaagcugcuca

SEQ ID NO: 999527 - RNA, 23 nt, Human
cccagguucaagugauucuccuc

SEQ ID NO: 999528 - RNA, 23 nt, Human
cccagguucaagugauucuccug

SEQ ID NO: 999529 - RNA, 18 nt, Human
cccccagaaagccagggg

SEQ ID NO: 999530 - RNA, 30 nt, Human
ccccccacccugagcaaugcuucccaggcc

SEQ ID NO: 999531 - RNA, 21 nt, Human
cccuaaggaggcccacuccuc

SEQ ID NO: 999532 - RNA, 25 nt, Human
cccucacagcuguggcagugccucu

SEQ ID NO: 999533 - RNA, 24 nt, Human
ccuaaggaggcccacuccuccccc

SEQ ID NO: 999534 - RNA, 18 nt, Human
ccucacagcuguggcagu

SEQ ID NO: 999535 - RNA, 21 nt, Human
ccucacagcuguggcagugcc

SEQ ID NO: 999536 - RNA, 24 nt, Human
ccucccagguucaagugauucucc

SEQ ID NO: 999537 - RNA, 21 nt, Human
ccucccccagaaagccagggg

SEQ ID NO: 999538 - RNA, 23 nt, Human
ccucuaccugccuucagcaacca

SEQ ID NO: 999539 - RNA, 23 nt, Human
ccugaguaccugggauuauaggc

SEQ ID NO: 999540 - RNA, 24 nt, Human
ccuguggccaggaaggcuucagac

SEQ ID NO: 999541 - RNA, 23 nt, Human
ccuucagcaaccacugagaacac

SEQ ID NO: 999542 - RNA, 22 nt, Human
ccuuggcccaaccgugggcccc

SEQ ID NO: 999543 - RNA, 21 nt, Human
cgacaaggacaaggcagggca

SEQ ID NO: 999544 - RNA, 22 nt, Human
cgaccucaacucauccgcccgc

SEQ ID NO: 999545 - RNA, 24 nt, Human
cgccucggccucccaaagugcugg

SEQ ID NO: 999546 - RNA, 21 nt, Human
cggcaacagaacaaaaccccc

SEQ ID NO: 999547 - RNA, 29 nt, Human
cggcuaauuuuguauuuuuaguagagacg

SEQ ID NO: 999548 - RNA, 20 nt, Human
cggcugccuugcuacccagg

SEQ ID NO: 999549 - RNA, 20 nt, Human
cgggagccaccgcgccgggc

SEQ ID NO: 999550 - RNA, 24 nt, Human
cucacugcaaccucugccucccag

SEQ ID NO: 999551 - RNA, 24 nt, Human
cucacugcaaccucugccucccag

SEQ ID NO: 999552 - RNA, 21 nt, Human
cucagcugugucugaggucug

SEQ ID NO: 999553 - RNA, 18 nt, Human
cucccagguucaagugau

SEQ ID NO: 999554 - RNA, 25 nt, Human
cucccgaccucaacucauccgcccg

SEQ ID NO: 999555 - RNA, 26 nt, Human
cucccgaccucaacucauccgcccgc

SEQ ID NO: 999556 - RNA, 22 nt, Human
cuccgaggagaggcccaggugu

SEQ ID NO: 999557 - RNA, 18 nt, Human
cuccuaccccaaacgggc

SEQ ID NO: 999558 - RNA, 20 nt, Human
cucuucuuccuuuuuccacu

SEQ ID NO: 999559 - RNA, 23 nt, Human
cucuuucaaugggccagcuucag

SEQ ID NO: 999560 - RNA, 24 nt, Human
cugaguaccugggauuauaggcau

SEQ ID NO: 999561 - RNA, 23 nt, Human
cugcaaccucugccucccagguu

SEQ ID NO: 999562 - RNA, 24 nt, Human
cugcaaccucugccucccagguuc

SEQ ID NO: 999563 - RNA, 21 nt, Human
cugcaguggcgcacggguuuu

SEQ ID NO: 999564 - RNA, 23 nt, Human
cugccucagccuccugaguaccu

SEQ ID NO: 999565 - RNA, 19 nt, Human
cuugggggaggguucucca

SEQ ID NO: 999566 - RNA, 24 nt, Human
gaccucaacucauccgcccgccuc

SEQ ID NO: 999567 - RNA, 22 nt, Human
gaguaccugggauuauaggcau

SEQ ID NO: 999568 - RNA, 18 nt, Human
gauuacaggcgggagcca

SEQ ID NO: 999569 - RNA, 18 nt, Human
gauuauaggcaugcgcca

SEQ ID NO: 999570 - RNA, 22 nt, Human
gcaaccucugccucccagguuc

SEQ ID NO: 999571 - RNA, 18 nt, Human
gcacccagggucaccugu

SEQ ID NO: 999572 - RNA, 22 nt, Human
gccaccaggccucugucccagg

SEQ ID NO: 999573 - RNA, 23 nt, Human
gcccacuccucccccagaaagcc

SEQ ID NO: 999574 - RNA, 24 nt, Human
gcccacuccucccccagaaagcca

SEQ ID NO: 999575 - RNA, 19 nt, Human
gcccgccugccccaggcac

SEQ ID NO: 999576 - RNA, 21 nt, Human
gcucacugcaaccucugccuc

SEQ ID NO: 999577 - RNA, 19 nt, Human
gcuggagugcaguggcaca

SEQ ID NO: 999578 - RNA, 21 nt, Human
gcuuuuguugcucaggcugga

SEQ ID NO: 999579 - RNA, 19 nt, Human
ggaggguucuccauccaca

SEQ ID NO: 999580 - RNA, 21 nt, Human
ggaugcgaggggaggggcagu

SEQ ID NO: 999581 - RNA, 20 nt, Human
ggcagggguggcacccaggg

SEQ ID NO: 999582 - RNA, 21 nt, Human
ggccauggucccagcccccca

SEQ ID NO: 999583 - RNA, 21 nt, Human
gggaggguucuccauccacac

SEQ ID NO: 999584 - RNA, 21 nt, Human
ggggcagggguggcacccagg

SEQ ID NO: 999585 - RNA, 27 nt, Human
ggggcagggguggcacccagggucacc

SEQ ID NO: 999586 - RNA, 21 nt, Human
ggucugugaacucccagccuc

SEQ ID NO: 999587 - RNA, 24 nt, Human
ggugauugcauaguguccuuugag

SEQ ID NO: 999588 - RNA, 18 nt, Human
ggugcagcccccucugcc

SEQ ID NO: 999589 - RNA, 23 nt, Human
ggugggccaggcccugcuucagg

SEQ ID NO: 999590 - RNA, 20 nt, Human
guaccugggauuauaggcau

SEQ ID NO: 999591 - RNA, 18 nt, Human
guagguguaagaggggag

SEQ ID NO: 999592 - RNA, 23 nt, Human
gugauucuccugccucagccucc

SEQ ID NO: 999593 - RNA, 23 nt, Human
guggcacccagggucaccugucu

SEQ ID NO: 999594 - RNA, 24 nt, Human
uaggcggcaacagaacaaaacccc

SEQ ID NO: 999595 - RNA, 24 nt, Human
uagguguaagaggggaggagaggu

SEQ ID NO: 999596 - RNA, 26 nt, Human
uaguagagacggggacucaaacuccc

SEQ ID NO: 999597 - RNA, 18 nt, Human
ucaacucauccgcccgcc

SEQ ID NO: 999598 - RNA, 19 nt, Human
ucaagugauucuccugccu

SEQ ID NO: 999599 - RNA, 21 nt, Human
ucacaugggggauacuggaca

SEQ ID NO: 999600 - RNA, 19 nt, Human
ucacugcaaccucugccuc

SEQ ID NO: 999601 - RNA, 24 nt, Human
ucacugcaaccucugccucccagg

SEQ ID NO: 999602 - RNA, 25 nt, Human
ucacugcaaccucugccucccaggu

SEQ ID NO: 999603 - RNA, 24 nt, Human
ucagccugacuuuccagagaccga

SEQ ID NO: 999604 - RNA, 20 nt, Human
ucagcugacuccaugagaaa

SEQ ID NO: 999605 - RNA, 19 nt, Human
ucagcugugucugaggucu

SEQ ID NO: 999606 - RNA, 24 nt, Human
ucccaaagugcugggauuacaggc

SEQ ID NO: 999607 - RNA, 22 nt, Human
ucccaggcccgcaggugcagcc

SEQ ID NO: 999608 - RNA, 23 nt, Human
ucccaggcccgcaggugcagccc

SEQ ID NO: 999609 - RNA, 21 nt, Human
ucccagguucaagugauucuc

SEQ ID NO: 999610 - RNA, 24 nt, Human
ucccagguucaagugauucuccug

SEQ ID NO: 999611 - RNA, 19 nt, Human
uccgaacuccaccauuugg

SEQ ID NO: 999612 - RNA, 24 nt, Human
uccugaguaccugggauuauaggc

SEQ ID NO: 999613 - RNA, 18 nt, Human
ucucagaaccccauggca

SEQ ID NO: 999614 - RNA, 22 nt, Human
ucuccauccacacuccuacccc

SEQ ID NO: 999615 - RNA, 24 nt, Human
ucuccugccucagccuccugagua

SEQ ID NO: 999616 - RNA, 20 nt, Human
ucucggcugccuugcuaccc

SEQ ID NO: 999617 - RNA, 25 nt, Human
ucugaggucugugaacucccagccu

SEQ ID NO: 999618 - RNA, 23 nt, Human
ucugcgggccauggucccagccc

SEQ ID NO: 999619 - RNA, 21 nt, Human
ugaaauacaucugagaagcca

SEQ ID NO: 999620 - RNA, 22 nt, Human
ugaaauacaucugagaagccaa

SEQ ID NO: 999621 - RNA, 18 nt, Human
ugacuuaggaugcaaugg

SEQ ID NO: 999622 - RNA, 20 nt, Human
ugaggaggaggagaaaguga

SEQ ID NO: 999623 - RNA, 20 nt, Human
ugauucuccugccucagccu

SEQ ID NO: 999624 - RNA, 18 nt, Human
ugcagcccccucugcccu

SEQ ID NO: 999625 - RNA, 22 nt, Human
ugcaguggcacaaucuuggcuc

SEQ ID NO: 999626 - RNA, 23 nt, Human
ugccccaggcaccuugggugggc

SEQ ID NO: 999627 - RNA, 24 nt, Human
ugcccuuggcccaaccgugggccc

SEQ ID NO: 999628 - RNA, 18 nt, Human
ugccguugguggccuggg

SEQ ID NO: 999629 - RNA, 24 nt, Human
ugccucagccuccugaguaccugg

SEQ ID NO: 999630 - RNA, 23 nt, Human
ugccucaggcaccgcuagaaacc

SEQ ID NO: 999631 - RNA, 25 nt, Human
ugccuugcuacccaggggucggcuc

SEQ ID NO: 999632 - RNA, 20 nt, Human
ugcucaggcuggagugcagu

SEQ ID NO: 999633 - RNA, 21 nt, Human
ugcucaggcuggagugcagug

SEQ ID NO: 999634 - RNA, 22 nt, Human
ugcucaggcuggagugcagugg

SEQ ID NO: 999635 - RNA, 24 nt, Human
ugcucaggcuggagugcaguggca

SEQ ID NO: 999636 - RNA, 24 nt, Human
ugcugggauuacaggcgggagcca

SEQ ID NO: 999637 - RNA, 23 nt, Human
uggagugcaguggcacaaucuug

SEQ ID NO: 999638 - RNA, 24 nt, Human
uggagugcaguggcacaaucuugg

SEQ ID NO: 999639 - RNA, 21 nt, Human
uggcaacacgacaaggacaag

SEQ ID NO: 999640 - RNA, 24 nt, Human
uggcacaaucuuggcucacugcaa

SEQ ID NO: 999641 - RNA, 23 nt, Human
uggccaggaaggcuucagaccuc

SEQ ID NO: 999642 - RNA, 18 nt, Human
ugggauuacaggcgggag

SEQ ID NO: 999643 - RNA, 19 nt, Human
ugggauuacaggcgggagc

SEQ ID NO: 999644 - RNA, 21 nt, Human
ugggauuacaggcgggagcca

SEQ ID NO: 999645 - RNA, 22 nt, Human
ugggauuacaggcgggagccac

SEQ ID NO: 999646 - RNA, 23 nt, Human
ugggauuacaggcgggagccacc

SEQ ID NO: 999647 - RNA, 24 nt, Human
ugggauuacaggcgggagccaccg

SEQ ID NO: 999648 - RNA, 21 nt, Human
ugggauuauaggcaugcgcca

SEQ ID NO: 999649 - RNA, 22 nt, Human
ugggauuauaggcaugcgccac

SEQ ID NO: 999650 - RNA, 18 nt, Human
ugggggaugcgaggggag

SEQ ID NO: 999651 - RNA, 23 nt, Human
ugggugggccaggcccugcuuca

SEQ ID NO: 999652 - RNA, 21 nt, Human
uguauuuuuaguagagacggg

SEQ ID NO: 999653 - RNA, 23 nt, Human
uguccggcuaauuuuguauuuuu

SEQ ID NO: 999654 - RNA, 23 nt, Human
uuaauggcaucagacaaggccuu

SEQ ID NO: 999655 - RNA, 21 nt, Human
uucaagugauucuccugccuc

SEQ ID NO: 999656 - RNA, 23 nt, Human
uucaagugauucuccugccucag

SEQ ID NO: 999657 - RNA, 24 nt, Human
uucaagugauucuccugccucagc

SEQ ID NO: 999658 - RNA, 22 nt, Human
uucacaugggggauacuggaca

SEQ ID NO: 999659 - RNA, 24 nt, Human
uugcucaggcuggagugcaguggc

SEQ ID NO: 999660 - RNA, 21 nt, Human
uugcuuuuguugcucaggcug

SEQ ID NO: 999661 - RNA, 23 nt, Human
uugcuuuuguugcucaggcugga

SEQ ID NO: 999662 - RNA, 19 nt, Human
uuggcccaaccgugggccc

SEQ ID NO: 999663 - RNA, 23 nt, Human
uuguauuuuuaguagagacgggg

SEQ ID NO: 999664 - RNA, 24 nt, Human
uuugcuuuuguugcucaggcugga

SEQ ID NO: 999665 - RNA, 24 nt, Human
uuuguugcucaggcuggagugcag

SEQ ID NO: 999666 - RNA, 24 nt, Human
uuuugcuuuuguugcucaggcugg

SEQ ID NO: 999667 - RNA, 19 nt, Human
uuuuguauuuuuaguagag

SEQ ID NO: 999668 - RNA, 20 nt, Human
uuuuguauuuuuaguagaga

SEQ ID NO: 999669 - RNA, 20 nt, Human
uuuuuaguagagacggggac

SEQ ID NO: 999670 - RNA, 22 nt, Human
aaaacccaauggcaacaugccc

SEQ ID NO: 999671 - RNA, 19 nt, Human
aaagagaaacagaacagua

SEQ ID NO: 999672 - RNA, 18 nt, Human
aaagauccccacgcgccu

SEQ ID NO: 999673 - RNA, 22 nt, Human
aaagaugaauagcagugaccca

SEQ ID NO: 999674 - RNA, 21 nt, Human
aacagaacaguaccuugagga

SEQ ID NO: 999675 - RNA, 25 nt, Human
aacaggacuccuccaggagggcccg

SEQ ID NO: 999676 - RNA, 26 nt, Human
aacaugcccacgaaagcuucaaguca

SEQ ID NO: 999677 - RNA, 23 nt, Human
aacccaacacaaaaaucaacucc

SEQ ID NO: 999678 - RNA, 24 nt, Human
aacugugcagcuuaggugaacccu

SEQ ID NO: 999679 - RNA, 19 nt, Human
aagccacuguuccucccca

SEQ ID NO: 999680 - RNA, 21 nt, Human
aaguggccaaaacacucagug

SEQ ID NO: 999681 - RNA, 23 nt, Human
acccaauggcaacaugcccacga

SEQ ID NO: 999682 - RNA, 20 nt, Human
accuugaggacaaagaaacc

SEQ ID NO: 999683 - RNA, 25 nt, Human
acgcaggcucagaaaggcaccagga

SEQ ID NO: 999684 - RNA, 20 nt, Human
agaacaguaccuugaggaca

SEQ ID NO: 999685 - RNA, 20 nt, Human
agaacgugggccugcaaaag

SEQ ID NO: 999686 - RNA, 18 nt, Human
agcagccacacccaggac

SEQ ID NO: 999687 - RNA, 21 nt, Human
agccugccccacacucuccca

SEQ ID NO: 999688 - RNA, 20 nt, Human
aggcaccaggaguuccuccu

SEQ ID NO: 999689 - RNA, 19 nt, Human
aggggugagaagaggggcc

SEQ ID NO: 999690 - RNA, 22 nt, Human
aggguuccccggacccaccuuu

SEQ ID NO: 999691 - RNA, 20 nt, Human
agugcacauccccaagcagc

SEQ ID NO: 999692 - RNA, 21 nt, Human
caaacccaacacaaaaaucaa

SEQ ID NO: 999693 - RNA, 19 nt, Human
cacaagacuuucagggggc

SEQ ID NO: 999694 - RNA, 21 nt, Human
cacauccccaagcagcagcug

SEQ ID NO: 999695 - RNA, 18 nt, Human
cacccgguggcuggaggg

SEQ ID NO: 999696 - RNA, 21 nt, Human
cacgcaggcucagaaaggcac

SEQ ID NO: 999697 - RNA, 24 nt, Human
cacucccuccucccagguccucca

SEQ ID NO: 999698 - RNA, 27 nt, Human
cacucccuccucccagguccuccaagg

SEQ ID NO: 999699 - RNA, 25 nt, Human
cacuggccccucccaucaucucucu

SEQ ID NO: 999700 - RNA, 21 nt, Human
cagcuucuggaaccacaggcc

SEQ ID NO: 999701 - RNA, 24 nt, Human
caggguuccccggacccaccuuuc

SEQ ID NO: 999702 - RNA, 18 nt, Human
cagguccuccaaguggcc

SEQ ID NO: 999703 - RNA, 21 nt, Human
ccaaacccaacacaaaaauca

SEQ ID NO: 999704 - RNA, 22 nt, Human
ccaauggcaacaugcccacgaa

SEQ ID NO: 999705 - RNA, 22 nt, Human
ccacacaccugcugaacagaca

SEQ ID NO: 999706 - RNA, 18 nt, Human
ccacuguuccuccccagg

SEQ ID NO: 999707 - RNA, 22 nt, Human
ccaggcaccucccagaagcccc

SEQ ID NO: 999708 - RNA, 19 nt, Human
cccacacaccugcugaaca

SEQ ID NO: 999709 - RNA, 21 nt, Human
cccacacaccugcugaacaga

SEQ ID NO: 999710 - RNA, 20 nt, Human
cccacaguuuccuggagugc

SEQ ID NO: 999711 - RNA, 18 nt, Human
cccagcuuugguaagggc

SEQ ID NO: 999712 - RNA, 18 nt, Human
cccaggcaccucccagaa

SEQ ID NO: 999713 - RNA, 23 nt, Human
ccccaagcagcagcugggacccu

SEQ ID NO: 999714 - RNA, 25 nt, Human
cccccagcaucuucagagguggggu

SEQ ID NO: 999715 - RNA, 22 nt, Human
cccuggauucugcaagccccag

SEQ ID NO: 999716 - RNA, 19 nt, Human
cccuggguccugaggggcc

SEQ ID NO: 999717 - RNA, 19 nt, Human
ccggacccaccuuucggcc

SEQ ID NO: 999718 - RNA, 23 nt, Human
ccuccaaguggccaaaacacucu

SEQ ID NO: 999719 - RNA, 18 nt, Human
ccucuaggcccacacacc

SEQ ID NO: 999720 - RNA, 22 nt, Human
ccugaggggccacuggagaccu

SEQ ID NO: 999721 - RNA, 18 nt, Human
ccugccccacacucuccc

SEQ ID NO: 999722 - RNA, 22 nt, Human
cggaguggagccaaggcccguu

SEQ ID NO: 999723 - RNA, 21 nt, Human
cgggaaagaugaauagcagug

SEQ ID NO: 999724 - RNA, 21 nt, Human
cuaggcccacacaccugcuga

SEQ ID NO: 999725 - RNA, 22 nt, Human
cucccaucccagcugccucccc

SEQ ID NO: 999726 - RNA, 19 nt, Human
cucuaggcccacacaccug

SEQ ID NO: 999727 - RNA, 20 nt, Human
cucuguuccuguccucacug

SEQ ID NO: 999728 - RNA, 19 nt, Human
cugaacagacaucugugcc

SEQ ID NO: 999729 - RNA, 25 nt, Human
cugaacagacaucugugcccaggca

SEQ ID NO: 999730 - RNA, 21 nt, Human
cugcugaacagacaucugugc

SEQ ID NO: 999731 - RNA, 18 nt, Human
cuggguccugaggggcca

SEQ ID NO: 999732 - RNA, 23 nt, Human
gagccaaggcccguuccgaggaa

SEQ ID NO: 999733 - RNA, 23 nt, Human
gcaaaacccaauggcaacaugcc

SEQ ID NO: 999734 - RNA, 23 nt, Human
gcaaagcugcaggaacugugcag

SEQ ID NO: 999735 - RNA, 19 nt, Human
gcaauggggcucccagcuu

SEQ ID NO: 999736 - RNA, 19 nt, Human
gcaggcucagaaaggcacc

SEQ ID NO: 999737 - RNA, 21 nt, Human
gccaaaacacucaguggccug

SEQ ID NO: 999738 - RNA, 21 nt, Human
gccccaggcucugagaagcca

SEQ ID NO: 999739 - RNA, 20 nt, Human
gcgcagggcguccuugaugu

SEQ ID NO: 999740 - RNA, 18 nt, Human
gcugcagcuucacauccu

SEQ ID NO: 999741 - RNA, 18 nt, Human
ggaguuccuccucuugcu

SEQ ID NO: 999742 - RNA, 23 nt, Human
ggccaaaacacucaguggccugg

SEQ ID NO: 999743 - RNA, 23 nt, Human
ggccagagcugccggggcaaugg

SEQ ID NO: 999744 - RNA, 19 nt, Human
ggccuggaggggcaggaga

SEQ ID NO: 999745 - RNA, 21 nt, Human
ggggagccaggguuccccgga

SEQ ID NO: 999746 - RNA, 21 nt, Human
gggguucucccacgcaggcuc

SEQ ID NO: 999747 - RNA, 22 nt, Human
ggguucucccacgcaggcucag

SEQ ID NO: 999748 - RNA, 21 nt, Human
ggucccggaguggagccaagg

SEQ ID NO: 999749 - RNA, 19 nt, Human
gucacagacaggcaugggg

SEQ ID NO: 999750 - RNA, 23 nt, Human
guccucacuggccccucccauca

SEQ ID NO: 999751 - RNA, 22 nt, Human
guccugaggggccacuggagac

SEQ ID NO: 999752 - RNA, 22 nt, Human
gugcagcuuaggugaacccugg

SEQ ID NO: 999753 - RNA, 23 nt, Human
gugcccaggcaccucccagaagc

SEQ ID NO: 999754 - RNA, 21 nt, Human
guggaguuuucucagcuucug

SEQ ID NO: 999755 - RNA, 22 nt, Human
uaaagagaaacagaacaguacc

SEQ ID NO: 999756 - RNA, 24 nt, Human
uaauucuuccagagcagccacacc

SEQ ID NO: 999757 - RNA, 23 nt, Human
uagcuccccaggaagaccaggau

SEQ ID NO: 999758 - RNA, 25 nt, Human
ucaacuccugccuucuucuguaugc

SEQ ID NO: 999759 - RNA, 26 nt, Human
ucacuggccccucccaucaucucucu

SEQ ID NO: 999760 - RNA, 19 nt, Human
ucacuggggagccaggguu

SEQ ID NO: 999761 - RNA, 21 nt, Human
ucacuggggagccaggguucc

SEQ ID NO: 999762 - RNA, 22 nt, Human
ucagaaaggcaccaggaguucc

SEQ ID NO: 999763 - RNA, 22 nt, Human
uccagaaagauccccacgcgcc

SEQ ID NO: 999764 - RNA, 20 nt, Human
ucccagcuuugguaagggcu

SEQ ID NO: 999765 - RNA, 24 nt, Human
ucccaucccagcugccucccccag

SEQ ID NO: 999766 - RNA, 25 nt, Human
ucccccagcaucuucagaggugggg

SEQ ID NO: 999767 - RNA, 20 nt, Human
uccccggacccaccuuucgg

SEQ ID NO: 999768 - RNA, 28 nt, Human
uccucuaggcccacacaccugcugaaca

SEQ ID NO: 999769 - RNA, 22 nt, Human
uccuggagugcuagaauugggg

SEQ ID NO: 999770 - RNA, 19 nt, Human
ucgggaaagaugaauagca

SEQ ID NO: 999771 - RNA, 26 nt, Human
ucuccucuaggcccacacaccugcug

SEQ ID NO: 999772 - RNA, 21 nt, Human
ucugcucucuccucuaggccc

SEQ ID NO: 999773 - RNA, 25 nt, Human
ucugugcccaggcaccucccagaag

SEQ ID NO: 999774 - RNA, 27 nt, Human
ucuucuguaugccccaggcucugagaa

SEQ ID NO: 999775 - RNA, 24 nt, Human
ugaacccuggauucugcaagcccc

SEQ ID NO: 999776 - RNA, 20 nt, Human
ugccccaggcucugagaagc

SEQ ID NO: 999777 - RNA, 22 nt, Human
ugcccgcggacagcucgcccuu

SEQ ID NO: 999778 - RNA, 20 nt, Human
ugcucucuccucuaggccca

SEQ ID NO: 999779 - RNA, 24 nt, Human
ugcucucuccucuaggcccacaca

SEQ ID NO: 999780 - RNA, 19 nt, Human
uggaaccacaggccagagc

SEQ ID NO: 999781 - RNA, 21 nt, Human
uggauucugcaagccccagug

SEQ ID NO: 999782 - RNA, 21 nt, Human
uggcaacaugcccacgaaagc

SEQ ID NO: 999783 - RNA, 24 nt, Human
uggcaacaugcccacgaaagcuuc

SEQ ID NO: 999784 - RNA, 22 nt, Human
uggcucccaucccagcugccuc

SEQ ID NO: 999785 - RNA, 23 nt, Human
uggcucccaucccagcugccucc

SEQ ID NO: 999786 - RNA, 19 nt, Human
ugggacccuggguccugag

SEQ ID NO: 999787 - RNA, 22 nt, Human
uggggagccaggguuccccgga

SEQ ID NO: 999788 - RNA, 23 nt, Human
ugggucccggaguggagccaagg

SEQ ID NO: 999789 - RNA, 23 nt, Human
uggguccugaggggccacuggag

SEQ ID NO: 999790 - RNA, 18 nt, Human
ugguaagggcuguuggca

SEQ ID NO: 999791 - RNA, 19 nt, Human
uucucccacgcaggcucag

SEQ ID NO: 999792 - RNA, 22 nt, Human
uugaggacaaagaaaccccaaa

SEQ ID NO: 999793 - RNA, 20 nt, Human
aaagcccgcuggcuccuagg

SEQ ID NO: 999794 - RNA, 22 nt, Human
acccugcccaccaccuaucagc

SEQ ID NO: 999795 - RNA, 19 nt, Human
acucugaggugcagagaag

SEQ ID NO: 999796 - RNA, 23 nt, Human
acucugaggugcagagaaggcca

SEQ ID NO: 999797 - RNA, 23 nt, Human
agagaaagagagagagagagagc

SEQ ID NO: 999798 - RNA, 18 nt, Human
agagacagagagagagag

SEQ ID NO: 999799 - RNA, 23 nt, Human
agagagagagagacagagagaga

SEQ ID NO: 999800 - RNA, 23 nt, Human
agagcgucacagggaggcucagg

SEQ ID NO: 999801 - RNA, 20 nt, Human
agccaguucuuuacuccugg

SEQ ID NO: 999802 - RNA, 19 nt, Human
auaaaguaaaaacaaccgc

SEQ ID NO: 999803 - RNA, 23 nt, Human
caaccgcuguucgagacucaagu

SEQ ID NO: 999804 - RNA, 26 nt, Human
caagaaugccagcacagggaagccac

SEQ ID NO: 999805 - RNA, 23 nt, Human
caaggcugagagacagagagaga

SEQ ID NO: 999806 - RNA, 20 nt, Human
cacgcgaguucccuuucccu

SEQ ID NO: 999807 - RNA, 20 nt, Human
cacggugccuuccccagccc

SEQ ID NO: 999808 - RNA, 18 nt, Human
cacucugaggugcagaga

SEQ ID NO: 999809 - RNA, 19 nt, Human
caguggcuggggagaacug

SEQ ID NO: 999810 - RNA, 20 nt, Human
caguggcuggggagaacugg

SEQ ID NO: 999811 - RNA, 21 nt, Human
ccaguggcggccaaguaagcc

SEQ ID NO: 999812 - RNA, 27 nt, Human
cccagcccguccacuccggucuccuca

SEQ ID NO: 999813 - RNA, 22 nt, Human
ccccagcccguccacuccgguc

SEQ ID NO: 999814 - RNA, 21 nt, Human
cccccgggccgcacacuggcc

SEQ ID NO: 999815 - RNA, 23 nt, Human
ccgccgucuccgcuucgccgccc

SEQ ID NO: 999816 - RNA, 24 nt, Human
ccgccgucuccgcuucgccgcccu

SEQ ID NO: 999817 - RNA, 21 nt, Human
ccucacgcgggcacagggagc

SEQ ID NO: 999818 - RNA, 21 nt, Human
ccugcccaccaccuaucagcg

SEQ ID NO: 999819 - RNA, 22 nt, Human
cgaaagcccgcuggcuccuagg

SEQ ID NO: 999820 - RNA, 19 nt, Human
cgccgcccuucgcgcgccc

SEQ ID NO: 999821 - RNA, 26 nt, Human
cgcuucgccgcccuucgcgcgcccca

SEQ ID NO: 999822 - RNA, 21 nt, Human
cgggcacagggagcccccggg

SEQ ID NO: 999823 - RNA, 23 nt, Human
cuagaacccugcccaccaccuau

SEQ ID NO: 999824 - RNA, 21 nt, Human
cuccuucuggucccuagggug

SEQ ID NO: 999825 - RNA, 22 nt, Human
cuggcuccuucuggucccuagg

SEQ ID NO: 999826 - RNA, 23 nt, Human
cuuuuucuuuuuuuuccccgaaa

SEQ ID NO: 999827 - RNA, 19 nt, Human
gaagccaccuggcuccgcc

SEQ ID NO: 999828 - RNA, 18 nt, Human
gaaucuguagaccacagu

SEQ ID NO: 999829 - RNA, 20 nt, Human
gagagagaaagagagagaga

SEQ ID NO: 999830 - RNA, 20 nt, Human
gagcacacccugaggucacc

SEQ ID NO: 999831 - RNA, 21 nt, Human
gagcaggugggagccauaaac

SEQ ID NO: 999832 - RNA, 22 nt, Human
gcuucgccgcccuucgcgcgcc

SEQ ID NO: 999833 - RNA, 18 nt, Human
ggaaucuguagaccacag

SEQ ID NO: 999834 - RNA, 22 nt, Human
ggucacagggggauggguuucc

SEQ ID NO: 999835 - RNA, 21 nt, Human
gucacacuuacaugaaucgcg

SEQ ID NO: 999836 - RNA, 19 nt, Human
gucacagggaggcucagga

SEQ ID NO: 999837 - RNA, 18 nt, Human
gucugugguucugcacuc

SEQ ID NO: 999838 - RNA, 30 nt, Human
uaaacuucuggcucugaggcgugcccacaa

SEQ ID NO: 999839 - RNA, 22 nt, Human
uaaaguaaaaacaaccgcuguu

SEQ ID NO: 999840 - RNA, 20 nt, Human
uaaauaaaguaaaaacaacc

SEQ ID NO: 999841 - RNA, 22 nt, Human
uacuccuggcuccuucuggucc

SEQ ID NO: 999842 - RNA, 21 nt, Human
ucacagggaggcucaggacgu

SEQ ID NO: 999843 - RNA, 22 nt, Human
uccccagcccguccacuccggu

SEQ ID NO: 999844 - RNA, 23 nt, Human
ucccuagaacccugcccaccacc

SEQ ID NO: 999845 - RNA, 24 nt, Human
ucccuagaacccugcccaccaccu

SEQ ID NO: 999846 - RNA, 21 nt, Human
ucccugaaaucgagucacacu

SEQ ID NO: 999847 - RNA, 21 nt, Human
ucgagacucaaguccccuguu

SEQ ID NO: 999848 - RNA, 20 nt, Human
ucgccgcccuucgcgcgccc

SEQ ID NO: 999849 - RNA, 24 nt, Human
ucuuuuucuuuuuuuuccccgaaa

SEQ ID NO: 999850 - RNA, 22 nt, Human
ucuuuuuuuuccccgaaagccc

SEQ ID NO: 999851 - RNA, 22 nt, Human
ucuuuuuuuuccccgaaagccc

SEQ ID NO: 999852 - RNA, 20 nt, Human
ugaggucacagggggauggg

SEQ ID NO: 999853 - RNA, 20 nt, Human
uggccaggggcggagcugga

SEQ ID NO: 999854 - RNA, 19 nt, Human
uggcuccgccucuuguguu

SEQ ID NO: 999855 - RNA, 18 nt, Human
uggcucugaggcgugccc

SEQ ID NO: 999856 - RNA, 18 nt, Human
ugggagccauaaacuucu

SEQ ID NO: 999857 - RNA, 20 nt, Human
ugggagccauaaacuucugg

SEQ ID NO: 999858 - RNA, 21 nt, Human
uuaaacauuuuauuuuagaug

SEQ ID NO: 999859 - RNA, 21 nt, Human
uuaaacauuuuauuuuagaug

SEQ ID NO: 999860 - RNA, 19 nt, Human
uucccuagaacccugccca

SEQ ID NO: 999861 - RNA, 24 nt, Human
uuggcuguugcccuaggcacagcc

SEQ ID NO: 999862 - RNA, 21 nt, Human
uuuccuggaaucuguagacca

SEQ ID NO: 999863 - RNA, 24 nt, Human
uuuuuuuuuuuuuuuuuuuauuuu

SEQ ID NO: 999864 - RNA, 24 nt, Human
uuuuuuuuuuuuuuuuuuuauuuu

SEQ ID NO: 999865 - RNA, 27 nt, Human
aaaaaaaaaaaaagaauuacugcaaac

SEQ ID NO: 999866 - RNA, 23 nt, Human
aaaaaaaaaagaauuacugcaaa

SEQ ID NO: 999867 - RNA, 18 nt, Human
aaagaauuacugcaaaca

SEQ ID NO: 999868 - RNA, 21 nt, Human
aacagcaccauauggagcaaa

SEQ ID NO: 999869 - RNA, 21 nt, Human
aacagugcgagacuccgucuc

SEQ ID NO: 999870 - RNA, 24 nt, Human
aacagugcgagacuccgucucaaa

SEQ ID NO: 999871 - RNA, 19 nt, Human
aacauggugaaaccccauc

SEQ ID NO: 999872 - RNA, 20 nt, Human
aacauggugaaaccccaucu

SEQ ID NO: 999873 - RNA, 21 nt, Human
aacauggugaaaccccaucuc

SEQ ID NO: 999874 - RNA, 21 nt, Human
aacauggugaaaccccaucuc

SEQ ID NO: 999875 - RNA, 19 nt, Human
aacuguuuccucccuccca

SEQ ID NO: 999876 - RNA, 24 nt, Human
aauugcuugaacucgggaggcgga

SEQ ID NO: 999877 - RNA, 24 nt, Human
acaggcagggcgcaguggcucacg

SEQ ID NO: 999878 - RNA, 24 nt, Human
acagugcgagacuccgucucaaaa

SEQ ID NO: 999879 - RNA, 23 nt, Human
accccauaggauuucaaaagcca

SEQ ID NO: 999880 - RNA, 24 nt, Human
accccaucucuacuaaaaauacaa

SEQ ID NO: 999881 - RNA, 18 nt, Human
acuacaaacaggcagggc

SEQ ID NO: 999882 - RNA, 18 nt, Human
acugcucuccagccuggg

SEQ ID NO: 999883 - RNA, 24 nt, Human
acugcucuccagccugggcaacag

SEQ ID NO: 999884 - RNA, 21 nt, Human
agaacagcaccauauggagca

SEQ ID NO: 999885 - RNA, 29 nt, Human
agagaccccauaggauuucaaaagccagg

SEQ ID NO: 999886 - RNA, 26 nt, Human
agagagcagcuggagaauguuuucau

SEQ ID NO: 999887 - RNA, 19 nt, Human
agaugauugcagcugcugc

SEQ ID NO: 999888 - RNA, 24 nt, Human
agcacuuugggaggccgagguggg

SEQ ID NO: 999889 - RNA, 24 nt, Human
agccugggcaacagugcgagacuc

SEQ ID NO: 999890 - RNA, 23 nt, Human
aggaguuugagaucugccuggcc

SEQ ID NO: 999891 - RNA, 24 nt, Human
aggcaggagaauugcuugaacucg

SEQ ID NO: 999892 - RNA, 21 nt, Human
aggccgaggugggugcaucac

SEQ ID NO: 999893 - RNA, 24 nt, Human
aggcggagcuugcagugagccaag

SEQ ID NO: 999894 - RNA, 21 nt, Human
aggcugaggcaggagaauugc

SEQ ID NO: 999895 - RNA, 24 nt, Human
aggcugaggcaggagaauugcuug

SEQ ID NO: 999896 - RNA, 24 nt, Human
aguggcucacgcauguaaucccag

SEQ ID NO: 999897 - RNA, 24 nt, Human
aucgcgccacugcucuccagccug

SEQ ID NO: 999898 - RNA, 23 nt, Human
auucugggcacagugugacauuu

SEQ ID NO: 999899 - RNA, 24 nt, Human
caacauggugaaaccccaucucua

SEQ ID NO: 999900 - RNA, 25 nt, Human
cacccuaaaaugcaaaucccaucac

SEQ ID NO: 999901 - RNA, 23 nt, Human
caccuguaaucccagcuacucgg

SEQ ID NO: 999902 - RNA, 24 nt, Human
caccuguaaucccagcuacucggg

SEQ ID NO: 999903 - RNA, 24 nt, Human
cacgcauguaaucccagcacuuug

SEQ ID NO: 999904 - RNA, 24 nt, Human
cacugcucuccagccugggcaaca

SEQ ID NO: 999905 - RNA, 22 nt, Human
cacuguagcuggcaaaggucug

SEQ ID NO: 999906 - RNA, 24 nt, Human
cagcacuuugggaggccgaggugg

SEQ ID NO: 999907 - RNA, 24 nt, Human
cagcuacucgggaggcugaggcag

SEQ ID NO: 999908 - RNA, 18 nt, Human
cagcuagaguacucaggc

SEQ ID NO: 999909 - RNA, 19 nt, Human
caucacgaggucaggaguu

SEQ ID NO: 999910 - RNA, 24 nt, Human
caucacgaggucaggaguuugaga

SEQ ID NO: 999911 - RNA, 24 nt, Human
cauucagagaccccauaggauuuc

SEQ ID NO: 999912 - RNA, 18 nt, Human
ccacugcucuccagccug

SEQ ID NO: 999913 - RNA, 21 nt, Human
ccacugcucuccagccugggc

SEQ ID NO: 999914 - RNA, 22 nt, Human
ccacugcucuccagccugggca

SEQ ID NO: 999915 - RNA, 23 nt, Human
ccacugcucuccagccugggcaa

SEQ ID NO: 999916 - RNA, 24 nt, Human
ccacugcucuccagccugggcaac

SEQ ID NO: 999917 - RNA, 18 nt, Human
cccaggaucugugcagcc

SEQ ID NO: 999918 - RNA, 22 nt, Human
ccugaacagagaggagaauggc

SEQ ID NO: 999919 - RNA, 23 nt, Human
ccuggccaacauggugaaacccc

SEQ ID NO: 999920 - RNA, 24 nt, Human
ccuggccaacauggugaaacccca

SEQ ID NO: 999921 - RNA, 21 nt, Human
ccuguaaucccagcuacucgg

SEQ ID NO: 999922 - RNA, 22 nt, Human
cgaggugggugcaucacgaggu

SEQ ID NO: 999923 - RNA, 19 nt, Human
cuacaaacaggcagggcgc

SEQ ID NO: 999924 - RNA, 24 nt, Human
cucacgcauguaaucccagcacuu

SEQ ID NO: 999925 - RNA, 18 nt, Human
cuccagccugggcaacag

SEQ ID NO: 999926 - RNA, 18 nt, Human
cuccagccugggcaacag

SEQ ID NO: 999927 - RNA, 19 nt, Human
cuccgucucaaaaaaaaaa

SEQ ID NO: 999928 - RNA, 23 nt, Human
cuggccaacauggugaaacccca

SEQ ID NO: 999929 - RNA, 21 nt, Human
cuguaaucccagcuacucggg

SEQ ID NO: 999930 - RNA, 20 nt, Human
cuuggcccaggaucugugca

SEQ ID NO: 999931 - RNA, 23 nt, Human
cuuggcccaggaucugugcagcc

SEQ ID NO: 999932 - RNA, 23 nt, Human
gagaauugcuugaacucgggagg

SEQ ID NO: 999933 - RNA, 23 nt, Human
gagaucugccuggccaacauggu

SEQ ID NO: 999934 - RNA, 18 nt, Human
gagcuugcagugagccaa

SEQ ID NO: 999935 - RNA, 23 nt, Human
gagcuugcagugagccaagaucg

SEQ ID NO: 999936 - RNA, 23 nt, Human
gaggugggugcaucacgagguca

SEQ ID NO: 999937 - RNA, 19 nt, Human
gcaaaagagagcagcugga

SEQ ID NO: 999938 - RNA, 18 nt, Human
gcagccagaugcgauggc

SEQ ID NO: 999939 - RNA, 20 nt, Human
gcaucacgaggucaggaguu

SEQ ID NO: 999940 - RNA, 23 nt, Human
gcaucacgaggucaggaguuuga

SEQ ID NO: 999941 - RNA, 24 nt, Human
gccaacauggugaaaccccaucuc

SEQ ID NO: 999942 - RNA, 22 nt, Human
gccacugcucuccagccugggc

SEQ ID NO: 999943 - RNA, 24 nt, Human
gccacugcucuccagccugggcaa

SEQ ID NO: 999944 - RNA, 23 nt, Human
gccuggccaacauggugaaaccc

SEQ ID NO: 999945 - RNA, 20 nt, Human
gcgcaguggcucacgcaugu

SEQ ID NO: 999946 - RNA, 24 nt, Human
ggagcuugcagugagccaagaucg

SEQ ID NO: 999947 - RNA, 19 nt, Human
ggcaccuguaaucccagcu

SEQ ID NO: 999948 - RNA, 18 nt, Human
ggcagggcgcaguggcuc

SEQ ID NO: 999949 - RNA, 23 nt, Human
ggcgcaguggcucacgcauguaa

SEQ ID NO: 999950 - RNA, 18 nt, Human
gggcgcaguggcucacgc

SEQ ID NO: 999951 - RNA, 24 nt, Human
gggugugguggcaggcaccuguaa

SEQ ID NO: 999952 - RNA, 24 nt, Human
gguggcaggcaccuguaaucccag

SEQ ID NO: 999953 - RNA, 20 nt, Human
gucucaaaaaaaaaaaaaag

SEQ ID NO: 999954 - RNA, 21 nt, Human
gugacauuuaccugaacagag

SEQ ID NO: 999955 - RNA, 24 nt, Human
guggcucacgcauguaaucccagc

SEQ ID NO: 999956 - RNA, 22 nt, Human
uaaaaauacaaaacauuagcug

SEQ ID NO: 999957 - RNA, 20 nt, Human
uaacucugcaaucuuuucag

SEQ ID NO: 999958 - RNA, 23 nt, Human
uacaaacaggcagggcgcagugg

SEQ ID NO: 999959 - RNA, 19 nt, Human
uagaagaugagggagauuu

SEQ ID NO: 999960 - RNA, 21 nt, Human
uauggagcaaaagagagcagc

SEQ ID NO: 999961 - RNA, 24 nt, Human
ucacgaggucaggaguuugagauc

SEQ ID NO: 999962 - RNA, 18 nt, Human
ucagacaagagaaccacg

SEQ ID NO: 999963 - RNA, 20 nt, Human
ucagacaagagaaccacgcc

SEQ ID NO: 999964 - RNA, 22 nt, Human
uccgucucaaaaaaaaaaaaaa

SEQ ID NO: 999965 - RNA, 23 nt, Human
uccgucucaaaaaaaaaaaaaag

SEQ ID NO: 999966 - RNA, 25 nt, Human
uccgucucaaaaaaaaaaaaaagaa

SEQ ID NO: 999967 - RNA, 23 nt, Human
ucgcgccacugcucuccagccug

SEQ ID NO: 999968 - RNA, 23 nt, Human
ucgggaggcugaggcaggagaau

SEQ ID NO: 999969 - RNA, 21 nt, Human
ucuccagccugggcaacagug

SEQ ID NO: 999970 - RNA, 20 nt, Human
ucucuacuaaaaauacaaaa

SEQ ID NO: 999971 - RNA, 19 nt, Human
ucugcaaucuuuucagcca

SEQ ID NO: 999972 - RNA, 23 nt, Human
ucugcaaucuuuucagccacucu

SEQ ID NO: 999973 - RNA, 21 nt, Human
ucuucugucccuuggcccagg

SEQ ID NO: 999974 - RNA, 19 nt, Human
ugaaaccccaucucuacua

SEQ ID NO: 999975 - RNA, 22 nt, Human
ugagccaagaucgcgccacugc

SEQ ID NO: 999976 - RNA, 23 nt, Human
ugaggcaggagaauugcuugaac

SEQ ID NO: 999977 - RNA, 25 nt, Human
ugaggcaggagaauugcuugaacuc

SEQ ID NO: 999978 - RNA, 20 nt, Human
ugcaaaucccaucacuguag

SEQ ID NO: 999979 - RNA, 21 nt, Human
ugcaucacgaggucaggaguu

SEQ ID NO: 999980 - RNA, 22 nt, Human
ugcaucacgaggucaggaguuu

SEQ ID NO: 999981 - RNA, 24 nt, Human
ugcaucacgaggucaggaguuuga

SEQ ID NO: 999982 - RNA, 23 nt, Human
ugccuaaaaauuacuacaaacag

SEQ ID NO: 999983 - RNA, 25 nt, Human
ugcgauggcgacaaggcagcuagag

SEQ ID NO: 999984 - RNA, 28 nt, Human
ugcgauggcgacaaggcagcuagaguac

SEQ ID NO: 999985 - RNA, 21 nt, Human
uggagcaaaagagagcagcug

SEQ ID NO: 999986 - RNA, 19 nt, Human
uggcagccagaugcgaugg

SEQ ID NO: 999987 - RNA, 24 nt, Human
uggccaacauggugaaaccccauc

SEQ ID NO: 999988 - RNA, 19 nt, Human
uggcgacaaggcagcuaga

SEQ ID NO: 999989 - RNA, 21 nt, Human
uggcucacgcauguaauccca

SEQ ID NO: 999990 - RNA, 22 nt, Human
uggcucacgcauguaaucccag

SEQ ID NO: 999991 - RNA, 24 nt, Human
uggcucacgcauguaaucccagca

SEQ ID NO: 999992 - RNA, 19 nt, Human
ugggaggccgaggugggug

SEQ ID NO: 999993 - RNA, 24 nt, Human
ugguggcaggcaccuguaauccca

SEQ ID NO: 999994 - RNA, 20 nt, Human
uguaaucccagcacuuuggg

SEQ ID NO: 999995 - RNA, 18 nt, Human
ugucuuucuucugucccu

SEQ ID NO: 999996 - RNA, 19 nt, Human
ugugguggcaggcaccugu

SEQ ID NO: 999997 - RNA, 18 nt, Human
uuagcugggugugguggc

SEQ ID NO: 999998 - RNA, 24 nt, Human
uuagcugggugugguggcaggcac

SEQ ID NO: 999999 - RNA, 22 nt, Human
uugcagugagccaagaucgcgc

SEQ ID NO: 1000000 - RNA, 18 nt, Human
uugcuugaacucgggagg

SEQ ID NO: 1000001 - RNA, 23 nt, Human
uugcuugaacucgggaggcggag

SEQ ID NO: 1000002 - RNA, 21 nt, Human
caccuucugcagagccaggag

SEQ ID NO: 1000003 - RNA, 19 nt, Human
cagguggccugcaguaagc

SEQ ID NO: 1000004 - RNA, 21 nt, Human
cccacaccuucugcagagcca

SEQ ID NO: 1000005 - RNA, 22 nt, Human
cccgcacagcgccuagugcacc

SEQ ID NO: 1000006 - RNA, 23 nt, Human
ccugcaguaagcagaaggcccac

SEQ ID NO: 1000007 - RNA, 21 nt, Human
ccuggccgagcgcucgcugcc

SEQ ID NO: 1000008 - RNA, 19 nt, Human
cgccuagugcaccuggccg

SEQ ID NO: 1000009 - RNA, 18 nt, Human
gaauuugagaaacccccc

SEQ ID NO: 1000010 - RNA, 20 nt, Human
gcaguaagcagaaggcccac

SEQ ID NO: 1000011 - RNA, 26 nt, Human
gccgagcgcucgcugccgggaaaggc

SEQ ID NO: 1000012 - RNA, 25 nt, Human
uaagcagaaggcccacaccuucugc

SEQ ID NO: 1000013 - RNA, 19 nt, Human
ucugcagagccaggagcag

SEQ ID NO: 1000014 - RNA, 22 nt, Human
uggcagguggccugcaguaagc

SEQ ID NO: 1000015 - RNA, 18 nt, Human
uuuagaauuugagaaacc

SEQ ID NO: 1000016 - RNA, 18 nt, Human
aaaaaaaccccuucauau

SEQ ID NO: 1000017 - RNA, 22 nt, Human
aaaaagaaaacaaagcaaaaaa

SEQ ID NO: 1000018 - RNA, 26 nt, Human
aaaacaaagcaaaaaaaaaaaaaccc

SEQ ID NO: 1000019 - RNA, 21 nt, Human
aaaauggcaaacagucauaaa

SEQ ID NO: 1000020 - RNA, 25 nt, Human
aaacauaugaaacagaccuauaaag

SEQ ID NO: 1000021 - RNA, 21 nt, Human
aaaccaacaguauuaccacuu

SEQ ID NO: 1000022 - RNA, 31 nt, Human
aaagaaaacaaagcaaaaaaaaaaaaacccc

SEQ ID NO: 1000023 - RNA, 21 nt, Human
aaaguuuuuaagcaucaugau

SEQ ID NO: 1000024 - RNA, 19 nt, Human
aacauagccaauuuauuaa

SEQ ID NO: 1000025 - RNA, 20 nt, Human
aacggggcaguuuguuuccc

SEQ ID NO: 1000026 - RNA, 18 nt, Human
aagaaaacaaagcaaaaa

SEQ ID NO: 1000027 - RNA, 18 nt, Human
aagaacacacaaaaaagg

SEQ ID NO: 1000028 - RNA, 21 nt, Human
aagcuaccauucacaggauua

SEQ ID NO: 1000029 - RNA, 19 nt, Human
aaguuuaaaacccugcaac

SEQ ID NO: 1000030 - RNA, 22 nt, Human
acaaagcaaaaaaaaaaaaacc

SEQ ID NO: 1000031 - RNA, 24 nt, Human
acaaagcaaaaaaaaaaaaacccc

SEQ ID NO: 1000032 - RNA, 18 nt, Human
accagaaaccauuuucca

SEQ ID NO: 1000033 - RNA, 25 nt, Human
accagagccagccuccuccaaucug

SEQ ID NO: 1000034 - RNA, 24 nt, Human
accauuaaaaaaaauggcaaacag

SEQ ID NO: 1000035 - RNA, 22 nt, Human
acccugcaacauuuacagaaac

SEQ ID NO: 1000036 - RNA, 21 nt, Human
acuaaguaccauuaaaaaaaa

SEQ ID NO: 1000037 - RNA, 28 nt, Human
acuauucauuaaacaaugauaaauaacc

SEQ ID NO: 1000038 - RNA, 18 nt, Human
agacaagagucuagccug

SEQ ID NO: 1000039 - RNA, 18 nt, Human
agacacgugugaaaacau

SEQ ID NO: 1000040 - RNA, 21 nt, Human
agacacgugugaaaacauggu

SEQ ID NO: 1000041 - RNA, 22 nt, Human
agaguuuuuuuuaacccuaaag

SEQ ID NO: 1000042 - RNA, 24 nt, Human
agccaccaccgucauucuuggaaa

SEQ ID NO: 1000043 - RNA, 19 nt, Human
agcuccccgcagcccgcag

SEQ ID NO: 1000044 - RNA, 23 nt, Human
agcugggaucauuuugcaagaca

SEQ ID NO: 1000045 - RNA, 23 nt, Human
agguacucaguaaauaugaaugu

SEQ ID NO: 1000046 - RNA, 18 nt, Human
agugcucauagcaugugu

SEQ ID NO: 1000047 - RNA, 20 nt, Human
auaaaacauaugaaacagac

SEQ ID NO: 1000048 - RNA, 22 nt, Human
auaaaacaugacuaacuuucuu

SEQ ID NO: 1000049 - RNA, 25 nt, Human
auagagucuacaaaaagauuuuucc

SEQ ID NO: 1000050 - RNA, 19 nt, Human
auauauauauauauauaua

SEQ ID NO: 1000051 - RNA, 19 nt, Human
augcuuucaagauaacaca

SEQ ID NO: 1000052 - RNA, 19 nt, Human
auucuagaauauuaauagc

SEQ ID NO: 1000053 - RNA, 23 nt, Human
auuucuggauggucaagugacuc

SEQ ID NO: 1000054 - RNA, 23 nt, Human
caaaagcauugaguuuaaggcug

SEQ ID NO: 1000055 - RNA, 26 nt, Human
caaagcaaaaaaaaaaaaaccccuuc

SEQ ID NO: 1000056 - RNA, 21 nt, Human
caagaaauacaguaaaugcac

SEQ ID NO: 1000057 - RNA, 19 nt, Human
caagugacucucugccucc

SEQ ID NO: 1000058 - RNA, 22 nt, Human
caagugacucucugccucccca

SEQ ID NO: 1000059 - RNA, 23 nt, Human
cacuuauuuuaauauccuucuca

SEQ ID NO: 1000060 - RNA, 22 nt, Human
cagaaggccauuuucugacuaa

SEQ ID NO: 1000061 - RNA, 20 nt, Human
cagagcugggaucauuuugc

SEQ ID NO: 1000062 - RNA, 22 nt, Human
cagcacuuucccccaaaaauau

SEQ ID NO: 1000063 - RNA, 24 nt, Human
cauacaaacacuuugaugcacagc

SEQ ID NO: 1000064 - RNA, 19 nt, Human
cauucuccacaaacagacc

SEQ ID NO: 1000065 - RNA, 19 nt, Human
ccaaccggcaauauuuugc

SEQ ID NO: 1000066 - RNA, 26 nt, Human
cccaaaaauaugcuuaccaagaaaua

SEQ ID NO: 1000067 - RNA, 20 nt, Human
ccccauguccagcaaggggg

SEQ ID NO: 1000068 - RNA, 20 nt, Human
ccccgcagcccgcagacaac

SEQ ID NO: 1000069 - RNA, 19 nt, Human
cccugcacgcugcugcugc

SEQ ID NO: 1000070 - RNA, 22 nt, Human
cccugcacgcugcugcugcguu

SEQ ID NO: 1000071 - RNA, 27 nt, Human
cccugcacgcugcugcugcguuccaua

SEQ ID NO: 1000072 - RNA, 19 nt, Human
ccuacuguaaaagugaggu

SEQ ID NO: 1000073 - RNA, 26 nt, Human
cuagugaauagagaggguacuauaga

SEQ ID NO: 1000074 - RNA, 24 nt, Human
cucaaguauuuuuuaaaacucuac

SEQ ID NO: 1000075 - RNA, 26 nt, Human
cuccaaagggcuacuuauggcucucu

SEQ ID NO: 1000076 - RNA, 18 nt, Human
cuccacaaacagaccaau

SEQ ID NO: 1000077 - RNA, 24 nt, Human
cugucauugaaaacaaaacaaaua

SEQ ID NO: 1000078 - RNA, 24 nt, Human
cuuggaaaguucaccaaugauucc

SEQ ID NO: 1000079 - RNA, 21 nt, Human
cuuugguugacaccaucaguc

SEQ ID NO: 1000080 - RNA, 23 nt, Human
gaagaccccaaagucacuaucaa

SEQ ID NO: 1000081 - RNA, 24 nt, Human
gaagaguuuuuuuuaacccuaaag

SEQ ID NO: 1000082 - RNA, 23 nt, Human
gcagcacuuucccccaaaaauau

SEQ ID NO: 1000083 - RNA, 21 nt, Human
gccggcugucuuugacccugc

SEQ ID NO: 1000084 - RNA, 18 nt, Human
gcuuucauacauucucca

SEQ ID NO: 1000085 - RNA, 22 nt, Human
guaauuauaaaguuuaaaaccc

SEQ ID NO: 1000086 - RNA, 19 nt, Human
guauauauauauauauaua

SEQ ID NO: 1000087 - RNA, 19 nt, Human
guguauauauauauauaua

SEQ ID NO: 1000088 - RNA, 20 nt, Human
guguguauauauauauauau

SEQ ID NO: 1000089 - RNA, 23 nt, Human
uaaaagaacaaaugacgagaaua

SEQ ID NO: 1000090 - RNA, 18 nt, Human
uaaaugcacauauguauc

SEQ ID NO: 1000091 - RNA, 25 nt, Human
uaaauuaaaauaaggaaacuuaggg

SEQ ID NO: 1000092 - RNA, 19 nt, Human
uaacauauauaaucacaua

SEQ ID NO: 1000093 - RNA, 27 nt, Human
uaacccagaaagguugagaaauuugca

SEQ ID NO: 1000094 - RNA, 18 nt, Human
uaagaucaacagccuggg

SEQ ID NO: 1000095 - RNA, 24 nt, Human
uaauaagcaauaaacaucacauuc

SEQ ID NO: 1000096 - RNA, 21 nt, Human
uacacuccauugaugacagaa

SEQ ID NO: 1000097 - RNA, 21 nt, Human
uaccuguaaugcuuucaagau

SEQ ID NO: 1000098 - RNA, 18 nt, Human
uacuacaugugcugacau

SEQ ID NO: 1000099 - RNA, 20 nt, Human
uagcauuacuuuuguaauau

SEQ ID NO: 1000100 - RNA, 21 nt, Human
uagcuacauaaauccuguccc

SEQ ID NO: 1000101 - RNA, 27 nt, Human
uagguuaaaugaaguauauaacuacaa

SEQ ID NO: 1000102 - RNA, 21 nt, Human
uaguggaagcaaguguguucu

SEQ ID NO: 1000103 - RNA, 23 nt, Human
uauauauauauauauauaauaca

SEQ ID NO: 1000104 - RNA, 19 nt, Human
uauauauauauauauauau

SEQ ID NO: 1000105 - RNA, 18 nt, Human
uaucaaaaaugucaaaca

SEQ ID NO: 1000106 - RNA, 22 nt, Human
uaucaaaaaugucaaacaugac

SEQ ID NO: 1000107 - RNA, 24 nt, Human
ucacugauguuaggaaacaguguc

SEQ ID NO: 1000108 - RNA, 18 nt, Human
ucaguagaagaguuuuuu

SEQ ID NO: 1000109 - RNA, 19 nt, Human
ucagugaagaagaccccaa

SEQ ID NO: 1000110 - RNA, 19 nt, Human
ucauaaaagaacaaaugac

SEQ ID NO: 1000111 - RNA, 22 nt, Human
ucauacauucuccacaaacaga

SEQ ID NO: 1000112 - RNA, 19 nt, Human
ucauagcauguguuuuagc

SEQ ID NO: 1000113 - RNA, 18 nt, Human
ucauguauacauaguccc

SEQ ID NO: 1000114 - RNA, 21 nt, Human
ucauugaaaacaaaacaaaua

SEQ ID NO: 1000115 - RNA, 20 nt, Human
uccacaaacagaccaaucac

SEQ ID NO: 1000116 - RNA, 23 nt, Human
ucccccaaaaauaugcuuaccaa

SEQ ID NO: 1000117 - RNA, 18 nt, Human
ucccugggucuugugacc

SEQ ID NO: 1000118 - RNA, 19 nt, Human
ucuuggaaaauggcaaaaa

SEQ ID NO: 1000119 - RNA, 25 nt, Human
ucuuuauuuauaccaaacaaaucuu

SEQ ID NO: 1000120 - RNA, 23 nt, Human
ugaaagcacagaaggccauuuuc

SEQ ID NO: 1000121 - RNA, 19 nt, Human
ugaagaagaccccaaaguc

SEQ ID NO: 1000122 - RNA, 18 nt, Human
ugacauggggggccggcu

SEQ ID NO: 1000123 - RNA, 24 nt, Human
ugagaaauuugcacugauacuuaa

SEQ ID NO: 1000124 - RNA, 21 nt, Human
ugagauuuugugcaugguaaa

SEQ ID NO: 1000125 - RNA, 20 nt, Human
ugcacauauguauccaagug

SEQ ID NO: 1000126 - RNA, 21 nt, Human
ugcagaacguuaguacguggc

SEQ ID NO: 1000127 - RNA, 19 nt, Human
ugcuguacauucauuggaa

SEQ ID NO: 1000128 - RNA, 24 nt, Human
uggcaaaaauuaaaucugcuuuag

SEQ ID NO: 1000129 - RNA, 20 nt, Human
ugggcauaauaaauuuaaca

SEQ ID NO: 1000130 - RNA, 24 nt, Human
uggguuuuuuaugugugugugugg

SEQ ID NO: 1000131 - RNA, 18 nt, Human
uguauauauauauauaua

SEQ ID NO: 1000132 - RNA, 22 nt, Human
uguauauauauauauauauaua

SEQ ID NO: 1000133 - RNA, 22 nt, Human
ugucagagagugcaagacuuag

SEQ ID NO: 1000134 - RNA, 18 nt, Human
uguguauauauauauaua

SEQ ID NO: 1000135 - RNA, 20 nt, Human
uguguauauauauauauaua

SEQ ID NO: 1000136 - RNA, 20 nt, Human
uguguauauauauauauaua

SEQ ID NO: 1000137 - RNA, 22 nt, Human
uguguauauauauauauauaua

SEQ ID NO: 1000138 - RNA, 18 nt, Human
uguguguauauauauaua

SEQ ID NO: 1000139 - RNA, 18 nt, Human
uguguguguauauauaua

SEQ ID NO: 1000140 - RNA, 23 nt, Human
uguguguguguauauauauauau

SEQ ID NO: 1000141 - RNA, 24 nt, Human
uguuuugcuuuuggaaguucugug

SEQ ID NO: 1000142 - RNA, 21 nt, Human
uuagcuccccgcagcccgcag

SEQ ID NO: 1000143 - RNA, 19 nt, Human
uuaguucuggagacuaaag

SEQ ID NO: 1000144 - RNA, 23 nt, Human
uucauauucauacauaggcuuga

SEQ ID NO: 1000145 - RNA, 22 nt, Human
uuccuccaauuaacuaaguagg

SEQ ID NO: 1000146 - RNA, 26 nt, Human
uucuccacaaacagaccaaucacugg

SEQ ID NO: 1000147 - RNA, 21 nt, Human
uuugccuuacgugcccagggg

SEQ ID NO: 1000148 - RNA, 23 nt, Human
uuugugcagaacguuaguacgug

SEQ ID NO: 1000149 - RNA, 21 nt, Human
uuugugcaugguaaagagaua

SEQ ID NO: 1000150 - RNA, 18 nt, Human
uuuguuuugcuuuuggaa

SEQ ID NO: 1000151 - RNA, 21 nt, Human
uuuuucagagguugauuuggg

SEQ ID NO: 1000152 - RNA, 22 nt, Human
uuuuuuuugaaagcacagaagg

SEQ ID NO: 1000153 - RNA, 25 nt, Human
aaaaagaaaacagaacaaaaacaaa

SEQ ID NO: 1000154 - RNA, 26 nt, Human
aaaaagaaaacagaacaaaaacaaaa

SEQ ID NO: 1000155 - RNA, 25 nt, Human
aaaagaaaacagaacaaaaacaaaa

SEQ ID NO: 1000156 - RNA, 27 nt, Human
aaaagaaaacagaacaaaaacaaaaaa

SEQ ID NO: 1000157 - RNA, 25 nt, Human
aaaagaaggggaaagaaaggaagag

SEQ ID NO: 1000158 - RNA, 18 nt, Human
aaaagggaaaacuugggc

SEQ ID NO: 1000159 - RNA, 23 nt, Human
aaacaaaaaauuguuucccaaga

SEQ ID NO: 1000160 - RNA, 21 nt, Human
aaacagaacaaaaacaaaaaa

SEQ ID NO: 1000161 - RNA, 23 nt, Human
aaacuccugcagugcuucagucc

SEQ ID NO: 1000162 - RNA, 23 nt, Human
aaaugaggaagaaaagaaaagga

SEQ ID NO: 1000163 - RNA, 21 nt, Human
aagaaaacagaacaaaaacaa

SEQ ID NO: 1000164 - RNA, 22 nt, Human
aagcaaaaagaaaacagaacaa

SEQ ID NO: 1000165 - RNA, 25 nt, Human
aagcaaaaagaaaacagaacaaaaa

SEQ ID NO: 1000166 - RNA, 24 nt, Human
aagugccuuacauuuaauaaaagu

SEQ ID NO: 1000167 - RNA, 26 nt, Human
acaagccaaggagagaggcauggaac

SEQ ID NO: 1000168 - RNA, 20 nt, Human
agaaaagaaaaggaauuaca

SEQ ID NO: 1000169 - RNA, 24 nt, Human
agaacacucaggagcucggugggg

SEQ ID NO: 1000170 - RNA, 25 nt, Human
agacauucuaaguaaaagaagggga

SEQ ID NO: 1000171 - RNA, 21 nt, Human
agagcccuuccuugcagaccu

SEQ ID NO: 1000172 - RNA, 23 nt, Human
agauuugggauuuccagcccaca

SEQ ID NO: 1000173 - RNA, 22 nt, Human
aggaaugagaacacucaggagc

SEQ ID NO: 1000174 - RNA, 25 nt, Human
aggcauuagcggugggcccugagcc

SEQ ID NO: 1000175 - RNA, 22 nt, Human
auuucauuaaggcauuagcggu

SEQ ID NO: 1000176 - RNA, 24 nt, Human
caaaaagaaaacagaacaaaaaca

SEQ ID NO: 1000177 - RNA, 21 nt, Human
caaugugaagagucauaggga

SEQ ID NO: 1000178 - RNA, 24 nt, Human
cagaacaaaaacaaaaaauuguuu

SEQ ID NO: 1000179 - RNA, 18 nt, Human
cagaaucugagucucagc

SEQ ID NO: 1000180 - RNA, 23 nt, Human
caggucgagaaaagcgacaucca

SEQ ID NO: 1000181 - RNA, 21 nt, Human
caguagagaugaacucaggug

SEQ ID NO: 1000182 - RNA, 23 nt, Human
ccucagaaacucugagcauuaaa

SEQ ID NO: 1000183 - RNA, 23 nt, Human
ccugcagugcuucaguccaaagc

SEQ ID NO: 1000184 - RNA, 24 nt, Human
ccuucuacaagccaaggagagagg

SEQ ID NO: 1000185 - RNA, 22 nt, Human
cgagaaaagcgacauccagaga

SEQ ID NO: 1000186 - RNA, 20 nt, Human
cuucuacaagccaaggagag

SEQ ID NO: 1000187 - RNA, 23 nt, Human
gaaaauacaccaaaauacauuaa

SEQ ID NO: 1000188 - RNA, 22 nt, Human
gaaauaaggucuuuguagagaa

SEQ ID NO: 1000189 - RNA, 30 nt, Human
gaagcaaaaagaaaacagaacaaaaacaaa

SEQ ID NO: 1000190 - RNA, 23 nt, Human
gagaaaagcgacauccagagaac

SEQ ID NO: 1000191 - RNA, 22 nt, Human
gauuuccagcccacaguacggc

SEQ ID NO: 1000192 - RNA, 21 nt, Human
gcggugggcccugagccagua

SEQ ID NO: 1000193 - RNA, 18 nt, Human
ggcacagagauguacaua

SEQ ID NO: 1000194 - RNA, 19 nt, Human
ggguaaaggaaugagaaca

SEQ ID NO: 1000195 - RNA, 21 nt, Human
uaaaaagggaaaacuugggca

SEQ ID NO: 1000196 - RNA, 22 nt, Human
uacuacuagugaaaccaagggg

SEQ ID NO: 1000197 - RNA, 19 nt, Human
uaugaugcuuugcuaugga

SEQ ID NO: 1000198 - RNA, 20 nt, Human
ucaguaauaaucagaacaau

SEQ ID NO: 1000199 - RNA, 21 nt, Human
ucaguagagaugaacucaggu

SEQ ID NO: 1000200 - RNA, 22 nt, Human
uccaaagcagaggagucuugaa

SEQ ID NO: 1000201 - RNA, 30 nt, Human
ucccaauaccuccaaauauuaucuuauuuu

SEQ ID NO: 1000202 - RNA, 20 nt, Human
uccuucugucuugacucuug

SEQ ID NO: 1000203 - RNA, 23 nt, Human
ucucagcacaagggcuacuaugc

SEQ ID NO: 1000204 - RNA, 25 nt, Human
ucucuugcaagaaaggguaagauug

SEQ ID NO: 1000205 - RNA, 26 nt, Human
ugaaaagauaaaauuugaccucaauu

SEQ ID NO: 1000206 - RNA, 26 nt, Human
ugaaaccaagguauuaggaaaauaau

SEQ ID NO: 1000207 - RNA, 19 nt, Human
ugaaauacggauaagcagg

SEQ ID NO: 1000208 - RNA, 19 nt, Human
ugaaauggcugacaucuuu

SEQ ID NO: 1000209 - RNA, 18 nt, Human
ugaagcaaaaagaaaaca

SEQ ID NO: 1000210 - RNA, 18 nt, Human
ugaggaagaaaagaaaag

SEQ ID NO: 1000211 - RNA, 20 nt, Human
ugcagaaucugagucucagc

SEQ ID NO: 1000212 - RNA, 25 nt, Human
ugcagaaucugagucucagcacaag

SEQ ID NO: 1000213 - RNA, 22 nt, Human
ugcagaccucagaaagaaccaa

SEQ ID NO: 1000214 - RNA, 18 nt, Human
ugcuauggaagcccuagc

SEQ ID NO: 1000215 - RNA, 21 nt, Human
ugcuuugcuauggaagcccua

SEQ ID NO: 1000216 - RNA, 25 nt, Human
uggaacagagcccuuccuugcagac

SEQ ID NO: 1000217 - RNA, 18 nt, Human
ugggcacacagucauggg

SEQ ID NO: 1000218 - RNA, 23 nt, Human
ugguuugugacauugaaaaauga

SEQ ID NO: 1000219 - RNA, 29 nt, Human
uugaccucagaaacucugagcauuaaaaa

SEQ ID NO: 1000220 - RNA, 19 nt, Human
uuuuuuuuuuagagccagc

SEQ ID NO: 1000221 - RNA, 29 nt, Human
aaacuagaggcagaaauaagagggacccc

SEQ ID NO: 1000222 - RNA, 21 nt, Human
aaaguggaaccuggaugcugg

SEQ ID NO: 1000223 - RNA, 21 nt, Human
aacuagaggcagaaauaagau

SEQ ID NO: 1000224 - RNA, 25 nt, Human
aaggaaccugggggguuuaagggaa

SEQ ID NO: 1000225 - RNA, 23 nt, Human
aagugaccacugaggcccagagc

SEQ ID NO: 1000226 - RNA, 20 nt, Human
acagcaaaaugaucuuaggc

SEQ ID NO: 1000227 - RNA, 26 nt, Human
accagcaggaggugggaaaagagccc

SEQ ID NO: 1000228 - RNA, 18 nt, Human
acucugugcccagcacug

SEQ ID NO: 1000229 - RNA, 28 nt, Human
agcaugugacacacacaaagugggcaac

SEQ ID NO: 1000230 - RNA, 23 nt, Human
aggcccagagccguuggaacagg

SEQ ID NO: 1000231 - RNA, 24 nt, Human
aggggcaccuggacagagguuggg

SEQ ID NO: 1000232 - RNA, 18 nt, Human
aggguggaggacuuaaaa

SEQ ID NO: 1000233 - RNA, 18 nt, Human
auggaaggcaacuacagc

SEQ ID NO: 1000234 - RNA, 18 nt, Human
augugacacacacaaagu

SEQ ID NO: 1000235 - RNA, 21 nt, Human
auucaacaagucuuuauugag

SEQ ID NO: 1000236 - RNA, 18 nt, Human
auuccagagagugcagag

SEQ ID NO: 1000237 - RNA, 18 nt, Human
auucuuaguucagagagg

SEQ ID NO: 1000238 - RNA, 19 nt, Human
auugaucagugaucacagc

SEQ ID NO: 1000239 - RNA, 19 nt, Human
caaaacuagaggcagaaau

SEQ ID NO: 1000240 - RNA, 24 nt, Human
caagugaccacugaggcccagagc

SEQ ID NO: 1000241 - RNA, 18 nt, Human
caaugguggucaagugac

SEQ ID NO: 1000242 - RNA, 23 nt, Human
caccauuacccuucucuccauuc

SEQ ID NO: 1000243 - RNA, 18 nt, Human
cacccugcuggggaaccc

SEQ ID NO: 1000244 - RNA, 23 nt, Human
cacccugcuggggaacccgguca

SEQ ID NO: 1000245 - RNA, 20 nt, Human
cacucucuccuaggaaagug

SEQ ID NO: 1000246 - RNA, 23 nt, Human
cacugagugagauuucagggggc

SEQ ID NO: 1000247 - RNA, 20 nt, Human
cagcgcgcacccugcuaugg

SEQ ID NO: 1000248 - RNA, 22 nt, Human
cagcgcgcacccugcuaugguu

SEQ ID NO: 1000249 - RNA, 22 nt, Human
caucccguccccccauugagag

SEQ ID NO: 1000250 - RNA, 22 nt, Human
caucuccacucucuccuaggaa

SEQ ID NO: 1000251 - RNA, 20 nt, Human
caugugacacacacaaagug

SEQ ID NO: 1000252 - RNA, 25 nt, Human
cauucaacaagucuuuauugagcac

SEQ ID NO: 1000253 - RNA, 21 nt, Human
ccaaagaagugaagcaucuga

SEQ ID NO: 1000254 - RNA, 20 nt, Human
ccacuggauguuugucuugg

SEQ ID NO: 1000255 - RNA, 24 nt, Human
cccaucuccacucucuccuaggaa

SEQ ID NO: 1000256 - RNA, 20 nt, Human
ccccaaagccguguaugucu

SEQ ID NO: 1000257 - RNA, 21 nt, Human
ccccccauugagaguccugga

SEQ ID NO: 1000258 - RNA, 26 nt, Human
ccccucacaaggaccaaucuagagau

SEQ ID NO: 1000259 - RNA, 19 nt, Human
cccugcuccaggugcuuag

SEQ ID NO: 1000260 - RNA, 18 nt, Human
ccguguaugucuggaucc

SEQ ID NO: 1000261 - RNA, 19 nt, Human
ccuaagaccacagauagcu

SEQ ID NO: 1000262 - RNA, 24 nt, Human
ccuaagaccacagauagcuccagg

SEQ ID NO: 1000263 - RNA, 21 nt, Human
ccucauggacuccagggucag

SEQ ID NO: 1000264 - RNA, 26 nt, Human
ccuccugcugccuuccuuucccuguc

SEQ ID NO: 1000265 - RNA, 21 nt, Human
ccugcugccuuccuuucccug

SEQ ID NO: 1000266 - RNA, 22 nt, Human
ccuuuuaugccgucaguauauu

SEQ ID NO: 1000267 - RNA, 24 nt, Human
cuacucugugcccagcacugcacu

SEQ ID NO: 1000268 - RNA, 23 nt, Human
cuuguggccuccugcugccuucc

SEQ ID NO: 1000269 - RNA, 21 nt, Human
gaagacauguuacucccucuc

SEQ ID NO: 1000270 - RNA, 21 nt, Human
gaaggaaccugggggguuuaa

SEQ ID NO: 1000271 - RNA, 20 nt, Human
gaaguucccucgggaaacca

SEQ ID NO: 1000272 - RNA, 19 nt, Human
gacauguuacucccucucu

SEQ ID NO: 1000273 - RNA, 26 nt, Human
gccagagacagaggcuuaacacccug

SEQ ID NO: 1000274 - RNA, 21 nt, Human
gcugggggcagaugucagggg

SEQ ID NO: 1000275 - RNA, 18 nt, Human
ggaugaacaggggcuggc

SEQ ID NO: 1000276 - RNA, 22 nt, Human
ggcuauggaaauaugcucagcc

SEQ ID NO: 1000277 - RNA, 22 nt, Human
ggcugggggcagaugucagggc

SEQ ID NO: 1000278 - RNA, 18 nt, Human
gggcaagaaaaugcugca

SEQ ID NO: 1000279 - RNA, 21 nt, Human
gggcaguagauggagcaacag

SEQ ID NO: 1000280 - RNA, 18 nt, Human
gggcugggggcagauguc

SEQ ID NO: 1000281 - RNA, 21 nt, Human
ggguccccugcuccaggugcu

SEQ ID NO: 1000282 - RNA, 21 nt, Human
gguaggucuguuuaaaaugcc

SEQ ID NO: 1000283 - RNA, 24 nt, Human
gugcaagaaggaaccugggggguu

SEQ ID NO: 1000284 - RNA, 23 nt, Human
guggaggacuuaaaacuuggaug

SEQ ID NO: 1000285 - RNA, 20 nt, Human
gugggcuuguggccuccugc

SEQ ID NO: 1000286 - RNA, 26 nt, Human
guucacuggugaggacuucuucuccu

SEQ ID NO: 1000287 - RNA, 21 nt, Human
uacccuucucuccauuccuga

SEQ ID NO: 1000288 - RNA, 18 nt, Human
uacucugugcccagcacu

SEQ ID NO: 1000289 - RNA, 21 nt, Human
ucacuggugaggacuucuucu

SEQ ID NO: 1000290 - RNA, 26 nt, Human
ucagugaucacagcuuguaccccaaa

SEQ ID NO: 1000291 - RNA, 22 nt, Human
uccaggcuuuaaauggccuggg

SEQ ID NO: 1000292 - RNA, 18 nt, Human
uccuaggaaaguggaacc

SEQ ID NO: 1000293 - RNA, 19 nt, Human
uccuggaggacuugcucuc

SEQ ID NO: 1000294 - RNA, 22 nt, Human
ucgggcccuuauuccagagagu

SEQ ID NO: 1000295 - RNA, 22 nt, Human
ucucuuauaacaggguggagga

SEQ ID NO: 1000296 - RNA, 21 nt, Human
ucucuugacaugaagaccugg

SEQ ID NO: 1000297 - RNA, 19 nt, Human
ucuuaaaacuccccucaca

SEQ ID NO: 1000298 - RNA, 20 nt, Human
ugacacacacaaagugggca

SEQ ID NO: 1000299 - RNA, 20 nt, Human
ugaggacuucuucuccugga

SEQ ID NO: 1000300 - RNA, 19 nt, Human
ugcaagaaggaaccugggg

SEQ ID NO: 1000301 - RNA, 22 nt, Human
ugccagggaaggugggcagcag

SEQ ID NO: 1000302 - RNA, 23 nt, Human
uggacagagguuggguccguggg

SEQ ID NO: 1000303 - RNA, 22 nt, Human
uggacuccagggucagaaguuc

SEQ ID NO: 1000304 - RNA, 21 nt, Human
uggaugcugguagggccagag

SEQ ID NO: 1000305 - RNA, 22 nt, Human
uggaugugcugaucaagagcaa

SEQ ID NO: 1000306 - RNA, 21 nt, Human
uggggagguggcuaccagugg

SEQ ID NO: 1000307 - RNA, 20 nt, Human
ugggguccccugcuccaggu

SEQ ID NO: 1000308 - RNA, 20 nt, Human
uggguaaggacaagacuggg

SEQ ID NO: 1000309 - RNA, 24 nt, Human
ugguucugcccuuuuaugccguca

SEQ ID NO: 1000310 - RNA, 23 nt, Human
ugugcaagaaggaaccugggggg

SEQ ID NO: 1000311 - RNA, 19 nt, Human
uuccaaagaagugaagcag

SEQ ID NO: 1000312 - RNA, 18 nt, Human
uuggaugugcugaucaag

SEQ ID NO: 1000313 - RNA, 19 nt, Human
acaaccgcucgcccgcgcg

SEQ ID NO: 1000314 - RNA, 19 nt, Human
acaagcacaagcacaaccg

SEQ ID NO: 1000315 - RNA, 23 nt, Human
acagagccaggcugggcuggcca

SEQ ID NO: 1000316 - RNA, 24 nt, Human
agagaacagagccaggcugggcug

SEQ ID NO: 1000317 - RNA, 19 nt, Human
aggcgcagacgcgcucgcc

SEQ ID NO: 1000318 - RNA, 19 nt, Human
caagcacaagcacaaccgc

SEQ ID NO: 1000319 - RNA, 20 nt, Human
caagcacaagcacaaccgcu

SEQ ID NO: 1000320 - RNA, 26 nt, Human
cacacgccgccgggggcgcccagggg

SEQ ID NO: 1000321 - RNA, 18 nt, Human
ccacgcgccacaagcaca

SEQ ID NO: 1000322 - RNA, 20 nt, Human
cccgcaccacgcgccacaag

SEQ ID NO: 1000323 - RNA, 20 nt, Human
ccgaaacccgcaccacgcgc

SEQ ID NO: 1000324 - RNA, 24 nt, Human
ccgccgaaacccgcaccacgcgcc

SEQ ID NO: 1000325 - RNA, 23 nt, Human
ccgccgccgccgccgcgaggccg

SEQ ID NO: 1000326 - RNA, 24 nt, Human
ccgccgccgccgccgcgaggccga

SEQ ID NO: 1000327 - RNA, 19 nt, Human
ccgccgggggcgcccaggg

SEQ ID NO: 1000328 - RNA, 18 nt, Human
ccgcgcgcgggacgcugc

SEQ ID NO: 1000329 - RNA, 18 nt, Human
ccgcgcuucuuccucagc

SEQ ID NO: 1000330 - RNA, 22 nt, Human
ccgcugcccgccgcgcgcggga

SEQ ID NO: 1000331 - RNA, 18 nt, Human
ccgcugccgccgccgccg

SEQ ID NO: 1000332 - RNA, 26 nt, Human
cgagcgccgccacgcgccuccugggc

SEQ ID NO: 1000333 - RNA, 20 nt, Human
cgaggccgagcgccgccacg

SEQ ID NO: 1000334 - RNA, 24 nt, Human
cgaggccgagcgccgccacgcgcc

SEQ ID NO: 1000335 - RNA, 23 nt, Human
cgccgccgccgccgcgaggcccc

SEQ ID NO: 1000336 - RNA, 20 nt, Human
cgccuccugggccgcugccc

SEQ ID NO: 1000337 - RNA, 20 nt, Human
gaacagagccaggcugggcu

SEQ ID NO: 1000338 - RNA, 20 nt, Human
gccgccgaaacccgcaccac

SEQ ID NO: 1000339 - RNA, 23 nt, Human
gccgcugccgccgccgccgccgg

SEQ ID NO: 1000340 - RNA, 21 nt, Human
gccgggggcgcccaggggggg

SEQ ID NO: 1000341 - RNA, 18 nt, Human
gcgcccagggggggagga

SEQ ID NO: 1000342 - RNA, 20 nt, Human
ggacagagaacagagccagg

SEQ ID NO: 1000343 - RNA, 19 nt, Human
ggaggaggggcgcggggcc

SEQ ID NO: 1000344 - RNA, 20 nt, Human
ggcgcagacgcgcucgccgc

SEQ ID NO: 1000345 - RNA, 22 nt, Human
ggcugggcuggccaugggggcu

SEQ ID NO: 1000346 - RNA, 22 nt, Human
ggggaggaggggcgcggggccc

SEQ ID NO: 1000347 - RNA, 22 nt, Human
gggggaggaggggcgcggggcc

SEQ ID NO: 1000348 - RNA, 22 nt, Human
ggggggaggaggggcgcggggc

SEQ ID NO: 1000349 - RNA, 24 nt, Human
uccucagccgccgccgaaacccgc

SEQ ID NO: 1000350 - RNA, 31 nt, Human
ucgccgccaacugcugggccgcugccgccgg

SEQ ID NO: 1000351 - RNA, 19 nt, Human
ugacaggacagagaacaga

SEQ ID NO: 1000352 - RNA, 18 nt, Human
ugcccgccgcgcgcggga

SEQ ID NO: 1000353 - RNA, 18 nt, Human
ugggggauggggccacca

SEQ ID NO: 1000354 - RNA, 23 nt, Human
ugggggauggggccaccagggag

SEQ ID NO: 1000355 - RNA, 24 nt, Human
uuccucagccgccgccgaaacccg

SEQ ID NO: 1000356 - RNA, 21 nt, Human
uuuuuuuuuuuuuuuaacugg

SEQ ID NO: 1000357 - RNA, 26 nt, Human
uuuuuuuuuuuuuuuuuuuuaacugg

SEQ ID NO: 1000358 - RNA, 24 nt, Human
aacggcugagggugggggcagugu

SEQ ID NO: 1000359 - RNA, 21 nt, Human
aagagcagcagggucaggagg

SEQ ID NO: 1000360 - RNA, 21 nt, Human
aagaggcuggcagagggcugc

SEQ ID NO: 1000361 - RNA, 21 nt, Human
aagcaggaggugggccaugug

SEQ ID NO: 1000362 - RNA, 22 nt, Human
aagcaggaggugggccauguga

SEQ ID NO: 1000363 - RNA, 22 nt, Human
acacuccaucgccagagagaau

SEQ ID NO: 1000364 - RNA, 24 nt, Human
accacagacucaaaguggcugugg

SEQ ID NO: 1000365 - RNA, 21 nt, Human
agaagccacccuccagggacc

SEQ ID NO: 1000366 - RNA, 22 nt, Human
agacaagcacaguagcuuagaa

SEQ ID NO: 1000367 - RNA, 19 nt, Human
agagggcaggugcaggacc

SEQ ID NO: 1000368 - RNA, 23 nt, Human
agauccagcccgagaggaggagg

SEQ ID NO: 1000369 - RNA, 19 nt, Human
agcagcagggucaggagga

SEQ ID NO: 1000370 - RNA, 23 nt, Human
aggcaggaaaggagucugaaugg

SEQ ID NO: 1000371 - RNA, 18 nt, Human
aggcaggcugauaccaug

SEQ ID NO: 1000372 - RNA, 18 nt, Human
aggugaccuuucuggcag

SEQ ID NO: 1000373 - RNA, 23 nt, Human
aguggggcaggcaaccacgagga

SEQ ID NO: 1000374 - RNA, 22 nt, Human
auccuugagcacccuuccgcca

SEQ ID NO: 1000375 - RNA, 20 nt, Human
caacggcugagggugggggc

SEQ ID NO: 1000376 - RNA, 20 nt, Human
caaugguuuauuccaaaggg

SEQ ID NO: 1000377 - RNA, 20 nt, Human
caaugguuuauuccaaaggg

SEQ ID NO: 1000378 - RNA, 21 nt, Human
cacaaggcaggaaaggagucu

SEQ ID NO: 1000379 - RNA, 23 nt, Human
cacacuccaucgccagagagaau

SEQ ID NO: 1000380 - RNA, 25 nt, Human
cacacuccaucgccagagagaaugc

SEQ ID NO: 1000381 - RNA, 25 nt, Human
cacccuccagggaccacagacucaa

SEQ ID NO: 1000382 - RNA, 18 nt, Human
cagauccagcccgagagg

SEQ ID NO: 1000383 - RNA, 19 nt, Human
cagcagggcgugggcggga

SEQ ID NO: 1000384 - RNA, 19 nt, Human
cagccacacuccaucgcca

SEQ ID NO: 1000385 - RNA, 18 nt, Human
cagcccagccacacucca

SEQ ID NO: 1000386 - RNA, 26 nt, Human
cagcccgagaggaggaggcuggcggg

SEQ ID NO: 1000387 - RNA, 19 nt, Human
caggaaugauggugaccau

SEQ ID NO: 1000388 - RNA, 20 nt, Human
cagggaccacagacucaaag

SEQ ID NO: 1000389 - RNA, 18 nt, Human
ccacacuccaucgccaga

SEQ ID NO: 1000390 - RNA, 18 nt, Human
ccacacuccaucgccaga

SEQ ID NO: 1000391 - RNA, 19 nt, Human
ccagacaagcacaguagcu

SEQ ID NO: 1000392 - RNA, 20 nt, Human
ccccaaccccugcaagcugg

SEQ ID NO: 1000393 - RNA, 18 nt, Human
ccccaaccuaucucaccc

SEQ ID NO: 1000394 - RNA, 19 nt, Human
ccccaaccuaucucacccc

SEQ ID NO: 1000395 - RNA, 19 nt, Human
ccccugugauggguuggcc

SEQ ID NO: 1000396 - RNA, 19 nt, Human
cccucccacccagacaagc

SEQ ID NO: 1000397 - RNA, 22 nt, Human
ccgagaggaggaggcuggcggg

SEQ ID NO: 1000398 - RNA, 20 nt, Human
ccuccagggaccacagacuc

SEQ ID NO: 1000399 - RNA, 21 nt, Human
ccuccccaaccccugcaagcu

SEQ ID NO: 1000400 - RNA, 21 nt, Human
ccuccccaaccccugcaagcu

SEQ ID NO: 1000401 - RNA, 23 nt, Human
ccucuccaauccuugagcacccu

SEQ ID NO: 1000402 - RNA, 23 nt, Human
ccucuccaauccuugagcacccu

SEQ ID NO: 1000403 - RNA, 22 nt, Human
ccucugggaagcaggagguggg

SEQ ID NO: 1000404 - RNA, 21 nt, Human
ccugguuuugucuccucucca

SEQ ID NO: 1000405 - RNA, 21 nt, Human
ccugguuuugucuccucucca

SEQ ID NO: 1000406 - RNA, 19 nt, Human
cgccucguuccuuccgcca

SEQ ID NO: 1000407 - RNA, 23 nt, Human
cggcagggaguggggcaggcaac

SEQ ID NO: 1000408 - RNA, 22 nt, Human
cgguagugagacucaaggguac

SEQ ID NO: 1000409 - RNA, 22 nt, Human
cuccccaaccccugcaagcugg

SEQ ID NO: 1000410 - RNA, 23 nt, Human
cugcaguggccaagggcugcagg

SEQ ID NO: 1000411 - RNA, 24 nt, Human
cuggaugucucccuccccaacccc

SEQ ID NO: 1000412 - RNA, 24 nt, Human
cuggaugucucccuccccaacccc

SEQ ID NO: 1000413 - RNA, 22 nt, Human
cuggcccauccuuccagagccc

SEQ ID NO: 1000414 - RNA, 22 nt, Human
cuggcccauccuuccagagccc

SEQ ID NO: 1000415 - RNA, 18 nt, Human
cugggguucaggauaggu

SEQ ID NO: 1000416 - RNA, 19 nt, Human
gaacugacaccuccugguc

SEQ ID NO: 1000417 - RNA, 25 nt, Human
gaccaucugaggucacaaggcagga

SEQ ID NO: 1000418 - RNA, 19 nt, Human
gagaagccacccuccaggg

SEQ ID NO: 1000419 - RNA, 23 nt, Human
gagcagggguguggcgccucguu

SEQ ID NO: 1000420 - RNA, 22 nt, Human
gaggaagagcagggguguggcg

SEQ ID NO: 1000421 - RNA, 22 nt, Human
gaggaggcuggcggguuagggc

SEQ ID NO: 1000422 - RNA, 23 nt, Human
gcaaccacgaggacuagagacac

SEQ ID NO: 1000423 - RNA, 25 nt, Human
gccacccuccagggaccacagacuc

SEQ ID NO: 1000424 - RNA, 22 nt, Human
gcugcuccugguuuugucuccu

SEQ ID NO: 1000425 - RNA, 22 nt, Human
gcugcuccugguuuugucuccu

SEQ ID NO: 1000426 - RNA, 19 nt, Human
ggagauggguggcugugcu

SEQ ID NO: 1000427 - RNA, 20 nt, Human
ggagauggguggcugugcug

SEQ ID NO: 1000428 - RNA, 26 nt, Human
ggcaguguguaaggcaccuuuugcgg

SEQ ID NO: 1000429 - RNA, 23 nt, Human
ggccaguggggaagucggagagg

SEQ ID NO: 1000430 - RNA, 22 nt, Human
ggcugcagguucugccaugcug

SEQ ID NO: 1000431 - RNA, 24 nt, Human
ggcugugcuguccaggcaucugcu

SEQ ID NO: 1000432 - RNA, 24 nt, Human
gggaacugacaccuccuggucagc

SEQ ID NO: 1000433 - RNA, 22 nt, Human
gggaagcaggaggugggccaug

SEQ ID NO: 1000434 - RNA, 21 nt, Human
gggaauucuuuaucucagcag

SEQ ID NO: 1000435 - RNA, 20 nt, Human
gggauagggccuuggagaga

SEQ ID NO: 1000436 - RNA, 18 nt, Human
ggggauagggccuuggag

SEQ ID NO: 1000437 - RNA, 23 nt, Human
gggggguaaucagaaggaggagg

SEQ ID NO: 1000438 - RNA, 19 nt, Human
gguaaucagaaggaggagg

SEQ ID NO: 1000439 - RNA, 19 nt, Human
gguggagacccaccgccug

SEQ ID NO: 1000440 - RNA, 18 nt, Human
gucaagacacugagaggu

SEQ ID NO: 1000441 - RNA, 21 nt, Human
uaagggaauucuuuaucucag

SEQ ID NO: 1000442 - RNA, 19 nt, Human
uagaauggccgguagugag

SEQ ID NO: 1000443 - RNA, 19 nt, Human
uagagacacaccugugagg

SEQ ID NO: 1000444 - RNA, 19 nt, Human
uagcccccagauccagccc

SEQ ID NO: 1000445 - RNA, 21 nt, Human
uagggcaggccccaaccuauc

SEQ ID NO: 1000446 - RNA, 21 nt, Human
uaggugaccuuucuggcaggc

SEQ ID NO: 1000447 - RNA, 19 nt, Human
ucaaggguacacugccuuu

SEQ ID NO: 1000448 - RNA, 18 nt, Human
ucagcuccuugccuuugu

SEQ ID NO: 1000449 - RNA, 21 nt, Human
uccaucgccagagagaaugcc

SEQ ID NO: 1000450 - RNA, 18 nt, Human
ucccguugccuuuguuga

SEQ ID NO: 1000451 - RNA, 20 nt, Human
ucccuccccaaccccugcaa

SEQ ID NO: 1000452 - RNA, 24 nt, Human
uccuugagcacccugauaugcaac

SEQ ID NO: 1000453 - RNA, 22 nt, Human
ucucucagggaacugacaccuc

SEQ ID NO: 1000454 - RNA, 23 nt, Human
ucugccaugcugggcauugauag

SEQ ID NO: 1000455 - RNA, 21 nt, Human
uggaugucucccuccccaacc

SEQ ID NO: 1000456 - RNA, 21 nt, Human
uggaugucucccuccccaacc

SEQ ID NO: 1000457 - RNA, 23 nt, Human
uggaugucucccuccccaacccc

SEQ ID NO: 1000458 - RNA, 23 nt, Human
uggaugucucccuccccaacccc

SEQ ID NO: 1000459 - RNA, 23 nt, Human
uggcccauccuuccagagccccc

SEQ ID NO: 1000460 - RNA, 23 nt, Human
uggcccauccuuccagagccccc

SEQ ID NO: 1000461 - RNA, 22 nt, Human
uggggcaacggcugaggguggg

SEQ ID NO: 1000462 - RNA, 21 nt, Human
uggguggcugugcuguccagg

SEQ ID NO: 1000463 - RNA, 26 nt, Human
ugguuuugucuccucuccaauccuug

SEQ ID NO: 1000464 - RNA, 26 nt, Human
ugguuuugucuccucuccaauccuug

SEQ ID NO: 1000465 - RNA, 19 nt, Human
ugucaagacacugagaggu

SEQ ID NO: 1000466 - RNA, 18 nt, Human
ugucuccucuccaauccu

SEQ ID NO: 1000467 - RNA, 24 nt, Human
uuggccucugagcacaggggucac

SEQ ID NO: 1000468 - RNA, 21 nt, Human
uuuugucuccucuccaauccu

SEQ ID NO: 1000469 - RNA, 21 nt, Human
aacucguccauuccuucucca

SEQ ID NO: 1000470 - RNA, 26 nt, Human
aacucguccauuccuucuccaacucu

SEQ ID NO: 1000471 - RNA, 23 nt, Human
acagaacaacagggcuguuucaa

SEQ ID NO: 1000472 - RNA, 20 nt, Human
accaccacccccgcccccau

SEQ ID NO: 1000473 - RNA, 19 nt, Human
acucucuucaccaccaccc

SEQ ID NO: 1000474 - RNA, 20 nt, Human
aggaagcugugccaagucug

SEQ ID NO: 1000475 - RNA, 23 nt, Human
agugucuccauccacccccuaca

SEQ ID NO: 1000476 - RNA, 18 nt, Human
augagggguugggagaga

SEQ ID NO: 1000477 - RNA, 20 nt, Human
caacucucuucaccaccacc

SEQ ID NO: 1000478 - RNA, 22 nt, Human
caagcguggggcggguggcugg

SEQ ID NO: 1000479 - RNA, 25 nt, Human
caccacagccaaagugauaagaagu

SEQ ID NO: 1000480 - RNA, 20 nt, Human
caccaccacccccgccccca

SEQ ID NO: 1000481 - RNA, 22 nt, Human
cacccccgcccccaucuccacu

SEQ ID NO: 1000482 - RNA, 19 nt, Human
cacuaggcggcaccacagc

SEQ ID NO: 1000483 - RNA, 23 nt, Human
cagaauggggaccucauucuauc

SEQ ID NO: 1000484 - RNA, 20 nt, Human
caguagcccgagcccuccca

SEQ ID NO: 1000485 - RNA, 20 nt, Human
ccaacucucuucaccaccac

SEQ ID NO: 1000486 - RNA, 18 nt, Human
ccccggaguccacugugg

SEQ ID NO: 1000487 - RNA, 25 nt, Human
cccgagcccucccauucuccacucc

SEQ ID NO: 1000488 - RNA, 23 nt, Human
ccucccauucuccacuccuucga

SEQ ID NO: 1000489 - RNA, 22 nt, Human
ccuucuccaacucucuucacca

SEQ ID NO: 1000490 - RNA, 24 nt, Human
cgagcccucccauucuccacuccu

SEQ ID NO: 1000491 - RNA, 22 nt, Human
cgccacucuaugcuccgaaguc

SEQ ID NO: 1000492 - RNA, 22 nt, Human
cucucuucaccaccacccccgc

SEQ ID NO: 1000493 - RNA, 20 nt, Human
cugugccaagucuguaggag

SEQ ID NO: 1000494 - RNA, 23 nt, Human
gacccaauuccacuaagucaaga

SEQ ID NO: 1000495 - RNA, 21 nt, Human
gagcccucccauucuccacuc

SEQ ID NO: 1000496 - RNA, 23 nt, Human
gccccggaguccacuguggauac

SEQ ID NO: 1000497 - RNA, 20 nt, Human
gcuugcguggugguuccagu

SEQ ID NO: 1000498 - RNA, 19 nt, Human
ggagcaccaccgcuccccg

SEQ ID NO: 1000499 - RNA, 21 nt, Human
gguugggagagaagggggacg

SEQ ID NO: 1000500 - RNA, 18 nt, Human
uaggaagcugugccaagu

SEQ ID NO: 1000501 - RNA, 18 nt, Human
uaggcggcaccacagcca

SEQ ID NO: 1000502 - RNA, 18 nt, Human
ucaguagcccgagcccuc

SEQ ID NO: 1000503 - RNA, 22 nt, Human
uccaacucucuucaccaccacc

SEQ ID NO: 1000504 - RNA, 22 nt, Human
ucuaugcuccgaaguccgugga

SEQ ID NO: 1000505 - RNA, 19 nt, Human
ugacccaggcuggcguugc

SEQ ID NO: 1000506 - RNA, 20 nt, Human
ugacccaggcuggcguugcu

SEQ ID NO: 1000507 - RNA, 18 nt, Human
ugauggacugugacccag

SEQ ID NO: 1000508 - RNA, 21 nt, Human
ugccaagucuguaggagcccc

SEQ ID NO: 1000509 - RNA, 22 nt, Human
ugcuccgaaguccguggagcac

SEQ ID NO: 1000510 - RNA, 18 nt, Human
ugcuuaaagagugcgggg

SEQ ID NO: 1000511 - RNA, 20 nt, Human
ugggagagaagggggacgug

SEQ ID NO: 1000512 - RNA, 24 nt, Human
ugggagagaagggggacgugggaa

SEQ ID NO: 1000513 - RNA, 21 nt, Human
uggggcggguggcuggagauu

SEQ ID NO: 1000514 - RNA, 22 nt, Human
ugguuccagucugcuaaauauu

SEQ ID NO: 1000515 - RNA, 25 nt, Human
uguaggaagcugugccaagucugua

SEQ ID NO: 1000516 - RNA, 18 nt, Human
uuagaagugucuccaucc

SEQ ID NO: 1000517 - RNA, 22 nt, Human
uucaccaccacccccgccccca

SEQ ID NO: 1000518 - RNA, 26 nt, Human
uucaccaccacccccgcccccaucuc

SEQ ID NO: 1000519 - RNA, 20 nt, Human
uucccuugcugauaugaggg

SEQ ID NO: 1000520 - RNA, 26 nt, Human
uucuccacuccuucgacccaauucca

SEQ ID NO: 1000521 - RNA, 18 nt, Human
uugcucgucucuggauuu

SEQ ID NO: 1000522 - RNA, 20 nt, Human
ccccgcgccgcccgccgccc

SEQ ID NO: 1000523 - RNA, 19 nt, Human
ccccgucgccgccgccgcc

SEQ ID NO: 1000524 - RNA, 19 nt, Human
ccccgucgccgccgccgcc

SEQ ID NO: 1000525 - RNA, 21 nt, Human
ccccgucgccgccgccgccgc

SEQ ID NO: 1000526 - RNA, 21 nt, Human
ccgccccgucgccgccgccgc

SEQ ID NO: 1000527 - RNA, 26 nt, Human
ccgccccgucgccgccgccgccgccc

SEQ ID NO: 1000528 - RNA, 26 nt, Human
ccgccgccccgucgccgccgccgccg

SEQ ID NO: 1000529 - RNA, 19 nt, Human
ccgccgccgcccccagccc

SEQ ID NO: 1000530 - RNA, 21 nt, Human
cgccgccgccgcccccagccc

SEQ ID NO: 1000531 - RNA, 19 nt, Human
cucuuugaacccgccggac

SEQ ID NO: 1000532 - RNA, 21 nt, Human
gccgccgcccccagccccagc

SEQ ID NO: 1000533 - RNA, 21 nt, Human
ucgccgccgccgccgccccca

SEQ ID NO: 1000534 - RNA, 28 nt, Human
ucgccgccgccgccgcccccagccccag

SEQ ID NO: 1000535 - RNA, 21 nt, Human
aaaaaagaagagcgaggaaga

SEQ ID NO: 1000536 - RNA, 23 nt, Human
aaaaagaagagcgaggaagaaau

SEQ ID NO: 1000537 - RNA, 20 nt, Human
aacauagugagaccccccuc

SEQ ID NO: 1000538 - RNA, 21 nt, Human
aacauagugagaccccccuca

SEQ ID NO: 1000539 - RNA, 22 nt, Human
aacauagugagaccccccucac

SEQ ID NO: 1000540 - RNA, 19 nt, Human
aagaagagcgaggaagaaa

SEQ ID NO: 1000541 - RNA, 23 nt, Human
aagaagagcgaggaagaaauaac

SEQ ID NO: 1000542 - RNA, 24 nt, Human
aagagcgaggaagaaauaacaggg

SEQ ID NO: 1000543 - RNA, 18 nt, Human
acagcaagacccugucuc

SEQ ID NO: 1000544 - RNA, 23 nt, Human
accccuaccugacugguaaaaaa

SEQ ID NO: 1000545 - RNA, 18 nt, Human
acuguacuccagccuggg

SEQ ID NO: 1000546 - RNA, 26 nt, Human
acuguacuccagccugggugauacag

SEQ ID NO: 1000547 - RNA, 23 nt, Human
agagcgaggaagaaauaacaggg

SEQ ID NO: 1000548 - RNA, 19 nt, Human
agcccaugaguuugagguu

SEQ ID NO: 1000549 - RNA, 22 nt, Human
agcuugggcaacauagugagac

SEQ ID NO: 1000550 - RNA, 23 nt, Human
agcuugggcaacauagugagacc

SEQ ID NO: 1000551 - RNA, 24 nt, Human
agcuugggcaacauagugagaccc

SEQ ID NO: 1000552 - RNA, 23 nt, Human
aucacccacuguacuccagccug

SEQ ID NO: 1000553 - RNA, 19 nt, Human
cacugagcuauaaucaccc

SEQ ID NO: 1000554 - RNA, 19 nt, Human
cacuguacuccagccuggg

SEQ ID NO: 1000555 - RNA, 19 nt, Human
cacuguacuccagccuggg

SEQ ID NO: 1000556 - RNA, 19 nt, Human
cacuguacuccagccuggg

SEQ ID NO: 1000557 - RNA, 22 nt, Human
cacuguacuccagccuggguga

SEQ ID NO: 1000558 - RNA, 23 nt, Human
cacuguacuccagccugggugau

SEQ ID NO: 1000559 - RNA, 24 nt, Human
cacuguacuccagccugggugaua

SEQ ID NO: 1000560 - RNA, 22 nt, Human
caggaagaugacguuggccagg

SEQ ID NO: 1000561 - RNA, 22 nt, Human
caguacccaggaagcuccagga

SEQ ID NO: 1000562 - RNA, 18 nt, Human
ccacuguacuccagccug

SEQ ID NO: 1000563 - RNA, 20 nt, Human
ccacuguacuccagccuggg

SEQ ID NO: 1000564 - RNA, 20 nt, Human
ccacuguacuccagccuggg

SEQ ID NO: 1000565 - RNA, 21 nt, Human
ccacuguacuccagccugggu

SEQ ID NO: 1000566 - RNA, 21 nt, Human
ccacuguacuccagccugggu

SEQ ID NO: 1000567 - RNA, 23 nt, Human
ccacuguacuccagccuggguga

SEQ ID NO: 1000568 - RNA, 26 nt, Human
ccacuguacuccagccugggugauac

SEQ ID NO: 1000569 - RNA, 23 nt, Human
ccagcuugggcaacauagugaga

SEQ ID NO: 1000570 - RNA, 24 nt, Human
cccacuguacuccagccuggguga

SEQ ID NO: 1000571 - RNA, 18 nt, Human
ccuccaggccaguaccca

SEQ ID NO: 1000572 - RNA, 18 nt, Human
ccuggaacauguggcccu

SEQ ID NO: 1000573 - RNA, 21 nt, Human
ccuguagucccagcuacucag

SEQ ID NO: 1000574 - RNA, 22 nt, Human
ccuguagucccagcuacucagg

SEQ ID NO: 1000575 - RNA, 19 nt, Human
cguuggccagggcuggugg

SEQ ID NO: 1000576 - RNA, 23 nt, Human
cucaccccuaccugacugguaaa

SEQ ID NO: 1000577 - RNA, 18 nt, Human
cucuaaaaaaaagaagag

SEQ ID NO: 1000578 - RNA, 24 nt, Human
cugacugguaaaaaaugaaaaaaa

SEQ ID NO: 1000579 - RNA, 22 nt, Human
gagaccccccucaccccuaccu

SEQ ID NO: 1000580 - RNA, 22 nt, Human
gaguuugagguuacacugagcu

SEQ ID NO: 1000581 - RNA, 24 nt, Human
gaucacuugagcccaugaguuuga

SEQ ID NO: 1000582 - RNA, 21 nt, Human
ggcacgagcagccggcucggg

SEQ ID NO: 1000583 - RNA, 24 nt, Human
guacuccagccugggugauacagc

SEQ ID NO: 1000584 - RNA, 19 nt, Human
guuacacugagcuauaauc

SEQ ID NO: 1000585 - RNA, 24 nt, Human
uacagcaagacccugucucuaaaa

SEQ ID NO: 1000586 - RNA, 27 nt, Human
uacagcaagacccugucucuaaaaaaa

SEQ ID NO: 1000587 - RNA, 22 nt, Human
uacuccagccugggugauacag

SEQ ID NO: 1000588 - RNA, 23 nt, Human
uacuccagccugggugauacagc

SEQ ID NO: 1000589 - RNA, 24 nt, Human
uccagccugggugauacagcaaga

SEQ ID NO: 1000590 - RNA, 19 nt, Human
uccaggccaguacccagga

SEQ ID NO: 1000591 - RNA, 20 nt, Human
uccaggccaguacccaggaa

SEQ ID NO: 1000592 - RNA, 18 nt, Human
ucccagcugguccuggaa

SEQ ID NO: 1000593 - RNA, 23 nt, Human
ucucuaaaaaaaagaagagcgag

SEQ ID NO: 1000594 - RNA, 18 nt, Human
ugacugguaaaaaaugaa

SEQ ID NO: 1000595 - RNA, 19 nt, Human
ugaguuugagguuacacug

SEQ ID NO: 1000596 - RNA, 22 nt, Human
ugauacagcaagacccugucuc

SEQ ID NO: 1000597 - RNA, 24 nt, Human
ugccuguagucccagcuacucagg

SEQ ID NO: 1000598 - RNA, 24 nt, Human
ugguggcucgugccuguaguccca

SEQ ID NO: 1000599 - RNA, 24 nt, Human
uuaguugggcaugguggcucgugc

SEQ ID NO: 1000600 - RNA, 18 nt, Human
aaaaaaaacaggccuaaa

SEQ ID NO: 1000601 - RNA, 19 nt, Human
aaaaaaacaggccuaaaag

SEQ ID NO: 1000602 - RNA, 21 nt, Human
aaaaaccaccuacuugaaagc

SEQ ID NO: 1000603 - RNA, 24 nt, Human
aaaaaugaaaagucaaacagaaga

SEQ ID NO: 1000604 - RNA, 19 nt, Human
aaaaugccacauaagugaa

SEQ ID NO: 1000605 - RNA, 19 nt, Human
aaacaaaugcaagacacau

SEQ ID NO: 1000606 - RNA, 24 nt, Human
aaacaaaugcaagacacauugcuu

SEQ ID NO: 1000607 - RNA, 22 nt, Human
aaacauguaaauauaaaucagg

SEQ ID NO: 1000608 - RNA, 24 nt, Human
aacaacaaggacaaccaaaaaaaa

SEQ ID NO: 1000609 - RNA, 21 nt, Human
aacaaggacaaccaaaaaaaa

SEQ ID NO: 1000610 - RNA, 20 nt, Human
aacagaaaaugccacauaag

SEQ ID NO: 1000611 - RNA, 18 nt, Human
aaccaaaaaaaacaggcc

SEQ ID NO: 1000612 - RNA, 24 nt, Human
aaccaccuacuugaaagcaacacc

SEQ ID NO: 1000613 - RNA, 22 nt, Human
aagaagaaucauacucaaacac

SEQ ID NO: 1000614 - RNA, 24 nt, Human
aagcaacaccuuucaaaaacagac

SEQ ID NO: 1000615 - RNA, 23 nt, Human
aaggacaaccaaaaaaaacaggc

SEQ ID NO: 1000616 - RNA, 23 nt, Human
aaugaaaagucaaacagaagaga

SEQ ID NO: 1000617 - RNA, 21 nt, Human
aaugcuaccagccugaguaac

SEQ ID NO: 1000618 - RNA, 25 nt, Human
acaaaacaaaacaguaguauuccuu

SEQ ID NO: 1000619 - RNA, 21 nt, Human
acaaccaaaaaaaacaggccu

SEQ ID NO: 1000620 - RNA, 24 nt, Human
acagaaaaugccacauaagugaac

SEQ ID NO: 1000621 - RNA, 23 nt, Human
accauaaggaaagugucagcaac

SEQ ID NO: 1000622 - RNA, 19 nt, Human
acugcuacaaugcauaaaa

SEQ ID NO: 1000623 - RNA, 18 nt, Human
acuuuuaugguguuuuuc

SEQ ID NO: 1000624 - RNA, 20 nt, Human
agaauaagaaaaacuaaaga

SEQ ID NO: 1000625 - RNA, 22 nt, Human
agccugaguaacagauuuccau

SEQ ID NO: 1000626 - RNA, 27 nt, Human
aguaaggggguaaaagaauaaauauga

SEQ ID NO: 1000627 - RNA, 19 nt, Human
auaaaguaaaagacagucc

SEQ ID NO: 1000628 - RNA, 24 nt, Human
auauuuuaaccucaaaaaaauaag

SEQ ID NO: 1000629 - RNA, 20 nt, Human
aucauacucaaacacaagug

SEQ ID NO: 1000630 - RNA, 22 nt, Human
augaacuuuucaaacauguaaa

SEQ ID NO: 1000631 - RNA, 22 nt, Human
caaccacaaaugugacuuuagc

SEQ ID NO: 1000632 - RNA, 24 nt, Human
caagaaaccaugcuuacuacccau

SEQ ID NO: 1000633 - RNA, 18 nt, Human
caaggacaaccaaaaaaa

SEQ ID NO: 1000634 - RNA, 21 nt, Human
cacucagcgauauguaauuag

SEQ ID NO: 1000635 - RNA, 25 nt, Human
cagaaaaugccacauaagugaacau

SEQ ID NO: 1000636 - RNA, 21 nt, Human
cagcaacaccagcugacagaa

SEQ ID NO: 1000637 - RNA, 22 nt, Human
caggaaaaccugauauguaaua

SEQ ID NO: 1000638 - RNA, 21 nt, Human
cauaaaugauuacugcuacaa

SEQ ID NO: 1000639 - RNA, 22 nt, Human
ccccgcccauaagcuguuaacc

SEQ ID NO: 1000640 - RNA, 21 nt, Human
ccgagcuccccgcccauaagc

SEQ ID NO: 1000641 - RNA, 23 nt, Human
ccuauccauaaggcauuuaaaaa

SEQ ID NO: 1000642 - RNA, 24 nt, Human
ccuauugaaaacaaaugcaagaca

SEQ ID NO: 1000643 - RNA, 22 nt, Human
ccugagucacaucagauguuuc

SEQ ID NO: 1000644 - RNA, 24 nt, Human
ccugcuaaacacugaaguucucca

SEQ ID NO: 1000645 - RNA, 18 nt, Human
cugaauauuuuaaccuca

SEQ ID NO: 1000646 - RNA, 23 nt, Human
cuuaaaauguccuuagcaauaca

SEQ ID NO: 1000647 - RNA, 18 nt, Human
gaaaagucaaacagaaga

SEQ ID NO: 1000648 - RNA, 21 nt, Human
ggcagaacaacgacaugaaga

SEQ ID NO: 1000649 - RNA, 23 nt, Human
ggccaaaaaugaaaaucacaaaa

SEQ ID NO: 1000650 - RNA, 21 nt, Human
guaaaagacaguccaguugca

SEQ ID NO: 1000651 - RNA, 18 nt, Human
guccuuucuuuucucuuu

SEQ ID NO: 1000652 - RNA, 19 nt, Human
uaaaagacaguccaguugc

SEQ ID NO: 1000653 - RNA, 19 nt, Human
uaaauauaaaucaggaaaa

SEQ ID NO: 1000654 - RNA, 21 nt, Human
uaacaacaaggacaaccaaaa

SEQ ID NO: 1000655 - RNA, 23 nt, Human
uaacaacaaggacaaccaaaaaa

SEQ ID NO: 1000656 - RNA, 18 nt, Human
uaacuuggaaagaacauc

SEQ ID NO: 1000657 - RNA, 20 nt, Human
uaagaaaaacuaaagauaaa

SEQ ID NO: 1000658 - RNA, 24 nt, Human
uaaggcauugcuuuguuuacaguu

SEQ ID NO: 1000659 - RNA, 21 nt, Human
uaauucuuugacauaagaaca

SEQ ID NO: 1000660 - RNA, 18 nt, Human
uacaguuuguggucuuaa

SEQ ID NO: 1000661 - RNA, 19 nt, Human
uacauaaaguaaaagacag

SEQ ID NO: 1000662 - RNA, 21 nt, Human
uaccagccugaguaacagauu

SEQ ID NO: 1000663 - RNA, 20 nt, Human
uagcagcuuuauugcauaau

SEQ ID NO: 1000664 - RNA, 19 nt, Human
uauuaccaaugagaaacag

SEQ ID NO: 1000665 - RNA, 18 nt, Human
ucaaacagaagagaauca

SEQ ID NO: 1000666 - RNA, 21 nt, Human
ucuccaugauauuugcuacuu

SEQ ID NO: 1000667 - RNA, 18 nt, Human
ucuguauuucaagaagaa

SEQ ID NO: 1000668 - RNA, 24 nt, Human
ugaaagcaacaccuuucaaaaaca

SEQ ID NO: 1000669 - RNA, 25 nt, Human
ugacauaagaacaaauauuuucaca

SEQ ID NO: 1000670 - RNA, 21 nt, Human
ugacuuuagcagcuuuauugc

SEQ ID NO: 1000671 - RNA, 18 nt, Human
ugcaaaguuaaccacuuc

SEQ ID NO: 1000672 - RNA, 24 nt, Human
ugcaagaaaccaugcuuacuaccc

SEQ ID NO: 1000673 - RNA, 21 nt, Human
ugcuuuguuuacaguuuuuau

SEQ ID NO: 1000674 - RNA, 18 nt, Human
uggaaagaacaucuucac

SEQ ID NO: 1000675 - RNA, 27 nt, Human
ugggccaaaaaugaaaaucacaaaaca

SEQ ID NO: 1000676 - RNA, 18 nt, Human
uggucuuaacaaaacaaa

SEQ ID NO: 1000677 - RNA, 18 nt, Human
uguaucccccccaccaua

SEQ ID NO: 1000678 - RNA, 25 nt, Human
ugucuacaugauaugugcuuguaca

SEQ ID NO: 1000679 - RNA, 20 nt, Human
ugugaaaggcagaacaacga

SEQ ID NO: 1000680 - RNA, 21 nt, Human
uguguuuucugcaagaaacca

SEQ ID NO: 1000681 - RNA, 25 nt, Human
uuaaaaauauaacaacaaggacaac

SEQ ID NO: 1000682 - RNA, 23 nt, Human
uuaaccucaaaaaaauaaguacu

SEQ ID NO: 1000683 - RNA, 24 nt, Human
uuaaccucaaaaaaauaaguacuu

SEQ ID NO: 1000684 - RNA, 18 nt, Human
uuagauuuucuguauuuc

SEQ ID NO: 1000685 - RNA, 19 nt, Human
uuaggacauaaacaugaua

SEQ ID NO: 1000686 - RNA, 18 nt, Human
uugccgagcuccccgccc

SEQ ID NO: 1000687 - RNA, 20 nt, Human
uuugccgagcuccccgccca

SEQ ID NO: 1000688 - RNA, 20 nt, Human
aaacaaacuaggagaacgca

SEQ ID NO: 1000689 - RNA, 25 nt, Human
aaaugacagcgaagaaaacagaccu

SEQ ID NO: 1000690 - RNA, 19 nt, Human
aaauggcagcaaacaaacu

SEQ ID NO: 1000691 - RNA, 18 nt, Human
aagaaaacagaccaaacg

SEQ ID NO: 1000692 - RNA, 24 nt, Human
aagcaauucuccugccuuggccuc

SEQ ID NO: 1000693 - RNA, 22 nt, Human
aaggaaaugacagcgaagaaaa

SEQ ID NO: 1000694 - RNA, 24 nt, Human
aagugauccaccugccucagccuc

SEQ ID NO: 1000695 - RNA, 21 nt, Human
aauucccuuuucauuugaagc

SEQ ID NO: 1000696 - RNA, 24 nt, Human
acagcgaagaaaacagaccaaaag

SEQ ID NO: 1000697 - RNA, 23 nt, Human
acaggccccuaccaccaugcccg

SEQ ID NO: 1000698 - RNA, 18 nt, Human
acaggguuucaccauguu

SEQ ID NO: 1000699 - RNA, 21 nt, Human
acaggguuucaccauguuggc

SEQ ID NO: 1000700 - RNA, 24 nt, Human
acaggguuucaccauguuggccag

SEQ ID NO: 1000701 - RNA, 24 nt, Human
acauaguucugggauuacaggcgu

SEQ ID NO: 1000702 - RNA, 20 nt, Human
accauguuggccaggcuggu

SEQ ID NO: 1000703 - RNA, 23 nt, Human
agacagcaacauacgaucaucac

SEQ ID NO: 1000704 - RNA, 22 nt, Human
agcccugacccauuaaagacgg

SEQ ID NO: 1000705 - RNA, 22 nt, Human
aggcacagcaugaucuuggcuu

SEQ ID NO: 1000706 - RNA, 22 nt, Human
aguagagacaggguuucaccau

SEQ ID NO: 1000707 - RNA, 22 nt, Human
aguucugggauuacaggcguga

SEQ ID NO: 1000708 - RNA, 24 nt, Human
auaguucugggauuacaggcguga

SEQ ID NO: 1000709 - RNA, 22 nt, Human
augaaguuaaggucuauuugcu

SEQ ID NO: 1000710 - RNA, 24 nt, Human
auggaggcccagccaugccucuga

SEQ ID NO: 1000711 - RNA, 18 nt, Human
caacagccauuucagcaa

SEQ ID NO: 1000712 - RNA, 26 nt, Human
caacauaaaucaauuauauauccacu

SEQ ID NO: 1000713 - RNA, 22 nt, Human
caagcaauucuccugccuuggc

SEQ ID NO: 1000714 - RNA, 22 nt, Human
caagugauccaccugccucagc

SEQ ID NO: 1000715 - RNA, 23 nt, Human
cacauaguucugggauuacaggc

SEQ ID NO: 1000716 - RNA, 24 nt, Human
caccaugcccggcuaauuuuugua

SEQ ID NO: 1000717 - RNA, 18 nt, Human
caccauguuggccaggcu

SEQ ID NO: 1000718 - RNA, 21 nt, Human
caccauguuggccaggcuggu

SEQ ID NO: 1000719 - RNA, 21 nt, Human
caccauguuggccaggcuggu

SEQ ID NO: 1000720 - RNA, 31 nt, Human
caccauguuggccaggcugguguugaacucc

SEQ ID NO: 1000721 - RNA, 22 nt, Human
cacgaguagcuggguuacaggc

SEQ ID NO: 1000722 - RNA, 19 nt, Human
cagaacugaaucccccauc

SEQ ID NO: 1000723 - RNA, 19 nt, Human
cagcugcugcaggcucaag

SEQ ID NO: 1000724 - RNA, 24 nt, Human
caggguuucaccauguuggccagg

SEQ ID NO: 1000725 - RNA, 19 nt, Human
caguccagguuaaccaucu

SEQ ID NO: 1000726 - RNA, 21 nt, Human
cauaguucugggauuacaggc

SEQ ID NO: 1000727 - RNA, 24 nt, Human
cauguuggccaggcugguguugaa

SEQ ID NO: 1000728 - RNA, 23 nt, Human
ccaacagccauuucagcaauaac

SEQ ID NO: 1000729 - RNA, 19 nt, Human
ccaccugccucagccucac

SEQ ID NO: 1000730 - RNA, 23 nt, Human
ccaucugugguauuuuuaguugc

SEQ ID NO: 1000731 - RNA, 23 nt, Human
ccaugccucugacaucuagacac

SEQ ID NO: 1000732 - RNA, 18 nt, Human
cccaucaaaguucaauuu

SEQ ID NO: 1000733 - RNA, 21 nt, Human
ccugaccucaagugauccacc

SEQ ID NO: 1000734 - RNA, 23 nt, Human
ccugaccucaagugauccaccug

SEQ ID NO: 1000735 - RNA, 23 nt, Human
ccugaccucaagugauccaccug

SEQ ID NO: 1000736 - RNA, 23 nt, Human
ccugccuuggccucacgaguagc

SEQ ID NO: 1000737 - RNA, 24 nt, Human
ccugccuuggccucacgaguagcu

SEQ ID NO: 1000738 - RNA, 23 nt, Human
cgugagccaccaugccuggccau

SEQ ID NO: 1000739 - RNA, 27 nt, Human
cuacccuucacuuacuacuuacaaccc

SEQ ID NO: 1000740 - RNA, 26 nt, Human
cucaagcaauucuccugccuuggccu

SEQ ID NO: 1000741 - RNA, 23 nt, Human
cucaagugauccaccugccucag

SEQ ID NO: 1000742 - RNA, 22 nt, Human
cugacccuggggaacaugggca

SEQ ID NO: 1000743 - RNA, 18 nt, Human
cugcagcugcugcaggcu

SEQ ID NO: 1000744 - RNA, 20 nt, Human
cugccucagccucacauagu

SEQ ID NO: 1000745 - RNA, 25 nt, Human
cuggaaaauaccaaauucuuuucca

SEQ ID NO: 1000746 - RNA, 18 nt, Human
cuuagauuauuaaacaac

SEQ ID NO: 1000747 - RNA, 21 nt, Human
cuucucucacacuuugcuugg

SEQ ID NO: 1000748 - RNA, 19 nt, Human
gaacucaguaagucuggua

SEQ ID NO: 1000749 - RNA, 24 nt, Human
gaccucaagugauccaccugccuc

SEQ ID NO: 1000750 - RNA, 21 nt, Human
gacuucaacaaauaucaguaa

SEQ ID NO: 1000751 - RNA, 18 nt, Human
gauuacaggcgugagcca

SEQ ID NO: 1000752 - RNA, 21 nt, Human
gauuacaggcgugagccacca

SEQ ID NO: 1000753 - RNA, 24 nt, Human
gauuacaggcgugagccaccaugc

SEQ ID NO: 1000754 - RNA, 22 nt, Human
gcagcugcugcaggcucaagca

SEQ ID NO: 1000755 - RNA, 22 nt, Human
gcccggcuaauuuuuguauuuu

SEQ ID NO: 1000756 - RNA, 24 nt, Human
gcugcaggcucaagcaauucuccu

SEQ ID NO: 1000757 - RNA, 23 nt, Human
gcugguguugaacuccugaccuc

SEQ ID NO: 1000758 - RNA, 24 nt, Human
ggauuacaggcgugagccaccaug

SEQ ID NO: 1000759 - RNA, 18 nt, Human
ggauuuauauuauuuucu

SEQ ID NO: 1000760 - RNA, 19 nt, Human
ggccaggcugguguugaac

SEQ ID NO: 1000761 - RNA, 24 nt, Human
ggcugguguugaacuccugaccuc

SEQ ID NO: 1000762 - RNA, 18 nt, Human
ggggaacaugggcaauag

SEQ ID NO: 1000763 - RNA, 22 nt, Human
ggguuucaccauguuggccagg

SEQ ID NO: 1000764 - RNA, 18 nt, Human
gugauccaccugccucag

SEQ ID NO: 1000765 - RNA, 22 nt, Human
gugauccaccugccucagccuc

SEQ ID NO: 1000766 - RNA, 19 nt, Human
uaaacaacaugucaguggu

SEQ ID NO: 1000767 - RNA, 18 nt, Human
uaaagacggauggagaca

SEQ ID NO: 1000768 - RNA, 24 nt, Human
uaauuuuuguauuuuuaguagaga

SEQ ID NO: 1000769 - RNA, 23 nt, Human
uacaacccagccucuaucaucau

SEQ ID NO: 1000770 - RNA, 24 nt, Human
uacaacccagccucuaucaucaua

SEQ ID NO: 1000771 - RNA, 22 nt, Human
uacaggcgugagccaccaugcc

SEQ ID NO: 1000772 - RNA, 22 nt, Human
uacaggcgugagccaccaugcc

SEQ ID NO: 1000773 - RNA, 23 nt, Human
uacaggcgugagccaccaugccu

SEQ ID NO: 1000774 - RNA, 22 nt, Human
uaccaccaugcccggcuaauuu

SEQ ID NO: 1000775 - RNA, 22 nt, Human
uagagacaggguuucaccaugu

SEQ ID NO: 1000776 - RNA, 24 nt, Human
uaguagagacaggguuucaccaug

SEQ ID NO: 1000777 - RNA, 26 nt, Human
uaguagagacaggguuucaccauguu

SEQ ID NO: 1000778 - RNA, 26 nt, Human
uaucucccuuaggcagagauggaggc

SEQ ID NO: 1000779 - RNA, 18 nt, Human
ucaaaguucaauuuuacu

SEQ ID NO: 1000780 - RNA, 22 nt, Human
ucaagugauccaccugccucag

SEQ ID NO: 1000781 - RNA, 18 nt, Human
ucacacuuugcuuggcug

SEQ ID NO: 1000782 - RNA, 24 nt, Human
ucacauaguucugggauuacaggc

SEQ ID NO: 1000783 - RNA, 22 nt, Human
ucaccugaagacccuuggaaau

SEQ ID NO: 1000784 - RNA, 23 nt, Human
ucacgaguagcuggguuacaggc

SEQ ID NO: 1000785 - RNA, 24 nt, Human
ucugcuacccuucacuuacuacuu

SEQ ID NO: 1000786 - RNA, 23 nt, Human
ucuguuuuguuuuguuuuaaaug

SEQ ID NO: 1000787 - RNA, 19 nt, Human
ucuuuuccagaacugaauc

SEQ ID NO: 1000788 - RNA, 24 nt, Human
ugaccucaagugauccaccugccu

SEQ ID NO: 1000789 - RNA, 18 nt, Human
ugacuuguggguaccccu

SEQ ID NO: 1000790 - RNA, 19 nt, Human
ugccaacagccauuucagc

SEQ ID NO: 1000791 - RNA, 24 nt, Human
ugcccggcuaauuuuuguauuuuu

SEQ ID NO: 1000792 - RNA, 21 nt, Human
ugccucagccucacauaguuc

SEQ ID NO: 1000793 - RNA, 24 nt, Human
ugccucagccucacauaguucugg

SEQ ID NO: 1000794 - RNA, 21 nt, Human
ugcuucauuucuccuauucuc

SEQ ID NO: 1000795 - RNA, 23 nt, Human
uggaaaauaccaaauucuuuucc

SEQ ID NO: 1000796 - RNA, 22 nt, Human
uggaaaucaaagcccugaccca

SEQ ID NO: 1000797 - RNA, 23 nt, Human
uggaggcccagccaugccucuga

SEQ ID NO: 1000798 - RNA, 24 nt, Human
uggccaggcugguguugaacuccu

SEQ ID NO: 1000799 - RNA, 18 nt, Human
ugggauuacaggcgugag

SEQ ID NO: 1000800 - RNA, 22 nt, Human
ugggauuacaggcgugagccac

SEQ ID NO: 1000801 - RNA, 23 nt, Human
ugggauuacaggcgugagccacc

SEQ ID NO: 1000802 - RNA, 24 nt, Human
ugggauuacaggcgugagccacca

SEQ ID NO: 1000803 - RNA, 25 nt, Human
ugggauuacaggcgugagccaccau

SEQ ID NO: 1000804 - RNA, 20 nt, Human
uggguuacaggccccuacca

SEQ ID NO: 1000805 - RNA, 23 nt, Human
uggguuacaggccccuaccacca

SEQ ID NO: 1000806 - RNA, 24 nt, Human
uggguuacaggccccuaccaccau

SEQ ID NO: 1000807 - RNA, 19 nt, Human
ugugcugguuaaaccaagg

SEQ ID NO: 1000808 - RNA, 21 nt, Human
uguuuuguuuuguuuuaaaug

SEQ ID NO: 1000809 - RNA, 20 nt, Human
uuaacccuucucucacacuu

SEQ ID NO: 1000810 - RNA, 20 nt, Human
uuacaggccccuaccaccau

SEQ ID NO: 1000811 - RNA, 18 nt, Human
uuacugcagcugcugcag

SEQ ID NO: 1000812 - RNA, 22 nt, Human
uuacugcagcugcugcaggcuc

SEQ ID NO: 1000813 - RNA, 22 nt, Human
uuagauuauuaaacaacauguc

SEQ ID NO: 1000814 - RNA, 24 nt, Human
uuaguagagacaggguuucaccau

SEQ ID NO: 1000815 - RNA, 22 nt, Human
uucaaaaugaaguuaaggucua

SEQ ID NO: 1000816 - RNA, 23 nt, Human
uucaacauaaaucaauuauauau

SEQ ID NO: 1000817 - RNA, 24 nt, Human
uucagcaauaacuauuuacugaga

SEQ ID NO: 1000818 - RNA, 20 nt, Human
uugcucuucucugaaucaua

SEQ ID NO: 1000819 - RNA, 22 nt, Human
uugguccuagcagacuggaaaa

SEQ ID NO: 1000820 - RNA, 24 nt, Human
uuucaccauguuggccaggcuggu

SEQ ID NO: 1000821 - RNA, 24 nt, Human
uuugaagcaucucauuguaagcca

SEQ ID NO: 1000822 - RNA, 22 nt, Human
uuuuguauuuuuaguagagaca

SEQ ID NO: 1000823 - RNA, 24 nt, Human
uuuuuaguagagacaggguuucac

SEQ ID NO: 1000824 - RNA, 20 nt, Human
uuuuuguauuuuuaguagag

SEQ ID NO: 1000825 - RNA, 19 nt, Human
aaaaagauucuaugccuuu

SEQ ID NO: 1000826 - RNA, 22 nt, Human
aaaccaaacaucacauguucuc

SEQ ID NO: 1000827 - RNA, 22 nt, Human
aaaccaacacaugaacagaaaa

SEQ ID NO: 1000828 - RNA, 23 nt, Human
aaaccugcacguguuccccuuaa

SEQ ID NO: 1000829 - RNA, 25 nt, Human
aaauacaacuaaaauugucuuauac

SEQ ID NO: 1000830 - RNA, 20 nt, Human
aacaagcguucaacauucuc

SEQ ID NO: 1000831 - RNA, 22 nt, Human
aacauucucaugaugacaugaa

SEQ ID NO: 1000832 - RNA, 21 nt, Human
aaccuaaaugcccaucaacag

SEQ ID NO: 1000833 - RNA, 18 nt, Human
aaccugcacguguucccc

SEQ ID NO: 1000834 - RNA, 19 nt, Human
aagagggcccagggaugug

SEQ ID NO: 1000835 - RNA, 25 nt, Human
aaguaacaaaaucaaaaccugaaac

SEQ ID NO: 1000836 - RNA, 21 nt, Human
acaaaaaagggaacaacagac

SEQ ID NO: 1000837 - RNA, 23 nt, Human
acaaaaaagggaacaacagacac

SEQ ID NO: 1000838 - RNA, 24 nt, Human
acaaagaucaacauccaauaaaug

SEQ ID NO: 1000839 - RNA, 21 nt, Human
accgccucacguaaaagggua

SEQ ID NO: 1000840 - RNA, 23 nt, Human
acuauccaguaacugccacaauc

SEQ ID NO: 1000841 - RNA, 19 nt, Human
acuaugcuuauuaccuggg

SEQ ID NO: 1000842 - RNA, 23 nt, Human
agaaaagcaaucauuaucuuaaa

SEQ ID NO: 1000843 - RNA, 18 nt, Human
agaagauggaccauccag

SEQ ID NO: 1000844 - RNA, 21 nt, Human
agacggaguccgacgugaggc

SEQ ID NO: 1000845 - RNA, 21 nt, Human
agaggccagcaagcugcgagc

SEQ ID NO: 1000846 - RNA, 18 nt, Human
agaggguggaggagggug

SEQ ID NO: 1000847 - RNA, 21 nt, Human
agaguuaugguugggaagaga

SEQ ID NO: 1000848 - RNA, 19 nt, Human
aggcgcgggagaggccagc

SEQ ID NO: 1000849 - RNA, 23 nt, Human
agggcagaagagggcccagggau

SEQ ID NO: 1000850 - RNA, 20 nt, Human
aggguggaggaggguggggu

SEQ ID NO: 1000851 - RNA, 19 nt, Human
auaaagaaaacauaguaca

SEQ ID NO: 1000852 - RNA, 24 nt, Human
auauacaccauggaauacuaugca

SEQ ID NO: 1000853 - RNA, 19 nt, Human
auggacacaaaaaagggaa

SEQ ID NO: 1000854 - RNA, 21 nt, Human
auuaccuggguaaugaaauaa

SEQ ID NO: 1000855 - RNA, 23 nt, Human
auuuuaaucccaacacugccauu

SEQ ID NO: 1000856 - RNA, 21 nt, Human
caaaaccugaaacaaagauca

SEQ ID NO: 1000857 - RNA, 23 nt, Human
caacacaugaacagaaaaccaaa

SEQ ID NO: 1000858 - RNA, 18 nt, Human
caacauaggcagagugag

SEQ ID NO: 1000859 - RNA, 24 nt, Human
caacauggauggagcuggaggcca

SEQ ID NO: 1000860 - RNA, 21 nt, Human
caaccuaaaugcccaucaaca

SEQ ID NO: 1000861 - RNA, 24 nt, Human
caauagcaaagacauggaauccua

SEQ ID NO: 1000862 - RNA, 22 nt, Human
cacacaaagggcagauaccaaa

SEQ ID NO: 1000863 - RNA, 25 nt, Human
cagaagagggcccagggaugugugu

SEQ ID NO: 1000864 - RNA, 18 nt, Human
caggcugcaaguaaccaa

SEQ ID NO: 1000865 - RNA, 22 nt, Human
ccaaaccccugugacauguaau

SEQ ID NO: 1000866 - RNA, 22 nt, Human
ccgccgucaccgccucacguaa

SEQ ID NO: 1000867 - RNA, 20 nt, Human
ccuauacugcgggauguuca

SEQ ID NO: 1000868 - RNA, 25 nt, Human
ccugccgcggagacggagucccccg

SEQ ID NO: 1000869 - RNA, 22 nt, Human
cgggauguucacacuacguccc

SEQ ID NO: 1000870 - RNA, 18 nt, Human
gagcggccgcggggaggc

SEQ ID NO: 1000871 - RNA, 25 nt, Human
gaggguagaggguggaggagggugg

SEQ ID NO: 1000872 - RNA, 22 nt, Human
gaguacccauggacacaaaaaa

SEQ ID NO: 1000873 - RNA, 23 nt, Human
gcacacaaagggcagauaccaaa

SEQ ID NO: 1000874 - RNA, 19 nt, Human
ggaaggaguuuuggucagg

SEQ ID NO: 1000875 - RNA, 20 nt, Human
ggagaggccagcaagcugcg

SEQ ID NO: 1000876 - RNA, 21 nt, Human
ggauucccacaauuuucuaag

SEQ ID NO: 1000877 - RNA, 20 nt, Human
ggccgcggggaggccagacg

SEQ ID NO: 1000878 - RNA, 20 nt, Human
guccgacgugaggcgcggga

SEQ ID NO: 1000879 - RNA, 22 nt, Human
uaaaaaaguaacaaaaucaaaa

SEQ ID NO: 1000880 - RNA, 24 nt, Human
uaaaaauaacuauccaguaacugc

SEQ ID NO: 1000881 - RNA, 24 nt, Human
uaaacuaaaauauaaguuaaaaua

SEQ ID NO: 1000882 - RNA, 19 nt, Human
uaaagggagaguagauaag

SEQ ID NO: 1000883 - RNA, 24 nt, Human
uaaaucacugccugaaagucuuuu

SEQ ID NO: 1000884 - RNA, 21 nt, Human
uaacaagcguucaacauucuc

SEQ ID NO: 1000885 - RNA, 24 nt, Human
uaacacuguacauacaacauacca

SEQ ID NO: 1000886 - RNA, 28 nt, Human
uaacugccacaaucuccugaguccagac

SEQ ID NO: 1000887 - RNA, 22 nt, Human
uacaauaaguacacaugacuua

SEQ ID NO: 1000888 - RNA, 23 nt, Human
uacacaguauaaaaaaguaacaa

SEQ ID NO: 1000889 - RNA, 28 nt, Human
uagacugaggaaaauauacacaguauaa

SEQ ID NO: 1000890 - RNA, 23 nt, Human
ucacaaaagugacuuaagccuau

SEQ ID NO: 1000891 - RNA, 26 nt, Human
ucacugaguugugaugagagucauau

SEQ ID NO: 1000892 - RNA, 19 nt, Human
ucaggcugcaaguaaccaa

SEQ ID NO: 1000893 - RNA, 18 nt, Human
uccucguuaaaucacugc

SEQ ID NO: 1000894 - RNA, 24 nt, Human
ugaaauaauauguacaccaaaccc

SEQ ID NO: 1000895 - RNA, 22 nt, Human
ugaacagaaaaccaaacaucac

SEQ ID NO: 1000896 - RNA, 21 nt, Human
ugacuuaagccuauacugcgg

SEQ ID NO: 1000897 - RNA, 18 nt, Human
ugagagucauaugcaaca

SEQ ID NO: 1000898 - RNA, 19 nt, Human
ugagagucauaugcaacag

SEQ ID NO: 1000899 - RNA, 20 nt, Human
ugaggaaaauauacacagua

SEQ ID NO: 1000900 - RNA, 18 nt, Human
ugaggcgcgggagaggcc

SEQ ID NO: 1000901 - RNA, 20 nt, Human
ugaggggggauucccacaau

SEQ ID NO: 1000902 - RNA, 19 nt, Human
ugaggguagaggguggagg

SEQ ID NO: 1000903 - RNA, 19 nt, Human
ugaucuauagaacaaaccu

SEQ ID NO: 1000904 - RNA, 18 nt, Human
ugaugacaugaauaacac

SEQ ID NO: 1000905 - RNA, 24 nt, Human
ugcagccauaaaaaaagaaugaga

SEQ ID NO: 1000906 - RNA, 18 nt, Human
uggaaagaauaggcaaug

SEQ ID NO: 1000907 - RNA, 20 nt, Human
uggaauacuaugcagccaua

SEQ ID NO: 1000908 - RNA, 20 nt, Human
uggaaucaaccuaaaugccc

SEQ ID NO: 1000909 - RNA, 20 nt, Human
uggauaaagaaaacauagua

SEQ ID NO: 1000910 - RNA, 18 nt, Human
uggauggagcuggaggcc

SEQ ID NO: 1000911 - RNA, 18 nt, Human
ugugaagcacacaaaggg

SEQ ID NO: 1000912 - RNA, 18 nt, Human
uguuucuucuaccuuucc

SEQ ID NO: 1000913 - RNA, 23 nt, Human
uuaagccuauacugcgggauguu

SEQ ID NO: 1000914 - RNA, 23 nt, Human
uuacuggaaagaauaggcaaugc

SEQ ID NO: 1000915 - RNA, 31 nt, Human
uuagugcaguuacgguacuucaggcugcaaa

SEQ ID NO: 1000916 - RNA, 18 nt, Human
uucacaauagcaaagaca

SEQ ID NO: 1000917 - RNA, 23 nt, Human
uuccccgcacaucucuuuaaaag

SEQ ID NO: 1000918 - RNA, 20 nt, Human
uuccgaaccgccgucaccgc

SEQ ID NO: 1000919 - RNA, 21 nt, Human
uuccugucccaucuccauugg

SEQ ID NO: 1000920 - RNA, 18 nt, Human
uugaucuauagaacaaac

SEQ ID NO: 1000921 - RNA, 25 nt, Human
uuggaaaauuuccugucccaucucc

SEQ ID NO: 1000922 - RNA, 26 nt, Human
uuggaaaauuuccugucccaucucca

SEQ ID NO: 1000923 - RNA, 18 nt, Human
uugugaagcacacaaagg

SEQ ID NO: 1000924 - RNA, 19 nt, Human
uuuuuuuuuuuuuuuugca

SEQ ID NO: 1000925 - RNA, 18 nt, Human
uuuuuuuuuuuuuuuuug

SEQ ID NO: 1000926 - RNA, 23 nt, Human
acccagugggggccuggacaggu

SEQ ID NO: 1000927 - RNA, 20 nt, Human
auucacugacuccuuucucc

SEQ ID NO: 1000928 - RNA, 22 nt, Human
auucacugacuccuuucuccaa

SEQ ID NO: 1000929 - RNA, 19 nt, Human
cugagggggcugaagaagc

SEQ ID NO: 1000930 - RNA, 23 nt, Human
gagaggaggcugaggugagccug

SEQ ID NO: 1000931 - RNA, 21 nt, Human
gaggugucccagggaugaaca

SEQ ID NO: 1000932 - RNA, 24 nt, Human
gggggcugaagaagcaauucacug

SEQ ID NO: 1000933 - RNA, 20 nt, Human
ggguagacccagugggggcc

SEQ ID NO: 1000934 - RNA, 19 nt, Human
ugagggggcugaagaagca

SEQ ID NO: 1000935 - RNA, 20 nt, Human
ugaggugucccagggaugaa

SEQ ID NO: 1000936 - RNA, 24 nt, Human
uggguagacccagugggggccugg

SEQ ID NO: 1000937 - RNA, 19 nt, Human
uuccuacccugucagccuc

SEQ ID NO: 1000938 - RNA, 21 nt, Human
uuggaggaaggagagagagga

SEQ ID NO: 1000939 - RNA, 21 nt, Human
uuggaggaaggagagagagga

SEQ ID NO: 1000940 - RNA, 25 nt, Human
aaaaaaaaaagaaaaaagaaaagaa

SEQ ID NO: 1000941 - RNA, 21 nt, Human
aaaaaagaaaaaagaaaagaa

SEQ ID NO: 1000942 - RNA, 18 nt, Human
aaaaaagaaaagaaaagg

SEQ ID NO: 1000943 - RNA, 18 nt, Human
aaaacugggaggaaccuu

SEQ ID NO: 1000944 - RNA, 23 nt, Human
aaaagaaaaggaaauaagcacag

SEQ ID NO: 1000945 - RNA, 19 nt, Human
aaaaugaugcaaaugaguu

SEQ ID NO: 1000946 - RNA, 25 nt, Human
aaauagaaagaagggagacagcaag

SEQ ID NO: 1000947 - RNA, 20 nt, Human
aacauggggaaaccccgucu

SEQ ID NO: 1000948 - RNA, 20 nt, Human
aacauggggaaaccccgucu

SEQ ID NO: 1000949 - RNA, 21 nt, Human
aacauggggaaaccccgucuc

SEQ ID NO: 1000950 - RNA, 21 nt, Human
aacauggggaaaccccgucuc

SEQ ID NO: 1000951 - RNA, 20 nt, Human
aagaaaaggaaauaagcaca

SEQ ID NO: 1000952 - RNA, 22 nt, Human
aagggcaucgaggguaaacuga

SEQ ID NO: 1000953 - RNA, 24 nt, Human
aauugcuugaaucugagaggugga

SEQ ID NO: 1000954 - RNA, 24 nt, Human
accccgucucuacugaaaauacaa

SEQ ID NO: 1000955 - RNA, 24 nt, Human
accccgucucuacugaaaauacaa

SEQ ID NO: 1000956 - RNA, 18 nt, Human
accuggacaagaggugcu

SEQ ID NO: 1000957 - RNA, 23 nt, Human
acugaaaauacaaauuuagccag

SEQ ID NO: 1000958 - RNA, 23 nt, Human
acugaaaauacaaauuuagccag

SEQ ID NO: 1000959 - RNA, 28 nt, Human
acuucaucucaaaaaaaaaaaaaaagaa

SEQ ID NO: 1000960 - RNA, 21 nt, Human
agaaaaaagaaaagaaaagga

SEQ ID NO: 1000961 - RNA, 22 nt, Human
agaaaaauuaacaggucagcua

SEQ ID NO: 1000962 - RNA, 24 nt, Human
agcacuuugggaggccgaggcggg

SEQ ID NO: 1000963 - RNA, 24 nt, Human
agcacuuugggaggccgaggcggg

SEQ ID NO: 1000964 - RNA, 19 nt, Human
agccagggguggugguggg

SEQ ID NO: 1000965 - RNA, 19 nt, Human
agccagggguggugguggg

SEQ ID NO: 1000966 - RNA, 20 nt, Human
agccaggggugguggugggc

SEQ ID NO: 1000967 - RNA, 24 nt, Human
aggaugccaguacaauaauugaaa

SEQ ID NO: 1000968 - RNA, 20 nt, Human
aggcaggagaauugcuugaa

SEQ ID NO: 1000969 - RNA, 24 nt, Human
aggcaggagaauugcuugaaucug

SEQ ID NO: 1000970 - RNA, 21 nt, Human
aggccgaggcggguggaucac

SEQ ID NO: 1000971 - RNA, 21 nt, Human
aggccgaggcggguggaucac

SEQ ID NO: 1000972 - RNA, 22 nt, Human
aggcggguggaucaccugaggu

SEQ ID NO: 1000973 - RNA, 22 nt, Human
aggcggguggaucaccugaggu

SEQ ID NO: 1000974 - RNA, 26 nt, Human
aggcggguggaucaccugaggucaga

SEQ ID NO: 1000975 - RNA, 26 nt, Human
aggcggguggaucaccugaggucaga

SEQ ID NO: 1000976 - RNA, 21 nt, Human
aggcugaggcaggagaauugc

SEQ ID NO: 1000977 - RNA, 24 nt, Human
aggcugaggcaggagaauugcuug

SEQ ID NO: 1000978 - RNA, 19 nt, Human
agggagacagcaaggaaaa

SEQ ID NO: 1000979 - RNA, 24 nt, Human
aggggugguggugggcaccuguaa

SEQ ID NO: 1000980 - RNA, 24 nt, Human
aggggugguggugggcaccuguaa

SEQ ID NO: 1000981 - RNA, 24 nt, Human
agguggagguugcagugaaccgag

SEQ ID NO: 1000982 - RNA, 19 nt, Human
aguacaauaauugaaauuc

SEQ ID NO: 1000983 - RNA, 19 nt, Human
auccucuagauacaaaacc

SEQ ID NO: 1000984 - RNA, 24 nt, Human
aucgugccauugcacuccagccug

SEQ ID NO: 1000985 - RNA, 21 nt, Human
aucucaaaaaaaaaaaaaaag

SEQ ID NO: 1000986 - RNA, 20 nt, Human
auguuucccugaugugauac

SEQ ID NO: 1000987 - RNA, 18 nt, Human
auucacucaccaauccac

SEQ ID NO: 1000988 - RNA, 24 nt, Human
auucuggggagaagagugaagaca

SEQ ID NO: 1000989 - RNA, 18 nt, Human
auugcacuccagccuggg

SEQ ID NO: 1000990 - RNA, 24 nt, Human
caacauggggaaaccccgucucua

SEQ ID NO: 1000991 - RNA, 24 nt, Human
caacauggggaaaccccgucucua

SEQ ID NO: 1000992 - RNA, 24 nt, Human
caagagcaaaacuucaucucaaaa

SEQ ID NO: 1000993 - RNA, 24 nt, Human
caauaauugaaauucacaaauguc

SEQ ID NO: 1000994 - RNA, 21 nt, Human
cacaaaaucacucaauacacc

SEQ ID NO: 1000995 - RNA, 21 nt, Human
cacaaauaagggcaucgaggg

SEQ ID NO: 1000996 - RNA, 19 nt, Human
cacaaggcaauuauuacau

SEQ ID NO: 1000997 - RNA, 21 nt, Human
caccaauccacgggccugauc

SEQ ID NO: 1000998 - RNA, 25 nt, Human
caccaauccacgggccugaucugca

SEQ ID NO: 1000999 - RNA, 26 nt, Human
caccuggacaagaggugcuguacaga

SEQ ID NO: 1001000 - RNA, 23 nt, Human
caccuguaaucccagcuacuugg

SEQ ID NO: 1001001 - RNA, 24 nt, Human
caccuguaaucccagcuacuuggg

SEQ ID NO: 1001002 - RNA, 24 nt, Human
cacgccuguaaucccagcacuuug

SEQ ID NO: 1001003 - RNA, 24 nt, Human
cacgccuguaaucccagcacuuug

SEQ ID NO: 1001004 - RNA, 24 nt, Human
cacuccagccuggggaacaagagc

SEQ ID NO: 1001005 - RNA, 20 nt, Human
cagaaggggcugagugugua

SEQ ID NO: 1001006 - RNA, 21 nt, Human
cagaucccaagguaaauacag

SEQ ID NO: 1001007 - RNA, 22 nt, Human
cagcacuuugggaggccgaggc

SEQ ID NO: 1001008 - RNA, 24 nt, Human
cagcacuuugggaggccgaggcgg

SEQ ID NO: 1001009 - RNA, 24 nt, Human
cagcacuuugggaggccgaggcgg

SEQ ID NO: 1001010 - RNA, 24 nt, Human
cagcuacuugggaggcugaggcag

SEQ ID NO: 1001011 - RNA, 18 nt, Human
caggauccaagcaguuuc

SEQ ID NO: 1001012 - RNA, 18 nt, Human
caggggugguggugggca

SEQ ID NO: 1001013 - RNA, 18 nt, Human
caggggugguggugggca

SEQ ID NO: 1001014 - RNA, 18 nt, Human
cauugcacuccagccugg

SEQ ID NO: 1001015 - RNA, 19 nt, Human
cauugcacuccagccuggg

SEQ ID NO: 1001016 - RNA, 22 nt, Human
cauugcacuccagccuggggaa

SEQ ID NO: 1001017 - RNA, 23 nt, Human
cauugcacuccagccuggggaac

SEQ ID NO: 1001018 - RNA, 24 nt, Human
cauugcacuccagccuggggaaca

SEQ ID NO: 1001019 - RNA, 21 nt, Human
ccaaagacuuccuacuucugc

SEQ ID NO: 1001020 - RNA, 24 nt, Human
ccacaaaaucacucaauacaccuu

SEQ ID NO: 1001021 - RNA, 19 nt, Human
ccauugcacuccagccugg

SEQ ID NO: 1001022 - RNA, 20 nt, Human
ccauugcacuccagccuggg

SEQ ID NO: 1001023 - RNA, 21 nt, Human
ccauugcacuccagccugggg

SEQ ID NO: 1001024 - RNA, 24 nt, Human
ccauugcacuccagccuggggaac

SEQ ID NO: 1001025 - RNA, 22 nt, Human
cccaaagacuuccuacuucugc

SEQ ID NO: 1001026 - RNA, 24 nt, Human
cccaaagacuuccuacuucugccc

SEQ ID NO: 1001027 - RNA, 22 nt, Human
cccaggauccaagcaguuuucu

SEQ ID NO: 1001028 - RNA, 24 nt, Human
cccaggauccaagcaguuuucuug

SEQ ID NO: 1001029 - RNA, 21 nt, Human
ccuguaaucccagcuacuugg

SEQ ID NO: 1001030 - RNA, 20 nt, Human
cgaggcggguggaucaccug

SEQ ID NO: 1001031 - RNA, 20 nt, Human
cgaggcggguggaucaccug

SEQ ID NO: 1001032 - RNA, 24 nt, Human
cgaggcggguggaucaccugaggu

SEQ ID NO: 1001033 - RNA, 24 nt, Human
cgaggcggguggaucaccugaggu

SEQ ID NO: 1001034 - RNA, 26 nt, Human
cgaggcggguggaucaccugagguca

SEQ ID NO: 1001035 - RNA, 26 nt, Human
cgaggcggguggaucaccugagguca

SEQ ID NO: 1001036 - RNA, 23 nt, Human
cgccuguaaucccagcacuuugg

SEQ ID NO: 1001037 - RNA, 24 nt, Human
cgccuguaaucccagcacuuuggg

SEQ ID NO: 1001038 - RNA, 24 nt, Human
cgccuguaaucccagcacuuuggg

SEQ ID NO: 1001039 - RNA, 22 nt, Human
cggaaaaugaugaaaaaaauug

SEQ ID NO: 1001040 - RNA, 23 nt, Human
cggguggaucaccugaggucaga

SEQ ID NO: 1001041 - RNA, 23 nt, Human
cggguggaucaccugaggucaga

SEQ ID NO: 1001042 - RNA, 24 nt, Human
cguggcucacgccuguaaucccag

SEQ ID NO: 1001043 - RNA, 23 nt, Human
cuacuaugcaauaaaacauuagc

SEQ ID NO: 1001044 - RNA, 23 nt, Human
cuacuaugcaauaaaacauuagc

SEQ ID NO: 1001045 - RNA, 22 nt, Human
cuagauacaaaaccucuauacu

SEQ ID NO: 1001046 - RNA, 22 nt, Human
cuauuccacugcuccugccugu

SEQ ID NO: 1001047 - RNA, 18 nt, Human
cucaaaaaaaaaaaaaaa

SEQ ID NO: 1001048 - RNA, 24 nt, Human
cucaaaaaaaaaaaaaaagaaaaa

SEQ ID NO: 1001049 - RNA, 25 nt, Human
cucaaaaaaaaaaaaaaagaaaaaa

SEQ ID NO: 1001050 - RNA, 22 nt, Human
cucacgccuguaaucccagcac

SEQ ID NO: 1001051 - RNA, 22 nt, Human
cucacgccuguaaucccagcac

SEQ ID NO: 1001052 - RNA, 24 nt, Human
cucacgccuguaaucccagcacuu

SEQ ID NO: 1001053 - RNA, 24 nt, Human
cucacgccuguaaucccagcacuu

SEQ ID NO: 1001054 - RNA, 26 nt, Human
cuccacaaaaucacucaauacaccuu

SEQ ID NO: 1001055 - RNA, 18 nt, Human
cugcuccugccuguccug

SEQ ID NO: 1001056 - RNA, 21 nt, Human
cuggcugcugagguuccucuu

SEQ ID NO: 1001057 - RNA, 18 nt, Human
cugggcgccguggcucac

SEQ ID NO: 1001058 - RNA, 18 nt, Human
cugggcgccguggcucac

SEQ ID NO: 1001059 - RNA, 21 nt, Human
cuguaaucccagcuacuuggg

SEQ ID NO: 1001060 - RNA, 19 nt, Human
cuuccuacuucugcccucc

SEQ ID NO: 1001061 - RNA, 18 nt, Human
gagagguggagguugcag

SEQ ID NO: 1001062 - RNA, 23 nt, Human
gagaucgugccauugcacuccag

SEQ ID NO: 1001063 - RNA, 24 nt, Human
gagccuaaccaacauggggaaacc

SEQ ID NO: 1001064 - RNA, 24 nt, Human
gagccuaaccaacauggggaaacc

SEQ ID NO: 1001065 - RNA, 23 nt, Human
gaggcggguggaucaccugaggu

SEQ ID NO: 1001066 - RNA, 23 nt, Human
gagguugcagugaaccgagaucg

SEQ ID NO: 1001067 - RNA, 18 nt, Human
gauaaauaucuggcagaa

SEQ ID NO: 1001068 - RNA, 26 nt, Human
gaucaccugaggucagagguucuaga

SEQ ID NO: 1001069 - RNA, 27 nt, Human
gaucaccugaggucagagguucuagac

SEQ ID NO: 1001070 - RNA, 20 nt, Human
gauucacucaccaauccacg

SEQ ID NO: 1001071 - RNA, 19 nt, Human
ggaagccagcacauacccc

SEQ ID NO: 1001072 - RNA, 23 nt, Human
ggagagacaggaguugaacugag

SEQ ID NO: 1001073 - RNA, 23 nt, Human
ggagguugcagugaaccgagauc

SEQ ID NO: 1001074 - RNA, 24 nt, Human
ggagguugcagugaaccgagaucg

SEQ ID NO: 1001075 - RNA, 24 nt, Human
ggcaccuguaaucccagcuacuug

SEQ ID NO: 1001076 - RNA, 24 nt, Human
ggcgccguggcucacgccuguaaa

SEQ ID NO: 1001077 - RNA, 24 nt, Human
ggcgccguggcucacgccuguaaa

SEQ ID NO: 1001078 - RNA, 21 nt, Human
ggcucacgccuguaaucccag

SEQ ID NO: 1001079 - RNA, 21 nt, Human
gggaaaccccgucucuacuga

SEQ ID NO: 1001080 - RNA, 21 nt, Human
gggaaaccccgucucuacuga

SEQ ID NO: 1001081 - RNA, 22 nt, Human
gggaacaagagcaaaacuucau

SEQ ID NO: 1001082 - RNA, 19 nt, Human
ggggagaagagugaagaca

SEQ ID NO: 1001083 - RNA, 24 nt, Human
gguggugggcaccuguaaucccag

SEQ ID NO: 1001084 - RNA, 24 nt, Human
gguggugggcaccuguaaucccag

SEQ ID NO: 1001085 - RNA, 19 nt, Human
gguuuuuuguuuuauuuug

SEQ ID NO: 1001086 - RNA, 19 nt, Human
gguuuuuuguuuuauuuug

SEQ ID NO: 1001087 - RNA, 18 nt, Human
guacagugugauguuuug

SEQ ID NO: 1001088 - RNA, 18 nt, Human
guacagugugauguuuug

SEQ ID NO: 1001089 - RNA, 23 nt, Human
guggcucacgccuguaaucccag

SEQ ID NO: 1001090 - RNA, 23 nt, Human
guggcucacgccuguaaucccag

SEQ ID NO: 1001091 - RNA, 24 nt, Human
gugguacagugugauguuuugaua

SEQ ID NO: 1001092 - RNA, 24 nt, Human
gugguacagugugauguuuugaua

SEQ ID NO: 1001093 - RNA, 23 nt, Human
guggugggcaccuguaaucccag

SEQ ID NO: 1001094 - RNA, 21 nt, Human
uaaauaucuggcagaaguaau

SEQ ID NO: 1001095 - RNA, 21 nt, Human
uaaggacucauucauugguga

SEQ ID NO: 1001096 - RNA, 22 nt, Human
uaagggcaucgaggguaaacug

SEQ ID NO: 1001097 - RNA, 19 nt, Human
uacacugcugguauaugga

SEQ ID NO: 1001098 - RNA, 21 nt, Human
uacagaaggggcugagugugu

SEQ ID NO: 1001099 - RNA, 23 nt, Human
uacuucaggaauuuauuuuuuca

SEQ ID NO: 1001100 - RNA, 23 nt, Human
uacuucaggaauuuauuuuuuca

SEQ ID NO: 1001101 - RNA, 21 nt, Human
uauuccacugcuccugccugu

SEQ ID NO: 1001102 - RNA, 19 nt, Human
uauuuuaagaaaauaagca

SEQ ID NO: 1001103 - RNA, 19 nt, Human
uauuuuaagaaaauaagca

SEQ ID NO: 1001104 - RNA, 19 nt, Human
ucaaaaaaaaaaaaaaaga

SEQ ID NO: 1001105 - RNA, 19 nt, Human
ucacaguuacacugcuggu

SEQ ID NO: 1001106 - RNA, 22 nt, Human
ucaucucaaaaaaaaaaaaaaa

SEQ ID NO: 1001107 - RNA, 24 nt, Human
ucccaaagacuuccuacuucugcc

SEQ ID NO: 1001108 - RNA, 23 nt, Human
ucgugccauugcacuccagccug

SEQ ID NO: 1001109 - RNA, 24 nt, Human
ucucaaaaaaaaaaaaaaagaaaa

SEQ ID NO: 1001110 - RNA, 19 nt, Human
ucucuacugaaaauacaaa

SEQ ID NO: 1001111 - RNA, 21 nt, Human
ucucuacugaaaauacaaauu

SEQ ID NO: 1001112 - RNA, 24 nt, Human
ucucuuuaacucacaaauaagggc

SEQ ID NO: 1001113 - RNA, 22 nt, Human
ucuggggagaagagugaagaca

SEQ ID NO: 1001114 - RNA, 18 nt, Human
ucugguaucuugucccuc

SEQ ID NO: 1001115 - RNA, 18 nt, Human
ucuucuuagucaguguca

SEQ ID NO: 1001116 - RNA, 22 nt, Human
ugaaccgagaucgugccauugc

SEQ ID NO: 1001117 - RNA, 22 nt, Human
ugaacugagauccucuagauac

SEQ ID NO: 1001118 - RNA, 21 nt, Human
ugaaggacguucaaauagaaa

SEQ ID NO: 1001119 - RNA, 20 nt, Human
ugacacagggcuaaggacuc

SEQ ID NO: 1001120 - RNA, 23 nt, Human
ugagagaaaacugggaggaaccu

SEQ ID NO: 1001121 - RNA, 25 nt, Human
ugagagaaaacugggaggaaccuug

SEQ ID NO: 1001122 - RNA, 21 nt, Human
ugagagcccaggaugccagua

SEQ ID NO: 1001123 - RNA, 24 nt, Human
ugagagguggagguugcagugaac

SEQ ID NO: 1001124 - RNA, 24 nt, Human
ugaggcaggagaauugcuugaauc

SEQ ID NO: 1001125 - RNA, 25 nt, Human
ugaggcaggagaauugcuugaaucu

SEQ ID NO: 1001126 - RNA, 21 nt, Human
uggaagccagcacauaccccc

SEQ ID NO: 1001127 - RNA, 24 nt, Human
uggaucaccugaggucagagguuc

SEQ ID NO: 1001128 - RNA, 24 nt, Human
uggaucaccugaggucagagguuc

SEQ ID NO: 1001129 - RNA, 22 nt, Human
uggcucacgccuguaaucccag

SEQ ID NO: 1001130 - RNA, 22 nt, Human
uggcucacgccuguaaucccag

SEQ ID NO: 1001131 - RNA, 24 nt, Human
uggcucacgccuguaaucccagca

SEQ ID NO: 1001132 - RNA, 24 nt, Human
uggcucacgccuguaaucccagca

SEQ ID NO: 1001133 - RNA, 23 nt, Human
ugggaggccgaggcggguggauc

SEQ ID NO: 1001134 - RNA, 23 nt, Human
ugggaggccgaggcggguggauc

SEQ ID NO: 1001135 - RNA, 24 nt, Human
ugggaggccgaggcggguggauca

SEQ ID NO: 1001136 - RNA, 24 nt, Human
ugggaggccgaggcggguggauca

SEQ ID NO: 1001137 - RNA, 19 nt, Human
ugggaggcugaggcaggag

SEQ ID NO: 1001138 - RNA, 22 nt, Human
ugggaggcugaggcaggagaau

SEQ ID NO: 1001139 - RNA, 22 nt, Human
uggugggcaccuguaaucccag

SEQ ID NO: 1001140 - RNA, 24 nt, Human
ugguggugggcaccuguaauccca

SEQ ID NO: 1001141 - RNA, 24 nt, Human
ugguggugggcaccuguaauccca

SEQ ID NO: 1001142 - RNA, 25 nt, Human
ugugauguuuugauacauguauaca

SEQ ID NO: 1001143 - RNA, 25 nt, Human
ugugauguuuugauacauguauaca

SEQ ID NO: 1001144 - RNA, 24 nt, Human
uuagccaggggugguggugggcac

SEQ ID NO: 1001145 - RNA, 24 nt, Human
uuagccaggggugguggugggcac

SEQ ID NO: 1001146 - RNA, 24 nt, Human
uucaaaauccucucuucuagcuau

SEQ ID NO: 1001147 - RNA, 24 nt, Human
uucaaaauccucucuucuagcuau

SEQ ID NO: 1001148 - RNA, 25 nt, Human
uucaaaauccucucuucuagcuauu

SEQ ID NO: 1001149 - RNA, 20 nt, Human
uuccacugcuccugccuguc

SEQ ID NO: 1001150 - RNA, 21 nt, Human
uucuagacgagccuaaccaac

SEQ ID NO: 1001151 - RNA, 24 nt, Human
uugaaucugagagguggagguugc

SEQ ID NO: 1001152 - RNA, 22 nt, Human
uugcagugaaccgagaucgugc

SEQ ID NO: 1001153 - RNA, 24 nt, Human
uugcuugaaucugagagguggagg

SEQ ID NO: 1001154 - RNA, 25 nt, Human
uugggaggccgaggcggguggauca

SEQ ID NO: 1001155 - RNA, 25 nt, Human
uugggaggccgaggcggguggauca

SEQ ID NO: 1001156 - RNA, 23 nt, Human
uugggaggcugaggcaggagaau

SEQ ID NO: 1001157 - RNA, 20 nt, Human
uuuaugugguacagugugau

SEQ ID NO: 1001158 - RNA, 20 nt, Human
uuuaugugguacagugugau

SEQ ID NO: 1001159 - RNA, 25 nt, Human
uuuuuuguuuuauuuugcuuuuaau

SEQ ID NO: 1001160 - RNA, 21 nt, Human
aaaaaacaacaaaagaauuga

SEQ ID NO: 1001161 - RNA, 22 nt, Human
aaaaaacaacaaaagaauugag

SEQ ID NO: 1001162 - RNA, 25 nt, Human
aaaaaacaacaaaagaauugagaac

SEQ ID NO: 1001163 - RNA, 22 nt, Human
aaaaacagaagaucagaaggga

SEQ ID NO: 1001164 - RNA, 20 nt, Human
aaaaaccaaaaaacaacaaa

SEQ ID NO: 1001165 - RNA, 21 nt, Human
aaaacaacaaaagaauugaga

SEQ ID NO: 1001166 - RNA, 19 nt, Human
aaaacgaaagaacugucug

SEQ ID NO: 1001167 - RNA, 18 nt, Human
aaaauuaguugggcaugg

SEQ ID NO: 1001168 - RNA, 24 nt, Human
aaacaacaaaagaauugagaacac

SEQ ID NO: 1001169 - RNA, 19 nt, Human
aaacagaagaucagaaggg

SEQ ID NO: 1001170 - RNA, 19 nt, Human
aaagcgcccccuauccacc

SEQ ID NO: 1001171 - RNA, 19 nt, Human
aaagcgcccccuauccacc

SEQ ID NO: 1001172 - RNA, 19 nt, Human
aacacggugaaacccuauc

SEQ ID NO: 1001173 - RNA, 20 nt, Human
aacacggugaaacccuaucu

SEQ ID NO: 1001174 - RNA, 21 nt, Human
aacacggugaaacccuaucuc

SEQ ID NO: 1001175 - RNA, 19 nt, Human
aagauguuuccugccugua

SEQ ID NO: 1001176 - RNA, 21 nt, Human
aagcgcccccuauccaccuca

SEQ ID NO: 1001177 - RNA, 22 nt, Human
aauaacauacuuuauuuaaucc

SEQ ID NO: 1001178 - RNA, 23 nt, Human
aaugguguauuucagcaaguugu

SEQ ID NO: 1001179 - RNA, 27 nt, Human
acaacaaaagaauugagaacacagagg

SEQ ID NO: 1001180 - RNA, 22 nt, Human
acagaaaaacagaagaucagaa

SEQ ID NO: 1001181 - RNA, 23 nt, Human
acagaaaaacagaagaucagaag

SEQ ID NO: 1001182 - RNA, 24 nt, Human
acagagcgagauuccaucucaaaa

SEQ ID NO: 1001183 - RNA, 24 nt, Human
acccaggaggcagagguugcagug

SEQ ID NO: 1001184 - RNA, 20 nt, Human
acuaugcuuaauggcaaaau

SEQ ID NO: 1001185 - RNA, 24 nt, Human
acugucugggcgcggcggcucaca

SEQ ID NO: 1001186 - RNA, 24 nt, Human
acuugcggucaggaguucgagauc

SEQ ID NO: 1001187 - RNA, 18 nt, Human
agaaaaacagaagaucag

SEQ ID NO: 1001188 - RNA, 23 nt, Human
agaaccuggcaaagauauuacaa

SEQ ID NO: 1001189 - RNA, 24 nt, Human
agaaucacaugcugauaagccuca

SEQ ID NO: 1001190 - RNA, 21 nt, Human
agaccgaggcggguggaucac

SEQ ID NO: 1001191 - RNA, 22 nt, Human
agagguugcagugagccgagau

SEQ ID NO: 1001192 - RNA, 24 nt, Human
agagguugcagugagccgagauug

SEQ ID NO: 1001193 - RNA, 24 nt, Human
agccuggccaacacggugaaaccc

SEQ ID NO: 1001194 - RNA, 24 nt, Human
agccugggcgacagagcgagauuc

SEQ ID NO: 1001195 - RNA, 18 nt, Human
agcuacucuccuggcucc

SEQ ID NO: 1001196 - RNA, 23 nt, Human
aggagguucgcuugaacccagga

SEQ ID NO: 1001197 - RNA, 21 nt, Human
aggcagagguugcagugagcc

SEQ ID NO: 1001198 - RNA, 24 nt, Human
aggcagagguugcagugagccgag

SEQ ID NO: 1001199 - RNA, 18 nt, Human
aggcaggagguucgcuug

SEQ ID NO: 1001200 - RNA, 24 nt, Human
aggcaggagguucgcuugaaccca

SEQ ID NO: 1001201 - RNA, 26 nt, Human
aggcggguggaucacuugcggucagg

SEQ ID NO: 1001202 - RNA, 22 nt, Human
aguguggaaaagcuggaagaaa

SEQ ID NO: 1001203 - RNA, 20 nt, Human
aguugugguaacaaauugaa

SEQ ID NO: 1001204 - RNA, 21 nt, Human
aucacuugcggucaggaguuc

SEQ ID NO: 1001205 - RNA, 18 nt, Human
aucauccucuuccuuuaa

SEQ ID NO: 1001206 - RNA, 24 nt, Human
augcugaggcaggagguucgcuug

SEQ ID NO: 1001207 - RNA, 24 nt, Human
auugcgccagugcacuccagccug

SEQ ID NO: 1001208 - RNA, 18 nt, Human
caaaaaccaaaaaacaac

SEQ ID NO: 1001209 - RNA, 21 nt, Human
caaaaaccaaaaaacaacaaa

SEQ ID NO: 1001210 - RNA, 21 nt, Human
caaaauacugaaagcgccccc

SEQ ID NO: 1001211 - RNA, 23 nt, Human
caaaauacugaaagcgcccccua

SEQ ID NO: 1001212 - RNA, 24 nt, Human
cacaucuguaaucccagcacuuug

SEQ ID NO: 1001213 - RNA, 21 nt, Human
cacaugcugauaagccucagg

SEQ ID NO: 1001214 - RNA, 20 nt, Human
caccacugggugcauccuag

SEQ ID NO: 1001215 - RNA, 23 nt, Human
caccucaagaccugucaucaguc

SEQ ID NO: 1001216 - RNA, 23 nt, Human
cacuccagccugggcgacagagc

SEQ ID NO: 1001217 - RNA, 24 nt, Human
cacuccagccugggcgacagagcg

SEQ ID NO: 1001218 - RNA, 20 nt, Human
cagagccaaggacuugaagc

SEQ ID NO: 1001219 - RNA, 24 nt, Human
cagcacuuugggagaccgaggcgg

SEQ ID NO: 1001220 - RNA, 19 nt, Human
cagugcacuccagccuggg

SEQ ID NO: 1001221 - RNA, 22 nt, Human
cagugcacuccagccugggcga

SEQ ID NO: 1001222 - RNA, 23 nt, Human
cagugcacuccagccugggcgac

SEQ ID NO: 1001223 - RNA, 24 nt, Human
cagugcacuccagccugggcgaca

SEQ ID NO: 1001224 - RNA, 23 nt, Human
caucucaaaaaagauucaaaaac

SEQ ID NO: 1001225 - RNA, 23 nt, Human
caucuguaaucccagcacuuugg

SEQ ID NO: 1001226 - RNA, 22 nt, Human
caugguggugggugccuguaau

SEQ ID NO: 1001227 - RNA, 18 nt, Human
ccaacccugauuucuaag

SEQ ID NO: 1001228 - RNA, 21 nt, Human
ccagugcacuccagccugggc

SEQ ID NO: 1001229 - RNA, 22 nt, Human
ccagugcacuccagccugggcg

SEQ ID NO: 1001230 - RNA, 23 nt, Human
ccagugcacuccagccugggcga

SEQ ID NO: 1001231 - RNA, 24 nt, Human
ccagugcacuccagccugggcgac

SEQ ID NO: 1001232 - RNA, 21 nt, Human
ccugcaucaaucaaaaaaaac

SEQ ID NO: 1001233 - RNA, 22 nt, Human
ccugccugcccaacccugauuu

SEQ ID NO: 1001234 - RNA, 19 nt, Human
ccuggaucagagccaagga

SEQ ID NO: 1001235 - RNA, 22 nt, Human
ccuggccaacacggugaaaccc

SEQ ID NO: 1001236 - RNA, 24 nt, Human
ccuggccaacacggugaaacccua

SEQ ID NO: 1001237 - RNA, 19 nt, Human
ccuggcuccugccugccca

SEQ ID NO: 1001238 - RNA, 22 nt, Human
ccugggcgacagagcgagauuc

SEQ ID NO: 1001239 - RNA, 21 nt, Human
ccuguaaucccagcuacuugg

SEQ ID NO: 1001240 - RNA, 21 nt, Human
cgaaagaacugucugggcgcg

SEQ ID NO: 1001241 - RNA, 24 nt, Human
cgagaucagccuggccaacacggu

SEQ ID NO: 1001242 - RNA, 24 nt, Human
cgaggcggguggaucacuugcggu

SEQ ID NO: 1001243 - RNA, 22 nt, Human
cggcucacaucuguaaucccag

SEQ ID NO: 1001244 - RNA, 24 nt, Human
cggguggaucacuugcggucagga

SEQ ID NO: 1001245 - RNA, 25 nt, Human
cucaaaaaagauucaaaaaccaaaa

SEQ ID NO: 1001246 - RNA, 24 nt, Human
cucacaucuguaaucccagcacuu

SEQ ID NO: 1001247 - RNA, 18 nt, Human
cucuccccacuacucuuu

SEQ ID NO: 1001248 - RNA, 23 nt, Human
cuggccaacacggugaaacccua

SEQ ID NO: 1001249 - RNA, 21 nt, Human
cuguaaucccagcacuuuggg

SEQ ID NO: 1001250 - RNA, 23 nt, Human
gagauugcgccagugcacuccag

SEQ ID NO: 1001251 - RNA, 25 nt, Human
gaggcggguggaucacuugcgguca

SEQ ID NO: 1001252 - RNA, 24 nt, Human
gaucacuugcggucaggaguucga

SEQ ID NO: 1001253 - RNA, 21 nt, Human
gcaaaauacugaaagcgcccc

SEQ ID NO: 1001254 - RNA, 24 nt, Human
gcacuccagccugggcgacagagc

SEQ ID NO: 1001255 - RNA, 22 nt, Human
gcaggagguucgcuugaaccca

SEQ ID NO: 1001256 - RNA, 19 nt, Human
gcauaaagagaguguggaa

SEQ ID NO: 1001257 - RNA, 24 nt, Human
gccaacacggugaaacccuaucuc

SEQ ID NO: 1001258 - RNA, 22 nt, Human
gccagugcacuccagccugggc

SEQ ID NO: 1001259 - RNA, 19 nt, Human
gccuggaucagagccaagg

SEQ ID NO: 1001260 - RNA, 23 nt, Human
gcggcucacaucuguaaucccag

SEQ ID NO: 1001261 - RNA, 22 nt, Human
ggaggcagagguugcagugagc

SEQ ID NO: 1001262 - RNA, 23 nt, Human
ggcucacaucuguaaucccagca

SEQ ID NO: 1001263 - RNA, 24 nt, Human
gggcaugguggugggugccuguaa

SEQ ID NO: 1001264 - RNA, 24 nt, Human
gggcgcggcggcucacaucuguaa

SEQ ID NO: 1001265 - RNA, 24 nt, Human
ggugccuguaaucccagcuacuug

SEQ ID NO: 1001266 - RNA, 24 nt, Human
gguggugggugccuguaaucccag

SEQ ID NO: 1001267 - RNA, 20 nt, Human
guauauauuuuauacauuga

SEQ ID NO: 1001268 - RNA, 18 nt, Human
gugccuguaaucccagcu

SEQ ID NO: 1001269 - RNA, 19 nt, Human
guugcagugagccgagauu

SEQ ID NO: 1001270 - RNA, 24 nt, Human
uaaaacgaaagaacugucugggcg

SEQ ID NO: 1001271 - RNA, 18 nt, Human
uacguuaucaaaauaaau

SEQ ID NO: 1001272 - RNA, 22 nt, Human
uacucuccuggcuccugccugc

SEQ ID NO: 1001273 - RNA, 21 nt, Human
uagaaccuggcaaagauauua

SEQ ID NO: 1001274 - RNA, 24 nt, Human
uagaugagaacaaaaucuaaacaa

SEQ ID NO: 1001275 - RNA, 19 nt, Human
uaugaaguacucaacagac

SEQ ID NO: 1001276 - RNA, 21 nt, Human
uaugaaguacucaacagacau

SEQ ID NO: 1001277 - RNA, 22 nt, Human
ucaaaauaaauccaguauugca

SEQ ID NO: 1001278 - RNA, 20 nt, Human
ucacuugcggucaggaguuc

SEQ ID NO: 1001279 - RNA, 18 nt, Human
ucagaagggagaaucaca

SEQ ID NO: 1001280 - RNA, 23 nt, Human
uccagccugggcgacagagcgag

SEQ ID NO: 1001281 - RNA, 24 nt, Human
uccagccugggcgacagagcgaga

SEQ ID NO: 1001282 - RNA, 22 nt, Human
ucgcuugaacccaggaggcaga

SEQ ID NO: 1001283 - RNA, 25 nt, Human
ugaaguaaaucaauguacuaagcca

SEQ ID NO: 1001284 - RNA, 23 nt, Human
ugaaguacucaacagacauuggu

SEQ ID NO: 1001285 - RNA, 25 nt, Human
ugaauaacauacuuuauuuaaucca

SEQ ID NO: 1001286 - RNA, 27 nt, Human
ugagaacacagaaaaacagcaggaacu

SEQ ID NO: 1001287 - RNA, 24 nt, Human
ugagaacacagaaaaacuggagac

SEQ ID NO: 1001288 - RNA, 22 nt, Human
ugagccgagauugcgccagugc

SEQ ID NO: 1001289 - RNA, 24 nt, Human
ugaggcaggagguucgcuugaacc

SEQ ID NO: 1001290 - RNA, 25 nt, Human
ugaggcaggagguucgcuugaaccc

SEQ ID NO: 1001291 - RNA, 21 nt, Human
ugcaauacacaaaggaaaagu

SEQ ID NO: 1001292 - RNA, 21 nt, Human
ugcaccucucuaccaaaguca

SEQ ID NO: 1001293 - RNA, 22 nt, Human
ugcacuccagccugggcgacag

SEQ ID NO: 1001294 - RNA, 23 nt, Human
ugccuguaaucccagcuacuugg

SEQ ID NO: 1001295 - RNA, 24 nt, Human
ugccuguaaucccagcuacuuggg

SEQ ID NO: 1001296 - RNA, 26 nt, Human
ugcgccagugcacuccagccugggcg

SEQ ID NO: 1001297 - RNA, 25 nt, Human
ugcggucaggaguucgagaucagcc

SEQ ID NO: 1001298 - RNA, 24 nt, Human
uggaucacuugcggucaggaguuc

SEQ ID NO: 1001299 - RNA, 18 nt, Human
uggcaaaauacugaaagc

SEQ ID NO: 1001300 - RNA, 18 nt, Human
uggcaaaauacugaaagc

SEQ ID NO: 1001301 - RNA, 24 nt, Human
ugggagaccgaggcggguggauca

SEQ ID NO: 1001302 - RNA, 22 nt, Human
uggugggugccuguaaucccag

SEQ ID NO: 1001303 - RNA, 24 nt, Human
uggugggugccuguaaucccagcu

SEQ ID NO: 1001304 - RNA, 24 nt, Human
ugguggugggugccuguaauccca

SEQ ID NO: 1001305 - RNA, 23 nt, Human
uguagaauccuggaaucuguggc

SEQ ID NO: 1001306 - RNA, 21 nt, Human
uguagcuacucuccuggcucc

SEQ ID NO: 1001307 - RNA, 23 nt, Human
uguaguaaauuaacagaucagaa

SEQ ID NO: 1001308 - RNA, 23 nt, Human
ugucaucagucaaagaugcuuac

SEQ ID NO: 1001309 - RNA, 23 nt, Human
uguggaaaagcuggaagaaauca

SEQ ID NO: 1001310 - RNA, 23 nt, Human
uuaaaacgaaagaacugucuggg

SEQ ID NO: 1001311 - RNA, 21 nt, Human
uuacugcaauuaauuugaaag

SEQ ID NO: 1001312 - RNA, 19 nt, Human
uuagagcucaauccuauac

SEQ ID NO: 1001313 - RNA, 24 nt, Human
uuaguugggcaugguggugggugc

SEQ ID NO: 1001314 - RNA, 25 nt, Human
uucaaaaaacauauugcaccucucu

SEQ ID NO: 1001315 - RNA, 18 nt, Human
uucaauuugaguuugaag

SEQ ID NO: 1001316 - RNA, 23 nt, Human
uucauauuuucucuuuguguuuu

SEQ ID NO: 1001317 - RNA, 22 nt, Human
uugaaguagguauuugaaaucu

SEQ ID NO: 1001318 - RNA, 18 nt, Human
uugcagugagccgagauu

SEQ ID NO: 1001319 - RNA, 20 nt, Human
uugcagugagccgagauugc

SEQ ID NO: 1001320 - RNA, 22 nt, Human
uugcagugagccgagauugcgc

SEQ ID NO: 1001321 - RNA, 23 nt, Human
uugcgccagugcacuccagccug

SEQ ID NO: 1001322 - RNA, 19 nt, Human
uuguuucuacccucacaug

SEQ ID NO: 1001323 - RNA, 18 nt, Human
aagaugcuuccgcaggcc

SEQ ID NO: 1001324 - RNA, 18 nt, Human
acaauuauguggacaccc

SEQ ID NO: 1001325 - RNA, 19 nt, Human
acagcuccaguuuaagcca

SEQ ID NO: 1001326 - RNA, 19 nt, Human
agcugggcgccgagggccc

SEQ ID NO: 1001327 - RNA, 18 nt, Human
aggcagagacucgagccc

SEQ ID NO: 1001328 - RNA, 24 nt, Human
auaauauggacucuauuaucuuuc

SEQ ID NO: 1001329 - RNA, 21 nt, Human
auucugcgguuccauagcaca

SEQ ID NO: 1001330 - RNA, 22 nt, Human
cacacacuccaacaccacacac

SEQ ID NO: 1001331 - RNA, 23 nt, Human
caccacacacaccgagcccuggu

SEQ ID NO: 1001332 - RNA, 25 nt, Human
cacuccaacaccacacacaccgagc

SEQ ID NO: 1001333 - RNA, 24 nt, Human
cagcuccaguuuaagccaguuguu

SEQ ID NO: 1001334 - RNA, 18 nt, Human
ccauagcacacacuccaa

SEQ ID NO: 1001335 - RNA, 22 nt, Human
ccucacaggacgcggagcuggg

SEQ ID NO: 1001336 - RNA, 20 nt, Human
cgagcccggggcgcgcccgg

SEQ ID NO: 1001337 - RNA, 21 nt, Human
cgggaggggaggcgcacguug

SEQ ID NO: 1001338 - RNA, 19 nt, Human
cuuuaaaaagcucugguuu

SEQ ID NO: 1001339 - RNA, 23 nt, Human
gagccgggaggggaggcgcacgu

SEQ ID NO: 1001340 - RNA, 22 nt, Human
gcacacacuccaacaccacaca

SEQ ID NO: 1001341 - RNA, 19 nt, Human
gcccggggcgcgcccggcu

SEQ ID NO: 1001342 - RNA, 19 nt, Human
gcgcgcccggcugggagcc

SEQ ID NO: 1001343 - RNA, 23 nt, Human
ggcugggagccgggaggggaggc

SEQ ID NO: 1001344 - RNA, 19 nt, Human
guacaacaauuauguggac

SEQ ID NO: 1001345 - RNA, 20 nt, Human
guacaacaauuauguggaca

SEQ ID NO: 1001346 - RNA, 19 nt, Human
uacaacaauuauguggaca

SEQ ID NO: 1001347 - RNA, 18 nt, Human
uacaagaugcuuccgcag

SEQ ID NO: 1001348 - RNA, 26 nt, Human
uccaacaccacacacaccgagcccug

SEQ ID NO: 1001349 - RNA, 23 nt, Human
uccgcgcacccagaucuggucgc

SEQ ID NO: 1001350 - RNA, 25 nt, Human
ugggagaggaagggcggggcugguc

SEQ ID NO: 1001351 - RNA, 19 nt, Human
ugggagccgggaggggagg

SEQ ID NO: 1001352 - RNA, 21 nt, Human
ugggagccgggaggggaggcg

SEQ ID NO: 1001353 - RNA, 18 nt, Human
uguacaacaauuaugugg

SEQ ID NO: 1001354 - RNA, 18 nt, Human
uucgcugggacagcucca

SEQ ID NO: 1001355 - RNA, 19 nt, Human
uucugcgguuccauagcac

SEQ ID NO: 1001356 - RNA, 24 nt, Human
uucugcgguuccauagcacacacu

SEQ ID NO: 1001357 - RNA, 22 nt, Human
uuuaagccaguuguuuugcaau

SEQ ID NO: 1001358 - RNA, 22 nt, Human
uuuucacuuuaaaaagcucugg

SEQ ID NO: 1001359 - RNA, 25 nt, Human
aaaaaacucacuucaaauucaaagc

SEQ ID NO: 1001360 - RNA, 22 nt, Human
aaaaagcucaauugguaaagac

SEQ ID NO: 1001361 - RNA, 22 nt, Human
aaaaucucggucaugcgcacau

SEQ ID NO: 1001362 - RNA, 22 nt, Human
aaaauuaugccaaaaaggaaag

SEQ ID NO: 1001363 - RNA, 18 nt, Human
aaacaauuguacauaagc

SEQ ID NO: 1001364 - RNA, 19 nt, Human
aaaccaugcaccaaacaug

SEQ ID NO: 1001365 - RNA, 20 nt, Human
aaacucacuucaaauucaaa

SEQ ID NO: 1001366 - RNA, 20 nt, Human
aaacugaaacaagaaggcca

SEQ ID NO: 1001367 - RNA, 21 nt, Human
aaagugccauuuuauaaaguu

SEQ ID NO: 1001368 - RNA, 21 nt, Human
aacaacaaagacaacaacaac

SEQ ID NO: 1001369 - RNA, 18 nt, Human
aacagccuugacaagugu

SEQ ID NO: 1001370 - RNA, 20 nt, Human
aacaugauggaugccuucug

SEQ ID NO: 1001371 - RNA, 25 nt, Human
aaccauuuacagccagaaaagguua

SEQ ID NO: 1001372 - RNA, 21 nt, Human
aagcaggaugcacacaacucc

SEQ ID NO: 1001373 - RNA, 21 nt, Human
aagcccuccucaaaaaccaug

SEQ ID NO: 1001374 - RNA, 20 nt, Human
acaaaagcccuccucaaaaa

SEQ ID NO: 1001375 - RNA, 24 nt, Human
acaaagacaacaacaacaacaaaa

SEQ ID NO: 1001376 - RNA, 19 nt, Human
acaacaacaacaacaaaac

SEQ ID NO: 1001377 - RNA, 18 nt, Human
acccuguuauuguucaga

SEQ ID NO: 1001378 - RNA, 22 nt, Human
acucugcucaaagcaaaaacua

SEQ ID NO: 1001379 - RNA, 25 nt, Human
acuguguguguguuuaugggugugu

SEQ ID NO: 1001380 - RNA, 20 nt, Human
acuuaaacccccagcuccac

SEQ ID NO: 1001381 - RNA, 21 nt, Human
agaaaaaacugaaacaagaag

SEQ ID NO: 1001382 - RNA, 20 nt, Human
agaaaaaauagacaaauaug

SEQ ID NO: 1001383 - RNA, 18 nt, Human
agacaaauaugcacaugc

SEQ ID NO: 1001384 - RNA, 25 nt, Human
aggaggcucuggccacugcucaccc

SEQ ID NO: 1001385 - RNA, 20 nt, Human
auaaaacuuauagaaaaaau

SEQ ID NO: 1001386 - RNA, 18 nt, Human
aucacaugcagcuccacc

SEQ ID NO: 1001387 - RNA, 21 nt, Human
augggugugugcaugugugug

SEQ ID NO: 1001388 - RNA, 21 nt, Human
augguggaggcggcggcggca

SEQ ID NO: 1001389 - RNA, 24 nt, Human
caaaagagaaccaucacuuaaacc

SEQ ID NO: 1001390 - RNA, 22 nt, Human
caaaagcccuccucaaaaacca

SEQ ID NO: 1001391 - RNA, 24 nt, Human
caaagacaacaacaacaacaaaac

SEQ ID NO: 1001392 - RNA, 21 nt, Human
caaaugaccaacaacaaagac

SEQ ID NO: 1001393 - RNA, 20 nt, Human
caacaacaacaaaacauccc

SEQ ID NO: 1001394 - RNA, 18 nt, Human
caagcaagggugcaugca

SEQ ID NO: 1001395 - RNA, 18 nt, Human
cacuccucagcuacuccc

SEQ ID NO: 1001396 - RNA, 18 nt, Human
cacugcuggaagcacauc

SEQ ID NO: 1001397 - RNA, 21 nt, Human
cacugcuggaagcacauccca

SEQ ID NO: 1001398 - RNA, 22 nt, Human
cagggcaaaaaugccagaaaag

SEQ ID NO: 1001399 - RNA, 18 nt, Human
cagugcuugugaaauuug

SEQ ID NO: 1001400 - RNA, 19 nt, Human
caguuauagaaagcaugga

SEQ ID NO: 1001401 - RNA, 22 nt, Human
caucuacuacaacccucaccuc

SEQ ID NO: 1001402 - RNA, 19 nt, Human
caugaagaaguugguugcu

SEQ ID NO: 1001403 - RNA, 23 nt, Human
ccagaaagacccaauuuuaucca

SEQ ID NO: 1001404 - RNA, 21 nt, Human
cccuaagcauugcaacagggc

SEQ ID NO: 1001405 - RNA, 18 nt, Human
ccgcccacuccucagcua

SEQ ID NO: 1001406 - RNA, 18 nt, Human
ccucaaaaaccaugcacc

SEQ ID NO: 1001407 - RNA, 22 nt, Human
ccucaagcugccugccuggccc

SEQ ID NO: 1001408 - RNA, 18 nt, Human
ccucuaaaaaggccgaag

SEQ ID NO: 1001409 - RNA, 27 nt, Human
ccugcuguuuuugggguuuuuguuuug

SEQ ID NO: 1001410 - RNA, 22 nt, Human
cgauaaaaagcucaauugguaa

SEQ ID NO: 1001411 - RNA, 21 nt, Human
cggauguaaaauuucagguca

SEQ ID NO: 1001412 - RNA, 18 nt, Human
cggcggcggcaggcagcg

SEQ ID NO: 1001413 - RNA, 21 nt, Human
cggcggcggcaggcagcggag

SEQ ID NO: 1001414 - RNA, 20 nt, Human
cguaaaggcaccucaagcug

SEQ ID NO: 1001415 - RNA, 20 nt, Human
cuaagcauugcaacagggcu

SEQ ID NO: 1001416 - RNA, 18 nt, Human
cucauucuuagaaacacu

SEQ ID NO: 1001417 - RNA, 26 nt, Human
cuccaggggcccgaggguggcgccgg

SEQ ID NO: 1001418 - RNA, 18 nt, Human
cuccaugcggagugcccc

SEQ ID NO: 1001419 - RNA, 18 nt, Human
cuccucagcuacucccgc

SEQ ID NO: 1001420 - RNA, 24 nt, Human
cucguaaaggcaccucaagcugcc

SEQ ID NO: 1001421 - RNA, 24 nt, Human
cugaauauugacaaaugaccaaca

SEQ ID NO: 1001422 - RNA, 21 nt, Human
cuggcccuggaugccauguga

SEQ ID NO: 1001423 - RNA, 21 nt, Human
cuuagaaacacugaaaacaau

SEQ ID NO: 1001424 - RNA, 28 nt, Human
gaaaaaauagacaaauaugcacaugcaa

SEQ ID NO: 1001425 - RNA, 25 nt, Human
gaaggcacuccaacucugcucaaag

SEQ ID NO: 1001426 - RNA, 27 nt, Human
gaccaacaacaaagacaacaacaacaa

SEQ ID NO: 1001427 - RNA, 27 nt, Human
gaggcggcggcggcaggcagcggagga

SEQ ID NO: 1001428 - RNA, 18 nt, Human
gaggguggcgccggggag

SEQ ID NO: 1001429 - RNA, 24 nt, Human
gcacagcucucaggucuguggggg

SEQ ID NO: 1001430 - RNA, 25 nt, Human
gcacugcuggaagcacaucccacac

SEQ ID NO: 1001431 - RNA, 19 nt, Human
gcggcaggcagcggaggag

SEQ ID NO: 1001432 - RNA, 20 nt, Human
gcggcagguuugccaggucc

SEQ ID NO: 1001433 - RNA, 19 nt, Human
gcuacuaaaaaaacuuuaa

SEQ ID NO: 1001434 - RNA, 24 nt, Human
ggaaaaaaacucacuucaaauuca

SEQ ID NO: 1001435 - RNA, 24 nt, Human
ggcaagaagugagcagaagggacc

SEQ ID NO: 1001436 - RNA, 22 nt, Human
ggcaggcagcggaggaggaagc

SEQ ID NO: 1001437 - RNA, 26 nt, Human
ggcuuggacccccuuuuaauacagau

SEQ ID NO: 1001438 - RNA, 18 nt, Human
gggccuggcuuggacccc

SEQ ID NO: 1001439 - RNA, 20 nt, Human
gggggaaaaaguaaauuaga

SEQ ID NO: 1001440 - RNA, 21 nt, Human
ggggggaaaaaguaaauuaga

SEQ ID NO: 1001441 - RNA, 22 nt, Human
gggguuuccgcccacuccucag

SEQ ID NO: 1001442 - RNA, 25 nt, Human
ggugauggggggggaauugggggga

SEQ ID NO: 1001443 - RNA, 18 nt, Human
gguuuucucguaaaggca

SEQ ID NO: 1001444 - RNA, 20 nt, Human
gugcagcaugcggcagguuu

SEQ ID NO: 1001445 - RNA, 18 nt, Human
gugcaugcacagugugga

SEQ ID NO: 1001446 - RNA, 25 nt, Human
guggaggcggcggcggcaggcagcg

SEQ ID NO: 1001447 - RNA, 21 nt, Human
guugccccuucugucauccag

SEQ ID NO: 1001448 - RNA, 19 nt, Human
guuggugccagggggucag

SEQ ID NO: 1001449 - RNA, 22 nt, Human
uaaaacuacaaaaguaagacug

SEQ ID NO: 1001450 - RNA, 22 nt, Human
uaaaauuaaauguacaccacua

SEQ ID NO: 1001451 - RNA, 23 nt, Human
uaaaauuaacaggcauacugaca

SEQ ID NO: 1001452 - RNA, 26 nt, Human
uaaaauuaacaggcauacugacacug

SEQ ID NO: 1001453 - RNA, 20 nt, Human
uaaagcacuguguguguguu

SEQ ID NO: 1001454 - RNA, 20 nt, Human
uaaaguaccauuggaagaaa

SEQ ID NO: 1001455 - RNA, 19 nt, Human
uaaagugccauuuuauaaa

SEQ ID NO: 1001456 - RNA, 21 nt, Human
uaacagcaagguuuucaaaaa

SEQ ID NO: 1001457 - RNA, 21 nt, Human
uaaccugcacucaacagcuaa

SEQ ID NO: 1001458 - RNA, 23 nt, Human
uaagaaagacaguagcuuuaccc

SEQ ID NO: 1001459 - RNA, 18 nt, Human
uaagauauauauauauag

SEQ ID NO: 1001460 - RNA, 19 nt, Human
uaaguugauacuuuggcuc

SEQ ID NO: 1001461 - RNA, 25 nt, Human
uacaaaaauauaaaauaaauuuggg

SEQ ID NO: 1001462 - RNA, 23 nt, Human
uacauaagagucagagaaccaag

SEQ ID NO: 1001463 - RNA, 23 nt, Human
uacauggucccugguccuauuaa

SEQ ID NO: 1001464 - RNA, 23 nt, Human
uacugacacuggaagcaucuacu

SEQ ID NO: 1001465 - RNA, 22 nt, Human
uacuuuggcucuuuggagcuua

SEQ ID NO: 1001466 - RNA, 18 nt, Human
uagacaaauaugcacaug

SEQ ID NO: 1001467 - RNA, 27 nt, Human
uaggagaacaagugcaauuugaucagu

SEQ ID NO: 1001468 - RNA, 20 nt, Human
uaggaugcaaaagcaauuag

SEQ ID NO: 1001469 - RNA, 20 nt, Human
uauacagggcaaaaaugccc

SEQ ID NO: 1001470 - RNA, 22 nt, Human
uaugggugugugcaugugugug

SEQ ID NO: 1001471 - RNA, 20 nt, Human
uauuguauauguguacguag

SEQ ID NO: 1001472 - RNA, 24 nt, Human
ucacuuuguaagaauaggaugcaa

SEQ ID NO: 1001473 - RNA, 19 nt, Human
ucagaaaauguauaaaggu

SEQ ID NO: 1001474 - RNA, 19 nt, Human
ucagagaaccaaguuuggg

SEQ ID NO: 1001475 - RNA, 20 nt, Human
ucagugcuugugaaauuugg

SEQ ID NO: 1001476 - RNA, 22 nt, Human
ucaguuacauggucccuggucc

SEQ ID NO: 1001477 - RNA, 21 nt, Human
uccaaaacuuguuauccccaa

SEQ ID NO: 1001478 - RNA, 25 nt, Human
ucccacacucaaacugggacuugga

SEQ ID NO: 1001479 - RNA, 18 nt, Human
ucccagccccagcucggu

SEQ ID NO: 1001480 - RNA, 23 nt, Human
uccucagcuacucccgcuccaug

SEQ ID NO: 1001481 - RNA, 21 nt, Human
ucuacuacaacccucaccuca

SEQ ID NO: 1001482 - RNA, 22 nt, Human
ucucccagccccagcucgguuu

SEQ ID NO: 1001483 - RNA, 21 nt, Human
ugaaacaagaaggccauaaac

SEQ ID NO: 1001484 - RNA, 18 nt, Human
ugacaaaagcccuccuca

SEQ ID NO: 1001485 - RNA, 24 nt, Human
ugacaaaagcccuccucaaaaacc

SEQ ID NO: 1001486 - RNA, 18 nt, Human
ugacaaaugaccaacaac

SEQ ID NO: 1001487 - RNA, 21 nt, Human
ugaccaacaacaaagacaaca

SEQ ID NO: 1001488 - RNA, 19 nt, Human
ugaccucagggcagcuggg

SEQ ID NO: 1001489 - RNA, 24 nt, Human
ugagaagaccugggggccuggcuu

SEQ ID NO: 1001490 - RNA, 24 nt, Human
ugagcacauguggcucuggcuuug

SEQ ID NO: 1001491 - RNA, 24 nt, Human
ugaguuuugggguaaaacagccuu

SEQ ID NO: 1001492 - RNA, 18 nt, Human
ugauggggggggaauugg

SEQ ID NO: 1001493 - RNA, 21 nt, Human
ugcuucacuugaacuguuuau

SEQ ID NO: 1001494 - RNA, 22 nt, Human
ugcuuuucuuaaaaauuuggag

SEQ ID NO: 1001495 - RNA, 21 nt, Human
uggaagaaaagaaaaaacuga

SEQ ID NO: 1001496 - RNA, 19 nt, Human
uggaggcggcggcggcagg

SEQ ID NO: 1001497 - RNA, 24 nt, Human
uggaugaaggcacuccaacucugc

SEQ ID NO: 1001498 - RNA, 22 nt, Human
uggccugcauuucucuuccaaa

SEQ ID NO: 1001499 - RNA, 23 nt, Human
uggcgccggggagcgggcagcag

SEQ ID NO: 1001500 - RNA, 21 nt, Human
ugggagauaaggugauggggg

SEQ ID NO: 1001501 - RNA, 18 nt, Human
ugguggaggcggcggcgg

SEQ ID NO: 1001502 - RNA, 18 nt, Human
uguaagagugcaucccgg

SEQ ID NO: 1001503 - RNA, 20 nt, Human
uguagcaguacgaggugucu

SEQ ID NO: 1001504 - RNA, 22 nt, Human
uguauaaagguccaauuuguaa

SEQ ID NO: 1001505 - RNA, 20 nt, Human
uguccugggagauaagguga

SEQ ID NO: 1001506 - RNA, 18 nt, Human
ugugcagcaugcggcagg

SEQ ID NO: 1001507 - RNA, 18 nt, Human
ugugcagcaugcggcagg

SEQ ID NO: 1001508 - RNA, 20 nt, Human
ugugcagcaugcggcagguu

SEQ ID NO: 1001509 - RNA, 20 nt, Human
ugugcaugugugugccugug

SEQ ID NO: 1001510 - RNA, 22 nt, Human
uguguacguagguagaugugug

SEQ ID NO: 1001511 - RNA, 23 nt, Human
uguguguguguuuaugggugugu

SEQ ID NO: 1001512 - RNA, 23 nt, Human
uguguguguuuaugggugugugc

SEQ ID NO: 1001513 - RNA, 19 nt, Human
uguugggacaucacuuugu

SEQ ID NO: 1001514 - RNA, 18 nt, Human
uguuggugccaggggguc

SEQ ID NO: 1001515 - RNA, 24 nt, Human
uuaaaaaacaaaauaaaaacaauu

SEQ ID NO: 1001516 - RNA, 23 nt, Human
uucaaagcucuuacgauucugcu

SEQ ID NO: 1001517 - RNA, 23 nt, Human
uuggcuuugucugcaauagcauu

SEQ ID NO: 1001518 - RNA, 18 nt, Human
uuggugacugaauauuga

SEQ ID NO: 1001519 - RNA, 24 nt, Human
uuuccaacuuaauccuugugcuuc

SEQ ID NO: 1001520 - RNA, 18 nt, Human
uuucucguaaaggcaccu

SEQ ID NO: 1001521 - RNA, 19 nt, Human
uuucuuaaaaauuuggagg

SEQ ID NO: 1001522 - RNA, 23 nt, Human
agggggcagcagguuacacagga

SEQ ID NO: 1001523 - RNA, 18 nt, Human
caaaauggccggagccga

SEQ ID NO: 1001524 - RNA, 23 nt, Human
cagguuacacaggucucagccga

SEQ ID NO: 1001525 - RNA, 19 nt, Human
ccacggggucagaaauaaa

SEQ ID NO: 1001526 - RNA, 28 nt, Human
ccagaagcagcagccgacagccccccuc

SEQ ID NO: 1001527 - RNA, 22 nt, Human
ccccguggcccagaagcagcag

SEQ ID NO: 1001528 - RNA, 22 nt, Human
cccgccgccgccgccgcagcca

SEQ ID NO: 1001529 - RNA, 20 nt, Human
ccgcagccaccaccgcggcc

SEQ ID NO: 1001530 - RNA, 21 nt, Human
ccgccgccgccgccgcagcca

SEQ ID NO: 1001531 - RNA, 22 nt, Human
cggagccgagcgcagaaagaaa

SEQ ID NO: 1001532 - RNA, 20 nt, Human
cuggggcuccccguggccca

SEQ ID NO: 1001533 - RNA, 18 nt, Human
cuggguuggggguggagg

SEQ ID NO: 1001534 - RNA, 23 nt, Human
gagggggcagcagguuacacagg

SEQ ID NO: 1001535 - RNA, 22 nt, Human
gcagaaagaaaagauguaaaac

SEQ ID NO: 1001536 - RNA, 20 nt, Human
gccgcagccaccaccgcggc

SEQ ID NO: 1001537 - RNA, 19 nt, Human
gcucccgccgccgccgccg

SEQ ID NO: 1001538 - RNA, 21 nt, Human
ggggguggagggggcagcagg

SEQ ID NO: 1001539 - RNA, 19 nt, Human
gggguggagggggcagcag

SEQ ID NO: 1001540 - RNA, 20 nt, Human
ggguuggggguggagggggc

SEQ ID NO: 1001541 - RNA, 25 nt, Human
guggaacgaugguagaaggcacagc

SEQ ID NO: 1001542 - RNA, 22 nt, Human
guggagggggcagcagguuaca

SEQ ID NO: 1001543 - RNA, 21 nt, Human
ucaaugguggaacgaugguuu

SEQ ID NO: 1001544 - RNA, 27 nt, Human
ugcucccgccgccgccgccgcagccac

SEQ ID NO: 1001545 - RNA, 22 nt, Human
uggcccagaagcagcagccgac

SEQ ID NO: 1001546 - RNA, 23 nt, Human
uggccggagccgagcgcagaaag

SEQ ID NO: 1001547 - RNA, 23 nt, Human
uuggggguggagggggcagcagg

SEQ ID NO: 1001548 - RNA, 23 nt, Human
aaaagcaccagauggggaagccc

SEQ ID NO: 1001549 - RNA, 23 nt, Human
aaaagguaagguaacauguucuu

SEQ ID NO: 1001550 - RNA, 21 nt, Human
aaacaaaaccgugggcagaaa

SEQ ID NO: 1001551 - RNA, 24 nt, Human
aaacaaaaccgugggcagaaacau

SEQ ID NO: 1001552 - RNA, 24 nt, Human
acaaacaaaaccgugggcagaaac

SEQ ID NO: 1001553 - RNA, 22 nt, Human
acaaagccuggccuugguggcu

SEQ ID NO: 1001554 - RNA, 19 nt, Human
accugcauuaaucuuccuu

SEQ ID NO: 1001555 - RNA, 20 nt, Human
agacaaacaaucugaauuau

SEQ ID NO: 1001556 - RNA, 21 nt, Human
agcaccagauggggaagccca

SEQ ID NO: 1001557 - RNA, 20 nt, Human
agguaagguaacauguucuu

SEQ ID NO: 1001558 - RNA, 25 nt, Human
auagaauacacuucuuuuaacaaag

SEQ ID NO: 1001559 - RNA, 21 nt, Human
augcuucuuuagggugacaca

SEQ ID NO: 1001560 - RNA, 21 nt, Human
auugcacaaacaaaaccgugg

SEQ ID NO: 1001561 - RNA, 22 nt, Human
caauugccaccuuccaccugga

SEQ ID NO: 1001562 - RNA, 21 nt, Human
cacaaacaaaaccgugggcag

SEQ ID NO: 1001563 - RNA, 21 nt, Human
cagagucugcacuuuuccugc

SEQ ID NO: 1001564 - RNA, 23 nt, Human
cagagucugcacuuuuccugcaa

SEQ ID NO: 1001565 - RNA, 20 nt, Human
cagcccgcgggccccgcccu

SEQ ID NO: 1001566 - RNA, 21 nt, Human
cagcccgcgggccccgcccua

SEQ ID NO: 1001567 - RNA, 18 nt, Human
caguaugcauuuuaaaac

SEQ ID NO: 1001568 - RNA, 18 nt, Human
cccagcgucgccgccaca

SEQ ID NO: 1001569 - RNA, 22 nt, Human
cccagcgucgccgccacagccg

SEQ ID NO: 1001570 - RNA, 19 nt, Human
cccauaccggguuacaagg

SEQ ID NO: 1001571 - RNA, 24 nt, Human
cccccgagagcaguggggacccaa

SEQ ID NO: 1001572 - RNA, 21 nt, Human
ccgccgccaccucacgcccag

SEQ ID NO: 1001573 - RNA, 24 nt, Human
cgccacagccgcugccucagcccg

SEQ ID NO: 1001574 - RNA, 19 nt, Human
cgcccagcgucgccgccac

SEQ ID NO: 1001575 - RNA, 18 nt, Human
cucauuagaaaugugaua

SEQ ID NO: 1001576 - RNA, 19 nt, Human
cuccaugggaaaagcacca

SEQ ID NO: 1001577 - RNA, 22 nt, Human
cuggaguaaugugugcauuuuu

SEQ ID NO: 1001578 - RNA, 18 nt, Human
cuugaaaacuucuaaaac

SEQ ID NO: 1001579 - RNA, 22 nt, Human
gaaagcaauugccaccuuccac

SEQ ID NO: 1001580 - RNA, 20 nt, Human
gagagcaguggggacccaac

SEQ ID NO: 1001581 - RNA, 22 nt, Human
gccgcugccucagcccgcgggc

SEQ ID NO: 1001582 - RNA, 27 nt, Human
uaaaacaacauaaauagaauacacuuc

SEQ ID NO: 1001583 - RNA, 21 nt, Human
uaacaaagccuggccuuggug

SEQ ID NO: 1001584 - RNA, 18 nt, Human
uaaguaacguuugguuug

SEQ ID NO: 1001585 - RNA, 18 nt, Human
uacugugagauaaaagca

SEQ ID NO: 1001586 - RNA, 23 nt, Human
ucacgcccagcgucgccgccaca

SEQ ID NO: 1001587 - RNA, 19 nt, Human
ucagcccgcgggccccgcc

SEQ ID NO: 1001588 - RNA, 28 nt, Human
ucagcccgcgggccccgcccuagcuucg

SEQ ID NO: 1001589 - RNA, 22 nt, Human
uccagcauguguuucccuggaa

SEQ ID NO: 1001590 - RNA, 25 nt, Human
ucccuggaacacucagagucugcac

SEQ ID NO: 1001591 - RNA, 22 nt, Human
ucccugggagacggcugugugg

SEQ ID NO: 1001592 - RNA, 18 nt, Human
ucuaaaacaaaagguaag

SEQ ID NO: 1001593 - RNA, 21 nt, Human
ucuccaugggaaaagcaccag

SEQ ID NO: 1001594 - RNA, 21 nt, Human
ucuuuuacaaacagugaaaau

SEQ ID NO: 1001595 - RNA, 22 nt, Human
ugagauaaaagcaaaacauaac

SEQ ID NO: 1001596 - RNA, 18 nt, Human
ugcagaagggauucccug

SEQ ID NO: 1001597 - RNA, 20 nt, Human
ugcagaagggauucccuggg

SEQ ID NO: 1001598 - RNA, 20 nt, Human
uggaacacucagagucugca

SEQ ID NO: 1001599 - RNA, 21 nt, Human
uggcuuucuagcuugcagucu

SEQ ID NO: 1001600 - RNA, 18 nt, Human
ugggaaaagcaccagaug

SEQ ID NO: 1001601 - RNA, 19 nt, Human
ugggaaaagcaccagaugg

SEQ ID NO: 1001602 - RNA, 24 nt, Human
ugggaaaagcaccagauggggaag

SEQ ID NO: 1001603 - RNA, 22 nt, Human
ugggaacaaacagguuucgaug

SEQ ID NO: 1001604 - RNA, 20 nt, Human
ugggagacggcugugugggg

SEQ ID NO: 1001605 - RNA, 23 nt, Human
ugguuugcagaagggauucccug

SEQ ID NO: 1001606 - RNA, 22 nt, Human
uuaacaaagccuggccuuggug

SEQ ID NO: 1001607 - RNA, 23 nt, Human
uuuuuuuuuucuaaaaaauauuu

SEQ ID NO: 1001608 - RNA, 22 nt, Human
aaacaugagccacaucaaugcc

SEQ ID NO: 1001609 - RNA, 19 nt, Human
agagggagcaggcagguuc

SEQ ID NO: 1001610 - RNA, 21 nt, Human
ccuaaucugcauccuggaaac

SEQ ID NO: 1001611 - RNA, 18 nt, Human
ccuggaaaccucuuuugc

SEQ ID NO: 1001612 - RNA, 23 nt, Human
cuccccagccccaaacuagcugg

SEQ ID NO: 1001613 - RNA, 22 nt, Human
gcacacgcuugagcaagcagca

SEQ ID NO: 1001614 - RNA, 18 nt, Human
gccugagcuccccagccc

SEQ ID NO: 1001615 - RNA, 26 nt, Human
ggucugggagagggagcaggcagguu

SEQ ID NO: 1001616 - RNA, 22 nt, Human
gucaaguuuucucuccauaaag

SEQ ID NO: 1001617 - RNA, 19 nt, Human
ucaacuguaccaaaaguaa

SEQ ID NO: 1001618 - RNA, 23 nt, Human
ucuccauaaaggacuugccaccu

SEQ ID NO: 1001619 - RNA, 22 nt, Human
ugagcaagcagcacaauaaucc

SEQ ID NO: 1001620 - RNA, 23 nt, Human
ugagcaagcagcacaauaaucca

SEQ ID NO: 1001621 - RNA, 19 nt, Human
ugccugagcuccccagccc

SEQ ID NO: 1001622 - RNA, 21 nt, Human
ugccugagcuccccagcccca

SEQ ID NO: 1001623 - RNA, 22 nt, Human
uuaaaaacaaucaucugaaugu

SEQ ID NO: 1001624 - RNA, 23 nt, Human
uugccaccuuaaggaccccaagu

SEQ ID NO: 1001625 - RNA, 24 nt, Human
ccacuaugcuguauaguuccuuuu

SEQ ID NO: 1001626 - RNA, 22 nt, Human
ccccauuacauaaaguaggaau

SEQ ID NO: 1001627 - RNA, 21 nt, Human
ccuuaagaaaaauauacagau

SEQ ID NO: 1001628 - RNA, 22 nt, Human
cuguauaguuccuuuucuccug

SEQ ID NO: 1001629 - RNA, 18 nt, Human
gccaagccuuuagguuuc

SEQ ID NO: 1001630 - RNA, 22 nt, Human
uagguuucuacuacuucaauuc

SEQ ID NO: 1001631 - RNA, 23 nt, Human
uuagguuucuacuacuucaauuu

SEQ ID NO: 1001632 - RNA, 18 nt, Human
uuaguacacaaaacucca

SEQ ID NO: 1001633 - RNA, 19 nt, Human
uucaagccugacgccaagc

SEQ ID NO: 1001634 - RNA, 20 nt, Human
aaacaagcaugaacggcagu

SEQ ID NO: 1001635 - RNA, 24 nt, Human
acauaccuaaguaaacauaacauu

SEQ ID NO: 1001636 - RNA, 21 nt, Human
caucuacuuggguagcuuggu

SEQ ID NO: 1001637 - RNA, 24 nt, Human
gcuuuggaaauuauugccucugau

SEQ ID NO: 1001638 - RNA, 18 nt, Human
uacuuggguagcuuggug

SEQ ID NO: 1001639 - RNA, 24 nt, Human
uagcuuggugccauuauccugugg

SEQ ID NO: 1001640 - RNA, 18 nt, Human
uaggaaacaagcaugaac

SEQ ID NO: 1001641 - RNA, 20 nt, Human
uaugcagucauuucugaggc

SEQ ID NO: 1001642 - RNA, 23 nt, Human
ucauagccccugugacauuuccu

SEQ ID NO: 1001643 - RNA, 24 nt, Human
ucuagaauaccagaaacaucuacu

SEQ ID NO: 1001644 - RNA, 21 nt, Human
ugaauagauacugcuucagaa

SEQ ID NO: 1001645 - RNA, 21 nt, Human
ugaugagauuauuuccuguau

SEQ ID NO: 1001646 - RNA, 23 nt, Human
ugcucugcuuuuuaguagccauc

SEQ ID NO: 1001647 - RNA, 24 nt, Human
uggaaaugaugagauuauuuccug

SEQ ID NO: 1001648 - RNA, 19 nt, Human
uggaaucugauaugucugg

SEQ ID NO: 1001649 - RNA, 20 nt, Human
ugugccaaugauacaggcac

SEQ ID NO: 1001650 - RNA, 21 nt, Human
uucagcacuggccugugccaa

SEQ ID NO: 1001651 - RNA, 23 nt, Human
uuggaaaugaugagauuauuucc

SEQ ID NO: 1001652 - RNA, 18 nt, Human
uuuuuuuuuuuuuuuuug

SEQ ID NO: 1001653 - RNA, 23 nt, Human
uuuuuuuuuuuuuuuuuuguuau

SEQ ID NO: 1001654 - RNA, 18 nt, Human
aauaagggcuaaaaggaa

SEQ ID NO: 1001655 - RNA, 24 nt, Human
aggaagaaguacggcagggcagga

SEQ ID NO: 1001656 - RNA, 22 nt, Human
aggccccucagggccuacccag

SEQ ID NO: 1001657 - RNA, 21 nt, Human
agggccuacccagcuuccucc

SEQ ID NO: 1001658 - RNA, 22 nt, Human
ccccucagggccuacccagcuu

SEQ ID NO: 1001659 - RNA, 19 nt, Human
cccucagggccuacccagc

SEQ ID NO: 1001660 - RNA, 25 nt, Human
ccucagggccuacccagcuuccucc

SEQ ID NO: 1001661 - RNA, 18 nt, Human
gaggacaaaagugggcgg

SEQ ID NO: 1001662 - RNA, 20 nt, Human
gggcagggcucagguaccuc

SEQ ID NO: 1001663 - RNA, 20 nt, Human
uaccgaggccccucagggcc

SEQ ID NO: 1001664 - RNA, 24 nt, Human
ugacccucucgggugcugcuggag

SEQ ID NO: 1001665 - RNA, 21 nt, Human
uggagggcagggcucaggucg

SEQ ID NO: 1001666 - RNA, 23 nt, Human
aaaacaauaaaaccauuaagagc

SEQ ID NO: 1001667 - RNA, 25 nt, Human
aagugacaccugugaucuaacccug

SEQ ID NO: 1001668 - RNA, 23 nt, Human
acuacucgccugaaagugacacc

SEQ ID NO: 1001669 - RNA, 19 nt, Human
acugcaaaccucuggcugc

SEQ ID NO: 1001670 - RNA, 20 nt, Human
acugcaaaccucuggcugcg

SEQ ID NO: 1001671 - RNA, 19 nt, Human
agacauggucccugucccc

SEQ ID NO: 1001672 - RNA, 24 nt, Human
agacauggucccuguccccaagga

SEQ ID NO: 1001673 - RNA, 20 nt, Human
agaugcuggagacacaaaga

SEQ ID NO: 1001674 - RNA, 29 nt, Human
aggcaaacagguagugcaaaggggacccc

SEQ ID NO: 1001675 - RNA, 21 nt, Human
auacuaaaaauuuacaucaua

SEQ ID NO: 1001676 - RNA, 22 nt, Human
auauugggcuuuucaacacaau

SEQ ID NO: 1001677 - RNA, 25 nt, Human
caaaccucuggcugcaggggucggc

SEQ ID NO: 1001678 - RNA, 21 nt, Human
caaagccaaauccagguugcu

SEQ ID NO: 1001679 - RNA, 23 nt, Human
cacuguacuagaugcuggagacc

SEQ ID NO: 1001680 - RNA, 22 nt, Human
caucgguaccuuccgcucuuaa

SEQ ID NO: 1001681 - RNA, 27 nt, Human
cauggucccuguccccaaggaacugau

SEQ ID NO: 1001682 - RNA, 21 nt, Human
ccacugcaaaccucuggcugc

SEQ ID NO: 1001683 - RNA, 25 nt, Human
cccaaggaacugauagucucuugga

SEQ ID NO: 1001684 - RNA, 18 nt, Human
cccagaaggaagccggca

SEQ ID NO: 1001685 - RNA, 22 nt, Human
ccccaaggaacugauagucucu

SEQ ID NO: 1001686 - RNA, 19 nt, Human
gaacucaucgguaccuucc

SEQ ID NO: 1001687 - RNA, 23 nt, Human
ggaauacacacuacccacugcaa

SEQ ID NO: 1001688 - RNA, 18 nt, Human
ggcacauuccuuccuuuc

SEQ ID NO: 1001689 - RNA, 25 nt, Human
uaaaacaacuguagaauauuagggc

SEQ ID NO: 1001690 - RNA, 24 nt, Human
uaacuacucgccugaaagugacac

SEQ ID NO: 1001691 - RNA, 19 nt, Human
uaauauugggcuuuucaac

SEQ ID NO: 1001692 - RNA, 20 nt, Human
uagaaauauuauugcccaca

SEQ ID NO: 1001693 - RNA, 27 nt, Human
uagaaauauuauugcccacauuugugc

SEQ ID NO: 1001694 - RNA, 21 nt, Human
uagcgauaccguugcuaacua

SEQ ID NO: 1001695 - RNA, 18 nt, Human
uaguaaaggauggaacuc

SEQ ID NO: 1001696 - RNA, 24 nt, Human
ucaaagccaaauccagguugcugc

SEQ ID NO: 1001697 - RNA, 29 nt, Human
ucaauaauauaguaauauugggcuuuucu

SEQ ID NO: 1001698 - RNA, 21 nt, Human
uccccaaggaacugauagucu

SEQ ID NO: 1001699 - RNA, 20 nt, Human
ucucuuggaggcaaacaggu

SEQ ID NO: 1001700 - RNA, 22 nt, Human
ugcuagaucccagaaggaagcc

SEQ ID NO: 1001701 - RNA, 21 nt, Human
uggaauacacacuacccacug

SEQ ID NO: 1001702 - RNA, 21 nt, Human
uggaggguacuugacauucaa

SEQ ID NO: 1001703 - RNA, 21 nt, Human
uggcugcaggggucggcucag

SEQ ID NO: 1001704 - RNA, 19 nt, Human
uguuggcaguucaguuggu

SEQ ID NO: 1001705 - RNA, 20 nt, Human
uuaaaagucuugggacauug

SEQ ID NO: 1001706 - RNA, 24 nt, Human
uuggaggguacuugacauucaagu

SEQ ID NO: 1001707 - RNA, 22 nt, Human
aaaaagguuuuugauugccuuu

SEQ ID NO: 1001708 - RNA, 25 nt, Human
aaagcaaaagcaggcuacaaaacaa

SEQ ID NO: 1001709 - RNA, 22 nt, Human
aacaaaaacaauuguaagacaa

SEQ ID NO: 1001710 - RNA, 26 nt, Human
aagcaaaagcaggcuacaaaacaaaa

SEQ ID NO: 1001711 - RNA, 21 nt, Human
acggcgcgggugccgugcggg

SEQ ID NO: 1001712 - RNA, 18 nt, Human
agacaaauugugaaagca

SEQ ID NO: 1001713 - RNA, 21 nt, Human
caaaagcaggcuacaaaacaa

SEQ ID NO: 1001714 - RNA, 18 nt, Human
cagcuggcaccgaacugg

SEQ ID NO: 1001715 - RNA, 19 nt, Human
cccacgcagcuggcaccga

SEQ ID NO: 1001716 - RNA, 18 nt, Human
cgcuuccuccuucaagua

SEQ ID NO: 1001717 - RNA, 27 nt, Human
uaacaaaaacaauuguaagacaaauug

SEQ ID NO: 1001718 - RNA, 19 nt, Human
uaagacaaauugugaaagc

SEQ ID NO: 1001719 - RNA, 26 nt, Human
ugaaagcaaaagcaggcuacaaaaca

SEQ ID NO: 1001720 - RNA, 20 nt, Human
ugaagugaugggauccgagg

SEQ ID NO: 1001721 - RNA, 25 nt, Human
ugagagcacgcccggcaaauuccaa

SEQ ID NO: 1001722 - RNA, 18 nt, Human
ugcuauaaaguguaaguu

SEQ ID NO: 1001723 - RNA, 23 nt, Human
uggagcccacgcagcuggcaccg

SEQ ID NO: 1001724 - RNA, 22 nt, Human
uguaaguuagcauuugcuaaua

SEQ ID NO: 1001725 - RNA, 25 nt, Human
uuuuuuuuuuuuuuuuuuuucaagg

SEQ ID NO: 1001726 - RNA, 18 nt, Human
aaaagaaaacagaaugga

SEQ ID NO: 1001727 - RNA, 25 nt, Human
aaaggggaaaaacuggaguuggaga

SEQ ID NO: 1001728 - RNA, 18 nt, Human
aacccuuccuucucccuc

SEQ ID NO: 1001729 - RNA, 22 nt, Human
aaggaaaggggaaaaacuggag

SEQ ID NO: 1001730 - RNA, 23 nt, Human
acagaauggaaguuuagaauauc

SEQ ID NO: 1001731 - RNA, 26 nt, Human
acccuuccuucucccucucuuccccc

SEQ ID NO: 1001732 - RNA, 21 nt, Human
agcuaagaauaaagcagguau

SEQ ID NO: 1001733 - RNA, 24 nt, Human
agugauggagccaaugugaaaaga

SEQ ID NO: 1001734 - RNA, 19 nt, Human
auggagcgugcucgaagcc

SEQ ID NO: 1001735 - RNA, 19 nt, Human
cagcaagugugaacaugcc

SEQ ID NO: 1001736 - RNA, 18 nt, Human
ccccugugucuggcacug

SEQ ID NO: 1001737 - RNA, 20 nt, Human
ccccuuguuuccccugcucu

SEQ ID NO: 1001738 - RNA, 21 nt, Human
ccccuuguuuccccugcucuc

SEQ ID NO: 1001739 - RNA, 19 nt, Human
cccucucuucccccucccu

SEQ ID NO: 1001740 - RNA, 20 nt, Human
cccuuccuucucccucucuu

SEQ ID NO: 1001741 - RNA, 21 nt, Human
cuauuuuauuuuauuuugcaa

SEQ ID NO: 1001742 - RNA, 20 nt, Human
cucccucucuucccccuccc

SEQ ID NO: 1001743 - RNA, 21 nt, Human
cuuucugcugugacugcggau

SEQ ID NO: 1001744 - RNA, 23 nt, Human
gaagccccuuguuuccccugcuc

SEQ ID NO: 1001745 - RNA, 21 nt, Human
gaguuggagagaauuuuaggg

SEQ ID NO: 1001746 - RNA, 19 nt, Human
gcuggccaaagucucugga

SEQ ID NO: 1001747 - RNA, 19 nt, Human
uaaacaguuguggcaccag

SEQ ID NO: 1001748 - RNA, 18 nt, Human
uauaauaaaucacuugac

SEQ ID NO: 1001749 - RNA, 22 nt, Human
ucaucagucaccagugauggag

SEQ ID NO: 1001750 - RNA, 19 nt, Human
ucucauggcuuucugcugu

SEQ ID NO: 1001751 - RNA, 19 nt, Human
ucuccugagcuugcucgac

SEQ ID NO: 1001752 - RNA, 20 nt, Human
ucuguggcccagaagucacc

SEQ ID NO: 1001753 - RNA, 21 nt, Human
ugaaaagaaaacagaauggaa

SEQ ID NO: 1001754 - RNA, 22 nt, Human
ugaaaagaaaacagaauggaag

SEQ ID NO: 1001755 - RNA, 21 nt, Human
ugaauagauaagagacaggug

SEQ ID NO: 1001756 - RNA, 20 nt, Human
ugccuuaaauccccuguguc

SEQ ID NO: 1001757 - RNA, 18 nt, Human
ugcuugcugccggcuuau

SEQ ID NO: 1001758 - RNA, 20 nt, Human
uggagagaauuuuagggcug

SEQ ID NO: 1001759 - RNA, 23 nt, Human
ugguccaggagcuccacagccag

SEQ ID NO: 1001760 - RNA, 19 nt, Human
uuaaauccccugugucugg

SEQ ID NO: 1001761 - RNA, 18 nt, Human
uucaaggaaaggggaaaa

SEQ ID NO: 1001762 - RNA, 23 nt, Human
uucaucagucaccagugauggag

SEQ ID NO: 1001763 - RNA, 25 nt, Human
uucauccaugacaggugagauacaa

SEQ ID NO: 1001764 - RNA, 22 nt, Human
uuguuuugcucagcuaagaaua

SEQ ID NO: 1001765 - RNA, 23 nt, Human
uuucuguucccuuauuuucuuca

SEQ ID NO: 1001766 - RNA, 25 nt, Human
aagaaacaggucuaggaugacagca

SEQ ID NO: 1001767 - RNA, 24 nt, Human
agacacuggcagauuauagaaaug

SEQ ID NO: 1001768 - RNA, 23 nt, Human
agauggggucuauuuggggcugg

SEQ ID NO: 1001769 - RNA, 20 nt, Human
aggcacagaaguuagacacu

SEQ ID NO: 1001770 - RNA, 20 nt, Human
aggcagaggucuccgucucu

SEQ ID NO: 1001771 - RNA, 18 nt, Human
augccaugccuggcucuu

SEQ ID NO: 1001772 - RNA, 21 nt, Human
augugugugcaugcagugugu

SEQ ID NO: 1001773 - RNA, 21 nt, Human
caaccgggaguaaggucaaga

SEQ ID NO: 1001774 - RNA, 19 nt, Human
ccagaaaauacgugagaca

SEQ ID NO: 1001775 - RNA, 22 nt, Human
ccccaggccaaccgggaguaag

SEQ ID NO: 1001776 - RNA, 18 nt, Human
ccccgcccccaggccaac

SEQ ID NO: 1001777 - RNA, 20 nt, Human
cccgcccccaggccaaccgg

SEQ ID NO: 1001778 - RNA, 22 nt, Human
cccgcccccaggccaaccggga

SEQ ID NO: 1001779 - RNA, 24 nt, Human
cccuggggagccagaauagccuca

SEQ ID NO: 1001780 - RNA, 21 nt, Human
ccucuaugccaugccuggcuc

SEQ ID NO: 1001781 - RNA, 20 nt, Human
ccuggagggggaggagcucu

SEQ ID NO: 1001782 - RNA, 22 nt, Human
cgaaagaaacaggucuaggaug

SEQ ID NO: 1001783 - RNA, 19 nt, Human
cgcugaggggacugaccgc

SEQ ID NO: 1001784 - RNA, 21 nt, Human
cgcugaggggacugaccgccc

SEQ ID NO: 1001785 - RNA, 23 nt, Human
cucuaugccaugccuggcucuuc

SEQ ID NO: 1001786 - RNA, 18 nt, Human
cuugcaagagcccagaaa

SEQ ID NO: 1001787 - RNA, 18 nt, Human
gcucuuugcagagcugag

SEQ ID NO: 1001788 - RNA, 18 nt, Human
gcugaggggacugaccgc

SEQ ID NO: 1001789 - RNA, 21 nt, Human
ggagggggaggagcucuuugc

SEQ ID NO: 1001790 - RNA, 22 nt, Human
ggcgaaagaaacaggucuagga

SEQ ID NO: 1001791 - RNA, 18 nt, Human
gggagccagaauagccuc

SEQ ID NO: 1001792 - RNA, 18 nt, Human
gggcagaagagaaauggg

SEQ ID NO: 1001793 - RNA, 21 nt, Human
gugugugugcaugcaggugcg

SEQ ID NO: 1001794 - RNA, 20 nt, Human
uaacaggcacagaaguuaga

SEQ ID NO: 1001795 - RNA, 20 nt, Human
uaggugugugugugugcaug

SEQ ID NO: 1001796 - RNA, 24 nt, Human
uaugcacaguguguggcuguggug

SEQ ID NO: 1001797 - RNA, 23 nt, Human
uaugugugugcaugcagugugug

SEQ ID NO: 1001798 - RNA, 18 nt, Human
ucuaggggcugcgugggg

SEQ ID NO: 1001799 - RNA, 21 nt, Human
ucuccuguaugacuuguguau

SEQ ID NO: 1001800 - RNA, 19 nt, Human
ugaccauugcccauugcca

SEQ ID NO: 1001801 - RNA, 22 nt, Human
ugagaugggugacuugcaagag

SEQ ID NO: 1001802 - RNA, 24 nt, Human
ugagguggugugugugcaugcagg

SEQ ID NO: 1001803 - RNA, 18 nt, Human
ugcagugugugguuguga

SEQ ID NO: 1001804 - RNA, 18 nt, Human
ugccucaugucuuuaguu

SEQ ID NO: 1001805 - RNA, 21 nt, Human
ugcguguaugcacagugugug

SEQ ID NO: 1001806 - RNA, 18 nt, Human
uggagggggaggagcucu

SEQ ID NO: 1001807 - RNA, 20 nt, Human
uggggcagaagagaaauggg

SEQ ID NO: 1001808 - RNA, 19 nt, Human
uggggugugcguguaugca

SEQ ID NO: 1001809 - RNA, 19 nt, Human
uggguuguggggugugcgu

SEQ ID NO: 1001810 - RNA, 18 nt, Human
uguaggugugugugugug

SEQ ID NO: 1001811 - RNA, 22 nt, Human
uguaugcagcaugcagcuugua

SEQ ID NO: 1001812 - RNA, 22 nt, Human
uguaugugugugcaugcagugu

SEQ ID NO: 1001813 - RNA, 19 nt, Human
uguggcgaaagaaacaggu

SEQ ID NO: 1001814 - RNA, 19 nt, Human
ugugguguaugugugugca

SEQ ID NO: 1001815 - RNA, 21 nt, Human
ugugguguaugugugugcaug

SEQ ID NO: 1001816 - RNA, 19 nt, Human
ugugguugugagguggugu

SEQ ID NO: 1001817 - RNA, 18 nt, Human
ugugugcaugcaggugcg

SEQ ID NO: 1001818 - RNA, 24 nt, Human
uguguggcugugguguaugugugu

SEQ ID NO: 1001819 - RNA, 24 nt, Human
ugugugguugugagguggugugug

SEQ ID NO: 1001820 - RNA, 20 nt, Human
ugugugugcaugcaguaugu

SEQ ID NO: 1001821 - RNA, 19 nt, Human
ugugugugugugcaugcag

SEQ ID NO: 1001822 - RNA, 19 nt, Human
uguucugucucacccuccc

SEQ ID NO: 1001823 - RNA, 25 nt, Human
uuaacaggcacagaaguuagacacu

SEQ ID NO: 1001824 - RNA, 18 nt, Human
uuagacacuugcauaggc

SEQ ID NO: 1001825 - RNA, 18 nt, Human
uucccacguaagcccugg

SEQ ID NO: 1001826 - RNA, 22 nt, Human
uucccacguaagcccuggggag

SEQ ID NO: 1001827 - RNA, 22 nt, Human
uuguggggugugcguguaugca

SEQ ID NO: 1001828 - RNA, 24 nt, Human
uuuaguugccaaccuccuuuuucc

SEQ ID NO: 1001829 - RNA, 20 nt, Human
acccaggaaaaugagagcaa

SEQ ID NO: 1001830 - RNA, 22 nt, Human
accuagccccacuucccacccc

SEQ ID NO: 1001831 - RNA, 25 nt, Human
agaguuccucacgcccugccagccc

SEQ ID NO: 1001832 - RNA, 22 nt, Human
aggagaguuccucacgcccugc

SEQ ID NO: 1001833 - RNA, 25 nt, Human
aggccgaggccagacccugacggga

SEQ ID NO: 1001834 - RNA, 18 nt, Human
aguaaugcaggccuggag

SEQ ID NO: 1001835 - RNA, 22 nt, Human
cagagccguuccugucucccuc

SEQ ID NO: 1001836 - RNA, 19 nt, Human
cauuccuuggcguucaugc

SEQ ID NO: 1001837 - RNA, 23 nt, Human
ccacccccagagccguuccuguc

SEQ ID NO: 1001838 - RNA, 22 nt, Human
ccagacccugacgggacucagc

SEQ ID NO: 1001839 - RNA, 18 nt, Human
cccaagggccggcccacc

SEQ ID NO: 1001840 - RNA, 24 nt, Human
cccaggaaaaugagagcaaguucc

SEQ ID NO: 1001841 - RNA, 26 nt, Human
ccccaagggccggcccaccgucuccc

SEQ ID NO: 1001842 - RNA, 18 nt, Human
ccccacuucccaccccca

SEQ ID NO: 1001843 - RNA, 21 nt, Human
ccccagccaguuuggagaggg

SEQ ID NO: 1001844 - RNA, 19 nt, Human
cccccaagggccggcccac

SEQ ID NO: 1001845 - RNA, 25 nt, Human
ccccgugcuugggcugggcuuccuc

SEQ ID NO: 1001846 - RNA, 21 nt, Human
cccgucuccugucuccugccu

SEQ ID NO: 1001847 - RNA, 23 nt, Human
cccugcaccugccugggugcccu

SEQ ID NO: 1001848 - RNA, 19 nt, Human
ccggcccaccgucucccug

SEQ ID NO: 1001849 - RNA, 22 nt, Human
ccugaggccgaggccagacccu

SEQ ID NO: 1001850 - RNA, 27 nt, Human
ccugaggccgaggccagaccggggucc

SEQ ID NO: 1001851 - RNA, 19 nt, Human
cuacuccucuuucuccccu

SEQ ID NO: 1001852 - RNA, 23 nt, Human
cucccucacucacacgcuuucca

SEQ ID NO: 1001853 - RNA, 23 nt, Human
cuugggcugggcuuccucugccc

SEQ ID NO: 1001854 - RNA, 24 nt, Human
gaaaaugagagcaaguuccaggaa

SEQ ID NO: 1001855 - RNA, 20 nt, Human
gaagauggaguuggcaagac

SEQ ID NO: 1001856 - RNA, 18 nt, Human
gaguuuguuacacuuggc

SEQ ID NO: 1001857 - RNA, 22 nt, Human
gccccagagcugaaggaguaau

SEQ ID NO: 1001858 - RNA, 18 nt, Human
ggccugggagaugagacc

SEQ ID NO: 1001859 - RNA, 18 nt, Human
ggcugggcuuccucugcc

SEQ ID NO: 1001860 - RNA, 19 nt, Human
gguguuugguuuuuguuuu

SEQ ID NO: 1001861 - RNA, 20 nt, Human
uacuccucuuucuccccugg

SEQ ID NO: 1001862 - RNA, 23 nt, Human
uagaggucccgucuccugucucc

SEQ ID NO: 1001863 - RNA, 20 nt, Human
uagccccacuucccaccccc

SEQ ID NO: 1001864 - RNA, 19 nt, Human
uaugacccugggguggaga

SEQ ID NO: 1001865 - RNA, 25 nt, Human
ucccagcagccccagccaguuugga

SEQ ID NO: 1001866 - RNA, 19 nt, Human
ucccuguagaggucccguc

SEQ ID NO: 1001867 - RNA, 22 nt, Human
ucccuguagaggucccgucucc

SEQ ID NO: 1001868 - RNA, 20 nt, Human
uccugucuccugccuuccug

SEQ ID NO: 1001869 - RNA, 22 nt, Human
uccuugggagucucccagcagc

SEQ ID NO: 1001870 - RNA, 19 nt, Human
ucuccugucuccugccuuc

SEQ ID NO: 1001871 - RNA, 24 nt, Human
ucuccugucuccugccuuccugac

SEQ ID NO: 1001872 - RNA, 21 nt, Human
ugacccugggguggagaccga

SEQ ID NO: 1001873 - RNA, 21 nt, Human
ugacgggacucagccuugggg

SEQ ID NO: 1001874 - RNA, 21 nt, Human
ugaggccgaggccagacccug

SEQ ID NO: 1001875 - RNA, 23 nt, Human
ugaugcacccaggaaaaugagag

SEQ ID NO: 1001876 - RNA, 21 nt, Human
ugggagucucccagcagcccc

SEQ ID NO: 1001877 - RNA, 21 nt, Human
ugggcugggcuuccucugccc

SEQ ID NO: 1001878 - RNA, 18 nt, Human
ugggugcccugggaaggg

SEQ ID NO: 1001879 - RNA, 19 nt, Human
uguagggccggcuccuugg

SEQ ID NO: 1001880 - RNA, 21 nt, Human
uuccuuggcguucaugcuacu

SEQ ID NO: 1001881 - RNA, 23 nt, Human
uugaagauggaguuggcaagacc

SEQ ID NO: 1001882 - RNA, 19 nt, Human
uuuuguuugaugcacccag

SEQ ID NO: 1001883 - RNA, 21 nt, Human
uuuuuuuuuuuucagggaucc

SEQ ID NO: 1001884 - RNA, 25 nt, Human
uuuuuuuuuuuuuuuuuuucagggg

SEQ ID NO: 1001885 - RNA, 18 nt, Human
aggaggugucugugaggu

SEQ ID NO: 1001886 - RNA, 24 nt, Human
cuggaggauccagagaggaggugu

SEQ ID NO: 1001887 - RNA, 19 nt, Human
ggaggauccagagaggagg

SEQ ID NO: 1001888 - RNA, 24 nt, Human
uggaggauccagagaggagguguc

SEQ ID NO: 1001889 - RNA, 20 nt, Human
uuuuuuuuuugagaacaggg

SEQ ID NO: 1001890 - RNA, 24 nt, Human
uuuuuuuuuuuugagaacaggguu

SEQ ID NO: 1001891 - RNA, 25 nt, Human
uuuuuuuuuuuuuuugagaacaggg

SEQ ID NO: 1001892 - RNA, 20 nt, Human
aagcaacagccugggcucca

SEQ ID NO: 1001893 - RNA, 20 nt, Human
accaccagacuggaaagcaa

SEQ ID NO: 1001894 - RNA, 21 nt, Human
auuuuauugcaggacuuuagg

SEQ ID NO: 1001895 - RNA, 23 nt, Human
caauggccaggagaguuuucagc

SEQ ID NO: 1001896 - RNA, 20 nt, Human
caccagacuggaaagcaacg

SEQ ID NO: 1001897 - RNA, 22 nt, Human
ccuccaauggccaggagaguuu

SEQ ID NO: 1001898 - RNA, 22 nt, Human
cugaaguuccagccuccaaugg

SEQ ID NO: 1001899 - RNA, 23 nt, Human
gauuuuauugcaggacuuuaggu

SEQ ID NO: 1001900 - RNA, 23 nt, Human
gcagugaaaggggcaguccugaa

SEQ ID NO: 1001901 - RNA, 21 nt, Human
uccuaagcaaaagagacugga

SEQ ID NO: 1001902 - RNA, 21 nt, Human
ugaaaggggcaguccugaagu

SEQ ID NO: 1001903 - RNA, 20 nt, Human
uggccaggagaguuuucagc

SEQ ID NO: 1001904 - RNA, 22 nt, Human
aaacguggaccuacauggagcu

SEQ ID NO: 1001905 - RNA, 18 nt, Human
aagagaggucccuuugau

SEQ ID NO: 1001906 - RNA, 23 nt, Human
aggggccguuugcccucugcccu

SEQ ID NO: 1001907 - RNA, 24 nt, Human
cauggagcugcguaaucucccggc

SEQ ID NO: 1001908 - RNA, 21 nt, Human
cccucugcccuaggagccuua

SEQ ID NO: 1001909 - RNA, 22 nt, Human
cccucugcccuaggagccuuac

SEQ ID NO: 1001910 - RNA, 22 nt, Human
ccucccaaccuaaacguggacc

SEQ ID NO: 1001911 - RNA, 24 nt, Human
ccucccaaccuaaacguggaccua

SEQ ID NO: 1001912 - RNA, 23 nt, Human
cucccaaccuaaacguggaccua

SEQ ID NO: 1001913 - RNA, 18 nt, Human
cucccggcucccuccugg

SEQ ID NO: 1001914 - RNA, 18 nt, Human
gcccuaggagccuuaccu

SEQ ID NO: 1001915 - RNA, 20 nt, Human
gggccguuugcccucugccc

SEQ ID NO: 1001916 - RNA, 21 nt, Human
gguggaggucugccagacugu

SEQ ID NO: 1001917 - RNA, 20 nt, Human
uaucaacuccuggggcuggu

SEQ ID NO: 1001918 - RNA, 21 nt, Human
uccuggggcugguggaggucu

SEQ ID NO: 1001919 - RNA, 18 nt, Human
ucucccagcgccaucacc

SEQ ID NO: 1001920 - RNA, 19 nt, Human
ucucccggcucccuccugg

SEQ ID NO: 1001921 - RNA, 22 nt, Human
ugaguaaagacuggagaucugg

SEQ ID NO: 1001922 - RNA, 24 nt, Human
ugaguaaagacuggagaucuggaa

SEQ ID NO: 1001923 - RNA, 23 nt, Human
ugccagacugugggccuaggggc

SEQ ID NO: 1001924 - RNA, 24 nt, Human
ugguggaggucugccagacugugg

SEQ ID NO: 1001925 - RNA, 23 nt, Human
uugaguaaagacuggagaucugg

SEQ ID NO: 1001926 - RNA, 23 nt, Human
uuggugacaagagaggucccuuu

SEQ ID NO: 1001927 - RNA, 25 nt, Human
uuuuuuuuuucuuuuuuuaaauuuu

SEQ ID NO: 1001928 - RNA, 25 nt, Human
cuagagaugguggcaucacuucuuc

SEQ ID NO: 1001929 - RNA, 22 nt, Human
aaacagaaaacggcagcccuaa

SEQ ID NO: 1001930 - RNA, 24 nt, Human
aacaugcacagaaacauaugcaua

SEQ ID NO: 1001931 - RNA, 22 nt, Human
aacucuguucccccucauuuua

SEQ ID NO: 1001932 - RNA, 20 nt, Human
aagaaagaggcacaguacua

SEQ ID NO: 1001933 - RNA, 18 nt, Human
aagcaggagagagaaccc

SEQ ID NO: 1001934 - RNA, 24 nt, Human
acaaagugaguaacugugccaaau

SEQ ID NO: 1001935 - RNA, 20 nt, Human
acaauaagcaaaacaaccuu

SEQ ID NO: 1001936 - RNA, 21 nt, Human
agagaacaugcacagaaacau

SEQ ID NO: 1001937 - RNA, 18 nt, Human
agcccagggagaaacaga

SEQ ID NO: 1001938 - RNA, 21 nt, Human
agcccagggagaaacagaaaa

SEQ ID NO: 1001939 - RNA, 19 nt, Human
aggagagaggcgaguccag

SEQ ID NO: 1001940 - RNA, 19 nt, Human
agggcuugaugaucccagg

SEQ ID NO: 1001941 - RNA, 23 nt, Human
caaccuucaugguaagauagccu

SEQ ID NO: 1001942 - RNA, 19 nt, Human
cacaccuccucagacagcc

SEQ ID NO: 1001943 - RNA, 23 nt, Human
cagacagccaaugaaacaacuaa

SEQ ID NO: 1001944 - RNA, 18 nt, Human
cagauucucccuagcaca

SEQ ID NO: 1001945 - RNA, 26 nt, Human
cagcccagggagaaacagaaaacggg

SEQ ID NO: 1001946 - RNA, 24 nt, Human
cagcuucuagggcuugaugauccc

SEQ ID NO: 1001947 - RNA, 20 nt, Human
caggugauaugcagaaaccc

SEQ ID NO: 1001948 - RNA, 22 nt, Human
caguacuauuguuuuuuaugaa

SEQ ID NO: 1001949 - RNA, 18 nt, Human
caguuaaauacagugaca

SEQ ID NO: 1001950 - RNA, 18 nt, Human
caguucacacgcagcagc

SEQ ID NO: 1001951 - RNA, 21 nt, Human
cauaugcauauaacuacuaua

SEQ ID NO: 1001952 - RNA, 19 nt, Human
ccacaccuccucagacagc

SEQ ID NO: 1001953 - RNA, 19 nt, Human
cccagggagaaacagaaaa

SEQ ID NO: 1001954 - RNA, 19 nt, Human
cccuagcacaucuucuccg

SEQ ID NO: 1001955 - RNA, 19 nt, Human
ccuaggucccagcuaccug

SEQ ID NO: 1001956 - RNA, 19 nt, Human
cggaagggauggaaaggca

SEQ ID NO: 1001957 - RNA, 23 nt, Human
cucauaguuuugugucauccauu

SEQ ID NO: 1001958 - RNA, 21 nt, Human
cuuuccgcagcccagggagaa

SEQ ID NO: 1001959 - RNA, 21 nt, Human
gaaacagaaaacggcagcccu

SEQ ID NO: 1001960 - RNA, 25 nt, Human
gaaauuucuccaagccauaagcaua

SEQ ID NO: 1001961 - RNA, 20 nt, Human
gacuucagugaacaaggauu

SEQ ID NO: 1001962 - RNA, 22 nt, Human
gagaaacagaaaacggcagccc

SEQ ID NO: 1001963 - RNA, 18 nt, Human
gccuaggucccagcuacc

SEQ ID NO: 1001964 - RNA, 21 nt, Human
gcggaucccagugccgugaag

SEQ ID NO: 1001965 - RNA, 22 nt, Human
gcuuuccgcagcccagggagaa

SEQ ID NO: 1001966 - RNA, 18 nt, Human
ggggggaggagaggagag

SEQ ID NO: 1001967 - RNA, 22 nt, Human
gguuuuugucauguagcaguuu

SEQ ID NO: 1001968 - RNA, 24 nt, Human
gucauguagcaguuuuuauguaga

SEQ ID NO: 1001969 - RNA, 19 nt, Human
gucccgguauauccaugcu

SEQ ID NO: 1001970 - RNA, 18 nt, Human
uaaauacagugacaccuu

SEQ ID NO: 1001971 - RNA, 21 nt, Human
uaacuacuauacaggugauau

SEQ ID NO: 1001972 - RNA, 18 nt, Human
uacuggaaaagagauaau

SEQ ID NO: 1001973 - RNA, 21 nt, Human
uacuucagcguauucagcagc

SEQ ID NO: 1001974 - RNA, 24 nt, Human
uauaaaaguccacaccuccucaga

SEQ ID NO: 1001975 - RNA, 25 nt, Human
uauauaaaaguccacaccuccucag

SEQ ID NO: 1001976 - RNA, 22 nt, Human
uaugaguguuuaauacuggaaa

SEQ ID NO: 1001977 - RNA, 21 nt, Human
ucaguucacacgcagcagcca

SEQ ID NO: 1001978 - RNA, 18 nt, Human
uccacaccuccucagaca

SEQ ID NO: 1001979 - RNA, 18 nt, Human
ucuuuuuacccuccuuuc

SEQ ID NO: 1001980 - RNA, 22 nt, Human
ugacaccuuacaauuguguaga

SEQ ID NO: 1001981 - RNA, 24 nt, Human
ugcaacaguuaaauacagugacac

SEQ ID NO: 1001982 - RNA, 22 nt, Human
uucacaaccccauguaggacac

SEQ ID NO: 1001983 - RNA, 23 nt, Human
aaagugcuuuuccccauccacca

SEQ ID NO: 1001984 - RNA, 21 nt, Human
aacccagugucugccuaaugg

SEQ ID NO: 1001985 - RNA, 24 nt, Human
aagcaguggguugcuuaggucacc

SEQ ID NO: 1001986 - RNA, 25 nt, Human
acaaaacaucccuuccacauucccc

SEQ ID NO: 1001987 - RNA, 20 nt, Human
acaaggauaugcucccaaau

SEQ ID NO: 1001988 - RNA, 24 nt, Human
accaguucccuggucccuucuuuu

SEQ ID NO: 1001989 - RNA, 21 nt, Human
auggcugauguuuucaguucc

SEQ ID NO: 1001990 - RNA, 20 nt, Human
cacagcacccaggugacuag

SEQ ID NO: 1001991 - RNA, 21 nt, Human
cagagccagggcacgcagcgc

SEQ ID NO: 1001992 - RNA, 18 nt, Human
cccgcccagcagccgagu

SEQ ID NO: 1001993 - RNA, 23 nt, Human
ccucccuguaacccuuaagguca

SEQ ID NO: 1001994 - RNA, 28 nt, Human
ccugagccagagcaggucauucugaggc

SEQ ID NO: 1001995 - RNA, 19 nt, Human
ccugugacagcagcccgcc

SEQ ID NO: 1001996 - RNA, 18 nt, Human
ccuuccacauuccccuca

SEQ ID NO: 1001997 - RNA, 21 nt, Human
cucaagacagucccuugaaga

SEQ ID NO: 1001998 - RNA, 21 nt, Human
cugggggccuggccauggcug

SEQ ID NO: 1001999 - RNA, 20 nt, Human
cuguagcuggagucugaagc

SEQ ID NO: 1002000 - RNA, 25 nt, Human
cugugugcagccucccuguaacccu

SEQ ID NO: 1002001 - RNA, 21 nt, Human
cuuaaggucaugcucugcuuu

SEQ ID NO: 1002002 - RNA, 19 nt, Human
gcuccgugcgccgggagcg

SEQ ID NO: 1002003 - RNA, 19 nt, Human
gcuccgugcgccgggagcg

SEQ ID NO: 1002004 - RNA, 18 nt, Human
ggagcgcgagugugcucc

SEQ ID NO: 1002005 - RNA, 20 nt, Human
ggugucuuaaagcugagaac

SEQ ID NO: 1002006 - RNA, 21 nt, Human
uacuuuggagcccucaagaca

SEQ ID NO: 1002007 - RNA, 18 nt, Human
ucaagacagucccuugaa

SEQ ID NO: 1002008 - RNA, 19 nt, Human
ucaagguuuuauuuuaauu

SEQ ID NO: 1002009 - RNA, 24 nt, Human
ucagguuucagucccggagcgcga

SEQ ID NO: 1002010 - RNA, 21 nt, Human
ucauucugaggccaacucugg

SEQ ID NO: 1002011 - RNA, 22 nt, Human
uccaccagggaucccugagcca

SEQ ID NO: 1002012 - RNA, 18 nt, Human
ucccggagcgcgagugug

SEQ ID NO: 1002013 - RNA, 24 nt, Human
ucccuguaacccuuaaggucaugc

SEQ ID NO: 1002014 - RNA, 18 nt, Human
uccgugcgccgggagcgc

SEQ ID NO: 1002015 - RNA, 18 nt, Human
uccgugcgccgggagcgc

SEQ ID NO: 1002016 - RNA, 19 nt, Human
ucuggcugcagugacaagg

SEQ ID NO: 1002017 - RNA, 28 nt, Human
ucuuuugucuucugggggccuggccaug

SEQ ID NO: 1002018 - RNA, 18 nt, Human
ugacagcagcccgcccag

SEQ ID NO: 1002019 - RNA, 19 nt, Human
ugggacuuucagcacagca

SEQ ID NO: 1002020 - RNA, 20 nt, Human
uuaaaagacauuguucgugc

SEQ ID NO: 1002021 - RNA, 23 nt, Human
uucugggggccuggccauggcug

SEQ ID NO: 1002022 - RNA, 18 nt, Human
uuuuuuuuuuuuuuuuug

SEQ ID NO: 1002023 - RNA, 26 nt, Human
uuuuuuuuuuuuuuuuuugacuuuuu

SEQ ID NO: 1002024 - RNA, 24 nt, Human
aaaguucugcacuaggugagaagu

SEQ ID NO: 1002025 - RNA, 22 nt, Human
acccuaagggaugagggagggg

SEQ ID NO: 1002026 - RNA, 19 nt, Human
acuuccuccauugcucuuc

SEQ ID NO: 1002027 - RNA, 21 nt, Human
agagcuccucccccgccuccc

SEQ ID NO: 1002028 - RNA, 25 nt, Human
agagcuccucccccgccucccgccu

SEQ ID NO: 1002029 - RNA, 23 nt, Human
agguaacaugaaucucaaagucc

SEQ ID NO: 1002030 - RNA, 24 nt, Human
agguaacaugaaucucaaagucca

SEQ ID NO: 1002031 - RNA, 23 nt, Human
caaaacacaacccaaauaaacug

SEQ ID NO: 1002032 - RNA, 22 nt, Human
caaagcgucauuuaaauuaaaa

SEQ ID NO: 1002033 - RNA, 22 nt, Human
cagccgccuagccgacuccagc

SEQ ID NO: 1002034 - RNA, 20 nt, Human
cagccugguaaaaguucugc

SEQ ID NO: 1002035 - RNA, 24 nt, Human
cagcugaagaauaacugcagguau

SEQ ID NO: 1002036 - RNA, 24 nt, Human
cccaagaaauuguacaguaguuga

SEQ ID NO: 1002037 - RNA, 19 nt, Human
cccccgccucccgccuccc

SEQ ID NO: 1002038 - RNA, 21 nt, Human
ccggcggcagccgccguuucc

SEQ ID NO: 1002039 - RNA, 18 nt, Human
cgccuagccgacuccagc

SEQ ID NO: 1002040 - RNA, 18 nt, Human
cucccccgccucccgccu

SEQ ID NO: 1002041 - RNA, 20 nt, Human
cucccccgccucccgccucc

SEQ ID NO: 1002042 - RNA, 18 nt, Human
cucccgccucccugaguc

SEQ ID NO: 1002043 - RNA, 18 nt, Human
cucccugagucaccggcg

SEQ ID NO: 1002044 - RNA, 20 nt, Human
gaggggacucagacacaaaa

SEQ ID NO: 1002045 - RNA, 25 nt, Human
uaaacacuagaaauauacauuagac

SEQ ID NO: 1002046 - RNA, 22 nt, Human
uacauauacacauuuacugucu

SEQ ID NO: 1002047 - RNA, 20 nt, Human
uagccgacuccagcgcugac

SEQ ID NO: 1002048 - RNA, 19 nt, Human
uccauugcucuucuggacc

SEQ ID NO: 1002049 - RNA, 21 nt, Human
ucccccgccucccgccucccu

SEQ ID NO: 1002050 - RNA, 22 nt, Human
uccucccccgccucccgccucc

SEQ ID NO: 1002051 - RNA, 20 nt, Human
ucuguaaacacuagaaauau

SEQ ID NO: 1002052 - RNA, 19 nt, Human
ugagguaacaugaaucuca

SEQ ID NO: 1002053 - RNA, 21 nt, Human
ugcaaaaugcuuaacacuuaa

SEQ ID NO: 1002054 - RNA, 22 nt, Human
ugcaggaagagcuccucccccg

SEQ ID NO: 1002055 - RNA, 24 nt, Human
ugcagguauuguuccagagcugau

SEQ ID NO: 1002056 - RNA, 24 nt, Human
ugccauacaauaagaacugcaaca

SEQ ID NO: 1002057 - RNA, 21 nt, Human
ugguaaaaguucugcacuagg

SEQ ID NO: 1002058 - RNA, 22 nt, Human
uuagcaaagcgucauuuaaauu

SEQ ID NO: 1002059 - RNA, 19 nt, Human
uucuguaaauaguuacuac

SEQ ID NO: 1002060 - RNA, 24 nt, Human
uuuaacuaaagaugguuaacccca

SEQ ID NO: 1002061 - RNA, 20 nt, Human
uuuacugucuguaaacacua

SEQ ID NO: 1002062 - RNA, 22 nt, Human
accccucagucucaagagagcg

SEQ ID NO: 1002063 - RNA, 18 nt, Human
aggcgggaggacugaggg

SEQ ID NO: 1002064 - RNA, 22 nt, Human
cacacaguguguacucaugccc

SEQ ID NO: 1002065 - RNA, 18 nt, Human
cgacuucugcggaccccu

SEQ ID NO: 1002066 - RNA, 22 nt, Human
cucuaaauaguccacguucugc

SEQ ID NO: 1002067 - RNA, 28 nt, Human
ucaauucaauccaaauauucuuuccuua

SEQ ID NO: 1002068 - RNA, 18 nt, Human
uccaaauauucuuuccuu

SEQ ID NO: 1002069 - RNA, 18 nt, Human
uccacguucugcaggggu

SEQ ID NO: 1002070 - RNA, 27 nt, Human
aaaaaaaacaaaacaaaaaaacuaaaa

SEQ ID NO: 1002071 - RNA, 22 nt, Human
aaaaaaacuaaaaacguagaua

SEQ ID NO: 1002072 - RNA, 21 nt, Human
aaaaaugugcauuuuucuauc

SEQ ID NO: 1002073 - RNA, 20 nt, Human
aaaauaguacuguuaaggca

SEQ ID NO: 1002074 - RNA, 24 nt, Human
aaacaacacagagagacccaacaa

SEQ ID NO: 1002075 - RNA, 27 nt, Human
aaacaacacagagagacccaacaagcu

SEQ ID NO: 1002076 - RNA, 22 nt, Human
aaacagaacugggcugaaucug

SEQ ID NO: 1002077 - RNA, 19 nt, Human
aaagaaaauacaaagccag

SEQ ID NO: 1002078 - RNA, 21 nt, Human
aaagaaaauacaaagccagag

SEQ ID NO: 1002079 - RNA, 22 nt, Human
aacaccgcucuuuuccaucuga

SEQ ID NO: 1002080 - RNA, 23 nt, Human
aagcaucggaaaauguugcacuu

SEQ ID NO: 1002081 - RNA, 22 nt, Human
aaucacaacuuccuaaucacag

SEQ ID NO: 1002082 - RNA, 22 nt, Human
acaaaaaaacuaaaaacguagg

SEQ ID NO: 1002083 - RNA, 24 nt, Human
acaaaacaaaaaaacuaaaaacgu

SEQ ID NO: 1002084 - RNA, 24 nt, Human
acaaaacaacacagagagacccaa

SEQ ID NO: 1002085 - RNA, 18 nt, Human
agaaacuggcaaaguaga

SEQ ID NO: 1002086 - RNA, 22 nt, Human
agaaauacuguggugcauuuuu

SEQ ID NO: 1002087 - RNA, 19 nt, Human
agacccaacaagcuggacc

SEQ ID NO: 1002088 - RNA, 24 nt, Human
agacccaacaagcuggaccuuauu

SEQ ID NO: 1002089 - RNA, 18 nt, Human
agugggcuuuucagaagc

SEQ ID NO: 1002090 - RNA, 18 nt, Human
auacaaagccagagcauu

SEQ ID NO: 1002091 - RNA, 20 nt, Human
aucacaacuuccuaaucaca

SEQ ID NO: 1002092 - RNA, 21 nt, Human
aucggaaaauguugcacuuug

SEQ ID NO: 1002093 - RNA, 26 nt, Human
caaaacaaaaaaacuaaaaacguaga

SEQ ID NO: 1002094 - RNA, 20 nt, Human
caaaacaacacagagagacc

SEQ ID NO: 1002095 - RNA, 21 nt, Human
caaaacaacacagagagaccc

SEQ ID NO: 1002096 - RNA, 22 nt, Human
caaaacaacacagagagaccca

SEQ ID NO: 1002097 - RNA, 21 nt, Human
caaaacgcagauuagaacagc

SEQ ID NO: 1002098 - RNA, 20 nt, Human
caaaguagaauguuaaaagc

SEQ ID NO: 1002099 - RNA, 24 nt, Human
caacaagcuggaccuuauuaaaaa

SEQ ID NO: 1002100 - RNA, 19 nt, Human
caacacagagagacccaac

SEQ ID NO: 1002101 - RNA, 19 nt, Human
caacuccugacaagucacc

SEQ ID NO: 1002102 - RNA, 19 nt, Human
caagaacagugaaugaaaa

SEQ ID NO: 1002103 - RNA, 23 nt, Human
cacaacuuccuaaucacaguuca

SEQ ID NO: 1002104 - RNA, 23 nt, Human
cacaccaagacugcccggagaag

SEQ ID NO: 1002105 - RNA, 20 nt, Human
cacagaccauaaaaauuaac

SEQ ID NO: 1002106 - RNA, 22 nt, Human
cacagaccauaaaaauuaacac

SEQ ID NO: 1002107 - RNA, 23 nt, Human
cacagagagacccaacaagcugg

SEQ ID NO: 1002108 - RNA, 22 nt, Human
cacaggcacuggcuuccauacu

SEQ ID NO: 1002109 - RNA, 19 nt, Human
cacucuaaaacagaacugg

SEQ ID NO: 1002110 - RNA, 23 nt, Human
cagaacuuucuuacagagaaaaa

SEQ ID NO: 1002111 - RNA, 22 nt, Human
caggacaggcaauuuucagugg

SEQ ID NO: 1002112 - RNA, 23 nt, Human
cauaacugauauacugaccacaa

SEQ ID NO: 1002113 - RNA, 18 nt, Human
cauacaaacacagccccc

SEQ ID NO: 1002114 - RNA, 23 nt, Human
ccaaagcugguauuuucaacugg

SEQ ID NO: 1002115 - RNA, 18 nt, Human
ccaugacaaagagcacaa

SEQ ID NO: 1002116 - RNA, 23 nt, Human
ccauuuacuuucaaaauagaauc

SEQ ID NO: 1002117 - RNA, 22 nt, Human
cccccaugcuagaaauacugug

SEQ ID NO: 1002118 - RNA, 23 nt, Human
cccggagaagccuucaugaaguc

SEQ ID NO: 1002119 - RNA, 23 nt, Human
ccugacaagucaccuuuaaaaca

SEQ ID NO: 1002120 - RNA, 20 nt, Human
ccugaggggagaggaacugg

SEQ ID NO: 1002121 - RNA, 24 nt, Human
cgcagauuagaacagcucuuuuga

SEQ ID NO: 1002122 - RNA, 19 nt, Human
cgggcagaugugacugaag

SEQ ID NO: 1002123 - RNA, 23 nt, Human
cguuuauuucucauacaaacaca

SEQ ID NO: 1002124 - RNA, 24 nt, Human
cuaaagcaucggaaaauguugcac

SEQ ID NO: 1002125 - RNA, 23 nt, Human
cuccugaggggagaggaacugga

SEQ ID NO: 1002126 - RNA, 25 nt, Human
cugaaucugaaaguuauuuuuccau

SEQ ID NO: 1002127 - RNA, 18 nt, Human
cugcugggguggggucug

SEQ ID NO: 1002128 - RNA, 21 nt, Human
cuuaacaugcaaaacgcagau

SEQ ID NO: 1002129 - RNA, 18 nt, Human
gaaaagguggcagggaca

SEQ ID NO: 1002130 - RNA, 23 nt, Human
gaacugggcugaaucugaaaguu

SEQ ID NO: 1002131 - RNA, 22 nt, Human
gaagccuucaugaagucaagaa

SEQ ID NO: 1002132 - RNA, 19 nt, Human
gacccaacuugggaaaugc

SEQ ID NO: 1002133 - RNA, 19 nt, Human
gauauuaacacuuaacaug

SEQ ID NO: 1002134 - RNA, 20 nt, Human
ggcaaagcaagcacugugga

SEQ ID NO: 1002135 - RNA, 23 nt, Human
ggcuggaaccuaaggcucaucug

SEQ ID NO: 1002136 - RNA, 19 nt, Human
gggcagagagcuccuugcu

SEQ ID NO: 1002137 - RNA, 21 nt, Human
ggucuuuccucugcagaaguu

SEQ ID NO: 1002138 - RNA, 23 nt, Human
guccucuucaccuugugugucca

SEQ ID NO: 1002139 - RNA, 21 nt, Human
guggagaaauacacauaaaua

SEQ ID NO: 1002140 - RNA, 23 nt, Human
uaaaaaaaaacaaaacaaaaaaa

SEQ ID NO: 1002141 - RNA, 20 nt, Human
uaaaacagcauaaccagaac

SEQ ID NO: 1002142 - RNA, 23 nt, Human
uaaacaacagggaggagacuaga

SEQ ID NO: 1002143 - RNA, 24 nt, Human
uaaauggaaugaaugucagucauu

SEQ ID NO: 1002144 - RNA, 24 nt, Human
uaaccagaacuuucuuacagagaa

SEQ ID NO: 1002145 - RNA, 18 nt, Human
uaacugauauacugacca

SEQ ID NO: 1002146 - RNA, 22 nt, Human
uaaucuaaugaagaaacuggca

SEQ ID NO: 1002147 - RNA, 21 nt, Human
uacaaacacagcccccaugcu

SEQ ID NO: 1002148 - RNA, 18 nt, Human
uacacaggcacuggcuuc

SEQ ID NO: 1002149 - RNA, 21 nt, Human
uacguuuauuucucauacaaa

SEQ ID NO: 1002150 - RNA, 25 nt, Human
uagcaaaggcugaacuaaguucuca

SEQ ID NO: 1002151 - RNA, 26 nt, Human
uauuaaaaaaaaacaaaacaaaaaaa

SEQ ID NO: 1002152 - RNA, 24 nt, Human
ucagcccugacaaaggacuucgga

SEQ ID NO: 1002153 - RNA, 21 nt, Human
ucagugaguguacagcuacuu

SEQ ID NO: 1002154 - RNA, 22 nt, Human
ucagugggcuuuucagaagcuc

SEQ ID NO: 1002155 - RNA, 18 nt, Human
uccaugcuaggggaaagc

SEQ ID NO: 1002156 - RNA, 19 nt, Human
ucccaugagaggcccuccu

SEQ ID NO: 1002157 - RNA, 22 nt, Human
uccugacaagucaccuuuaaaa

SEQ ID NO: 1002158 - RNA, 22 nt, Human
ucggaacaaggagggaagacca

SEQ ID NO: 1002159 - RNA, 25 nt, Human
ucuccaaccgaccacguucgggguu

SEQ ID NO: 1002160 - RNA, 24 nt, Human
ugaaaagaggaagaacauuuauuu

SEQ ID NO: 1002161 - RNA, 22 nt, Human
ugaaugucagucauuuagcaau

SEQ ID NO: 1002162 - RNA, 22 nt, Human
ugacaggcuccucauuaaagcu

SEQ ID NO: 1002163 - RNA, 20 nt, Human
ugagaaugaaaaguaagcag

SEQ ID NO: 1002164 - RNA, 22 nt, Human
ugcaaaacgcagauuagaacag

SEQ ID NO: 1002165 - RNA, 23 nt, Human
ugcccggagaagccuucaugaag

SEQ ID NO: 1002166 - RNA, 22 nt, Human
ugcugagugagccugcuggggu

SEQ ID NO: 1002167 - RNA, 24 nt, Human
ugcugggcagagagcuccuugcug

SEQ ID NO: 1002168 - RNA, 19 nt, Human
ugcugggguggggucugca

SEQ ID NO: 1002169 - RNA, 20 nt, Human
ugcugggguggggucugcag

SEQ ID NO: 1002170 - RNA, 22 nt, Human
uggcuugacaucugaacaaugu

SEQ ID NO: 1002171 - RNA, 19 nt, Human
ugggaaaugcucagggguu

SEQ ID NO: 1002172 - RNA, 21 nt, Human
ugggaacgcagaaucggaaca

SEQ ID NO: 1002173 - RNA, 19 nt, Human
uggggaaacaugacaggcu

SEQ ID NO: 1002174 - RNA, 24 nt, Human
ugggguggggucugcaggcggcug

SEQ ID NO: 1002175 - RNA, 21 nt, Human
uguaaagaaaauacaaagcca

SEQ ID NO: 1002176 - RNA, 18 nt, Human
uguggugcauuuuuuuuu

SEQ ID NO: 1002177 - RNA, 20 nt, Human
uuaacacuuaacaugcaaaa

SEQ ID NO: 1002178 - RNA, 26 nt, Human
uucaaaauagaauccggcagggaagu

SEQ ID NO: 1002179 - RNA, 18 nt, Human
uuccucaucuucaauuuc

SEQ ID NO: 1002180 - RNA, 22 nt, Human
uucucaggcaauaaauuuaugg

SEQ ID NO: 1002181 - RNA, 24 nt, Human
uucucauacaaacacagcccccau

SEQ ID NO: 1002182 - RNA, 19 nt, Human
uuucagaguuccucauccu

SEQ ID NO: 1002183 - RNA, 21 nt, Human
uuuucagugggcuuuucagaa

SEQ ID NO: 1002184 - RNA, 18 nt, Human
uuuuuuuuuuuuuuuuug

SEQ ID NO: 1002185 - RNA, 22 nt, Human
uuuuuuuuuuuuuuuuuggugg

SEQ ID NO: 1002186 - RNA, 25 nt, Human
aagcaauccuccugccucagccucu

SEQ ID NO: 1002187 - RNA, 24 nt, Human
aaguagcuggaacuagauacacac

SEQ ID NO: 1002188 - RNA, 21 nt, Human
acugcacccggcuaacgacag

SEQ ID NO: 1002189 - RNA, 19 nt, Human
agagcaguggcgcgaucuc

SEQ ID NO: 1002190 - RNA, 21 nt, Human
agcccggaagauggggagcgg

SEQ ID NO: 1002191 - RNA, 20 nt, Human
auccuccugccucagccucu

SEQ ID NO: 1002192 - RNA, 22 nt, Human
caagcaauccuccugccucagc

SEQ ID NO: 1002193 - RNA, 23 nt, Human
cacacagcacugcacccggcuaa

SEQ ID NO: 1002194 - RNA, 22 nt, Human
cacccaggcuggagagcagugg

SEQ ID NO: 1002195 - RNA, 22 nt, Human
ccagcccggaagauggggagcg

SEQ ID NO: 1002196 - RNA, 23 nt, Human
ccagcccggaagauggggagcgg

SEQ ID NO: 1002197 - RNA, 21 nt, Human
ccgccgcgucccgcgucgcca

SEQ ID NO: 1002198 - RNA, 21 nt, Human
ccgccgcgucccgcgucgcca

SEQ ID NO: 1002199 - RNA, 19 nt, Human
ccucccagcccggaagaug

SEQ ID NO: 1002200 - RNA, 26 nt, Human
ccuccugccucagccucucaaguagc

SEQ ID NO: 1002201 - RNA, 24 nt, Human
ccugccucagccucucaaguagcu

SEQ ID NO: 1002202 - RNA, 19 nt, Human
ccuggaucacagccgcagc

SEQ ID NO: 1002203 - RNA, 19 nt, Human
cgcggccggucccgccucc

SEQ ID NO: 1002204 - RNA, 22 nt, Human
cgcggccggucccgccucccuc

SEQ ID NO: 1002205 - RNA, 18 nt, Human
cggggacaggcgacgcgg

SEQ ID NO: 1002206 - RNA, 23 nt, Human
cuagauacacacagcacugcacc

SEQ ID NO: 1002207 - RNA, 24 nt, Human
cucaagcaauccuccugccucagc

SEQ ID NO: 1002208 - RNA, 24 nt, Human
gacuaaaaacccucuaauaaagau

SEQ ID NO: 1002209 - RNA, 18 nt, Human
gcccggaagauggggagc

SEQ ID NO: 1002210 - RNA, 18 nt, Human
gccggucccgccucccuc

SEQ ID NO: 1002211 - RNA, 25 nt, Human
gcucugccacccaggcuggagagca

SEQ ID NO: 1002212 - RNA, 21 nt, Human
uaacauacagcugagaaagaa

SEQ ID NO: 1002213 - RNA, 20 nt, Human
uacagcugagaaagaaagac

SEQ ID NO: 1002214 - RNA, 23 nt, Human
ucacugcaacugccacuuucugg

SEQ ID NO: 1002215 - RNA, 25 nt, Human
ucacugcaacugccacuuugggccu

SEQ ID NO: 1002216 - RNA, 18 nt, Human
ucucaaguagcuggaacu

SEQ ID NO: 1002217 - RNA, 23 nt, Human
ucucgcucugccacccaggcugg

SEQ ID NO: 1002218 - RNA, 24 nt, Human
ucucgcucugccacccaggcugga

SEQ ID NO: 1002219 - RNA, 24 nt, Human
ucucgcucugccacccaggcugga

SEQ ID NO: 1002220 - RNA, 25 nt, Human
ucucgcucugccacccaggcuggag

SEQ ID NO: 1002221 - RNA, 22 nt, Human
ugagacagggucucgcucugcc

SEQ ID NO: 1002222 - RNA, 24 nt, Human
ugccucagccucucaaguagcugg

SEQ ID NO: 1002223 - RNA, 24 nt, Human
uggacucaagcaauccuccugccu

SEQ ID NO: 1002224 - RNA, 23 nt, Human
uggagagcaguggcgcgaucucc

SEQ ID NO: 1002225 - RNA, 24 nt, Human
uguuuauuuuuugagacagggucu

SEQ ID NO: 1002226 - RNA, 26 nt, Human
uuuuguuuauuuuuugagacaggguc

SEQ ID NO: 1002227 - RNA, 19 nt, Human
acccccaucccugcccaag

SEQ ID NO: 1002228 - RNA, 18 nt, Human
agaagcccaccaucccag

SEQ ID NO: 1002229 - RNA, 23 nt, Human
aggcauccaacacccccaucccu

SEQ ID NO: 1002230 - RNA, 20 nt, Human
aggccuaggccugggguggg

SEQ ID NO: 1002231 - RNA, 24 nt, Human
cacccccaucccugcccaagcguc

SEQ ID NO: 1002232 - RNA, 21 nt, Human
cacuucuggcccuuacagaga

SEQ ID NO: 1002233 - RNA, 26 nt, Human
cauccaacacccccaucccugcccaa

SEQ ID NO: 1002234 - RNA, 23 nt, Human
ccaacacccccaucccugcccaa

SEQ ID NO: 1002235 - RNA, 22 nt, Human
cccaccaucccagacucuggua

SEQ ID NO: 1002236 - RNA, 26 nt, Human
cccagcccaggcccaggccuaggccu

SEQ ID NO: 1002237 - RNA, 19 nt, Human
ccccagcccaggcccaggc

SEQ ID NO: 1002238 - RNA, 20 nt, Human
ccccugggggacccagaccu

SEQ ID NO: 1002239 - RNA, 23 nt, Human
ccccugggggacccagaccucug

SEQ ID NO: 1002240 - RNA, 18 nt, Human
ccgccgccgccgccgccg

SEQ ID NO: 1002241 - RNA, 18 nt, Human
ccgccgccgccgccgccg

SEQ ID NO: 1002242 - RNA, 23 nt, Human
ccucugggcccucacuucuggcc

SEQ ID NO: 1002243 - RNA, 19 nt, Human
ccuuuggccccugcccccu

SEQ ID NO: 1002244 - RNA, 21 nt, Human
cuugcagcuggcagugggggg

SEQ ID NO: 1002245 - RNA, 19 nt, Human
gacccagaccucugggccc

SEQ ID NO: 1002246 - RNA, 18 nt, Human
gaccucugggcccucacu

SEQ ID NO: 1002247 - RNA, 22 nt, Human
gccgccgccgccgccgccgccg

SEQ ID NO: 1002248 - RNA, 21 nt, Human
ggagaagcccaccaucccaga

SEQ ID NO: 1002249 - RNA, 20 nt, Human
gggacccagaccucugggcc

SEQ ID NO: 1002250 - RNA, 22 nt, Human
ggggacccagaccucugggccc

SEQ ID NO: 1002251 - RNA, 21 nt, Human
uccaacacccccaucccugcc

SEQ ID NO: 1002252 - RNA, 24 nt, Human
uccaacacccccaucccugcccaa

SEQ ID NO: 1002253 - RNA, 23 nt, Human
ugggggacccagaccucugggcc

SEQ ID NO: 1002254 - RNA, 25 nt, Human
uggggggagaagcccaccaucccag

SEQ ID NO: 1002255 - RNA, 18 nt, Human
uuggccccugcccccugg

SEQ ID NO: 1002256 - RNA, 19 nt, Human
aagcaugagaaacagcaac

SEQ ID NO: 1002257 - RNA, 21 nt, Human
aagccggacccggaccucgaa

SEQ ID NO: 1002258 - RNA, 20 nt, Human
acaccaaccaaaacuggacc

SEQ ID NO: 1002259 - RNA, 18 nt, Human
agccaauggcaacgcagc

SEQ ID NO: 1002260 - RNA, 20 nt, Human
aucugcuaacagcuuucccu

SEQ ID NO: 1002261 - RNA, 24 nt, Human
cagccucuaggcaauucauauuuu

SEQ ID NO: 1002262 - RNA, 27 nt, Human
cauuuuaauuuuaagcuaucuuaagga

SEQ ID NO: 1002263 - RNA, 19 nt, Human
cccucccuguuuccuuccu

SEQ ID NO: 1002264 - RNA, 20 nt, Human
cccuguuuccuuccuuccuu

SEQ ID NO: 1002265 - RNA, 21 nt, Human
ccguccuuucccucccuguuu

SEQ ID NO: 1002266 - RNA, 21 nt, Human
ccucccuguuuccuuccuucc

SEQ ID NO: 1002267 - RNA, 19 nt, Human
ccucuccaguucgcugacc

SEQ ID NO: 1002268 - RNA, 22 nt, Human
cuacaccaaccaaaacuggacc

SEQ ID NO: 1002269 - RNA, 20 nt, Human
cucugugugcuguucacagu

SEQ ID NO: 1002270 - RNA, 23 nt, Human
cuugaagcugcaaucucccaucc

SEQ ID NO: 1002271 - RNA, 23 nt, Human
gcaaucucccauccugccuuagc

SEQ ID NO: 1002272 - RNA, 22 nt, Human
ggcaacauuauccucggcccuc

SEQ ID NO: 1002273 - RNA, 18 nt, Human
guuuguuugccuuuuucc

SEQ ID NO: 1002274 - RNA, 21 nt, Human
uaacagcuuucccucccgcuu

SEQ ID NO: 1002275 - RNA, 25 nt, Human
uaagcuaucuuaaggauauuacuau

SEQ ID NO: 1002276 - RNA, 22 nt, Human
uacaccaaccaaaacuggaccu

SEQ ID NO: 1002277 - RNA, 18 nt, Human
uaguucuuagggaaaggg

SEQ ID NO: 1002278 - RNA, 24 nt, Human
uaguucuuagggaaagggcuugau

SEQ ID NO: 1002279 - RNA, 25 nt, Human
uauugcucucuucucucugucuucu

SEQ ID NO: 1002280 - RNA, 19 nt, Human
ucagugauguaucuugucu

SEQ ID NO: 1002281 - RNA, 20 nt, Human
uccaacuuccucaauucuuu

SEQ ID NO: 1002282 - RNA, 21 nt, Human
ucccuccguccuuucccuccc

SEQ ID NO: 1002283 - RNA, 19 nt, Human
ucccuguuuccuuccuucc

SEQ ID NO: 1002284 - RNA, 19 nt, Human
ucccuguuuccuuccuucc

SEQ ID NO: 1002285 - RNA, 19 nt, Human
ucuacaccaaccaaaacug

SEQ ID NO: 1002286 - RNA, 18 nt, Human
ucucugucuucugauaua

SEQ ID NO: 1002287 - RNA, 20 nt, Human
ugaaaaggauccaacuuccu

SEQ ID NO: 1002288 - RNA, 18 nt, Human
ugccauuucauagccauc

SEQ ID NO: 1002289 - RNA, 20 nt, Human
ugccuuagcuuucuugaucu

SEQ ID NO: 1002290 - RNA, 21 nt, Human
ugccuuuuuccaaauuucagu

SEQ ID NO: 1002291 - RNA, 20 nt, Human
ugcuugugauuucuuucccu

SEQ ID NO: 1002292 - RNA, 20 nt, Human
uggacuguucucaucauucu

SEQ ID NO: 1002293 - RNA, 22 nt, Human
uuaaagauuccauguaauuauu

SEQ ID NO: 1002294 - RNA, 23 nt, Human
uuaguaguugcuugugauuucuu

SEQ ID NO: 1002295 - RNA, 21 nt, Human
uucacaguuuggguuaauuua

SEQ ID NO: 1002296 - RNA, 18 nt, Human
uucaccccugcucccggg

SEQ ID NO: 1002297 - RNA, 21 nt, Human
uucucucugucuucugauaua

SEQ ID NO: 1002298 - RNA, 18 nt, Human
uucuuuugaggggggccc

SEQ ID NO: 1002299 - RNA, 26 nt, Human
uugcucucuucucucugucuucugau

SEQ ID NO: 1002300 - RNA, 22 nt, Human
aagucaaaagcuaaaaccauga

SEQ ID NO: 1002301 - RNA, 24 nt, Human
auggggcucugcucagcuugggac

SEQ ID NO: 1002302 - RNA, 23 nt, Human
cacagcaaagucaaaagcuaaaa

SEQ ID NO: 1002303 - RNA, 18 nt, Human
cagaaagauggggcucug

SEQ ID NO: 1002304 - RNA, 26 nt, Human
cagcaaagucaaaagcuaaaaccaug

SEQ ID NO: 1002305 - RNA, 22 nt, Human
cagcuugggacagaaggaccuc

SEQ ID NO: 1002306 - RNA, 27 nt, Human
cagggguucuuucucuauuugacauuc

SEQ ID NO: 1002307 - RNA, 20 nt, Human
cauucuuagcauaauuccaa

SEQ ID NO: 1002308 - RNA, 20 nt, Human
cuaaaacucgaucuuccagc

SEQ ID NO: 1002309 - RNA, 21 nt, Human
cuaaaacucgaucuuccagca

SEQ ID NO: 1002310 - RNA, 24 nt, Human
gucuguaucuuuacagagaagucu

SEQ ID NO: 1002311 - RNA, 20 nt, Human
uaaaaaucagauaguuaaaa

SEQ ID NO: 1002312 - RNA, 24 nt, Human
uaagugccguuuaugaagaacuag

SEQ ID NO: 1002313 - RNA, 24 nt, Human
uaauauagacccagaaagaugggg

SEQ ID NO: 1002314 - RNA, 19 nt, Human
uauuuacacagcaaaguca

SEQ ID NO: 1002315 - RNA, 20 nt, Human
ucuguaucuuuacagagaag

SEQ ID NO: 1002316 - RNA, 18 nt, Human
ugaagaacuagaauccuc

SEQ ID NO: 1002317 - RNA, 19 nt, Human
uucacauuuuuaaagagcu

SEQ ID NO: 1002318 - RNA, 18 nt, Human
aagugccuucuacacauc

SEQ ID NO: 1002319 - RNA, 24 nt, Human
acauccacccagaggcucugcuga

SEQ ID NO: 1002320 - RNA, 21 nt, Human
aggcagagggacgccuggcuc

SEQ ID NO: 1002321 - RNA, 23 nt, Human
agguccauucuggcccaagugac

SEQ ID NO: 1002322 - RNA, 19 nt, Human
agucuggagcagaaagggc

SEQ ID NO: 1002323 - RNA, 18 nt, Human
auccuguccccuccccca

SEQ ID NO: 1002324 - RNA, 23 nt, Human
caaaacagcucccggguguugcc

SEQ ID NO: 1002325 - RNA, 19 nt, Human
caaaggacaaaacagcucc

SEQ ID NO: 1002326 - RNA, 19 nt, Human
caccaauggaaggaaaguc

SEQ ID NO: 1002327 - RNA, 19 nt, Human
cacccauccacccaccaau

SEQ ID NO: 1002328 - RNA, 20 nt, Human
caggcuauaaaaugccuuuc

SEQ ID NO: 1002329 - RNA, 21 nt, Human
cagguccauucuggcccaagu

SEQ ID NO: 1002330 - RNA, 22 nt, Human
cccauccacccaccaauggaag

SEQ ID NO: 1002331 - RNA, 20 nt, Human
ccccaaucacugcugcuugc

SEQ ID NO: 1002332 - RNA, 19 nt, Human
cccccaaucacugcugcuu

SEQ ID NO: 1002333 - RNA, 19 nt, Human
ccccccacccauccaccca

SEQ ID NO: 1002334 - RNA, 23 nt, Human
ccccccacccauccacccaccaa

SEQ ID NO: 1002335 - RNA, 19 nt, Human
cuagggggcauaucaaggg

SEQ ID NO: 1002336 - RNA, 24 nt, Human
cuccuguucagggcucuuggcagu

SEQ ID NO: 1002337 - RNA, 24 nt, Human
cuggagcagaaagggcagguccau

SEQ ID NO: 1002338 - RNA, 24 nt, Human
gaggcucuggaaugccccccaccc

SEQ ID NO: 1002339 - RNA, 19 nt, Human
gcccaggcuauaaaaugcc

SEQ ID NO: 1002340 - RNA, 21 nt, Human
gcuccuguucagggcucuugg

SEQ ID NO: 1002341 - RNA, 21 nt, Human
gcucuuggcagugaguucuga

SEQ ID NO: 1002342 - RNA, 23 nt, Human
gcugaggcuccacaaaggacaaa

SEQ ID NO: 1002343 - RNA, 24 nt, Human
ggaaugccccccacccauccaccc

SEQ ID NO: 1002344 - RNA, 22 nt, Human
ggaguggucccuaucuagcccc

SEQ ID NO: 1002345 - RNA, 24 nt, Human
gggcaggcagagggacgccuggcu

SEQ ID NO: 1002346 - RNA, 25 nt, Human
gggcaggcagagggacgccuggcuc

SEQ ID NO: 1002347 - RNA, 20 nt, Human
gggcucuuggcagugaguuc

SEQ ID NO: 1002348 - RNA, 19 nt, Human
gguggcuccuguucagggc

SEQ ID NO: 1002349 - RNA, 19 nt, Human
guagagcacugggaucacc

SEQ ID NO: 1002350 - RNA, 22 nt, Human
guucugaaagagggaacugcug

SEQ ID NO: 1002351 - RNA, 23 nt, Human
uaaaaugccuuucucucaucccc

SEQ ID NO: 1002352 - RNA, 21 nt, Human
uaccuuagaggcucuggaaug

SEQ ID NO: 1002353 - RNA, 22 nt, Human
uagaggcucuggaaugcccccc

SEQ ID NO: 1002354 - RNA, 20 nt, Human
ucacaguucccauguggcag

SEQ ID NO: 1002355 - RNA, 19 nt, Human
ucccccaaucacugcugcu

SEQ ID NO: 1002356 - RNA, 23 nt, Human
ucuagccccaagucuggagcaga

SEQ ID NO: 1002357 - RNA, 18 nt, Human
uggcagaggcagaagugg

SEQ ID NO: 1002358 - RNA, 19 nt, Human
uggcagcaguaguggcaga

SEQ ID NO: 1002359 - RNA, 20 nt, Human
uggcagcaguaguggcagag

SEQ ID NO: 1002360 - RNA, 26 nt, Human
uggcagcaguaguggcagaggcagaa

SEQ ID NO: 1002361 - RNA, 20 nt, Human
ugggaucaccacuaggccua

SEQ ID NO: 1002362 - RNA, 23 nt, Human
uguuagauccuguccccuccccc

SEQ ID NO: 1002363 - RNA, 22 nt, Human
uuaugcauuuugaagugccuuc

SEQ ID NO: 1002364 - RNA, 24 nt, Human
uucccauguggcagcaguaguggc

SEQ ID NO: 1002365 - RNA, 19 nt, Human
uuugaagugccuucuacac

SEQ ID NO: 1002366 - RNA, 21 nt, Human
uuuuuuuuuuuuuuuuuaaca

SEQ ID NO: 1002367 - RNA, 19 nt, Human
aaaauuuccuccaaaauca

SEQ ID NO: 1002368 - RNA, 25 nt, Human
aaacagaagaguuugacauaaaagu

SEQ ID NO: 1002369 - RNA, 19 nt, Human
aacccuucucuucuacuuu

SEQ ID NO: 1002370 - RNA, 20 nt, Human
aagaacccgaguaugcacuu

SEQ ID NO: 1002371 - RNA, 19 nt, Human
agaacccuucucuucuacu

SEQ ID NO: 1002372 - RNA, 25 nt, Human
agagauggacugccuguucuuugcc

SEQ ID NO: 1002373 - RNA, 20 nt, Human
agcugggagacagcuccugu

SEQ ID NO: 1002374 - RNA, 18 nt, Human
auaaacuaaagcuaagag

SEQ ID NO: 1002375 - RNA, 21 nt, Human
auguguauguauauauauaua

SEQ ID NO: 1002376 - RNA, 31 nt, Human
cacacaucuguauauacauacauguauauag

SEQ ID NO: 1002377 - RNA, 19 nt, Human
caguaaugagccaaacaua

SEQ ID NO: 1002378 - RNA, 26 nt, Human
caguagcaguagcaaguauggcagaa

SEQ ID NO: 1002379 - RNA, 19 nt, Human
ccuaaauuuggguuuacua

SEQ ID NO: 1002380 - RNA, 19 nt, Human
cgcagaucacacaugaaua

SEQ ID NO: 1002381 - RNA, 25 nt, Human
cuagaaaaauuuccuccaaaaucag

SEQ ID NO: 1002382 - RNA, 22 nt, Human
gaaaaauuuccuccaaaaucag

SEQ ID NO: 1002383 - RNA, 23 nt, Human
gaaacccuuacacccaacuuaga

SEQ ID NO: 1002384 - RNA, 20 nt, Human
ggaauucucuaauuuuacuc

SEQ ID NO: 1002385 - RNA, 21 nt, Human
guauguauauauauauauaca

SEQ ID NO: 1002386 - RNA, 22 nt, Human
guucuaaaacugugguuuacug

SEQ ID NO: 1002387 - RNA, 18 nt, Human
uaaacacucacuuuuaua

SEQ ID NO: 1002388 - RNA, 20 nt, Human
uaacacguuaaaaaucacuu

SEQ ID NO: 1002389 - RNA, 19 nt, Human
uaagaagaaaucucugaau

SEQ ID NO: 1002390 - RNA, 24 nt, Human
uaagaccaaaaaaacauugaaaau

SEQ ID NO: 1002391 - RNA, 23 nt, Human
uaaguuuuuagcuugccucaaau

SEQ ID NO: 1002392 - RNA, 21 nt, Human
uacaaauucucuuucccacaa

SEQ ID NO: 1002393 - RNA, 23 nt, Human
uacagcagggucagaaaaugaaa

SEQ ID NO: 1002394 - RNA, 18 nt, Human
uacauggaacagaacccu

SEQ ID NO: 1002395 - RNA, 30 nt, Human
uagccaaguucucaaaguuucugaaagcuu

SEQ ID NO: 1002396 - RNA, 18 nt, Human
uaggagaagaugcuuuuc

SEQ ID NO: 1002397 - RNA, 21 nt, Human
uaguccuauaaacacucacuu

SEQ ID NO: 1002398 - RNA, 18 nt, Human
uauaaaaaaacccaggaa

SEQ ID NO: 1002399 - RNA, 22 nt, Human
uauaaacacucacuuuuauagg

SEQ ID NO: 1002400 - RNA, 21 nt, Human
uauaacaagaaucaggaauuc

SEQ ID NO: 1002401 - RNA, 20 nt, Human
uauacagauauauauauaua

SEQ ID NO: 1002402 - RNA, 21 nt, Human
uauacagauauauauauauau

SEQ ID NO: 1002403 - RNA, 22 nt, Human
uauauacacacacaucuguaua

SEQ ID NO: 1002404 - RNA, 24 nt, Human
uauauacacacacaucuguauaua

SEQ ID NO: 1002405 - RNA, 25 nt, Human
uauauacacacacaucuguauauac

SEQ ID NO: 1002406 - RNA, 20 nt, Human
uauauacauacauguauaua

SEQ ID NO: 1002407 - RNA, 27 nt, Human
uauauacauacauguauauauucaaau

SEQ ID NO: 1002408 - RNA, 22 nt, Human
uauauauauacacacacaucug

SEQ ID NO: 1002409 - RNA, 26 nt, Human
uauauauauccacacacacauauaaa

SEQ ID NO: 1002410 - RNA, 26 nt, Human
uauauccacacacacauauaaaaucu

SEQ ID NO: 1002411 - RNA, 22 nt, Human
uauauguguauguauauauaua

SEQ ID NO: 1002412 - RNA, 18 nt, Human
uauguauauauauauaua

SEQ ID NO: 1002413 - RNA, 18 nt, Human
uauguauauguguaugua

SEQ ID NO: 1002414 - RNA, 18 nt, Human
uauguauauguguaugua

SEQ ID NO: 1002415 - RNA, 22 nt, Human
uauguguauguauauauauaua

SEQ ID NO: 1002416 - RNA, 24 nt, Human
ucaaagacuuguguuuucacaugu

SEQ ID NO: 1002417 - RNA, 18 nt, Human
ucaggcagagagauaaac

SEQ ID NO: 1002418 - RNA, 19 nt, Human
ucagucaucauaaacaggc

SEQ ID NO: 1002419 - RNA, 22 nt, Human
uccacacacacauauaaaaucu

SEQ ID NO: 1002420 - RNA, 28 nt, Human
uccuauaaacacucacuuuuccucccug

SEQ ID NO: 1002421 - RNA, 18 nt, Human
ucuaaucucaaauuaguu

SEQ ID NO: 1002422 - RNA, 24 nt, Human
ucugaguuggaaagaaccgggguc

SEQ ID NO: 1002423 - RNA, 21 nt, Human
ugacauaaaagucccuuugag

SEQ ID NO: 1002424 - RNA, 24 nt, Human
ugcccacacacaacuaggagaaga

SEQ ID NO: 1002425 - RNA, 22 nt, Human
uggaaagcuuaucuccaaaagg

SEQ ID NO: 1002426 - RNA, 20 nt, Human
uggaacagaacccuucucuu

SEQ ID NO: 1002427 - RNA, 21 nt, Human
uggaacagaacccuucucuuc

SEQ ID NO: 1002428 - RNA, 21 nt, Human
uggagaaacagaagaguuuga

SEQ ID NO: 1002429 - RNA, 20 nt, Human
uguauauacauacauguaua

SEQ ID NO: 1002430 - RNA, 19 nt, Human
uguauauauauauauacac

SEQ ID NO: 1002431 - RNA, 27 nt, Human
uguauauauauauauacacacacaucu

SEQ ID NO: 1002432 - RNA, 19 nt, Human
uguauauguguauguauau

SEQ ID NO: 1002433 - RNA, 20 nt, Human
uguauauguguauguauaua

SEQ ID NO: 1002434 - RNA, 23 nt, Human
uguggaaucagagaugauucuga

SEQ ID NO: 1002435 - RNA, 24 nt, Human
uguggccuuacaaaauguaguuuu

SEQ ID NO: 1002436 - RNA, 18 nt, Human
uguguauauauauccaca

SEQ ID NO: 1002437 - RNA, 18 nt, Human
uguguauguauauauaua

SEQ ID NO: 1002438 - RNA, 18 nt, Human
uguguauguauauauaua

SEQ ID NO: 1002439 - RNA, 20 nt, Human
uguguauguauauauauaua

SEQ ID NO: 1002440 - RNA, 22 nt, Human
uguguauguauauauauauaua

SEQ ID NO: 1002441 - RNA, 21 nt, Human
ugugugacuucucuuuccaga

SEQ ID NO: 1002442 - RNA, 24 nt, Human
uguguguguauauauauccacaca

SEQ ID NO: 1002443 - RNA, 22 nt, Human
uuaaaagcauguuugggucuaa

SEQ ID NO: 1002444 - RNA, 23 nt, Human
uuauacagauauauauauauaua

SEQ ID NO: 1002445 - RNA, 23 nt, Human
uucaucuggggguuuccaaagcc

SEQ ID NO: 1002446 - RNA, 21 nt, Human
uucccagcaaacagauuucau

SEQ ID NO: 1002447 - RNA, 19 nt, Human
uugaaaauuuuauuuucac

SEQ ID NO: 1002448 - RNA, 21 nt, Human
uugaaaauuuuauuuucacag

SEQ ID NO: 1002449 - RNA, 25 nt, Human
uugcaguaguuuacagcagggucag

SEQ ID NO: 1002450 - RNA, 20 nt, Human
uugcuuuagucuuuuuuccc

SEQ ID NO: 1002451 - RNA, 19 nt, Human
uuuacuguauucuggggag

SEQ ID NO: 1002452 - RNA, 26 nt, Human
uuucaagcagucauaucuuuuuagca

SEQ ID NO: 1002453 - RNA, 19 nt, Human
uuugcauaaaaagaacauu

SEQ ID NO: 1002454 - RNA, 20 nt, Human
uuuugugaguuuuuugggag

SEQ ID NO: 1002455 - RNA, 24 nt, Human
uuuuuaguccuauaaacacucacu

SEQ ID NO: 1002456 - RNA, 22 nt, Human
uuuuugggagugugacacuuuu

SEQ ID NO: 1002457 - RNA, 21 nt, Human
aaaaaccacuaguuucaaagc

SEQ ID NO: 1002458 - RNA, 21 nt, Human
aaaaccuuuggccaagaguuc

SEQ ID NO: 1002459 - RNA, 23 nt, Human
aaccagaaagcugguuuccuccu

SEQ ID NO: 1002460 - RNA, 27 nt, Human
aagccaacuuugauuaaaaaccacuag

SEQ ID NO: 1002461 - RNA, 21 nt, Human
aaggacaccaaugaggggcac

SEQ ID NO: 1002462 - RNA, 23 nt, Human
aaggaccuggugacauuucggca

SEQ ID NO: 1002463 - RNA, 19 nt, Human
agaacaagaccaaaaagcu

SEQ ID NO: 1002464 - RNA, 19 nt, Human
agacugaaaggaccuggug

SEQ ID NO: 1002465 - RNA, 19 nt, Human
agccccgaccccagcaagc

SEQ ID NO: 1002466 - RNA, 22 nt, Human
agcuagaacaaggaaaaagaaa

SEQ ID NO: 1002467 - RNA, 26 nt, Human
agcugguuuccuccuccuccccccaa

SEQ ID NO: 1002468 - RNA, 24 nt, Human
agguaacagaagcaggcucguguc

SEQ ID NO: 1002469 - RNA, 23 nt, Human
agguaguagguaaguaggugggc

SEQ ID NO: 1002470 - RNA, 18 nt, Human
augaaccaagauauacgc

SEQ ID NO: 1002471 - RNA, 21 nt, Human
caacagcagcagaccugcuca

SEQ ID NO: 1002472 - RNA, 19 nt, Human
cagaacaagaccaaaaagc

SEQ ID NO: 1002473 - RNA, 20 nt, Human
cagaacaagaccaaaaagcu

SEQ ID NO: 1002474 - RNA, 24 nt, Human
cagguaguagguaaguaggugggc

SEQ ID NO: 1002475 - RNA, 23 nt, Human
caucaguccuguuaccacuugga

SEQ ID NO: 1002476 - RNA, 18 nt, Human
caugaaaagccaagcugc

SEQ ID NO: 1002477 - RNA, 23 nt, Human
ccacacuacaugacucgcaauug

SEQ ID NO: 1002478 - RNA, 20 nt, Human
cccagcaagcgccucgcucc

SEQ ID NO: 1002479 - RNA, 19 nt, Human
ccccaaaaaccuuuggcca

SEQ ID NO: 1002480 - RNA, 20 nt, Human
ccccccaaaaaccuuuggcc

SEQ ID NO: 1002481 - RNA, 22 nt, Human
ccccccaaaaaccuuuggccaa

SEQ ID NO: 1002482 - RNA, 22 nt, Human
cccgcagccccugcgccgucgc

SEQ ID NO: 1002483 - RNA, 18 nt, Human
cccgcgaaggcccggccc

SEQ ID NO: 1002484 - RNA, 19 nt, Human
ccgucgcgcagccccgacc

SEQ ID NO: 1002485 - RNA, 21 nt, Human
ccucagggcucccgcgccgcu

SEQ ID NO: 1002486 - RNA, 22 nt, Human
ccuccuccuccccccaaaaacc

SEQ ID NO: 1002487 - RNA, 19 nt, Human
ccugcgcggcgcuccccgc

SEQ ID NO: 1002488 - RNA, 27 nt, Human
cgccucgcuccuccgcgcagccgccgc

SEQ ID NO: 1002489 - RNA, 21 nt, Human
cggcccggagagcggggcugc

SEQ ID NO: 1002490 - RNA, 23 nt, Human
cuccagaggccaacagcagcaga

SEQ ID NO: 1002491 - RNA, 24 nt, Human
cuccccccaaaaaccuuuggccaa

SEQ ID NO: 1002492 - RNA, 24 nt, Human
cugcgcggcgcuccccgcagcccc

SEQ ID NO: 1002493 - RNA, 21 nt, Human
cuuuaacuaaaugaacuccag

SEQ ID NO: 1002494 - RNA, 21 nt, Human
gaccuggugacauuucggcau

SEQ ID NO: 1002495 - RNA, 22 nt, Human
gagcggcaauggcggcggcgcc

SEQ ID NO: 1002496 - RNA, 27 nt, Human
gcagguaguagguaaguaggugggcac

SEQ ID NO: 1002497 - RNA, 18 nt, Human
gcccgcgaaggcccggcc

SEQ ID NO: 1002498 - RNA, 20 nt, Human
gccucgcuccuccgcgcagc

SEQ ID NO: 1002499 - RNA, 18 nt, Human
gcgcuccccgcagccccu

SEQ ID NO: 1002500 - RNA, 25 nt, Human
gcggcaauggcggcggcgccuccuc

SEQ ID NO: 1002501 - RNA, 23 nt, Human
uaaaaggacaccaaugaggggca

SEQ ID NO: 1002502 - RNA, 21 nt, Human
uaacagaagcaggcucguguc

SEQ ID NO: 1002503 - RNA, 29 nt, Human
uaacuaaaugaacuccagaggccaacagg

SEQ ID NO: 1002504 - RNA, 22 nt, Human
uagaacguucaccaucguacuu

SEQ ID NO: 1002505 - RNA, 27 nt, Human
uagaacguucaccaucguacuuaaaaa

SEQ ID NO: 1002506 - RNA, 22 nt, Human
uaggugggcacaugaaaagcca

SEQ ID NO: 1002507 - RNA, 18 nt, Human
ucaauucaccuuccaaau

SEQ ID NO: 1002508 - RNA, 20 nt, Human
ucagcuagaacaaggaaaaa

SEQ ID NO: 1002509 - RNA, 19 nt, Human
uccaaaucagaacaagacc

SEQ ID NO: 1002510 - RNA, 26 nt, Human
uccaaaucagaacaagaccaaaaagc

SEQ ID NO: 1002511 - RNA, 26 nt, Human
uccccccaaaaaccuuuggccaagaa

SEQ ID NO: 1002512 - RNA, 23 nt, Human
uccgcgcagccgccgcagucccc

SEQ ID NO: 1002513 - RNA, 19 nt, Human
uccuccuccccccaaaaac

SEQ ID NO: 1002514 - RNA, 24 nt, Human
ucguguccuccuuuaauucuacca

SEQ ID NO: 1002515 - RNA, 20 nt, Human
ucucugauuuugaagaugaa

SEQ ID NO: 1002516 - RNA, 21 nt, Human
ucuguccaacaccaguguaca

SEQ ID NO: 1002517 - RNA, 19 nt, Human
ugaaaagccaagcugcucu

SEQ ID NO: 1002518 - RNA, 19 nt, Human
ugaagagucagcuagaaca

SEQ ID NO: 1002519 - RNA, 18 nt, Human
ugaggggcaccaucuggu

SEQ ID NO: 1002520 - RNA, 19 nt, Human
ugaggggcaccaucuggug

SEQ ID NO: 1002521 - RNA, 19 nt, Human
ugcucaauucaccuuccaa

SEQ ID NO: 1002522 - RNA, 23 nt, Human
ugcucaauucaccuuccaaauca

SEQ ID NO: 1002523 - RNA, 18 nt, Human
uggaacugaaauaucccc

SEQ ID NO: 1002524 - RNA, 18 nt, Human
uguccuccuuuaauucua

SEQ ID NO: 1002525 - RNA, 20 nt, Human
ugugcuuuaacuaaaugaac

SEQ ID NO: 1002526 - RNA, 20 nt, Human
uuaauucuaccacacuacau

SEQ ID NO: 1002527 - RNA, 26 nt, Human
uuacaacugagaucacaucuacauac

SEQ ID NO: 1002528 - RNA, 19 nt, Human
uuuccuccuccucccccca

SEQ ID NO: 1002529 - RNA, 23 nt, Human
uuuuuuuuuuuuuuuuuggaacu

SEQ ID NO: 1002530 - RNA, 20 nt, Human
uuuuuuuuuuuuuuuuuugg

SEQ ID NO: 1002531 - RNA, 19 nt, Human
aagcgagcgcccgcguccg

SEQ ID NO: 1002532 - RNA, 21 nt, Human
agagcggcucccgcaccucca

SEQ ID NO: 1002533 - RNA, 20 nt, Human
agcgcccgcguccgugcgcc

SEQ ID NO: 1002534 - RNA, 22 nt, Human
cacgcgggagggucccgaaagc

SEQ ID NO: 1002535 - RNA, 22 nt, Human
cacuccccuaauggcagcucca

SEQ ID NO: 1002536 - RNA, 18 nt, Human
cagcccggcggggagcag

SEQ ID NO: 1002537 - RNA, 18 nt, Human
cagcuccauuaggcgaga

SEQ ID NO: 1002538 - RNA, 18 nt, Human
ccccgaacacaaagcgag

SEQ ID NO: 1002539 - RNA, 19 nt, Human
cccucgcgcgccgaggccg

SEQ ID NO: 1002540 - RNA, 20 nt, Human
cccucgcgcgccgaggccgc

SEQ ID NO: 1002541 - RNA, 20 nt, Human
ccgcaccuccagccccucgc

SEQ ID NO: 1002542 - RNA, 22 nt, Human
cgccgacgcuagccccgaacac

SEQ ID NO: 1002543 - RNA, 18 nt, Human
cggagcagcccggcgggg

SEQ ID NO: 1002544 - RNA, 23 nt, Human
cggcucccgcaccuccagccccu

SEQ ID NO: 1002545 - RNA, 19 nt, Human
cuccccuaauggcagcucc

SEQ ID NO: 1002546 - RNA, 19 nt, Human
cugcaagcucaagccucgc

SEQ ID NO: 1002547 - RNA, 19 nt, Human
gaacacaaagcgagcgccc

SEQ ID NO: 1002548 - RNA, 19 nt, Human
gagaaagcagggaagccgc

SEQ ID NO: 1002549 - RNA, 20 nt, Human
gagaaagcagggaagccgcg

SEQ ID NO: 1002550 - RNA, 19 nt, Human
gagcgcccgcguccgugcg

SEQ ID NO: 1002551 - RNA, 22 nt, Human
gccgacgcuagccccgaacaca

SEQ ID NO: 1002552 - RNA, 22 nt, Human
ucauggcuacaguagagauuca

SEQ ID NO: 1002553 - RNA, 22 nt, Human
uccccuaauggcagcuccauua

SEQ ID NO: 1002554 - RNA, 19 nt, Human
uccgugcgccaggcggucg

SEQ ID NO: 1002555 - RNA, 20 nt, Human
ucgccgacgcuagccccgaa

SEQ ID NO: 1002556 - RNA, 21 nt, Human
ugcagcagcgguugcaggggg

SEQ ID NO: 1002557 - RNA, 23 nt, Human
uggcggccugggcucagccgcgc

SEQ ID NO: 1002558 - RNA, 20 nt, Human
uucaugaagacacuugcccc

SEQ ID NO: 1002559 - RNA, 21 nt, Human
uugcucggagcagcccggcgg

SEQ ID NO: 1002560 - RNA, 21 nt, Human
aaacacgaaggucccaaagcc

SEQ ID NO: 1002561 - RNA, 22 nt, Human
aaagagcaguauaaauacacuu

SEQ ID NO: 1002562 - RNA, 18 nt, Human
aaggacucagagguggau

SEQ ID NO: 1002563 - RNA, 19 nt, Human
aaggagcaggugggaacag

SEQ ID NO: 1002564 - RNA, 21 nt, Human
aaggggcacacagagcagcca

SEQ ID NO: 1002565 - RNA, 18 nt, Human
aaggucccaaagccggca

SEQ ID NO: 1002566 - RNA, 21 nt, Human
acccaggccaugcccaggcuu

SEQ ID NO: 1002567 - RNA, 21 nt, Human
accugagccccggaaaaacac

SEQ ID NO: 1002568 - RNA, 22 nt, Human
acggcaccacaccugcucaggc

SEQ ID NO: 1002569 - RNA, 19 nt, Human
agaccagaccgucacuggg

SEQ ID NO: 1002570 - RNA, 21 nt, Human
agagggaggagggugugguca

SEQ ID NO: 1002571 - RNA, 20 nt, Human
aggagaaaaggagcaggugg

SEQ ID NO: 1002572 - RNA, 21 nt, Human
agggagcuaggacagccagca

SEQ ID NO: 1002573 - RNA, 22 nt, Human
agugcauuuacggguaaacuga

SEQ ID NO: 1002574 - RNA, 19 nt, Human
caagaccagaccgucacug

SEQ ID NO: 1002575 - RNA, 22 nt, Human
cacagcgauggcuggagugaga

SEQ ID NO: 1002576 - RNA, 19 nt, Human
caccacaccugcucaggcg

SEQ ID NO: 1002577 - RNA, 19 nt, Human
cacccccucucauccucac

SEQ ID NO: 1002578 - RNA, 18 nt, Human
caccuggccaccccaguu

SEQ ID NO: 1002579 - RNA, 19 nt, Human
cacgaaggucccaaagccg

SEQ ID NO: 1002580 - RNA, 20 nt, Human
cagcacacaggcagacggag

SEQ ID NO: 1002581 - RNA, 22 nt, Human
caggagugcucucugagcugaa

SEQ ID NO: 1002582 - RNA, 19 nt, Human
caggcagacggaggcacgc

SEQ ID NO: 1002583 - RNA, 21 nt, Human
caggggcucugggccucugcc

SEQ ID NO: 1002584 - RNA, 25 nt, Human
caugacugauugcuccaugcugcag

SEQ ID NO: 1002585 - RNA, 23 nt, Human
ccacaccugcucaggcggccgga

SEQ ID NO: 1002586 - RNA, 19 nt, Human
cccaggcuugugauuucug

SEQ ID NO: 1002587 - RNA, 22 nt, Human
ccccggaaaaacacgaaggucc

SEQ ID NO: 1002588 - RNA, 20 nt, Human
cccuaggcugggcccaccug

SEQ ID NO: 1002589 - RNA, 25 nt, Human
cccuccugcccaggacgcuugggaa

SEQ ID NO: 1002590 - RNA, 19 nt, Human
ccgcucagccugcagggaa

SEQ ID NO: 1002591 - RNA, 20 nt, Human
ccguguccguggugaggggc

SEQ ID NO: 1002592 - RNA, 18 nt, Human
ccuacauggguuaagagg

SEQ ID NO: 1002593 - RNA, 18 nt, Human
ccuguuuaucucgugcuc

SEQ ID NO: 1002594 - RNA, 21 nt, Human
ccuugcgcccaucacccccuc

SEQ ID NO: 1002595 - RNA, 23 nt, Human
cgaaauccccgcuugacacucag

SEQ ID NO: 1002596 - RNA, 24 nt, Human
cggacagacaagcagcucucccag

SEQ ID NO: 1002597 - RNA, 22 nt, Human
cggccggacgcacacugcagga

SEQ ID NO: 1002598 - RNA, 21 nt, Human
cgggacggcaccacaccugcu

SEQ ID NO: 1002599 - RNA, 24 nt, Human
cucagccugcagggaaguggcugc

SEQ ID NO: 1002600 - RNA, 20 nt, Human
cugcacccugccugaugccc

SEQ ID NO: 1002601 - RNA, 22 nt, Human
cugcagagacaagaugaccaca

SEQ ID NO: 1002602 - RNA, 22 nt, Human
cugcgguguaggaaauaggaag

SEQ ID NO: 1002603 - RNA, 23 nt, Human
cugggagggaagccucucucugu

SEQ ID NO: 1002604 - RNA, 18 nt, Human
gaaaaaaucccgggcccg

SEQ ID NO: 1002605 - RNA, 25 nt, Human
gaaagcagggcccaacccuccugcc

SEQ ID NO: 1002606 - RNA, 18 nt, Human
gaaggucccaaagccggc

SEQ ID NO: 1002607 - RNA, 19 nt, Human
gacaagaugaccacaggag

SEQ ID NO: 1002608 - RNA, 23 nt, Human
gagcugaaggugaacagacagcu

SEQ ID NO: 1002609 - RNA, 24 nt, Human
gcagagacaagaugaccacaggag

SEQ ID NO: 1002610 - RNA, 18 nt, Human
gcccaucacccccucuca

SEQ ID NO: 1002611 - RNA, 23 nt, Human
gccccaccuggccaccccaguug

SEQ ID NO: 1002612 - RNA, 26 nt, Human
gccccggagccugcugucugagccuc

SEQ ID NO: 1002613 - RNA, 18 nt, Human
gccugagucccagucagc

SEQ ID NO: 1002614 - RNA, 19 nt, Human
gcuaaggaugcacccagga

SEQ ID NO: 1002615 - RNA, 21 nt, Human
gcugggagggaagccucucuc

SEQ ID NO: 1002616 - RNA, 19 nt, Human
ggaaaaaaucccgggccca

SEQ ID NO: 1002617 - RNA, 21 nt, Human
ggaaagcagggcccaacccuc

SEQ ID NO: 1002618 - RNA, 21 nt, Human
ggaaaggcagcuuccugcagg

SEQ ID NO: 1002619 - RNA, 22 nt, Human
ggcaggggcucugggccucugc

SEQ ID NO: 1002620 - RNA, 18 nt, Human
ggcuggcgagaggccagc

SEQ ID NO: 1002621 - RNA, 18 nt, Human
ggcugugcccacccgcug

SEQ ID NO: 1002622 - RNA, 18 nt, Human
ggcuugggugccaagcuc

SEQ ID NO: 1002623 - RNA, 21 nt, Human
gggaguggcucuccacuggcc

SEQ ID NO: 1002624 - RNA, 19 nt, Human
gggcaaagggaaaggcagc

SEQ ID NO: 1002625 - RNA, 18 nt, Human
gggcagagggaggagggu

SEQ ID NO: 1002626 - RNA, 21 nt, Human
gggcccaacccuccugcccag

SEQ ID NO: 1002627 - RNA, 20 nt, Human
gggccguggggagggggugc

SEQ ID NO: 1002628 - RNA, 19 nt, Human
ggggaaaagccggcuggag

SEQ ID NO: 1002629 - RNA, 24 nt, Human
ggggugguuucucuggcaccuaca

SEQ ID NO: 1002630 - RNA, 21 nt, Human
ggguaaacugaggcugggagg

SEQ ID NO: 1002631 - RNA, 20 nt, Human
ggguggggccguggggaggg

SEQ ID NO: 1002632 - RNA, 21 nt, Human
ggguggggccguggggagggg

SEQ ID NO: 1002633 - RNA, 22 nt, Human
ggugguuucucuggcaccuaca

SEQ ID NO: 1002634 - RNA, 21 nt, Human
guaaagagcaguauaaauaca

SEQ ID NO: 1002635 - RNA, 19 nt, Human
guccacaguucugauuggc

SEQ ID NO: 1002636 - RNA, 22 nt, Human
guggcucuccacuggccacagc

SEQ ID NO: 1002637 - RNA, 20 nt, Human
guggguggggccguggggag

SEQ ID NO: 1002638 - RNA, 24 nt, Human
guggguggggccguggggaggggg

SEQ ID NO: 1002639 - RNA, 21 nt, Human
uaaauacacuuccguucagau

SEQ ID NO: 1002640 - RNA, 23 nt, Human
uaaauacacuuccguucagauaa

SEQ ID NO: 1002641 - RNA, 20 nt, Human
uagggcaaagggaaaggcag

SEQ ID NO: 1002642 - RNA, 19 nt, Human
ucacaugacugauugcucc

SEQ ID NO: 1002643 - RNA, 22 nt, Human
ucacugccugugacggacagac

SEQ ID NO: 1002644 - RNA, 19 nt, Human
ucagcuggaggacauguga

SEQ ID NO: 1002645 - RNA, 21 nt, Human
ucagcuggaggacaugugauu

SEQ ID NO: 1002646 - RNA, 21 nt, Human
ucaguugggggaggugcuggg

SEQ ID NO: 1002647 - RNA, 19 nt, Human
ucccaaagccggcaaaagu

SEQ ID NO: 1002648 - RNA, 21 nt, Human
ucccgggcccagaaguugagg

SEQ ID NO: 1002649 - RNA, 19 nt, Human
uccuggaagaccguggcag

SEQ ID NO: 1002650 - RNA, 20 nt, Human
ucucucccaagaugauguug

SEQ ID NO: 1002651 - RNA, 20 nt, Human
ugaacagacagcugcggugu

SEQ ID NO: 1002652 - RNA, 21 nt, Human
ugaaggugaacagacagcugc

SEQ ID NO: 1002653 - RNA, 19 nt, Human
ugaauuggggugucgaguu

SEQ ID NO: 1002654 - RNA, 21 nt, Human
ugaccacaggagagccagcag

SEQ ID NO: 1002655 - RNA, 19 nt, Human
ugagccccggaaaaacacg

SEQ ID NO: 1002656 - RNA, 23 nt, Human
ugagccccggaaaaacacgaagg

SEQ ID NO: 1002657 - RNA, 19 nt, Human
ugaggucccuguggguggg

SEQ ID NO: 1002658 - RNA, 22 nt, Human
ugagugaauuggggugucgagu

SEQ ID NO: 1002659 - RNA, 18 nt, Human
ugcagagacaagaugacc

SEQ ID NO: 1002660 - RNA, 23 nt, Human
ugcaggacucagcuuucagcuuu

SEQ ID NO: 1002661 - RNA, 22 nt, Human
ugcccaggacgcuugggaaagc

SEQ ID NO: 1002662 - RNA, 18 nt, Human
ugcccuaggcugggccca

SEQ ID NO: 1002663 - RNA, 26 nt, Human
ugcccuaggcugggcccaccuggacg

SEQ ID NO: 1002664 - RNA, 22 nt, Human
ugcuggggucccgccccggggg

SEQ ID NO: 1002665 - RNA, 22 nt, Human
uggacggaggggaaggaggcuc

SEQ ID NO: 1002666 - RNA, 18 nt, Human
uggcucagaaggacucag

SEQ ID NO: 1002667 - RNA, 24 nt, Human
ugggcugcguggccccggagccug

SEQ ID NO: 1002668 - RNA, 21 nt, Human
uuaccagggagcuaggacagc

SEQ ID NO: 1002669 - RNA, 21 nt, Human
uucuugguugagugaauuggg

SEQ ID NO: 1002670 - RNA, 18 nt, Human
uugacagcgaaauccccg

SEQ ID NO: 1002671 - RNA, 20 nt, Human
uugaggucccuguggguggg

SEQ ID NO: 1002672 - RNA, 21 nt, Human
uuggcggaaaaagcacauugu

SEQ ID NO: 1002673 - RNA, 20 nt, Human
uugggaccuucugagugacu

SEQ ID NO: 1002674 - RNA, 26 nt, Human
uuuacggguaaacugaggcugggagg

SEQ ID NO: 1002675 - RNA, 23 nt, Human
aaaaagcgaaacuccugacaccc

SEQ ID NO: 1002676 - RNA, 23 nt, Human
aaacuccugacacccuuaaaaca

SEQ ID NO: 1002677 - RNA, 23 nt, Human
aagaggaaaaccacucaauggga

SEQ ID NO: 1002678 - RNA, 21 nt, Human
accccggccacucacacgcua

SEQ ID NO: 1002679 - RNA, 20 nt, Human
acucucaagagaaagaagag

SEQ ID NO: 1002680 - RNA, 19 nt, Human
agcgaaacuccugacaccc

SEQ ID NO: 1002681 - RNA, 23 nt, Human
agcgaaacuccugacacccuuaa

SEQ ID NO: 1002682 - RNA, 27 nt, Human
agcgcccauucauucccuccccgcagc

SEQ ID NO: 1002683 - RNA, 18 nt, Human
auucauucccuccccgca

SEQ ID NO: 1002684 - RNA, 19 nt, Human
caaagagcugcgacuguuu

SEQ ID NO: 1002685 - RNA, 19 nt, Human
caagaggaaaaccacucaa

SEQ ID NO: 1002686 - RNA, 21 nt, Human
cccgcagcaaacgacuccaaa

SEQ ID NO: 1002687 - RNA, 23 nt, Human
ccggcgcguccccaccucgcggg

SEQ ID NO: 1002688 - RNA, 23 nt, Human
ccucgcuacggccggcgcguccc

SEQ ID NO: 1002689 - RNA, 23 nt, Human
ccuggauaacccaggcccgggag

SEQ ID NO: 1002690 - RNA, 19 nt, Human
cgaccccggccacucacac

SEQ ID NO: 1002691 - RNA, 23 nt, Human
cuacaggaagggaacagcggcuc

SEQ ID NO: 1002692 - RNA, 21 nt, Human
cucaagagaaagaagaguuac

SEQ ID NO: 1002693 - RNA, 22 nt, Human
cucaagagaaagaagaguuacu

SEQ ID NO: 1002694 - RNA, 22 nt, Human
cucaaugggaccuggauaaccc

SEQ ID NO: 1002695 - RNA, 23 nt, Human
cucugucucugccgacaggggcu

SEQ ID NO: 1002696 - RNA, 19 nt, Human
cuggaagucuucucgugcc

SEQ ID NO: 1002697 - RNA, 23 nt, Human
gcugcugcuacaggaagggaaca

SEQ ID NO: 1002698 - RNA, 21 nt, Human
ggaacagcggcucucccagag

SEQ ID NO: 1002699 - RNA, 19 nt, Human
ucacauaauaauguggggc

SEQ ID NO: 1002700 - RNA, 19 nt, Human
ucccagagagggauccacc

SEQ ID NO: 1002701 - RNA, 23 nt, Human
ucgcgggcguguucccagcgccc

SEQ ID NO: 1002702 - RNA, 19 nt, Human
ucucaagagaaagaagagu

SEQ ID NO: 1002703 - RNA, 21 nt, Human
uucccagcgcccauucauucc

SEQ ID NO: 1002704 - RNA, 20 nt, Human
uuuuuuuuuuuuuuugucag

SEQ ID NO: 1002705 - RNA, 21 nt, Human
uuuuuuuuuuuuuuugucagc

SEQ ID NO: 1002706 - RNA, 18 nt, Human
uuuuuuuuuuuuuuuuug

SEQ ID NO: 1002707 - RNA, 19 nt, Human
uuuuuuuuuuuuuuuuugu

SEQ ID NO: 1002708 - RNA, 20 nt, Human
aaaacgaaacugcucuaagc

SEQ ID NO: 1002709 - RNA, 30 nt, Human
aacugagaaaacgaaacugcucuaagcacu

SEQ ID NO: 1002710 - RNA, 23 nt, Human
acaaaaauucacaagcugccucc

SEQ ID NO: 1002711 - RNA, 20 nt, Human
auugguucccuuugcuccaa

SEQ ID NO: 1002712 - RNA, 23 nt, Human
cacagagacacagggcauccaac

SEQ ID NO: 1002713 - RNA, 21 nt, Human
cagagacacagggcauccaac

SEQ ID NO: 1002714 - RNA, 19 nt, Human
cagggcauccaacugagaa

SEQ ID NO: 1002715 - RNA, 23 nt, Human
caguaaaacaaaaauucacaagc

SEQ ID NO: 1002716 - RNA, 19 nt, Human
caucgcacuccgcggcagc

SEQ ID NO: 1002717 - RNA, 22 nt, Human
ccacccccgccucccuccccug

SEQ ID NO: 1002718 - RNA, 20 nt, Human
cccccgccucccuccccugc

SEQ ID NO: 1002719 - RNA, 22 nt, Human
cccccgccucccuccccugccc

SEQ ID NO: 1002720 - RNA, 19 nt, Human
ccucggucuucggcauugg

SEQ ID NO: 1002721 - RNA, 20 nt, Human
cugccucccuguccaccccc

SEQ ID NO: 1002722 - RNA, 19 nt, Human
cuggguucugggugguugc

SEQ ID NO: 1002723 - RNA, 18 nt, Human
ggagacgugaugaaggga

SEQ ID NO: 1002724 - RNA, 21 nt, Human
gggcauccaacugagaaaacg

SEQ ID NO: 1002725 - RNA, 23 nt, Human
uaaaacaaaaauucacaagcugc

SEQ ID NO: 1002726 - RNA, 26 nt, Human
uaaaacaaaaauucacaagcugccuc

SEQ ID NO: 1002727 - RNA, 23 nt, Human
uccaccccacucacagagacaca

SEQ ID NO: 1002728 - RNA, 21 nt, Human
ucccuuugcuccaccccacuc

SEQ ID NO: 1002729 - RNA, 26 nt, Human
ugagugaaucugcauuuucugggucg

SEQ ID NO: 1002730 - RNA, 25 nt, Human
ugcccucggucuucggcauugguuc

SEQ ID NO: 1002731 - RNA, 20 nt, Human
uguccacccccgccucccuc

SEQ ID NO: 1002732 - RNA, 23 nt, Human
uucuggguucugggugguugccc

SEQ ID NO: 1002733 - RNA, 18 nt, Human
uugcuccaccccacucac

SEQ ID NO: 1002734 - RNA, 25 nt, Human
uugguucccuuugcuccaccccacu

SEQ ID NO: 1002735 - RNA, 19 nt, Human
uuuuuuuuuuucuuuuuua

SEQ ID NO: 1002736 - RNA, 18 nt, Human
aaaaauauacucuguaac

SEQ ID NO: 1002737 - RNA, 23 nt, Human
aaacugcagaggaacucaagagg

SEQ ID NO: 1002738 - RNA, 24 nt, Human
aaaugucaaaacugcagaggaacu

SEQ ID NO: 1002739 - RNA, 18 nt, Human
aacaaccaaccccuaaau

SEQ ID NO: 1002740 - RNA, 21 nt, Human
acauggcuucccucugugcgc

SEQ ID NO: 1002741 - RNA, 25 nt, Human
agacaaaaauauacucuguaacaac

SEQ ID NO: 1002742 - RNA, 18 nt, Human
agcaaacauugcucucuc

SEQ ID NO: 1002743 - RNA, 22 nt, Human
aggaaagugaagaccagccaga

SEQ ID NO: 1002744 - RNA, 24 nt, Human
aggacaucauggccaagacccaga

SEQ ID NO: 1002745 - RNA, 20 nt, Human
aggcuccucccccaccacga

SEQ ID NO: 1002746 - RNA, 21 nt, Human
agggugacggaaagaaagcac

SEQ ID NO: 1002747 - RNA, 23 nt, Human
agucaggauggauaaacuccucu

SEQ ID NO: 1002748 - RNA, 25 nt, Human
auggggcaacaaacagcugcagaca

SEQ ID NO: 1002749 - RNA, 22 nt, Human
caacaaacagcugcagacaaaa

SEQ ID NO: 1002750 - RNA, 23 nt, Human
caaccccuaaaucucacugcuua

SEQ ID NO: 1002751 - RNA, 19 nt, Human
caagaggccacuguccaaa

SEQ ID NO: 1002752 - RNA, 21 nt, Human
caaggcaucuucagcaacccc

SEQ ID NO: 1002753 - RNA, 22 nt, Human
caccucaaggcaucuucagcaa

SEQ ID NO: 1002754 - RNA, 23 nt, Human
caccucaaggcaucuucagcaac

SEQ ID NO: 1002755 - RNA, 19 nt, Human
cagaggcuccucccccacc

SEQ ID NO: 1002756 - RNA, 20 nt, Human
cagcaaccccacauggcuuc

SEQ ID NO: 1002757 - RNA, 24 nt, Human
cagcugauucaggugugcuagguu

SEQ ID NO: 1002758 - RNA, 18 nt, Human
caguggcugcaggccagc

SEQ ID NO: 1002759 - RNA, 18 nt, Human
ccaaccccuaaaucucac

SEQ ID NO: 1002760 - RNA, 18 nt, Human
ccagaguuuuauaucaac

SEQ ID NO: 1002761 - RNA, 21 nt, Human
ccagaguuuuauaucaacuga

SEQ ID NO: 1002762 - RNA, 18 nt, Human
ccagcugauucaggugug

SEQ ID NO: 1002763 - RNA, 22 nt, Human
ccaggaaggacuauccccaggg

SEQ ID NO: 1002764 - RNA, 23 nt, Human
cccagcagaggaggguaagggag

SEQ ID NO: 1002765 - RNA, 21 nt, Human
cccccaccacgaugccaggaa

SEQ ID NO: 1002766 - RNA, 18 nt, Human
ccccuaaaucucacugcu

SEQ ID NO: 1002767 - RNA, 23 nt, Human
ccgugaagcgagcggcuccuucc

SEQ ID NO: 1002768 - RNA, 18 nt, Human
ccuuccggcggcgcgggu

SEQ ID NO: 1002769 - RNA, 19 nt, Human
cgaugccaggaaggacuau

SEQ ID NO: 1002770 - RNA, 23 nt, Human
cgcggguucccuucccucaaucc

SEQ ID NO: 1002771 - RNA, 20 nt, Human
cggcgcggguucccuucccu

SEQ ID NO: 1002772 - RNA, 21 nt, Human
cggggggauggggugggggca

SEQ ID NO: 1002773 - RNA, 21 nt, Human
cucaagaggccacuguccaaa

SEQ ID NO: 1002774 - RNA, 20 nt, Human
cucacagcagagggaagaag

SEQ ID NO: 1002775 - RNA, 22 nt, Human
cuccacagaccagggugccgcu

SEQ ID NO: 1002776 - RNA, 18 nt, Human
cucccccaccacgaugcc

SEQ ID NO: 1002777 - RNA, 20 nt, Human
cugcccccauuucaccucaa

SEQ ID NO: 1002778 - RNA, 19 nt, Human
gacggaaagaaagcacugg

SEQ ID NO: 1002779 - RNA, 24 nt, Human
gacggaaagaaagcacuggacucc

SEQ ID NO: 1002780 - RNA, 18 nt, Human
gcaggacagcucaugccu

SEQ ID NO: 1002781 - RNA, 22 nt, Human
ggaagagcacaggccaaccaca

SEQ ID NO: 1002782 - RNA, 19 nt, Human
ggcaucuucagcaacccca

SEQ ID NO: 1002783 - RNA, 24 nt, Human
ggcgcggguucccuucccucaauc

SEQ ID NO: 1002784 - RNA, 23 nt, Human
gggucucucagcuuuaaagccuu

SEQ ID NO: 1002785 - RNA, 18 nt, Human
guggcuuuccugccccca

SEQ ID NO: 1002786 - RNA, 22 nt, Human
uaccaaggaucugaguuuguac

SEQ ID NO: 1002787 - RNA, 24 nt, Human
uacucauguauuagcucugcuaua

SEQ ID NO: 1002788 - RNA, 21 nt, Human
ucagacgcaggacagcucaug

SEQ ID NO: 1002789 - RNA, 23 nt, Human
ucagcaaccccacauggcuuccc

SEQ ID NO: 1002790 - RNA, 22 nt, Human
uccggcggcgcggguucccuuc

SEQ ID NO: 1002791 - RNA, 26 nt, Human
uccuccauauggcaaagaugaagaaa

SEQ ID NO: 1002792 - RNA, 25 nt, Human
ucucccggggggauggggugggggc

SEQ ID NO: 1002793 - RNA, 23 nt, Human
ucucucagcuuuaaagccuugga

SEQ ID NO: 1002794 - RNA, 22 nt, Human
ugacggaaagaaagcacuggac

SEQ ID NO: 1002795 - RNA, 22 nt, Human
ugcagaggaacucaagaggcca

SEQ ID NO: 1002796 - RNA, 26 nt, Human
ugcccugccuuccagcccggguccca

SEQ ID NO: 1002797 - RNA, 18 nt, Human
uggauccugaguccaucu

SEQ ID NO: 1002798 - RNA, 27 nt, Human
uggcaaucuuuuuagggguaccaagga

SEQ ID NO: 1002799 - RNA, 23 nt, Human
uguaacaacccaacaugcuagaa

SEQ ID NO: 1002800 - RNA, 24 nt, Human
aaaggaaaaaagcucuacaaaagg

SEQ ID NO: 1002801 - RNA, 20 nt, Human
aagcucuacaaaagggaaau

SEQ ID NO: 1002802 - RNA, 24 nt, Human
acucggaggagcgcccugcaggga

SEQ ID NO: 1002803 - RNA, 21 nt, Human
acugccaggcgcaccggcccg

SEQ ID NO: 1002804 - RNA, 18 nt, Human
agccgcgcccucgccccg

SEQ ID NO: 1002805 - RNA, 21 nt, Human
aggaaaaaagcucuacaaaag

SEQ ID NO: 1002806 - RNA, 21 nt, Human
auaggcacugacagagcacca

SEQ ID NO: 1002807 - RNA, 22 nt, Human
cagguggagugaguaguuuuga

SEQ ID NO: 1002808 - RNA, 19 nt, Human
ccgccuccagccccucucc

SEQ ID NO: 1002809 - RNA, 18 nt, Human
ccggccccuccuucuucc

SEQ ID NO: 1002810 - RNA, 21 nt, Human
cgcagccgacugccaggcgca

SEQ ID NO: 1002811 - RNA, 21 nt, Human
cucgccccgccuccagccccu

SEQ ID NO: 1002812 - RNA, 18 nt, Human
gaggacgcagccgacugc

SEQ ID NO: 1002813 - RNA, 19 nt, Human
gcagccgacugccaggcgc

SEQ ID NO: 1002814 - RNA, 21 nt, Human
gccggccccuccuucuucccu

SEQ ID NO: 1002815 - RNA, 21 nt, Human
ggacucggaggagcgcccugc

SEQ ID NO: 1002816 - RNA, 22 nt, Human
gggcuuaggaaaggaaaaaagc

SEQ ID NO: 1002817 - RNA, 21 nt, Human
ucacugacgccggccccuccu

SEQ ID NO: 1002818 - RNA, 18 nt, Human
ucagcaggggcccaggug

SEQ ID NO: 1002819 - RNA, 23 nt, Human
ucccugugggcucagagcgccga

SEQ ID NO: 1002820 - RNA, 24 nt, Human
ucgccccgccuccagccccucucc

SEQ ID NO: 1002821 - RNA, 21 nt, Human
ugacgccggccccuccuucuu

SEQ ID NO: 1002822 - RNA, 23 nt, Human
ugccaggcgcaccggcccgcccc

SEQ ID NO: 1002823 - RNA, 22 nt, Human
uggcaacgcccacgcucaccuc

SEQ ID NO: 1002824 - RNA, 18 nt, Human
uuugauaagguccaggug

SEQ ID NO: 1002825 - RNA, 21 nt, Human
uuugauaagguccagguggga

SEQ ID NO: 1002826 - RNA, 24 nt, Human
uuuuuuuuuuuuuuuuuuccaaag

SEQ ID NO: 1002827 - RNA, 24 nt, Human
aaaaaaccaggaugggauuuggca

SEQ ID NO: 1002828 - RNA, 23 nt, Human
aaccaggaugggauuuggcaguu

SEQ ID NO: 1002829 - RNA, 21 nt, Human
accacuaaauugccuccgauu

SEQ ID NO: 1002830 - RNA, 20 nt, Human
agaaaaaaaccaggauggga

SEQ ID NO: 1002831 - RNA, 24 nt, Human
aggcuggagcugacacuggaucca

SEQ ID NO: 1002832 - RNA, 22 nt, Human
cacacagggcuaggauggucaa

SEQ ID NO: 1002833 - RNA, 31 nt, Human
cuguuuugcagaaaaaaaccaggaugggauu

SEQ ID NO: 1002834 - RNA, 20 nt, Human
gauucugcuggguccaggua

SEQ ID NO: 1002835 - RNA, 23 nt, Human
ggaugggauuuggcaguuggcca

SEQ ID NO: 1002836 - RNA, 20 nt, Human
guggauaaucaccaagcugc

SEQ ID NO: 1002837 - RNA, 20 nt, Human
guggggucacaugccccuuc

SEQ ID NO: 1002838 - RNA, 22 nt, Human
uccuuaaccacuaaauugccuc

SEQ ID NO: 1002839 - RNA, 23 nt, Human
uccuucuucuuuugcauuucucu

SEQ ID NO: 1002840 - RNA, 18 nt, Human
ugcagaaaaaaaccagga

SEQ ID NO: 1002841 - RNA, 21 nt, Human
uggaaaauuuccuucuucuuu

SEQ ID NO: 1002842 - RNA, 22 nt, Human
uggcugcugcaauggggugggg

SEQ ID NO: 1002843 - RNA, 18 nt, Human
ugucacagcauuggcugu

SEQ ID NO: 1002844 - RNA, 18 nt, Human
uugccuccgauuuucagc

SEQ ID NO: 1002845 - RNA, 25 nt, Human
uuuccuucuucuuuugcauuucucu

SEQ ID NO: 1002846 - RNA, 25 nt, Human
uuuucagccuggggauggauggagc

SEQ ID NO: 1002847 - RNA, 20 nt, Human
aaagauaugacucuucugac

SEQ ID NO: 1002848 - RNA, 21 nt, Human
aggugauguaacucucuugcc

SEQ ID NO: 1002849 - RNA, 18 nt, Human
auuccugucuuuaacccc

SEQ ID NO: 1002850 - RNA, 23 nt, Human
caaccuguaaaagauaugacucu

SEQ ID NO: 1002851 - RNA, 19 nt, Human
caucauagugauauaucac

SEQ ID NO: 1002852 - RNA, 19 nt, Human
cauucucacagacaucaua

SEQ ID NO: 1002853 - RNA, 20 nt, Human
cccauucucacagacaucau

SEQ ID NO: 1002854 - RNA, 18 nt, Human
cccccaaguuaugcaacu

SEQ ID NO: 1002855 - RNA, 22 nt, Human
cccccaaguuaugcaacuuuuc

SEQ ID NO: 1002856 - RNA, 19 nt, Human
ccugucuuuaacccccaag

SEQ ID NO: 1002857 - RNA, 21 nt, Human
cuaggugaugugacuuucuuc

SEQ ID NO: 1002858 - RNA, 24 nt, Human
cugcccauucucacagacaucaua

SEQ ID NO: 1002859 - RNA, 20 nt, Human
gaacucagaaccagaugaug

SEQ ID NO: 1002860 - RNA, 23 nt, Human
uaacccccaaguuaugcaacuuu

SEQ ID NO: 1002861 - RNA, 21 nt, Human
uaugagucucuucuucugucu

SEQ ID NO: 1002862 - RNA, 18 nt, Human
ucucagaacucagaacca

SEQ ID NO: 1002863 - RNA, 18 nt, Human
ucuugccugaguuguuuu

SEQ ID NO: 1002864 - RNA, 20 nt, Human
ugaaaacaagagaugugugg

SEQ ID NO: 1002865 - RNA, 20 nt, Human
ugacauaaggguggaacggg

SEQ ID NO: 1002866 - RNA, 18 nt, Human
uggaacgggcuccuaggu

SEQ ID NO: 1002867 - RNA, 21 nt, Human
uggcaauucauccucguuucu

SEQ ID NO: 1002868 - RNA, 20 nt, Human
uguacacaugaagcacugug

SEQ ID NO: 1002869 - RNA, 24 nt, Human
ugugacauauucuggguuugucau

SEQ ID NO: 1002870 - RNA, 20 nt, Human
uuagcaaacagaggaaauug

SEQ ID NO: 1002871 - RNA, 22 nt, Human
uuaggugauaugagucucuucu

SEQ ID NO: 1002872 - RNA, 26 nt, Human
uucuuaguccuguacacaugaagcac

SEQ ID NO: 1002873 - RNA, 22 nt, Human
uuggcugacaguaaggacuuuc

SEQ ID NO: 1002874 - RNA, 27 nt, Human
uugugccauauuccugucuuuaacccc

SEQ ID NO: 1002875 - RNA, 20 nt, Human
uuguuuucuaaggggacuug

SEQ ID NO: 1002876 - RNA, 19 nt, Human
uuucugguccuuucaacag

SEQ ID NO: 1002877 - RNA, 18 nt, Human
acaggggugaggauacaa

SEQ ID NO: 1002878 - RNA, 24 nt, Human
auaaggucagacaggggugaggau

SEQ ID NO: 1002879 - RNA, 23 nt, Human
auggggugaggauacaaucugcu

SEQ ID NO: 1002880 - RNA, 19 nt, Human
cccacaacuucaacuuuua

SEQ ID NO: 1002881 - RNA, 22 nt, Human
cuacgauggugguaauccccuu

SEQ ID NO: 1002882 - RNA, 20 nt, Human
cuauagcugcugcugcuguu

SEQ ID NO: 1002883 - RNA, 21 nt, Human
cuucuugggauuuuauccugg

SEQ ID NO: 1002884 - RNA, 19 nt, Human
cuugguggugagucucccu

SEQ ID NO: 1002885 - RNA, 24 nt, Human
gacaggggugaggauacaaucugg

SEQ ID NO: 1002886 - RNA, 20 nt, Human
gaugcacuucuccaucuucu

SEQ ID NO: 1002887 - RNA, 19 nt, Human
gcacaugcuucacaucaug

SEQ ID NO: 1002888 - RNA, 19 nt, Human
ggaauuggaugagauccca

SEQ ID NO: 1002889 - RNA, 23 nt, Human
ggaugagaucccacaacuucaac

SEQ ID NO: 1002890 - RNA, 22 nt, Human
ggggugaggauacaaucuggug

SEQ ID NO: 1002891 - RNA, 18 nt, Human
ucaacuuuuauuuugguu

SEQ ID NO: 1002892 - RNA, 18 nt, Human
ucaacuuuuauuuugguu

SEQ ID NO: 1002893 - RNA, 19 nt, Human
ucaacuuuuauuuugguug

SEQ ID NO: 1002894 - RNA, 19 nt, Human
uccaucuucuugggauuuu

SEQ ID NO: 1002895 - RNA, 23 nt, Human
ugcugcugcuguuguagcuuugg

SEQ ID NO: 1002896 - RNA, 21 nt, Human
uggcucugcuugggcucuggg

SEQ ID NO: 1002897 - RNA, 22 nt, Human
uggcucugcuugggcucugggg

SEQ ID NO: 1002898 - RNA, 20 nt, Human
uucaacuuuuauuuugguug

SEQ ID NO: 1002899 - RNA, 21 nt, Human
uuggcucugcuugggcucugg

SEQ ID NO: 1002900 - RNA, 22 nt, Human
aaguauuccuucagccucagcc

SEQ ID NO: 1002901 - RNA, 25 nt, Human
aaguauuccuucagccucagccucc

SEQ ID NO: 1002902 - RNA, 18 nt, Human
aggcuagucuugaauucc

SEQ ID NO: 1002903 - RNA, 22 nt, Human
caagcugggauucgaagacugg

SEQ ID NO: 1002904 - RNA, 22 nt, Human
caccaagcugggauucgaagac

SEQ ID NO: 1002905 - RNA, 19 nt, Human
caccccuuauccgucacag

SEQ ID NO: 1002906 - RNA, 21 nt, Human
caugcaugccaccaagcuggg

SEQ ID NO: 1002907 - RNA, 24 nt, Human
caugccaccaagcugggauucgaa

SEQ ID NO: 1002908 - RNA, 26 nt, Human
cccacaccccuuauccgucacagcca

SEQ ID NO: 1002909 - RNA, 22 nt, Human
ccccgcaccccacaccccuuau

SEQ ID NO: 1002910 - RNA, 21 nt, Human
cccuuauccgucacagccauu

SEQ ID NO: 1002911 - RNA, 19 nt, Human
ccggcggcucagcggcggg

SEQ ID NO: 1002912 - RNA, 19 nt, Human
ccugggcucaaguauuccu

SEQ ID NO: 1002913 - RNA, 20 nt, Human
cggcucagcggcggggcgcg

SEQ ID NO: 1002914 - RNA, 19 nt, Human
cucaaguauuccuucagcc

SEQ ID NO: 1002915 - RNA, 20 nt, Human
cuugaauuccugggcucaag

SEQ ID NO: 1002916 - RNA, 18 nt, Human
gucagggucucaguaugu

SEQ ID NO: 1002917 - RNA, 23 nt, Human
guggcggcguuuccccggcggcg

SEQ ID NO: 1002918 - RNA, 24 nt, Human
uauguugugcaggcuagucuugaa

SEQ ID NO: 1002919 - RNA, 21 nt, Human
uccccgcaccccacaccccuu

SEQ ID NO: 1002920 - RNA, 18 nt, Human
uccugggcucaaguauuc

SEQ ID NO: 1002921 - RNA, 20 nt, Human
uccugggcucaaguauuccu

SEQ ID NO: 1002922 - RNA, 24 nt, Human
ugggacuaaacaugcaugccacca

SEQ ID NO: 1002923 - RNA, 25 nt, Human
uguagcugggacuaaaccggggucc

SEQ ID NO: 1002924 - RNA, 23 nt, Human
uuccugggcucaaguauuccuuc

SEQ ID NO: 1002925 - RNA, 18 nt, Human
aaaacccucaaaccagga

SEQ ID NO: 1002926 - RNA, 25 nt, Human
aaagcaggaaccaagacaaaggcaa

SEQ ID NO: 1002927 - RNA, 23 nt, Human
aaaggcaaguccaaauugaaaca

SEQ ID NO: 1002928 - RNA, 23 nt, Human
aaaggcagguccaaagucaagca

SEQ ID NO: 1002929 - RNA, 19 nt, Human
aacugcugggaacacagga

SEQ ID NO: 1002930 - RNA, 19 nt, Human
aacugucccauggauccca

SEQ ID NO: 1002931 - RNA, 18 nt, Human
aagcagcugcucagcugg

SEQ ID NO: 1002932 - RNA, 21 nt, Human
acaaacacacaaagccacaca

SEQ ID NO: 1002933 - RNA, 23 nt, Human
acacaaauguggaggccacaacc

SEQ ID NO: 1002934 - RNA, 21 nt, Human
acacacacacagacacauaca

SEQ ID NO: 1002935 - RNA, 19 nt, Human
acacacacagacacauaca

SEQ ID NO: 1002936 - RNA, 19 nt, Human
acacauacacaaacacaca

SEQ ID NO: 1002937 - RNA, 22 nt, Human
acacucccacaguaacacacag

SEQ ID NO: 1002938 - RNA, 19 nt, Human
acagacacauacacaaaca

SEQ ID NO: 1002939 - RNA, 19 nt, Human
accaaugaggacaauggaa

SEQ ID NO: 1002940 - RNA, 19 nt, Human
accucacugucucccuuca

SEQ ID NO: 1002941 - RNA, 19 nt, Human
acucugugucccagaauga

SEQ ID NO: 1002942 - RNA, 19 nt, Human
acugcugggaacacaggaa

SEQ ID NO: 1002943 - RNA, 19 nt, Human
agaagacaggugacagugc

SEQ ID NO: 1002944 - RNA, 24 nt, Human
agacaaaggcaaguccaaauugaa

SEQ ID NO: 1002945 - RNA, 24 nt, Human
agacacauacacaaacacacaaag

SEQ ID NO: 1002946 - RNA, 25 nt, Human
agacacauacacaaacacacaaagc

SEQ ID NO: 1002947 - RNA, 22 nt, Human
agacugaaaucccaagacaaug

SEQ ID NO: 1002948 - RNA, 24 nt, Human
agaggucuccuucucuaccaagcc

SEQ ID NO: 1002949 - RNA, 22 nt, Human
aggaaaaugguacaggcagagc

SEQ ID NO: 1002950 - RNA, 22 nt, Human
aggaaccaagacaaaggcaagu

SEQ ID NO: 1002951 - RNA, 22 nt, Human
aggcaggaaccacgacaaaggc

SEQ ID NO: 1002952 - RNA, 23 nt, Human
aggccacaacccacccagcauca

SEQ ID NO: 1002953 - RNA, 22 nt, Human
aggggcagacgauggggaaccc

SEQ ID NO: 1002954 - RNA, 24 nt, Human
agggguuuugugaaagaaucaugc

SEQ ID NO: 1002955 - RNA, 24 nt, Human
agggugucagggcugucagccugc

SEQ ID NO: 1002956 - RNA, 21 nt, Human
agguauuaaaacccucaaacc

SEQ ID NO: 1002957 - RNA, 22 nt, Human
aggugcuaucugggaaaagcag

SEQ ID NO: 1002958 - RNA, 19 nt, Human
auaaaacauucuccaggaa

SEQ ID NO: 1002959 - RNA, 18 nt, Human
augauagugucucuccuu

SEQ ID NO: 1002960 - RNA, 22 nt, Human
augcuagcuggagcccauagcu

SEQ ID NO: 1002961 - RNA, 18 nt, Human
auguccacuaaugcuguu

SEQ ID NO: 1002962 - RNA, 18 nt, Human
caaaagauggccuggcac

SEQ ID NO: 1002963 - RNA, 18 nt, Human
caaacacacaaagccaca

SEQ ID NO: 1002964 - RNA, 21 nt, Human
caaacacacaaagccacacac

SEQ ID NO: 1002965 - RNA, 20 nt, Human
caaauguggaggccacaacc

SEQ ID NO: 1002966 - RNA, 22 nt, Human
caacacucccacaguaacacac

SEQ ID NO: 1002967 - RNA, 18 nt, Human
caaguccaaauugaaaca

SEQ ID NO: 1002968 - RNA, 19 nt, Human
caccagguuguauacucac

SEQ ID NO: 1002969 - RNA, 20 nt, Human
cacuccaaauuuuuccugca

SEQ ID NO: 1002970 - RNA, 23 nt, Human
cagccugccuaagcagaggaaaa

SEQ ID NO: 1002971 - RNA, 22 nt, Human
caggaaccaagacaaaggcaag

SEQ ID NO: 1002972 - RNA, 23 nt, Human
caugaaaucucaagaugauggag

SEQ ID NO: 1002973 - RNA, 21 nt, Human
cauucugcagaaagccccacc

SEQ ID NO: 1002974 - RNA, 30 nt, Human
cauuuacauacacacacacagacacauaca

SEQ ID NO: 1002975 - RNA, 23 nt, Human
ccaacacucgcaacacucccaca

SEQ ID NO: 1002976 - RNA, 23 nt, Human
ccacggaguucuuauccacaaag

SEQ ID NO: 1002977 - RNA, 23 nt, Human
ccagcaucaaucuauuccacuuc

SEQ ID NO: 1002978 - RNA, 22 nt, Human
cccacaguaacacacagcccag

SEQ ID NO: 1002979 - RNA, 24 nt, Human
cccacccagcaucaaucuauucca

SEQ ID NO: 1002980 - RNA, 18 nt, Human
cccaguagcuucugaggc

SEQ ID NO: 1002981 - RNA, 18 nt, Human
ccccauccacccuucacc

SEQ ID NO: 1002982 - RNA, 21 nt, Human
ccuaggaucauggaacugucc

SEQ ID NO: 1002983 - RNA, 22 nt, Human
ccucacaacgugaagcagcugc

SEQ ID NO: 1002984 - RNA, 21 nt, Human
ccuggcacuugaccucucugc

SEQ ID NO: 1002985 - RNA, 18 nt, Human
ccuggguuggguaggugc

SEQ ID NO: 1002986 - RNA, 21 nt, Human
cuccauggucagaucacaugg

SEQ ID NO: 1002987 - RNA, 22 nt, Human
cucgcaacacucccacaguaac

SEQ ID NO: 1002988 - RNA, 31 nt, Human
cucgcaacacucccacaguaacacacagccu

SEQ ID NO: 1002989 - RNA, 22 nt, Human
cuggagcaccagggugucaggg

SEQ ID NO: 1002990 - RNA, 18 nt, Human
cugucccauggaucccac

SEQ ID NO: 1002991 - RNA, 22 nt, Human
cuugaccucacugucucccuuc

SEQ ID NO: 1002992 - RNA, 21 nt, Human
gaaaucccaagacaauggaga

SEQ ID NO: 1002993 - RNA, 21 nt, Human
gaagacguugagccagaccaa

SEQ ID NO: 1002994 - RNA, 19 nt, Human
gaagauguugagccagauc

SEQ ID NO: 1002995 - RNA, 22 nt, Human
gacaauggaagucaguaaaaga

SEQ ID NO: 1002996 - RNA, 19 nt, Human
gacugaaaucccaagacaa

SEQ ID NO: 1002997 - RNA, 20 nt, Human
gagaagacaggugacagugc

SEQ ID NO: 1002998 - RNA, 21 nt, Human
gauguugaaaaauguucacag

SEQ ID NO: 1002999 - RNA, 20 nt, Human
gcagagcuggcuugguauca

SEQ ID NO: 1003000 - RNA, 18 nt, Human
gccacaacccacccagca

SEQ ID NO: 1003001 - RNA, 20 nt, Human
gcucuccucuucuuuguaga

SEQ ID NO: 1003002 - RNA, 18 nt, Human
ggauaaaggcugccugug

SEQ ID NO: 1003003 - RNA, 18 nt, Human
gguacaggcagagcuggc

SEQ ID NO: 1003004 - RNA, 22 nt, Human
guucuuggguguggugcucucc

SEQ ID NO: 1003005 - RNA, 19 nt, Human
uaaaacccucaaaccagga

SEQ ID NO: 1003006 - RNA, 19 nt, Human
uaaaagaggacacaaaugu

SEQ ID NO: 1003007 - RNA, 23 nt, Human
uacagguauuaaaacccucaaac

SEQ ID NO: 1003008 - RNA, 26 nt, Human
uacauacacacacacagacacauaca

SEQ ID NO: 1003009 - RNA, 22 nt, Human
uacccuaaaagucucaaacuua

SEQ ID NO: 1003010 - RNA, 24 nt, Human
uaucccagacugaaaucccaagac

SEQ ID NO: 1003011 - RNA, 21 nt, Human
ucaaaccaggaguuuuccaga

SEQ ID NO: 1003012 - RNA, 22 nt, Human
ucacagaaggugucugcggaaa

SEQ ID NO: 1003013 - RNA, 19 nt, Human
ucagugaaagauggcuggg

SEQ ID NO: 1003014 - RNA, 23 nt, Human
uccauggucagaucacaugggag

SEQ ID NO: 1003015 - RNA, 18 nt, Human
ucccacagagaagacagg

SEQ ID NO: 1003016 - RNA, 19 nt, Human
ucccaugaggaucauuuuc

SEQ ID NO: 1003017 - RNA, 22 nt, Human
ucucacaggugcagaugugguu

SEQ ID NO: 1003018 - RNA, 21 nt, Human
ucugugucccagaaugaaauc

SEQ ID NO: 1003019 - RNA, 23 nt, Human
ucuguucuuggguguggugcucu

SEQ ID NO: 1003020 - RNA, 24 nt, Human
ugaaagaaucaugccccaugagga

SEQ ID NO: 1003021 - RNA, 19 nt, Human
ugaaagauggcugggcucu

SEQ ID NO: 1003022 - RNA, 26 nt, Human
ugacauccaacacucgcaacacuccc

SEQ ID NO: 1003023 - RNA, 24 nt, Human
ugacugauuuugcaauuaugggaa

SEQ ID NO: 1003024 - RNA, 25 nt, Human
ugagaaaggcaggaaccacgacaaa

SEQ ID NO: 1003025 - RNA, 22 nt, Human
ugagauguugagcagucuuugg

SEQ ID NO: 1003026 - RNA, 22 nt, Human
ugagauguugagcagucuuugg

SEQ ID NO: 1003027 - RNA, 21 nt, Human
ugcagauccuuuuggaucugu

SEQ ID NO: 1003028 - RNA, 19 nt, Human
ugccugugauaacgcauug

SEQ ID NO: 1003029 - RNA, 22 nt, Human
uggaagauguugagccagaucc

SEQ ID NO: 1003030 - RNA, 22 nt, Human
uggaagucaguaaaagaggaca

SEQ ID NO: 1003031 - RNA, 21 nt, Human
uggagcaccagggugucaggg

SEQ ID NO: 1003032 - RNA, 19 nt, Human
uggcaggggaucuaugaga

SEQ ID NO: 1003033 - RNA, 20 nt, Human
uggcucacaucuacccucuc

SEQ ID NO: 1003034 - RNA, 21 nt, Human
uggcucacaucuacccucucc

SEQ ID NO: 1003035 - RNA, 18 nt, Human
uggcugggcucuugaccu

SEQ ID NO: 1003036 - RNA, 21 nt, Human
uggcuugguaucaggauaaag

SEQ ID NO: 1003037 - RNA, 21 nt, Human
ugggagagagaaacugcuggg

SEQ ID NO: 1003038 - RNA, 20 nt, Human
ugggagaugucuguucuugg

SEQ ID NO: 1003039 - RNA, 23 nt, Human
ugggugucagugaaagauggcug

SEQ ID NO: 1003040 - RNA, 22 nt, Human
ugguacaggcagagcuggcuug

SEQ ID NO: 1003041 - RNA, 18 nt, Human
ugguaucaggauaaaggc

SEQ ID NO: 1003042 - RNA, 24 nt, Human
uggugagauguugagcagucuuug

SEQ ID NO: 1003043 - RNA, 19 nt, Human
ugugaaagaaucaugcccc

SEQ ID NO: 1003044 - RNA, 23 nt, Human
ugugaacagggaagaguuuagug

SEQ ID NO: 1003045 - RNA, 26 nt, Human
ugugaacagggaagaguuuaguguga

SEQ ID NO: 1003046 - RNA, 19 nt, Human
uucacccuuuuugcuggug

SEQ ID NO: 1003047 - RNA, 26 nt, Human
uucaggacaauaaaacauucuccagg

SEQ ID NO: 1003048 - RNA, 23 nt, Human
uucuuuguagaagaguaccugac

SEQ ID NO: 1003049 - RNA, 21 nt, Human
uugcaagucugacaaucaugu

SEQ ID NO: 1003050 - RNA, 24 nt, Human
uuggccacaauuugcacuccaaau

SEQ ID NO: 1003051 - RNA, 25 nt, Human
uuuggaucuguagugauuuugugcu

SEQ ID NO: 1003052 - RNA, 18 nt, Human
uuuuaugauggucuucug

SEQ ID NO: 1003053 - RNA, 18 nt, Human
uuuuuuggcaggggcagc

SEQ ID NO: 1003054 - RNA, 23 nt, Human
acuucauauucaguuccuagcug

SEQ ID NO: 1003055 - RNA, 27 nt, Human
caucccauggagaaacacuagcagucc

SEQ ID NO: 1003056 - RNA, 24 nt, Human
cccauggagaaacacuagcagucc

SEQ ID NO: 1003057 - RNA, 20 nt, Human
ccccuugaauuuacuucaua

SEQ ID NO: 1003058 - RNA, 22 nt, Human
ccuacaacaucuaggcaggccu

SEQ ID NO: 1003059 - RNA, 20 nt, Human
cuccaguguacaucccaugg

SEQ ID NO: 1003060 - RNA, 24 nt, Human
uacuucauauucaguuccuagcug

SEQ ID NO: 1003061 - RNA, 18 nt, Human
ucccauggagaaacacua

SEQ ID NO: 1003062 - RNA, 24 nt, Human
ucuccaguguacaucccauggaga

SEQ ID NO: 1003063 - RNA, 26 nt, Human
ugcuuuauucuccaguguacauccca

SEQ ID NO: 1003064 - RNA, 22 nt, Human
uucuccaguguacaucccaugg

SEQ ID NO: 1003065 - RNA, 23 nt, Human
uuuuuuuuuuuuuuuuuuaacag

SEQ ID NO: 1003066 - RNA, 18 nt, Human
aaucauggcacuguccug

SEQ ID NO: 1003067 - RNA, 24 nt, Human
acacacacucacacacacacacag

SEQ ID NO: 1003068 - RNA, 23 nt, Human
acacccucuuugccagaaugaaa

SEQ ID NO: 1003069 - RNA, 19 nt, Human
acagaaacaagcagccugg

SEQ ID NO: 1003070 - RNA, 23 nt, Human
acucacacacacacacacacaca

SEQ ID NO: 1003071 - RNA, 20 nt, Human
aggcaaacacacacacacuc

SEQ ID NO: 1003072 - RNA, 19 nt, Human
cacacaauggcacacacac

SEQ ID NO: 1003073 - RNA, 24 nt, Human
cacacacacacacacacaccccua

SEQ ID NO: 1003074 - RNA, 22 nt, Human
cacacacacacucacacacaca

SEQ ID NO: 1003075 - RNA, 24 nt, Human
cacacacacacucacacacacaca

SEQ ID NO: 1003076 - RNA, 24 nt, Human
cacacacaccccuaagcacacaau

SEQ ID NO: 1003077 - RNA, 25 nt, Human
cacacacacucacacacacacacac

SEQ ID NO: 1003078 - RNA, 22 nt, Human
caccugcucggcuggggaugga

SEQ ID NO: 1003079 - RNA, 27 nt, Human
cacucacacacacacacacacacaccc

SEQ ID NO: 1003080 - RNA, 22 nt, Human
cagaaugaaauuccaagaaaau

SEQ ID NO: 1003081 - RNA, 22 nt, Human
ccaacacucacaacauuuucac

SEQ ID NO: 1003082 - RNA, 19 nt, Human
cccaccuuauugcugcuca

SEQ ID NO: 1003083 - RNA, 31 nt, Human
cucacaacauuuucacagaaacaagcagccu

SEQ ID NO: 1003084 - RNA, 20 nt, Human
cucacacacacacacacaca

SEQ ID NO: 1003085 - RNA, 21 nt, Human
cucacacacacacacacacac

SEQ ID NO: 1003086 - RNA, 21 nt, Human
cuccugaguuugguugguucu

SEQ ID NO: 1003087 - RNA, 21 nt, Human
cuuugccagaaugaaauucca

SEQ ID NO: 1003088 - RNA, 23 nt, Human
gaagacccaccuuauugcugcuc

SEQ ID NO: 1003089 - RNA, 22 nt, Human
gcagacauccaacacucacaac

SEQ ID NO: 1003090 - RNA, 18 nt, Human
uaaaggcaaacacacaca

SEQ ID NO: 1003091 - RNA, 21 nt, Human
uaagcaccugcucggcugggg

SEQ ID NO: 1003092 - RNA, 23 nt, Human
uaagcagacuccaguuaaaggca

SEQ ID NO: 1003093 - RNA, 21 nt, Human
ucacacacacacacacacaca

SEQ ID NO: 1003094 - RNA, 20 nt, Human
uggcacacacacaugcagac

SEQ ID NO: 1003095 - RNA, 22 nt, Human
uggcacacacacaugcagacau

SEQ ID NO: 1003096 - RNA, 26 nt, Human
aaaaacuaacgaaauacuugaagccc

SEQ ID NO: 1003097 - RNA, 20 nt, Human
aaaaagccuagcuacuucca

SEQ ID NO: 1003098 - RNA, 21 nt, Human
aaauaaaaaugagaucaauug

SEQ ID NO: 1003099 - RNA, 25 nt, Human
aagugacuacaaagugagacagucu

SEQ ID NO: 1003100 - RNA, 24 nt, Human
aauaagaaggcuuuuuuaaaagaa

SEQ ID NO: 1003101 - RNA, 21 nt, Human
aauauucuuuuaucuccacuc

SEQ ID NO: 1003102 - RNA, 19 nt, Human
acacuggauuacccaccgg

SEQ ID NO: 1003103 - RNA, 18 nt, Human
acaguaccuuggacuggg

SEQ ID NO: 1003104 - RNA, 21 nt, Human
acauuaggaaaaaccaguaca

SEQ ID NO: 1003105 - RNA, 21 nt, Human
accuccucccaaaguccccac

SEQ ID NO: 1003106 - RNA, 22 nt, Human
accuugaaguucaaucugucuc

SEQ ID NO: 1003107 - RNA, 23 nt, Human
acuggauuacccaccgguuucua

SEQ ID NO: 1003108 - RNA, 20 nt, Human
agaaggcuuuuuuaaaagaa

SEQ ID NO: 1003109 - RNA, 24 nt, Human
agccagaacaccaguuucuggacc

SEQ ID NO: 1003110 - RNA, 19 nt, Human
aggcacuaauagguccaau

SEQ ID NO: 1003111 - RNA, 18 nt, Human
agggaccagagcagggcu

SEQ ID NO: 1003112 - RNA, 25 nt, Human
agguagaaaacagaaauaugcuggg

SEQ ID NO: 1003113 - RNA, 18 nt, Human
agugugauuagagcuggg

SEQ ID NO: 1003114 - RNA, 18 nt, Human
auaagaaggcuuuuuuaa

SEQ ID NO: 1003115 - RNA, 23 nt, Human
auguuccugaugcuauaacacag

SEQ ID NO: 1003116 - RNA, 21 nt, Human
auuccaacauauaaauucugg

SEQ ID NO: 1003117 - RNA, 19 nt, Human
cacaguaccuuggacuggg

SEQ ID NO: 1003118 - RNA, 21 nt, Human
caccuuguugcuguguucucc

SEQ ID NO: 1003119 - RNA, 25 nt, Human
cacuaaaaaugagguuuucuggaua

SEQ ID NO: 1003120 - RNA, 21 nt, Human
cacucuuucacuaaaaaugag

SEQ ID NO: 1003121 - RNA, 18 nt, Human
cacuggauuacccaccgg

SEQ ID NO: 1003122 - RNA, 20 nt, Human
cauuaaguaugaggaccaaa

SEQ ID NO: 1003123 - RNA, 23 nt, Human
cauugaguucuuuuauaaggucu

SEQ ID NO: 1003124 - RNA, 23 nt, Human
ccaaauacauuaggaaaaaccag

SEQ ID NO: 1003125 - RNA, 21 nt, Human
ccaacauauaaauucuggagc

SEQ ID NO: 1003126 - RNA, 21 nt, Human
ccacaaaaucuaggacacucu

SEQ ID NO: 1003127 - RNA, 21 nt, Human
ccagagaggacaaauacagug

SEQ ID NO: 1003128 - RNA, 22 nt, Human
cuggauuacccaccgguuucua

SEQ ID NO: 1003129 - RNA, 19 nt, Human
cuuguccgcaucugaaaau

SEQ ID NO: 1003130 - RNA, 19 nt, Human
gaaaaaacacagcuuaccc

SEQ ID NO: 1003131 - RNA, 20 nt, Human
gacagucuaaggcagggcca

SEQ ID NO: 1003132 - RNA, 19 nt, Human
gauuacccaccgguuucua

SEQ ID NO: 1003133 - RNA, 21 nt, Human
gccuagcuacuuccauugagu

SEQ ID NO: 1003134 - RNA, 22 nt, Human
ggaaaaaccaguacacuggagg

SEQ ID NO: 1003135 - RNA, 18 nt, Human
ggccacagccagaacacc

SEQ ID NO: 1003136 - RNA, 18 nt, Human
ggcuuguuguccucuucu

SEQ ID NO: 1003137 - RNA, 24 nt, Human
guagaaaaauaagaaggcuuuuuu

SEQ ID NO: 1003138 - RNA, 24 nt, Human
guguucuccagagaggacaaauac

SEQ ID NO: 1003139 - RNA, 20 nt, Human
uaaauuauccauagugauuc

SEQ ID NO: 1003140 - RNA, 22 nt, Human
uaaauuauccauagugauucug

SEQ ID NO: 1003141 - RNA, 20 nt, Human
uaaccuccucccaaaguccc

SEQ ID NO: 1003142 - RNA, 26 nt, Human
uaaggcagggccacagccagaacacc

SEQ ID NO: 1003143 - RNA, 24 nt, Human
uacccaccgguuucuauucagagu

SEQ ID NO: 1003144 - RNA, 18 nt, Human
uagaaaacagaaauaugc

SEQ ID NO: 1003145 - RNA, 23 nt, Human
uagguuauacuuaucuaaaaauu

SEQ ID NO: 1003146 - RNA, 20 nt, Human
uauaacacaguaccuuggac

SEQ ID NO: 1003147 - RNA, 21 nt, Human
uaugcugggaaaaacgacguc

SEQ ID NO: 1003148 - RNA, 24 nt, Human
uauucuuuuaucuccacucuuuca

SEQ ID NO: 1003149 - RNA, 23 nt, Human
ucaaucugucucugggaaagacu

SEQ ID NO: 1003150 - RNA, 19 nt, Human
ucacagcccaacucuucgg

SEQ ID NO: 1003151 - RNA, 24 nt, Human
ucuaucacacaggggcauuuaaau

SEQ ID NO: 1003152 - RNA, 21 nt, Human
ucucuaauugcacucuuaacu

SEQ ID NO: 1003153 - RNA, 21 nt, Human
ucugaaaauucacuuuuaccu

SEQ ID NO: 1003154 - RNA, 23 nt, Human
ucuggugaaggugggucucuucu

SEQ ID NO: 1003155 - RNA, 18 nt, Human
ucugucucugggaaagac

SEQ ID NO: 1003156 - RNA, 21 nt, Human
ucuuacaguuuuagacacugg

SEQ ID NO: 1003157 - RNA, 19 nt, Human
ugacuacaaagugagacag

SEQ ID NO: 1003158 - RNA, 18 nt, Human
ugacucgauuauucucgg

SEQ ID NO: 1003159 - RNA, 20 nt, Human
ugagguuuucuggauauuua

SEQ ID NO: 1003160 - RNA, 19 nt, Human
ugccacaaaaucuaggaca

SEQ ID NO: 1003161 - RNA, 24 nt, Human
uggaaagaaauaaauuucuuacag

SEQ ID NO: 1003162 - RNA, 21 nt, Human
uggauuacccaccgguuucua

SEQ ID NO: 1003163 - RNA, 20 nt, Human
ugggaaagacugaugaguuu

SEQ ID NO: 1003164 - RNA, 19 nt, Human
ugggaaguccaagaucaag

SEQ ID NO: 1003165 - RNA, 24 nt, Human
ugggaaguccaagaucaaggcacu

SEQ ID NO: 1003166 - RNA, 25 nt, Human
uggguaacuuaugaaacuggaaaga

SEQ ID NO: 1003167 - RNA, 22 nt, Human
uguaaaggaggagcccuguuuu

SEQ ID NO: 1003168 - RNA, 20 nt, Human
uguaagccuagauuugagga

SEQ ID NO: 1003169 - RNA, 21 nt, Human
uuauaaggucucuaauugcac

SEQ ID NO: 1003170 - RNA, 22 nt, Human
uuccugcauaaagugacuacaa

SEQ ID NO: 1003171 - RNA, 19 nt, Human
uuuagguagaaaacagaaa

SEQ ID NO: 1003172 - RNA, 19 nt, Human
uuuggagggaccagagcag

SEQ ID NO: 1003173 - RNA, 19 nt, Human
aauggcagagguaggagga

SEQ ID NO: 1003174 - RNA, 21 nt, Human
acacccagacacccacccagu

SEQ ID NO: 1003175 - RNA, 23 nt, Human
accucaugacauuuuuaaggcug

SEQ ID NO: 1003176 - RNA, 19 nt, Human
accugcaccuguuuccccu

SEQ ID NO: 1003177 - RNA, 18 nt, Human
agaaauagaagagcggcc

SEQ ID NO: 1003178 - RNA, 19 nt, Human
agacacccacccaguuucc

SEQ ID NO: 1003179 - RNA, 23 nt, Human
agagguggggcccacacucccac

SEQ ID NO: 1003180 - RNA, 18 nt, Human
agcacuuauaaaaauaag

SEQ ID NO: 1003181 - RNA, 19 nt, Human
aggaggaaaagaguggcug

SEQ ID NO: 1003182 - RNA, 18 nt, Human
auccggagggaaauaaaa

SEQ ID NO: 1003183 - RNA, 24 nt, Human
augaauggcagagguaggaggaaa

SEQ ID NO: 1003184 - RNA, 22 nt, Human
augaugggggaaagaaugcaac

SEQ ID NO: 1003185 - RNA, 22 nt, Human
auuauguuggguaaaacgcauc

SEQ ID NO: 1003186 - RNA, 20 nt, Human
auucagggaagaagcaacag

SEQ ID NO: 1003187 - RNA, 21 nt, Human
caaagucuuuuucaugauggg

SEQ ID NO: 1003188 - RNA, 25 nt, Human
caaugugugccggagaccuugaucc

SEQ ID NO: 1003189 - RNA, 20 nt, Human
cagaaccugcagggcuuugg

SEQ ID NO: 1003190 - RNA, 22 nt, Human
caugacauuuuuaaggcugacc

SEQ ID NO: 1003191 - RNA, 18 nt, Human
cauggaccugaaaugaca

SEQ ID NO: 1003192 - RNA, 22 nt, Human
ccacaggugugccucaaacgca

SEQ ID NO: 1003193 - RNA, 19 nt, Human
ccacccaguuucccuggua

SEQ ID NO: 1003194 - RNA, 18 nt, Human
ccagagguggggcccaca

SEQ ID NO: 1003195 - RNA, 23 nt, Human
ccaggaugccucaccuggaagcc

SEQ ID NO: 1003196 - RNA, 24 nt, Human
cgugugcacguuccagccugcaug

SEQ ID NO: 1003197 - RNA, 22 nt, Human
cuccuuaacccggagggacucc

SEQ ID NO: 1003198 - RNA, 20 nt, Human
gagaugucauggaccugaaa

SEQ ID NO: 1003199 - RNA, 22 nt, Human
gcauccagcacuuauaaaaaua

SEQ ID NO: 1003200 - RNA, 22 nt, Human
gccagagguggggcccacacuc

SEQ ID NO: 1003201 - RNA, 18 nt, Human
gccccgcacauccucucc

SEQ ID NO: 1003202 - RNA, 25 nt, Human
gcgaacuaccuaaaggagaugucau

SEQ ID NO: 1003203 - RNA, 21 nt, Human
gcgugugcacguuccagccug

SEQ ID NO: 1003204 - RNA, 24 nt, Human
ggaagaagcaacagaaccugcagg

SEQ ID NO: 1003205 - RNA, 21 nt, Human
ggaagcccagcaccagcugag

SEQ ID NO: 1003206 - RNA, 20 nt, Human
ggcugggcgaacuaccuaaa

SEQ ID NO: 1003207 - RNA, 20 nt, Human
ggucggggaaggcaggcauu

SEQ ID NO: 1003208 - RNA, 18 nt, Human
gguguagacacccagaca

SEQ ID NO: 1003209 - RNA, 27 nt, Human
guaaaacgcauccagcacuuauaaaaa

SEQ ID NO: 1003210 - RNA, 26 nt, Human
guauugguguagacacccagacaccc

SEQ ID NO: 1003211 - RNA, 23 nt, Human
guccuuguccuguccaaguacua

SEQ ID NO: 1003212 - RNA, 19 nt, Human
uaccuuuguuuggccagag

SEQ ID NO: 1003213 - RNA, 24 nt, Human
uaccuuuguuuggccagagguggg

SEQ ID NO: 1003214 - RNA, 20 nt, Human
uauguuggguaaaacgcauc

SEQ ID NO: 1003215 - RNA, 21 nt, Human
uccaaguacuauccauagaaa

SEQ ID NO: 1003216 - RNA, 21 nt, Human
ucuguaucugcuauuauguug

SEQ ID NO: 1003217 - RNA, 18 nt, Human
ugaaaugacauccggagg

SEQ ID NO: 1003218 - RNA, 22 nt, Human
ugaccuucgccccgcacauccu

SEQ ID NO: 1003219 - RNA, 18 nt, Human
ugagcuggcaagcagggg

SEQ ID NO: 1003220 - RNA, 18 nt, Human
uggaagcccagcaccagc

SEQ ID NO: 1003221 - RNA, 24 nt, Human
uggcaagcaggggaccacuggguu

SEQ ID NO: 1003222 - RNA, 24 nt, Human
ugguuuuggcuggaagcauuacuc

SEQ ID NO: 1003223 - RNA, 20 nt, Human
ugucauggaccugaaaugac

SEQ ID NO: 1003224 - RNA, 21 nt, Human
ugucauggaccugaaaugaca

SEQ ID NO: 1003225 - RNA, 19 nt, Human
uucaugaugggggaaagaa

SEQ ID NO: 1003226 - RNA, 21 nt, Human
uucucaugaauggcagagguu

SEQ ID NO: 1003227 - RNA, 20 nt, Human
aaacaacccucuaguugcca

SEQ ID NO: 1003228 - RNA, 26 nt, Human
aaacagaagcaccgagucaccgcacg

SEQ ID NO: 1003229 - RNA, 19 nt, Human
aacucuggucccucaacag

SEQ ID NO: 1003230 - RNA, 20 nt, Human
aagcaccaaagaccccaacu

SEQ ID NO: 1003231 - RNA, 22 nt, Human
aagguuugcccaccugguuccu

SEQ ID NO: 1003232 - RNA, 21 nt, Human
acacuggagaaaagaaagacc

SEQ ID NO: 1003233 - RNA, 18 nt, Human
accagagagaacacacag

SEQ ID NO: 1003234 - RNA, 24 nt, Human
accagccugugaucccccagcccc

SEQ ID NO: 1003235 - RNA, 20 nt, Human
accgagucaccgcacgcccc

SEQ ID NO: 1003236 - RNA, 19 nt, Human
acuggguggggacaggugg

SEQ ID NO: 1003237 - RNA, 24 nt, Human
agagagaggcuggcccgcguggug

SEQ ID NO: 1003238 - RNA, 23 nt, Human
agaggccuauccuccuauaaaga

SEQ ID NO: 1003239 - RNA, 21 nt, Human
agccccggagccaccagcccc

SEQ ID NO: 1003240 - RNA, 22 nt, Human
aggaacuccccgaggaaucugu

SEQ ID NO: 1003241 - RNA, 24 nt, Human
aggcagccagcucagggaugguac

SEQ ID NO: 1003242 - RNA, 23 nt, Human
aggcuggcccgcguggugagucu

SEQ ID NO: 1003243 - RNA, 24 nt, Human
aggcuucgcugggagcugagaaca

SEQ ID NO: 1003244 - RNA, 20 nt, Human
agggaacgaggacagagggg

SEQ ID NO: 1003245 - RNA, 23 nt, Human
agggaggggacagcugauguagg

SEQ ID NO: 1003246 - RNA, 23 nt, Human
agugccagcaaaaucugcaaaag

SEQ ID NO: 1003247 - RNA, 19 nt, Human
caaaacagaagcaccgagu

SEQ ID NO: 1003248 - RNA, 23 nt, Human
caaaacagaagcaccgagucacc

SEQ ID NO: 1003249 - RNA, 21 nt, Human
caaagaccccaacucuggucc

SEQ ID NO: 1003250 - RNA, 19 nt, Human
caacaggcaguauuggggg

SEQ ID NO: 1003251 - RNA, 18 nt, Human
caacauguuuaaaacacu

SEQ ID NO: 1003252 - RNA, 21 nt, Human
caccaaagaccccaacucugg

SEQ ID NO: 1003253 - RNA, 21 nt, Human
caccgagucaccgcacgcccc

SEQ ID NO: 1003254 - RNA, 20 nt, Human
caccgggguucaccagccug

SEQ ID NO: 1003255 - RNA, 20 nt, Human
caccucuguucccaccgggg

SEQ ID NO: 1003256 - RNA, 21 nt, Human
cacuggagaaaagaaagaccu

SEQ ID NO: 1003257 - RNA, 22 nt, Human
cagagcuuuccugaugccuccc

SEQ ID NO: 1003258 - RNA, 23 nt, Human
cagaucugcagaucuccagauca

SEQ ID NO: 1003259 - RNA, 25 nt, Human
cagggagucccggcugcccuguggc

SEQ ID NO: 1003260 - RNA, 19 nt, Human
cagggcaaaagagagaggc

SEQ ID NO: 1003261 - RNA, 19 nt, Human
ccaaaacagaagcaccgag

SEQ ID NO: 1003262 - RNA, 23 nt, Human
ccauucuguuguggaggcuucgc

SEQ ID NO: 1003263 - RNA, 20 nt, Human
ccccacugcagagcuuuccu

SEQ ID NO: 1003264 - RNA, 25 nt, Human
cccccagccccggagccaccagccc

SEQ ID NO: 1003265 - RNA, 21 nt, Human
ccccggagccaccagcccccc

SEQ ID NO: 1003266 - RNA, 23 nt, Human
cccucuguggcccaggaagagcc

SEQ ID NO: 1003267 - RNA, 19 nt, Human
cccuggggcuuuggucggg

SEQ ID NO: 1003268 - RNA, 21 nt, Human
ccuauccuccuauaaagacac

SEQ ID NO: 1003269 - RNA, 22 nt, Human
ccucacugccacuccccuccug

SEQ ID NO: 1003270 - RNA, 22 nt, Human
ccuccuggccaauaagcuccug

SEQ ID NO: 1003271 - RNA, 22 nt, Human
ccucugaggcagccaagcaccu

SEQ ID NO: 1003272 - RNA, 22 nt, Human
ccucuguggcccaggaagagcc

SEQ ID NO: 1003273 - RNA, 24 nt, Human
ccugggacacuggguggggacagg

SEQ ID NO: 1003274 - RNA, 20 nt, Human
cgaggccguggggcucuggu

SEQ ID NO: 1003275 - RNA, 21 nt, Human
cggaaaaaggaggcaggaacc

SEQ ID NO: 1003276 - RNA, 22 nt, Human
cggcugcccuguggccccauuc

SEQ ID NO: 1003277 - RNA, 27 nt, Human
cuccagaucagugccagcaaaaucugc

SEQ ID NO: 1003278 - RNA, 23 nt, Human
cucugaggcagccaagcaccugg

SEQ ID NO: 1003279 - RNA, 18 nt, Human
cugcagaucuccagauca

SEQ ID NO: 1003280 - RNA, 23 nt, Human
cuggcccuggaacucugauuugg

SEQ ID NO: 1003281 - RNA, 20 nt, Human
cugguguggagagcagggca

SEQ ID NO: 1003282 - RNA, 22 nt, Human
cuguggccugggacacugggug

SEQ ID NO: 1003283 - RNA, 19 nt, Human
cuuucccucuuggcuuuuu

SEQ ID NO: 1003284 - RNA, 24 nt, Human
gaaagaccuaaagucguuucaaag

SEQ ID NO: 1003285 - RNA, 20 nt, Human
gaagcaccaaagaccccaac

SEQ ID NO: 1003286 - RNA, 21 nt, Human
gaaucuguuuaguuuccaugc

SEQ ID NO: 1003287 - RNA, 24 nt, Human
gaaucuguuuaguuuccaugcauu

SEQ ID NO: 1003288 - RNA, 20 nt, Human
gacuccuucccgucuccucc

SEQ ID NO: 1003289 - RNA, 24 nt, Human
gagaaaagaaagaccuaaagucgu

SEQ ID NO: 1003290 - RNA, 28 nt, Human
gagcagggccaggcagccagcucaggga

SEQ ID NO: 1003291 - RNA, 22 nt, Human
gcagggcagaggccuauccucc

SEQ ID NO: 1003292 - RNA, 24 nt, Human
ggaaucccagcugcuccucugccc

SEQ ID NO: 1003293 - RNA, 21 nt, Human
ggaaugagcugcaaaucuguu

SEQ ID NO: 1003294 - RNA, 20 nt, Human
ggacagcugauguaggcauu

SEQ ID NO: 1003295 - RNA, 19 nt, Human
ggaggguuagggagacagg

SEQ ID NO: 1003296 - RNA, 18 nt, Human
ggcaggagguuggaagca

SEQ ID NO: 1003297 - RNA, 19 nt, Human
gggacacuggguggggaca

SEQ ID NO: 1003298 - RNA, 21 nt, Human
gggcaaaagagagaggcuggc

SEQ ID NO: 1003299 - RNA, 19 nt, Human
ggggguggggcagggcaga

SEQ ID NO: 1003300 - RNA, 21 nt, Human
gggguggggcagggcagaggc

SEQ ID NO: 1003301 - RNA, 21 nt, Human
ggguggggacagguggugggg

SEQ ID NO: 1003302 - RNA, 19 nt, Human
gugaggccgcauguauaua

SEQ ID NO: 1003303 - RNA, 20 nt, Human
gugguucuuccaaaacagaa

SEQ ID NO: 1003304 - RNA, 24 nt, Human
guucccaccgggguucaccagccu

SEQ ID NO: 1003305 - RNA, 20 nt, Human
uaaagagcaucuccugauca

SEQ ID NO: 1003306 - RNA, 18 nt, Human
uaagaaucgacuccuucc

SEQ ID NO: 1003307 - RNA, 18 nt, Human
uagcacuuugcuaaaacc

SEQ ID NO: 1003308 - RNA, 18 nt, Human
uauaagcaaagguuugcc

SEQ ID NO: 1003309 - RNA, 24 nt, Human
uauauaagcaaagguuugcccacc

SEQ ID NO: 1003310 - RNA, 20 nt, Human
ucagugugcgaggccguggg

SEQ ID NO: 1003311 - RNA, 24 nt, Human
uccaaaacagaagcaccgagucac

SEQ ID NO: 1003312 - RNA, 23 nt, Human
uccccuagaacagggaacucugg

SEQ ID NO: 1003313 - RNA, 22 nt, Human
ucccucaacaggcaguauuggg

SEQ ID NO: 1003314 - RNA, 23 nt, Human
ucccucaacaggcaguauugggg

SEQ ID NO: 1003315 - RNA, 23 nt, Human
uccuccagaucugcagaucucca

SEQ ID NO: 1003316 - RNA, 24 nt, Human
ucucuugaugguggugccugaccu

SEQ ID NO: 1003317 - RNA, 21 nt, Human
ucugcagcuaacacauucugc

SEQ ID NO: 1003318 - RNA, 21 nt, Human
ucuggcccuggaacucugauu

SEQ ID NO: 1003319 - RNA, 18 nt, Human
ucuguggcccaggaagag

SEQ ID NO: 1003320 - RNA, 21 nt, Human
ucuuggcugggcugacaagag

SEQ ID NO: 1003321 - RNA, 21 nt, Human
ugaaacuuuaagaagcaacac

SEQ ID NO: 1003322 - RNA, 20 nt, Human
ugaacccagauccccaccaa

SEQ ID NO: 1003323 - RNA, 19 nt, Human
ugacgucgcagaguuccuc

SEQ ID NO: 1003324 - RNA, 18 nt, Human
ugagaacacccugcuguc

SEQ ID NO: 1003325 - RNA, 19 nt, Human
ugagaacacccugcugucc

SEQ ID NO: 1003326 - RNA, 19 nt, Human
ugagaccaugccuaucugc

SEQ ID NO: 1003327 - RNA, 23 nt, Human
ugagaugaacccagauccccacc

SEQ ID NO: 1003328 - RNA, 24 nt, Human
ugaggccgcauguauauaagcaaa

SEQ ID NO: 1003329 - RNA, 26 nt, Human
ugaucccccagccccggagccaccag

SEQ ID NO: 1003330 - RNA, 19 nt, Human
ugccagcaaaaucugcaaa

SEQ ID NO: 1003331 - RNA, 23 nt, Human
ugcgaggccguggggcucugguc

SEQ ID NO: 1003332 - RNA, 19 nt, Human
uggaagcaccaaagacccc

SEQ ID NO: 1003333 - RNA, 22 nt, Human
uggaagcaccaaagaccccaac

SEQ ID NO: 1003334 - RNA, 19 nt, Human
uggcugggcugacaagagg

SEQ ID NO: 1003335 - RNA, 24 nt, Human
ugggacacuggguggggacaggug

SEQ ID NO: 1003336 - RNA, 23 nt, Human
ugggggacauuauucccuccugg

SEQ ID NO: 1003337 - RNA, 25 nt, Human
ugguaccucugaggcagccaagcac

SEQ ID NO: 1003338 - RNA, 21 nt, Human
ugguggggguggggcagggca

SEQ ID NO: 1003339 - RNA, 21 nt, Human
ugguggggguggggcagggcc

SEQ ID NO: 1003340 - RNA, 19 nt, Human
ugguggugccugaccuggc

SEQ ID NO: 1003341 - RNA, 25 nt, Human
ugucagcaggggugcgaacuucuua

SEQ ID NO: 1003342 - RNA, 20 nt, Human
uguucuggugucagcagggg

SEQ ID NO: 1003343 - RNA, 23 nt, Human
uuaaaaacaacccucuaguugcc

SEQ ID NO: 1003344 - RNA, 21 nt, Human
uuaaagauccucccucugugg

SEQ ID NO: 1003345 - RNA, 19 nt, Human
uucagugugcgaggccgug

SEQ ID NO: 1003346 - RNA, 21 nt, Human
uuggcugggcugacaagaggc

SEQ ID NO: 1003347 - RNA, 24 nt, Human
uuggcugggcugacaagaggcaga

SEQ ID NO: 1003348 - RNA, 22 nt, Human
uuugcuaaaaccuuuucuggca

SEQ ID NO: 1003349 - RNA, 19 nt, Human
uuuggucgggaaucccagc

SEQ ID NO: 1003350 - RNA, 24 nt, Human
uuuuucuccucuuaaagauccucc

SEQ ID NO: 1003351 - RNA, 23 nt, Human
aaaaaaaaaaaaaaaaaaaagag

SEQ ID NO: 1003352 - RNA, 24 nt, Human
aaaaaaaaaaaaaagagaaaagag

SEQ ID NO: 1003353 - RNA, 25 nt, Human
aaaaaaaaaaaacaaacuauacaaa

SEQ ID NO: 1003354 - RNA, 25 nt, Human
aaaaaacaaaacaaaacaaaaaaaa

SEQ ID NO: 1003355 - RNA, 20 nt, Human
aaaaagagcaaaacuaaauc

SEQ ID NO: 1003356 - RNA, 27 nt, Human
aaaacaaaacaaaacaaaaaaaaaaaa

SEQ ID NO: 1003357 - RNA, 23 nt, Human
aaaacacccuauaacuggcaccu

SEQ ID NO: 1003358 - RNA, 20 nt, Human
aaaacaccuagaagcaagca

SEQ ID NO: 1003359 - RNA, 19 nt, Human
aaaacagacaggcacuaug

SEQ ID NO: 1003360 - RNA, 22 nt, Human
aaaaggccuuuugagaagagga

SEQ ID NO: 1003361 - RNA, 21 nt, Human
aaaauaaauagcaaauucaca

SEQ ID NO: 1003362 - RNA, 21 nt, Human
aaacaaaaaggcaaaaucaga

SEQ ID NO: 1003363 - RNA, 22 nt, Human
aaacaaaaaggcaaaaucagag

SEQ ID NO: 1003364 - RNA, 24 nt, Human
aaacaaaacaaaaaaaaaaaaaca

SEQ ID NO: 1003365 - RNA, 19 nt, Human
aaacaaaacaaaacaaaaa

SEQ ID NO: 1003366 - RNA, 21 nt, Human
aaacaaacuauacaaacuccc

SEQ ID NO: 1003367 - RNA, 20 nt, Human
aaacagcccaaaaagccaaa

SEQ ID NO: 1003368 - RNA, 19 nt, Human
aaacaucacaggagugaaa

SEQ ID NO: 1003369 - RNA, 21 nt, Human
aaacuacaaaacuuggccagg

SEQ ID NO: 1003370 - RNA, 27 nt, Human
aaagaaagaaaaaccugguacaaaaga

SEQ ID NO: 1003371 - RNA, 20 nt, Human
aaagcaacacucagacccac

SEQ ID NO: 1003372 - RNA, 24 nt, Human
aacaaaacaaaaaaaaaaaaacaa

SEQ ID NO: 1003373 - RNA, 25 nt, Human
aacaaaacaaaaaaaaaaaaacaaa

SEQ ID NO: 1003374 - RNA, 19 nt, Human
aacaacacuggaaaaagaa

SEQ ID NO: 1003375 - RNA, 19 nt, Human
aacauggugaaaccccauc

SEQ ID NO: 1003376 - RNA, 20 nt, Human
aacauggugaaaccccaucu

SEQ ID NO: 1003377 - RNA, 21 nt, Human
aacauggugaaaccccaucuc

SEQ ID NO: 1003378 - RNA, 21 nt, Human
aacauggugaaaccccaucuc

SEQ ID NO: 1003379 - RNA, 19 nt, Human
aacauggugaaaccccguc

SEQ ID NO: 1003380 - RNA, 20 nt, Human
aacauggugaaaccccgucu

SEQ ID NO: 1003381 - RNA, 21 nt, Human
aacauggugaaaccccgucuc

SEQ ID NO: 1003382 - RNA, 23 nt, Human
aaccaagaauuauuuuuaagcaa

SEQ ID NO: 1003383 - RNA, 21 nt, Human
aaccccaucaugccugcccaa

SEQ ID NO: 1003384 - RNA, 19 nt, Human
aaccugggaggcaagaggu

SEQ ID NO: 1003385 - RNA, 26 nt, Human
aagaaagaaagaaaaaccugguacaa

SEQ ID NO: 1003386 - RNA, 28 nt, Human
aagaaagaaagaaaaaccugguacaaaa

SEQ ID NO: 1003387 - RNA, 18 nt, Human
aagaggacagaagaaaag

SEQ ID NO: 1003388 - RNA, 21 nt, Human
aagaggacagaagaaaagcca

SEQ ID NO: 1003389 - RNA, 22 nt, Human
aagcaaacagcccaaaaagcca

SEQ ID NO: 1003390 - RNA, 24 nt, Human
aagcaaacagcccaaaaagccaaa

SEQ ID NO: 1003391 - RNA, 21 nt, Human
aagcagaaacuugaagccaag

SEQ ID NO: 1003392 - RNA, 20 nt, Human
aagccacagccugaggacca

SEQ ID NO: 1003393 - RNA, 19 nt, Human
aaggacgcaggaaccacac

SEQ ID NO: 1003394 - RNA, 20 nt, Human
aaggaugcuauauaacucau

SEQ ID NO: 1003395 - RNA, 25 nt, Human
aaggcgggcagauuaucugagguca

SEQ ID NO: 1003396 - RNA, 25 nt, Human
aaggguuacaggcaggaagggggua

SEQ ID NO: 1003397 - RNA, 24 nt, Human
aaucacuugaacccaggaggcgga

SEQ ID NO: 1003398 - RNA, 24 nt, Human
aaucgcuugaacccgggaggcaga

SEQ ID NO: 1003399 - RNA, 21 nt, Human
aauucaaacuuuuauuuggca

SEQ ID NO: 1003400 - RNA, 20 nt, Human
aauugauuacaaaacucauu

SEQ ID NO: 1003401 - RNA, 18 nt, Human
aauugcuugaaccuggga

SEQ ID NO: 1003402 - RNA, 24 nt, Human
acaaaacaaaacaaaaaaaaaaaa

SEQ ID NO: 1003403 - RNA, 21 nt, Human
acaaaacagaaagaaaugaga

SEQ ID NO: 1003404 - RNA, 19 nt, Human
acaaaacuuggccaggccu

SEQ ID NO: 1003405 - RNA, 24 nt, Human
acaaaauguagaagaaaagauggg

SEQ ID NO: 1003406 - RNA, 24 nt, Human
acaccacugcacuccagaaugggc

SEQ ID NO: 1003407 - RNA, 19 nt, Human
acagaagaaaagccacuua

SEQ ID NO: 1003408 - RNA, 20 nt, Human
acagaagaaaagccacuuag

SEQ ID NO: 1003409 - RNA, 24 nt, Human
acagagcgagaccuugccucaaaa

SEQ ID NO: 1003410 - RNA, 21 nt, Human
acagugcugugggcugagccg

SEQ ID NO: 1003411 - RNA, 19 nt, Human
acaguggcucacacccaga

SEQ ID NO: 1003412 - RNA, 19 nt, Human
accaaauacagcccacagc

SEQ ID NO: 1003413 - RNA, 19 nt, Human
accauggagaaaccccauc

SEQ ID NO: 1003414 - RNA, 20 nt, Human
accauggagaaaccccaucu

SEQ ID NO: 1003415 - RNA, 24 nt, Human
acccaaggucaggaguucgagacc

SEQ ID NO: 1003416 - RNA, 24 nt, Human
accccaucucuacuagaaauacaa

SEQ ID NO: 1003417 - RNA, 24 nt, Human
accccaucucuauuaaaacuacaa

SEQ ID NO: 1003418 - RNA, 24 nt, Human
accccgucucuacuaaaaauacaa

SEQ ID NO: 1003419 - RNA, 20 nt, Human
accuacagaacuuucuccuc

SEQ ID NO: 1003420 - RNA, 20 nt, Human
accugauguuccaggaccuc

SEQ ID NO: 1003421 - RNA, 24 nt, Human
acuacuuuucaauucuccuuugca

SEQ ID NO: 1003422 - RNA, 19 nt, Human
acucacagcagcguuuuac

SEQ ID NO: 1003423 - RNA, 24 nt, Human
acugcacuccagaaugggcaacag

SEQ ID NO: 1003424 - RNA, 18 nt, Human
acugcacuccagccuggg

SEQ ID NO: 1003425 - RNA, 21 nt, Human
acugcacuccagccugggcaa

SEQ ID NO: 1003426 - RNA, 24 nt, Human
acugcacuccagccugggcaauaa

SEQ ID NO: 1003427 - RNA, 25 nt, Human
agaaaagccacuuaguuugcccaaa

SEQ ID NO: 1003428 - RNA, 21 nt, Human
agaaacuugaagccaagaaca

SEQ ID NO: 1003429 - RNA, 23 nt, Human
agaaagaaaugaaaaaaggggac

SEQ ID NO: 1003430 - RNA, 21 nt, Human
agaagaaaagauggggagaag

SEQ ID NO: 1003431 - RNA, 18 nt, Human
agaagaggacagaagaaa

SEQ ID NO: 1003432 - RNA, 25 nt, Human
agaagcaagcaaacaauaaacaaaa

SEQ ID NO: 1003433 - RNA, 18 nt, Human
agaaggcucuauagaagg

SEQ ID NO: 1003434 - RNA, 18 nt, Human
agacauggcaucaagugg

SEQ ID NO: 1003435 - RNA, 18 nt, Human
agagguugcagugagccg

SEQ ID NO: 1003436 - RNA, 23 nt, Human
agagguugcagugagccgagauc

SEQ ID NO: 1003437 - RNA, 24 nt, Human
agagguugcagugagccgagauca

SEQ ID NO: 1003438 - RNA, 22 nt, Human
agagguugcagugagcugagau

SEQ ID NO: 1003439 - RNA, 24 nt, Human
agagguugcagugagcugagauug

SEQ ID NO: 1003440 - RNA, 22 nt, Human
agauuaucugaggucaggaguu

SEQ ID NO: 1003441 - RNA, 23 nt, Human
agauuaucugaggucaggaguuc

SEQ ID NO: 1003442 - RNA, 21 nt, Human
agcacaauuacaaacuaaugc

SEQ ID NO: 1003443 - RNA, 24 nt, Human
agcacuuuggaaggcugagguggg

SEQ ID NO: 1003444 - RNA, 20 nt, Human
agcagacauucccauagcac

SEQ ID NO: 1003445 - RNA, 18 nt, Human
agccugaccaccauggag

SEQ ID NO: 1003446 - RNA, 22 nt, Human
agccuggccaacauggugaaac

SEQ ID NO: 1003447 - RNA, 22 nt, Human
agccuggccaacauggugaaac

SEQ ID NO: 1003448 - RNA, 24 nt, Human
agccuggccaacauggugaaaccc

SEQ ID NO: 1003449 - RNA, 24 nt, Human
agccuggccaacauggugaaaccc

SEQ ID NO: 1003450 - RNA, 20 nt, Human
agcuggaugugguggugggc

SEQ ID NO: 1003451 - RNA, 23 nt, Human
agcugggugugguagugcaugcc

SEQ ID NO: 1003452 - RNA, 22 nt, Human
aggaggccagaccuuuguaccc

SEQ ID NO: 1003453 - RNA, 20 nt, Human
aggaguuugagaccagccug

SEQ ID NO: 1003454 - RNA, 22 nt, Human
aggaucuuguuuguuuccaucu

SEQ ID NO: 1003455 - RNA, 30 nt, Human
aggcaaaaaagaaagaaagaaaaaccuggg

SEQ ID NO: 1003456 - RNA, 26 nt, Human
aggcaaaaaagaaagaaaggggaccc

SEQ ID NO: 1003457 - RNA, 22 nt, Human
aggcacgaaaauugcuugaacc

SEQ ID NO: 1003458 - RNA, 24 nt, Human
aggcacgaaaauugcuugaaccug

SEQ ID NO: 1003459 - RNA, 20 nt, Human
aggcagagguugcagugagc

SEQ ID NO: 1003460 - RNA, 24 nt, Human
aggcagagguugcagugagcugag

SEQ ID NO: 1003461 - RNA, 27 nt, Human
aggcaggaaggggguaugaucuggggc

SEQ ID NO: 1003462 - RNA, 18 nt, Human
aggcaggagaaucacuug

SEQ ID NO: 1003463 - RNA, 23 nt, Human
aggcaggagaaucacuugaaccc

SEQ ID NO: 1003464 - RNA, 24 nt, Human
aggcaggagaaucgcuugaacccg

SEQ ID NO: 1003465 - RNA, 26 nt, Human
aggcagguggauuacccaaggucagg

SEQ ID NO: 1003466 - RNA, 18 nt, Human
aggccaaggcgggcagau

SEQ ID NO: 1003467 - RNA, 19 nt, Human
aggcggagguuggagugag

SEQ ID NO: 1003468 - RNA, 24 nt, Human
aggcggagguuggagugagccaag

SEQ ID NO: 1003469 - RNA, 24 nt, Human
aggcugaggcacgaaaauugcuug

SEQ ID NO: 1003470 - RNA, 24 nt, Human
aggcugaggcaggagaaucacuug

SEQ ID NO: 1003471 - RNA, 20 nt, Human
aggcugaggcaggagaaucg

SEQ ID NO: 1003472 - RNA, 24 nt, Human
aggcugaggcaggagaaucgcuug

SEQ ID NO: 1003473 - RNA, 24 nt, Human
aggcugaggugggcagaacacuug

SEQ ID NO: 1003474 - RNA, 20 nt, Human
aggguuacaggcaggaaggg

SEQ ID NO: 1003475 - RNA, 23 nt, Human
aggguuacaggcaggaagggggu

SEQ ID NO: 1003476 - RNA, 21 nt, Human
agguaaucaaugaauaucuga

SEQ ID NO: 1003477 - RNA, 19 nt, Human
aggucaggaguucgagacc

SEQ ID NO: 1003478 - RNA, 24 nt, Human
aggugcgguggcucacaccuguaa

SEQ ID NO: 1003479 - RNA, 22 nt, Human
agguggauuacccaaggucagg

SEQ ID NO: 1003480 - RNA, 23 nt, Human
aggugggcagaacacuugaggcu

SEQ ID NO: 1003481 - RNA, 21 nt, Human
agugcaguaaauaugcacuuu

SEQ ID NO: 1003482 - RNA, 21 nt, Human
agugggagcucuaagccaaac

SEQ ID NO: 1003483 - RNA, 22 nt, Human
aguuaaaaucuguccugacuga

SEQ ID NO: 1003484 - RNA, 20 nt, Human
aucacaccacugcacuccag

SEQ ID NO: 1003485 - RNA, 24 nt, Human
aucgugccauugcacuccggccug

SEQ ID NO: 1003486 - RNA, 22 nt, Human
aucugaggucaggaguucgaga

SEQ ID NO: 1003487 - RNA, 24 nt, Human
aucugaggucaggaguucgagacc

SEQ ID NO: 1003488 - RNA, 19 nt, Human
augccuguaaucccagcac

SEQ ID NO: 1003489 - RNA, 22 nt, Human
auuaaaacaguauuagcagccc

SEQ ID NO: 1003490 - RNA, 24 nt, Human
auuacccaaggucaggaguucgag

SEQ ID NO: 1003491 - RNA, 22 nt, Human
auugcacuccggccugggcaaa

SEQ ID NO: 1003492 - RNA, 23 nt, Human
auugccccuagaaagaaaugaaa

SEQ ID NO: 1003493 - RNA, 24 nt, Human
auugugccacugcacuccagccug

SEQ ID NO: 1003494 - RNA, 21 nt, Human
auuuagcccagucucugcugc

SEQ ID NO: 1003495 - RNA, 20 nt, Human
caaaaaagaaagaaagaaaa

SEQ ID NO: 1003496 - RNA, 22 nt, Human
caaaaagagcaaaacuaaaucu

SEQ ID NO: 1003497 - RNA, 22 nt, Human
caaaaagccaaaaauacuuccu

SEQ ID NO: 1003498 - RNA, 23 nt, Human
caaaaaggcaaaaucagaguucc

SEQ ID NO: 1003499 - RNA, 27 nt, Human
caaaacaaaacagaaagaaaugagaaa

SEQ ID NO: 1003500 - RNA, 21 nt, Human
caaaacacccagugcagugug

SEQ ID NO: 1003501 - RNA, 22 nt, Human
caaaaucagaguuccaauguga

SEQ ID NO: 1003502 - RNA, 26 nt, Human
caaacagcccaaaaagccaaaaauac

SEQ ID NO: 1003503 - RNA, 26 nt, Human
caaacucccaaauagucgcacaaaca

SEQ ID NO: 1003504 - RNA, 22 nt, Human
caaagcagaaacuugaagccaa

SEQ ID NO: 1003505 - RNA, 24 nt, Human
caaagcagaaacuugaagccaaga

SEQ ID NO: 1003506 - RNA, 23 nt, Human
caacaaaacaaaacagaaagaaa

SEQ ID NO: 1003507 - RNA, 21 nt, Human
caacacaauccauuagagcaa

SEQ ID NO: 1003508 - RNA, 24 nt, Human
caacauggugaaaccccaucucua

SEQ ID NO: 1003509 - RNA, 24 nt, Human
caacauggugaaaccccgucucua

SEQ ID NO: 1003510 - RNA, 25 nt, Human
caagaacaccagcgcauuggagacc

SEQ ID NO: 1003511 - RNA, 24 nt, Human
caagaucgugccauugcacuccgg

SEQ ID NO: 1003512 - RNA, 24 nt, Human
caagcucaauggcccagagacuga

SEQ ID NO: 1003513 - RNA, 24 nt, Human
caaggcagguggauuacccaaggu

SEQ ID NO: 1003514 - RNA, 26 nt, Human
caaggcagguggauuacccaagguca

SEQ ID NO: 1003515 - RNA, 19 nt, Human
caaggggcucuggagcugg

SEQ ID NO: 1003516 - RNA, 24 nt, Human
caauaugcauucaucaaugugcac

SEQ ID NO: 1003517 - RNA, 22 nt, Human
caauucaaacuuuuauuuggca

SEQ ID NO: 1003518 - RNA, 24 nt, Human
cacacccagaaucccagcacuuug

SEQ ID NO: 1003519 - RNA, 24 nt, Human
cacaccuguaaucccagcaauuug

SEQ ID NO: 1003520 - RNA, 18 nt, Human
cacacugaggacaaaagg

SEQ ID NO: 1003521 - RNA, 19 nt, Human
cacacuggccauacaugua

SEQ ID NO: 1003522 - RNA, 27 nt, Human
cacagccugaggaccaaauacagccca

SEQ ID NO: 1003523 - RNA, 23 nt, Human
caccauuauaguuaaauacagcc

SEQ ID NO: 1003524 - RNA, 22 nt, Human
cacccuauaacuggcaccuggu

SEQ ID NO: 1003525 - RNA, 21 nt, Human
caccuagaagcaagcaaacaa

SEQ ID NO: 1003526 - RNA, 23 nt, Human
caccuguaaucccagcaauuugg

SEQ ID NO: 1003527 - RNA, 24 nt, Human
caccuguaaucccagcaauuuggg

SEQ ID NO: 1003528 - RNA, 21 nt, Human
caccuguaaucccagcuacuc

SEQ ID NO: 1003529 - RNA, 24 nt, Human
caccuguaaucccagcuacucggg

SEQ ID NO: 1003530 - RNA, 24 nt, Human
cacuccagccugggcaauaagagc

SEQ ID NO: 1003531 - RNA, 18 nt, Human
cacugcacuccagaaugg

SEQ ID NO: 1003532 - RNA, 19 nt, Human
cacugcacuccagaauggg

SEQ ID NO: 1003533 - RNA, 23 nt, Human
cacugcacuccagaaugggcaac

SEQ ID NO: 1003534 - RNA, 24 nt, Human
cacugcacuccagaaugggcaaca

SEQ ID NO: 1003535 - RNA, 18 nt, Human
cacugcacuccagccugg

SEQ ID NO: 1003536 - RNA, 19 nt, Human
cacugcacuccagccuggg

SEQ ID NO: 1003537 - RNA, 21 nt, Human
cacugcacuccagccugggca

SEQ ID NO: 1003538 - RNA, 23 nt, Human
cacugcacuccagccugggcaau

SEQ ID NO: 1003539 - RNA, 24 nt, Human
cacugcacuccagccugggcaaua

SEQ ID NO: 1003540 - RNA, 27 nt, Human
cacugcacuccagccugggcaauaaga

SEQ ID NO: 1003541 - RNA, 18 nt, Human
cacuuuggaaggcugagg

SEQ ID NO: 1003542 - RNA, 21 nt, Human
cagaaacuugaagccaagaac

SEQ ID NO: 1003543 - RNA, 24 nt, Human
cagaacacuugaggcuaggaguuu

SEQ ID NO: 1003544 - RNA, 21 nt, Human
cagaugaaaccaacucaggug

SEQ ID NO: 1003545 - RNA, 24 nt, Human
cagauuaucugaggucaggaguuc

SEQ ID NO: 1003546 - RNA, 24 nt, Human
cagcaauuugggaggccaaggcgg

SEQ ID NO: 1003547 - RNA, 21 nt, Human
cagcaccuugggaggccaagg

SEQ ID NO: 1003548 - RNA, 24 nt, Human
cagcaccuugggaggccaaggcag

SEQ ID NO: 1003549 - RNA, 24 nt, Human
cagcacuuuggaaggcugaggugg

SEQ ID NO: 1003550 - RNA, 20 nt, Human
cagcccaaaaagccaaaaau

SEQ ID NO: 1003551 - RNA, 22 nt, Human
cagcccaaaaagccaaaaauac

SEQ ID NO: 1003552 - RNA, 19 nt, Human
cagccugaccaccauggag

SEQ ID NO: 1003553 - RNA, 24 nt, Human
cagcuacucgggaggcugaggcag

SEQ ID NO: 1003554 - RNA, 24 nt, Human
cagcuacuugggaggcugaggcag

SEQ ID NO: 1003555 - RNA, 24 nt, Human
cagguggauuacccaaggucagga

SEQ ID NO: 1003556 - RNA, 24 nt, Human
cagugcacuuauuaccuacagaac

SEQ ID NO: 1003557 - RNA, 18 nt, Human
caucagagaacaaaacac

SEQ ID NO: 1003558 - RNA, 22 nt, Human
caucagagaacaaaacacccag

SEQ ID NO: 1003559 - RNA, 25 nt, Human
caucuaaaaaaaaacaaaacaaaac

SEQ ID NO: 1003560 - RNA, 20 nt, Human
caugccacuugcauugcccc

SEQ ID NO: 1003561 - RNA, 24 nt, Human
caugccuguaaucccagcuacuug

SEQ ID NO: 1003562 - RNA, 19 nt, Human
cauggagaaaccccaucuc

SEQ ID NO: 1003563 - RNA, 18 nt, Human
cauugcacuccggccugg

SEQ ID NO: 1003564 - RNA, 19 nt, Human
cauugcacuccggccuggg

SEQ ID NO: 1003565 - RNA, 21 nt, Human
cauugcacuccggccugggca

SEQ ID NO: 1003566 - RNA, 22 nt, Human
cauugcacuccggccugggcaa

SEQ ID NO: 1003567 - RNA, 23 nt, Human
cauugcacuccggccugggcaaa

SEQ ID NO: 1003568 - RNA, 27 nt, Human
cauugcacuccggccugggcaaaaaga

SEQ ID NO: 1003569 - RNA, 19 nt, Human
ccaaaaauacuuccuaucu

SEQ ID NO: 1003570 - RNA, 20 nt, Human
ccaaaagcaacacucagacu

SEQ ID NO: 1003571 - RNA, 18 nt, Human
ccaauacacccugauggc

SEQ ID NO: 1003572 - RNA, 20 nt, Human
ccacugcacuccagaauggg

SEQ ID NO: 1003573 - RNA, 21 nt, Human
ccacugcacuccagaaugggc

SEQ ID NO: 1003574 - RNA, 22 nt, Human
ccacugcacuccagaaugggca

SEQ ID NO: 1003575 - RNA, 24 nt, Human
ccacugcacuccagaaugggcaac

SEQ ID NO: 1003576 - RNA, 20 nt, Human
ccacugcacuccagccuggg

SEQ ID NO: 1003577 - RNA, 20 nt, Human
ccacugcacuccagccuggg

SEQ ID NO: 1003578 - RNA, 21 nt, Human
ccacugcacuccagccugggc

SEQ ID NO: 1003579 - RNA, 23 nt, Human
ccacugcacuccagccugggcaa

SEQ ID NO: 1003580 - RNA, 23 nt, Human
ccacugcacuccagccugggcaa

SEQ ID NO: 1003581 - RNA, 24 nt, Human
ccacugcacuccagccugggcaau

SEQ ID NO: 1003582 - RNA, 23 nt, Human
ccagaucccaguugagucaugau

SEQ ID NO: 1003583 - RNA, 19 nt, Human
ccagcaccuugggaggcca

SEQ ID NO: 1003584 - RNA, 19 nt, Human
ccagccagcagcacuccca

SEQ ID NO: 1003585 - RNA, 23 nt, Human
ccaggcuucugucacaugggaga

SEQ ID NO: 1003586 - RNA, 21 nt, Human
ccaguagucccagcuacucgg

SEQ ID NO: 1003587 - RNA, 21 nt, Human
ccagugcagugugccagaucc

SEQ ID NO: 1003588 - RNA, 20 nt, Human
ccauugcacuccggccuggg

SEQ ID NO: 1003589 - RNA, 21 nt, Human
ccauugcacuccggccugggc

SEQ ID NO: 1003590 - RNA, 23 nt, Human
ccauugcacuccggccugggcaa

SEQ ID NO: 1003591 - RNA, 19 nt, Human
cccaaaaagccaaaaauac

SEQ ID NO: 1003592 - RNA, 23 nt, Human
cccaaagcuaaauuaacuaggac

SEQ ID NO: 1003593 - RNA, 22 nt, Human
cccaaauagucgcacaaacauc

SEQ ID NO: 1003594 - RNA, 22 nt, Human
cccaaggucaggaguucgagac

SEQ ID NO: 1003595 - RNA, 21 nt, Human
cccaaguuggggugaggaggc

SEQ ID NO: 1003596 - RNA, 22 nt, Human
cccacaguaguaguagcaaaag

SEQ ID NO: 1003597 - RNA, 24 nt, Human
ccccagaggguuucccaaguuggg

SEQ ID NO: 1003598 - RNA, 27 nt, Human
ccccguuaccgccacgacaugggucua

SEQ ID NO: 1003599 - RNA, 20 nt, Human
ccccuagaaagaaaugaaaa

SEQ ID NO: 1003600 - RNA, 20 nt, Human
ccccuggccaauccaagcac

SEQ ID NO: 1003601 - RNA, 19 nt, Human
cccuagaaagaaaugaaaa

SEQ ID NO: 1003602 - RNA, 25 nt, Human
ccgacaccgagcaguucugggcgua

SEQ ID NO: 1003603 - RNA, 24 nt, Human
ccggccugggcaaaaagagcaaaa

SEQ ID NO: 1003604 - RNA, 19 nt, Human
ccuaccacaaauguuuugg

SEQ ID NO: 1003605 - RNA, 23 nt, Human
ccuggccaacauggugaaacccc

SEQ ID NO: 1003606 - RNA, 23 nt, Human
ccuggccaacauggugaaacccc

SEQ ID NO: 1003607 - RNA, 24 nt, Human
ccuggccaacauggugaaacccca

SEQ ID NO: 1003608 - RNA, 24 nt, Human
ccuggccaacauggugaaaccccg

SEQ ID NO: 1003609 - RNA, 19 nt, Human
ccuggccaauccaagcacc

SEQ ID NO: 1003610 - RNA, 20 nt, Human
ccuguaaucccagcaccuug

SEQ ID NO: 1003611 - RNA, 22 nt, Human
ccuguaaucccagcaccuuggg

SEQ ID NO: 1003612 - RNA, 21 nt, Human
ccuguaaucccagcuacucgg

SEQ ID NO: 1003613 - RNA, 21 nt, Human
ccuguaaucccagcuacuugg

SEQ ID NO: 1003614 - RNA, 24 nt, Human
ccuugccucaaaaaaaaaaaaaaa

SEQ ID NO: 1003615 - RNA, 24 nt, Human
cgacaccgagcaguucugggcgua

SEQ ID NO: 1003616 - RNA, 20 nt, Human
cgacaugggucuacagucug

SEQ ID NO: 1003617 - RNA, 24 nt, Human
cgagaccagccuggccaacauggu

SEQ ID NO: 1003618 - RNA, 27 nt, Human
cgaggccaggcaugacaguggcucaca

SEQ ID NO: 1003619 - RNA, 21 nt, Human
cgauauuaagaaggcaaaaug

SEQ ID NO: 1003620 - RNA, 21 nt, Human
cgccucccggguagcgcuccc

SEQ ID NO: 1003621 - RNA, 24 nt, Human
cgggaggcagagguugcagugagc

SEQ ID NO: 1003622 - RNA, 27 nt, Human
cgggaggcugaggcacgaaaauugcuu

SEQ ID NO: 1003623 - RNA, 24 nt, Human
cgggaggcugaggcaggagaauca

SEQ ID NO: 1003624 - RNA, 24 nt, Human
cgggcagauuaucugaggucagga

SEQ ID NO: 1003625 - RNA, 21 nt, Human
cgguaaggguuacaggcagga

SEQ ID NO: 1003626 - RNA, 25 nt, Human
cuaaaaaaaaacaaaacaaaacaaa

SEQ ID NO: 1003627 - RNA, 20 nt, Human
cuaaggcaaaaaagaaagaa

SEQ ID NO: 1003628 - RNA, 22 nt, Human
cuaauaacagcagacauuccca

SEQ ID NO: 1003629 - RNA, 18 nt, Human
cuacagaacuuucuccuc

SEQ ID NO: 1003630 - RNA, 18 nt, Human
cuagaagcaagcaaacaa

SEQ ID NO: 1003631 - RNA, 23 nt, Human
cucacacccagaaucccagcacu

SEQ ID NO: 1003632 - RNA, 24 nt, Human
cucacacccagaaucccagcacuu

SEQ ID NO: 1003633 - RNA, 21 nt, Human
cucacaccuguaaucccagca

SEQ ID NO: 1003634 - RNA, 21 nt, Human
cucacaccuguaaucccagca

SEQ ID NO: 1003635 - RNA, 25 nt, Human
cucaugccuguaaucccagcaccuu

SEQ ID NO: 1003636 - RNA, 20 nt, Human
cucauguuccugccauccuu

SEQ ID NO: 1003637 - RNA, 20 nt, Human
cucuccacaagcuccccuca

SEQ ID NO: 1003638 - RNA, 18 nt, Human
cugcaucccagcuauaag

SEQ ID NO: 1003639 - RNA, 24 nt, Human
cugccuaauuugcauuaauugugc

SEQ ID NO: 1003640 - RNA, 22 nt, Human
cuggaaaagucuccaaagucag

SEQ ID NO: 1003641 - RNA, 24 nt, Human
cuggaaaagucuccaaagucagag

SEQ ID NO: 1003642 - RNA, 21 nt, Human
cuggaggggugggcugcuagc

SEQ ID NO: 1003643 - RNA, 23 nt, Human
cuggccaacauggugaaacccca

SEQ ID NO: 1003644 - RNA, 24 nt, Human
cugggcaauaagagcaaaacucca

SEQ ID NO: 1003645 - RNA, 21 nt, Human
cuguaaucccagcuacucggg

SEQ ID NO: 1003646 - RNA, 24 nt, Human
cugugcuucucuucgccucccggg

SEQ ID NO: 1003647 - RNA, 23 nt, Human
cuuuggaaggcugaggugggcag

SEQ ID NO: 1003648 - RNA, 19 nt, Human
gaacacagccaugaccaug

SEQ ID NO: 1003649 - RNA, 20 nt, Human
gaacacucauggaaacaggu

SEQ ID NO: 1003650 - RNA, 24 nt, Human
gaacacuugaggcuaggaguuuga

SEQ ID NO: 1003651 - RNA, 21 nt, Human
gacaccgagcaguucugggcg

SEQ ID NO: 1003652 - RNA, 26 nt, Human
gacgcaggaaccacacacugaggaca

SEQ ID NO: 1003653 - RNA, 23 nt, Human
gagaaucacuugaacccaggagg

SEQ ID NO: 1003654 - RNA, 23 nt, Human
gagaaucgcuugaacccgggagg

SEQ ID NO: 1003655 - RNA, 23 nt, Human
gagaucacaccacugcacuccag

SEQ ID NO: 1003656 - RNA, 23 nt, Human
gagauugugccacugcacuccag

SEQ ID NO: 1003657 - RNA, 21 nt, Human
gagcugggauggccccagagg

SEQ ID NO: 1003658 - RNA, 24 nt, Human
gaggcacgaaaauugcuugaaccu

SEQ ID NO: 1003659 - RNA, 23 nt, Human
gagguuggagugagccaagaucg

SEQ ID NO: 1003660 - RNA, 24 nt, Human
gauuacccaaggucaggaguucga

SEQ ID NO: 1003661 - RNA, 24 nt, Human
gauuaucugaggucaggaguucga

SEQ ID NO: 1003662 - RNA, 23 nt, Human
gcagaaacuugaagccaagaaca

SEQ ID NO: 1003663 - RNA, 22 nt, Human
gcaggagaaucacuugaaccca

SEQ ID NO: 1003664 - RNA, 24 nt, Human
gcaggccaggugcgguggcucaca

SEQ ID NO: 1003665 - RNA, 24 nt, Human
gccaacauggugaaaccccaucuc

SEQ ID NO: 1003666 - RNA, 24 nt, Human
gccaacauggugaaaccccgucuc

SEQ ID NO: 1003667 - RNA, 19 nt, Human
gccaauccaagcaccucuc

SEQ ID NO: 1003668 - RNA, 22 nt, Human
gccacugcacuccagccugggc

SEQ ID NO: 1003669 - RNA, 24 nt, Human
gccacugcacuccagccugggcaa

SEQ ID NO: 1003670 - RNA, 22 nt, Human
gccauugcacuccggccugggc

SEQ ID NO: 1003671 - RNA, 24 nt, Human
gccauugcacuccggccugggcaa

SEQ ID NO: 1003672 - RNA, 20 nt, Human
gccgagaucacaccacugca

SEQ ID NO: 1003673 - RNA, 20 nt, Human
gccuguaaucccagcuacuu

SEQ ID NO: 1003674 - RNA, 23 nt, Human
gcugagccggcuggguacaggcu

SEQ ID NO: 1003675 - RNA, 22 nt, Human
gcugggcacgguggcucaugcc

SEQ ID NO: 1003676 - RNA, 27 nt, Human
ggaauagcagaaaauagugccgaaggg

SEQ ID NO: 1003677 - RNA, 23 nt, Human
ggacaaaaggguccaggaguugc

SEQ ID NO: 1003678 - RNA, 23 nt, Human
ggacauggcuaaguugugguggc

SEQ ID NO: 1003679 - RNA, 20 nt, Human
ggagcugggauggccccaga

SEQ ID NO: 1003680 - RNA, 24 nt, Human
ggagguuggagugagccaagaucg

SEQ ID NO: 1003681 - RNA, 22 nt, Human
ggauuacccaaggucaggaguu

SEQ ID NO: 1003682 - RNA, 21 nt, Human
ggcaagagguugcagugagcc

SEQ ID NO: 1003683 - RNA, 24 nt, Human
ggcaagagguugcagugagccgag

SEQ ID NO: 1003684 - RNA, 23 nt, Human
ggcacgguggcucaugccuguaa

SEQ ID NO: 1003685 - RNA, 21 nt, Human
ggcagauuaucugaggucagg

SEQ ID NO: 1003686 - RNA, 24 nt, Human
ggcccagagacugaaauucuucua

SEQ ID NO: 1003687 - RNA, 19 nt, Human
ggcuaggaguuugagacca

SEQ ID NO: 1003688 - RNA, 21 nt, Human
ggcucacaccuguaaucccag

SEQ ID NO: 1003689 - RNA, 20 nt, Human
ggcugagccggcuggguaca

SEQ ID NO: 1003690 - RNA, 23 nt, Human
ggcugggcacgguggcucaugcc

SEQ ID NO: 1003691 - RNA, 21 nt, Human
ggcuugucagggagaggcacu

SEQ ID NO: 1003692 - RNA, 22 nt, Human
gggaaaggcuggaggggugggc

SEQ ID NO: 1003693 - RNA, 24 nt, Human
gggaggcaagagguugcagugagc

SEQ ID NO: 1003694 - RNA, 24 nt, Human
gggugugguagugcaugccuguaa

SEQ ID NO: 1003695 - RNA, 24 nt, Human
gguagugcaugccuguaaucccag

SEQ ID NO: 1003696 - RNA, 23 nt, Human
gguggcucacaccuguaauccca

SEQ ID NO: 1003697 - RNA, 24 nt, Human
gguggcucacaccuguaaucccag

SEQ ID NO: 1003698 - RNA, 23 nt, Human
gguggcucaugccuguaauccca

SEQ ID NO: 1003699 - RNA, 24 nt, Human
gguggcucaugccuguaaucccag

SEQ ID NO: 1003700 - RNA, 24 nt, Human
gguggugggcaccuguaaucccag

SEQ ID NO: 1003701 - RNA, 23 nt, Human
guaaacaaaaaggcaaaaucaga

SEQ ID NO: 1003702 - RNA, 24 nt, Human
guacacacacuggccauacaugua

SEQ ID NO: 1003703 - RNA, 24 nt, Human
guagaagaaaagauggggagaagc

SEQ ID NO: 1003704 - RNA, 22 nt, Human
gugaacacucauggaaacaggu

SEQ ID NO: 1003705 - RNA, 19 nt, Human
gugcagugugccagauccc

SEQ ID NO: 1003706 - RNA, 21 nt, Human
guggagcccacgaaaucagcc

SEQ ID NO: 1003707 - RNA, 23 nt, Human
guggugggcaccuguaaucccag

SEQ ID NO: 1003708 - RNA, 21 nt, Human
guuccacuagcuggcagguuu

SEQ ID NO: 1003709 - RNA, 19 nt, Human
guugcagugagccgagauc

SEQ ID NO: 1003710 - RNA, 24 nt, Human
guugcagugagcugagauugugcc

SEQ ID NO: 1003711 - RNA, 25 nt, Human
uaaaaaaaaacaaaacaaaacaaaa

SEQ ID NO: 1003712 - RNA, 19 nt, Human
uaaaaaacagacaggcacu

SEQ ID NO: 1003713 - RNA, 18 nt, Human
uaaaacaguauuagcagc

SEQ ID NO: 1003714 - RNA, 21 nt, Human
uaaaacuacaaaacuuggcca

SEQ ID NO: 1003715 - RNA, 22 nt, Human
uaauaauaaagugggaugugcc

SEQ ID NO: 1003716 - RNA, 22 nt, Human
uacauguaacuaugcccaggaa

SEQ ID NO: 1003717 - RNA, 23 nt, Human
uaccaguagucccagcuacucgg

SEQ ID NO: 1003718 - RNA, 24 nt, Human
uaccaguagucccagcuacucggg

SEQ ID NO: 1003719 - RNA, 23 nt, Human
uacccaaggucaggaguucgaga

SEQ ID NO: 1003720 - RNA, 24 nt, Human
uagaagaaaagauggggagaagcc

SEQ ID NO: 1003721 - RNA, 18 nt, Human
uagauaaaaaccaagaau

SEQ ID NO: 1003722 - RNA, 22 nt, Human
uagcaaaagcaaacagcccaaa

SEQ ID NO: 1003723 - RNA, 18 nt, Human
uagcaaauucacaucuag

SEQ ID NO: 1003724 - RNA, 18 nt, Human
uagcagugucaaagguua

SEQ ID NO: 1003725 - RNA, 19 nt, Human
uagcucagagggaauacag

SEQ ID NO: 1003726 - RNA, 22 nt, Human
uagcugaacuuugagcuaagcu

SEQ ID NO: 1003727 - RNA, 22 nt, Human
uagcugaacuuugagcuaagcu

SEQ ID NO: 1003728 - RNA, 23 nt, Human
uagcugaacuuugagcuaagcuc

SEQ ID NO: 1003729 - RNA, 23 nt, Human
uagcugaacuuugagcuaagcuc

SEQ ID NO: 1003730 - RNA, 22 nt, Human
uagugcaugccuguaaucccag

SEQ ID NO: 1003731 - RNA, 20 nt, Human
ucaaaaaaaaaaaaaaaaaa

SEQ ID NO: 1003732 - RNA, 22 nt, Human
ucaaaaaaaaaaaaaaaaaaaa

SEQ ID NO: 1003733 - RNA, 23 nt, Human
ucaaaaaaaaaaaaaaaaaaaaa

SEQ ID NO: 1003734 - RNA, 24 nt, Human
ucaaagcaacuaguaauuguaguc

SEQ ID NO: 1003735 - RNA, 22 nt, Human
ucacaccacugcacuccagaau

SEQ ID NO: 1003736 - RNA, 23 nt, Human
ucacaccacugcacuccagaaug

SEQ ID NO: 1003737 - RNA, 22 nt, Human
ucaccuggggaaccucucugcc

SEQ ID NO: 1003738 - RNA, 22 nt, Human
ucagaguucaaaccugcaggac

SEQ ID NO: 1003739 - RNA, 18 nt, Human
ucagaguuccaaugugaa

SEQ ID NO: 1003740 - RNA, 18 nt, Human
ucagccuucuggaagcag

SEQ ID NO: 1003741 - RNA, 18 nt, Human
ucaggaaauguuccaugg

SEQ ID NO: 1003742 - RNA, 30 nt, Human
ucaugauaggcugggcacgguggcucaugg

SEQ ID NO: 1003743 - RNA, 22 nt, Human
ucaugccuguaaucccagcacc

SEQ ID NO: 1003744 - RNA, 24 nt, Human
uccaaaagcaacacucagacccac

SEQ ID NO: 1003745 - RNA, 21 nt, Human
uccaaagucagaguucaaacc

SEQ ID NO: 1003746 - RNA, 21 nt, Human
uccaacuauaacaagcagcau

SEQ ID NO: 1003747 - RNA, 18 nt, Human
uccagggaggcuguguuc

SEQ ID NO: 1003748 - RNA, 23 nt, Human
ucccaggaaaccugauguuccag

SEQ ID NO: 1003749 - RNA, 22 nt, Human
ucccuccaacaaaaggaauaca

SEQ ID NO: 1003750 - RNA, 18 nt, Human
uccuucagucuggaaagg

SEQ ID NO: 1003751 - RNA, 18 nt, Human
ucgcuugaacccgggagg

SEQ ID NO: 1003752 - RNA, 23 nt, Human
ucgggaggcugaggcacgaaaau

SEQ ID NO: 1003753 - RNA, 25 nt, Human
ucgggaggcugaggcaggagaauca

SEQ ID NO: 1003754 - RNA, 23 nt, Human
ucgugccauugcacuccggccug

SEQ ID NO: 1003755 - RNA, 27 nt, Human
ucuaaagggucaccuucaccauuauag

SEQ ID NO: 1003756 - RNA, 19 nt, Human
ucucaaaaaaaaaaaaaaa

SEQ ID NO: 1003757 - RNA, 25 nt, Human
ucucuacuaaaaauacaaaaaaauu

SEQ ID NO: 1003758 - RNA, 22 nt, Human
ucucuacuagaaauacaaaauu

SEQ ID NO: 1003759 - RNA, 18 nt, Human
ucucuuguucuuucucac

SEQ ID NO: 1003760 - RNA, 22 nt, Human
ucugaggucaggaguucgagac

SEQ ID NO: 1003761 - RNA, 19 nt, Human
ucuucaaacccacucguuu

SEQ ID NO: 1003762 - RNA, 24 nt, Human
ugaaaacacacagaagcuggagac

SEQ ID NO: 1003763 - RNA, 25 nt, Human
ugaaccugggaggcaagagguugca

SEQ ID NO: 1003764 - RNA, 21 nt, Human
ugaagucaaccccaucaugcc

SEQ ID NO: 1003765 - RNA, 19 nt, Human
ugaccaccauggagaaacc

SEQ ID NO: 1003766 - RNA, 20 nt, Human
ugaccagagcucucaucucc

SEQ ID NO: 1003767 - RNA, 21 nt, Human
ugacugaguauauacaaggau

SEQ ID NO: 1003768 - RNA, 23 nt, Human
ugagaccagccuggccaacaugg

SEQ ID NO: 1003769 - RNA, 24 nt, Human
ugagaccagccuggccaacauggu

SEQ ID NO: 1003770 - RNA, 22 nt, Human
ugagccaagaucgugccauugc

SEQ ID NO: 1003771 - RNA, 18 nt, Human
ugagccugauggcucaag

SEQ ID NO: 1003772 - RNA, 22 nt, Human
ugagcugagauugugccacugc

SEQ ID NO: 1003773 - RNA, 24 nt, Human
ugaggacaaaaggguccaggaguu

SEQ ID NO: 1003774 - RNA, 24 nt, Human
ugaggcacgaaaauugcuugaacc

SEQ ID NO: 1003775 - RNA, 20 nt, Human
ugaggcaggagaaucacuug

SEQ ID NO: 1003776 - RNA, 24 nt, Human
ugaggcaggagaaucacuugaacc

SEQ ID NO: 1003777 - RNA, 25 nt, Human
ugaggcaggagaaucacuugaaccc

SEQ ID NO: 1003778 - RNA, 24 nt, Human
ugaggcaggagaaucgcuugaacc

SEQ ID NO: 1003779 - RNA, 25 nt, Human
ugaggcaggagaaucgcuugaaccc

SEQ ID NO: 1003780 - RNA, 24 nt, Human
ugaggugggcagaacacuugaggc

SEQ ID NO: 1003781 - RNA, 19 nt, Human
ugauaucauacaggcacaa

SEQ ID NO: 1003782 - RNA, 20 nt, Human
ugaucuggggcaggcagggc

SEQ ID NO: 1003783 - RNA, 21 nt, Human
ugcaauuaaaacaguauuagc

SEQ ID NO: 1003784 - RNA, 24 nt, Human
ugcacaucagagaacaaaacaccc

SEQ ID NO: 1003785 - RNA, 19 nt, Human
ugcacuccggccugggcaa

SEQ ID NO: 1003786 - RNA, 22 nt, Human
ugcacuccggccugggcaaaaa

SEQ ID NO: 1003787 - RNA, 21 nt, Human
ugcauggggggaaaggcugga

SEQ ID NO: 1003788 - RNA, 19 nt, Human
ugccaagcucaauggccca

SEQ ID NO: 1003789 - RNA, 24 nt, Human
ugccacugcacuccagccugggca

SEQ ID NO: 1003790 - RNA, 23 nt, Human
ugccccugcaguucccaaugcau

SEQ ID NO: 1003791 - RNA, 21 nt, Human
ugcccuggggaaggacgcagg

SEQ ID NO: 1003792 - RNA, 23 nt, Human
ugccucaaaaaaaaaaaaaaaaa

SEQ ID NO: 1003793 - RNA, 21 nt, Human
ugccuguaaucccagcaccuu

SEQ ID NO: 1003794 - RNA, 23 nt, Human
ugccuguaaucccagcaccuugg

SEQ ID NO: 1003795 - RNA, 23 nt, Human
ugccuguaaucccagcaccuugg

SEQ ID NO: 1003796 - RNA, 23 nt, Human
ugccuguaaucccagcuacuugg

SEQ ID NO: 1003797 - RNA, 24 nt, Human
ugccuguaaucccagcuacuuggg

SEQ ID NO: 1003798 - RNA, 21 nt, Human
ugcuucucuucgccucccggg

SEQ ID NO: 1003799 - RNA, 20 nt, Human
uggaaaaagaaaaucagcug

SEQ ID NO: 1003800 - RNA, 25 nt, Human
uggaaaagucuccaaagucagaguu

SEQ ID NO: 1003801 - RNA, 18 nt, Human
uggaacacagccaugacc

SEQ ID NO: 1003802 - RNA, 24 nt, Human
uggaaggaaccaauucuucugugg

SEQ ID NO: 1003803 - RNA, 19 nt, Human
uggaaggcugaggugggca

SEQ ID NO: 1003804 - RNA, 20 nt, Human
uggaaggcugaggugggcag

SEQ ID NO: 1003805 - RNA, 24 nt, Human
uggaaggcugaggugggcagaaca

SEQ ID NO: 1003806 - RNA, 23 nt, Human
uggaaugccagacuuggauuuca

SEQ ID NO: 1003807 - RNA, 25 nt, Human
uggacauggcuaaguugugguggcc

SEQ ID NO: 1003808 - RNA, 20 nt, Human
uggaggggugggcugcuagc

SEQ ID NO: 1003809 - RNA, 24 nt, Human
uggaggggugggcugcuagcuccu

SEQ ID NO: 1003810 - RNA, 24 nt, Human
uggauuacccaaggucaggaguuc

SEQ ID NO: 1003811 - RNA, 23 nt, Human
uggcagcaaaugagcaggcagaa

SEQ ID NO: 1003812 - RNA, 24 nt, Human
uggccaacauggugaaaccccauc

SEQ ID NO: 1003813 - RNA, 24 nt, Human
uggccaacauggugaaaccccguc

SEQ ID NO: 1003814 - RNA, 22 nt, Human
uggcucacacccagaaucccag

SEQ ID NO: 1003815 - RNA, 24 nt, Human
uggcucacacccagaaucccagca

SEQ ID NO: 1003816 - RNA, 21 nt, Human
uggcucacaccuguaauccca

SEQ ID NO: 1003817 - RNA, 22 nt, Human
uggcucacaccuguaaucccag

SEQ ID NO: 1003818 - RNA, 24 nt, Human
uggcucacaccuguaaucccagca

SEQ ID NO: 1003819 - RNA, 22 nt, Human
uggcucaugccuguaaucccag

SEQ ID NO: 1003820 - RNA, 24 nt, Human
uggcucaugccuguaaucccagca

SEQ ID NO: 1003821 - RNA, 21 nt, Human
ugggagaucucaacacugcca

SEQ ID NO: 1003822 - RNA, 22 nt, Human
ugggaggccaaggcgggcagau

SEQ ID NO: 1003823 - RNA, 19 nt, Human
ugggaggcugaggcaggag

SEQ ID NO: 1003824 - RNA, 23 nt, Human
ugggaggcugaggcaggagaauc

SEQ ID NO: 1003825 - RNA, 20 nt, Human
ugggauggccccagaggguu

SEQ ID NO: 1003826 - RNA, 24 nt, Human
uggggagaagccuuauuggaucua

SEQ ID NO: 1003827 - RNA, 25 nt, Human
uggguacaggcuugucagggagagg

SEQ ID NO: 1003828 - RNA, 24 nt, Human
ugguagugcaugccuguaauccca

SEQ ID NO: 1003829 - RNA, 24 nt, Human
ugguggugggcaccuguaauccca

SEQ ID NO: 1003830 - RNA, 21 nt, Human
uguggccacaaugaggucuca

SEQ ID NO: 1003831 - RNA, 18 nt, Human
uguuuuaaaaaacagaca

SEQ ID NO: 1003832 - RNA, 22 nt, Human
uuagacaucuaaaaaaaaacaa

SEQ ID NO: 1003833 - RNA, 18 nt, Human
uuagauaaaaaccaagaa

SEQ ID NO: 1003834 - RNA, 18 nt, Human
uuagcuggaugugguggu

SEQ ID NO: 1003835 - RNA, 20 nt, Human
uuagcugggugugguagugc

SEQ ID NO: 1003836 - RNA, 24 nt, Human
uuagcugggugugguagugcaugc

SEQ ID NO: 1003837 - RNA, 18 nt, Human
uucaaaccugcaggacug

SEQ ID NO: 1003838 - RNA, 28 nt, Human
uuccaaaaaaagaacauacuacuguggu

SEQ ID NO: 1003839 - RNA, 21 nt, Human
uuccaacuauaacaagcagca

SEQ ID NO: 1003840 - RNA, 25 nt, Human
uugaaccugggaggcaagagguugc

SEQ ID NO: 1003841 - RNA, 18 nt, Human
uugcagugagccgagauc

SEQ ID NO: 1003842 - RNA, 19 nt, Human
uugcagugagccgagauca

SEQ ID NO: 1003843 - RNA, 20 nt, Human
uugcagugagccgagaucac

SEQ ID NO: 1003844 - RNA, 19 nt, Human
uugcagugagcugagauug

SEQ ID NO: 1003845 - RNA, 22 nt, Human
uugcagugagcugagauugugc

SEQ ID NO: 1003846 - RNA, 18 nt, Human
uugcuugaaccugggagg

SEQ ID NO: 1003847 - RNA, 25 nt, Human
uugcuugaaccugggaggcaagagg

SEQ ID NO: 1003848 - RNA, 19 nt, Human
uuggaaggcugaggugggc

SEQ ID NO: 1003849 - RNA, 22 nt, Human
uuggagugagccaagaucgugc

SEQ ID NO: 1003850 - RNA, 24 nt, Human
uugggaggcugaggcaggagaauc

SEQ ID NO: 1003851 - RNA, 23 nt, Human
uugucagggagaggcacugggcu

SEQ ID NO: 1003852 - RNA, 23 nt, Human
uugugccacugcacuccagccug

SEQ ID NO: 1003853 - RNA, 20 nt, Human
uuuagaaccccgacaccgag

SEQ ID NO: 1003854 - RNA, 20 nt, Human
uuucuaguuuuugcccuugg

SEQ ID NO: 1003855 - RNA, 23 nt, Human
uuugugauggcugcugcccugga

SEQ ID NO: 1003856 - RNA, 22 nt, Human
aaaaggaacuguuacuauagua

SEQ ID NO: 1003857 - RNA, 19 nt, Human
aaagaaacaggccugguuu

SEQ ID NO: 1003858 - RNA, 19 nt, Human
aaaggagaugcuauuccag

SEQ ID NO: 1003859 - RNA, 18 nt, Human
aacuguucagcuuuucau

SEQ ID NO: 1003860 - RNA, 18 nt, Human
aagaggcccagggaggug

SEQ ID NO: 1003861 - RNA, 19 nt, Human
aagcauggguuaagggaga

SEQ ID NO: 1003862 - RNA, 26 nt, Human
aagccagaggcagggauuucagggga

SEQ ID NO: 1003863 - RNA, 18 nt, Human
aagcuuccugaggcagcc

SEQ ID NO: 1003864 - RNA, 21 nt, Human
aaggggccaguccauaaaggu

SEQ ID NO: 1003865 - RNA, 25 nt, Human
aaucccuuuccuccgacagucccac

SEQ ID NO: 1003866 - RNA, 18 nt, Human
acaggaaaggccuucuga

SEQ ID NO: 1003867 - RNA, 21 nt, Human
acaucacagacgucccagggc

SEQ ID NO: 1003868 - RNA, 19 nt, Human
accacugggugaaucccca

SEQ ID NO: 1003869 - RNA, 27 nt, Human
acccaguuaugaguaagaccagaacaa

SEQ ID NO: 1003870 - RNA, 20 nt, Human
acccucaaaccacccaguua

SEQ ID NO: 1003871 - RNA, 24 nt, Human
accugcagucugcccugcccuucc

SEQ ID NO: 1003872 - RNA, 22 nt, Human
acgaccccugaaaagugaacca

SEQ ID NO: 1003873 - RNA, 18 nt, Human
agaagacccuaaacagcu

SEQ ID NO: 1003874 - RNA, 21 nt, Human
agaagacccuaaacagcuguc

SEQ ID NO: 1003875 - RNA, 19 nt, Human
agacuagcaaggagggcug

SEQ ID NO: 1003876 - RNA, 18 nt, Human
agccuccacaguuggagu

SEQ ID NO: 1003877 - RNA, 26 nt, Human
aggaaaaaguaaaaaaaaagggaccc

SEQ ID NO: 1003878 - RNA, 21 nt, Human
aggaaaaccuaggagcuuagg

SEQ ID NO: 1003879 - RNA, 20 nt, Human
aggaagaagaggcccaggga

SEQ ID NO: 1003880 - RNA, 22 nt, Human
aggccugggcagaacagaaggc

SEQ ID NO: 1003881 - RNA, 19 nt, Human
agggcguggugcuugaggu

SEQ ID NO: 1003882 - RNA, 19 nt, Human
auccccgcccaccuggccg

SEQ ID NO: 1003883 - RNA, 21 nt, Human
auuccguaacccguacuaccg

SEQ ID NO: 1003884 - RNA, 18 nt, Human
auucuggagaaggauggc

SEQ ID NO: 1003885 - RNA, 26 nt, Human
caacaaggccaccugcagucugcccu

SEQ ID NO: 1003886 - RNA, 18 nt, Human
caagccacacgcuugaga

SEQ ID NO: 1003887 - RNA, 25 nt, Human
caagcuggcguaucagaucgaaaca

SEQ ID NO: 1003888 - RNA, 21 nt, Human
caagguaggaagaagaggccc

SEQ ID NO: 1003889 - RNA, 27 nt, Human
cacacgcacacaggcgcaauaucugca

SEQ ID NO: 1003890 - RNA, 21 nt, Human
cacaggaaaagcacgacuuca

SEQ ID NO: 1003891 - RNA, 23 nt, Human
cacaggugggggaguucucugag

SEQ ID NO: 1003892 - RNA, 22 nt, Human
cacauaaccaacacaauuugcu

SEQ ID NO: 1003893 - RNA, 18 nt, Human
caccucuuccuccucaag

SEQ ID NO: 1003894 - RNA, 20 nt, Human
caccucuuccuccucaauuc

SEQ ID NO: 1003895 - RNA, 24 nt, Human
caccugaucacauagccauccuaa

SEQ ID NO: 1003896 - RNA, 25 nt, Human
caccugcagucugcccugcccuucc

SEQ ID NO: 1003897 - RNA, 18 nt, Human
cacuggaguuggcccagc

SEQ ID NO: 1003898 - RNA, 18 nt, Human
cacuggaguuggcccagc

SEQ ID NO: 1003899 - RNA, 23 nt, Human
cacugguaagaaaugcagauugg

SEQ ID NO: 1003900 - RNA, 21 nt, Human
cagcaacaaggccaccugcag

SEQ ID NO: 1003901 - RNA, 21 nt, Human
cagcgauggcuucagggguga

SEQ ID NO: 1003902 - RNA, 18 nt, Human
cagcuagggcaucgacag

SEQ ID NO: 1003903 - RNA, 26 nt, Human
caggaaaagcacgacuucagucaccc

SEQ ID NO: 1003904 - RNA, 20 nt, Human
caggggaaaagaaacaggcc

SEQ ID NO: 1003905 - RNA, 24 nt, Human
cagggugggcaguggccugagccc

SEQ ID NO: 1003906 - RNA, 24 nt, Human
cagguguccuugaagcuaagcucu

SEQ ID NO: 1003907 - RNA, 18 nt, Human
cagucacauucaggagcc

SEQ ID NO: 1003908 - RNA, 26 nt, Human
caucacagacgucccagggccugggg

SEQ ID NO: 1003909 - RNA, 23 nt, Human
cauggacccgagggcugcuucuu

SEQ ID NO: 1003910 - RNA, 23 nt, Human
ccaccgggaagucccagacuagc

SEQ ID NO: 1003911 - RNA, 20 nt, Human
ccaccucuuccuccucaauu

SEQ ID NO: 1003912 - RNA, 23 nt, Human
ccaccucuuccuccucaauucuu

SEQ ID NO: 1003913 - RNA, 23 nt, Human
ccacugggugaauccccaggcau

SEQ ID NO: 1003914 - RNA, 23 nt, Human
ccagggugggcaguggccccggg

SEQ ID NO: 1003915 - RNA, 18 nt, Human
ccccagccucccagggag

SEQ ID NO: 1003916 - RNA, 18 nt, Human
ccccgcccaccuggccgg

SEQ ID NO: 1003917 - RNA, 24 nt, Human
cccuaaacagcugucuuuguuaau

SEQ ID NO: 1003918 - RNA, 18 nt, Human
cccugcccuuccuccccu

SEQ ID NO: 1003919 - RNA, 24 nt, Human
cccuggagggcguggugcuugagg

SEQ ID NO: 1003920 - RNA, 27 nt, Human
ccucacuccaccgggaagucccagaag

SEQ ID NO: 1003921 - RNA, 25 nt, Human
ccucaguggcuuugaaggcaggugu

SEQ ID NO: 1003922 - RNA, 19 nt, Human
ccucugggaacggaggcug

SEQ ID NO: 1003923 - RNA, 21 nt, Human
ccucuggggaccacuggguga

SEQ ID NO: 1003924 - RNA, 24 nt, Human
ccugggguugcagaaguggggugg

SEQ ID NO: 1003925 - RNA, 25 nt, Human
ccugugcuggcagcacacacaggaa

SEQ ID NO: 1003926 - RNA, 19 nt, Human
ccuugggaagggaagucag

SEQ ID NO: 1003927 - RNA, 21 nt, Human
cuaauucuuuaaaaaugggau

SEQ ID NO: 1003928 - RNA, 21 nt, Human
cuauugaguuagaagcuguau

SEQ ID NO: 1003929 - RNA, 22 nt, Human
cucaaaggggccaguccauaaa

SEQ ID NO: 1003930 - RNA, 24 nt, Human
cucacauaaccaacacaauuugcu

SEQ ID NO: 1003931 - RNA, 21 nt, Human
cucugauuaaaacaacacuca

SEQ ID NO: 1003932 - RNA, 22 nt, Human
cuggugggaaggccugggcaga

SEQ ID NO: 1003933 - RNA, 21 nt, Human
cuuggagcaggagggcugggu

SEQ ID NO: 1003934 - RNA, 20 nt, Human
cuuguuagaaaugcaggauc

SEQ ID NO: 1003935 - RNA, 26 nt, Human
gacuuguugccuccauggagcaccuc

SEQ ID NO: 1003936 - RNA, 21 nt, Human
gagaagcggggcccuggggag

SEQ ID NO: 1003937 - RNA, 23 nt, Human
gagaggcacaaauaaauacccau

SEQ ID NO: 1003938 - RNA, 19 nt, Human
gagcaugccaguggcagcu

SEQ ID NO: 1003939 - RNA, 22 nt, Human
gagcugggguguacggagaagc

SEQ ID NO: 1003940 - RNA, 24 nt, Human
gcagcacacacaggaaaagcacga

SEQ ID NO: 1003941 - RNA, 21 nt, Human
gcagguaaaaccacagguggg

SEQ ID NO: 1003942 - RNA, 20 nt, Human
gcaugaaauucagagacugc

SEQ ID NO: 1003943 - RNA, 22 nt, Human
gccaccucuuccuccucaauuc

SEQ ID NO: 1003944 - RNA, 25 nt, Human
gccccagccucccagggagagccag

SEQ ID NO: 1003945 - RNA, 18 nt, Human
gccugggcagaacagaag

SEQ ID NO: 1003946 - RNA, 21 nt, Human
gccugggcagaacagaaggcu

SEQ ID NO: 1003947 - RNA, 24 nt, Human
gcuagaauugcaucguaacagugu

SEQ ID NO: 1003948 - RNA, 21 nt, Human
ggagcaggagggcugggugcu

SEQ ID NO: 1003949 - RNA, 23 nt, Human
ggagcugggguguacggagaagc

SEQ ID NO: 1003950 - RNA, 19 nt, Human
ggagggucaggcaagagug

SEQ ID NO: 1003951 - RNA, 20 nt, Human
ggaguucucugagaccuagg

SEQ ID NO: 1003952 - RNA, 20 nt, Human
ggaguuggcccagcuagggg

SEQ ID NO: 1003953 - RNA, 21 nt, Human
ggcacccuggguagguguggu

SEQ ID NO: 1003954 - RNA, 20 nt, Human
ggcaguggccugagcccggc

SEQ ID NO: 1003955 - RNA, 18 nt, Human
ggccuggggcccagggcu

SEQ ID NO: 1003956 - RNA, 23 nt, Human
ggcugaaggaggcuguccaggcc

SEQ ID NO: 1003957 - RNA, 21 nt, Human
ggcugcuguggcuccaggcau

SEQ ID NO: 1003958 - RNA, 25 nt, Human
gggaaucccuggggcaucaguccac

SEQ ID NO: 1003959 - RNA, 21 nt, Human
gggagccucggagauuccugg

SEQ ID NO: 1003960 - RNA, 21 nt, Human
gggcccuggggagccucggag

SEQ ID NO: 1003961 - RNA, 24 nt, Human
ggggagccucggagauuccuggug

SEQ ID NO: 1003962 - RNA, 21 nt, Human
gggguugcagaaguggggugg

SEQ ID NO: 1003963 - RNA, 23 nt, Human
gggguugcagaagugggguggga

SEQ ID NO: 1003964 - RNA, 22 nt, Human
ggguaggugugguuagaaagcc

SEQ ID NO: 1003965 - RNA, 24 nt, Human
gguaaaaccacaggugggggaguu

SEQ ID NO: 1003966 - RNA, 18 nt, Human
ggugacagaggccgggga

SEQ ID NO: 1003967 - RNA, 20 nt, Human
gucaccuuagaugauggguu

SEQ ID NO: 1003968 - RNA, 20 nt, Human
uaaaacaacacucacauaac

SEQ ID NO: 1003969 - RNA, 22 nt, Human
uaagaaaugcagauuggcaauc

SEQ ID NO: 1003970 - RNA, 25 nt, Human
uaagaaaugcagauuggcaaucaug

SEQ ID NO: 1003971 - RNA, 21 nt, Human
uacaagaauucuggagaagga

SEQ ID NO: 1003972 - RNA, 24 nt, Human
uacaagaauucuggagaaggaugg

SEQ ID NO: 1003973 - RNA, 20 nt, Human
uaccugggguugcagaagug

SEQ ID NO: 1003974 - RNA, 19 nt, Human
uagcaaggagggcugccuc

SEQ ID NO: 1003975 - RNA, 21 nt, Human
uagcaaggagggcugccucua

SEQ ID NO: 1003976 - RNA, 18 nt, Human
uaggaaaaaguaaaaaaa

SEQ ID NO: 1003977 - RNA, 19 nt, Human
uaggaagaagaggcccagg

SEQ ID NO: 1003978 - RNA, 22 nt, Human
uauacacacgcacacaggcgca

SEQ ID NO: 1003979 - RNA, 25 nt, Human
uauacacacgcacacaggcgcaaua

SEQ ID NO: 1003980 - RNA, 18 nt, Human
uauauuugcuuuccauaa

SEQ ID NO: 1003981 - RNA, 21 nt, Human
ucacaccagcagccuccgccu

SEQ ID NO: 1003982 - RNA, 24 nt, Human
ucacuccaccgggaagucccagac

SEQ ID NO: 1003983 - RNA, 24 nt, Human
ucaggucgaguccuugggaaggga

SEQ ID NO: 1003984 - RNA, 24 nt, Human
uccaggccagggugggcaguggcc

SEQ ID NO: 1003985 - RNA, 18 nt, Human
ucccagggccuggggccc

SEQ ID NO: 1003986 - RNA, 20 nt, Human
ucccaugggagggaagccaa

SEQ ID NO: 1003987 - RNA, 18 nt, Human
ucccuggggcaucagucc

SEQ ID NO: 1003988 - RNA, 27 nt, Human
ucccuggggugggagucugggaugggg

SEQ ID NO: 1003989 - RNA, 23 nt, Human
uccugugcugggcucugaacccc

SEQ ID NO: 1003990 - RNA, 22 nt, Human
uccuugggaagggaagucagga

SEQ ID NO: 1003991 - RNA, 19 nt, Human
ucucugauuaaaacaacac

SEQ ID NO: 1003992 - RNA, 19 nt, Human
ucugcacggcugcccugga

SEQ ID NO: 1003993 - RNA, 25 nt, Human
ucuuaugggagggucaggcaagagu

SEQ ID NO: 1003994 - RNA, 24 nt, Human
ugaggcacccugcagacuucugag

SEQ ID NO: 1003995 - RNA, 20 nt, Human
ugaguaagaccagaacaauc

SEQ ID NO: 1003996 - RNA, 21 nt, Human
ugauagggucaaugacucugu

SEQ ID NO: 1003997 - RNA, 19 nt, Human
ugcaggaucucccagaucu

SEQ ID NO: 1003998 - RNA, 24 nt, Human
ugcagggaggggugcagguuaucc

SEQ ID NO: 1003999 - RNA, 20 nt, Human
ugcagucugcccugcccuuc

SEQ ID NO: 1004000 - RNA, 20 nt, Human
ugccaguggcagcuaucugu

SEQ ID NO: 1004001 - RNA, 21 nt, Human
ugcccugcccuuccuccccuc

SEQ ID NO: 1004002 - RNA, 19 nt, Human
ugcccuggagggcgugguu

SEQ ID NO: 1004003 - RNA, 18 nt, Human
ugcggcacccuggguagg

SEQ ID NO: 1004004 - RNA, 24 nt, Human
ugcuaggccaaagucuucacgggc

SEQ ID NO: 1004005 - RNA, 19 nt, Human
uggagaaggauggcggcug

SEQ ID NO: 1004006 - RNA, 21 nt, Human
uggcagcuaucuguggcaguu

SEQ ID NO: 1004007 - RNA, 20 nt, Human
uggcuccaggcaucacaccc

SEQ ID NO: 1004008 - RNA, 27 nt, Human
ugggacgaccccugaaaagugaaccaa

SEQ ID NO: 1004009 - RNA, 20 nt, Human
ugggaugggguggauaauga

SEQ ID NO: 1004010 - RNA, 22 nt, Human
ugggcaguggccugagcccggc

SEQ ID NO: 1004011 - RNA, 18 nt, Human
uggggaccacugggugaa

SEQ ID NO: 1004012 - RNA, 24 nt, Human
ugggggccagcgauggcuucaggg

SEQ ID NO: 1004013 - RNA, 23 nt, Human
ugggguguacggagaagcggggc

SEQ ID NO: 1004014 - RNA, 19 nt, Human
uguccaggccagggugggc

SEQ ID NO: 1004015 - RNA, 24 nt, Human
ugucuaacucuauccacaguucca

SEQ ID NO: 1004016 - RNA, 19 nt, Human
ugucugaacaacacaugga

SEQ ID NO: 1004017 - RNA, 21 nt, Human
ugugcuggcagcacacacagg

SEQ ID NO: 1004018 - RNA, 20 nt, Human
uuacagccuccacaguugga

SEQ ID NO: 1004019 - RNA, 19 nt, Human
uucagagacugcugugucc

SEQ ID NO: 1004020 - RNA, 20 nt, Human
uuccuggugggaaggccugg

SEQ ID NO: 1004021 - RNA, 21 nt, Human
uuccuggugggaaggccuggg

SEQ ID NO: 1004022 - RNA, 18 nt, Human
uucugccagagaaagcuc

SEQ ID NO: 1004023 - RNA, 23 nt, Human
uugaggucccuucuaccucuggg

SEQ ID NO: 1004024 - RNA, 18 nt, Human
uuuuuuuuuuuuuuuuug

SEQ ID NO: 1004025 - RNA, 22 nt, Human
uuuuuuuuuuuuuuuuuuuggc

SEQ ID NO: 1004026 - RNA, 22 nt, Human
aaagaaaucaagagaacuugaa

SEQ ID NO: 1004027 - RNA, 18 nt, Human
aaaguugggucuuuccag

SEQ ID NO: 1004028 - RNA, 23 nt, Human
aaguugggucuuuccagagagag

SEQ ID NO: 1004029 - RNA, 19 nt, Human
aaugcgcuagaaaccuagc

SEQ ID NO: 1004030 - RNA, 21 nt, Human
acacacauucacugugccccu

SEQ ID NO: 1004031 - RNA, 25 nt, Human
acagcagcccugcagugugcuuccu

SEQ ID NO: 1004032 - RNA, 19 nt, Human
accaccaucacccauuaau

SEQ ID NO: 1004033 - RNA, 22 nt, Human
acccgcucuccauuacuccccu

SEQ ID NO: 1004034 - RNA, 22 nt, Human
acuacaacacacuacuacccca

SEQ ID NO: 1004035 - RNA, 19 nt, Human
acugugccccuaccugcug

SEQ ID NO: 1004036 - RNA, 24 nt, Human
agaaaucaagagaacuugaaguuc

SEQ ID NO: 1004037 - RNA, 22 nt, Human
agacacagcaaaccuggagaaa

SEQ ID NO: 1004038 - RNA, 20 nt, Human
agauacuaguuucuuggggg

SEQ ID NO: 1004039 - RNA, 20 nt, Human
agcuggguuccuacugccuc

SEQ ID NO: 1004040 - RNA, 24 nt, Human
aggcugcauaguaagaccuggagc

SEQ ID NO: 1004041 - RNA, 23 nt, Human
aggcuggugaccuggaccccauu

SEQ ID NO: 1004042 - RNA, 18 nt, Human
agggagcccacugagggc

SEQ ID NO: 1004043 - RNA, 22 nt, Human
agggcccauccaccaagacagc

SEQ ID NO: 1004044 - RNA, 19 nt, Human
aguuucuugggggacagug

SEQ ID NO: 1004045 - RNA, 22 nt, Human
augcagaaugggccccaggagg

SEQ ID NO: 1004046 - RNA, 21 nt, Human
auucacccugucccauucccu

SEQ ID NO: 1004047 - RNA, 26 nt, Human
auucucaucccuucacacccacccac

SEQ ID NO: 1004048 - RNA, 23 nt, Human
caacacacuacuaccccaagggu

SEQ ID NO: 1004049 - RNA, 21 nt, Human
caaccccaaagggcacgaaga

SEQ ID NO: 1004050 - RNA, 18 nt, Human
caagacagcccugagagc

SEQ ID NO: 1004051 - RNA, 21 nt, Human
caagccaggcaccugcaaucc

SEQ ID NO: 1004052 - RNA, 24 nt, Human
cacacauucacugugccccuaccu

SEQ ID NO: 1004053 - RNA, 24 nt, Human
cacauucacugugccccuaccugc

SEQ ID NO: 1004054 - RNA, 21 nt, Human
caccaagacagcccugagagc

SEQ ID NO: 1004055 - RNA, 18 nt, Human
caccuaaagcaacaaggu

SEQ ID NO: 1004056 - RNA, 21 nt, Human
cacuacuaccccaaggguggg

SEQ ID NO: 1004057 - RNA, 23 nt, Human
cacuacuaccccaagggugggag

SEQ ID NO: 1004058 - RNA, 19 nt, Human
cacugcugaucucuugugg

SEQ ID NO: 1004059 - RNA, 19 nt, Human
cacugugccccuaccugcu

SEQ ID NO: 1004060 - RNA, 23 nt, Human
cacugugccccuaccugcuggag

SEQ ID NO: 1004061 - RNA, 21 nt, Human
cagaaugggccccaggaggcc

SEQ ID NO: 1004062 - RNA, 18 nt, Human
cagcccugcagugugcuu

SEQ ID NO: 1004063 - RNA, 18 nt, Human
caguacugaaaccagcac

SEQ ID NO: 1004064 - RNA, 22 nt, Human
caugcacuucugcaugcugagc

SEQ ID NO: 1004065 - RNA, 22 nt, Human
ccacagcaagccaggcaccugc

SEQ ID NO: 1004066 - RNA, 28 nt, Human
ccagcugauucccauagccacagcaagc

SEQ ID NO: 1004067 - RNA, 23 nt, Human
ccagggagcccacugagggccaa

SEQ ID NO: 1004068 - RNA, 18 nt, Human
cccagaacaacccugauc

SEQ ID NO: 1004069 - RNA, 23 nt, Human
cccauagccacagcaagccaggc

SEQ ID NO: 1004070 - RNA, 21 nt, Human
cccauagccacagcaagccuu

SEQ ID NO: 1004071 - RNA, 23 nt, Human
cccuucacacccacccacccgcu

SEQ ID NO: 1004072 - RNA, 22 nt, Human
cccuucaucaccguggcaacag

SEQ ID NO: 1004073 - RNA, 24 nt, Human
ccucaguagcagaggcaaaggagc

SEQ ID NO: 1004074 - RNA, 21 nt, Human
ccucccaacuucucucaggcu

SEQ ID NO: 1004075 - RNA, 20 nt, Human
ccucucccucuaugccucuu

SEQ ID NO: 1004076 - RNA, 19 nt, Human
ccugcaauccugacagggu

SEQ ID NO: 1004077 - RNA, 18 nt, Human
ccugcagugugcuuccuc

SEQ ID NO: 1004078 - RNA, 23 nt, Human
ccugccacuuaccuguccccacc

SEQ ID NO: 1004079 - RNA, 23 nt, Human
ccugucccauucccucccaagaa

SEQ ID NO: 1004080 - RNA, 25 nt, Human
ccuucaggaccagacugaauccuca

SEQ ID NO: 1004081 - RNA, 25 nt, Human
cgacuacaacacacuacuaccccaa

SEQ ID NO: 1004082 - RNA, 22 nt, Human
cgccucaguacugaaaccagca

SEQ ID NO: 1004083 - RNA, 25 nt, Human
cuccccccaaacccuucaggaccag

SEQ ID NO: 1004084 - RNA, 23 nt, Human
cuccccugccucaguagcagagg

SEQ ID NO: 1004085 - RNA, 21 nt, Human
cugcagugugcuuccucuccc

SEQ ID NO: 1004086 - RNA, 22 nt, Human
cuguccccaccacccucccaac

SEQ ID NO: 1004087 - RNA, 19 nt, Human
cugugccccuaccugcugg

SEQ ID NO: 1004088 - RNA, 25 nt, Human
cuucacacccacccacccgcucucc

SEQ ID NO: 1004089 - RNA, 22 nt, Human
cuucaggcugcauaguaagacc

SEQ ID NO: 1004090 - RNA, 23 nt, Human
cuucccagcugaagagguugcuc

SEQ ID NO: 1004091 - RNA, 19 nt, Human
gaaguggggagggcaugca

SEQ ID NO: 1004092 - RNA, 20 nt, Human
gacagcagugagaaaguugg

SEQ ID NO: 1004093 - RNA, 19 nt, Human
gacagugggaacaaagaaa

SEQ ID NO: 1004094 - RNA, 19 nt, Human
gacuccuuggcugagcgga

SEQ ID NO: 1004095 - RNA, 18 nt, Human
gagauucuucaaggagca

SEQ ID NO: 1004096 - RNA, 21 nt, Human
gagugaggccuucugaaguug

SEQ ID NO: 1004097 - RNA, 22 nt, Human
gccacuuaccuguccccaccac

SEQ ID NO: 1004098 - RNA, 21 nt, Human
gcccugagagcuggguuccua

SEQ ID NO: 1004099 - RNA, 20 nt, Human
gcucagcagagagcuccugg

SEQ ID NO: 1004100 - RNA, 22 nt, Human
gcugagccugugucuugcaggg

SEQ ID NO: 1004101 - RNA, 21 nt, Human
ggaaggccuauauacagagga

SEQ ID NO: 1004102 - RNA, 19 nt, Human
ggccacagcagcccugcag

SEQ ID NO: 1004103 - RNA, 24 nt, Human
ggcccauccaccaagacagcccug

SEQ ID NO: 1004104 - RNA, 19 nt, Human
gggcaaccccaaagggcaa

SEQ ID NO: 1004105 - RNA, 25 nt, Human
gggcaaccccaaagggcacgaagag

SEQ ID NO: 1004106 - RNA, 20 nt, Human
ggggaaguggggagggcaug

SEQ ID NO: 1004107 - RNA, 21 nt, Human
gugcagucaggcuggugaccu

SEQ ID NO: 1004108 - RNA, 18 nt, Human
gugugcagucaggcuggu

SEQ ID NO: 1004109 - RNA, 23 nt, Human
uaccuguccccaccacccuccca

SEQ ID NO: 1004110 - RNA, 27 nt, Human
uauauacagaggauaggcagggcuguc

SEQ ID NO: 1004111 - RNA, 24 nt, Human
ucaucccuucacacccacccaccc

SEQ ID NO: 1004112 - RNA, 19 nt, Human
ucccagaacaacccugauc

SEQ ID NO: 1004113 - RNA, 20 nt, Human
ucccauagccacagcaagcc

SEQ ID NO: 1004114 - RNA, 29 nt, Human
ucccucuaugccucuugcggccuuccccu

SEQ ID NO: 1004115 - RNA, 18 nt, Human
ugacaggacucccagaac

SEQ ID NO: 1004116 - RNA, 19 nt, Human
ugacccagggcaagcccca

SEQ ID NO: 1004117 - RNA, 20 nt, Human
ugacucaccuaaagcaacaa

SEQ ID NO: 1004118 - RNA, 21 nt, Human
ugacuuggcugacagcaguga

SEQ ID NO: 1004119 - RNA, 26 nt, Human
ugauguggccuucauacauacacaca

SEQ ID NO: 1004120 - RNA, 23 nt, Human
ugcaauccugacaggguccugcc

SEQ ID NO: 1004121 - RNA, 20 nt, Human
ugcuuuauucacccuguccc

SEQ ID NO: 1004122 - RNA, 33 nt, Human
ugcuuuauucacccugucccauucccucccaac

SEQ ID NO: 1004123 - RNA, 18 nt, Human
uggaaagaauauucucau

SEQ ID NO: 1004124 - RNA, 21 nt, Human
uggaguggguuuaagggaugg

SEQ ID NO: 1004125 - RNA, 18 nt, Human
uggcugggccagggagcc

SEQ ID NO: 1004126 - RNA, 18 nt, Human
uggcugggccagggagcc

SEQ ID NO: 1004127 - RNA, 19 nt, Human
ugggaguguguguugaucu

SEQ ID NO: 1004128 - RNA, 20 nt, Human
ugucuccacaggcaggcagg

SEQ ID NO: 1004129 - RNA, 18 nt, Human
ugugcugggcugcucagc

SEQ ID NO: 1004130 - RNA, 22 nt, Human
uguucaugcacuucugcaugcu

SEQ ID NO: 1004131 - RNA, 22 nt, Human
uuaagggauggucccacuucag

SEQ ID NO: 1004132 - RNA, 25 nt, Human
uucauacauacacacauucacugug

SEQ ID NO: 1004133 - RNA, 19 nt, Human
uucaugcacuucugcaugc

SEQ ID NO: 1004134 - RNA, 23 nt, Human
uucccaggcaugccuagcugugu

SEQ ID NO: 1004135 - RNA, 18 nt, Human
uuccuggcuggcugggcc

SEQ ID NO: 1004136 - RNA, 23 nt, Human
uucucuggcagcaggauucccag

SEQ ID NO: 1004137 - RNA, 22 nt, Human
uucugaaugcugccauuaacca

SEQ ID NO: 1004138 - RNA, 31 nt, Human
uuucuugggggacagugggaacaaagaaauu

SEQ ID NO: 1004139 - RNA, 19 nt, Human
aacauagugaauaggcucc

SEQ ID NO: 1004140 - RNA, 19 nt, Human
uuaaccgugcaaggaaacu

SEQ ID NO: 1004141 - RNA, 24 nt, Human
uuuuuuuuuuaaccgugcaaggaa

SEQ ID NO: 1004142 - RNA, 23 nt, Human
uuuuuuuuuuuuuuuuuuaaccg

SEQ ID NO: 1004143 - RNA, 20 nt, Human
aaauaaagagacacagccaa

SEQ ID NO: 1004144 - RNA, 18 nt, Human
aaggcaggaaucaggcug

SEQ ID NO: 1004145 - RNA, 18 nt, Human
acaguggcccucacuuuc

SEQ ID NO: 1004146 - RNA, 21 nt, Human
accaacucuccagcucucagu

SEQ ID NO: 1004147 - RNA, 26 nt, Human
accccugccccggaaucuucccaggc

SEQ ID NO: 1004148 - RNA, 19 nt, Human
acccuggguacuggggccc

SEQ ID NO: 1004149 - RNA, 23 nt, Human
aggcacccuccuccuggguaagg

SEQ ID NO: 1004150 - RNA, 18 nt, Human
aggcuggggcggggagag

SEQ ID NO: 1004151 - RNA, 21 nt, Human
aggcuggggcggggagagugu

SEQ ID NO: 1004152 - RNA, 19 nt, Human
caccccugccccggaaucu

SEQ ID NO: 1004153 - RNA, 23 nt, Human
cacucaugugaacguccgcucac

SEQ ID NO: 1004154 - RNA, 23 nt, Human
caguguccacuuagcccagucgu

SEQ ID NO: 1004155 - RNA, 18 nt, Human
ccacuuagcccagucgug

SEQ ID NO: 1004156 - RNA, 20 nt, Human
ccagcaggccauguuuuggg

SEQ ID NO: 1004157 - RNA, 21 nt, Human
cccaggcccagaucuccccuu

SEQ ID NO: 1004158 - RNA, 22 nt, Human
cccgccccgacugcuccagaua

SEQ ID NO: 1004159 - RNA, 21 nt, Human
ccgccccgacugcuccagaua

SEQ ID NO: 1004160 - RNA, 24 nt, Human
ccgcgcaccucucagcugggccug

SEQ ID NO: 1004161 - RNA, 19 nt, Human
ccgcuguccucgcccgcgc

SEQ ID NO: 1004162 - RNA, 19 nt, Human
ccuccuccuggguaaggca

SEQ ID NO: 1004163 - RNA, 21 nt, Human
ccuccuggguaaggcaggaau

SEQ ID NO: 1004164 - RNA, 19 nt, Human
ccucgcccgcgcaccucuc

SEQ ID NO: 1004165 - RNA, 21 nt, Human
cucgcuuaucaccaacucucc

SEQ ID NO: 1004166 - RNA, 21 nt, Human
cucugaguguucccacucccc

SEQ ID NO: 1004167 - RNA, 22 nt, Human
cuuaucaccaacucuccagcuc

SEQ ID NO: 1004168 - RNA, 26 nt, Human
gagcgggcuauagacccacucaugug

SEQ ID NO: 1004169 - RNA, 22 nt, Human
gccccggaaucuucccaggccc

SEQ ID NO: 1004170 - RNA, 18 nt, Human
gcugcagccucacccgcc

SEQ ID NO: 1004171 - RNA, 21 nt, Human
ggaaucuucccaggcccagau

SEQ ID NO: 1004172 - RNA, 23 nt, Human
ggccauguuuuggggcuggaccc

SEQ ID NO: 1004173 - RNA, 18 nt, Human
gggagggccugaugaagc

SEQ ID NO: 1004174 - RNA, 21 nt, Human
gguguguauuggaauauguga

SEQ ID NO: 1004175 - RNA, 24 nt, Human
gucucgcuuaucaccaacucucca

SEQ ID NO: 1004176 - RNA, 21 nt, Human
gugaaacugggcugcagccuc

SEQ ID NO: 1004177 - RNA, 19 nt, Human
uaaauaaagagacacagcc

SEQ ID NO: 1004178 - RNA, 21 nt, Human
uaaauaaagagacacagccaa

SEQ ID NO: 1004179 - RNA, 18 nt, Human
uauguguguaugagggca

SEQ ID NO: 1004180 - RNA, 20 nt, Human
ucagugccuagggcagggug

SEQ ID NO: 1004181 - RNA, 24 nt, Human
uccgcucaccccugccccggaauc

SEQ ID NO: 1004182 - RNA, 24 nt, Human
ugaacguccgcucaccccugcccc

SEQ ID NO: 1004183 - RNA, 22 nt, Human
ugacacaaagcugcuccuaccc

SEQ ID NO: 1004184 - RNA, 20 nt, Human
ugccccggaaucuucccagg

SEQ ID NO: 1004185 - RNA, 20 nt, Human
ugcccggagcgggcuauaga

SEQ ID NO: 1004186 - RNA, 21 nt, Human
uggggccaggcacccuccucc

SEQ ID NO: 1004187 - RNA, 20 nt, Human
uggggcuggacccagcccga

SEQ ID NO: 1004188 - RNA, 19 nt, Human
uguucuguucucuugaaca

SEQ ID NO: 1004189 - RNA, 20 nt, Human
uuggaauaugugauggggga

SEQ ID NO: 1004190 - RNA, 21 nt, Human
uuggaauaugugaugggggag

SEQ ID NO: 1004191 - RNA, 20 nt, Human
uuuuggggcuggacccagcc

SEQ ID NO: 1004192 - RNA, 18 nt, Human
aaaaaacaaaaccguaaa

SEQ ID NO: 1004193 - RNA, 22 nt, Human
aaacacaaaccaguaaaaaaca

SEQ ID NO: 1004194 - RNA, 22 nt, Human
aaacgucaggccuggagcugca

SEQ ID NO: 1004195 - RNA, 19 nt, Human
aagcaggaaggagucguug

SEQ ID NO: 1004196 - RNA, 20 nt, Human
acaaaccaguaaaaaacaaa

SEQ ID NO: 1004197 - RNA, 18 nt, Human
accugccucucacuccag

SEQ ID NO: 1004198 - RNA, 18 nt, Human
acgaggccauaaauacug

SEQ ID NO: 1004199 - RNA, 25 nt, Human
aggaaggagucguuggaagguuacc

SEQ ID NO: 1004200 - RNA, 18 nt, Human
aggagcagcucacacgug

SEQ ID NO: 1004201 - RNA, 26 nt, Human
aggagggcggcaagggagcccuaggg

SEQ ID NO: 1004202 - RNA, 19 nt, Human
aguaaaaaacaaaaccgua

SEQ ID NO: 1004203 - RNA, 22 nt, Human
caaaccaguaaaaaacaaaacc

SEQ ID NO: 1004204 - RNA, 23 nt, Human
caaaccaguaaaaaacaaaaccg

SEQ ID NO: 1004205 - RNA, 22 nt, Human
caauaagacagagacaggagca

SEQ ID NO: 1004206 - RNA, 22 nt, Human
cagguccccacaguucuucccc

SEQ ID NO: 1004207 - RNA, 19 nt, Human
cccacaguucuuccccucc

SEQ ID NO: 1004208 - RNA, 20 nt, Human
cccacaguucuuccccucca

SEQ ID NO: 1004209 - RNA, 20 nt, Human
ccccacaguucuuccccucc

SEQ ID NO: 1004210 - RNA, 22 nt, Human
ccccgaaaauauaaacacaaac

SEQ ID NO: 1004211 - RNA, 19 nt, Human
ccccggccgccaccugccu

SEQ ID NO: 1004212 - RNA, 23 nt, Human
ccuccagguguccugcuuaguuc

SEQ ID NO: 1004213 - RNA, 24 nt, Human
cugcaauaagacagagacaggagc

SEQ ID NO: 1004214 - RNA, 22 nt, Human
gaaaauauaaacacaaaccagu

SEQ ID NO: 1004215 - RNA, 24 nt, Human
gagacaggagcagcucacacgugg

SEQ ID NO: 1004216 - RNA, 20 nt, Human
gauggcuccggggguuuaga

SEQ ID NO: 1004217 - RNA, 19 nt, Human
gccccggccgccaccugcc

SEQ ID NO: 1004218 - RNA, 20 nt, Human
ggagggcggcaagggagccc

SEQ ID NO: 1004219 - RNA, 20 nt, Human
ggccuccagguccccacagu

SEQ ID NO: 1004220 - RNA, 21 nt, Human
ggggaaagcagggugucggca

SEQ ID NO: 1004221 - RNA, 24 nt, Human
uaaacacaaaccaguaaaaaacaa

SEQ ID NO: 1004222 - RNA, 18 nt, Human
uaagacagagacaggagc

SEQ ID NO: 1004223 - RNA, 21 nt, Human
uccccgaaaauauaaacacaa

SEQ ID NO: 1004224 - RNA, 25 nt, Human
ucggcagcaagauggcuccgggggu

SEQ ID NO: 1004225 - RNA, 21 nt, Human
aaagauaaauuagggcucaaa

SEQ ID NO: 1004226 - RNA, 18 nt, Human
aaaggugaagcagaaguc

SEQ ID NO: 1004227 - RNA, 24 nt, Human
aaguagccagagguaaagcgagcu

SEQ ID NO: 1004228 - RNA, 20 nt, Human
agagaaguuggagucagagg

SEQ ID NO: 1004229 - RNA, 23 nt, Human
aggagcuggggcucagguggggg

SEQ ID NO: 1004230 - RNA, 25 nt, Human
aggcagggaagcggggagggagggu

SEQ ID NO: 1004231 - RNA, 21 nt, Human
aggcagggaggaugcaugggg

SEQ ID NO: 1004232 - RNA, 23 nt, Human
aggcagggaggaugcauggggcc

SEQ ID NO: 1004233 - RNA, 19 nt, Human
agggaagcggggagggagg

SEQ ID NO: 1004234 - RNA, 19 nt, Human
aggggugaccucucuuccu

SEQ ID NO: 1004235 - RNA, 21 nt, Human
aggguggacgcggcggcgggg

SEQ ID NO: 1004236 - RNA, 23 nt, Human
agguaggagcuggggcucaggug

SEQ ID NO: 1004237 - RNA, 24 nt, Human
agguaggagcuggggcucaggugg

SEQ ID NO: 1004238 - RNA, 21 nt, Human
cagcucagagggaggggucaa

SEQ ID NO: 1004239 - RNA, 19 nt, Human
caggugggggguuaaaggu

SEQ ID NO: 1004240 - RNA, 21 nt, Human
cggcaggggcugaggggagug

SEQ ID NO: 1004241 - RNA, 21 nt, Human
cucauagagggugaaagagaa

SEQ ID NO: 1004242 - RNA, 19 nt, Human
cugacgcuguggggggugg

SEQ ID NO: 1004243 - RNA, 20 nt, Human
gaagcggggagggaggguag

SEQ ID NO: 1004244 - RNA, 22 nt, Human
gacaggugggaagcgaugggag

SEQ ID NO: 1004245 - RNA, 22 nt, Human
gaccucucuuccucacaggcac

SEQ ID NO: 1004246 - RNA, 18 nt, Human
gcaaaguuaaaggugcgg

SEQ ID NO: 1004247 - RNA, 20 nt, Human
gccuuggagggaaagcgggg

SEQ ID NO: 1004248 - RNA, 20 nt, Human
gcggcggcgguggcacgagc

SEQ ID NO: 1004249 - RNA, 19 nt, Human
gcugugggggguggggggu

SEQ ID NO: 1004250 - RNA, 20 nt, Human
ggaagcggggagggagggua

SEQ ID NO: 1004251 - RNA, 23 nt, Human
ggcacgagcgcggggagcugcgg

SEQ ID NO: 1004252 - RNA, 20 nt, Human
ggcggagcacggucccugcg

SEQ ID NO: 1004253 - RNA, 19 nt, Human
gggccuagcggaucaaagg

SEQ ID NO: 1004254 - RNA, 21 nt, Human
gggcugaggggagugaggcag

SEQ ID NO: 1004255 - RNA, 18 nt, Human
gggggcagaggucaaagg

SEQ ID NO: 1004256 - RNA, 24 nt, Human
ggggggccuagcggaucaaagguc

SEQ ID NO: 1004257 - RNA, 19 nt, Human
gggguuaaaggugaggcaa

SEQ ID NO: 1004258 - RNA, 21 nt, Human
guggacgcggcggcgguggca

SEQ ID NO: 1004259 - RNA, 22 nt, Human
gugggaaucagagagaagcugg

SEQ ID NO: 1004260 - RNA, 18 nt, Human
uaaagauaaauuagggcu

SEQ ID NO: 1004261 - RNA, 22 nt, Human
uaaagcgagcuccaaagguauu

SEQ ID NO: 1004262 - RNA, 24 nt, Human
uaagcuaaggucggcaggggcuga

SEQ ID NO: 1004263 - RNA, 21 nt, Human
uagagguaaaaugggauucau

SEQ ID NO: 1004264 - RNA, 23 nt, Human
uagccagagguaaagcgagcucc

SEQ ID NO: 1004265 - RNA, 18 nt, Human
ucaaagagaaguuggggu

SEQ ID NO: 1004266 - RNA, 24 nt, Human
ucagcggugaagugcagcucagag

SEQ ID NO: 1004267 - RNA, 22 nt, Human
ucuaggguucagagaugggggg

SEQ ID NO: 1004268 - RNA, 21 nt, Human
ugaaagagaaguuggagucag

SEQ ID NO: 1004269 - RNA, 18 nt, Human
ugaaaggugaggcaaggu

SEQ ID NO: 1004270 - RNA, 19 nt, Human
ugaagcagaagucaggggu

SEQ ID NO: 1004271 - RNA, 20 nt, Human
ugaagcagaagucaggggug

SEQ ID NO: 1004272 - RNA, 24 nt, Human
ugaccucucuuccucacaggcacc

SEQ ID NO: 1004273 - RNA, 20 nt, Human
ugcagguguagaaguaaaau

SEQ ID NO: 1004274 - RNA, 25 nt, Human
ugcggcggcggcgaggguggaagau

SEQ ID NO: 1004275 - RNA, 21 nt, Human
uggaagagcucaaggggguua

SEQ ID NO: 1004276 - RNA, 19 nt, Human
uguggggggugggggguga

SEQ ID NO: 1004277 - RNA, 19 nt, Human
uuggaagagcucaaggggg

SEQ ID NO: 1004278 - RNA, 24 nt, Human
uuggagucagaggggauucagaga

SEQ ID NO: 1004279 - RNA, 19 nt, Human
uuuauugagggugaggcag

SEQ ID NO: 1004280 - RNA, 20 nt, Human
uuuuuuuuuuuuuuuuccau

SEQ ID NO: 1004281 - RNA, 24 nt, Human
uuuuuuuuuuuuuuuuuuuccaug

SEQ ID NO: 1004282 - RNA, 27 nt, Human
accccacacccuuccuuccugucacag

SEQ ID NO: 1004283 - RNA, 23 nt, Human
aucacaauauguucuccgcaguc

SEQ ID NO: 1004284 - RNA, 18 nt, Human
caauauguucuccgcagu

SEQ ID NO: 1004285 - RNA, 22 nt, Human
caccagucccugcugaccccac

SEQ ID NO: 1004286 - RNA, 21 nt, Human
ccagucccugcugaccccaca

SEQ ID NO: 1004287 - RNA, 26 nt, Human
cccugcugaccccacacccuuccuuc

SEQ ID NO: 1004288 - RNA, 23 nt, Human
gaacaucacaauauguucuccgc

SEQ ID NO: 1004289 - RNA, 22 nt, Human
gcaccagucccugcugacccca

SEQ ID NO: 1004290 - RNA, 18 nt, Human
uucuccgcagucccggag

SEQ ID NO: 1004291 - RNA, 22 nt, Human
uuugaaaauucuggacccauuu

SEQ ID NO: 1004292 - RNA, 18 nt, Human
aaaaaacaauccccccca

SEQ ID NO: 1004293 - RNA, 18 nt, Human
aaaaaacaauccccccca

SEQ ID NO: 1004294 - RNA, 27 nt, Human
aaaaaacaaucccccccaccccaacau

SEQ ID NO: 1004295 - RNA, 21 nt, Human
aaaaacaaucccccccacccc

SEQ ID NO: 1004296 - RNA, 20 nt, Human
aaacacgacguggcuucucc

SEQ ID NO: 1004297 - RNA, 23 nt, Human
aaacacgacguggcuucucccac

SEQ ID NO: 1004298 - RNA, 18 nt, Human
acaaaaaacaaucccccc

SEQ ID NO: 1004299 - RNA, 20 nt, Human
acaaaaaacaauccccccca

SEQ ID NO: 1004300 - RNA, 23 nt, Human
acuccauuaacuuucucaucacu

SEQ ID NO: 1004301 - RNA, 19 nt, Human
agacaaaugugaacagugc

SEQ ID NO: 1004302 - RNA, 20 nt, Human
aggaaaaaggaaaucuucau

SEQ ID NO: 1004303 - RNA, 23 nt, Human
aggaaaucuucauuauccauguc

SEQ ID NO: 1004304 - RNA, 24 nt, Human
aggagagaaaauaagaauaaauau

SEQ ID NO: 1004305 - RNA, 26 nt, Human
caaaaaacaaucccccccaccccaac

SEQ ID NO: 1004306 - RNA, 19 nt, Human
caccugcagcaugcaguuc

SEQ ID NO: 1004307 - RNA, 20 nt, Human
cacggugguccgggcagagc

SEQ ID NO: 1004308 - RNA, 20 nt, Human
cagugcaacgaacaucaccc

SEQ ID NO: 1004309 - RNA, 19 nt, Human
ccacugccgccgcacgcgc

SEQ ID NO: 1004310 - RNA, 23 nt, Human
ccaucuuaacuaaugaauauccu

SEQ ID NO: 1004311 - RNA, 27 nt, Human
ccgacaugugaaacacgacguggcuuu

SEQ ID NO: 1004312 - RNA, 20 nt, Human
ccgcacgcgcagggaccgcg

SEQ ID NO: 1004313 - RNA, 22 nt, Human
cgccgcacgcgcagggaccgcg

SEQ ID NO: 1004314 - RNA, 20 nt, Human
cgcggcccgcgcccuuccug

SEQ ID NO: 1004315 - RNA, 22 nt, Human
cucugaaaggagagaaaauaag

SEQ ID NO: 1004316 - RNA, 21 nt, Human
cuuucucaucacuccuauuua

SEQ ID NO: 1004317 - RNA, 27 nt, Human
gaaaaaggaaaucuucauuauccaugu

SEQ ID NO: 1004318 - RNA, 22 nt, Human
gcgcacucgugggcggaagggc

SEQ ID NO: 1004319 - RNA, 21 nt, Human
ggaaaucuucauuauccaugu

SEQ ID NO: 1004320 - RNA, 21 nt, Human
uaaaauacuccauuaacuuuc

SEQ ID NO: 1004321 - RNA, 22 nt, Human
uaaugaauauccuaucacccua

SEQ ID NO: 1004322 - RNA, 22 nt, Human
uacaaaaaacaaucccccccac

SEQ ID NO: 1004323 - RNA, 22 nt, Human
uacaacacuaaaaaaaaauaaa

SEQ ID NO: 1004324 - RNA, 19 nt, Human
ucccccccaccccaacauc

SEQ ID NO: 1004325 - RNA, 20 nt, Human
ucccugggaggaccgcgagc

SEQ ID NO: 1004326 - RNA, 20 nt, Human
ucgcccggagccgugcacgg

SEQ ID NO: 1004327 - RNA, 18 nt, Human
ucgugggcggaagggcag

SEQ ID NO: 1004328 - RNA, 23 nt, Human
ucuuuuagcgaugaagacuuuua

SEQ ID NO: 1004329 - RNA, 27 nt, Human
ugaaaauaaaauacuccauuaacuuuc

SEQ ID NO: 1004330 - RNA, 18 nt, Human
ugaauauccuaucacccu

SEQ ID NO: 1004331 - RNA, 24 nt, Human
ugaauauccuaucacccuaauuuu

SEQ ID NO: 1004332 - RNA, 21 nt, Human
ugggcggaagggcaggacacc

SEQ ID NO: 1004333 - RNA, 24 nt, Human
uuccugcaggacgucaaugggaau

SEQ ID NO: 1004334 - RNA, 20 nt, Human
uuuacaaaaaacaauccccc

SEQ ID NO: 1004335 - RNA, 20 nt, Human
uuuagagacaaaugugaaca

SEQ ID NO: 1004336 - RNA, 25 nt, Human
uuuugguuauguuaacaaaaauuac

SEQ ID NO: 1004337 - RNA, 22 nt, Human
uuuuuguucucuaucacuccua

SEQ ID NO: 1004338 - RNA, 25 nt, Human
aaaaaaaaaaaauacucaaaugugc

SEQ ID NO: 1004339 - RNA, 21 nt, Human
aaaaaacgucuaucagaagaa

SEQ ID NO: 1004340 - RNA, 22 nt, Human
aaaaacaucacugagaaugaag

SEQ ID NO: 1004341 - RNA, 22 nt, Human
aaaaaugugagaugucacaaag

SEQ ID NO: 1004342 - RNA, 21 nt, Human
aaaauggugaaacccugucuc

SEQ ID NO: 1004343 - RNA, 18 nt, Human
aaacagagucucauaaga

SEQ ID NO: 1004344 - RNA, 21 nt, Human
aaagaauuccacuauucauca

SEQ ID NO: 1004345 - RNA, 21 nt, Human
aaaucugacagaaaaaugaca

SEQ ID NO: 1004346 - RNA, 22 nt, Human
aaaucuuccaguuaaaagagac

SEQ ID NO: 1004347 - RNA, 21 nt, Human
aacagaguugagacccugucu

SEQ ID NO: 1004348 - RNA, 20 nt, Human
aacauagcaaaacucugucu

SEQ ID NO: 1004349 - RNA, 21 nt, Human
aacauagcaaaacucugucuc

SEQ ID NO: 1004350 - RNA, 24 nt, Human
aaccaggaggcagagguugcagug

SEQ ID NO: 1004351 - RNA, 19 nt, Human
aagccaagaaauuuaaaau

SEQ ID NO: 1004352 - RNA, 18 nt, Human
aaucgcuugagcccggga

SEQ ID NO: 1004353 - RNA, 18 nt, Human
acaagcaaaaaacaucac

SEQ ID NO: 1004354 - RNA, 19 nt, Human
acaagcaaaugcugacaca

SEQ ID NO: 1004355 - RNA, 20 nt, Human
acaagucuguccugaaagcc

SEQ ID NO: 1004356 - RNA, 18 nt, Human
acaccacugcacuccagc

SEQ ID NO: 1004357 - RNA, 20 nt, Human
acaccacugcacuccagccu

SEQ ID NO: 1004358 - RNA, 24 nt, Human
acagagcgagacuccaucucaaaa

SEQ ID NO: 1004359 - RNA, 19 nt, Human
accacugcacuccagccug

SEQ ID NO: 1004360 - RNA, 22 nt, Human
accauaaaaaaaacugacucaa

SEQ ID NO: 1004361 - RNA, 18 nt, Human
acccugucucuacuaaaa

SEQ ID NO: 1004362 - RNA, 23 nt, Human
accuguaguccuagcuacucagg

SEQ ID NO: 1004363 - RNA, 19 nt, Human
acuacugagaauacaagga

SEQ ID NO: 1004364 - RNA, 24 nt, Human
acugcacuccagccuagaugacag

SEQ ID NO: 1004365 - RNA, 26 nt, Human
acugcacuccagccuagaugacagag

SEQ ID NO: 1004366 - RNA, 24 nt, Human
acugcacuccagccuggguaacag

SEQ ID NO: 1004367 - RNA, 26 nt, Human
acugcacuccagccuggguaacagag

SEQ ID NO: 1004368 - RNA, 25 nt, Human
agaaaacaaugucaacuaaaaauac

SEQ ID NO: 1004369 - RNA, 18 nt, Human
agaaagccaaauaaauaa

SEQ ID NO: 1004370 - RNA, 24 nt, Human
agaaauuuaaaauauagagaacaa

SEQ ID NO: 1004371 - RNA, 20 nt, Human
agacagaggcugcagugagc

SEQ ID NO: 1004372 - RNA, 24 nt, Human
agacagaggcugcagugagcugag

SEQ ID NO: 1004373 - RNA, 23 nt, Human
agaggcugcagugagcugagauc

SEQ ID NO: 1004374 - RNA, 24 nt, Human
agaggcugcagugagcugagauca

SEQ ID NO: 1004375 - RNA, 22 nt, Human
agagguugcagugagcugagau

SEQ ID NO: 1004376 - RNA, 23 nt, Human
agagguugcagugagcugagauc

SEQ ID NO: 1004377 - RNA, 24 nt, Human
agagguugcagugagcugagaucg

SEQ ID NO: 1004378 - RNA, 18 nt, Human
agaguuggcuuauuuuuu

SEQ ID NO: 1004379 - RNA, 24 nt, Human
agauguuacccagucuucuucugu

SEQ ID NO: 1004380 - RNA, 19 nt, Human
agcaaauuugaaaauagac

SEQ ID NO: 1004381 - RNA, 24 nt, Human
agcacuuugggaggcugagguggg

SEQ ID NO: 1004382 - RNA, 22 nt, Human
agccuggccaacauagcaaaac

SEQ ID NO: 1004383 - RNA, 24 nt, Human
agccuggccaacauagcaaaacuc

SEQ ID NO: 1004384 - RNA, 20 nt, Human
agccuggccaacauagcaag

SEQ ID NO: 1004385 - RNA, 21 nt, Human
agcugggcugugguggugcau

SEQ ID NO: 1004386 - RNA, 24 nt, Human
agcugggcugugguggugcaugcc

SEQ ID NO: 1004387 - RNA, 23 nt, Human
aggaaaauagaauauaagccaag

SEQ ID NO: 1004388 - RNA, 21 nt, Human
aggaaauacggaagcuaaaag

SEQ ID NO: 1004389 - RNA, 19 nt, Human
aggaggcugaggcaagaga

SEQ ID NO: 1004390 - RNA, 22 nt, Human
aggaggcugaggcacaauaauc

SEQ ID NO: 1004391 - RNA, 18 nt, Human
aggcaagagaaucgcuug

SEQ ID NO: 1004392 - RNA, 24 nt, Human
aggcaagagaaucgcuugagcccg

SEQ ID NO: 1004393 - RNA, 24 nt, Human
aggcacgguggcucaugccuguaa

SEQ ID NO: 1004394 - RNA, 20 nt, Human
aggcagagguugcagugagc

SEQ ID NO: 1004395 - RNA, 24 nt, Human
aggcagagguugcagugagcugag

SEQ ID NO: 1004396 - RNA, 20 nt, Human
aggccgaggcggguggauca

SEQ ID NO: 1004397 - RNA, 24 nt, Human
aggcggguggaucaugaggucagg

SEQ ID NO: 1004398 - RNA, 24 nt, Human
aggcugaggcaagagaaucgcuug

SEQ ID NO: 1004399 - RNA, 24 nt, Human
aggcugaggcacaauaaucgcuug

SEQ ID NO: 1004400 - RNA, 24 nt, Human
aggcugagguggguggaucacuug

SEQ ID NO: 1004401 - RNA, 23 nt, Human
agguggguggaucacuugaggcc

SEQ ID NO: 1004402 - RNA, 24 nt, Human
agguguaguggccuguaaucccag

SEQ ID NO: 1004403 - RNA, 19 nt, Human
aguggacaccaaacacuga

SEQ ID NO: 1004404 - RNA, 19 nt, Human
aguuuuuuaaaucuucuga

SEQ ID NO: 1004405 - RNA, 20 nt, Human
aguuuuuuaaaucuucugag

SEQ ID NO: 1004406 - RNA, 22 nt, Human
auaaaauagugauauaucaagc

SEQ ID NO: 1004407 - RNA, 20 nt, Human
auaacagauuacucuucuca

SEQ ID NO: 1004408 - RNA, 20 nt, Human
auacaaaaaaaaaaaagacu

SEQ ID NO: 1004409 - RNA, 26 nt, Human
auacaaaaaaaaaaaagacugucauc

SEQ ID NO: 1004410 - RNA, 20 nt, Human
aucacaccacugcacuccag

SEQ ID NO: 1004411 - RNA, 24 nt, Human
aucgcaccacugcacuccagccug

SEQ ID NO: 1004412 - RNA, 19 nt, Human
augccuguaaucccagcac

SEQ ID NO: 1004413 - RNA, 18 nt, Human
augguuuauuucuagaug

SEQ ID NO: 1004414 - RNA, 24 nt, Human
caaaauggugaaacccugucucua

SEQ ID NO: 1004415 - RNA, 24 nt, Human
caacauagcaaaacucugucucua

SEQ ID NO: 1004416 - RNA, 23 nt, Human
caacuaaaaauacuacaagcaaa

SEQ ID NO: 1004417 - RNA, 21 nt, Human
cacaccacugcacuccagccu

SEQ ID NO: 1004418 - RNA, 23 nt, Human
cacagacaacaacaggugaacac

SEQ ID NO: 1004419 - RNA, 24 nt, Human
caccuguaguccuagcuacucagg

SEQ ID NO: 1004420 - RNA, 28 nt, Human
cacgaaaacauuaaucaaaagacagcug

SEQ ID NO: 1004421 - RNA, 24 nt, Human
cacuccagccuagaugacagagcg

SEQ ID NO: 1004422 - RNA, 22 nt, Human
cacuccagccuggguaacagag

SEQ ID NO: 1004423 - RNA, 18 nt, Human
cacugcacuccagccuag

SEQ ID NO: 1004424 - RNA, 19 nt, Human
cacugcacuccagccuaga

SEQ ID NO: 1004425 - RNA, 19 nt, Human
cacugcacuccagccuaga

SEQ ID NO: 1004426 - RNA, 22 nt, Human
cacugcacuccagccuagauga

SEQ ID NO: 1004427 - RNA, 19 nt, Human
cacugcacuccagccuggg

SEQ ID NO: 1004428 - RNA, 21 nt, Human
cacugcacuccagccugggua

SEQ ID NO: 1004429 - RNA, 22 nt, Human
cacugcacuccagccuggguaa

SEQ ID NO: 1004430 - RNA, 23 nt, Human
cacugcacuccagccuggguaac

SEQ ID NO: 1004431 - RNA, 24 nt, Human
cacugcacuccagccuggguaaca

SEQ ID NO: 1004432 - RNA, 18 nt, Human
cacuuuggaaggccgagg

SEQ ID NO: 1004433 - RNA, 19 nt, Human
cagacaacaacaggugaac

SEQ ID NO: 1004434 - RNA, 24 nt, Human
cagcacuuuggaaggccgaggcgg

SEQ ID NO: 1004435 - RNA, 24 nt, Human
cagcacuuugggaggcugaggugg

SEQ ID NO: 1004436 - RNA, 18 nt, Human
caggauacacugcaccca

SEQ ID NO: 1004437 - RNA, 25 nt, Human
cauaacagauuacucuucucaugag

SEQ ID NO: 1004438 - RNA, 24 nt, Human
caugccuguaaucccagcacuuug

SEQ ID NO: 1004439 - RNA, 19 nt, Human
cauuuucuuuuuggugguu

SEQ ID NO: 1004440 - RNA, 19 nt, Human
ccacugcacuccagccuag

SEQ ID NO: 1004441 - RNA, 20 nt, Human
ccacugcacuccagccuaga

SEQ ID NO: 1004442 - RNA, 21 nt, Human
ccacugcacuccagccuagau

SEQ ID NO: 1004443 - RNA, 23 nt, Human
ccacugcacuccagccuagauga

SEQ ID NO: 1004444 - RNA, 25 nt, Human
ccacugcacuccagccuagaugaca

SEQ ID NO: 1004445 - RNA, 20 nt, Human
ccacugcacuccagccuggg

SEQ ID NO: 1004446 - RNA, 20 nt, Human
ccacugcacuccagccuggg

SEQ ID NO: 1004447 - RNA, 21 nt, Human
ccacugcacuccagccugggu

SEQ ID NO: 1004448 - RNA, 22 nt, Human
ccacugcacuccagccugggua

SEQ ID NO: 1004449 - RNA, 23 nt, Human
ccacugcacuccagccuggguaa

SEQ ID NO: 1004450 - RNA, 24 nt, Human
ccacugcacuccagccuggguaac

SEQ ID NO: 1004451 - RNA, 25 nt, Human
ccacugcacuccagccuggguaaca

SEQ ID NO: 1004452 - RNA, 19 nt, Human
ccagaugcuugcacuaacc

SEQ ID NO: 1004453 - RNA, 25 nt, Human
ccaucucaaaaaaaaaaaaaaaaaa

SEQ ID NO: 1004454 - RNA, 22 nt, Human
ccuagaugacagagcgagacuc

SEQ ID NO: 1004455 - RNA, 19 nt, Human
ccuaucagaaccacucuaa

SEQ ID NO: 1004456 - RNA, 23 nt, Human
ccucacugcugcuacucuuuucu

SEQ ID NO: 1004457 - RNA, 22 nt, Human
ccuggccaaaauggugaaaccc

SEQ ID NO: 1004458 - RNA, 24 nt, Human
ccuggccaaaauggugaaacccug

SEQ ID NO: 1004459 - RNA, 20 nt, Human
ccuggccaacauagcaaaac

SEQ ID NO: 1004460 - RNA, 20 nt, Human
ccuguaaucccagcacuuug

SEQ ID NO: 1004461 - RNA, 19 nt, Human
ccuguaaucccagcuacuc

SEQ ID NO: 1004462 - RNA, 21 nt, Human
ccuguaaucccagcuacucag

SEQ ID NO: 1004463 - RNA, 18 nt, Human
cgacacagacaacaacag

SEQ ID NO: 1004464 - RNA, 30 nt, Human
cgacacagacaacaacaggugaacacuccu

SEQ ID NO: 1004465 - RNA, 19 nt, Human
cgaccggaaguccugagag

SEQ ID NO: 1004466 - RNA, 24 nt, Human
cgagaccauccuggccaaaauggu

SEQ ID NO: 1004467 - RNA, 22 nt, Human
cgaggcggguggaucaugaggu

SEQ ID NO: 1004468 - RNA, 24 nt, Human
cgaggcggguggaucaugagguca

SEQ ID NO: 1004469 - RNA, 21 nt, Human
cgcaccacugcacuccagccu

SEQ ID NO: 1004470 - RNA, 19 nt, Human
cgcccacagccaucauggc

SEQ ID NO: 1004471 - RNA, 19 nt, Human
cuacaagcaaaaaacauca

SEQ ID NO: 1004472 - RNA, 19 nt, Human
cuauucaucaaaauuuuca

SEQ ID NO: 1004473 - RNA, 22 nt, Human
cucagaagaggaggaaaaaaac

SEQ ID NO: 1004474 - RNA, 19 nt, Human
cucaguggacaccaaacac

SEQ ID NO: 1004475 - RNA, 23 nt, Human
cucaugccuguaaucccagcacu

SEQ ID NO: 1004476 - RNA, 24 nt, Human
cucaugccuguaaucccagcacuu

SEQ ID NO: 1004477 - RNA, 19 nt, Human
cuccaucucaaaaaaaaaa

SEQ ID NO: 1004478 - RNA, 20 nt, Human
cucuuccucacugcugcuac

SEQ ID NO: 1004479 - RNA, 19 nt, Human
cugcagugagcugagauca

SEQ ID NO: 1004480 - RNA, 20 nt, Human
cugcagugagcugagaucac

SEQ ID NO: 1004481 - RNA, 24 nt, Human
cuggccaaaauggugaaacccugu

SEQ ID NO: 1004482 - RNA, 18 nt, Human
cuggcugacugaggauaa

SEQ ID NO: 1004483 - RNA, 28 nt, Human
cuuccucacugcugcuacucuuuucugg

SEQ ID NO: 1004484 - RNA, 20 nt, Human
cuugaacacugaaaucaaug

SEQ ID NO: 1004485 - RNA, 19 nt, Human
gaaacccugucucuacuaa

SEQ ID NO: 1004486 - RNA, 20 nt, Human
gacacagacaacaacaggug

SEQ ID NO: 1004487 - RNA, 18 nt, Human
gacgacacagacaacaac

SEQ ID NO: 1004488 - RNA, 22 nt, Human
gacgacacagacaacaacaggu

SEQ ID NO: 1004489 - RNA, 23 nt, Human
gagaaucgcuugagcccgggaga

SEQ ID NO: 1004490 - RNA, 23 nt, Human
gaggcggguggaucaugagguca

SEQ ID NO: 1004491 - RNA, 18 nt, Human
gaggcugcagugagcuga

SEQ ID NO: 1004492 - RNA, 22 nt, Human
gagguggguggaucacuugagg

SEQ ID NO: 1004493 - RNA, 18 nt, Human
gaucacuugaggccagga

SEQ ID NO: 1004494 - RNA, 24 nt, Human
gaucacuugaggccaggaguucaa

SEQ ID NO: 1004495 - RNA, 22 nt, Human
gcaaaugacaacucaguggaca

SEQ ID NO: 1004496 - RNA, 20 nt, Human
gcaccacugcacuccagccu

SEQ ID NO: 1004497 - RNA, 24 nt, Human
gcacuccagccuagaugacagagc

SEQ ID NO: 1004498 - RNA, 23 nt, Human
gcacuccagccuggguaacagag

SEQ ID NO: 1004499 - RNA, 24 nt, Human
gccaaaauggugaaacccugucuc

SEQ ID NO: 1004500 - RNA, 24 nt, Human
gccaacauagcaaaacucugucuc

SEQ ID NO: 1004501 - RNA, 22 nt, Human
gccaggcacgguggcucaugcc

SEQ ID NO: 1004502 - RNA, 22 nt, Human
gcccagaugcuugcacuaaccg

SEQ ID NO: 1004503 - RNA, 24 nt, Human
gcccgggagacagaggcugcagug

SEQ ID NO: 1004504 - RNA, 19 nt, Human
gccuguaaucccagcacuu

SEQ ID NO: 1004505 - RNA, 20 nt, Human
gcugagaucacaccacugca

SEQ ID NO: 1004506 - RNA, 20 nt, Human
gcugagaucgcaccacugca

SEQ ID NO: 1004507 - RNA, 22 nt, Human
ggaggcagagguugcagugagc

SEQ ID NO: 1004508 - RNA, 19 nt, Human
ggccaaaauggugaaaccc

SEQ ID NO: 1004509 - RNA, 23 nt, Human
ggccuguaaucccagcacuuugg

SEQ ID NO: 1004510 - RNA, 24 nt, Human
ggccuguaaucccagcacuuuggg

SEQ ID NO: 1004511 - RNA, 23 nt, Human
ggcggguggaucaugaggucagg

SEQ ID NO: 1004512 - RNA, 18 nt, Human
ggcuaaaaacuaaagaua

SEQ ID NO: 1004513 - RNA, 24 nt, Human
ggcugugguggugcaugccuguaa

SEQ ID NO: 1004514 - RNA, 24 nt, Human
gggcguguuggcaugcaccuguag

SEQ ID NO: 1004515 - RNA, 21 nt, Human
gguggaucaugaggucaggag

SEQ ID NO: 1004516 - RNA, 23 nt, Human
gguggcucaugccuguaauccca

SEQ ID NO: 1004517 - RNA, 24 nt, Human
gguggcucaugccuguaaucccag

SEQ ID NO: 1004518 - RNA, 24 nt, Human
gguggugcaugccuguaaucccag

SEQ ID NO: 1004519 - RNA, 22 nt, Human
gguguaguggccuguaauccca

SEQ ID NO: 1004520 - RNA, 23 nt, Human
gguguaguggccuguaaucccag

SEQ ID NO: 1004521 - RNA, 19 nt, Human
gucucuacuaaaaauacaa

SEQ ID NO: 1004522 - RNA, 22 nt, Human
guggaucacuugaggccaggag

SEQ ID NO: 1004523 - RNA, 23 nt, Human
guggcucaugccuguaaucccag

SEQ ID NO: 1004524 - RNA, 23 nt, Human
guggugcaugccuguaaucccag

SEQ ID NO: 1004525 - RNA, 24 nt, Human
guguaguggccuguaaucccagca

SEQ ID NO: 1004526 - RNA, 19 nt, Human
guugcagugagcugagauc

SEQ ID NO: 1004527 - RNA, 21 nt, Human
guugcagugagcugagaucgc

SEQ ID NO: 1004528 - RNA, 24 nt, Human
guuggcaugcaccuguaguccuag

SEQ ID NO: 1004529 - RNA, 25 nt, Human
uaaaaauacucaaaugaggccaguc

SEQ ID NO: 1004530 - RNA, 20 nt, Human
uaaaagagacuaucagaaug

SEQ ID NO: 1004531 - RNA, 19 nt, Human
uaaaaggaaacugcugaac

SEQ ID NO: 1004532 - RNA, 19 nt, Human
uaacaguagaauagaaaag

SEQ ID NO: 1004533 - RNA, 22 nt, Human
uaacauacaaaaaaaaaaaaga

SEQ ID NO: 1004534 - RNA, 19 nt, Human
uaauuuauugauggguuuu

SEQ ID NO: 1004535 - RNA, 25 nt, Human
uacaaaaaaaaaaaagacugucauc

SEQ ID NO: 1004536 - RNA, 28 nt, Human
uacagaaagauuauguagaagauaacua

SEQ ID NO: 1004537 - RNA, 22 nt, Human
uacauacagugaccaaaauuua

SEQ ID NO: 1004538 - RNA, 20 nt, Human
uacuaccuucuucagacauu

SEQ ID NO: 1004539 - RNA, 18 nt, Human
uacuguaucuuuuuuacc

SEQ ID NO: 1004540 - RNA, 24 nt, Human
uagaaauuaggcugaaaaccucua

SEQ ID NO: 1004541 - RNA, 22 nt, Human
uaugaauuggagcaaauuccaa

SEQ ID NO: 1004542 - RNA, 22 nt, Human
ucaaaaaaaaaaaaaaaaaaaa

SEQ ID NO: 1004543 - RNA, 23 nt, Human
ucaaaaaaaaaaaaaaaaaaaaa

SEQ ID NO: 1004544 - RNA, 25 nt, Human
ucaaaaaaaaaaaaaaaaaaaaaau

SEQ ID NO: 1004545 - RNA, 21 nt, Human
ucaaaaccagccuggccaaca

SEQ ID NO: 1004546 - RNA, 22 nt, Human
ucacugcugcuacucuuuucug

SEQ ID NO: 1004547 - RNA, 24 nt, Human
ucagaaccacucuaaaagaacuaa

SEQ ID NO: 1004548 - RNA, 18 nt, Human
ucaugaggucaggagauc

SEQ ID NO: 1004549 - RNA, 24 nt, Human
ucaugaggucaggagaucgagacc

SEQ ID NO: 1004550 - RNA, 23 nt, Human
uccagccuagaugacagagcgag

SEQ ID NO: 1004551 - RNA, 24 nt, Human
uccagccuagaugacagagcgaga

SEQ ID NO: 1004552 - RNA, 23 nt, Human
uccaucucaaaaaaaaaaaaaaa

SEQ ID NO: 1004553 - RNA, 23 nt, Human
ucgcaccacugcacuccagccug

SEQ ID NO: 1004554 - RNA, 24 nt, Human
ucgcuugagcccgggagacagagg

SEQ ID NO: 1004555 - RNA, 22 nt, Human
ucucuacuaaaaauacaaaaaa

SEQ ID NO: 1004556 - RNA, 25 nt, Human
ucucuacuaaaaauauuuuuuaaaa

SEQ ID NO: 1004557 - RNA, 22 nt, Human
ugaacauuuaacccaacaacuc

SEQ ID NO: 1004558 - RNA, 19 nt, Human
ugaauuggagcaaauucca

SEQ ID NO: 1004559 - RNA, 19 nt, Human
ugacaaagacuuuaaaaga

SEQ ID NO: 1004560 - RNA, 22 nt, Human
ugacacacuacauacagggaaa

SEQ ID NO: 1004561 - RNA, 21 nt, Human
ugaccaaaauuuaaaaggugg

SEQ ID NO: 1004562 - RNA, 19 nt, Human
ugaccaugaacauuuaacc

SEQ ID NO: 1004563 - RNA, 20 nt, Human
ugaccaugaacauuuaaccc

SEQ ID NO: 1004564 - RNA, 21 nt, Human
ugaccaugaacauuuaaccca

SEQ ID NO: 1004565 - RNA, 22 nt, Human
ugagaaggauauaaaaguuugu

SEQ ID NO: 1004566 - RNA, 21 nt, Human
ugagaauacaaggaugagcug

SEQ ID NO: 1004567 - RNA, 23 nt, Human
ugagaauacaaggaugagcugca

SEQ ID NO: 1004568 - RNA, 18 nt, Human
ugagaucacaccacugca

SEQ ID NO: 1004569 - RNA, 24 nt, Human
ugagaucacaccacugcacuccag

SEQ ID NO: 1004570 - RNA, 24 nt, Human
ugagaucgcaccacugcacuccag

SEQ ID NO: 1004571 - RNA, 24 nt, Human
ugagcccgggagacagaggcugca

SEQ ID NO: 1004572 - RNA, 22 nt, Human
ugagcugagaucgcaccacugc

SEQ ID NO: 1004573 - RNA, 21 nt, Human
ugagcugauauuaagaccuca

SEQ ID NO: 1004574 - RNA, 19 nt, Human
ugaggaaaaugcaugagga

SEQ ID NO: 1004575 - RNA, 20 nt, Human
ugaggcaagagaaucgcuug

SEQ ID NO: 1004576 - RNA, 24 nt, Human
ugaggcaagagaaucgcuugagcc

SEQ ID NO: 1004577 - RNA, 25 nt, Human
ugaggcaagagaaucgcuugagccc

SEQ ID NO: 1004578 - RNA, 23 nt, Human
ugaggccaggaguucaaaaccag

SEQ ID NO: 1004579 - RNA, 24 nt, Human
ugaggccaggcacgguggcucaug

SEQ ID NO: 1004580 - RNA, 23 nt, Human
ugagguggguggaucacuugagg

SEQ ID NO: 1004581 - RNA, 24 nt, Human
ugagguggguggaucacuugaggc

SEQ ID NO: 1004582 - RNA, 26 nt, Human
ugagguggguggaucacuugaggcca

SEQ ID NO: 1004583 - RNA, 23 nt, Human
ugccuguaaucccagcacuuugg

SEQ ID NO: 1004584 - RNA, 24 nt, Human
ugccuguaaucccagcuacucagg

SEQ ID NO: 1004585 - RNA, 19 nt, Human
ugccuugaguguccucagc

SEQ ID NO: 1004586 - RNA, 24 nt, Human
ugcgcugguccuaauucacauuca

SEQ ID NO: 1004587 - RNA, 24 nt, Human
uggaaggccgaggcggguggauca

SEQ ID NO: 1004588 - RNA, 24 nt, Human
uggaucacuugaggccaggaguuc

SEQ ID NO: 1004589 - RNA, 27 nt, Human
uggaucacuugaggccaggaguucaaa

SEQ ID NO: 1004590 - RNA, 24 nt, Human
uggccaaaauggugaaacccuguc

SEQ ID NO: 1004591 - RNA, 19 nt, Human
uggcccagaugcuugcacu

SEQ ID NO: 1004592 - RNA, 24 nt, Human
uggcucaugccuguaaucccagca

SEQ ID NO: 1004593 - RNA, 19 nt, Human
uggcuuauuuuuuguaugg

SEQ ID NO: 1004594 - RNA, 20 nt, Human
uggcuuauuuuuuguauggu

SEQ ID NO: 1004595 - RNA, 19 nt, Human
ugggacgacacagacaaca

SEQ ID NO: 1004596 - RNA, 20 nt, Human
ugggaggcugaggugggugg

SEQ ID NO: 1004597 - RNA, 23 nt, Human
ugggaggcugagguggguggauc

SEQ ID NO: 1004598 - RNA, 24 nt, Human
ugggaggcugagguggguggauca

SEQ ID NO: 1004599 - RNA, 24 nt, Human
uggguggaucacuugaggccagga

SEQ ID NO: 1004600 - RNA, 21 nt, Human
uggugcaugccuguaauccca

SEQ ID NO: 1004601 - RNA, 22 nt, Human
uggugcaugccuguaaucccag

SEQ ID NO: 1004602 - RNA, 24 nt, Human
ugguggugcaugccuguaauccca

SEQ ID NO: 1004603 - RNA, 20 nt, Human
uguagcaggcuacacaccag

SEQ ID NO: 1004604 - RNA, 19 nt, Human
ugucaacuaaaaauacuac

SEQ ID NO: 1004605 - RNA, 24 nt, Human
uguuggcaugcaccuguaguccua

SEQ ID NO: 1004606 - RNA, 28 nt, Human
uuaaaagagacauuauaaaaauacucaa

SEQ ID NO: 1004607 - RNA, 22 nt, Human
uuagccgggcguguuggcaugc

SEQ ID NO: 1004608 - RNA, 21 nt, Human
uuagcugggcugugguggugc

SEQ ID NO: 1004609 - RNA, 25 nt, Human
uuagcugggcugugguggugcaugc

SEQ ID NO: 1004610 - RNA, 18 nt, Human
uuccagacuaccuaacug

SEQ ID NO: 1004611 - RNA, 22 nt, Human
uucuuuuuggugguucugugga

SEQ ID NO: 1004612 - RNA, 18 nt, Human
uugcagugagcugagauc

SEQ ID NO: 1004613 - RNA, 19 nt, Human
uugcagugagcugagaucg

SEQ ID NO: 1004614 - RNA, 22 nt, Human
uugcagugagcugagaucgcac

SEQ ID NO: 1004615 - RNA, 25 nt, Human
uuggaaggccgaggcggguggauca

SEQ ID NO: 1004616 - RNA, 21 nt, Human
uuggauacaaauaaaacagag

SEQ ID NO: 1004617 - RNA, 25 nt, Human
uugggaggcugagguggguggauca

SEQ ID NO: 1004618 - RNA, 19 nt, Human
uuuacuguaucuuuuuuac

SEQ ID NO: 1004619 - RNA, 26 nt, Human
uuuacuguaucuuuuuuaccauugaa

SEQ ID NO: 1004620 - RNA, 20 nt, Human
uuuauccauuuccaaugaga

SEQ ID NO: 1004621 - RNA, 23 nt, Human
uuugcauuuucucccauuuuugu

SEQ ID NO: 1004622 - RNA, 23 nt, Human
aaaaaaaaaaaaaagggaaaaag

SEQ ID NO: 1004623 - RNA, 21 nt, Human
aaaaaaaccuucuaucauauc

SEQ ID NO: 1004624 - RNA, 18 nt, Human
aaaaaagcuaaucuuaga

SEQ ID NO: 1004625 - RNA, 24 nt, Human
aaaaaauccauuuuuuucuucuca

SEQ ID NO: 1004626 - RNA, 24 nt, Human
aaaacaaaaaacaacaacaaaaaa

SEQ ID NO: 1004627 - RNA, 23 nt, Human
aaaacaaaaacaaaaaacaacaa

SEQ ID NO: 1004628 - RNA, 26 nt, Human
aaaacaaaaacaaaaacaaaaaacaa

SEQ ID NO: 1004629 - RNA, 27 nt, Human
aaaacaaaagcagaagccagagucaga

SEQ ID NO: 1004630 - RNA, 24 nt, Human
aaaacagaccagaguuugugcaga

SEQ ID NO: 1004631 - RNA, 20 nt, Human
aaaauacaaaaacauuagcc

SEQ ID NO: 1004632 - RNA, 25 nt, Human
aaacaaaaaacaacaacaaaaaaca

SEQ ID NO: 1004633 - RNA, 26 nt, Human
aaacaaaaaacaacaacaaaaaacaa

SEQ ID NO: 1004634 - RNA, 23 nt, Human
aaacaaaaacaaaaaacaacaac

SEQ ID NO: 1004635 - RNA, 25 nt, Human
aaacaaaaacaaaaaacaacaacaa

SEQ ID NO: 1004636 - RNA, 19 nt, Human
aaacaaaagcagaagccag

SEQ ID NO: 1004637 - RNA, 20 nt, Human
aaacaaaagcagaagccaga

SEQ ID NO: 1004638 - RNA, 26 nt, Human
aaacaaacaaaccaacacuggagggg

SEQ ID NO: 1004639 - RNA, 23 nt, Human
aaacaaaguaagccacaacccau

SEQ ID NO: 1004640 - RNA, 20 nt, Human
aaacaaaugcaaaaacaaua

SEQ ID NO: 1004641 - RNA, 25 nt, Human
aaacaaaugcaaaaacaauaccccu

SEQ ID NO: 1004642 - RNA, 22 nt, Human
aaacaacaacaaaaaacaacaa

SEQ ID NO: 1004643 - RNA, 26 nt, Human
aaacaacaacaaaaaacaacaacaaa

SEQ ID NO: 1004644 - RNA, 21 nt, Human
aaacaacaagaucuuagaacc

SEQ ID NO: 1004645 - RNA, 25 nt, Human
aaacagaccagaguuugugcagaca

SEQ ID NO: 1004646 - RNA, 21 nt, Human
aacaaaaaacaacaacaaaaa

SEQ ID NO: 1004647 - RNA, 22 nt, Human
aacaaaaacaaaaaacaacaac

SEQ ID NO: 1004648 - RNA, 22 nt, Human
aacaaacaaaccaacacuggag

SEQ ID NO: 1004649 - RNA, 20 nt, Human
aacaaacacaauuccaaaca

SEQ ID NO: 1004650 - RNA, 19 nt, Human
aacaacaaaaaacaacaac

SEQ ID NO: 1004651 - RNA, 22 nt, Human
aacaacaacaaaaaacaacaac

SEQ ID NO: 1004652 - RNA, 27 nt, Human
aacaacaacaaaaaacaacaacaaaaa

SEQ ID NO: 1004653 - RNA, 27 nt, Human
aacaacaucacagguaagacugagaaa

SEQ ID NO: 1004654 - RNA, 19 nt, Human
aacauggcaaaaccccauc

SEQ ID NO: 1004655 - RNA, 21 nt, Human
aacauggcaaaaccccaucuc

SEQ ID NO: 1004656 - RNA, 21 nt, Human
aacauggcaaaaccccaucuc

SEQ ID NO: 1004657 - RNA, 24 nt, Human
aacucacgugcgccaaacauccga

SEQ ID NO: 1004658 - RNA, 20 nt, Human
aagaagaaaagaagaacaga

SEQ ID NO: 1004659 - RNA, 19 nt, Human
aagaccaccacuauuaacu

SEQ ID NO: 1004660 - RNA, 23 nt, Human
aagaccaccacuauuaacugaaa

SEQ ID NO: 1004661 - RNA, 23 nt, Human
aagagugggacuccgucucaaaa

SEQ ID NO: 1004662 - RNA, 20 nt, Human
aagauaaauaauuaucuccu

SEQ ID NO: 1004663 - RNA, 23 nt, Human
aagcagaagccagaggggacccc

SEQ ID NO: 1004664 - RNA, 22 nt, Human
aagcagaagccagagucagauu

SEQ ID NO: 1004665 - RNA, 26 nt, Human
aauaaaaugcaaauuuggaacccagu

SEQ ID NO: 1004666 - RNA, 24 nt, Human
aaucaccugaacccuggagucaga

SEQ ID NO: 1004667 - RNA, 22 nt, Human
aaucccuuaaaacaaaagcaga

SEQ ID NO: 1004668 - RNA, 20 nt, Human
aaugcaaaccauuaaugccu

SEQ ID NO: 1004669 - RNA, 19 nt, Human
acaacaaaaaacaacaaca

SEQ ID NO: 1004670 - RNA, 21 nt, Human
acaagagugggacuccgucuc

SEQ ID NO: 1004671 - RNA, 24 nt, Human
acaagagugggacuccgucucaaa

SEQ ID NO: 1004672 - RNA, 24 nt, Human
acacaaaaauugcacaaagccaaa

SEQ ID NO: 1004673 - RNA, 23 nt, Human
acacaaaccgugcaaaacagacc

SEQ ID NO: 1004674 - RNA, 23 nt, Human
acacuggguuuugucaucagggc

SEQ ID NO: 1004675 - RNA, 22 nt, Human
acagaaaucccaggaacucaaa

SEQ ID NO: 1004676 - RNA, 21 nt, Human
accaacuaccuagguauuaca

SEQ ID NO: 1004677 - RNA, 21 nt, Human
accauggacuccuucuccagu

SEQ ID NO: 1004678 - RNA, 24 nt, Human
accccaucucuauuaaaaauacaa

SEQ ID NO: 1004679 - RNA, 24 nt, Human
accugaggucaggaguucaagacc

SEQ ID NO: 1004680 - RNA, 24 nt, Human
acgguuaaaaaaaaaaaaaaggga

SEQ ID NO: 1004681 - RNA, 20 nt, Human
acuccccuuuucugcuccua

SEQ ID NO: 1004682 - RNA, 21 nt, Human
acugcuaccacuaccacaggc

SEQ ID NO: 1004683 - RNA, 26 nt, Human
agaaaaacaaaaacaaaaacaaaaaa

SEQ ID NO: 1004684 - RNA, 22 nt, Human
agacaagaguccaaauuuuagg

SEQ ID NO: 1004685 - RNA, 28 nt, Human
agacagaagccugugccuccaucggggg

SEQ ID NO: 1004686 - RNA, 25 nt, Human
agacagaauacacaggaucaucuuc

SEQ ID NO: 1004687 - RNA, 19 nt, Human
agagacagaauacacagga

SEQ ID NO: 1004688 - RNA, 22 nt, Human
agagcaggcuugacccuggggu

SEQ ID NO: 1004689 - RNA, 19 nt, Human
agaggcuagaaagaaggcc

SEQ ID NO: 1004690 - RNA, 25 nt, Human
agagggcuguccaggcugauccuuu

SEQ ID NO: 1004691 - RNA, 22 nt, Human
agagguuguggggagccgagau

SEQ ID NO: 1004692 - RNA, 23 nt, Human
agagguuguggggagccgagauu

SEQ ID NO: 1004693 - RNA, 24 nt, Human
agagguuguggggagccgagauug

SEQ ID NO: 1004694 - RNA, 23 nt, Human
agauuugaccauacucccucugu

SEQ ID NO: 1004695 - RNA, 24 nt, Human
agcacuuugggaggccgaggcggg

SEQ ID NO: 1004696 - RNA, 18 nt, Human
agccuggccaacauggca

SEQ ID NO: 1004697 - RNA, 24 nt, Human
agccuggccaacauggcaaaaccc

SEQ ID NO: 1004698 - RNA, 21 nt, Human
aggcaaaauaaucaccugaac

SEQ ID NO: 1004699 - RNA, 21 nt, Human
aggccccuggguagaggggag

SEQ ID NO: 1004700 - RNA, 21 nt, Human
aggccgaggcgggcggaucac

SEQ ID NO: 1004701 - RNA, 22 nt, Human
aggcgggcggaucaccugaggu

SEQ ID NO: 1004702 - RNA, 26 nt, Human
aggcgggcggaucaccugaggucagg

SEQ ID NO: 1004703 - RNA, 20 nt, Human
aggcuauaaccauuauugca

SEQ ID NO: 1004704 - RNA, 23 nt, Human
agggcagccccucuuuucaggcc

SEQ ID NO: 1004705 - RNA, 21 nt, Human
aggggcagagagaguagaggc

SEQ ID NO: 1004706 - RNA, 26 nt, Human
aguaaaguuacacaaaaauugcacaa

SEQ ID NO: 1004707 - RNA, 24 nt, Human
agucagagguuguggggagccgag

SEQ ID NO: 1004708 - RNA, 18 nt, Human
aguggaaugaugaggcug

SEQ ID NO: 1004709 - RNA, 20 nt, Human
auaaagggaaaaaaaggcac

SEQ ID NO: 1004710 - RNA, 18 nt, Human
auacacaggaucaucuuc

SEQ ID NO: 1004711 - RNA, 24 nt, Human
auaggucuccccuuuuuauuucag

SEQ ID NO: 1004712 - RNA, 23 nt, Human
aucaaccaacuaccuagguauua

SEQ ID NO: 1004713 - RNA, 24 nt, Human
aucaccugaggucaggaguucaag

SEQ ID NO: 1004714 - RNA, 20 nt, Human
aucaguguaaaucaaaugcu

SEQ ID NO: 1004715 - RNA, 24 nt, Human
aucccuuaaaacaaaagcagaagc

SEQ ID NO: 1004716 - RNA, 22 nt, Human
augaacauaacacauucuucca

SEQ ID NO: 1004717 - RNA, 25 nt, Human
augauacaggcacacagcgacaccg

SEQ ID NO: 1004718 - RNA, 20 nt, Human
augauuccagagacaaaggg

SEQ ID NO: 1004719 - RNA, 21 nt, Human
auugcacaaccaauaagcacu

SEQ ID NO: 1004720 - RNA, 23 nt, Human
auuucugcugcuaaagcugaaaa

SEQ ID NO: 1004721 - RNA, 21 nt, Human
auuugcucuuauuaaacaggu

SEQ ID NO: 1004722 - RNA, 25 nt, Human
caaaaacaaaaacaaaaaacaacaa

SEQ ID NO: 1004723 - RNA, 22 nt, Human
caaaaauugcacaaagccaaag

SEQ ID NO: 1004724 - RNA, 24 nt, Human
caaaauaaucaccugaacccugga

SEQ ID NO: 1004725 - RNA, 26 nt, Human
caaaauaauuccuaagaacacuauga

SEQ ID NO: 1004726 - RNA, 22 nt, Human
caaacaccacaccacuagucca

SEQ ID NO: 1004727 - RNA, 21 nt, Human
caaaccgugcaaaacagacca

SEQ ID NO: 1004728 - RNA, 21 nt, Human
caaauuuacaguaccaaaaua

SEQ ID NO: 1004729 - RNA, 23 nt, Human
caacaaaaaacaacaacaaaaaa

SEQ ID NO: 1004730 - RNA, 19 nt, Human
caacaacaaaaaacaacaa

SEQ ID NO: 1004731 - RNA, 23 nt, Human
caagaaaaaaauaaggagauuaa

SEQ ID NO: 1004732 - RNA, 30 nt, Human
caaguaaaguuacacaaaaauugcacaaaa

SEQ ID NO: 1004733 - RNA, 20 nt, Human
caccacaccacuaguccaac

SEQ ID NO: 1004734 - RNA, 21 nt, Human
caccacaccacuaguccaaca

SEQ ID NO: 1004735 - RNA, 22 nt, Human
caccacaccacuaguccaacaa

SEQ ID NO: 1004736 - RNA, 24 nt, Human
caccacuaguccaacaaaaagaaa

SEQ ID NO: 1004737 - RNA, 23 nt, Human
caccugaggucaggaguucaaga

SEQ ID NO: 1004738 - RNA, 24 nt, Human
cacgucuguaaucccagcacuuug

SEQ ID NO: 1004739 - RNA, 24 nt, Human
cagaaaauaacuuggacaaaccac

SEQ ID NO: 1004740 - RNA, 19 nt, Human
cagagcacacucaggaauu

SEQ ID NO: 1004741 - RNA, 20 nt, Human
cagagugaugugaaccugug

SEQ ID NO: 1004742 - RNA, 22 nt, Human
cagcacuuugggaggccgaggc

SEQ ID NO: 1004743 - RNA, 24 nt, Human
cagcacuuugggaggccgaggcgg

SEQ ID NO: 1004744 - RNA, 20 nt, Human
cagccccucuuuucaggccc

SEQ ID NO: 1004745 - RNA, 21 nt, Human
cagcuugugucugccuuggcg

SEQ ID NO: 1004746 - RNA, 19 nt, Human
caggcccaggagaggggcc

SEQ ID NO: 1004747 - RNA, 23 nt, Human
caggccccuggguagaggggagg

SEQ ID NO: 1004748 - RNA, 23 nt, Human
caguaccaaaauaaugcauuuau

SEQ ID NO: 1004749 - RNA, 22 nt, Human
cagucuucuaagaaaagguaau

SEQ ID NO: 1004750 - RNA, 23 nt, Human
cagugccauagaggcuagaaaga

SEQ ID NO: 1004751 - RNA, 19 nt, Human
cauacaaacucacgugcgc

SEQ ID NO: 1004752 - RNA, 21 nt, Human
cauccaacccuguggcagagc

SEQ ID NO: 1004753 - RNA, 21 nt, Human
cauuaaaacgcauuugggagu

SEQ ID NO: 1004754 - RNA, 24 nt, Human
cauucagagacugucuccaaacac

SEQ ID NO: 1004755 - RNA, 23 nt, Human
ccaagcuguuuccugaaagaacu

SEQ ID NO: 1004756 - RNA, 19 nt, Human
ccacuacacucuaguuggg

SEQ ID NO: 1004757 - RNA, 19 nt, Human
ccacuacacucuaguuggg

SEQ ID NO: 1004758 - RNA, 20 nt, Human
ccacuacacucuaguugggc

SEQ ID NO: 1004759 - RNA, 23 nt, Human
ccacuacacucuaguugggcgac

SEQ ID NO: 1004760 - RNA, 24 nt, Human
ccacuacacucuaguugggcgaca

SEQ ID NO: 1004761 - RNA, 24 nt, Human
ccagagguaaggaaucacacaaau

SEQ ID NO: 1004762 - RNA, 18 nt, Human
ccaguaguaauaaacuca

SEQ ID NO: 1004763 - RNA, 22 nt, Human
ccaucccauuccccaagaaccu

SEQ ID NO: 1004764 - RNA, 22 nt, Human
ccaucuugaugaaaaaagcuaa

SEQ ID NO: 1004765 - RNA, 19 nt, Human
ccccagggacuugcccaag

SEQ ID NO: 1004766 - RNA, 21 nt, Human
ccccaguuagcacuccccuuu

SEQ ID NO: 1004767 - RNA, 20 nt, Human
cccccagcugucucccuaga

SEQ ID NO: 1004768 - RNA, 20 nt, Human
ccccucagugccauagaggc

SEQ ID NO: 1004769 - RNA, 19 nt, Human
ccccucuuuucaggccccu

SEQ ID NO: 1004770 - RNA, 20 nt, Human
ccccuggguagaggggaggu

SEQ ID NO: 1004771 - RNA, 22 nt, Human
cccguggagacuccuucuuacc

SEQ ID NO: 1004772 - RNA, 20 nt, Human
cccucuagcauguuuccuga

SEQ ID NO: 1004773 - RNA, 19 nt, Human
ccuagccagccccagggac

SEQ ID NO: 1004774 - RNA, 25 nt, Human
ccucuagcucgaauuuuucucuuca

SEQ ID NO: 1004775 - RNA, 22 nt, Human
ccucuugcugacaaaacagagc

SEQ ID NO: 1004776 - RNA, 20 nt, Human
ccucuuuucaggccccuggg

SEQ ID NO: 1004777 - RNA, 24 nt, Human
ccuggccaacauggcaaaacccca

SEQ ID NO: 1004778 - RNA, 20 nt, Human
cgagacagaagccugugccu

SEQ ID NO: 1004779 - RNA, 24 nt, Human
cgagauugugccacuacacucuag

SEQ ID NO: 1004780 - RNA, 20 nt, Human
cgaggcgggcggaucaccug

SEQ ID NO: 1004781 - RNA, 24 nt, Human
cgaggcgggcggaucaccugaggu

SEQ ID NO: 1004782 - RNA, 19 nt, Human
cgaugaaacuaguggaggc

SEQ ID NO: 1004783 - RNA, 19 nt, Human
cgccaaacauccgagacag

SEQ ID NO: 1004784 - RNA, 26 nt, Human
cgccuuugggggagggagcuaggcau

SEQ ID NO: 1004785 - RNA, 24 nt, Human
cggaucaccugaggucaggaguuc

SEQ ID NO: 1004786 - RNA, 23 nt, Human
cgucuguaaucccagcacuuugg

SEQ ID NO: 1004787 - RNA, 27 nt, Human
cgugcaaaacagaccagaguuugugca

SEQ ID NO: 1004788 - RNA, 23 nt, Human
cuaccccuccccuuaaaaagaac

SEQ ID NO: 1004789 - RNA, 25 nt, Human
cuacuccuccaccagccggcgcacc

SEQ ID NO: 1004790 - RNA, 24 nt, Human
cucacgucuguaaucccagcacuu

SEQ ID NO: 1004791 - RNA, 19 nt, Human
cuccgucucaaaaaaaaaa

SEQ ID NO: 1004792 - RNA, 19 nt, Human
cuccugggccugccgggcu

SEQ ID NO: 1004793 - RNA, 24 nt, Human
cuccugggccugccgggcuuuucc

SEQ ID NO: 1004794 - RNA, 20 nt, Human
cucuauuaaaaauacaaaaa

SEQ ID NO: 1004795 - RNA, 22 nt, Human
cucucugcaucucucuccuccc

SEQ ID NO: 1004796 - RNA, 21 nt, Human
cucugggguuuggagagaauu

SEQ ID NO: 1004797 - RNA, 28 nt, Human
cugaaacgucacacuacuaggaccgcac

SEQ ID NO: 1004798 - RNA, 22 nt, Human
cugaagccacccucuagcaugu

SEQ ID NO: 1004799 - RNA, 18 nt, Human
cugaaugaccaucacuga

SEQ ID NO: 1004800 - RNA, 21 nt, Human
cugauccuaaacaacaucaca

SEQ ID NO: 1004801 - RNA, 24 nt, Human
cugauccuaaacaacaucacaggu

SEQ ID NO: 1004802 - RNA, 25 nt, Human
cugcuaaagcugaaaaagauugcau

SEQ ID NO: 1004803 - RNA, 22 nt, Human
cugcuucuuuggccccaauuuu

SEQ ID NO: 1004804 - RNA, 23 nt, Human
cuggccaacauggcaaaacccca

SEQ ID NO: 1004805 - RNA, 21 nt, Human
cuguaaucccagcacuuuggg

SEQ ID NO: 1004806 - RNA, 18 nt, Human
cuucugaagccacccucu

SEQ ID NO: 1004807 - RNA, 20 nt, Human
cuuggacuugacagggaagu

SEQ ID NO: 1004808 - RNA, 20 nt, Human
cuuuuuacuccacuugguua

SEQ ID NO: 1004809 - RNA, 27 nt, Human
gaacauaacacauucuuccauguccuu

SEQ ID NO: 1004810 - RNA, 22 nt, Human
gacaccauggacuccuucucca

SEQ ID NO: 1004811 - RNA, 27 nt, Human
gacuacuccuccaccagccggcgcacc

SEQ ID NO: 1004812 - RNA, 19 nt, Human
gagacugucuccaaacacc

SEQ ID NO: 1004813 - RNA, 18 nt, Human
gagccgagauugugccac

SEQ ID NO: 1004814 - RNA, 24 nt, Human
gaucaaccaacuaccuagguauua

SEQ ID NO: 1004815 - RNA, 21 nt, Human
gaucaccugaggucaggaguu

SEQ ID NO: 1004816 - RNA, 23 nt, Human
gaucaccugaggucaggaguuca

SEQ ID NO: 1004817 - RNA, 24 nt, Human
gaucaccugaggucaggaguucaa

SEQ ID NO: 1004818 - RNA, 24 nt, Human
gaugcugaauuaaaaaacaaacaa

SEQ ID NO: 1004819 - RNA, 18 nt, Human
gcaaaauauacugugacc

SEQ ID NO: 1004820 - RNA, 23 nt, Human
gcagagcaggcuugacccugggg

SEQ ID NO: 1004821 - RNA, 19 nt, Human
gcaggagggcagccccucu

SEQ ID NO: 1004822 - RNA, 22 nt, Human
gcaggugccuagcacucuuugc

SEQ ID NO: 1004823 - RNA, 21 nt, Human
gcccaggagaggggccugauc

SEQ ID NO: 1004824 - RNA, 20 nt, Human
gcgggugucuauaaucccag

SEQ ID NO: 1004825 - RNA, 23 nt, Human
gcuccaucggacuacuccuccac

SEQ ID NO: 1004826 - RNA, 23 nt, Human
gcuguucagugcugcgcucuuag

SEQ ID NO: 1004827 - RNA, 23 nt, Human
gcuguuggcuucugguccuccca

SEQ ID NO: 1004828 - RNA, 23 nt, Human
ggagugguggcucacgucuguaa

SEQ ID NO: 1004829 - RNA, 23 nt, Human
ggaucaccugaggucaggaguuc

SEQ ID NO: 1004830 - RNA, 25 nt, Human
ggaucaccugaggucaggaguucaa

SEQ ID NO: 1004831 - RNA, 18 nt, Human
ggcaguggcugccggggu

SEQ ID NO: 1004832 - RNA, 21 nt, Human
ggcggaucaccugaggucagg

SEQ ID NO: 1004833 - RNA, 21 nt, Human
ggcucacgucuguaaucccag

SEQ ID NO: 1004834 - RNA, 22 nt, Human
ggcuucugguccucccaggcau

SEQ ID NO: 1004835 - RNA, 22 nt, Human
gggaaaaaaaggcacacaaacc

SEQ ID NO: 1004836 - RNA, 24 nt, Human
ggugagucuuaaauccucuugcug

SEQ ID NO: 1004837 - RNA, 24 nt, Human
gguggcucacgucuguaaucccag

SEQ ID NO: 1004838 - RNA, 23 nt, Human
guggcucacgucuguaaucccag

SEQ ID NO: 1004839 - RNA, 19 nt, Human
guuucuuuuccaauuuuuu

SEQ ID NO: 1004840 - RNA, 20 nt, Human
uaaaaaaacaugggguccau

SEQ ID NO: 1004841 - RNA, 23 nt, Human
uaaaaaaauccauuuuuuucuuc

SEQ ID NO: 1004842 - RNA, 19 nt, Human
uaaaaaacaaacaaaccaa

SEQ ID NO: 1004843 - RNA, 22 nt, Human
uaaaaacacuagccugugaaau

SEQ ID NO: 1004844 - RNA, 18 nt, Human
uaaaacaaaagcagaagc

SEQ ID NO: 1004845 - RNA, 18 nt, Human
uaaaacaaaagcagaagc

SEQ ID NO: 1004846 - RNA, 20 nt, Human
uaaaacaaaagcagaagcca

SEQ ID NO: 1004847 - RNA, 19 nt, Human
uaaacagucuguacaguua

SEQ ID NO: 1004848 - RNA, 19 nt, Human
uaacucaccaaaacguaac

SEQ ID NO: 1004849 - RNA, 23 nt, Human
uaagaccaccacuauuaacugaa

SEQ ID NO: 1004850 - RNA, 22 nt, Human
uaagacugagaaaaacaaaaac

SEQ ID NO: 1004851 - RNA, 19 nt, Human
uaccacagccaagcuguuu

SEQ ID NO: 1004852 - RNA, 23 nt, Human
uaccacaggccaggaucuuucca

SEQ ID NO: 1004853 - RNA, 21 nt, Human
uacuuuaaaugcacugguuua

SEQ ID NO: 1004854 - RNA, 20 nt, Human
uagaaagaaggccccuucac

SEQ ID NO: 1004855 - RNA, 24 nt, Human
uagaaggucaguauuuuauaaaga

SEQ ID NO: 1004856 - RNA, 19 nt, Human
uagcacuccccuuuucugc

SEQ ID NO: 1004857 - RNA, 19 nt, Human
uaucaagcuacauaaacuc

SEQ ID NO: 1004858 - RNA, 28 nt, Human
uauugcacaaccaauaagcacugaaaca

SEQ ID NO: 1004859 - RNA, 20 nt, Human
ucaccauccaacccuguggc

SEQ ID NO: 1004860 - RNA, 21 nt, Human
ucaccuucucccagaaccagu

SEQ ID NO: 1004861 - RNA, 21 nt, Human
ucaguacuuuuguauauucua

SEQ ID NO: 1004862 - RNA, 22 nt, Human
ucaguacuuuuguauauucuau

SEQ ID NO: 1004863 - RNA, 20 nt, Human
uccagauuaaaaaguaaaaa

SEQ ID NO: 1004864 - RNA, 26 nt, Human
ucccccagcugucucccuagagagug

SEQ ID NO: 1004865 - RNA, 22 nt, Human
ucccccaguuagcacuccccuu

SEQ ID NO: 1004866 - RNA, 24 nt, Human
ucccccaguuagcacuccccuuuu

SEQ ID NO: 1004867 - RNA, 30 nt, Human
ucccccaguuagcacuccccuuuucugcuu

SEQ ID NO: 1004868 - RNA, 23 nt, Human
uccccggggaacgcagggcucca

SEQ ID NO: 1004869 - RNA, 23 nt, Human
uccgucucaaaaaaaaaaaaaaa

SEQ ID NO: 1004870 - RNA, 18 nt, Human
uccuauagaugcaggaaa

SEQ ID NO: 1004871 - RNA, 21 nt, Human
ucuauaaucccagcugcuugg

SEQ ID NO: 1004872 - RNA, 22 nt, Human
ucuaucauauccucuuuauuuc

SEQ ID NO: 1004873 - RNA, 25 nt, Human
ucuccaaacaccacaccacuagucc

SEQ ID NO: 1004874 - RNA, 20 nt, Human
ucuccaguugcugggccaaa

SEQ ID NO: 1004875 - RNA, 21 nt, Human
ucucuauuaaaaauacaaaaa

SEQ ID NO: 1004876 - RNA, 18 nt, Human
ucucucaccuucucccag

SEQ ID NO: 1004877 - RNA, 19 nt, Human
ucugaagccacccucuagc

SEQ ID NO: 1004878 - RNA, 20 nt, Human
ucugaagccacccucuagca

SEQ ID NO: 1004879 - RNA, 21 nt, Human
ucugcaucucucuccucccca

SEQ ID NO: 1004880 - RNA, 23 nt, Human
ucugcaucucucuccuccccaca

SEQ ID NO: 1004881 - RNA, 25 nt, Human
ucuucaaugaacuguuuuacuuaaa

SEQ ID NO: 1004882 - RNA, 20 nt, Human
ugaaaaaauuccucuauaaa

SEQ ID NO: 1004883 - RNA, 24 nt, Human
ugaaaauaagaccaccacuauuaa

SEQ ID NO: 1004884 - RNA, 21 nt, Human
ugaaugcaaaccauuaaugcc

SEQ ID NO: 1004885 - RNA, 22 nt, Human
ugagaaaaacaaaaacaaaaac

SEQ ID NO: 1004886 - RNA, 21 nt, Human
ugagaaaacugcuaccacuac

SEQ ID NO: 1004887 - RNA, 23 nt, Human
ugagaacaccccuguaaagagcc

SEQ ID NO: 1004888 - RNA, 24 nt, Human
ugagaacaccccuguaaagagccu

SEQ ID NO: 1004889 - RNA, 20 nt, Human
ugaggcaaaauaaucaccug

SEQ ID NO: 1004890 - RNA, 24 nt, Human
ugaggcaaaauaaucaccugaacc

SEQ ID NO: 1004891 - RNA, 20 nt, Human
ugauacaggcacacagcgac

SEQ ID NO: 1004892 - RNA, 20 nt, Human
ugaugugaaccuguguauac

SEQ ID NO: 1004893 - RNA, 20 nt, Human
ugcaaauacauagauuucaa

SEQ ID NO: 1004894 - RNA, 25 nt, Human
ugcacgccacugccgaggucuggac

SEQ ID NO: 1004895 - RNA, 19 nt, Human
ugcagagacagaauacaca

SEQ ID NO: 1004896 - RNA, 19 nt, Human
ugcauaaagggaaaaaaag

SEQ ID NO: 1004897 - RNA, 22 nt, Human
ugcuaugauuacaagaugaaca

SEQ ID NO: 1004898 - RNA, 21 nt, Human
ugcugcuaaagcugaaaaaga

SEQ ID NO: 1004899 - RNA, 21 nt, Human
ugcugugaaauuuaaaccaau

SEQ ID NO: 1004900 - RNA, 22 nt, Human
ugcuucuuuggccccaauuuuu

SEQ ID NO: 1004901 - RNA, 18 nt, Human
uggaaacaaaguaagcca

SEQ ID NO: 1004902 - RNA, 18 nt, Human
uggagagaauugggagug

SEQ ID NO: 1004903 - RNA, 18 nt, Human
uggcagagcacacucagg

SEQ ID NO: 1004904 - RNA, 27 nt, Human
uggcagagcaggcuugacccugggguu

SEQ ID NO: 1004905 - RNA, 18 nt, Human
uggcgcaggagggcagcc

SEQ ID NO: 1004906 - RNA, 24 nt, Human
uggcgggugucuauaaucccagcu

SEQ ID NO: 1004907 - RNA, 24 nt, Human
uggcucacgucuguaaucccagca

SEQ ID NO: 1004908 - RNA, 19 nt, Human
ugggaggccgaggcgggcg

SEQ ID NO: 1004909 - RNA, 24 nt, Human
ugggaggccgaggcgggcggauca

SEQ ID NO: 1004910 - RNA, 24 nt, Human
ugggaggcugaggcaaaauaauca

SEQ ID NO: 1004911 - RNA, 21 nt, Human
ugggcgacaagagugggacuc

SEQ ID NO: 1004912 - RNA, 19 nt, Human
uggguauaacucaccaaaa

SEQ ID NO: 1004913 - RNA, 18 nt, Human
uggugaucaagaaacggu

SEQ ID NO: 1004914 - RNA, 24 nt, Human
ugguggcucacgucuguaauccca

SEQ ID NO: 1004915 - RNA, 19 nt, Human
ugguggucuaguuuggucu

SEQ ID NO: 1004916 - RNA, 21 nt, Human
ugucaaaagauuugaccauac

SEQ ID NO: 1004917 - RNA, 23 nt, Human
ugucuauaaucccagcugcuugg

SEQ ID NO: 1004918 - RNA, 24 nt, Human
ugucuauaaucccagcugcuuggg

SEQ ID NO: 1004919 - RNA, 22 nt, Human
uguuugcccugggugagucuua

SEQ ID NO: 1004920 - RNA, 21 nt, Human
uuaaccuuuuacuggacugcu

SEQ ID NO: 1004921 - RNA, 18 nt, Human
uuagaacccuaccccucc

SEQ ID NO: 1004922 - RNA, 24 nt, Human
uuagcacuccccuuuucugcuccu

SEQ ID NO: 1004923 - RNA, 24 nt, Human
uucacagauggacaaguggaggcc

SEQ ID NO: 1004924 - RNA, 18 nt, Human
uuccugaaagaacugcag

SEQ ID NO: 1004925 - RNA, 23 nt, Human
uuccugaacuagacaaauuucug

SEQ ID NO: 1004926 - RNA, 20 nt, Human
uucgucaguauuucucuggg

SEQ ID NO: 1004927 - RNA, 26 nt, Human
uucucugggguuuggagagaauuggg

SEQ ID NO: 1004928 - RNA, 22 nt, Human
uugaaaauacuuuucuguagca

SEQ ID NO: 1004929 - RNA, 20 nt, Human
uugcacaaccaauaagcacu

SEQ ID NO: 1004930 - RNA, 18 nt, Human
uugcugggccaaacuuuc

SEQ ID NO: 1004931 - RNA, 25 nt, Human
uugggaggccgaggcgggcggauca

SEQ ID NO: 1004932 - RNA, 25 nt, Human
uugggaggcugaggcaaaauaauca

SEQ ID NO: 1004933 - RNA, 24 nt, Human
uuuauauucaguacauagcucauu

SEQ ID NO: 1004934 - RNA, 24 nt, Human
uuuguagucaacugaauuuuaaug

SEQ ID NO: 1004935 - RNA, 23 nt, Human
uuuugugguuggcuugcguugcu

SEQ ID NO: 1004936 - RNA, 23 nt, Human
aaagucccuccuggggaccacau

SEQ ID NO: 1004937 - RNA, 25 nt, Human
acacuuuuauauuaaaagcuagggg

SEQ ID NO: 1004938 - RNA, 21 nt, Human
acauguccucccgcugguacc

SEQ ID NO: 1004939 - RNA, 24 nt, Human
accccguccuacccuccuggcccu

SEQ ID NO: 1004940 - RNA, 24 nt, Human
aucuucuccucauucuuuuugucg

SEQ ID NO: 1004941 - RNA, 22 nt, Human
cauuucaaagucccuccugggg

SEQ ID NO: 1004942 - RNA, 20 nt, Human
ccacaucuccaaaguuggcc

SEQ ID NO: 1004943 - RNA, 18 nt, Human
ccagcaggaggagcuccu

SEQ ID NO: 1004944 - RNA, 23 nt, Human
ccaggauccucucauugcagucc

SEQ ID NO: 1004945 - RNA, 22 nt, Human
cccccagaugccuggcgacugg

SEQ ID NO: 1004946 - RNA, 22 nt, Human
ccguccuacccuccuggcccug

SEQ ID NO: 1004947 - RNA, 23 nt, Human
ccuggcccugccugccugccagc

SEQ ID NO: 1004948 - RNA, 26 nt, Human
ccuggcccugccugccugccagcacc

SEQ ID NO: 1004949 - RNA, 22 nt, Human
ccuucauguuguugaguuccau

SEQ ID NO: 1004950 - RNA, 19 nt, Human
cucauucaggucugcgaug

SEQ ID NO: 1004951 - RNA, 21 nt, Human
cuccuggcccugccugccugc

SEQ ID NO: 1004952 - RNA, 21 nt, Human
cugccugccugccagcaccug

SEQ ID NO: 1004953 - RNA, 21 nt, Human
cugugagaccccguccuaccc

SEQ ID NO: 1004954 - RNA, 20 nt, Human
cuucaggggcuccagagccc

SEQ ID NO: 1004955 - RNA, 20 nt, Human
gcagguacuccucagccaag

SEQ ID NO: 1004956 - RNA, 20 nt, Human
ggacauuggcccuggccccc

SEQ ID NO: 1004957 - RNA, 26 nt, Human
ggcccuggccccccaccugugagacc

SEQ ID NO: 1004958 - RNA, 18 nt, Human
uaccgcagcucauucagg

SEQ ID NO: 1004959 - RNA, 24 nt, Human
uaguuccuggguggaaucugugcc

SEQ ID NO: 1004960 - RNA, 24 nt, Human
ucauauuucuccucagcucucaug

SEQ ID NO: 1004961 - RNA, 19 nt, Human
uccuggguggaaucugugc

SEQ ID NO: 1004962 - RNA, 19 nt, Human
uccuuguuggucuucuccu

SEQ ID NO: 1004963 - RNA, 22 nt, Human
ucucaggguguccagcuguggg

SEQ ID NO: 1004964 - RNA, 18 nt, Human
ucuuaagagccaggguua

SEQ ID NO: 1004965 - RNA, 22 nt, Human
ugagaccccguccuacccuccu

SEQ ID NO: 1004966 - RNA, 19 nt, Human
ugccgggucaucuuaagag

SEQ ID NO: 1004967 - RNA, 23 nt, Human
ugccgggucaucuuaagagccag

SEQ ID NO: 1004968 - RNA, 20 nt, Human
uggcagugcgaaaggggugc

SEQ ID NO: 1004969 - RNA, 24 nt, Human
uggcccugccugccugccagcacc

SEQ ID NO: 1004970 - RNA, 24 nt, Human
ugggaagcugugguagcguacagc

SEQ ID NO: 1004971 - RNA, 25 nt, Human
uuaagagccaggguuaacuucacag

SEQ ID NO: 1004972 - RNA, 20 nt, Human
uucacaggguccucccccca

SEQ ID NO: 1004973 - RNA, 23 nt, Human
uucgucuauggucacuccugaag

SEQ ID NO: 1004974 - RNA, 19 nt, Human
uucucuuucuugagcaggg

SEQ ID NO: 1004975 - RNA, 20 nt, Human
uucucuuucuugagcaggga

SEQ ID NO: 1004976 - RNA, 25 nt, Human
uugcgaaccuccucguagcuggcuc

SEQ ID NO: 1004977 - RNA, 22 nt, Human
uuuuuuuuuuuuuuuuuuucag

SEQ ID NO: 1004978 - RNA, 26 nt, Human
aagggaccaagaugaggaccaaggug

SEQ ID NO: 1004979 - RNA, 23 nt, Human
acaaaacagcagcuggaaagaga

SEQ ID NO: 1004980 - RNA, 19 nt, Human
accaagguguggcugccug

SEQ ID NO: 1004981 - RNA, 20 nt, Human
agacaggagggaggcagcag

SEQ ID NO: 1004982 - RNA, 20 nt, Human
agacaggagggaggcagcag

SEQ ID NO: 1004983 - RNA, 22 nt, Human
agacaggagggaggcagcagga

SEQ ID NO: 1004984 - RNA, 22 nt, Human
agcagcaccaccauccucugau

SEQ ID NO: 1004985 - RNA, 18 nt, Human
aggcccuagaaggaggga

SEQ ID NO: 1004986 - RNA, 24 nt, Human
aguuugggcuucuuuuuucuuuuu

SEQ ID NO: 1004987 - RNA, 27 nt, Human
caagaugaggaccaagguguggcugcc

SEQ ID NO: 1004988 - RNA, 18 nt, Human
cagacaggagggaggcag

SEQ ID NO: 1004989 - RNA, 18 nt, Human
cagcaggaagggcuggca

SEQ ID NO: 1004990 - RNA, 21 nt, Human
caguccgccagcucggaagca

SEQ ID NO: 1004991 - RNA, 23 nt, Human
caguccgccagcucggaagcacu

SEQ ID NO: 1004992 - RNA, 23 nt, Human
ccggaucagcagcagcaccacca

SEQ ID NO: 1004993 - RNA, 22 nt, Human
cuaagcaugggccccaggagcc

SEQ ID NO: 1004994 - RNA, 22 nt, Human
cugaguucuauuggggucccac

SEQ ID NO: 1004995 - RNA, 29 nt, Human
cuucuuuuuucuuuuucuuuuuacaaaaa

SEQ ID NO: 1004996 - RNA, 23 nt, Human
gcagcaggaagggcuggcaugga

SEQ ID NO: 1004997 - RNA, 18 nt, Human
ggcaguccgccagcucgg

SEQ ID NO: 1004998 - RNA, 19 nt, Human
ggcucuaagcaugggcccc

SEQ ID NO: 1004999 - RNA, 24 nt, Human
gggaugaaaggcguaugggaggga

SEQ ID NO: 1005000 - RNA, 23 nt, Human
uaagcaugggccccaggagccag

SEQ ID NO: 1005001 - RNA, 26 nt, Human
ucccacgcgggcaagggaaccaggac

SEQ ID NO: 1005002 - RNA, 19 nt, Human
uccccggaucagcagcagc

SEQ ID NO: 1005003 - RNA, 22 nt, Human
uccccggaucagcagcagcacc

SEQ ID NO: 1005004 - RNA, 22 nt, Human
ugaaaggcguaugggagggaag

SEQ ID NO: 1005005 - RNA, 19 nt, Human
ugaggaccaagguguggcu

SEQ ID NO: 1005006 - RNA, 19 nt, Human
uggaagggaccaagaugag

SEQ ID NO: 1005007 - RNA, 24 nt, Human
uggaagggaccaagaugaggacca

SEQ ID NO: 1005008 - RNA, 23 nt, Human
uggcagacgagccaggcacgagg

SEQ ID NO: 1005009 - RNA, 22 nt, Human
uggccccugggcaguccgccag

SEQ ID NO: 1005010 - RNA, 18 nt, Human
uggccccugggcaguccu

SEQ ID NO: 1005011 - RNA, 19 nt, Human
ugggagggaagacagcggu

SEQ ID NO: 1005012 - RNA, 24 nt, Human
ugggagggaagacagcgguccccg

SEQ ID NO: 1005013 - RNA, 18 nt, Human
ugggcucuaagcaugggc

SEQ ID NO: 1005014 - RNA, 23 nt, Human
uguagguggcagacgagccaggc

SEQ ID NO: 1005015 - RNA, 18 nt, Human
uuggaagggaccaagaug

SEQ ID NO: 1005016 - RNA, 23 nt, Human
uuucuuuuuacaaaacagcagcu

SEQ ID NO: 1005017 - RNA, 25 nt, Human
uuuuucuuuuuacaaaacagcagcu

SEQ ID NO: 1005018 - RNA, 21 nt, Human
uuuuuuuuuuuuuuaguuugg

SEQ ID NO: 1005019 - RNA, 20 nt, Human
aaaccaaacaaaaugaucaa

SEQ ID NO: 1005020 - RNA, 21 nt, Human
aacccugcaauauucaaaaaa

SEQ ID NO: 1005021 - RNA, 22 nt, Human
gcccaccucacagggagcgcgg

SEQ ID NO: 1005022 - RNA, 26 nt, Human
gcgggcugcucagcgcaagcgcacua

SEQ ID NO: 1005023 - RNA, 21 nt, Human
ucaaaccaaacaaaaugauca

SEQ ID NO: 1005024 - RNA, 20 nt, Human
cacaacagugauauuugaga

SEQ ID NO: 1005025 - RNA, 25 nt, Human
caguugguuuucccucucuguauuc

SEQ ID NO: 1005026 - RNA, 18 nt, Human
ccuucucuuuggccuggg

SEQ ID NO: 1005027 - RNA, 20 nt, Human
gagagcuucaagguggcucc

SEQ ID NO: 1005028 - RNA, 22 nt, Human
ggagaggcacguugcuggacag

SEQ ID NO: 1005029 - RNA, 19 nt, Human
ucuagggccaggagaggca

SEQ ID NO: 1005030 - RNA, 23 nt, Human
uggccugggcuauuuccaagaac

SEQ ID NO: 1005031 - RNA, 26 nt, Human
aaacacuagugauaccaucugaacaa

SEQ ID NO: 1005032 - RNA, 23 nt, Human
aaggccgaggccuggacagaaga

SEQ ID NO: 1005033 - RNA, 20 nt, Human
agaggaaggagagaugcuca

SEQ ID NO: 1005034 - RNA, 19 nt, Human
agaucugauugcaauaugg

SEQ ID NO: 1005035 - RNA, 18 nt, Human
agcuguagaucugauugc

SEQ ID NO: 1005036 - RNA, 21 nt, Human
aggaaggagagaugcucagga

SEQ ID NO: 1005037 - RNA, 24 nt, Human
aggaaggccgaggccuggacagaa

SEQ ID NO: 1005038 - RNA, 23 nt, Human
aggagaagacgaucugggagagg

SEQ ID NO: 1005039 - RNA, 20 nt, Human
cacagagagcccggcagggu

SEQ ID NO: 1005040 - RNA, 22 nt, Human
caucugaacaaaagcaaugauu

SEQ ID NO: 1005041 - RNA, 22 nt, Human
ccagggacgcggagcggccgag

SEQ ID NO: 1005042 - RNA, 19 nt, Human
cgccacuggcuuugaaacu

SEQ ID NO: 1005043 - RNA, 22 nt, Human
cgcgacgccacuggcuuugaaa

SEQ ID NO: 1005044 - RNA, 24 nt, Human
gagaagacgaucugggagaggaag

SEQ ID NO: 1005045 - RNA, 20 nt, Human
ggaaacacuagugauaccau

SEQ ID NO: 1005046 - RNA, 21 nt, Human
guaauggcaaugaaugaaaca

SEQ ID NO: 1005047 - RNA, 21 nt, Human
guagaucugauugcaauaugg

SEQ ID NO: 1005048 - RNA, 21 nt, Human
uacaauggaaacacuagugau

SEQ ID NO: 1005049 - RNA, 23 nt, Human
uauccaggagcuguagaucugau

SEQ ID NO: 1005050 - RNA, 23 nt, Human
ucaagauuacaauggaaacacua

SEQ ID NO: 1005051 - RNA, 20 nt, Human
ucaagcaauuauccaggagc

SEQ ID NO: 1005052 - RNA, 18 nt, Human
ugaaacauugacagucuc

SEQ ID NO: 1005053 - RNA, 26 nt, Human
ugaaggagaagacgaucugggagagg

SEQ ID NO: 1005054 - RNA, 23 nt, Human
ugcucaggaaggccgaggccugg

SEQ ID NO: 1005055 - RNA, 18 nt, Human
uggcaaaaguggugacuu

SEQ ID NO: 1005056 - RNA, 20 nt, Human
ugguaauggcaaugaaugaa

SEQ ID NO: 1005057 - RNA, 22 nt, Human
ugucaagauuacaauggaaaca

SEQ ID NO: 1005058 - RNA, 24 nt, Human
ugugucaagauuacaauggaaaca

SEQ ID NO: 1005059 - RNA, 25 nt, Human
uuggcaaaaguggugacuuuuauuu

SEQ ID NO: 1005060 - RNA, 27 nt, Human
aaagcccccaagacucugaaaccagga

SEQ ID NO: 1005061 - RNA, 18 nt, Human
aaagugcugggauuacaa

SEQ ID NO: 1005062 - RNA, 23 nt, Human
aacccgccugccuccgccuccca

SEQ ID NO: 1005063 - RNA, 19 nt, Human
aagugcugggauuacaagc

SEQ ID NO: 1005064 - RNA, 26 nt, Human
aagugcugggauuacaagcacgagcc

SEQ ID NO: 1005065 - RNA, 21 nt, Human
aaucgugccacugcacuccag

SEQ ID NO: 1005066 - RNA, 18 nt, Human
acccgccugccuccgccu

SEQ ID NO: 1005067 - RNA, 24 nt, Human
acugcacuccagccugggugacag

SEQ ID NO: 1005068 - RNA, 26 nt, Human
acugcacuccagccugggugacagag

SEQ ID NO: 1005069 - RNA, 24 nt, Human
agcacuuugggaggcugaggcagg

SEQ ID NO: 1005070 - RNA, 22 nt, Human
agcuguaugaaaaaagccccca

SEQ ID NO: 1005071 - RNA, 18 nt, Human
aggcaggaggaucgcuug

SEQ ID NO: 1005072 - RNA, 24 nt, Human
aggcaggaggaucgcuuggccccg

SEQ ID NO: 1005073 - RNA, 24 nt, Human
aggcaucaggaagcuacugcagcu

SEQ ID NO: 1005074 - RNA, 20 nt, Human
aggcugaggcaggaggaucg

SEQ ID NO: 1005075 - RNA, 24 nt, Human
aggcugaggcaggaggaucgcuug

SEQ ID NO: 1005076 - RNA, 18 nt, Human
agugcugggauuacaagc

SEQ ID NO: 1005077 - RNA, 24 nt, Human
aucgugccacugcacuccagccug

SEQ ID NO: 1005078 - RNA, 20 nt, Human
augaggcaucaggaagcuac

SEQ ID NO: 1005079 - RNA, 18 nt, Human
augagguuucgccauguu

SEQ ID NO: 1005080 - RNA, 24 nt, Human
augagguuucgccauguugcucag

SEQ ID NO: 1005081 - RNA, 23 nt, Human
caaagugcugggauuacaagcac

SEQ ID NO: 1005082 - RNA, 24 nt, Human
caaagugcugggauuacaagcacg

SEQ ID NO: 1005083 - RNA, 28 nt, Human
caagcaacccgccugccuccccugaaag

SEQ ID NO: 1005084 - RNA, 18 nt, Human
cacgccuguggucccagc

SEQ ID NO: 1005085 - RNA, 22 nt, Human
cacuccagccugggugacagag

SEQ ID NO: 1005086 - RNA, 23 nt, Human
cacuccagccugggugacagagc

SEQ ID NO: 1005087 - RNA, 19 nt, Human
cacugcacuccagccuggg

SEQ ID NO: 1005088 - RNA, 21 nt, Human
cacugcacuccagccugggug

SEQ ID NO: 1005089 - RNA, 22 nt, Human
cacugcacuccagccuggguga

SEQ ID NO: 1005090 - RNA, 23 nt, Human
cacugcacuccagccugggugac

SEQ ID NO: 1005091 - RNA, 24 nt, Human
cacugcacuccagccugggugaca

SEQ ID NO: 1005092 - RNA, 25 nt, Human
cacugcacuccagccugggugacag

SEQ ID NO: 1005093 - RNA, 22 nt, Human
cagaagccccagacuugggcaa

SEQ ID NO: 1005094 - RNA, 24 nt, Human
cagcacuuugggaggcugaggcag

SEQ ID NO: 1005095 - RNA, 25 nt, Human
cagcacuuugggaggcugaggcagg

SEQ ID NO: 1005096 - RNA, 24 nt, Human
cagcuacucagaaggcugaggcag

SEQ ID NO: 1005097 - RNA, 23 nt, Human
cauguugcucaggcuggucucaa

SEQ ID NO: 1005098 - RNA, 24 nt, Human
cauguugcucaggcuggucucaag

SEQ ID NO: 1005099 - RNA, 19 nt, Human
ccaaagugcugggauuaca

SEQ ID NO: 1005100 - RNA, 20 nt, Human
ccacugcacuccagccuggg

SEQ ID NO: 1005101 - RNA, 20 nt, Human
ccacugcacuccagccuggg

SEQ ID NO: 1005102 - RNA, 20 nt, Human
ccacugcacuccagccuggg

SEQ ID NO: 1005103 - RNA, 21 nt, Human
ccacugcacuccagccugggu

SEQ ID NO: 1005104 - RNA, 21 nt, Human
ccacugcacuccagccugggu

SEQ ID NO: 1005105 - RNA, 24 nt, Human
ccacugcacuccagccugggugac

SEQ ID NO: 1005106 - RNA, 22 nt, Human
ccauguugcucaggcuggucuc

SEQ ID NO: 1005107 - RNA, 18 nt, Human
ccauugugcccagccugg

SEQ ID NO: 1005108 - RNA, 19 nt, Human
ccauugugcccagccuggc

SEQ ID NO: 1005109 - RNA, 27 nt, Human
cccccaagacucugaaaccagaugggg

SEQ ID NO: 1005110 - RNA, 23 nt, Human
cccgccugccuccgccucccaaa

SEQ ID NO: 1005111 - RNA, 19 nt, Human
ccuguaaauuccagcacuu

SEQ ID NO: 1005112 - RNA, 21 nt, Human
ccuguggucccagcuacucag

SEQ ID NO: 1005113 - RNA, 22 nt, Human
ccuguggucccagcuacucaga

SEQ ID NO: 1005114 - RNA, 24 nt, Human
cgccauguugcucaggcuggucuc

SEQ ID NO: 1005115 - RNA, 19 nt, Human
cgccuguggucccagcuac

SEQ ID NO: 1005116 - RNA, 24 nt, Human
cucaagcaacccgccugccuccgc

SEQ ID NO: 1005117 - RNA, 21 nt, Human
cucccucaauguguucugcug

SEQ ID NO: 1005118 - RNA, 21 nt, Human
cuucaagcacagcacuggggc

SEQ ID NO: 1005119 - RNA, 20 nt, Human
gacaaagcuguaugaaaaaa

SEQ ID NO: 1005120 - RNA, 22 nt, Human
gagguuucgccauguugcucag

SEQ ID NO: 1005121 - RNA, 21 nt, Human
gauuacaagcacgagccauug

SEQ ID NO: 1005122 - RNA, 24 nt, Human
gcacuccagccugggugacagagc

SEQ ID NO: 1005123 - RNA, 24 nt, Human
gcaugguggugcacgccugugguc

SEQ ID NO: 1005124 - RNA, 19 nt, Human
gccacugcacuccagccug

SEQ ID NO: 1005125 - RNA, 21 nt, Human
gccacugcacuccagccuggg

SEQ ID NO: 1005126 - RNA, 24 nt, Human
gccacugcacuccagccuggguga

SEQ ID NO: 1005127 - RNA, 19 nt, Human
gccauaaucgugccacugc

SEQ ID NO: 1005128 - RNA, 21 nt, Human
gccuccgccucccaaagugcu

SEQ ID NO: 1005129 - RNA, 19 nt, Human
gcugcaaugagccauaauc

SEQ ID NO: 1005130 - RNA, 19 nt, Human
ggaggcugaggcaggagac

SEQ ID NO: 1005131 - RNA, 24 nt, Human
ggauuacaagcacgagccauugug

SEQ ID NO: 1005132 - RNA, 21 nt, Human
ggcaugguggugcacgccugu

SEQ ID NO: 1005133 - RNA, 21 nt, Human
gggaugccaguuauaaaacuu

SEQ ID NO: 1005134 - RNA, 18 nt, Human
gggcaacuccacucacua

SEQ ID NO: 1005135 - RNA, 24 nt, Human
gguggugcacgccuguggucccag

SEQ ID NO: 1005136 - RNA, 21 nt, Human
guagauaugagguuucgccau

SEQ ID NO: 1005137 - RNA, 20 nt, Human
uaaaguuacccauccuggug

SEQ ID NO: 1005138 - RNA, 21 nt, Human
uaacuugcagcgugcuaccuc

SEQ ID NO: 1005139 - RNA, 20 nt, Human
uaauuugugaaagccacacc

SEQ ID NO: 1005140 - RNA, 21 nt, Human
uaauuuuuuauuuuuuguaga

SEQ ID NO: 1005141 - RNA, 24 nt, Human
uacaagcacgagccauugugccca

SEQ ID NO: 1005142 - RNA, 23 nt, Human
uaccaggucauuucagaagcccc

SEQ ID NO: 1005143 - RNA, 23 nt, Human
uagaaccuuacagugaccuaagu

SEQ ID NO: 1005144 - RNA, 23 nt, Human
ucaaagccaguguggcacgaggc

SEQ ID NO: 1005145 - RNA, 25 nt, Human
ucaagcacagcacuggggcugcgcu

SEQ ID NO: 1005146 - RNA, 23 nt, Human
ucagacaaagcuguaugaaaaaa

SEQ ID NO: 1005147 - RNA, 24 nt, Human
uccagccugggugacagagccaga

SEQ ID NO: 1005148 - RNA, 22 nt, Human
uccaucacaaggggcacagccg

SEQ ID NO: 1005149 - RNA, 18 nt, Human
ucccaaagugcugggauu

SEQ ID NO: 1005150 - RNA, 24 nt, Human
ucccaaagugcugggauuacaagc

SEQ ID NO: 1005151 - RNA, 22 nt, Human
ucccagcccuagaaccuuacag

SEQ ID NO: 1005152 - RNA, 22 nt, Human
uccuguaaauuccagcacuuug

SEQ ID NO: 1005153 - RNA, 21 nt, Human
ucgccauguugcucaggcugg

SEQ ID NO: 1005154 - RNA, 22 nt, Human
ucgccauguugcucaggcuggu

SEQ ID NO: 1005155 - RNA, 23 nt, Human
ucgugccacugcacuccagccug

SEQ ID NO: 1005156 - RNA, 19 nt, Human
ugaaaaaagcccccaagac

SEQ ID NO: 1005157 - RNA, 19 nt, Human
ugaaagccacaccauuucu

SEQ ID NO: 1005158 - RNA, 20 nt, Human
ugaggcaggaggaucgcuug

SEQ ID NO: 1005159 - RNA, 24 nt, Human
ugagguuucgccauguugcucagg

SEQ ID NO: 1005160 - RNA, 20 nt, Human
ugauucagaaagguggauac

SEQ ID NO: 1005161 - RNA, 22 nt, Human
ugcaaugagccauaaucgugcc

SEQ ID NO: 1005162 - RNA, 18 nt, Human
ugcccggcccaugagcua

SEQ ID NO: 1005163 - RNA, 24 nt, Human
ugccuccgccucccaaagugcugg

SEQ ID NO: 1005164 - RNA, 21 nt, Human
ugcucaggcuggucucaagcu

SEQ ID NO: 1005165 - RNA, 24 nt, Human
ugcugggauuacaagcacgagcca

SEQ ID NO: 1005166 - RNA, 18 nt, Human
ugggaggcugaggcagga

SEQ ID NO: 1005167 - RNA, 19 nt, Human
ugggaggcugaggcaggag

SEQ ID NO: 1005168 - RNA, 21 nt, Human
ugggauuacaagcacgagcca

SEQ ID NO: 1005169 - RNA, 21 nt, Human
ugggauuacaagcacgagcca

SEQ ID NO: 1005170 - RNA, 22 nt, Human
ugggauuacaagcacgagccau

SEQ ID NO: 1005171 - RNA, 24 nt, Human
ugggauuacaagcacgagccauug

SEQ ID NO: 1005172 - RNA, 26 nt, Human
ugggauuacaagcacgagccauugug

SEQ ID NO: 1005173 - RNA, 27 nt, Human
ugggauuacaagcacgagccauugugc

SEQ ID NO: 1005174 - RNA, 18 nt, Human
uggugcacgccugugguc

SEQ ID NO: 1005175 - RNA, 21 nt, Human
uggugcacgccugugguccca

SEQ ID NO: 1005176 - RNA, 24 nt, Human
uggugcacgccuguggucccagcu

SEQ ID NO: 1005177 - RNA, 24 nt, Human
ugguggugcacgccugugguccca

SEQ ID NO: 1005178 - RNA, 20 nt, Human
uguugcucaggcuggucuca

SEQ ID NO: 1005179 - RNA, 19 nt, Human
uuaaaguuacccauccugg

SEQ ID NO: 1005180 - RNA, 20 nt, Human
uuaggugggcaugguggugc

SEQ ID NO: 1005181 - RNA, 24 nt, Human
uuaggugggcaugguggugcacgc

SEQ ID NO: 1005182 - RNA, 22 nt, Human
uuauaaaacuugucuuuaaagu

SEQ ID NO: 1005183 - RNA, 24 nt, Human
uuccagcacuuugggaggcugagg

SEQ ID NO: 1005184 - RNA, 24 nt, Human
uuguagauaugagguuucgccaug

SEQ ID NO: 1005185 - RNA, 23 nt, Human
uuucgccauguugcucaggcugg

SEQ ID NO: 1005186 - RNA, 24 nt, Human
uuucgccauguugcucaggcuggu

SEQ ID NO: 1005187 - RNA, 24 nt, Human
uuuguagauaugagguuucgccau

SEQ ID NO: 1005188 - RNA, 22 nt, Human
uuuuuuguagauaugagguuuc

SEQ ID NO: 1005189 - RNA, 23 nt, Human
uuuuuuguagauaugagguuucg

SEQ ID NO: 1005190 - RNA, 18 nt, Human
uuuuuuuuuuuuuuuuug

SEQ ID NO: 1005191 - RNA, 20 nt, Human
aaccccccaacccccgcucc

SEQ ID NO: 1005192 - RNA, 21 nt, Human
aaccccccaacccccgcuccc

SEQ ID NO: 1005193 - RNA, 24 nt, Human
agaagcccccagccagcccugccc

SEQ ID NO: 1005194 - RNA, 23 nt, Human
agccagcccugcccccacccucc

SEQ ID NO: 1005195 - RNA, 21 nt, Human
cagagggggauaagggggggg

SEQ ID NO: 1005196 - RNA, 26 nt, Human
caguccccucccugcccuaacccccc

SEQ ID NO: 1005197 - RNA, 22 nt, Human
ccagcccugcccccacccuccc

SEQ ID NO: 1005198 - RNA, 26 nt, Human
cccaacccccgcuccccacccuuaau

SEQ ID NO: 1005199 - RNA, 23 nt, Human
cccagccagcccugcccccaccc

SEQ ID NO: 1005200 - RNA, 26 nt, Human
cccagccagcccugcccccacccucc

SEQ ID NO: 1005201 - RNA, 25 nt, Human
ccccaaccccccaacccccgcuccc

SEQ ID NO: 1005202 - RNA, 18 nt, Human
ccccaacccccgcucccc

SEQ ID NO: 1005203 - RNA, 20 nt, Human
ccccagccagcccugccccc

SEQ ID NO: 1005204 - RNA, 19 nt, Human
ccccaguccccucccugcc

SEQ ID NO: 1005205 - RNA, 18 nt, Human
cccccaaccccccaaccc

SEQ ID NO: 1005206 - RNA, 19 nt, Human
cccccaaccccccaacccc

SEQ ID NO: 1005207 - RNA, 22 nt, Human
cccccaaccccccaacccccgc

SEQ ID NO: 1005208 - RNA, 19 nt, Human
cccccaacccccgcucccc

SEQ ID NO: 1005209 - RNA, 24 nt, Human
ccccccaacccccgcuccccaccc

SEQ ID NO: 1005210 - RNA, 21 nt, Human
cccccgcuccccacccuuaaa

SEQ ID NO: 1005211 - RNA, 18 nt, Human
ccccucccugcccuaacc

SEQ ID NO: 1005212 - RNA, 18 nt, Human
cccuaaccccccaacccc

SEQ ID NO: 1005213 - RNA, 19 nt, Human
cccugcccccacccucccc

SEQ ID NO: 1005214 - RNA, 23 nt, Human
cccuuaauugcugccauuccagu

SEQ ID NO: 1005215 - RNA, 21 nt, Human
ccuaaccccccaaccccccaa

SEQ ID NO: 1005216 - RNA, 23 nt, Human
ccucccugcccuaaccccccaac

SEQ ID NO: 1005217 - RNA, 19 nt, Human
ccugcccuaaccccccaac

SEQ ID NO: 1005218 - RNA, 26 nt, Human
ccugcccuaaccccccaaccccccaa

SEQ ID NO: 1005219 - RNA, 23 nt, Human
cugcccuaaccccccaacccccc

SEQ ID NO: 1005220 - RNA, 19 nt, Human
cugcggcugucacuccucu

SEQ ID NO: 1005221 - RNA, 23 nt, Human
cugcggcugucacuccucugccc

SEQ ID NO: 1005222 - RNA, 24 nt, Human
cugugugcgcacuuccccaguccc

SEQ ID NO: 1005223 - RNA, 27 nt, Human
cugugugcgcacuuccccaguccccuc

SEQ ID NO: 1005224 - RNA, 22 nt, Human
gauaagggggggggcgggagug

SEQ ID NO: 1005225 - RNA, 22 nt, Human
gccagcccugcccccacccucc

SEQ ID NO: 1005226 - RNA, 22 nt, Human
gcccugcccccacccuccccca

SEQ ID NO: 1005227 - RNA, 20 nt, Human
gggcgggaguggggagaagc

SEQ ID NO: 1005228 - RNA, 19 nt, Human
uaaccccccaaccccccaa

SEQ ID NO: 1005229 - RNA, 23 nt, Human
uaaccccccaaccccccaacccc

SEQ ID NO: 1005230 - RNA, 24 nt, Human
uaaccccccaaccccccaaccccc

SEQ ID NO: 1005231 - RNA, 18 nt, Human
uccaguugcugccggcug

SEQ ID NO: 1005232 - RNA, 21 nt, Human
uccccaguccccucccugccc

SEQ ID NO: 1005233 - RNA, 20 nt, Human
ugugcgcacuuccccagucc

SEQ ID NO: 1005234 - RNA, 19 nt, Human
uugcugccauuccaguugc

SEQ ID NO: 1005235 - RNA, 23 nt, Human
uugcugccauuccaguugcugcc

SEQ ID NO: 1005236 - RNA, 19 nt, Human
ccaccaggcguguagcagc

SEQ ID NO: 1005237 - RNA, 25 nt, Human
ugggaaggacuuaaauaaggaggau

SEQ ID NO: 1005238 - RNA, 21 nt, Human
aaacaggaaaacagcuguccg

SEQ ID NO: 1005239 - RNA, 21 nt, Human
aacagcuguccagaugacagu

SEQ ID NO: 1005240 - RNA, 20 nt, Human
aacuuccuuuaccauccaaa

SEQ ID NO: 1005241 - RNA, 21 nt, Human
aagcaaagaagggcagaacug

SEQ ID NO: 1005242 - RNA, 22 nt, Human
aauuugcucucccugccuccga

SEQ ID NO: 1005243 - RNA, 20 nt, Human
acacagucaagucugugcca

SEQ ID NO: 1005244 - RNA, 23 nt, Human
acccugagucugaaccgcccaac

SEQ ID NO: 1005245 - RNA, 21 nt, Human
accgcccaacgcggccucaac

SEQ ID NO: 1005246 - RNA, 18 nt, Human
agggaugugaggguucug

SEQ ID NO: 1005247 - RNA, 18 nt, Human
agugacaaagauggacac

SEQ ID NO: 1005248 - RNA, 18 nt, Human
caacgcggccucaacguc

SEQ ID NO: 1005249 - RNA, 22 nt, Human
caagagugaggaccuggaaaga

SEQ ID NO: 1005250 - RNA, 21 nt, Human
caaucccaaagcaaagaaggg

SEQ ID NO: 1005251 - RNA, 23 nt, Human
cacucagugacaaagauggacac

SEQ ID NO: 1005252 - RNA, 18 nt, Human
cagcgucguccucuccuu

SEQ ID NO: 1005253 - RNA, 21 nt, Human
ccaaagcaaagaagggcagaa

SEQ ID NO: 1005254 - RNA, 21 nt, Human
ccaagagugaggaccuggaaa

SEQ ID NO: 1005255 - RNA, 26 nt, Human
ccagugcaaucccaaagcaaagaagg

SEQ ID NO: 1005256 - RNA, 20 nt, Human
cccaaagcaaagaagggcag

SEQ ID NO: 1005257 - RNA, 19 nt, Human
ccccauaucccaagaguga

SEQ ID NO: 1005258 - RNA, 21 nt, Human
cccccauaucccaagagugag

SEQ ID NO: 1005259 - RNA, 22 nt, Human
ccccccaucuacuuagaaaauc

SEQ ID NO: 1005260 - RNA, 20 nt, Human
ccccuuggugcggggcugug

SEQ ID NO: 1005261 - RNA, 20 nt, Human
ccuaagcccccauaucccaa

SEQ ID NO: 1005262 - RNA, 22 nt, Human
ccuaagcccccauaucccaaga

SEQ ID NO: 1005263 - RNA, 23 nt, Human
ccuaagcccccauaucccaagag

SEQ ID NO: 1005264 - RNA, 18 nt, Human
cuaagcccccauauccca

SEQ ID NO: 1005265 - RNA, 21 nt, Human
cugagggucugggcuagggag

SEQ ID NO: 1005266 - RNA, 23 nt, Human
gccagguuucuguucagucuggg

SEQ ID NO: 1005267 - RNA, 25 nt, Human
gcccccauaucccaagagugaggac

SEQ ID NO: 1005268 - RNA, 24 nt, Human
ggcugugcacaggucuaaagacuc

SEQ ID NO: 1005269 - RNA, 21 nt, Human
gggucugggcuagggaguugg

SEQ ID NO: 1005270 - RNA, 18 nt, Human
ggucugggcuagggaguu

SEQ ID NO: 1005271 - RNA, 22 nt, Human
ggucugggcuagggaguuggau

SEQ ID NO: 1005272 - RNA, 23 nt, Human
gugaggguucugaaaaacaggca

SEQ ID NO: 1005273 - RNA, 18 nt, Human
uaagcccccauaucccaa

SEQ ID NO: 1005274 - RNA, 22 nt, Human
uagaaaacagagauuucacuca

SEQ ID NO: 1005275 - RNA, 19 nt, Human
ucagcccacaggaagagug

SEQ ID NO: 1005276 - RNA, 22 nt, Human
ucauggugccaggucuccuggg

SEQ ID NO: 1005277 - RNA, 19 nt, Human
uccaaacaggaaaacagcu

SEQ ID NO: 1005278 - RNA, 18 nt, Human
uccagaugacaguaagau

SEQ ID NO: 1005279 - RNA, 18 nt, Human
ucccaaagcaaagaaggg

SEQ ID NO: 1005280 - RNA, 22 nt, Human
uccuaagcccccauaucccaag

SEQ ID NO: 1005281 - RNA, 19 nt, Human
ucuccuggggcaucuaggg

SEQ ID NO: 1005282 - RNA, 28 nt, Human
ugagcugauggcccagugcuguaaugac

SEQ ID NO: 1005283 - RNA, 22 nt, Human
ugagggucugggcuagggaguu

SEQ ID NO: 1005284 - RNA, 18 nt, Human
ugagucugaaccgcccaa

SEQ ID NO: 1005285 - RNA, 19 nt, Human
uggaaagagggaugugagg

SEQ ID NO: 1005286 - RNA, 20 nt, Human
uggacacagccaguucaccg

SEQ ID NO: 1005287 - RNA, 24 nt, Human
uggcccagugcaaucccaaagcaa

SEQ ID NO: 1005288 - RNA, 22 nt, Human
uggugccaggucuccuggggca

SEQ ID NO: 1005289 - RNA, 21 nt, Human
uguuuuccuaagcccccauau

SEQ ID NO: 1005290 - RNA, 21 nt, Human
uuuaccauccaaacaggaaaa

SEQ ID NO: 1005291 - RNA, 23 nt, Human
uuugcagccccacacgcaggccu

SEQ ID NO: 1005292 - RNA, 27 nt, Human
uuuuccuaagcccccauaucccaagag

SEQ ID NO: 1005293 - RNA, 22 nt, Human
aaagugcucuggcccccuacuc

SEQ ID NO: 1005294 - RNA, 24 nt, Human
aaagugcucuggcccccuacucca

SEQ ID NO: 1005295 - RNA, 23 nt, Human
aaccauggcuaaggucaaacuug

SEQ ID NO: 1005296 - RNA, 18 nt, Human
aagacagaggucagaaug

SEQ ID NO: 1005297 - RNA, 25 nt, Human
aagacagaggucagaauguucuguu

SEQ ID NO: 1005298 - RNA, 21 nt, Human
aagcaccagauggggcagggg

SEQ ID NO: 1005299 - RNA, 19 nt, Human
aagcagaggcagugaagcc

SEQ ID NO: 1005300 - RNA, 18 nt, Human
aaggaagcaggaggccaa

SEQ ID NO: 1005301 - RNA, 23 nt, Human
acucucugacaacacgaaggcca

SEQ ID NO: 1005302 - RNA, 23 nt, Human
acuuggaguaaauggcuggaaau

SEQ ID NO: 1005303 - RNA, 24 nt, Human
agagcaagacagaggucagaaugu

SEQ ID NO: 1005304 - RNA, 25 nt, Human
agauucuuaggggaggcagcaguuu

SEQ ID NO: 1005305 - RNA, 21 nt, Human
aggaaggaggcugcagcugga

SEQ ID NO: 1005306 - RNA, 18 nt, Human
aggcaggaaggaggcugc

SEQ ID NO: 1005307 - RNA, 24 nt, Human
aggcaggaaggaggcugcagcugg

SEQ ID NO: 1005308 - RNA, 21 nt, Human
aggcaggcggcuucccugggg

SEQ ID NO: 1005309 - RNA, 19 nt, Human
agggccccuugggguuuca

SEQ ID NO: 1005310 - RNA, 23 nt, Human
agguggugggguagacuucugau

SEQ ID NO: 1005311 - RNA, 20 nt, Human
aguaaauggcuggaaaucaa

SEQ ID NO: 1005312 - RNA, 18 nt, Human
auggagcccggcagaggc

SEQ ID NO: 1005313 - RNA, 29 nt, Human
caacucccaagccaucuuaggucccuuuu

SEQ ID NO: 1005314 - RNA, 19 nt, Human
caagcuccucucuuuuccu

SEQ ID NO: 1005315 - RNA, 19 nt, Human
caaguacaggaguugcagc

SEQ ID NO: 1005316 - RNA, 19 nt, Human
cacugggggagaacagagu

SEQ ID NO: 1005317 - RNA, 20 nt, Human
cagagcaagacagaggucag

SEQ ID NO: 1005318 - RNA, 22 nt, Human
cagcauggagugggagcaaggg

SEQ ID NO: 1005319 - RNA, 19 nt, Human
caggaacccaacaacuccc

SEQ ID NO: 1005320 - RNA, 19 nt, Human
ccaagcuccucucuuuucc

SEQ ID NO: 1005321 - RNA, 21 nt, Human
ccaagcuccucucuuuuccuu

SEQ ID NO: 1005322 - RNA, 22 nt, Human
ccaagcuccucucuuuuccuuc

SEQ ID NO: 1005323 - RNA, 21 nt, Human
cccaaagauagggccccuugg

SEQ ID NO: 1005324 - RNA, 22 nt, Human
cccaacaacucccaagccaucu

SEQ ID NO: 1005325 - RNA, 21 nt, Human
cccacuguagggagcaggagc

SEQ ID NO: 1005326 - RNA, 20 nt, Human
ccccuugggguuucaucccc

SEQ ID NO: 1005327 - RNA, 20 nt, Human
cugcagcuggaagcagaggc

SEQ ID NO: 1005328 - RNA, 18 nt, Human
cuggcccccuacuccagg

SEQ ID NO: 1005329 - RNA, 19 nt, Human
gagaggacuuggaguaaau

SEQ ID NO: 1005330 - RNA, 21 nt, Human
gaugaaaggagcagagcaaga

SEQ ID NO: 1005331 - RNA, 25 nt, Human
gcagugaagccucuugggagaugac

SEQ ID NO: 1005332 - RNA, 19 nt, Human
ggagacgaggaugaaagga

SEQ ID NO: 1005333 - RNA, 24 nt, Human
gggagaggacuuggaguaaauggc

SEQ ID NO: 1005334 - RNA, 24 nt, Human
gggcaauaauggggccuuggcgcu

SEQ ID NO: 1005335 - RNA, 20 nt, Human
ggggcaauaauggggccuug

SEQ ID NO: 1005336 - RNA, 24 nt, Human
guagggagcaggagcucccaggag

SEQ ID NO: 1005337 - RNA, 20 nt, Human
ucagaauguucuguucacuu

SEQ ID NO: 1005338 - RNA, 18 nt, Human
ucauaugaggucucagcu

SEQ ID NO: 1005339 - RNA, 26 nt, Human
uccagggcaaggaagauucuuagggg

SEQ ID NO: 1005340 - RNA, 23 nt, Human
uccauguaaaucccaaagauagg

SEQ ID NO: 1005341 - RNA, 27 nt, Human
ucccaagccaucuuaggucccaccguu

SEQ ID NO: 1005342 - RNA, 18 nt, Human
ucccuggggacccaggca

SEQ ID NO: 1005343 - RNA, 25 nt, Human
uccuugggaauggagcccggcagag

SEQ ID NO: 1005344 - RNA, 18 nt, Human
ucucugacaacacgaagg

SEQ ID NO: 1005345 - RNA, 19 nt, Human
uggaagcagaggcagugaa

SEQ ID NO: 1005346 - RNA, 19 nt, Human
uggagguuggugaguuguu

SEQ ID NO: 1005347 - RNA, 22 nt, Human
uggaguaaauggcuggaaauca

SEQ ID NO: 1005348 - RNA, 21 nt, Human
uggagugggagcaagggggca

SEQ ID NO: 1005349 - RNA, 19 nt, Human
uggguuggagguuggugag

SEQ ID NO: 1005350 - RNA, 20 nt, Human
uuccugaggagguggugggg

SEQ ID NO: 1005351 - RNA, 21 nt, Human
uuccuugggaauggagcccgg

SEQ ID NO: 1005352 - RNA, 25 nt, Human
aagauaaaacagauacuggcaguca

SEQ ID NO: 1005353 - RNA, 18 nt, Human
accuuaaaggcugcggag

SEQ ID NO: 1005354 - RNA, 20 nt, Human
aguaaggcccagaaagacca

SEQ ID NO: 1005355 - RNA, 23 nt, Human
caaagaauguucagcaccagcaa

SEQ ID NO: 1005356 - RNA, 19 nt, Human
caagauaaaacagauacug

SEQ ID NO: 1005357 - RNA, 22 nt, Human
cacaguaaggcccagaaagacc

SEQ ID NO: 1005358 - RNA, 18 nt, Human
ccauggaguugcacaaag

SEQ ID NO: 1005359 - RNA, 18 nt, Human
ccccaccugccugccacc

SEQ ID NO: 1005360 - RNA, 22 nt, Human
cccccgcgcgaaccuuaaaggc

SEQ ID NO: 1005361 - RNA, 21 nt, Human
ccccgcgcgaaccuuaaaggc

SEQ ID NO: 1005362 - RNA, 19 nt, Human
gcagcagaggcggcgcggg

SEQ ID NO: 1005363 - RNA, 22 nt, Human
gcgaaccuuaaaggcugcggag

SEQ ID NO: 1005364 - RNA, 20 nt, Human
gcuaacucuugccuggcccc

SEQ ID NO: 1005365 - RNA, 20 nt, Human
ggcugcagcagaggcggcgc

SEQ ID NO: 1005366 - RNA, 21 nt, Human
uaaggcccagaaagaccaugg

SEQ ID NO: 1005367 - RNA, 24 nt, Human
uagacggcagcggcugcagcagag

SEQ ID NO: 1005368 - RNA, 24 nt, Human
uauaccagcacaguaaggcccaga

SEQ ID NO: 1005369 - RNA, 24 nt, Human
aaucauaaaaaugcuaucugaaau

SEQ ID NO: 1005370 - RNA, 22 nt, Human
accccgccccucucgccacgac

SEQ ID NO: 1005371 - RNA, 24 nt, Human
agacgucuuguagguucacaguug

SEQ ID NO: 1005372 - RNA, 20 nt, Human
agccccggccaccccgcccc

SEQ ID NO: 1005373 - RNA, 19 nt, Human
agcgccagccccggccacc

SEQ ID NO: 1005374 - RNA, 20 nt, Human
caaaauaaaacccuguggau

SEQ ID NO: 1005375 - RNA, 21 nt, Human
caacaagcaaaauaaaacccu

SEQ ID NO: 1005376 - RNA, 31 nt, Human
caacaagcaaaauaaaacccuguggauauuu

SEQ ID NO: 1005377 - RNA, 20 nt, Human
caccccgccccucucgccac

SEQ ID NO: 1005378 - RNA, 23 nt, Human
cacgacuaguggcugccgacgcc

SEQ ID NO: 1005379 - RNA, 23 nt, Human
cagccccggccaccccgccccuc

SEQ ID NO: 1005380 - RNA, 26 nt, Human
caguuguccaagacgucuuguagguu

SEQ ID NO: 1005381 - RNA, 22 nt, Human
ccaccccgccccucucgccacg

SEQ ID NO: 1005382 - RNA, 24 nt, Human
ccagacacgucagcgccgggagca

SEQ ID NO: 1005383 - RNA, 19 nt, Human
cccagacacgucagcgccg

SEQ ID NO: 1005384 - RNA, 21 nt, Human
ccccgccccucucgccacgac

SEQ ID NO: 1005385 - RNA, 20 nt, Human
ccccggccaccccgccccuc

SEQ ID NO: 1005386 - RNA, 25 nt, Human
ccccggccaccccgccccucucgcc

SEQ ID NO: 1005387 - RNA, 22 nt, Human
cccgccccucucgccacgacua

SEQ ID NO: 1005388 - RNA, 22 nt, Human
cccggccaccccgccccucucg

SEQ ID NO: 1005389 - RNA, 21 nt, Human
ccgcagcuacgaccgucucca

SEQ ID NO: 1005390 - RNA, 27 nt, Human
cgccagccccggccaccccgccccucu

SEQ ID NO: 1005391 - RNA, 21 nt, Human
cugcaaguaaacugauguuga

SEQ ID NO: 1005392 - RNA, 20 nt, Human
gaccgcagcuacgaccgucu

SEQ ID NO: 1005393 - RNA, 23 nt, Human
gagcgggggccaaguggagcgcc

SEQ ID NO: 1005394 - RNA, 22 nt, Human
gccaccccgccccucucgccac

SEQ ID NO: 1005395 - RNA, 26 nt, Human
gccagccccggccaccccgccccucu

SEQ ID NO: 1005396 - RNA, 21 nt, Human
gccgcggcggcggggcgggcc

SEQ ID NO: 1005397 - RNA, 21 nt, Human
gccgggagcacagccucgugc

SEQ ID NO: 1005398 - RNA, 22 nt, Human
gggggccgcggcggcggggcgg

SEQ ID NO: 1005399 - RNA, 21 nt, Human
uacaaugacauauuauuacua

SEQ ID NO: 1005400 - RNA, 22 nt, Human
uaucaaaaauaaaagcuauucc

SEQ ID NO: 1005401 - RNA, 19 nt, Human
uauuucagcuguacgaaau

SEQ ID NO: 1005402 - RNA, 21 nt, Human
uccgcgcggccacucaucggc

SEQ ID NO: 1005403 - RNA, 20 nt, Human
uccuggauggccaauggucu

SEQ ID NO: 1005404 - RNA, 24 nt, Human
ucggcgcgaccgcagcuacgaccg

SEQ ID NO: 1005405 - RNA, 21 nt, Human
ucuccagcuccuuccgcgcgg

SEQ ID NO: 1005406 - RNA, 19 nt, Human
ugauaaaauaaaacaaacu

SEQ ID NO: 1005407 - RNA, 22 nt, Human
uggcaaacaaaacuugguaucu

SEQ ID NO: 1005408 - RNA, 21 nt, Human
uuuuuuuuuuuuuuuuccaga

SEQ ID NO: 1005409 - RNA, 22 nt, Human
uuuuuuuuuuuuuuuuuuccag

SEQ ID NO: 1005410 - RNA, 20 nt, Human
aaauaaccugaaacuguaac

SEQ ID NO: 1005411 - RNA, 18 nt, Human
aaccagguaucaacuuua

SEQ ID NO: 1005412 - RNA, 19 nt, Human
agacauaccaggcgguaca

SEQ ID NO: 1005413 - RNA, 21 nt, Human
aggcgguacaaacugaaaacu

SEQ ID NO: 1005414 - RNA, 21 nt, Human
agguaucaacuuuacuaaacc

SEQ ID NO: 1005415 - RNA, 19 nt, Human
aucuaggcuaaaaauaauu

SEQ ID NO: 1005416 - RNA, 23 nt, Human
cauaccaggcgguacaaacugaa

SEQ ID NO: 1005417 - RNA, 25 nt, Human
cauuguguuguuuuaucucaugacu

SEQ ID NO: 1005418 - RNA, 20 nt, Human
cugaaacuguaacaauacac

SEQ ID NO: 1005419 - RNA, 19 nt, Human
gaauauaaauaaccugaaa

SEQ ID NO: 1005420 - RNA, 18 nt, Human
gcaaaaugaaugcuuuca

SEQ ID NO: 1005421 - RNA, 23 nt, Human
gguacaaacugaaaacuugagua

SEQ ID NO: 1005422 - RNA, 24 nt, Human
uaacaauacacaaaaauuggcuuc

SEQ ID NO: 1005423 - RNA, 23 nt, Human
uacaaaacaucgaauauaaauaa

SEQ ID NO: 1005424 - RNA, 20 nt, Human
uacaaacugaaaacuugagu

SEQ ID NO: 1005425 - RNA, 25 nt, Human
uacaaacugaaaacuugaguaaauu

SEQ ID NO: 1005426 - RNA, 22 nt, Human
uagccaaaaauaaaggcauaau

SEQ ID NO: 1005427 - RNA, 23 nt, Human
uagccaaaaauaaaggcauaaua

SEQ ID NO: 1005428 - RNA, 19 nt, Human
uauaaauaaccugaaacug

SEQ ID NO: 1005429 - RNA, 22 nt, Human
uauaaccagguaucaacuuuac

SEQ ID NO: 1005430 - RNA, 22 nt, Human
ucuucuagccaaaaauaaaggc

SEQ ID NO: 1005431 - RNA, 21 nt, Human
ugaguaaauuaacauuguuuu

SEQ ID NO: 1005432 - RNA, 22 nt, Human
ugaguaaauuaacauuguuuua

SEQ ID NO: 1005433 - RNA, 21 nt, Human
uugaaucuguuucaaucaguu

SEQ ID NO: 1005434 - RNA, 20 nt, Human
uuucaaagggagcagaauca

SEQ ID NO: 1005435 - RNA, 19 nt, Human
acaccugaccuucuaaccc

SEQ ID NO: 1005436 - RNA, 22 nt, Human
acauaaacaccccagaaagacu

SEQ ID NO: 1005437 - RNA, 21 nt, Human
agagauauugcagaaccagug

SEQ ID NO: 1005438 - RNA, 22 nt, Human
agcaccuagcuccacagcagca

SEQ ID NO: 1005439 - RNA, 20 nt, Human
agcagcacugagucuggccc

SEQ ID NO: 1005440 - RNA, 18 nt, Human
agggaagcauggugacug

SEQ ID NO: 1005441 - RNA, 20 nt, Human
agguggaguuagugcuggcc

SEQ ID NO: 1005442 - RNA, 24 nt, Human
auuauuuuagauucaagacuguau

SEQ ID NO: 1005443 - RNA, 20 nt, Human
caaaacaaaccagagagacu

SEQ ID NO: 1005444 - RNA, 21 nt, Human
caaaagaaacaggcuggggua

SEQ ID NO: 1005445 - RNA, 23 nt, Human
caacauaauacaaaacaaaccag

SEQ ID NO: 1005446 - RNA, 26 nt, Human
cacaccugaccuucuaacccccaaaa

SEQ ID NO: 1005447 - RNA, 25 nt, Human
cagaaaaggcaaacucugggcccca

SEQ ID NO: 1005448 - RNA, 20 nt, Human
cagcaacuaggccaggcuuc

SEQ ID NO: 1005449 - RNA, 18 nt, Human
cagcagcacugagucugg

SEQ ID NO: 1005450 - RNA, 21 nt, Human
cagcagcacugagucuggccc

SEQ ID NO: 1005451 - RNA, 20 nt, Human
cagcugaggacauaaacacc

SEQ ID NO: 1005452 - RNA, 23 nt, Human
cauaauacaaaacaaaccagaga

SEQ ID NO: 1005453 - RNA, 18 nt, Human
ccaaaccaagccaaaaga

SEQ ID NO: 1005454 - RNA, 25 nt, Human
ccaaugauuucuuaaacuguuuccu

SEQ ID NO: 1005455 - RNA, 20 nt, Human
ccagucucaggggaaggggg

SEQ ID NO: 1005456 - RNA, 20 nt, Human
cccagcucagggccuaggcu

SEQ ID NO: 1005457 - RNA, 23 nt, Human
cccccaaaagaaaauccggaagc

SEQ ID NO: 1005458 - RNA, 19 nt, Human
ccuagagcaggggcucuaa

SEQ ID NO: 1005459 - RNA, 18 nt, Human
ccucccagggaugguggu

SEQ ID NO: 1005460 - RNA, 23 nt, Human
ccucccgccccaucuccccagcc

SEQ ID NO: 1005461 - RNA, 20 nt, Human
cgaaucuuccccaccucccc

SEQ ID NO: 1005462 - RNA, 24 nt, Human
cgccaccaccuccaacucugcccg

SEQ ID NO: 1005463 - RNA, 19 nt, Human
cgccccaucuccccagccc

SEQ ID NO: 1005464 - RNA, 19 nt, Human
cgccccaucuccccagccc

SEQ ID NO: 1005465 - RNA, 21 nt, Human
cggccucccaggcucgguccc

SEQ ID NO: 1005466 - RNA, 23 nt, Human
cucacagagacuggcgagcaguc

SEQ ID NO: 1005467 - RNA, 25 nt, Human
cuccacaccugaccuucuaaccccc

SEQ ID NO: 1005468 - RNA, 19 nt, Human
cuccccagcucagggccua

SEQ ID NO: 1005469 - RNA, 23 nt, Human
cucccgccccaucuccccagccc

SEQ ID NO: 1005470 - RNA, 22 nt, Human
cucuaaaacccuggguagcaga

SEQ ID NO: 1005471 - RNA, 18 nt, Human
cucuccggagggcugaag

SEQ ID NO: 1005472 - RNA, 20 nt, Human
gaagccgaaaggugcuggca

SEQ ID NO: 1005473 - RNA, 21 nt, Human
gcagaaccaguguuaacacua

SEQ ID NO: 1005474 - RNA, 24 nt, Human
gcaggggcucuaaaacccugggua

SEQ ID NO: 1005475 - RNA, 24 nt, Human
gccccaucuccccagccccucuca

SEQ ID NO: 1005476 - RNA, 19 nt, Human
gccuaggcucacagagacu

SEQ ID NO: 1005477 - RNA, 24 nt, Human
ggaaaagugcauucuuugcaccuc

SEQ ID NO: 1005478 - RNA, 21 nt, Human
ggccaggccgucaccguagcc

SEQ ID NO: 1005479 - RNA, 18 nt, Human
ggguagggaagcauggug

SEQ ID NO: 1005480 - RNA, 20 nt, Human
guacaacauaauacaaaaca

SEQ ID NO: 1005481 - RNA, 21 nt, Human
guucaaggagaacagaggugg

SEQ ID NO: 1005482 - RNA, 21 nt, Human
uaaacaccccagaaagacuag

SEQ ID NO: 1005483 - RNA, 22 nt, Human
uagggagagcgaacgccaccac

SEQ ID NO: 1005484 - RNA, 18 nt, Human
ucaaggagaacagaggug

SEQ ID NO: 1005485 - RNA, 18 nt, Human
uccccgcugagcucccga

SEQ ID NO: 1005486 - RNA, 24 nt, Human
ucccgccccaucuccccagccccu

SEQ ID NO: 1005487 - RNA, 26 nt, Human
uccggaagcugccccuucucuuuccc

SEQ ID NO: 1005488 - RNA, 21 nt, Human
ucuaaaacccuggguagcaga

SEQ ID NO: 1005489 - RNA, 19 nt, Human
ucuaacccccaaaagaaaa

SEQ ID NO: 1005490 - RNA, 21 nt, Human
ucucagaagccgaaaggugcu

SEQ ID NO: 1005491 - RNA, 21 nt, Human
ucuccacaccugaccuucuaa

SEQ ID NO: 1005492 - RNA, 21 nt, Human
ucuccccagccccucucagca

SEQ ID NO: 1005493 - RNA, 24 nt, Human
ucugcggcagggccuaggcagggc

SEQ ID NO: 1005494 - RNA, 26 nt, Human
ucuuuccccacaggugggcucugcag

SEQ ID NO: 1005495 - RNA, 23 nt, Human
ugaagugggaaggacacuucuca

SEQ ID NO: 1005496 - RNA, 24 nt, Human
ugauuucuaugacuagguguuauu

SEQ ID NO: 1005497 - RNA, 22 nt, Human
uggcagaaaaggcaaacucugg

SEQ ID NO: 1005498 - RNA, 21 nt, Human
uggcccucccgccccaucucc

SEQ ID NO: 1005499 - RNA, 24 nt, Human
ugggaaggggccaaugauuucuua

SEQ ID NO: 1005500 - RNA, 27 nt, Human
ugggcucugcagggccucccagggaug

SEQ ID NO: 1005501 - RNA, 18 nt, Human
ugggcuggaggggaagcu

SEQ ID NO: 1005502 - RNA, 19 nt, Human
ugggcuggaggggaagcug

SEQ ID NO: 1005503 - RNA, 21 nt, Human
ugggcuggaggggaagcuguu

SEQ ID NO: 1005504 - RNA, 22 nt, Human
uucagcugaggacauaaacacc

SEQ ID NO: 1005505 - RNA, 19 nt, Human
aaaacgaagaaagaugagc

SEQ ID NO: 1005506 - RNA, 21 nt, Human
aaacacauuuguaaaugcuga

SEQ ID NO: 1005507 - RNA, 18 nt, Human
aaagacaacacggaagau

SEQ ID NO: 1005508 - RNA, 20 nt, Human
aaagcuaaaccuaggagccu

SEQ ID NO: 1005509 - RNA, 18 nt, Human
aagaacgcaggagcagcc

SEQ ID NO: 1005510 - RNA, 22 nt, Human
aagcuaaaccuaggagccuggu

SEQ ID NO: 1005511 - RNA, 23 nt, Human
acacaaggcccacccacaccagc

SEQ ID NO: 1005512 - RNA, 24 nt, Human
acacggaagauaagcuacaaaucc

SEQ ID NO: 1005513 - RNA, 20 nt, Human
acccaggcgaagucacggaa

SEQ ID NO: 1005514 - RNA, 18 nt, Human
acccgcggacgccagcuc

SEQ ID NO: 1005515 - RNA, 22 nt, Human
acggccgagacccggggagcca

SEQ ID NO: 1005516 - RNA, 23 nt, Human
agaaauaaagauauaaugaaaga

SEQ ID NO: 1005517 - RNA, 22 nt, Human
agaagguggaccccugaccaag

SEQ ID NO: 1005518 - RNA, 18 nt, Human
agacccggggagccacgc

SEQ ID NO: 1005519 - RNA, 22 nt, Human
agacggccgagacccggggagc

SEQ ID NO: 1005520 - RNA, 20 nt, Human
agagaaaagcucugcaggua

SEQ ID NO: 1005521 - RNA, 20 nt, Human
agcacacaaggcccacccac

SEQ ID NO: 1005522 - RNA, 24 nt, Human
agccacgcggcccgaaacagcccc

SEQ ID NO: 1005523 - RNA, 18 nt, Human
agccauuaccuacuguga

SEQ ID NO: 1005524 - RNA, 26 nt, Human
agccccugcuggcucuggcgucuuuc

SEQ ID NO: 1005525 - RNA, 23 nt, Human
aggaggcccggccugcggagggc

SEQ ID NO: 1005526 - RNA, 21 nt, Human
agggcagcaaaaacccccaag

SEQ ID NO: 1005527 - RNA, 23 nt, Human
agggcagcaaaaacccccaagca

SEQ ID NO: 1005528 - RNA, 22 nt, Human
agguacccaaggccccccagcc

SEQ ID NO: 1005529 - RNA, 28 nt, Human
auccagcacacaaggcccacccacaccc

SEQ ID NO: 1005530 - RNA, 21 nt, Human
caaaaacccccaagcacuuuc

SEQ ID NO: 1005531 - RNA, 21 nt, Human
caaggcccacccacaccagcc

SEQ ID NO: 1005532 - RNA, 21 nt, Human
cacaccagccccagcggcccg

SEQ ID NO: 1005533 - RNA, 21 nt, Human
caccacacggccaggccagac

SEQ ID NO: 1005534 - RNA, 26 nt, Human
caccacacggccaggccagaccagca

SEQ ID NO: 1005535 - RNA, 19 nt, Human
cacccuggguauccuccgc

SEQ ID NO: 1005536 - RNA, 18 nt, Human
caccgaggggcgcccagg

SEQ ID NO: 1005537 - RNA, 19 nt, Human
cacgcggcccgaaacagcc

SEQ ID NO: 1005538 - RNA, 26 nt, Human
cagcaaaaacccccaagcacuuucua

SEQ ID NO: 1005539 - RNA, 24 nt, Human
cagcacacaaggcccacccacacc

SEQ ID NO: 1005540 - RNA, 24 nt, Human
cagcauaggaggacgggcuucugg

SEQ ID NO: 1005541 - RNA, 24 nt, Human
caggagcuccaagaacgcagggaa

SEQ ID NO: 1005542 - RNA, 22 nt, Human
cagggcugaggcuccagucucc

SEQ ID NO: 1005543 - RNA, 24 nt, Human
ccaccccugggccccgagguuccc

SEQ ID NO: 1005544 - RNA, 22 nt, Human
ccagcacccgcggacgccagcu

SEQ ID NO: 1005545 - RNA, 18 nt, Human
ccaggacagggcugaggc

SEQ ID NO: 1005546 - RNA, 19 nt, Human
ccaggccagaccagcaccc

SEQ ID NO: 1005547 - RNA, 20 nt, Human
ccaggccagaccagcacccg

SEQ ID NO: 1005548 - RNA, 20 nt, Human
cccacccacaccagccccag

SEQ ID NO: 1005549 - RNA, 24 nt, Human
ccccaccucgacgcgaugcaccug

SEQ ID NO: 1005550 - RNA, 18 nt, Human
ccccccagccugcagcac

SEQ ID NO: 1005551 - RNA, 19 nt, Human
ccccccagccugcagcacc

SEQ ID NO: 1005552 - RNA, 24 nt, Human
cccccgagugcacggggccuucug

SEQ ID NO: 1005553 - RNA, 22 nt, Human
ccccugggccccgagguuccca

SEQ ID NO: 1005554 - RNA, 24 nt, Human
ccccugggccccgagguucccacc

SEQ ID NO: 1005555 - RNA, 20 nt, Human
cccgcuaagccucaucacca

SEQ ID NO: 1005556 - RNA, 19 nt, Human
cccgcugaggagccgggag

SEQ ID NO: 1005557 - RNA, 19 nt, Human
cccggggagccacgcggcc

SEQ ID NO: 1005558 - RNA, 19 nt, Human
cccguggccaggacagggc

SEQ ID NO: 1005559 - RNA, 25 nt, Human
cccguggccaggacagggcugaggc

SEQ ID NO: 1005560 - RNA, 22 nt, Human
cccugggccccgagguucccac

SEQ ID NO: 1005561 - RNA, 23 nt, Human
ccgggccggggugccccucugcc

SEQ ID NO: 1005562 - RNA, 22 nt, Human
cgcagaagaggggagacggccg

SEQ ID NO: 1005563 - RNA, 26 nt, Human
cgccaggagcuccaagaacgcaggag

SEQ ID NO: 1005564 - RNA, 26 nt, Human
cuaaaacagguccaaagacaacacgg

SEQ ID NO: 1005565 - RNA, 21 nt, Human
cuccagucuccuccaaagccc

SEQ ID NO: 1005566 - RNA, 19 nt, Human
cugagccacggccgucacu

SEQ ID NO: 1005567 - RNA, 20 nt, Human
cugaggcuccagucuccucc

SEQ ID NO: 1005568 - RNA, 21 nt, Human
cugaucaaaaaacgaagaaag

SEQ ID NO: 1005569 - RNA, 22 nt, Human
cuggcgucuuuccgggccgggg

SEQ ID NO: 1005570 - RNA, 20 nt, Human
cuugucucacgcccgccucc

SEQ ID NO: 1005571 - RNA, 25 nt, Human
gagagcacucugguggccaaggggc

SEQ ID NO: 1005572 - RNA, 18 nt, Human
gagccgggagcuccgaga

SEQ ID NO: 1005573 - RNA, 18 nt, Human
gcagcaccgaggggcgcc

SEQ ID NO: 1005574 - RNA, 20 nt, Human
gccccgagguucccacccgc

SEQ ID NO: 1005575 - RNA, 21 nt, Human
gccccgagguucccacccgcu

SEQ ID NO: 1005576 - RNA, 21 nt, Human
gccugggcugggccuccucug

SEQ ID NO: 1005577 - RNA, 18 nt, Human
gcggacgccagcuccacc

SEQ ID NO: 1005578 - RNA, 18 nt, Human
ggacuccgguccuccgcc

SEQ ID NO: 1005579 - RNA, 22 nt, Human
ggagggcaccggcagcccccgc

SEQ ID NO: 1005580 - RNA, 23 nt, Human
ggccgagacccggggagccacgg

SEQ ID NO: 1005581 - RNA, 20 nt, Human
gggagccacgcggcccgaaa

SEQ ID NO: 1005582 - RNA, 22 nt, Human
gggcugggccuccucugugagc

SEQ ID NO: 1005583 - RNA, 19 nt, Human
gggcugggcuugucucacg

SEQ ID NO: 1005584 - RNA, 19 nt, Human
guccaaagacaacacggaa

SEQ ID NO: 1005585 - RNA, 19 nt, Human
guuuuugcuuccccuuuca

SEQ ID NO: 1005586 - RNA, 22 nt, Human
uacccaaggccccccagccugc

SEQ ID NO: 1005587 - RNA, 18 nt, Human
uaggagccuggugggucu

SEQ ID NO: 1005588 - RNA, 22 nt, Human
uaggaggacgggcuucuggccc

SEQ ID NO: 1005589 - RNA, 24 nt, Human
uauggauccugagccacggccguc

SEQ ID NO: 1005590 - RNA, 21 nt, Human
uccccuuucagguuuuuaaaa

SEQ ID NO: 1005591 - RNA, 18 nt, Human
uccgccugccugggcugg

SEQ ID NO: 1005592 - RNA, 22 nt, Human
uccgguccuccgccuuccacca

SEQ ID NO: 1005593 - RNA, 21 nt, Human
uccuccgccugccugggcugg

SEQ ID NO: 1005594 - RNA, 18 nt, Human
uccucugugagccagaga

SEQ ID NO: 1005595 - RNA, 23 nt, Human
uccucugugagccagagaaggug

SEQ ID NO: 1005596 - RNA, 24 nt, Human
ugaaaaacggguuuacuaaaacag

SEQ ID NO: 1005597 - RNA, 26 nt, Human
ugaaagaccuuuuuuuuccacaagaa

SEQ ID NO: 1005598 - RNA, 20 nt, Human
ugaaggccagcgcagggggc

SEQ ID NO: 1005599 - RNA, 19 nt, Human
ugagcgcgugcgggcuggg

SEQ ID NO: 1005600 - RNA, 21 nt, Human
ugaggcuccagucuccuccaa

SEQ ID NO: 1005601 - RNA, 21 nt, Human
ugagggaggcccccgagugca

SEQ ID NO: 1005602 - RNA, 23 nt, Human
ugcacggggccuucugcagggac

SEQ ID NO: 1005603 - RNA, 22 nt, Human
ugcagcaccgaggggcgcccag

SEQ ID NO: 1005604 - RNA, 27 nt, Human
ugccugggcugggccuccucugugagc

SEQ ID NO: 1005605 - RNA, 24 nt, Human
ugcggagggcaccggcagcccccg

SEQ ID NO: 1005606 - RNA, 20 nt, Human
uggagugagcaggcuccugg

SEQ ID NO: 1005607 - RNA, 19 nt, Human
uggauccugagccacggcc

SEQ ID NO: 1005608 - RNA, 28 nt, Human
ugggggcagagagcacucuccccgaggg

SEQ ID NO: 1005609 - RNA, 19 nt, Human
uggguauccuccgccugcc

SEQ ID NO: 1005610 - RNA, 23 nt, Human
ugguggccaaggggcuccgccuc

SEQ ID NO: 1005611 - RNA, 23 nt, Human
uguccagccugccgaggucacgc

SEQ ID NO: 1005612 - RNA, 18 nt, Human
ugugaaggccagcgcagg

SEQ ID NO: 1005613 - RNA, 19 nt, Human
uuccagggcagcaaaaacc

SEQ ID NO: 1005614 - RNA, 21 nt, Human
uuggagugagcaggcuccugg

SEQ ID NO: 1005615 - RNA, 23 nt, Human
aaaaaaaaaaaaaaaagcaacua

SEQ ID NO: 1005616 - RNA, 22 nt, Human
aaaaaaagcaacuaaccccaaa

SEQ ID NO: 1005617 - RNA, 26 nt, Human
aaaaaaaugcaggcuuggcuaggcga

SEQ ID NO: 1005618 - RNA, 22 nt, Human
aaaagcaacuaaccccaaaccc

SEQ ID NO: 1005619 - RNA, 24 nt, Human
aaagugcugggauaauaggcauga

SEQ ID NO: 1005620 - RNA, 24 nt, Human
aaccccaaacccagaucucuaaag

SEQ ID NO: 1005621 - RNA, 20 nt, Human
aaccucugccuccccggcuc

SEQ ID NO: 1005622 - RNA, 23 nt, Human
aacuaaccccaaacccagaucuc

SEQ ID NO: 1005623 - RNA, 22 nt, Human
aagaacacaagcacaccggagg

SEQ ID NO: 1005624 - RNA, 21 nt, Human
aagagccccgggagggagcag

SEQ ID NO: 1005625 - RNA, 21 nt, Human
aagcaacuaaccccaaaccca

SEQ ID NO: 1005626 - RNA, 24 nt, Human
aagcagccugauccucccgaaggu

SEQ ID NO: 1005627 - RNA, 22 nt, Human
aagcaucuuuaggcuguuccuu

SEQ ID NO: 1005628 - RNA, 21 nt, Human
aagcccaggaguucgaggcug

SEQ ID NO: 1005629 - RNA, 19 nt, Human
aagcuaaauguugggcuga

SEQ ID NO: 1005630 - RNA, 18 nt, Human
aagcugcagugacugcac

SEQ ID NO: 1005631 - RNA, 24 nt, Human
aagugauccacccaccuuggccuc

SEQ ID NO: 1005632 - RNA, 19 nt, Human
aagugcugggauaauaggc

SEQ ID NO: 1005633 - RNA, 23 nt, Human
aaugauguaggaacucaaaaaaa

SEQ ID NO: 1005634 - RNA, 20 nt, Human
acaccaccaugcccagcuaa

SEQ ID NO: 1005635 - RNA, 22 nt, Human
acagacacccccacugcuccca

SEQ ID NO: 1005636 - RNA, 23 nt, Human
acagacccagaaagccaggggca

SEQ ID NO: 1005637 - RNA, 21 nt, Human
acagagaccaacccugucuca

SEQ ID NO: 1005638 - RNA, 20 nt, Human
accaggaggaaacccacagc

SEQ ID NO: 1005639 - RNA, 20 nt, Human
accccaaacccagaucucua

SEQ ID NO: 1005640 - RNA, 22 nt, Human
accuugucucuacaaaaaauaa

SEQ ID NO: 1005641 - RNA, 24 nt, Human
acuagagcucuggacggccuaaag

SEQ ID NO: 1005642 - RNA, 22 nt, Human
acuccacagacacccccacugc

SEQ ID NO: 1005643 - RNA, 18 nt, Human
acuccgucgcccaggcug

SEQ ID NO: 1005644 - RNA, 19 nt, Human
acuccgucgcccaggcugg

SEQ ID NO: 1005645 - RNA, 25 nt, Human
acuccgucgcccaggcuggaguaca

SEQ ID NO: 1005646 - RNA, 24 nt, Human
acugcccucaagcuugggcaacag

SEQ ID NO: 1005647 - RNA, 23 nt, Human
agaaaaacacacgcaacuccugg

SEQ ID NO: 1005648 - RNA, 19 nt, Human
agaaagccaggggcacaca

SEQ ID NO: 1005649 - RNA, 22 nt, Human
agaggcacagacccagaaagcc

SEQ ID NO: 1005650 - RNA, 22 nt, Human
agcaacuaaccccaaacccaga

SEQ ID NO: 1005651 - RNA, 19 nt, Human
agcaucagaagcagccuga

SEQ ID NO: 1005652 - RNA, 19 nt, Human
agcuggcacuggccagagg

SEQ ID NO: 1005653 - RNA, 23 nt, Human
agcugggcaugguggcacaugcc

SEQ ID NO: 1005654 - RNA, 23 nt, Human
aggaaugugccgguucacaggga

SEQ ID NO: 1005655 - RNA, 20 nt, Human
aggaguuugagaccagucug

SEQ ID NO: 1005656 - RNA, 19 nt, Human
aggcacagacccagaaagc

SEQ ID NO: 1005657 - RNA, 19 nt, Human
aggcaggggggguggcagg

SEQ ID NO: 1005658 - RNA, 19 nt, Human
aggcaggggggguggcagg

SEQ ID NO: 1005659 - RNA, 22 nt, Human
aggcaggggggguggcagggag

SEQ ID NO: 1005660 - RNA, 20 nt, Human
aggcaugagccaccaugccc

SEQ ID NO: 1005661 - RNA, 21 nt, Human
aggcaugagccaccaugcccg

SEQ ID NO: 1005662 - RNA, 21 nt, Human
aggcgaaguggcucaugccug

SEQ ID NO: 1005663 - RNA, 19 nt, Human
aggcugagguagaaggauc

SEQ ID NO: 1005664 - RNA, 18 nt, Human
aggcugcgagucgggggg

SEQ ID NO: 1005665 - RNA, 20 nt, Human
agggagcccuccacccuccc

SEQ ID NO: 1005666 - RNA, 19 nt, Human
agggccugccacuccaggg

SEQ ID NO: 1005667 - RNA, 26 nt, Human
agggggguaugcggacugaccuucgg

SEQ ID NO: 1005668 - RNA, 19 nt, Human
aggguggggcuggcuccag

SEQ ID NO: 1005669 - RNA, 22 nt, Human
aggugaugaagaagagccccgg

SEQ ID NO: 1005670 - RNA, 20 nt, Human
aguacaguggugcgaucucg

SEQ ID NO: 1005671 - RNA, 24 nt, Human
aguacaguggugcgaucucggcuc

SEQ ID NO: 1005672 - RNA, 18 nt, Human
aguagcuggcauuacagg

SEQ ID NO: 1005673 - RNA, 24 nt, Human
agucuggacaacauagcaagaccu

SEQ ID NO: 1005674 - RNA, 19 nt, Human
agugauccacccaccuugg

SEQ ID NO: 1005675 - RNA, 24 nt, Human
aguggcucaugccugcaauccaag

SEQ ID NO: 1005676 - RNA, 24 nt, Human
auccuuguauuuuuaguagagaug

SEQ ID NO: 1005677 - RNA, 22 nt, Human
augccucagccuccugaguagc

SEQ ID NO: 1005678 - RNA, 20 nt, Human
auggggucuugccauguugg

SEQ ID NO: 1005679 - RNA, 24 nt, Human
caaagugcugggauaauaggcaug

SEQ ID NO: 1005680 - RNA, 25 nt, Human
caacagagaccaacccugucucaau

SEQ ID NO: 1005681 - RNA, 22 nt, Human
caacauagcaagaccuugucuc

SEQ ID NO: 1005682 - RNA, 24 nt, Human
caacauagcaagaccuugucucua

SEQ ID NO: 1005683 - RNA, 24 nt, Human
caacuaaccccaaacccagaucuc

SEQ ID NO: 1005684 - RNA, 19 nt, Human
caacuccuggggguggcuc

SEQ ID NO: 1005685 - RNA, 21 nt, Human
caagaaaugcuuuugcuacau

SEQ ID NO: 1005686 - RNA, 28 nt, Human
caagcgauucucaugccucagccuccug

SEQ ID NO: 1005687 - RNA, 23 nt, Human
caagcuugggcaacagagaccaa

SEQ ID NO: 1005688 - RNA, 19 nt, Human
caaggguagugaaaagacc

SEQ ID NO: 1005689 - RNA, 18 nt, Human
caaugggucuccuccagu

SEQ ID NO: 1005690 - RNA, 18 nt, Human
cacaagcacaccggaggg

SEQ ID NO: 1005691 - RNA, 22 nt, Human
cacaaucuagggugagccaccc

SEQ ID NO: 1005692 - RNA, 19 nt, Human
cacacaccaccaugcccag

SEQ ID NO: 1005693 - RNA, 18 nt, Human
cacaccaccaugcccagc

SEQ ID NO: 1005694 - RNA, 20 nt, Human
cacaggagccucgccagcga

SEQ ID NO: 1005695 - RNA, 19 nt, Human
cacagggacccgcggcuaa

SEQ ID NO: 1005696 - RNA, 19 nt, Human
caccaaaccggggacgccg

SEQ ID NO: 1005697 - RNA, 20 nt, Human
caccaaaccggggacgccgc

SEQ ID NO: 1005698 - RNA, 18 nt, Human
caccagagcagucuuggg

SEQ ID NO: 1005699 - RNA, 21 nt, Human
caccagagcagucuugggggc

SEQ ID NO: 1005700 - RNA, 19 nt, Human
caccagcccccacacucac

SEQ ID NO: 1005701 - RNA, 22 nt, Human
cacccaccuuggccucccaaag

SEQ ID NO: 1005702 - RNA, 23 nt, Human
cacccaccuuggccucccaaagu

SEQ ID NO: 1005703 - RNA, 22 nt, Human
cacccucccaccacguaugccc

SEQ ID NO: 1005704 - RNA, 24 nt, Human
cacucaccaagaaaugcuuuugcc

SEQ ID NO: 1005705 - RNA, 21 nt, Human
cacuccacagacacccccacu

SEQ ID NO: 1005706 - RNA, 22 nt, Human
cacuccgucgcccaggcuggag

SEQ ID NO: 1005707 - RNA, 18 nt, Human
cacugcaaccucugccuc

SEQ ID NO: 1005708 - RNA, 24 nt, Human
cacugcccucaagcuugggcaaca

SEQ ID NO: 1005709 - RNA, 22 nt, Human
cagagggagcccuccacccucc

SEQ ID NO: 1005710 - RNA, 19 nt, Human
cagccuccugaguagcugg

SEQ ID NO: 1005711 - RNA, 18 nt, Human
cagccugauccucccgaa

SEQ ID NO: 1005712 - RNA, 20 nt, Human
caggaguucgaggcugcaau

SEQ ID NO: 1005713 - RNA, 19 nt, Human
cagggacauccccccgccc

SEQ ID NO: 1005714 - RNA, 19 nt, Human
cagggacccgcggcuaagc

SEQ ID NO: 1005715 - RNA, 22 nt, Human
cagugccaagaggaagcagagc

SEQ ID NO: 1005716 - RNA, 19 nt, Human
cagugcccugcuggacagg

SEQ ID NO: 1005717 - RNA, 25 nt, Human
cauagcaagaccuugucucuacaaa

SEQ ID NO: 1005718 - RNA, 23 nt, Human
caugagccaccaugcccggccau

SEQ ID NO: 1005719 - RNA, 24 nt, Human
caugccucagccuccugaguagcu

SEQ ID NO: 1005720 - RNA, 24 nt, Human
cauguuggccaggcuggucucgaa

SEQ ID NO: 1005721 - RNA, 24 nt, Human
cauuacaggcacacaccaccaugc

SEQ ID NO: 1005722 - RNA, 24 nt, Human
ccaaagugcugggauaauaggcau

SEQ ID NO: 1005723 - RNA, 25 nt, Human
ccacuccaggggcucccaggcugga

SEQ ID NO: 1005724 - RNA, 24 nt, Human
ccacugcccucaagcuugggcaac

SEQ ID NO: 1005725 - RNA, 24 nt, Human
ccagagcagucuugggggcaggag

SEQ ID NO: 1005726 - RNA, 22 nt, Human
ccaugcccggccaugcuggggc

SEQ ID NO: 1005727 - RNA, 19 nt, Human
ccauguuggccaggcuggu

SEQ ID NO: 1005728 - RNA, 22 nt, Human
ccauguuggccaggcuggucuc

SEQ ID NO: 1005729 - RNA, 23 nt, Human
ccauguuggccaggcuggucucg

SEQ ID NO: 1005730 - RNA, 19 nt, Human
cccagcagccagagcacac

SEQ ID NO: 1005731 - RNA, 21 nt, Human
ccccacugcucccaaggucca

SEQ ID NO: 1005732 - RNA, 21 nt, Human
cccccucagcuccucccagca

SEQ ID NO: 1005733 - RNA, 20 nt, Human
ccccggcucaagcgauucuc

SEQ ID NO: 1005734 - RNA, 19 nt, Human
cccucagcaggggucuucc

SEQ ID NO: 1005735 - RNA, 19 nt, Human
ccgucgcccaggcuggagu

SEQ ID NO: 1005736 - RNA, 19 nt, Human
ccgugcugacgcugacugc

SEQ ID NO: 1005737 - RNA, 19 nt, Human
ccuauaguuccugcuaccu

SEQ ID NO: 1005738 - RNA, 20 nt, Human
ccucaggggugcuguggccc

SEQ ID NO: 1005739 - RNA, 22 nt, Human
ccucaggggugcuguggcccug

SEQ ID NO: 1005740 - RNA, 24 nt, Human
ccugaccucaagugauccacccac

SEQ ID NO: 1005741 - RNA, 23 nt, Human
ccugaguagcuggcauuacaggc

SEQ ID NO: 1005742 - RNA, 19 nt, Human
ccugcagcggucugggcag

SEQ ID NO: 1005743 - RNA, 22 nt, Human
cgacuccgagccucacagcccc

SEQ ID NO: 1005744 - RNA, 22 nt, Human
cuaggguggggcuggcuccagu

SEQ ID NO: 1005745 - RNA, 24 nt, Human
cucaagugauccacccaccuuggc

SEQ ID NO: 1005746 - RNA, 25 nt, Human
cucacugcaaccucugccuccccgg

SEQ ID NO: 1005747 - RNA, 25 nt, Human
cucaugccucagccuccugaguagc

SEQ ID NO: 1005748 - RNA, 23 nt, Human
cuccacagacacccccacugcuc

SEQ ID NO: 1005749 - RNA, 24 nt, Human
cuccgagccucacagccccacuuc

SEQ ID NO: 1005750 - RNA, 23 nt, Human
cuccuguucccccucagcuccuc

SEQ ID NO: 1005751 - RNA, 18 nt, Human
cucugugccuggggccug

SEQ ID NO: 1005752 - RNA, 21 nt, Human
cugaagccagcugagcacagc

SEQ ID NO: 1005753 - RNA, 20 nt, Human
cugcaaccucugccuccccg

SEQ ID NO: 1005754 - RNA, 20 nt, Human
cuggacaacauagcaagacc

SEQ ID NO: 1005755 - RNA, 18 nt, Human
gacacagauacuggcucc

SEQ ID NO: 1005756 - RNA, 23 nt, Human
gaccucaagugauccacccaccu

SEQ ID NO: 1005757 - RNA, 24 nt, Human
gagagggagucucacuccgucgcc

SEQ ID NO: 1005758 - RNA, 19 nt, Human
gagcacagcuggcacuggc

SEQ ID NO: 1005759 - RNA, 22 nt, Human
gagccucacagccccacuuccg

SEQ ID NO: 1005760 - RNA, 24 nt, Human
gaguagcuggcauuacaggcacac

SEQ ID NO: 1005761 - RNA, 18 nt, Human
gauaauaggcaugagcca

SEQ ID NO: 1005762 - RNA, 24 nt, Human
gauaauaggcaugagccaccaugc

SEQ ID NO: 1005763 - RNA, 21 nt, Human
gauucucaugccucagccucc

SEQ ID NO: 1005764 - RNA, 19 nt, Human
gcacacaccaccaugccca

SEQ ID NO: 1005765 - RNA, 18 nt, Human
gcacagacccagaaagcc

SEQ ID NO: 1005766 - RNA, 22 nt, Human
gcacagacccagaaagccaggg

SEQ ID NO: 1005767 - RNA, 20 nt, Human
gcauuacaggcacacaccac

SEQ ID NO: 1005768 - RNA, 20 nt, Human
gcccaggcuggaguacagug

SEQ ID NO: 1005769 - RNA, 18 nt, Human
gccccgggagggagcagg

SEQ ID NO: 1005770 - RNA, 22 nt, Human
gcccugcuccuguucccccuca

SEQ ID NO: 1005771 - RNA, 22 nt, Human
gccgcaacaccaaaccggggac

SEQ ID NO: 1005772 - RNA, 22 nt, Human
gccugauccucccgaagguggg

SEQ ID NO: 1005773 - RNA, 24 nt, Human
gcgauucucaugccucagccuccu

SEQ ID NO: 1005774 - RNA, 23 nt, Human
gcgggcggcggcgacacagauac

SEQ ID NO: 1005775 - RNA, 19 nt, Human
gcuaccugggaggcugagg

SEQ ID NO: 1005776 - RNA, 19 nt, Human
gcucugugccuggggccug

SEQ ID NO: 1005777 - RNA, 23 nt, Human
gcuggucucgaacuccugaccuc

SEQ ID NO: 1005778 - RNA, 19 nt, Human
ggaggcaguccggcccuca

SEQ ID NO: 1005779 - RNA, 21 nt, Human
ggagggagcaggcagcucugu

SEQ ID NO: 1005780 - RNA, 24 nt, Human
ggauaauaggcaugagccaccaug

SEQ ID NO: 1005781 - RNA, 24 nt, Human
ggcagggacauccccccgcccucu

SEQ ID NO: 1005782 - RNA, 24 nt, Human
ggcuggucucgaacuccugaccuc

SEQ ID NO: 1005783 - RNA, 25 nt, Human
gggaagcaggcuguucccugagacc

SEQ ID NO: 1005784 - RNA, 19 nt, Human
gggagcccuccacccuccc

SEQ ID NO: 1005785 - RNA, 19 nt, Human
gggcgccgcaacaccaaac

SEQ ID NO: 1005786 - RNA, 22 nt, Human
gggcucucgggguuggguggac

SEQ ID NO: 1005787 - RNA, 19 nt, Human
gggcuuuuuucuuuuuuug

SEQ ID NO: 1005788 - RNA, 22 nt, Human
ggggucuugccauguuggccag

SEQ ID NO: 1005789 - RNA, 23 nt, Human
ggguaagacaagauucuggagag

SEQ ID NO: 1005790 - RNA, 23 nt, Human
ggguagugaaaagaccacuuccu

SEQ ID NO: 1005791 - RNA, 20 nt, Human
ggguccugggcucaggcagg

SEQ ID NO: 1005792 - RNA, 22 nt, Human
gggucuugccauguuggccagg

SEQ ID NO: 1005793 - RNA, 20 nt, Human
gggugcaggugggcgacagg

SEQ ID NO: 1005794 - RNA, 22 nt, Human
gggugcuguggcccugcuccug

SEQ ID NO: 1005795 - RNA, 23 nt, Human
ggguguggacuagagcucuggac

SEQ ID NO: 1005796 - RNA, 19 nt, Human
gguccugggcucaggcagg

SEQ ID NO: 1005797 - RNA, 19 nt, Human
ggucucgaacuccugaccu

SEQ ID NO: 1005798 - RNA, 27 nt, Human
ggugaugaagaagagccccgggaggga

SEQ ID NO: 1005799 - RNA, 24 nt, Human
gguggcacaugccuauaguuccug

SEQ ID NO: 1005800 - RNA, 18 nt, Human
guaagacaagauucugga

SEQ ID NO: 1005801 - RNA, 23 nt, Human
guagagauggggucuugccaugu

SEQ ID NO: 1005802 - RNA, 23 nt, Human
gucagugccaagaggaagcagag

SEQ ID NO: 1005803 - RNA, 20 nt, Human
gugaggugaugaagaagaga

SEQ ID NO: 1005804 - RNA, 24 nt, Human
gugauccacccaccuuggccuccc

SEQ ID NO: 1005805 - RNA, 20 nt, Human
gugccaagaggaagcagagc

SEQ ID NO: 1005806 - RNA, 28 nt, Human
guuuguguccuuucaggucgucgacagg

SEQ ID NO: 1005807 - RNA, 19 nt, Human
uaagaaaaacacacgcaac

SEQ ID NO: 1005808 - RNA, 18 nt, Human
uaagaacacaagcacacc

SEQ ID NO: 1005809 - RNA, 19 nt, Human
uaagaacacaagcacaccg

SEQ ID NO: 1005810 - RNA, 22 nt, Human
uaaggggaggcaguccggcccu

SEQ ID NO: 1005811 - RNA, 23 nt, Human
uaaggggaggcaguccggcccuc

SEQ ID NO: 1005812 - RNA, 24 nt, Human
uaauccuuguauuuuuaguagaga

SEQ ID NO: 1005813 - RNA, 23 nt, Human
uagaaggaucccuuaagcccagg

SEQ ID NO: 1005814 - RNA, 22 nt, Human
uagagauggggucuugccaugu

SEQ ID NO: 1005815 - RNA, 22 nt, Human
uagagcucuggacggccuaaag

SEQ ID NO: 1005816 - RNA, 18 nt, Human
uagcauguuucuggcaag

SEQ ID NO: 1005817 - RNA, 18 nt, Human
uagcuggcauuacaggca

SEQ ID NO: 1005818 - RNA, 22 nt, Human
uagcugggcaugguggcacaug

SEQ ID NO: 1005819 - RNA, 24 nt, Human
uaguagagauggggucuugccaug

SEQ ID NO: 1005820 - RNA, 24 nt, Human
uaucgcuugagcccaggaguuuga

SEQ ID NO: 1005821 - RNA, 21 nt, Human
ucaaaaaaaugcaggcuuggc

SEQ ID NO: 1005822 - RNA, 25 nt, Human
ucaauuaaaaaaaaaaaaaaaaaaa

SEQ ID NO: 1005823 - RNA, 27 nt, Human
ucaauuaaaaaaaaaaaaaaaaaaagc

SEQ ID NO: 1005824 - RNA, 21 nt, Human
ucacugagguucuucuagugg

SEQ ID NO: 1005825 - RNA, 23 nt, Human
ucacugagguucuucuaguggcu

SEQ ID NO: 1005826 - RNA, 19 nt, Human
ucacugcaaccucugccuc

SEQ ID NO: 1005827 - RNA, 24 nt, Human
ucacugcaaccucugccuccccgg

SEQ ID NO: 1005828 - RNA, 27 nt, Human
ucacugcaaccucugccuccccggcuc

SEQ ID NO: 1005829 - RNA, 20 nt, Human
ucagccuccugaguagcugg

SEQ ID NO: 1005830 - RNA, 20 nt, Human
ucaggcaggggggguggcag

SEQ ID NO: 1005831 - RNA, 24 nt, Human
uccacagacacccccacugcuccc

SEQ ID NO: 1005832 - RNA, 24 nt, Human
uccacagacacccccacugcuccc

SEQ ID NO: 1005833 - RNA, 20 nt, Human
uccacuugugugggugcagg

SEQ ID NO: 1005834 - RNA, 21 nt, Human
uccaguuuguguccuuucagg

SEQ ID NO: 1005835 - RNA, 24 nt, Human
ucccaaagugcugggauaauaggc

SEQ ID NO: 1005836 - RNA, 20 nt, Human
ucccagcagccagagcacac

SEQ ID NO: 1005837 - RNA, 23 nt, Human
uccccagggaccugcagcggucu

SEQ ID NO: 1005838 - RNA, 18 nt, Human
ucccccucagcuccuccc

SEQ ID NO: 1005839 - RNA, 21 nt, Human
uccccggcucaagcgauucuc

SEQ ID NO: 1005840 - RNA, 21 nt, Human
uccccggcucaagcgauucuc

SEQ ID NO: 1005841 - RNA, 23 nt, Human
ucccuuaagcccaggaguucgag

SEQ ID NO: 1005842 - RNA, 23 nt, Human
uccggcgacuccgagccucacag

SEQ ID NO: 1005843 - RNA, 26 nt, Human
uccucccagcaaugggucuccuccag

SEQ ID NO: 1005844 - RNA, 19 nt, Human
uccugagaucugggccaca

SEQ ID NO: 1005845 - RNA, 24 nt, Human
uccugaguagcuggcauuacaggc

SEQ ID NO: 1005846 - RNA, 20 nt, Human
uccuuguauuuuuaguagag

SEQ ID NO: 1005847 - RNA, 24 nt, Human
ucgcccaggcuggaguacaguggu

SEQ ID NO: 1005848 - RNA, 19 nt, Human
ucgcuugagcccaggaguu

SEQ ID NO: 1005849 - RNA, 23 nt, Human
ucucacuccgucgcccaggcugg

SEQ ID NO: 1005850 - RNA, 24 nt, Human
ucucacuccgucgcccaggcugga

SEQ ID NO: 1005851 - RNA, 25 nt, Human
ucucacuccgucgcccaggcuggag

SEQ ID NO: 1005852 - RNA, 21 nt, Human
ucuccgagagaugggcuccca

SEQ ID NO: 1005853 - RNA, 21 nt, Human
ucucgaacuccugaccucaag

SEQ ID NO: 1005854 - RNA, 18 nt, Human
ucucgggguuggguggac

SEQ ID NO: 1005855 - RNA, 23 nt, Human
ucuugccauguuggccaggcugg

SEQ ID NO: 1005856 - RNA, 24 nt, Human
ucuugccauguuggccaggcuggu

SEQ ID NO: 1005857 - RNA, 18 nt, Human
ugaaaaaaggaugcagcc

SEQ ID NO: 1005858 - RNA, 24 nt, Human
ugaagaagagccccgggagggagc

SEQ ID NO: 1005859 - RNA, 18 nt, Human
ugacacagacaggcacuc

SEQ ID NO: 1005860 - RNA, 19 nt, Human
ugacacagacaggcacucc

SEQ ID NO: 1005861 - RNA, 23 nt, Human
ugagcccaggaguuugagaccag

SEQ ID NO: 1005862 - RNA, 30 nt, Human
ugaggaaacgcugcgcucccccucaauucc

SEQ ID NO: 1005863 - RNA, 20 nt, Human
ugagguucuucuaguggcug

SEQ ID NO: 1005864 - RNA, 19 nt, Human
ugagucaugcacuccacag

SEQ ID NO: 1005865 - RNA, 24 nt, Human
ugauccacccaccuuggccuccca

SEQ ID NO: 1005866 - RNA, 22 nt, Human
ugcaaugaguuaugauugcacc

SEQ ID NO: 1005867 - RNA, 19 nt, Human
ugcaccacugcccucaagc

SEQ ID NO: 1005868 - RNA, 27 nt, Human
ugccacuccaggggcucccaggcugga

SEQ ID NO: 1005869 - RNA, 24 nt, Human
ugccauguuggccaggcuggucuc

SEQ ID NO: 1005870 - RNA, 27 nt, Human
ugccauguuggccaggcuggucucgaa

SEQ ID NO: 1005871 - RNA, 22 nt, Human
ugccuaggguggggcuggcucc

SEQ ID NO: 1005872 - RNA, 24 nt, Human
ugccucagccuccugaguagcugg

SEQ ID NO: 1005873 - RNA, 23 nt, Human
ugccugcaauccaagcacucugg

SEQ ID NO: 1005874 - RNA, 18 nt, Human
ugccuggggccuggccag

SEQ ID NO: 1005875 - RNA, 24 nt, Human
uggaguacaguggugcgaucucgg

SEQ ID NO: 1005876 - RNA, 19 nt, Human
uggcacaugccuauaguuc

SEQ ID NO: 1005877 - RNA, 23 nt, Human
uggcauuacaggcacacaccacc

SEQ ID NO: 1005878 - RNA, 24 nt, Human
uggcauuacaggcacacaccacca

SEQ ID NO: 1005879 - RNA, 20 nt, Human
uggccagaccucaggggugc

SEQ ID NO: 1005880 - RNA, 24 nt, Human
uggccaggcuggucucgaacuccu

SEQ ID NO: 1005881 - RNA, 24 nt, Human
uggcuaggcgaaguggcucaugcc

SEQ ID NO: 1005882 - RNA, 22 nt, Human
uggcucaugccugcaauccaag

SEQ ID NO: 1005883 - RNA, 24 nt, Human
uggcucaugccugcaauccaagca

SEQ ID NO: 1005884 - RNA, 26 nt, Human
uggcugagaggauaucuuccaagcau

SEQ ID NO: 1005885 - RNA, 25 nt, Human
ugggaagcaggcuguucccugagac

SEQ ID NO: 1005886 - RNA, 19 nt, Human
ugggaggcugagguagaag

SEQ ID NO: 1005887 - RNA, 23 nt, Human
ugggauaauaggcaugagccacc

SEQ ID NO: 1005888 - RNA, 24 nt, Human
ugggauaauaggcaugagccacca

SEQ ID NO: 1005889 - RNA, 21 nt, Human
ugggcgccgcaacaccaaacc

SEQ ID NO: 1005890 - RNA, 24 nt, Human
uggggucuugccauguuggccagg

SEQ ID NO: 1005891 - RNA, 23 nt, Human
ugguggcacaugccuauaguucc

SEQ ID NO: 1005892 - RNA, 21 nt, Human
uguauuuuuaguagagauggg

SEQ ID NO: 1005893 - RNA, 21 nt, Human
uuaagcccaggaguucgaggc

SEQ ID NO: 1005894 - RNA, 18 nt, Human
uuagcugggcaugguggc

SEQ ID NO: 1005895 - RNA, 24 nt, Human
uuagcugggcaugguggcacaugc

SEQ ID NO: 1005896 - RNA, 18 nt, Human
uuaguagagauggggucu

SEQ ID NO: 1005897 - RNA, 23 nt, Human
uuaguagagauggggucuugcca

SEQ ID NO: 1005898 - RNA, 24 nt, Human
uuaguagagauggggucuugccau

SEQ ID NO: 1005899 - RNA, 22 nt, Human
uugagcccaggaguuugagacc

SEQ ID NO: 1005900 - RNA, 24 nt, Human
uugccauguuggccaggcuggucu

SEQ ID NO: 1005901 - RNA, 18 nt, Human
uuggccucccaaagugcu

SEQ ID NO: 1005902 - RNA, 23 nt, Human
uuguauuuuuaguagagaugggg

SEQ ID NO: 1005903 - RNA, 19 nt, Human
uuuggaugacccugaaggc

SEQ ID NO: 1005904 - RNA, 23 nt, Human
uuuucuuuuuuugagagggaguc

SEQ ID NO: 1005905 - RNA, 21 nt, Human
uuuuuaguagagauggggucu

SEQ ID NO: 1005906 - RNA, 21 nt, Human
uuuuuucuuuuuuugagaggg

SEQ ID NO: 1005907 - RNA, 20 nt, Human
aaaaaaagacaaaucguggc

SEQ ID NO: 1005908 - RNA, 22 nt, Human
aaaaaaagacaaaucguggcaa

SEQ ID NO: 1005909 - RNA, 20 nt, Human
aaaaagacaaaucguggcaa

SEQ ID NO: 1005910 - RNA, 23 nt, Human
aaacagaugaaaauauugcccau

SEQ ID NO: 1005911 - RNA, 21 nt, Human
aaaugcuuacaagcaccaaca

SEQ ID NO: 1005912 - RNA, 21 nt, Human
accaacaccaaaauucugucu

SEQ ID NO: 1005913 - RNA, 21 nt, Human
acuauugcuaaaaaugacauc

SEQ ID NO: 1005914 - RNA, 19 nt, Human
agagguuguaugcuuccuc

SEQ ID NO: 1005915 - RNA, 19 nt, Human
agcuauaacaccauuuaca

SEQ ID NO: 1005916 - RNA, 20 nt, Human
auggccacaauuaaaugagu

SEQ ID NO: 1005917 - RNA, 24 nt, Human
caagaaauagccuauguucaauau

SEQ ID NO: 1005918 - RNA, 21 nt, Human
caccaacaccaaaauucuguc

SEQ ID NO: 1005919 - RNA, 26 nt, Human
ccauuuacaaaucauuaugaacaaga

SEQ ID NO: 1005920 - RNA, 19 nt, Human
cuacaaguaaacagaugaa

SEQ ID NO: 1005921 - RNA, 25 nt, Human
cucauaaucucucucuccagguauc

SEQ ID NO: 1005922 - RNA, 19 nt, Human
gcuuacaagcaccaacacc

SEQ ID NO: 1005923 - RNA, 22 nt, Human
uaaaaaaagacaaaucguggca

SEQ ID NO: 1005924 - RNA, 20 nt, Human
uaaaagaagcaauacauuug

SEQ ID NO: 1005925 - RNA, 21 nt, Human
uacaagcaccaacaccaaaau

SEQ ID NO: 1005926 - RNA, 26 nt, Human
uauaaaaaaagacaaaucguggcaac

SEQ ID NO: 1005927 - RNA, 22 nt, Human
uaugaacaagauaaauucugca

SEQ ID NO: 1005928 - RNA, 21 nt, Human
ucauaaucucucucuccaggu

SEQ ID NO: 1005929 - RNA, 19 nt, Human
ugaaaaugcuuacaagcac

SEQ ID NO: 1005930 - RNA, 27 nt, Human
ugaacaagauaaauucugcaauaauau

SEQ ID NO: 1005931 - RNA, 20 nt, Human
uuaaacagccaugucuuggc

SEQ ID NO: 1005932 - RNA, 18 nt, Human
uuguaugcuuccuccucu

SEQ ID NO: 1005933 - RNA, 22 nt, Human
uuuccaugaguuuucuauuaug

SEQ ID NO: 1005934 - RNA, 22 nt, Human
aaaaacaaaacaaaaauaccac

SEQ ID NO: 1005935 - RNA, 20 nt, Human
aaaaagacgacacaaggaca

SEQ ID NO: 1005936 - RNA, 22 nt, Human
aaaaagacgacacaaggacagg

SEQ ID NO: 1005937 - RNA, 26 nt, Human
aaaaagacgacacaaggacaggcugg

SEQ ID NO: 1005938 - RNA, 19 nt, Human
aaaacaaaacaaaaauacc

SEQ ID NO: 1005939 - RNA, 20 nt, Human
aaaaggacagaccaucuaag

SEQ ID NO: 1005940 - RNA, 21 nt, Human
aaaauaccacagcucaagaua

SEQ ID NO: 1005941 - RNA, 21 nt, Human
aaacaaaacaaaaauaccaca

SEQ ID NO: 1005942 - RNA, 24 nt, Human
aauuuaaaagacaaaaacaaaaca

SEQ ID NO: 1005943 - RNA, 18 nt, Human
acaaaacaaaaauaccac

SEQ ID NO: 1005944 - RNA, 21 nt, Human
caaaacaaaaauaccacagcu

SEQ ID NO: 1005945 - RNA, 22 nt, Human
cacagcucaagauaaagagucc

SEQ ID NO: 1005946 - RNA, 22 nt, Human
cagaccaucuaaggaaaaauua

SEQ ID NO: 1005947 - RNA, 21 nt, Human
cagcucaagauaaagaguccu

SEQ ID NO: 1005948 - RNA, 22 nt, Human
ccaucuaaggaaaaauuaaaaa

SEQ ID NO: 1005949 - RNA, 23 nt, Human
gggcggcguuggcagagagacag

SEQ ID NO: 1005950 - RNA, 19 nt, Human
uaaaaagacgacacaagga

SEQ ID NO: 1005951 - RNA, 22 nt, Human
uaaaagacaaaaacaaaacaaa

SEQ ID NO: 1005952 - RNA, 22 nt, Human
uacagaaaucacaaaaaggaca

SEQ ID NO: 1005953 - RNA, 25 nt, Human
uauacaagggcucaaccgaggcuua

SEQ ID NO: 1005954 - RNA, 21 nt, Human
ucuaaggaaaaauuaaaaaga

SEQ ID NO: 1005955 - RNA, 22 nt, Human
ucuaaggaaaaauuaaaaagac

SEQ ID NO: 1005956 - RNA, 22 nt, Human
uuaaaaagacgacacaaggaca

SEQ ID NO: 1005957 - RNA, 21 nt, Human
uuuuuuuuuuuaaaaaaggac

SEQ ID NO: 1005958 - RNA, 22 nt, Human
aaacugacaucuuagacaacac

SEQ ID NO: 1005959 - RNA, 23 nt, Human
aaacugacaucuuagacaacaca

SEQ ID NO: 1005960 - RNA, 23 nt, Human
aagucaaguauaacaaaaucaaa

SEQ ID NO: 1005961 - RNA, 21 nt, Human
agacaaauaguagaaaaagca

SEQ ID NO: 1005962 - RNA, 24 nt, Human
auacagauuuauaaaacugacauc

SEQ ID NO: 1005963 - RNA, 18 nt, Human
caaauaguagaaaaagca

SEQ ID NO: 1005964 - RNA, 23 nt, Human
caagacaaauaguagaaaaagca

SEQ ID NO: 1005965 - RNA, 21 nt, Human
caaguauaacaaaaucaaaac

SEQ ID NO: 1005966 - RNA, 23 nt, Human
caauacuguucacaggaaaaaag

SEQ ID NO: 1005967 - RNA, 18 nt, Human
ccgcucccuggcucgcuc

SEQ ID NO: 1005968 - RNA, 24 nt, Human
cgccggucccugcuccgugugcgc

SEQ ID NO: 1005969 - RNA, 18 nt, Human
cucccuggcucgcuccgg

SEQ ID NO: 1005970 - RNA, 18 nt, Human
cuccgcgcgguggguccc

SEQ ID NO: 1005971 - RNA, 19 nt, Human
ggaaaaaauucaaauguga

SEQ ID NO: 1005972 - RNA, 27 nt, Human
gggcucgcuggcagcuaggcuggcucc

SEQ ID NO: 1005973 - RNA, 23 nt, Human
guaaaaacaucuaguuucagcaa

SEQ ID NO: 1005974 - RNA, 18 nt, Human
uaaaauggguaaaaauca

SEQ ID NO: 1005975 - RNA, 22 nt, Human
uaaaugcucucaucacagucuu

SEQ ID NO: 1005976 - RNA, 21 nt, Human
uaacaaagaaugaaaucugaa

SEQ ID NO: 1005977 - RNA, 23 nt, Human
uaacaaagaaugaaaucugaaua

SEQ ID NO: 1005978 - RNA, 19 nt, Human
uaagaaaucugcaaucaau

SEQ ID NO: 1005979 - RNA, 22 nt, Human
uaagucaaguauaacaaaauca

SEQ ID NO: 1005980 - RNA, 21 nt, Human
uacagaauauccuaagacaag

SEQ ID NO: 1005981 - RNA, 24 nt, Human
uacuguucacaggaaaaaaguaau

SEQ ID NO: 1005982 - RNA, 20 nt, Human
uauaaagugagcuaacaaag

SEQ ID NO: 1005983 - RNA, 21 nt, Human
uauaaagugagcuaacaaaga

SEQ ID NO: 1005984 - RNA, 20 nt, Human
uauggaaaaagcuacaguaa

SEQ ID NO: 1005985 - RNA, 24 nt, Human
ucacuuaauuaucagccguugggg

SEQ ID NO: 1005986 - RNA, 22 nt, Human
ucagaaacacauuuaaaauggg

SEQ ID NO: 1005987 - RNA, 20 nt, Human
uccgggcgccggucccugcu

SEQ ID NO: 1005988 - RNA, 23 nt, Human
uccgggcgccggucccugcuccg

SEQ ID NO: 1005989 - RNA, 21 nt, Human
ucuuaaggguauuuuuggaag

SEQ ID NO: 1005990 - RNA, 20 nt, Human
ugagcuaacaaagaaugaaa

SEQ ID NO: 1005991 - RNA, 21 nt, Human
uggcuccgcgcgguggguccc

SEQ ID NO: 1005992 - RNA, 18 nt, Human
uggcucgcuccgggcgcc

SEQ ID NO: 1005993 - RNA, 21 nt, Human
uguaaagaucauuucagauuu

SEQ ID NO: 1005994 - RNA, 24 nt, Human
uuuuuuaaguaaucaagacaaaua

SEQ ID NO: 1005995 - RNA, 18 nt, Human
aagaaaaucaaaaaagga

SEQ ID NO: 1005996 - RNA, 23 nt, Human
aagcaguuauuguccaaagcugg

SEQ ID NO: 1005997 - RNA, 21 nt, Human
aaucaaaaaaggaacaguaau

SEQ ID NO: 1005998 - RNA, 22 nt, Human
acacaggcgcuugguaucgagg

SEQ ID NO: 1005999 - RNA, 22 nt, Human
acuacuuuacaguuucuaaaag

SEQ ID NO: 1006000 - RNA, 22 nt, Human
auaaagcauaucauguaaccuc

SEQ ID NO: 1006001 - RNA, 18 nt, Human
auccaucucccucccccu

SEQ ID NO: 1006002 - RNA, 21 nt, Human
augagcaugugaaugaaugga

SEQ ID NO: 1006003 - RNA, 20 nt, Human
caaagguccggccaaaacuc

SEQ ID NO: 1006004 - RNA, 19 nt, Human
caacugagcauccaucucc

SEQ ID NO: 1006005 - RNA, 22 nt, Human
caacugagcauccaucucccuc

SEQ ID NO: 1006006 - RNA, 18 nt, Human
caagaacaggucauuccu

SEQ ID NO: 1006007 - RNA, 18 nt, Human
cagcuauaaugcagguua

SEQ ID NO: 1006008 - RNA, 21 nt, Human
ccggccaaaacucuugauuau

SEQ ID NO: 1006009 - RNA, 21 nt, Human
cggccaaaacucuugauuauc

SEQ ID NO: 1006010 - RNA, 24 nt, Human
cuccucacucucucgguguaugcu

SEQ ID NO: 1006011 - RNA, 22 nt, Human
cucgucucacaccagcucugcc

SEQ ID NO: 1006012 - RNA, 19 nt, Human
cugcuagaauaaugcugua

SEQ ID NO: 1006013 - RNA, 21 nt, Human
cuuugaugugacaacugagca

SEQ ID NO: 1006014 - RNA, 25 nt, Human
gacccuauuuuggaauacaaagggu

SEQ ID NO: 1006015 - RNA, 18 nt, Human
gagcauccaucucccucc

SEQ ID NO: 1006016 - RNA, 27 nt, Human
gcaacuuuauugaagaaaaauaaauca

SEQ ID NO: 1006017 - RNA, 20 nt, Human
gguaucgaggagacgacucu

SEQ ID NO: 1006018 - RNA, 26 nt, Human
guagaacaagaacaggucauuccuuu

SEQ ID NO: 1006019 - RNA, 21 nt, Human
uaaaaaagaugaggucugaua

SEQ ID NO: 1006020 - RNA, 20 nt, Human
uaagaaaaucaaaaaaggaa

SEQ ID NO: 1006021 - RNA, 20 nt, Human
uauuuuggaauacaaagggu

SEQ ID NO: 1006022 - RNA, 23 nt, Human
uccaucucccucccccucagaug

SEQ ID NO: 1006023 - RNA, 24 nt, Human
ucuaacaguggaaggcuuaaacaa

SEQ ID NO: 1006024 - RNA, 18 nt, Human
ucucuguagaacaagaac

SEQ ID NO: 1006025 - RNA, 18 nt, Human
ugaaugaauggagggagg

SEQ ID NO: 1006026 - RNA, 23 nt, Human
ugacaugcauaaaauacaucaca

SEQ ID NO: 1006027 - RNA, 20 nt, Human
ugacuuccaauuuccauucu

SEQ ID NO: 1006028 - RNA, 22 nt, Human
ugagcauccaucucccuccccc

SEQ ID NO: 1006029 - RNA, 21 nt, Human
ugagucuugggcaacuguucu

SEQ ID NO: 1006030 - RNA, 18 nt, Human
ugaugugacaacugagca

SEQ ID NO: 1006031 - RNA, 20 nt, Human
ugcucaaagguccggccaaa

SEQ ID NO: 1006032 - RNA, 20 nt, Human
uuuuuuuuuuuuuuuuuugg

SEQ ID NO: 1006033 - RNA, 23 nt, Human
uuuuuuuuuuuuuuuuuugguuu

SEQ ID NO: 1006034 - RNA, 19 nt, Human
aaccccccaccccaccccg

SEQ ID NO: 1006035 - RNA, 20 nt, Human
aaccccccaccccaccccgc

SEQ ID NO: 1006036 - RNA, 22 nt, Human
aacucccacccucccugacccc

SEQ ID NO: 1006037 - RNA, 18 nt, Human
aagacugaauaauaucug

SEQ ID NO: 1006038 - RNA, 21 nt, Human
aagcggaagugcagcaacagc

SEQ ID NO: 1006039 - RNA, 21 nt, Human
aaguaguccacaacauagaac

SEQ ID NO: 1006040 - RNA, 24 nt, Human
acccucccugaccccuucaaaauc

SEQ ID NO: 1006041 - RNA, 19 nt, Human
acucccacccucccugacc

SEQ ID NO: 1006042 - RNA, 21 nt, Human
agaccuuuuuuaaacaaagua

SEQ ID NO: 1006043 - RNA, 18 nt, Human
agggaaaacaaauuccaa

SEQ ID NO: 1006044 - RNA, 18 nt, Human
caaaugucuaaauguaca

SEQ ID NO: 1006045 - RNA, 21 nt, Human
caaauuaagcuguuuuaaauu

SEQ ID NO: 1006046 - RNA, 20 nt, Human
caacauagaaccaauccacu

SEQ ID NO: 1006047 - RNA, 25 nt, Human
caacugaacccaaaugucuaaaugu

SEQ ID NO: 1006048 - RNA, 21 nt, Human
caccccaccccgcaaacagcc

SEQ ID NO: 1006049 - RNA, 26 nt, Human
caccccgcaaacagccccucucuuug

SEQ ID NO: 1006050 - RNA, 25 nt, Human
cagcuaauauugcagaacuaaugac

SEQ ID NO: 1006051 - RNA, 19 nt, Human
ccaacucccacccucccug

SEQ ID NO: 1006052 - RNA, 23 nt, Human
ccaccccgcaaacagccccucuc

SEQ ID NO: 1006053 - RNA, 24 nt, Human
ccacccucccugaccccuucaaaa

SEQ ID NO: 1006054 - RNA, 25 nt, Human
ccacugagcaacuccuauuccacgc

SEQ ID NO: 1006055 - RNA, 23 nt, Human
ccauauguguaaccuguaccaaa

SEQ ID NO: 1006056 - RNA, 24 nt, Human
cccacccucccugaccccuucaaa

SEQ ID NO: 1006057 - RNA, 18 nt, Human
ccccaccccaccccgcaa

SEQ ID NO: 1006058 - RNA, 21 nt, Human
ccccccaccccaccccgcaaa

SEQ ID NO: 1006059 - RNA, 22 nt, Human
ccccccaccccaccccgcaaac

SEQ ID NO: 1006060 - RNA, 26 nt, Human
ccccccaccccaccccgcaaacagcc

SEQ ID NO: 1006061 - RNA, 21 nt, Human
cccucccugaccccuucaaaa

SEQ ID NO: 1006062 - RNA, 19 nt, Human
ccgcaaacagccccucucu

SEQ ID NO: 1006063 - RNA, 21 nt, Human
ccgugccgccgcggcggcugc

SEQ ID NO: 1006064 - RNA, 23 nt, Human
cucccacccucccugaccccuuc

SEQ ID NO: 1006065 - RNA, 26 nt, Human
cucccacccucccugaccccuucaaa

SEQ ID NO: 1006066 - RNA, 19 nt, Human
cugcugcugcggcugcggc

SEQ ID NO: 1006067 - RNA, 25 nt, Human
cuuccaagaagggaaaacaaauucc

SEQ ID NO: 1006068 - RNA, 20 nt, Human
gcggcggcugcugcugcggc

SEQ ID NO: 1006069 - RNA, 22 nt, Human
ggagagaagcggaagugcagca

SEQ ID NO: 1006070 - RNA, 19 nt, Human
uaagguauuucacuacagg

SEQ ID NO: 1006071 - RNA, 19 nt, Human
uaaguaguccacaacauag

SEQ ID NO: 1006072 - RNA, 22 nt, Human
uacauaaauggccauaugugua

SEQ ID NO: 1006073 - RNA, 18 nt, Human
uagaaccaauccacugag

SEQ ID NO: 1006074 - RNA, 24 nt, Human
uagaaccaauccacugagcaacuc

SEQ ID NO: 1006075 - RNA, 20 nt, Human
uagcacaguaacaaaugcag

SEQ ID NO: 1006076 - RNA, 24 nt, Human
uagcacaguaacaaaugcagacuu

SEQ ID NO: 1006077 - RNA, 19 nt, Human
uccgugccgccgcggcggc

SEQ ID NO: 1006078 - RNA, 21 nt, Human
uccgugccgccgcggcggcug

SEQ ID NO: 1006079 - RNA, 26 nt, Human
ucucucgcugggagagaagcggaagu

SEQ ID NO: 1006080 - RNA, 18 nt, Human
ucuggcuccuccgugccg

SEQ ID NO: 1006081 - RNA, 18 nt, Human
ugcugcugcggcugcggc

SEQ ID NO: 1006082 - RNA, 22 nt, Human
uuaccaacucccacccucccug

SEQ ID NO: 1006083 - RNA, 21 nt, Human
uuuacauaaauggccauaugu

SEQ ID NO: 1006084 - RNA, 18 nt, Human
aaaaaaggacauacaacg

SEQ ID NO: 1006085 - RNA, 25 nt, Human
aaaaaggacauacaacguuuguaga

SEQ ID NO: 1006086 - RNA, 19 nt, Human
aaacaguucauuagaauuc

SEQ ID NO: 1006087 - RNA, 22 nt, Human
aaagccuguagcugugcaugcu

SEQ ID NO: 1006088 - RNA, 26 nt, Human
aaccucacaacaaacaugaaggagcc

SEQ ID NO: 1006089 - RNA, 18 nt, Human
aagcaccuagugaugacu

SEQ ID NO: 1006090 - RNA, 24 nt, Human
aaggacaaagcaccuagugaugac

SEQ ID NO: 1006091 - RNA, 18 nt, Human
aaggagccuaaggccugc

SEQ ID NO: 1006092 - RNA, 19 nt, Human
aauucaaaaugcguaauca

SEQ ID NO: 1006093 - RNA, 20 nt, Human
acaacaaacaugaaggagcc

SEQ ID NO: 1006094 - RNA, 21 nt, Human
acaacaaacaugaaggagccu

SEQ ID NO: 1006095 - RNA, 23 nt, Human
acagugccauguuucucaauugg

SEQ ID NO: 1006096 - RNA, 18 nt, Human
accggagcgccggagccg

SEQ ID NO: 1006097 - RNA, 18 nt, Human
agaacauucuggcaggua

SEQ ID NO: 1006098 - RNA, 20 nt, Human
agagauaaaagcaaagggga

SEQ ID NO: 1006099 - RNA, 24 nt, Human
agaggucugggcucuuggcaggag

SEQ ID NO: 1006100 - RNA, 20 nt, Human
agcauuucuccaaaccccac

SEQ ID NO: 1006101 - RNA, 21 nt, Human
agccaacaacuugacaauuau

SEQ ID NO: 1006102 - RNA, 24 nt, Human
aggaaagaaaaccugcuaaaaucu

SEQ ID NO: 1006103 - RNA, 24 nt, Human
aggguuuaagggaaauuaaaugga

SEQ ID NO: 1006104 - RNA, 21 nt, Human
agguaagagauaaaagcaaag

SEQ ID NO: 1006105 - RNA, 19 nt, Human
aucccuuauaagccaaaga

SEQ ID NO: 1006106 - RNA, 20 nt, Human
auuucuuuguacaauaggug

SEQ ID NO: 1006107 - RNA, 24 nt, Human
auuugcugaaguuguuuuagaaaa

SEQ ID NO: 1006108 - RNA, 23 nt, Human
caaaaaggacaaagcaccuagug

SEQ ID NO: 1006109 - RNA, 19 nt, Human
caaaccccacagagcagag

SEQ ID NO: 1006110 - RNA, 22 nt, Human
cacaacaaacaugaaggagccu

SEQ ID NO: 1006111 - RNA, 19 nt, Human
cacaaucaaacaccauguc

SEQ ID NO: 1006112 - RNA, 22 nt, Human
cacacaaccucacaacaaacau

SEQ ID NO: 1006113 - RNA, 21 nt, Human
cacacacaaccucacaacaaa

SEQ ID NO: 1006114 - RNA, 21 nt, Human
cacuacauaaggugacagaau

SEQ ID NO: 1006115 - RNA, 26 nt, Human
caucgcaauuucuuuguacaauaggu

SEQ ID NO: 1006116 - RNA, 28 nt, Human
cauuuuauuucugcuuaaaaaaggacau

SEQ ID NO: 1006117 - RNA, 20 nt, Human
ccccgcgaccggagcgccgg

SEQ ID NO: 1006118 - RNA, 20 nt, Human
ccgaagggcuggggacaggc

SEQ ID NO: 1006119 - RNA, 21 nt, Human
ccgggcugaggcggcgggagc

SEQ ID NO: 1006120 - RNA, 18 nt, Human
ccuuauaagccaaagacu

SEQ ID NO: 1006121 - RNA, 21 nt, Human
cugggaucaagagcucacaac

SEQ ID NO: 1006122 - RNA, 19 nt, Human
cuuauaagccaaagacuac

SEQ ID NO: 1006123 - RNA, 22 nt, Human
cuuccgaagggcuggggacagg

SEQ ID NO: 1006124 - RNA, 23 nt, Human
gauguacaugaacaguauauaua

SEQ ID NO: 1006125 - RNA, 21 nt, Human
gcgggagcggcgccucgcugc

SEQ ID NO: 1006126 - RNA, 21 nt, Human
gcggggugugccgaggaaccc

SEQ ID NO: 1006127 - RNA, 18 nt, Human
gcuaaaaucucuuagaau

SEQ ID NO: 1006128 - RNA, 21 nt, Human
ggaaaagucagauuugcuauu

SEQ ID NO: 1006129 - RNA, 20 nt, Human
ggcuggggacaggcucuggg

SEQ ID NO: 1006130 - RNA, 22 nt, Human
gggaaauuuucaguaaguugaa

SEQ ID NO: 1006131 - RNA, 21 nt, Human
gggcuggcgccggggcuuccg

SEQ ID NO: 1006132 - RNA, 20 nt, Human
gucaaaacaaagaagauaca

SEQ ID NO: 1006133 - RNA, 22 nt, Human
uaaaaucucuuagaauuuacac

SEQ ID NO: 1006134 - RNA, 18 nt, Human
uaaacugauaagaaacaa

SEQ ID NO: 1006135 - RNA, 24 nt, Human
uaacuggcauguuuuauugcagcc

SEQ ID NO: 1006136 - RNA, 24 nt, Human
uaaggugacagaauuccaaaauca

SEQ ID NO: 1006137 - RNA, 22 nt, Human
uaaguagaaagccuguagcugu

SEQ ID NO: 1006138 - RNA, 18 nt, Human
uacaaaaguuuaguaagu

SEQ ID NO: 1006139 - RNA, 22 nt, Human
uacaagaaagcauuauuuggua

SEQ ID NO: 1006140 - RNA, 24 nt, Human
uagaaccaaauacauauacugcca

SEQ ID NO: 1006141 - RNA, 23 nt, Human
uagaggcagagaaauaugaagga

SEQ ID NO: 1006142 - RNA, 20 nt, Human
uauauauauuauccggauca

SEQ ID NO: 1006143 - RNA, 20 nt, Human
ucaaaacaaagaagauacaa

SEQ ID NO: 1006144 - RNA, 18 nt, Human
ucaaggguuuaagggaaa

SEQ ID NO: 1006145 - RNA, 19 nt, Human
ucacuacauaaggugacag

SEQ ID NO: 1006146 - RNA, 24 nt, Human
ucagggguaaugacugggaucaag

SEQ ID NO: 1006147 - RNA, 20 nt, Human
ucauuuauccaaccuuaaua

SEQ ID NO: 1006148 - RNA, 23 nt, Human
uccaaaccccacagagcagagau

SEQ ID NO: 1006149 - RNA, 19 nt, Human
uccaagaggugggugcaac

SEQ ID NO: 1006150 - RNA, 20 nt, Human
ucuccaaaccccacagagca

SEQ ID NO: 1006151 - RNA, 21 nt, Human
ugaaauauauugaagcucaaa

SEQ ID NO: 1006152 - RNA, 22 nt, Human
ugaauaggaaagaaaaccugcu

SEQ ID NO: 1006153 - RNA, 21 nt, Human
ugacagaauuccaaaaucaaa

SEQ ID NO: 1006154 - RNA, 18 nt, Human
ugagaaaaaucugcagua

SEQ ID NO: 1006155 - RNA, 21 nt, Human
ugauucucacaaucaaacacc

SEQ ID NO: 1006156 - RNA, 22 nt, Human
ugcaacuagaauacaaaaagga

SEQ ID NO: 1006157 - RNA, 21 nt, Human
ugccgaggaacccgggccccg

SEQ ID NO: 1006158 - RNA, 24 nt, Human
ugccgaggaacccgggccccgcga

SEQ ID NO: 1006159 - RNA, 19 nt, Human
ugggugcaacuagaauaca

SEQ ID NO: 1006160 - RNA, 20 nt, Human
uuaaugaagccucaaggguu

SEQ ID NO: 1006161 - RNA, 19 nt, Human
uucacucuucugccaaagc

SEQ ID NO: 1006162 - RNA, 18 nt, Human
uuuuuuuuuuuuuuuucg

SEQ ID NO: 1006163 - RNA, 23 nt, Human
aaaaauaacuaggggcacguggc

SEQ ID NO: 1006164 - RNA, 23 nt, Human
caaaccccuacccauggccccca

SEQ ID NO: 1006165 - RNA, 20 nt, Human
cacguggcaggaaggggagg

SEQ ID NO: 1006166 - RNA, 22 nt, Human
ccccaaaccccuacccauggcc

SEQ ID NO: 1006167 - RNA, 24 nt, Human
ccccaaaccccuacccauggcccc

SEQ ID NO: 1006168 - RNA, 21 nt, Human
cccccaaaccccuacccaugg

SEQ ID NO: 1006169 - RNA, 22 nt, Human
cccccaaaccccuacccauggc

SEQ ID NO: 1006170 - RNA, 22 nt, Human
cccccaccggccgccccccaaa

SEQ ID NO: 1006171 - RNA, 21 nt, Human
ccccuacccauggcccccaau

SEQ ID NO: 1006172 - RNA, 19 nt, Human
ccguggcggcgggugggua

SEQ ID NO: 1006173 - RNA, 21 nt, Human
ggccgccccccaaaccccuac

SEQ ID NO: 1006174 - RNA, 21 nt, Human
gggauucccccaccggccgcc

SEQ ID NO: 1006175 - RNA, 22 nt, Human
gggauucccccaccggccgccc

SEQ ID NO: 1006176 - RNA, 19 nt, Human
guggccguggcggcgggug

SEQ ID NO: 1006177 - RNA, 26 nt, Human
uagccugguguuaaaaaaaaaauaac

SEQ ID NO: 1006178 - RNA, 23 nt, Human
ucccccaccggccgccccccaaa

SEQ ID NO: 1006179 - RNA, 24 nt, Human
ucccccaccggccgccccccaaac

SEQ ID NO: 1006180 - RNA, 18 nt, Human
uggcaggaaggggaggca

SEQ ID NO: 1006181 - RNA, 19 nt, Human
uggcaggaaggggaggcaa

SEQ ID NO: 1006182 - RNA, 21 nt, Human
uggcaggaaggggaggcaagg

SEQ ID NO: 1006183 - RNA, 22 nt, Human
uggcaggaaggggaggcaaggc

SEQ ID NO: 1006184 - RNA, 24 nt, Human
uggcaggaaggggaggcaaggcca

SEQ ID NO: 1006185 - RNA, 25 nt, Human
uggcaggaaggggaggcaaggccaa

SEQ ID NO: 1006186 - RNA, 18 nt, Human
aaacguuucacaacaauc

SEQ ID NO: 1006187 - RNA, 21 nt, Human
aaauaaaauaaaaacacccac

SEQ ID NO: 1006188 - RNA, 25 nt, Human
aaccugacaacuaccuucauucaca

SEQ ID NO: 1006189 - RNA, 23 nt, Human
aagaggaggaagucuuggcagaa

SEQ ID NO: 1006190 - RNA, 22 nt, Human
aaggagcccauaaaauuaaacu

SEQ ID NO: 1006191 - RNA, 24 nt, Human
aauaaaauaaaaacacccacaccc

SEQ ID NO: 1006192 - RNA, 23 nt, Human
aauaaaauaaaauaaaaacaccc

SEQ ID NO: 1006193 - RNA, 22 nt, Human
accugguuagcugcuuuuaacc

SEQ ID NO: 1006194 - RNA, 18 nt, Human
agaacccgaguucggccu

SEQ ID NO: 1006195 - RNA, 21 nt, Human
agacauagauuugcuaaugug

SEQ ID NO: 1006196 - RNA, 18 nt, Human
agugagggcugugauguu

SEQ ID NO: 1006197 - RNA, 25 nt, Human
auaaaauaaaaacacccacaccccc

SEQ ID NO: 1006198 - RNA, 20 nt, Human
auauucuaaagaccugguua

SEQ ID NO: 1006199 - RNA, 22 nt, Human
auuagaucaccaaaaaaggggg

SEQ ID NO: 1006200 - RNA, 23 nt, Human
caaacaaagaggaggaagucuug

SEQ ID NO: 1006201 - RNA, 19 nt, Human
cacaccccugcagcuaacc

SEQ ID NO: 1006202 - RNA, 18 nt, Human
cacccacaccccugcagc

SEQ ID NO: 1006203 - RNA, 19 nt, Human
cagaacaggagaagugaug

SEQ ID NO: 1006204 - RNA, 24 nt, Human
ccaaaaaagggggaaaggagccca

SEQ ID NO: 1006205 - RNA, 21 nt, Human
ccaggaugggggaaaugaaua

SEQ ID NO: 1006206 - RNA, 21 nt, Human
cccauaaaauuaaacuaccuc

SEQ ID NO: 1006207 - RNA, 25 nt, Human
ccccugcagcuaaccugacaacuac

SEQ ID NO: 1006208 - RNA, 21 nt, Human
cuacagcgucuaaauaaaguu

SEQ ID NO: 1006209 - RNA, 20 nt, Human
cugguuagcugcuuuuaacc

SEQ ID NO: 1006210 - RNA, 24 nt, Human
gagggcugugauguuuguuuaaug

SEQ ID NO: 1006211 - RNA, 24 nt, Human
gcagaacaggagaagugaugcaca

SEQ ID NO: 1006212 - RNA, 23 nt, Human
gcagggaggggccacugcuuuua

SEQ ID NO: 1006213 - RNA, 24 nt, Human
gcuagagcauauucuaaagaccug

SEQ ID NO: 1006214 - RNA, 23 nt, Human
uaaaauaaaauaaaaacacccac

SEQ ID NO: 1006215 - RNA, 19 nt, Human
uacuuaaaccaggaugggg

SEQ ID NO: 1006216 - RNA, 19 nt, Human
uagaucaccaaaaaagggg

SEQ ID NO: 1006217 - RNA, 22 nt, Human
ugacagcaauguuauuagugag

SEQ ID NO: 1006218 - RNA, 18 nt, Human
ugcaaacaaagaggagga

SEQ ID NO: 1006219 - RNA, 20 nt, Human
uggcagaacaggagaaguga

SEQ ID NO: 1006220 - RNA, 23 nt, Human
uuauuagugagggcugugauguu

SEQ ID NO: 1006221 - RNA, 24 nt, Human
uucccauuuugguuccaacaauca

SEQ ID NO: 1006222 - RNA, 20 nt, Human
uuuaaccaaugcaauuagaa

SEQ ID NO: 1006223 - RNA, 21 nt, Human
uuuacagaaguuuccagacaa

SEQ ID NO: 1006224 - RNA, 22 nt, Human
aaacacacaugcuuccacugcc

SEQ ID NO: 1006225 - RNA, 24 nt, Human
aaauggcacagucucugaggacac

SEQ ID NO: 1006226 - RNA, 24 nt, Human
aagcaugccauuucuguuuucuug

SEQ ID NO: 1006227 - RNA, 22 nt, Human
aagcuacaauaauuccaauuuu

SEQ ID NO: 1006228 - RNA, 24 nt, Human
aaugacagugccuuucaagagaaa

SEQ ID NO: 1006229 - RNA, 23 nt, Human
acugccaucugacacuucuccac

SEQ ID NO: 1006230 - RNA, 24 nt, Human
agaaacacacaugcuuccacugcc

SEQ ID NO: 1006231 - RNA, 22 nt, Human
aguaagauggguaaagcaugcc

SEQ ID NO: 1006232 - RNA, 18 nt, Human
auguguauuuugcauugu

SEQ ID NO: 1006233 - RNA, 26 nt, Human
caaaacaauccugaacauauuuuuga

SEQ ID NO: 1006234 - RNA, 21 nt, Human
caacauaauagaaauggcaca

SEQ ID NO: 1006235 - RNA, 18 nt, Human
cacagucucugaggacac

SEQ ID NO: 1006236 - RNA, 18 nt, Human
cagcucucuuucacuaag

SEQ ID NO: 1006237 - RNA, 23 nt, Human
caucaacauaauagaaauggcac

SEQ ID NO: 1006238 - RNA, 19 nt, Human
cuaguagucagcacccaca

SEQ ID NO: 1006239 - RNA, 21 nt, Human
cugcagcucucuuucacuaag

SEQ ID NO: 1006240 - RNA, 20 nt, Human
cuuguaaaccugaauucuau

SEQ ID NO: 1006241 - RNA, 27 nt, Human
cuuuuuaauauuauuauuucuggugaa

SEQ ID NO: 1006242 - RNA, 23 nt, Human
gccagaaugcaaagaucuuuuua

SEQ ID NO: 1006243 - RNA, 19 nt, Human
guacauauacaucaacaua

SEQ ID NO: 1006244 - RNA, 20 nt, Human
guguacauauauuaaauaua

SEQ ID NO: 1006245 - RNA, 21 nt, Human
guguacauauauuaaauauaa

SEQ ID NO: 1006246 - RNA, 21 nt, Human
uaagauggguaaagcaugcca

SEQ ID NO: 1006247 - RNA, 23 nt, Human
uaauccuaaaagaacugccagaa

SEQ ID NO: 1006248 - RNA, 19 nt, Human
uaauggguguacauauauu

SEQ ID NO: 1006249 - RNA, 21 nt, Human
ucaaaaucacauauccauaca

SEQ ID NO: 1006250 - RNA, 24 nt, Human
ucaagacauuaacaugaguagaag

SEQ ID NO: 1006251 - RNA, 24 nt, Human
uccagguuuauguuuaaaugacag

SEQ ID NO: 1006252 - RNA, 21 nt, Human
uggcaagguacuguacauaua

SEQ ID NO: 1006253 - RNA, 20 nt, Human
uguaaacaaauauuuaccau

SEQ ID NO: 1006254 - RNA, 23 nt, Human
uguaaacaaauauuuaccauguc

SEQ ID NO: 1006255 - RNA, 20 nt, Human
uguacauauacaucaacaua

SEQ ID NO: 1006256 - RNA, 20 nt, Human
uguauacaugaaaagcuaca

SEQ ID NO: 1006257 - RNA, 20 nt, Human
uguuuaaaugacagugccuu

SEQ ID NO: 1006258 - RNA, 19 nt, Human
uuaugcuuuaaaaaauggg

SEQ ID NO: 1006259 - RNA, 22 nt, Human
uucaagagaaaaaaaauugugc

SEQ ID NO: 1006260 - RNA, 23 nt, Human
uucaagagaaaaaaaauugugcu

SEQ ID NO: 1006261 - RNA, 24 nt, Human
uucacaagaaguacacaaaauagg

SEQ ID NO: 1006262 - RNA, 20 nt, Human
uucccuggcaagguacugua

SEQ ID NO: 1006263 - RNA, 21 nt, Human
uuuuuuuuuuuuaugcuuuaa

SEQ ID NO: 1006264 - RNA, 23 nt, Human
aaaaaaaaacaaaaaacccagag

SEQ ID NO: 1006265 - RNA, 25 nt, Human
aaaaaaaaacaaaaaacccagaggg

SEQ ID NO: 1006266 - RNA, 20 nt, Human
aaaaaacaaaaaacccagag

SEQ ID NO: 1006267 - RNA, 23 nt, Human
aaaagcuuguuauuuuuuccaag

SEQ ID NO: 1006268 - RNA, 23 nt, Human
aaacaaaaaacccagagggugug

SEQ ID NO: 1006269 - RNA, 22 nt, Human
aacaaaucacccagcauuaguc

SEQ ID NO: 1006270 - RNA, 21 nt, Human
aacccaugcugcaaaaaccac

SEQ ID NO: 1006271 - RNA, 19 nt, Human
aacuagcuaaaagaagccc

SEQ ID NO: 1006272 - RNA, 24 nt, Human
aacuagcuaaaagaagccccucug

SEQ ID NO: 1006273 - RNA, 22 nt, Human
aagccaccgcccagaugggaug

SEQ ID NO: 1006274 - RNA, 22 nt, Human
acacacucuuuuccagaagccu

SEQ ID NO: 1006275 - RNA, 20 nt, Human
acaggcagcacauucuggaa

SEQ ID NO: 1006276 - RNA, 23 nt, Human
acccaaguuuccugggauuuugc

SEQ ID NO: 1006277 - RNA, 21 nt, Human
accgcaggcccuaccggccua

SEQ ID NO: 1006278 - RNA, 23 nt, Human
accuggccaggcagggacugugc

SEQ ID NO: 1006279 - RNA, 22 nt, Human
acucccaaaagaucaaacuagc

SEQ ID NO: 1006280 - RNA, 19 nt, Human
agaaucagagguuacgaac

SEQ ID NO: 1006281 - RNA, 21 nt, Human
agacaaauaagcagggucaaa

SEQ ID NO: 1006282 - RNA, 19 nt, Human
agagcacacacucuuuucc

SEQ ID NO: 1006283 - RNA, 21 nt, Human
agagcacacacucuuuuccag

SEQ ID NO: 1006284 - RNA, 24 nt, Human
agauaaccagugagacaaauaagc

SEQ ID NO: 1006285 - RNA, 19 nt, Human
agcagaggagggacugggc

SEQ ID NO: 1006286 - RNA, 23 nt, Human
agcaggcgccugcgcuucccugg

SEQ ID NO: 1006287 - RNA, 21 nt, Human
agcagggucaaaggcagccgu

SEQ ID NO: 1006288 - RNA, 21 nt, Human
aggaaagacagacucccaaaa

SEQ ID NO: 1006289 - RNA, 24 nt, Human
aggaaggaugggcagcaagaccca

SEQ ID NO: 1006290 - RNA, 21 nt, Human
aggcgcuguggacggcaugga

SEQ ID NO: 1006291 - RNA, 21 nt, Human
agggacugggccuuccuggcu

SEQ ID NO: 1006292 - RNA, 23 nt, Human
agggacugggccuuccuggcuuc

SEQ ID NO: 1006293 - RNA, 18 nt, Human
auagguccgggaagacuc

SEQ ID NO: 1006294 - RNA, 19 nt, Human
augcagcugaaacucugaa

SEQ ID NO: 1006295 - RNA, 19 nt, Human
caaacuagcuaaaagaagc

SEQ ID NO: 1006296 - RNA, 20 nt, Human
caaaguccccagccccacca

SEQ ID NO: 1006297 - RNA, 21 nt, Human
caaaucacccagcauuagucc

SEQ ID NO: 1006298 - RNA, 21 nt, Human
caacgggcuuccggguucccu

SEQ ID NO: 1006299 - RNA, 24 nt, Human
caagacccaaguuuccugggauuu

SEQ ID NO: 1006300 - RNA, 21 nt, Human
cacaggaacaaaucacccagc

SEQ ID NO: 1006301 - RNA, 19 nt, Human
cacauucuggaaacggggc

SEQ ID NO: 1006302 - RNA, 23 nt, Human
caccuggagaugcuguguagugc

SEQ ID NO: 1006303 - RNA, 20 nt, Human
cacgccagaucccagcacuu

SEQ ID NO: 1006304 - RNA, 21 nt, Human
cacucggaggacugacgaccc

SEQ ID NO: 1006305 - RNA, 19 nt, Human
caggaacaaaucacccagc

SEQ ID NO: 1006306 - RNA, 20 nt, Human
caggagcccuggaggcaggg

SEQ ID NO: 1006307 - RNA, 22 nt, Human
caggagcccuggaggcagggcu

SEQ ID NO: 1006308 - RNA, 22 nt, Human
caggaugcagcugaaacucuga

SEQ ID NO: 1006309 - RNA, 22 nt, Human
caguuuaggugaguccuggggc

SEQ ID NO: 1006310 - RNA, 19 nt, Human
caucaaaguagagcacaca

SEQ ID NO: 1006311 - RNA, 19 nt, Human
ccacucggaggacugacga

SEQ ID NO: 1006312 - RNA, 18 nt, Human
ccagugagacaaauaagc

SEQ ID NO: 1006313 - RNA, 23 nt, Human
cccaaaagaucaaacuagcuaaa

SEQ ID NO: 1006314 - RNA, 22 nt, Human
ccccaaagugaaaagaggugga

SEQ ID NO: 1006315 - RNA, 22 nt, Human
cccuagcaggcgccugcgcuuc

SEQ ID NO: 1006316 - RNA, 23 nt, Human
cccucaaaguccccagccccacc

SEQ ID NO: 1006317 - RNA, 23 nt, Human
cccuggagcacacacgccagauc

SEQ ID NO: 1006318 - RNA, 21 nt, Human
ccggguucccugugcugagga

SEQ ID NO: 1006319 - RNA, 22 nt, Human
ccggguucccugugcugaggaa

SEQ ID NO: 1006320 - RNA, 20 nt, Human
ccucaaaguccccagcccca

SEQ ID NO: 1006321 - RNA, 22 nt, Human
cgaacaguauucgaacuccagu

SEQ ID NO: 1006322 - RNA, 26 nt, Human
cggaaggagaggaucucacgcacagu

SEQ ID NO: 1006323 - RNA, 23 nt, Human
cggcaucaaccuugguggugcag

SEQ ID NO: 1006324 - RNA, 23 nt, Human
cggggccgcagcugccacugucu

SEQ ID NO: 1006325 - RNA, 19 nt, Human
cguccccaaagugaaaaga

SEQ ID NO: 1006326 - RNA, 22 nt, Human
cguggagcgcguggcuucaagg

SEQ ID NO: 1006327 - RNA, 18 nt, Human
cucaaaguccccagcccc

SEQ ID NO: 1006328 - RNA, 18 nt, Human
cucaggagugaagccacc

SEQ ID NO: 1006329 - RNA, 20 nt, Human
cucaggagugaagccaccgc

SEQ ID NO: 1006330 - RNA, 23 nt, Human
cugcaaaaaccacucuagacucu

SEQ ID NO: 1006331 - RNA, 21 nt, Human
cuggggcccagagucuuuccu

SEQ ID NO: 1006332 - RNA, 21 nt, Human
cuuguuccuccgaccuggcca

SEQ ID NO: 1006333 - RNA, 22 nt, Human
gaacaccaguuacaaaaggaga

SEQ ID NO: 1006334 - RNA, 19 nt, Human
gagcagaggagggacuggg

SEQ ID NO: 1006335 - RNA, 20 nt, Human
gagguggaaagggccgcgga

SEQ ID NO: 1006336 - RNA, 24 nt, Human
gccaucaccaggaagaauggaccc

SEQ ID NO: 1006337 - RNA, 19 nt, Human
gcccaggagcccuggaggc

SEQ ID NO: 1006338 - RNA, 21 nt, Human
gccgcggaaagagccccugga

SEQ ID NO: 1006339 - RNA, 23 nt, Human
gccugcgcuucccugggcagcag

SEQ ID NO: 1006340 - RNA, 21 nt, Human
gcggaaagagccccuggagca

SEQ ID NO: 1006341 - RNA, 23 nt, Human
gcggaaagagccccuggagcaca

SEQ ID NO: 1006342 - RNA, 22 nt, Human
gcuaagggccguuguuuuucuu

SEQ ID NO: 1006343 - RNA, 20 nt, Human
ggacgggaauagguccggga

SEQ ID NO: 1006344 - RNA, 25 nt, Human
ggcaggagcagcgccuugggguccc

SEQ ID NO: 1006345 - RNA, 25 nt, Human
ggcccagagucuuuccucggcauca

SEQ ID NO: 1006346 - RNA, 18 nt, Human
gggcucgaccuggguggg

SEQ ID NO: 1006347 - RNA, 20 nt, Human
gguggugcaggugcaggagc

SEQ ID NO: 1006348 - RNA, 24 nt, Human
guggagcgcguggcuucaaggcag

SEQ ID NO: 1006349 - RNA, 25 nt, Human
uaaaagaagccccucugccaucacc

SEQ ID NO: 1006350 - RNA, 21 nt, Human
uaaaggccuaccguccccaaa

SEQ ID NO: 1006351 - RNA, 18 nt, Human
uaaggaaagacagacucc

SEQ ID NO: 1006352 - RNA, 26 nt, Human
uaagggccguuguuuuucuuccccca

SEQ ID NO: 1006353 - RNA, 21 nt, Human
uaauaaagccuuugaucacau

SEQ ID NO: 1006354 - RNA, 23 nt, Human
uacaaaaacaaaaaauccuacaa

SEQ ID NO: 1006355 - RNA, 24 nt, Human
uacacagcucacucagacggcuaa

SEQ ID NO: 1006356 - RNA, 25 nt, Human
uaccugaguaagagauuucagaaac

SEQ ID NO: 1006357 - RNA, 21 nt, Human
uagagccaacucccucaaagu

SEQ ID NO: 1006358 - RNA, 22 nt, Human
uagauaaccagugagacaaaua

SEQ ID NO: 1006359 - RNA, 21 nt, Human
uagugcaauauuuccagcugc

SEQ ID NO: 1006360 - RNA, 23 nt, Human
ucaauaauauuaauacauuccug

SEQ ID NO: 1006361 - RNA, 18 nt, Human
uccccaaagugaaaagag

SEQ ID NO: 1006362 - RNA, 21 nt, Human
ucccccaaaccaggaugccaa

SEQ ID NO: 1006363 - RNA, 22 nt, Human
ucccugggcagcagaugggccu

SEQ ID NO: 1006364 - RNA, 24 nt, Human
ucucccgcaggccggaccgcaggc

SEQ ID NO: 1006365 - RNA, 18 nt, Human
ucucuggcagcucagccc

SEQ ID NO: 1006366 - RNA, 22 nt, Human
ugacgacccaguucucccgcag

SEQ ID NO: 1006367 - RNA, 21 nt, Human
ugagacaaauaagcaggguca

SEQ ID NO: 1006368 - RNA, 18 nt, Human
ugaggagagcagaggagg

SEQ ID NO: 1006369 - RNA, 21 nt, Human
ugagggcagaggaacacaaug

SEQ ID NO: 1006370 - RNA, 24 nt, Human
ugagggcagaggaacacaaugggu

SEQ ID NO: 1006371 - RNA, 18 nt, Human
ugaggugggagagggugg

SEQ ID NO: 1006372 - RNA, 21 nt, Human
ugaggugggagagggugggug

SEQ ID NO: 1006373 - RNA, 22 nt, Human
ugccucaguucccuggagcuaa

SEQ ID NO: 1006374 - RNA, 20 nt, Human
ugcugaggaaggaugggcag

SEQ ID NO: 1006375 - RNA, 21 nt, Human
ugcugcaaaaaccacucuaga

SEQ ID NO: 1006376 - RNA, 21 nt, Human
uggaaacggggcugcugcuaa

SEQ ID NO: 1006377 - RNA, 27 nt, Human
uggaacuccugggacuuguucauacac

SEQ ID NO: 1006378 - RNA, 18 nt, Human
uggaagagaaaugaaguu

SEQ ID NO: 1006379 - RNA, 19 nt, Human
uggaagagaaaugaaguuu

SEQ ID NO: 1006380 - RNA, 21 nt, Human
uggacggcauggaggcagaaa

SEQ ID NO: 1006381 - RNA, 21 nt, Human
uggagcacacacgccagaucc

SEQ ID NO: 1006382 - RNA, 22 nt, Human
uggagcuaaaguucuuacaaca

SEQ ID NO: 1006383 - RNA, 23 nt, Human
uggcaaguccacagaaucagagg

SEQ ID NO: 1006384 - RNA, 23 nt, Human
uggcagcucagcccgcugaggac

SEQ ID NO: 1006385 - RNA, 22 nt, Human
uggcuauagagagggucuaggg

SEQ ID NO: 1006386 - RNA, 22 nt, Human
ugggaagaggcgcuguggacgg

SEQ ID NO: 1006387 - RNA, 23 nt, Human
ugggaagaggcgcuguggacggc

SEQ ID NO: 1006388 - RNA, 21 nt, Human
ugggagcugaaggucccuggc

SEQ ID NO: 1006389 - RNA, 19 nt, Human
ugggauuuugcagacucag

SEQ ID NO: 1006390 - RNA, 21 nt, Human
ugucaacacagaccacaaaca

SEQ ID NO: 1006391 - RNA, 21 nt, Human
ugucagugcaacgggcuuccg

SEQ ID NO: 1006392 - RNA, 23 nt, Human
uuccuggcuucgaauccggcauc

SEQ ID NO: 1006393 - RNA, 19 nt, Human
uuggagaaaguggcaaguc

SEQ ID NO: 1006394 - RNA, 18 nt, Human
uugguggugcaggugcag

SEQ ID NO: 1006395 - RNA, 22 nt, Human
uuuauaaaggccuaccgucccc

SEQ ID NO: 1006396 - RNA, 28 nt, Human
uuuuccaaggucacacagcgagcgaaca

SEQ ID NO: 1006397 - RNA, 21 nt, Human
aaaaaaaaauucaugaaggga

SEQ ID NO: 1006398 - RNA, 23 nt, Human
aaaaaagauucuuuagcagcaaa

SEQ ID NO: 1006399 - RNA, 23 nt, Human
aaaaacccaacccucaucucccc

SEQ ID NO: 1006400 - RNA, 18 nt, Human
aaaauguccaagguucuc

SEQ ID NO: 1006401 - RNA, 21 nt, Human
aaacaaauaugugaauaugau

SEQ ID NO: 1006402 - RNA, 24 nt, Human
aaacccaacccucaucuccccaaa

SEQ ID NO: 1006403 - RNA, 20 nt, Human
aaaccggcagacauacuccc

SEQ ID NO: 1006404 - RNA, 23 nt, Human
aaaggguaggaaggagagcaggg

SEQ ID NO: 1006405 - RNA, 19 nt, Human
aacaccaauuaaaaaaaca

SEQ ID NO: 1006406 - RNA, 24 nt, Human
aacccucaucuccccaaaauauaa

SEQ ID NO: 1006407 - RNA, 24 nt, Human
aaccugucccuuaagcuuuugacc

SEQ ID NO: 1006408 - RNA, 19 nt, Human
aagaaaaaaaaaacugaaa

SEQ ID NO: 1006409 - RNA, 18 nt, Human
aagaaaaaagaaaguaug

SEQ ID NO: 1006410 - RNA, 21 nt, Human
acccaacccucaucuccccaa

SEQ ID NO: 1006411 - RNA, 21 nt, Human
acccugccucaaacucacaca

SEQ ID NO: 1006412 - RNA, 18 nt, Human
aggaagggggagagggga

SEQ ID NO: 1006413 - RNA, 19 nt, Human
agggucaggaagggggaga

SEQ ID NO: 1006414 - RNA, 20 nt, Human
aguuuacuuuuguuuuugcu

SEQ ID NO: 1006415 - RNA, 23 nt, Human
auacucccacauucuugcacccu

SEQ ID NO: 1006416 - RNA, 21 nt, Human
augcugcccagacccauuagc

SEQ ID NO: 1006417 - RNA, 19 nt, Human
caaaagaaaaaaaaaacug

SEQ ID NO: 1006418 - RNA, 23 nt, Human
cacaagcaaccauaaaaccuguc

SEQ ID NO: 1006419 - RNA, 18 nt, Human
cacaaggaccagagcagc

SEQ ID NO: 1006420 - RNA, 20 nt, Human
cacacaaaugacccugccuc

SEQ ID NO: 1006421 - RNA, 23 nt, Human
cacacaaaugacccugccucaaa

SEQ ID NO: 1006422 - RNA, 24 nt, Human
cacacaaaugacccugccucaaac

SEQ ID NO: 1006423 - RNA, 18 nt, Human
cagcagcuucgcugcggc

SEQ ID NO: 1006424 - RNA, 22 nt, Human
cagcaggauuuucuuuauuuug

SEQ ID NO: 1006425 - RNA, 23 nt, Human
cauccauguccuuucaggucuca

SEQ ID NO: 1006426 - RNA, 23 nt, Human
caugcuuuauuacacaagcaacc

SEQ ID NO: 1006427 - RNA, 21 nt, Human
ccaacccucaucuccccaaaa

SEQ ID NO: 1006428 - RNA, 23 nt, Human
ccucaaacucacacacccaaggg

SEQ ID NO: 1006429 - RNA, 23 nt, Human
ccuucuguucucgagaccaaagg

SEQ ID NO: 1006430 - RNA, 20 nt, Human
ccuuuuuuuuuuuuuacccc

SEQ ID NO: 1006431 - RNA, 18 nt, Human
cucagcguuugcucgcuc

SEQ ID NO: 1006432 - RNA, 19 nt, Human
cugaacgugugucaccauu

SEQ ID NO: 1006433 - RNA, 24 nt, Human
cuuaaagggacauuucaaaagaaa

SEQ ID NO: 1006434 - RNA, 19 nt, Human
cuugccucguuggccuugg

SEQ ID NO: 1006435 - RNA, 24 nt, Human
cuugccucguuggccuuggcugug

SEQ ID NO: 1006436 - RNA, 19 nt, Human
gcucugggugggccugggg

SEQ ID NO: 1006437 - RNA, 23 nt, Human
ggcagacauacucccacauucuu

SEQ ID NO: 1006438 - RNA, 26 nt, Human
ggccuccaacacaugaacagcagcuu

SEQ ID NO: 1006439 - RNA, 20 nt, Human
ggcuguguuugucugugugu

SEQ ID NO: 1006440 - RNA, 18 nt, Human
gggaaaaaagauucuuua

SEQ ID NO: 1006441 - RNA, 22 nt, Human
ggugaaaggcguuaaggagaga

SEQ ID NO: 1006442 - RNA, 20 nt, Human
uaaaaaaaaacccaacccuc

SEQ ID NO: 1006443 - RNA, 21 nt, Human
uaaaaaaaaacccaacccuca

SEQ ID NO: 1006444 - RNA, 22 nt, Human
uaaaaaaaaacccaacccucau

SEQ ID NO: 1006445 - RNA, 20 nt, Human
uaaaaaaaaauucaugaagg

SEQ ID NO: 1006446 - RNA, 22 nt, Human
uaaaaaaacaaauaugugaaua

SEQ ID NO: 1006447 - RNA, 23 nt, Human
uaaaaaaauccacagcagugcaa

SEQ ID NO: 1006448 - RNA, 26 nt, Human
uaaagggacauuucaaaagaaaaaaa

SEQ ID NO: 1006449 - RNA, 18 nt, Human
uacacuuacaccccuaga

SEQ ID NO: 1006450 - RNA, 23 nt, Human
uagaauaaaaaaaucuuaaaggg

SEQ ID NO: 1006451 - RNA, 20 nt, Human
ucacaaggaccagagcagca

SEQ ID NO: 1006452 - RNA, 22 nt, Human
ucacagaauauauguuuggagg

SEQ ID NO: 1006453 - RNA, 26 nt, Human
ucagaacacuuuaugguuucaaaucc

SEQ ID NO: 1006454 - RNA, 23 nt, Human
ucugaaaauaucuugccuuuuuu

SEQ ID NO: 1006455 - RNA, 18 nt, Human
ucuguucucgagaccaaa

SEQ ID NO: 1006456 - RNA, 22 nt, Human
ucuuuagcagcaaaauguccaa

SEQ ID NO: 1006457 - RNA, 24 nt, Human
ugacccugccucaaacucacacac

SEQ ID NO: 1006458 - RNA, 18 nt, Human
ugauauaaaaauacgauc

SEQ ID NO: 1006459 - RNA, 18 nt, Human
ugccucguuggccuuggc

SEQ ID NO: 1006460 - RNA, 18 nt, Human
ugcguuaggaauugaaca

SEQ ID NO: 1006461 - RNA, 23 nt, Human
ugcucgcucugggugggccuggg

SEQ ID NO: 1006462 - RNA, 24 nt, Human
uggcugugucuagcagaggguggg

SEQ ID NO: 1006463 - RNA, 23 nt, Human
uggcuguguuugucugugugugu

SEQ ID NO: 1006464 - RNA, 20 nt, Human
uuaaguagggagcaguaaua

SEQ ID NO: 1006465 - RNA, 25 nt, Human
uucaaaagaaaaaaaaaacugaaau

SEQ ID NO: 1006466 - RNA, 23 nt, Human
uugcucgcucugggugggccugg

SEQ ID NO: 1006467 - RNA, 21 nt, Human
uugcuucucuuaaaaaaaucc

SEQ ID NO: 1006468 - RNA, 20 nt, Human
uuggagggccagggaaagga

SEQ ID NO: 1006469 - RNA, 21 nt, Human
uuuggagggccagggaaagga

SEQ ID NO: 1006470 - RNA, 18 nt, Human
uuuuuuuuuuuucuucug

SEQ ID NO: 1006471 - RNA, 23 nt, Human
aaaaugcaaaacauaaaccacug

SEQ ID NO: 1006472 - RNA, 18 nt, Human
aaagcaucagguuuacaa

SEQ ID NO: 1006473 - RNA, 25 nt, Human
aaagcuaugggguuuucccagagcu

SEQ ID NO: 1006474 - RNA, 24 nt, Human
aaagugcugggauuacagguguga

SEQ ID NO: 1006475 - RNA, 21 nt, Human
aacaagccuggccagcauggu

SEQ ID NO: 1006476 - RNA, 18 nt, Human
aacaugguaaaaccccau

SEQ ID NO: 1006477 - RNA, 19 nt, Human
aacaugguaaaaccccauc

SEQ ID NO: 1006478 - RNA, 23 nt, Human
aacaugguaaaaccccaucccca

SEQ ID NO: 1006479 - RNA, 23 nt, Human
aagaaucaguugaacuugggagg

SEQ ID NO: 1006480 - RNA, 21 nt, Human
aagcagagguugcaaugagcc

SEQ ID NO: 1006481 - RNA, 24 nt, Human
aagcagagguugcaaugagccgag

SEQ ID NO: 1006482 - RNA, 23 nt, Human
aagcaucagguuuacaagcauga

SEQ ID NO: 1006483 - RNA, 18 nt, Human
aagugcugggauuacagg

SEQ ID NO: 1006484 - RNA, 19 nt, Human
aagugcugggauuacaggu

SEQ ID NO: 1006485 - RNA, 26 nt, Human
aagugcugggauuacaggugugagcc

SEQ ID NO: 1006486 - RNA, 24 nt, Human
aaucaguugaacuugggaggcaga

SEQ ID NO: 1006487 - RNA, 19 nt, Human
aaucaugccaccuaacucc

SEQ ID NO: 1006488 - RNA, 22 nt, Human
acagacaaaaacaagaagcaug

SEQ ID NO: 1006489 - RNA, 21 nt, Human
acagagcgagacucugucuca

SEQ ID NO: 1006490 - RNA, 24 nt, Human
acagagcgagacucugucucaaaa

SEQ ID NO: 1006491 - RNA, 24 nt, Human
acagagugagacucugucucaaaa

SEQ ID NO: 1006492 - RNA, 19 nt, Human
accauagugaaacauaccu

SEQ ID NO: 1006493 - RNA, 22 nt, Human
acggggcugcagagccgccucu

SEQ ID NO: 1006494 - RNA, 24 nt, Human
acgguacucuagccugggagacag

SEQ ID NO: 1006495 - RNA, 24 nt, Human
acgugacucaggcacugcacacca

SEQ ID NO: 1006496 - RNA, 18 nt, Human
acucaggcacugcacacc

SEQ ID NO: 1006497 - RNA, 21 nt, Human
acuccagcaagagcuuauacc

SEQ ID NO: 1006498 - RNA, 21 nt, Human
acucccgccugggugacagag

SEQ ID NO: 1006499 - RNA, 23 nt, Human
acucccgccugggugacagagug

SEQ ID NO: 1006500 - RNA, 19 nt, Human
acucuagccugggagacag

SEQ ID NO: 1006501 - RNA, 24 nt, Human
acucuagccugggagacagagcga

SEQ ID NO: 1006502 - RNA, 24 nt, Human
acuugaggucaggaguuugagacc

SEQ ID NO: 1006503 - RNA, 23 nt, Human
agacaaaaacaagaagcauguca

SEQ ID NO: 1006504 - RNA, 26 nt, Human
agagagcaggaugguccugauaucau

SEQ ID NO: 1006505 - RNA, 19 nt, Human
agaggcucaugccuguaau

SEQ ID NO: 1006506 - RNA, 24 nt, Human
agaggcucaugccuguaauuucag

SEQ ID NO: 1006507 - RNA, 22 nt, Human
agagguugcaaugagccgagau

SEQ ID NO: 1006508 - RNA, 24 nt, Human
agagguugcaaugagccgagauug

SEQ ID NO: 1006509 - RNA, 18 nt, Human
agagguugcagugagccg

SEQ ID NO: 1006510 - RNA, 24 nt, Human
agagguugcagugagccgaaauca

SEQ ID NO: 1006511 - RNA, 22 nt, Human
agcaguuucauuuauaacagac

SEQ ID NO: 1006512 - RNA, 19 nt, Human
agcauggugaaaccccauu

SEQ ID NO: 1006513 - RNA, 21 nt, Human
agcauggugaaaccccauugc

SEQ ID NO: 1006514 - RNA, 22 nt, Human
agccuggccaacaugguaaaac

SEQ ID NO: 1006515 - RNA, 24 nt, Human
agccuggccaacaugguaaaaccc

SEQ ID NO: 1006516 - RNA, 22 nt, Human
agccuggccagcauggugaaac

SEQ ID NO: 1006517 - RNA, 24 nt, Human
agccuggccagcauggugaaaccc

SEQ ID NO: 1006518 - RNA, 24 nt, Human
agccugggagacagagcgagacuc

SEQ ID NO: 1006519 - RNA, 24 nt, Human
agcuacucuggaggcugagguggg

SEQ ID NO: 1006520 - RNA, 22 nt, Human
agcugggcguggugguguguac

SEQ ID NO: 1006521 - RNA, 22 nt, Human
aggaggucuggccauguugccc

SEQ ID NO: 1006522 - RNA, 20 nt, Human
aggaguuugagaccagccug

SEQ ID NO: 1006523 - RNA, 21 nt, Human
aggcagaagaaucaguugaac

SEQ ID NO: 1006524 - RNA, 24 nt, Human
aggcagaagaaucaguugaacuug

SEQ ID NO: 1006525 - RNA, 21 nt, Human
aggcagagguugcagugagcc

SEQ ID NO: 1006526 - RNA, 22 nt, Human
aggcagagguugcagugagccg

SEQ ID NO: 1006527 - RNA, 21 nt, Human
aggcaggcagaucacuugagg

SEQ ID NO: 1006528 - RNA, 22 nt, Human
aggcaggcagaucacuugaggu

SEQ ID NO: 1006529 - RNA, 20 nt, Human
aggcagugccccugcugggc

SEQ ID NO: 1006530 - RNA, 22 nt, Human
aggccaagcacaguaggucaca

SEQ ID NO: 1006531 - RNA, 21 nt, Human
aggcggguggaucacuugagg

SEQ ID NO: 1006532 - RNA, 22 nt, Human
aggcggguggaucacuugaggu

SEQ ID NO: 1006533 - RNA, 26 nt, Human
aggcggguggaucacuugaggucagg

SEQ ID NO: 1006534 - RNA, 24 nt, Human
aggcucaugccuguaauuucagca

SEQ ID NO: 1006535 - RNA, 24 nt, Human
aggcugaggugggcagagugcuug

SEQ ID NO: 1006536 - RNA, 24 nt, Human
aggugcagaggcucaugccuguaa

SEQ ID NO: 1006537 - RNA, 23 nt, Human
agguuuacaagcaugagccacca

SEQ ID NO: 1006538 - RNA, 19 nt, Human
aucacgugacucaggcacu

SEQ ID NO: 1006539 - RNA, 20 nt, Human
aucacuugaggucaggaguu

SEQ ID NO: 1006540 - RNA, 24 nt, Human
aucacuugaggucaggaguuugag

SEQ ID NO: 1006541 - RNA, 23 nt, Human
auuagcugggcgugguggugugu

SEQ ID NO: 1006542 - RNA, 21 nt, Human
caaaacaaaaaaaaugcaaaa

SEQ ID NO: 1006543 - RNA, 18 nt, Human
caaaacauaaaccacuga

SEQ ID NO: 1006544 - RNA, 21 nt, Human
caaaacauaaaccacugacuc

SEQ ID NO: 1006545 - RNA, 24 nt, Human
caaagugcugggauuacaggugug

SEQ ID NO: 1006546 - RNA, 23 nt, Human
caacuccuggccuccaaugaacc

SEQ ID NO: 1006547 - RNA, 24 nt, Human
caaggcggguggaucacuugaggu

SEQ ID NO: 1006548 - RNA, 26 nt, Human
caaggcggguggaucacuugagguca

SEQ ID NO: 1006549 - RNA, 23 nt, Human
cacaccugagaagcugaggcagg

SEQ ID NO: 1006550 - RNA, 21 nt, Human
caccauauuaccauagugaaa

SEQ ID NO: 1006551 - RNA, 22 nt, Human
cacccaccucggccucccaaag

SEQ ID NO: 1006552 - RNA, 23 nt, Human
cacccaccucggccucccaaagu

SEQ ID NO: 1006553 - RNA, 24 nt, Human
caccucggccucccaaagugcugg

SEQ ID NO: 1006554 - RNA, 21 nt, Human
caccuucuagguucagucacc

SEQ ID NO: 1006555 - RNA, 27 nt, Human
cacgugacucaggcacugcacaccacc

SEQ ID NO: 1006556 - RNA, 21 nt, Human
cacugcgccugacccuugcag

SEQ ID NO: 1006557 - RNA, 20 nt, Human
cacuggauagagagcaggau

SEQ ID NO: 1006558 - RNA, 18 nt, Human
cacugugggugcaucgua

SEQ ID NO: 1006559 - RNA, 23 nt, Human
cacuugaggucaggaguuugaga

SEQ ID NO: 1006560 - RNA, 21 nt, Human
cagcacuuugggagucaaggc

SEQ ID NO: 1006561 - RNA, 23 nt, Human
cagcacuuugggagucaaggcgg

SEQ ID NO: 1006562 - RNA, 18 nt, Human
caggcagaucacuugagg

SEQ ID NO: 1006563 - RNA, 22 nt, Human
caguaggucacaccugagaagc

SEQ ID NO: 1006564 - RNA, 24 nt, Human
caugccuguaauuucagcacuuug

SEQ ID NO: 1006565 - RNA, 24 nt, Human
cauguugcccaggcugaucuccaa

SEQ ID NO: 1006566 - RNA, 20 nt, Human
cauuugauaaggcuuucagg

SEQ ID NO: 1006567 - RNA, 21 nt, Human
ccaaagugcugggauuacagg

SEQ ID NO: 1006568 - RNA, 21 nt, Human
ccaaagugcugggauuacagg

SEQ ID NO: 1006569 - RNA, 24 nt, Human
ccaaagugcugggauuacaggugu

SEQ ID NO: 1006570 - RNA, 20 nt, Human
ccacgguacucuagccuggg

SEQ ID NO: 1006571 - RNA, 22 nt, Human
ccacgguacucuagccugggag

SEQ ID NO: 1006572 - RNA, 24 nt, Human
ccacgguacucuagccugggagac

SEQ ID NO: 1006573 - RNA, 27 nt, Human
ccauugcuaauagaaauaaaaaaaaaa

SEQ ID NO: 1006574 - RNA, 21 nt, Human
cccauccccacuaaaaacaca

SEQ ID NO: 1006575 - RNA, 20 nt, Human
ccccugcugggcucagcucc

SEQ ID NO: 1006576 - RNA, 23 nt, Human
ccucugggcaccgaggacgauuc

SEQ ID NO: 1006577 - RNA, 24 nt, Human
ccuggccaacaugguaaaacccca

SEQ ID NO: 1006578 - RNA, 18 nt, Human
ccuggccagcauggugaa

SEQ ID NO: 1006579 - RNA, 23 nt, Human
ccuggccagcauggugaaacccc

SEQ ID NO: 1006580 - RNA, 24 nt, Human
ccuggccagcauggugaaacccca

SEQ ID NO: 1006581 - RNA, 22 nt, Human
ccugggagacagagcgagacuc

SEQ ID NO: 1006582 - RNA, 22 nt, Human
ccugggugacagagugagacuc

SEQ ID NO: 1006583 - RNA, 22 nt, Human
ccuguaauuucagcacuuuggg

SEQ ID NO: 1006584 - RNA, 19 nt, Human
ccuuggacucucuacguca

SEQ ID NO: 1006585 - RNA, 22 nt, Human
ccuuuuggcuacagggccccag

SEQ ID NO: 1006586 - RNA, 22 nt, Human
cgaaaagaaugaaggccaggug

SEQ ID NO: 1006587 - RNA, 24 nt, Human
cgggaggcugaggcagaagaauca

SEQ ID NO: 1006588 - RNA, 24 nt, Human
cggguggaucacuugaggucagga

SEQ ID NO: 1006589 - RNA, 24 nt, Human
cucaaaacaaaaaaaaugcaaaac

SEQ ID NO: 1006590 - RNA, 24 nt, Human
cucaugccuguaauuucagcacuu

SEQ ID NO: 1006591 - RNA, 26 nt, Human
cuccugcuguagccuuuuggcuacag

SEQ ID NO: 1006592 - RNA, 19 nt, Human
cuccuuuaugggcgguggc

SEQ ID NO: 1006593 - RNA, 24 nt, Human
cugcuacucgggaggcugaggcag

SEQ ID NO: 1006594 - RNA, 23 nt, Human
cuggccaacaugguaaaacccca

SEQ ID NO: 1006595 - RNA, 23 nt, Human
cuggccagcauggugaaacccca

SEQ ID NO: 1006596 - RNA, 23 nt, Human
cuucauacacugugccagcugcu

SEQ ID NO: 1006597 - RNA, 24 nt, Human
gacagagcgagacucugucucaaa

SEQ ID NO: 1006598 - RNA, 24 nt, Human
gacagagugagacucugucucaaa

SEQ ID NO: 1006599 - RNA, 22 nt, Human
gagccaccaugccugguucagc

SEQ ID NO: 1006600 - RNA, 21 nt, Human
gaucacuugaggucaggaguu

SEQ ID NO: 1006601 - RNA, 24 nt, Human
gaucacuugaggucaggaguuuga

SEQ ID NO: 1006602 - RNA, 20 nt, Human
gaucacuugaggucaguuca

SEQ ID NO: 1006603 - RNA, 21 nt, Human
gaucacuugaggucaguucau

SEQ ID NO: 1006604 - RNA, 18 nt, Human
gauuacaggugugagcca

SEQ ID NO: 1006605 - RNA, 22 nt, Human
gauuacaggugugagccacugc

SEQ ID NO: 1006606 - RNA, 22 nt, Human
gauuacaggugugagccacugc

SEQ ID NO: 1006607 - RNA, 24 nt, Human
gcacuguauuuccagcuacucugg

SEQ ID NO: 1006608 - RNA, 24 nt, Human
gcagagccgccucugggcaccgag

SEQ ID NO: 1006609 - RNA, 20 nt, Human
gcauucaaauauagcaguuu

SEQ ID NO: 1006610 - RNA, 22 nt, Human
gccaacaugguaaaaccccauc

SEQ ID NO: 1006611 - RNA, 20 nt, Human
gccacgguacucuagccugg

SEQ ID NO: 1006612 - RNA, 21 nt, Human
gccagcauggugaaaccccau

SEQ ID NO: 1006613 - RNA, 21 nt, Human
gccagcugcuucauggauggu

SEQ ID NO: 1006614 - RNA, 24 nt, Human
gccaggugcagaggcucaugccug

SEQ ID NO: 1006615 - RNA, 23 nt, Human
gccugggugacagagugagacuc

SEQ ID NO: 1006616 - RNA, 23 nt, Human
gcugaucuccaacuccuggccuc

SEQ ID NO: 1006617 - RNA, 27 nt, Human
ggccauguugcccaggcugaucuccaa

SEQ ID NO: 1006618 - RNA, 21 nt, Human
ggcucaugccuguaauuucag

SEQ ID NO: 1006619 - RNA, 19 nt, Human
ggucaggaguuugagacca

SEQ ID NO: 1006620 - RNA, 21 nt, Human
gguggaucacuugaggucagg

SEQ ID NO: 1006621 - RNA, 22 nt, Human
gguuuacaagcaugagccacca

SEQ ID NO: 1006622 - RNA, 24 nt, Human
guacucuagccugggagacagagc

SEQ ID NO: 1006623 - RNA, 20 nt, Human
gucaggugauccauccaccc

SEQ ID NO: 1006624 - RNA, 24 nt, Human
gugacagagugagacucugucuca

SEQ ID NO: 1006625 - RNA, 28 nt, Human
gugauccauccacccaccucggccuccc

SEQ ID NO: 1006626 - RNA, 23 nt, Human
gugcaucguaaagguggguaguc

SEQ ID NO: 1006627 - RNA, 23 nt, Human
gugcuugagcccaggaagcagag

SEQ ID NO: 1006628 - RNA, 24 nt, Human
gugcuugagcccaggaagcagagg

SEQ ID NO: 1006629 - RNA, 20 nt, Human
guguguucaaagggcuauca

SEQ ID NO: 1006630 - RNA, 22 nt, Human
uaaaaccccauccccacuaaaa

SEQ ID NO: 1006631 - RNA, 23 nt, Human
uaaagcuaugggguuuucccaga

SEQ ID NO: 1006632 - RNA, 23 nt, Human
uaaccauacucccucuugguaag

SEQ ID NO: 1006633 - RNA, 21 nt, Human
uaagauagaacagaaauucuu

SEQ ID NO: 1006634 - RNA, 22 nt, Human
uacaagcaugagccaccaugcc

SEQ ID NO: 1006635 - RNA, 22 nt, Human
uacaggugugagccacugcgcc

SEQ ID NO: 1006636 - RNA, 23 nt, Human
uacaggugugagccacugcgccu

SEQ ID NO: 1006637 - RNA, 19 nt, Human
uaccauagugaaacauacc

SEQ ID NO: 1006638 - RNA, 26 nt, Human
uacccuggguguccacguuagggugg

SEQ ID NO: 1006639 - RNA, 20 nt, Human
uacgaaaagaaugaaggcca

SEQ ID NO: 1006640 - RNA, 22 nt, Human
uacucuagccugggagacagag

SEQ ID NO: 1006641 - RNA, 24 nt, Human
uacucuagccugggagacagagcg

SEQ ID NO: 1006642 - RNA, 22 nt, Human
uacuuggggaagcacggcccgg

SEQ ID NO: 1006643 - RNA, 21 nt, Human
uagaacagaaauucuuggaca

SEQ ID NO: 1006644 - RNA, 20 nt, Human
uagcugggcgugguggugug

SEQ ID NO: 1006645 - RNA, 21 nt, Human
ucagcuccugcuguagccuuu

SEQ ID NO: 1006646 - RNA, 22 nt, Human
ucauaacaagccuggccagcau

SEQ ID NO: 1006647 - RNA, 19 nt, Human
uccaacuccuggccuccaa

SEQ ID NO: 1006648 - RNA, 24 nt, Human
uccaacuccuggccuccaaugaac

SEQ ID NO: 1006649 - RNA, 21 nt, Human
uccacccaccucggccuccca

SEQ ID NO: 1006650 - RNA, 23 nt, Human
ucccaaagugcugggauuacagg

SEQ ID NO: 1006651 - RNA, 18 nt, Human
ucccagagcuugguagca

SEQ ID NO: 1006652 - RNA, 24 nt, Human
ucccgccugggugacagagugaga

SEQ ID NO: 1006653 - RNA, 18 nt, Human
ucggccucccaaagugcu

SEQ ID NO: 1006654 - RNA, 25 nt, Human
ucgggaggcugaggcagaagaauca

SEQ ID NO: 1006655 - RNA, 23 nt, Human
ucuagccugggagacagagcgag

SEQ ID NO: 1006656 - RNA, 24 nt, Human
ucuagccugggagacagagcgaga

SEQ ID NO: 1006657 - RNA, 24 nt, Human
ugagaagcugaggcaggcagauca

SEQ ID NO: 1006658 - RNA, 23 nt, Human
ugagaccagccuggccaacaugg

SEQ ID NO: 1006659 - RNA, 24 nt, Human
ugagaccagccuggccaacauggu

SEQ ID NO: 1006660 - RNA, 22 nt, Human
ugagccgaaaucaugccaccua

SEQ ID NO: 1006661 - RNA, 22 nt, Human
ugagccgagauugugccacggu

SEQ ID NO: 1006662 - RNA, 18 nt, Human
ugaggaacuucacugugg

SEQ ID NO: 1006663 - RNA, 20 nt, Human
ugaggcagaagaaucaguug

SEQ ID NO: 1006664 - RNA, 23 nt, Human
ugaggcagaagaaucaguugaac

SEQ ID NO: 1006665 - RNA, 23 nt, Human
ugaggcagaagaaucaguugaac

SEQ ID NO: 1006666 - RNA, 26 nt, Human
ugaggcaggcagaucacuugagguca

SEQ ID NO: 1006667 - RNA, 18 nt, Human
ugaggucaggaguuugag

SEQ ID NO: 1006668 - RNA, 25 nt, Human
ugaggugggcagagugcuugagccc

SEQ ID NO: 1006669 - RNA, 22 nt, Human
ugcaaugagccgagauugugcc

SEQ ID NO: 1006670 - RNA, 23 nt, Human
ugccacgguacucuagccuggga

SEQ ID NO: 1006671 - RNA, 26 nt, Human
ugccagcugcuucauggauggugucc

SEQ ID NO: 1006672 - RNA, 23 nt, Human
ugccuguaauuucagcacuuugg

SEQ ID NO: 1006673 - RNA, 23 nt, Human
ugccuguaauuucagcacuuugg

SEQ ID NO: 1006674 - RNA, 24 nt, Human
ugcugggauuacaggugugagcca

SEQ ID NO: 1006675 - RNA, 23 nt, Human
uggaucacuugaggucaggaguu

SEQ ID NO: 1006676 - RNA, 24 nt, Human
uggaucacuugaggucaggaguuu

SEQ ID NO: 1006677 - RNA, 27 nt, Human
uggaucacuugaggucaggaguuugag

SEQ ID NO: 1006678 - RNA, 19 nt, Human
uggaugguguccauuugau

SEQ ID NO: 1006679 - RNA, 24 nt, Human
uggccagcauggugaaaccccauu

SEQ ID NO: 1006680 - RNA, 22 nt, Human
uggcugggucaaaguuuuguga

SEQ ID NO: 1006681 - RNA, 22 nt, Human
ugggaggcagagguugcaguga

SEQ ID NO: 1006682 - RNA, 24 nt, Human
ugggaggcagagguugcagugagc

SEQ ID NO: 1006683 - RNA, 18 nt, Human
ugggauuacaggugugag

SEQ ID NO: 1006684 - RNA, 19 nt, Human
ugggauuacaggugugagc

SEQ ID NO: 1006685 - RNA, 21 nt, Human
ugggauuacaggugugagcca

SEQ ID NO: 1006686 - RNA, 22 nt, Human
ugggauuacaggugugagccac

SEQ ID NO: 1006687 - RNA, 22 nt, Human
ugggauuacaggugugagccac

SEQ ID NO: 1006688 - RNA, 24 nt, Human
ugggauuacaggugugagccacug

SEQ ID NO: 1006689 - RNA, 21 nt, Human
ugggugacagagugagacucu

SEQ ID NO: 1006690 - RNA, 22 nt, Human
uggguggcacuguauuuccagc

SEQ ID NO: 1006691 - RNA, 23 nt, Human
uguauuuccagcuacucuggagg

SEQ ID NO: 1006692 - RNA, 20 nt, Human
uguccacguuagggugguag

SEQ ID NO: 1006693 - RNA, 19 nt, Human
ugucucaaaacaaaaaaaa

SEQ ID NO: 1006694 - RNA, 25 nt, Human
ugugaggaacuucacugugggugca

SEQ ID NO: 1006695 - RNA, 21 nt, Human
uguguguucaaagggcuauca

SEQ ID NO: 1006696 - RNA, 22 nt, Human
uuagcugggcgugguggugugu

SEQ ID NO: 1006697 - RNA, 24 nt, Human
uugaacuugggaggcagagguugc

SEQ ID NO: 1006698 - RNA, 22 nt, Human
uugcaaugagccgagauugugc

SEQ ID NO: 1006699 - RNA, 23 nt, Human
uugcagugagccgaaaucaugcc

SEQ ID NO: 1006700 - RNA, 21 nt, Human
uugggaggcagagguugcagu

SEQ ID NO: 1006701 - RNA, 22 nt, Human
uugguaagauagaacagaaauu

SEQ ID NO: 1006702 - RNA, 21 nt, Human
uuuacaagcaugagccaccau

SEQ ID NO: 1006703 - RNA, 21 nt, Human
aaaaaacaaaaugggagccau

SEQ ID NO: 1006704 - RNA, 22 nt, Human
aaaaaacaaaaugggagccaug

SEQ ID NO: 1006705 - RNA, 22 nt, Human
aaaaaauauauauaacaaaggg

SEQ ID NO: 1006706 - RNA, 19 nt, Human
aaacaaaaugggagccaug

SEQ ID NO: 1006707 - RNA, 18 nt, Human
aaaccgggaaggccagca

SEQ ID NO: 1006708 - RNA, 18 nt, Human
aaacuggcuuucucuuca

SEQ ID NO: 1006709 - RNA, 23 nt, Human
aagaaugauuccuaagaauacaa

SEQ ID NO: 1006710 - RNA, 21 nt, Human
aagccacagccccucucacac

SEQ ID NO: 1006711 - RNA, 24 nt, Human
aaggagccccugagcaguggggug

SEQ ID NO: 1006712 - RNA, 23 nt, Human
aagggcucugggcuaugcagucc

SEQ ID NO: 1006713 - RNA, 19 nt, Human
aaguguagaaaacucaaaa

SEQ ID NO: 1006714 - RNA, 20 nt, Human
aaugaugaaaacugagccca

SEQ ID NO: 1006715 - RNA, 23 nt, Human
aaugaugaaaacugagcccaaaa

SEQ ID NO: 1006716 - RNA, 19 nt, Human
acagugcaggucucccagc

SEQ ID NO: 1006717 - RNA, 22 nt, Human
acccugguauccuugacccuca

SEQ ID NO: 1006718 - RNA, 21 nt, Human
acgcuccuccagaagaacacc

SEQ ID NO: 1006719 - RNA, 23 nt, Human
acuggcccccacagugagcacac

SEQ ID NO: 1006720 - RNA, 23 nt, Human
agaagaacaccaagcagcagaaa

SEQ ID NO: 1006721 - RNA, 23 nt, Human
aggaaaagaaaucucaaacuccc

SEQ ID NO: 1006722 - RNA, 23 nt, Human
aggagggccugggacccgggugu

SEQ ID NO: 1006723 - RNA, 22 nt, Human
aggcaagugcccucaaauccuu

SEQ ID NO: 1006724 - RNA, 24 nt, Human
agggacauggaauuugggggccca

SEQ ID NO: 1006725 - RNA, 20 nt, Human
augaagggcucugggcuaug

SEQ ID NO: 1006726 - RNA, 18 nt, Human
augccgguccccgggcgg

SEQ ID NO: 1006727 - RNA, 19 nt, Human
auuaacaaucuccacacca

SEQ ID NO: 1006728 - RNA, 24 nt, Human
caaagggaaaggaaggagggccug

SEQ ID NO: 1006729 - RNA, 20 nt, Human
caaccgucuagcgacagagc

SEQ ID NO: 1006730 - RNA, 26 nt, Human
caagacaggcaagugcccucaaaucc

SEQ ID NO: 1006731 - RNA, 20 nt, Human
caagccagagcacggggcag

SEQ ID NO: 1006732 - RNA, 23 nt, Human
caagccccagccuagagcugccc

SEQ ID NO: 1006733 - RNA, 18 nt, Human
caccaagcagcagaaagg

SEQ ID NO: 1006734 - RNA, 20 nt, Human
caccaagcagcagaaagggc

SEQ ID NO: 1006735 - RNA, 22 nt, Human
cacccagacccaaguggcaagc

SEQ ID NO: 1006736 - RNA, 18 nt, Human
cacccucugcugcggccu

SEQ ID NO: 1006737 - RNA, 19 nt, Human
cacccucugcugcggccuc

SEQ ID NO: 1006738 - RNA, 22 nt, Human
cacccuucagucgacacauaac

SEQ ID NO: 1006739 - RNA, 21 nt, Human
cacggcccagcgcaagcccca

SEQ ID NO: 1006740 - RNA, 18 nt, Human
cacugccuggagagcccc

SEQ ID NO: 1006741 - RNA, 19 nt, Human
cagagcacggggcagucug

SEQ ID NO: 1006742 - RNA, 25 nt, Human
cagagcagaggccgggccaaagggc

SEQ ID NO: 1006743 - RNA, 18 nt, Human
cagagccuguaaacacug

SEQ ID NO: 1006744 - RNA, 19 nt, Human
cagccuagagcugccccuc

SEQ ID NO: 1006745 - RNA, 24 nt, Human
cagccuccacugccggccucugcu

SEQ ID NO: 1006746 - RNA, 20 nt, Human
caggcagauucacccacagg

SEQ ID NO: 1006747 - RNA, 23 nt, Human
cagggaaaccccugcagccccca

SEQ ID NO: 1006748 - RNA, 21 nt, Human
cagucaguucagacucaccuu

SEQ ID NO: 1006749 - RNA, 23 nt, Human
caguucagacucaccuuguggca

SEQ ID NO: 1006750 - RNA, 26 nt, Human
cauuaccacaaauaaagcauaaacaa

SEQ ID NO: 1006751 - RNA, 22 nt, Human
cauucuagucaggacggcacag

SEQ ID NO: 1006752 - RNA, 24 nt, Human
ccaaaauaggugucuguaaaaauc

SEQ ID NO: 1006753 - RNA, 24 nt, Human
ccacccagacccaaguggcaagcc

SEQ ID NO: 1006754 - RNA, 23 nt, Human
ccacugccggccucugcuuggcu

SEQ ID NO: 1006755 - RNA, 22 nt, Human
ccagagccuguaaacacugugc

SEQ ID NO: 1006756 - RNA, 22 nt, Human
cccacagugagcacacccuagg

SEQ ID NO: 1006757 - RNA, 20 nt, Human
ccccgaggcugcucugcccc

SEQ ID NO: 1006758 - RNA, 23 nt, Human
ccgaggcugcucugccccacccu

SEQ ID NO: 1006759 - RNA, 19 nt, Human
ccgucuagcgacagagcug

SEQ ID NO: 1006760 - RNA, 20 nt, Human
ccuagucucucugauccacu

SEQ ID NO: 1006761 - RNA, 19 nt, Human
ccucaugccgguccccggg

SEQ ID NO: 1006762 - RNA, 25 nt, Human
ccuccacgaacucgggaaaaaacaa

SEQ ID NO: 1006763 - RNA, 20 nt, Human
ccuggagagccccaggacuu

SEQ ID NO: 1006764 - RNA, 25 nt, Human
ccuguaaacacugugccucccacca

SEQ ID NO: 1006765 - RNA, 18 nt, Human
cgaauucugcuccaccau

SEQ ID NO: 1006766 - RNA, 19 nt, Human
cgaggagaaacuggccccc

SEQ ID NO: 1006767 - RNA, 19 nt, Human
cgcuccuccagaagaacac

SEQ ID NO: 1006768 - RNA, 20 nt, Human
cggcagacacuucacagagg

SEQ ID NO: 1006769 - RNA, 23 nt, Human
cggcagacacuucacagaggccu

SEQ ID NO: 1006770 - RNA, 20 nt, Human
cggcccagcgcaagccccag

SEQ ID NO: 1006771 - RNA, 20 nt, Human
cgucuagcgacagagcugca

SEQ ID NO: 1006772 - RNA, 20 nt, Human
cucacaagacaggcaagugc

SEQ ID NO: 1006773 - RNA, 23 nt, Human
cucacaagacaggcaagugcccu

SEQ ID NO: 1006774 - RNA, 21 nt, Human
cuccacaccaccccuaacacc

SEQ ID NO: 1006775 - RNA, 20 nt, Human
cuccugagcagcaagggccc

SEQ ID NO: 1006776 - RNA, 18 nt, Human
cucgccuguaggucugcc

SEQ ID NO: 1006777 - RNA, 21 nt, Human
cugcucugccccacccucugc

SEQ ID NO: 1006778 - RNA, 18 nt, Human
cuggagcagucaguucag

SEQ ID NO: 1006779 - RNA, 18 nt, Human
cuugggacccugguaucc

SEQ ID NO: 1006780 - RNA, 18 nt, Human
gaacucgggaaaaaacaa

SEQ ID NO: 1006781 - RNA, 19 nt, Human
gaagaacaguccccuucua

SEQ ID NO: 1006782 - RNA, 18 nt, Human
gaagggcucugggcuaug

SEQ ID NO: 1006783 - RNA, 18 nt, Human
gagaugaagggcucuggg

SEQ ID NO: 1006784 - RNA, 21 nt, Human
gagcaguggggugcucugagg

SEQ ID NO: 1006785 - RNA, 23 nt, Human
gaggcaucacuagauuccuaaaa

SEQ ID NO: 1006786 - RNA, 18 nt, Human
gagucaggagccaagagc

SEQ ID NO: 1006787 - RNA, 24 nt, Human
gcaccuccugagcagcaagggccc

SEQ ID NO: 1006788 - RNA, 22 nt, Human
gcagcagaaagggcgcagugag

SEQ ID NO: 1006789 - RNA, 19 nt, Human
gcagugaguguacauccug

SEQ ID NO: 1006790 - RNA, 21 nt, Human
gccagagcacggggcagucug

SEQ ID NO: 1006791 - RNA, 22 nt, Human
ggaaaggaaggagggccuggga

SEQ ID NO: 1006792 - RNA, 20 nt, Human
ggauaaggaauccacuuagc

SEQ ID NO: 1006793 - RNA, 27 nt, Human
gggaaaccccugcagcccccagacccc

SEQ ID NO: 1006794 - RNA, 18 nt, Human
gggcagaauggacaugug

SEQ ID NO: 1006795 - RNA, 21 nt, Human
gugaagaacaguccccuucua

SEQ ID NO: 1006796 - RNA, 21 nt, Human
uaaacacugugccucccacca

SEQ ID NO: 1006797 - RNA, 21 nt, Human
uaacaaagggauaaggaaucc

SEQ ID NO: 1006798 - RNA, 22 nt, Human
uaacaaccgucuagcgacagag

SEQ ID NO: 1006799 - RNA, 18 nt, Human
uaagaaacggucacgccc

SEQ ID NO: 1006800 - RNA, 25 nt, Human
uaagaaacggucacgcccgguaagu

SEQ ID NO: 1006801 - RNA, 23 nt, Human
uaccacaaauaaagcauaaacaa

SEQ ID NO: 1006802 - RNA, 24 nt, Human
uaccacaaauaaagcauaaacaag

SEQ ID NO: 1006803 - RNA, 19 nt, Human
uacucuguaaacaaacugg

SEQ ID NO: 1006804 - RNA, 23 nt, Human
uacugggcgcuguacccugggag

SEQ ID NO: 1006805 - RNA, 24 nt, Human
uagcgggugucacugcauggcuuc

SEQ ID NO: 1006806 - RNA, 19 nt, Human
uaggugucuguaaaaaucc

SEQ ID NO: 1006807 - RNA, 23 nt, Human
uauguaaaaaaaggagucagagc

SEQ ID NO: 1006808 - RNA, 19 nt, Human
ucacugcauggcuucuuug

SEQ ID NO: 1006809 - RNA, 18 nt, Human
ucaggcagauucacccac

SEQ ID NO: 1006810 - RNA, 27 nt, Human
uccaagaucuucugcacaucacccuuu

SEQ ID NO: 1006811 - RNA, 20 nt, Human
uccacgaacucgggaaaaaa

SEQ ID NO: 1006812 - RNA, 22 nt, Human
uccagggagcuuacugcagcca

SEQ ID NO: 1006813 - RNA, 23 nt, Human
uccagggagcuuacugcagccag

SEQ ID NO: 1006814 - RNA, 21 nt, Human
uccccagcgccgacgcgggcc

SEQ ID NO: 1006815 - RNA, 25 nt, Human
uccgcugagaacucacgcuccucca

SEQ ID NO: 1006816 - RNA, 24 nt, Human
uccugagcagcaagggcccggcuc

SEQ ID NO: 1006817 - RNA, 20 nt, Human
ucucccagcuguggcucugg

SEQ ID NO: 1006818 - RNA, 20 nt, Human
ucucuucuuuggcucuuuug

SEQ ID NO: 1006819 - RNA, 22 nt, Human
ucuuauguaaaaaaaggaguca

SEQ ID NO: 1006820 - RNA, 24 nt, Human
ugacccucagagagaugaagggcu

SEQ ID NO: 1006821 - RNA, 19 nt, Human
ugacuuaggagcucugcag

SEQ ID NO: 1006822 - RNA, 23 nt, Human
ugaggacaccauauacucucaac

SEQ ID NO: 1006823 - RNA, 19 nt, Human
ugaggcaagaggcaucacu

SEQ ID NO: 1006824 - RNA, 24 nt, Human
ugaggguauucugcuccagcugca

SEQ ID NO: 1006825 - RNA, 21 nt, Human
ugaguggugacuuaggagcuc

SEQ ID NO: 1006826 - RNA, 25 nt, Human
ugaguuacugggcgcuguacccugg

SEQ ID NO: 1006827 - RNA, 22 nt, Human
ugcaagccagagcacggggcag

SEQ ID NO: 1006828 - RNA, 21 nt, Human
ugccgguccccgggcggcggc

SEQ ID NO: 1006829 - RNA, 19 nt, Human
ugcucagccuccacugccg

SEQ ID NO: 1006830 - RNA, 18 nt, Human
ugcucugccaccagagcc

SEQ ID NO: 1006831 - RNA, 21 nt, Human
uggaaauccaaguugcaaaaa

SEQ ID NO: 1006832 - RNA, 19 nt, Human
uggaauuugggggcccaga

SEQ ID NO: 1006833 - RNA, 18 nt, Human
uggcaagccuugccucug

SEQ ID NO: 1006834 - RNA, 22 nt, Human
uggcacagaccucacaagacag

SEQ ID NO: 1006835 - RNA, 19 nt, Human
ugggacccugguauccuug

SEQ ID NO: 1006836 - RNA, 22 nt, Human
ugggagccauggauauaaaggg

SEQ ID NO: 1006837 - RNA, 23 nt, Human
uguaaacaaacuggaaauccaag

SEQ ID NO: 1006838 - RNA, 19 nt, Human
uguagaaaacucaaaacug

SEQ ID NO: 1006839 - RNA, 25 nt, Human
uguucuuaguauuucgcagggacag

SEQ ID NO: 1006840 - RNA, 18 nt, Human
uuacugcagccagaagga

SEQ ID NO: 1006841 - RNA, 21 nt, Human
uuagcccaaugugaaacacag

SEQ ID NO: 1006842 - RNA, 20 nt, Human
uuauguaaaaaaaggagucu

SEQ ID NO: 1006843 - RNA, 18 nt, Human
uucucuaaaagagcuuca

SEQ ID NO: 1006844 - RNA, 22 nt, Human
uuguugaaucuacaaaggucuu

SEQ ID NO: 1006845 - RNA, 21 nt, Human
uuugcuacuaccuaagacuac

SEQ ID NO: 1006846 - RNA, 19 nt, Human
aaaaauggaagcagaagca

SEQ ID NO: 1006847 - RNA, 25 nt, Human
aaaaccugaugaggaauucaaaaua

SEQ ID NO: 1006848 - RNA, 22 nt, Human
aaagcaaagggaaaaagucaga

SEQ ID NO: 1006849 - RNA, 23 nt, Human
aaagcaaagggaaaaagucagaa

SEQ ID NO: 1006850 - RNA, 21 nt, Human
aaagccccuaaaucaucacca

SEQ ID NO: 1006851 - RNA, 20 nt, Human
aacaauaauacuuucucccc

SEQ ID NO: 1006852 - RNA, 20 nt, Human
aacagcacugucccccaucu

SEQ ID NO: 1006853 - RNA, 21 nt, Human
aagcaaagggaaaaagucaga

SEQ ID NO: 1006854 - RNA, 20 nt, Human
aagccaaaacacaaaagucc

SEQ ID NO: 1006855 - RNA, 19 nt, Human
aagccccuaaaucaucacc

SEQ ID NO: 1006856 - RNA, 18 nt, Human
aagccuccggaggggcgg

SEQ ID NO: 1006857 - RNA, 20 nt, Human
aagguuuuggaugaaggacg

SEQ ID NO: 1006858 - RNA, 23 nt, Human
aaguuaaaaaaaaaauucagucc

SEQ ID NO: 1006859 - RNA, 24 nt, Human
acaaaguaacaaauuugcuggugc

SEQ ID NO: 1006860 - RNA, 22 nt, Human
acaacacaacucuccgcauaca

SEQ ID NO: 1006861 - RNA, 23 nt, Human
acagcucauuagaaaggucaucu

SEQ ID NO: 1006862 - RNA, 21 nt, Human
acgaaagcaaagggaaaaagu

SEQ ID NO: 1006863 - RNA, 24 nt, Human
acuauuaaaaaaacaaaguaacaa

SEQ ID NO: 1006864 - RNA, 21 nt, Human
agaaaacaguggauucccuca

SEQ ID NO: 1006865 - RNA, 22 nt, Human
agaaaggucaucuuguguuuuc

SEQ ID NO: 1006866 - RNA, 21 nt, Human
agaaguuaaaaaaaaaauuca

SEQ ID NO: 1006867 - RNA, 19 nt, Human
agacaagcauuugguuuua

SEQ ID NO: 1006868 - RNA, 27 nt, Human
agacagcaaaggcugcuucuaggaacu

SEQ ID NO: 1006869 - RNA, 24 nt, Human
agagaaagaagcuaguauguggug

SEQ ID NO: 1006870 - RNA, 19 nt, Human
agagagggaagaaaaugag

SEQ ID NO: 1006871 - RNA, 21 nt, Human
agagauggagggagagaggga

SEQ ID NO: 1006872 - RNA, 19 nt, Human
agagauuucaaacucaaaa

SEQ ID NO: 1006873 - RNA, 25 nt, Human
agcaaagggaaaaagucagaaagga

SEQ ID NO: 1006874 - RNA, 21 nt, Human
agcacaacacaacucuccgca

SEQ ID NO: 1006875 - RNA, 18 nt, Human
agccaaaacacaaaaguc

SEQ ID NO: 1006876 - RNA, 19 nt, Human
aggacggagauaugggagg

SEQ ID NO: 1006877 - RNA, 21 nt, Human
aggacggagauaugggaggaa

SEQ ID NO: 1006878 - RNA, 23 nt, Human
aggcagcuaugccugcaccgugg

SEQ ID NO: 1006879 - RNA, 23 nt, Human
agggagagagggaagaaaaugag

SEQ ID NO: 1006880 - RNA, 20 nt, Human
agugacagugaggagauuca

SEQ ID NO: 1006881 - RNA, 18 nt, Human
auaaaucuugagacccaa

SEQ ID NO: 1006882 - RNA, 24 nt, Human
auacagcucauuagaaaggucauc

SEQ ID NO: 1006883 - RNA, 22 nt, Human
augaaaaccagaaacuaaaaug

SEQ ID NO: 1006884 - RNA, 22 nt, Human
augaaggacggagauaugggag

SEQ ID NO: 1006885 - RNA, 19 nt, Human
augcaguuugcuucaagcc

SEQ ID NO: 1006886 - RNA, 23 nt, Human
caaacgagauaaacucacuucuu

SEQ ID NO: 1006887 - RNA, 19 nt, Human
caaacgguacacccucaga

SEQ ID NO: 1006888 - RNA, 25 nt, Human
caaacuggcacagaaagguaaaugc

SEQ ID NO: 1006889 - RNA, 23 nt, Human
caaauaguacauucaaaucagga

SEQ ID NO: 1006890 - RNA, 24 nt, Human
caacagcacugucccccaucuccu

SEQ ID NO: 1006891 - RNA, 22 nt, Human
caaggaaucuccaaaaaugaaa

SEQ ID NO: 1006892 - RNA, 21 nt, Human
cacaacacaacucuccgcaua

SEQ ID NO: 1006893 - RNA, 19 nt, Human
cacaacagcacuguccccc

SEQ ID NO: 1006894 - RNA, 19 nt, Human
cacacgaaagcaaagggaa

SEQ ID NO: 1006895 - RNA, 20 nt, Human
cacagcauuaaaugacauuu

SEQ ID NO: 1006896 - RNA, 19 nt, Human
caccagcggcgcccgggac

SEQ ID NO: 1006897 - RNA, 21 nt, Human
caccguggccuccagagcugg

SEQ ID NO: 1006898 - RNA, 22 nt, Human
cagauucacugcuggccccaca

SEQ ID NO: 1006899 - RNA, 21 nt, Human
cagcacugucccccaucuccu

SEQ ID NO: 1006900 - RNA, 18 nt, Human
caguguaaaaagacagca

SEQ ID NO: 1006901 - RNA, 21 nt, Human
cauucaaaucaggacaccugg

SEQ ID NO: 1006902 - RNA, 22 nt, Human
ccacaucagcacaacacaacuc

SEQ ID NO: 1006903 - RNA, 23 nt, Human
ccagagcuggaugcaugcugugc

SEQ ID NO: 1006904 - RNA, 24 nt, Human
cccacaacagcacugucccccauc

SEQ ID NO: 1006905 - RNA, 19 nt, Human
ccccgcacaccgcggccuc

SEQ ID NO: 1006906 - RNA, 23 nt, Human
ccgcacaccgcggccuccgcguc

SEQ ID NO: 1006907 - RNA, 23 nt, Human
ccugcaccguggccuccagagcu

SEQ ID NO: 1006908 - RNA, 25 nt, Human
cgcccgggacgagagcugcgggggc

SEQ ID NO: 1006909 - RNA, 18 nt, Human
cuauaggaguuacagaua

SEQ ID NO: 1006910 - RNA, 25 nt, Human
cugccagagcagcaggcagcuaugc

SEQ ID NO: 1006911 - RNA, 19 nt, Human
cuggccccacaacagcacu

SEQ ID NO: 1006912 - RNA, 20 nt, Human
cuggccccacaacagcacug

SEQ ID NO: 1006913 - RNA, 22 nt, Human
cuggugccaaaauuuauuuagc

SEQ ID NO: 1006914 - RNA, 21 nt, Human
cugucccccaucuccucucca

SEQ ID NO: 1006915 - RNA, 25 nt, Human
cuuuuacucacugaaguaguuuguc

SEQ ID NO: 1006916 - RNA, 19 nt, Human
gaagaaaaugagagaaaaa

SEQ ID NO: 1006917 - RNA, 19 nt, Human
gagccucuuaccugaccac

SEQ ID NO: 1006918 - RNA, 20 nt, Human
gagcuccgcuggcgcguccu

SEQ ID NO: 1006919 - RNA, 21 nt, Human
gaucuauaggaguuacagaua

SEQ ID NO: 1006920 - RNA, 23 nt, Human
gcagcaggcagcuaugccugcac

SEQ ID NO: 1006921 - RNA, 27 nt, Human
gccaaaacacaaaagucuuuguaccua

SEQ ID NO: 1006922 - RNA, 24 nt, Human
gccaaacuggcacagaaagguaaa

SEQ ID NO: 1006923 - RNA, 21 nt, Human
ggagagauuucaaacucaaaa

SEQ ID NO: 1006924 - RNA, 18 nt, Human
ggccacaucagcacaaca

SEQ ID NO: 1006925 - RNA, 22 nt, Human
gggaagaaaaugagagaaaaac

SEQ ID NO: 1006926 - RNA, 20 nt, Human
gggcuuuaaaaauguuuaau

SEQ ID NO: 1006927 - RNA, 23 nt, Human
gggggugggggguuagggugggg

SEQ ID NO: 1006928 - RNA, 21 nt, Human
gguuaggguggggguggucag

SEQ ID NO: 1006929 - RNA, 20 nt, Human
guccugggggagggcgcggg

SEQ ID NO: 1006930 - RNA, 19 nt, Human
gugaggagauucaccucuc

SEQ ID NO: 1006931 - RNA, 20 nt, Human
uaaaacauaaaaugucaaag

SEQ ID NO: 1006932 - RNA, 23 nt, Human
uaaaugcccacaguaaguuucua

SEQ ID NO: 1006933 - RNA, 20 nt, Human
uacacugauccucucaccaa

SEQ ID NO: 1006934 - RNA, 22 nt, Human
uagaaguuaaaaaaaaaauuca

SEQ ID NO: 1006935 - RNA, 19 nt, Human
uagcaaauaauuaaccccc

SEQ ID NO: 1006936 - RNA, 22 nt, Human
uagcaaauaauuaacccccuuu

SEQ ID NO: 1006937 - RNA, 20 nt, Human
uagcauacuuuucaaaguga

SEQ ID NO: 1006938 - RNA, 19 nt, Human
uaguuugucuucugggaga

SEQ ID NO: 1006939 - RNA, 20 nt, Human
uaugcuagcagacaagcauu

SEQ ID NO: 1006940 - RNA, 20 nt, Human
uauuguuccauaaaucuuga

SEQ ID NO: 1006941 - RNA, 26 nt, Human
ucaauaaaucugugacaaagccaaaa

SEQ ID NO: 1006942 - RNA, 18 nt, Human
ucacugaaguaguuuguc

SEQ ID NO: 1006943 - RNA, 18 nt, Human
ucacugggacaaacucac

SEQ ID NO: 1006944 - RNA, 24 nt, Human
ucagcauaagguucaggcaauaaa

SEQ ID NO: 1006945 - RNA, 22 nt, Human
ucauaugguaaaauccaauccc

SEQ ID NO: 1006946 - RNA, 20 nt, Human
uccaaugucugggguagggc

SEQ ID NO: 1006947 - RNA, 19 nt, Human
uccagggcgaaggagccgg

SEQ ID NO: 1006948 - RNA, 18 nt, Human
uccaugauuguacuaaag

SEQ ID NO: 1006949 - RNA, 22 nt, Human
uccccagugacugguacagaaa

SEQ ID NO: 1006950 - RNA, 22 nt, Human
uccccuacaccacaggccucaa

SEQ ID NO: 1006951 - RNA, 22 nt, Human
uccgcguccagggcgaaggagc

SEQ ID NO: 1006952 - RNA, 20 nt, Human
uccuacaauuaaaauggaau

SEQ ID NO: 1006953 - RNA, 20 nt, Human
ucuccaaaaaugaaaaccag

SEQ ID NO: 1006954 - RNA, 23 nt, Human
ucugugacaaagccaaaacacaa

SEQ ID NO: 1006955 - RNA, 27 nt, Human
ucugugacaaagccaaaaccggggucc

SEQ ID NO: 1006956 - RNA, 18 nt, Human
ugccugaacacaaugagg

SEQ ID NO: 1006957 - RNA, 20 nt, Human
uggaagcagaagcaaaaaag

SEQ ID NO: 1006958 - RNA, 18 nt, Human
uggcgcguccugggggag

SEQ ID NO: 1006959 - RNA, 23 nt, Human
ugggacaaacucacguucaaugc

SEQ ID NO: 1006960 - RNA, 21 nt, Human
ugggggguuagggugggggug

SEQ ID NO: 1006961 - RNA, 20 nt, Human
ugggggugggggguuagggu

SEQ ID NO: 1006962 - RNA, 22 nt, Human
ugggggugggggguuagggugg

SEQ ID NO: 1006963 - RNA, 23 nt, Human
uggugggggugggggguuagggu

SEQ ID NO: 1006964 - RNA, 22 nt, Human
uguaaaaagacagcaaaggcug

SEQ ID NO: 1006965 - RNA, 20 nt, Human
ugucccccaucuccucucca

SEQ ID NO: 1006966 - RNA, 23 nt, Human
ugugacaaagccaaaacacaaaa

SEQ ID NO: 1006967 - RNA, 19 nt, Human
uguuuaauaggaugguggg

SEQ ID NO: 1006968 - RNA, 22 nt, Human
uuaauaggaugguggggguggg

SEQ ID NO: 1006969 - RNA, 25 nt, Human
uuacacugauccucucaccaaggua

SEQ ID NO: 1006970 - RNA, 18 nt, Human
uuauagagaaagaagcua

SEQ ID NO: 1006971 - RNA, 22 nt, Human
uuccaagaaggugccgagccuc

SEQ ID NO: 1006972 - RNA, 23 nt, Human
uuuauuuagccuguuucacuggg

SEQ ID NO: 1006973 - RNA, 22 nt, Human
uuuuaccccgcuucuaaaaccu

SEQ ID NO: 1006974 - RNA, 19 nt, Human
acaacauguucggaauuca

SEQ ID NO: 1006975 - RNA, 22 nt, Human
acucugaaauccagggaugcug

SEQ ID NO: 1006976 - RNA, 25 nt, Human
agcugacugcaagaaagggaacugg

SEQ ID NO: 1006977 - RNA, 19 nt, Human
agucaccacaucaccucag

SEQ ID NO: 1006978 - RNA, 27 nt, Human
caauguccuucacuuugggucagucuc

SEQ ID NO: 1006979 - RNA, 24 nt, Human
ccagggaugcugcaggccucuccc

SEQ ID NO: 1006980 - RNA, 24 nt, Human
gggaugcugcaggccucucccggc

SEQ ID NO: 1006981 - RNA, 24 nt, Human
uaagcuaauggugaaaguacaacg

SEQ ID NO: 1006982 - RNA, 24 nt, Human
uaauuggcagaucuacucucaaac

SEQ ID NO: 1006983 - RNA, 23 nt, Human
ucacuuugggucagucuccuggg

SEQ ID NO: 1006984 - RNA, 25 nt, Human
ucagauuuauugauuuccauuguau

SEQ ID NO: 1006985 - RNA, 21 nt, Human
uccacacaacauguucggaau

SEQ ID NO: 1006986 - RNA, 23 nt, Human
ucucccggcaauguccuucacuu

SEQ ID NO: 1006987 - RNA, 23 nt, Human
ucuccugggccagaggugaaagu

SEQ ID NO: 1006988 - RNA, 18 nt, Human
ugcaagaaagggaacugg

SEQ ID NO: 1006989 - RNA, 21 nt, Human
ugcugcaggccucucccggca

SEQ ID NO: 1006990 - RNA, 23 nt, Human
uguccuucacuuugggucccguu

SEQ ID NO: 1006991 - RNA, 23 nt, Human
agcaugagacagacccacagggc

SEQ ID NO: 1006992 - RNA, 19 nt, Human
aggaacagggagagcauga

SEQ ID NO: 1006993 - RNA, 25 nt, Human
cacagcuccacggcuggcgccccuc

SEQ ID NO: 1006994 - RNA, 18 nt, Human
cagggcugaggccaaccc

SEQ ID NO: 1006995 - RNA, 20 nt, Human
ccaggccucucccucggggg

SEQ ID NO: 1006996 - RNA, 22 nt, Human
cggcggcggggggccgcggggg

SEQ ID NO: 1006997 - RNA, 20 nt, Human
cuccacggcuggcgccccuc

SEQ ID NO: 1006998 - RNA, 21 nt, Human
cuccacggcuggcgccccucc

SEQ ID NO: 1006999 - RNA, 24 nt, Human
gagagcaugagacagacccacagg

SEQ ID NO: 1007000 - RNA, 21 nt, Human
gccacggggcccaauuccaca

SEQ ID NO: 1007001 - RNA, 20 nt, Human
gcggcggggggccgcggggg

SEQ ID NO: 1007002 - RNA, 21 nt, Human
ggcggcggggggccgcggggg

SEQ ID NO: 1007003 - RNA, 18 nt, Human
gggcgggggggcacgggg

SEQ ID NO: 1007004 - RNA, 19 nt, Human
ggggacggggccgccggag

SEQ ID NO: 1007005 - RNA, 21 nt, Human
guggcggcuggcccggcggcg

SEQ ID NO: 1007006 - RNA, 27 nt, Human
uccccacagcccccaagggaugggggc

SEQ ID NO: 1007007 - RNA, 24 nt, Human
uccccaggccucucccucgggggc

SEQ ID NO: 1007008 - RNA, 21 nt, Human
uggaggcccugggguggcggg

SEQ ID NO: 1007009 - RNA, 22 nt, Human
uggcuuggaggcccuggggugg

SEQ ID NO: 1007010 - RNA, 20 nt, Human
ugggggcucugccacggggc

SEQ ID NO: 1007011 - RNA, 21 nt, Human
ugggguggcggggagaggaac

SEQ ID NO: 1007012 - RNA, 22 nt, Human
uugguguccccaggccucuccc

SEQ ID NO: 1007013 - RNA, 24 nt, Human
aaaaaaaaaaucagagacauagga

SEQ ID NO: 1007014 - RNA, 21 nt, Human
aaaaauaccacuaaaaucaca

SEQ ID NO: 1007015 - RNA, 22 nt, Human
aaaacauauauaagggugccaa

SEQ ID NO: 1007016 - RNA, 21 nt, Human
aaacuagguugcagacuagca

SEQ ID NO: 1007017 - RNA, 21 nt, Human
aacagaugcucaguaaacaug

SEQ ID NO: 1007018 - RNA, 21 nt, Human
aacccacacccacuaagcagg

SEQ ID NO: 1007019 - RNA, 19 nt, Human
aagaagcugauggaggcag

SEQ ID NO: 1007020 - RNA, 21 nt, Human
aagaagcugauggaggcaggc

SEQ ID NO: 1007021 - RNA, 20 nt, Human
aagcaaggaccuagcagaga

SEQ ID NO: 1007022 - RNA, 19 nt, Human
acaaaacucaaagcaaaac

SEQ ID NO: 1007023 - RNA, 21 nt, Human
acagguaaaaaauagaaaguu

SEQ ID NO: 1007024 - RNA, 21 nt, Human
accuucaacccacacccacua

SEQ ID NO: 1007025 - RNA, 21 nt, Human
acuaacaaagacauacggaua

SEQ ID NO: 1007026 - RNA, 21 nt, Human
agagacauuuuauagaccagu

SEQ ID NO: 1007027 - RNA, 19 nt, Human
agaugcuagauaacaaaac

SEQ ID NO: 1007028 - RNA, 19 nt, Human
aggaacuguuuucaaacau

SEQ ID NO: 1007029 - RNA, 25 nt, Human
aggcaggcuguggcagauuuuuggu

SEQ ID NO: 1007030 - RNA, 20 nt, Human
agguugcagacuagcagcug

SEQ ID NO: 1007031 - RNA, 19 nt, Human
agucacaugccaucagugu

SEQ ID NO: 1007032 - RNA, 19 nt, Human
auacuggggaaaaaaaaaa

SEQ ID NO: 1007033 - RNA, 24 nt, Human
auauaagcaaggaccuagcagaga

SEQ ID NO: 1007034 - RNA, 19 nt, Human
aucacugcugaaaguuugg

SEQ ID NO: 1007035 - RNA, 20 nt, Human
augaucccauuuauuuaaaa

SEQ ID NO: 1007036 - RNA, 21 nt, Human
caaaacucaaagcaaaacuaa

SEQ ID NO: 1007037 - RNA, 22 nt, Human
caaaauaaagucacagucuuuc

SEQ ID NO: 1007038 - RNA, 21 nt, Human
caaaguagcucuaaacaaaac

SEQ ID NO: 1007039 - RNA, 20 nt, Human
caacuuuuuaagaaaaacca

SEQ ID NO: 1007040 - RNA, 21 nt, Human
cacagucuuuccguaugucca

SEQ ID NO: 1007041 - RNA, 22 nt, Human
caucauuaguuuagcggucucc

SEQ ID NO: 1007042 - RNA, 21 nt, Human
ccaguuacuuugggcuuaaga

SEQ ID NO: 1007043 - RNA, 19 nt, Human
ccaguuggaaaauauaaag

SEQ ID NO: 1007044 - RNA, 18 nt, Human
ccgcaaccuuggcugguu

SEQ ID NO: 1007045 - RNA, 23 nt, Human
ccgcaaccuuggcugguucggcc

SEQ ID NO: 1007046 - RNA, 22 nt, Human
ccucccauuacaaaauaaaguc

SEQ ID NO: 1007047 - RNA, 23 nt, Human
cgcccuccgucuucguccggcuc

SEQ ID NO: 1007048 - RNA, 20 nt, Human
cggcccccaccuccggcucc

SEQ ID NO: 1007049 - RNA, 25 nt, Human
cugacaccgagucaaguuacucagu

SEQ ID NO: 1007050 - RNA, 22 nt, Human
cugcggcccccgcaaccuuggc

SEQ ID NO: 1007051 - RNA, 20 nt, Human
cuggagauuuucuuuuucaa

SEQ ID NO: 1007052 - RNA, 20 nt, Human
cuggauccugcugcuuuuuc

SEQ ID NO: 1007053 - RNA, 20 nt, Human
cuugccaacacugucaccau

SEQ ID NO: 1007054 - RNA, 24 nt, Human
gaucauuccaauuuaggggaaagu

SEQ ID NO: 1007055 - RNA, 23 nt, Human
gcaaagcugagaucacacuguac

SEQ ID NO: 1007056 - RNA, 19 nt, Human
gcaacaaaaagaugcuaga

SEQ ID NO: 1007057 - RNA, 20 nt, Human
gcgcucgcucgguguguagu

SEQ ID NO: 1007058 - RNA, 20 nt, Human
gcuguuuccuugccaacacu

SEQ ID NO: 1007059 - RNA, 20 nt, Human
ggugagagggaaaacuaggu

SEQ ID NO: 1007060 - RNA, 19 nt, Human
guuaaaggugagagggaaa

SEQ ID NO: 1007061 - RNA, 26 nt, Human
guuugcucugagaaaauuucuuccuc

SEQ ID NO: 1007062 - RNA, 22 nt, Human
uaaagagacauuuuauagacca

SEQ ID NO: 1007063 - RNA, 24 nt, Human
uaagaaaaaccaaaugacuaaagg

SEQ ID NO: 1007064 - RNA, 19 nt, Human
uacaagauuuugcuugcag

SEQ ID NO: 1007065 - RNA, 19 nt, Human
uacugguuuucacuccuac

SEQ ID NO: 1007066 - RNA, 19 nt, Human
uaggagacaagucacaugc

SEQ ID NO: 1007067 - RNA, 19 nt, Human
uaguugguuuccaguucuu

SEQ ID NO: 1007068 - RNA, 20 nt, Human
uauauaagggugccaaaaag

SEQ ID NO: 1007069 - RNA, 19 nt, Human
ucaaagcaaaacuaagauc

SEQ ID NO: 1007070 - RNA, 21 nt, Human
ucaacuuuuuaagaaaaacca

SEQ ID NO: 1007071 - RNA, 20 nt, Human
ucaaggcaaacugacuugag

SEQ ID NO: 1007072 - RNA, 20 nt, Human
ucaguaaacauguuaaacca

SEQ ID NO: 1007073 - RNA, 21 nt, Human
ucaguaaacauguuaaaccaa

SEQ ID NO: 1007074 - RNA, 18 nt, Human
uccgucuucguccggcuc

SEQ ID NO: 1007075 - RNA, 24 nt, Human
ucugagaaaauuucuuccucccau

SEQ ID NO: 1007076 - RNA, 21 nt, Human
ucuggauccugcugcuuuuuc

SEQ ID NO: 1007077 - RNA, 22 nt, Human
ugaaauacuaaauaagaagcug

SEQ ID NO: 1007078 - RNA, 19 nt, Human
ugagaaaauuucuuccucc

SEQ ID NO: 1007079 - RNA, 24 nt, Human
ugagaaaauuucuuccucccauua

SEQ ID NO: 1007080 - RNA, 20 nt, Human
ugaguuaaacaccuucaacc

SEQ ID NO: 1007081 - RNA, 28 nt, Human
ugaguuaaacaccuucaacccacaccca

SEQ ID NO: 1007082 - RNA, 18 nt, Human
uggaaaacauauauaagg

SEQ ID NO: 1007083 - RNA, 24 nt, Human
uggagauuuucuuuuucaaacuca

SEQ ID NO: 1007084 - RNA, 23 nt, Human
uguguuugcaaagcugagaucac

SEQ ID NO: 1007085 - RNA, 22 nt, Human
uuaaacaccuucaacccacacc

SEQ ID NO: 1007086 - RNA, 24 nt, Human
uuagcggucuccacuaacaaagac

SEQ ID NO: 1007087 - RNA, 20 nt, Human
uucacagguaaaaaauagaa

SEQ ID NO: 1007088 - RNA, 21 nt, Human
uucacuccuaccaacagcgca

SEQ ID NO: 1007089 - RNA, 24 nt, Human
uuccucccauuacaaaauaaaguc

SEQ ID NO: 1007090 - RNA, 19 nt, Human
uuccugucuuuacuuuucu

SEQ ID NO: 1007091 - RNA, 21 nt, Human
uucguccggcucugcggcccc

SEQ ID NO: 1007092 - RNA, 23 nt, Human
uucuuuuauguacauuucucuaa

SEQ ID NO: 1007093 - RNA, 19 nt, Human
uuucacagguaaaaaauag

SEQ ID NO: 1007094 - RNA, 20 nt, Human
uuucagaagaauuauacugg

SEQ ID NO: 1007095 - RNA, 19 nt, Human
uuugcaaagcugagaucac

SEQ ID NO: 1007096 - RNA, 22 nt, Human
uuuucugaaaauuacauaagaa

SEQ ID NO: 1007097 - RNA, 22 nt, Human
agaaaacuaacaguugucagac

SEQ ID NO: 1007098 - RNA, 25 nt, Human
agaaaacuaacaguugucagacuca

SEQ ID NO: 1007099 - RNA, 25 nt, Human
agacaggcuggcacuauugccaaac

SEQ ID NO: 1007100 - RNA, 19 nt, Human
aucguuugugcauuuucua

SEQ ID NO: 1007101 - RNA, 18 nt, Human
caaccacacgucaccccg

SEQ ID NO: 1007102 - RNA, 18 nt, Human
cacagaucucagcaaacc

SEQ ID NO: 1007103 - RNA, 21 nt, Human
caccgccccgauccaccucuc

SEQ ID NO: 1007104 - RNA, 19 nt, Human
caugcacaugaugcaggua

SEQ ID NO: 1007105 - RNA, 22 nt, Human
ccacagaucucagcaaacccgc

SEQ ID NO: 1007106 - RNA, 25 nt, Human
ccgccccgauccaccucucgcucuc

SEQ ID NO: 1007107 - RNA, 21 nt, Human
cgccgagcucgucaaccacac

SEQ ID NO: 1007108 - RNA, 26 nt, Human
cucagcugccccccgcaccagcugcc

SEQ ID NO: 1007109 - RNA, 20 nt, Human
cucgcucucagcugcccccc

SEQ ID NO: 1007110 - RNA, 18 nt, Human
cugccccccgcaccagcu

SEQ ID NO: 1007111 - RNA, 21 nt, Human
gccacagaucucagcaaaccc

SEQ ID NO: 1007112 - RNA, 24 nt, Human
gccggccacagaucucagcaaacc

SEQ ID NO: 1007113 - RNA, 24 nt, Human
ggaaagcauucuuaauaucacuuu

SEQ ID NO: 1007114 - RNA, 23 nt, Human
uaaaauccucaaaacacuuagau

SEQ ID NO: 1007115 - RNA, 28 nt, Human
uaaaauccucaaaacacuuagauaucaa

SEQ ID NO: 1007116 - RNA, 22 nt, Human
uaauaugcacuacaugcacaug

SEQ ID NO: 1007117 - RNA, 25 nt, Human
uagcuucauaugguaguuggacaac

SEQ ID NO: 1007118 - RNA, 24 nt, Human
uaugcacuacaugcacaugaugca

SEQ ID NO: 1007119 - RNA, 19 nt, Human
ucaaaacacuuagauauca

SEQ ID NO: 1007120 - RNA, 18 nt, Human
ucagcugccccccgcacc

SEQ ID NO: 1007121 - RNA, 18 nt, Human
ucucagcaaacccgccgc

SEQ ID NO: 1007122 - RNA, 23 nt, Human
ugaauccaugcauuaaagacaag

SEQ ID NO: 1007123 - RNA, 20 nt, Human
ugacagcagugaaaaucacu

SEQ ID NO: 1007124 - RNA, 24 nt, Human
ugacagcagugaaaaucacuggaa

SEQ ID NO: 1007125 - RNA, 18 nt, Human
ugagaagaaauaagacaa

SEQ ID NO: 1007126 - RNA, 22 nt, Human
ugcacugagccaauuaggaugu

SEQ ID NO: 1007127 - RNA, 24 nt, Human
ugccgccggccacagaucucagca

SEQ ID NO: 1007128 - RNA, 21 nt, Human
uguacauaucugaaaacaucu

SEQ ID NO: 1007129 - RNA, 19 nt, Human
ugucaaauaauggaauuug

SEQ ID NO: 1007130 - RNA, 20 nt, Human
ccuccagcucugaccggacg

SEQ ID NO: 1007131 - RNA, 20 nt, Human
uaguguauggcagagaaaau

SEQ ID NO: 1007132 - RNA, 21 nt, Human
ugcccggcccuccagcucuga

SEQ ID NO: 1007133 - RNA, 20 nt, Human
uggcagagaaaauuuaguug

SEQ ID NO: 1007134 - RNA, 18 nt, Human
uguauggcagagaaaauu

SEQ ID NO: 1007135 - RNA, 18 nt, Human
uguauggcagagaaaauu

SEQ ID NO: 1007136 - RNA, 21 nt, Human
uuuaguugcaaauaauacagu

SEQ ID NO: 1007137 - RNA, 18 nt, Human
aaaggaggcuugcugacu

SEQ ID NO: 1007138 - RNA, 20 nt, Human
aaaguacuuguucacaaaac

SEQ ID NO: 1007139 - RNA, 20 nt, Human
aaaguacuuguucacaaaac

SEQ ID NO: 1007140 - RNA, 25 nt, Human
aaaguacuuguucacaaaacuuuug

SEQ ID NO: 1007141 - RNA, 22 nt, Human
aacagaaaacagaaaacaugag

SEQ ID NO: 1007142 - RNA, 18 nt, Human
aagaaccagaucagacug

SEQ ID NO: 1007143 - RNA, 23 nt, Human
aaggaggcuugcugacuuugggc

SEQ ID NO: 1007144 - RNA, 19 nt, Human
accugggugauccagugcg

SEQ ID NO: 1007145 - RNA, 19 nt, Human
acgcuguucuccagccggg

SEQ ID NO: 1007146 - RNA, 21 nt, Human
acugugggugagccuggacgg

SEQ ID NO: 1007147 - RNA, 21 nt, Human
agaaaacagaaaacaugagga

SEQ ID NO: 1007148 - RNA, 23 nt, Human
agcaaggggggaaaacaucccuc

SEQ ID NO: 1007149 - RNA, 24 nt, Human
agcaaggggggaaaacaucccuca

SEQ ID NO: 1007150 - RNA, 24 nt, Human
agcaccuugggggcuccccugagg

SEQ ID NO: 1007151 - RNA, 19 nt, Human
agccgggacagaccuggcc

SEQ ID NO: 1007152 - RNA, 22 nt, Human
aggaagcagugggugugggugg

SEQ ID NO: 1007153 - RNA, 21 nt, Human
aggcccggcgcgcccgcccag

SEQ ID NO: 1007154 - RNA, 23 nt, Human
agggaucuuuaaaccgcaacgag

SEQ ID NO: 1007155 - RNA, 22 nt, Human
augcuuuccagagacagccacc

SEQ ID NO: 1007156 - RNA, 21 nt, Human
caacaaaacaucaggccagcc

SEQ ID NO: 1007157 - RNA, 18 nt, Human
cacaagccugggugugau

SEQ ID NO: 1007158 - RNA, 21 nt, Human
caccccaggcaacccagacac

SEQ ID NO: 1007159 - RNA, 24 nt, Human
cagaaaacagaaaacaugaggaca

SEQ ID NO: 1007160 - RNA, 24 nt, Human
cagaaaacaugaggacauguaaca

SEQ ID NO: 1007161 - RNA, 18 nt, Human
cagaacccagccacaggg

SEQ ID NO: 1007162 - RNA, 22 nt, Human
cagccgggacagaccuggccuc

SEQ ID NO: 1007163 - RNA, 24 nt, Human
cagcggcaagggaugcuuuccaga

SEQ ID NO: 1007164 - RNA, 18 nt, Human
caggcucagucccugaac

SEQ ID NO: 1007165 - RNA, 19 nt, Human
caucugaguuuccacuccu

SEQ ID NO: 1007166 - RNA, 21 nt, Human
cauguaaaaaaggaaaguacu

SEQ ID NO: 1007167 - RNA, 22 nt, Human
cauucuguggcauuucucaguc

SEQ ID NO: 1007168 - RNA, 25 nt, Human
ccaaaggggccuaagcucgacaaaa

SEQ ID NO: 1007169 - RNA, 23 nt, Human
ccagccagugucuaggcugucuc

SEQ ID NO: 1007170 - RNA, 23 nt, Human
ccaggcuuccugcacauucugug

SEQ ID NO: 1007171 - RNA, 19 nt, Human
ccagggcauccgccucgcu

SEQ ID NO: 1007172 - RNA, 21 nt, Human
ccagugcgugccacagccaga

SEQ ID NO: 1007173 - RNA, 21 nt, Human
ccagugucuaggcugucuccu

SEQ ID NO: 1007174 - RNA, 21 nt, Human
cccgcgcaucggguccccgcg

SEQ ID NO: 1007175 - RNA, 21 nt, Human
cccgcgcccgccccuucccca

SEQ ID NO: 1007176 - RNA, 24 nt, Human
cccggcgcgcccgcccagcgccga

SEQ ID NO: 1007177 - RNA, 22 nt, Human
ccgcgcccgccccuuccccagg

SEQ ID NO: 1007178 - RNA, 22 nt, Human
ccgcucccgcgcaucggguccc

SEQ ID NO: 1007179 - RNA, 19 nt, Human
ccgggcgggagaccugccc

SEQ ID NO: 1007180 - RNA, 20 nt, Human
ccucgcugcuaacacucccc

SEQ ID NO: 1007181 - RNA, 21 nt, Human
ccucgcugcuaacacuccccu

SEQ ID NO: 1007182 - RNA, 23 nt, Human
ccugcacauucuguggcauuucu

SEQ ID NO: 1007183 - RNA, 20 nt, Human
cgagaggaagcagugggugu

SEQ ID NO: 1007184 - RNA, 18 nt, Human
cgccgagaggaagcagug

SEQ ID NO: 1007185 - RNA, 24 nt, Human
cucacagaagccucccaggcuucc

SEQ ID NO: 1007186 - RNA, 24 nt, Human
cucugccuuuaaggcacaagcaag

SEQ ID NO: 1007187 - RNA, 19 nt, Human
cugcccguggcagcggcaa

SEQ ID NO: 1007188 - RNA, 19 nt, Human
cuguucuccagccgggaca

SEQ ID NO: 1007189 - RNA, 18 nt, Human
gaaaacaugaggacaugu

SEQ ID NO: 1007190 - RNA, 26 nt, Human
gaaacagaaaacagaaaacaugagga

SEQ ID NO: 1007191 - RNA, 21 nt, Human
gaugcuuuccagagacagcca

SEQ ID NO: 1007192 - RNA, 20 nt, Human
gccacuagccacccuggggu

SEQ ID NO: 1007193 - RNA, 22 nt, Human
gccagccagugucuaggcuguc

SEQ ID NO: 1007194 - RNA, 27 nt, Human
gccuaaguggcugaaaaccucaggaac

SEQ ID NO: 1007195 - RNA, 18 nt, Human
ggaaaaaacucucuccca

SEQ ID NO: 1007196 - RNA, 24 nt, Human
ggacgggggcuggggcugcccgug

SEQ ID NO: 1007197 - RNA, 20 nt, Human
ggacugcaaaccacuggguc

SEQ ID NO: 1007198 - RNA, 23 nt, Human
gggaccugggugauccagugcgu

SEQ ID NO: 1007199 - RNA, 18 nt, Human
ggggcugcccguggcagc

SEQ ID NO: 1007200 - RNA, 21 nt, Human
ggggcuggggcugcccguggc

SEQ ID NO: 1007201 - RNA, 20 nt, Human
ggugcgccgagaggaagcag

SEQ ID NO: 1007202 - RNA, 23 nt, Human
uaaggcacaagcaaggggggaaa

SEQ ID NO: 1007203 - RNA, 21 nt, Human
uaugaaacagaaaacagaaaa

SEQ ID NO: 1007204 - RNA, 21 nt, Human
ucaccccaggcaacccagaca

SEQ ID NO: 1007205 - RNA, 20 nt, Human
ucagaacccagccacagggc

SEQ ID NO: 1007206 - RNA, 20 nt, Human
uccagugcgugccacagcca

SEQ ID NO: 1007207 - RNA, 18 nt, Human
uccccaggcucagucccu

SEQ ID NO: 1007208 - RNA, 23 nt, Human
uccccaggcucagucccugaaca

SEQ ID NO: 1007209 - RNA, 18 nt, Human
uccccugagggucaguga

SEQ ID NO: 1007210 - RNA, 22 nt, Human
uccccugagggucagugagggc

SEQ ID NO: 1007211 - RNA, 24 nt, Human
ucccgcgcaucggguccccgcggu

SEQ ID NO: 1007212 - RNA, 20 nt, Human
ucccucaguggcuccccaua

SEQ ID NO: 1007213 - RNA, 19 nt, Human
ucccugaacacacaugccg

SEQ ID NO: 1007214 - RNA, 22 nt, Human
ucccugaacacacaugccgggc

SEQ ID NO: 1007215 - RNA, 19 nt, Human
uccucacagaagccuccca

SEQ ID NO: 1007216 - RNA, 23 nt, Human
uccugagugaggaaggccucgcu

SEQ ID NO: 1007217 - RNA, 23 nt, Human
ucuccagccgggacagaccuggc

SEQ ID NO: 1007218 - RNA, 23 nt, Human
ucugcugggaccugggugaucca

SEQ ID NO: 1007219 - RNA, 19 nt, Human
ugaaacagaaaacagaaaa

SEQ ID NO: 1007220 - RNA, 19 nt, Human
ugaacacacaugccgggcg

SEQ ID NO: 1007221 - RNA, 26 nt, Human
ugagccuggacggacgggggcugggg

SEQ ID NO: 1007222 - RNA, 21 nt, Human
ugaugcugggugcuuccaggg

SEQ ID NO: 1007223 - RNA, 22 nt, Human
ugcccuacugcaugggcuccca

SEQ ID NO: 1007224 - RNA, 20 nt, Human
ugcgugccacagccagaagc

SEQ ID NO: 1007225 - RNA, 20 nt, Human
uggaaaaaacucucucccac

SEQ ID NO: 1007226 - RNA, 23 nt, Human
ugggcguccccaggcucaguccc

SEQ ID NO: 1007227 - RNA, 21 nt, Human
ugggugggcguccccaggcuc

SEQ ID NO: 1007228 - RNA, 22 nt, Human
uggguucacugucaacaaaaca

SEQ ID NO: 1007229 - RNA, 24 nt, Human
uguaaaaaaggaaaguacuuguuc

SEQ ID NO: 1007230 - RNA, 20 nt, Human
ugucuaggcugucuccucaa

SEQ ID NO: 1007231 - RNA, 23 nt, Human
ugucuaggcugucuccucaauuu

SEQ ID NO: 1007232 - RNA, 18 nt, Human
uuccagagacagccacca

SEQ ID NO: 1007233 - RNA, 20 nt, Human
uugggggcuccccugagggu

SEQ ID NO: 1007234 - RNA, 22 nt, Human
uuuguaggccacaaccagccuu

SEQ ID NO: 1007235 - RNA, 22 nt, Human
acagagcuuuaaucccaaagau

SEQ ID NO: 1007236 - RNA, 23 nt, Human
accagaguacagaagucagaauc

SEQ ID NO: 1007237 - RNA, 20 nt, Human
caaaagguguggcacuccug

SEQ ID NO: 1007238 - RNA, 20 nt, Human
ccaaagauccaguggccacc

SEQ ID NO: 1007239 - RNA, 21 nt, Human
cccaaagauccaguggccacc

SEQ ID NO: 1007240 - RNA, 23 nt, Human
gucagaaucaaaugcucagaauc

SEQ ID NO: 1007241 - RNA, 19 nt, Human
ucccaaagauccaguggcc

SEQ ID NO: 1007242 - RNA, 18 nt, Human
ugauuuccuguccuucuc

SEQ ID NO: 1007243 - RNA, 18 nt, Human
uugagguacaaauccaac

SEQ ID NO: 1007244 - RNA, 21 nt, Human
uuuuuuuuuuuuuuuuugagg

SEQ ID NO: 1007245 - RNA, 18 nt, Human
aggcggcagguuuccugu

SEQ ID NO: 1007246 - RNA, 21 nt, Human
cacagucuguggccgccacgc

SEQ ID NO: 1007247 - RNA, 21 nt, Human
ccagcaggcggcagguuuccu

SEQ ID NO: 1007248 - RNA, 21 nt, Human
cccacagucuguggccgccac

SEQ ID NO: 1007249 - RNA, 19 nt, Human
uuccccagcaggcggcagg

SEQ ID NO: 1007250 - RNA, 20 nt, Human
uuucgccuuccuucucauau

SEQ ID NO: 1007251 - RNA, 25 nt, Human
uuuuaaaauuaaagaauaugucacu

SEQ ID NO: 1007252 - RNA, 21 nt, Human
uuuuuuuuuuuuaaauacuca

SEQ ID NO: 1007253 - RNA, 24 nt, Human
aaacuccauggaacacauuaguaa

SEQ ID NO: 1007254 - RNA, 18 nt, Human
aagaggaagggaaggaag

SEQ ID NO: 1007255 - RNA, 18 nt, Human
aagggaaacacaggaugc

SEQ ID NO: 1007256 - RNA, 22 nt, Human
acccgaagacuccuccaaguuc

SEQ ID NO: 1007257 - RNA, 21 nt, Human
acugacaugcagggaccccug

SEQ ID NO: 1007258 - RNA, 21 nt, Human
agaaaguauacaauuauuccu

SEQ ID NO: 1007259 - RNA, 21 nt, Human
agcuaggggaguccagcugga

SEQ ID NO: 1007260 - RNA, 19 nt, Human
auagaagagcagagcagag

SEQ ID NO: 1007261 - RNA, 18 nt, Human
auccaggagaggagagau

SEQ ID NO: 1007262 - RNA, 22 nt, Human
augaagauggguacuaugaacu

SEQ ID NO: 1007263 - RNA, 23 nt, Human
augaagauggguacuaugaacug

SEQ ID NO: 1007264 - RNA, 21 nt, Human
caagacccgaagacuccucca

SEQ ID NO: 1007265 - RNA, 23 nt, Human
caaggucauccaaaguuuacuga

SEQ ID NO: 1007266 - RNA, 21 nt, Human
cagagcagaguugggcaugga

SEQ ID NO: 1007267 - RNA, 20 nt, Human
cagcccaccuuccuggccag

SEQ ID NO: 1007268 - RNA, 22 nt, Human
cagguuaaccugaaucuucaau

SEQ ID NO: 1007269 - RNA, 23 nt, Human
ccacagagcauuacuggggcuca

SEQ ID NO: 1007270 - RNA, 21 nt, Human
ccacccccuguaugaugacuc

SEQ ID NO: 1007271 - RNA, 23 nt, Human
ccccugugugaucuagugggagu

SEQ ID NO: 1007272 - RNA, 19 nt, Human
cccuguaugaugacucccc

SEQ ID NO: 1007273 - RNA, 23 nt, Human
cccuuuuuuuucugccggauccc

SEQ ID NO: 1007274 - RNA, 18 nt, Human
cuccuccaaguucucacu

SEQ ID NO: 1007275 - RNA, 27 nt, Human
cuuaaccuuaguccuaauuccgguucc

SEQ ID NO: 1007276 - RNA, 19 nt, Human
gaaaacuuggauuucccaa

SEQ ID NO: 1007277 - RNA, 24 nt, Human
gaagauggagaagagccaucccaa

SEQ ID NO: 1007278 - RNA, 18 nt, Human
gaaggaagcaggcccuaa

SEQ ID NO: 1007279 - RNA, 20 nt, Human
gagcagagcagaguugggca

SEQ ID NO: 1007280 - RNA, 18 nt, Human
gcaauccaggagaggaga

SEQ ID NO: 1007281 - RNA, 24 nt, Human
gcccaacucauaagaaucagacug

SEQ ID NO: 1007282 - RNA, 20 nt, Human
gcuggagcagaagagucugg

SEQ ID NO: 1007283 - RNA, 18 nt, Human
ggagagagagacugaggg

SEQ ID NO: 1007284 - RNA, 20 nt, Human
gggaguccagcuggagcaga

SEQ ID NO: 1007285 - RNA, 25 nt, Human
gggcuggggcagaaagucaaagggu

SEQ ID NO: 1007286 - RNA, 24 nt, Human
gugcagcccaccuuccuggccagu

SEQ ID NO: 1007287 - RNA, 18 nt, Human
uaacuugauucagguuaa

SEQ ID NO: 1007288 - RNA, 23 nt, Human
uaagaggggcuggggcagaaagu

SEQ ID NO: 1007289 - RNA, 20 nt, Human
uaauaggcucuuuuuguauc

SEQ ID NO: 1007290 - RNA, 22 nt, Human
uaggagaacuaagaggggcugg

SEQ ID NO: 1007291 - RNA, 18 nt, Human
uagguuucauagcaccca

SEQ ID NO: 1007292 - RNA, 22 nt, Human
uauuugaaggaagcaggcccua

SEQ ID NO: 1007293 - RNA, 19 nt, Human
ucccaagacccgaagacuc

SEQ ID NO: 1007294 - RNA, 21 nt, Human
ucccaagagggcacuuaaccu

SEQ ID NO: 1007295 - RNA, 25 nt, Human
uccccugcaucccuuuuuuuucugc

SEQ ID NO: 1007296 - RNA, 18 nt, Human
ucccuuaaggaaccgagc

SEQ ID NO: 1007297 - RNA, 22 nt, Human
uccugguaaaugauccaccccc

SEQ ID NO: 1007298 - RNA, 27 nt, Human
ucuaggagaacuaagaggggcuggggc

SEQ ID NO: 1007299 - RNA, 23 nt, Human
ugacuccccugcaucccuuuuuu

SEQ ID NO: 1007300 - RNA, 25 nt, Human
ugacuccccugcaucccuuuuuuuu

SEQ ID NO: 1007301 - RNA, 20 nt, Human
ugaugacuccccugcauccc

SEQ ID NO: 1007302 - RNA, 20 nt, Human
ugcaacuaggaagggaacuc

SEQ ID NO: 1007303 - RNA, 19 nt, Human
ugccaaggagauaggauaa

SEQ ID NO: 1007304 - RNA, 24 nt, Human
ugccaaggagauaggauaagugag

SEQ ID NO: 1007305 - RNA, 19 nt, Human
ugccacagagcauuacugg

SEQ ID NO: 1007306 - RNA, 21 nt, Human
ugccacagagcauuacugggg

SEQ ID NO: 1007307 - RNA, 24 nt, Human
ugccacagagcauuacuggggcuc

SEQ ID NO: 1007308 - RNA, 26 nt, Human
ugcugucaggaaauagaagagcagag

SEQ ID NO: 1007309 - RNA, 23 nt, Human
uggauccugguaaaugauccacc

SEQ ID NO: 1007310 - RNA, 20 nt, Human
uggauuucccaagacccgaa

SEQ ID NO: 1007311 - RNA, 20 nt, Human
uggggcagaaagucaaaggg

SEQ ID NO: 1007312 - RNA, 19 nt, Human
ugguaaaugauccaccccc

SEQ ID NO: 1007313 - RNA, 22 nt, Human
uguaggaaguguggauccuggu

SEQ ID NO: 1007314 - RNA, 22 nt, Human
uguggauccugguaaaugaucc

SEQ ID NO: 1007315 - RNA, 25 nt, Human
uguuaaaucaggaaacuauuuuguu

SEQ ID NO: 1007316 - RNA, 18 nt, Human
uuacuggggcucauuuuc

SEQ ID NO: 1007317 - RNA, 19 nt, Human
uuccccagcuucaaaucuc

SEQ ID NO: 1007318 - RNA, 20 nt, Human
uuuguaggaaguguggaucc

SEQ ID NO: 1007319 - RNA, 20 nt, Human
aaccggcaccggcagcagcg

SEQ ID NO: 1007320 - RNA, 19 nt, Human
agccgacuggagacccgcu

SEQ ID NO: 1007321 - RNA, 20 nt, Human
agcggcggcggaggcgacag

SEQ ID NO: 1007322 - RNA, 26 nt, Human
cagcagcggcggcggaggcgacagcu

SEQ ID NO: 1007323 - RNA, 21 nt, Human
cgacuggagacccgcucacaa

SEQ ID NO: 1007324 - RNA, 21 nt, Human
cgcucacaaccggcaccggca

SEQ ID NO: 1007325 - RNA, 20 nt, Human
cggcagcagcggcggcggag

SEQ ID NO: 1007326 - RNA, 22 nt, Human
cuggagacccgcucacaaccgg

SEQ ID NO: 1007327 - RNA, 24 nt, Human
cuugauguggagguagucucucuc

SEQ ID NO: 1007328 - RNA, 25 nt, Human
uaaaaaagacuggaacucaguccca

SEQ ID NO: 1007329 - RNA, 18 nt, Human
cagcagcgguggccuggc

SEQ ID NO: 1007330 - RNA, 18 nt, Human
cagcgguggccuggcggc

SEQ ID NO: 1007331 - RNA, 21 nt, Human
ccgcagcagcgguggccuggc

SEQ ID NO: 1007332 - RNA, 19 nt, Human
ccuacguaucagaugaagc

SEQ ID NO: 1007333 - RNA, 26 nt, Human
uaggaacugccaguguucugaguuga

SEQ ID NO: 1007334 - RNA, 18 nt, Human
uccauaaucaagacaccu

SEQ ID NO: 1007335 - RNA, 27 nt, Human
aaaaaaauacaaaaacaaaaacaacca

SEQ ID NO: 1007336 - RNA, 21 nt, Human
aaaacaaaaacaaccaaaccc

SEQ ID NO: 1007337 - RNA, 24 nt, Human
aaaagaaaaaaaauacaaaaacaa

SEQ ID NO: 1007338 - RNA, 21 nt, Human
aaacaucaacagccuccacac

SEQ ID NO: 1007339 - RNA, 20 nt, Human
aaccuuuuuagggaacggag

SEQ ID NO: 1007340 - RNA, 19 nt, Human
aauacaaaaacaaaaacaa

SEQ ID NO: 1007341 - RNA, 23 nt, Human
aauacaaaaacaaaaacaaccaa

SEQ ID NO: 1007342 - RNA, 24 nt, Human
aauacaaaaacaaaaacaaccaaa

SEQ ID NO: 1007343 - RNA, 21 nt, Human
aaucuggacaaaguacuggac

SEQ ID NO: 1007344 - RNA, 24 nt, Human
acaaaaacaaaaacaaccaaaccc

SEQ ID NO: 1007345 - RNA, 19 nt, Human
acaaaaucagugccgauga

SEQ ID NO: 1007346 - RNA, 22 nt, Human
acaaaaucagugccgaugaacg

SEQ ID NO: 1007347 - RNA, 24 nt, Human
acaccagaaacaucaacagccucc

SEQ ID NO: 1007348 - RNA, 18 nt, Human
accgcaguuucuagaauc

SEQ ID NO: 1007349 - RNA, 18 nt, Human
accuugggggccagaacc

SEQ ID NO: 1007350 - RNA, 22 nt, Human
acgcggaucucagacgcuaagc

SEQ ID NO: 1007351 - RNA, 22 nt, Human
acugagaaguccaacuuuuagc

SEQ ID NO: 1007352 - RNA, 22 nt, Human
acuggacuuuagaaaaagccua

SEQ ID NO: 1007353 - RNA, 18 nt, Human
agaaacaucaacagccuc

SEQ ID NO: 1007354 - RNA, 20 nt, Human
agaaacaucaacagccucca

SEQ ID NO: 1007355 - RNA, 25 nt, Human
agaacuaaacacaauacugagaagu

SEQ ID NO: 1007356 - RNA, 18 nt, Human
agcaccucugagccaugc

SEQ ID NO: 1007357 - RNA, 20 nt, Human
aggaagacaaaccuuuuuag

SEQ ID NO: 1007358 - RNA, 24 nt, Human
aggcaaagguuugaacuaggcccg

SEQ ID NO: 1007359 - RNA, 22 nt, Human
auaaauuccugaaaauguauag

SEQ ID NO: 1007360 - RNA, 23 nt, Human
auacaaaaacaaaaacaaccaaa

SEQ ID NO: 1007361 - RNA, 19 nt, Human
aucaacagccuccacacca

SEQ ID NO: 1007362 - RNA, 27 nt, Human
caaaaacaaaaacaaccaaacccuaac

SEQ ID NO: 1007363 - RNA, 19 nt, Human
caaaaacaaccaaacccua

SEQ ID NO: 1007364 - RNA, 22 nt, Human
caaaaacaaccaaacccuaacg

SEQ ID NO: 1007365 - RNA, 22 nt, Human
caaaagaaaaaaaauacaaaaa

SEQ ID NO: 1007366 - RNA, 18 nt, Human
caacagccuccacaccac

SEQ ID NO: 1007367 - RNA, 20 nt, Human
caacuuuuagccagaauaca

SEQ ID NO: 1007368 - RNA, 31 nt, Human
caauacugagaaguccaacuuuuagccagaa

SEQ ID NO: 1007369 - RNA, 22 nt, Human
caggaagaacuggaugaccgca

SEQ ID NO: 1007370 - RNA, 23 nt, Human
ccagaacccuagagaaggacuga

SEQ ID NO: 1007371 - RNA, 18 nt, Human
ccccacguggagcagagu

SEQ ID NO: 1007372 - RNA, 19 nt, Human
cccugcucucgugggcaga

SEQ ID NO: 1007373 - RNA, 23 nt, Human
ccgacacguuuucagcaaaacgc

SEQ ID NO: 1007374 - RNA, 21 nt, Human
ccuccacaccacguaguuucu

SEQ ID NO: 1007375 - RNA, 21 nt, Human
ccuggccccacguggagcaga

SEQ ID NO: 1007376 - RNA, 23 nt, Human
cucccugcucucgugggcagagg

SEQ ID NO: 1007377 - RNA, 19 nt, Human
cuggacaaaguacuggacu

SEQ ID NO: 1007378 - RNA, 21 nt, Human
cuugacaccagaaacaucaac

SEQ ID NO: 1007379 - RNA, 19 nt, Human
cuuguaaguucucacuugc

SEQ ID NO: 1007380 - RNA, 22 nt, Human
cuuuagaaaaagccuacacaaa

SEQ ID NO: 1007381 - RNA, 21 nt, Human
gagaaucuaaaaucuggacaa

SEQ ID NO: 1007382 - RNA, 20 nt, Human
gagcccuccgacacguuuuc

SEQ ID NO: 1007383 - RNA, 25 nt, Human
gagggacagcaaaaacccccaucag

SEQ ID NO: 1007384 - RNA, 22 nt, Human
gauggcuuugaggcaaagguuu

SEQ ID NO: 1007385 - RNA, 19 nt, Human
gcagaguccccuugaggcc

SEQ ID NO: 1007386 - RNA, 20 nt, Human
gcagaguccccuugaggcca

SEQ ID NO: 1007387 - RNA, 18 nt, Human
gcagcaacuucugagaac

SEQ ID NO: 1007388 - RNA, 23 nt, Human
gccuucuuaaagaguugguggca

SEQ ID NO: 1007389 - RNA, 23 nt, Human
ggaucucagacgcuaagcagucu

SEQ ID NO: 1007390 - RNA, 20 nt, Human
uaaaaaaaaacccucuuguu

SEQ ID NO: 1007391 - RNA, 22 nt, Human
uaaacacaauacugagaagucc

SEQ ID NO: 1007392 - RNA, 23 nt, Human
uaacaacaaagacugucgucuuu

SEQ ID NO: 1007393 - RNA, 18 nt, Human
uaagaacaaaaucagugc

SEQ ID NO: 1007394 - RNA, 22 nt, Human
uacaaaaacaaaaacaaccaaa

SEQ ID NO: 1007395 - RNA, 23 nt, Human
uacaaaaacaaaaacaaccaaac

SEQ ID NO: 1007396 - RNA, 26 nt, Human
uagaaaaagccuacacaaaauugucu

SEQ ID NO: 1007397 - RNA, 18 nt, Human
uauucugagaaucuaaaa

SEQ ID NO: 1007398 - RNA, 22 nt, Human
ucaaacgguucccaagcaccca

SEQ ID NO: 1007399 - RNA, 20 nt, Human
ucaacagacagcugagccac

SEQ ID NO: 1007400 - RNA, 18 nt, Human
ucacuggacuuuagauga

SEQ ID NO: 1007401 - RNA, 23 nt, Human
uccgacacguuuucagcaaaacg

SEQ ID NO: 1007402 - RNA, 19 nt, Human
uccguccguggccgccuuc

SEQ ID NO: 1007403 - RNA, 23 nt, Human
ucuggugggggauggcuuugagg

SEQ ID NO: 1007404 - RNA, 26 nt, Human
ugaaaaauaaaaauaaaaaaaaagga

SEQ ID NO: 1007405 - RNA, 19 nt, Human
ugacaccagaaacaucaac

SEQ ID NO: 1007406 - RNA, 18 nt, Human
ugagaacuugacaccaga

SEQ ID NO: 1007407 - RNA, 19 nt, Human
ugagaaucuaaaaucugga

SEQ ID NO: 1007408 - RNA, 19 nt, Human
ugccacgggccaccacggg

SEQ ID NO: 1007409 - RNA, 23 nt, Human
ugccacgggcugccacgggccac

SEQ ID NO: 1007410 - RNA, 20 nt, Human
ugcucucgugggcagaggac

SEQ ID NO: 1007411 - RNA, 22 nt, Human
ugcuugcucugaccuugggggc

SEQ ID NO: 1007412 - RNA, 20 nt, Human
uggacaaaguacuggacuuu

SEQ ID NO: 1007413 - RNA, 23 nt, Human
uuaaaaaaucuuguguuguuuug

SEQ ID NO: 1007414 - RNA, 25 nt, Human
uuaagagaaaaaaaaauuaaaaaaa

SEQ ID NO: 1007415 - RNA, 23 nt, Human
uuaccagcaccucugagccaugc

SEQ ID NO: 1007416 - RNA, 18 nt, Human
uuagccagaauacauaaa

SEQ ID NO: 1007417 - RNA, 24 nt, Human
uucaaaagaaaaaaaauacaaaaa

SEQ ID NO: 1007418 - RNA, 21 nt, Human
uucaaagaacuaaacacaaua

SEQ ID NO: 1007419 - RNA, 22 nt, Human
uuucaaagaacuaaacacaaua

SEQ ID NO: 1007420 - RNA, 18 nt, Human
uuucugauuccaucuuua

SEQ ID NO: 1007421 - RNA, 20 nt, Human
aaaacaccagaaaaaagcac

SEQ ID NO: 1007422 - RNA, 24 nt, Human
aaaagacaguugagaaaugggccu

SEQ ID NO: 1007423 - RNA, 22 nt, Human
aaaauaaaucauaacuuggaua

SEQ ID NO: 1007424 - RNA, 21 nt, Human
aaccacaccacauuacacuaa

SEQ ID NO: 1007425 - RNA, 21 nt, Human
aagcaauuucaaauccucuca

SEQ ID NO: 1007426 - RNA, 20 nt, Human
aagccaccaugaacaacaca

SEQ ID NO: 1007427 - RNA, 24 nt, Human
accacaccacauuacacuaaugca

SEQ ID NO: 1007428 - RNA, 18 nt, Human
agaaaaaagcacaaugga

SEQ ID NO: 1007429 - RNA, 20 nt, Human
agcacagcccucaaaacucu

SEQ ID NO: 1007430 - RNA, 19 nt, Human
agccaccaugaacaacaca

SEQ ID NO: 1007431 - RNA, 24 nt, Human
aguguguagcuaaaauuucauuua

SEQ ID NO: 1007432 - RNA, 20 nt, Human
auaaaacaccagaaaaaagc

SEQ ID NO: 1007433 - RNA, 23 nt, Human
auaaaacaccagaaaaaagcaca

SEQ ID NO: 1007434 - RNA, 21 nt, Human
auaaaucuuuucuguccugag

SEQ ID NO: 1007435 - RNA, 19 nt, Human
auauuugggaggcagugug

SEQ ID NO: 1007436 - RNA, 23 nt, Human
auuucuuccacccuccccaccca

SEQ ID NO: 1007437 - RNA, 22 nt, Human
caaaaagccaccaugaacaaca

SEQ ID NO: 1007438 - RNA, 23 nt, Human
caaaaagccaccaugaacaacac

SEQ ID NO: 1007439 - RNA, 28 nt, Human
caaauuacaagaaccaggcacaacuaaa

SEQ ID NO: 1007440 - RNA, 25 nt, Human
cacaacuaauauuugggaggcagug

SEQ ID NO: 1007441 - RNA, 23 nt, Human
cacagcccucaaaacucugcaga

SEQ ID NO: 1007442 - RNA, 24 nt, Human
caccacauuacacuaaugcagcaa

SEQ ID NO: 1007443 - RNA, 18 nt, Human
caccagaaaaaagcacaa

SEQ ID NO: 1007444 - RNA, 20 nt, Human
caccagaaaaaagcacaaug

SEQ ID NO: 1007445 - RNA, 20 nt, Human
cacuuuagaagcuguguuca

SEQ ID NO: 1007446 - RNA, 18 nt, Human
cagcaacaaugcauucau

SEQ ID NO: 1007447 - RNA, 24 nt, Human
cauaaaacaccagaaaaaagcaca

SEQ ID NO: 1007448 - RNA, 21 nt, Human
cauaaaucuuuucuguccuga

SEQ ID NO: 1007449 - RNA, 22 nt, Human
cauuucuuccacccuccccacc

SEQ ID NO: 1007450 - RNA, 24 nt, Human
ccaggcacaacuaauauuugggag

SEQ ID NO: 1007451 - RNA, 20 nt, Human
ccccugagcucugggcgccg

SEQ ID NO: 1007452 - RNA, 19 nt, Human
cccgcgccgcuuucccugc

SEQ ID NO: 1007453 - RNA, 23 nt, Human
cccggcccgcgccgcuuucccug

SEQ ID NO: 1007454 - RNA, 18 nt, Human
ccgcgccccgcccggccc

SEQ ID NO: 1007455 - RNA, 18 nt, Human
ccgcgccgcuuucccugc

SEQ ID NO: 1007456 - RNA, 20 nt, Human
ccggcccgcgccgcuuuccc

SEQ ID NO: 1007457 - RNA, 21 nt, Human
ccucaaaacucugcagaugua

SEQ ID NO: 1007458 - RNA, 22 nt, Human
cgcgccccgcccggcccgcgcc

SEQ ID NO: 1007459 - RNA, 20 nt, Human
cggcccgcgccgcuuucccu

SEQ ID NO: 1007460 - RNA, 22 nt, Human
cggcucgggcccucagcggcag

SEQ ID NO: 1007461 - RNA, 20 nt, Human
gccccgcccggcccgcgccg

SEQ ID NO: 1007462 - RNA, 23 nt, Human
uaaaacaccagaaaaaaggggag

SEQ ID NO: 1007463 - RNA, 22 nt, Human
uaaaaccacuggugagacacua

SEQ ID NO: 1007464 - RNA, 22 nt, Human
uaaaauccccauaaaucuuuuc

SEQ ID NO: 1007465 - RNA, 19 nt, Human
uaacuaguuauucaaugau

SEQ ID NO: 1007466 - RNA, 23 nt, Human
uaacuaguuauucaaugauuuuu

SEQ ID NO: 1007467 - RNA, 18 nt, Human
uaauggaagaagagacgu

SEQ ID NO: 1007468 - RNA, 23 nt, Human
uagagcauaugaauaccucuuuu

SEQ ID NO: 1007469 - RNA, 21 nt, Human
uauuguccaaaaagccaccau

SEQ ID NO: 1007470 - RNA, 19 nt, Human
ucagaacgugagagauaca

SEQ ID NO: 1007471 - RNA, 19 nt, Human
ucagaacgugagagauaca

SEQ ID NO: 1007472 - RNA, 19 nt, Human
uccacccuccccacccauu

SEQ ID NO: 1007473 - RNA, 18 nt, Human
uggaguucacaaaguggg

SEQ ID NO: 1007474 - RNA, 21 nt, Human
uggcgccuagagaggaaccgg

SEQ ID NO: 1007475 - RNA, 24 nt, Human
ugggcuaaaaaaaaugaaccuguc

SEQ ID NO: 1007476 - RNA, 22 nt, Human
uucccugcggcucgggcccuca

SEQ ID NO: 1007477 - RNA, 24 nt, Human
uuuaaaauccccauaaaucuuuuc

SEQ ID NO: 1007478 - RNA, 21 nt, Human
uuuauuguccaaaaagccacc

SEQ ID NO: 1007479 - RNA, 26 nt, Human
uuuucuguaaaaucaaauuacaagaa

SEQ ID NO: 1007480 - RNA, 21 nt, Human
aagaagccccagcaccagccc

SEQ ID NO: 1007481 - RNA, 21 nt, Human
aauacaggugcacacaggugu

SEQ ID NO: 1007482 - RNA, 27 nt, Human
aaucacauaacggacaucaaaacuaaa

SEQ ID NO: 1007483 - RNA, 27 nt, Human
agccccuucaggagaagaagccccagc

SEQ ID NO: 1007484 - RNA, 19 nt, Human
aucucuuuccuauauucag

SEQ ID NO: 1007485 - RNA, 23 nt, Human
ccagcccugcuggcuucuuacug

SEQ ID NO: 1007486 - RNA, 18 nt, Human
cccagcaccagcccugcu

SEQ ID NO: 1007487 - RNA, 23 nt, Human
ccccagcaccagcccugcuggcu

SEQ ID NO: 1007488 - RNA, 22 nt, Human
cuauguaauggguaucucuuuc

SEQ ID NO: 1007489 - RNA, 22 nt, Human
cucaggaauaguaacucuucuu

SEQ ID NO: 1007490 - RNA, 18 nt, Human
cugaccaaccacagcagc

SEQ ID NO: 1007491 - RNA, 21 nt, Human
cuugcagccccuucaggagaa

SEQ ID NO: 1007492 - RNA, 19 nt, Human
gaauaguaacucuucuuuc

SEQ ID NO: 1007493 - RNA, 25 nt, Human
uaacuggauuccuucucuaauauuc

SEQ ID NO: 1007494 - RNA, 25 nt, Human
uaauggguaucucuuuccuauauuc

SEQ ID NO: 1007495 - RNA, 25 nt, Human
uacugaguaacuauguaauggguaa

SEQ ID NO: 1007496 - RNA, 22 nt, Human
uaguaacucuucuuuccuaccu

SEQ ID NO: 1007497 - RNA, 19 nt, Human
ugguauuucucuuuuguuu

SEQ ID NO: 1007498 - RNA, 21 nt, Human
uuacuggacugaccaaccacu

SEQ ID NO: 1007499 - RNA, 20 nt, Human
uuuuuuggaaaucugccuau

SEQ ID NO: 1007500 - RNA, 22 nt, Human
aaaaaaaaaaaaaugugcaaag

SEQ ID NO: 1007501 - RNA, 24 nt, Human
aaaauacacauuaggcagaagaca

SEQ ID NO: 1007502 - RNA, 24 nt, Human
aaccaaauaauacacaacguagga

SEQ ID NO: 1007503 - RNA, 23 nt, Human
aagaaaccaaauaauacacaacg

SEQ ID NO: 1007504 - RNA, 25 nt, Human
aagcagguaaguaaaagaaaccaaa

SEQ ID NO: 1007505 - RNA, 21 nt, Human
aagcugccgcgcggagccagg

SEQ ID NO: 1007506 - RNA, 23 nt, Human
aagcugccgcgcggagccagggu

SEQ ID NO: 1007507 - RNA, 23 nt, Human
aagcuguaaucccaaaggcauca

SEQ ID NO: 1007508 - RNA, 23 nt, Human
acaacguaggaaccauuccugga

SEQ ID NO: 1007509 - RNA, 19 nt, Human
acaauaaaaaauggaacca

SEQ ID NO: 1007510 - RNA, 20 nt, Human
acaggcaauaauaaaaaggc

SEQ ID NO: 1007511 - RNA, 21 nt, Human
agaauaaaccuacaacugaga

SEQ ID NO: 1007512 - RNA, 22 nt, Human
agaccggagcggaaacugggga

SEQ ID NO: 1007513 - RNA, 24 nt, Human
agagguagaaacacuguauuaaag

SEQ ID NO: 1007514 - RNA, 24 nt, Human
agccuugauaauggaaguauaacc

SEQ ID NO: 1007515 - RNA, 18 nt, Human
aggcaauaauaaaaaggc

SEQ ID NO: 1007516 - RNA, 22 nt, Human
agggaaagggugauuuucucca

SEQ ID NO: 1007517 - RNA, 18 nt, Human
aguccaaacugggagcca

SEQ ID NO: 1007518 - RNA, 21 nt, Human
aguuccugacuuuaggccaau

SEQ ID NO: 1007519 - RNA, 21 nt, Human
augguuuauucaaguauucaa

SEQ ID NO: 1007520 - RNA, 20 nt, Human
auguacauucugcaugcaca

SEQ ID NO: 1007521 - RNA, 25 nt, Human
auuuuccuaagagaaaacgaacuuc

SEQ ID NO: 1007522 - RNA, 20 nt, Human
caacugagauaacacaggug

SEQ ID NO: 1007523 - RNA, 22 nt, Human
caccaucuaccccaagaccuuu

SEQ ID NO: 1007524 - RNA, 19 nt, Human
cacugugcgcgcccagagc

SEQ ID NO: 1007525 - RNA, 24 nt, Human
cacuuaauauguacccagcuacac

SEQ ID NO: 1007526 - RNA, 23 nt, Human
cacuuugucaguuuuauuuuacc

SEQ ID NO: 1007527 - RNA, 22 nt, Human
cagcggacgggcgggcggcgca

SEQ ID NO: 1007528 - RNA, 24 nt, Human
caguagccaagaucuaaauccugg

SEQ ID NO: 1007529 - RNA, 23 nt, Human
caugacaguagccaagaucuaaa

SEQ ID NO: 1007530 - RNA, 21 nt, Human
cauggccaagucucuaaacuc

SEQ ID NO: 1007531 - RNA, 23 nt, Human
cauuuauucaccaaguccaaacu

SEQ ID NO: 1007532 - RNA, 22 nt, Human
ccaaauaaaccuagccuuuaau

SEQ ID NO: 1007533 - RNA, 19 nt, Human
ccccgcgcuuccccgccuc

SEQ ID NO: 1007534 - RNA, 20 nt, Human
ccccgggcccgggcggacuc

SEQ ID NO: 1007535 - RNA, 20 nt, Human
cccgcaccgccgcggccccg

SEQ ID NO: 1007536 - RNA, 19 nt, Human
cccgguacucuccaucccc

SEQ ID NO: 1007537 - RNA, 19 nt, Human
ccgccgcggccccgcgcuu

SEQ ID NO: 1007538 - RNA, 18 nt, Human
ccgcggccccgcgcuucc

SEQ ID NO: 1007539 - RNA, 24 nt, Human
ccgcucggggcgcugcugcgacgg

SEQ ID NO: 1007540 - RNA, 19 nt, Human
ccggccgcuggcugucugg

SEQ ID NO: 1007541 - RNA, 22 nt, Human
ccugcaugacaguagccaagau

SEQ ID NO: 1007542 - RNA, 20 nt, Human
ccugccgcucauggcccggc

SEQ ID NO: 1007543 - RNA, 18 nt, Human
cgcaccgccgcggccccg

SEQ ID NO: 1007544 - RNA, 23 nt, Human
cgcccagagccgcacacgcgcuc

SEQ ID NO: 1007545 - RNA, 22 nt, Human
cgcggcuccgcgggcccggagc

SEQ ID NO: 1007546 - RNA, 22 nt, Human
cgcucugaggcagugaggggcc

SEQ ID NO: 1007547 - RNA, 19 nt, Human
cggccucggcgcugccggg

SEQ ID NO: 1007548 - RNA, 18 nt, Human
cuagaacccgcaccgccg

SEQ ID NO: 1007549 - RNA, 27 nt, Human
cugcgacggcgacggccgccgcccuuu

SEQ ID NO: 1007550 - RNA, 18 nt, Human
gaagaggagaggauagaa

SEQ ID NO: 1007551 - RNA, 18 nt, Human
gacaaccauguuuguuuu

SEQ ID NO: 1007552 - RNA, 21 nt, Human
gacagaacucaagcuguaauc

SEQ ID NO: 1007553 - RNA, 23 nt, Human
gagccgcacacgcgcucugaggc

SEQ ID NO: 1007554 - RNA, 22 nt, Human
gcauguaggaacuccacaucac

SEQ ID NO: 1007555 - RNA, 20 nt, Human
gcccaaauaaaccuagccuu

SEQ ID NO: 1007556 - RNA, 20 nt, Human
gcccaacgcccucgcgcgcg

SEQ ID NO: 1007557 - RNA, 19 nt, Human
gcccuagaacccgcaccgc

SEQ ID NO: 1007558 - RNA, 18 nt, Human
gcgggucuggggcagccg

SEQ ID NO: 1007559 - RNA, 18 nt, Human
ggcccggagcgcgccagc

SEQ ID NO: 1007560 - RNA, 24 nt, Human
ggcgcccaacgcccucgcgcgcgc

SEQ ID NO: 1007561 - RNA, 22 nt, Human
gggccaggggugccgucaccgu

SEQ ID NO: 1007562 - RNA, 23 nt, Human
gucuggggcagccgcagccccgg

SEQ ID NO: 1007563 - RNA, 23 nt, Human
uaaaaaauggaaccaaaagcuaa

SEQ ID NO: 1007564 - RNA, 24 nt, Human
uaaaaggauuaaaauaaaaggauu

SEQ ID NO: 1007565 - RNA, 23 nt, Human
uaaaauuagauuaaugccaaaga

SEQ ID NO: 1007566 - RNA, 22 nt, Human
uaacaaaaacauuacugagaaa

SEQ ID NO: 1007567 - RNA, 24 nt, Human
uaacuacuggaauuucauacagau

SEQ ID NO: 1007568 - RNA, 20 nt, Human
uaauaacaaauaggguugug

SEQ ID NO: 1007569 - RNA, 19 nt, Human
uacaaaauccaauacacag

SEQ ID NO: 1007570 - RNA, 18 nt, Human
uacaacugagauaacacc

SEQ ID NO: 1007571 - RNA, 24 nt, Human
uacacaguuguuuuaauaaauuag

SEQ ID NO: 1007572 - RNA, 22 nt, Human
uacccagcuacacccuagaaac

SEQ ID NO: 1007573 - RNA, 23 nt, Human
uacccagcuacacccuagaaaca

SEQ ID NO: 1007574 - RNA, 18 nt, Human
uaccuggcucaacaagcc

SEQ ID NO: 1007575 - RNA, 20 nt, Human
uagaauaaaccuacaacuga

SEQ ID NO: 1007576 - RNA, 19 nt, Human
uaggguuguggagguaaaa

SEQ ID NO: 1007577 - RNA, 23 nt, Human
uaggguuguggagguaaaacagu

SEQ ID NO: 1007578 - RNA, 18 nt, Human
uauguaguuuuuggauug

SEQ ID NO: 1007579 - RNA, 19 nt, Human
uauguaguuuuuggauugu

SEQ ID NO: 1007580 - RNA, 22 nt, Human
uauguuccuggaagccugcaug

SEQ ID NO: 1007581 - RNA, 22 nt, Human
ucacuaaggaaguaccuggcuc

SEQ ID NO: 1007582 - RNA, 21 nt, Human
ucacuggagauuacaugugaa

SEQ ID NO: 1007583 - RNA, 30 nt, Human
ucccaaaggcaucaccucacguucccaccc

SEQ ID NO: 1007584 - RNA, 18 nt, Human
ucgggccuccucggcccu

SEQ ID NO: 1007585 - RNA, 22 nt, Human
ucggggcgcugcugcgacggcg

SEQ ID NO: 1007586 - RNA, 19 nt, Human
ucuaaacucacuaaggaag

SEQ ID NO: 1007587 - RNA, 24 nt, Human
ugagauaacacaggugauaacuga

SEQ ID NO: 1007588 - RNA, 21 nt, Human
ugaggcagugaggggcccggu

SEQ ID NO: 1007589 - RNA, 19 nt, Human
ugaugaacccagugacgag

SEQ ID NO: 1007590 - RNA, 21 nt, Human
ugcacaauaaaaaauggaacc

SEQ ID NO: 1007591 - RNA, 20 nt, Human
ugccaaagagcucugugcaa

SEQ ID NO: 1007592 - RNA, 19 nt, Human
ugccgggccaggggugccg

SEQ ID NO: 1007593 - RNA, 24 nt, Human
ugcgcgcccagagccgcacacgcg

SEQ ID NO: 1007594 - RNA, 24 nt, Human
uggaaccaaaagcuaacaaaaacc

SEQ ID NO: 1007595 - RNA, 18 nt, Human
ugggagaggaagaggaga

SEQ ID NO: 1007596 - RNA, 19 nt, Human
ugggagaggaagaggagag

SEQ ID NO: 1007597 - RNA, 20 nt, Human
ugggagccaaacacucuugc

SEQ ID NO: 1007598 - RNA, 23 nt, Human
uggggaagcugccgcgcggagcc

SEQ ID NO: 1007599 - RNA, 18 nt, Human
uggggauggggugacaga

SEQ ID NO: 1007600 - RNA, 26 nt, Human
uggggauggggugacagaacucaagc

SEQ ID NO: 1007601 - RNA, 26 nt, Human
uguauacaaucaaguaaaauauuuua

SEQ ID NO: 1007602 - RNA, 24 nt, Human
ugucaaagaguucagauuauuuua

SEQ ID NO: 1007603 - RNA, 22 nt, Human
uucaaaauuucuuccaagaucc

SEQ ID NO: 1007604 - RNA, 18 nt, Human
uucaaaucacugcuuguu

SEQ ID NO: 1007605 - RNA, 18 nt, Human
uucacuucuucuuaagcu

SEQ ID NO: 1007606 - RNA, 24 nt, Human
uucuuccugagcuguuuaaagaug

SEQ ID NO: 1007607 - RNA, 20 nt, Human
uuucacacacaccaucuacc

SEQ ID NO: 1007608 - RNA, 22 nt, Human
uuucacacacaccaucuacccc

SEQ ID NO: 1007609 - RNA, 19 nt, Human
aaaaacauccauuaacuug

SEQ ID NO: 1007610 - RNA, 23 nt, Human
aaaaaccuuugaaguguuacuaa

SEQ ID NO: 1007611 - RNA, 19 nt, Human
aaaaaguuuugcucacaga

SEQ ID NO: 1007612 - RNA, 20 nt, Human
aaaacaaacaaaaaaaaacc

SEQ ID NO: 1007613 - RNA, 25 nt, Human
aaaaugcuccuaagaauccauuuug

SEQ ID NO: 1007614 - RNA, 19 nt, Human
aaacaaaaagcaaagccuc

SEQ ID NO: 1007615 - RNA, 22 nt, Human
aaacaaacaaaaaaaaaccuuu

SEQ ID NO: 1007616 - RNA, 18 nt, Human
aaaggaagcaaagcaccu

SEQ ID NO: 1007617 - RNA, 23 nt, Human
aaaguauucaagaaaauaaaaua

SEQ ID NO: 1007618 - RNA, 23 nt, Human
aaauaacuaugaaaaaaguauuc

SEQ ID NO: 1007619 - RNA, 23 nt, Human
aagaaaccaagauaaucucaaua

SEQ ID NO: 1007620 - RNA, 24 nt, Human
aagcaaacaaaaagcaaagccuca

SEQ ID NO: 1007621 - RNA, 18 nt, Human
aagcaugauuucaaggau

SEQ ID NO: 1007622 - RNA, 19 nt, Human
aagguuggaaauuuaaaac

SEQ ID NO: 1007623 - RNA, 25 nt, Human
acacuaaaaugcuccuaagaaucca

SEQ ID NO: 1007624 - RNA, 26 nt, Human
acauccaacaucacugaauggaaaua

SEQ ID NO: 1007625 - RNA, 25 nt, Human
agaagaaaaaaaaguaaggcgaaaa

SEQ ID NO: 1007626 - RNA, 18 nt, Human
agaaggcacaaacuauaa

SEQ ID NO: 1007627 - RNA, 21 nt, Human
agaaggcacaaacuauaaaag

SEQ ID NO: 1007628 - RNA, 20 nt, Human
agaauaugcccugucauaca

SEQ ID NO: 1007629 - RNA, 25 nt, Human
agauuccuaucugacagauuucuuc

SEQ ID NO: 1007630 - RNA, 19 nt, Human
agcaaaggccacagcacaa

SEQ ID NO: 1007631 - RNA, 23 nt, Human
aguuaagucauauuaucucaauc

SEQ ID NO: 1007632 - RNA, 21 nt, Human
aucagucuucuucaaaacuuu

SEQ ID NO: 1007633 - RNA, 18 nt, Human
augucagacuaaagcuga

SEQ ID NO: 1007634 - RNA, 22 nt, Human
auguuucuugguuucuguucuc

SEQ ID NO: 1007635 - RNA, 23 nt, Human
caaaaaacucaaaacauucuugg

SEQ ID NO: 1007636 - RNA, 22 nt, Human
caaaacucaauguugccaacau

SEQ ID NO: 1007637 - RNA, 23 nt, Human
caaaacucaauguugccaacaug

SEQ ID NO: 1007638 - RNA, 22 nt, Human
caaaugauguaagugcugaaaa

SEQ ID NO: 1007639 - RNA, 21 nt, Human
cagcugaaucaugaauaacac

SEQ ID NO: 1007640 - RNA, 25 nt, Human
caggcucugaaccccuagugccccc

SEQ ID NO: 1007641 - RNA, 18 nt, Human
ccacaugcauuucaaggu

SEQ ID NO: 1007642 - RNA, 23 nt, Human
cccccaacccaaaucuuggaagc

SEQ ID NO: 1007643 - RNA, 19 nt, Human
ccccuagugcccccaaccc

SEQ ID NO: 1007644 - RNA, 18 nt, Human
cccuagugcccccaaccc

SEQ ID NO: 1007645 - RNA, 19 nt, Human
ccucggccggacgcugagg

SEQ ID NO: 1007646 - RNA, 19 nt, Human
ccugaauucacugucuacu

SEQ ID NO: 1007647 - RNA, 21 nt, Human
cuagaaaacaaacaaaaaaaa

SEQ ID NO: 1007648 - RNA, 20 nt, Human
cuaucucuuccaagaaacca

SEQ ID NO: 1007649 - RNA, 19 nt, Human
cugaaccccuagugccccc

SEQ ID NO: 1007650 - RNA, 19 nt, Human
cugaaccccuagugccccc

SEQ ID NO: 1007651 - RNA, 22 nt, Human
gaaaacaaauuccucagagauu

SEQ ID NO: 1007652 - RNA, 22 nt, Human
gaacucauuccuaucucuucca

SEQ ID NO: 1007653 - RNA, 22 nt, Human
gaaggcacaaacuauaaaaggg

SEQ ID NO: 1007654 - RNA, 23 nt, Human
gcaaacaaaaagcaaagccucau

SEQ ID NO: 1007655 - RNA, 23 nt, Human
gcagguaucccuaaauccuaaaa

SEQ ID NO: 1007656 - RNA, 19 nt, Human
ggacacaagcauuagaugu

SEQ ID NO: 1007657 - RNA, 18 nt, Human
ggccggacgcugagggag

SEQ ID NO: 1007658 - RNA, 28 nt, Human
uaaaaugcuccuaagaauccauuuugag

SEQ ID NO: 1007659 - RNA, 20 nt, Human
uaauagaguauaaggacaca

SEQ ID NO: 1007660 - RNA, 19 nt, Human
uaauuaccauguuucuugg

SEQ ID NO: 1007661 - RNA, 19 nt, Human
uaauuuaguaauuaccaug

SEQ ID NO: 1007662 - RNA, 22 nt, Human
uacacaaaaaguuccuuugaaa

SEQ ID NO: 1007663 - RNA, 19 nt, Human
uacuuaaaagcaaacaaaa

SEQ ID NO: 1007664 - RNA, 22 nt, Human
uagaaaacaaacaaaaaaaaac

SEQ ID NO: 1007665 - RNA, 22 nt, Human
uagcaauacuuuguuuucuaau

SEQ ID NO: 1007666 - RNA, 21 nt, Human
uaguaauuaccauguuucuug

SEQ ID NO: 1007667 - RNA, 25 nt, Human
uaucaaagcaauauucaagcaugau

SEQ ID NO: 1007668 - RNA, 20 nt, Human
uaucucuuccaagaaaccaa

SEQ ID NO: 1007669 - RNA, 21 nt, Human
ucaaaacauucuuggugacug

SEQ ID NO: 1007670 - RNA, 21 nt, Human
ucaaagcaauauucaagcaug

SEQ ID NO: 1007671 - RNA, 22 nt, Human
ucagcugaaucaugaauaacac

SEQ ID NO: 1007672 - RNA, 20 nt, Human
uccucagagauuuuuaaagg

SEQ ID NO: 1007673 - RNA, 23 nt, Human
ugaaaaaaguauucaagaaaaua

SEQ ID NO: 1007674 - RNA, 25 nt, Human
ugaaccccuagugcccccaacccaa

SEQ ID NO: 1007675 - RNA, 18 nt, Human
ugaccaaaaaaagaacau

SEQ ID NO: 1007676 - RNA, 18 nt, Human
ugagcaccauaacuaagg

SEQ ID NO: 1007677 - RNA, 23 nt, Human
ugccaaacaaaaaucuacugaau

SEQ ID NO: 1007678 - RNA, 20 nt, Human
ugcucacagaaggcacaaac

SEQ ID NO: 1007679 - RNA, 23 nt, Human
uggaaauuuaaaacuugcaagaa

SEQ ID NO: 1007680 - RNA, 19 nt, Human
uggaaugacaaaacuaguu

SEQ ID NO: 1007681 - RNA, 18 nt, Human
uuaaaacuugcaagaaaa

SEQ ID NO: 1007682 - RNA, 21 nt, Human
uuaaaagcaaacaaaaagcaa

SEQ ID NO: 1007683 - RNA, 26 nt, Human
uucaagcaugauuucaaggaugcuuu

SEQ ID NO: 1007684 - RNA, 19 nt, Human
uucauaacacauagaaaua

SEQ ID NO: 1007685 - RNA, 24 nt, Human
uuugaauuuaaaaaaaaauagcug

SEQ ID NO: 1007686 - RNA, 24 nt, Human
uuugaguuuguuuaccaaacacau

SEQ ID NO: 1007687 - RNA, 18 nt, Human
uuugcuggccugcaacac

SEQ ID NO: 1007688 - RNA, 22 nt, Human
aaaagaaacauaaagaagaaac

SEQ ID NO: 1007689 - RNA, 23 nt, Human
aaaaguucuucucuuuaaagaga

SEQ ID NO: 1007690 - RNA, 22 nt, Human
aaaauccuccaagauggauucc

SEQ ID NO: 1007691 - RNA, 22 nt, Human
aacuccccaccucccccauucc

SEQ ID NO: 1007692 - RNA, 25 nt, Human
aagaaacaagacaggcugaaggaug

SEQ ID NO: 1007693 - RNA, 21 nt, Human
aagaagaaacaagacaggcug

SEQ ID NO: 1007694 - RNA, 18 nt, Human
aagaggcaaaaugaggau

SEQ ID NO: 1007695 - RNA, 18 nt, Human
aagcaaauguccccaagc

SEQ ID NO: 1007696 - RNA, 19 nt, Human
aagcacacuagcaaaaggg

SEQ ID NO: 1007697 - RNA, 21 nt, Human
aagcuuccuuuuggcuuaaag

SEQ ID NO: 1007698 - RNA, 22 nt, Human
aaggaaaaacaaaagcauauca

SEQ ID NO: 1007699 - RNA, 22 nt, Human
aaguaaaagguggagggacccc

SEQ ID NO: 1007700 - RNA, 18 nt, Human
aaguaacuuaccaaguac

SEQ ID NO: 1007701 - RNA, 22 nt, Human
aagucauacaaauggguuggca

SEQ ID NO: 1007702 - RNA, 22 nt, Human
aauccauagagcaagcuuccuu

SEQ ID NO: 1007703 - RNA, 24 nt, Human
acaaugggccacagacagugggcc

SEQ ID NO: 1007704 - RNA, 18 nt, Human
acauuuugaaauucacag

SEQ ID NO: 1007705 - RNA, 21 nt, Human
acccaaauguggauuccaagg

SEQ ID NO: 1007706 - RNA, 22 nt, Human
acuagugacugguugaccaucu

SEQ ID NO: 1007707 - RNA, 21 nt, Human
acugaaagaaaaauacagaga

SEQ ID NO: 1007708 - RNA, 20 nt, Human
acugagagauuuugugauga

SEQ ID NO: 1007709 - RNA, 24 nt, Human
acuuaaaauguaucaaacaucuaa

SEQ ID NO: 1007710 - RNA, 24 nt, Human
agacaaaacaguggaaacuacgga

SEQ ID NO: 1007711 - RNA, 23 nt, Human
agagaaagcauauucagggaggc

SEQ ID NO: 1007712 - RNA, 18 nt, Human
agagaccucugcgagaac

SEQ ID NO: 1007713 - RNA, 19 nt, Human
agaggaagaaagaauaagg

SEQ ID NO: 1007714 - RNA, 20 nt, Human
agaguucuuccaugccuuac

SEQ ID NO: 1007715 - RNA, 21 nt, Human
agcaagagcaaaucuguucac

SEQ ID NO: 1007716 - RNA, 20 nt, Human
agggaaaaugcuaaagacag

SEQ ID NO: 1007717 - RNA, 25 nt, Human
agggaggcugaauagucacagggug

SEQ ID NO: 1007718 - RNA, 19 nt, Human
augacacaguacccacaug

SEQ ID NO: 1007719 - RNA, 25 nt, Human
caacugaaagaaaaauacagagacc

SEQ ID NO: 1007720 - RNA, 19 nt, Human
caagacaggcugaaggaug

SEQ ID NO: 1007721 - RNA, 23 nt, Human
caccacaccuuggucuguaaauc

SEQ ID NO: 1007722 - RNA, 23 nt, Human
cacuauggcaacuaacaccaaag

SEQ ID NO: 1007723 - RNA, 22 nt, Human
cagaaagcggccucuuucccag

SEQ ID NO: 1007724 - RNA, 24 nt, Human
cagagaccuuggcaaaagacacca

SEQ ID NO: 1007725 - RNA, 22 nt, Human
cauagcucaucuuuucccacag

SEQ ID NO: 1007726 - RNA, 21 nt, Human
caucuuuaggccuuuuucacu

SEQ ID NO: 1007727 - RNA, 23 nt, Human
ccaggccaaaggaaaaaaaaauc

SEQ ID NO: 1007728 - RNA, 23 nt, Human
cccaaagacaacugaaagaaaaa

SEQ ID NO: 1007729 - RNA, 21 nt, Human
ccccagauaacauauuacagc

SEQ ID NO: 1007730 - RNA, 24 nt, Human
cccccagauaacauauuacagcuu

SEQ ID NO: 1007731 - RNA, 21 nt, Human
ccuugugguucaucugggucc

SEQ ID NO: 1007732 - RNA, 18 nt, Human
cuaauagcacucagcaau

SEQ ID NO: 1007733 - RNA, 18 nt, Human
cuagaagagacagggagc

SEQ ID NO: 1007734 - RNA, 24 nt, Human
cucaacacauuuacagagggcaga

SEQ ID NO: 1007735 - RNA, 21 nt, Human
cuccccaacuccccaccuccc

SEQ ID NO: 1007736 - RNA, 18 nt, Human
cucuuugaaauuguauug

SEQ ID NO: 1007737 - RNA, 19 nt, Human
cugaggauucaaacucugc

SEQ ID NO: 1007738 - RNA, 18 nt, Human
cuuugaggacugaaagau

SEQ ID NO: 1007739 - RNA, 21 nt, Human
gacacaguacccacauguuag

SEQ ID NO: 1007740 - RNA, 23 nt, Human
gcaagcuuccuuuuggcuuaaag

SEQ ID NO: 1007741 - RNA, 22 nt, Human
gcacaccaccucaugccaacca

SEQ ID NO: 1007742 - RNA, 22 nt, Human
ggaaaaacaaaagcauaucaag

SEQ ID NO: 1007743 - RNA, 18 nt, Human
ggaaaaugcuaaagacag

SEQ ID NO: 1007744 - RNA, 19 nt, Human
ggaauagagauggucccac

SEQ ID NO: 1007745 - RNA, 18 nt, Human
ggacugaaagauuuggca

SEQ ID NO: 1007746 - RNA, 24 nt, Human
ggacugaaagauuuggcauugagu

SEQ ID NO: 1007747 - RNA, 22 nt, Human
gggcagaaagcggccucuuucc

SEQ ID NO: 1007748 - RNA, 21 nt, Human
guagaggauuccucaagucua

SEQ ID NO: 1007749 - RNA, 18 nt, Human
gugcuuucuacaaguuuu

SEQ ID NO: 1007750 - RNA, 21 nt, Human
uaaaacaaaaauccuccaaga

SEQ ID NO: 1007751 - RNA, 19 nt, Human
uaaaacccaggccaaagga

SEQ ID NO: 1007752 - RNA, 24 nt, Human
uaaaccaguaagaauguagaagca

SEQ ID NO: 1007753 - RNA, 20 nt, Human
uaaagcaaauguccccaagc

SEQ ID NO: 1007754 - RNA, 20 nt, Human
uaaauucuaaaugcccuccu

SEQ ID NO: 1007755 - RNA, 23 nt, Human
uaaccaaccucuaaguagcugac

SEQ ID NO: 1007756 - RNA, 21 nt, Human
uaacuaaguucaaguguaagc

SEQ ID NO: 1007757 - RNA, 25 nt, Human
uaacuagaucaacacgugucuccua

SEQ ID NO: 1007758 - RNA, 22 nt, Human
uacccaugguaucacaaauuca

SEQ ID NO: 1007759 - RNA, 21 nt, Human
uacucaauagugaaugcagcu

SEQ ID NO: 1007760 - RNA, 24 nt, Human
uagaagaaauaaauaaguuaagca

SEQ ID NO: 1007761 - RNA, 18 nt, Human
uagcuauaucacucaaca

SEQ ID NO: 1007762 - RNA, 21 nt, Human
uauaacaacaauguuagauaa

SEQ ID NO: 1007763 - RNA, 21 nt, Human
uauguagauucacagaguaga

SEQ ID NO: 1007764 - RNA, 21 nt, Human
uauuuguguugugacaggcac

SEQ ID NO: 1007765 - RNA, 19 nt, Human
ucaagaguucuuccaugcc

SEQ ID NO: 1007766 - RNA, 23 nt, Human
ucaauucuuuuucaucucuuaca

SEQ ID NO: 1007767 - RNA, 21 nt, Human
ucacugauuauaaaugaaggc

SEQ ID NO: 1007768 - RNA, 22 nt, Human
ucacugauuauaaaugaaggcu

SEQ ID NO: 1007769 - RNA, 21 nt, Human
ucauacauuucuauagaaauc

SEQ ID NO: 1007770 - RNA, 18 nt, Human
ucaugcuguuuaucuauu

SEQ ID NO: 1007771 - RNA, 24 nt, Human
uccaaggagauaguagagcccucu

SEQ ID NO: 1007772 - RNA, 19 nt, Human
uccacaauaucacugccuc

SEQ ID NO: 1007773 - RNA, 23 nt, Human
uccacaauaucacugccuccuaa

SEQ ID NO: 1007774 - RNA, 22 nt, Human
uccccaagcuggccaucacucu

SEQ ID NO: 1007775 - RNA, 23 nt, Human
uccccaagcuggccaucacucug

SEQ ID NO: 1007776 - RNA, 20 nt, Human
uccccaccucccccauuccc

SEQ ID NO: 1007777 - RNA, 20 nt, Human
uccugugaccuuuacagagc

SEQ ID NO: 1007778 - RNA, 18 nt, Human
ucuguaggccaacauuuu

SEQ ID NO: 1007779 - RNA, 23 nt, Human
ugaaauucacagguaaauuugcc

SEQ ID NO: 1007780 - RNA, 19 nt, Human
ugacaaugggccacagaca

SEQ ID NO: 1007781 - RNA, 24 nt, Human
ugacaggcacauauuacaauagga

SEQ ID NO: 1007782 - RNA, 23 nt, Human
ugacaucacagaugccaguuggu

SEQ ID NO: 1007783 - RNA, 21 nt, Human
ugacuuaacauccccucccaa

SEQ ID NO: 1007784 - RNA, 24 nt, Human
ugagcaagagcaaaucuguucacc

SEQ ID NO: 1007785 - RNA, 19 nt, Human
ugaguaaaucucuuucaag

SEQ ID NO: 1007786 - RNA, 22 nt, Human
ugaucugcaauucuaccuccuc

SEQ ID NO: 1007787 - RNA, 21 nt, Human
ugccaaguacuccccaacucc

SEQ ID NO: 1007788 - RNA, 22 nt, Human
ugccaguugguagaaaacucug

SEQ ID NO: 1007789 - RNA, 26 nt, Human
uggacaaaauacauuuuugcuuguag

SEQ ID NO: 1007790 - RNA, 23 nt, Human
uggccaucacucugucucauggg

SEQ ID NO: 1007791 - RNA, 26 nt, Human
uggcuaaagcaucgauuuucaaauac

SEQ ID NO: 1007792 - RNA, 18 nt, Human
uggugaaucugugaagug

SEQ ID NO: 1007793 - RNA, 21 nt, Human
uuaacccaaauguggauucca

SEQ ID NO: 1007794 - RNA, 18 nt, Human
uucaauacaucugauagc

SEQ ID NO: 1007795 - RNA, 21 nt, Human
uucacagaguagaugaaacaa

SEQ ID NO: 1007796 - RNA, 22 nt, Human
uucucagcuccuucacgauucc

SEQ ID NO: 1007797 - RNA, 22 nt, Human
uugaauuacauguagcaaagac

SEQ ID NO: 1007798 - RNA, 21 nt, Human
uuggcaacccuguuucacguc

SEQ ID NO: 1007799 - RNA, 22 nt, Human
uuguauuguaacauacugugca

SEQ ID NO: 1007800 - RNA, 24 nt, Human
uuucucagcuccuucacgauuccu

SEQ ID NO: 1007801 - RNA, 23 nt, Human
aaacugaggccggcgaggaggga

SEQ ID NO: 1007802 - RNA, 21 nt, Human
agaagacccugaccgugcucc

SEQ ID NO: 1007803 - RNA, 21 nt, Human
agcccggaggugaccugggcu

SEQ ID NO: 1007804 - RNA, 18 nt, Human
agcuguggggaucuggag

SEQ ID NO: 1007805 - RNA, 22 nt, Human
caggggccuuugaagacagcgc

SEQ ID NO: 1007806 - RNA, 19 nt, Human
cccggaggugaccugggcu

SEQ ID NO: 1007807 - RNA, 24 nt, Human
cccggaggugaccugggcucuggg

SEQ ID NO: 1007808 - RNA, 18 nt, Human
ccugggcucugggagggg

SEQ ID NO: 1007809 - RNA, 18 nt, Human
cggcgcuggggcgcgugc

SEQ ID NO: 1007810 - RNA, 19 nt, Human
cggcgcuggggcgcgugcu

SEQ ID NO: 1007811 - RNA, 26 nt, Human
cggcggacccuggggauaggaggugc

SEQ ID NO: 1007812 - RNA, 21 nt, Human
cggggaggggagacaggggcc

SEQ ID NO: 1007813 - RNA, 22 nt, Human
cucggcggacccuggggauagg

SEQ ID NO: 1007814 - RNA, 21 nt, Human
gaagacagcgcgggacucgga

SEQ ID NO: 1007815 - RNA, 18 nt, Human
gccuuggagggggcugcg

SEQ ID NO: 1007816 - RNA, 20 nt, Human
gcgcucacacgcggcccggg

SEQ ID NO: 1007817 - RNA, 19 nt, Human
gggaggcugaguccgggga

SEQ ID NO: 1007818 - RNA, 18 nt, Human
gugaccugggcucuggga

SEQ ID NO: 1007819 - RNA, 18 nt, Human
guggcucucggcggaccc

SEQ ID NO: 1007820 - RNA, 22 nt, Human
ugacaguacaaaaucucuuuau

SEQ ID NO: 1007821 - RNA, 18 nt, Human
ugcuaagggcccgcgggg

SEQ ID NO: 1007822 - RNA, 29 nt, Human
uggccgagggguucccaaggcuccacucc

SEQ ID NO: 1007823 - RNA, 24 nt, Human
uucagcuguauuuucgaaccccug

SEQ ID NO: 1007824 - RNA, 25 nt, Human
uucagcuguauuuucgaaccccugu

SEQ ID NO: 1007825 - RNA, 22 nt, Human
uuuucuguaaaaaaucguggcu

SEQ ID NO: 1007826 - RNA, 24 nt, Human
cagguccugaagccuucucugugg

SEQ ID NO: 1007827 - RNA, 22 nt, Human
cugaagccuucucuguggacca

SEQ ID NO: 1007828 - RNA, 18 nt, Human
uaaaauaccagaugcuag

SEQ ID NO: 1007829 - RNA, 20 nt, Human
uaggaguccagacucaaccc

SEQ ID NO: 1007830 - RNA, 19 nt, Human
uccagacucaacccggaaa

SEQ ID NO: 1007831 - RNA, 19 nt, Human
ugcagcugaccaagcaggu

SEQ ID NO: 1007832 - RNA, 23 nt, Human
ugcccgaguucgguaggagucca

SEQ ID NO: 1007833 - RNA, 22 nt, Human
ugcucgcugcaaaauaaauaaa

SEQ ID NO: 1007834 - RNA, 18 nt, Human
aagcagccccuuacccau

SEQ ID NO: 1007835 - RNA, 21 nt, Human
aagcugacacauccaaagacc

SEQ ID NO: 1007836 - RNA, 19 nt, Human
aaggcaggcacugaagccg

SEQ ID NO: 1007837 - RNA, 20 nt, Human
aaucaggucaggcugaccca

SEQ ID NO: 1007838 - RNA, 18 nt, Human
agccugccacacuugcua

SEQ ID NO: 1007839 - RNA, 19 nt, Human
aggcaggcuaucagaaggg

SEQ ID NO: 1007840 - RNA, 19 nt, Human
caccacagccuugcuguag

SEQ ID NO: 1007841 - RNA, 24 nt, Human
cagacugucaggaacucucgccaa

SEQ ID NO: 1007842 - RNA, 21 nt, Human
caggcagaauuucuuccucag

SEQ ID NO: 1007843 - RNA, 18 nt, Human
ccaugccacucucccccu

SEQ ID NO: 1007844 - RNA, 18 nt, Human
ccccagaaguaagcagcc

SEQ ID NO: 1007845 - RNA, 25 nt, Human
ccccagaaguaagcagccccuuacc

SEQ ID NO: 1007846 - RNA, 18 nt, Human
ccuagcuaagcugacaca

SEQ ID NO: 1007847 - RNA, 19 nt, Human
ccucuaccuaguccccaaa

SEQ ID NO: 1007848 - RNA, 21 nt, Human
cuaaccucaaauccaccugca

SEQ ID NO: 1007849 - RNA, 19 nt, Human
cucuggaucagcccucacc

SEQ ID NO: 1007850 - RNA, 22 nt, Human
cucuguucuuuaggccuucuga

SEQ ID NO: 1007851 - RNA, 19 nt, Human
cugccuaaccucaaaucca

SEQ ID NO: 1007852 - RNA, 24 nt, Human
cugccugcccuuugcccgcagugg

SEQ ID NO: 1007853 - RNA, 21 nt, Human
gcacaagcaguaccugggcau

SEQ ID NO: 1007854 - RNA, 18 nt, Human
gccugggaauuuuaaaac

SEQ ID NO: 1007855 - RNA, 22 nt, Human
gcuaagcugacacauccaaaga

SEQ ID NO: 1007856 - RNA, 26 nt, Human
uaaaaccaaccuggacaauguuaguu

SEQ ID NO: 1007857 - RNA, 21 nt, Human
uaagcagccccuuacccauua

SEQ ID NO: 1007858 - RNA, 22 nt, Human
uagcuaagcugacacauccaaa

SEQ ID NO: 1007859 - RNA, 25 nt, Human
uagcuaagcugacacauccaaagac

SEQ ID NO: 1007860 - RNA, 24 nt, Human
uagugucugauugaauuacuggug

SEQ ID NO: 1007861 - RNA, 21 nt, Human
ucagcccucacccucuuccca

SEQ ID NO: 1007862 - RNA, 19 nt, Human
ucaucugccuaaccucaaa

SEQ ID NO: 1007863 - RNA, 20 nt, Human
uccaauaccccagaaguaag

SEQ ID NO: 1007864 - RNA, 22 nt, Human
uccccaugccacucucccccug

SEQ ID NO: 1007865 - RNA, 21 nt, Human
ucugccuaaccucaaauccac

SEQ ID NO: 1007866 - RNA, 22 nt, Human
ucugccuaaccucaaauccacc

SEQ ID NO: 1007867 - RNA, 20 nt, Human
ugauugaauuacuggugacu

SEQ ID NO: 1007868 - RNA, 18 nt, Human
ugccacacuugcuaaucc

SEQ ID NO: 1007869 - RNA, 18 nt, Human
ugccugggaauuuuaaaa

SEQ ID NO: 1007870 - RNA, 21 nt, Human
uggccuagcuaagcugacaca

SEQ ID NO: 1007871 - RNA, 18 nt, Human
ugucuaaacucugugagg

SEQ ID NO: 1007872 - RNA, 21 nt, Human
ugucugauugaauuacuggug

SEQ ID NO: 1007873 - RNA, 18 nt, Human
uucaguggcauuuaguac

SEQ ID NO: 1007874 - RNA, 20 nt, Human
uucuuuaggccuucugacua

SEQ ID NO: 1007875 - RNA, 23 nt, Human
uuguaggagcuggcuagucaugu

SEQ ID NO: 1007876 - RNA, 19 nt, Human
uuuccaauaccccagaagu

SEQ ID NO: 1007877 - RNA, 23 nt, Human
uuuuuaguugagguaaaauuuac

SEQ ID NO: 1007878 - RNA, 21 nt, Human
aaacgguucagcaagaauggc

SEQ ID NO: 1007879 - RNA, 19 nt, Human
aagcaggaggaggaugcgg

SEQ ID NO: 1007880 - RNA, 20 nt, Human
agaggcuuccagagcucaaa

SEQ ID NO: 1007881 - RNA, 20 nt, Human
aggaggaugcggaggagucc

SEQ ID NO: 1007882 - RNA, 20 nt, Human
caagagagguaucugugaau

SEQ ID NO: 1007883 - RNA, 19 nt, Human
caggcccagcggaggaagc

SEQ ID NO: 1007884 - RNA, 20 nt, Human
ccccgugcugggugaugaug

SEQ ID NO: 1007885 - RNA, 22 nt, Human
cccgugcugggugaugaugggg

SEQ ID NO: 1007886 - RNA, 21 nt, Human
ccuugaaagaugggcuaagga

SEQ ID NO: 1007887 - RNA, 21 nt, Human
cucauggcaauagaggcuucc

SEQ ID NO: 1007888 - RNA, 21 nt, Human
gaaaaagaucuuggaagugga

SEQ ID NO: 1007889 - RNA, 22 nt, Human
gcccugggguuucagggcacac

SEQ ID NO: 1007890 - RNA, 22 nt, Human
guagggcucaggaaccuggaaa

SEQ ID NO: 1007891 - RNA, 23 nt, Human
uaugugcacacaagcccuggggu

SEQ ID NO: 1007892 - RNA, 22 nt, Human
ucagggcacaccugagacacag

SEQ ID NO: 1007893 - RNA, 19 nt, Human
ucuaguauaugcuuagccc

SEQ ID NO: 1007894 - RNA, 19 nt, Human
ucucauggcaauagaggcu

SEQ ID NO: 1007895 - RNA, 24 nt, Human
ucucauggcaauagaggcuuccag

SEQ ID NO: 1007896 - RNA, 19 nt, Human
ugaggcagccauccaggcc

SEQ ID NO: 1007897 - RNA, 18 nt, Human
uggaaaaagaucuuggaa

SEQ ID NO: 1007898 - RNA, 20 nt, Human
ugggaggugggaucauggag

SEQ ID NO: 1007899 - RNA, 23 nt, Human
ugggaggugggaucauggagagg

SEQ ID NO: 1007900 - RNA, 23 nt, Human
uuggaaguggaaggacguaaggg

SEQ ID NO: 1007901 - RNA, 20 nt, Human
uugggaggugagaggugagg

SEQ ID NO: 1007902 - RNA, 19 nt, Human
agaggaggaugcugcugcc

SEQ ID NO: 1007903 - RNA, 19 nt, Human
aggaugcugcugcccaggg

SEQ ID NO: 1007904 - RNA, 21 nt, Human
caagcccuguuucaccuuccc

SEQ ID NO: 1007905 - RNA, 22 nt, Human
gaggaggaugcugcugcccagg

SEQ ID NO: 1007906 - RNA, 18 nt, Human
gaggaugcugcugcccag

SEQ ID NO: 1007907 - RNA, 21 nt, Human
gcagggccuggggcaaggcca

SEQ ID NO: 1007908 - RNA, 22 nt, Human
ugcugcccagggguggugcugg

SEQ ID NO: 1007909 - RNA, 23 nt, Human
ugcugcugcccagggguggugcu

SEQ ID NO: 1007910 - RNA, 20 nt, Human
uggggcaaggccagagagga

SEQ ID NO: 1007911 - RNA, 19 nt, Human
ugugacaaccaccgcugca

SEQ ID NO: 1007912 - RNA, 19 nt, Human
uuuagaacucaucagaaga

SEQ ID NO: 1007913 - RNA, 21 nt, Human
aaacagcacagccuccccagc

SEQ ID NO: 1007914 - RNA, 23 nt, Human
aagagaaagagaagagaaguggg

SEQ ID NO: 1007915 - RNA, 24 nt, Human
aagcccccagacugacgggggaaa

SEQ ID NO: 1007916 - RNA, 20 nt, Human
aaggaccaccccugcagggc

SEQ ID NO: 1007917 - RNA, 27 nt, Human
aaugaaaccagacacugggggcucaaa

SEQ ID NO: 1007918 - RNA, 21 nt, Human
acagcacagccuccccagcca

SEQ ID NO: 1007919 - RNA, 18 nt, Human
acuguaauggucauauag

SEQ ID NO: 1007920 - RNA, 21 nt, Human
agaacccuuaagucucugccc

SEQ ID NO: 1007921 - RNA, 24 nt, Human
agauguuagugguugaugauggcu

SEQ ID NO: 1007922 - RNA, 21 nt, Human
agggacugagaguucugcagc

SEQ ID NO: 1007923 - RNA, 18 nt, Human
agucaggucuccagggga

SEQ ID NO: 1007924 - RNA, 22 nt, Human
auucagaauauuuuuauuuaac

SEQ ID NO: 1007925 - RNA, 18 nt, Human
caaaagacaacccuguuc

SEQ ID NO: 1007926 - RNA, 21 nt, Human
caagcccaacccuuaagacca

SEQ ID NO: 1007927 - RNA, 23 nt, Human
cagauccagccacagggcuccca

SEQ ID NO: 1007928 - RNA, 23 nt, Human
cagcccuaacagggaaaggccau

SEQ ID NO: 1007929 - RNA, 19 nt, Human
caggagcacucagauccag

SEQ ID NO: 1007930 - RNA, 24 nt, Human
ccaaaggaccaccccugcagggcc

SEQ ID NO: 1007931 - RNA, 18 nt, Human
ccagacugacgggggaaa

SEQ ID NO: 1007932 - RNA, 22 nt, Human
ccagcacccagcaacuggcaag

SEQ ID NO: 1007933 - RNA, 22 nt, Human
ccagcuuuccaccaaaggacca

SEQ ID NO: 1007934 - RNA, 19 nt, Human
cccucagacuaaaaggcuc

SEQ ID NO: 1007935 - RNA, 18 nt, Human
ccggagcggagcgcgggg

SEQ ID NO: 1007936 - RNA, 19 nt, Human
ccggagcggagcgcggggg

SEQ ID NO: 1007937 - RNA, 18 nt, Human
ccuguggcaggaagaagg

SEQ ID NO: 1007938 - RNA, 19 nt, Human
ccuuaagucucugcccucc

SEQ ID NO: 1007939 - RNA, 19 nt, Human
ccuuccugcuaaaucaagg

SEQ ID NO: 1007940 - RNA, 23 nt, Human
cuaacacagguccagacauagag

SEQ ID NO: 1007941 - RNA, 21 nt, Human
cucucccuucuuucuuugccu

SEQ ID NO: 1007942 - RNA, 19 nt, Human
cugaguccagagccaugcc

SEQ ID NO: 1007943 - RNA, 27 nt, Human
cuuggcccauuccugccagggcccagc

SEQ ID NO: 1007944 - RNA, 22 nt, Human
cuugugaagcccccagacugac

SEQ ID NO: 1007945 - RNA, 19 nt, Human
gaacaaaugucucagcucc

SEQ ID NO: 1007946 - RNA, 24 nt, Human
gaaugaaaccagacacugggggcu

SEQ ID NO: 1007947 - RNA, 21 nt, Human
gagagugagauccaagagaac

SEQ ID NO: 1007948 - RNA, 24 nt, Human
gcauccaucaaccccgacuauucc

SEQ ID NO: 1007949 - RNA, 22 nt, Human
gccacagggcucccaggccccu

SEQ ID NO: 1007950 - RNA, 18 nt, Human
gcccuaacagggaaaggc

SEQ ID NO: 1007951 - RNA, 23 nt, Human
gcgcgagcguggagcugccggag

SEQ ID NO: 1007952 - RNA, 18 nt, Human
gcgggcgcgagcguggag

SEQ ID NO: 1007953 - RNA, 19 nt, Human
gcuccugaguugaccaaga

SEQ ID NO: 1007954 - RNA, 18 nt, Human
ggagcggagcgcgggggg

SEQ ID NO: 1007955 - RNA, 25 nt, Human
gggaauauaggagaaugccgguacc

SEQ ID NO: 1007956 - RNA, 18 nt, Human
gguaaugagauaggaaag

SEQ ID NO: 1007957 - RNA, 19 nt, Human
gguaaugagauaggaaaga

SEQ ID NO: 1007958 - RNA, 24 nt, Human
ggugcucucuagucuccccugcuu

SEQ ID NO: 1007959 - RNA, 24 nt, Human
guuccugugggaaccacagaccag

SEQ ID NO: 1007960 - RNA, 18 nt, Human
guuggaauuuagugaagg

SEQ ID NO: 1007961 - RNA, 23 nt, Human
uaaaaggcuccugaguugaccaa

SEQ ID NO: 1007962 - RNA, 24 nt, Human
uagaauuucuagggcugggaagca

SEQ ID NO: 1007963 - RNA, 25 nt, Human
uaggaaagaaccgccaucagcccua

SEQ ID NO: 1007964 - RNA, 18 nt, Human
uccagagccaugcccugg

SEQ ID NO: 1007965 - RNA, 19 nt, Human
uccagagccaugcccugga

SEQ ID NO: 1007966 - RNA, 18 nt, Human
uccaucaaccccgacuau

SEQ ID NO: 1007967 - RNA, 23 nt, Human
ucccaagcccaacccuuaagacc

SEQ ID NO: 1007968 - RNA, 23 nt, Human
ucccucagacuaaaaggcuccug

SEQ ID NO: 1007969 - RNA, 21 nt, Human
uccugccagggcccagcaccc

SEQ ID NO: 1007970 - RNA, 18 nt, Human
ucugcagcugaagccagc

SEQ ID NO: 1007971 - RNA, 26 nt, Human
ucugcagcugaagccagcucaggagc

SEQ ID NO: 1007972 - RNA, 21 nt, Human
ugaaauaacaagucugagaug

SEQ ID NO: 1007973 - RNA, 25 nt, Human
ugaaauaacaagucugagaugaaug

SEQ ID NO: 1007974 - RNA, 18 nt, Human
ugaccagccagaauggau

SEQ ID NO: 1007975 - RNA, 18 nt, Human
ugacccugccuauuccca

SEQ ID NO: 1007976 - RNA, 18 nt, Human
ugagaugaaugaaaccag

SEQ ID NO: 1007977 - RNA, 23 nt, Human
ugaguugaccaagagaaagagaa

SEQ ID NO: 1007978 - RNA, 20 nt, Human
ugcaucugacucuacaauuu

SEQ ID NO: 1007979 - RNA, 18 nt, Human
ugccagggcccagcaccc

SEQ ID NO: 1007980 - RNA, 25 nt, Human
uggaugugaucuguagacaacugua

SEQ ID NO: 1007981 - RNA, 19 nt, Human
uggcaggaagaaggccagc

SEQ ID NO: 1007982 - RNA, 18 nt, Human
uggcccauuccugccagg

SEQ ID NO: 1007983 - RNA, 21 nt, Human
uggcuuggcccauuccugcca

SEQ ID NO: 1007984 - RNA, 24 nt, Human
uggcuuggcccauuccugccaggg

SEQ ID NO: 1007985 - RNA, 20 nt, Human
ugucucagcuccccaguuuu

SEQ ID NO: 1007986 - RNA, 22 nt, Human
uucuauuacucucccuucuuuc

SEQ ID NO: 1007987 - RNA, 19 nt, Human
uuggcccauuccugccagg

SEQ ID NO: 1007988 - RNA, 26 nt, Human
aaacauaagaagccugaagcugagcu

SEQ ID NO: 1007989 - RNA, 21 nt, Human
aaccaagccaccagcaugauc

SEQ ID NO: 1007990 - RNA, 25 nt, Human
aaccaagccaccagcaugaucaaca

SEQ ID NO: 1007991 - RNA, 21 nt, Human
aaccucauucuccucccucug

SEQ ID NO: 1007992 - RNA, 24 nt, Human
aaccucauucuccucccucugcac

SEQ ID NO: 1007993 - RNA, 21 nt, Human
aagaagccugaagcugagcug

SEQ ID NO: 1007994 - RNA, 24 nt, Human
aagccaccagcaugaucaacaucc

SEQ ID NO: 1007995 - RNA, 18 nt, Human
aaguggcuccagccccag

SEQ ID NO: 1007996 - RNA, 25 nt, Human
aaguguugggauuguaggcugagcc

SEQ ID NO: 1007997 - RNA, 21 nt, Human
acaaccacccagauacaucac

SEQ ID NO: 1007998 - RNA, 18 nt, Human
acagacugugagagagug

SEQ ID NO: 1007999 - RNA, 18 nt, Human
agaggccaugccgugagg

SEQ ID NO: 1008000 - RNA, 24 nt, Human
agauacaucacucccaaauccccg

SEQ ID NO: 1008001 - RNA, 19 nt, Human
aggcagaggccaugccgug

SEQ ID NO: 1008002 - RNA, 22 nt, Human
aggcuguggcggaagugaucac

SEQ ID NO: 1008003 - RNA, 22 nt, Human
aggugcugaggugggaggagcu

SEQ ID NO: 1008004 - RNA, 18 nt, Human
augcagcaggugcugagg

SEQ ID NO: 1008005 - RNA, 18 nt, Human
caaaguguugggauugua

SEQ ID NO: 1008006 - RNA, 22 nt, Human
caaccacccagauacaucacuc

SEQ ID NO: 1008007 - RNA, 22 nt, Human
cacagaaccucauucuccuccc

SEQ ID NO: 1008008 - RNA, 23 nt, Human
cagccccaguugagccuuccuca

SEQ ID NO: 1008009 - RNA, 22 nt, Human
cagcuacagucacaguaaccaa

SEQ ID NO: 1008010 - RNA, 19 nt, Human
caggcaccagagcagucug

SEQ ID NO: 1008011 - RNA, 20 nt, Human
caggggccucuuuguugccc

SEQ ID NO: 1008012 - RNA, 19 nt, Human
caguaaccaagccaccagc

SEQ ID NO: 1008013 - RNA, 23 nt, Human
cauccugaggcuugggcugcucc

SEQ ID NO: 1008014 - RNA, 18 nt, Human
ccaaaguguugggauugu

SEQ ID NO: 1008015 - RNA, 23 nt, Human
ccaaaguguugggauuguaggcu

SEQ ID NO: 1008016 - RNA, 23 nt, Human
ccaaauccccgacugacacagac

SEQ ID NO: 1008017 - RNA, 19 nt, Human
ccccuuccucagccuccca

SEQ ID NO: 1008018 - RNA, 19 nt, Human
cccuucaaaacacagaacc

SEQ ID NO: 1008019 - RNA, 22 nt, Human
ccucagccucccaaaguguugg

SEQ ID NO: 1008020 - RNA, 23 nt, Human
ccugaggcuugggcugcuccaga

SEQ ID NO: 1008021 - RNA, 20 nt, Human
ccugguucaagugaugcccc

SEQ ID NO: 1008022 - RNA, 19 nt, Human
ccuugguucaccugcucug

SEQ ID NO: 1008023 - RNA, 21 nt, Human
cugacacagacugugagagag

SEQ ID NO: 1008024 - RNA, 20 nt, Human
cugugccacuccagcuacag

SEQ ID NO: 1008025 - RNA, 23 nt, Human
cuguucauuuuuguaucccuaau

SEQ ID NO: 1008026 - RNA, 24 nt, Human
gagacucugggccacaaccaccca

SEQ ID NO: 1008027 - RNA, 24 nt, Human
gagagacucugggccacaaccacc

SEQ ID NO: 1008028 - RNA, 21 nt, Human
gagcagguuucagugagguuu

SEQ ID NO: 1008029 - RNA, 18 nt, Human
gaggaugcucaagcagcu

SEQ ID NO: 1008030 - RNA, 21 nt, Human
gaugccccuuccucagccucc

SEQ ID NO: 1008031 - RNA, 20 nt, Human
gauuguaggcugagccacca

SEQ ID NO: 1008032 - RNA, 19 nt, Human
gcacgugggcugggccugg

SEQ ID NO: 1008033 - RNA, 24 nt, Human
ggccacaaccacccagauacauca

SEQ ID NO: 1008034 - RNA, 19 nt, Human
gggccucuuuguugcccag

SEQ ID NO: 1008035 - RNA, 21 nt, Human
ggguggcucauagaagcacug

SEQ ID NO: 1008036 - RNA, 22 nt, Human
gugcugaggugggaggagcuag

SEQ ID NO: 1008037 - RNA, 22 nt, Human
guugagccuuccucagacgaag

SEQ ID NO: 1008038 - RNA, 20 nt, Human
uauuuuuucauuuuuuuucu

SEQ ID NO: 1008039 - RNA, 19 nt, Human
ucaaaacacagaaccucau

SEQ ID NO: 1008040 - RNA, 22 nt, Human
ucaagcagcuucguguaggggc

SEQ ID NO: 1008041 - RNA, 22 nt, Human
uccaagcuguuuucagaaacau

SEQ ID NO: 1008042 - RNA, 24 nt, Human
ucccaaaguguugggauuguaggc

SEQ ID NO: 1008043 - RNA, 18 nt, Human
ucccuaaugugacaguuu

SEQ ID NO: 1008044 - RNA, 25 nt, Human
ucccucugcacgugggcugggccug

SEQ ID NO: 1008045 - RNA, 23 nt, Human
uccuagacuugcaacauucugga

SEQ ID NO: 1008046 - RNA, 24 nt, Human
ucugauauucuucccuucaaaaca

SEQ ID NO: 1008047 - RNA, 20 nt, Human
ucugcacgugggcugggccc

SEQ ID NO: 1008048 - RNA, 23 nt, Human
ucugcacgugggcugggccuggg

SEQ ID NO: 1008049 - RNA, 24 nt, Human
ucugcacgugggcugggccugggg

SEQ ID NO: 1008050 - RNA, 18 nt, Human
ucuuguccauccugaggc

SEQ ID NO: 1008051 - RNA, 20 nt, Human
ugaacacacugcagauacua

SEQ ID NO: 1008052 - RNA, 18 nt, Human
ugaggaugcucaagcagc

SEQ ID NO: 1008053 - RNA, 21 nt, Human
ugaggaugcucaagcagcuuc

SEQ ID NO: 1008054 - RNA, 21 nt, Human
ugagggcacuggcuuggaagu

SEQ ID NO: 1008055 - RNA, 23 nt, Human
ugaugucuuaacugcaaccucau

SEQ ID NO: 1008056 - RNA, 21 nt, Human
ugcagcaggugcugagguggg

SEQ ID NO: 1008057 - RNA, 24 nt, Human
ugcccagguuaguacugaacuccu

SEQ ID NO: 1008058 - RNA, 18 nt, Human
ugccccuuccucagccuc

SEQ ID NO: 1008059 - RNA, 26 nt, Human
ugcuccagaugcagcaggugcugguc

SEQ ID NO: 1008060 - RNA, 20 nt, Human
uggaaguggcuccagcccca

SEQ ID NO: 1008061 - RNA, 24 nt, Human
uggaaguggcuccagccccgaccc

SEQ ID NO: 1008062 - RNA, 20 nt, Human
ugggauuguaggcugagcca

SEQ ID NO: 1008063 - RNA, 23 nt, Human
ugggauuguaggcugagccacca

SEQ ID NO: 1008064 - RNA, 21 nt, Human
ugggcugcuccagaugcagca

SEQ ID NO: 1008065 - RNA, 21 nt, Human
ugggcugggccuggggggcuu

SEQ ID NO: 1008066 - RNA, 22 nt, Human
uguaucccuaaugugacaguuu

SEQ ID NO: 1008067 - RNA, 21 nt, Human
ugucagccauuggaacacucu

SEQ ID NO: 1008068 - RNA, 18 nt, Human
uguugcccagguuaguac

SEQ ID NO: 1008069 - RNA, 23 nt, Human
uucaagugaugccccuuccucag

SEQ ID NO: 1008070 - RNA, 20 nt, Human
uuccucagccucccaaagug

SEQ ID NO: 1008071 - RNA, 23 nt, Human
uuccucagccucccaaaguguug

SEQ ID NO: 1008072 - RNA, 24 nt, Human
uugggauuguaggcugagccacca

SEQ ID NO: 1008073 - RNA, 24 nt, Human
uuucuuuuuaucagagacaggggc

SEQ ID NO: 1008074 - RNA, 24 nt, Human
uuuguugcccagguuaguacugaa

SEQ ID NO: 1008075 - RNA, 23 nt, Human
uuuuucuuuuuaucagagacagg

SEQ ID NO: 1008076 - RNA, 27 nt, Human
uuuuuuuucuuuuuaucagagacaggg

SEQ ID NO: 1008077 - RNA, 25 nt, Human
uuuuuuuuuuuuuuuuuuucuuuuu

SEQ ID NO: 1008078 - RNA, 22 nt, Human
aaacaaaugguacauccaaaac

SEQ ID NO: 1008079 - RNA, 25 nt, Human
aaauaagaaacaaaugguacaucca

SEQ ID NO: 1008080 - RNA, 20 nt, Human
aagccaaacccaugagguca

SEQ ID NO: 1008081 - RNA, 26 nt, Human
agaaacaaaugguacauccaaaacca

SEQ ID NO: 1008082 - RNA, 22 nt, Human
agacuggggugaauuaagucca

SEQ ID NO: 1008083 - RNA, 24 nt, Human
cagcaacagcggcaccuaacccag

SEQ ID NO: 1008084 - RNA, 18 nt, Human
cagcggcaccuaacccag

SEQ ID NO: 1008085 - RNA, 26 nt, Human
caggaucaagaaggacuuguaagggu

SEQ ID NO: 1008086 - RNA, 24 nt, Human
cuaagccaaacccaugagguucau

SEQ ID NO: 1008087 - RNA, 21 nt, Human
guacauccaaaaccauaagga

SEQ ID NO: 1008088 - RNA, 25 nt, Human
ucaugugaacuuacaguuacacaaa

SEQ ID NO: 1008089 - RNA, 24 nt, Human
ugaugcccagaugaugaagacugg

SEQ ID NO: 1008090 - RNA, 21 nt, Human
uuacaguuacacaaauaagaa

SEQ ID NO: 1008091 - RNA, 22 nt, Human
aaaaacacugaaagaaaaaggc

SEQ ID NO: 1008092 - RNA, 24 nt, Human
aaaccaaacucaaacaacagcagc

SEQ ID NO: 1008093 - RNA, 22 nt, Human
accaaacucaaacaacagcagc

SEQ ID NO: 1008094 - RNA, 24 nt, Human
accaaacucaaacaacagcagcca

SEQ ID NO: 1008095 - RNA, 19 nt, Human
agaaaaacacugaaagaaa

SEQ ID NO: 1008096 - RNA, 18 nt, Human
aguguggaagaauggagc

SEQ ID NO: 1008097 - RNA, 19 nt, Human
cacugaaagaaaaaggcag

SEQ ID NO: 1008098 - RNA, 19 nt, Human
cacuuuuuccuccucuuuu

SEQ ID NO: 1008099 - RNA, 19 nt, Human
ccaaacucaaacaacagcc

SEQ ID NO: 1008100 - RNA, 19 nt, Human
ccacuuuuuccuccucuuu

SEQ ID NO: 1008101 - RNA, 19 nt, Human
ccuggauucagucccagaa

SEQ ID NO: 1008102 - RNA, 24 nt, Human
cuggauucagucccagaaauguua

SEQ ID NO: 1008103 - RNA, 20 nt, Human
cuuuuuccuccucuuuuucu

SEQ ID NO: 1008104 - RNA, 20 nt, Human
cuuuuucuucuucuuuuucu

SEQ ID NO: 1008105 - RNA, 22 nt, Human
gaaaaaggcaggaaauguagua

SEQ ID NO: 1008106 - RNA, 19 nt, Human
gaaagaaaaaggcaggaaa

SEQ ID NO: 1008107 - RNA, 20 nt, Human
gcacuagagccccuccaguu

SEQ ID NO: 1008108 - RNA, 21 nt, Human
gcacuagagccccuccaguua

SEQ ID NO: 1008109 - RNA, 18 nt, Human
uagaaaaacacugaaaga

SEQ ID NO: 1008110 - RNA, 20 nt, Human
uagaaaaacacugaaagaaa

SEQ ID NO: 1008111 - RNA, 22 nt, Human
ucaguuuugcuccaaaccaaac

SEQ ID NO: 1008112 - RNA, 18 nt, Human
uccacuuuuuccuccucu

SEQ ID NO: 1008113 - RNA, 21 nt, Human
uccacuuuuuccuccucuuuu

SEQ ID NO: 1008114 - RNA, 22 nt, Human
ucccagaaauguuaggacuacc

SEQ ID NO: 1008115 - RNA, 28 nt, Human
ucuuuuucuucuucuuuuucuucuuuuc

SEQ ID NO: 1008116 - RNA, 19 nt, Human
ucuuuuucuucuuucucuu

SEQ ID NO: 1008117 - RNA, 24 nt, Human
ugaaagaaaaaggcaggaaaugua

SEQ ID NO: 1008118 - RNA, 21 nt, Human
ugcagaggaaacuggcugagu

SEQ ID NO: 1008119 - RNA, 27 nt, Human
uguaauccacuuuuuccuccucuuuuu

SEQ ID NO: 1008120 - RNA, 19 nt, Human
uguggaagaauggagcugg

SEQ ID NO: 1008121 - RNA, 18 nt, Human
uuccuccucuuuuucuuc

SEQ ID NO: 1008122 - RNA, 24 nt, Human
uuugcuccaaaccaaacucaaaca

SEQ ID NO: 1008123 - RNA, 19 nt, Human
uuuuccuccucuuuuucuu

SEQ ID NO: 1008124 - RNA, 27 nt, Human
uuuuuccuccucuuuuucuucuucuuu

SEQ ID NO: 1008125 - RNA, 22 nt, Human
aaaacacaugggguggggauca

SEQ ID NO: 1008126 - RNA, 19 nt, Human
aaacagaacaaaaaaauau

SEQ ID NO: 1008127 - RNA, 23 nt, Human
aaauauauauauauauaauuuuu

SEQ ID NO: 1008128 - RNA, 23 nt, Human
aaugcagcaaauccuucugaaca

SEQ ID NO: 1008129 - RNA, 23 nt, Human
acacauggucacgaaggacaugc

SEQ ID NO: 1008130 - RNA, 21 nt, Human
acagcaaaaggcccaucagca

SEQ ID NO: 1008131 - RNA, 23 nt, Human
acagcaaaaggcccaucagcaag

SEQ ID NO: 1008132 - RNA, 19 nt, Human
acaucaaagucgaggacac

SEQ ID NO: 1008133 - RNA, 21 nt, Human
acggcauggaaaggggagaga

SEQ ID NO: 1008134 - RNA, 21 nt, Human
agaaucugaggagcacacugu

SEQ ID NO: 1008135 - RNA, 18 nt, Human
agacaggucccugcaaag

SEQ ID NO: 1008136 - RNA, 19 nt, Human
aggacagcaaaaggcccau

SEQ ID NO: 1008137 - RNA, 20 nt, Human
aggagaugugcauagaugag

SEQ ID NO: 1008138 - RNA, 21 nt, Human
aggugaggaaacaggcggcgg

SEQ ID NO: 1008139 - RNA, 22 nt, Human
auccugcccuucuucuccuuca

SEQ ID NO: 1008140 - RNA, 22 nt, Human
augcaaacagaacaaaaaaaua

SEQ ID NO: 1008141 - RNA, 22 nt, Human
auuaagaaaugcaaacagaaca

SEQ ID NO: 1008142 - RNA, 21 nt, Human
caacacagacgccaaucuugu

SEQ ID NO: 1008143 - RNA, 21 nt, Human
caagcacaaauuaagaaaugc

SEQ ID NO: 1008144 - RNA, 21 nt, Human
caaugguaaaaaaaaccccac

SEQ ID NO: 1008145 - RNA, 19 nt, Human
cacagugcggugagucucu

SEQ ID NO: 1008146 - RNA, 21 nt, Human
cacgaaggacaugcacagcca

SEQ ID NO: 1008147 - RNA, 19 nt, Human
cccgcaggagcccgccagg

SEQ ID NO: 1008148 - RNA, 18 nt, Human
ccuuuuuaaaacacaugg

SEQ ID NO: 1008149 - RNA, 20 nt, Human
cgcuggggaagauggggcag

SEQ ID NO: 1008150 - RNA, 20 nt, Human
cgcuggggaagauggggcag

SEQ ID NO: 1008151 - RNA, 24 nt, Human
cggagccccucaucuaaacgcucc

SEQ ID NO: 1008152 - RNA, 28 nt, Human
cggcauggaaaggggagagaaggugagg

SEQ ID NO: 1008153 - RNA, 22 nt, Human
cuccccagguccaacaauggua

SEQ ID NO: 1008154 - RNA, 21 nt, Human
cuccccccuccccagguccaa

SEQ ID NO: 1008155 - RNA, 23 nt, Human
cuccccccuccccagguccaaca

SEQ ID NO: 1008156 - RNA, 18 nt, Human
cugcaaaggcuacugccu

SEQ ID NO: 1008157 - RNA, 21 nt, Human
cuggggaagauggggcagcug

SEQ ID NO: 1008158 - RNA, 19 nt, Human
gacagacaggucccugcaa

SEQ ID NO: 1008159 - RNA, 19 nt, Human
gacaucaaagucgaggaca

SEQ ID NO: 1008160 - RNA, 26 nt, Human
gagugcucuuuauuugaaaccuccac

SEQ ID NO: 1008161 - RNA, 19 nt, Human
gcuggggaagauggggcag

SEQ ID NO: 1008162 - RNA, 21 nt, Human
ggacagacaggucccugcaaa

SEQ ID NO: 1008163 - RNA, 22 nt, Human
ggagccccucaucuaaacgcuc

SEQ ID NO: 1008164 - RNA, 18 nt, Human
ggcauggaaaggggagag

SEQ ID NO: 1008165 - RNA, 27 nt, Human
ggugaggaaacaggcggcggggagaga

SEQ ID NO: 1008166 - RNA, 22 nt, Human
guuuuugacaauuucuuucugg

SEQ ID NO: 1008167 - RNA, 20 nt, Human
uagcugugcacaucaacaca

SEQ ID NO: 1008168 - RNA, 23 nt, Human
uauauaauuuuuuccccuaucca

SEQ ID NO: 1008169 - RNA, 24 nt, Human
uauuugaaaccuccacaacacaga

SEQ ID NO: 1008170 - RNA, 21 nt, Human
ucccugcaaaggcuacugccu

SEQ ID NO: 1008171 - RNA, 21 nt, Human
ucccugcaaaggcuacugccu

SEQ ID NO: 1008172 - RNA, 21 nt, Human
uccuucugaacacagaaucug

SEQ ID NO: 1008173 - RNA, 20 nt, Human
ucucugcaaagcgaaggaac

SEQ ID NO: 1008174 - RNA, 22 nt, Human
ucucugcaaagcgaaggaacuu

SEQ ID NO: 1008175 - RNA, 18 nt, Human
ugaaaccuccacaacaca

SEQ ID NO: 1008176 - RNA, 19 nt, Human
ugaaaccuccacaacacag

SEQ ID NO: 1008177 - RNA, 21 nt, Human
ugacaucaaagucgaggacac

SEQ ID NO: 1008178 - RNA, 19 nt, Human
ugaggaaacaggcggcggg

SEQ ID NO: 1008179 - RNA, 21 nt, Human
ugcaaacagaacaaaaaaaua

SEQ ID NO: 1008180 - RNA, 23 nt, Human
ugccguaggaucugguuuaacac

SEQ ID NO: 1008181 - RNA, 25 nt, Human
ugccuuuuuaaaacacauggggugg

SEQ ID NO: 1008182 - RNA, 24 nt, Human
uguagucuaccaggacagcaaaag

SEQ ID NO: 1008183 - RNA, 23 nt, Human
uuaacuccccccuccccaggucc

SEQ ID NO: 1008184 - RNA, 25 nt, Human
uuauugguuuuugacaauuucuuuc

SEQ ID NO: 1008185 - RNA, 22 nt, Human
uuugacaauuucuuucugguuc

SEQ ID NO: 1008186 - RNA, 24 nt, Human
aagcgucuacaaugugccaggccc

SEQ ID NO: 1008187 - RNA, 22 nt, Human
agacagggcugcccacagcagc

SEQ ID NO: 1008188 - RNA, 23 nt, Human
agcacagccccacacgggugccc

SEQ ID NO: 1008189 - RNA, 19 nt, Human
aggggccagugacagagag

SEQ ID NO: 1008190 - RNA, 21 nt, Human
agugacagagagcagcuauac

SEQ ID NO: 1008191 - RNA, 18 nt, Human
caaagugcuguggggcac

SEQ ID NO: 1008192 - RNA, 18 nt, Human
caggacaacuuccccacc

SEQ ID NO: 1008193 - RNA, 18 nt, Human
cagggcugcccacagcag

SEQ ID NO: 1008194 - RNA, 18 nt, Human
ccacuggaggcccuuggg

SEQ ID NO: 1008195 - RNA, 22 nt, Human
ccaggcccuggggacacagagc

SEQ ID NO: 1008196 - RNA, 22 nt, Human
ccaggggccagugacagagagc

SEQ ID NO: 1008197 - RNA, 18 nt, Human
cccgccugggccugcagu

SEQ ID NO: 1008198 - RNA, 21 nt, Human
cgggagcaaggccuacuucug

SEQ ID NO: 1008199 - RNA, 20 nt, Human
cuccuacaccugaacugggu

SEQ ID NO: 1008200 - RNA, 21 nt, Human
cuccuacaccugaacuggguu

SEQ ID NO: 1008201 - RNA, 22 nt, Human
gcaccagagcacagccccacac

SEQ ID NO: 1008202 - RNA, 21 nt, Human
gcagagguauaacaaagugcu

SEQ ID NO: 1008203 - RNA, 23 nt, Human
gcuauacagagggcccaccccgc

SEQ ID NO: 1008204 - RNA, 18 nt, Human
gggcacucacaucuugaa

SEQ ID NO: 1008205 - RNA, 19 nt, Human
uaacaucucugagcugguc

SEQ ID NO: 1008206 - RNA, 22 nt, Human
uacuucugcuuccucaggacaa

SEQ ID NO: 1008207 - RNA, 21 nt, Human
ucccugcccucaaggagcuca

SEQ ID NO: 1008208 - RNA, 20 nt, Human
uccucaggacaacuucccca

SEQ ID NO: 1008209 - RNA, 22 nt, Human
uccucaggacaacuuccccacc

SEQ ID NO: 1008210 - RNA, 22 nt, Human
uccugggcaggggucagggaag

SEQ ID NO: 1008211 - RNA, 22 nt, Human
ucugcucgucuucucaugucga

SEQ ID NO: 1008212 - RNA, 18 nt, Human
ugaaguguguggcagagg

SEQ ID NO: 1008213 - RNA, 19 nt, Human
ugaaugcugguccacugga

SEQ ID NO: 1008214 - RNA, 22 nt, Human
ugacagagagcagcuauacaga

SEQ ID NO: 1008215 - RNA, 21 nt, Human
ugagacagaacaaacugcugc

SEQ ID NO: 1008216 - RNA, 19 nt, Human
ugccccaucagacagggcu

SEQ ID NO: 1008217 - RNA, 20 nt, Human
uggaggcccuuggguugggc

SEQ ID NO: 1008218 - RNA, 21 nt, Human
ugguaacaucucugagcuggu

SEQ ID NO: 1008219 - RNA, 25 nt, Human
uuccucaggacaacuuccccaccuc

SEQ ID NO: 1008220 - RNA, 22 nt, Human
uuuuuuuuuuuuuuuuucauuu

SEQ ID NO: 1008221 - RNA, 18 nt, Human
aggagggugguggggacg

SEQ ID NO: 1008222 - RNA, 18 nt, Human
aggcaggaggaggguggu

SEQ ID NO: 1008223 - RNA, 22 nt, Human
aggcaggaggaggguggugggg

SEQ ID NO: 1008224 - RNA, 20 nt, Human
aucuuuguauucaacagucc

SEQ ID NO: 1008225 - RNA, 18 nt, Human
cgggauggcucacugggc

SEQ ID NO: 1008226 - RNA, 20 nt, Human
gagggugguggggacgggau

SEQ ID NO: 1008227 - RNA, 22 nt, Human
ggaggagggugguggggacggg

SEQ ID NO: 1008228 - RNA, 20 nt, Human
gggucaggaggcaggaggag

SEQ ID NO: 1008229 - RNA, 18 nt, Human
gguggggacgggauggcu

SEQ ID NO: 1008230 - RNA, 24 nt, Human
ugcgggccuggccgggcggcgcgc

SEQ ID NO: 1008231 - RNA, 18 nt, Human
ugggucaggaggcaggag

SEQ ID NO: 1008232 - RNA, 25 nt, Human
ugggucaggaggcaggaggagggug

SEQ ID NO: 1008233 - RNA, 19 nt, Human
uuuuuuuuuuuuuuucuaa

SEQ ID NO: 1008234 - RNA, 19 nt, Human
uuuuuuuuuuuuuuuuucu

SEQ ID NO: 1008235 - RNA, 22 nt, Human
aaauuuacaaguguuguugcug

SEQ ID NO: 1008236 - RNA, 19 nt, Human
aaguguuguugcuggugca

SEQ ID NO: 1008237 - RNA, 22 nt, Human
agggacgcagcauuagagaaga

SEQ ID NO: 1008238 - RNA, 23 nt, Human
auggauuaaaaaauuucuuuuuu

SEQ ID NO: 1008239 - RNA, 23 nt, Human
auggcaauaaaguuacaaucacc

SEQ ID NO: 1008240 - RNA, 23 nt, Human
caagcaacagucuguuucaacca

SEQ ID NO: 1008241 - RNA, 21 nt, Human
cacacacagcgcacacagggu

SEQ ID NO: 1008242 - RNA, 22 nt, Human
cacgaaccccaaggcaucuccu

SEQ ID NO: 1008243 - RNA, 18 nt, Human
cagacagcagaauuaaac

SEQ ID NO: 1008244 - RNA, 24 nt, Human
cagcagaauuaaacagagcagacu

SEQ ID NO: 1008245 - RNA, 20 nt, Human
cagcauuauuucagaaauau

SEQ ID NO: 1008246 - RNA, 21 nt, Human
cauacacacucgcaucggccg

SEQ ID NO: 1008247 - RNA, 30 nt, Human
cauuuuuaucauuuaucaaaaacuaaaggg

SEQ ID NO: 1008248 - RNA, 21 nt, Human
ccccgccgccgccaucuucuc

SEQ ID NO: 1008249 - RNA, 23 nt, Human
cccgccgccgccaucuucucgcc

SEQ ID NO: 1008250 - RNA, 21 nt, Human
ccgccgccaucuucucgcccg

SEQ ID NO: 1008251 - RNA, 20 nt, Human
ccgccgccgccaucuucucg

SEQ ID NO: 1008252 - RNA, 22 nt, Human
ccgccgccgccaucuucucgcc

SEQ ID NO: 1008253 - RNA, 20 nt, Human
cgaaccccaaggcaucuccu

SEQ ID NO: 1008254 - RNA, 18 nt, Human
cgcacauacacacucgca

SEQ ID NO: 1008255 - RNA, 23 nt, Human
cuagcccauuuuugcaaagggag

SEQ ID NO: 1008256 - RNA, 24 nt, Human
cucuaaagagccacuaaagagagg

SEQ ID NO: 1008257 - RNA, 19 nt, Human
cugaaggagagaucuucau

SEQ ID NO: 1008258 - RNA, 21 nt, Human
cuucccccgccgccgccaucu

SEQ ID NO: 1008259 - RNA, 23 nt, Human
gcagacagcagaauuaaacagag

SEQ ID NO: 1008260 - RNA, 19 nt, Human
gcgacaacuuuauacuccu

SEQ ID NO: 1008261 - RNA, 20 nt, Human
ggcaauaaaguuacaaucac

SEQ ID NO: 1008262 - RNA, 23 nt, Human
gugguguccuacgaagcgggcac

SEQ ID NO: 1008263 - RNA, 23 nt, Human
guuucaaccaaaugauuuugauu

SEQ ID NO: 1008264 - RNA, 19 nt, Human
uaaacagagcagacugaag

SEQ ID NO: 1008265 - RNA, 23 nt, Human
uaaacagagcagacugaaggaga

SEQ ID NO: 1008266 - RNA, 22 nt, Human
uaaagagccacuaaagagaggc

SEQ ID NO: 1008267 - RNA, 20 nt, Human
uagggaagaaaagugugaug

SEQ ID NO: 1008268 - RNA, 18 nt, Human
uaucucaggaaucagcau

SEQ ID NO: 1008269 - RNA, 25 nt, Human
uauuugcccauuuuucauuaugugu

SEQ ID NO: 1008270 - RNA, 21 nt, Human
ucagcauuauuucagaaauau

SEQ ID NO: 1008271 - RNA, 22 nt, Human
ucccccgccgccgccaucuucu

SEQ ID NO: 1008272 - RNA, 23 nt, Human
ucccccgccgccgccaucuucuc

SEQ ID NO: 1008273 - RNA, 22 nt, Human
uccuccggcugcucacgcugcu

SEQ ID NO: 1008274 - RNA, 21 nt, Human
ucuucuuugauaacuggcuca

SEQ ID NO: 1008275 - RNA, 24 nt, Human
ugaaggagagaucuucauuauuug

SEQ ID NO: 1008276 - RNA, 21 nt, Human
ugagacuggggaucaaaucca

SEQ ID NO: 1008277 - RNA, 23 nt, Human
ugagacuggggaucaaauccacu

SEQ ID NO: 1008278 - RNA, 23 nt, Human
ugggcgcacacacagcgcacaca

SEQ ID NO: 1008279 - RNA, 18 nt, Human
uguguacacagaagcaug

SEQ ID NO: 1008280 - RNA, 19 nt, Human
uuaaaauuuuuccuguuag

SEQ ID NO: 1008281 - RNA, 24 nt, Human
uuacaaucacccaucuauguagac

SEQ ID NO: 1008282 - RNA, 18 nt, Human
aaaaaaaaaaaaaagaaa

SEQ ID NO: 1008283 - RNA, 19 nt, Human
aaaaaaaaaaagaaaaaaa

SEQ ID NO: 1008284 - RNA, 30 nt, Human
aaaaaaaaaaagaaaaaaaaaaccccaaaa

SEQ ID NO: 1008285 - RNA, 25 nt, Human
aaaaaagaaaaaaaaaaccccaaag

SEQ ID NO: 1008286 - RNA, 24 nt, Human
aaaaagaaaaaaaaaaccccaaag

SEQ ID NO: 1008287 - RNA, 23 nt, Human
aaaacagcagcaaacuuaaaagg

SEQ ID NO: 1008288 - RNA, 23 nt, Human
aaaagaaaaaaaaaaccccaaag

SEQ ID NO: 1008289 - RNA, 18 nt, Human
aaaauaaaugaccaacau

SEQ ID NO: 1008290 - RNA, 19 nt, Human
aacagugggacacaaagca

SEQ ID NO: 1008291 - RNA, 20 nt, Human
aaccagcuuuaauaucaaga

SEQ ID NO: 1008292 - RNA, 21 nt, Human
aaccuguuuccacaguggcag

SEQ ID NO: 1008293 - RNA, 23 nt, Human
aagcaaagccaugaucaacauac

SEQ ID NO: 1008294 - RNA, 25 nt, Human
aagcagcaaauaaaaauguuucaaa

SEQ ID NO: 1008295 - RNA, 20 nt, Human
agaaaaaaaaaaccccaaag

SEQ ID NO: 1008296 - RNA, 23 nt, Human
agagcucaaguugccaaauuacc

SEQ ID NO: 1008297 - RNA, 20 nt, Human
agccuaaugcacaugaacua

SEQ ID NO: 1008298 - RNA, 20 nt, Human
auaaaugaccaacauccaca

SEQ ID NO: 1008299 - RNA, 22 nt, Human
aucauuuccauagauaccacca

SEQ ID NO: 1008300 - RNA, 18 nt, Human
augaacuagauuauccaa

SEQ ID NO: 1008301 - RNA, 18 nt, Human
caaagaaaguuaacagac

SEQ ID NO: 1008302 - RNA, 23 nt, Human
caacauaccucauuuauccuggu

SEQ ID NO: 1008303 - RNA, 23 nt, Human
cacaaauuuaacauuugucauca

SEQ ID NO: 1008304 - RNA, 20 nt, Human
cacauugauacugcagcuaa

SEQ ID NO: 1008305 - RNA, 21 nt, Human
caccagcaggaaagugucucu

SEQ ID NO: 1008306 - RNA, 19 nt, Human
cacuucaaguacugcacaa

SEQ ID NO: 1008307 - RNA, 20 nt, Human
cagcaggaaagugucucuuu

SEQ ID NO: 1008308 - RNA, 24 nt, Human
ccacaaaaugggguagagaaaaac

SEQ ID NO: 1008309 - RNA, 18 nt, Human
cuauaucaaagggaaaaa

SEQ ID NO: 1008310 - RNA, 19 nt, Human
gagaaaaacagacagcaaa

SEQ ID NO: 1008311 - RNA, 21 nt, Human
gccgcaguauuuaugccacau

SEQ ID NO: 1008312 - RNA, 25 nt, Human
gggaaaaagcagcaaauaaaaaugu

SEQ ID NO: 1008313 - RNA, 21 nt, Human
uaaacucaagugaacucaagu

SEQ ID NO: 1008314 - RNA, 23 nt, Human
uaaagcaaaaaauguuuuugaau

SEQ ID NO: 1008315 - RNA, 22 nt, Human
uacagaauacuauuaugucugu

SEQ ID NO: 1008316 - RNA, 18 nt, Human
uagcuuguaaauacaaga

SEQ ID NO: 1008317 - RNA, 22 nt, Human
uauaaagcaaagccaugaucaa

SEQ ID NO: 1008318 - RNA, 23 nt, Human
uauccuggucaaaugcauuuuuu

SEQ ID NO: 1008319 - RNA, 21 nt, Human
uaugaaaucuagaaccuguuu

SEQ ID NO: 1008320 - RNA, 24 nt, Human
ucaaauguaaacucaagugaacuc

SEQ ID NO: 1008321 - RNA, 24 nt, Human
uccacaaauuuaacauuugucauc

SEQ ID NO: 1008322 - RNA, 19 nt, Human
uccacaguggcaguaaaau

SEQ ID NO: 1008323 - RNA, 24 nt, Human
ucccaauagcaguaaauaauacuu

SEQ ID NO: 1008324 - RNA, 19 nt, Human
ucgaagaaugcugccgcag

SEQ ID NO: 1008325 - RNA, 20 nt, Human
ucgaagaaugcugccgcagu

SEQ ID NO: 1008326 - RNA, 18 nt, Human
ugaaaaaaauuucucauc

SEQ ID NO: 1008327 - RNA, 24 nt, Human
ugaacuagauuauccaaaaacuaa

SEQ ID NO: 1008328 - RNA, 25 nt, Human
ugagaaaagcuguaaggcuauggug

SEQ ID NO: 1008329 - RNA, 20 nt, Human
ugauuugguuuuuuaauagg

SEQ ID NO: 1008330 - RNA, 21 nt, Human
ugccccagcauuuagguuuuc

SEQ ID NO: 1008331 - RNA, 25 nt, Human
uggaguaugaaaucuagaaccuguu

SEQ ID NO: 1008332 - RNA, 23 nt, Human
ugugaaaugugccccagcauuua

SEQ ID NO: 1008333 - RNA, 22 nt, Human
uuaaagguauuacaaagggaaa

SEQ ID NO: 1008334 - RNA, 18 nt, Human
uuaaaugcuaacauaaau

SEQ ID NO: 1008335 - RNA, 28 nt, Human
uuaacauuugucaucaacucacauccaa

SEQ ID NO: 1008336 - RNA, 27 nt, Human
uuacauuaaaaaaaaaaaaaagaaaaa

SEQ ID NO: 1008337 - RNA, 19 nt, Human
uucaucauuuccauagaua

SEQ ID NO: 1008338 - RNA, 20 nt, Human
uugaauaucugaagaauaga

SEQ ID NO: 1008339 - RNA, 22 nt, Human
uuuaccaaaaugugcacucaca

SEQ ID NO: 1008340 - RNA, 19 nt, Human
aaaaaccacuaugacaaua

SEQ ID NO: 1008341 - RNA, 22 nt, Human
aaagcaggaauaaaaaccacua

SEQ ID NO: 1008342 - RNA, 22 nt, Human
aagcaggaauaaaaaccacuau

SEQ ID NO: 1008343 - RNA, 25 nt, Human
aagcaggaauaaaaaccacuaugag

SEQ ID NO: 1008344 - RNA, 20 nt, Human
agccauuauaaaagccauaa

SEQ ID NO: 1008345 - RNA, 20 nt, Human
cauccccucaugggccuuug

SEQ ID NO: 1008346 - RNA, 22 nt, Human
ccacuaugacaauauaaaaccu

SEQ ID NO: 1008347 - RNA, 20 nt, Human
ggccuuugggcugggcagcc

SEQ ID NO: 1008348 - RNA, 18 nt, Human
gggcugggcagccagcuc

SEQ ID NO: 1008349 - RNA, 23 nt, Human
uauuuaauguuaagugaacauga

SEQ ID NO: 1008350 - RNA, 21 nt, Human
ucagccauuauaaaagccaua

SEQ ID NO: 1008351 - RNA, 25 nt, Human
ucuuuuuuuaucguuauuucagcca

SEQ ID NO: 1008352 - RNA, 22 nt, Human
ugggcagccagcuccgucuucc

SEQ ID NO: 1008353 - RNA, 25 nt, Human
uguacauuuuuagguauuuuucccu

SEQ ID NO: 1008354 - RNA, 22 nt, Human
uguguuuccagaaaaagugcuu

SEQ ID NO: 1008355 - RNA, 18 nt, Human
uuuccagaaacaaagcag

SEQ ID NO: 1008356 - RNA, 22 nt, Human
aaccuccccacccucucccacc

SEQ ID NO: 1008357 - RNA, 22 nt, Human
acaaccuccccacccucuccca

SEQ ID NO: 1008358 - RNA, 19 nt, Human
acccuaggauacucugccc

SEQ ID NO: 1008359 - RNA, 24 nt, Human
agccagauggauacacacccuagg

SEQ ID NO: 1008360 - RNA, 23 nt, Human
agccgagcgagaccgccgcagcc

SEQ ID NO: 1008361 - RNA, 18 nt, Human
caaaggcaggcauggccu

SEQ ID NO: 1008362 - RNA, 19 nt, Human
cacaaccuccccacccucu

SEQ ID NO: 1008363 - RNA, 20 nt, Human
cacaaccuccccacccucuc

SEQ ID NO: 1008364 - RNA, 23 nt, Human
cacccucucccaccagaugcaac

SEQ ID NO: 1008365 - RNA, 23 nt, Human
caggaugaauggacagacagcca

SEQ ID NO: 1008366 - RNA, 31 nt, Human
cccacaacaaaggcaggcauggccuggggcc

SEQ ID NO: 1008367 - RNA, 18 nt, Human
ccccacccucucccacca

SEQ ID NO: 1008368 - RNA, 19 nt, Human
ccccacccucucccaccag

SEQ ID NO: 1008369 - RNA, 20 nt, Human
ccccacccucucccaccaga

SEQ ID NO: 1008370 - RNA, 18 nt, Human
ccccacccucucccaccg

SEQ ID NO: 1008371 - RNA, 22 nt, Human
ccgagcgagaccgccgcagcca

SEQ ID NO: 1008372 - RNA, 22 nt, Human
ccggcgcgccccucccccgucc

SEQ ID NO: 1008373 - RNA, 21 nt, Human
ccugaggccaagggucagagc

SEQ ID NO: 1008374 - RNA, 20 nt, Human
ccuggcccagcuaucuuggc

SEQ ID NO: 1008375 - RNA, 22 nt, Human
cuccagcaaggaacggacagcc

SEQ ID NO: 1008376 - RNA, 22 nt, Human
cugcaggggccacaaccucccc

SEQ ID NO: 1008377 - RNA, 18 nt, Human
gagcagcaggaugaaugg

SEQ ID NO: 1008378 - RNA, 21 nt, Human
gagugccccggggucggcaac

SEQ ID NO: 1008379 - RNA, 19 nt, Human
gccaagggucagagcagcg

SEQ ID NO: 1008380 - RNA, 21 nt, Human
gcccaaagcccagagguguuc

SEQ ID NO: 1008381 - RNA, 20 nt, Human
gcccuggcaacccgcucucc

SEQ ID NO: 1008382 - RNA, 19 nt, Human
ggcaggcagguaggccagc

SEQ ID NO: 1008383 - RNA, 20 nt, Human
gggcaggcagguaggccagc

SEQ ID NO: 1008384 - RNA, 22 nt, Human
gggccaagccugaggccaaggg

SEQ ID NO: 1008385 - RNA, 24 nt, Human
guggccaaauucuccagcaaggaa

SEQ ID NO: 1008386 - RNA, 19 nt, Human
uaagcugaggcccaaagcc

SEQ ID NO: 1008387 - RNA, 21 nt, Human
ucacagcagcugccugcaggc

SEQ ID NO: 1008388 - RNA, 24 nt, Human
ucugguuuuauuaacacuuuuaag

SEQ ID NO: 1008389 - RNA, 23 nt, Human
ugaauagucugguuuuauuaaca

SEQ ID NO: 1008390 - RNA, 18 nt, Human
ugaauggacagacagcca

SEQ ID NO: 1008391 - RNA, 22 nt, Human
ugaauggacagacagccagaug

SEQ ID NO: 1008392 - RNA, 18 nt, Human
ugaggcccaaagcccaga

SEQ ID NO: 1008393 - RNA, 21 nt, Human
ugccccggggucggcaacagc

SEQ ID NO: 1008394 - RNA, 18 nt, Human
uggauacacacccuagga

SEQ ID NO: 1008395 - RNA, 19 nt, Human
uggcaacucuuuguggcca

SEQ ID NO: 1008396 - RNA, 18 nt, Human
uggccuggggcaggcagg

SEQ ID NO: 1008397 - RNA, 21 nt, Human
uuucuuccuggcccagcuauc

SEQ ID NO: 1008398 - RNA, 26 nt, Human
aaaccaaaaccagcguuuuccaaaga

SEQ ID NO: 1008399 - RNA, 19 nt, Human
aagggacguggcuccuggc

SEQ ID NO: 1008400 - RNA, 19 nt, Human
acucucucccaccuccgcc

SEQ ID NO: 1008401 - RNA, 21 nt, Human
agcugcgggugagucccggcu

SEQ ID NO: 1008402 - RNA, 21 nt, Human
auggagcugcgggugaguccc

SEQ ID NO: 1008403 - RNA, 19 nt, Human
caaaaccagcguuuuccaa

SEQ ID NO: 1008404 - RNA, 22 nt, Human
caaaugcaaacgccgagggcac

SEQ ID NO: 1008405 - RNA, 22 nt, Human
caagacacaguuguuucugaca

SEQ ID NO: 1008406 - RNA, 25 nt, Human
cauccacuccugcucggcagcuuca

SEQ ID NO: 1008407 - RNA, 19 nt, Human
ccacagcucaggaaagccc

SEQ ID NO: 1008408 - RNA, 19 nt, Human
ccaggcgaucuucccugcc

SEQ ID NO: 1008409 - RNA, 23 nt, Human
cccaagacacaguuguuucugac

SEQ ID NO: 1008410 - RNA, 23 nt, Human
cccccaagacacaguuguuucug

SEQ ID NO: 1008411 - RNA, 18 nt, Human
ccccucggaggcgcgggc

SEQ ID NO: 1008412 - RNA, 18 nt, Human
ccgggcacaagcauggag

SEQ ID NO: 1008413 - RNA, 21 nt, Human
ccuccgccgggggcccagaag

SEQ ID NO: 1008414 - RNA, 24 nt, Human
cgcgggcguccaggcggugaugcu

SEQ ID NO: 1008415 - RNA, 23 nt, Human
cggccucggcuccugccugacuc

SEQ ID NO: 1008416 - RNA, 19 nt, Human
cggcuccugccugacucuc

SEQ ID NO: 1008417 - RNA, 20 nt, Human
cuccagagggcgcugucccc

SEQ ID NO: 1008418 - RNA, 18 nt, Human
cuccccggccucggcucc

SEQ ID NO: 1008419 - RNA, 21 nt, Human
cucucccaccuccgccggggg

SEQ ID NO: 1008420 - RNA, 20 nt, Human
cucuuggcucauggcucugg

SEQ ID NO: 1008421 - RNA, 20 nt, Human
gaagggagaagggacguggc

SEQ ID NO: 1008422 - RNA, 18 nt, Human
gagcaccagcugacgaag

SEQ ID NO: 1008423 - RNA, 27 nt, Human
gagcugcgggugagucccggcuggcgc

SEQ ID NO: 1008424 - RNA, 24 nt, Human
gccacagcucaggaaagcccggcu

SEQ ID NO: 1008425 - RNA, 22 nt, Human
gcccagaagggaccuccccggg

SEQ ID NO: 1008426 - RNA, 18 nt, Human
gcucuggaccggcgagcc

SEQ ID NO: 1008427 - RNA, 19 nt, Human
ggagaagggacguggcucc

SEQ ID NO: 1008428 - RNA, 22 nt, Human
ggagcggggccaccacggggaa

SEQ ID NO: 1008429 - RNA, 25 nt, Human
ggagcugcgggugagucccggcugg

SEQ ID NO: 1008430 - RNA, 21 nt, Human
ggccacagcucaggaaagccc

SEQ ID NO: 1008431 - RNA, 21 nt, Human
ggggacugggagccucauggg

SEQ ID NO: 1008432 - RNA, 19 nt, Human
gucugaacacuuuaguuau

SEQ ID NO: 1008433 - RNA, 18 nt, Human
uccccggccucggcuccu

SEQ ID NO: 1008434 - RNA, 23 nt, Human
uccccggccucggcuccugccug

SEQ ID NO: 1008435 - RNA, 19 nt, Human
ucccggcuggcgcuggcgc

SEQ ID NO: 1008436 - RNA, 22 nt, Human
ucccggcuggcgcuggcgcggc

SEQ ID NO: 1008437 - RNA, 19 nt, Human
uccugccugacucucuccc

SEQ ID NO: 1008438 - RNA, 19 nt, Human
ucuguccccuggaguuagc

SEQ ID NO: 1008439 - RNA, 18 nt, Human
ucuucuuggaggauggac

SEQ ID NO: 1008440 - RNA, 18 nt, Human
ugaagagggcucuuggcu

SEQ ID NO: 1008441 - RNA, 23 nt, Human
ugagcaccagcugacgaagaggg

SEQ ID NO: 1008442 - RNA, 24 nt, Human
ugccugacucucucccaccuccgc

SEQ ID NO: 1008443 - RNA, 21 nt, Human
ugcuccagacccugaucaggc

SEQ ID NO: 1008444 - RNA, 18 nt, Human
ugggcuuuuuaaaaacca

SEQ ID NO: 1008445 - RNA, 21 nt, Human
uguuguuguuuuguuuuuguc

SEQ ID NO: 1008446 - RNA, 24 nt, Human
uguuguuguuuuguuuuugucuuu

SEQ ID NO: 1008447 - RNA, 18 nt, Human
uuggaggauggacgaguc

SEQ ID NO: 1008448 - RNA, 19 nt, Human
uuguuguuguuuuguuuuu

SEQ ID NO: 1008449 - RNA, 22 nt, Human
uuguuguuguuuuguuuuuguc

SEQ ID NO: 1008450 - RNA, 24 nt, Human
uuguuguuuuguuuuugucuuuuu

SEQ ID NO: 1008451 - RNA, 21 nt, Human
aaacaaagacgcaguagugug

SEQ ID NO: 1008452 - RNA, 18 nt, Human
aaacaucccccacuggca

SEQ ID NO: 1008453 - RNA, 20 nt, Human
aaauuacagccaauccaggg

SEQ ID NO: 1008454 - RNA, 19 nt, Human
aacacaaacuagacagcac

SEQ ID NO: 1008455 - RNA, 21 nt, Human
aaggcuggggccaaugccagg

SEQ ID NO: 1008456 - RNA, 19 nt, Human
acaaacuagacagcacaga

SEQ ID NO: 1008457 - RNA, 19 nt, Human
acaaagacugauagaaaca

SEQ ID NO: 1008458 - RNA, 23 nt, Human
acaaagacugauagaaacaaaga

SEQ ID NO: 1008459 - RNA, 24 nt, Human
accucgcccuggcgguuucuccag

SEQ ID NO: 1008460 - RNA, 22 nt, Human
acgaagcccacaggaagcggcc

SEQ ID NO: 1008461 - RNA, 24 nt, Human
acuggccagggcuucuggcugcgc

SEQ ID NO: 1008462 - RNA, 22 nt, Human
acuuuucugccucuuuacacgg

SEQ ID NO: 1008463 - RNA, 25 nt, Human
agaaauccaaccuccuccugguguu

SEQ ID NO: 1008464 - RNA, 20 nt, Human
agacagcacagacauggggc

SEQ ID NO: 1008465 - RNA, 18 nt, Human
agagccccuuccccaccc

SEQ ID NO: 1008466 - RNA, 23 nt, Human
agcaucagcucgggaagcugccu

SEQ ID NO: 1008467 - RNA, 23 nt, Human
aggacaaagacccaaauuaacgu

SEQ ID NO: 1008468 - RNA, 18 nt, Human
aggccucagggccucugc

SEQ ID NO: 1008469 - RNA, 18 nt, Human
aggccucuggcaaggagc

SEQ ID NO: 1008470 - RNA, 23 nt, Human
aggcuggggccaaugccagggga

SEQ ID NO: 1008471 - RNA, 21 nt, Human
agugcugagagcagcccggga

SEQ ID NO: 1008472 - RNA, 19 nt, Human
aguggaggccucuggcaag

SEQ ID NO: 1008473 - RNA, 20 nt, Human
augaagaugaacugcugaac

SEQ ID NO: 1008474 - RNA, 22 nt, Human
auggggcccgaucccagccugc

SEQ ID NO: 1008475 - RNA, 24 nt, Human
caccaccaccugcuucuacaaaga

SEQ ID NO: 1008476 - RNA, 18 nt, Human
caccaccugcuucuacaa

SEQ ID NO: 1008477 - RNA, 22 nt, Human
cagcagcccggccucucuucug

SEQ ID NO: 1008478 - RNA, 23 nt, Human
cagcagcccggccucucuucugg

SEQ ID NO: 1008479 - RNA, 22 nt, Human
cagcaggacgcgguguggggga

SEQ ID NO: 1008480 - RNA, 18 nt, Human
cagcccccacaucccucc

SEQ ID NO: 1008481 - RNA, 25 nt, Human
caggacaaagacccaaauuaacguc

SEQ ID NO: 1008482 - RNA, 20 nt, Human
caggagaagugcugagagca

SEQ ID NO: 1008483 - RNA, 19 nt, Human
caggcucagcagggaggga

SEQ ID NO: 1008484 - RNA, 18 nt, Human
cagugacuggcagaggca

SEQ ID NO: 1008485 - RNA, 22 nt, Human
cagugcagcgugcggccucugg

SEQ ID NO: 1008486 - RNA, 23 nt, Human
ccacgccccgucugcuuugaucc

SEQ ID NO: 1008487 - RNA, 21 nt, Human
ccagagccccuuccccaccca

SEQ ID NO: 1008488 - RNA, 19 nt, Human
ccaggccgcagccucuguc

SEQ ID NO: 1008489 - RNA, 19 nt, Human
cccuuccccacccacgccc

SEQ ID NO: 1008490 - RNA, 21 nt, Human
ccgaucccagccugcacagaa

SEQ ID NO: 1008491 - RNA, 21 nt, Human
ccucugggugacacgaagccc

SEQ ID NO: 1008492 - RNA, 21 nt, Human
ccugcacagcccccacauccc

SEQ ID NO: 1008493 - RNA, 19 nt, Human
ccugcuggaauuuccacca

SEQ ID NO: 1008494 - RNA, 21 nt, Human
cgaugacagugacuggcagag

SEQ ID NO: 1008495 - RNA, 24 nt, Human
cgcaccucgcccuggcgguuucuc

SEQ ID NO: 1008496 - RNA, 18 nt, Human
cggcccugagcagcuccc

SEQ ID NO: 1008497 - RNA, 18 nt, Human
cgggaagcugccuuugcc

SEQ ID NO: 1008498 - RNA, 18 nt, Human
cugcacccugcacagccc

SEQ ID NO: 1008499 - RNA, 18 nt, Human
cugcagcagcccggccuc

SEQ ID NO: 1008500 - RNA, 19 nt, Human
cugccaggacaaagaccca

SEQ ID NO: 1008501 - RNA, 19 nt, Human
cuggcccaggccgcagccu

SEQ ID NO: 1008502 - RNA, 20 nt, Human
cuggucccagagccccuucc

SEQ ID NO: 1008503 - RNA, 22 nt, Human
cuucggggcuccgggccaaucg

SEQ ID NO: 1008504 - RNA, 18 nt, Human
cuuugauccugaugaugg

SEQ ID NO: 1008505 - RNA, 20 nt, Human
gcacagcccccacaucccuc

SEQ ID NO: 1008506 - RNA, 23 nt, Human
gcagcucccuccgagucuucggg

SEQ ID NO: 1008507 - RNA, 24 nt, Human
gcccaggagaugcagaggugcggg

SEQ ID NO: 1008508 - RNA, 20 nt, Human
gccccuuccccacccacgcc

SEQ ID NO: 1008509 - RNA, 21 nt, Human
gcccggccucucuucugggca

SEQ ID NO: 1008510 - RNA, 23 nt, Human
gcccggccucucuucugggcaca

SEQ ID NO: 1008511 - RNA, 20 nt, Human
gccugggcucaccucugggu

SEQ ID NO: 1008512 - RNA, 18 nt, Human
gcugagagcagcccggga

SEQ ID NO: 1008513 - RNA, 18 nt, Human
gggccaaugccaggggaa

SEQ ID NO: 1008514 - RNA, 18 nt, Human
gggggcucagcaaauuuc

SEQ ID NO: 1008515 - RNA, 22 nt, Human
ggggggucuggucccagagccc

SEQ ID NO: 1008516 - RNA, 23 nt, Human
gggguggggcacauggggagacu

SEQ ID NO: 1008517 - RNA, 23 nt, Human
gucccagagccccuuccccaccc

SEQ ID NO: 1008518 - RNA, 21 nt, Human
gugcagcgugcggccucuggc

SEQ ID NO: 1008519 - RNA, 21 nt, Human
gugcagcgugcggccucuggc

SEQ ID NO: 1008520 - RNA, 23 nt, Human
guugacagcugacagcgacgggc

SEQ ID NO: 1008521 - RNA, 20 nt, Human
uagcaagaggacaguugugg

SEQ ID NO: 1008522 - RNA, 22 nt, Human
uagcaagaggacaguugugggg

SEQ ID NO: 1008523 - RNA, 21 nt, Human
ucacagagucuuggucguuuc

SEQ ID NO: 1008524 - RNA, 24 nt, Human
ucacuggccagggcuucuggcugc

SEQ ID NO: 1008525 - RNA, 19 nt, Human
ucagagccuuccuggugac

SEQ ID NO: 1008526 - RNA, 23 nt, Human
ucagcauccagaggcugcuuccc

SEQ ID NO: 1008527 - RNA, 24 nt, Human
ucccuccgagucuucggggcuccc

SEQ ID NO: 1008528 - RNA, 19 nt, Human
ucccugacucuggcccagg

SEQ ID NO: 1008529 - RNA, 25 nt, Human
uccgcgggguggggcacauggggag

SEQ ID NO: 1008530 - RNA, 21 nt, Human
ucgcacaguggagacgccgug

SEQ ID NO: 1008531 - RNA, 22 nt, Human
ucugcgggacccaccugcugga

SEQ ID NO: 1008532 - RNA, 19 nt, Human
ucuucggggcuccgggcca

SEQ ID NO: 1008533 - RNA, 22 nt, Human
ugacacgaagcccacaggaagc

SEQ ID NO: 1008534 - RNA, 21 nt, Human
ugacagcugacagcgacgggc

SEQ ID NO: 1008535 - RNA, 22 nt, Human
ugacagcugacagcgacgggcu

SEQ ID NO: 1008536 - RNA, 23 nt, Human
ugacagggguagcaucgggcucc

SEQ ID NO: 1008537 - RNA, 19 nt, Human
ugaguggaggccucuggca

SEQ ID NO: 1008538 - RNA, 19 nt, Human
ugauagaaacaaagacgca

SEQ ID NO: 1008539 - RNA, 18 nt, Human
ugcagcguuacugcaaac

SEQ ID NO: 1008540 - RNA, 20 nt, Human
ugccuuugccucaaauggcc

SEQ ID NO: 1008541 - RNA, 20 nt, Human
ugcugaacuucgaggcaaau

SEQ ID NO: 1008542 - RNA, 21 nt, Human
ugcugggaggaagggaaaguc

SEQ ID NO: 1008543 - RNA, 22 nt, Human
ugcuuugauccugaugaugguc

SEQ ID NO: 1008544 - RNA, 22 nt, Human
uggcucccuccacucagcaucc

SEQ ID NO: 1008545 - RNA, 22 nt, Human
uggugccuugcugugcucagug

SEQ ID NO: 1008546 - RNA, 22 nt, Human
uuccgcgggguggggcacaugg

SEQ ID NO: 1008547 - RNA, 23 nt, Human
uucuguguuuauucugacauuuu

SEQ ID NO: 1008548 - RNA, 23 nt, Human
agaacacagcgcggaggccggac

SEQ ID NO: 1008549 - RNA, 24 nt, Human
agcgcggcgugggggcugcucggc

SEQ ID NO: 1008550 - RNA, 21 nt, Human
aggccggacaaagauggggcu

SEQ ID NO: 1008551 - RNA, 21 nt, Human
caggcuggccaaggcccgggc

SEQ ID NO: 1008552 - RNA, 18 nt, Human
gagaacacagcgcggagg

SEQ ID NO: 1008553 - RNA, 20 nt, Human
gccgagaacacagcgcggag

SEQ ID NO: 1008554 - RNA, 24 nt, Human
ggccaggcuggccaaggcccgggc

SEQ ID NO: 1008555 - RNA, 21 nt, Human
ggccgcgcgcggggggcggcg

SEQ ID NO: 1008556 - RNA, 20 nt, Human
ggcugcucggcggcuggcca

SEQ ID NO: 1008557 - RNA, 18 nt, Human
gggcaaggcccggccgcg

SEQ ID NO: 1008558 - RNA, 22 nt, Human
gggcugcucggcggcuggccag

SEQ ID NO: 1008559 - RNA, 21 nt, Human
gggggcggcggcgagggaggc

SEQ ID NO: 1008560 - RNA, 18 nt, Human
ugccaaggcaggcaucgc

SEQ ID NO: 1008561 - RNA, 20 nt, Human
aaaacagggccgaaaaugug

SEQ ID NO: 1008562 - RNA, 18 nt, Human
aaacagcucccaaaccuu

SEQ ID NO: 1008563 - RNA, 20 nt, Human
aaacaucuucauccaaaaaa

SEQ ID NO: 1008564 - RNA, 18 nt, Human
aaaccuggcacuuccuaa

SEQ ID NO: 1008565 - RNA, 18 nt, Human
aagcagcuugcuuuuucu

SEQ ID NO: 1008566 - RNA, 23 nt, Human
aagucacagaauaacaaugaagu

SEQ ID NO: 1008567 - RNA, 20 nt, Human
aauuucuuuuguagcaucgu

SEQ ID NO: 1008568 - RNA, 19 nt, Human
acaagcaguguguaccaac

SEQ ID NO: 1008569 - RNA, 18 nt, Human
acaggcacuucagggcug

SEQ ID NO: 1008570 - RNA, 23 nt, Human
accuccagcaagucacagaauaa

SEQ ID NO: 1008571 - RNA, 19 nt, Human
accuggcacuuccuaaggc

SEQ ID NO: 1008572 - RNA, 24 nt, Human
accuggcacuuccuaaggcucccu

SEQ ID NO: 1008573 - RNA, 22 nt, Human
acuacaguuuauucaauauguc

SEQ ID NO: 1008574 - RNA, 19 nt, Human
agaaagcaguucuuuuaua

SEQ ID NO: 1008575 - RNA, 19 nt, Human
agaccacgcucccgggaca

SEQ ID NO: 1008576 - RNA, 18 nt, Human
agagguagcagaggaaaa

SEQ ID NO: 1008577 - RNA, 20 nt, Human
aggagaaacaaauucucaaa

SEQ ID NO: 1008578 - RNA, 23 nt, Human
aggaugccuucaacgggcagaau

SEQ ID NO: 1008579 - RNA, 25 nt, Human
aguaaaauuauaucuuaaagugcuu

SEQ ID NO: 1008580 - RNA, 18 nt, Human
agucugaugauacggcac

SEQ ID NO: 1008581 - RNA, 22 nt, Human
aguggcaauuucacuccugauu

SEQ ID NO: 1008582 - RNA, 21 nt, Human
auaagcaacaugaucugaagc

SEQ ID NO: 1008583 - RNA, 18 nt, Human
aucuccaggcucuuccaa

SEQ ID NO: 1008584 - RNA, 20 nt, Human
auuuuugauccugauccugg

SEQ ID NO: 1008585 - RNA, 22 nt, Human
caaucaagugguuaccagcaaa

SEQ ID NO: 1008586 - RNA, 19 nt, Human
cacaaugccacagcagcca

SEQ ID NO: 1008587 - RNA, 21 nt, Human
cacaaugccacagcagccaga

SEQ ID NO: 1008588 - RNA, 19 nt, Human
cacagaaacccucacugcc

SEQ ID NO: 1008589 - RNA, 22 nt, Human
cacugccaaacagcucccaaac

SEQ ID NO: 1008590 - RNA, 18 nt, Human
cagaaacccucacugcca

SEQ ID NO: 1008591 - RNA, 25 nt, Human
cagcaacaauauaagcaacaugauc

SEQ ID NO: 1008592 - RNA, 23 nt, Human
caguaaaaaugacaacucuucca

SEQ ID NO: 1008593 - RNA, 23 nt, Human
cauauacaaccaauaccaagggu

SEQ ID NO: 1008594 - RNA, 25 nt, Human
caucugaaauucuauacaaauaggg

SEQ ID NO: 1008595 - RNA, 23 nt, Human
ccaaccuccagcaagucacagaa

SEQ ID NO: 1008596 - RNA, 20 nt, Human
ccacaugcccacacaaugcc

SEQ ID NO: 1008597 - RNA, 20 nt, Human
ccagucugcuuguuccaagc

SEQ ID NO: 1008598 - RNA, 21 nt, Human
ccaucugaaauucuauacaaa

SEQ ID NO: 1008599 - RNA, 22 nt, Human
cccacacaaugccacagcagcc

SEQ ID NO: 1008600 - RNA, 23 nt, Human
cccacacaaugccacagcagcca

SEQ ID NO: 1008601 - RNA, 21 nt, Human
cccacauaucuaaaagcagcu

SEQ ID NO: 1008602 - RNA, 18 nt, Human
cccacauaucuaaaagcu

SEQ ID NO: 1008603 - RNA, 25 nt, Human
ccuguaacuaaaggcaaaacagggc

SEQ ID NO: 1008604 - RNA, 25 nt, Human
cguggugagaugcccgcugggaugc

SEQ ID NO: 1008605 - RNA, 23 nt, Human
cuaguggcuuaaaaaugcuuucc

SEQ ID NO: 1008606 - RNA, 20 nt, Human
cucccgggacagcugaucca

SEQ ID NO: 1008607 - RNA, 20 nt, Human
cuccugauuuugggcuccug

SEQ ID NO: 1008608 - RNA, 18 nt, Human
cugguauaaaugagugaa

SEQ ID NO: 1008609 - RNA, 19 nt, Human
cuguaguugucagugaccg

SEQ ID NO: 1008610 - RNA, 25 nt, Human
cuuaaaauauaaaaaccaaaggaau

SEQ ID NO: 1008611 - RNA, 21 nt, Human
cuucagggcuggcugcgccuc

SEQ ID NO: 1008612 - RNA, 19 nt, Human
gaaaaauaucuucaagagc

SEQ ID NO: 1008613 - RNA, 23 nt, Human
gaacacacagcauuauugaguua

SEQ ID NO: 1008614 - RNA, 21 nt, Human
gaaguauucacguacucaaaa

SEQ ID NO: 1008615 - RNA, 18 nt, Human
gaccauuggaaccgucug

SEQ ID NO: 1008616 - RNA, 27 nt, Human
gaggacuccaggagaagucguggugag

SEQ ID NO: 1008617 - RNA, 19 nt, Human
gcacagaaacccucacugc

SEQ ID NO: 1008618 - RNA, 21 nt, Human
gcacagaaacccucacugcca

SEQ ID NO: 1008619 - RNA, 23 nt, Human
gcagaaucggccaucuuaagauc

SEQ ID NO: 1008620 - RNA, 19 nt, Human
gccaaccuccagcaaguca

SEQ ID NO: 1008621 - RNA, 20 nt, Human
ggaagguggggcaggacagg

SEQ ID NO: 1008622 - RNA, 26 nt, Human
ggaguucucccacugccaaacagcuc

SEQ ID NO: 1008623 - RNA, 21 nt, Human
gggaagguggggcaggacagg

SEQ ID NO: 1008624 - RNA, 19 nt, Human
gucuccaagcauuaaaaag

SEQ ID NO: 1008625 - RNA, 18 nt, Human
uaacuaaaggcaaaacag

SEQ ID NO: 1008626 - RNA, 21 nt, Human
uaacuaugaaacucacaagca

SEQ ID NO: 1008627 - RNA, 19 nt, Human
uaauuauaucagaaaaaua

SEQ ID NO: 1008628 - RNA, 26 nt, Human
uacaauaacuaugaaacucacaagca

SEQ ID NO: 1008629 - RNA, 19 nt, Human
uagaaguggcaauuucacu

SEQ ID NO: 1008630 - RNA, 23 nt, Human
uagcaucguagagaaagcaacag

SEQ ID NO: 1008631 - RNA, 24 nt, Human
uauaaacaagauuuuauacacaag

SEQ ID NO: 1008632 - RNA, 21 nt, Human
ucaaauaaugcacccuguacu

SEQ ID NO: 1008633 - RNA, 18 nt, Human
ucaagugguuaccagcaa

SEQ ID NO: 1008634 - RNA, 24 nt, Human
ucacagaauaacaaugaagucuga

SEQ ID NO: 1008635 - RNA, 26 nt, Human
ucagaaaaauaucuucaagagcuuag

SEQ ID NO: 1008636 - RNA, 20 nt, Human
uccaaaaaauuggcaguaaa

SEQ ID NO: 1008637 - RNA, 24 nt, Human
ucccacugccaaacagcucccaaa

SEQ ID NO: 1008638 - RNA, 24 nt, Human
ucuaguggcuuaaaaaugcuuucc

SEQ ID NO: 1008639 - RNA, 22 nt, Human
ucuggagaacacagcauuuuca

SEQ ID NO: 1008640 - RNA, 21 nt, Human
ucuugacuccucucaggcugg

SEQ ID NO: 1008641 - RNA, 22 nt, Human
ugaaaaccuggcacuuccuaag

SEQ ID NO: 1008642 - RNA, 25 nt, Human
ugaaaaccuggcacuuccuaaggcu

SEQ ID NO: 1008643 - RNA, 20 nt, Human
ugacaaaggccacugccaac

SEQ ID NO: 1008644 - RNA, 19 nt, Human
ugacagcacagaaacccuc

SEQ ID NO: 1008645 - RNA, 19 nt, Human
ugacuguagcugucagcaa

SEQ ID NO: 1008646 - RNA, 18 nt, Human
ugagaugccaucugccug

SEQ ID NO: 1008647 - RNA, 19 nt, Human
ugagaugccaucugccugg

SEQ ID NO: 1008648 - RNA, 21 nt, Human
ugagaugccaucugccuggcc

SEQ ID NO: 1008649 - RNA, 25 nt, Human
ugagaugcccgcugggaugcuuguu

SEQ ID NO: 1008650 - RNA, 21 nt, Human
ugaugucaaauaaugcacccu

SEQ ID NO: 1008651 - RNA, 22 nt, Human
ugauuuugggcuccugagagug

SEQ ID NO: 1008652 - RNA, 24 nt, Human
ugccacacaugaaccaaauuuaga

SEQ ID NO: 1008653 - RNA, 19 nt, Human
ugcccacacaaugccacag

SEQ ID NO: 1008654 - RNA, 19 nt, Human
ugccuggccacaugcccac

SEQ ID NO: 1008655 - RNA, 19 nt, Human
uggcaguaaaaaugacaac

SEQ ID NO: 1008656 - RNA, 21 nt, Human
ugguauaaaugagugaauggu

SEQ ID NO: 1008657 - RNA, 19 nt, Human
ugugggcggagagaaggug

SEQ ID NO: 1008658 - RNA, 19 nt, Human
uguuuuaagcaaaagcaaa

SEQ ID NO: 1008659 - RNA, 18 nt, Human
uuaagguucuucccuagu

SEQ ID NO: 1008660 - RNA, 19 nt, Human
uuagcagggaagguggggc

SEQ ID NO: 1008661 - RNA, 25 nt, Human
uucccaguccaaucuccaggcucuu

SEQ ID NO: 1008662 - RNA, 22 nt, Human
uucuggagaacacagcauuuuc

SEQ ID NO: 1008663 - RNA, 23 nt, Human
uugcuguuuuuaaaaucuguuug

SEQ ID NO: 1008664 - RNA, 21 nt, Human
aaaauaggugguuaguaacau

SEQ ID NO: 1008665 - RNA, 21 nt, Human
aaacagcaucauauaauagca

SEQ ID NO: 1008666 - RNA, 18 nt, Human
aaaguuucaguguaguuu

SEQ ID NO: 1008667 - RNA, 19 nt, Human
aaaucuaaacccaaacaua

SEQ ID NO: 1008668 - RNA, 22 nt, Human
aauauauauauacaugugugua

SEQ ID NO: 1008669 - RNA, 20 nt, Human
aaucuuaauccccagacaaa

SEQ ID NO: 1008670 - RNA, 22 nt, Human
acaaacagcaucauauaauagc

SEQ ID NO: 1008671 - RNA, 18 nt, Human
acauuuaaaaaguaagau

SEQ ID NO: 1008672 - RNA, 22 nt, Human
acuauguucacaaaacaucauu

SEQ ID NO: 1008673 - RNA, 24 nt, Human
agaguuuauacaguguguucaggg

SEQ ID NO: 1008674 - RNA, 22 nt, Human
aggcgcgaaggcgauggcggca

SEQ ID NO: 1008675 - RNA, 19 nt, Human
aguguaguuugacuuaaaa

SEQ ID NO: 1008676 - RNA, 24 nt, Human
auacauguguguauguguauauau

SEQ ID NO: 1008677 - RNA, 24 nt, Human
auacugcaacaggaagguggcaaa

SEQ ID NO: 1008678 - RNA, 18 nt, Human
aucuuacuccuccaucca

SEQ ID NO: 1008679 - RNA, 24 nt, Human
auggcggcaggcgugcgcgggcac

SEQ ID NO: 1008680 - RNA, 20 nt, Human
auuaauaccuuuacaaacag

SEQ ID NO: 1008681 - RNA, 19 nt, Human
auuucaucuuacuccucca

SEQ ID NO: 1008682 - RNA, 19 nt, Human
cacgucuccacgcggcccg

SEQ ID NO: 1008683 - RNA, 24 nt, Human
caguagacaacuuaaaaucuaaac

SEQ ID NO: 1008684 - RNA, 19 nt, Human
cauggaaggauccagacug

SEQ ID NO: 1008685 - RNA, 20 nt, Human
cauuuugucuuuugcaguua

SEQ ID NO: 1008686 - RNA, 22 nt, Human
cccgcggcggcggcggcggcuu

SEQ ID NO: 1008687 - RNA, 18 nt, Human
ccgccgagcuccagggag

SEQ ID NO: 1008688 - RNA, 20 nt, Human
ccggcccuggcugccgcgcu

SEQ ID NO: 1008689 - RNA, 23 nt, Human
ccucgcgccuccgccggcccugg

SEQ ID NO: 1008690 - RNA, 18 nt, Human
cgccagccaggcgcgaag

SEQ ID NO: 1008691 - RNA, 19 nt, Human
cgcccccgccagccaggcg

SEQ ID NO: 1008692 - RNA, 19 nt, Human
cgccggcccuggcugccgc

SEQ ID NO: 1008693 - RNA, 20 nt, Human
cgccucagcgccgaucgucc

SEQ ID NO: 1008694 - RNA, 21 nt, Human
cgcggcggcggcggcggcggc

SEQ ID NO: 1008695 - RNA, 22 nt, Human
cgcgggcaggcggcgaaacgcc

SEQ ID NO: 1008696 - RNA, 19 nt, Human
cggcccgggccaugagcgg

SEQ ID NO: 1008697 - RNA, 21 nt, Human
cggcggcggcgguggcgcccg

SEQ ID NO: 1008698 - RNA, 22 nt, Human
cgggccaugagcgggcggagga

SEQ ID NO: 1008699 - RNA, 21 nt, Human
cguccgcggcggcccgggcca

SEQ ID NO: 1008700 - RNA, 21 nt, Human
cuaguauuacuaauacacuaa

SEQ ID NO: 1008701 - RNA, 21 nt, Human
cuccucgcgccuccgccggcc

SEQ ID NO: 1008702 - RNA, 23 nt, Human
cucgcgccuccgccggcccuggc

SEQ ID NO: 1008703 - RNA, 22 nt, Human
cuuuuucuuuuugaaaaggaau

SEQ ID NO: 1008704 - RNA, 18 nt, Human
gaaacgccgacugugagg

SEQ ID NO: 1008705 - RNA, 22 nt, Human
gagcgcgagccagucgggcggc

SEQ ID NO: 1008706 - RNA, 20 nt, Human
gagcgggcggaggacgccgg

SEQ ID NO: 1008707 - RNA, 24 nt, Human
gauggcggcaggcgugcgcgggca

SEQ ID NO: 1008708 - RNA, 18 nt, Human
gccggcccuggcugccgc

SEQ ID NO: 1008709 - RNA, 18 nt, Human
gcgcccccgccagccagg

SEQ ID NO: 1008710 - RNA, 19 nt, Human
gcgcgggcaccgcgggcag

SEQ ID NO: 1008711 - RNA, 19 nt, Human
gcggcccgggccaugagcg

SEQ ID NO: 1008712 - RNA, 19 nt, Human
gcggcggcggcggcggcgg

SEQ ID NO: 1008713 - RNA, 20 nt, Human
gcggcggcggcggcggcggc

SEQ ID NO: 1008714 - RNA, 20 nt, Human
gcggcggcggcggcggcggc

SEQ ID NO: 1008715 - RNA, 20 nt, Human
gcggcggcggcggcggcggc

SEQ ID NO: 1008716 - RNA, 23 nt, Human
gcggcggcggcggcggcggcggc

SEQ ID NO: 1008717 - RNA, 20 nt, Human
gcggcggcggcggcggcggu

SEQ ID NO: 1008718 - RNA, 23 nt, Human
gcggcggcggcggcggcgguggc

SEQ ID NO: 1008719 - RNA, 21 nt, Human
gcgggcaggcggcgaaacgcc

SEQ ID NO: 1008720 - RNA, 19 nt, Human
gcgucacgcguucgcacgu

SEQ ID NO: 1008721 - RNA, 19 nt, Human
ggaauaaaggcaguuaaga

SEQ ID NO: 1008722 - RNA, 20 nt, Human
ggcggcggcggcggcggcgg

SEQ ID NO: 1008723 - RNA, 20 nt, Human
ggcggcggcggcggcggcgg

SEQ ID NO: 1008724 - RNA, 23 nt, Human
ggcggcggcggcggcggcggcgg

SEQ ID NO: 1008725 - RNA, 19 nt, Human
ggcggcggcggcggcggug

SEQ ID NO: 1008726 - RNA, 21 nt, Human
gggccaugagcgggcggagga

SEQ ID NO: 1008727 - RNA, 18 nt, Human
gggcggaggacgccgggg

SEQ ID NO: 1008728 - RNA, 20 nt, Human
guauguguauauauguguau

SEQ ID NO: 1008729 - RNA, 20 nt, Human
gugcugaacacuuaaauggc

SEQ ID NO: 1008730 - RNA, 23 nt, Human
uaaaaaaaacaccacuuacuuga

SEQ ID NO: 1008731 - RNA, 23 nt, Human
uaaauaaaacuuuauucuuuauu

SEQ ID NO: 1008732 - RNA, 22 nt, Human
uaacaggacuggaaaaccaaug

SEQ ID NO: 1008733 - RNA, 26 nt, Human
uaacaggacuggaaaaccaaugcaga

SEQ ID NO: 1008734 - RNA, 20 nt, Human
uaauccccagacaaaauuca

SEQ ID NO: 1008735 - RNA, 18 nt, Human
uacaagcuaccaaauauu

SEQ ID NO: 1008736 - RNA, 23 nt, Human
uagacaacuuaaaaucuaaaccc

SEQ ID NO: 1008737 - RNA, 28 nt, Human
uagacaacuuaaaaucuaaacccaaaca

SEQ ID NO: 1008738 - RNA, 19 nt, Human
uagcagcaacaagcaaacc

SEQ ID NO: 1008739 - RNA, 23 nt, Human
uaguuugacuuaaaaaaaacacc

SEQ ID NO: 1008740 - RNA, 21 nt, Human
uauauauauacauguguguau

SEQ ID NO: 1008741 - RNA, 24 nt, Human
uauauauauacauguguguaugug

SEQ ID NO: 1008742 - RNA, 18 nt, Human
uauauauguguauauaua

SEQ ID NO: 1008743 - RNA, 26 nt, Human
uaucuaguauuacuaauacacuaaua

SEQ ID NO: 1008744 - RNA, 21 nt, Human
uaugaagaauauauauauaca

SEQ ID NO: 1008745 - RNA, 23 nt, Human
uaugaagaauauauauauacaug

SEQ ID NO: 1008746 - RNA, 18 nt, Human
uauguguauauauaaaua

SEQ ID NO: 1008747 - RNA, 19 nt, Human
uauguguauauauguguau

SEQ ID NO: 1008748 - RNA, 22 nt, Human
uauguguauauauguguauaua

SEQ ID NO: 1008749 - RNA, 22 nt, Human
uauguguauauauguguauaua

SEQ ID NO: 1008750 - RNA, 25 nt, Human
ucaaaaauaggugguuaguaacaug

SEQ ID NO: 1008751 - RNA, 18 nt, Human
uccagacugaauggaaag

SEQ ID NO: 1008752 - RNA, 21 nt, Human
uccucgcgccuccgccggccc

SEQ ID NO: 1008753 - RNA, 23 nt, Human
uccucgcgccuccgccggcccug

SEQ ID NO: 1008754 - RNA, 20 nt, Human
ugacaggaaggcaaggguua

SEQ ID NO: 1008755 - RNA, 21 nt, Human
ugagaaagaaaagauaaaagc

SEQ ID NO: 1008756 - RNA, 22 nt, Human
ugcgauuuucagcuuuauuguc

SEQ ID NO: 1008757 - RNA, 25 nt, Human
uggaaaaccaaugcagaaaucugcu

SEQ ID NO: 1008758 - RNA, 22 nt, Human
uggaaagcuguugagaaagaaa

SEQ ID NO: 1008759 - RNA, 23 nt, Human
uggaaggauccagacugaauggu

SEQ ID NO: 1008760 - RNA, 29 nt, Human
uguauauauguguauauauaaauaaugua

SEQ ID NO: 1008761 - RNA, 20 nt, Human
uguauauauguguauauauu

SEQ ID NO: 1008762 - RNA, 19 nt, Human
uguaucaaacauacacaua

SEQ ID NO: 1008763 - RNA, 18 nt, Human
uguguauauauguguaua

SEQ ID NO: 1008764 - RNA, 21 nt, Human
uguguauauauguguauauau

SEQ ID NO: 1008765 - RNA, 22 nt, Human
uguguauauauguguauauaua

SEQ ID NO: 1008766 - RNA, 21 nt, Human
uguguauguguauauaugugu

SEQ ID NO: 1008767 - RNA, 22 nt, Human
uguguauguguauauaugugua

SEQ ID NO: 1008768 - RNA, 26 nt, Human
uguguauguguauauauguguauaua

SEQ ID NO: 1008769 - RNA, 18 nt, Human
uguguguauguguauaua

SEQ ID NO: 1008770 - RNA, 19 nt, Human
uguguguauguguauauau

SEQ ID NO: 1008771 - RNA, 27 nt, Human
uguguguauguguauauaugugucaau

SEQ ID NO: 1008772 - RNA, 22 nt, Human
uuaaucuuaaacaguaguuuca

SEQ ID NO: 1008773 - RNA, 18 nt, Human
uuagagcagaauuaaaag

SEQ ID NO: 1008774 - RNA, 20 nt, Human
uuagagcagaauuaaaagau

SEQ ID NO: 1008775 - RNA, 23 nt, Human
uuaugaagaauauauauauacau

SEQ ID NO: 1008776 - RNA, 18 nt, Human
accuaauccuuuucccaa

SEQ ID NO: 1008777 - RNA, 29 nt, Human
agaggcaggcagccaggaacccccaaggg

SEQ ID NO: 1008778 - RNA, 19 nt, Human
aggcagccaggaaccagaa

SEQ ID NO: 1008779 - RNA, 22 nt, Human
aggcaggcagccaggaaccaga

SEQ ID NO: 1008780 - RNA, 18 nt, Human
caucugguucagguucuc

SEQ ID NO: 1008781 - RNA, 18 nt, Human
uaugugcccaccuaaucc

SEQ ID NO: 1008782 - RNA, 21 nt, Human
ucaauccuucuuuacacaugc

SEQ ID NO: 1008783 - RNA, 23 nt, Human
ucuucuauucugcugucaaaaau

SEQ ID NO: 1008784 - RNA, 23 nt, Human
ucuuuacacaugcagcaugguug

SEQ ID NO: 1008785 - RNA, 19 nt, Human
ugcaauuuuauuuucaauc

SEQ ID NO: 1008786 - RNA, 19 nt, Human
ugcagcaugguuggggucu

SEQ ID NO: 1008787 - RNA, 22 nt, Human
uguagguacaaggcauuucagg

SEQ ID NO: 1008788 - RNA, 20 nt, Human
uucccaaggugagcacuaug

SEQ ID NO: 1008789 - RNA, 26 nt, Human
uuucccaaggugagcacuaugacaac

SEQ ID NO: 1008790 - RNA, 23 nt, Human
aaauacaccaagauacuccacac

SEQ ID NO: 1008791 - RNA, 21 nt, Human
aagcaauccauaucaacagua

SEQ ID NO: 1008792 - RNA, 20 nt, Human
acaccaagauacuccacaca

SEQ ID NO: 1008793 - RNA, 21 nt, Human
agcacuagaaucuccaucuga

SEQ ID NO: 1008794 - RNA, 18 nt, Human
agggaaaauaugcauaug

SEQ ID NO: 1008795 - RNA, 18 nt, Human
aguagcaaaauacaccaa

SEQ ID NO: 1008796 - RNA, 21 nt, Human
aucugauugcuggcucacacc

SEQ ID NO: 1008797 - RNA, 20 nt, Human
caacaguagcaaaauacacc

SEQ ID NO: 1008798 - RNA, 21 nt, Human
caacaguagcaaaauacacca

SEQ ID NO: 1008799 - RNA, 23 nt, Human
caucaguuggucuagagagugac

SEQ ID NO: 1008800 - RNA, 24 nt, Human
ccuccuguuucugcaucaguuggu

SEQ ID NO: 1008801 - RNA, 23 nt, Human
cgucaaaacgugaagagcaccau

SEQ ID NO: 1008802 - RNA, 23 nt, Human
cugaguucugggaucuagguguc

SEQ ID NO: 1008803 - RNA, 23 nt, Human
cuggcucacaccuccuguuucug

SEQ ID NO: 1008804 - RNA, 19 nt, Human
gcaaggaugaagugaggcc

SEQ ID NO: 1008805 - RNA, 21 nt, Human
gcaaggaugaagugaggccga

SEQ ID NO: 1008806 - RNA, 19 nt, Human
guuaaaauagauauucccc

SEQ ID NO: 1008807 - RNA, 22 nt, Human
uaaaauagauauucccccaaaa

SEQ ID NO: 1008808 - RNA, 20 nt, Human
uaccaguguucuucaaacuu

SEQ ID NO: 1008809 - RNA, 21 nt, Human
uagagagugacccaagaauuu

SEQ ID NO: 1008810 - RNA, 18 nt, Human
ucauccugagauacuugu

SEQ ID NO: 1008811 - RNA, 23 nt, Human
uccacacauuaccaguguucuuc

SEQ ID NO: 1008812 - RNA, 20 nt, Human
ucccuagcuguugcuguugc

SEQ ID NO: 1008813 - RNA, 21 nt, Human
ugaagugaggccgagugaguc

SEQ ID NO: 1008814 - RNA, 20 nt, Human
ugauugcuggcucacaccuc

SEQ ID NO: 1008815 - RNA, 21 nt, Human
uugcuggcucacaccuccugu

SEQ ID NO: 1008816 - RNA, 23 nt, Human
uuguuccuucauucugagugaag

SEQ ID NO: 1008817 - RNA, 18 nt, Human
uuuauguaaccuaaagaa

SEQ ID NO: 1008818 - RNA, 23 nt, Human
aaauccuuccacaguggacacuu

SEQ ID NO: 1008819 - RNA, 23 nt, Human
aaucacuugagccuagaguucga

SEQ ID NO: 1008820 - RNA, 18 nt, Human
acugugugcugaacuuua

SEQ ID NO: 1008821 - RNA, 20 nt, Human
agacccaagggcuuuuguug

SEQ ID NO: 1008822 - RNA, 23 nt, Human
agccugggcaacauacaguacuc

SEQ ID NO: 1008823 - RNA, 20 nt, Human
agcucagguguggacacucc

SEQ ID NO: 1008824 - RNA, 18 nt, Human
aggcagaagaaucacuug

SEQ ID NO: 1008825 - RNA, 22 nt, Human
aggcagaagaaucacuugagcc

SEQ ID NO: 1008826 - RNA, 24 nt, Human
aggcagaagaaucacuugagccua

SEQ ID NO: 1008827 - RNA, 24 nt, Human
aggcugaggcagaagaaucacuug

SEQ ID NO: 1008828 - RNA, 21 nt, Human
agguguggacacuccauggcc

SEQ ID NO: 1008829 - RNA, 22 nt, Human
auaaacauuugaaggcgcugca

SEQ ID NO: 1008830 - RNA, 19 nt, Human
auggccacgaggagggcag

SEQ ID NO: 1008831 - RNA, 23 nt, Human
cacuccauggccacgaggagggc

SEQ ID NO: 1008832 - RNA, 18 nt, Human
cagcaaaacugcucaauc

SEQ ID NO: 1008833 - RNA, 24 nt, Human
cagcuacuugggaggcugaggcag

SEQ ID NO: 1008834 - RNA, 20 nt, Human
cagguuccccaaauccuucc

SEQ ID NO: 1008835 - RNA, 25 nt, Human
caguggacacuugaacaagucaaac

SEQ ID NO: 1008836 - RNA, 24 nt, Human
caucuguagucccagcuacuuggg

SEQ ID NO: 1008837 - RNA, 20 nt, Human
ccacgaggagggcagcuggg

SEQ ID NO: 1008838 - RNA, 20 nt, Human
ccuuccugcuguuuucccau

SEQ ID NO: 1008839 - RNA, 22 nt, Human
cgccuuccugcuguuuucccau

SEQ ID NO: 1008840 - RNA, 23 nt, Human
cuacuuuucuucuuuuuuaaaaa

SEQ ID NO: 1008841 - RNA, 20 nt, Human
cuguagucccagcuacuugg

SEQ ID NO: 1008842 - RNA, 21 nt, Human
cuguagucccagcuacuuggg

SEQ ID NO: 1008843 - RNA, 27 nt, Human
cuuccugcuguuuucccauuccuuaac

SEQ ID NO: 1008844 - RNA, 21 nt, Human
cuugagccuagaguucgaggc

SEQ ID NO: 1008845 - RNA, 22 nt, Human
gaaucacuugagccuagaguuc

SEQ ID NO: 1008846 - RNA, 21 nt, Human
gcagaagaaucacuugagccu

SEQ ID NO: 1008847 - RNA, 22 nt, Human
gcagcugggaggacugcggcuc

SEQ ID NO: 1008848 - RNA, 19 nt, Human
gcugaguccggagcaaugc

SEQ ID NO: 1008849 - RNA, 20 nt, Human
ggacacuugaacaagucaaa

SEQ ID NO: 1008850 - RNA, 19 nt, Human
gugugguggugauugcauc

SEQ ID NO: 1008851 - RNA, 23 nt, Human
uaucuugcuuuucugauuucuua

SEQ ID NO: 1008852 - RNA, 19 nt, Human
ucacuugagccuagaguuc

SEQ ID NO: 1008853 - RNA, 20 nt, Human
ugaggcagaagaaucacuug

SEQ ID NO: 1008854 - RNA, 24 nt, Human
ugaggcagaagaaucacuugagcc

SEQ ID NO: 1008855 - RNA, 24 nt, Human
ugaggcagaagaaucacuugagcc

SEQ ID NO: 1008856 - RNA, 21 nt, Human
uggcugaguccggagcaaugc

SEQ ID NO: 1008857 - RNA, 24 nt, Human
ugggaggcugaggcagaagaauca

SEQ ID NO: 1008858 - RNA, 26 nt, Human
ugguggugauugcaucuguaguccca

SEQ ID NO: 1008859 - RNA, 20 nt, Human
uguggacacuccauggccac

SEQ ID NO: 1008860 - RNA, 21 nt, Human
uuaaagguacuugugcaucuu

SEQ ID NO: 1008861 - RNA, 20 nt, Human
uucagguuccccaaauccuu

SEQ ID NO: 1008862 - RNA, 23 nt, Human
uugagccuagaguucgaggccag

SEQ ID NO: 1008863 - RNA, 25 nt, Human
uugggaggcugaggcagaagaauca

SEQ ID NO: 1008864 - RNA, 22 nt, Human
uuggggaacuuggcugaguccg

SEQ ID NO: 1008865 - RNA, 22 nt, Human
uuuaucuugcuuuucugauuuc

SEQ ID NO: 1008866 - RNA, 24 nt, Human
aaaaaagcaauccucugaguucua

SEQ ID NO: 1008867 - RNA, 22 nt, Human
aaaaaguuguuuugaaauaaau

SEQ ID NO: 1008868 - RNA, 24 nt, Human
aaaaggccauaacagugaaaagga

SEQ ID NO: 1008869 - RNA, 24 nt, Human
aaagaaaaaaagcaauccucugag

SEQ ID NO: 1008870 - RNA, 18 nt, Human
aaaugcccaucucccaag

SEQ ID NO: 1008871 - RNA, 20 nt, Human
aacagugaaaaggaaaaaaa

SEQ ID NO: 1008872 - RNA, 24 nt, Human
aaggaccacguguuaaacuaugua

SEQ ID NO: 1008873 - RNA, 25 nt, Human
aauucccguuuuaaaaaaauuaaag

SEQ ID NO: 1008874 - RNA, 20 nt, Human
acagcggacgacuucccaga

SEQ ID NO: 1008875 - RNA, 22 nt, Human
acuguccuagaauuccucuaaa

SEQ ID NO: 1008876 - RNA, 22 nt, Human
agaaaggacugaaguuaacuca

SEQ ID NO: 1008877 - RNA, 22 nt, Human
agaaaugugaaaaggccauaac

SEQ ID NO: 1008878 - RNA, 24 nt, Human
agagaacaggugcuagggcccaag

SEQ ID NO: 1008879 - RNA, 19 nt, Human
agcccaaagccaacagaaa

SEQ ID NO: 1008880 - RNA, 22 nt, Human
agcuugucuccgggguaaccag

SEQ ID NO: 1008881 - RNA, 22 nt, Human
auacagcccaaagccaacagaa

SEQ ID NO: 1008882 - RNA, 21 nt, Human
auaggcugaaagaaaaaaagc

SEQ ID NO: 1008883 - RNA, 19 nt, Human
cacaaauacagcccaaagc

SEQ ID NO: 1008884 - RNA, 19 nt, Human
cagcccaaagccaacagaa

SEQ ID NO: 1008885 - RNA, 19 nt, Human
ccaucucccaagaacucga

SEQ ID NO: 1008886 - RNA, 23 nt, Human
cccaaagccaacagaaaaauugc

SEQ ID NO: 1008887 - RNA, 23 nt, Human
ccucuaaauggccagcuauagcu

SEQ ID NO: 1008888 - RNA, 22 nt, Human
ccucuccgcggacagagcuugu

SEQ ID NO: 1008889 - RNA, 22 nt, Human
ccucugaguucuagguuucaca

SEQ ID NO: 1008890 - RNA, 24 nt, Human
ccuucucgccaaaugcccaucucc

SEQ ID NO: 1008891 - RNA, 18 nt, Human
ccuuuuaaaagauaacua

SEQ ID NO: 1008892 - RNA, 24 nt, Human
cgccagccuucucgccaaaugccc

SEQ ID NO: 1008893 - RNA, 23 nt, Human
cgggguaaccagcagcuggugga

SEQ ID NO: 1008894 - RNA, 19 nt, Human
ggacgacuucccagagaac

SEQ ID NO: 1008895 - RNA, 21 nt, Human
ggacggaagccagcccagcuc

SEQ ID NO: 1008896 - RNA, 20 nt, Human
guuguguugcugagccuuuu

SEQ ID NO: 1008897 - RNA, 24 nt, Human
uaaauauguacacauacauuccua

SEQ ID NO: 1008898 - RNA, 23 nt, Human
uaacucaaaauaggcugaaagaa

SEQ ID NO: 1008899 - RNA, 19 nt, Human
uaagaaaggacugaaguua

SEQ ID NO: 1008900 - RNA, 19 nt, Human
uaagaaaggacugaaguua

SEQ ID NO: 1008901 - RNA, 22 nt, Human
uaagugaugauuacugcaauac

SEQ ID NO: 1008902 - RNA, 19 nt, Human
uacagcccaaagccaacag

SEQ ID NO: 1008903 - RNA, 27 nt, Human
uagggcccaagacccgcacuccgaggg

SEQ ID NO: 1008904 - RNA, 23 nt, Human
uauguacaucgauuugaugugca

SEQ ID NO: 1008905 - RNA, 18 nt, Human
ucacaaaaggaccacgug

SEQ ID NO: 1008906 - RNA, 19 nt, Human
ucagcacugaccggaauua

SEQ ID NO: 1008907 - RNA, 20 nt, Human
ugaaagaaaaaaagcaaucc

SEQ ID NO: 1008908 - RNA, 24 nt, Human
ugaaauaaaugguaccuguaagug

SEQ ID NO: 1008909 - RNA, 23 nt, Human
ugaguucuagguuucacaaaagg

SEQ ID NO: 1008910 - RNA, 26 nt, Human
ugcuucuuuccuuuaggaguuguccc

SEQ ID NO: 1008911 - RNA, 20 nt, Human
ugcuuugcccugucauuucc

SEQ ID NO: 1008912 - RNA, 19 nt, Human
ugguggaaggaaaggcguu

SEQ ID NO: 1008913 - RNA, 22 nt, Human
uuaaaagauaacuaguuuauaa

SEQ ID NO: 1008914 - RNA, 25 nt, Human
uuaaaguuuccauuuuuuuuuuuag

SEQ ID NO: 1008915 - RNA, 20 nt, Human
uugucccacuccucuccgcg

SEQ ID NO: 1008916 - RNA, 22 nt, Human
uuucacaaaaggaccacguguu

SEQ ID NO: 1008917 - RNA, 22 nt, Human
aaaaacauccaucagaccaaaa

SEQ ID NO: 1008918 - RNA, 19 nt, Human
aaaacacagccaacucaac

SEQ ID NO: 1008919 - RNA, 23 nt, Human
aaaacauccaucagaccaaaaua

SEQ ID NO: 1008920 - RNA, 22 nt, Human
aaacaaauaaaacccgcaaaac

SEQ ID NO: 1008921 - RNA, 23 nt, Human
aaacauccaucagaccaaaauaa

SEQ ID NO: 1008922 - RNA, 19 nt, Human
aacacacaucucaugauaa

SEQ ID NO: 1008923 - RNA, 21 nt, Human
aagccauggcaccuggcucca

SEQ ID NO: 1008924 - RNA, 22 nt, Human
aagcucuugcugcuucuuuuug

SEQ ID NO: 1008925 - RNA, 23 nt, Human
aaugacucacaggguaccaggca

SEQ ID NO: 1008926 - RNA, 22 nt, Human
aauggagcuggccaugcacuuu

SEQ ID NO: 1008927 - RNA, 22 nt, Human
aauugguuccuagaacuuccau

SEQ ID NO: 1008928 - RNA, 18 nt, Human
aauuuuccuuuuaaaaaa

SEQ ID NO: 1008929 - RNA, 18 nt, Human
acagcucacugcaaccuc

SEQ ID NO: 1008930 - RNA, 21 nt, Human
acauccaucagaccaaaauaa

SEQ ID NO: 1008931 - RNA, 23 nt, Human
acaugugggaauguuuuguucuu

SEQ ID NO: 1008932 - RNA, 19 nt, Human
acccaaagagccaagagaa

SEQ ID NO: 1008933 - RNA, 23 nt, Human
acccaggcuggagugcaguggug

SEQ ID NO: 1008934 - RNA, 24 nt, Human
acccaggcuggagugcaguggugu

SEQ ID NO: 1008935 - RNA, 19 nt, Human
acccauggagauccuccuc

SEQ ID NO: 1008936 - RNA, 20 nt, Human
accugcacagaacucaggua

SEQ ID NO: 1008937 - RNA, 19 nt, Human
accuggcuccauccuccuu

SEQ ID NO: 1008938 - RNA, 18 nt, Human
acucugucacccaggcug

SEQ ID NO: 1008939 - RNA, 25 nt, Human
acucugucacccaggcuggagugca

SEQ ID NO: 1008940 - RNA, 24 nt, Human
acuuuauuuucagauugugagauu

SEQ ID NO: 1008941 - RNA, 18 nt, Human
agaaaacacagccaacuc

SEQ ID NO: 1008942 - RNA, 21 nt, Human
aggcagaaagaaggcccauga

SEQ ID NO: 1008943 - RNA, 21 nt, Human
aggcaucauugauagguggca

SEQ ID NO: 1008944 - RNA, 20 nt, Human
aggcaucauugauagguggg

SEQ ID NO: 1008945 - RNA, 23 nt, Human
agugcaguggugugaucacagcu

SEQ ID NO: 1008946 - RNA, 24 nt, Human
agugcaguggugugaucacagcuc

SEQ ID NO: 1008947 - RNA, 23 nt, Human
caaaagacacagccaugcccuuu

SEQ ID NO: 1008948 - RNA, 25 nt, Human
caaacuccugggcucaagugauccu

SEQ ID NO: 1008949 - RNA, 21 nt, Human
caaagaucaacuagcuuaaaa

SEQ ID NO: 1008950 - RNA, 19 nt, Human
caaauaaaacccgcaaaac

SEQ ID NO: 1008951 - RNA, 24 nt, Human
caaccucaaacuccugggcucaag

SEQ ID NO: 1008952 - RNA, 22 nt, Human
caagagcagagaaaacacagcc

SEQ ID NO: 1008953 - RNA, 20 nt, Human
caagugauccucccaccuca

SEQ ID NO: 1008954 - RNA, 23 nt, Human
caauaguacauaguaccaggucc

SEQ ID NO: 1008955 - RNA, 25 nt, Human
caccaucuguggucaggcucagaac

SEQ ID NO: 1008956 - RNA, 21 nt, Human
cacccaggcuggagugcagug

SEQ ID NO: 1008957 - RNA, 23 nt, Human
cacucugucacccaggcuggagu

SEQ ID NO: 1008958 - RNA, 24 nt, Human
cacucugucacccaggcuggagug

SEQ ID NO: 1008959 - RNA, 21 nt, Human
cacugcaaccucaaacuccug

SEQ ID NO: 1008960 - RNA, 23 nt, Human
cacugcaaccucaaacuccuggg

SEQ ID NO: 1008961 - RNA, 21 nt, Human
cacugcugaaaagaaaugccu

SEQ ID NO: 1008962 - RNA, 25 nt, Human
caggacaaaggauauuuccuccucu

SEQ ID NO: 1008963 - RNA, 22 nt, Human
cauuuuaauuaacuccuuccug

SEQ ID NO: 1008964 - RNA, 20 nt, Human
ccaaagagccaagagaaaac

SEQ ID NO: 1008965 - RNA, 20 nt, Human
ccacaugaccuucagauuua

SEQ ID NO: 1008966 - RNA, 21 nt, Human
ccaggcagcaguucuuguacu

SEQ ID NO: 1008967 - RNA, 23 nt, Human
ccaggcuguggauugguugggga

SEQ ID NO: 1008968 - RNA, 21 nt, Human
ccauggagauccuccuccuuc

SEQ ID NO: 1008969 - RNA, 18 nt, Human
ccauggcaccuggcucca

SEQ ID NO: 1008970 - RNA, 18 nt, Human
cccaaagagccaagagaa

SEQ ID NO: 1008971 - RNA, 21 nt, Human
cccacagccugcccgugccuu

SEQ ID NO: 1008972 - RNA, 24 nt, Human
cccagauaaacuugcaguaagagg

SEQ ID NO: 1008973 - RNA, 23 nt, Human
cccauaagaaaugggacucuacc

SEQ ID NO: 1008974 - RNA, 19 nt, Human
cccaugcggguagaaacca

SEQ ID NO: 1008975 - RNA, 19 nt, Human
ccccgccuucccuggacuc

SEQ ID NO: 1008976 - RNA, 24 nt, Human
cccgcaaaaccgggcaucucccag

SEQ ID NO: 1008977 - RNA, 22 nt, Human
cccuggacuccugugggcugca

SEQ ID NO: 1008978 - RNA, 21 nt, Human
ccgccgcgaggaggagagccc

SEQ ID NO: 1008979 - RNA, 28 nt, Human
ccucccaccucagccucggauuauaggc

SEQ ID NO: 1008980 - RNA, 23 nt, Human
ccucugaggcagaaagaaggccc

SEQ ID NO: 1008981 - RNA, 22 nt, Human
ccugggcucaagugauccuccc

SEQ ID NO: 1008982 - RNA, 21 nt, Human
ccuuuaaaaaaaaaaaauuaa

SEQ ID NO: 1008983 - RNA, 25 nt, Human
cgcaaaaccgggcaucucccaauga

SEQ ID NO: 1008984 - RNA, 19 nt, Human
cggauuauaggcucaagcc

SEQ ID NO: 1008985 - RNA, 21 nt, Human
cgggaaagacccaaagagcca

SEQ ID NO: 1008986 - RNA, 22 nt, Human
cgggaaagacccaaagagccaa

SEQ ID NO: 1008987 - RNA, 24 nt, Human
cucaagugauccucccaccucagc

SEQ ID NO: 1008988 - RNA, 24 nt, Human
cucacucugucacccaggcuggag

SEQ ID NO: 1008989 - RNA, 21 nt, Human
cucacugcaaccucaaacucc

SEQ ID NO: 1008990 - RNA, 24 nt, Human
cucacugcaaccucaaacuccugg

SEQ ID NO: 1008991 - RNA, 18 nt, Human
cucccaacucacacauuu

SEQ ID NO: 1008992 - RNA, 22 nt, Human
cucccaacucacacauuugcua

SEQ ID NO: 1008993 - RNA, 21 nt, Human
cucccacagccugcccgugcc

SEQ ID NO: 1008994 - RNA, 22 nt, Human
cuccgcugccucccacagccug

SEQ ID NO: 1008995 - RNA, 23 nt, Human
cuccugggcucaagugauccucc

SEQ ID NO: 1008996 - RNA, 25 nt, Human
cuccugggcucaagugauccuccca

SEQ ID NO: 1008997 - RNA, 20 nt, Human
cucggauuauaggcucaagc

SEQ ID NO: 1008998 - RNA, 21 nt, Human
cugaaccucggcuucuuagcc

SEQ ID NO: 1008999 - RNA, 21 nt, Human
cugaugccacaugaccuucag

SEQ ID NO: 1009000 - RNA, 23 nt, Human
cugcaaccucaaacuccugggcu

SEQ ID NO: 1009001 - RNA, 19 nt, Human
cugcacagaacucaggacc

SEQ ID NO: 1009002 - RNA, 24 nt, Human
cugcagccuucuuaacacacaucu

SEQ ID NO: 1009003 - RNA, 20 nt, Human
cugccucccacagccugccc

SEQ ID NO: 1009004 - RNA, 21 nt, Human
cuuaggacagugagacugccc

SEQ ID NO: 1009005 - RNA, 23 nt, Human
cuuccugcugccaccacugaacc

SEQ ID NO: 1009006 - RNA, 22 nt, Human
gaaaauauuucagaacucaaag

SEQ ID NO: 1009007 - RNA, 21 nt, Human
gagaagauguuucauauuggg

SEQ ID NO: 1009008 - RNA, 21 nt, Human
gaguucucaggagcacacagg

SEQ ID NO: 1009009 - RNA, 24 nt, Human
gcugcagccuucuuaacacacauc

SEQ ID NO: 1009010 - RNA, 22 nt, Human
ggaaagaagacauaccuuagga

SEQ ID NO: 1009011 - RNA, 20 nt, Human
ggcagaacucuacccaugcg

SEQ ID NO: 1009012 - RNA, 22 nt, Human
ggcuggagugcaguggugugau

SEQ ID NO: 1009013 - RNA, 21 nt, Human
gggcucaagugauccucccac

SEQ ID NO: 1009014 - RNA, 22 nt, Human
gggcucaagugauccucccacc

SEQ ID NO: 1009015 - RNA, 22 nt, Human
guacuccaggcuguggauuggu

SEQ ID NO: 1009016 - RNA, 19 nt, Human
guguacccgggaaagaccc

SEQ ID NO: 1009017 - RNA, 21 nt, Human
uaaaaaacauccaucagacca

SEQ ID NO: 1009018 - RNA, 20 nt, Human
uaaauaagacagucaaagau

SEQ ID NO: 1009019 - RNA, 20 nt, Human
uaaguuaauguuucaguucc

SEQ ID NO: 1009020 - RNA, 24 nt, Human
uaauugagacagagucucacucug

SEQ ID NO: 1009021 - RNA, 21 nt, Human
uacuuccccaaacaaagaacu

SEQ ID NO: 1009022 - RNA, 19 nt, Human
uagaggcaacacagucaca

SEQ ID NO: 1009023 - RNA, 24 nt, Human
uagcuguucuccagguugcuucug

SEQ ID NO: 1009024 - RNA, 20 nt, Human
uagcuuguguaaagucagag

SEQ ID NO: 1009025 - RNA, 22 nt, Human
uaggacccaacuuggccagggg

SEQ ID NO: 1009026 - RNA, 24 nt, Human
uaugaaaaguauaaaauguguagc

SEQ ID NO: 1009027 - RNA, 22 nt, Human
ucacccaggcuggagugcagug

SEQ ID NO: 1009028 - RNA, 24 nt, Human
ucacucugucacccaggcuggagu

SEQ ID NO: 1009029 - RNA, 24 nt, Human
ucacugcaaccucaaacuccuggg

SEQ ID NO: 1009030 - RNA, 19 nt, Human
ucagagauaauuacacugc

SEQ ID NO: 1009031 - RNA, 23 nt, Human
ucagagucuuauuuacuauuaac

SEQ ID NO: 1009032 - RNA, 18 nt, Human
uccaccugcacagaacuc

SEQ ID NO: 1009033 - RNA, 20 nt, Human
uccaucagaccaaaauaaaa

SEQ ID NO: 1009034 - RNA, 20 nt, Human
ucccacagccugcccgugcc

SEQ ID NO: 1009035 - RNA, 23 nt, Human
ucccccuuuucccaugauauggg

SEQ ID NO: 1009036 - RNA, 21 nt, Human
uccccgccuucccuggacucc

SEQ ID NO: 1009037 - RNA, 21 nt, Human
uccugggcucaagugauccuc

SEQ ID NO: 1009038 - RNA, 22 nt, Human
uccugugggcugcagccuucuu

SEQ ID NO: 1009039 - RNA, 18 nt, Human
uccuuacacagcaaacaa

SEQ ID NO: 1009040 - RNA, 23 nt, Human
ucucaaguaagaguucucaggag

SEQ ID NO: 1009041 - RNA, 22 nt, Human
ucucacucugucacccaggcug

SEQ ID NO: 1009042 - RNA, 23 nt, Human
ucucacucugucacccaggcugg

SEQ ID NO: 1009043 - RNA, 24 nt, Human
ucucacucugucacccaggcugga

SEQ ID NO: 1009044 - RNA, 26 nt, Human
ucucacucugucacccaggcuggagu

SEQ ID NO: 1009045 - RNA, 27 nt, Human
ucucacucugucacccaggcuggagug

SEQ ID NO: 1009046 - RNA, 24 nt, Human
ucugucacccaggcuggagugcag

SEQ ID NO: 1009047 - RNA, 28 nt, Human
ucuguggucaggcucagaaccggggucc

SEQ ID NO: 1009048 - RNA, 21 nt, Human
ugaaaagaaaugccuuugaac

SEQ ID NO: 1009049 - RNA, 23 nt, Human
ugaaaagaaaugccuuugaacac

SEQ ID NO: 1009050 - RNA, 23 nt, Human
ugaaauagacaaaauuuguggca

SEQ ID NO: 1009051 - RNA, 19 nt, Human
ugaaauauacaagucugga

SEQ ID NO: 1009052 - RNA, 19 nt, Human
ugaacaggacaaaggauau

SEQ ID NO: 1009053 - RNA, 21 nt, Human
ugaauguuuuugaacgaccaa

SEQ ID NO: 1009054 - RNA, 22 nt, Human
ugagacagagucucacucuguc

SEQ ID NO: 1009055 - RNA, 22 nt, Human
ugauauggggugggggaaagcu

SEQ ID NO: 1009056 - RNA, 24 nt, Human
ugauauggggugggggaaagcuga

SEQ ID NO: 1009057 - RNA, 18 nt, Human
ugaucacugcugaaaaga

SEQ ID NO: 1009058 - RNA, 19 nt, Human
ugccaggaaaaggucaccc

SEQ ID NO: 1009059 - RNA, 22 nt, Human
uggaaagaagacauaccuuagg

SEQ ID NO: 1009060 - RNA, 19 nt, Human
uggagugcaguggugugau

SEQ ID NO: 1009061 - RNA, 19 nt, Human
uggagugcaguggugugau

SEQ ID NO: 1009062 - RNA, 21 nt, Human
uggagugcaguggugugauca

SEQ ID NO: 1009063 - RNA, 28 nt, Human
uggagugcaguggugugauggcucuagc

SEQ ID NO: 1009064 - RNA, 20 nt, Human
uggcaggggaggggcagugg

SEQ ID NO: 1009065 - RNA, 24 nt, Human
ugggcucaagugauccucccaccu

SEQ ID NO: 1009066 - RNA, 24 nt, Human
uggugugaucacagcucacugcaa

SEQ ID NO: 1009067 - RNA, 27 nt, Human
ugucuuaccuucucuuagauccuucca

SEQ ID NO: 1009068 - RNA, 23 nt, Human
uguguuugauagauuacacacca

SEQ ID NO: 1009069 - RNA, 24 nt, Human
uguguuugauagauuacacaccau

SEQ ID NO: 1009070 - RNA, 21 nt, Human
uguucuuuuuaaugcacccaa

SEQ ID NO: 1009071 - RNA, 21 nt, Human
uucagaacucaaagcaacaga

SEQ ID NO: 1009072 - RNA, 23 nt, Human
uuccagaggagauacccuggucu

SEQ ID NO: 1009073 - RNA, 20 nt, Human
uuccaucaacgucaaacacc

SEQ ID NO: 1009074 - RNA, 24 nt, Human
uucuuaacacacaucucaugauaa

SEQ ID NO: 1009075 - RNA, 20 nt, Human
uugguuccuagaacuuccau

SEQ ID NO: 1009076 - RNA, 22 nt, Human
uuuugugaaguuauaaugauua

SEQ ID NO: 1009077 - RNA, 20 nt, Human
aaggugcugggauuacaggc

SEQ ID NO: 1009078 - RNA, 24 nt, Human
aaggugcugggauuacaggcguga

SEQ ID NO: 1009079 - RNA, 18 nt, Human
acaggguuucaccauguu

SEQ ID NO: 1009080 - RNA, 23 nt, Human
acaggguuucaccauguuggcca

SEQ ID NO: 1009081 - RNA, 24 nt, Human
acaggguuucaccauguuggccag

SEQ ID NO: 1009082 - RNA, 22 nt, Human
agagguucaaagagggaaaaug

SEQ ID NO: 1009083 - RNA, 20 nt, Human
agccaccgcacccagccuug

SEQ ID NO: 1009084 - RNA, 26 nt, Human
aggugcugggauuacaggcgugagcc

SEQ ID NO: 1009085 - RNA, 27 nt, Human
aguuuuguauuuguuuuaguagagaca

SEQ ID NO: 1009086 - RNA, 24 nt, Human
augaucugcccgccucagccuccc

SEQ ID NO: 1009087 - RNA, 24 nt, Human
caaggugcugggauuacaggcgug

SEQ ID NO: 1009088 - RNA, 18 nt, Human
caccauguuggccagggu

SEQ ID NO: 1009089 - RNA, 22 nt, Human
caccauguuggccagggugguc

SEQ ID NO: 1009090 - RNA, 23 nt, Human
caccauguuggccaggguggucu

SEQ ID NO: 1009091 - RNA, 24 nt, Human
caccauguuggccaggguggucuu

SEQ ID NO: 1009092 - RNA, 24 nt, Human
caggguuucaccauguuggccagg

SEQ ID NO: 1009093 - RNA, 22 nt, Human
ccaaggugcugggauuacaggc

SEQ ID NO: 1009094 - RNA, 22 nt, Human
ccaaggugcugggauuacaggc

SEQ ID NO: 1009095 - RNA, 24 nt, Human
ccaaggugcugggauuacaggcgu

SEQ ID NO: 1009096 - RNA, 24 nt, Human
ccgccucagccucccaaggugcug

SEQ ID NO: 1009097 - RNA, 22 nt, Human
ccuaagucacacuaaauguguu

SEQ ID NO: 1009098 - RNA, 23 nt, Human
cguaagaaauaauuugcucagau

SEQ ID NO: 1009099 - RNA, 18 nt, Human
cucaugaucugcccgccu

SEQ ID NO: 1009100 - RNA, 19 nt, Human
cugauuguucccuucaucu

SEQ ID NO: 1009101 - RNA, 24 nt, Human
cuucugaccucaugaucugcccgc

SEQ ID NO: 1009102 - RNA, 23 nt, Human
gagagguucaaagagggaaaaug

SEQ ID NO: 1009103 - RNA, 18 nt, Human
gauuacaggcgugagcca

SEQ ID NO: 1009104 - RNA, 20 nt, Human
gauuacaggcgugagccacc

SEQ ID NO: 1009105 - RNA, 23 nt, Human
gauuacaggcgugagccaccgca

SEQ ID NO: 1009106 - RNA, 23 nt, Human
gccucagccucccaaggugcugg

SEQ ID NO: 1009107 - RNA, 18 nt, Human
gggaaaauguuuucuuuc

SEQ ID NO: 1009108 - RNA, 18 nt, Human
gggucagauagguagccg

SEQ ID NO: 1009109 - RNA, 22 nt, Human
ggguuucaccauguuggccagg

SEQ ID NO: 1009110 - RNA, 18 nt, Human
ggugcugggauuacaggc

SEQ ID NO: 1009111 - RNA, 23 nt, Human
gguggucuuuaucuucugaccuc

SEQ ID NO: 1009112 - RNA, 21 nt, Human
gugcugggauuacaggcguga

SEQ ID NO: 1009113 - RNA, 20 nt, Human
guuuugauccugaccccacu

SEQ ID NO: 1009114 - RNA, 24 nt, Human
uacaggcgugagccaccgcaccca

SEQ ID NO: 1009115 - RNA, 22 nt, Human
uagagacaggguuucaccaugu

SEQ ID NO: 1009116 - RNA, 24 nt, Human
uaguagagacaggguuucaccaug

SEQ ID NO: 1009117 - RNA, 26 nt, Human
uaguagagacaggguuucaccauguu

SEQ ID NO: 1009118 - RNA, 24 nt, Human
ucaccauguuggccaggguggucu

SEQ ID NO: 1009119 - RNA, 24 nt, Human
ucccaaggugcugggauuacaggc

SEQ ID NO: 1009120 - RNA, 21 nt, Human
ucccuaagucacacuaaaugu

SEQ ID NO: 1009121 - RNA, 20 nt, Human
ucugcagcaggaccguggaa

SEQ ID NO: 1009122 - RNA, 21 nt, Human
ucugcccgccucagccuccca

SEQ ID NO: 1009123 - RNA, 24 nt, Human
ugcugggauuacaggcgugagcca

SEQ ID NO: 1009124 - RNA, 18 nt, Human
ugggauuacaggcgugag

SEQ ID NO: 1009125 - RNA, 19 nt, Human
ugggauuacaggcgugagc

SEQ ID NO: 1009126 - RNA, 21 nt, Human
ugggauuacaggcgugagcca

SEQ ID NO: 1009127 - RNA, 22 nt, Human
ugggauuacaggcgugagccac

SEQ ID NO: 1009128 - RNA, 23 nt, Human
ugggauuacaggcgugagccacc

SEQ ID NO: 1009129 - RNA, 24 nt, Human
ugggauuacaggcgugagccaccg

SEQ ID NO: 1009130 - RNA, 19 nt, Human
uguucccuucaucuggcuc

SEQ ID NO: 1009131 - RNA, 24 nt, Human
uuaguagagacaggguuucaccau

SEQ ID NO: 1009132 - RNA, 21 nt, Human
uucccuaagucacacuaaaug

SEQ ID NO: 1009133 - RNA, 21 nt, Human
uuggggucagauagguagccg

SEQ ID NO: 1009134 - RNA, 19 nt, Human
uuucaccauguuggccagg

SEQ ID NO: 1009135 - RNA, 23 nt, Human
uuuuaguagagacaggguuucac

SEQ ID NO: 1009136 - RNA, 21 nt, Human
augcuguguuuagggcugcca

SEQ ID NO: 1009137 - RNA, 20 nt, Human
caagauagacggcuuccuuc

SEQ ID NO: 1009138 - RNA, 18 nt, Human
caucccugaagaaugaca

SEQ ID NO: 1009139 - RNA, 23 nt, Human
ccacaagauagacggcuuccuuc

SEQ ID NO: 1009140 - RNA, 20 nt, Human
cugagcugacuaacagaugc

SEQ ID NO: 1009141 - RNA, 19 nt, Human
gcaaaacauagaggauuua

SEQ ID NO: 1009142 - RNA, 27 nt, Human
uaagauggguguuucugagcugacuaa

SEQ ID NO: 1009143 - RNA, 24 nt, Human
ucuuucaugagugaguagaugagu

SEQ ID NO: 1009144 - RNA, 22 nt, Human
ugagcugacuaacagaugcuua

SEQ ID NO: 1009145 - RNA, 20 nt, Human
ugaguagaugaguugccaug

SEQ ID NO: 1009146 - RNA, 22 nt, Human
ugagugaguagaugaguugcca

SEQ ID NO: 1009147 - RNA, 23 nt, Human
uuucugagcugacuaacagaugc

SEQ ID NO: 1009148 - RNA, 21 nt, Human
uuuuccagguaacaaugaaca

SEQ ID NO: 1009149 - RNA, 22 nt, Human
aaaaaacuugaaaauacgcaga

SEQ ID NO: 1009150 - RNA, 18 nt, Human
aaagaaaccaguaaauaa

SEQ ID NO: 1009151 - RNA, 21 nt, Human
aaauacaucccaucaagugua

SEQ ID NO: 1009152 - RNA, 26 nt, Human
aacaaaaaaaagccaaaaauacaucc

SEQ ID NO: 1009153 - RNA, 23 nt, Human
aacgacaacaaaaaaaagccaaa

SEQ ID NO: 1009154 - RNA, 29 nt, Human
aagauaaaaaaacuugaaaauacgcagaa

SEQ ID NO: 1009155 - RNA, 23 nt, Human
aagcaagcuucagaaugaaauuc

SEQ ID NO: 1009156 - RNA, 19 nt, Human
aggcaaaaucugcaguuuu

SEQ ID NO: 1009157 - RNA, 23 nt, Human
auacaucccaucaaguguacaau

SEQ ID NO: 1009158 - RNA, 24 nt, Human
augcaucuacgcuauuuuacauaa

SEQ ID NO: 1009159 - RNA, 26 nt, Human
caaaaaaaagccaaaaauacauccca

SEQ ID NO: 1009160 - RNA, 21 nt, Human
caaaguuucccaccacccccc

SEQ ID NO: 1009161 - RNA, 20 nt, Human
caaaugcagacuccugagcc

SEQ ID NO: 1009162 - RNA, 19 nt, Human
cacagcaagauaaaaaaac

SEQ ID NO: 1009163 - RNA, 22 nt, Human
cagaaugaaauuccaguuuguu

SEQ ID NO: 1009164 - RNA, 22 nt, Human
cagagauucacacaugccuucc

SEQ ID NO: 1009165 - RNA, 24 nt, Human
cagcuucacaaagaaaccaguaaa

SEQ ID NO: 1009166 - RNA, 21 nt, Human
caucugguucaguguuucuuc

SEQ ID NO: 1009167 - RNA, 18 nt, Human
cauuaaagcaagcuucag

SEQ ID NO: 1009168 - RNA, 25 nt, Human
ccaaaggccauuccaucugguucag

SEQ ID NO: 1009169 - RNA, 24 nt, Human
cccuccucgucgucugcuccaguc

SEQ ID NO: 1009170 - RNA, 20 nt, Human
ccggaaggcugagggccgcc

SEQ ID NO: 1009171 - RNA, 25 nt, Human
cggaaggcugagggccgccccauca

SEQ ID NO: 1009172 - RNA, 20 nt, Human
cucuucccuccucgucgucu

SEQ ID NO: 1009173 - RNA, 20 nt, Human
cugcuccaguccuggcuuuc

SEQ ID NO: 1009174 - RNA, 22 nt, Human
gacaacaaaaaaaagccaaaaa

SEQ ID NO: 1009175 - RNA, 25 nt, Human
gacaacaaaaaaaagccaaaaauac

SEQ ID NO: 1009176 - RNA, 27 nt, Human
gagcccacugcaggucucacccuucag

SEQ ID NO: 1009177 - RNA, 24 nt, Human
gagggccgccccaucagacugucg

SEQ ID NO: 1009178 - RNA, 20 nt, Human
gauucacacaugccuuccuc

SEQ ID NO: 1009179 - RNA, 18 nt, Human
gcaggccuuucccuuccu

SEQ ID NO: 1009180 - RNA, 25 nt, Human
gcuccacaaaaguuagcugagagaa

SEQ ID NO: 1009181 - RNA, 19 nt, Human
gcucuccacaguguggacu

SEQ ID NO: 1009182 - RNA, 21 nt, Human
ggaggggaggcuggagaugcc

SEQ ID NO: 1009183 - RNA, 22 nt, Human
ggaggggaggcuggagaugcca

SEQ ID NO: 1009184 - RNA, 21 nt, Human
ggcugagggccgccccaucag

SEQ ID NO: 1009185 - RNA, 21 nt, Human
ggggaggcccccucggucacc

SEQ ID NO: 1009186 - RNA, 18 nt, Human
uaaaaaaacuugaaaaua

SEQ ID NO: 1009187 - RNA, 22 nt, Human
uaacaauaacuccaguuccuau

SEQ ID NO: 1009188 - RNA, 19 nt, Human
uacaacaaauaccccucca

SEQ ID NO: 1009189 - RNA, 24 nt, Human
uacaacaaauaccccuccacggug

SEQ ID NO: 1009190 - RNA, 19 nt, Human
uaccccuccacggugcucu

SEQ ID NO: 1009191 - RNA, 23 nt, Human
uauuuuacauaaaaagagagauu

SEQ ID NO: 1009192 - RNA, 20 nt, Human
ucaaacucuucccuccucgu

SEQ ID NO: 1009193 - RNA, 19 nt, Human
ucaaagcucaauccagacg

SEQ ID NO: 1009194 - RNA, 22 nt, Human
ucacugagcacaagaugcaggc

SEQ ID NO: 1009195 - RNA, 22 nt, Human
ucagcgcugccuuguccagaga

SEQ ID NO: 1009196 - RNA, 18 nt, Human
ucagucccacugcugcuc

SEQ ID NO: 1009197 - RNA, 22 nt, Human
ucagucccacugcugcuccgga

SEQ ID NO: 1009198 - RNA, 21 nt, Human
uccacggugcucuggcccagg

SEQ ID NO: 1009199 - RNA, 19 nt, Human
uccagagauucacacaugc

SEQ ID NO: 1009200 - RNA, 26 nt, Human
uccccaaaggccauuccaucugguuc

SEQ ID NO: 1009201 - RNA, 20 nt, Human
ucuuguguccuaaaagugag

SEQ ID NO: 1009202 - RNA, 21 nt, Human
ugaaaacccuaugaaaaucaa

SEQ ID NO: 1009203 - RNA, 22 nt, Human
ugagaggaaacugaaaacccua

SEQ ID NO: 1009204 - RNA, 21 nt, Human
uggaggggaggcuggagaugc

SEQ ID NO: 1009205 - RNA, 18 nt, Human
uguccagagauucacaca

SEQ ID NO: 1009206 - RNA, 24 nt, Human
uguggacucuagagggaggggagg

SEQ ID NO: 1009207 - RNA, 18 nt, Human
uucccaccaccccccucu

SEQ ID NO: 1009208 - RNA, 20 nt, Human
uuucuuuaaacgacaacaaa

SEQ ID NO: 1009209 - RNA, 21 nt, Human
uuugggaacagggcuccacaa

SEQ ID NO: 1009210 - RNA, 22 nt, Human
cagcaauaagaacgguugguag

SEQ ID NO: 1009211 - RNA, 19 nt, Human
gguaggaaccgcggcuucc

SEQ ID NO: 1009212 - RNA, 22 nt, Human
ucaggccgccagcaauaagaac

SEQ ID NO: 1009213 - RNA, 21 nt, Human
aagaaggccucuucaucagcc

SEQ ID NO: 1009214 - RNA, 24 nt, Human
aggggaguaauggcaauuaauuag

SEQ ID NO: 1009215 - RNA, 21 nt, Human
agguuucuugaacagcaguuu

SEQ ID NO: 1009216 - RNA, 21 nt, Human
cagguucuaagucaaaagucu

SEQ ID NO: 1009217 - RNA, 19 nt, Human
gugcauauuaaaaaacaaa

SEQ ID NO: 1009218 - RNA, 26 nt, Human
uaaaaaacaaaggcacguuuccuaga

SEQ ID NO: 1009219 - RNA, 19 nt, Human
uaacaguagguaagcuuga

SEQ ID NO: 1009220 - RNA, 21 nt, Human
uaacaguagguaagcuugaua

SEQ ID NO: 1009221 - RNA, 24 nt, Human
uagcagguucuaagucaaaagucu

SEQ ID NO: 1009222 - RNA, 23 nt, Human
ucuaagucaaaagucuugaagag

SEQ ID NO: 1009223 - RNA, 23 nt, Human
ucuguaaaggcacugugcaaaau

SEQ ID NO: 1009224 - RNA, 18 nt, Human
ugauaauauagcagguuc

SEQ ID NO: 1009225 - RNA, 21 nt, Human
uggcaauuaauuagugacaac

SEQ ID NO: 1009226 - RNA, 21 nt, Human
uguggacggggccggccuucu

SEQ ID NO: 1009227 - RNA, 24 nt, Human
uuacauuaacacaaaaaaaauuuu

SEQ ID NO: 1009228 - RNA, 20 nt, Human
uugauaauauagcagguucu

SEQ ID NO: 1009229 - RNA, 19 nt, Human
uuggcagcugcggcgcuuu

SEQ ID NO: 1009230 - RNA, 21 nt, Human
uuuagagauaacaguagguaa

SEQ ID NO: 1009231 - RNA, 18 nt, Human
aaaggaacuauauuucug

SEQ ID NO: 1009232 - RNA, 19 nt, Human
aaaguuauauacacauagg

SEQ ID NO: 1009233 - RNA, 20 nt, Human
aacauuuuguuagaaaggga

SEQ ID NO: 1009234 - RNA, 19 nt, Human
aggcuaguucucuuugccu

SEQ ID NO: 1009235 - RNA, 19 nt, Human
aggcucccggggaacuccc

SEQ ID NO: 1009236 - RNA, 27 nt, Human
caaaacaacuguaauaugaaaggaacc

SEQ ID NO: 1009237 - RNA, 20 nt, Human
caaaguaucuuuugcuucuc

SEQ ID NO: 1009238 - RNA, 22 nt, Human
cagcagcgccuccgcucaucga

SEQ ID NO: 1009239 - RNA, 19 nt, Human
caggauagucaccaccuga

SEQ ID NO: 1009240 - RNA, 23 nt, Human
ccggcgucggccgcagcgccgca

SEQ ID NO: 1009241 - RNA, 19 nt, Human
ccugaggcucccggggaac

SEQ ID NO: 1009242 - RNA, 25 nt, Human
cgagguaagaagcugggagggggag

SEQ ID NO: 1009243 - RNA, 18 nt, Human
cucaacaggauagucacc

SEQ ID NO: 1009244 - RNA, 19 nt, Human
cucccggcagcucucccgg

SEQ ID NO: 1009245 - RNA, 21 nt, Human
cucccgggcuggcggugcugg

SEQ ID NO: 1009246 - RNA, 22 nt, Human
cugggagggggagacaguuggu

SEQ ID NO: 1009247 - RNA, 23 nt, Human
gagacaguuggugcggacccggc

SEQ ID NO: 1009248 - RNA, 22 nt, Human
ggaaggaguaggaagccgaggu

SEQ ID NO: 1009249 - RNA, 24 nt, Human
guuucauuuaaauuaugcagcaau

SEQ ID NO: 1009250 - RNA, 19 nt, Human
uauggaaaaauagaggcua

SEQ ID NO: 1009251 - RNA, 19 nt, Human
uccugacccccagcaugac

SEQ ID NO: 1009252 - RNA, 21 nt, Human
ucuuucagcauauaauuuggu

SEQ ID NO: 1009253 - RNA, 19 nt, Human
ugaaaggaacuauauuucu

SEQ ID NO: 1009254 - RNA, 23 nt, Human
ugacccccagcaugacccgcucc

SEQ ID NO: 1009255 - RNA, 19 nt, Human
ugacccgcucccuaaugca

SEQ ID NO: 1009256 - RNA, 20 nt, Human
uggcggugcugggcgggcgg

SEQ ID NO: 1009257 - RNA, 23 nt, Human
uuaaaagaacauuuuguuagaaa

SEQ ID NO: 1009258 - RNA, 24 nt, Human
uuacuggaauguuuuuaguuauac

SEQ ID NO: 1009259 - RNA, 18 nt, Human
uuggugcggacccggcgu

SEQ ID NO: 1009260 - RNA, 25 nt, Human
uuugccuuaaacauaauuauuaaaa

SEQ ID NO: 1009261 - RNA, 26 nt, Human
aaacagaauaaagauguguccccugg

SEQ ID NO: 1009262 - RNA, 25 nt, Human
aaugaagaagaauuuuuaaaaaaga

SEQ ID NO: 1009263 - RNA, 18 nt, Human
agccacaaauauagaacu

SEQ ID NO: 1009264 - RNA, 22 nt, Human
cgaggcucccaagaagcaccag

SEQ ID NO: 1009265 - RNA, 22 nt, Human
gaagaagaauuuuuaaaaaaga

SEQ ID NO: 1009266 - RNA, 24 nt, Human
gggcugaccagaagcaacggggga

SEQ ID NO: 1009267 - RNA, 20 nt, Human
guaacagaagcuccaaggaa

SEQ ID NO: 1009268 - RNA, 19 nt, Human
gugucgugacugguuuccu

SEQ ID NO: 1009269 - RNA, 21 nt, Human
uaacauacacaaauacauaug

SEQ ID NO: 1009270 - RNA, 28 nt, Human
uaacauacacaaauacauauguggaagg

SEQ ID NO: 1009271 - RNA, 23 nt, Human
uaauaaagccacaaauauagaac

SEQ ID NO: 1009272 - RNA, 19 nt, Human
uacacaaauacauaugugg

SEQ ID NO: 1009273 - RNA, 20 nt, Human
ugacugguuuccugaaacag

SEQ ID NO: 1009274 - RNA, 21 nt, Human
uggcuucuugagaagucccuc

SEQ ID NO: 1009275 - RNA, 20 nt, Human
uuccugaaacagaauaaaga

SEQ ID NO: 1009276 - RNA, 23 nt, Human
aaaacaaauguacugcaagaccc

SEQ ID NO: 1009277 - RNA, 19 nt, Human
aaacaaauguacugcaaga

SEQ ID NO: 1009278 - RNA, 19 nt, Human
aagaguacacuuugaggug

SEQ ID NO: 1009279 - RNA, 20 nt, Human
acaaaaguccacugacccuc

SEQ ID NO: 1009280 - RNA, 20 nt, Human
acaaauguacugcaagaccc

SEQ ID NO: 1009281 - RNA, 19 nt, Human
accauauuacacaagggcu

SEQ ID NO: 1009282 - RNA, 21 nt, Human
agaaaucucagcauuaagacu

SEQ ID NO: 1009283 - RNA, 21 nt, Human
agaaaucucagcauuaagacu

SEQ ID NO: 1009284 - RNA, 19 nt, Human
agacaaaacauucccgaga

SEQ ID NO: 1009285 - RNA, 18 nt, Human
aggcuacaccugcuucau

SEQ ID NO: 1009286 - RNA, 23 nt, Human
aggcugcucccuccauaacaaag

SEQ ID NO: 1009287 - RNA, 21 nt, Human
agggauagcucacuuaugaug

SEQ ID NO: 1009288 - RNA, 18 nt, Human
auaagacuuuacaggaaa

SEQ ID NO: 1009289 - RNA, 19 nt, Human
auacacucccaggaugggc

SEQ ID NO: 1009290 - RNA, 23 nt, Human
augcuacaauaccauccacagga

SEQ ID NO: 1009291 - RNA, 23 nt, Human
augggcugcagagggggagacuc

SEQ ID NO: 1009292 - RNA, 22 nt, Human
caaaacaaauguacugcaagac

SEQ ID NO: 1009293 - RNA, 23 nt, Human
caaaacaaauguacugcaagacc

SEQ ID NO: 1009294 - RNA, 25 nt, Human
caaaacaaauguacugcaagaccca

SEQ ID NO: 1009295 - RNA, 20 nt, Human
caaaacauucccgagacaga

SEQ ID NO: 1009296 - RNA, 23 nt, Human
caaaccugagcacuggccucaua

SEQ ID NO: 1009297 - RNA, 19 nt, Human
caaauauaaucaggacacc

SEQ ID NO: 1009298 - RNA, 19 nt, Human
caccauauuacacaagggc

SEQ ID NO: 1009299 - RNA, 21 nt, Human
cagacaaaacauucccgagac

SEQ ID NO: 1009300 - RNA, 23 nt, Human
cagacggauugaugagagggcag

SEQ ID NO: 1009301 - RNA, 18 nt, Human
caggaaagggccaaguua

SEQ ID NO: 1009302 - RNA, 28 nt, Human
caggcuguuucuugcacagcucuaggcc

SEQ ID NO: 1009303 - RNA, 25 nt, Human
ccacugaaccuugaguucuggcacc

SEQ ID NO: 1009304 - RNA, 22 nt, Human
ccacugacccucuuucuguccc

SEQ ID NO: 1009305 - RNA, 18 nt, Human
ccaggcccaugaaaugca

SEQ ID NO: 1009306 - RNA, 22 nt, Human
cccacaaaaguccacugacccu

SEQ ID NO: 1009307 - RNA, 22 nt, Human
cccaggaagaauguauuuaggc

SEQ ID NO: 1009308 - RNA, 19 nt, Human
cccaggaugggcugcagag

SEQ ID NO: 1009309 - RNA, 20 nt, Human
ccuaauauaccuagcccaga

SEQ ID NO: 1009310 - RNA, 22 nt, Human
ccuagaugaaaaguccuagccc

SEQ ID NO: 1009311 - RNA, 22 nt, Human
ccuuccaaaauccucaacaaag

SEQ ID NO: 1009312 - RNA, 18 nt, Human
ccuugaguucuggcaccc

SEQ ID NO: 1009313 - RNA, 18 nt, Human
cgcggcugggccggggcg

SEQ ID NO: 1009314 - RNA, 24 nt, Human
cgggacgcggcugggccggggcgg

SEQ ID NO: 1009315 - RNA, 25 nt, Human
cuccaauauccucugcuaggaaacc

SEQ ID NO: 1009316 - RNA, 20 nt, Human
cuccgggacgcggcugggcc

SEQ ID NO: 1009317 - RNA, 25 nt, Human
cugaccagaagaaguaaagggaagc

SEQ ID NO: 1009318 - RNA, 20 nt, Human
cugacccucuuucuguccca

SEQ ID NO: 1009319 - RNA, 23 nt, Human
cugcaagacccaucuucccucca

SEQ ID NO: 1009320 - RNA, 20 nt, Human
gaagaaguaaagggaagcac

SEQ ID NO: 1009321 - RNA, 20 nt, Human
gaagguugugaagguuuaau

SEQ ID NO: 1009322 - RNA, 21 nt, Human
gacaaaacauucccgagacag

SEQ ID NO: 1009323 - RNA, 18 nt, Human
gcaagacccaucuucccu

SEQ ID NO: 1009324 - RNA, 20 nt, Human
ggaaaacauuuacuucuguc

SEQ ID NO: 1009325 - RNA, 20 nt, Human
ggaaagaauccauuccaaga

SEQ ID NO: 1009326 - RNA, 23 nt, Human
ggaggggcuaaggagggaggaug

SEQ ID NO: 1009327 - RNA, 22 nt, Human
ggcaaaacaaauguacugcaag

SEQ ID NO: 1009328 - RNA, 18 nt, Human
ggccggggcgggcggcaa

SEQ ID NO: 1009329 - RNA, 19 nt, Human
gguuuugcccuggucccug

SEQ ID NO: 1009330 - RNA, 22 nt, Human
gucccugacaaugacagacugg

SEQ ID NO: 1009331 - RNA, 23 nt, Human
guccuagcccaugagggucucua

SEQ ID NO: 1009332 - RNA, 21 nt, Human
guuucuguaaacaaugccagc

SEQ ID NO: 1009333 - RNA, 22 nt, Human
uaaaaguguuugccgggcaaug

SEQ ID NO: 1009334 - RNA, 22 nt, Human
uaaagggaagcacgaaccaaug

SEQ ID NO: 1009335 - RNA, 21 nt, Human
uaaggagggaggauguugaac

SEQ ID NO: 1009336 - RNA, 24 nt, Human
uaauucacgaugcugugcaggcuu

SEQ ID NO: 1009337 - RNA, 22 nt, Human
uaggaaacccccaggcccauga

SEQ ID NO: 1009338 - RNA, 21 nt, Human
uaggaggggcuaaggagggag

SEQ ID NO: 1009339 - RNA, 23 nt, Human
uaggcaagccauuaaucugucag

SEQ ID NO: 1009340 - RNA, 19 nt, Human
uauaaucaggacaccaaau

SEQ ID NO: 1009341 - RNA, 19 nt, Human
uccaagaaaaugugggaau

SEQ ID NO: 1009342 - RNA, 23 nt, Human
uccaauauccucugcuaggaaac

SEQ ID NO: 1009343 - RNA, 23 nt, Human
ucccagaaaugaauaaaggaccc

SEQ ID NO: 1009344 - RNA, 19 nt, Human
ucugaccagaagaaguaaa

SEQ ID NO: 1009345 - RNA, 23 nt, Human
ucugcagcauuuaaauuuuccaa

SEQ ID NO: 1009346 - RNA, 18 nt, Human
ucugcuaggaaaccccca

SEQ ID NO: 1009347 - RNA, 23 nt, Human
ugaaaaguccuagcccaugaggg

SEQ ID NO: 1009348 - RNA, 21 nt, Human
ugaaaugcaacaggaagacua

SEQ ID NO: 1009349 - RNA, 21 nt, Human
ugaagguuuaauaugaagaca

SEQ ID NO: 1009350 - RNA, 23 nt, Human
ugacggcaacagacaaaacauuc

SEQ ID NO: 1009351 - RNA, 21 nt, Human
ugagaauaaagcaaaagugua

SEQ ID NO: 1009352 - RNA, 24 nt, Human
ugagagaagcuggaggcccacaaa

SEQ ID NO: 1009353 - RNA, 19 nt, Human
ugaggguaaaaguguuugc

SEQ ID NO: 1009354 - RNA, 24 nt, Human
ugagguaaaggucuugaaucuauc

SEQ ID NO: 1009355 - RNA, 23 nt, Human
ugauggcugggcaaaacaaaugu

SEQ ID NO: 1009356 - RNA, 18 nt, Human
ugcagggugcaacacggg

SEQ ID NO: 1009357 - RNA, 21 nt, Human
ugcauacaggcaagacaaagu

SEQ ID NO: 1009358 - RNA, 24 nt, Human
ugcauacaggcaagacaaaguaua

SEQ ID NO: 1009359 - RNA, 27 nt, Human
ugcuaggaaacccccaggcccaugaaa

SEQ ID NO: 1009360 - RNA, 23 nt, Human
uggcaacuaccccuaauauaccu

SEQ ID NO: 1009361 - RNA, 31 nt, Human
uggcaggcuguuucuugcacagcucuaggcc

SEQ ID NO: 1009362 - RNA, 25 nt, Human
ugggaagaacagcucuugguuuugc

SEQ ID NO: 1009363 - RNA, 25 nt, Human
ugguaaugucacaaaaaggggcucc

SEQ ID NO: 1009364 - RNA, 25 nt, Human
ugucaguaccagcaucuuuagaaau

SEQ ID NO: 1009365 - RNA, 24 nt, Human
ugugugugugcgggggagguggau

SEQ ID NO: 1009366 - RNA, 18 nt, Human
uucugcuucuuuguacca

SEQ ID NO: 1009367 - RNA, 21 nt, Human
uugaugagagggcaggcuaca

SEQ ID NO: 1009368 - RNA, 21 nt, Human
uugguaaugucacaaaaaggg

SEQ ID NO: 1009369 - RNA, 22 nt, Human
uuuacaaaauaauacaaaguga

SEQ ID NO: 1009370 - RNA, 23 nt, Human
uuuaucccuucucugaaauuuuu

SEQ ID NO: 1009371 - RNA, 22 nt, Human
uuugugugcuuuuuucaccuuu

SEQ ID NO: 1009372 - RNA, 22 nt, Human
aauggcaagcaccccgcuggug

SEQ ID NO: 1009373 - RNA, 21 nt, Human
agaauggcaagcaccccgcug

SEQ ID NO: 1009374 - RNA, 19 nt, Human
cgacuaacuccaggcugcc

SEQ ID NO: 1009375 - RNA, 22 nt, Human
ucuucagaauggcaagcacccc

SEQ ID NO: 1009376 - RNA, 19 nt, Human
ugagaucucugaggucugg

SEQ ID NO: 1009377 - RNA, 19 nt, Human
uggugagaucucugagguc

SEQ ID NO: 1009378 - RNA, 22 nt, Human
uucagaauggcaagcaccccgc

SEQ ID NO: 1009379 - RNA, 24 nt, Human
uuuucaauuugcaacacauucauu

SEQ ID NO: 1009380 - RNA, 22 nt, Human
aauggcaagcaccccgcuggug

SEQ ID NO: 1009381 - RNA, 21 nt, Human
agaauggcaagcaccccgcug

SEQ ID NO: 1009382 - RNA, 22 nt, Human
ggagauaggggaguagcuggcc

SEQ ID NO: 1009383 - RNA, 22 nt, Human
ucuucagaauggcaagcacccc

SEQ ID NO: 1009384 - RNA, 19 nt, Human
ugagaucucugaggucugg

SEQ ID NO: 1009385 - RNA, 19 nt, Human
uggugagaucucugagguc

SEQ ID NO: 1009386 - RNA, 22 nt, Human
uucagaauggcaagcaccccgc

SEQ ID NO: 1009387 - RNA, 24 nt, Human
uuuucaauuugcaacacauucauu

SEQ ID NO: 1009388 - RNA, 23 nt, Human
acaauaucaccuggguguugagc

SEQ ID NO: 1009389 - RNA, 19 nt, Human
agaagugucagcuuuaugc

SEQ ID NO: 1009390 - RNA, 23 nt, Human
cagaagaguaacaucauccaggu

SEQ ID NO: 1009391 - RNA, 20 nt, Human
cagacuccagaauaaagagg

SEQ ID NO: 1009392 - RNA, 20 nt, Human
cagacuccagaauaaagagg

SEQ ID NO: 1009393 - RNA, 21 nt, Human
ccuuugaaggcagagccacga

SEQ ID NO: 1009394 - RNA, 21 nt, Human
ccuuugaaggcagagccacga

SEQ ID NO: 1009395 - RNA, 22 nt, Human
cgcugggagugucauaauacug

SEQ ID NO: 1009396 - RNA, 22 nt, Human
cgcugggagugucauaauacug

SEQ ID NO: 1009397 - RNA, 18 nt, Human
cucaaagauuaugucacc

SEQ ID NO: 1009398 - RNA, 18 nt, Human
gaaggcugggcauaguca

SEQ ID NO: 1009399 - RNA, 18 nt, Human
gaccuaggcagaagaguu

SEQ ID NO: 1009400 - RNA, 23 nt, Human
gagaguugcauuacccaguuuuu

SEQ ID NO: 1009401 - RNA, 23 nt, Human
gagaguugcauuacccaguuuuu

SEQ ID NO: 1009402 - RNA, 20 nt, Human
gcccauaucacaugguccug

SEQ ID NO: 1009403 - RNA, 18 nt, Human
guuguaucauugcauggu

SEQ ID NO: 1009404 - RNA, 18 nt, Human
guuguauuauugcauggu

SEQ ID NO: 1009405 - RNA, 20 nt, Human
uacccaguuuuugcagucag

SEQ ID NO: 1009406 - RNA, 20 nt, Human
uacccaguuuuugcagucag

SEQ ID NO: 1009407 - RNA, 23 nt, Human
uaccugggugcuggacuccgcaa

SEQ ID NO: 1009408 - RNA, 23 nt, Human
uaccugggugcuggacuccgcaa

SEQ ID NO: 1009409 - RNA, 20 nt, Human
ucaccaagcacacuucugug

SEQ ID NO: 1009410 - RNA, 25 nt, Human
uccacauauggcacaauuacuucug

SEQ ID NO: 1009411 - RNA, 18 nt, Human
uccagaauaaagaggaga

SEQ ID NO: 1009412 - RNA, 18 nt, Human
uccagaauaaagaggaga

SEQ ID NO: 1009413 - RNA, 20 nt, Human
ucccuuugaaggcagagcca

SEQ ID NO: 1009414 - RNA, 20 nt, Human
ucccuuugaaggcagagcca

SEQ ID NO: 1009415 - RNA, 19 nt, Human
ugaagcuggguauaugaca

SEQ ID NO: 1009416 - RNA, 19 nt, Human
ugaagcuggguauaugaca

SEQ ID NO: 1009417 - RNA, 21 nt, Human
uggaacaauaucaccugggug

SEQ ID NO: 1009418 - RNA, 20 nt, Human
uggcagacuccagaauaaag

SEQ ID NO: 1009419 - RNA, 20 nt, Human
uggcagacuccagaauaaag

SEQ ID NO: 1009420 - RNA, 20 nt, Human
uuacccaguuuuugcaguca

SEQ ID NO: 1009421 - RNA, 20 nt, Human
uuacccaguuuuugcaguca

SEQ ID NO: 1009422 - RNA, 22 nt, Human
uuacccaguuuuugcagucagc

SEQ ID NO: 1009423 - RNA, 22 nt, Human
uuacccaguuuuugcagucagc

SEQ ID NO: 1009424 - RNA, 20 nt, Human
uuggguccagguaugauagu

SEQ ID NO: 1009425 - RNA, 20 nt, Human
uuggguccagguaugauagu

SEQ ID NO: 1009426 - RNA, 24 nt, Human
uuggugaugugacagccucaaaga

SEQ ID NO: 1009427 - RNA, 24 nt, Human
aagaacuccucauccaccaggugg

SEQ ID NO: 1009428 - RNA, 21 nt, Human
acaggggugcccggccucccu

SEQ ID NO: 1009429 - RNA, 19 nt, Human
accuugcaggccgggaagg

SEQ ID NO: 1009430 - RNA, 18 nt, Human
caccgugaugcccagcgc

SEQ ID NO: 1009431 - RNA, 20 nt, Human
cacugaugacguagcagagc

SEQ ID NO: 1009432 - RNA, 18 nt, Human
caggggugcccggccucc

SEQ ID NO: 1009433 - RNA, 20 nt, Human
cagggucaccugcaggucac

SEQ ID NO: 1009434 - RNA, 19 nt, Human
ccaccgagucgaaaguggg

SEQ ID NO: 1009435 - RNA, 23 nt, Human
ccggcugcuggcugaccccgacg

SEQ ID NO: 1009436 - RNA, 24 nt, Human
ccugcaggucacggucccaaugcu

SEQ ID NO: 1009437 - RNA, 21 nt, Human
ccuggugccgggcgugcgucu

SEQ ID NO: 1009438 - RNA, 19 nt, Human
ccuugcgcugguccuggcc

SEQ ID NO: 1009439 - RNA, 20 nt, Human
cgcugggcagguaggccagg

SEQ ID NO: 1009440 - RNA, 22 nt, Human
cgggcugggcugaguggggggc

SEQ ID NO: 1009441 - RNA, 22 nt, Human
cguagcagagcgcgcgcacgcg

SEQ ID NO: 1009442 - RNA, 18 nt, Human
cugcuggcugaccccgac

SEQ ID NO: 1009443 - RNA, 27 nt, Human
gauguggcugaaucuagggacaggcgg

SEQ ID NO: 1009444 - RNA, 21 nt, Human
gcccaacaccgugaugcccag

SEQ ID NO: 1009445 - RNA, 21 nt, Human
gcgcacgcgcuggaagaacuc

SEQ ID NO: 1009446 - RNA, 18 nt, Human
gggccucgaguggcaguc

SEQ ID NO: 1009447 - RNA, 19 nt, Human
gggcugggcugaguggggg

SEQ ID NO: 1009448 - RNA, 21 nt, Human
ggugggguggcugacaccccg

SEQ ID NO: 1009449 - RNA, 23 nt, Human
ggugggguggcugacaccccggg

SEQ ID NO: 1009450 - RNA, 22 nt, Human
guggcugacaccccgggccggc

SEQ ID NO: 1009451 - RNA, 19 nt, Human
gugggguggcugacacccc

SEQ ID NO: 1009452 - RNA, 22 nt, Human
ucggcgauggggcuagaacucc

SEQ ID NO: 1009453 - RNA, 22 nt, Human
ucuggacaggggugcccggccu

SEQ ID NO: 1009454 - RNA, 23 nt, Human
ugaggacuuucuggacaggggug

SEQ ID NO: 1009455 - RNA, 23 nt, Human
uggcugaccccgacgggccucga

SEQ ID NO: 1009456 - RNA, 19 nt, Human
ugggcagguaggccagguc

SEQ ID NO: 1009457 - RNA, 23 nt, Human
uggggaucagggucaccugcagg

SEQ ID NO: 1009458 - RNA, 23 nt, Human
uggggggcgugucggcgaugggg

SEQ ID NO: 1009459 - RNA, 27 nt, Human
aaagagcacguagcaugccagcaccau

SEQ ID NO: 1009460 - RNA, 19 nt, Human
accaaagaccuccaccccg

SEQ ID NO: 1009461 - RNA, 20 nt, Human
acuucagaacugaacugaaa

SEQ ID NO: 1009462 - RNA, 28 nt, Human
agaaaaaucucucucaggcucuuaugaa

SEQ ID NO: 1009463 - RNA, 21 nt, Human
agaaguuucuuguccuucacu

SEQ ID NO: 1009464 - RNA, 24 nt, Human
aggauucagcaacgauugagauug

SEQ ID NO: 1009465 - RNA, 19 nt, Human
augaaaccaaagaccucca

SEQ ID NO: 1009466 - RNA, 20 nt, Human
auguacaaacugguggguca

SEQ ID NO: 1009467 - RNA, 18 nt, Human
caaaaccaaagauuccac

SEQ ID NO: 1009468 - RNA, 22 nt, Human
cagcucccccaguuugaccucc

SEQ ID NO: 1009469 - RNA, 22 nt, Human
cauuucucuucacuuccaggga

SEQ ID NO: 1009470 - RNA, 20 nt, Human
ccaaaacauaguggguucau

SEQ ID NO: 1009471 - RNA, 21 nt, Human
ccacuaggacugaagucccgc

SEQ ID NO: 1009472 - RNA, 25 nt, Human
ccagaaguuucuuguccuucacugg

SEQ ID NO: 1009473 - RNA, 20 nt, Human
ccaguuugaccuccagaagu

SEQ ID NO: 1009474 - RNA, 23 nt, Human
ccgguaguaaccucuuugaaacg

SEQ ID NO: 1009475 - RNA, 21 nt, Human
cgagggccugucucugcuccg

SEQ ID NO: 1009476 - RNA, 21 nt, Human
cgcuccgaaaaugccacuagg

SEQ ID NO: 1009477 - RNA, 18 nt, Human
cugaacugaaacguggca

SEQ ID NO: 1009478 - RNA, 24 nt, Human
cugucgcugaggaacacauuuaau

SEQ ID NO: 1009479 - RNA, 18 nt, Human
cugucucugcuccgccuc

SEQ ID NO: 1009480 - RNA, 21 nt, Human
gaaaaugccacuaggacugaa

SEQ ID NO: 1009481 - RNA, 19 nt, Human
gaaacgcuccgaaaaugcc

SEQ ID NO: 1009482 - RNA, 21 nt, Human
gagaugcuccccuucuucaca

SEQ ID NO: 1009483 - RNA, 20 nt, Human
gaguuuuuuuuuuuuuuuuu

SEQ ID NO: 1009484 - RNA, 22 nt, Human
gaguuuuuuuuuuuuuuuuuuu

SEQ ID NO: 1009485 - RNA, 22 nt, Human
gcaucaagauccagcuuggcag

SEQ ID NO: 1009486 - RNA, 21 nt, Human
gcucuuaugaaaccaaagacu

SEQ ID NO: 1009487 - RNA, 22 nt, Human
gucguggggugggggggugcag

SEQ ID NO: 1009488 - RNA, 24 nt, Human
gugauguacaaacuggugggucag

SEQ ID NO: 1009489 - RNA, 21 nt, Human
uagcuaaagagcacguagcau

SEQ ID NO: 1009490 - RNA, 22 nt, Human
uaggaaaaggaguagcuaaaga

SEQ ID NO: 1009491 - RNA, 24 nt, Human
uaguggguucauuucucuucacuu

SEQ ID NO: 1009492 - RNA, 19 nt, Human
uaugaaaccaaagaccucc

SEQ ID NO: 1009493 - RNA, 20 nt, Human
uaugaaaggauucagcaacg

SEQ ID NO: 1009494 - RNA, 19 nt, Human
uauuuuacuaugaugcaaa

SEQ ID NO: 1009495 - RNA, 22 nt, Human
ucaagauccagcuuggcagcuc

SEQ ID NO: 1009496 - RNA, 23 nt, Human
ucaggcucuuaugaaaccaaaga

SEQ ID NO: 1009497 - RNA, 19 nt, Human
ucagugguauuugcggagc

SEQ ID NO: 1009498 - RNA, 20 nt, Human
uccacuauagcacagagacu

SEQ ID NO: 1009499 - RNA, 25 nt, Human
ucccucaggagggauucgcaacccc

SEQ ID NO: 1009500 - RNA, 22 nt, Human
ucucucucaggcucuuaugaaa

SEQ ID NO: 1009501 - RNA, 22 nt, Human
ucuuuggaagaauaaaaaguuc

SEQ ID NO: 1009502 - RNA, 22 nt, Human
ugaaacgcuccgaaaaugccac

SEQ ID NO: 1009503 - RNA, 23 nt, Human
ugaaacguggcacaaacaugaca

SEQ ID NO: 1009504 - RNA, 21 nt, Human
ugaaaggauucagcaacgauu

SEQ ID NO: 1009505 - RNA, 26 nt, Human
ugacgccauugagagagagagacuag

SEQ ID NO: 1009506 - RNA, 19 nt, Human
ugcaaaaccaaagauucca

SEQ ID NO: 1009507 - RNA, 21 nt, Human
ugccuucaagcaucucccuca

SEQ ID NO: 1009508 - RNA, 18 nt, Human
uggcacaaacaugacaac

SEQ ID NO: 1009509 - RNA, 28 nt, Human
uggggccggacacucaccaacugacgcc

SEQ ID NO: 1009510 - RNA, 20 nt, Human
uggggugggggggugcagag

SEQ ID NO: 1009511 - RNA, 19 nt, Human
uggugugggacaugcagga

SEQ ID NO: 1009512 - RNA, 21 nt, Human
uggugugggacaugcaggacg

SEQ ID NO: 1009513 - RNA, 23 nt, Human
uguuccaaaugugauggguuuau

SEQ ID NO: 1009514 - RNA, 26 nt, Human
uuaaggccaaaacauaguggguucau

SEQ ID NO: 1009515 - RNA, 22 nt, Human
uucacagaagaauuuuaaggcc

SEQ ID NO: 1009516 - RNA, 18 nt, Human
uuucuuguccuucacugg

SEQ ID NO: 1009517 - RNA, 20 nt, Human
uuuuuuuuuuuuuuuuucac

SEQ ID NO: 1009518 - RNA, 22 nt, Human
uuuuuuuuuuuuuuuuucacgu

SEQ ID NO: 1009519 - RNA, 23 nt, Human
aaaaaguuuucaaagcaaaagua

SEQ ID NO: 1009520 - RNA, 24 nt, Human
aacaaagccaucaugagguaacca

SEQ ID NO: 1009521 - RNA, 22 nt, Human
aacaccacagcacuccagccug

SEQ ID NO: 1009522 - RNA, 19 nt, Human
aacauggugaaaccccauc

SEQ ID NO: 1009523 - RNA, 20 nt, Human
aacauggugaaaccccaucu

SEQ ID NO: 1009524 - RNA, 21 nt, Human
aacauggugaaaccccaucuc

SEQ ID NO: 1009525 - RNA, 21 nt, Human
aacauggugaaaccccaucuc

SEQ ID NO: 1009526 - RNA, 23 nt, Human
aagcaaauaaacacgcuuuuagg

SEQ ID NO: 1009527 - RNA, 18 nt, Human
aagugcccuaaaacuaac

SEQ ID NO: 1009528 - RNA, 24 nt, Human
aaucgcuugaacccaggaggugga

SEQ ID NO: 1009529 - RNA, 23 nt, Human
acaaagcaagacucugucucaaa

SEQ ID NO: 1009530 - RNA, 24 nt, Human
acaaagcaagacucugucucaaaa

SEQ ID NO: 1009531 - RNA, 22 nt, Human
acaccacagcacuccagccugg

SEQ ID NO: 1009532 - RNA, 18 nt, Human
acagcacuccagccuggg

SEQ ID NO: 1009533 - RNA, 23 nt, Human
acagcacuccagccugggugaca

SEQ ID NO: 1009534 - RNA, 24 nt, Human
accacagcacuccagccuggguga

SEQ ID NO: 1009535 - RNA, 24 nt, Human
acccaggagguggaggcugcagug

SEQ ID NO: 1009536 - RNA, 23 nt, Human
accccaucucuacuaaaauacaa

SEQ ID NO: 1009537 - RNA, 24 nt, Human
accugaggucaggaguuugagacu

SEQ ID NO: 1009538 - RNA, 24 nt, Human
acuaaaauacaaaaauuagccggu

SEQ ID NO: 1009539 - RNA, 23 nt, Human
agcaaauaaacacgcuuuuagga

SEQ ID NO: 1009540 - RNA, 24 nt, Human
agcacuuugggaggccgagguggg

SEQ ID NO: 1009541 - RNA, 23 nt, Human
agccgggcaugguggcaggugcc

SEQ ID NO: 1009542 - RNA, 22 nt, Human
agccuggccaacauggugaaac

SEQ ID NO: 1009543 - RNA, 24 nt, Human
agccuggccaacauggugaaaccc

SEQ ID NO: 1009544 - RNA, 24 nt, Human
agccugggugacaaagcaagacuc

SEQ ID NO: 1009545 - RNA, 24 nt, Human
agcucgaccaacaacggccugcag

SEQ ID NO: 1009546 - RNA, 21 nt, Human
agcugccccaaaccaaaacaa

SEQ ID NO: 1009547 - RNA, 25 nt, Human
agcuggugacagcugccccaaacca

SEQ ID NO: 1009548 - RNA, 20 nt, Human
aggaauugaaguuuaacauu

SEQ ID NO: 1009549 - RNA, 23 nt, Human
aggcaggagaaucgcuugaaccc

SEQ ID NO: 1009550 - RNA, 24 nt, Human
aggcaggagaaucgcuugaaccca

SEQ ID NO: 1009551 - RNA, 21 nt, Human
aggccgagguggguggaucac

SEQ ID NO: 1009552 - RNA, 24 nt, Human
aggcgcuguggcucacaccuguaa

SEQ ID NO: 1009553 - RNA, 20 nt, Human
aggcugaggcaggagaaucg

SEQ ID NO: 1009554 - RNA, 24 nt, Human
aggcugaggcaggagaaucgcuug

SEQ ID NO: 1009555 - RNA, 20 nt, Human
agguggaggcugcagugagc

SEQ ID NO: 1009556 - RNA, 24 nt, Human
agguggaggcugcagugagcugag

SEQ ID NO: 1009557 - RNA, 22 nt, Human
agguggguggaucaccugaggu

SEQ ID NO: 1009558 - RNA, 22 nt, Human
auaaaaagugcccuaaaacuaa

SEQ ID NO: 1009559 - RNA, 21 nt, Human
auaaagcaaauaaacacgcuu

SEQ ID NO: 1009560 - RNA, 21 nt, Human
caaaaagacuuuaucuauuuc

SEQ ID NO: 1009561 - RNA, 22 nt, Human
caacaaucguagugacacauuc

SEQ ID NO: 1009562 - RNA, 24 nt, Human
caacauggugaaaccccaucucua

SEQ ID NO: 1009563 - RNA, 19 nt, Human
caagcuccucuuuuccuuc

SEQ ID NO: 1009564 - RNA, 24 nt, Human
cacaccuguaaucccagcacuuug

SEQ ID NO: 1009565 - RNA, 24 nt, Human
cacagcacuccagccugggugaca

SEQ ID NO: 1009566 - RNA, 19 nt, Human
caccacagcacuccagccu

SEQ ID NO: 1009567 - RNA, 23 nt, Human
caccugaggucaggaguuugaga

SEQ ID NO: 1009568 - RNA, 23 nt, Human
caccuguaaucccagcacuuugg

SEQ ID NO: 1009569 - RNA, 24 nt, Human
caccuguaaucccagcacuuuggg

SEQ ID NO: 1009570 - RNA, 22 nt, Human
cacuccagccugggugacaaag

SEQ ID NO: 1009571 - RNA, 23 nt, Human
cacuccagccugggugacaaagc

SEQ ID NO: 1009572 - RNA, 24 nt, Human
cagcacuuugggaggccgaggugg

SEQ ID NO: 1009573 - RNA, 18 nt, Human
cagccgcaccuccgcaag

SEQ ID NO: 1009574 - RNA, 24 nt, Human
cagcuacucgagaggcugaggcag

SEQ ID NO: 1009575 - RNA, 25 nt, Human
cagcuuuaucaacaaucguagugac

SEQ ID NO: 1009576 - RNA, 20 nt, Human
caggagguggaggcugcagu

SEQ ID NO: 1009577 - RNA, 22 nt, Human
caugguggcaggugccuguaau

SEQ ID NO: 1009578 - RNA, 20 nt, Human
cauugcuuuagcuggugaca

SEQ ID NO: 1009579 - RNA, 23 nt, Human
cauuuaaaaaaucaaguugcaag

SEQ ID NO: 1009580 - RNA, 24 nt, Human
ccaaaccaaaacaaagccaucaug

SEQ ID NO: 1009581 - RNA, 18 nt, Human
ccacagcacuccagccug

SEQ ID NO: 1009582 - RNA, 20 nt, Human
ccacagcacuccagccuggg

SEQ ID NO: 1009583 - RNA, 21 nt, Human
ccacagcacuccagccugggu

SEQ ID NO: 1009584 - RNA, 24 nt, Human
ccacagcacuccagccugggugac

SEQ ID NO: 1009585 - RNA, 19 nt, Human
ccagcucgaccaacaacgg

SEQ ID NO: 1009586 - RNA, 18 nt, Human
ccaggcgcuguggcucac

SEQ ID NO: 1009587 - RNA, 19 nt, Human
cccacuaagaagaaauaaa

SEQ ID NO: 1009588 - RNA, 24 nt, Human
cccgcagcagccgcggcuccuucc

SEQ ID NO: 1009589 - RNA, 18 nt, Human
cccgcagcgcugcccucg

SEQ ID NO: 1009590 - RNA, 20 nt, Human
cccgcgggacccgccagcuc

SEQ ID NO: 1009591 - RNA, 24 nt, Human
cccgcgggacccgccagcucgacc

SEQ ID NO: 1009592 - RNA, 21 nt, Human
cccucgggggguccgccuccu

SEQ ID NO: 1009593 - RNA, 19 nt, Human
ccgcaagcuccucuuuucc

SEQ ID NO: 1009594 - RNA, 20 nt, Human
ccgcaagcuccucuuuuccu

SEQ ID NO: 1009595 - RNA, 20 nt, Human
ccgcagcagccgcggcuccu

SEQ ID NO: 1009596 - RNA, 22 nt, Human
ccgcagcagccgcggcuccuuc

SEQ ID NO: 1009597 - RNA, 19 nt, Human
ccucaauguaauccaguau

SEQ ID NO: 1009598 - RNA, 19 nt, Human
ccuccgcaagcuccucuuu

SEQ ID NO: 1009599 - RNA, 22 nt, Human
ccugaggucaggaguuugagac

SEQ ID NO: 1009600 - RNA, 23 nt, Human
ccuggccaacauggugaaacccc

SEQ ID NO: 1009601 - RNA, 24 nt, Human
ccuggccaacauggugaaacccca

SEQ ID NO: 1009602 - RNA, 22 nt, Human
ccugggugacaaagcaagacuc

SEQ ID NO: 1009603 - RNA, 19 nt, Human
ccuguaaucccagcuacuc

SEQ ID NO: 1009604 - RNA, 22 nt, Human
ccuguaaucccagcuacucgag

SEQ ID NO: 1009605 - RNA, 21 nt, Human
ccuugauacauucaaaaagac

SEQ ID NO: 1009606 - RNA, 20 nt, Human
cgaccaacaacggccugcag

SEQ ID NO: 1009607 - RNA, 24 nt, Human
cgagguggguggaucaccugaggu

SEQ ID NO: 1009608 - RNA, 24 nt, Human
cgcgucaggagggccggaaaacgg

SEQ ID NO: 1009609 - RNA, 20 nt, Human
cggaaaacggccccgcagcg

SEQ ID NO: 1009610 - RNA, 18 nt, Human
cggccccgcagcgcugcc

SEQ ID NO: 1009611 - RNA, 30 nt, Human
cucaaaauaaaaagugcccuaaaacuaacc

SEQ ID NO: 1009612 - RNA, 22 nt, Human
cucacaccuguaaucccagcac

SEQ ID NO: 1009613 - RNA, 24 nt, Human
cucacaccuguaaucccagcacuu

SEQ ID NO: 1009614 - RNA, 18 nt, Human
cucugucucaaaaaaaaa

SEQ ID NO: 1009615 - RNA, 18 nt, Human
cugaaagacuuuauggua

SEQ ID NO: 1009616 - RNA, 21 nt, Human
cugccccaaaccaaaacaaag

SEQ ID NO: 1009617 - RNA, 23 nt, Human
cuggccaacauggugaaacccca

SEQ ID NO: 1009618 - RNA, 21 nt, Human
cuggccacuucccgcagcagc

SEQ ID NO: 1009619 - RNA, 21 nt, Human
gaaaaaaaauaaagcaaauaa

SEQ ID NO: 1009620 - RNA, 21 nt, Human
gaccaacaacggccugcagcc

SEQ ID NO: 1009621 - RNA, 24 nt, Human
gaccaacaacggccugcagccgca

SEQ ID NO: 1009622 - RNA, 23 nt, Human
gagaaucgcuugaacccaggagg

SEQ ID NO: 1009623 - RNA, 19 nt, Human
gaggcugcagugagcugag

SEQ ID NO: 1009624 - RNA, 22 nt, Human
gagguaacaccuccacggccug

SEQ ID NO: 1009625 - RNA, 25 nt, Human
gagguggguggaucaccugagguca

SEQ ID NO: 1009626 - RNA, 24 nt, Human
gaucaccugaggucaggaguuuga

SEQ ID NO: 1009627 - RNA, 20 nt, Human
gcaagcuccucuuuuccuuc

SEQ ID NO: 1009628 - RNA, 22 nt, Human
gcaggagaaucgcuugaaccca

SEQ ID NO: 1009629 - RNA, 24 nt, Human
gccaacauggugaaaccccaucuc

SEQ ID NO: 1009630 - RNA, 18 nt, Human
ggaggcugcagugagcug

SEQ ID NO: 1009631 - RNA, 20 nt, Human
ggaggcugcagugagcugag

SEQ ID NO: 1009632 - RNA, 23 nt, Human
ggaggcugcagugagcugaggua

SEQ ID NO: 1009633 - RNA, 22 nt, Human
ggaucaccugaggucaggaguu

SEQ ID NO: 1009634 - RNA, 21 nt, Human
ggcaggugccuguaaucccag

SEQ ID NO: 1009635 - RNA, 23 nt, Human
ggcaugguggcaggugccuguaa

SEQ ID NO: 1009636 - RNA, 21 nt, Human
gguggaucaccugaggucagg

SEQ ID NO: 1009637 - RNA, 24 nt, Human
gguggcaggugccuguaaucccag

SEQ ID NO: 1009638 - RNA, 20 nt, Human
guggaggcugcagugagcug

SEQ ID NO: 1009639 - RNA, 22 nt, Human
guggcucacaccuguaauccca

SEQ ID NO: 1009640 - RNA, 21 nt, Human
uaaaaagugcccuaaaacuaa

SEQ ID NO: 1009641 - RNA, 22 nt, Human
uaaaaagugcccuaaaacuaac

SEQ ID NO: 1009642 - RNA, 24 nt, Human
uaaaugaugaaaaaaaauaaagca

SEQ ID NO: 1009643 - RNA, 24 nt, Human
uaacauuguacaauauaagcggca

SEQ ID NO: 1009644 - RNA, 21 nt, Human
uaagaagaaauaaaugggaua

SEQ ID NO: 1009645 - RNA, 23 nt, Human
uaagaagaaauaaaugggauaaa

SEQ ID NO: 1009646 - RNA, 23 nt, Human
uaccaaccugugguauauuacac

SEQ ID NO: 1009647 - RNA, 22 nt, Human
uagaacucucuacauccuaaaa

SEQ ID NO: 1009648 - RNA, 24 nt, Human
uagccuggccaacauggugaaacc

SEQ ID NO: 1009649 - RNA, 21 nt, Human
uaggacaaugaaaaaguuuuc

SEQ ID NO: 1009650 - RNA, 23 nt, Human
ucaaaaauauuacacugggccag

SEQ ID NO: 1009651 - RNA, 19 nt, Human
ucaccugaggucaggaguu

SEQ ID NO: 1009652 - RNA, 22 nt, Human
uccacggccuggcccgcgggac

SEQ ID NO: 1009653 - RNA, 24 nt, Human
uccagccugggugacaaagcaaga

SEQ ID NO: 1009654 - RNA, 24 nt, Human
ucgcuugaacccaggagguggagg

SEQ ID NO: 1009655 - RNA, 20 nt, Human
ucucuacuaaaauacaaaaa

SEQ ID NO: 1009656 - RNA, 23 nt, Human
ucuuccauaaugcccacuaagaa

SEQ ID NO: 1009657 - RNA, 19 nt, Human
ugaaaccccaucucuacua

SEQ ID NO: 1009658 - RNA, 24 nt, Human
ugaagccaugacaaaacuauacaa

SEQ ID NO: 1009659 - RNA, 21 nt, Human
ugaaugcuauucaacauccuc

SEQ ID NO: 1009660 - RNA, 20 nt, Human
ugacaaagcaagacucuguc

SEQ ID NO: 1009661 - RNA, 23 nt, Human
ugagacuagccuggccaacaugg

SEQ ID NO: 1009662 - RNA, 24 nt, Human
ugagacuagccuggccaacauggu

SEQ ID NO: 1009663 - RNA, 24 nt, Human
ugagcuuuaggaaauuaacaauuu

SEQ ID NO: 1009664 - RNA, 20 nt, Human
ugaggcaggagaaucgcuug

SEQ ID NO: 1009665 - RNA, 24 nt, Human
ugaggcaggagaaucgcuugaacc

SEQ ID NO: 1009666 - RNA, 25 nt, Human
ugaggcaggagaaucgcuugaaccc

SEQ ID NO: 1009667 - RNA, 18 nt, Human
ugaggucaggaguuugag

SEQ ID NO: 1009668 - RNA, 22 nt, Human
ugccccaaaccaaaacaaagcc

SEQ ID NO: 1009669 - RNA, 21 nt, Human
ugccuguaaucccagcuacuc

SEQ ID NO: 1009670 - RNA, 22 nt, Human
ugccuguaaucccagcuacucg

SEQ ID NO: 1009671 - RNA, 18 nt, Human
uggaggcugcagugagcu

SEQ ID NO: 1009672 - RNA, 22 nt, Human
uggaggcugcagugagcugagg

SEQ ID NO: 1009673 - RNA, 23 nt, Human
uggaucaccugaggucaggaguu

SEQ ID NO: 1009674 - RNA, 24 nt, Human
uggaucaccugaggucaggaguuu

SEQ ID NO: 1009675 - RNA, 27 nt, Human
uggaucaccugaggucaggaguuugag

SEQ ID NO: 1009676 - RNA, 22 nt, Human
uggcaggugccuguaaucccag

SEQ ID NO: 1009677 - RNA, 24 nt, Human
uggcaggugccuguaaucccagcu

SEQ ID NO: 1009678 - RNA, 24 nt, Human
uggccaacauggugaaaccccauc

SEQ ID NO: 1009679 - RNA, 21 nt, Human
uggcucacaccuguaauccca

SEQ ID NO: 1009680 - RNA, 24 nt, Human
uggcucacaccuguaaucccagca

SEQ ID NO: 1009681 - RNA, 23 nt, Human
ugggaggccgagguggguggauc

SEQ ID NO: 1009682 - RNA, 24 nt, Human
ugggaggccgagguggguggauca

SEQ ID NO: 1009683 - RNA, 22 nt, Human
ugggauaaaugaugaaaaaaaa

SEQ ID NO: 1009684 - RNA, 24 nt, Human
uggguggaucaccugaggucagga

SEQ ID NO: 1009685 - RNA, 24 nt, Human
uggucagagucagggugauuuagg

SEQ ID NO: 1009686 - RNA, 24 nt, Human
ugguggcaggugccuguaauccca

SEQ ID NO: 1009687 - RNA, 24 nt, Human
uguggcucacaccuguaaucccag

SEQ ID NO: 1009688 - RNA, 20 nt, Human
uguguacaugucagggcaca

SEQ ID NO: 1009689 - RNA, 21 nt, Human
uguguacaugucagggcacau

SEQ ID NO: 1009690 - RNA, 22 nt, Human
uguguacaugucagggcacaug

SEQ ID NO: 1009691 - RNA, 23 nt, Human
uuagaacucucuacauccuaaaa

SEQ ID NO: 1009692 - RNA, 24 nt, Human
uuagccgggcaugguggcaggugc

SEQ ID NO: 1009693 - RNA, 25 nt, Human
uugggaggccgagguggguggauca

SEQ ID NO: 1009694 - RNA, 19 nt, Human
uuucacaauugucccuccu

SEQ ID NO: 1009695 - RNA, 22 nt, Human
aaccggacauccgagcuccccg

SEQ ID NO: 1009696 - RNA, 21 nt, Human
aagaggccuuuugcagaugag

SEQ ID NO: 1009697 - RNA, 20 nt, Human
agaaaaccagucuuuacaag

SEQ ID NO: 1009698 - RNA, 21 nt, Human
agaaaaucgaugaacuggaaa

SEQ ID NO: 1009699 - RNA, 26 nt, Human
agaaaucacaagaggaaaaucuuggc

SEQ ID NO: 1009700 - RNA, 21 nt, Human
agccagugccggggaaaggcg

SEQ ID NO: 1009701 - RNA, 20 nt, Human
aggcggcgggagcggguccg

SEQ ID NO: 1009702 - RNA, 27 nt, Human
caccagaacaccccgcgauguucagcc

SEQ ID NO: 1009703 - RNA, 23 nt, Human
cagaacaccccgcgauguucagc

SEQ ID NO: 1009704 - RNA, 18 nt, Human
cagagcccucgucccccu

SEQ ID NO: 1009705 - RNA, 19 nt, Human
cagagcccucgucccccuc

SEQ ID NO: 1009706 - RNA, 19 nt, Human
cauccgagcuccccgcauu

SEQ ID NO: 1009707 - RNA, 19 nt, Human
cccccgggcuccucccggc

SEQ ID NO: 1009708 - RNA, 21 nt, Human
cccccuccucccuccccuucc

SEQ ID NO: 1009709 - RNA, 21 nt, Human
ccccgcgauguucagccccuc

SEQ ID NO: 1009710 - RNA, 24 nt, Human
ccccgggcuccucccggcgacccc

SEQ ID NO: 1009711 - RNA, 18 nt, Human
ccccugcgaggccgcggg

SEQ ID NO: 1009712 - RNA, 22 nt, Human
ccccugcgaggccgcgggcccc

SEQ ID NO: 1009713 - RNA, 24 nt, Human
ccccugcgaggccgcgggccccuc

SEQ ID NO: 1009714 - RNA, 25 nt, Human
cccgccagagcccucgucccccucc

SEQ ID NO: 1009715 - RNA, 24 nt, Human
cccgcgaggugaagcgagggcgag

SEQ ID NO: 1009716 - RNA, 21 nt, Human
cccuccaaacccgccagagcc

SEQ ID NO: 1009717 - RNA, 24 nt, Human
ccuccaaacccgccagagcccucg

SEQ ID NO: 1009718 - RNA, 21 nt, Human
ccucccggcgacccccccugg

SEQ ID NO: 1009719 - RNA, 23 nt, Human
ccucccggcgacccccccugggc

SEQ ID NO: 1009720 - RNA, 20 nt, Human
ccuccucccuccccuucccc

SEQ ID NO: 1009721 - RNA, 24 nt, Human
ccuccuggucccucucccccgggc

SEQ ID NO: 1009722 - RNA, 27 nt, Human
ccuggucccucucccccgggcuccucc

SEQ ID NO: 1009723 - RNA, 20 nt, Human
cucucccccgggcuccuccc

SEQ ID NO: 1009724 - RNA, 23 nt, Human
cucucuguucacagacaguucua

SEQ ID NO: 1009725 - RNA, 22 nt, Human
cuuuuuggagaggcggggcggg

SEQ ID NO: 1009726 - RNA, 20 nt, Human
gagcccucgucccccuccuc

SEQ ID NO: 1009727 - RNA, 22 nt, Human
gagcggguccggggcuccgcgu

SEQ ID NO: 1009728 - RNA, 22 nt, Human
gagcuccccgcauucggagccc

SEQ ID NO: 1009729 - RNA, 24 nt, Human
gcauggacccacaagggucucucu

SEQ ID NO: 1009730 - RNA, 18 nt, Human
gcuccucccggcgacccc

SEQ ID NO: 1009731 - RNA, 22 nt, Human
gcuggcgggggcaggggugggg

SEQ ID NO: 1009732 - RNA, 23 nt, Human
gggaccgguccgcuggcgggggc

SEQ ID NO: 1009733 - RNA, 22 nt, Human
gggcaggggugggggcgcgggc

SEQ ID NO: 1009734 - RNA, 18 nt, Human
guucacagacaguucuac

SEQ ID NO: 1009735 - RNA, 18 nt, Human
ucccagccagugccgggg

SEQ ID NO: 1009736 - RNA, 21 nt, Human
ucccccgggcuccucccggcg

SEQ ID NO: 1009737 - RNA, 22 nt, Human
ucccccuccucccuccccuucc

SEQ ID NO: 1009738 - RNA, 19 nt, Human
uccccgcauucggagcccg

SEQ ID NO: 1009739 - RNA, 25 nt, Human
uggucccucucccccgggcuccucc

SEQ ID NO: 1009740 - RNA, 24 nt, Human
uguaaaguuauccacaugguucag

SEQ ID NO: 1009741 - RNA, 24 nt, Human
uguucagccccuccaaacccgcca

SEQ ID NO: 1009742 - RNA, 25 nt, Human
uguugcuauaaaaaugaaugcagaa

SEQ ID NO: 1009743 - RNA, 21 nt, Human
aagcuuggguggguugguagc

SEQ ID NO: 1009744 - RNA, 21 nt, Human
aagguguugaguugccuuggu

SEQ ID NO: 1009745 - RNA, 22 nt, Human
acuuuauucuucuuacacuguu

SEQ ID NO: 1009746 - RNA, 23 nt, Human
agacggaaaggagggggaggagg

SEQ ID NO: 1009747 - RNA, 25 nt, Human
agcccagagaaagaagguguugagu

SEQ ID NO: 1009748 - RNA, 23 nt, Human
aggaggagauugggggcgggggu

SEQ ID NO: 1009749 - RNA, 26 nt, Human
aggagggggaaggaaggaagguggug

SEQ ID NO: 1009750 - RNA, 21 nt, Human
agggaagacggaaaggagggg

SEQ ID NO: 1009751 - RNA, 19 nt, Human
agggggaaggaaggaaggu

SEQ ID NO: 1009752 - RNA, 21 nt, Human
agggggaaggaaggaaggugg

SEQ ID NO: 1009753 - RNA, 24 nt, Human
aguguugucuuuuacuaugugcug

SEQ ID NO: 1009754 - RNA, 22 nt, Human
caauguauguaaagcccacgug

SEQ ID NO: 1009755 - RNA, 19 nt, Human
cagacuagaaaaccucucc

SEQ ID NO: 1009756 - RNA, 21 nt, Human
ccgcucguagugagaaaaaaa

SEQ ID NO: 1009757 - RNA, 24 nt, Human
cggaaaggagggggaggaggggga

SEQ ID NO: 1009758 - RNA, 26 nt, Human
cuagaaaaccucucccucugcacacu

SEQ ID NO: 1009759 - RNA, 19 nt, Human
gacuuuauucuucuuacac

SEQ ID NO: 1009760 - RNA, 22 nt, Human
gagauugggggcggggguggag

SEQ ID NO: 1009761 - RNA, 19 nt, Human
gagggggaggagggggaag

SEQ ID NO: 1009762 - RNA, 22 nt, Human
gagggggaggagggggaaggaa

SEQ ID NO: 1009763 - RNA, 19 nt, Human
ggaaaggagggggaggagg

SEQ ID NO: 1009764 - RNA, 20 nt, Human
ggaaaggagggggaggaggg

SEQ ID NO: 1009765 - RNA, 21 nt, Human
ggaaaggagggggaggagggg

SEQ ID NO: 1009766 - RNA, 19 nt, Human
ggaagacggaaaggagggg

SEQ ID NO: 1009767 - RNA, 23 nt, Human
ggaagacggaaaggagggggagg

SEQ ID NO: 1009768 - RNA, 21 nt, Human
ggaggagauugggggcggggg

SEQ ID NO: 1009769 - RNA, 22 nt, Human
ggaggagauugggggcgggggu

SEQ ID NO: 1009770 - RNA, 23 nt, Human
ggaggagauugggggcgggggug

SEQ ID NO: 1009771 - RNA, 22 nt, Human
ggagggggaaggaaggaaggug

SEQ ID NO: 1009772 - RNA, 29 nt, Human
ggagggggaaggaaggaaggugguggugg

SEQ ID NO: 1009773 - RNA, 18 nt, Human
ggagggggaggaggggga

SEQ ID NO: 1009774 - RNA, 18 nt, Human
ggagggggaggaggggga

SEQ ID NO: 1009775 - RNA, 18 nt, Human
gggaagacggaaaggagg

SEQ ID NO: 1009776 - RNA, 18 nt, Human
ggggcggggguggagagg

SEQ ID NO: 1009777 - RNA, 18 nt, Human
ggguggguugguagccag

SEQ ID NO: 1009778 - RNA, 21 nt, Human
guaaagaauuuauacaccaug

SEQ ID NO: 1009779 - RNA, 18 nt, Human
gugagaaaaaaaggagga

SEQ ID NO: 1009780 - RNA, 18 nt, Human
guggagaagaaagcuugg

SEQ ID NO: 1009781 - RNA, 21 nt, Human
guggagaagaaagcuugggug

SEQ ID NO: 1009782 - RNA, 19 nt, Human
guuugcagacuagaaaacc

SEQ ID NO: 1009783 - RNA, 24 nt, Human
uauacaccauguguucacagcuuc

SEQ ID NO: 1009784 - RNA, 21 nt, Human
ucauagacuuuauucuucuua

SEQ ID NO: 1009785 - RNA, 19 nt, Human
ucccacugcagugaaugga

SEQ ID NO: 1009786 - RNA, 22 nt, Human
ucguagugagaaaaaaaggagg

SEQ ID NO: 1009787 - RNA, 24 nt, Human
ugagcaguggcgguucaagcccag

SEQ ID NO: 1009788 - RNA, 19 nt, Human
ugaucaaguagcuuucccu

SEQ ID NO: 1009789 - RNA, 18 nt, Human
uggaaggucaauguaugu

SEQ ID NO: 1009790 - RNA, 25 nt, Human
uggagagggaagacggaaaggaggg

SEQ ID NO: 1009791 - RNA, 21 nt, Human
ugggggcggggguggagaggg

SEQ ID NO: 1009792 - RNA, 18 nt, Human
uggguggguugguagcca

SEQ ID NO: 1009793 - RNA, 21 nt, Human
ugguggagaagaaagcuuggg

SEQ ID NO: 1009794 - RNA, 23 nt, Human
ugugcugggauucugaagcacgg

SEQ ID NO: 1009795 - RNA, 18 nt, Human
uuuauucuucuuacacug

SEQ ID NO: 1009796 - RNA, 21 nt, Human
uuugaucaaguagcuuucccu

SEQ ID NO: 1009797 - RNA, 21 nt, Human
aaaguaaucuaaacccaggac

SEQ ID NO: 1009798 - RNA, 22 nt, Human
aacugcuuuauauacagcaacu

SEQ ID NO: 1009799 - RNA, 20 nt, Human
aagcaggcuguuccauuuug

SEQ ID NO: 1009800 - RNA, 21 nt, Human
aagcaggcuguuccauuuugg

SEQ ID NO: 1009801 - RNA, 24 nt, Human
aagucacagacuuacagaaaccaa

SEQ ID NO: 1009802 - RNA, 23 nt, Human
aaucuucagaagucuuuauuauu

SEQ ID NO: 1009803 - RNA, 20 nt, Human
acacauuccaaaagcgagcc

SEQ ID NO: 1009804 - RNA, 22 nt, Human
acuagaaucccuuauuguacca

SEQ ID NO: 1009805 - RNA, 18 nt, Human
acuccaugcuuauaacaa

SEQ ID NO: 1009806 - RNA, 26 nt, Human
agaacuauacauaaggauuugaauaa

SEQ ID NO: 1009807 - RNA, 25 nt, Human
agaccuaaauggcacaucuuggcag

SEQ ID NO: 1009808 - RNA, 21 nt, Human
agcaggcuguuccauuuugga

SEQ ID NO: 1009809 - RNA, 20 nt, Human
agccggccuccugaccaccc

SEQ ID NO: 1009810 - RNA, 28 nt, Human
aggaacagcaaagagcaauccgguaccc

SEQ ID NO: 1009811 - RNA, 18 nt, Human
aggcaguguucuagugcu

SEQ ID NO: 1009812 - RNA, 23 nt, Human
auaacacauuccaaaagcgagca

SEQ ID NO: 1009813 - RNA, 23 nt, Human
auagaagaaguagaaaacccuag

SEQ ID NO: 1009814 - RNA, 22 nt, Human
auguuugcuuuauugacuacag

SEQ ID NO: 1009815 - RNA, 20 nt, Human
auuacauacuugggcacccc

SEQ ID NO: 1009816 - RNA, 21 nt, Human
caaaagcgagcauauauuaaa

SEQ ID NO: 1009817 - RNA, 22 nt, Human
caacaguaauagcaagcacuua

SEQ ID NO: 1009818 - RNA, 19 nt, Human
caacuaacuccaugcuuau

SEQ ID NO: 1009819 - RNA, 19 nt, Human
caagagguuacccuaacca

SEQ ID NO: 1009820 - RNA, 20 nt, Human
caagagguuacccuaaccaa

SEQ ID NO: 1009821 - RNA, 24 nt, Human
cacagcuaauauguggcaaaacca

SEQ ID NO: 1009822 - RNA, 20 nt, Human
caccccacaauccuuugcca

SEQ ID NO: 1009823 - RNA, 23 nt, Human
cagacaugcuauauaagaaacug

SEQ ID NO: 1009824 - RNA, 18 nt, Human
caggacucuaaccauguc

SEQ ID NO: 1009825 - RNA, 18 nt, Human
cauaucagucacauuuca

SEQ ID NO: 1009826 - RNA, 21 nt, Human
cauuuuggacagcucuaauga

SEQ ID NO: 1009827 - RNA, 25 nt, Human
ccaccccuacuguagcacuuggaaa

SEQ ID NO: 1009828 - RNA, 22 nt, Human
ccagcaaaauauagugcucaga

SEQ ID NO: 1009829 - RNA, 19 nt, Human
cccaccccuacuguagcac

SEQ ID NO: 1009830 - RNA, 25 nt, Human
ccuguuacguguccuuccuucuucc

SEQ ID NO: 1009831 - RNA, 25 nt, Human
ccuuccuucugcucuuuuuugaguu

SEQ ID NO: 1009832 - RNA, 19 nt, Human
ccuucuuccuuccuucugc

SEQ ID NO: 1009833 - RNA, 18 nt, Human
cuagaacucugccuagcu

SEQ ID NO: 1009834 - RNA, 21 nt, Human
cuccaagaaauaccgaauucu

SEQ ID NO: 1009835 - RNA, 21 nt, Human
cuccugaccaccccacaaucc

SEQ ID NO: 1009836 - RNA, 23 nt, Human
cuguuccauuuuggacagcucua

SEQ ID NO: 1009837 - RNA, 25 nt, Human
cuucuuccuuccuucugcucuuuuu

SEQ ID NO: 1009838 - RNA, 18 nt, Human
gcagugguagagaauaua

SEQ ID NO: 1009839 - RNA, 21 nt, Human
gcaguguucuagugcucaaaa

SEQ ID NO: 1009840 - RNA, 21 nt, Human
gcuaaacuucaccaucuaccu

SEQ ID NO: 1009841 - RNA, 21 nt, Human
ggaauagagaaaauaaucaug

SEQ ID NO: 1009842 - RNA, 23 nt, Human
ggcuacgauaguacuuguuuauu

SEQ ID NO: 1009843 - RNA, 20 nt, Human
gucaggaacagcaaagagca

SEQ ID NO: 1009844 - RNA, 18 nt, Human
guuacuggaaauucccca

SEQ ID NO: 1009845 - RNA, 22 nt, Human
uaacagcaacaguaauagcaag

SEQ ID NO: 1009846 - RNA, 21 nt, Human
uaacaucaaugcauaacacau

SEQ ID NO: 1009847 - RNA, 23 nt, Human
uaacuccaugcuuauaacaaucu

SEQ ID NO: 1009848 - RNA, 20 nt, Human
uaagagagcuaacaaaagug

SEQ ID NO: 1009849 - RNA, 21 nt, Human
uaaguugggcugaaaucugcc

SEQ ID NO: 1009850 - RNA, 22 nt, Human
uaauaauaacagcaacaguaau

SEQ ID NO: 1009851 - RNA, 18 nt, Human
uacacagcuaauaugugg

SEQ ID NO: 1009852 - RNA, 22 nt, Human
uacuuagauccauucacuuaac

SEQ ID NO: 1009853 - RNA, 24 nt, Human
uacuugggcacccccuggcuacga

SEQ ID NO: 1009854 - RNA, 21 nt, Human
uagaagaaguagaaaacccua

SEQ ID NO: 1009855 - RNA, 22 nt, Human
uauauuacacagcuaauaugug

SEQ ID NO: 1009856 - RNA, 23 nt, Human
uauuacacagcuaauauguggca

SEQ ID NO: 1009857 - RNA, 22 nt, Human
uauuuagcacucucuagaauca

SEQ ID NO: 1009858 - RNA, 19 nt, Human
ucaauaccuauugaaugaa

SEQ ID NO: 1009859 - RNA, 19 nt, Human
ucacugcugcacacaacau

SEQ ID NO: 1009860 - RNA, 18 nt, Human
ucagauauuaagagagcu

SEQ ID NO: 1009861 - RNA, 19 nt, Human
ucagguacuggucuaacug

SEQ ID NO: 1009862 - RNA, 23 nt, Human
ucauuuuuuucuucuuaauguuu

SEQ ID NO: 1009863 - RNA, 22 nt, Human
uccuucuuccuuccuucugcuc

SEQ ID NO: 1009864 - RNA, 23 nt, Human
ucuccucccccaccccuacugua

SEQ ID NO: 1009865 - RNA, 20 nt, Human
ucucucauggucagauggcu

SEQ ID NO: 1009866 - RNA, 19 nt, Human
ucucucuccucccccaccc

SEQ ID NO: 1009867 - RNA, 23 nt, Human
ucugccuagcucauagcuggugc

SEQ ID NO: 1009868 - RNA, 19 nt, Human
ucugcucuuuuuugaguug

SEQ ID NO: 1009869 - RNA, 24 nt, Human
ugaacagcugucaagccacgugga

SEQ ID NO: 1009870 - RNA, 18 nt, Human
ugagaaagagcaguggua

SEQ ID NO: 1009871 - RNA, 20 nt, Human
ugagaaagagcagugguaga

SEQ ID NO: 1009872 - RNA, 20 nt, Human
ugcauaacacauuccaaaag

SEQ ID NO: 1009873 - RNA, 18 nt, Human
ugccaggauuaguguucu

SEQ ID NO: 1009874 - RNA, 18 nt, Human
ugccuagcucauagcugg

SEQ ID NO: 1009875 - RNA, 19 nt, Human
uggcuggugugucauccuu

SEQ ID NO: 1009876 - RNA, 23 nt, Human
ugguagagaauauacuucucacu

SEQ ID NO: 1009877 - RNA, 19 nt, Human
uguaaaaaucccuguuacg

SEQ ID NO: 1009878 - RNA, 26 nt, Human
uguuuuaagcuaggauucugugagag

SEQ ID NO: 1009879 - RNA, 25 nt, Human
uuaaaaauaacaaaaaugaagaaaa

SEQ ID NO: 1009880 - RNA, 18 nt, Human
uuacugcccucauucuga

SEQ ID NO: 1009881 - RNA, 19 nt, Human
uuagauccauucacuuaac

SEQ ID NO: 1009882 - RNA, 19 nt, Human
uuaucauuuuaucuuccuc

SEQ ID NO: 1009883 - RNA, 22 nt, Human
uuuuuuuuuuuuagagauauca

SEQ ID NO: 1009884 - RNA, 23 nt, Human
aaaaaagaaaaaaaauaacuaag

SEQ ID NO: 1009885 - RNA, 24 nt, Human
aaaaagaaaaaagaaaaaaaauaa

SEQ ID NO: 1009886 - RNA, 20 nt, Human
aaaaaggagucauacuaaau

SEQ ID NO: 1009887 - RNA, 21 nt, Human
aaaaaugcaaauucuugggcc

SEQ ID NO: 1009888 - RNA, 18 nt, Human
aaaaucaaugaaaauuua

SEQ ID NO: 1009889 - RNA, 22 nt, Human
aaaaugccuaagaaaugaaaug

SEQ ID NO: 1009890 - RNA, 27 nt, Human
aaaaugccuaagaaaugaaaugagaua

SEQ ID NO: 1009891 - RNA, 22 nt, Human
aaagaaaaaaaauaacuaagga

SEQ ID NO: 1009892 - RNA, 22 nt, Human
aacauauuucaaagucugugug

SEQ ID NO: 1009893 - RNA, 24 nt, Human
aaccuggaucuuuaagacugguag

SEQ ID NO: 1009894 - RNA, 19 nt, Human
aagcagcaacaacagaaaa

SEQ ID NO: 1009895 - RNA, 18 nt, Human
aagcagugguucugaaag

SEQ ID NO: 1009896 - RNA, 21 nt, Human
aauaagcagcaugguuuucac

SEQ ID NO: 1009897 - RNA, 20 nt, Human
acaaagaagaacauauuuca

SEQ ID NO: 1009898 - RNA, 28 nt, Human
acacggcuucaaauaaaaagggaacgcc

SEQ ID NO: 1009899 - RNA, 24 nt, Human
acaguaaaaaggagucauacuaaa

SEQ ID NO: 1009900 - RNA, 20 nt, Human
agaccuccugaaauggaaac

SEQ ID NO: 1009901 - RNA, 23 nt, Human
agagaagcagcaacaacagaaaa

SEQ ID NO: 1009902 - RNA, 20 nt, Human
agcuguagccgugccagccu

SEQ ID NO: 1009903 - RNA, 20 nt, Human
aggcaguggguugcuugcua

SEQ ID NO: 1009904 - RNA, 19 nt, Human
agguagcaaauucuggcaa

SEQ ID NO: 1009905 - RNA, 23 nt, Human
aguaugaagcaugacggaaggaa

SEQ ID NO: 1009906 - RNA, 22 nt, Human
aucaccuuaagguagcaaauuc

SEQ ID NO: 1009907 - RNA, 18 nt, Human
augaagcaugacggaagg

SEQ ID NO: 1009908 - RNA, 22 nt, Human
auucccuuuccagucuugaagc

SEQ ID NO: 1009909 - RNA, 20 nt, Human
auugucuguuguggcggauu

SEQ ID NO: 1009910 - RNA, 21 nt, Human
caaagaagaacauauuucaaa

SEQ ID NO: 1009911 - RNA, 24 nt, Human
caaauucuugggccugaucccaga

SEQ ID NO: 1009912 - RNA, 18 nt, Human
caacagaaaaaaaauggc

SEQ ID NO: 1009913 - RNA, 22 nt, Human
caacagaaaaaaaauggccaca

SEQ ID NO: 1009914 - RNA, 24 nt, Human
caagcccucaucuugauucugaua

SEQ ID NO: 1009915 - RNA, 18 nt, Human
cacauguauacauauaua

SEQ ID NO: 1009916 - RNA, 18 nt, Human
caccaaaagucuguuccu

SEQ ID NO: 1009917 - RNA, 25 nt, Human
cacgaaaaauacaaaugaagucugc

SEQ ID NO: 1009918 - RNA, 18 nt, Human
cacugggucuacaggaga

SEQ ID NO: 1009919 - RNA, 23 nt, Human
cacuucugcagcaaggccagcag

SEQ ID NO: 1009920 - RNA, 24 nt, Human
cagaaccuggaucuuuaagacugg

SEQ ID NO: 1009921 - RNA, 21 nt, Human
cagcaugagggguuaguacaa

SEQ ID NO: 1009922 - RNA, 18 nt, Human
caggaaccaucccuaagc

SEQ ID NO: 1009923 - RNA, 18 nt, Human
caguaaaaaggagucaua

SEQ ID NO: 1009924 - RNA, 23 nt, Human
caguuuauucaaaagagcccuua

SEQ ID NO: 1009925 - RNA, 19 nt, Human
ccuccucaucaccaaaagu

SEQ ID NO: 1009926 - RNA, 21 nt, Human
ccugcauggugguaaaggaga

SEQ ID NO: 1009927 - RNA, 21 nt, Human
cuccugaaauggaaacucugg

SEQ ID NO: 1009928 - RNA, 23 nt, Human
cugauacacacuaaaguuugaga

SEQ ID NO: 1009929 - RNA, 23 nt, Human
cuuccuguaaauccacaucuuag

SEQ ID NO: 1009930 - RNA, 18 nt, Human
gaccacuuccaucugcuu

SEQ ID NO: 1009931 - RNA, 23 nt, Human
ggaaggaaaaaagugcuucucga

SEQ ID NO: 1009932 - RNA, 25 nt, Human
guaggacucuuguaggaggcuuuug

SEQ ID NO: 1009933 - RNA, 23 nt, Human
uaaaaaggagucauacuaaaugu

SEQ ID NO: 1009934 - RNA, 23 nt, Human
uaaaaggcuuaaaguaaucuaga

SEQ ID NO: 1009935 - RNA, 25 nt, Human
uaaaauacaaacaacuuguuauuaa

SEQ ID NO: 1009936 - RNA, 23 nt, Human
uacaaguuaaaacagcauggaaa

SEQ ID NO: 1009937 - RNA, 24 nt, Human
uacaauacaauauaguaugaagca

SEQ ID NO: 1009938 - RNA, 21 nt, Human
uaccacgaaaaauacaaauga

SEQ ID NO: 1009939 - RNA, 22 nt, Human
uagaaguugucccuugcaagga

SEQ ID NO: 1009940 - RNA, 18 nt, Human
uagagaagcagcaacaac

SEQ ID NO: 1009941 - RNA, 18 nt, Human
uagccgugccagccucug

SEQ ID NO: 1009942 - RNA, 20 nt, Human
uagcugcaguuauuaacugc

SEQ ID NO: 1009943 - RNA, 25 nt, Human
uauaaacaaaaauaaaauacaaaca

SEQ ID NO: 1009944 - RNA, 24 nt, Human
uauuuucuucuauuauuuguucuu

SEQ ID NO: 1009945 - RNA, 26 nt, Human
ucaaauaaaaaaaaagaaaaaagaaa

SEQ ID NO: 1009946 - RNA, 19 nt, Human
ucacauaaauacucagucc

SEQ ID NO: 1009947 - RNA, 19 nt, Human
ucagaccacuuccaucugc

SEQ ID NO: 1009948 - RNA, 23 nt, Human
ucaguaucauuuuuacugacuuu

SEQ ID NO: 1009949 - RNA, 22 nt, Human
uccacuagagaagcagcaacaa

SEQ ID NO: 1009950 - RNA, 25 nt, Human
ucccagaccuccugaaauggaaacu

SEQ ID NO: 1009951 - RNA, 18 nt, Human
ucccagguauuuugguag

SEQ ID NO: 1009952 - RNA, 20 nt, Human
ucccuaagcugcaguaacuc

SEQ ID NO: 1009953 - RNA, 20 nt, Human
ucccugaaccaacauuauca

SEQ ID NO: 1009954 - RNA, 21 nt, Human
uccuccucaucaccaaaaguc

SEQ ID NO: 1009955 - RNA, 20 nt, Human
ucuguugugcauuuuucugu

SEQ ID NO: 1009956 - RNA, 23 nt, Human
ucuugggccugaucccagaccuc

SEQ ID NO: 1009957 - RNA, 24 nt, Human
ugaaagaaaagccauaacuucuac

SEQ ID NO: 1009958 - RNA, 18 nt, Human
ugaauuacuuauggguuc

SEQ ID NO: 1009959 - RNA, 20 nt, Human
ugagugauuacuauauccca

SEQ ID NO: 1009960 - RNA, 19 nt, Human
ugccacaaauaaaacagca

SEQ ID NO: 1009961 - RNA, 19 nt, Human
uggaaacucugggaguugg

SEQ ID NO: 1009962 - RNA, 21 nt, Human
ugguauaaacaaaaauaaaau

SEQ ID NO: 1009963 - RNA, 24 nt, Human
uggugacagcuguagccgugccag

SEQ ID NO: 1009964 - RNA, 23 nt, Human
uguucuugcaacagaauuuuccc

SEQ ID NO: 1009965 - RNA, 22 nt, Human
uguugugcauuuuucuguuuuu

SEQ ID NO: 1009966 - RNA, 22 nt, Human
uuaaaacagcauggaaaaaaau

SEQ ID NO: 1009967 - RNA, 25 nt, Human
uuaguacaauacaauauaguaugaa

SEQ ID NO: 1009968 - RNA, 22 nt, Human
uucaaauaaaaaaaaagaaaaa

SEQ ID NO: 1009969 - RNA, 23 nt, Human
uucacugauaauacaucagauaa

SEQ ID NO: 1009970 - RNA, 19 nt, Human
uucagaaccuggaucuuua

SEQ ID NO: 1009971 - RNA, 21 nt, Human
uucuugcaacagaauuuuccc

SEQ ID NO: 1009972 - RNA, 27 nt, Human
uuuaacuuacuugccaaccaccuaaca

SEQ ID NO: 1009973 - RNA, 25 nt, Human
uuuucacauaaauacucaguccuac

SEQ ID NO: 1009974 - RNA, 25 nt, Human
aaaaauacccuaaaguuuuccagga

SEQ ID NO: 1009975 - RNA, 21 nt, Human
aaaucauuacaaaaccaaguc

SEQ ID NO: 1009976 - RNA, 21 nt, Human
aacaccaaguucccagcuccu

SEQ ID NO: 1009977 - RNA, 18 nt, Human
aacaguuggaaaaccucc

SEQ ID NO: 1009978 - RNA, 20 nt, Human
aagagcaggagacaaacaca

SEQ ID NO: 1009979 - RNA, 19 nt, Human
aagcccccagugacuccag

SEQ ID NO: 1009980 - RNA, 21 nt, Human
aaggccucaugggaaaggaca

SEQ ID NO: 1009981 - RNA, 19 nt, Human
acaagaaagacaccccuga

SEQ ID NO: 1009982 - RNA, 21 nt, Human
acagacccgagggcacuugua

SEQ ID NO: 1009983 - RNA, 20 nt, Human
acaguuggaaaaccucccuu

SEQ ID NO: 1009984 - RNA, 20 nt, Human
acccaucaccccagugugca

SEQ ID NO: 1009985 - RNA, 21 nt, Human
accccagaccccccaaagagc

SEQ ID NO: 1009986 - RNA, 18 nt, Human
accccccaaagagcugag

SEQ ID NO: 1009987 - RNA, 24 nt, Human
accgcccccacaaccuccacaacc

SEQ ID NO: 1009988 - RNA, 19 nt, Human
accucugggaccuccccac

SEQ ID NO: 1009989 - RNA, 21 nt, Human
accucugggaccuccccaccg

SEQ ID NO: 1009990 - RNA, 21 nt, Human
acugcacaagaaagacacccc

SEQ ID NO: 1009991 - RNA, 24 nt, Human
agaaaacagcuuaagguuuugauc

SEQ ID NO: 1009992 - RNA, 23 nt, Human
agaaagacaccccugauuaaccu

SEQ ID NO: 1009993 - RNA, 21 nt, Human
agcagaguggggagugauugg

SEQ ID NO: 1009994 - RNA, 21 nt, Human
agggggaaggguuuguccaag

SEQ ID NO: 1009995 - RNA, 22 nt, Human
auccuccucaaggcccugauug

SEQ ID NO: 1009996 - RNA, 21 nt, Human
auuacaaaaccaagucugggg

SEQ ID NO: 1009997 - RNA, 23 nt, Human
caaaaauacccuaaaguuuucca

SEQ ID NO: 1009998 - RNA, 18 nt, Human
caaccccacaaauucucu

SEQ ID NO: 1009999 - RNA, 28 nt, Human
caagaaagacaccccugauuaaccacau

SEQ ID NO: 1010000 - RNA, 22 nt, Human
caagaccuggaugccagccucc

SEQ ID NO: 1010001 - RNA, 22 nt, Human
cacccaucaccccagugugcaa

SEQ ID NO: 1010002 - RNA, 19 nt, Human
caccccacugaggcccagc

SEQ ID NO: 1010003 - RNA, 25 nt, Human
caccccagaccccccaaagagcuga

SEQ ID NO: 1010004 - RNA, 21 nt, Human
caccgcccccacaaccuccac

SEQ ID NO: 1010005 - RNA, 21 nt, Human
caccucugggaccuccccacc

SEQ ID NO: 1010006 - RNA, 21 nt, Human
cacuccagcaagccuugauug

SEQ ID NO: 1010007 - RNA, 20 nt, Human
cagaaauacccccucuaccc

SEQ ID NO: 1010008 - RNA, 21 nt, Human
cagaaauacccccucuacccu

SEQ ID NO: 1010009 - RNA, 23 nt, Human
cagaaauacccccucuacccuga

SEQ ID NO: 1010010 - RNA, 24 nt, Human
cagaaauacccccucuacccugau

SEQ ID NO: 1010011 - RNA, 22 nt, Human
cagaagagcaggagacaaacac

SEQ ID NO: 1010012 - RNA, 19 nt, Human
cagagccaagaccuggaug

SEQ ID NO: 1010013 - RNA, 21 nt, Human
cagagccaagaccuggaugcc

SEQ ID NO: 1010014 - RNA, 18 nt, Human
cagaguggggagugauug

SEQ ID NO: 1010015 - RNA, 24 nt, Human
caggagacaaacacaccccacuga

SEQ ID NO: 1010016 - RNA, 22 nt, Human
caggcuccagaagagcaggaga

SEQ ID NO: 1010017 - RNA, 23 nt, Human
cagggcagagccaagaccuggau

SEQ ID NO: 1010018 - RNA, 23 nt, Human
ccaacccugaaggaguuugcgca

SEQ ID NO: 1010019 - RNA, 18 nt, Human
ccacaaccuccacaaccc

SEQ ID NO: 1010020 - RNA, 19 nt, Human
ccacaaccuccacaacccc

SEQ ID NO: 1010021 - RNA, 20 nt, Human
cccaaaggcgccuccaacag

SEQ ID NO: 1010022 - RNA, 21 nt, Human
cccacaaccuccacaacccca

SEQ ID NO: 1010023 - RNA, 23 nt, Human
cccacacaaucucucuuucuggu

SEQ ID NO: 1010024 - RNA, 25 nt, Human
cccacccaucaccccagugugcaag

SEQ ID NO: 1010025 - RNA, 18 nt, Human
ccccacacaaucucucuu

SEQ ID NO: 1010026 - RNA, 19 nt, Human
ccccacugaggcccagcuu

SEQ ID NO: 1010027 - RNA, 21 nt, Human
ccccauuaucccagcagagug

SEQ ID NO: 1010028 - RNA, 21 nt, Human
cccccacaaccuccacaaccc

SEQ ID NO: 1010029 - RNA, 22 nt, Human
cccccacaaccuccacaacccc

SEQ ID NO: 1010030 - RNA, 19 nt, Human
cccccacccaucaccccag

SEQ ID NO: 1010031 - RNA, 22 nt, Human
cccccacccaucaccccagugu

SEQ ID NO: 1010032 - RNA, 18 nt, Human
ccccccgcggcccccgag

SEQ ID NO: 1010033 - RNA, 21 nt, Human
cccccgagcccccucacaugg

SEQ ID NO: 1010034 - RNA, 22 nt, Human
cccccgagcccccucacauggc

SEQ ID NO: 1010035 - RNA, 21 nt, Human
cccccgcggcccccgagcccc

SEQ ID NO: 1010036 - RNA, 22 nt, Human
ccccucacauggcgccgggagc

SEQ ID NO: 1010037 - RNA, 24 nt, Human
ccccugauuaaccacauagacucu

SEQ ID NO: 1010038 - RNA, 24 nt, Human
cccucggaagcccccagugacucc

SEQ ID NO: 1010039 - RNA, 23 nt, Human
cccugcuagagggcagaaaagga

SEQ ID NO: 1010040 - RNA, 19 nt, Human
ccuagcggcugggcggagg

SEQ ID NO: 1010041 - RNA, 24 nt, Human
ccucacagccuccuccugaagccc

SEQ ID NO: 1010042 - RNA, 21 nt, Human
ccucacauggcgccgggagcc

SEQ ID NO: 1010043 - RNA, 23 nt, Human
ccuccacaaccccacaaauucuc

SEQ ID NO: 1010044 - RNA, 22 nt, Human
ccucugggaccuccccaccgcc

SEQ ID NO: 1010045 - RNA, 23 nt, Human
ccucugggaccuccccaccgccc

SEQ ID NO: 1010046 - RNA, 23 nt, Human
ccucugggaccuccccaccgccc

SEQ ID NO: 1010047 - RNA, 22 nt, Human
cgcccccacaaccuccacaacc

SEQ ID NO: 1010048 - RNA, 24 nt, Human
cgcccccacccaucaccccaguuu

SEQ ID NO: 1010049 - RNA, 23 nt, Human
cuagcugcuggccuccuccaucu

SEQ ID NO: 1010050 - RNA, 18 nt, Human
cucacagccuccuccuga

SEQ ID NO: 1010051 - RNA, 23 nt, Human
cuccagacagcuucuacccccac

SEQ ID NO: 1010052 - RNA, 23 nt, Human
cuccucugacccuccugaggucc

SEQ ID NO: 1010053 - RNA, 20 nt, Human
cuccugaggucccacaggcu

SEQ ID NO: 1010054 - RNA, 20 nt, Human
gagccaagcuaauggcagcu

SEQ ID NO: 1010055 - RNA, 26 nt, Human
gccagccucccaccucugggaccucc

SEQ ID NO: 1010056 - RNA, 18 nt, Human
gccgggccuccagacagc

SEQ ID NO: 1010057 - RNA, 18 nt, Human
ggaggguccagacgggga

SEQ ID NO: 1010058 - RNA, 20 nt, Human
ggcccccgagcccccucaca

SEQ ID NO: 1010059 - RNA, 24 nt, Human
gggaccuccccaccgcccccacaa

SEQ ID NO: 1010060 - RNA, 20 nt, Human
ggugcccagagagggggaag

SEQ ID NO: 1010061 - RNA, 23 nt, Human
uaagaaaacagcuuaagguuuug

SEQ ID NO: 1010062 - RNA, 19 nt, Human
uaagagccaagcuaauggc

SEQ ID NO: 1010063 - RNA, 22 nt, Human
uacaaaaccaagucuggggcag

SEQ ID NO: 1010064 - RNA, 23 nt, Human
ucaccccagaccccccaaagagc

SEQ ID NO: 1010065 - RNA, 21 nt, Human
ucaccgcccccacccaucacc

SEQ ID NO: 1010066 - RNA, 25 nt, Human
ucaccgcccccacccaucaccccag

SEQ ID NO: 1010067 - RNA, 25 nt, Human
uccagacaaaggggcagccccaaag

SEQ ID NO: 1010068 - RNA, 24 nt, Human
ucccaaaucccugauucgccaaca

SEQ ID NO: 1010069 - RNA, 21 nt, Human
uccccaccgcccccacaaccu

SEQ ID NO: 1010070 - RNA, 23 nt, Human
uccccaccgcccccacaaccucc

SEQ ID NO: 1010071 - RNA, 25 nt, Human
uccccaccgcccccacaaccuccac

SEQ ID NO: 1010072 - RNA, 22 nt, Human
ucccccaacccugaaggaguuu

SEQ ID NO: 1010073 - RNA, 23 nt, Human
ucccuccagccucacagccuccc

SEQ ID NO: 1010074 - RNA, 18 nt, Human
ucccuggccuagcggcug

SEQ ID NO: 1010075 - RNA, 23 nt, Human
uccuccugaagcccuuuccuucc

SEQ ID NO: 1010076 - RNA, 21 nt, Human
uccuugggacaggaccccauu

SEQ ID NO: 1010077 - RNA, 23 nt, Human
ucggaagcccccagugacuccag

SEQ ID NO: 1010078 - RNA, 24 nt, Human
ucuccggcggggagcgcccggccc

SEQ ID NO: 1010079 - RNA, 26 nt, Human
ugaagcccuuuccuuccaggcuccag

SEQ ID NO: 1010080 - RNA, 24 nt, Human
ugagccucaguuuccucaucuccg

SEQ ID NO: 1010081 - RNA, 22 nt, Human
ugagggggcaacaccaaguucc

SEQ ID NO: 1010082 - RNA, 21 nt, Human
ugauucgccaacagauucccc

SEQ ID NO: 1010083 - RNA, 19 nt, Human
ugccugauacagagccagg

SEQ ID NO: 1010084 - RNA, 20 nt, Human
ugccugauacagagccaggg

SEQ ID NO: 1010085 - RNA, 21 nt, Human
uggccgggccuccagacagcu

SEQ ID NO: 1010086 - RNA, 18 nt, Human
uggcgccgggagccgagc

SEQ ID NO: 1010087 - RNA, 21 nt, Human
uggcugggaggguccagacgg

SEQ ID NO: 1010088 - RNA, 21 nt, Human
uggcugggaggguccagacgg

SEQ ID NO: 1010089 - RNA, 23 nt, Human
uggcugggaggguccagacgggg

SEQ ID NO: 1010090 - RNA, 22 nt, Human
ugggaaaggacauguccuuagc

SEQ ID NO: 1010091 - RNA, 25 nt, Human
ugggacaggaccccauuaucccagc

SEQ ID NO: 1010092 - RNA, 19 nt, Human
ugggaggguccagacgggg

SEQ ID NO: 1010093 - RNA, 18 nt, Human
uggggagugauugggggg

SEQ ID NO: 1010094 - RNA, 25 nt, Human
ugucccguuuccuucagaguccccc

SEQ ID NO: 1010095 - RNA, 26 nt, Human
ugucccguuuccuucagaguccccca

SEQ ID NO: 1010096 - RNA, 23 nt, Human
uguccuuagccucagauugacuc

SEQ ID NO: 1010097 - RNA, 28 nt, Human
ugugggcagaagggugcccagagagggg

SEQ ID NO: 1010098 - RNA, 19 nt, Human
uucagagucccccaacccu

SEQ ID NO: 1010099 - RNA, 21 nt, Human
uuccaggagguggggagguca

SEQ ID NO: 1010100 - RNA, 20 nt, Human
uuccccaggcccugauuggc

SEQ ID NO: 1010101 - RNA, 18 nt, Human
uuuuuuuuuuuuuuuucg

SEQ ID NO: 1010102 - RNA, 18 nt, Human
aaaagaaaggacaacaga

SEQ ID NO: 1010103 - RNA, 20 nt, Human
aaaggacaacagaaacgcag

SEQ ID NO: 1010104 - RNA, 20 nt, Human
aaccaaagugucggggcccc

SEQ ID NO: 1010105 - RNA, 19 nt, Human
aagcgcucuugcuggaaau

SEQ ID NO: 1010106 - RNA, 19 nt, Human
aagcuggccccgccgcggc

SEQ ID NO: 1010107 - RNA, 28 nt, Human
aaggacccgaggaugcggggaacgcgau

SEQ ID NO: 1010108 - RNA, 22 nt, Human
aaucccuguccccucccauccc

SEQ ID NO: 1010109 - RNA, 22 nt, Human
accccgccuccccccaaaacca

SEQ ID NO: 1010110 - RNA, 23 nt, Human
accccgccuccccccaaaaccag

SEQ ID NO: 1010111 - RNA, 27 nt, Human
agaacccugcccgcaaaugcaccccgc

SEQ ID NO: 1010112 - RNA, 24 nt, Human
agagauguuuaaagcuuggccucc

SEQ ID NO: 1010113 - RNA, 20 nt, Human
agcggcggcggcggcggugg

SEQ ID NO: 1010114 - RNA, 24 nt, Human
agcggcggcggcggcggugguggc

SEQ ID NO: 1010115 - RNA, 19 nt, Human
auucaccacgagcacacca

SEQ ID NO: 1010116 - RNA, 21 nt, Human
caaaugcaccccgccuccccc

SEQ ID NO: 1010117 - RNA, 22 nt, Human
caacagaaacgcagacgcgaug

SEQ ID NO: 1010118 - RNA, 20 nt, Human
caaggaggcgagggcugggg

SEQ ID NO: 1010119 - RNA, 19 nt, Human
caccugauaaauugcacaa

SEQ ID NO: 1010120 - RNA, 20 nt, Human
cagccuuucccgcugcaggg

SEQ ID NO: 1010121 - RNA, 22 nt, Human
cagcggaaaggacagaaggacc

SEQ ID NO: 1010122 - RNA, 21 nt, Human
ccaaagugucggggccccacu

SEQ ID NO: 1010123 - RNA, 18 nt, Human
ccacacgcacaguagaac

SEQ ID NO: 1010124 - RNA, 19 nt, Human
ccagucagccuuucccgcu

SEQ ID NO: 1010125 - RNA, 24 nt, Human
cccccaaggucaaguugccacgcc

SEQ ID NO: 1010126 - RNA, 25 nt, Human
ccccucucccucccuucccaacccc

SEQ ID NO: 1010127 - RNA, 19 nt, Human
cccucucccucccuuccca

SEQ ID NO: 1010128 - RNA, 23 nt, Human
ccucccaucccccccauccccga

SEQ ID NO: 1010129 - RNA, 24 nt, Human
ccucccuucccaacccccucgaug

SEQ ID NO: 1010130 - RNA, 23 nt, Human
ccugcccgcaaaugcaccccgcc

SEQ ID NO: 1010131 - RNA, 22 nt, Human
cgaggaugcggggaacgcgaug

SEQ ID NO: 1010132 - RNA, 21 nt, Human
cgcaaaugcaccccgccuccc

SEQ ID NO: 1010133 - RNA, 26 nt, Human
cgcccccucucccucccuucccaacc

SEQ ID NO: 1010134 - RNA, 26 nt, Human
cggaaaggacagaaggacccgaggau

SEQ ID NO: 1010135 - RNA, 18 nt, Human
cggcggcggcggcggugg

SEQ ID NO: 1010136 - RNA, 18 nt, Human
cucagggcuggaccgggc

SEQ ID NO: 1010137 - RNA, 18 nt, Human
cucccucccuucccaacc

SEQ ID NO: 1010138 - RNA, 18 nt, Human
cucuaaauuagagauaga

SEQ ID NO: 1010139 - RNA, 19 nt, Human
cuggccccgccgcggcuuc

SEQ ID NO: 1010140 - RNA, 21 nt, Human
cuggcggagcggcggcggcuu

SEQ ID NO: 1010141 - RNA, 24 nt, Human
gaaaagaaaggacaacagaaacgc

SEQ ID NO: 1010142 - RNA, 22 nt, Human
gaaaggacaacagaaacgcaga

SEQ ID NO: 1010143 - RNA, 22 nt, Human
gacagcggaaaggacagaagga

SEQ ID NO: 1010144 - RNA, 19 nt, Human
gagcggcggcggcggcggu

SEQ ID NO: 1010145 - RNA, 20 nt, Human
gcaaaugcaccccgccuccc

SEQ ID NO: 1010146 - RNA, 22 nt, Human
gcaaaugcaccccgccuccccc

SEQ ID NO: 1010147 - RNA, 25 nt, Human
gccccgccgcggcuucucgccuucc

SEQ ID NO: 1010148 - RNA, 25 nt, Human
gcggcggcggugguggcuagugcac

SEQ ID NO: 1010149 - RNA, 20 nt, Human
gcugcgcccccucucccucc

SEQ ID NO: 1010150 - RNA, 23 nt, Human
gcuggugggggcggggugagggg

SEQ ID NO: 1010151 - RNA, 27 nt, Human
ggaaggacagagaacccugcccgcaaa

SEQ ID NO: 1010152 - RNA, 22 nt, Human
ggagcggcggcggcggcggugg

SEQ ID NO: 1010153 - RNA, 20 nt, Human
ggcagggcgcacugggcugg

SEQ ID NO: 1010154 - RNA, 20 nt, Human
ggccccgccgcggcuucucg

SEQ ID NO: 1010155 - RNA, 19 nt, Human
ggcggcggcggcgguggug

SEQ ID NO: 1010156 - RNA, 20 nt, Human
ggcggcggugguggcuagug

SEQ ID NO: 1010157 - RNA, 25 nt, Human
ggggacagcggaaaggaccgguacc

SEQ ID NO: 1010158 - RNA, 23 nt, Human
ggggcggggugaggggagaaggg

SEQ ID NO: 1010159 - RNA, 21 nt, Human
ggugaggggagaagggagaga

SEQ ID NO: 1010160 - RNA, 19 nt, Human
gucgcuaucuccgcuugcu

SEQ ID NO: 1010161 - RNA, 20 nt, Human
uagaacaguuccacaccuga

SEQ ID NO: 1010162 - RNA, 24 nt, Human
uccacaccugauaaauugcacaag

SEQ ID NO: 1010163 - RNA, 19 nt, Human
ucccaucccccccaucccc

SEQ ID NO: 1010164 - RNA, 18 nt, Human
uccccucccauccccccc

SEQ ID NO: 1010165 - RNA, 20 nt, Human
ucccuucccaacccccucga

SEQ ID NO: 1010166 - RNA, 23 nt, Human
ugaaggaaauugcccacccaaaa

SEQ ID NO: 1010167 - RNA, 19 nt, Human
ugcaaggaggcgagggcug

SEQ ID NO: 1010168 - RNA, 24 nt, Human
ugcaccccgccuccccccaaaacc

SEQ ID NO: 1010169 - RNA, 26 nt, Human
ugcgcccccucucccucccuucccaa

SEQ ID NO: 1010170 - RNA, 18 nt, Human
ugcuggaaauggcuggac

SEQ ID NO: 1010171 - RNA, 19 nt, Human
uggcagcaggucuggcgga

SEQ ID NO: 1010172 - RNA, 21 nt, Human
uggcggagcggcggcggcggc

SEQ ID NO: 1010173 - RNA, 22 nt, Human
ugggaagcgcucuugcuggaaa

SEQ ID NO: 1010174 - RNA, 20 nt, Human
ugggcuggugggggcggggu

SEQ ID NO: 1010175 - RNA, 26 nt, Human
ugggcuggugggggcggggugagggg

SEQ ID NO: 1010176 - RNA, 22 nt, Human
uggugggggcggggugagggga

SEQ ID NO: 1010177 - RNA, 20 nt, Human
uguccccucccauccccccc

SEQ ID NO: 1010178 - RNA, 21 nt, Human
uucaucuuauucaccacgagc

SEQ ID NO: 1010179 - RNA, 21 nt, Human
uucccaacccccucgaugacu

SEQ ID NO: 1010180 - RNA, 21 nt, Human
uucccagucagccuuucccgc

SEQ ID NO: 1010181 - RNA, 18 nt, Human
uugaaggaaauugcccac

SEQ ID NO: 1010182 - RNA, 19 nt, Human
accacaccuccaccuuccc

SEQ ID NO: 1010183 - RNA, 20 nt, Human
acgcaggcugcccacccugc

SEQ ID NO: 1010184 - RNA, 22 nt, Human
acgggcugccuguguaaguccu

SEQ ID NO: 1010185 - RNA, 21 nt, Human
acugacacgcagaggaugacc

SEQ ID NO: 1010186 - RNA, 21 nt, Human
agccgcaaguuguugacuucu

SEQ ID NO: 1010187 - RNA, 18 nt, Human
caaaagccucugagggga

SEQ ID NO: 1010188 - RNA, 24 nt, Human
cacagaucauuauaugagcugucc

SEQ ID NO: 1010189 - RNA, 21 nt, Human
caccaaucugugcacgaccac

SEQ ID NO: 1010190 - RNA, 18 nt, Human
caccacaccaaucugugc

SEQ ID NO: 1010191 - RNA, 22 nt, Human
cacccugcggcccagcacagcc

SEQ ID NO: 1010192 - RNA, 22 nt, Human
caccuccaccuucccagagccg

SEQ ID NO: 1010193 - RNA, 18 nt, Human
cacggcccagccucuggu

SEQ ID NO: 1010194 - RNA, 25 nt, Human
cacguugguguagguucggguuagc

SEQ ID NO: 1010195 - RNA, 21 nt, Human
cagccuccaugaucugcauga

SEQ ID NO: 1010196 - RNA, 19 nt, Human
caggcccccguugaucgug

SEQ ID NO: 1010197 - RNA, 20 nt, Human
cagguccugggucagugggg

SEQ ID NO: 1010198 - RNA, 19 nt, Human
caugaaucgauuuaucccu

SEQ ID NO: 1010199 - RNA, 20 nt, Human
ccacacauagaucuugaagc

SEQ ID NO: 1010200 - RNA, 20 nt, Human
ccacgcccucuggcaggucc

SEQ ID NO: 1010201 - RNA, 18 nt, Human
ccacggcaccugcccugc

SEQ ID NO: 1010202 - RNA, 24 nt, Human
cccaagugaagaaccauccaauga

SEQ ID NO: 1010203 - RNA, 24 nt, Human
ccccguugaucguggcgcuggugc

SEQ ID NO: 1010204 - RNA, 23 nt, Human
ccgggcuccucccugcuggggga

SEQ ID NO: 1010205 - RNA, 20 nt, Human
ccucaucauccaccacacca

SEQ ID NO: 1010206 - RNA, 26 nt, Human
ccuccacguggccaugcuguagaauu

SEQ ID NO: 1010207 - RNA, 21 nt, Human
ccuccugcagcagguccuggg

SEQ ID NO: 1010208 - RNA, 22 nt, Human
ccucgcgccgagcuucugguuc

SEQ ID NO: 1010209 - RNA, 19 nt, Human
ccucugaggggaguggaag

SEQ ID NO: 1010210 - RNA, 22 nt, Human
ccugccgcugccuccacguggc

SEQ ID NO: 1010211 - RNA, 25 nt, Human
ccuucucagaaaugcuggucuuggg

SEQ ID NO: 1010212 - RNA, 25 nt, Human
cgaccaccaccacguucccuguccc

SEQ ID NO: 1010213 - RNA, 21 nt, Human
cgccaacuccaggaccaccag

SEQ ID NO: 1010214 - RNA, 22 nt, Human
cgcuugggguccacgggcugcc

SEQ ID NO: 1010215 - RNA, 22 nt, Human
cuccaugaucugcaugaggucc

SEQ ID NO: 1010216 - RNA, 20 nt, Human
cuccuuggauuucccaaaga

SEQ ID NO: 1010217 - RNA, 18 nt, Human
cugccauccaccacuucc

SEQ ID NO: 1010218 - RNA, 22 nt, Human
cugccgggcugccauccaccac

SEQ ID NO: 1010219 - RNA, 22 nt, Human
cugguuccugcgccgcuucuca

SEQ ID NO: 1010220 - RNA, 24 nt, Human
cugguuccugcgccgcuucucaga

SEQ ID NO: 1010221 - RNA, 18 nt, Human
cuugggguccacgggcug

SEQ ID NO: 1010222 - RNA, 20 nt, Human
gaccagcacgaugggugugg

SEQ ID NO: 1010223 - RNA, 22 nt, Human
gcacgcaggcugcccacccugc

SEQ ID NO: 1010224 - RNA, 22 nt, Human
gccagccccgagccuucucaga

SEQ ID NO: 1010225 - RNA, 19 nt, Human
gccucugaggggaguggaa

SEQ ID NO: 1010226 - RNA, 19 nt, Human
ggauaggggcagucgagag

SEQ ID NO: 1010227 - RNA, 18 nt, Human
ggcggcacgcaggcugcc

SEQ ID NO: 1010228 - RNA, 20 nt, Human
ggcuguaggucaaagccagc

SEQ ID NO: 1010229 - RNA, 19 nt, Human
gggauaggggcagucgaga

SEQ ID NO: 1010230 - RNA, 21 nt, Human
gggcagucgagagggcuuggg

SEQ ID NO: 1010231 - RNA, 28 nt, Human
guagaauuccuccuuggauuucccaaag

SEQ ID NO: 1010232 - RNA, 22 nt, Human
uacaggcgaacauuggccuucu

SEQ ID NO: 1010233 - RNA, 27 nt, Human
uagaaguccuccuccugcagcaggucc

SEQ ID NO: 1010234 - RNA, 23 nt, Human
uaucucagagaugguugaugcug

SEQ ID NO: 1010235 - RNA, 24 nt, Human
uccaccauccugagcugggccgcu

SEQ ID NO: 1010236 - RNA, 20 nt, Human
uccacgggcugccuguguaa

SEQ ID NO: 1010237 - RNA, 20 nt, Human
ucccaaagauaucuuggaag

SEQ ID NO: 1010238 - RNA, 20 nt, Human
ucccucgcgccgagcuucug

SEQ ID NO: 1010239 - RNA, 19 nt, Human
ucccugccacacauagauc

SEQ ID NO: 1010240 - RNA, 21 nt, Human
ucccugcugggggagucuuca

SEQ ID NO: 1010241 - RNA, 24 nt, Human
uccugggagcccuugagggccugc

SEQ ID NO: 1010242 - RNA, 19 nt, Human
ucgagagggcuuggguuca

SEQ ID NO: 1010243 - RNA, 27 nt, Human
ucucagaaaugcuggucuugggcccau

SEQ ID NO: 1010244 - RNA, 21 nt, Human
ucuccugccgcugccuccacg

SEQ ID NO: 1010245 - RNA, 19 nt, Human
ugacuucugcuguuaucuc

SEQ ID NO: 1010246 - RNA, 22 nt, Human
ugcacgaccaccaccacguucc

SEQ ID NO: 1010247 - RNA, 18 nt, Human
ugcugcugacggagcugc

SEQ ID NO: 1010248 - RNA, 21 nt, Human
uggaagucagagucugagaga

SEQ ID NO: 1010249 - RNA, 20 nt, Human
uggccgggcuccucccugcu

SEQ ID NO: 1010250 - RNA, 19 nt, Human
uggcggcacgcaggcugcc

SEQ ID NO: 1010251 - RNA, 25 nt, Human
ugggagcccuugagggccugcaggg

SEQ ID NO: 1010252 - RNA, 23 nt, Human
uggggcuucgcacagaucauuau

SEQ ID NO: 1010253 - RNA, 21 nt, Human
ugguauguguagagcacaagg

SEQ ID NO: 1010254 - RNA, 22 nt, Human
uguagguauguugggguccagg

SEQ ID NO: 1010255 - RNA, 22 nt, Human
uguccugggagcccuugagggc

SEQ ID NO: 1010256 - RNA, 24 nt, Human
uguggccgggcuccucccugcugg

SEQ ID NO: 1010257 - RNA, 18 nt, Human
uguugggguccaggggau

SEQ ID NO: 1010258 - RNA, 23 nt, Human
uuacaugaaucgauuuaucccuc

SEQ ID NO: 1010259 - RNA, 30 nt, Human
uuagcccuuggccuggaugaagccccacaa

SEQ ID NO: 1010260 - RNA, 18 nt, Human
uuccucagcguugcuguu

SEQ ID NO: 1010261 - RNA, 27 nt, Human
uuccucagcguugcuguucaggccuca

SEQ ID NO: 1010262 - RNA, 21 nt, Human
uucggguuagcccuuggccuc

SEQ ID NO: 1010263 - RNA, 26 nt, Human
uuuucuccugccgcugccuccacgug

SEQ ID NO: 1010264 - RNA, 22 nt, Human
aaauaacaacuuaaaaaucuca

SEQ ID NO: 1010265 - RNA, 18 nt, Human
acauugucaugacaaaaa

SEQ ID NO: 1010266 - RNA, 21 nt, Human
accacacagaaugaauauucu

SEQ ID NO: 1010267 - RNA, 19 nt, Human
acuugaugcaccgugcgug

SEQ ID NO: 1010268 - RNA, 24 nt, Human
agcacccucaacaugauguagccu

SEQ ID NO: 1010269 - RNA, 22 nt, Human
aggaagaaacagggagaggucc

SEQ ID NO: 1010270 - RNA, 20 nt, Human
aucacaaaucccauccaaau

SEQ ID NO: 1010271 - RNA, 26 nt, Human
augauggcaaagaauaauaacaagac

SEQ ID NO: 1010272 - RNA, 22 nt, Human
caaaaaauuuucaccacacaga

SEQ ID NO: 1010273 - RNA, 22 nt, Human
caacacgucaguuaguaaagca

SEQ ID NO: 1010274 - RNA, 23 nt, Human
caagacauuuguuucuccaugcc

SEQ ID NO: 1010275 - RNA, 21 nt, Human
caccacacagaaugaauauuc

SEQ ID NO: 1010276 - RNA, 19 nt, Human
cacccuuguuugaagaagg

SEQ ID NO: 1010277 - RNA, 23 nt, Human
cacccuuguuugaagaaggcaau

SEQ ID NO: 1010278 - RNA, 24 nt, Human
caccgugcgugccccauuaagcug

SEQ ID NO: 1010279 - RNA, 23 nt, Human
cagggagagguccaagaaccuuu

SEQ ID NO: 1010280 - RNA, 24 nt, Human
cuuuuuuuuuuuuuuuucauccuu

SEQ ID NO: 1010281 - RNA, 22 nt, Human
gaaaaagcaugauggcaaagaa

SEQ ID NO: 1010282 - RNA, 20 nt, Human
gaacauuuauuuugaaaaca

SEQ ID NO: 1010283 - RNA, 20 nt, Human
gcucuacguaagccugucgu

SEQ ID NO: 1010284 - RNA, 18 nt, Human
guuacagaguucuaauca

SEQ ID NO: 1010285 - RNA, 19 nt, Human
uaaaaucuccagcacccuc

SEQ ID NO: 1010286 - RNA, 24 nt, Human
uaaaaucuccagcacccucaacau

SEQ ID NO: 1010287 - RNA, 20 nt, Human
ucagaaauaacaacuuaaaa

SEQ ID NO: 1010288 - RNA, 25 nt, Human
uccugcaucacaaaucccauccaaa

SEQ ID NO: 1010289 - RNA, 20 nt, Human
ucuaaucagaaauaacaacu

SEQ ID NO: 1010290 - RNA, 18 nt, Human
ugaaaaagcaugauggca

SEQ ID NO: 1010291 - RNA, 25 nt, Human
ugaaaaagcaugauggcaaagaaua

SEQ ID NO: 1010292 - RNA, 22 nt, Human
ugacaaaaaugaaacuugcuga

SEQ ID NO: 1010293 - RNA, 21 nt, Human
uugaagaaggcaauuuuuuuu

SEQ ID NO: 1010294 - RNA, 23 nt, Human
aaaaauaagccuccaaaccgguu

SEQ ID NO: 1010295 - RNA, 20 nt, Human
aaaauugcuacaaugacagg

SEQ ID NO: 1010296 - RNA, 19 nt, Human
aaacacucacuuuuucuag

SEQ ID NO: 1010297 - RNA, 25 nt, Human
aaacugaccuuacuaacguuuucca

SEQ ID NO: 1010298 - RNA, 24 nt, Human
aaagcuaugaaacuguauagggcu

SEQ ID NO: 1010299 - RNA, 19 nt, Human
aaagugcugggguuacagg

SEQ ID NO: 1010300 - RNA, 24 nt, Human
aaagugcugggguuacaggcauga

SEQ ID NO: 1010301 - RNA, 25 nt, Human
aagcagcugggauuacaagcaccug

SEQ ID NO: 1010302 - RNA, 21 nt, Human
aagugcugggguuacaggcau

SEQ ID NO: 1010303 - RNA, 26 nt, Human
aagugcugggguuacaggcaugagcc

SEQ ID NO: 1010304 - RNA, 24 nt, Human
aaguguacuuaaaacauaguaguu

SEQ ID NO: 1010305 - RNA, 24 nt, Human
accauauuacaaaagcaauuggua

SEQ ID NO: 1010306 - RNA, 18 nt, Human
accauguuggccaggcug

SEQ ID NO: 1010307 - RNA, 24 nt, Human
acccaggcuggagugcaauggugu

SEQ ID NO: 1010308 - RNA, 18 nt, Human
acucugccacccaggcug

SEQ ID NO: 1010309 - RNA, 26 nt, Human
acucugccacccaggcuggagugcaa

SEQ ID NO: 1010310 - RNA, 18 nt, Human
agacaacauuaugaucua

SEQ ID NO: 1010311 - RNA, 26 nt, Human
agaugcuaaaaauaagccuccaaacc

SEQ ID NO: 1010312 - RNA, 24 nt, Human
agcugggauuacaagcaccugcca

SEQ ID NO: 1010313 - RNA, 19 nt, Human
aggaacgcagaagugcuag

SEQ ID NO: 1010314 - RNA, 19 nt, Human
agguuucaccauguuggcc

SEQ ID NO: 1010315 - RNA, 21 nt, Human
agguuucaccauguuggccag

SEQ ID NO: 1010316 - RNA, 22 nt, Human
agguuucaccauguuggccagg

SEQ ID NO: 1010317 - RNA, 23 nt, Human
agugcaauggugugaucuuggcu

SEQ ID NO: 1010318 - RNA, 24 nt, Human
agugcaauggugugaucuuggcuc

SEQ ID NO: 1010319 - RNA, 21 nt, Human
aguuuauuagcaauucagagg

SEQ ID NO: 1010320 - RNA, 24 nt, Human
aucauauuucucaaucugaauaca

SEQ ID NO: 1010321 - RNA, 25 nt, Human
augaccauuuuuccauuuucuuucu

SEQ ID NO: 1010322 - RNA, 23 nt, Human
caaaaaaaaacuaugaacagagu

SEQ ID NO: 1010323 - RNA, 24 nt, Human
caaagugcugggguuacaggcaug

SEQ ID NO: 1010324 - RNA, 18 nt, Human
caacaaagcugcuugucu

SEQ ID NO: 1010325 - RNA, 23 nt, Human
caagcaagcccuuauuucuggcc

SEQ ID NO: 1010326 - RNA, 22 nt, Human
caagcaauucuccugcuucagc

SEQ ID NO: 1010327 - RNA, 18 nt, Human
cacaguaaugcuaaaaca

SEQ ID NO: 1010328 - RNA, 24 nt, Human
caccacaccuggcuaauuuuugua

SEQ ID NO: 1010329 - RNA, 24 nt, Human
caccagaugcuaaaaauaagccuc

SEQ ID NO: 1010330 - RNA, 21 nt, Human
caccauguuggccaggcuggu

SEQ ID NO: 1010331 - RNA, 24 nt, Human
caccauguuggccaggcuggucuc

SEQ ID NO: 1010332 - RNA, 27 nt, Human
caccauguuggccaggcuggucucaaa

SEQ ID NO: 1010333 - RNA, 24 nt, Human
caccugggccucccccaaagugcu

SEQ ID NO: 1010334 - RNA, 22 nt, Human
cacucugccacccaggcuggag

SEQ ID NO: 1010335 - RNA, 23 nt, Human
cacucugccacccaggcuggagu

SEQ ID NO: 1010336 - RNA, 23 nt, Human
cagccucccaagcagcugggauu

SEQ ID NO: 1010337 - RNA, 22 nt, Human
cauaaaggcagcaacaaagcug

SEQ ID NO: 1010338 - RNA, 22 nt, Human
caucccuuccuaggaagucuca

SEQ ID NO: 1010339 - RNA, 24 nt, Human
caugagauuaaggcauuaaaauca

SEQ ID NO: 1010340 - RNA, 24 nt, Human
cauguuggccaggcuggucucaaa

SEQ ID NO: 1010341 - RNA, 23 nt, Human
ccaaagugcugggguuacaggca

SEQ ID NO: 1010342 - RNA, 24 nt, Human
ccaaagugcugggguuacaggcau

SEQ ID NO: 1010343 - RNA, 22 nt, Human
ccaagcagcugggauuacaagc

SEQ ID NO: 1010344 - RNA, 23 nt, Human
ccaauaaucugccaucuccauga

SEQ ID NO: 1010345 - RNA, 20 nt, Human
ccauauuacaaaagcaauug

SEQ ID NO: 1010346 - RNA, 24 nt, Human
cccaaagugcugggguuacaggca

SEQ ID NO: 1010347 - RNA, 19 nt, Human
cccaagcagcugggauuac

SEQ ID NO: 1010348 - RNA, 24 nt, Human
ccccaaagugcugggguuacaggc

SEQ ID NO: 1010349 - RNA, 19 nt, Human
ccggguucaagcaauucuc

SEQ ID NO: 1010350 - RNA, 22 nt, Human
ccggguucaagcaauucuccug

SEQ ID NO: 1010351 - RNA, 18 nt, Human
ccuccaaccuacuuguuu

SEQ ID NO: 1010352 - RNA, 23 nt, Human
ccuccggguucaagcaauucucc

SEQ ID NO: 1010353 - RNA, 20 nt, Human
ccugaccucaaaugauccac

SEQ ID NO: 1010354 - RNA, 24 nt, Human
ccugaccucaaaugauccacccac

SEQ ID NO: 1010355 - RNA, 23 nt, Human
ccugccuccggguucaagcaauu

SEQ ID NO: 1010356 - RNA, 22 nt, Human
cuaacaaaauugcuacaaugac

SEQ ID NO: 1010357 - RNA, 20 nt, Human
cuaauuuuuguauuuuuagg

SEQ ID NO: 1010358 - RNA, 24 nt, Human
cucaaaugauccacccaccugggc

SEQ ID NO: 1010359 - RNA, 19 nt, Human
cucagcuuaaugcaggaaa

SEQ ID NO: 1010360 - RNA, 23 nt, Human
cugcuucagccucccaagcagcu

SEQ ID NO: 1010361 - RNA, 23 nt, Human
cugggccucccccaaagugcugg

SEQ ID NO: 1010362 - RNA, 19 nt, Human
cuuagauuaaggcuaaugc

SEQ ID NO: 1010363 - RNA, 19 nt, Human
cuuauuuucuucacuucug

SEQ ID NO: 1010364 - RNA, 22 nt, Human
cuuccuguagcaugggcaaaua

SEQ ID NO: 1010365 - RNA, 20 nt, Human
cuucugucccuucaagucuu

SEQ ID NO: 1010366 - RNA, 21 nt, Human
gaacagaguucaaauacagga

SEQ ID NO: 1010367 - RNA, 18 nt, Human
gaagauuacuacugcaaa

SEQ ID NO: 1010368 - RNA, 20 nt, Human
gaguacaguuacagcaaguc

SEQ ID NO: 1010369 - RNA, 21 nt, Human
gcaaccccugccuccggguuc

SEQ ID NO: 1010370 - RNA, 21 nt, Human
gcucacugcaaccccugccuc

SEQ ID NO: 1010371 - RNA, 23 nt, Human
gcuggucucaaacuccugaccuc

SEQ ID NO: 1010372 - RNA, 21 nt, Human
ggcaagcaagcccuuauuucu

SEQ ID NO: 1010373 - RNA, 22 nt, Human
ggcuggagugcaauggugugau

SEQ ID NO: 1010374 - RNA, 24 nt, Human
ggcuggucucaaacuccugaccuc

SEQ ID NO: 1010375 - RNA, 20 nt, Human
gggaaaaaucugacucagua

SEQ ID NO: 1010376 - RNA, 22 nt, Human
ggguuacaggcaugagccacug

SEQ ID NO: 1010377 - RNA, 22 nt, Human
gguuacaggcaugagccacugc

SEQ ID NO: 1010378 - RNA, 22 nt, Human
gugauuuuugaaugcugcacag

SEQ ID NO: 1010379 - RNA, 23 nt, Human
uaaaaacaaacuacaugagauua

SEQ ID NO: 1010380 - RNA, 24 nt, Human
uaaaaacaccagcuuuucagaagu

SEQ ID NO: 1010381 - RNA, 19 nt, Human
uaaaaauaagccuccaaac

SEQ ID NO: 1010382 - RNA, 18 nt, Human
uaaaacacccagcuuuga

SEQ ID NO: 1010383 - RNA, 24 nt, Human
uaaaacacccagcuuugagauccu

SEQ ID NO: 1010384 - RNA, 19 nt, Human
uaaaggcagcaacaaagcu

SEQ ID NO: 1010385 - RNA, 26 nt, Human
uaaaggcagcaacaaagcuggagacc

SEQ ID NO: 1010386 - RNA, 20 nt, Human
uaaaucuucuuccaaaaaag

SEQ ID NO: 1010387 - RNA, 20 nt, Human
uaacuucuugggguccuccu

SEQ ID NO: 1010388 - RNA, 21 nt, Human
uaacuucuugggguccuccuc

SEQ ID NO: 1010389 - RNA, 21 nt, Human
uaauaucaccuugccuuucaa

SEQ ID NO: 1010390 - RNA, 18 nt, Human
uaaugcauauaacagacu

SEQ ID NO: 1010391 - RNA, 22 nt, Human
uacaaaagcaauugguacccau

SEQ ID NO: 1010392 - RNA, 22 nt, Human
uacaagcaccugccaccacacc

SEQ ID NO: 1010393 - RNA, 23 nt, Human
uacacaguaaugcuaaaacaccc

SEQ ID NO: 1010394 - RNA, 18 nt, Human
uacaggacuguuuguuuu

SEQ ID NO: 1010395 - RNA, 23 nt, Human
uacaggcaugagccacugcaccc

SEQ ID NO: 1010396 - RNA, 18 nt, Human
uagaaccuuuguauccuc

SEQ ID NO: 1010397 - RNA, 23 nt, Human
uagguuucaccauguuggccagg

SEQ ID NO: 1010398 - RNA, 22 nt, Human
uaucaccuugccuuucaaaaua

SEQ ID NO: 1010399 - RNA, 21 nt, Human
uauuuuaaaucuucuuccaaa

SEQ ID NO: 1010400 - RNA, 22 nt, Human
ucaaucugaauacauguuaaaa

SEQ ID NO: 1010401 - RNA, 24 nt, Human
ucacucugccacccaggcuggagu

SEQ ID NO: 1010402 - RNA, 20 nt, Human
ucacugcaaccccugccucc

SEQ ID NO: 1010403 - RNA, 23 nt, Human
ucacugcaaccccugccuccggg

SEQ ID NO: 1010404 - RNA, 25 nt, Human
ucacugcaaccccugccuccggguu

SEQ ID NO: 1010405 - RNA, 20 nt, Human
ucagccucccaagcagcugg

SEQ ID NO: 1010406 - RNA, 23 nt, Human
ucaguaacuucuugggguccucc

SEQ ID NO: 1010407 - RNA, 23 nt, Human
uccacccaccugggccuccccca

SEQ ID NO: 1010408 - RNA, 18 nt, Human
uccugaccucaaaugauc

SEQ ID NO: 1010409 - RNA, 20 nt, Human
ucuaaaguguacuuaaaaca

SEQ ID NO: 1010410 - RNA, 23 nt, Human
ucucacucugccacccaggcugg

SEQ ID NO: 1010411 - RNA, 24 nt, Human
ucucacucugccacccaggcugga

SEQ ID NO: 1010412 - RNA, 26 nt, Human
ucucacucugccacccaggcuggagu

SEQ ID NO: 1010413 - RNA, 27 nt, Human
ucucacucugccacccaggcuggagug

SEQ ID NO: 1010414 - RNA, 24 nt, Human
ucugccacccaggcuggagugcaa

SEQ ID NO: 1010415 - RNA, 20 nt, Human
ugaaauuaaaaacaaacuac

SEQ ID NO: 1010416 - RNA, 24 nt, Human
ugaacagaguucaaauacaggacu

SEQ ID NO: 1010417 - RNA, 20 nt, Human
ugaccuuacuaacguuuucc

SEQ ID NO: 1010418 - RNA, 18 nt, Human
ugagacagagucucacuc

SEQ ID NO: 1010419 - RNA, 22 nt, Human
ugagacagagucucacucugcc

SEQ ID NO: 1010420 - RNA, 26 nt, Human
ugauccacccaccugggccuccccca

SEQ ID NO: 1010421 - RNA, 18 nt, Human
ugaugagaacaccugcuu

SEQ ID NO: 1010422 - RNA, 20 nt, Human
ugaugagaacaccugcuuga

SEQ ID NO: 1010423 - RNA, 24 nt, Human
ugcaaccccugccuccggguucaa

SEQ ID NO: 1010424 - RNA, 23 nt, Human
ugcaauggugugaucuuggcucc

SEQ ID NO: 1010425 - RNA, 19 nt, Human
ugcacccggccacuguugc

SEQ ID NO: 1010426 - RNA, 22 nt, Human
ugcaggaaauugguuuaauuuc

SEQ ID NO: 1010427 - RNA, 20 nt, Human
ugccacccaggcuggagugc

SEQ ID NO: 1010428 - RNA, 23 nt, Human
ugccacuuucuuuuugguagcuu

SEQ ID NO: 1010429 - RNA, 22 nt, Human
ugccuccggguucaagcaauuc

SEQ ID NO: 1010430 - RNA, 18 nt, Human
ugcuaaaaauaagccucc

SEQ ID NO: 1010431 - RNA, 24 nt, Human
ugcuucagccucccaagcagcugg

SEQ ID NO: 1010432 - RNA, 19 nt, Human
uggagugcaauggugugau

SEQ ID NO: 1010433 - RNA, 23 nt, Human
uggagugcaauggugugaucuug

SEQ ID NO: 1010434 - RNA, 24 nt, Human
uggagugcaauggugugaucuugg

SEQ ID NO: 1010435 - RNA, 24 nt, Human
uggauucaguguuuaaaaacugac

SEQ ID NO: 1010436 - RNA, 24 nt, Human
uggccaggcuggucucaaacuccu

SEQ ID NO: 1010437 - RNA, 18 nt, Human
ugggaaaaaucugacuca

SEQ ID NO: 1010438 - RNA, 21 nt, Human
ugggaaaaaucugacucagua

SEQ ID NO: 1010439 - RNA, 22 nt, Human
ugggauuacaagcaccugccac

SEQ ID NO: 1010440 - RNA, 24 nt, Human
ugggauuacaagcaccugccacca

SEQ ID NO: 1010441 - RNA, 18 nt, Human
ugggguuacaggcaugag

SEQ ID NO: 1010442 - RNA, 19 nt, Human
ugggguuacaggcaugagc

SEQ ID NO: 1010443 - RNA, 22 nt, Human
ugggguuacaggcaugagccac

SEQ ID NO: 1010444 - RNA, 22 nt, Human
ugggguuacaggcaugagccac

SEQ ID NO: 1010445 - RNA, 24 nt, Human
ugggguuacaggcaugagccacug

SEQ ID NO: 1010446 - RNA, 24 nt, Human
ugggguuacaggcaugagccacug

SEQ ID NO: 1010447 - RNA, 24 nt, Human
uggguauuaauauuucuggguucu

SEQ ID NO: 1010448 - RNA, 24 nt, Human
uuaauucuuaucuaccuucuacau

SEQ ID NO: 1010449 - RNA, 21 nt, Human
uuacaggcaugagccacugca

SEQ ID NO: 1010450 - RNA, 21 nt, Human
uuagguuugcuuuuaguuucu

SEQ ID NO: 1010451 - RNA, 23 nt, Human
uucaaaauaucccuccaaccuuu

SEQ ID NO: 1010452 - RNA, 24 nt, Human
uucaagcaauucuccugcuucagc

SEQ ID NO: 1010453 - RNA, 22 nt, Human
uucauagugucaacugaccuug

SEQ ID NO: 1010454 - RNA, 27 nt, Human
uuccagaaaccauuuccuuccuggugg

SEQ ID NO: 1010455 - RNA, 22 nt, Human
uuguauccucuuuguuuuuagu

SEQ ID NO: 1010456 - RNA, 23 nt, Human
uuguauuuuuagguuucaccaug

SEQ ID NO: 1010457 - RNA, 25 nt, Human
uuuaaaaaugaccauuuuuccauuu

SEQ ID NO: 1010458 - RNA, 24 nt, Human
uuuacacaguaaugcuaaaacacc

SEQ ID NO: 1010459 - RNA, 24 nt, Human
uuuagguuucaccauguuggccag

SEQ ID NO: 1010460 - RNA, 24 nt, Human
uuucaccauguuggccaggcuggu

SEQ ID NO: 1010461 - RNA, 21 nt, Human
uuuccugaugaguuuccuuua

SEQ ID NO: 1010462 - RNA, 24 nt, Human
uuuuuuuuuuuuuuuuuuaauuuu

SEQ ID NO: 1010463 - RNA, 20 nt, Human
agaagacagcucugaucuca

SEQ ID NO: 1010464 - RNA, 21 nt, Human
agacagcucugaucucagccc

SEQ ID NO: 1010465 - RNA, 21 nt, Human
agggcuuacaccugaaguucu

SEQ ID NO: 1010466 - RNA, 23 nt, Human
cacggagaccgcagauccucacu

SEQ ID NO: 1010467 - RNA, 20 nt, Human
cagaagacagcucugaucuc

SEQ ID NO: 1010468 - RNA, 23 nt, Human
ccagaagacagcucugaucucag

SEQ ID NO: 1010469 - RNA, 18 nt, Human
ccccaccagcguccuucu

SEQ ID NO: 1010470 - RNA, 20 nt, Human
ccgcagauccucacuacuca

SEQ ID NO: 1010471 - RNA, 20 nt, Human
gcucugaucucagcccccac

SEQ ID NO: 1010472 - RNA, 25 nt, Human
uccuucucuuccaagcacagcucuc

SEQ ID NO: 1010473 - RNA, 21 nt, Human
ucuugucagcuuuuccggggc

SEQ ID NO: 1010474 - RNA, 20 nt, Human
aagggacaccgaguguguug

SEQ ID NO: 1010475 - RNA, 22 nt, Human
accccaguggguuggccagguu

SEQ ID NO: 1010476 - RNA, 23 nt, Human
acugagguugaggguauggccag

SEQ ID NO: 1010477 - RNA, 24 nt, Human
aucugaguuuauucugccacugcu

SEQ ID NO: 1010478 - RNA, 26 nt, Human
cauuuccagcccacugagguugaggg

SEQ ID NO: 1010479 - RNA, 21 nt, Human
ccaggaugaaagggacaccga

SEQ ID NO: 1010480 - RNA, 19 nt, Human
cccacugucauuuccagcc

SEQ ID NO: 1010481 - RNA, 23 nt, Human
ccccuaccccaguggguuggcca

SEQ ID NO: 1010482 - RNA, 20 nt, Human
cccuaccccuaccccagugg

SEQ ID NO: 1010483 - RNA, 23 nt, Human
ccgaguguguuggggugggggug

SEQ ID NO: 1010484 - RNA, 20 nt, Human
gcuuugaucccuaccccuac

SEQ ID NO: 1010485 - RNA, 19 nt, Human
ucccuaggagccggacgcg

SEQ ID NO: 1010486 - RNA, 26 nt, Human
ugaaagggacaccgaguguguugggg

SEQ ID NO: 1010487 - RNA, 18 nt, Human
uggcuggcuuugaucccu

SEQ ID NO: 1010488 - RNA, 20 nt, Human
ugggguggggguggcuggcu

SEQ ID NO: 1010489 - RNA, 20 nt, Human
uuuauucugccacugcuaca

SEQ ID NO: 1010490 - RNA, 18 nt, Human
uuuuuuuuuuuuuuuuug

SEQ ID NO: 1010491 - RNA, 20 nt, Human
aaaaacaucacaaacaucug

SEQ ID NO: 1010492 - RNA, 22 nt, Human
aaaaauggagaaaacaaaaaga

SEQ ID NO: 1010493 - RNA, 27 nt, Human
aaacaucacaaacaucuguuggggagc

SEQ ID NO: 1010494 - RNA, 20 nt, Human
aaagucacgaucuaugaaag

SEQ ID NO: 1010495 - RNA, 22 nt, Human
aagacagcaccacgcagaaaac

SEQ ID NO: 1010496 - RNA, 20 nt, Human
aaggaagaaaaaaaaaaggg

SEQ ID NO: 1010497 - RNA, 20 nt, Human
aaguccucuuuuucuucuuc

SEQ ID NO: 1010498 - RNA, 20 nt, Human
aagugcagccagccuagcug

SEQ ID NO: 1010499 - RNA, 21 nt, Human
agacaggaauggaagacagca

SEQ ID NO: 1010500 - RNA, 22 nt, Human
agccacaaaaacaucacaaaca

SEQ ID NO: 1010501 - RNA, 24 nt, Human
agcuacuugggaggcugagguggg

SEQ ID NO: 1010502 - RNA, 18 nt, Human
agcugccugaacugagca

SEQ ID NO: 1010503 - RNA, 19 nt, Human
aggaaaaaaaauggagaaa

SEQ ID NO: 1010504 - RNA, 25 nt, Human
aggaaaaaaaauggagaaaacaaaa

SEQ ID NO: 1010505 - RNA, 19 nt, Human
aggaauggaagacagcacc

SEQ ID NO: 1010506 - RNA, 24 nt, Human
aggaucgcuugagcccaggaguuc

SEQ ID NO: 1010507 - RNA, 24 nt, Human
aggcugaggugggaggaucgcuug

SEQ ID NO: 1010508 - RNA, 24 nt, Human
agggguuuucugguggccggguac

SEQ ID NO: 1010509 - RNA, 23 nt, Human
aggugggaggaucgcuugagccc

SEQ ID NO: 1010510 - RNA, 18 nt, Human
agugagacaggaauggaa

SEQ ID NO: 1010511 - RNA, 23 nt, Human
aucgcuugagcccaggaguucaa

SEQ ID NO: 1010512 - RNA, 22 nt, Human
caagauacagucuaaaaacuca

SEQ ID NO: 1010513 - RNA, 19 nt, Human
cacauggcaaaaauggaau

SEQ ID NO: 1010514 - RNA, 18 nt, Human
cacauuagccauugguga

SEQ ID NO: 1010515 - RNA, 24 nt, Human
caccgcccuccagcagagcugccu

SEQ ID NO: 1010516 - RNA, 23 nt, Human
cagcacuucaucucaaaggaaaa

SEQ ID NO: 1010517 - RNA, 24 nt, Human
cagcuacuugggaggcugaggugg

SEQ ID NO: 1010518 - RNA, 18 nt, Human
ccacagcugaacacagcc

SEQ ID NO: 1010519 - RNA, 21 nt, Human
ccagugaaggaagaaaaaaaa

SEQ ID NO: 1010520 - RNA, 26 nt, Human
cccacagcugaacacagcccuagggc

SEQ ID NO: 1010521 - RNA, 25 nt, Human
cccaccauggugacagccacaaaaa

SEQ ID NO: 1010522 - RNA, 18 nt, Human
cccaucgccgucggccac

SEQ ID NO: 1010523 - RNA, 21 nt, Human
cccccuccgauccccugaccc

SEQ ID NO: 1010524 - RNA, 21 nt, Human
cccguggagcaagugcagcca

SEQ ID NO: 1010525 - RNA, 19 nt, Human
ccgcccuccagcagagcug

SEQ ID NO: 1010526 - RNA, 21 nt, Human
ccgcuguacuccaaccuaggc

SEQ ID NO: 1010527 - RNA, 22 nt, Human
ccgcuguacuccaaccuaggca

SEQ ID NO: 1010528 - RNA, 22 nt, Human
ccuagcugcagaucucucgcug

SEQ ID NO: 1010529 - RNA, 18 nt, Human
ccuguagucccagcuacu

SEQ ID NO: 1010530 - RNA, 21 nt, Human
ccuguagucccagcuacuugg

SEQ ID NO: 1010531 - RNA, 19 nt, Human
ccuucccagcuuugaaguc

SEQ ID NO: 1010532 - RNA, 21 nt, Human
cgacucgaugacacauggcaa

SEQ ID NO: 1010533 - RNA, 18 nt, Human
cucaaaaucagagaauuc

SEQ ID NO: 1010534 - RNA, 18 nt, Human
cucaaaggaaaaaaaaug

SEQ ID NO: 1010535 - RNA, 24 nt, Human
cucaaaggaaaaaaaauggagaaa

SEQ ID NO: 1010536 - RNA, 21 nt, Human
cugaaagaaucccaccauggu

SEQ ID NO: 1010537 - RNA, 23 nt, Human
cugacucagugaauuuccaggag

SEQ ID NO: 1010538 - RNA, 19 nt, Human
cuugaucuuuccuuuuaau

SEQ ID NO: 1010539 - RNA, 22 nt, Human
gagcaagugugaguccacccau

SEQ ID NO: 1010540 - RNA, 21 nt, Human
gaggugggaggaucgcuugag

SEQ ID NO: 1010541 - RNA, 22 nt, Human
gauucuaaaguuggcaauuuua

SEQ ID NO: 1010542 - RNA, 20 nt, Human
gcaccgcccuccagcagagc

SEQ ID NO: 1010543 - RNA, 23 nt, Human
gccaaaucuucuuuaucucgaaa

SEQ ID NO: 1010544 - RNA, 24 nt, Human
gcccaggaguucaaggcugcagug

SEQ ID NO: 1010545 - RNA, 22 nt, Human
gccggguacaaggaagcaccca

SEQ ID NO: 1010546 - RNA, 24 nt, Human
ggaaaauaacacaaagucacgauc

SEQ ID NO: 1010547 - RNA, 23 nt, Human
ggaucgcuugagcccaggaguuc

SEQ ID NO: 1010548 - RNA, 22 nt, Human
ggcauaaaucagacaagaagaa

SEQ ID NO: 1010549 - RNA, 19 nt, Human
gggguuuucugguggccgg

SEQ ID NO: 1010550 - RNA, 23 nt, Human
gggguuuucugguggccggguac

SEQ ID NO: 1010551 - RNA, 24 nt, Human
gguggccggguacaaggaagcacc

SEQ ID NO: 1010552 - RNA, 23 nt, Human
gucucauucugaaagaaucccac

SEQ ID NO: 1010553 - RNA, 18 nt, Human
uaaccacgggcauaaauc

SEQ ID NO: 1010554 - RNA, 24 nt, Human
uaagcagcuggaugcaugugcaca

SEQ ID NO: 1010555 - RNA, 25 nt, Human
uacaaggaagcacccaucuuaagca

SEQ ID NO: 1010556 - RNA, 22 nt, Human
uagaaggaacuaaaacuuccug

SEQ ID NO: 1010557 - RNA, 18 nt, Human
uauauugcccacagcuga

SEQ ID NO: 1010558 - RNA, 19 nt, Human
uaugacagcguuguauaaa

SEQ ID NO: 1010559 - RNA, 21 nt, Human
uauugugauccagaacuccca

SEQ ID NO: 1010560 - RNA, 23 nt, Human
ucaaucccccuccgauccccuga

SEQ ID NO: 1010561 - RNA, 18 nt, Human
ucagugaauuuccaggag

SEQ ID NO: 1010562 - RNA, 23 nt, Human
ucgcuugagcccaggaguucaag

SEQ ID NO: 1010563 - RNA, 24 nt, Human
ucgcuugagcccaggaguucaagg

SEQ ID NO: 1010564 - RNA, 21 nt, Human
ucuaugaaagaggaguuccag

SEQ ID NO: 1010565 - RNA, 21 nt, Human
ucuaugaacacauaugacaaa

SEQ ID NO: 1010566 - RNA, 22 nt, Human
ucucagucuaaucugaauccau

SEQ ID NO: 1010567 - RNA, 19 nt, Human
ucuguuggggagcgacucg

SEQ ID NO: 1010568 - RNA, 18 nt, Human
ucuucuucuucugguuua

SEQ ID NO: 1010569 - RNA, 22 nt, Human
ucuuguuugagaaugaaaaccc

SEQ ID NO: 1010570 - RNA, 18 nt, Human
ugaaagaaucccaccaug

SEQ ID NO: 1010571 - RNA, 19 nt, Human
ugaaagaaucccaccaugg

SEQ ID NO: 1010572 - RNA, 21 nt, Human
ugaaagaaucccaccauggug

SEQ ID NO: 1010573 - RNA, 21 nt, Human
ugaaagaggaguuccaggggu

SEQ ID NO: 1010574 - RNA, 27 nt, Human
ugaaggaagaaaaaaaaaagggggggg

SEQ ID NO: 1010575 - RNA, 22 nt, Human
ugaauccauacauuaaaacaaa

SEQ ID NO: 1010576 - RNA, 19 nt, Human
ugacaaaaucuuacacaua

SEQ ID NO: 1010577 - RNA, 24 nt, Human
ugacagccacaaaaacaucacaaa

SEQ ID NO: 1010578 - RNA, 20 nt, Human
ugagaaugaaaacccuuuuu

SEQ ID NO: 1010579 - RNA, 18 nt, Human
ugaggugggaggaucgcu

SEQ ID NO: 1010580 - RNA, 20 nt, Human
ugaggugggaggaucgcuug

SEQ ID NO: 1010581 - RNA, 22 nt, Human
ugaggugggaggaucgcuugag

SEQ ID NO: 1010582 - RNA, 24 nt, Human
ugaggugggaggaucgcuugagcc

SEQ ID NO: 1010583 - RNA, 20 nt, Human
ugcaagugaugagacgaaca

SEQ ID NO: 1010584 - RNA, 22 nt, Human
ugcagaucucucgcuggggucc

SEQ ID NO: 1010585 - RNA, 21 nt, Human
ugcccacagcugaacacagcc

SEQ ID NO: 1010586 - RNA, 23 nt, Human
ugccugaacugagcaagugugag

SEQ ID NO: 1010587 - RNA, 24 nt, Human
ugccuguagucccagcuacuuggg

SEQ ID NO: 1010588 - RNA, 21 nt, Human
uggcaaaaauggaaucucaga

SEQ ID NO: 1010589 - RNA, 23 nt, Human
uggcaaaaauggaaucucagaug

SEQ ID NO: 1010590 - RNA, 19 nt, Human
uggcaccgcccuccagcag

SEQ ID NO: 1010591 - RNA, 19 nt, Human
ugggaggcugaggugggag

SEQ ID NO: 1010592 - RNA, 23 nt, Human
ugggaggcugaggugggaggauc

SEQ ID NO: 1010593 - RNA, 24 nt, Human
ugggaggcugaggugggaggaucg

SEQ ID NO: 1010594 - RNA, 23 nt, Human
ugggggugguggcaggugccugu

SEQ ID NO: 1010595 - RNA, 19 nt, Human
uggugacagccacaaaaac

SEQ ID NO: 1010596 - RNA, 24 nt, Human
ugguggcaggugccuguaguccca

SEQ ID NO: 1010597 - RNA, 21 nt, Human
uuagauaaaccaauauuagaa

SEQ ID NO: 1010598 - RNA, 21 nt, Human
uugaacacugcauaaauagau

SEQ ID NO: 1010599 - RNA, 21 nt, Human
uugagcccaggaguucaaggc

SEQ ID NO: 1010600 - RNA, 24 nt, Human
uugggaggcugaggugggaggauc

SEQ ID NO: 1010601 - RNA, 21 nt, Human
uuuaagguggcacaauuuuaa

SEQ ID NO: 1010602 - RNA, 21 nt, Human
uuugaaguccucuuuuucuuc

SEQ ID NO: 1010603 - RNA, 20 nt, Human
uuugagaaugaaaacccuuu

SEQ ID NO: 1010604 - RNA, 20 nt, Human
uuuuuuggucaagauucuaa

SEQ ID NO: 1010605 - RNA, 22 nt, Human
aaaaacaucccaauggaaaaaa

SEQ ID NO: 1010606 - RNA, 21 nt, Human
aaauggcccuuuuuugaggau

SEQ ID NO: 1010607 - RNA, 22 nt, Human
aacccauccacuccaauuucug

SEQ ID NO: 1010608 - RNA, 22 nt, Human
aagaaaacggacacaauuuugg

SEQ ID NO: 1010609 - RNA, 24 nt, Human
aagacuguuauccaaucuagauaa

SEQ ID NO: 1010610 - RNA, 21 nt, Human
aagaugucuuuauaaaguuuu

SEQ ID NO: 1010611 - RNA, 21 nt, Human
aaucauuugugacaagccuaa

SEQ ID NO: 1010612 - RNA, 24 nt, Human
acacuuacagaacggcaagaaaac

SEQ ID NO: 1010613 - RNA, 23 nt, Human
acccauccacuccaauuucugca

SEQ ID NO: 1010614 - RNA, 21 nt, Human
agacaccaaccagauuuuccu

SEQ ID NO: 1010615 - RNA, 22 nt, Human
aggcagaacccauccacuccaa

SEQ ID NO: 1010616 - RNA, 18 nt, Human
auaaaguuuuuuucaaga

SEQ ID NO: 1010617 - RNA, 24 nt, Human
auuuuccucccaagcaaaacaaaa

SEQ ID NO: 1010618 - RNA, 24 nt, Human
caagaaauccccagguaggccaaa

SEQ ID NO: 1010619 - RNA, 24 nt, Human
cacccuaagaaaacacaaggugga

SEQ ID NO: 1010620 - RNA, 19 nt, Human
cacuuguaagacaccaacc

SEQ ID NO: 1010621 - RNA, 21 nt, Human
caugcaaauaaaagaaagcuu

SEQ ID NO: 1010622 - RNA, 20 nt, Human
ccaagcaaaacaaaaugaac

SEQ ID NO: 1010623 - RNA, 24 nt, Human
ccaaucccagaggugccauuuagc

SEQ ID NO: 1010624 - RNA, 22 nt, Human
ccgcuccgaccccggcugcucc

SEQ ID NO: 1010625 - RNA, 19 nt, Human
ccucccaauuuaaggcaga

SEQ ID NO: 1010626 - RNA, 19 nt, Human
cggcuuggaguccucccaa

SEQ ID NO: 1010627 - RNA, 22 nt, Human
cggcuuggaguccucccaauuu

SEQ ID NO: 1010628 - RNA, 23 nt, Human
cuaaacugcuuucaggaaaaaag

SEQ ID NO: 1010629 - RNA, 22 nt, Human
cucaugcaaauaaaagaaagcu

SEQ ID NO: 1010630 - RNA, 23 nt, Human
cucucaugcaaauaaaagaaagc

SEQ ID NO: 1010631 - RNA, 22 nt, Human
cuugaggagccgcuccgacccc

SEQ ID NO: 1010632 - RNA, 21 nt, Human
gaacaaguucaaucaaaaaca

SEQ ID NO: 1010633 - RNA, 18 nt, Human
gcuccgaccccggcugcu

SEQ ID NO: 1010634 - RNA, 20 nt, Human
gggaauucucuaauuguauc

SEQ ID NO: 1010635 - RNA, 24 nt, Human
guaucaugugggccuuuugaaagu

SEQ ID NO: 1010636 - RNA, 20 nt, Human
uaaaacacuuacagaacggc

SEQ ID NO: 1010637 - RNA, 18 nt, Human
uaacacagauacgacaga

SEQ ID NO: 1010638 - RNA, 23 nt, Human
uacaugcuagaaaacauuaacac

SEQ ID NO: 1010639 - RNA, 27 nt, Human
uagcacagaaggaaaaaguaugucagu

SEQ ID NO: 1010640 - RNA, 24 nt, Human
ucacacccgccgcugggcuccccc

SEQ ID NO: 1010641 - RNA, 18 nt, Human
ucugcaguuuaaaacuuc

SEQ ID NO: 1010642 - RNA, 23 nt, Human
ugaaaguaacaaacagaaggcca

SEQ ID NO: 1010643 - RNA, 20 nt, Human
ugaggaugggagaggaaggg

SEQ ID NO: 1010644 - RNA, 26 nt, Human
ugaggaugggagaggaaggguuggaa

SEQ ID NO: 1010645 - RNA, 19 nt, Human
uggacuaaacugcuuucag

SEQ ID NO: 1010646 - RNA, 20 nt, Human
ugggagaggaaggguugggc

SEQ ID NO: 1010647 - RNA, 23 nt, Human
uuauuuuccucccaagcaaaaca

SEQ ID NO: 1010648 - RNA, 22 nt, Human
uucccggcuuggaguccuccca

SEQ ID NO: 1010649 - RNA, 21 nt, Human
uugauacagguuggaaaaggg

SEQ ID NO: 1010650 - RNA, 21 nt, Human
uugguaguggcucucucaugc

SEQ ID NO: 1010651 - RNA, 18 nt, Human
aaccagacagcccugcua

SEQ ID NO: 1010652 - RNA, 22 nt, Human
aagcaccgaggggacacccacc

SEQ ID NO: 1010653 - RNA, 21 nt, Human
accagacagcccugcuaccau

SEQ ID NO: 1010654 - RNA, 18 nt, Human
caccuugauggccagcuc

SEQ ID NO: 1010655 - RNA, 23 nt, Human
ccaugcccccgcuccucagcauu

SEQ ID NO: 1010656 - RNA, 20 nt, Human
cuaccaugcccccgcuccuc

SEQ ID NO: 1010657 - RNA, 21 nt, Human
cuccgugcggccacaaccaua

SEQ ID NO: 1010658 - RNA, 19 nt, Human
cuccucagcauugcucuag

SEQ ID NO: 1010659 - RNA, 21 nt, Human
gcuucugguuaauggcucgag

SEQ ID NO: 1010660 - RNA, 21 nt, Human
guggagggcugggcacccaca

SEQ ID NO: 1010661 - RNA, 24 nt, Human
uaccaugcccccgcuccucagcau

SEQ ID NO: 1010662 - RNA, 24 nt, Human
ucaucugagacauccuucuguugc

SEQ ID NO: 1010663 - RNA, 25 nt, Human
ucccccagcuucugguuaauggcuc

SEQ ID NO: 1010664 - RNA, 18 nt, Human
uccgugcggccacaacca

SEQ ID NO: 1010665 - RNA, 20 nt, Human
uccgugcggccacaaccaua

SEQ ID NO: 1010666 - RNA, 19 nt, Human
uguggagggcugggcaccc

SEQ ID NO: 1010667 - RNA, 18 nt, Human
uuuuuuuuuuuuuuuuug

SEQ ID NO: 1010668 - RNA, 19 nt, Human
aaaagcaugccccaacuag

SEQ ID NO: 1010669 - RNA, 22 nt, Human
aaccugcagccgucgccuccuc

SEQ ID NO: 1010670 - RNA, 20 nt, Human
acaaaagggcuacccccccg

SEQ ID NO: 1010671 - RNA, 20 nt, Human
acagauccugggaaccugca

SEQ ID NO: 1010672 - RNA, 20 nt, Human
accaccaccgaccauccucc

SEQ ID NO: 1010673 - RNA, 18 nt, Human
acccaaugcccaggacuu

SEQ ID NO: 1010674 - RNA, 25 nt, Human
agggcacccuucacacuggagcccc

SEQ ID NO: 1010675 - RNA, 18 nt, Human
caccaccaccgaccaucc

SEQ ID NO: 1010676 - RNA, 22 nt, Human
cacuggagccccagagagugug

SEQ ID NO: 1010677 - RNA, 23 nt, Human
cagccggugccaggugaucccaa

SEQ ID NO: 1010678 - RNA, 21 nt, Human
caucaccaccaccgaccaucc

SEQ ID NO: 1010679 - RNA, 19 nt, Human
ccaccgaccauccuccaca

SEQ ID NO: 1010680 - RNA, 22 nt, Human
ccagagagugugcacaaaagca

SEQ ID NO: 1010681 - RNA, 25 nt, Human
cccaaccucgccccggcagcucagc

SEQ ID NO: 1010682 - RNA, 24 nt, Human
ccccaacuagcaucacuuucucac

SEQ ID NO: 1010683 - RNA, 23 nt, Human
cccccccgggguccccgucgccc

SEQ ID NO: 1010684 - RNA, 18 nt, Human
cccccgcuacaaaaaaau

SEQ ID NO: 1010685 - RNA, 23 nt, Human
ccccgucgccccagaauggaagc

SEQ ID NO: 1010686 - RNA, 20 nt, Human
cccucagccccagggcaccc

SEQ ID NO: 1010687 - RNA, 22 nt, Human
cccucagccccagggcacccuu

SEQ ID NO: 1010688 - RNA, 18 nt, Human
ccgaccauccuccacaag

SEQ ID NO: 1010689 - RNA, 21 nt, Human
ccgcuacaaaaaaaucacagg

SEQ ID NO: 1010690 - RNA, 19 nt, Human
ccuccaucaccaccaccga

SEQ ID NO: 1010691 - RNA, 21 nt, Human
cggccucugggcucuuugucc

SEQ ID NO: 1010692 - RNA, 19 nt, Human
cgucgccccagaauggaag

SEQ ID NO: 1010693 - RNA, 20 nt, Human
cucuuuguccggggccuggg

SEQ ID NO: 1010694 - RNA, 22 nt, Human
cucuuuguccggggccugggga

SEQ ID NO: 1010695 - RNA, 19 nt, Human
gauccucuugcucuugccu

SEQ ID NO: 1010696 - RNA, 22 nt, Human
gcacccuucacacuggagcccc

SEQ ID NO: 1010697 - RNA, 22 nt, Human
gccucugacagauccugggaac

SEQ ID NO: 1010698 - RNA, 19 nt, Human
gcuacaaaaaaaucacagg

SEQ ID NO: 1010699 - RNA, 28 nt, Human
gggcacccuucacacuggagccccagag

SEQ ID NO: 1010700 - RNA, 21 nt, Human
uacaaaaaaaucacaggcucc

SEQ ID NO: 1010701 - RNA, 18 nt, Human
uacaaaagggcuaccccc

SEQ ID NO: 1010702 - RNA, 23 nt, Human
ucacacuggagccccagagagug

SEQ ID NO: 1010703 - RNA, 22 nt, Human
ucaccaccaccgaccauccucc

SEQ ID NO: 1010704 - RNA, 18 nt, Human
uccaccuccaucaccacc

SEQ ID NO: 1010705 - RNA, 22 nt, Human
uccaucaccaccaccgaccauc

SEQ ID NO: 1010706 - RNA, 23 nt, Human
uccaucaccaccaccgaccaucc

SEQ ID NO: 1010707 - RNA, 18 nt, Human
ucccaaccucgccccggc

SEQ ID NO: 1010708 - RNA, 21 nt, Human
uccccgcccccgcuacaaaaa

SEQ ID NO: 1010709 - RNA, 25 nt, Human
uccuccacaaggcccucagccccag

SEQ ID NO: 1010710 - RNA, 23 nt, Human
ugaucccaaccucgccccggcag

SEQ ID NO: 1010711 - RNA, 25 nt, Human
ugccaggugaucccaaccucgcccc

SEQ ID NO: 1010712 - RNA, 18 nt, Human
uggcgcagucuugcaccu

SEQ ID NO: 1010713 - RNA, 24 nt, Human
ugggaaccugcagccgucgccucc

SEQ ID NO: 1010714 - RNA, 23 nt, Human
ugggcucuuuguccggggccugg

SEQ ID NO: 1010715 - RNA, 18 nt, Human
uugcaccuuacuccccgc

SEQ ID NO: 1010716 - RNA, 22 nt, Human
uugcaccuuacuccccgccccc

SEQ ID NO: 1010717 - RNA, 18 nt, Human
uuuuuuuuuuuuuuuuug

SEQ ID NO: 1010718 - RNA, 19 nt, Human
uuuuuuuuuuuuuuuuugc

SEQ ID NO: 1010719 - RNA, 21 nt, Human
uuuuuuuuuuuuuuuuugcag

SEQ ID NO: 1010720 - RNA, 22 nt, Human
acaccaaagacagacaccagac

SEQ ID NO: 1010721 - RNA, 18 nt, Human
accaaagacagacaccag

SEQ ID NO: 1010722 - RNA, 22 nt, Human
agacagacaccagacaggcagc

SEQ ID NO: 1010723 - RNA, 23 nt, Human
agacagacaccagacaggcagcu

SEQ ID NO: 1010724 - RNA, 21 nt, Human
caaaguucugacaccaaagac

SEQ ID NO: 1010725 - RNA, 22 nt, Human
caccaaagacagacaccagaca

SEQ ID NO: 1010726 - RNA, 22 nt, Human
caccaaagacagacaccagacu

SEQ ID NO: 1010727 - RNA, 19 nt, Human
cagacagugaguugugugg

SEQ ID NO: 1010728 - RNA, 23 nt, Human
ccaaagacagacaccagacaggc

SEQ ID NO: 1010729 - RNA, 21 nt, Human
cccccaaaguucugacaccaa

SEQ ID NO: 1010730 - RNA, 29 nt, Human
cccccaaaguucugacaccaaagacagag

SEQ ID NO: 1010731 - RNA, 20 nt, Human
ccucagacucugcccuucug

SEQ ID NO: 1010732 - RNA, 20 nt, Human
cgccucagacucugcccuuc

SEQ ID NO: 1010733 - RNA, 22 nt, Human
cggcccccaaaguucugacacc

SEQ ID NO: 1010734 - RNA, 19 nt, Human
ucugacaccaaagacagac

SEQ ID NO: 1010735 - RNA, 19 nt, Human
ucuggggggggcacagcac

SEQ ID NO: 1010736 - RNA, 21 nt, Human
ugacaccaaagacagacacca

SEQ ID NO: 1010737 - RNA, 21 nt, Human
uggggaggggcccggccccca

SEQ ID NO: 1010738 - RNA, 21 nt, Human
uuguggggaggggcccggccc

SEQ ID NO: 1010739 - RNA, 20 nt, Human
uuuuuuuuuuuuugaagguc

SEQ ID NO: 1010740 - RNA, 23 nt, Human
uuuuuuuuuuuuugaaggucgga

SEQ ID NO: 1010741 - RNA, 23 nt, Human
aaaaaaaaccaaaaaucaucaag

SEQ ID NO: 1010742 - RNA, 25 nt, Human
aaaaaaccaaaaaucaucaagacag

SEQ ID NO: 1010743 - RNA, 24 nt, Human
aacaggacaaugaaaaaaaaccaa

SEQ ID NO: 1010744 - RNA, 24 nt, Human
aacaggacaaugaaaaaaaaccaa

SEQ ID NO: 1010745 - RNA, 21 nt, Human
aaccaaaaaucaucaagacag

SEQ ID NO: 1010746 - RNA, 19 nt, Human
aaugaaaaaaaaccaaaaa

SEQ ID NO: 1010747 - RNA, 20 nt, Human
acugcaaaauauuauaaaag

SEQ ID NO: 1010748 - RNA, 22 nt, Human
acuuugaagauacuuacaagga

SEQ ID NO: 1010749 - RNA, 21 nt, Human
aggacaaugaaaaaaaaccaa

SEQ ID NO: 1010750 - RNA, 25 nt, Human
aggacaaugaaaaaaaaccgguacc

SEQ ID NO: 1010751 - RNA, 24 nt, Human
aggucaucucguccacuuuaauau

SEQ ID NO: 1010752 - RNA, 20 nt, Human
auaaaguuccaaauaucaac

SEQ ID NO: 1010753 - RNA, 20 nt, Human
augaaaaaaaaccaaaaauu

SEQ ID NO: 1010754 - RNA, 25 nt, Human
caacaggacaaugaaaaaaaaccaa

SEQ ID NO: 1010755 - RNA, 26 nt, Human
caacaggacaaugaaaaaaaaccaaa

SEQ ID NO: 1010756 - RNA, 20 nt, Human
caccaccgucgccgcccucu

SEQ ID NO: 1010757 - RNA, 25 nt, Human
caggacaaugaaaaaaaaccaaaaa

SEQ ID NO: 1010758 - RNA, 19 nt, Human
cgcucagucaccaccaccg

SEQ ID NO: 1010759 - RNA, 21 nt, Human
cuuaacaagugaccaauuacu

SEQ ID NO: 1010760 - RNA, 23 nt, Human
gaaagguaauuguuuauuacugg

SEQ ID NO: 1010761 - RNA, 22 nt, Human
gacaaugaaaaaaaaccaaaaa

SEQ ID NO: 1010762 - RNA, 21 nt, Human
uaauuacuugauuucaacagg

SEQ ID NO: 1010763 - RNA, 19 nt, Human
uauuauaaaagugauacaa

SEQ ID NO: 1010764 - RNA, 23 nt, Human
uauuauaaaagugauacaauuuu

SEQ ID NO: 1010765 - RNA, 27 nt, Human
ucaacaggacaaugaaaaaaaaccaaa

SEQ ID NO: 1010766 - RNA, 25 nt, Human
ucaccaccaccgucgccgcccucuu

SEQ ID NO: 1010767 - RNA, 21 nt, Human
ugaaaaaaaaccaaaaaucau

SEQ ID NO: 1010768 - RNA, 21 nt, Human
uggaauaaaguuccaaauauc

SEQ ID NO: 1010769 - RNA, 19 nt, Human
uggcucuuaaauguuuaau

SEQ ID NO: 1010770 - RNA, 21 nt, Human
uggcucuuaaauguuuaauua

SEQ ID NO: 1010771 - RNA, 21 nt, Human
uguauuaacagagaagauggu

SEQ ID NO: 1010772 - RNA, 19 nt, Human
aaaaagggaauacaaaaga

SEQ ID NO: 1010773 - RNA, 18 nt, Human
aacauggugaaacaccau

SEQ ID NO: 1010774 - RNA, 21 nt, Human
aagcaguaaacaguaguauaa

SEQ ID NO: 1010775 - RNA, 24 nt, Human
aauugcuugaaccuaggaggugga

SEQ ID NO: 1010776 - RNA, 20 nt, Human
acagagcaagacuccgucuc

SEQ ID NO: 1010777 - RNA, 23 nt, Human
acagagcaagacuccgucucaaa

SEQ ID NO: 1010778 - RNA, 24 nt, Human
acagagcaagacuccgucucaaag

SEQ ID NO: 1010779 - RNA, 20 nt, Human
acccugagcuuagaaaacuc

SEQ ID NO: 1010780 - RNA, 24 nt, Human
accgugccacugcacucuagucug

SEQ ID NO: 1010781 - RNA, 24 nt, Human
accugaggucaggaguuugagacc

SEQ ID NO: 1010782 - RNA, 24 nt, Human
acugcacucuagucugggugacag

SEQ ID NO: 1010783 - RNA, 26 nt, Human
acugcacucuagucugggugacagag

SEQ ID NO: 1010784 - RNA, 22 nt, Human
agaauugcuugaaccuaggagg

SEQ ID NO: 1010785 - RNA, 23 nt, Human
agccgggugugguggugcaugcc

SEQ ID NO: 1010786 - RNA, 19 nt, Human
agccuggccaacaugguga

SEQ ID NO: 1010787 - RNA, 20 nt, Human
aggaguuugagaccagccug

SEQ ID NO: 1010788 - RNA, 24 nt, Human
aggcacgguggcucaggccuguaa

SEQ ID NO: 1010789 - RNA, 22 nt, Human
aggcaggagaauugcuugaacc

SEQ ID NO: 1010790 - RNA, 23 nt, Human
aggcaggagaauugcuugaaccu

SEQ ID NO: 1010791 - RNA, 24 nt, Human
aggcaggagaauugcuugaaccua

SEQ ID NO: 1010792 - RNA, 18 nt, Human
aggcagguggaucaccug

SEQ ID NO: 1010793 - RNA, 22 nt, Human
aggcagguggaucaccugaggu

SEQ ID NO: 1010794 - RNA, 26 nt, Human
aggcagguggaucaccugaggucagg

SEQ ID NO: 1010795 - RNA, 21 nt, Human
aggccgaggcagguggaucac

SEQ ID NO: 1010796 - RNA, 21 nt, Human
aggcugaggcaggagaauugc

SEQ ID NO: 1010797 - RNA, 24 nt, Human
aggcugaggcaggagaauugcuug

SEQ ID NO: 1010798 - RNA, 19 nt, Human
agguggagguugcagugag

SEQ ID NO: 1010799 - RNA, 24 nt, Human
agguggagguugcagugaggugag

SEQ ID NO: 1010800 - RNA, 24 nt, Human
agucugggugacagagcaagacuc

SEQ ID NO: 1010801 - RNA, 20 nt, Human
aucaccugaggucaggaguu

SEQ ID NO: 1010802 - RNA, 24 nt, Human
aucaccugaggucaggaguuugag

SEQ ID NO: 1010803 - RNA, 23 nt, Human
caaaagagacggagaaagcagua

SEQ ID NO: 1010804 - RNA, 25 nt, Human
caaaagagacggagaaagcaguaaa

SEQ ID NO: 1010805 - RNA, 21 nt, Human
caaaggaaaaaaaaaaaggga

SEQ ID NO: 1010806 - RNA, 23 nt, Human
caagacuccgucucaaaggaaaa

SEQ ID NO: 1010807 - RNA, 24 nt, Human
caccauggcuacuaaaaauacaaa

SEQ ID NO: 1010808 - RNA, 23 nt, Human
caccugaggucaggaguuugaga

SEQ ID NO: 1010809 - RNA, 22 nt, Human
cacucuagucugggugacagag

SEQ ID NO: 1010810 - RNA, 19 nt, Human
cacugcacucuagucuggg

SEQ ID NO: 1010811 - RNA, 19 nt, Human
cacugcacucuagucuggg

SEQ ID NO: 1010812 - RNA, 22 nt, Human
cacugcacucuagucuggguga

SEQ ID NO: 1010813 - RNA, 23 nt, Human
cacugcacucuagucugggugac

SEQ ID NO: 1010814 - RNA, 24 nt, Human
cacugcacucuagucugggugaca

SEQ ID NO: 1010815 - RNA, 25 nt, Human
cacugcacucuagucugggugacag

SEQ ID NO: 1010816 - RNA, 21 nt, Human
cacuuguuaagucuccucuga

SEQ ID NO: 1010817 - RNA, 24 nt, Human
cagcacugugggaggccgaggcag

SEQ ID NO: 1010818 - RNA, 26 nt, Human
cagcacugugggaggccgaggcaggu

SEQ ID NO: 1010819 - RNA, 22 nt, Human
cagcagauuaggggccaggcac

SEQ ID NO: 1010820 - RNA, 24 nt, Human
cagcuacucaggaggcugaggcag

SEQ ID NO: 1010821 - RNA, 22 nt, Human
caggccuguaaucccagcacug

SEQ ID NO: 1010822 - RNA, 24 nt, Human
cagguggaucaccugaggucagga

SEQ ID NO: 1010823 - RNA, 19 nt, Human
caguuucaccuccucaguc

SEQ ID NO: 1010824 - RNA, 20 nt, Human
ccacugcacucuagucuggg

SEQ ID NO: 1010825 - RNA, 20 nt, Human
ccacugcacucuagucuggg

SEQ ID NO: 1010826 - RNA, 21 nt, Human
ccacugcacucuagucugggu

SEQ ID NO: 1010827 - RNA, 21 nt, Human
ccacugcacucuagucugggu

SEQ ID NO: 1010828 - RNA, 24 nt, Human
ccacugcacucuagucugggugac

SEQ ID NO: 1010829 - RNA, 19 nt, Human
cccccaccauccuuaaugu

SEQ ID NO: 1010830 - RNA, 22 nt, Human
ccugaggucaggaguuugagac

SEQ ID NO: 1010831 - RNA, 19 nt, Human
ccuggccaacauggugaaa

SEQ ID NO: 1010832 - RNA, 24 nt, Human
ccuggccaacauggugaaacacca

SEQ ID NO: 1010833 - RNA, 21 nt, Human
ccuguaaucccagcacugugg

SEQ ID NO: 1010834 - RNA, 21 nt, Human
ccuguagucccagcuacucag

SEQ ID NO: 1010835 - RNA, 22 nt, Human
ccuguagucccagcuacucagg

SEQ ID NO: 1010836 - RNA, 26 nt, Human
cgaggcagguggaucaccugagguca

SEQ ID NO: 1010837 - RNA, 26 nt, Human
cucaaaggaaaaaaaaaaagggaaua

SEQ ID NO: 1010838 - RNA, 23 nt, Human
cucaggccuguaaucccagcacu

SEQ ID NO: 1010839 - RNA, 21 nt, Human
cugggugacagagcaagacuc

SEQ ID NO: 1010840 - RNA, 19 nt, Human
gaggcagguggaucaccug

SEQ ID NO: 1010841 - RNA, 23 nt, Human
gaggcagguggaucaccugaggu

SEQ ID NO: 1010842 - RNA, 23 nt, Human
gagguugcagugaggugagaccg

SEQ ID NO: 1010843 - RNA, 21 nt, Human
gaucaccugaggucaggaguu

SEQ ID NO: 1010844 - RNA, 24 nt, Human
gaucaccugaggucaggaguuuga

SEQ ID NO: 1010845 - RNA, 24 nt, Human
gcacucuagucugggugacagagc

SEQ ID NO: 1010846 - RNA, 24 nt, Human
gccacugcacucuagucuggguga

SEQ ID NO: 1010847 - RNA, 25 nt, Human
ggaaaaaaaaaaagggaauacaaaa

SEQ ID NO: 1010848 - RNA, 20 nt, Human
ggaauacaaaagagacggag

SEQ ID NO: 1010849 - RNA, 18 nt, Human
ggagguugcagugaggug

SEQ ID NO: 1010850 - RNA, 20 nt, Human
ggagguugcagugaggugag

SEQ ID NO: 1010851 - RNA, 24 nt, Human
ggagguugcagugaggugagaccg

SEQ ID NO: 1010852 - RNA, 23 nt, Human
ggccuguaaucccagcacugugg

SEQ ID NO: 1010853 - RNA, 24 nt, Human
ggccuguaaucccagcacuguggg

SEQ ID NO: 1010854 - RNA, 18 nt, Human
gggaauacaaaagagacc

SEQ ID NO: 1010855 - RNA, 19 nt, Human
ggucaggaguuugagacca

SEQ ID NO: 1010856 - RNA, 23 nt, Human
gguggcucaggccuguaauccca

SEQ ID NO: 1010857 - RNA, 24 nt, Human
gguggcucaggccuguaaucccag

SEQ ID NO: 1010858 - RNA, 19 nt, Human
guaguauaauuuaagaagc

SEQ ID NO: 1010859 - RNA, 18 nt, Human
uacaaaagagacggagaa

SEQ ID NO: 1010860 - RNA, 29 nt, Human
uaggagguggagguugcagugacaacggu

SEQ ID NO: 1010861 - RNA, 26 nt, Human
uaggagguggagguugcagugaggug

SEQ ID NO: 1010862 - RNA, 24 nt, Human
ucaaagagguaguuuauucugcag

SEQ ID NO: 1010863 - RNA, 24 nt, Human
ucaaaggaaaaaaaaaaagggaau

SEQ ID NO: 1010864 - RNA, 26 nt, Human
ucaccuccucagucucagcuuucuua

SEQ ID NO: 1010865 - RNA, 24 nt, Human
ucuagucugggugacagagcaaga

SEQ ID NO: 1010866 - RNA, 21 nt, Human
ugaaacaccauggcuacuaaa

SEQ ID NO: 1010867 - RNA, 23 nt, Human
ugagaccagccuggccaacaugg

SEQ ID NO: 1010868 - RNA, 24 nt, Human
ugagaccagccuggccaacauggu

SEQ ID NO: 1010869 - RNA, 24 nt, Human
ugagaccgugccacugcacucuag

SEQ ID NO: 1010870 - RNA, 24 nt, Human
ugaggcaggagaauugcuugaacc

SEQ ID NO: 1010871 - RNA, 24 nt, Human
ugaggcaggagaauugcuugaacc

SEQ ID NO: 1010872 - RNA, 18 nt, Human
ugaggucaggaguuugag

SEQ ID NO: 1010873 - RNA, 24 nt, Human
ugccuguagucccagcuacucagg

SEQ ID NO: 1010874 - RNA, 23 nt, Human
uggaucaccugaggucaggaguu

SEQ ID NO: 1010875 - RNA, 24 nt, Human
uggaucaccugaggucaggaguuu

SEQ ID NO: 1010876 - RNA, 27 nt, Human
uggaucaccugaggucaggaguuugag

SEQ ID NO: 1010877 - RNA, 18 nt, Human
uggccaacauggugaaac

SEQ ID NO: 1010878 - RNA, 24 nt, Human
uggcucaggccuguaaucccagca

SEQ ID NO: 1010879 - RNA, 24 nt, Human
ugggaggccgaggcagguggauca

SEQ ID NO: 1010880 - RNA, 18 nt, Human
uggugcaugccuguaguc

SEQ ID NO: 1010881 - RNA, 24 nt, Human
ugguggugcaugccuguaguccca

SEQ ID NO: 1010882 - RNA, 22 nt, Human
uuagccgggugugguggugcau

SEQ ID NO: 1010883 - RNA, 24 nt, Human
uuagccgggugugguggugcaugc

SEQ ID NO: 1010884 - RNA, 24 nt, Human
uucagcagauuaggggccaggcac

SEQ ID NO: 1010885 - RNA, 20 nt, Human
uucccauguuucuucuaugg

SEQ ID NO: 1010886 - RNA, 22 nt, Human
uucuuauuuuaagagcuggccc

SEQ ID NO: 1010887 - RNA, 24 nt, Human
uugaaccuaggagguggagguugc

SEQ ID NO: 1010888 - RNA, 21 nt, Human
uugcagugaggugagaccgug

SEQ ID NO: 1010889 - RNA, 22 nt, Human
uugcagugaggugagaccgugc

SEQ ID NO: 1010890 - RNA, 24 nt, Human
uugcuugaaccuaggagguggagg

SEQ ID NO: 1010891 - RNA, 18 nt, Human
uuuuuuuuuuuuagagga

SEQ ID NO: 1010892 - RNA, 22 nt, Human
uuuuuuuuuuuuuuuuuagagg

SEQ ID NO: 1010893 - RNA, 24 nt, Human
aaacagaaaagagaaauauccugg

SEQ ID NO: 1010894 - RNA, 18 nt, Human
agaaccccgccuucuacc

SEQ ID NO: 1010895 - RNA, 18 nt, Human
cagaccugcagccaccgu

SEQ ID NO: 1010896 - RNA, 21 nt, Human
cagauaauguucucuaaaucc

SEQ ID NO: 1010897 - RNA, 22 nt, Human
cagcaggauuccggucuacacc

SEQ ID NO: 1010898 - RNA, 19 nt, Human
cagggaagaugucaacacu

SEQ ID NO: 1010899 - RNA, 19 nt, Human
ccacucugcccgucagcag

SEQ ID NO: 1010900 - RNA, 22 nt, Human
ccugcgccgcgggguggaagga

SEQ ID NO: 1010901 - RNA, 20 nt, Human
cgacccucccucccugaucc

SEQ ID NO: 1010902 - RNA, 19 nt, Human
cgccgcgggguggaaggac

SEQ ID NO: 1010903 - RNA, 21 nt, Human
cuccaggaaugaauggccacc

SEQ ID NO: 1010904 - RNA, 21 nt, Human
cucccugauccacucugcccg

SEQ ID NO: 1010905 - RNA, 25 nt, Human
cuccucagcagcacuccaggaauga

SEQ ID NO: 1010906 - RNA, 19 nt, Human
cucugcccgucagcaggau

SEQ ID NO: 1010907 - RNA, 23 nt, Human
cugagagcagaggcuuuauuuac

SEQ ID NO: 1010908 - RNA, 25 nt, Human
cuuuucucagauaauguucucuaaa

SEQ ID NO: 1010909 - RNA, 22 nt, Human
gaaaagagaaauauccugggag

SEQ ID NO: 1010910 - RNA, 18 nt, Human
gagcagccuugucucaga

SEQ ID NO: 1010911 - RNA, 24 nt, Human
gaugucaacacuggccgggaaaaa

SEQ ID NO: 1010912 - RNA, 25 nt, Human
gaugucaacacuggccgggaaaaac

SEQ ID NO: 1010913 - RNA, 18 nt, Human
gauuccggucuacacccc

SEQ ID NO: 1010914 - RNA, 21 nt, Human
gcagccaccgugucucgaccc

SEQ ID NO: 1010915 - RNA, 20 nt, Human
gcagcugggugccagaugcc

SEQ ID NO: 1010916 - RNA, 24 nt, Human
ggagcaggaagugaacucuuuucu

SEQ ID NO: 1010917 - RNA, 23 nt, Human
uacaaugacauucaaacaggauu

SEQ ID NO: 1010918 - RNA, 24 nt, Human
uagcagcauggguuguacuucaua

SEQ ID NO: 1010919 - RNA, 22 nt, Human
ucaacacuggccgggaaaaaca

SEQ ID NO: 1010920 - RNA, 21 nt, Human
ucagggaagaugucaacacug

SEQ ID NO: 1010921 - RNA, 20 nt, Human
ucccaacacguuccaugcuc

SEQ ID NO: 1010922 - RNA, 18 nt, Human
uccugggagcaggaagug

SEQ ID NO: 1010923 - RNA, 25 nt, Human
ucuacaccccgcagagacuccgcag

SEQ ID NO: 1010924 - RNA, 18 nt, Human
ugaauggccaccuccagg

SEQ ID NO: 1010925 - RNA, 19 nt, Human
ugggagcaggaagugaacu

SEQ ID NO: 1010926 - RNA, 21 nt, Human
uuagcaaaggaugccucuucc

SEQ ID NO: 1010927 - RNA, 18 nt, Human
uucucuaaaucccaacac

SEQ ID NO: 1010928 - RNA, 20 nt, Human
uuuucucagauaauguucuc

SEQ ID NO: 1010929 - RNA, 25 nt, Human
uuuuuuuuuuuuuuuuuacaucuga

SEQ ID NO: 1010930 - RNA, 25 nt, Human
uuuuuuuuuuuuuuuuuuacaucug

SEQ ID NO: 1010931 - RNA, 20 nt, Human
aaaacccucacuggauguac

SEQ ID NO: 1010932 - RNA, 21 nt, Human
aaacacaucacagguaagaaa

SEQ ID NO: 1010933 - RNA, 22 nt, Human
agaaagacuugaacacuuacca

SEQ ID NO: 1010934 - RNA, 23 nt, Human
agaaagacuugaacacuuaccaa

SEQ ID NO: 1010935 - RNA, 18 nt, Human
agagccugcagcaagcag

SEQ ID NO: 1010936 - RNA, 20 nt, Human
aggugaguguccggaggugc

SEQ ID NO: 1010937 - RNA, 20 nt, Human
aguauggugagcuauuuccu

SEQ ID NO: 1010938 - RNA, 22 nt, Human
cacaaucuauggaagggaaacc

SEQ ID NO: 1010939 - RNA, 24 nt, Human
cagguaagaaaugggaaaccuacc

SEQ ID NO: 1010940 - RNA, 20 nt, Human
caugcuacuuggggugauca

SEQ ID NO: 1010941 - RNA, 24 nt, Human
ccccagagccugcagcaagcagca

SEQ ID NO: 1010942 - RNA, 23 nt, Human
cuugaacacuuaccaagugaaua

SEQ ID NO: 1010943 - RNA, 21 nt, Human
gaguauggugagcuauuuccu

SEQ ID NO: 1010944 - RNA, 23 nt, Human
gguaagaaaugggaaaccuaccu

SEQ ID NO: 1010945 - RNA, 20 nt, Human
ggugcuggguaaaacacauc

SEQ ID NO: 1010946 - RNA, 21 nt, Human
guaaaacacaucacagguaaa

SEQ ID NO: 1010947 - RNA, 22 nt, Human
gugcuggguaaaacacaucaca

SEQ ID NO: 1010948 - RNA, 19 nt, Human
guguccggaggugcugggu

SEQ ID NO: 1010949 - RNA, 22 nt, Human
uacagaucacaggaauuuuaaa

SEQ ID NO: 1010950 - RNA, 26 nt, Human
ucagaaagacuugaacaacgggggcg

SEQ ID NO: 1010951 - RNA, 22 nt, Human
uccccagagccugcagcaagca

SEQ ID NO: 1010952 - RNA, 21 nt, Human
ugcagcaagcagcacccgccc

SEQ ID NO: 1010953 - RNA, 21 nt, Human
uggguaaaacacaucacaggu

SEQ ID NO: 1010954 - RNA, 19 nt, Human
uguccggaggugcugggua

SEQ ID NO: 1010955 - RNA, 21 nt, Human
aaaaagcuggcaaugccagac

SEQ ID NO: 1010956 - RNA, 24 nt, Human
aaacuccagccugugcaccucugg

SEQ ID NO: 1010957 - RNA, 21 nt, Human
aaauggugagaaagaaaagga

SEQ ID NO: 1010958 - RNA, 23 nt, Human
aaucucuuuucccauuaaaaagc

SEQ ID NO: 1010959 - RNA, 18 nt, Human
aauggcacucacugucuc

SEQ ID NO: 1010960 - RNA, 20 nt, Human
acaccauugcugaacaaagc

SEQ ID NO: 1010961 - RNA, 18 nt, Human
acagaaugcgagccaucg

SEQ ID NO: 1010962 - RNA, 21 nt, Human
accaucacccacccucaccac

SEQ ID NO: 1010963 - RNA, 21 nt, Human
acggcaggucaaggacaggcc

SEQ ID NO: 1010964 - RNA, 22 nt, Human
acuggugugcaaaggcaagaug

SEQ ID NO: 1010965 - RNA, 18 nt, Human
acuugugacaaguuuccu

SEQ ID NO: 1010966 - RNA, 19 nt, Human
acuugugacaaguuuccuu

SEQ ID NO: 1010967 - RNA, 22 nt, Human
agaaaacacacauucuuuauuc

SEQ ID NO: 1010968 - RNA, 19 nt, Human
agaaagaaaaggagacuga

SEQ ID NO: 1010969 - RNA, 19 nt, Human
agaaagggcccagagcaca

SEQ ID NO: 1010970 - RNA, 21 nt, Human
agaccgggauccggccaggaa

SEQ ID NO: 1010971 - RNA, 25 nt, Human
agaguuguuccagggcacaagauag

SEQ ID NO: 1010972 - RNA, 22 nt, Human
agcacaacucuccaaccacacc

SEQ ID NO: 1010973 - RNA, 20 nt, Human
agccaguaauguccaaaugg

SEQ ID NO: 1010974 - RNA, 22 nt, Human
agccuagucuacuuaccaucag

SEQ ID NO: 1010975 - RNA, 22 nt, Human
agcucuguggagggcagagagu

SEQ ID NO: 1010976 - RNA, 21 nt, Human
agcuggcccagaugaggcccc

SEQ ID NO: 1010977 - RNA, 20 nt, Human
aggaagcagaguccaagcug

SEQ ID NO: 1010978 - RNA, 21 nt, Human
agggaagugggagagaaagcc

SEQ ID NO: 1010979 - RNA, 25 nt, Human
agggaagugggagagaaagccuggg

SEQ ID NO: 1010980 - RNA, 19 nt, Human
agguccacucauccccugc

SEQ ID NO: 1010981 - RNA, 21 nt, Human
agugauaaauggugagaaaga

SEQ ID NO: 1010982 - RNA, 26 nt, Human
aguugagggaaggaagaauggagcuu

SEQ ID NO: 1010983 - RNA, 24 nt, Human
auguccaaauggggagccuugugg

SEQ ID NO: 1010984 - RNA, 22 nt, Human
caaauggggagccuuguggugg

SEQ ID NO: 1010985 - RNA, 23 nt, Human
caaccacaccauugcugaacaaa

SEQ ID NO: 1010986 - RNA, 19 nt, Human
caagauagccaguaauguc

SEQ ID NO: 1010987 - RNA, 23 nt, Human
caaugccagaccaugagucuaau

SEQ ID NO: 1010988 - RNA, 20 nt, Human
cacaacucuccaaccacacc

SEQ ID NO: 1010989 - RNA, 19 nt, Human
cacacacugcuccuccgaa

SEQ ID NO: 1010990 - RNA, 22 nt, Human
cacacacugcuccuccgaacuc

SEQ ID NO: 1010991 - RNA, 21 nt, Human
caccaccaucaaagacacugg

SEQ ID NO: 1010992 - RNA, 27 nt, Human
cagggcacacauggcaggucaaguucc

SEQ ID NO: 1010993 - RNA, 19 nt, Human
caggugcuccuucaccucu

SEQ ID NO: 1010994 - RNA, 21 nt, Human
cauagcucuguggagggcaga

SEQ ID NO: 1010995 - RNA, 18 nt, Human
cauguacuuaauagaaaa

SEQ ID NO: 1010996 - RNA, 22 nt, Human
ccacaccauugcugaacaaagc

SEQ ID NO: 1010997 - RNA, 28 nt, Human
ccacccucaccaccaucaaggccucggc

SEQ ID NO: 1010998 - RNA, 24 nt, Human
ccagagcuucccugcugcuccugg

SEQ ID NO: 1010999 - RNA, 28 nt, Human
ccagaguguuccgggccgggcugggguc

SEQ ID NO: 1011000 - RNA, 20 nt, Human
ccagguccacucauccccug

SEQ ID NO: 1011001 - RNA, 20 nt, Human
cccacaucugcgaauggggc

SEQ ID NO: 1011002 - RNA, 28 nt, Human
cccacccucaccaccaucaaccccuagg

SEQ ID NO: 1011003 - RNA, 18 nt, Human
cccagaguguuccgggcc

SEQ ID NO: 1011004 - RNA, 24 nt, Human
cccaugguuacaaacacuugugac

SEQ ID NO: 1011005 - RNA, 21 nt, Human
cccccacggacggcaugccug

SEQ ID NO: 1011006 - RNA, 22 nt, Human
cccccgcguccccucugcugug

SEQ ID NO: 1011007 - RNA, 25 nt, Human
ccccgcguccccucugcugugccua

SEQ ID NO: 1011008 - RNA, 24 nt, Human
ccccggcuacaggcccuucaacaa

SEQ ID NO: 1011009 - RNA, 21 nt, Human
ccccggggaggacaggaggca

SEQ ID NO: 1011010 - RNA, 21 nt, Human
ccccucugcugugccuaaaca

SEQ ID NO: 1011011 - RNA, 19 nt, Human
ccggggaggacaggaggca

SEQ ID NO: 1011012 - RNA, 22 nt, Human
ccugcagugccugaaacuccag

SEQ ID NO: 1011013 - RNA, 21 nt, Human
ccugcgcuaucccagcacaac

SEQ ID NO: 1011014 - RNA, 23 nt, Human
ccuuguggugguggcagccagga

SEQ ID NO: 1011015 - RNA, 20 nt, Human
cggccagggcaggcuguaag

SEQ ID NO: 1011016 - RNA, 22 nt, Human
cggccugaggcaagggaugcag

SEQ ID NO: 1011017 - RNA, 25 nt, Human
cgggacccaccuuccugcgcuaucc

SEQ ID NO: 1011018 - RNA, 18 nt, Human
cguccccucugcugugcc

SEQ ID NO: 1011019 - RNA, 24 nt, Human
cuagcacuguauuccuagaacuga

SEQ ID NO: 1011020 - RNA, 19 nt, Human
cucccugugugucaucagc

SEQ ID NO: 1011021 - RNA, 21 nt, Human
cucuccaaccacaccauugcu

SEQ ID NO: 1011022 - RNA, 18 nt, Human
cugaaacuccagccugug

SEQ ID NO: 1011023 - RNA, 24 nt, Human
cugcugcuccuggaggaagcagag

SEQ ID NO: 1011024 - RNA, 21 nt, Human
cuggcuggaaaaagagaaagg

SEQ ID NO: 1011025 - RNA, 21 nt, Human
cuuccugcgcuaucccagcac

SEQ ID NO: 1011026 - RNA, 21 nt, Human
gaaggaagaauggagcuuggg

SEQ ID NO: 1011027 - RNA, 18 nt, Human
gaccaugagucuaauuaa

SEQ ID NO: 1011028 - RNA, 25 nt, Human
gaccccuugcuucucaucuuaccuu

SEQ ID NO: 1011029 - RNA, 24 nt, Human
gacggagcaggcaccucuguggga

SEQ ID NO: 1011030 - RNA, 24 nt, Human
gaggccccgggcagcacugcuucu

SEQ ID NO: 1011031 - RNA, 19 nt, Human
gagugcuguucucucaugg

SEQ ID NO: 1011032 - RNA, 24 nt, Human
gauaacaagcacagcuggccagga

SEQ ID NO: 1011033 - RNA, 22 nt, Human
gcaagggaugcagggccuugcc

SEQ ID NO: 1011034 - RNA, 18 nt, Human
gccccgggcagcacugcu

SEQ ID NO: 1011035 - RNA, 22 nt, Human
gccccgggcagcacugcuucug

SEQ ID NO: 1011036 - RNA, 26 nt, Human
gcuuucaucuccagccuucuccauag

SEQ ID NO: 1011037 - RNA, 18 nt, Human
ggaagaauggagcuuggg

SEQ ID NO: 1011038 - RNA, 20 nt, Human
ggaagcagaguccaagcugg

SEQ ID NO: 1011039 - RNA, 20 nt, Human
ggaauugcccacaacauaau

SEQ ID NO: 1011040 - RNA, 18 nt, Human
ggaggaagcagaguccaa

SEQ ID NO: 1011041 - RNA, 18 nt, Human
ggccaauggcacucacug

SEQ ID NO: 1011042 - RNA, 19 nt, Human
ggccaggugcuccuucacc

SEQ ID NO: 1011043 - RNA, 22 nt, Human
gggcaggcccauccucaggagc

SEQ ID NO: 1011044 - RNA, 21 nt, Human
ggggagccuuguggugguggc

SEQ ID NO: 1011045 - RNA, 21 nt, Human
ggguauggccagucgggacgu

SEQ ID NO: 1011046 - RNA, 27 nt, Human
guaaaacacuacacagaaugcgagcca

SEQ ID NO: 1011047 - RNA, 19 nt, Human
guaaggcaagugaauggaa

SEQ ID NO: 1011048 - RNA, 18 nt, Human
guauaccaggaaagaaaa

SEQ ID NO: 1011049 - RNA, 23 nt, Human
gugaagggcugcccagccucaca

SEQ ID NO: 1011050 - RNA, 23 nt, Human
gugccuaaacaccucucaggaac

SEQ ID NO: 1011051 - RNA, 21 nt, Human
gugggaacauguaucuaggga

SEQ ID NO: 1011052 - RNA, 20 nt, Human
gugguggcagccaggauucc

SEQ ID NO: 1011053 - RNA, 18 nt, Human
uaacaagcacagcuggcc

SEQ ID NO: 1011054 - RNA, 22 nt, Human
uaacaagcacagcuggccagga

SEQ ID NO: 1011055 - RNA, 22 nt, Human
uaaggccaggugcuccuucacc

SEQ ID NO: 1011056 - RNA, 19 nt, Human
uacaaagcuuucaucucca

SEQ ID NO: 1011057 - RNA, 24 nt, Human
uaccaggaaagaaaacacacauuc

SEQ ID NO: 1011058 - RNA, 19 nt, Human
uaccaucagcacguugauc

SEQ ID NO: 1011059 - RNA, 25 nt, Human
uauaacuaaucucuuuucccauuaa

SEQ ID NO: 1011060 - RNA, 24 nt, Human
uauggccagucgggacguggcgcc

SEQ ID NO: 1011061 - RNA, 22 nt, Human
ucccugcugcuccuggaggaag

SEQ ID NO: 1011062 - RNA, 24 nt, Human
uccgcuggauccccaggaugcugg

SEQ ID NO: 1011063 - RNA, 22 nt, Human
ucucauggaacucuccagugag

SEQ ID NO: 1011064 - RNA, 18 nt, Human
ugaagggcugcccagccu

SEQ ID NO: 1011065 - RNA, 22 nt, Human
ugaauucucuggaauugcccac

SEQ ID NO: 1011066 - RNA, 19 nt, Human
ugagcagagucucccacau

SEQ ID NO: 1011067 - RNA, 19 nt, Human
ugaggccccgggcagcacu

SEQ ID NO: 1011068 - RNA, 23 nt, Human
ugaggccccgggcagcacugcuu

SEQ ID NO: 1011069 - RNA, 24 nt, Human
ugagggaaggaagaauggagcuug

SEQ ID NO: 1011070 - RNA, 21 nt, Human
ugagggaagugauaaauggug

SEQ ID NO: 1011071 - RNA, 19 nt, Human
ugcagggcacaguuaccau

SEQ ID NO: 1011072 - RNA, 21 nt, Human
ugccagaccaugagucuaauu

SEQ ID NO: 1011073 - RNA, 19 nt, Human
ugcccagccucacaggccu

SEQ ID NO: 1011074 - RNA, 20 nt, Human
ugccuaaacaccucucagga

SEQ ID NO: 1011075 - RNA, 24 nt, Human
ugccuaaacaccucucaggaacac

SEQ ID NO: 1011076 - RNA, 23 nt, Human
ugccugaaacuccagccugugca

SEQ ID NO: 1011077 - RNA, 21 nt, Human
uggaaacuggcuggaaaaaga

SEQ ID NO: 1011078 - RNA, 23 nt, Human
uggaagauaacaagcacagcugg

SEQ ID NO: 1011079 - RNA, 18 nt, Human
uggcaggaugccccacac

SEQ ID NO: 1011080 - RNA, 19 nt, Human
uggccaaagagggucuauu

SEQ ID NO: 1011081 - RNA, 23 nt, Human
uggcccagagcuucccugcugcu

SEQ ID NO: 1011082 - RNA, 22 nt, Human
uggcuggaaaaagagaaagggc

SEQ ID NO: 1011083 - RNA, 22 nt, Human
ugggaacauguaucuagggauc

SEQ ID NO: 1011084 - RNA, 27 nt, Human
ugguuacaaacacuugugacaaguuuc

SEQ ID NO: 1011085 - RNA, 20 nt, Human
ugucacacagcauggagcca

SEQ ID NO: 1011086 - RNA, 26 nt, Human
ugucaucagccugcagugccugaaac

SEQ ID NO: 1011087 - RNA, 19 nt, Human
uguggugguggcagccagg

SEQ ID NO: 1011088 - RNA, 24 nt, Human
uguggugguggcagccaggauucc

SEQ ID NO: 1011089 - RNA, 22 nt, Human
uuccugcgcuaucccagcacaa

SEQ ID NO: 1011090 - RNA, 22 nt, Human
uugagugcuguucucucaugga

SEQ ID NO: 1011091 - RNA, 18 nt, Human
aacaaaauucaucaguaa

SEQ ID NO: 1011092 - RNA, 24 nt, Human
aacaaccagcacagaacccaaagc

SEQ ID NO: 1011093 - RNA, 24 nt, Human
aacccuuuccccaagucagauccc

SEQ ID NO: 1011094 - RNA, 22 nt, Human
aaugaaaagcagaaaggguuaa

SEQ ID NO: 1011095 - RNA, 23 nt, Human
acaaccagcacagaacccaaagc

SEQ ID NO: 1011096 - RNA, 22 nt, Human
acccuacagcccuucccgcccc

SEQ ID NO: 1011097 - RNA, 21 nt, Human
agcacagaacccaaagcugcu

SEQ ID NO: 1011098 - RNA, 22 nt, Human
caaaugauuacuuuuuaagccc

SEQ ID NO: 1011099 - RNA, 18 nt, Human
caaccagcacagaaccca

SEQ ID NO: 1011100 - RNA, 21 nt, Human
cagaacccaaagcugcucucc

SEQ ID NO: 1011101 - RNA, 21 nt, Human
cagacuuauuguuaggacaac

SEQ ID NO: 1011102 - RNA, 22 nt, Human
cccuacagcccuucccgccccc

SEQ ID NO: 1011103 - RNA, 21 nt, Human
cccucuaggcucugauaaccc

SEQ ID NO: 1011104 - RNA, 22 nt, Human
ccuacagcccuucccgcccccu

SEQ ID NO: 1011105 - RNA, 23 nt, Human
ccuguaguggggacaagagagga

SEQ ID NO: 1011106 - RNA, 23 nt, Human
ccuucccgcccccuuuucuggcu

SEQ ID NO: 1011107 - RNA, 18 nt, Human
cuccaacaccuuuguuua

SEQ ID NO: 1011108 - RNA, 22 nt, Human
cucugauaacccuuuccccaag

SEQ ID NO: 1011109 - RNA, 22 nt, Human
gaaaagcagaaaggguuaaggg

SEQ ID NO: 1011110 - RNA, 22 nt, Human
gacuuauuguuaggacaacucu

SEQ ID NO: 1011111 - RNA, 19 nt, Human
gaggaagcugugcccuucc

SEQ ID NO: 1011112 - RNA, 18 nt, Human
gcacagaacccaaagcug

SEQ ID NO: 1011113 - RNA, 22 nt, Human
ggagaaaaguggguugagaugg

SEQ ID NO: 1011114 - RNA, 19 nt, Human
ggcucugauaacccuuucc

SEQ ID NO: 1011115 - RNA, 20 nt, Human
uacagcccuucccgcccccu

SEQ ID NO: 1011116 - RNA, 20 nt, Human
uaguggggacaagagaggaa

SEQ ID NO: 1011117 - RNA, 21 nt, Human
ucugggagucuugugucugug

SEQ ID NO: 1011118 - RNA, 20 nt, Human
ugaaaagcagaaaggguuaa

SEQ ID NO: 1011119 - RNA, 19 nt, Human
ugguagguuuucagaaaug

SEQ ID NO: 1011120 - RNA, 19 nt, Human
ugugguuaaugaaaagcag

SEQ ID NO: 1011121 - RNA, 19 nt, Human
uguuaggacaacucuggga

SEQ ID NO: 1011122 - RNA, 18 nt, Human
uuaagggaagagaaagga

SEQ ID NO: 1011123 - RNA, 18 nt, Human
uuuuuuuuccuuucacaa

SEQ ID NO: 1011124 - RNA, 21 nt, Human
uuuuuuuuccuuucacaaaaa

SEQ ID NO: 1011125 - RNA, 22 nt, Human
aaaaaaagggggggaggcagaa

SEQ ID NO: 1011126 - RNA, 24 nt, Human
aaccuaggagggugggaauggcuu

SEQ ID NO: 1011127 - RNA, 25 nt, Human
agcuugggcugggguugcaggggca

SEQ ID NO: 1011128 - RNA, 21 nt, Human
aggaagaaaaggcagugguga

SEQ ID NO: 1011129 - RNA, 19 nt, Human
aggaggaaguaggaagagc

SEQ ID NO: 1011130 - RNA, 28 nt, Human
aggggaacaaaagauggaaaaaaaaggg

SEQ ID NO: 1011131 - RNA, 20 nt, Human
caaucaaccucccaccuuca

SEQ ID NO: 1011132 - RNA, 18 nt, Human
cacugugugccccagggc

SEQ ID NO: 1011133 - RNA, 18 nt, Human
caggggcaguggcugggu

SEQ ID NO: 1011134 - RNA, 28 nt, Human
caucuccucccccaaggaagacacagcc

SEQ ID NO: 1011135 - RNA, 19 nt, Human
caucuccuggguccgcccc

SEQ ID NO: 1011136 - RNA, 24 nt, Human
ccaaucugcucucaaggagcaaaa

SEQ ID NO: 1011137 - RNA, 24 nt, Human
ccacaccccgcggcgcugcuugcg

SEQ ID NO: 1011138 - RNA, 18 nt, Human
ccaccccgccccacuccu

SEQ ID NO: 1011139 - RNA, 27 nt, Human
ccaccccgccccacuccuugacacugu

SEQ ID NO: 1011140 - RNA, 18 nt, Human
ccagacagcagagggaac

SEQ ID NO: 1011141 - RNA, 25 nt, Human
ccccacaccccgcggcgcugcuugc

SEQ ID NO: 1011142 - RNA, 23 nt, Human
cccccgccaccccgccccacucc

SEQ ID NO: 1011143 - RNA, 18 nt, Human
cccgcggcgcugcuugcg

SEQ ID NO: 1011144 - RNA, 23 nt, Human
cgccccacuccuugacacuucca

SEQ ID NO: 1011145 - RNA, 27 nt, Human
cggugggcgcugagcgcggugcgcggg

SEQ ID NO: 1011146 - RNA, 20 nt, Human
cucccccgccaccccgcccc

SEQ ID NO: 1011147 - RNA, 22 nt, Human
cucccccgccaccccgccccac

SEQ ID NO: 1011148 - RNA, 20 nt, Human
cugcuugcggccucgguccg

SEQ ID NO: 1011149 - RNA, 22 nt, Human
cuggauuugccccaaucaaccu

SEQ ID NO: 1011150 - RNA, 19 nt, Human
gaaaaggcaguggugaaca

SEQ ID NO: 1011151 - RNA, 21 nt, Human
gcccuggagcccugucuggcu

SEQ ID NO: 1011152 - RNA, 23 nt, Human
gcucaagaagggaaaaggauuua

SEQ ID NO: 1011153 - RNA, 28 nt, Human
ggaacaaaagauggaaaaaaaagggggg

SEQ ID NO: 1011154 - RNA, 23 nt, Human
gggaggcagaaggagcugaugag

SEQ ID NO: 1011155 - RNA, 19 nt, Human
gggcaguggggcuagccgg

SEQ ID NO: 1011156 - RNA, 19 nt, Human
gggcuagccggcugucugg

SEQ ID NO: 1011157 - RNA, 19 nt, Human
guccgccccacaccccgcg

SEQ ID NO: 1011158 - RNA, 19 nt, Human
gugaaccuaggaggguggg

SEQ ID NO: 1011159 - RNA, 22 nt, Human
uaaacgacaccaucuccucccc

SEQ ID NO: 1011160 - RNA, 23 nt, Human
uaaacgacaccaucuccuccccc

SEQ ID NO: 1011161 - RNA, 23 nt, Human
uaaacgacaccaucuccuccccc

SEQ ID NO: 1011162 - RNA, 18 nt, Human
uaagaugaaaauccaagc

SEQ ID NO: 1011163 - RNA, 22 nt, Human
ucaagaagggaaaaggauuuau

SEQ ID NO: 1011164 - RNA, 20 nt, Human
ucaaggagcaaaacuugggc

SEQ ID NO: 1011165 - RNA, 20 nt, Human
ucaaggagcaaaacuugggc

SEQ ID NO: 1011166 - RNA, 22 nt, Human
uccacugugugccccagggcag

SEQ ID NO: 1011167 - RNA, 21 nt, Human
ucccaccuucaccauugccca

SEQ ID NO: 1011168 - RNA, 23 nt, Human
ucccccaaggaagacacagcccu

SEQ ID NO: 1011169 - RNA, 19 nt, Human
ucucccccgccaccccgcc

SEQ ID NO: 1011170 - RNA, 24 nt, Human
ucuccuggguccgccccacacccc

SEQ ID NO: 1011171 - RNA, 19 nt, Human
ucucuguggcugcaaggcc

SEQ ID NO: 1011172 - RNA, 24 nt, Human
ucucuguggcugcaaggcccuucc

SEQ ID NO: 1011173 - RNA, 24 nt, Human
ugaaccuaggagggugggaauggc

SEQ ID NO: 1011174 - RNA, 19 nt, Human
ugccuuacccugaucuaaa

SEQ ID NO: 1011175 - RNA, 21 nt, Human
uggaaaaaaaagggggggagg

SEQ ID NO: 1011176 - RNA, 18 nt, Human
uggagcccugucuggcug

SEQ ID NO: 1011177 - RNA, 24 nt, Human
uggcagacggccagacagcagagg

SEQ ID NO: 1011178 - RNA, 21 nt, Human
uggggagugccuggauuugcc

SEQ ID NO: 1011179 - RNA, 25 nt, Human
uggggagugccuggauuugccccaa

SEQ ID NO: 1011180 - RNA, 19 nt, Human
ugugccccagggcagugga

SEQ ID NO: 1011181 - RNA, 22 nt, Human
uuccuucuggcucccuggcaga

SEQ ID NO: 1011182 - RNA, 24 nt, Human
uuuaggggaacaaaagauggaaaa

SEQ ID NO: 1011183 - RNA, 23 nt, Human
aaaaaagacacugaaauagacaa

SEQ ID NO: 1011184 - RNA, 24 nt, Human
aaaaaggaaauauacauauaugua

SEQ ID NO: 1011185 - RNA, 20 nt, Human
aaaacccaaaggcaaccaca

SEQ ID NO: 1011186 - RNA, 22 nt, Human
aaaaucuuucaaacccaaucac

SEQ ID NO: 1011187 - RNA, 18 nt, Human
aaacuggggaggccggug

SEQ ID NO: 1011188 - RNA, 19 nt, Human
aaagugcugggauuacagg

SEQ ID NO: 1011189 - RNA, 21 nt, Human
aaagugcugggauuacaggca

SEQ ID NO: 1011190 - RNA, 23 nt, Human
aaagugcugggauuacaggcaua

SEQ ID NO: 1011191 - RNA, 22 nt, Human
aacaaaaacaaucuguacagaa

SEQ ID NO: 1011192 - RNA, 25 nt, Human
aacccuauaucauuuuaguaaaaaa

SEQ ID NO: 1011193 - RNA, 22 nt, Human
aacuuaaaaggugaaggacaag

SEQ ID NO: 1011194 - RNA, 20 nt, Human
aagaaacuucccauaauuca

SEQ ID NO: 1011195 - RNA, 18 nt, Human
aaggacaagaccccauau

SEQ ID NO: 1011196 - RNA, 19 nt, Human
aaggucccaaaauaaagaa

SEQ ID NO: 1011197 - RNA, 19 nt, Human
aagugcugggauuacaggc

SEQ ID NO: 1011198 - RNA, 21 nt, Human
aagugcugggauuacaggcau

SEQ ID NO: 1011199 - RNA, 26 nt, Human
aagugcugggauuacaggcauaagcc

SEQ ID NO: 1011200 - RNA, 25 nt, Human
aauaaguaauggaggaaaaguacaa

SEQ ID NO: 1011201 - RNA, 19 nt, Human
aauauacauauauguacac

SEQ ID NO: 1011202 - RNA, 25 nt, Human
acaacacucucuccaccagagcucc

SEQ ID NO: 1011203 - RNA, 24 nt, Human
accauguuggccagacuggucuug

SEQ ID NO: 1011204 - RNA, 24 nt, Human
acggcauuucaccauguuggccag

SEQ ID NO: 1011205 - RNA, 23 nt, Human
acuggucuugaacuccugaccuc

SEQ ID NO: 1011206 - RNA, 20 nt, Human
agaaggucccaaaauaaaga

SEQ ID NO: 1011207 - RNA, 25 nt, Human
agacaccccauaucacagacaagaa

SEQ ID NO: 1011208 - RNA, 27 nt, Human
agccaacagcagcaacgucgaagcgcg

SEQ ID NO: 1011209 - RNA, 23 nt, Human
agcgcgcacgggguaacagcccu

SEQ ID NO: 1011210 - RNA, 19 nt, Human
agcuccgacccuccccacc

SEQ ID NO: 1011211 - RNA, 21 nt, Human
aggagagccaacagcagcaac

SEQ ID NO: 1011212 - RNA, 19 nt, Human
aggggcgaggagagccaaa

SEQ ID NO: 1011213 - RNA, 24 nt, Human
aggugauccacccaucguagccuc

SEQ ID NO: 1011214 - RNA, 21 nt, Human
agguucaagugauucucccgc

SEQ ID NO: 1011215 - RNA, 23 nt, Human
agguucaagugauucucccgccu

SEQ ID NO: 1011216 - RNA, 21 nt, Human
aguagcugggauuacagacac

SEQ ID NO: 1011217 - RNA, 18 nt, Human
agugcugggauuacaggc

SEQ ID NO: 1011218 - RNA, 21 nt, Human
auaaaaccuaauggaacucug

SEQ ID NO: 1011219 - RNA, 20 nt, Human
auaauacacagaauacaguc

SEQ ID NO: 1011220 - RNA, 21 nt, Human
aucguagccucccaaagugcu

SEQ ID NO: 1011221 - RNA, 19 nt, Human
aucucggcgcccaggcugg

SEQ ID NO: 1011222 - RNA, 21 nt, Human
augucaauuucugacauccuu

SEQ ID NO: 1011223 - RNA, 24 nt, Human
auuuuuguauuuuuaguagagacg

SEQ ID NO: 1011224 - RNA, 24 nt, Human
caaagugcugggauuacaggcaua

SEQ ID NO: 1011225 - RNA, 21 nt, Human
caaggcacaacucagcguuga

SEQ ID NO: 1011226 - RNA, 22 nt, Human
caagugauucucccgccucagc

SEQ ID NO: 1011227 - RNA, 18 nt, Human
cacaaagcucuuugcugu

SEQ ID NO: 1011228 - RNA, 24 nt, Human
cacaccuaccaccuguuuugguca

SEQ ID NO: 1011229 - RNA, 18 nt, Human
caccagagcuccgacccu

SEQ ID NO: 1011230 - RNA, 22 nt, Human
caccagagcuccgacccucccc

SEQ ID NO: 1011231 - RNA, 19 nt, Human
caccaugcccagccaaagc

SEQ ID NO: 1011232 - RNA, 21 nt, Human
caccauguuggccagacuggu

SEQ ID NO: 1011233 - RNA, 24 nt, Human
caccauguuggccagacuggucuu

SEQ ID NO: 1011234 - RNA, 27 nt, Human
caccauguuggccagacuggucuugaa

SEQ ID NO: 1011235 - RNA, 23 nt, Human
cacccaucguagccucccaaagu

SEQ ID NO: 1011236 - RNA, 22 nt, Human
caccccauaucacagacaagaa

SEQ ID NO: 1011237 - RNA, 18 nt, Human
cacugcaaccucugccuc

SEQ ID NO: 1011238 - RNA, 21 nt, Human
cacugcaaccucugccuccca

SEQ ID NO: 1011239 - RNA, 21 nt, Human
cagaaaacccaaaggcaacca

SEQ ID NO: 1011240 - RNA, 22 nt, Human
cagaaaacccaaaggcaaccac

SEQ ID NO: 1011241 - RNA, 20 nt, Human
cagccuccugaguagcuggg

SEQ ID NO: 1011242 - RNA, 22 nt, Human
caggcgguucccaagggaacga

SEQ ID NO: 1011243 - RNA, 21 nt, Human
caugcccagcuaauuuuugua

SEQ ID NO: 1011244 - RNA, 24 nt, Human
cauguuggccagacuggucuugaa

SEQ ID NO: 1011245 - RNA, 24 nt, Human
cauuacacugauaacauaugugug

SEQ ID NO: 1011246 - RNA, 23 nt, Human
ccaaagugcugggauuacaggca

SEQ ID NO: 1011247 - RNA, 24 nt, Human
ccaaagugcugggauuacaggcau

SEQ ID NO: 1011248 - RNA, 21 nt, Human
ccaacagcagcaacgucgaag

SEQ ID NO: 1011249 - RNA, 20 nt, Human
ccaccaugcccagccaaagc

SEQ ID NO: 1011250 - RNA, 24 nt, Human
cccaaagugcugggauuacaggca

SEQ ID NO: 1011251 - RNA, 18 nt, Human
cccaggcuggagugcaau

SEQ ID NO: 1011252 - RNA, 22 nt, Human
cccagguucaagugauucuccc

SEQ ID NO: 1011253 - RNA, 23 nt, Human
cccgccucagccuccugaguagc

SEQ ID NO: 1011254 - RNA, 24 nt, Human
cccgccucagccuccugaguagcu

SEQ ID NO: 1011255 - RNA, 21 nt, Human
cccuccccaccaaacuuccgc

SEQ ID NO: 1011256 - RNA, 19 nt, Human
ccgacccuccccaccaaac

SEQ ID NO: 1011257 - RNA, 21 nt, Human
ccgcgaagggcagccucccuu

SEQ ID NO: 1011258 - RNA, 24 nt, Human
ccucccagguucaagugauucucc

SEQ ID NO: 1011259 - RNA, 20 nt, Human
ccugaacuuaaaaggugaag

SEQ ID NO: 1011260 - RNA, 23 nt, Human
ccugaccucaggugauccaccca

SEQ ID NO: 1011261 - RNA, 24 nt, Human
ccugaccucaggugauccacccau

SEQ ID NO: 1011262 - RNA, 19 nt, Human
ccugaguagcugggauuac

SEQ ID NO: 1011263 - RNA, 20 nt, Human
ccugugguaaaagaguuuua

SEQ ID NO: 1011264 - RNA, 24 nt, Human
cgccucagccuccugaguagcugg

SEQ ID NO: 1011265 - RNA, 20 nt, Human
cuaaccaauuuagguaauau

SEQ ID NO: 1011266 - RNA, 24 nt, Human
cucacugcaaccucugccucccag

SEQ ID NO: 1011267 - RNA, 24 nt, Human
cucacugcaaccucugccucccag

SEQ ID NO: 1011268 - RNA, 24 nt, Human
cucagccuccugaguagcugggau

SEQ ID NO: 1011269 - RNA, 19 nt, Human
cucccagguucaagugauu

SEQ ID NO: 1011270 - RNA, 23 nt, Human
cugcaaccucugccucccagguu

SEQ ID NO: 1011271 - RNA, 24 nt, Human
cugcaaccucugccucccagguuc

SEQ ID NO: 1011272 - RNA, 21 nt, Human
gaccauuuccuuauuagcaaa

SEQ ID NO: 1011273 - RNA, 20 nt, Human
gaccucaggugauccaccca

SEQ ID NO: 1011274 - RNA, 24 nt, Human
gacuggucuugaacuccugaccuc

SEQ ID NO: 1011275 - RNA, 20 nt, Human
gagcuccgacccuccccacc

SEQ ID NO: 1011276 - RNA, 25 nt, Human
gaguagcugggauuacagacacucg

SEQ ID NO: 1011277 - RNA, 24 nt, Human
gauuacagacacucgccaucaugc

SEQ ID NO: 1011278 - RNA, 18 nt, Human
gauuacaggcauaagcca

SEQ ID NO: 1011279 - RNA, 21 nt, Human
gauuacaggcauaagccacca

SEQ ID NO: 1011280 - RNA, 24 nt, Human
gauuacaggcauaagccaccaugc

SEQ ID NO: 1011281 - RNA, 21 nt, Human
gauucucccgccucagccucc

SEQ ID NO: 1011282 - RNA, 22 nt, Human
gcaaccucugccucccagguuc

SEQ ID NO: 1011283 - RNA, 22 nt, Human
gcccagcuaauuuuuguauuuu

SEQ ID NO: 1011284 - RNA, 20 nt, Human
gcccaggcuggagugcaaug

SEQ ID NO: 1011285 - RNA, 21 nt, Human
gcuggagugcaauggcgcuag

SEQ ID NO: 1011286 - RNA, 20 nt, Human
ggacaagaccccauauuauu

SEQ ID NO: 1011287 - RNA, 24 nt, Human
ggauuacagacacucgccaucaug

SEQ ID NO: 1011288 - RNA, 24 nt, Human
ggauuacaggcauaagccaccaug

SEQ ID NO: 1011289 - RNA, 22 nt, Human
ggcggaguucccaggcgguucc

SEQ ID NO: 1011290 - RNA, 19 nt, Human
ggucuugaacuccugaccu

SEQ ID NO: 1011291 - RNA, 20 nt, Human
guagagacggcauuucacca

SEQ ID NO: 1011292 - RNA, 19 nt, Human
gucgcccaggcuggagugc

SEQ ID NO: 1011293 - RNA, 24 nt, Human
gugauccacccaucguagccuccc

SEQ ID NO: 1011294 - RNA, 23 nt, Human
gugauucucccgccucagccucc

SEQ ID NO: 1011295 - RNA, 19 nt, Human
uaaaagaguuuuacuggaa

SEQ ID NO: 1011296 - RNA, 20 nt, Human
uaauuuagaaaaucuuccuc

SEQ ID NO: 1011297 - RNA, 24 nt, Human
uaauuuuuguauuuuuaguagaga

SEQ ID NO: 1011298 - RNA, 21 nt, Human
uacacagacaccccauaucac

SEQ ID NO: 1011299 - RNA, 24 nt, Human
uacagacacucgccaucaugccca

SEQ ID NO: 1011300 - RNA, 24 nt, Human
uacaggcauaagccaccaugccca

SEQ ID NO: 1011301 - RNA, 23 nt, Human
uacauauauguacacagacaccc

SEQ ID NO: 1011302 - RNA, 20 nt, Human
uagaauuucacuguaauuag

SEQ ID NO: 1011303 - RNA, 22 nt, Human
uagagacggcauuucaccaugu

SEQ ID NO: 1011304 - RNA, 24 nt, Human
uagcgcgaucucagcucacugcaa

SEQ ID NO: 1011305 - RNA, 20 nt, Human
uaguaaaaaaaaaagaaaau

SEQ ID NO: 1011306 - RNA, 24 nt, Human
uaguagagacggcauuucaccaug

SEQ ID NO: 1011307 - RNA, 24 nt, Human
uaucauuuuaguaaaaaaaaaaga

SEQ ID NO: 1011308 - RNA, 21 nt, Human
uauuaaaaacuauuaagagca

SEQ ID NO: 1011309 - RNA, 21 nt, Human
uauucagucgcccaggcugga

SEQ ID NO: 1011310 - RNA, 24 nt, Human
uauucagucgcccaggcuggagug

SEQ ID NO: 1011311 - RNA, 19 nt, Human
ucaagugauucucccgccu

SEQ ID NO: 1011312 - RNA, 19 nt, Human
ucacugcaaccucugccuc

SEQ ID NO: 1011313 - RNA, 24 nt, Human
ucacugcaaccucugccucccagg

SEQ ID NO: 1011314 - RNA, 25 nt, Human
ucacugcaaccucugccucccaggu

SEQ ID NO: 1011315 - RNA, 18 nt, Human
ucagauuauuuauuugaa

SEQ ID NO: 1011316 - RNA, 20 nt, Human
ucagccuccugaguagcugg

SEQ ID NO: 1011317 - RNA, 19 nt, Human
ucagcguugaugcuaaagu

SEQ ID NO: 1011318 - RNA, 27 nt, Human
ucagcucacugcaaccucugccuccca

SEQ ID NO: 1011319 - RNA, 18 nt, Human
ucagucgcccaggcugga

SEQ ID NO: 1011320 - RNA, 24 nt, Human
ucagucgcccaggcuggagugcaa

SEQ ID NO: 1011321 - RNA, 25 nt, Human
uccaccagagcuccgacccucccca

SEQ ID NO: 1011322 - RNA, 24 nt, Human
ucccaaagugcugggauuacaggc

SEQ ID NO: 1011323 - RNA, 21 nt, Human
ucccagguucaagugauucuc

SEQ ID NO: 1011324 - RNA, 24 nt, Human
ucccagguucaagugauucucccg

SEQ ID NO: 1011325 - RNA, 19 nt, Human
ucccugaguaaagauucua

SEQ ID NO: 1011326 - RNA, 18 nt, Human
uccugaguagcugggauu

SEQ ID NO: 1011327 - RNA, 18 nt, Human
ucgcccaggcuggagugc

SEQ ID NO: 1011328 - RNA, 24 nt, Human
ucucccgccucagccuccugagua

SEQ ID NO: 1011329 - RNA, 24 nt, Human
ucucggaccgcgaagggcagccuc

SEQ ID NO: 1011330 - RNA, 18 nt, Human
ucucggcgcccaggcugg

SEQ ID NO: 1011331 - RNA, 21 nt, Human
ucuguacagaaaacccaaagg

SEQ ID NO: 1011332 - RNA, 23 nt, Human
ucuugaacuccugaccucaggug

SEQ ID NO: 1011333 - RNA, 18 nt, Human
ugaaggacaagaccccau

SEQ ID NO: 1011334 - RNA, 21 nt, Human
ugacaguuaaaaauuacacac

SEQ ID NO: 1011335 - RNA, 19 nt, Human
ugaccucaggugauccacc

SEQ ID NO: 1011336 - RNA, 21 nt, Human
ugaccucaggugauccaccca

SEQ ID NO: 1011337 - RNA, 20 nt, Human
ugauucucccgccucagccu

SEQ ID NO: 1011338 - RNA, 24 nt, Human
ugcaaagaccaccauucauaaaaa

SEQ ID NO: 1011339 - RNA, 18 nt, Human
ugcaagauagaauuucac

SEQ ID NO: 1011340 - RNA, 22 nt, Human
ugcaguagcgcgaucucagcuc

SEQ ID NO: 1011341 - RNA, 24 nt, Human
ugcugggauuacaggcauaagcca

SEQ ID NO: 1011342 - RNA, 24 nt, Human
uggaaugcaguagcgcgaucucag

SEQ ID NO: 1011343 - RNA, 23 nt, Human
uggagugcaauggcgcuaucucg

SEQ ID NO: 1011344 - RNA, 24 nt, Human
uggagugcaauggcgcuaucucgg

SEQ ID NO: 1011345 - RNA, 24 nt, Human
uggccagacuggucuugaacuccu

SEQ ID NO: 1011346 - RNA, 19 nt, Human
ugggauuacagacacucgc

SEQ ID NO: 1011347 - RNA, 21 nt, Human
ugggauuacagacacucgcca

SEQ ID NO: 1011348 - RNA, 22 nt, Human
ugggauuacagacacucgccau

SEQ ID NO: 1011349 - RNA, 24 nt, Human
ugggauuacagacacucgccauca

SEQ ID NO: 1011350 - RNA, 18 nt, Human
ugggauuacaggcauaag

SEQ ID NO: 1011351 - RNA, 22 nt, Human
ugggauuacaggcauaagccac

SEQ ID NO: 1011352 - RNA, 24 nt, Human
ugggauuacaggcauaagccacca

SEQ ID NO: 1011353 - RNA, 25 nt, Human
uggucaaucuugcuaaaaaagacac

SEQ ID NO: 1011354 - RNA, 20 nt, Human
uguuuuuuuuugagacagag

SEQ ID NO: 1011355 - RNA, 24 nt, Human
uuaacaauuuuuuugaaaauauaa

SEQ ID NO: 1011356 - RNA, 24 nt, Human
uuaguagagacggcauuucaccau

SEQ ID NO: 1011357 - RNA, 22 nt, Human
uuauucagucgcccaggcugga

SEQ ID NO: 1011358 - RNA, 24 nt, Human
uuauucagucgcccaggcuggagu

SEQ ID NO: 1011359 - RNA, 23 nt, Human
uucaaaaucuuucaaacccaauc

SEQ ID NO: 1011360 - RNA, 23 nt, Human
uucaagugauucucccgccucag

SEQ ID NO: 1011361 - RNA, 24 nt, Human
uucaagugauucucccgccucagc

SEQ ID NO: 1011362 - RNA, 21 nt, Human
uucccaggcgguucccaaggg

SEQ ID NO: 1011363 - RNA, 24 nt, Human
uucccugugguaaaagaguuuuac

SEQ ID NO: 1011364 - RNA, 22 nt, Human
uugaaaauauaaaauaaacccu

SEQ ID NO: 1011365 - RNA, 18 nt, Human
uuuacuggguaauuucug

SEQ ID NO: 1011366 - RNA, 21 nt, Human
uuucaccauguuggccagacu

SEQ ID NO: 1011367 - RNA, 23 nt, Human
uuuuaugccguucauauaucgcu

SEQ ID NO: 1011368 - RNA, 23 nt, Human
uuuuauucagucgcccaggcugg

SEQ ID NO: 1011369 - RNA, 24 nt, Human
uuuuauucagucgcccaggcugga

SEQ ID NO: 1011370 - RNA, 24 nt, Human
uuuugaaaauauaaaauaaacccu

SEQ ID NO: 1011371 - RNA, 24 nt, Human
uuuuuaguagagacggcauuucac

SEQ ID NO: 1011372 - RNA, 20 nt, Human
uuuuuguauuuuuaguagag

SEQ ID NO: 1011373 - RNA, 20 nt, Human
aggcaggauuuugucauaua

SEQ ID NO: 1011374 - RNA, 19 nt, Human
caggauuuugucauauagg

SEQ ID NO: 1011375 - RNA, 21 nt, Human
caggauuuugucauauaggca

SEQ ID NO: 1011376 - RNA, 19 nt, Human
uaaagcagugugguuaggc

SEQ ID NO: 1011377 - RNA, 20 nt, Human
uaaaguaaaugggcuuaaaa

SEQ ID NO: 1011378 - RNA, 21 nt, Human
ugguuaggcaggauuuuguca

SEQ ID NO: 1011379 - RNA, 20 nt, Human
uuccaaaaagagcuuugugg

SEQ ID NO: 1011380 - RNA, 21 nt, Human
uuccaaaaagagcuuuguggg

SEQ ID NO: 1011381 - RNA, 19 nt, Human
uuugugggggacggaaaaa

SEQ ID NO: 1011382 - RNA, 27 nt, Human
acauuacaguggcccagagucuucugu

SEQ ID NO: 1011383 - RNA, 20 nt, Human
cacaaacauuacaguggccc

SEQ ID NO: 1011384 - RNA, 20 nt, Human
cccgaccuugggccuccagc

SEQ ID NO: 1011385 - RNA, 21 nt, Human
cccugugggugcugcuuuucc

SEQ ID NO: 1011386 - RNA, 19 nt, Human
cgcaggcgcucccuguggg

SEQ ID NO: 1011387 - RNA, 19 nt, Human
cgccagaugccuuucagaa

SEQ ID NO: 1011388 - RNA, 20 nt, Human
cuccccgaccuugggccucc

SEQ ID NO: 1011389 - RNA, 21 nt, Human
cuccccgaccuugggccucca

SEQ ID NO: 1011390 - RNA, 18 nt, Human
gaccuugggccuccagcc

SEQ ID NO: 1011391 - RNA, 23 nt, Human
gagaagaaaccucgcaggcgcuc

SEQ ID NO: 1011392 - RNA, 19 nt, Human
uccaaaucuaaacacaaac

SEQ ID NO: 1011393 - RNA, 19 nt, Human
uggcccagagucuucugcc

SEQ ID NO: 1011394 - RNA, 21 nt, Human
uguccaaaucuaaacacaaac

SEQ ID NO: 1011395 - RNA, 19 nt, Human
aaaaagccaaauacaauug

SEQ ID NO: 1011396 - RNA, 27 nt, Human
aaaaagccaaauacaauugcacagaua

SEQ ID NO: 1011397 - RNA, 23 nt, Human
aaacagugcaaaaaaaagccaaa

SEQ ID NO: 1011398 - RNA, 23 nt, Human
aaagccaaauacaauugcacaga

SEQ ID NO: 1011399 - RNA, 19 nt, Human
aaagugaauacaaccaaau

SEQ ID NO: 1011400 - RNA, 23 nt, Human
aacuugauuccugaccucuccca

SEQ ID NO: 1011401 - RNA, 22 nt, Human
aagaaggaguagaagcagaggu

SEQ ID NO: 1011402 - RNA, 22 nt, Human
aagugcccauuucagcaaaucc

SEQ ID NO: 1011403 - RNA, 23 nt, Human
acaggcccccgagaagugugcgc

SEQ ID NO: 1011404 - RNA, 19 nt, Human
accagcuucuccgccucgg

SEQ ID NO: 1011405 - RNA, 22 nt, Human
acccugcccuuccaacagcagc

SEQ ID NO: 1011406 - RNA, 19 nt, Human
accuucccuuugacaaaac

SEQ ID NO: 1011407 - RNA, 21 nt, Human
agcaaccccaaagucaaaaug

SEQ ID NO: 1011408 - RNA, 22 nt, Human
agcaaccccaaagucaaaaugc

SEQ ID NO: 1011409 - RNA, 22 nt, Human
agccugcugcuggucuccuccu

SEQ ID NO: 1011410 - RNA, 19 nt, Human
aggaacauggagaagucac

SEQ ID NO: 1011411 - RNA, 20 nt, Human
agugugcgcugcuucaacga

SEQ ID NO: 1011412 - RNA, 18 nt, Human
aguuuucagccacagucu

SEQ ID NO: 1011413 - RNA, 21 nt, Human
auuuuguuccagccaguccca

SEQ ID NO: 1011414 - RNA, 24 nt, Human
caaaaaaaagccaaauacaauugc

SEQ ID NO: 1011415 - RNA, 19 nt, Human
caaguuuaaguuccuugcc

SEQ ID NO: 1011416 - RNA, 18 nt, Human
cagcagcaggaguaguag

SEQ ID NO: 1011417 - RNA, 19 nt, Human
cagugcaaaaaaaagccaa

SEQ ID NO: 1011418 - RNA, 20 nt, Human
cauggagaagucacgcuccu

SEQ ID NO: 1011419 - RNA, 27 nt, Human
cauuuugacuccuggcuuuucagcaac

SEQ ID NO: 1011420 - RNA, 25 nt, Human
ccacagucuccccaacuccggcucu

SEQ ID NO: 1011421 - RNA, 21 nt, Human
ccagcuucuccgccucgggga

SEQ ID NO: 1011422 - RNA, 20 nt, Human
cccuuccaacagcagcagga

SEQ ID NO: 1011423 - RNA, 21 nt, Human
ccucgcagguguuggcgaaca

SEQ ID NO: 1011424 - RNA, 20 nt, Human
ccuugggucucgcaccggau

SEQ ID NO: 1011425 - RNA, 18 nt, Human
cggcucugcuccccucuc

SEQ ID NO: 1011426 - RNA, 19 nt, Human
cucucccauugucacucca

SEQ ID NO: 1011427 - RNA, 21 nt, Human
cugcuccccucuccuuggguc

SEQ ID NO: 1011428 - RNA, 21 nt, Human
gaaacagucugguucgugcuu

SEQ ID NO: 1011429 - RNA, 23 nt, Human
gaaacagugcaaaaaaaagccaa

SEQ ID NO: 1011430 - RNA, 20 nt, Human
gaaccaauggauaccuuagg

SEQ ID NO: 1011431 - RNA, 21 nt, Human
gacacacggcuuuaccuuccc

SEQ ID NO: 1011432 - RNA, 18 nt, Human
gacagucacaccugauga

SEQ ID NO: 1011433 - RNA, 23 nt, Human
gacuccuggcuuuucagcaaccc

SEQ ID NO: 1011434 - RNA, 23 nt, Human
gagccugcugcuggucuccucgg

SEQ ID NO: 1011435 - RNA, 20 nt, Human
gcaaugguggcagucaaagc

SEQ ID NO: 1011436 - RNA, 23 nt, Human
ggaaccacaaguuuaaguuccuu

SEQ ID NO: 1011437 - RNA, 21 nt, Human
ggccucgaacuucaccagggc

SEQ ID NO: 1011438 - RNA, 19 nt, Human
ggcgcgggcggcugguggg

SEQ ID NO: 1011439 - RNA, 23 nt, Human
gggcugaccccaagaaacagucu

SEQ ID NO: 1011440 - RNA, 22 nt, Human
gguuggagguacucacggcacc

SEQ ID NO: 1011441 - RNA, 21 nt, Human
guugcaaugguggcagucaaa

SEQ ID NO: 1011442 - RNA, 18 nt, Human
uaguaggugaccagcuuc

SEQ ID NO: 1011443 - RNA, 19 nt, Human
uaguggacucccuuagauc

SEQ ID NO: 1011444 - RNA, 19 nt, Human
uaucaaagacagacaaggu

SEQ ID NO: 1011445 - RNA, 20 nt, Human
uaucaaagacagacaaggug

SEQ ID NO: 1011446 - RNA, 22 nt, Human
uauguacacaacaacauuuuug

SEQ ID NO: 1011447 - RNA, 26 nt, Human
uauuaaaaaacuuggaagccaacauu

SEQ ID NO: 1011448 - RNA, 18 nt, Human
ucaaagcacaccacgcag

SEQ ID NO: 1011449 - RNA, 18 nt, Human
uccagccagucccagugc

SEQ ID NO: 1011450 - RNA, 18 nt, Human
ucccacacuccucgcagg

SEQ ID NO: 1011451 - RNA, 21 nt, Human
ucccagugcugauugauuucc

SEQ ID NO: 1011452 - RNA, 23 nt, Human
ucccgcaggauguaccucuugcc

SEQ ID NO: 1011453 - RNA, 22 nt, Human
ucucgcaccggauucggccccc

SEQ ID NO: 1011454 - RNA, 21 nt, Human
ucuugcuucuugguuaguaug

SEQ ID NO: 1011455 - RNA, 21 nt, Human
ugaaacagugcaaaaaaaagc

SEQ ID NO: 1011456 - RNA, 23 nt, Human
ugaaacagugcaaaaaaaagcca

SEQ ID NO: 1011457 - RNA, 18 nt, Human
ugaccccaagaaacaguc

SEQ ID NO: 1011458 - RNA, 19 nt, Human
ugaccccaagaaacagucu

SEQ ID NO: 1011459 - RNA, 23 nt, Human
ugagagcaaaaucaacacuagca

SEQ ID NO: 1011460 - RNA, 24 nt, Human
ugagguacagccagcccuggcggg

SEQ ID NO: 1011461 - RNA, 23 nt, Human
ugaugaggagaauggcucagcug

SEQ ID NO: 1011462 - RNA, 23 nt, Human
ugcaaaaaaaagccaaauacaau

SEQ ID NO: 1011463 - RNA, 19 nt, Human
ugcacagauaguggacucc

SEQ ID NO: 1011464 - RNA, 23 nt, Human
ugccagccuagucuccaggaaga

SEQ ID NO: 1011465 - RNA, 20 nt, Human
uggcagucaaagcgcucagu

SEQ ID NO: 1011466 - RNA, 22 nt, Human
uggcagucaaagcgcucaguca

SEQ ID NO: 1011467 - RNA, 19 nt, Human
ugggaaggcagggggugca

SEQ ID NO: 1011468 - RNA, 23 nt, Human
uugaggguugugucgguuccccu

SEQ ID NO: 1011469 - RNA, 22 nt, Human
uugaugcugagguacagccagc

SEQ ID NO: 1011470 - RNA, 23 nt, Human
uuugucagguuguuuagccagau

SEQ ID NO: 1011471 - RNA, 21 nt, Human
aagccugacgagaagucggga

SEQ ID NO: 1011472 - RNA, 20 nt, Human
accaccgccgcccaggacga

SEQ ID NO: 1011473 - RNA, 24 nt, Human
accuucuccagccagugauugcug

SEQ ID NO: 1011474 - RNA, 21 nt, Human
agcaauaugcuuauucuaucc

SEQ ID NO: 1011475 - RNA, 25 nt, Human
agccugacgagaagucgggagacug

SEQ ID NO: 1011476 - RNA, 18 nt, Human
agcgccggcgcgaaagcc

SEQ ID NO: 1011477 - RNA, 18 nt, Human
augcauucacaaggucaa

SEQ ID NO: 1011478 - RNA, 23 nt, Human
cagcccaguggccauaacggcga

SEQ ID NO: 1011479 - RNA, 18 nt, Human
caucccuaacaucaugca

SEQ ID NO: 1011480 - RNA, 22 nt, Human
cccgagaagugccggguccggg

SEQ ID NO: 1011481 - RNA, 21 nt, Human
cccugggcccuuuccuagccc

SEQ ID NO: 1011482 - RNA, 22 nt, Human
ccgccgcaccaccgccgcccag

SEQ ID NO: 1011483 - RNA, 20 nt, Human
ccgcgccggggcgaucggca

SEQ ID NO: 1011484 - RNA, 18 nt, Human
ccgcgcuggagcagcggc

SEQ ID NO: 1011485 - RNA, 19 nt, Human
ccggguccggguuggggaa

SEQ ID NO: 1011486 - RNA, 19 nt, Human
cgcaggccgcgcuggagca

SEQ ID NO: 1011487 - RNA, 18 nt, Human
cggaacccgagaagugcc

SEQ ID NO: 1011488 - RNA, 20 nt, Human
cgggcccugggcccuuuccu

SEQ ID NO: 1011489 - RNA, 23 nt, Human
gcccaguggccauaacggcgacc

SEQ ID NO: 1011490 - RNA, 25 nt, Human
gcccugggcccuuuccuagcccgcg

SEQ ID NO: 1011491 - RNA, 18 nt, Human
gcggucagccgcccagcc

SEQ ID NO: 1011492 - RNA, 19 nt, Human
ggccauaacggcgaccgcc

SEQ ID NO: 1011493 - RNA, 22 nt, Human
ggcccugggcccuuuccuagcc

SEQ ID NO: 1011494 - RNA, 21 nt, Human
ggcgaucggcagucgcggaac

SEQ ID NO: 1011495 - RNA, 21 nt, Human
gggaaaggccgcagcgaaagg

SEQ ID NO: 1011496 - RNA, 22 nt, Human
uaaagaagucauaaacagcauu

SEQ ID NO: 1011497 - RNA, 18 nt, Human
uacagugcauccuugaac

SEQ ID NO: 1011498 - RNA, 22 nt, Human
uauucuauccacaucccuaaca

SEQ ID NO: 1011499 - RNA, 23 nt, Human
ucaugcauucacaaggucaaagu

SEQ ID NO: 1011500 - RNA, 19 nt, Human
uuccggagccgcggcaggg

SEQ ID NO: 1011501 - RNA, 21 nt, Human
uuccucccuccucccacagcc

SEQ ID NO: 1011502 - RNA, 24 nt, Human
uuuucaucuuuccucccuccuccc

SEQ ID NO: 1011503 - RNA, 18 nt, Human
uuuuuuuuuuaaagaagu

SEQ ID NO: 1011504 - RNA, 23 nt, Human
uuuuuuuuuuuuuaaagaaguca

SEQ ID NO: 1011505 - RNA, 18 nt, Human
cacuccgccaccucgucc

SEQ ID NO: 1011506 - RNA, 22 nt, Human
cccgggcugcauauuccagggg

SEQ ID NO: 1011507 - RNA, 21 nt, Human
ccgccaccucguccuugccgc

SEQ ID NO: 1011508 - RNA, 22 nt, Human
ccgcugucuggggcucccccgg

SEQ ID NO: 1011509 - RNA, 22 nt, Human
ccucccgccccacuccgccacc

SEQ ID NO: 1011510 - RNA, 21 nt, Human
cucguccuugccgcugucugg

SEQ ID NO: 1011511 - RNA, 20 nt, Human
gcauauuccaggggcugggg

SEQ ID NO: 1011512 - RNA, 22 nt, Human
gccaccgucaggaccaaccauu

SEQ ID NO: 1011513 - RNA, 19 nt, Human
gcucagccaccgucaggac

SEQ ID NO: 1011514 - RNA, 19 nt, Human
ggcugggggcucagccacc

SEQ ID NO: 1011515 - RNA, 24 nt, Human
ggcugggggcucagccaccgucag

SEQ ID NO: 1011516 - RNA, 20 nt, Human
ucccccgggcugcauauucc

SEQ ID NO: 1011517 - RNA, 23 nt, Human
ugcauauuccaggggcugggggc

SEQ ID NO: 1011518 - RNA, 22 nt, Human
aacauauuuacaacgugaagga

SEQ ID NO: 1011519 - RNA, 18 nt, Human
aacauuucucugcaaaac

SEQ ID NO: 1011520 - RNA, 20 nt, Human
aacauuucucugcaaaacaa

SEQ ID NO: 1011521 - RNA, 22 nt, Human
acaggaaugaaaagguuauaga

SEQ ID NO: 1011522 - RNA, 20 nt, Human
accacguucauugggccauu

SEQ ID NO: 1011523 - RNA, 26 nt, Human
agaaaggagauaaagaggagggaccc

SEQ ID NO: 1011524 - RNA, 23 nt, Human
agaaggaaauggaaacacacggg

SEQ ID NO: 1011525 - RNA, 23 nt, Human
agcaacagugccuuaagaaagga

SEQ ID NO: 1011526 - RNA, 19 nt, Human
aucaggugcaaguguggaa

SEQ ID NO: 1011527 - RNA, 18 nt, Human
caaaacaaauggagaagc

SEQ ID NO: 1011528 - RNA, 20 nt, Human
caaaacaaauggagaagcac

SEQ ID NO: 1011529 - RNA, 24 nt, Human
caaaacaaauggagaagcacugcu

SEQ ID NO: 1011530 - RNA, 25 nt, Human
caacagugccuuaagaaaggagaua

SEQ ID NO: 1011531 - RNA, 23 nt, Human
cacaggaaugaaaagguuauaga

SEQ ID NO: 1011532 - RNA, 28 nt, Human
cagaaggaaauggaaacacacgggaaau

SEQ ID NO: 1011533 - RNA, 18 nt, Human
cagacagguuuacaugua

SEQ ID NO: 1011534 - RNA, 19 nt, Human
cagggugcaaauggauuuc

SEQ ID NO: 1011535 - RNA, 23 nt, Human
cagucugcccuuuccuucuuuuc

SEQ ID NO: 1011536 - RNA, 21 nt, Human
cauagcaacagugccuuaaga

SEQ ID NO: 1011537 - RNA, 24 nt, Human
cauagcaacagugccuuaagaaga

SEQ ID NO: 1011538 - RNA, 25 nt, Human
ccagcaguacuuuuaaguccauucu

SEQ ID NO: 1011539 - RNA, 23 nt, Human
cccccuccggucgugacagcucg

SEQ ID NO: 1011540 - RNA, 19 nt, Human
ccggaagaggacggugggg

SEQ ID NO: 1011541 - RNA, 26 nt, Human
ccggccuuucuccuccucugaggccu

SEQ ID NO: 1011542 - RNA, 19 nt, Human
ccuuaagaaaggagauaaa

SEQ ID NO: 1011543 - RNA, 23 nt, Human
cggccugugagugugugucgggg

SEQ ID NO: 1011544 - RNA, 21 nt, Human
cuacuggggugacucuucgau

SEQ ID NO: 1011545 - RNA, 18 nt, Human
cuagguauuuagccaccu

SEQ ID NO: 1011546 - RNA, 24 nt, Human
cugaggccuggaucuucucuucgc

SEQ ID NO: 1011547 - RNA, 26 nt, Human
cuggaucuucucuucgcgaccagucu

SEQ ID NO: 1011548 - RNA, 24 nt, Human
cugguaaggcugcgaguccccccu

SEQ ID NO: 1011549 - RNA, 22 nt, Human
cuguuacacauggcuucccaug

SEQ ID NO: 1011550 - RNA, 25 nt, Human
cuuaaaaaaauggauaaaaucagaa

SEQ ID NO: 1011551 - RNA, 24 nt, Human
cuuaagaaaggagauaaagaggag

SEQ ID NO: 1011552 - RNA, 22 nt, Human
gauaaagaggagccuuaaaaaa

SEQ ID NO: 1011553 - RNA, 19 nt, Human
gcaaaacaaauggagaagc

SEQ ID NO: 1011554 - RNA, 25 nt, Human
gcucuguuuccucuuuccccuccca

SEQ ID NO: 1011555 - RNA, 21 nt, Human
ggaagaggacgguggggcgcg

SEQ ID NO: 1011556 - RNA, 18 nt, Human
gugaaggauacaucuaca

SEQ ID NO: 1011557 - RNA, 23 nt, Human
uaaaaaaauggauaaaaucagaa

SEQ ID NO: 1011558 - RNA, 21 nt, Human
uaacccccccaauuuuuuuuu

SEQ ID NO: 1011559 - RNA, 22 nt, Human
uaagcucuguuacacauggcuu

SEQ ID NO: 1011560 - RNA, 20 nt, Human
uaagugccugguaaggcugc

SEQ ID NO: 1011561 - RNA, 22 nt, Human
uacaacagauacaauucacauc

SEQ ID NO: 1011562 - RNA, 18 nt, Human
uacuguacacaggaauga

SEQ ID NO: 1011563 - RNA, 19 nt, Human
uacuuugagcacacaugcc

SEQ ID NO: 1011564 - RNA, 19 nt, Human
uacuuugagcacacaugcc

SEQ ID NO: 1011565 - RNA, 24 nt, Human
uccccugaauugacucucacagac

SEQ ID NO: 1011566 - RNA, 22 nt, Human
ucggcuggcuccggccuuucuc

SEQ ID NO: 1011567 - RNA, 18 nt, Human
ucugcccuuuccuucuuu

SEQ ID NO: 1011568 - RNA, 22 nt, Human
ucuguuuccucuuuccccuccc

SEQ ID NO: 1011569 - RNA, 18 nt, Human
ugaaaaacauuucucugc

SEQ ID NO: 1011570 - RNA, 19 nt, Human
ugaaaaacauuucucugca

SEQ ID NO: 1011571 - RNA, 24 nt, Human
ugaaaaacauuucucugcaaaaca

SEQ ID NO: 1011572 - RNA, 18 nt, Human
ugauaaauuaaccccccc

SEQ ID NO: 1011573 - RNA, 21 nt, Human
ugcaaaacaaauggagaagca

SEQ ID NO: 1011574 - RNA, 23 nt, Human
ugcucgaggcugaucucaggggc

SEQ ID NO: 1011575 - RNA, 18 nt, Human
uggagaagcacugcucuu

SEQ ID NO: 1011576 - RNA, 24 nt, Human
uggcuucacucuacaaaacauauu

SEQ ID NO: 1011577 - RNA, 23 nt, Human
uggggugacucuucgaugaauac

SEQ ID NO: 1011578 - RNA, 21 nt, Human
uuacacauggcuucccauggc

SEQ ID NO: 1011579 - RNA, 23 nt, Human
uucucugcaaaacaaauggagaa

SEQ ID NO: 1011580 - RNA, 20 nt, Human
uuuuuuuuguuuguuuuaac

SEQ ID NO: 1011581 - RNA, 22 nt, Human
uuuuuuuuguuuguuuuaacau

SEQ ID NO: 1011582 - RNA, 22 nt, Human
uuuuuuuuuuuuuguuuguuuu

SEQ ID NO: 1011583 - RNA, 24 nt, Human
uuuuuuuuuuuuuguuuuaacaug

SEQ ID NO: 1011584 - RNA, 18 nt, Human
uuuuuuuuuuuuuuuuug

SEQ ID NO: 1011585 - RNA, 18 nt, Human
uuuuuuuuuuuuuuuuug

SEQ ID NO: 1011586 - RNA, 21 nt, Human
uuuuuuuuuuuuuuuuuguuu

SEQ ID NO: 1011587 - RNA, 24 nt, Human
uuuuuuuuuuuuuuuuuuuguuuu

SEQ ID NO: 1011588 - RNA, 28 nt, Human
uuuuuuuuuuuuuuuuuuuuuguuuuaa

SEQ ID NO: 1011589 - RNA, 21 nt, Human
acaggcagcgugcaaccuauc

SEQ ID NO: 1011590 - RNA, 19 nt, Human
agaaaccagggguggaugg

SEQ ID NO: 1011591 - RNA, 22 nt, Human
agccacagauccuaaaucagaa

SEQ ID NO: 1011592 - RNA, 18 nt, Human
agcgggcagggccccagg

SEQ ID NO: 1011593 - RNA, 21 nt, Human
cagaggccuuccuccgagcuc

SEQ ID NO: 1011594 - RNA, 20 nt, Human
cauucuggaugguugggcug

SEQ ID NO: 1011595 - RNA, 24 nt, Human
ccccaggccucccaucgugaacuc

SEQ ID NO: 1011596 - RNA, 18 nt, Human
ccuaucauggugcuauuu

SEQ ID NO: 1011597 - RNA, 18 nt, Human
ccugagggagaggucagg

SEQ ID NO: 1011598 - RNA, 21 nt, Human
cuccgagcucaggcuauggac

SEQ ID NO: 1011599 - RNA, 18 nt, Human
cugagggagaggucaggg

SEQ ID NO: 1011600 - RNA, 25 nt, Human
gaaaaucaugaaagaggugaaugac

SEQ ID NO: 1011601 - RNA, 18 nt, Human
ggcagggccccaggccuc

SEQ ID NO: 1011602 - RNA, 19 nt, Human
ggcuauggacuuugacucc

SEQ ID NO: 1011603 - RNA, 18 nt, Human
ggguggauggguugcagg

SEQ ID NO: 1011604 - RNA, 19 nt, Human
gguggauggguugcaggga

SEQ ID NO: 1011605 - RNA, 19 nt, Human
gugugaaagcguuaggaag

SEQ ID NO: 1011606 - RNA, 23 nt, Human
uacggauuggugugaaagcguua

SEQ ID NO: 1011607 - RNA, 20 nt, Human
uauggcaguggugcagagua

SEQ ID NO: 1011608 - RNA, 21 nt, Human
ucaggcuauggacuuugacuc

SEQ ID NO: 1011609 - RNA, 23 nt, Human
ucgugaacucuuuccguuggucc

SEQ ID NO: 1011610 - RNA, 22 nt, Human
ugaaagaggugaaugacugaug

SEQ ID NO: 1011611 - RNA, 19 nt, Human
ugauacagaggccuuccuc

SEQ ID NO: 1011612 - RNA, 21 nt, Human
ugccugagggagaggucaggg

SEQ ID NO: 1011613 - RNA, 19 nt, Human
ugcugccggcucagggccc

SEQ ID NO: 1011614 - RNA, 18 nt, Human
ugggaagcucguauggca

SEQ ID NO: 1011615 - RNA, 24 nt, Human
uggugugaaagcguuaggaagggu

SEQ ID NO: 1011616 - RNA, 23 nt, Human
uucugcugccggcucagggccca

SEQ ID NO: 1011617 - RNA, 18 nt, Human
uuucugcugccggcucag

SEQ ID NO: 1011618 - RNA, 22 nt, Human
agcaggcgcugacggcgagcca

SEQ ID NO: 1011619 - RNA, 19 nt, Human
agcggggaggaggacgagg

SEQ ID NO: 1011620 - RNA, 21 nt, Human
ccccucucggugacaggggcu

SEQ ID NO: 1011621 - RNA, 24 nt, Human
ccggagcggggaggaggacgaggu

SEQ ID NO: 1011622 - RNA, 21 nt, Human
ccucucggugacaggggcggg

SEQ ID NO: 1011623 - RNA, 21 nt, Human
cgagagcucguucccccucuc

SEQ ID NO: 1011624 - RNA, 18 nt, Human
cggagcggggaggaggac

SEQ ID NO: 1011625 - RNA, 22 nt, Human
cggggagaaguggagucagagg

SEQ ID NO: 1011626 - RNA, 20 nt, Human
cguucccccucucggugaca

SEQ ID NO: 1011627 - RNA, 22 nt, Human
cucguucccccucucggugaca

SEQ ID NO: 1011628 - RNA, 21 nt, Human
gagcggggaggaggacgaggu

SEQ ID NO: 1011629 - RNA, 18 nt, Human
gcggggaggaggacgagg

SEQ ID NO: 1011630 - RNA, 21 nt, Human
ggaggaggacgaggucgaggg

SEQ ID NO: 1011631 - RNA, 20 nt, Human
gggagaaguggagucagagg

SEQ ID NO: 1011632 - RNA, 18 nt, Human
ucggcucguccggagcgg

SEQ ID NO: 1011633 - RNA, 24 nt, Human
ucucuccggcgagugggcgagagc

SEQ ID NO: 1011634 - RNA, 20 nt, Human
ugagaaagggaagcucccgg

SEQ ID NO: 1011635 - RNA, 19 nt, Human
aagaagcaggaggagggua

SEQ ID NO: 1011636 - RNA, 18 nt, Human
aagcaggaggaggguaug

SEQ ID NO: 1011637 - RNA, 20 nt, Human
aauguuugaauuugguuggu

SEQ ID NO: 1011638 - RNA, 22 nt, Human
accgauucccacccacacacgc

SEQ ID NO: 1011639 - RNA, 22 nt, Human
agcagugaauguuugaauuugg

SEQ ID NO: 1011640 - RNA, 21 nt, Human
agccagcacaggcaggcugca

SEQ ID NO: 1011641 - RNA, 19 nt, Human
caacuucucgaguuccccu

SEQ ID NO: 1011642 - RNA, 20 nt, Human
caauaugaaaagcuaggugc

SEQ ID NO: 1011643 - RNA, 19 nt, Human
cagcugaagcaagcaauag

SEQ ID NO: 1011644 - RNA, 23 nt, Human
caggcugcagcugaagcaagcaa

SEQ ID NO: 1011645 - RNA, 25 nt, Human
cauauucccacucccccucccaccu

SEQ ID NO: 1011646 - RNA, 24 nt, Human
ccacacacgcauauucccacuccc

SEQ ID NO: 1011647 - RNA, 27 nt, Human
ccacccacacacgcauauucccacucc

SEQ ID NO: 1011648 - RNA, 19 nt, Human
cccacacacgcauauuccc

SEQ ID NO: 1011649 - RNA, 19 nt, Human
cccaccuuuccuccugccc

SEQ ID NO: 1011650 - RNA, 25 nt, Human
cccccucccaccuuuccuccugccc

SEQ ID NO: 1011651 - RNA, 24 nt, Human
cccugcugucuucuaaccugcccg

SEQ ID NO: 1011652 - RNA, 21 nt, Human
ccgauucccacccacacacgc

SEQ ID NO: 1011653 - RNA, 22 nt, Human
ccucccaccuuuccuccugccc

SEQ ID NO: 1011654 - RNA, 23 nt, Human
ccucccaccuuuccuccugccca

SEQ ID NO: 1011655 - RNA, 21 nt, Human
cgcauauucccacucccccuc

SEQ ID NO: 1011656 - RNA, 28 nt, Human
cugaaaacaaccaacuucucgaguuccc

SEQ ID NO: 1011657 - RNA, 22 nt, Human
cugcagcugaagcaagcaauag

SEQ ID NO: 1011658 - RNA, 23 nt, Human
cugcagcugaagcaagcaauagc

SEQ ID NO: 1011659 - RNA, 21 nt, Human
cugcugucuucuaaccugccc

SEQ ID NO: 1011660 - RNA, 20 nt, Human
gacaaaagccuaucgacccc

SEQ ID NO: 1011661 - RNA, 23 nt, Human
gcaauagccuggagaauaaacac

SEQ ID NO: 1011662 - RNA, 18 nt, Human
ggaagaagcaggaggagg

SEQ ID NO: 1011663 - RNA, 21 nt, Human
uacagucuguaacaaauaagc

SEQ ID NO: 1011664 - RNA, 19 nt, Human
uaccgauucccacccacac

SEQ ID NO: 1011665 - RNA, 18 nt, Human
uaggugcauuucuuaccg

SEQ ID NO: 1011666 - RNA, 26 nt, Human
uauuacgacaaaagccuaucgacccc

SEQ ID NO: 1011667 - RNA, 19 nt, Human
ucccacucccccucccacc

SEQ ID NO: 1011668 - RNA, 22 nt, Human
ugcccauacaugaggcacaagg

SEQ ID NO: 1011669 - RNA, 21 nt, Human
ugguggaaagcugggaugcaa

SEQ ID NO: 1011670 - RNA, 22 nt, Human
uguaacaaauaagcagugaaug

SEQ ID NO: 1011671 - RNA, 25 nt, Human
uucccacucccccucccaccuuucc

SEQ ID NO: 1011672 - RNA, 21 nt, Human
uugguugguggaaagcuggga

SEQ ID NO: 1011673 - RNA, 21 nt, Human
aaaaauaacucaaacacaaaa

SEQ ID NO: 1011674 - RNA, 19 nt, Human
aagcggguagggggcgacu

SEQ ID NO: 1011675 - RNA, 24 nt, Human
aaucaaauaauuguacauauucuu

SEQ ID NO: 1011676 - RNA, 21 nt, Human
acuacgagaagcggguagggg

SEQ ID NO: 1011677 - RNA, 21 nt, Human
agaaaucucuacuccagugcc

SEQ ID NO: 1011678 - RNA, 26 nt, Human
aggcaagaugaaauaaacuguuuuuu

SEQ ID NO: 1011679 - RNA, 18 nt, Human
auuacaaaauauuuacag

SEQ ID NO: 1011680 - RNA, 27 nt, Human
caaaacaaauaagcaacuaagaucccc

SEQ ID NO: 1011681 - RNA, 19 nt, Human
caaauaagcaacuaagauc

SEQ ID NO: 1011682 - RNA, 21 nt, Human
caaauaauuguacauauucuu

SEQ ID NO: 1011683 - RNA, 24 nt, Human
cacacaagagucaaaacaaauaag

SEQ ID NO: 1011684 - RNA, 25 nt, Human
cacagcacacaagagucaaaacaaa

SEQ ID NO: 1011685 - RNA, 21 nt, Human
cagcacugcuucaauaacuga

SEQ ID NO: 1011686 - RNA, 20 nt, Human
ccaaagaacuggaggagggg

SEQ ID NO: 1011687 - RNA, 19 nt, Human
ccagugcccacagcacaca

SEQ ID NO: 1011688 - RNA, 21 nt, Human
ccagugcccacagcacacaag

SEQ ID NO: 1011689 - RNA, 21 nt, Human
cgacucccggccucuuucacu

SEQ ID NO: 1011690 - RNA, 24 nt, Human
cuaagaucccccgaucacaaauuu

SEQ ID NO: 1011691 - RNA, 24 nt, Human
cucaaacacaaaaggcaagaugaa

SEQ ID NO: 1011692 - RNA, 19 nt, Human
cugaaaguuuaggucagug

SEQ ID NO: 1011693 - RNA, 24 nt, Human
cugaaauuagaaaauacccugaca

SEQ ID NO: 1011694 - RNA, 26 nt, Human
cugacaauggaagcagcucuuucauc

SEQ ID NO: 1011695 - RNA, 21 nt, Human
gaggggaagaaacagggugaa

SEQ ID NO: 1011696 - RNA, 25 nt, Human
ggguagggggcgacucccggccucu

SEQ ID NO: 1011697 - RNA, 18 nt, Human
gugguaugaaagggaaug

SEQ ID NO: 1011698 - RNA, 23 nt, Human
uaaaaaaagaaaaacacuucugc

SEQ ID NO: 1011699 - RNA, 21 nt, Human
uaacucaaacacaaaaggcaa

SEQ ID NO: 1011700 - RNA, 19 nt, Human
uaagagccucuuucuccau

SEQ ID NO: 1011701 - RNA, 24 nt, Human
uagcagcacugcuucaauaacuga

SEQ ID NO: 1011702 - RNA, 20 nt, Human
uaggauauuccuugaacuga

SEQ ID NO: 1011703 - RNA, 21 nt, Human
uauccugccuuguauuaggaa

SEQ ID NO: 1011704 - RNA, 20 nt, Human
uauucuggaugaaauacccu

SEQ ID NO: 1011705 - RNA, 21 nt, Human
ucccccgaucacaaauuucca

SEQ ID NO: 1011706 - RNA, 21 nt, Human
ucucuacuccagugcccacag

SEQ ID NO: 1011707 - RNA, 22 nt, Human
ugaaagggaauggauguuagca

SEQ ID NO: 1011708 - RNA, 22 nt, Human
ugaaauuagaaaauacccugac

SEQ ID NO: 1011709 - RNA, 24 nt, Human
ugaacaaggcuaaauuuuaggaua

SEQ ID NO: 1011710 - RNA, 21 nt, Human
ugcaguaaauucugaacaagg

SEQ ID NO: 1011711 - RNA, 24 nt, Human
uucguaaaggccuucaacuggguc

SEQ ID NO: 1011712 - RNA, 26 nt, Human
uuguacauauucuucccacauauccu

SEQ ID NO: 1011713 - RNA, 22 nt, Human
uuuucccacaaaucacugaaag

SEQ ID NO: 1011714 - RNA, 20 nt, Human
uuuuuuuuuuuuuuuuuggu

SEQ ID NO: 1011715 - RNA, 24 nt, Human
uuuuuuuuuuuuuuuuugguguag

SEQ ID NO: 1011716 - RNA, 20 nt, Human
uuuuuuuuuuuuuuuuuugg

SEQ ID NO: 1011717 - RNA, 26 nt, Human
aaacacuaaaaacuuuuacugaagcu

SEQ ID NO: 1011718 - RNA, 21 nt, Human
aacuuuuacugaagcuggaga

SEQ ID NO: 1011719 - RNA, 18 nt, Human
aaguaccugagcugcucc

SEQ ID NO: 1011720 - RNA, 22 nt, Human
agacagaaagugagaaauuacu

SEQ ID NO: 1011721 - RNA, 24 nt, Human
agacagaaagugagaaauuacuaa

SEQ ID NO: 1011722 - RNA, 26 nt, Human
aguaaacacuaaaaacuuuuacugaa

SEQ ID NO: 1011723 - RNA, 19 nt, Human
augcauuuucaaugcagga

SEQ ID NO: 1011724 - RNA, 22 nt, Human
auguacaaaaagcucuccugca

SEQ ID NO: 1011725 - RNA, 23 nt, Human
auuucauucaucuuuaucccugg

SEQ ID NO: 1011726 - RNA, 31 nt, Human
caaacaaacacagauaaacuuuggguguugu

SEQ ID NO: 1011727 - RNA, 23 nt, Human
caaacacagauaaacuuugggug

SEQ ID NO: 1011728 - RNA, 24 nt, Human
caaauacauuuagaauaaaucuaa

SEQ ID NO: 1011729 - RNA, 19 nt, Human
cagaaccaaaucaucacug

SEQ ID NO: 1011730 - RNA, 20 nt, Human
cagccgcccgaugcccaccc

SEQ ID NO: 1011731 - RNA, 22 nt, Human
cagccgcccgaugcccacccga

SEQ ID NO: 1011732 - RNA, 23 nt, Human
caucugaaguaccugagcugcuc

SEQ ID NO: 1011733 - RNA, 24 nt, Human
caucuuaaaaagacaaauauuaac

SEQ ID NO: 1011734 - RNA, 25 nt, Human
cauucuguccuaaaagcauguacaa

SEQ ID NO: 1011735 - RNA, 18 nt, Human
ccacccgaaccucccucc

SEQ ID NO: 1011736 - RNA, 18 nt, Human
ccacccgaaccucccucc

SEQ ID NO: 1011737 - RNA, 20 nt, Human
ccagccgcccgaugcccacc

SEQ ID NO: 1011738 - RNA, 19 nt, Human
cgagcucuuccagccgccc

SEQ ID NO: 1011739 - RNA, 24 nt, Human
cgccagccgcucugcaagucgucc

SEQ ID NO: 1011740 - RNA, 23 nt, Human
cguccaggguuccacucagacuc

SEQ ID NO: 1011741 - RNA, 20 nt, Human
cuccauauuaagcacaucug

SEQ ID NO: 1011742 - RNA, 22 nt, Human
cugaagaacagaaauacauuuc

SEQ ID NO: 1011743 - RNA, 23 nt, Human
cuuaaauuaugacuuaauuagca

SEQ ID NO: 1011744 - RNA, 24 nt, Human
gaaaaaaggcauaugcuagaaugu

SEQ ID NO: 1011745 - RNA, 22 nt, Human
gaaguaccugagcugcuccugg

SEQ ID NO: 1011746 - RNA, 18 nt, Human
gacugggggaaaaaaggc

SEQ ID NO: 1011747 - RNA, 19 nt, Human
gcaggauaaauaugcucuu

SEQ ID NO: 1011748 - RNA, 18 nt, Human
uaagguaagccaauaugc

SEQ ID NO: 1011749 - RNA, 19 nt, Human
uaaguaaacacuaaaaacu

SEQ ID NO: 1011750 - RNA, 22 nt, Human
uaaguaaacacuaaaaacuuuu

SEQ ID NO: 1011751 - RNA, 18 nt, Human
uacaucagcuuucucaca

SEQ ID NO: 1011752 - RNA, 19 nt, Human
uaccugagcugcuccuggc

SEQ ID NO: 1011753 - RNA, 22 nt, Human
uaccugagcugcuccuggcugu

SEQ ID NO: 1011754 - RNA, 23 nt, Human
uaugcuagaaugugaacuccuga

SEQ ID NO: 1011755 - RNA, 21 nt, Human
ucaucuuuaucccuggauucc

SEQ ID NO: 1011756 - RNA, 23 nt, Human
ucaucuuuaucccuggauuccua

SEQ ID NO: 1011757 - RNA, 21 nt, Human
uccuaacacaaugccugguuc

SEQ ID NO: 1011758 - RNA, 20 nt, Human
ucucacaucagccucagaac

SEQ ID NO: 1011759 - RNA, 22 nt, Human
ugaagugaacuggggcaaauac

SEQ ID NO: 1011760 - RNA, 24 nt, Human
ugcucuuaugaauaugaauggaau

SEQ ID NO: 1011761 - RNA, 19 nt, Human
uggauuccuaacacaaugc

SEQ ID NO: 1011762 - RNA, 22 nt, Human
uuaagacauuuuaaccagacag

SEQ ID NO: 1011763 - RNA, 19 nt, Human
uuagacacugaacauaaua

SEQ ID NO: 1011764 - RNA, 20 nt, Human
uuagacacugaacauaauac

SEQ ID NO: 1011765 - RNA, 24 nt, Human
uucuuacauguacagucaucuuaa

SEQ ID NO: 1011766 - RNA, 27 nt, Human
uuuuuuuuuuuuuuuuuuucuuugggg

SEQ ID NO: 1011767 - RNA, 18 nt, Human
aaaaccaaaaggcagaaa

SEQ ID NO: 1011768 - RNA, 29 nt, Human
aaccaaaaggcagaaaauagagggacccc

SEQ ID NO: 1011769 - RNA, 18 nt, Human
aauuucuggaucuuccuc

SEQ ID NO: 1011770 - RNA, 19 nt, Human
acacaaaccaagagacugc

SEQ ID NO: 1011771 - RNA, 21 nt, Human
acacugcacgcaggguccucc

SEQ ID NO: 1011772 - RNA, 21 nt, Human
acugcagcugagccuuggcgg

SEQ ID NO: 1011773 - RNA, 22 nt, Human
agacagagcagaaaccucccga

SEQ ID NO: 1011774 - RNA, 21 nt, Human
agcguggugggaggcuggggc

SEQ ID NO: 1011775 - RNA, 25 nt, Human
aggcagaaaauagacuuuauuccaa

SEQ ID NO: 1011776 - RNA, 22 nt, Human
aggcagugagcguggugggagg

SEQ ID NO: 1011777 - RNA, 24 nt, Human
aggcggccaggaagggccaugagc

SEQ ID NO: 1011778 - RNA, 21 nt, Human
caaaccaagagacugccauga

SEQ ID NO: 1011779 - RNA, 18 nt, Human
caaaggcugccauccaag

SEQ ID NO: 1011780 - RNA, 24 nt, Human
cacaaaccaagagacugccaugac

SEQ ID NO: 1011781 - RNA, 21 nt, Human
cacgcauggccuuggccagac

SEQ ID NO: 1011782 - RNA, 22 nt, Human
cacugcacgcaggguccuccgc

SEQ ID NO: 1011783 - RNA, 20 nt, Human
cacugcagcugagccuuggc

SEQ ID NO: 1011784 - RNA, 21 nt, Human
cacuguguucaagcuaagcuu

SEQ ID NO: 1011785 - RNA, 22 nt, Human
cagccugacucccucgccuaag

SEQ ID NO: 1011786 - RNA, 22 nt, Human
caggccacggugcuucuagugu

SEQ ID NO: 1011787 - RNA, 21 nt, Human
caugacagacagagcagaaac

SEQ ID NO: 1011788 - RNA, 23 nt, Human
caugacagacagagcagaaaccu

SEQ ID NO: 1011789 - RNA, 18 nt, Human
ccccagcgagcuugcggu

SEQ ID NO: 1011790 - RNA, 18 nt, Human
cccccagcgagcuugcgg

SEQ ID NO: 1011791 - RNA, 19 nt, Human
ccccccagcgagcuugcgg

SEQ ID NO: 1011792 - RNA, 22 nt, Human
ccgccaccaccauccaagaacc

SEQ ID NO: 1011793 - RNA, 27 nt, Human
ccgccaccaccauccaagaaccccggg

SEQ ID NO: 1011794 - RNA, 25 nt, Human
ccuaagcuggggcucgguccgaggc

SEQ ID NO: 1011795 - RNA, 23 nt, Human
ccuccgccaccaccauccaagaa

SEQ ID NO: 1011796 - RNA, 18 nt, Human
ccugcagcuggagaggga

SEQ ID NO: 1011797 - RNA, 21 nt, Human
cgccaccaccauccaagaacc

SEQ ID NO: 1011798 - RNA, 23 nt, Human
cgcgcuggccucugccaaggagu

SEQ ID NO: 1011799 - RNA, 24 nt, Human
gaaucccaggccacggugcuucua

SEQ ID NO: 1011800 - RNA, 19 nt, Human
gaggcuggggcuggugccu

SEQ ID NO: 1011801 - RNA, 21 nt, Human
gcacugcagcugagccuuggc

SEQ ID NO: 1011802 - RNA, 22 nt, Human
gcaggguccuccgccaccacca

SEQ ID NO: 1011803 - RNA, 18 nt, Human
gccagugguucccgggac

SEQ ID NO: 1011804 - RNA, 18 nt, Human
gccugcggacagcuccag

SEQ ID NO: 1011805 - RNA, 21 nt, Human
ggaacuuggccucgauucucu

SEQ ID NO: 1011806 - RNA, 25 nt, Human
ggacagagcgucacacugcacgcag

SEQ ID NO: 1011807 - RNA, 20 nt, Human
ggccucaccugcagcuggag

SEQ ID NO: 1011808 - RNA, 26 nt, Human
guccuccgccaccaccauccaagaac

SEQ ID NO: 1011809 - RNA, 21 nt, Human
uaaaucaaacauuguucacaa

SEQ ID NO: 1011810 - RNA, 26 nt, Human
uccuccgccaccaccauccaagaacc

SEQ ID NO: 1011811 - RNA, 23 nt, Human
ucgccuaagcuggggcucggucc

SEQ ID NO: 1011812 - RNA, 19 nt, Human
ugacagacagagcagaaac

SEQ ID NO: 1011813 - RNA, 24 nt, Human
ugacagacagagcagaaaccuccc

SEQ ID NO: 1011814 - RNA, 19 nt, Human
ugagcguggugggaggcug

SEQ ID NO: 1011815 - RNA, 23 nt, Human
ugcccugauccuccugguaggua

SEQ ID NO: 1011816 - RNA, 21 nt, Human
uggcacugcagcugagccuug

SEQ ID NO: 1011817 - RNA, 22 nt, Human
uggcaggcggccaggaagggag

SEQ ID NO: 1011818 - RNA, 18 nt, Human
uggccugaaugaaaaccg

SEQ ID NO: 1011819 - RNA, 24 nt, Human
uguucaagcuaagcuuuccuaagg

SEQ ID NO: 1011820 - RNA, 21 nt, Human
uuccgcaggccucaccugcag

SEQ ID NO: 1011821 - RNA, 24 nt, Human
uuccugaggggcuucuuaacuuuu

SEQ ID NO: 1011822 - RNA, 24 nt, Human
aaaaaauacucuucagagaggaaa

SEQ ID NO: 1011823 - RNA, 21 nt, Human
aacccacacccuucucauccc

SEQ ID NO: 1011824 - RNA, 28 nt, Human
aacgcacagccagacacacacacacaca

SEQ ID NO: 1011825 - RNA, 21 nt, Human
aagacgucaccaaaugagaca

SEQ ID NO: 1011826 - RNA, 22 nt, Human
aagcagcaagcccaaggccaca

SEQ ID NO: 1011827 - RNA, 24 nt, Human
aagcagcaagcccaaggccacaca

SEQ ID NO: 1011828 - RNA, 26 nt, Human
aagcagcaagcccaaggccacacagc

SEQ ID NO: 1011829 - RNA, 24 nt, Human
acacacacacacacacccugccac

SEQ ID NO: 1011830 - RNA, 30 nt, Human
acagccagacacacacacacacacccugcc

SEQ ID NO: 1011831 - RNA, 19 nt, Human
acagcucccagcuguaccc

SEQ ID NO: 1011832 - RNA, 21 nt, Human
acaggaggggacccugccagu

SEQ ID NO: 1011833 - RNA, 23 nt, Human
accaaaugagacacugcgaaucc

SEQ ID NO: 1011834 - RNA, 24 nt, Human
accccacagggcagggcugagacc

SEQ ID NO: 1011835 - RNA, 21 nt, Human
acucuucagagaggaaacgac

SEQ ID NO: 1011836 - RNA, 23 nt, Human
acugcgaaucccacacagggcaa

SEQ ID NO: 1011837 - RNA, 19 nt, Human
agagggcaaucgaaaaaaa

SEQ ID NO: 1011838 - RNA, 18 nt, Human
agccagcagagcgugggg

SEQ ID NO: 1011839 - RNA, 23 nt, Human
aggcaggagagcuggcccaagca

SEQ ID NO: 1011840 - RNA, 22 nt, Human
aggggcaguagcugccuugggg

SEQ ID NO: 1011841 - RNA, 22 nt, Human
aggggccagaaaaguccagagc

SEQ ID NO: 1011842 - RNA, 22 nt, Human
aggguggggggcuuuuccaggg

SEQ ID NO: 1011843 - RNA, 20 nt, Human
agguucuggauggaggaccg

SEQ ID NO: 1011844 - RNA, 22 nt, Human
auccuuccggccagugacaugg

SEQ ID NO: 1011845 - RNA, 23 nt, Human
augaagcagcaagcccaaggcca

SEQ ID NO: 1011846 - RNA, 21 nt, Human
caaaagcaucuucaagggucc

SEQ ID NO: 1011847 - RNA, 19 nt, Human
caagagaugagacacagga

SEQ ID NO: 1011848 - RNA, 19 nt, Human
caagcccaaggccacacag

SEQ ID NO: 1011849 - RNA, 21 nt, Human
caagcccaaggccacacagcu

SEQ ID NO: 1011850 - RNA, 19 nt, Human
caaggguccuggcagccuu

SEQ ID NO: 1011851 - RNA, 24 nt, Human
cacacacacccugccacgcacagc

SEQ ID NO: 1011852 - RNA, 19 nt, Human
cacacccuucucaucccuc

SEQ ID NO: 1011853 - RNA, 20 nt, Human
cacacgcguucauauauuaa

SEQ ID NO: 1011854 - RNA, 21 nt, Human
cacagggcagggcugagacac

SEQ ID NO: 1011855 - RNA, 24 nt, Human
caccacagcucccagcuguacccg

SEQ ID NO: 1011856 - RNA, 18 nt, Human
caccccacagggcagggc

SEQ ID NO: 1011857 - RNA, 27 nt, Human
cacgcacagcacgcaggcacacacaca

SEQ ID NO: 1011858 - RNA, 26 nt, Human
cagagcugcagugcccaaagcuaccc

SEQ ID NO: 1011859 - RNA, 18 nt, Human
cagccuuugcuucagccc

SEQ ID NO: 1011860 - RNA, 21 nt, Human
caggaggggccagaaaagucc

SEQ ID NO: 1011861 - RNA, 22 nt, Human
caggaggggccagaaaagucca

SEQ ID NO: 1011862 - RNA, 23 nt, Human
cauccggggucccugugcugccc

SEQ ID NO: 1011863 - RNA, 22 nt, Human
ccaaaugagacacugcgaaucc

SEQ ID NO: 1011864 - RNA, 20 nt, Human
ccacaaggugggagaugggg

SEQ ID NO: 1011865 - RNA, 20 nt, Human
cccacacagggcaagggggc

SEQ ID NO: 1011866 - RNA, 19 nt, Human
ccccgcugccucccaccgg

SEQ ID NO: 1011867 - RNA, 19 nt, Human
cccuggagaagcccugggg

SEQ ID NO: 1011868 - RNA, 19 nt, Human
cccugguccuugacccagc

SEQ ID NO: 1011869 - RNA, 19 nt, Human
ccgcugccucccaccgugu

SEQ ID NO: 1011870 - RNA, 21 nt, Human
ccggccccuugcugucucucc

SEQ ID NO: 1011871 - RNA, 21 nt, Human
ccgugggccgaguucucguac

SEQ ID NO: 1011872 - RNA, 20 nt, Human
ccucugccagccagcagagc

SEQ ID NO: 1011873 - RNA, 21 nt, Human
ccugguccucacugccuccuu

SEQ ID NO: 1011874 - RNA, 20 nt, Human
cgaaaaaaauacucuucaga

SEQ ID NO: 1011875 - RNA, 25 nt, Human
cgcacagcacgcaggcacacacaca

SEQ ID NO: 1011876 - RNA, 19 nt, Human
cgcacagccagacacacac

SEQ ID NO: 1011877 - RNA, 22 nt, Human
cgcacagccagacacacacaca

SEQ ID NO: 1011878 - RNA, 28 nt, Human
cgcaggcacacacacacuugugcaugca

SEQ ID NO: 1011879 - RNA, 20 nt, Human
cgggggcaccccacagggca

SEQ ID NO: 1011880 - RNA, 21 nt, Human
cugggcagggcuuggccaggg

SEQ ID NO: 1011881 - RNA, 25 nt, Human
cuugugcaugcacacgcguucauau

SEQ ID NO: 1011882 - RNA, 24 nt, Human
cuuugcuucagcccuuagguucug

SEQ ID NO: 1011883 - RNA, 19 nt, Human
gaagcagcaagcccaaggc

SEQ ID NO: 1011884 - RNA, 26 nt, Human
gacacacacacacacacccugccacg

SEQ ID NO: 1011885 - RNA, 18 nt, Human
gacauggcugaagccccc

SEQ ID NO: 1011886 - RNA, 20 nt, Human
gauggcuggaguucagcagc

SEQ ID NO: 1011887 - RNA, 24 nt, Human
gcacgcaggcacacacacacuugu

SEQ ID NO: 1011888 - RNA, 18 nt, Human
gcagcuacaggguucagc

SEQ ID NO: 1011889 - RNA, 22 nt, Human
gccauguccugggggccaggcu

SEQ ID NO: 1011890 - RNA, 23 nt, Human
gccggccccuugcugucucuccc

SEQ ID NO: 1011891 - RNA, 21 nt, Human
gcucccugguccuugacccag

SEQ ID NO: 1011892 - RNA, 22 nt, Human
ggcagggcugagacacauccuu

SEQ ID NO: 1011893 - RNA, 21 nt, Human
ggccacacagcuaggucagca

SEQ ID NO: 1011894 - RNA, 21 nt, Human
gggauuaggagagaaagcauc

SEQ ID NO: 1011895 - RNA, 24 nt, Human
gggcagcugaaugccugagggggg

SEQ ID NO: 1011896 - RNA, 24 nt, Human
ggggucccugugcugcccuggaga

SEQ ID NO: 1011897 - RNA, 18 nt, Human
guccugggggccaggcuc

SEQ ID NO: 1011898 - RNA, 20 nt, Human
guccuugacccagcuccauc

SEQ ID NO: 1011899 - RNA, 23 nt, Human
gugcugcccuggagaagcccugg

SEQ ID NO: 1011900 - RNA, 18 nt, Human
uauaugugcacccuaacc

SEQ ID NO: 1011901 - RNA, 23 nt, Human
ucacugccuccuuuuagggcggg

SEQ ID NO: 1011902 - RNA, 23 nt, Human
ucagaggcuguggaagacagcug

SEQ ID NO: 1011903 - RNA, 23 nt, Human
uccagagcugcagugcccaaagc

SEQ ID NO: 1011904 - RNA, 19 nt, Human
uccauccugcggggcccuu

SEQ ID NO: 1011905 - RNA, 22 nt, Human
ucccaccguguugauggcugga

SEQ ID NO: 1011906 - RNA, 19 nt, Human
ucccagaggaagggugggg

SEQ ID NO: 1011907 - RNA, 22 nt, Human
ucccugguccuugacccagcuc

SEQ ID NO: 1011908 - RNA, 26 nt, Human
ucccugguccuugacccagcuccauc

SEQ ID NO: 1011909 - RNA, 19 nt, Human
uccuacugcaggcuuagcc

SEQ ID NO: 1011910 - RNA, 20 nt, Human
uccugggggccaggcuccag

SEQ ID NO: 1011911 - RNA, 22 nt, Human
ugaagcagcaagcccaaggcca

SEQ ID NO: 1011912 - RNA, 21 nt, Human
ugacccagcuccauccugcgg

SEQ ID NO: 1011913 - RNA, 22 nt, Human
ugacccagcuccauccugcggg

SEQ ID NO: 1011914 - RNA, 21 nt, Human
ugagacacaggaggggacccu

SEQ ID NO: 1011915 - RNA, 23 nt, Human
ugauaagagccuagugcccaggg

SEQ ID NO: 1011916 - RNA, 22 nt, Human
ugcaugcacacgcguucauaua

SEQ ID NO: 1011917 - RNA, 26 nt, Human
ugccagccagcagagcgugggguggu

SEQ ID NO: 1011918 - RNA, 19 nt, Human
uggcugagauccuacugca

SEQ ID NO: 1011919 - RNA, 18 nt, Human
uggcuggaguucagcagc

SEQ ID NO: 1011920 - RNA, 21 nt, Human
uggcuuccucuagacacaggc

SEQ ID NO: 1011921 - RNA, 19 nt, Human
ugggaaggguuaggggcag

SEQ ID NO: 1011922 - RNA, 21 nt, Human
ugggaaggguuaggggcagua

SEQ ID NO: 1011923 - RNA, 21 nt, Human
ugggagauguggaggagaacu

SEQ ID NO: 1011924 - RNA, 19 nt, Human
uggggacugggagauggga

SEQ ID NO: 1011925 - RNA, 19 nt, Human
uggggccaaacccacaccc

SEQ ID NO: 1011926 - RNA, 23 nt, Human
uggggggagcagccauguccugg

SEQ ID NO: 1011927 - RNA, 23 nt, Human
uggggggcccaucgagcaccugc

SEQ ID NO: 1011928 - RNA, 24 nt, Human
uggggggcccaucgagcaccugcc

SEQ ID NO: 1011929 - RNA, 22 nt, Human
uggugggaaggguuaggggcag

SEQ ID NO: 1011930 - RNA, 19 nt, Human
ugucaguuucccagaggaa

SEQ ID NO: 1011931 - RNA, 23 nt, Human
uguccugggggccaggcuccagu

SEQ ID NO: 1011932 - RNA, 21 nt, Human
uugugcaugcacacgcguuca

SEQ ID NO: 1011933 - RNA, 21 nt, Human
aagcaagaagacagacucugg

SEQ ID NO: 1011934 - RNA, 18 nt, Human
aagguuacagaggcccac

SEQ ID NO: 1011935 - RNA, 22 nt, Human
accacaucuggaagcaagaaga

SEQ ID NO: 1011936 - RNA, 20 nt, Human
acccuagagacuccaggaac

SEQ ID NO: 1011937 - RNA, 23 nt, Human
acccuagagacuccaggaacccc

SEQ ID NO: 1011938 - RNA, 18 nt, Human
acuccugggcuuucggga

SEQ ID NO: 1011939 - RNA, 25 nt, Human
agcaagaagacagacucuggaagaa

SEQ ID NO: 1011940 - RNA, 20 nt, Human
agcacccuagagacuccagg

SEQ ID NO: 1011941 - RNA, 25 nt, Human
aggcaggaaaaaaggccguuucugg

SEQ ID NO: 1011942 - RNA, 20 nt, Human
aucggcuaagcugggcgggu

SEQ ID NO: 1011943 - RNA, 20 nt, Human
caagaagacagacucuggaa

SEQ ID NO: 1011944 - RNA, 21 nt, Human
caagaagacagacucuggaag

SEQ ID NO: 1011945 - RNA, 25 nt, Human
cacuccccuucccuucucucuccga

SEQ ID NO: 1011946 - RNA, 18 nt, Human
caggaggagauaaaucuu

SEQ ID NO: 1011947 - RNA, 18 nt, Human
ccccuucccuucucucuc

SEQ ID NO: 1011948 - RNA, 19 nt, Human
ccccuucccuucucucucc

SEQ ID NO: 1011949 - RNA, 20 nt, Human
cccuagagacuccaggaacc

SEQ ID NO: 1011950 - RNA, 18 nt, Human
cggcuaagcugggcgggu

SEQ ID NO: 1011951 - RNA, 18 nt, Human
cggcuaagcugggcgggu

SEQ ID NO: 1011952 - RNA, 22 nt, Human
cuccaggaacccccuucacucc

SEQ ID NO: 1011953 - RNA, 21 nt, Human
cuccugggcuuucgggacucu

SEQ ID NO: 1011954 - RNA, 22 nt, Human
cuucacuccugggcuuucggga

SEQ ID NO: 1011955 - RNA, 19 nt, Human
gaaguugaccacaucugga

SEQ ID NO: 1011956 - RNA, 20 nt, Human
gcggggcaggaggagauaaa

SEQ ID NO: 1011957 - RNA, 24 nt, Human
gcuggggacacuccccuucccuuc

SEQ ID NO: 1011958 - RNA, 19 nt, Human
gggcagggggaguacaguu

SEQ ID NO: 1011959 - RNA, 23 nt, Human
gggucggggagggcagggggagu

SEQ ID NO: 1011960 - RNA, 20 nt, Human
gugcaggucaucggcuaagc

SEQ ID NO: 1011961 - RNA, 18 nt, Human
guuacagaggcccaccau

SEQ ID NO: 1011962 - RNA, 22 nt, Human
guuucugggggguuggcugggg

SEQ ID NO: 1011963 - RNA, 19 nt, Human
uccugggcuuucgggacuc

SEQ ID NO: 1011964 - RNA, 22 nt, Human
ucuacagcguggggccucuuuc

SEQ ID NO: 1011965 - RNA, 23 nt, Human
ugcaggucaucggcuaagcuggg

SEQ ID NO: 1011966 - RNA, 22 nt, Human
ugggggguuggcuggggacacu

SEQ ID NO: 1011967 - RNA, 22 nt, Human
uucugggggguuggcuggggac

SEQ ID NO: 1011968 - RNA, 23 nt, Human
uucugggggguuggcuggggaca

SEQ ID NO: 1011969 - RNA, 20 nt, Human
uuuuuuuuucguacaacccc

SEQ ID NO: 1011970 - RNA, 19 nt, Human
uuuuuuuuuuucguacaac

SEQ ID NO: 1011971 - RNA, 18 nt, Human
uuuuuuuuuuuuuuuucg

SEQ ID NO: 1011972 - RNA, 20 nt, Human
uuuuuuuuuuuuuuuuucgu

SEQ ID NO: 1011973 - RNA, 18 nt, Human
aaacggagcaggucuuga

SEQ ID NO: 1011974 - RNA, 18 nt, Human
aagcaggagaaucgcuug

SEQ ID NO: 1011975 - RNA, 24 nt, Human
aagcaggagaaucgcuugaaccca

SEQ ID NO: 1011976 - RNA, 24 nt, Human
aaggagucagcccggagccucugc

SEQ ID NO: 1011977 - RNA, 24 nt, Human
aaucgcuugaacccaggaggcaga

SEQ ID NO: 1011978 - RNA, 25 nt, Human
acacagcccgaggaaggggggaacc

SEQ ID NO: 1011979 - RNA, 21 nt, Human
acagcccgaggaagggaccca

SEQ ID NO: 1011980 - RNA, 24 nt, Human
acccaggaggcagagguugcggug

SEQ ID NO: 1011981 - RNA, 23 nt, Human
accccgaagaaccuugagccgag

SEQ ID NO: 1011982 - RNA, 20 nt, Human
acccuuggccaggugcggcu

SEQ ID NO: 1011983 - RNA, 23 nt, Human
accucgccuggugccgucccaac

SEQ ID NO: 1011984 - RNA, 24 nt, Human
agagccuuccauuggcccccaccc

SEQ ID NO: 1011985 - RNA, 24 nt, Human
agagguugcggugagccgagaucg

SEQ ID NO: 1011986 - RNA, 21 nt, Human
agcccggagccucugcuaugu

SEQ ID NO: 1011987 - RNA, 27 nt, Human
aggagaaaccuugucucuccucggaag

SEQ ID NO: 1011988 - RNA, 21 nt, Human
aggcagagguugcggugagcc

SEQ ID NO: 1011989 - RNA, 24 nt, Human
aggcagagguugcggugagccgag

SEQ ID NO: 1011990 - RNA, 24 nt, Human
aggcugaagcaggagaaucgcuug

SEQ ID NO: 1011991 - RNA, 22 nt, Human
caacaacucauacacuagcacc

SEQ ID NO: 1011992 - RNA, 20 nt, Human
caagaacacagcccaaggaa

SEQ ID NO: 1011993 - RNA, 20 nt, Human
caagaacacagcccgaggaa

SEQ ID NO: 1011994 - RNA, 19 nt, Human
cacacgcacaaaucgaggc

SEQ ID NO: 1011995 - RNA, 22 nt, Human
caccagcaagaacacagcccaa

SEQ ID NO: 1011996 - RNA, 22 nt, Human
cacuuuugcucaccagcaagaa

SEQ ID NO: 1011997 - RNA, 21 nt, Human
caggagaaaaugcuuccccuu

SEQ ID NO: 1011998 - RNA, 28 nt, Human
cauccugcgccucccaagcacgccccca

SEQ ID NO: 1011999 - RNA, 22 nt, Human
caucuuccuuucccaccaggaa

SEQ ID NO: 1012000 - RNA, 18 nt, Human
ccaaggaagggacccaau

SEQ ID NO: 1012001 - RNA, 26 nt, Human
ccacccccucgaaagcccuuucccaa

SEQ ID NO: 1012002 - RNA, 23 nt, Human
ccagcucacaccccgaagaaccu

SEQ ID NO: 1012003 - RNA, 19 nt, Human
ccagggcacuccauccagc

SEQ ID NO: 1012004 - RNA, 19 nt, Human
ccauccugcgccucccaag

SEQ ID NO: 1012005 - RNA, 22 nt, Human
cccaaggaagggacccaauaac

SEQ ID NO: 1012006 - RNA, 24 nt, Human
cccacagauguggaggggcaggcc

SEQ ID NO: 1012007 - RNA, 26 nt, Human
cccccacccccucgaaagcccuuucc

SEQ ID NO: 1012008 - RNA, 19 nt, Human
cccccucgaaagcccuuuc

SEQ ID NO: 1012009 - RNA, 25 nt, Human
cccccucgaaagcccuuucccaaca

SEQ ID NO: 1012010 - RNA, 19 nt, Human
ccuugagccgagccaacuc

SEQ ID NO: 1012011 - RNA, 24 nt, Human
cgaaagcccuuucccaacaacuca

SEQ ID NO: 1012012 - RNA, 21 nt, Human
cgccagggcacuccauccagc

SEQ ID NO: 1012013 - RNA, 19 nt, Human
cugcaggcaacacuuuugc

SEQ ID NO: 1012014 - RNA, 21 nt, Human
cugcggugagggcccaggguc

SEQ ID NO: 1012015 - RNA, 19 nt, Human
cuggcggcucuccacgccg

SEQ ID NO: 1012016 - RNA, 21 nt, Human
cuuccaacagguccucaugcc

SEQ ID NO: 1012017 - RNA, 21 nt, Human
cuuucccaacaacucauacac

SEQ ID NO: 1012018 - RNA, 23 nt, Human
gagaaucgcuugaacccaggagg

SEQ ID NO: 1012019 - RNA, 21 nt, Human
gaggcagagguugcggugagc

SEQ ID NO: 1012020 - RNA, 21 nt, Human
gccaccccuucauaaucccag

SEQ ID NO: 1012021 - RNA, 21 nt, Human
gcccccacccccucgaaagcc

SEQ ID NO: 1012022 - RNA, 22 nt, Human
gcccggagccucugcuaugugc

SEQ ID NO: 1012023 - RNA, 22 nt, Human
gcugcagcuucuucgcacugag

SEQ ID NO: 1012024 - RNA, 21 nt, Human
gcugggugugcguucuggugc

SEQ ID NO: 1012025 - RNA, 19 nt, Human
guugcggugagccgagauc

SEQ ID NO: 1012026 - RNA, 20 nt, Human
uagagcccuggcggcucucc

SEQ ID NO: 1012027 - RNA, 19 nt, Human
uagcacccuuggccaggug

SEQ ID NO: 1012028 - RNA, 28 nt, Human
uaggagaaaccuugucucuccucggaag

SEQ ID NO: 1012029 - RNA, 18 nt, Human
uaucccacagauguggag

SEQ ID NO: 1012030 - RNA, 23 nt, Human
ucaaaacccaaacugcuuccugc

SEQ ID NO: 1012031 - RNA, 19 nt, Human
ucccacuuccaacaggucc

SEQ ID NO: 1012032 - RNA, 24 nt, Human
ucuuucucuuuggggcugggcugg

SEQ ID NO: 1012033 - RNA, 20 nt, Human
ugaagcaggagaaucgcuug

SEQ ID NO: 1012034 - RNA, 24 nt, Human
ugaagcaggagaaucgcuugaacc

SEQ ID NO: 1012035 - RNA, 22 nt, Human
ugagccgagaucgcgccagggc

SEQ ID NO: 1012036 - RNA, 22 nt, Human
ugagccgagccaacucaacacc

SEQ ID NO: 1012037 - RNA, 23 nt, Human
uggaaguugcuggaguacaccag

SEQ ID NO: 1012038 - RNA, 20 nt, Human
ugggaggcuggaccaggccu

SEQ ID NO: 1012039 - RNA, 21 nt, Human
uucgcacugaggaggccggcg

SEQ ID NO: 1012040 - RNA, 18 nt, Human
uugcggugagccgagauc

SEQ ID NO: 1012041 - RNA, 19 nt, Human
uugcggugagccgagaucg

SEQ ID NO: 1012042 - RNA, 22 nt, Human
uugcggugagccgagaucgcgc

SEQ ID NO: 1012043 - RNA, 19 nt, Human
aaagugcuggaauuacagg

SEQ ID NO: 1012044 - RNA, 24 nt, Human
aaagugcuggaauuacaggcauga

SEQ ID NO: 1012045 - RNA, 21 nt, Human
aaccucgugcccacacagugc

SEQ ID NO: 1012046 - RNA, 26 nt, Human
aagugcuggaauuacaggcaugagcc

SEQ ID NO: 1012047 - RNA, 21 nt, Human
aauuacaggcaugagccacca

SEQ ID NO: 1012048 - RNA, 18 nt, Human
acaggguuucaccauguu

SEQ ID NO: 1012049 - RNA, 23 nt, Human
acaggguuucaccauguuggcca

SEQ ID NO: 1012050 - RNA, 24 nt, Human
acaggguuucaccauguuggccag

SEQ ID NO: 1012051 - RNA, 18 nt, Human
accauguuggccaggcug

SEQ ID NO: 1012052 - RNA, 18 nt, Human
acgacgcagggcaccagg

SEQ ID NO: 1012053 - RNA, 21 nt, Human
acgccaggcuaauuuuuguau

SEQ ID NO: 1012054 - RNA, 22 nt, Human
acuccuggccucaagucaucuu

SEQ ID NO: 1012055 - RNA, 18 nt, Human
agccuccagaguagcugg

SEQ ID NO: 1012056 - RNA, 27 nt, Human
agccugggguuuugugccuccuuuuug

SEQ ID NO: 1012057 - RNA, 18 nt, Human
aggaaagcggaagcggcc

SEQ ID NO: 1012058 - RNA, 23 nt, Human
aggguucaagugauucuccugcc

SEQ ID NO: 1012059 - RNA, 19 nt, Human
agguugcaaagugggagac

SEQ ID NO: 1012060 - RNA, 18 nt, Human
aguagcugggauuacagg

SEQ ID NO: 1012061 - RNA, 24 nt, Human
agugauucuccugccucagccucc

SEQ ID NO: 1012062 - RNA, 19 nt, Human
aguguaguggugugaucuc

SEQ ID NO: 1012063 - RNA, 20 nt, Human
aguguaguggugugaucucg

SEQ ID NO: 1012064 - RNA, 24 nt, Human
aguguaguggugugaucucggcuc

SEQ ID NO: 1012065 - RNA, 21 nt, Human
auguggagcaggcugcagaga

SEQ ID NO: 1012066 - RNA, 24 nt, Human
auuuuuguauuuuuaguagagaca

SEQ ID NO: 1012067 - RNA, 24 nt, Human
caaagugcuggaauuacaggcaug

SEQ ID NO: 1012068 - RNA, 24 nt, Human
caacuccuggccucaagucauccu

SEQ ID NO: 1012069 - RNA, 22 nt, Human
caagugauucuccugccucagc

SEQ ID NO: 1012070 - RNA, 27 nt, Human
caagugauucuccugccucagccucca

SEQ ID NO: 1012071 - RNA, 24 nt, Human
caccacgccaggcuaauuuuugua

SEQ ID NO: 1012072 - RNA, 21 nt, Human
caccaggcccagcuggggcag

SEQ ID NO: 1012073 - RNA, 21 nt, Human
caccauguuggccaggcuggu

SEQ ID NO: 1012074 - RNA, 24 nt, Human
caccauguuggccaggcuggucuc

SEQ ID NO: 1012075 - RNA, 27 nt, Human
caccauguuggccaggcuggucuccaa

SEQ ID NO: 1012076 - RNA, 22 nt, Human
cagagacuugaagccugggguu

SEQ ID NO: 1012077 - RNA, 24 nt, Human
cagaguagcugggauuacaggugu

SEQ ID NO: 1012078 - RNA, 24 nt, Human
caggguuucaccauguuggccagg

SEQ ID NO: 1012079 - RNA, 24 nt, Human
cauguuggccaggcuggucuccaa

SEQ ID NO: 1012080 - RNA, 19 nt, Human
ccaaagugcuggaauuaca

SEQ ID NO: 1012081 - RNA, 24 nt, Human
ccaaagugcuggaauuacaggcau

SEQ ID NO: 1012082 - RNA, 23 nt, Human
ccaccacgcccggccaucuucuu

SEQ ID NO: 1012083 - RNA, 19 nt, Human
ccaccagcucuggcugugg

SEQ ID NO: 1012084 - RNA, 22 nt, Human
ccacugggcugauaucuacagc

SEQ ID NO: 1012085 - RNA, 19 nt, Human
ccagaguagcugggauuac

SEQ ID NO: 1012086 - RNA, 22 nt, Human
ccagaguagcugggauuacagg

SEQ ID NO: 1012087 - RNA, 22 nt, Human
ccagaguagcugggauuacagg

SEQ ID NO: 1012088 - RNA, 24 nt, Human
ccagaguagcugggauuacaggug

SEQ ID NO: 1012089 - RNA, 25 nt, Human
ccagaguagcugggauuacaggugu

SEQ ID NO: 1012090 - RNA, 20 nt, Human
ccaggcuggucuccaacucc

SEQ ID NO: 1012091 - RNA, 20 nt, Human
ccaggguucaagugauucuc

SEQ ID NO: 1012092 - RNA, 23 nt, Human
ccaggguucaagugauucuccug

SEQ ID NO: 1012093 - RNA, 21 nt, Human
ccccucggccgccgcugcugc

SEQ ID NO: 1012094 - RNA, 20 nt, Human
ccccuguaaaaccucgugcc

SEQ ID NO: 1012095 - RNA, 21 nt, Human
ccccuguaaaaccucgugccc

SEQ ID NO: 1012096 - RNA, 20 nt, Human
ccgaagagcccgugcaaaaa

SEQ ID NO: 1012097 - RNA, 24 nt, Human
ccgccuuagccucccaaagugcug

SEQ ID NO: 1012098 - RNA, 19 nt, Human
ccuaggcuggaguguagug

SEQ ID NO: 1012099 - RNA, 24 nt, Human
ccuccaggguucaagugauucucc

SEQ ID NO: 1012100 - RNA, 24 nt, Human
ccugccucagccuccagaguagcu

SEQ ID NO: 1012101 - RNA, 19 nt, Human
ccuguaaaaccucgugccc

SEQ ID NO: 1012102 - RNA, 24 nt, Human
cgaagcuagggccgugggggccga

SEQ ID NO: 1012103 - RNA, 23 nt, Human
cgacgacgcagggcaccaggccc

SEQ ID NO: 1012104 - RNA, 21 nt, Human
cgcccccucggccgccgcugc

SEQ ID NO: 1012105 - RNA, 24 nt, Human
cgccuuagccucccaaagugcugg

SEQ ID NO: 1012106 - RNA, 21 nt, Human
cgcgggagccuccaggcucgg

SEQ ID NO: 1012107 - RNA, 23 nt, Human
cucagccuccagaguagcuggga

SEQ ID NO: 1012108 - RNA, 24 nt, Human
cucauugcaaccucugccuccagg

SEQ ID NO: 1012109 - RNA, 19 nt, Human
cuccaggguucaagugauu

SEQ ID NO: 1012110 - RNA, 22 nt, Human
cucggcucggcgcccccucggc

SEQ ID NO: 1012111 - RNA, 21 nt, Human
cugaacuuggucauccaacga

SEQ ID NO: 1012112 - RNA, 21 nt, Human
cugcagagacuugaagccugg

SEQ ID NO: 1012113 - RNA, 21 nt, Human
cugcagggcccucaggguaua

SEQ ID NO: 1012114 - RNA, 24 nt, Human
cugcugcugcugggugcgacaggc

SEQ ID NO: 1012115 - RNA, 18 nt, Human
cugggcugugggggcugu

SEQ ID NO: 1012116 - RNA, 18 nt, Human
cuggucuccaacuccugg

SEQ ID NO: 1012117 - RNA, 18 nt, Human
cugugcuuuccacugggc

SEQ ID NO: 1012118 - RNA, 19 nt, Human
cugugggggcugucaccgu

SEQ ID NO: 1012119 - RNA, 19 nt, Human
cuucugugcccaaaugugg

SEQ ID NO: 1012120 - RNA, 24 nt, Human
cuugcucuguugccuaggcuggag

SEQ ID NO: 1012121 - RNA, 19 nt, Human
gaauuacaggcaugagcca

SEQ ID NO: 1012122 - RNA, 18 nt, Human
gagcaggcugcagagacu

SEQ ID NO: 1012123 - RNA, 24 nt, Human
gaguagcugggauuacaggugugc

SEQ ID NO: 1012124 - RNA, 24 nt, Human
gccuaggcuggaguguaguggugu

SEQ ID NO: 1012125 - RNA, 19 nt, Human
gccugaggucugaccaccc

SEQ ID NO: 1012126 - RNA, 23 nt, Human
gccugucugcugggccaagaucu

SEQ ID NO: 1012127 - RNA, 23 nt, Human
gcuggucuccaacuccuggccuc

SEQ ID NO: 1012128 - RNA, 19 nt, Human
ggaaagcggaagcggccuc

SEQ ID NO: 1012129 - RNA, 22 nt, Human
ggcuggaguguaguggugugau

SEQ ID NO: 1012130 - RNA, 24 nt, Human
ggcuggucuccaacuccuggccuc

SEQ ID NO: 1012131 - RNA, 24 nt, Human
gggcggcucacccucuguagugcc

SEQ ID NO: 1012132 - RNA, 22 nt, Human
gggcugugggggcugucaccgu

SEQ ID NO: 1012133 - RNA, 23 nt, Human
ggguucaagugauucuccugccu

SEQ ID NO: 1012134 - RNA, 22 nt, Human
ggguuucaccauguuggccagg

SEQ ID NO: 1012135 - RNA, 25 nt, Human
gguccagcggagcaugcuugcaagc

SEQ ID NO: 1012136 - RNA, 18 nt, Human
guagcugggauuacaggu

SEQ ID NO: 1012137 - RNA, 24 nt, Human
gucauccucccgccuuagccuccc

SEQ ID NO: 1012138 - RNA, 27 nt, Human
gucccagguugccugcagggcccucag

SEQ ID NO: 1012139 - RNA, 19 nt, Human
gucuuaggcagacauaggg

SEQ ID NO: 1012140 - RNA, 21 nt, Human
gugauucuccugccucagccu

SEQ ID NO: 1012141 - RNA, 26 nt, Human
guggagcaggcugcagagacuugaag

SEQ ID NO: 1012142 - RNA, 24 nt, Human
uaauuuuuguauuuuuaguagaga

SEQ ID NO: 1012143 - RNA, 23 nt, Human
uacaggcaugagccaccacgccc

SEQ ID NO: 1012144 - RNA, 22 nt, Human
uagagacaggguuucaccaugu

SEQ ID NO: 1012145 - RNA, 24 nt, Human
uaguagagacaggguuucaccaug

SEQ ID NO: 1012146 - RNA, 26 nt, Human
uaguagagacaggguuucaccauguu

SEQ ID NO: 1012147 - RNA, 25 nt, Human
ucaagucauccucccgccuuagccu

SEQ ID NO: 1012148 - RNA, 19 nt, Human
ucaagugauucuccugccu

SEQ ID NO: 1012149 - RNA, 23 nt, Human
ucauugcaaccucugccuccagg

SEQ ID NO: 1012150 - RNA, 24 nt, Human
ucauugcaaccucugccuccaggg

SEQ ID NO: 1012151 - RNA, 24 nt, Human
uccagaguagcugggauuacaggu

SEQ ID NO: 1012152 - RNA, 24 nt, Human
uccaggguucaagugauucuccug

SEQ ID NO: 1012153 - RNA, 24 nt, Human
ucccaaagugcuggaauuacaggc

SEQ ID NO: 1012154 - RNA, 27 nt, Human
uccucccgccuuagccucccaaagugc

SEQ ID NO: 1012155 - RNA, 20 nt, Human
ucggccgccgcugcugcugc

SEQ ID NO: 1012156 - RNA, 30 nt, Human
ucggcgcccccucggccgccgcugcugcug

SEQ ID NO: 1012157 - RNA, 24 nt, Human
ucuccugccucagccuccagagua

SEQ ID NO: 1012158 - RNA, 24 nt, Human
ucugccuccaggguucaagugauu

SEQ ID NO: 1012159 - RNA, 24 nt, Human
ucuguugccuaggcuggaguguag

SEQ ID NO: 1012160 - RNA, 20 nt, Human
ucuugcucuguugccuaggc

SEQ ID NO: 1012161 - RNA, 23 nt, Human
ucuugcucuguugccuaggcugg

SEQ ID NO: 1012162 - RNA, 24 nt, Human
ucuugcucuguugccuaggcugga

SEQ ID NO: 1012163 - RNA, 19 nt, Human
ugaccaccccuguaaaacc

SEQ ID NO: 1012164 - RNA, 18 nt, Human
ugagacagagucuugcuc

SEQ ID NO: 1012165 - RNA, 22 nt, Human
ugagacagagucuugcucuguu

SEQ ID NO: 1012166 - RNA, 20 nt, Human
ugauucuccugccucagccu

SEQ ID NO: 1012167 - RNA, 18 nt, Human
ugcaaaaagacgacggcc

SEQ ID NO: 1012168 - RNA, 20 nt, Human
ugcaaccucugccuccaggg

SEQ ID NO: 1012169 - RNA, 18 nt, Human
ugccagcagcauggcugu

SEQ ID NO: 1012170 - RNA, 20 nt, Human
ugccuaggcuggaguguagu

SEQ ID NO: 1012171 - RNA, 24 nt, Human
ugccuaggcuggaguguaguggug

SEQ ID NO: 1012172 - RNA, 24 nt, Human
ugccucagccuccagaguagcugg

SEQ ID NO: 1012173 - RNA, 20 nt, Human
ugcugggccaagaucuuggc

SEQ ID NO: 1012174 - RNA, 24 nt, Human
ugcugggugcgacaggcacccucg

SEQ ID NO: 1012175 - RNA, 18 nt, Human
uggaauuacaggcaugag

SEQ ID NO: 1012176 - RNA, 22 nt, Human
uggaauuacaggcaugagccac

SEQ ID NO: 1012177 - RNA, 24 nt, Human
uggaauuacaggcaugagccacca

SEQ ID NO: 1012178 - RNA, 24 nt, Human
uggaauuacaggcaugagccacca

SEQ ID NO: 1012179 - RNA, 24 nt, Human
uggaguguaguggugugaucucgg

SEQ ID NO: 1012180 - RNA, 24 nt, Human
uggccaggcuggucuccaacuccu

SEQ ID NO: 1012181 - RNA, 20 nt, Human
uggccucaagucauccuccc

SEQ ID NO: 1012182 - RNA, 24 nt, Human
uggccucaagucauccucccgccu

SEQ ID NO: 1012183 - RNA, 21 nt, Human
ugggauuacaggugugcacca

SEQ ID NO: 1012184 - RNA, 22 nt, Human
ugggauuacaggugugcaccac

SEQ ID NO: 1012185 - RNA, 24 nt, Human
ugggauuacaggugugcaccacca

SEQ ID NO: 1012186 - RNA, 25 nt, Human
ugggauuacaggugugcaccaccac

SEQ ID NO: 1012187 - RNA, 18 nt, Human
ugggguuuugugccuccu

SEQ ID NO: 1012188 - RNA, 24 nt, Human
ugggguuuugugccuccuuuuugu

SEQ ID NO: 1012189 - RNA, 20 nt, Human
ugucugggcugugggggcug

SEQ ID NO: 1012190 - RNA, 24 nt, Human
ugugcaccaccacgccaggcuaau

SEQ ID NO: 1012191 - RNA, 19 nt, Human
uguugccuaggcuggagug

SEQ ID NO: 1012192 - RNA, 24 nt, Human
uuaguagagacaggguuucaccau

SEQ ID NO: 1012193 - RNA, 21 nt, Human
uucaagugauucuccugccuc

SEQ ID NO: 1012194 - RNA, 23 nt, Human
uucaagugauucuccugccucag

SEQ ID NO: 1012195 - RNA, 24 nt, Human
uucaagugauucuccugccucagc

SEQ ID NO: 1012196 - RNA, 19 nt, Human
uugcaaccucugccuccag

SEQ ID NO: 1012197 - RNA, 24 nt, Human
uugcaaccucugccuccaggguuc

SEQ ID NO: 1012198 - RNA, 24 nt, Human
uugccuaggcuggaguguaguggu

SEQ ID NO: 1012199 - RNA, 24 nt, Human
uugcucuguugccuaggcuggagu

SEQ ID NO: 1012200 - RNA, 20 nt, Human
uuguuuuuuuugagacagag

SEQ ID NO: 1012201 - RNA, 24 nt, Human
uuucaccauguuggccaggcuggu

SEQ ID NO: 1012202 - RNA, 24 nt, Human
uuuuuaguagagacaggguuucac

SEQ ID NO: 1012203 - RNA, 20 nt, Human
uuuuuguauuuuuaguagag

SEQ ID NO: 1012204 - RNA, 25 nt, Human
aaaugauccucccaccucagccucc

SEQ ID NO: 1012205 - RNA, 18 nt, Human
aacaaagcaacuccccuc

SEQ ID NO: 1012206 - RNA, 24 nt, Human
aagccugccuuuguggccuggguu

SEQ ID NO: 1012207 - RNA, 22 nt, Human
aaggcaucccaccccaccuccg

SEQ ID NO: 1012208 - RNA, 18 nt, Human
aaggcccagaaaacaagc

SEQ ID NO: 1012209 - RNA, 20 nt, Human
aaggugcugggauuacaggu

SEQ ID NO: 1012210 - RNA, 24 nt, Human
aaggugcugggauuacagguguga

SEQ ID NO: 1012211 - RNA, 20 nt, Human
aagugccuuuccagaaccgc

SEQ ID NO: 1012212 - RNA, 19 nt, Human
acagaacaaagcaacuccc

SEQ ID NO: 1012213 - RNA, 21 nt, Human
accaagagaaggcaucccacc

SEQ ID NO: 1012214 - RNA, 27 nt, Human
accucccuccccuccuucagaagccag

SEQ ID NO: 1012215 - RNA, 20 nt, Human
accuccgcagaugccacccc

SEQ ID NO: 1012216 - RNA, 18 nt, Human
agaaaacaagcagaggua

SEQ ID NO: 1012217 - RNA, 19 nt, Human
agaaaacaagcagagguag

SEQ ID NO: 1012218 - RNA, 20 nt, Human
agacagcuucaccucccucc

SEQ ID NO: 1012219 - RNA, 23 nt, Human
agagaaaaguacaggcuagaauc

SEQ ID NO: 1012220 - RNA, 20 nt, Human
agcagacagcuucaccuccc

SEQ ID NO: 1012221 - RNA, 22 nt, Human
agcagacagcuucaccucccuc

SEQ ID NO: 1012222 - RNA, 21 nt, Human
agccaccacgcccggcccaga

SEQ ID NO: 1012223 - RNA, 23 nt, Human
aggcaggucucaaacuccuggcc

SEQ ID NO: 1012224 - RNA, 20 nt, Human
agggacccagcuccccacuc

SEQ ID NO: 1012225 - RNA, 26 nt, Human
aggugcugggauuacaggugugagcc

SEQ ID NO: 1012226 - RNA, 20 nt, Human
aucccaccccaccuccgcag

SEQ ID NO: 1012227 - RNA, 27 nt, Human
caaaugauccucccaccucagccuccc

SEQ ID NO: 1012228 - RNA, 24 nt, Human
caaggugcugggauuacaggugug

SEQ ID NO: 1012229 - RNA, 24 nt, Human
caagugccuuuccagaaccgcgug

SEQ ID NO: 1012230 - RNA, 24 nt, Human
caccucagccucccaaggugcugg

SEQ ID NO: 1012231 - RNA, 21 nt, Human
cagaacaaagcaacuccccuc

SEQ ID NO: 1012232 - RNA, 18 nt, Human
cagaggcaagugccuuuc

SEQ ID NO: 1012233 - RNA, 25 nt, Human
cagcuccaacugaggaaagaaaggc

SEQ ID NO: 1012234 - RNA, 20 nt, Human
cagcugaacaauauagaaaa

SEQ ID NO: 1012235 - RNA, 19 nt, Human
caucccaccccaccuccgc

SEQ ID NO: 1012236 - RNA, 19 nt, Human
cauggcccacaccucccuc

SEQ ID NO: 1012237 - RNA, 27 nt, Human
cauuauguugcccaggcaggucucaaa

SEQ ID NO: 1012238 - RNA, 22 nt, Human
cauucauguuauuagucaggaa

SEQ ID NO: 1012239 - RNA, 21 nt, Human
ccaaggugcugggauuacagg

SEQ ID NO: 1012240 - RNA, 21 nt, Human
ccaaggugcugggauuacagg

SEQ ID NO: 1012241 - RNA, 24 nt, Human
ccaaggugcugggauuacaggugu

SEQ ID NO: 1012242 - RNA, 22 nt, Human
cccuggguucaacuucauccug

SEQ ID NO: 1012243 - RNA, 25 nt, Human
ccgacucuuccucaccauuccccgc

SEQ ID NO: 1012244 - RNA, 24 nt, Human
ccuggccucaaaugauccucccac

SEQ ID NO: 1012245 - RNA, 22 nt, Human
cgcagaugccacccccuuagga

SEQ ID NO: 1012246 - RNA, 23 nt, Human
cggccgguguacugggugucagg

SEQ ID NO: 1012247 - RNA, 21 nt, Human
cggugcccucucacccuuccu

SEQ ID NO: 1012248 - RNA, 24 nt, Human
cucaaaugauccucccaccucagc

SEQ ID NO: 1012249 - RNA, 23 nt, Human
cuccagcacccaugcccgacucu

SEQ ID NO: 1012250 - RNA, 27 nt, Human
cuccuggccucaaaugauccucccacc

SEQ ID NO: 1012251 - RNA, 19 nt, Human
cucuuccucaccauucccc

SEQ ID NO: 1012252 - RNA, 20 nt, Human
cugugccgcuccuucuucuc

SEQ ID NO: 1012253 - RNA, 21 nt, Human
cuucagaagccagucugcucc

SEQ ID NO: 1012254 - RNA, 20 nt, Human
gaaggcccagaaaacaagca

SEQ ID NO: 1012255 - RNA, 18 nt, Human
gauuacaggugugagcca

SEQ ID NO: 1012256 - RNA, 21 nt, Human
gauuacaggugugagccacca

SEQ ID NO: 1012257 - RNA, 22 nt, Human
gauuacaggugugagccaccac

SEQ ID NO: 1012258 - RNA, 22 nt, Human
gcagaaaacauuuuuauaacuu

SEQ ID NO: 1012259 - RNA, 24 nt, Human
gcuucaccucccuccccuccuuca

SEQ ID NO: 1012260 - RNA, 22 nt, Human
ggaaaggaaguuucauuauguu

SEQ ID NO: 1012261 - RNA, 24 nt, Human
ggaaguuucauuauguugcccagg

SEQ ID NO: 1012262 - RNA, 26 nt, Human
ggagaagccugccuuuguggccuggg

SEQ ID NO: 1012263 - RNA, 20 nt, Human
ggucucaaacuccuggccuc

SEQ ID NO: 1012264 - RNA, 21 nt, Human
gugcugggauuacagguguga

SEQ ID NO: 1012265 - RNA, 23 nt, Human
uacagaacaaagcaacuccccuc

SEQ ID NO: 1012266 - RNA, 23 nt, Human
uacaggugugagccaccacgccc

SEQ ID NO: 1012267 - RNA, 25 nt, Human
uaccaagagaaggcaucccacccca

SEQ ID NO: 1012268 - RNA, 24 nt, Human
uauguugcccaggcaggucucaaa

SEQ ID NO: 1012269 - RNA, 19 nt, Human
ucaacaucuacauccuacu

SEQ ID NO: 1012270 - RNA, 24 nt, Human
ucaacuucauccugauuuucacuc

SEQ ID NO: 1012271 - RNA, 18 nt, Human
uccagaaccgcgugguga

SEQ ID NO: 1012272 - RNA, 23 nt, Human
ucccaaggugcugggauuacagg

SEQ ID NO: 1012273 - RNA, 20 nt, Human
ucccaccccaccuccgcaga

SEQ ID NO: 1012274 - RNA, 20 nt, Human
uccgcagaugccacccccuu

SEQ ID NO: 1012275 - RNA, 27 nt, Human
uccucccaccucagccucccaaggugc

SEQ ID NO: 1012276 - RNA, 24 nt, Human
ucuaccaagagaaggcaucccacc

SEQ ID NO: 1012277 - RNA, 23 nt, Human
ucuccagcacccaugcccgacuc

SEQ ID NO: 1012278 - RNA, 21 nt, Human
ugcccucucacccuuccuaaa

SEQ ID NO: 1012279 - RNA, 20 nt, Human
ugcuccaggacaaauccugc

SEQ ID NO: 1012280 - RNA, 24 nt, Human
ugcugggauuacaggugugagcca

SEQ ID NO: 1012281 - RNA, 18 nt, Human
uggccucaaaugauccuc

SEQ ID NO: 1012282 - RNA, 21 nt, Human
ugggagaacuuaaggucgcug

SEQ ID NO: 1012283 - RNA, 18 nt, Human
ugggauuacaggugugag

SEQ ID NO: 1012284 - RNA, 19 nt, Human
ugggauuacaggugugagc

SEQ ID NO: 1012285 - RNA, 22 nt, Human
ugggauuacaggugugagccac

SEQ ID NO: 1012286 - RNA, 23 nt, Human
ugggauuacaggugugagccacc

SEQ ID NO: 1012287 - RNA, 24 nt, Human
ugggauuacaggugugagccacca

SEQ ID NO: 1012288 - RNA, 21 nt, Human
ugucaucuaccaagagaaggc

SEQ ID NO: 1012289 - RNA, 22 nt, Human
ugucaucuaccaagagaaggca

SEQ ID NO: 1012290 - RNA, 22 nt, Human
ugugagccaccacgcccggccc

SEQ ID NO: 1012291 - RNA, 22 nt, Human
ugugaucagcuccaacugagga

SEQ ID NO: 1012292 - RNA, 22 nt, Human
uucaacaucuacauccuacucc

SEQ ID NO: 1012293 - RNA, 19 nt, Human
uuccccgccucgacauccu

SEQ ID NO: 1012294 - RNA, 18 nt, Human
uugcccaggcaggucuca

SEQ ID NO: 1012295 - RNA, 19 nt, Human
uuggaauccagagucauuc

SEQ ID NO: 1012296 - RNA, 20 nt, Human
uuggugaacacagacucccu

SEQ ID NO: 1012297 - RNA, 23 nt, Human
uuggugaacacagacucccuggg

SEQ ID NO: 1012298 - RNA, 24 nt, Human
uuguggccuggguugugaucagcu

SEQ ID NO: 1012299 - RNA, 18 nt, Human
uuuuuuuuuuucucccug

SEQ ID NO: 1012300 - RNA, 21 nt, Human
aaaacaggagucauugucagc

SEQ ID NO: 1012301 - RNA, 24 nt, Human
aaacuggcuuccuuucugaggccu

SEQ ID NO: 1012302 - RNA, 24 nt, Human
aaagugcugggauuacaggcguga

SEQ ID NO: 1012303 - RNA, 19 nt, Human
aacauggugaaaccccguc

SEQ ID NO: 1012304 - RNA, 20 nt, Human
aacauggugaaaccccgucu

SEQ ID NO: 1012305 - RNA, 21 nt, Human
aacauggugaaaccccgucuc

SEQ ID NO: 1012306 - RNA, 24 nt, Human
aacuggcuuccuuucugaggccug

SEQ ID NO: 1012307 - RNA, 22 nt, Human
aagcaggagagacuuugcagga

SEQ ID NO: 1012308 - RNA, 20 nt, Human
aaguagcugggacuauaggc

SEQ ID NO: 1012309 - RNA, 22 nt, Human
aaguagcugggacuauaggcau

SEQ ID NO: 1012310 - RNA, 19 nt, Human
aagugcuaggauuacaagu

SEQ ID NO: 1012311 - RNA, 19 nt, Human
aagugcugggauuacaggc

SEQ ID NO: 1012312 - RNA, 19 nt, Human
aagugcugggauuacaggc

SEQ ID NO: 1012313 - RNA, 23 nt, Human
aaucauagcucacugcagacuug

SEQ ID NO: 1012314 - RNA, 18 nt, Human
aauugcuugaaccugaga

SEQ ID NO: 1012315 - RNA, 24 nt, Human
aauugcuugaaccugagaggcgga

SEQ ID NO: 1012316 - RNA, 18 nt, Human
acagacaagagccacugu

SEQ ID NO: 1012317 - RNA, 18 nt, Human
acagacgugcaccaccau

SEQ ID NO: 1012318 - RNA, 21 nt, Human
accaaugccagcuaaguuuua

SEQ ID NO: 1012319 - RNA, 24 nt, Human
accauguuggccaggcuggucucg

SEQ ID NO: 1012320 - RNA, 19 nt, Human
acccaggcuggagugcagu

SEQ ID NO: 1012321 - RNA, 23 nt, Human
acccaggcuggagugcaguggug

SEQ ID NO: 1012322 - RNA, 24 nt, Human
accccgucucuacuaaaaauacaa

SEQ ID NO: 1012323 - RNA, 24 nt, Human
accugaggucaggaguuugagacc

SEQ ID NO: 1012324 - RNA, 18 nt, Human
acgugcaccaccaugccc

SEQ ID NO: 1012325 - RNA, 19 nt, Human
acuacaggugcauaccacc

SEQ ID NO: 1012326 - RNA, 19 nt, Human
acuauauugcccagguugg

SEQ ID NO: 1012327 - RNA, 19 nt, Human
acugcagccuccaauuccu

SEQ ID NO: 1012328 - RNA, 23 nt, Human
acuugaacuccuggguucaagcg

SEQ ID NO: 1012329 - RNA, 25 nt, Human
acuuugucgcccaggcuggagugca

SEQ ID NO: 1012330 - RNA, 18 nt, Human
agacagggucuuacugug

SEQ ID NO: 1012331 - RNA, 19 nt, Human
agagaauguauuggaggag

SEQ ID NO: 1012332 - RNA, 22 nt, Human
agagauagggucuggcucuguc

SEQ ID NO: 1012333 - RNA, 19 nt, Human
agauagggucuggcucugu

SEQ ID NO: 1012334 - RNA, 23 nt, Human
agccaggugugguggugcaugcc

SEQ ID NO: 1012335 - RNA, 21 nt, Human
agcccauuucccaccagcacc

SEQ ID NO: 1012336 - RNA, 23 nt, Human
agccgggcgugguggcucaagcc

SEQ ID NO: 1012337 - RNA, 22 nt, Human
agccuggccaacauggugaaac

SEQ ID NO: 1012338 - RNA, 24 nt, Human
agccuggccaacauggugaaaccc

SEQ ID NO: 1012339 - RNA, 24 nt, Human
agcgauucuucugccucagccucc

SEQ ID NO: 1012340 - RNA, 24 nt, Human
agcgcugggauuacagacaagagc

SEQ ID NO: 1012341 - RNA, 23 nt, Human
aggagagagagcagugagcuagg

SEQ ID NO: 1012342 - RNA, 20 nt, Human
aggaguuugagaccagccug

SEQ ID NO: 1012343 - RNA, 22 nt, Human
aggcaggagaauugcuugaacc

SEQ ID NO: 1012344 - RNA, 24 nt, Human
aggcaggagaauugcuugaaccug

SEQ ID NO: 1012345 - RNA, 18 nt, Human
aggcagguggaucaccug

SEQ ID NO: 1012346 - RNA, 22 nt, Human
aggcagguggaucaccugaggu

SEQ ID NO: 1012347 - RNA, 26 nt, Human
aggcagguggaucaccugaggucagg

SEQ ID NO: 1012348 - RNA, 19 nt, Human
aggcggaggcaggagaauu

SEQ ID NO: 1012349 - RNA, 24 nt, Human
aggcggaggcaggagaauugcuug

SEQ ID NO: 1012350 - RNA, 20 nt, Human
aggcuggagguggagguggg

SEQ ID NO: 1012351 - RNA, 23 nt, Human
aggcuggagguggagguggggac

SEQ ID NO: 1012352 - RNA, 18 nt, Human
aggcuggagugcaguggc

SEQ ID NO: 1012353 - RNA, 25 nt, Human
aggcuggagugcaguggcgcgaucu

SEQ ID NO: 1012354 - RNA, 25 nt, Human
aggcuggagugcaguggugcgaucu

SEQ ID NO: 1012355 - RNA, 24 nt, Human
agggauucuccucccucagccucc

SEQ ID NO: 1012356 - RNA, 24 nt, Human
aggugauccaccugccucagccuc

SEQ ID NO: 1012357 - RNA, 22 nt, Human
aggugcacggccuucagugcug

SEQ ID NO: 1012358 - RNA, 22 nt, Human
agguggaucaccugaggucagg

SEQ ID NO: 1012359 - RNA, 24 nt, Human
aggugugguggugcaugccuguaa

SEQ ID NO: 1012360 - RNA, 22 nt, Human
aguagagaugggguuucaccau

SEQ ID NO: 1012361 - RNA, 19 nt, Human
aguagcugggacuacagac

SEQ ID NO: 1012362 - RNA, 23 nt, Human
aguagcugggacuauaggcaugc

SEQ ID NO: 1012363 - RNA, 23 nt, Human
aguagcugggauuacaggcgugu

SEQ ID NO: 1012364 - RNA, 25 nt, Human
agugauccuccuccgucagccuccu

SEQ ID NO: 1012365 - RNA, 19 nt, Human
agugcaguggcgcgaucuc

SEQ ID NO: 1012366 - RNA, 21 nt, Human
agugcaguggcgcgaucucag

SEQ ID NO: 1012367 - RNA, 21 nt, Human
agugcaguggcgugaucauag

SEQ ID NO: 1012368 - RNA, 23 nt, Human
agugcaguggcgugaucauagcu

SEQ ID NO: 1012369 - RNA, 24 nt, Human
agugcaguggcgugaucauagcuc

SEQ ID NO: 1012370 - RNA, 21 nt, Human
agugcaguggugcaaucauag

SEQ ID NO: 1012371 - RNA, 23 nt, Human
agugcaguggugcaaucauagcu

SEQ ID NO: 1012372 - RNA, 24 nt, Human
agugcaguggugcaaucauagcuc

SEQ ID NO: 1012373 - RNA, 23 nt, Human
agugcaguggugcgaucuuggcu

SEQ ID NO: 1012374 - RNA, 24 nt, Human
agugcaguggugcgaucuuggcuc

SEQ ID NO: 1012375 - RNA, 18 nt, Human
agugcugggauuacaggc

SEQ ID NO: 1012376 - RNA, 24 nt, Human
auagcucacugcagacuugaacuc

SEQ ID NO: 1012377 - RNA, 18 nt, Human
auagcucacugcagccuc

SEQ ID NO: 1012378 - RNA, 22 nt, Human
augggguuucaccauguuggcc

SEQ ID NO: 1012379 - RNA, 24 nt, Human
augggguuucaccauguuggccag

SEQ ID NO: 1012380 - RNA, 24 nt, Human
auuucuguauuuuuaguagagaug

SEQ ID NO: 1012381 - RNA, 24 nt, Human
caaagugcugggauuacaggcgug

SEQ ID NO: 1012382 - RNA, 24 nt, Human
caacauggugaaaccccgucucua

SEQ ID NO: 1012383 - RNA, 25 nt, Human
caagagccacugugccuggccucgu

SEQ ID NO: 1012384 - RNA, 24 nt, Human
caagccuauaaucccaguacuuug

SEQ ID NO: 1012385 - RNA, 27 nt, Human
caagcgauccuccuaccucaaccuccc

SEQ ID NO: 1012386 - RNA, 28 nt, Human
caagcgauccuccuaccucaaccuccca

SEQ ID NO: 1012387 - RNA, 22 nt, Human
caagcgauucuucugccucagc

SEQ ID NO: 1012388 - RNA, 19 nt, Human
caaggugaaccgugggauc

SEQ ID NO: 1012389 - RNA, 22 nt, Human
caagugauccuccugccucagc

SEQ ID NO: 1012390 - RNA, 27 nt, Human
caagugauccuccugccucagccuccc

SEQ ID NO: 1012391 - RNA, 27 nt, Human
caagugauccuccugccucagccuccc

SEQ ID NO: 1012392 - RNA, 22 nt, Human
caagugauccuccugucucagc

SEQ ID NO: 1012393 - RNA, 19 nt, Human
caccagcaccuacucugaa

SEQ ID NO: 1012394 - RNA, 21 nt, Human
caccauguuggccaggcuggu

SEQ ID NO: 1012395 - RNA, 24 nt, Human
caccauguuggccaggcuggucuc

SEQ ID NO: 1012396 - RNA, 27 nt, Human
caccauguuggccaggcuggucucgaa

SEQ ID NO: 1012397 - RNA, 21 nt, Human
cacccagccuaucccaaaccu

SEQ ID NO: 1012398 - RNA, 24 nt, Human
cacccaggcuggagugcaguggug

SEQ ID NO: 1012399 - RNA, 23 nt, Human
cacccagugauggagacacaguc

SEQ ID NO: 1012400 - RNA, 23 nt, Human
caccugaggucaggaguuugaga

SEQ ID NO: 1012401 - RNA, 23 nt, Human
caccugccucagccucccaaagu

SEQ ID NO: 1012402 - RNA, 23 nt, Human
cacggcacccagccuaucccaaa

SEQ ID NO: 1012403 - RNA, 22 nt, Human
cacuauauugcccagguugguc

SEQ ID NO: 1012404 - RNA, 24 nt, Human
cacuuugucgcccaggcuggagug

SEQ ID NO: 1012405 - RNA, 22 nt, Human
cagagcgcugggauuacagaca

SEQ ID NO: 1012406 - RNA, 21 nt, Human
cagcacaaggugaaccguggg

SEQ ID NO: 1012407 - RNA, 19 nt, Human
cagccgggcgugguggcuc

SEQ ID NO: 1012408 - RNA, 19 nt, Human
cagccuccaauuccugggc

SEQ ID NO: 1012409 - RNA, 23 nt, Human
cagccuccaauuccugggcucaa

SEQ ID NO: 1012410 - RNA, 20 nt, Human
cagccuccugaguagcuggg

SEQ ID NO: 1012411 - RNA, 20 nt, Human
cagccuccugaguagcuggg

SEQ ID NO: 1012412 - RNA, 22 nt, Human
cagccucgcucccccagcucug

SEQ ID NO: 1012413 - RNA, 18 nt, Human
cagggucuuacuguguug

SEQ ID NO: 1012414 - RNA, 24 nt, Human
cagguggaucaccugaggucagga

SEQ ID NO: 1012415 - RNA, 20 nt, Human
caguacuuugggaagcccag

SEQ ID NO: 1012416 - RNA, 21 nt, Human
caguacuuugggaagcccagg

SEQ ID NO: 1012417 - RNA, 24 nt, Human
caguacuuugggaagcccaggcag

SEQ ID NO: 1012418 - RNA, 26 nt, Human
caguagcuaggacuacaggugcauac

SEQ ID NO: 1012419 - RNA, 23 nt, Human
cagugacaggcacaggacggcac

SEQ ID NO: 1012420 - RNA, 19 nt, Human
caguggugcgaucuuggcu

SEQ ID NO: 1012421 - RNA, 18 nt, Human
caguuagggaaagcaugg

SEQ ID NO: 1012422 - RNA, 18 nt, Human
cauaccaccaggccuggc

SEQ ID NO: 1012423 - RNA, 24 nt, Human
cauguuggccaggcuggucucgaa

SEQ ID NO: 1012424 - RNA, 22 nt, Human
cauuuagggacccaagucaucc

SEQ ID NO: 1012425 - RNA, 20 nt, Human
cauuuuugcacaguuaggga

SEQ ID NO: 1012426 - RNA, 22 nt, Human
ccaaagugcugggauuacaggc

SEQ ID NO: 1012427 - RNA, 22 nt, Human
ccaaagugcugggauuacaggc

SEQ ID NO: 1012428 - RNA, 24 nt, Human
ccaaagugcugggauuacaggcgu

SEQ ID NO: 1012429 - RNA, 22 nt, Human
ccaagugcuaggauuacaagug

SEQ ID NO: 1012430 - RNA, 26 nt, Human
ccaccugccucagccucccaaagugc

SEQ ID NO: 1012431 - RNA, 19 nt, Human
ccagagcgcugggauuaca

SEQ ID NO: 1012432 - RNA, 26 nt, Human
ccaggcagguggaucaccugagguca

SEQ ID NO: 1012433 - RNA, 19 nt, Human
ccaggguucaagcgauucu

SEQ ID NO: 1012434 - RNA, 23 nt, Human
ccaggguucaagcgauucuucug

SEQ ID NO: 1012435 - RNA, 22 nt, Human
ccaugaaccuccgccucccggg

SEQ ID NO: 1012436 - RNA, 19 nt, Human
cccaaguagcugggacuau

SEQ ID NO: 1012437 - RNA, 24 nt, Human
cccaaguagcugggacuauaggca

SEQ ID NO: 1012438 - RNA, 21 nt, Human
cccaggcuggagugcaguggc

SEQ ID NO: 1012439 - RNA, 21 nt, Human
ccccaugaaccuccgccuccc

SEQ ID NO: 1012440 - RNA, 24 nt, Human
ccccaugaaccuccgccucccggg

SEQ ID NO: 1012441 - RNA, 18 nt, Human
cccggguucaagggauuc

SEQ ID NO: 1012442 - RNA, 21 nt, Human
cccuggggcggucuuggaggg

SEQ ID NO: 1012443 - RNA, 23 nt, Human
ccuaccucaaccucccaaguagc

SEQ ID NO: 1012444 - RNA, 22 nt, Human
ccucaagugauccuccugucuc

SEQ ID NO: 1012445 - RNA, 24 nt, Human
ccuccaggguucaagcgauucuuc

SEQ ID NO: 1012446 - RNA, 24 nt, Human
ccucccggguucaagggauucucc

SEQ ID NO: 1012447 - RNA, 21 nt, Human
ccuccugccucagccucccag

SEQ ID NO: 1012448 - RNA, 22 nt, Human
ccuccugccucagccucccaga

SEQ ID NO: 1012449 - RNA, 26 nt, Human
ccuccugucucagccuuuccaagugc

SEQ ID NO: 1012450 - RNA, 18 nt, Human
ccugaccucaagugaucc

SEQ ID NO: 1012451 - RNA, 23 nt, Human
ccugaccucaagugauccuccug

SEQ ID NO: 1012452 - RNA, 21 nt, Human
ccugacuugaggugauccacc

SEQ ID NO: 1012453 - RNA, 22 nt, Human
ccugaggucaggaguuugagac

SEQ ID NO: 1012454 - RNA, 19 nt, Human
ccugaguagcugggacuac

SEQ ID NO: 1012455 - RNA, 23 nt, Human
ccugaguagcugggauuacaggc

SEQ ID NO: 1012456 - RNA, 24 nt, Human
ccugaguagcugggauuacaggcg

SEQ ID NO: 1012457 - RNA, 24 nt, Human
ccugccucagccucccaaagugcu

SEQ ID NO: 1012458 - RNA, 23 nt, Human
ccuggccaacauggugaaacccc

SEQ ID NO: 1012459 - RNA, 24 nt, Human
ccuggccaacauggugaaaccccg

SEQ ID NO: 1012460 - RNA, 18 nt, Human
ccuggccucaagugaucc

SEQ ID NO: 1012461 - RNA, 21 nt, Human
ccuggccucaagugauccucc

SEQ ID NO: 1012462 - RNA, 22 nt, Human
ccuggccucaagugauccuccu

SEQ ID NO: 1012463 - RNA, 23 nt, Human
ccuggccucaagugauccuccug

SEQ ID NO: 1012464 - RNA, 21 nt, Human
ccuggccucuacccugugggc

SEQ ID NO: 1012465 - RNA, 22 nt, Human
ccugggcucaagugauccuccu

SEQ ID NO: 1012466 - RNA, 20 nt, Human
ccuggguucaagcgauccuc

SEQ ID NO: 1012467 - RNA, 19 nt, Human
ccuguaaucccagcuacuu

SEQ ID NO: 1012468 - RNA, 21 nt, Human
ccuguaaucccagcuacuugg

SEQ ID NO: 1012469 - RNA, 22 nt, Human
ccuguaaucccagcuacuuggg

SEQ ID NO: 1012470 - RNA, 18 nt, Human
ccuuuuuuuuuuuuuuga

SEQ ID NO: 1012471 - RNA, 24 nt, Human
ccuuuuuuuuuuuuuugaguuggg

SEQ ID NO: 1012472 - RNA, 22 nt, Human
cgccaccaaugccagcuaaguu

SEQ ID NO: 1012473 - RNA, 24 nt, Human
cgcccaggcuggagugcaguggcg

SEQ ID NO: 1012474 - RNA, 24 nt, Human
cgcccaggcuggagugcaguggcg

SEQ ID NO: 1012475 - RNA, 24 nt, Human
cgcccaggcuggagugcaguggug

SEQ ID NO: 1012476 - RNA, 22 nt, Human
cgcugggauuacagacaagagc

SEQ ID NO: 1012477 - RNA, 24 nt, Human
cggcaaccuccgccuccaggguuc

SEQ ID NO: 1012478 - RNA, 20 nt, Human
cggcacagagcagagcugcc

SEQ ID NO: 1012479 - RNA, 24 nt, Human
cuagccaggugugguggugcaugc

SEQ ID NO: 1012480 - RNA, 24 nt, Human
cucaagccuauaaucccaguacuu

SEQ ID NO: 1012481 - RNA, 24 nt, Human
cucaagugauccuccuccgucagc

SEQ ID NO: 1012482 - RNA, 24 nt, Human
cucaagugauccuccugccucagc

SEQ ID NO: 1012483 - RNA, 20 nt, Human
cucacaacucccugggggcc

SEQ ID NO: 1012484 - RNA, 21 nt, Human
cucacugcagccuccaauucc

SEQ ID NO: 1012485 - RNA, 24 nt, Human
cucacugcagccuccaauuccugg

SEQ ID NO: 1012486 - RNA, 24 nt, Human
cucacuuugucgcccaggcuggag

SEQ ID NO: 1012487 - RNA, 24 nt, Human
cucagccuccugaguagcugggac

SEQ ID NO: 1012488 - RNA, 24 nt, Human
cucagccuccugaguagcugggau

SEQ ID NO: 1012489 - RNA, 24 nt, Human
cucagggaauaauuuugggggaaa

SEQ ID NO: 1012490 - RNA, 19 nt, Human
cucccccagcucugccucc

SEQ ID NO: 1012491 - RNA, 23 nt, Human
cucccucagccuccugaguagcu

SEQ ID NO: 1012492 - RNA, 25 nt, Human
cucccucagccuccugaguagcugg

SEQ ID NO: 1012493 - RNA, 24 nt, Human
cuccucaguagcuaggacuacagg

SEQ ID NO: 1012494 - RNA, 19 nt, Human
cuccuccgucagccuccuc

SEQ ID NO: 1012495 - RNA, 20 nt, Human
cugaggccugcuuccucagc

SEQ ID NO: 1012496 - RNA, 22 nt, Human
cugaguagcugggauuacaggc

SEQ ID NO: 1012497 - RNA, 24 nt, Human
cugaguagcugggauuacaggcgu

SEQ ID NO: 1012498 - RNA, 20 nt, Human
cugcagacuugaacuccugg

SEQ ID NO: 1012499 - RNA, 23 nt, Human
cugcagccuccaauuccugggcu

SEQ ID NO: 1012500 - RNA, 23 nt, Human
cugccucagccucccagagcgcu

SEQ ID NO: 1012501 - RNA, 18 nt, Human
cuggaggcuggaggugga

SEQ ID NO: 1012502 - RNA, 21 nt, Human
cuggagguggaggugcacggc

SEQ ID NO: 1012503 - RNA, 21 nt, Human
cuggcucugucgcccaggcug

SEQ ID NO: 1012504 - RNA, 22 nt, Human
cugggcucaagugauccuccuc

SEQ ID NO: 1012505 - RNA, 22 nt, Human
cuguauuuuuaguagagauggg

SEQ ID NO: 1012506 - RNA, 23 nt, Human
cuguauuuuuaguagagaugggg

SEQ ID NO: 1012507 - RNA, 23 nt, Human
cugucucagccuuuccaagugcu

SEQ ID NO: 1012508 - RNA, 18 nt, Human
cuuugucgcccaggcugg

SEQ ID NO: 1012509 - RNA, 23 nt, Human
cuuuuuuuuuuuuuugaguuggg

SEQ ID NO: 1012510 - RNA, 22 nt, Human
gaccucaagugauccuccugcc

SEQ ID NO: 1012511 - RNA, 24 nt, Human
gaccucaagugauccuccugccuc

SEQ ID NO: 1012512 - RNA, 24 nt, Human
gacuugaggugauccaccugccuc

SEQ ID NO: 1012513 - RNA, 23 nt, Human
gagaauguauuggaggaggggag

SEQ ID NO: 1012514 - RNA, 20 nt, Human
gagacagagucucacuuugu

SEQ ID NO: 1012515 - RNA, 18 nt, Human
gagaugggguuucaccau

SEQ ID NO: 1012516 - RNA, 24 nt, Human
gagaugggguuucaccauguuggc

SEQ ID NO: 1012517 - RNA, 23 nt, Human
gaggcaggagaauugcuugaacc

SEQ ID NO: 1012518 - RNA, 24 nt, Human
gaggcaggagaauugcuugaaccu

SEQ ID NO: 1012519 - RNA, 24 nt, Human
gaguagcugggacuacagacgugc

SEQ ID NO: 1012520 - RNA, 20 nt, Human
gaguagcugggauuacaggc

SEQ ID NO: 1012521 - RNA, 25 nt, Human
gaguagcugggauuacaggcgugug

SEQ ID NO: 1012522 - RNA, 21 nt, Human
gaucaccugaggucaggaguu

SEQ ID NO: 1012523 - RNA, 24 nt, Human
gaucaccugaggucaggaguuuga

SEQ ID NO: 1012524 - RNA, 19 nt, Human
gaucauagcucacugcagc

SEQ ID NO: 1012525 - RNA, 18 nt, Human
gauuacagacaagagcca

SEQ ID NO: 1012526 - RNA, 21 nt, Human
gauuacagacaagagccacug

SEQ ID NO: 1012527 - RNA, 23 nt, Human
gauuacaggcgugacccacggca

SEQ ID NO: 1012528 - RNA, 22 nt, Human
gcaaccuccgccuccaggguuc

SEQ ID NO: 1012529 - RNA, 24 nt, Human
gccaacauggugaaaccccgucuc

SEQ ID NO: 1012530 - RNA, 19 nt, Human
gcccaggcuggagugcagu

SEQ ID NO: 1012531 - RNA, 19 nt, Human
gcccaggcuggagugcagu

SEQ ID NO: 1012532 - RNA, 20 nt, Human
gcccaggcuggagugcagug

SEQ ID NO: 1012533 - RNA, 20 nt, Human
gcccaggcuggagugcagug

SEQ ID NO: 1012534 - RNA, 20 nt, Human
gcccaggcuggagugcagug

SEQ ID NO: 1012535 - RNA, 23 nt, Human
gcccaggcuggagugcaguggug

SEQ ID NO: 1012536 - RNA, 21 nt, Human
gccucagccucccaaagugcu

SEQ ID NO: 1012537 - RNA, 21 nt, Human
gccugcuuccucagccccacc

SEQ ID NO: 1012538 - RNA, 20 nt, Human
gccuguaaucccagcuacuu

SEQ ID NO: 1012539 - RNA, 20 nt, Human
gccuucagugcuguccucag

SEQ ID NO: 1012540 - RNA, 23 nt, Human
gcgauucuucugccucagccucc

SEQ ID NO: 1012541 - RNA, 25 nt, Human
gcucuaucacccaggcuggagugca

SEQ ID NO: 1012542 - RNA, 25 nt, Human
gcucugucgcccaggcuggagugca

SEQ ID NO: 1012543 - RNA, 25 nt, Human
gcucugucgcccaggcuggagugca

SEQ ID NO: 1012544 - RNA, 19 nt, Human
gcuggagugcaguggcgcg

SEQ ID NO: 1012545 - RNA, 19 nt, Human
gcuggagugcaguggcgug

SEQ ID NO: 1012546 - RNA, 22 nt, Human
ggacuacaggugcauaccacca

SEQ ID NO: 1012547 - RNA, 20 nt, Human
ggagacacagucagcauugg

SEQ ID NO: 1012548 - RNA, 19 nt, Human
ggagguggaggugcacggc

SEQ ID NO: 1012549 - RNA, 19 nt, Human
ggccucaagugauccuccu

SEQ ID NO: 1012550 - RNA, 20 nt, Human
ggcgugguggcucaagccua

SEQ ID NO: 1012551 - RNA, 21 nt, Human
ggcucaagccuauaaucccag

SEQ ID NO: 1012552 - RNA, 24 nt, Human
ggcucugucgcccaggcuggagug

SEQ ID NO: 1012553 - RNA, 22 nt, Human
ggcuggagugcaguggcgugau

SEQ ID NO: 1012554 - RNA, 18 nt, Human
gggcacccaggggcccau

SEQ ID NO: 1012555 - RNA, 19 nt, Human
gggcucaagugauccuccu

SEQ ID NO: 1012556 - RNA, 22 nt, Human
gggguuucaccauguuggccag

SEQ ID NO: 1012557 - RNA, 23 nt, Human
ggguuccccaugaaccuccgccu

SEQ ID NO: 1012558 - RNA, 18 nt, Human
ggguuucaccauguuggc

SEQ ID NO: 1012559 - RNA, 21 nt, Human
ggucagauuaucagagaaugu

SEQ ID NO: 1012560 - RNA, 19 nt, Human
ggucaggaguuugagacca

SEQ ID NO: 1012561 - RNA, 24 nt, Human
ggugauccaccugccucagccucc

SEQ ID NO: 1012562 - RNA, 21 nt, Human
ggugcaugccuguaaucccag

SEQ ID NO: 1012563 - RNA, 24 nt, Human
gguggcucaagccuauaaucccag

SEQ ID NO: 1012564 - RNA, 24 nt, Human
gguuggucucaaacuccuggccuc

SEQ ID NO: 1012565 - RNA, 21 nt, Human
gguugucguuuuauuauuguu

SEQ ID NO: 1012566 - RNA, 23 nt, Human
guagagaugggguuucaccaugu

SEQ ID NO: 1012567 - RNA, 18 nt, Human
guagcugggauuacaggc

SEQ ID NO: 1012568 - RNA, 18 nt, Human
guagcugggauuacaggc

SEQ ID NO: 1012569 - RNA, 24 nt, Human
gucuugcucuaucacccaggcugg

SEQ ID NO: 1012570 - RNA, 19 nt, Human
gugaggugacuggaggcug

SEQ ID NO: 1012571 - RNA, 18 nt, Human
gugauccaccugccucag

SEQ ID NO: 1012572 - RNA, 19 nt, Human
gugauccaccugccucagc

SEQ ID NO: 1012573 - RNA, 24 nt, Human
gugauccaccugccucagccuccc

SEQ ID NO: 1012574 - RNA, 24 nt, Human
gugauccuccuccgucagccuccu

SEQ ID NO: 1012575 - RNA, 24 nt, Human
gugauccuccugccucagccuccc

SEQ ID NO: 1012576 - RNA, 24 nt, Human
gugauccuccugucucagccuuuc

SEQ ID NO: 1012577 - RNA, 23 nt, Human
gugggauccuuuuuuuuuuuuuu

SEQ ID NO: 1012578 - RNA, 23 nt, Human
guggugcaugccuguaaucccag

SEQ ID NO: 1012579 - RNA, 21 nt, Human
uaaaaauacaaaaacuagcca

SEQ ID NO: 1012580 - RNA, 24 nt, Human
uaauuucuguauuuuuaguagaga

SEQ ID NO: 1012581 - RNA, 22 nt, Human
uacagacaagagccacugugcc

SEQ ID NO: 1012582 - RNA, 24 nt, Human
uacaggcgugugcaaccacaccca

SEQ ID NO: 1012583 - RNA, 19 nt, Human
uacccugugggcaacaggu

SEQ ID NO: 1012584 - RNA, 24 nt, Human
uaccucaaccucccaaguagcugg

SEQ ID NO: 1012585 - RNA, 22 nt, Human
uagagacagggucuuacugugu

SEQ ID NO: 1012586 - RNA, 22 nt, Human
uagagaugggguuucaccaugu

SEQ ID NO: 1012587 - RNA, 24 nt, Human
uagcucacugcagccuccaauucc

SEQ ID NO: 1012588 - RNA, 21 nt, Human
uaggacuacaggugcauacca

SEQ ID NO: 1012589 - RNA, 24 nt, Human
uaggacuacaggugcauaccacca

SEQ ID NO: 1012590 - RNA, 24 nt, Human
uagggucucacuauauugcccagg

SEQ ID NO: 1012591 - RNA, 24 nt, Human
uagggucuggcucugucgcccagg

SEQ ID NO: 1012592 - RNA, 24 nt, Human
uaguagagaugggguuucaccaug

SEQ ID NO: 1012593 - RNA, 26 nt, Human
uaguagagaugggguuucaccauguu

SEQ ID NO: 1012594 - RNA, 23 nt, Human
uauaggcaugcgccaccaaugcc

SEQ ID NO: 1012595 - RNA, 24 nt, Human
uauauugcccagguuggucucaaa

SEQ ID NO: 1012596 - RNA, 28 nt, Human
uauuuuauuuuuuguagaaauagggucu

SEQ ID NO: 1012597 - RNA, 22 nt, Human
ucaagcccauuucccaccagca

SEQ ID NO: 1012598 - RNA, 22 nt, Human
ucaagccuauaaucccaguacu

SEQ ID NO: 1012599 - RNA, 24 nt, Human
ucacccaggcuggagugcaguggu

SEQ ID NO: 1012600 - RNA, 19 nt, Human
ucaccugaggucaggaguu

SEQ ID NO: 1012601 - RNA, 23 nt, Human
ucacggcaaccuccgccuccagg

SEQ ID NO: 1012602 - RNA, 24 nt, Human
ucacggcaaccuccgccuccaggg

SEQ ID NO: 1012603 - RNA, 25 nt, Human
ucacggcaaccuccgccuccagggu

SEQ ID NO: 1012604 - RNA, 27 nt, Human
ucacggcaaccuccgccuccaggguuc

SEQ ID NO: 1012605 - RNA, 24 nt, Human
ucacugcagacuugaacuccuggg

SEQ ID NO: 1012606 - RNA, 24 nt, Human
ucacugcagccuccaauuccuggg

SEQ ID NO: 1012607 - RNA, 24 nt, Human
ucacuuugucgcccaggcuggagu

SEQ ID NO: 1012608 - RNA, 20 nt, Human
ucagcauugguugucguuuu

SEQ ID NO: 1012609 - RNA, 20 nt, Human
ucagccuccugaguagcugg

SEQ ID NO: 1012610 - RNA, 23 nt, Human
ucagccuccugaguagcugggac

SEQ ID NO: 1012611 - RNA, 23 nt, Human
ucauagcucacugcagacuugaa

SEQ ID NO: 1012612 - RNA, 21 nt, Human
uccacaggcccagaggcagcc

SEQ ID NO: 1012613 - RNA, 24 nt, Human
uccaggguucaagcgauucuucug

SEQ ID NO: 1012614 - RNA, 24 nt, Human
ucccaaagugcugggauuacaggc

SEQ ID NO: 1012615 - RNA, 24 nt, Human
ucccaaguagcugggacuauaggc

SEQ ID NO: 1012616 - RNA, 18 nt, Human
ucccagagcgcugggauu

SEQ ID NO: 1012617 - RNA, 22 nt, Human
ucccagcuacuugggaggcgga

SEQ ID NO: 1012618 - RNA, 19 nt, Human
ucccccagcucugccuccc

SEQ ID NO: 1012619 - RNA, 21 nt, Human
ucccggguucaagggauucuc

SEQ ID NO: 1012620 - RNA, 23 nt, Human
ucccggguucaagggauucuccu

SEQ ID NO: 1012621 - RNA, 18 nt, Human
ucccucagccuccugagu

SEQ ID NO: 1012622 - RNA, 24 nt, Human
ucccucagccuccugaguagcugg

SEQ ID NO: 1012623 - RNA, 23 nt, Human
ucccugggggccucuucuggccc

SEQ ID NO: 1012624 - RNA, 19 nt, Human
uccucagccccacccagug

SEQ ID NO: 1012625 - RNA, 18 nt, Human
uccucaggcaccuggccu

SEQ ID NO: 1012626 - RNA, 21 nt, Human
uccucaggcaccuggccucua

SEQ ID NO: 1012627 - RNA, 27 nt, Human
uccuccuaccucaaccucccaaguagc

SEQ ID NO: 1012628 - RNA, 22 nt, Human
uccuccugccucagccucccag

SEQ ID NO: 1012629 - RNA, 25 nt, Human
uccuccugccucagccucccagagc

SEQ ID NO: 1012630 - RNA, 18 nt, Human
uccugaguagcugggacu

SEQ ID NO: 1012631 - RNA, 24 nt, Human
uccugaguagcugggauuacaggc

SEQ ID NO: 1012632 - RNA, 21 nt, Human
uccugggcucaagugauccuc

SEQ ID NO: 1012633 - RNA, 22 nt, Human
uccugggcucaagugauccucc

SEQ ID NO: 1012634 - RNA, 22 nt, Human
uccugggcucaagugauccucc

SEQ ID NO: 1012635 - RNA, 21 nt, Human
uccuggguucaagcgauccuc

SEQ ID NO: 1012636 - RNA, 24 nt, Human
ucgcccaggcuggagugcaguggc

SEQ ID NO: 1012637 - RNA, 24 nt, Human
ucgcccaggcuggagugcaguggc

SEQ ID NO: 1012638 - RNA, 24 nt, Human
ucgcccaggcuggagugcaguggu

SEQ ID NO: 1012639 - RNA, 19 nt, Human
ucgcucccccagcucugcc

SEQ ID NO: 1012640 - RNA, 19 nt, Human
ucuaucacccaggcuggag

SEQ ID NO: 1012641 - RNA, 24 nt, Human
ucuaucacccaggcuggagugcag

SEQ ID NO: 1012642 - RNA, 19 nt, Human
ucucacuauauugcccagg

SEQ ID NO: 1012643 - RNA, 23 nt, Human
ucucacuauauugcccagguugg

SEQ ID NO: 1012644 - RNA, 22 nt, Human
ucucacuuugucgcccaggcug

SEQ ID NO: 1012645 - RNA, 23 nt, Human
ucucacuuugucgcccaggcugg

SEQ ID NO: 1012646 - RNA, 24 nt, Human
ucucacuuugucgcccaggcugga

SEQ ID NO: 1012647 - RNA, 21 nt, Human
ucucuacuaaaaauacaaaaa

SEQ ID NO: 1012648 - RNA, 24 nt, Human
ucugccucagccuccugaguagcu

SEQ ID NO: 1012649 - RNA, 19 nt, Human
ucuggcucugucgcccagg

SEQ ID NO: 1012650 - RNA, 23 nt, Human
ucuggcucugucgcccaggcugg

SEQ ID NO: 1012651 - RNA, 24 nt, Human
ucuggcucugucgcccaggcugga

SEQ ID NO: 1012652 - RNA, 24 nt, Human
ucugucgcccaggcuggagugcag

SEQ ID NO: 1012653 - RNA, 24 nt, Human
ucugucgcccaggcuggagugcag

SEQ ID NO: 1012654 - RNA, 19 nt, Human
ucuugcucuaucacccagg

SEQ ID NO: 1012655 - RNA, 23 nt, Human
ucuugcucuaucacccaggcugg

SEQ ID NO: 1012656 - RNA, 24 nt, Human
ucuugcucuaucacccaggcugga

SEQ ID NO: 1012657 - RNA, 23 nt, Human
ucuugcucugucgcccaggcugg

SEQ ID NO: 1012658 - RNA, 24 nt, Human
ucuugcucugucgcccaggcugga

SEQ ID NO: 1012659 - RNA, 24 nt, Human
ugaaaacaggagucauugucagcc

SEQ ID NO: 1012660 - RNA, 25 nt, Human
ugaacuccuggguucaagcgauccu

SEQ ID NO: 1012661 - RNA, 18 nt, Human
ugaccucaagugauccuc

SEQ ID NO: 1012662 - RNA, 20 nt, Human
ugaccucaagugauccuccu

SEQ ID NO: 1012663 - RNA, 21 nt, Human
ugaccucaagugauccuccug

SEQ ID NO: 1012664 - RNA, 24 nt, Human
ugaccucaagugauccuccugccu

SEQ ID NO: 1012665 - RNA, 24 nt, Human
ugacuugaggugauccaccugccu

SEQ ID NO: 1012666 - RNA, 23 nt, Human
ugagaccagccuggccaacaugg

SEQ ID NO: 1012667 - RNA, 24 nt, Human
ugagaccagccuggccaacauggu

SEQ ID NO: 1012668 - RNA, 22 nt, Human
ugagauggagucuugcucuguc

SEQ ID NO: 1012669 - RNA, 25 nt, Human
ugagcuaggugaggugacuggaggc

SEQ ID NO: 1012670 - RNA, 18 nt, Human
ugaggucaggaguuugag

SEQ ID NO: 1012671 - RNA, 22 nt, Human
ugcaguggugcgaucuuggcuc

SEQ ID NO: 1012672 - RNA, 24 nt, Human
ugcccagguuggucucaaacuccu

SEQ ID NO: 1012673 - RNA, 24 nt, Human
ugccucagccucccaaagugcugg

SEQ ID NO: 1012674 - RNA, 24 nt, Human
ugccucagccucccagagcgcugg

SEQ ID NO: 1012675 - RNA, 24 nt, Human
ugccucagccuccugaguagcugg

SEQ ID NO: 1012676 - RNA, 23 nt, Human
ugccuguaaucccagcuacuugg

SEQ ID NO: 1012677 - RNA, 24 nt, Human
ugccuguaaucccagcuacuuggg

SEQ ID NO: 1012678 - RNA, 22 nt, Human
ugcucuaucacccaggcuggag

SEQ ID NO: 1012679 - RNA, 24 nt, Human
ugcucuaucacccaggcuggagug

SEQ ID NO: 1012680 - RNA, 24 nt, Human
ugcucugucgcccaggcuggagug

SEQ ID NO: 1012681 - RNA, 22 nt, Human
ugcugggauuacaggcgugacc

SEQ ID NO: 1012682 - RNA, 21 nt, Human
uggaaccagccgggcguggug

SEQ ID NO: 1012683 - RNA, 18 nt, Human
uggaggaggggaggcugg

SEQ ID NO: 1012684 - RNA, 19 nt, Human
uggaggcuggagguggagg

SEQ ID NO: 1012685 - RNA, 23 nt, Human
uggagucuugcucugucgcccag

SEQ ID NO: 1012686 - RNA, 24 nt, Human
uggagucuugcucugucgcccagg

SEQ ID NO: 1012687 - RNA, 23 nt, Human
uggagugcaguggcgcgaucuca

SEQ ID NO: 1012688 - RNA, 24 nt, Human
uggagugcaguggcgcgaucucag

SEQ ID NO: 1012689 - RNA, 19 nt, Human
uggagugcaguggcgugau

SEQ ID NO: 1012690 - RNA, 19 nt, Human
uggagugcaguggcgugau

SEQ ID NO: 1012691 - RNA, 21 nt, Human
uggagugcaguggcgugauca

SEQ ID NO: 1012692 - RNA, 28 nt, Human
uggagugcaguggcgugauggcucuagc

SEQ ID NO: 1012693 - RNA, 18 nt, Human
uggagugcaguggugcaa

SEQ ID NO: 1012694 - RNA, 19 nt, Human
uggagugcaguggugcaau

SEQ ID NO: 1012695 - RNA, 21 nt, Human
uggagugcaguggugcaauca

SEQ ID NO: 1012696 - RNA, 23 nt, Human
uggagugcaguggugcgaucuug

SEQ ID NO: 1012697 - RNA, 24 nt, Human
uggagugcaguggugcgaucuugg

SEQ ID NO: 1012698 - RNA, 23 nt, Human
uggaucaccugaggucaggaguu

SEQ ID NO: 1012699 - RNA, 24 nt, Human
uggaucaccugaggucaggaguuu

SEQ ID NO: 1012700 - RNA, 27 nt, Human
uggaucaccugaggucaggaguuugag

SEQ ID NO: 1012701 - RNA, 24 nt, Human
uggccaacauggugaaaccccguc

SEQ ID NO: 1012702 - RNA, 24 nt, Human
uggccaggcuggucucgaacuccu

SEQ ID NO: 1012703 - RNA, 18 nt, Human
uggccucaagugauccuc

SEQ ID NO: 1012704 - RNA, 20 nt, Human
uggccucaagugauccuccu

SEQ ID NO: 1012705 - RNA, 24 nt, Human
uggccucaagugauccuccugucu

SEQ ID NO: 1012706 - RNA, 18 nt, Human
uggcgugaucauagcuca

SEQ ID NO: 1012707 - RNA, 24 nt, Human
uggcgugaucauagcucacugcag

SEQ ID NO: 1012708 - RNA, 24 nt, Human
uggcucaagccuauaaucccagua

SEQ ID NO: 1012709 - RNA, 24 nt, Human
uggcucugucgcccaggcuggagu

SEQ ID NO: 1012710 - RNA, 24 nt, Human
ugggaagcccaggcagguggauca

SEQ ID NO: 1012711 - RNA, 22 nt, Human
ugggacccuucacaggugucuu

SEQ ID NO: 1012712 - RNA, 21 nt, Human
ugggacuacagacgugcacca

SEQ ID NO: 1012713 - RNA, 24 nt, Human
ugggacuacagacgugcaccacca

SEQ ID NO: 1012714 - RNA, 21 nt, Human
ugggacuauaggcaugcgcca

SEQ ID NO: 1012715 - RNA, 22 nt, Human
ugggacuauaggcaugcgccac

SEQ ID NO: 1012716 - RNA, 24 nt, Human
ugggacuauaggcaugcgccacca

SEQ ID NO: 1012717 - RNA, 19 nt, Human
ugggaggcggaggcaggag

SEQ ID NO: 1012718 - RNA, 20 nt, Human
ugggaggcggaggcaggaga

SEQ ID NO: 1012719 - RNA, 22 nt, Human
ugggauccuuuuuuuuuuuuuu

SEQ ID NO: 1012720 - RNA, 21 nt, Human
ugggauuacagacaagagcca

SEQ ID NO: 1012721 - RNA, 22 nt, Human
ugggauuacagacaagagccac

SEQ ID NO: 1012722 - RNA, 22 nt, Human
ugggauuacagacaagagccac

SEQ ID NO: 1012723 - RNA, 23 nt, Human
ugggauuacagacaagagccacu

SEQ ID NO: 1012724 - RNA, 24 nt, Human
ugggauuacagacaagagccacug

SEQ ID NO: 1012725 - RNA, 18 nt, Human
ugggauuacaggcgugac

SEQ ID NO: 1012726 - RNA, 21 nt, Human
ugggauuacaggcgugaccca

SEQ ID NO: 1012727 - RNA, 22 nt, Human
ugggauuacaggcgugacccac

SEQ ID NO: 1012728 - RNA, 22 nt, Human
ugggauuacaggcgugacccac

SEQ ID NO: 1012729 - RNA, 23 nt, Human
ugggauuacaggcgugacccacg

SEQ ID NO: 1012730 - RNA, 24 nt, Human
ugggauuacaggcgugacccacgg

SEQ ID NO: 1012731 - RNA, 19 nt, Human
ugggauuacaggcgugugc

SEQ ID NO: 1012732 - RNA, 24 nt, Human
ugggauuacaggcgugugcaacca

SEQ ID NO: 1012733 - RNA, 20 nt, Human
ugggcucaagugauccuccu

SEQ ID NO: 1012734 - RNA, 20 nt, Human
ugggggaaaacuggcuuccu

SEQ ID NO: 1012735 - RNA, 19 nt, Human
uggggucuugcucuaucac

SEQ ID NO: 1012736 - RNA, 24 nt, Human
ugggguuucaccauguuggccagg

SEQ ID NO: 1012737 - RNA, 19 nt, Human
uggguucaagcgauccucc

SEQ ID NO: 1012738 - RNA, 23 nt, Human
uggguucaagcgauccuccuacc

SEQ ID NO: 1012739 - RNA, 24 nt, Human
uggugcaaucauagcucacugcag

SEQ ID NO: 1012740 - RNA, 21 nt, Human
uggugcaugccuguaauccca

SEQ ID NO: 1012741 - RNA, 22 nt, Human
uggugcaugccuguaaucccag

SEQ ID NO: 1012742 - RNA, 24 nt, Human
ugguggcucaagccuauaauccca

SEQ ID NO: 1012743 - RNA, 24 nt, Human
ugguggugcaugccuguaauccca

SEQ ID NO: 1012744 - RNA, 24 nt, Human
uguagagacagggucuuacugugu

SEQ ID NO: 1012745 - RNA, 21 nt, Human
ugucgcccaggcuggagugca

SEQ ID NO: 1012746 - RNA, 20 nt, Human
ugucucagccuuuccaagug

SEQ ID NO: 1012747 - RNA, 18 nt, Human
ugugggcaacaggugccc

SEQ ID NO: 1012748 - RNA, 18 nt, Human
uuaguagagaugggguuu

SEQ ID NO: 1012749 - RNA, 22 nt, Human
uuaguagagaugggguuucacc

SEQ ID NO: 1012750 - RNA, 24 nt, Human
uuaguagagaugggguuucaccau

SEQ ID NO: 1012751 - RNA, 24 nt, Human
uucaagcgauccuccuaccucaac

SEQ ID NO: 1012752 - RNA, 23 nt, Human
uucaagcgauucuucugccucag

SEQ ID NO: 1012753 - RNA, 24 nt, Human
uucaagcgauucuucugccucagc

SEQ ID NO: 1012754 - RNA, 18 nt, Human
uucuccugcaucuuacuc

SEQ ID NO: 1012755 - RNA, 21 nt, Human
uugagauggagucuugcucug

SEQ ID NO: 1012756 - RNA, 23 nt, Human
uugaggugauccaccugccucag

SEQ ID NO: 1012757 - RNA, 24 nt, Human
uugcucuaucacccaggcuggagu

SEQ ID NO: 1012758 - RNA, 24 nt, Human
uugcucugucgcccaggcuggagu

SEQ ID NO: 1012759 - RNA, 24 nt, Human
uugcuugaaccugagaggcggagg

SEQ ID NO: 1012760 - RNA, 24 nt, Human
uuguagaaauagggucucacuaua

SEQ ID NO: 1012761 - RNA, 23 nt, Human
uuguuuucagagauagggucugg

SEQ ID NO: 1012762 - RNA, 24 nt, Human
uuucaccauguuggccaggcuggu

SEQ ID NO: 1012763 - RNA, 20 nt, Human
uuucuguauuuuuaguagag

SEQ ID NO: 1012764 - RNA, 23 nt, Human
uuuguagagacagggucuuacug

SEQ ID NO: 1012765 - RNA, 24 nt, Human
uuuguagagacagggucuuacugu

SEQ ID NO: 1012766 - RNA, 24 nt, Human
uuuuuaguagagaugggguuucac

SEQ ID NO: 1012767 - RNA, 25 nt, Human
uuuuuggagacagagucucacuuug

SEQ ID NO: 1012768 - RNA, 18 nt, Human
uuuuuuuguagagacagg

SEQ ID NO: 1012769 - RNA, 24 nt, Human
uuuuuuuuuuuugaguuggggucu

SEQ ID NO: 1012770 - RNA, 27 nt, Human
uuuuuuuuuuuuggagacagagucuca

SEQ ID NO: 1012771 - RNA, 18 nt, Human
uuuuuuuuuuuuuuuuug

SEQ ID NO: 1012772 - RNA, 19 nt, Human
aagaguccccuugcgagug

SEQ ID NO: 1012773 - RNA, 18 nt, Human
acucugguaaugauuugg

SEQ ID NO: 1012774 - RNA, 22 nt, Human
gccgggcugaggagacugcugg

SEQ ID NO: 1012775 - RNA, 19 nt, Human
gucugcuuuaccacucugg

SEQ ID NO: 1012776 - RNA, 22 nt, Human
ugcuuuaccacucugguaauga

SEQ ID NO: 1012777 - RNA, 21 nt, Human
uggccggagcggaacgccgga

SEQ ID NO: 1012778 - RNA, 25 nt, Human
uggccggagcggaacgccggaaacc

SEQ ID NO: 1012779 - RNA, 19 nt, Human
ugugcacauggguaaucug

SEQ ID NO: 1012780 - RNA, 18 nt, Human
uguuaaaaaaauagcuuc

SEQ ID NO: 1012781 - RNA, 18 nt, Human
uuuuuuuuuuuuuuuuug

SEQ ID NO: 1012782 - RNA, 20 nt, Human
uuuuuuuuuuuuuuuuuguu

SEQ ID NO: 1012783 - RNA, 19 nt, Human
aaguuuguauagagaaugu

SEQ ID NO: 1012784 - RNA, 24 nt, Human
acaacacgaagcuccugccuuuua

SEQ ID NO: 1012785 - RNA, 19 nt, Human
agcagacccacaacacgaa

SEQ ID NO: 1012786 - RNA, 23 nt, Human
caaagaggcagcucaaaauuaga

SEQ ID NO: 1012787 - RNA, 24 nt, Human
cagcucaaaauuagacugcacagg

SEQ ID NO: 1012788 - RNA, 22 nt, Human
cuccugccuuuuaagacuacaa

SEQ ID NO: 1012789 - RNA, 24 nt, Human
cuuucugcaucugcaucuauguaa

SEQ ID NO: 1012790 - RNA, 21 nt, Human
ugccuucugcccuccggucuc

SEQ ID NO: 1012791 - RNA, 21 nt, Human
acagcagcagggccgacagga

SEQ ID NO: 1012792 - RNA, 24 nt, Human
accauggucaucaccccagcccug

SEQ ID NO: 1012793 - RNA, 23 nt, Human
acccaucuuguccccgccgcccu

SEQ ID NO: 1012794 - RNA, 18 nt, Human
acgaggcuggaguaagag

SEQ ID NO: 1012795 - RNA, 18 nt, Human
agaacagacaccgccccu

SEQ ID NO: 1012796 - RNA, 21 nt, Human
agccugcaggacaagggccug

SEQ ID NO: 1012797 - RNA, 18 nt, Human
aggacaagggccuggaau

SEQ ID NO: 1012798 - RNA, 22 nt, Human
aggcuggaguaagagggguggg

SEQ ID NO: 1012799 - RNA, 24 nt, Human
cacacagcgauucagaacagacac

SEQ ID NO: 1012800 - RNA, 20 nt, Human
caccaggcgaccauugccau

SEQ ID NO: 1012801 - RNA, 22 nt, Human
caccgccccuccccagucgcca

SEQ ID NO: 1012802 - RNA, 19 nt, Human
cagacaccgccccucccca

SEQ ID NO: 1012803 - RNA, 18 nt, Human
cagcagcagggccgacag

SEQ ID NO: 1012804 - RNA, 21 nt, Human
cagcgauucagaacagacacc

SEQ ID NO: 1012805 - RNA, 18 nt, Human
caucaccccagcccugcc

SEQ ID NO: 1012806 - RNA, 21 nt, Human
ccauagacaucgagucccucc

SEQ ID NO: 1012807 - RNA, 23 nt, Human
cccagcccugcccuuccugggca

SEQ ID NO: 1012808 - RNA, 22 nt, Human
ccccgccgcccuccgccuuccc

SEQ ID NO: 1012809 - RNA, 21 nt, Human
ccccggccuccuccucuggcg

SEQ ID NO: 1012810 - RNA, 23 nt, Human
cccgcugcccucugcccuguccg

SEQ ID NO: 1012811 - RNA, 22 nt, Human
cccgggugacacacagcgauuc

SEQ ID NO: 1012812 - RNA, 19 nt, Human
cccuccgccuucccuucuc

SEQ ID NO: 1012813 - RNA, 18 nt, Human
cccugcccuuccugggca

SEQ ID NO: 1012814 - RNA, 22 nt, Human
ccggagaugucacgaacuccca

SEQ ID NO: 1012815 - RNA, 19 nt, Human
ccuggagcugcccgcugcc

SEQ ID NO: 1012816 - RNA, 18 nt, Human
ccuugcuugacauucucc

SEQ ID NO: 1012817 - RNA, 18 nt, Human
cugcccucugcccugucc

SEQ ID NO: 1012818 - RNA, 19 nt, Human
cugucgccgguuccuucug

SEQ ID NO: 1012819 - RNA, 19 nt, Human
gaacagacaccgccccucc

SEQ ID NO: 1012820 - RNA, 23 nt, Human
gacaagggccuggaaugugagcc

SEQ ID NO: 1012821 - RNA, 22 nt, Human
gagcugcccgcugcccucugcc

SEQ ID NO: 1012822 - RNA, 20 nt, Human
gccgcccuccgccuucccuu

SEQ ID NO: 1012823 - RNA, 24 nt, Human
ggagcugcccgcugcccucugccc

SEQ ID NO: 1012824 - RNA, 29 nt, Human
uagcaacgccccucccccgccuagcauuc

SEQ ID NO: 1012825 - RNA, 21 nt, Human
uccuggagcugcccgcugccc

SEQ ID NO: 1012826 - RNA, 22 nt, Human
uccuugcuugacauucuccacc

SEQ ID NO: 1012827 - RNA, 26 nt, Human
ucgccauagcaacgccccucccccgc

SEQ ID NO: 1012828 - RNA, 20 nt, Human
ucgccgguuccuucugucuc

SEQ ID NO: 1012829 - RNA, 21 nt, Human
ucgccgguuccuucugucucu

SEQ ID NO: 1012830 - RNA, 19 nt, Human
ucugucucuccucccuuuc

SEQ ID NO: 1012831 - RNA, 23 nt, Human
ucuugaggccccccggagcggcc

SEQ ID NO: 1012832 - RNA, 21 nt, Human
ugccuccgguucuugaggccc

SEQ ID NO: 1012833 - RNA, 20 nt, Human
uggaguaagaggggugggau

SEQ ID NO: 1012834 - RNA, 18 nt, Human
ugggcagcgcccggguga

SEQ ID NO: 1012835 - RNA, 21 nt, Human
ugucacgaacucccacccggg

SEQ ID NO: 1012836 - RNA, 23 nt, Human
uugacauucuccacccaucuugu

SEQ ID NO: 1012837 - RNA, 21 nt, Human
uuucucaggcuccaggcaaga

SEQ ID NO: 1012838 - RNA, 26 nt, Human
aaaacccgaacacgacacagaacuga

SEQ ID NO: 1012839 - RNA, 23 nt, Human
aaacagacuagcaccacugugac

SEQ ID NO: 1012840 - RNA, 19 nt, Human
acagaggaaaaacccgaac

SEQ ID NO: 1012841 - RNA, 21 nt, Human
aggccugggcuggugggggcc

SEQ ID NO: 1012842 - RNA, 21 nt, Human
cacgacacagaacugaggaga

SEQ ID NO: 1012843 - RNA, 22 nt, Human
cacgagacaccaagacggccca

SEQ ID NO: 1012844 - RNA, 18 nt, Human
cccgaacacgacacagaa

SEQ ID NO: 1012845 - RNA, 24 nt, Human
cccgaacacgacacagaacugagg

SEQ ID NO: 1012846 - RNA, 18 nt, Human
ccucgggccggggucucc

SEQ ID NO: 1012847 - RNA, 21 nt, Human
cggcccagucacagaggaaaa

SEQ ID NO: 1012848 - RNA, 18 nt, Human
cuagcaccacugugacgc

SEQ ID NO: 1012849 - RNA, 19 nt, Human
gaaaaacccgaacacgaca

SEQ ID NO: 1012850 - RNA, 23 nt, Human
gacacagaacugaggagagucca

SEQ ID NO: 1012851 - RNA, 22 nt, Human
gaggaaaaacccgaacacgaca

SEQ ID NO: 1012852 - RNA, 22 nt, Human
gcgggcccugguugcugggagg

SEQ ID NO: 1012853 - RNA, 18 nt, Human
ggccggggucuccgggcc

SEQ ID NO: 1012854 - RNA, 18 nt, Human
ggccugggcugguggggg

SEQ ID NO: 1012855 - RNA, 22 nt, Human
guccaggccugggcuggugggg

SEQ ID NO: 1012856 - RNA, 18 nt, Human
ugaggagaguccaggccu

SEQ ID NO: 1012857 - RNA, 21 nt, Human
ugaggagaguccaggccuggg

SEQ ID NO: 1012858 - RNA, 21 nt, Human
uggugggggccacacccgcgg

SEQ ID NO: 1012859 - RNA, 22 nt, Human
ugguugcugggaggcauggggc

SEQ ID NO: 1012860 - RNA, 23 nt, Human
uugcugggaggcauggggcucag

SEQ ID NO: 1012861 - RNA, 23 nt, Human
aacauggauggaccuggaggcca

SEQ ID NO: 1012862 - RNA, 20 nt, Human
aaccaggcaguccaguacuu

SEQ ID NO: 1012863 - RNA, 23 nt, Human
aagugacauaaauccauaaaaau

SEQ ID NO: 1012864 - RNA, 22 nt, Human
agacggaaucagcagcacggcu

SEQ ID NO: 1012865 - RNA, 19 nt, Human
auuugggugaggguauacu

SEQ ID NO: 1012866 - RNA, 24 nt, Human
cacuagagccuucaaaggugggaa

SEQ ID NO: 1012867 - RNA, 22 nt, Human
cagcaaaaugaagauaaacgca

SEQ ID NO: 1012868 - RNA, 22 nt, Human
cauaaaaauuacaaaaaguugc

SEQ ID NO: 1012869 - RNA, 22 nt, Human
ccagauuucaccacuaugcaau

SEQ ID NO: 1012870 - RNA, 20 nt, Human
ccuucaaaggugggaguggg

SEQ ID NO: 1012871 - RNA, 21 nt, Human
cuugagaaauacuguuagaag

SEQ ID NO: 1012872 - RNA, 21 nt, Human
gauggaccuggaggccauuaa

SEQ ID NO: 1012873 - RNA, 24 nt, Human
ggagauaaacaauguguacacccc

SEQ ID NO: 1012874 - RNA, 20 nt, Human
gggaguggggugagagaugg

SEQ ID NO: 1012875 - RNA, 22 nt, Human
guacaguuuugaaagcuuaaag

SEQ ID NO: 1012876 - RNA, 21 nt, Human
uacaaaaaguugcucaaaaaa

SEQ ID NO: 1012877 - RNA, 20 nt, Human
uacagaaagucaaaaaccac

SEQ ID NO: 1012878 - RNA, 18 nt, Human
uaccaaacugccaaaauu

SEQ ID NO: 1012879 - RNA, 23 nt, Human
uagguacaauguauacuauuugg

SEQ ID NO: 1012880 - RNA, 18 nt, Human
ucaaaggugggagugggg

SEQ ID NO: 1012881 - RNA, 22 nt, Human
ucccaaaauuuaacaauagaca

SEQ ID NO: 1012882 - RNA, 19 nt, Human
ucugaagcuccaaguuagc

SEQ ID NO: 1012883 - RNA, 21 nt, Human
ucuuaucuuuugcaacaacau

SEQ ID NO: 1012884 - RNA, 23 nt, Human
ugaaguaaugauacagaaaguca

SEQ ID NO: 1012885 - RNA, 18 nt, Human
ugccaaaauuaaaagaaa

SEQ ID NO: 1012886 - RNA, 18 nt, Human
uggaggccauuaagugaa

SEQ ID NO: 1012887 - RNA, 18 nt, Human
ugggaguggggugagaga

SEQ ID NO: 1012888 - RNA, 21 nt, Human
ugugagacggaaucagcagca

SEQ ID NO: 1012889 - RNA, 25 nt, Human
aaacacaacagcacguucaccaaac

SEQ ID NO: 1012890 - RNA, 20 nt, Human
aaacauuaaagguguacgcu

SEQ ID NO: 1012891 - RNA, 25 nt, Human
aaacuacuaaauagacuaucauuua

SEQ ID NO: 1012892 - RNA, 21 nt, Human
aacacacauauguacacagga

SEQ ID NO: 1012893 - RNA, 21 nt, Human
aacagcacguucaccaaacaa

SEQ ID NO: 1012894 - RNA, 19 nt, Human
aacauuaaagguguacgcu

SEQ ID NO: 1012895 - RNA, 20 nt, Human
aaccaaacaaccccucacaa

SEQ ID NO: 1012896 - RNA, 23 nt, Human
aaccaaacaaccccucacaagua

SEQ ID NO: 1012897 - RNA, 19 nt, Human
aaccgcuggcuuuccccug

SEQ ID NO: 1012898 - RNA, 21 nt, Human
aaccuaaacuuuuaagacuaa

SEQ ID NO: 1012899 - RNA, 19 nt, Human
aacuacuaaauagacuauc

SEQ ID NO: 1012900 - RNA, 21 nt, Human
aagcaacaagagcguucccag

SEQ ID NO: 1012901 - RNA, 24 nt, Human
aagcaagagaugagcacuucagaa

SEQ ID NO: 1012902 - RNA, 27 nt, Human
aagcugggaugaaguuugggacugugg

SEQ ID NO: 1012903 - RNA, 23 nt, Human
aauuucauaacugacauaugcca

SEQ ID NO: 1012904 - RNA, 18 nt, Human
accccaggguuuugcagc

SEQ ID NO: 1012905 - RNA, 23 nt, Human
acuggggugggcaggccccuggg

SEQ ID NO: 1012906 - RNA, 18 nt, Human
agaagaaaguggucuagu

SEQ ID NO: 1012907 - RNA, 26 nt, Human
agagauuaguuacagugacuggauaa

SEQ ID NO: 1012908 - RNA, 23 nt, Human
agcaacaagagcguucccaggaa

SEQ ID NO: 1012909 - RNA, 21 nt, Human
aggcaaccaaacaaccccuca

SEQ ID NO: 1012910 - RNA, 18 nt, Human
aggccuacccacgcuugu

SEQ ID NO: 1012911 - RNA, 23 nt, Human
aguggaaucauuaagaaaugucu

SEQ ID NO: 1012912 - RNA, 20 nt, Human
auacaauguacaugcaugug

SEQ ID NO: 1012913 - RNA, 20 nt, Human
auauguacacaggaacauuc

SEQ ID NO: 1012914 - RNA, 20 nt, Human
augaaguuugggacuguggc

SEQ ID NO: 1012915 - RNA, 25 nt, Human
augaccucaacacccagugucagaa

SEQ ID NO: 1012916 - RNA, 23 nt, Human
caaccuaaacuuuuaagacuaaa

SEQ ID NO: 1012917 - RNA, 21 nt, Human
caaugaagccacauaugucuc

SEQ ID NO: 1012918 - RNA, 24 nt, Human
cacauccugcagagcaugugugcg

SEQ ID NO: 1012919 - RNA, 21 nt, Human
cacuggggugggcaggccccu

SEQ ID NO: 1012920 - RNA, 21 nt, Human
cagaacggccagauucaagca

SEQ ID NO: 1012921 - RNA, 20 nt, Human
cagugccaguaaaaucaaua

SEQ ID NO: 1012922 - RNA, 20 nt, Human
ccaacuaaccaaccaaucaa

SEQ ID NO: 1012923 - RNA, 24 nt, Human
ccacacauaugggaacuacaggau

SEQ ID NO: 1012924 - RNA, 19 nt, Human
ccacuggauggcacugggg

SEQ ID NO: 1012925 - RNA, 21 nt, Human
ccaucucuggcagggaaaaac

SEQ ID NO: 1012926 - RNA, 23 nt, Human
ccaucucuggcagggaaaaacua

SEQ ID NO: 1012927 - RNA, 18 nt, Human
cccacuggaaaacaaagu

SEQ ID NO: 1012928 - RNA, 23 nt, Human
cccaggaaccgcuggcuuucccc

SEQ ID NO: 1012929 - RNA, 24 nt, Human
ccucacaaguauauacagaucaag

SEQ ID NO: 1012930 - RNA, 18 nt, Human
ccucugggcccccuggcu

SEQ ID NO: 1012931 - RNA, 19 nt, Human
cgucaauggaaauaacauc

SEQ ID NO: 1012932 - RNA, 25 nt, Human
cuaccgcucucacaccucuuuccug

SEQ ID NO: 1012933 - RNA, 20 nt, Human
cuccucugggcccccuggcu

SEQ ID NO: 1012934 - RNA, 21 nt, Human
gcacuggggugggcaggcccc

SEQ ID NO: 1012935 - RNA, 20 nt, Human
gccacaugaccucaacaccc

SEQ ID NO: 1012936 - RNA, 19 nt, Human
gcuagaaccagcacaaucu

SEQ ID NO: 1012937 - RNA, 21 nt, Human
ggaaggacagagcaacaucgg

SEQ ID NO: 1012938 - RNA, 22 nt, Human
gggaaaaacuaccuggugacag

SEQ ID NO: 1012939 - RNA, 20 nt, Human
gucacggcggcaggcagcag

SEQ ID NO: 1012940 - RNA, 20 nt, Human
uaaaacgcagucacggcggc

SEQ ID NO: 1012941 - RNA, 25 nt, Human
uaaaugauuuugcccaacuaaccaa

SEQ ID NO: 1012942 - RNA, 22 nt, Human
uaaauuaccaaugaagccacau

SEQ ID NO: 1012943 - RNA, 26 nt, Human
uaaguggaaucauuaaggguguauaa

SEQ ID NO: 1012944 - RNA, 23 nt, Human
uacauuuaccucaucauuccaaa

SEQ ID NO: 1012945 - RNA, 22 nt, Human
uacgcugggaugacaaugcaga

SEQ ID NO: 1012946 - RNA, 20 nt, Human
uacuggccuugguugccugu

SEQ ID NO: 1012947 - RNA, 22 nt, Human
uagccaaggagagauuuauguu

SEQ ID NO: 1012948 - RNA, 19 nt, Human
uagcuaaacccuaggaaau

SEQ ID NO: 1012949 - RNA, 21 nt, Human
uauuaugagcuagaaccagca

SEQ ID NO: 1012950 - RNA, 19 nt, Human
ucaaacaucguccacccca

SEQ ID NO: 1012951 - RNA, 27 nt, Human
ucaacacccagugucagaacggccaga

SEQ ID NO: 1012952 - RNA, 19 nt, Human
ucaaccuucguggcggggg

SEQ ID NO: 1012953 - RNA, 19 nt, Human
ucaguaguaguuugaaggc

SEQ ID NO: 1012954 - RNA, 28 nt, Human
ucccaggaaccgcuggcuuuccccugcc

SEQ ID NO: 1012955 - RNA, 23 nt, Human
ucuaaaaccaaggaacaguauag

SEQ ID NO: 1012956 - RNA, 22 nt, Human
ugaaauaaccaauguuuguucc

SEQ ID NO: 1012957 - RNA, 21 nt, Human
ugcccaacuaaccaaccaauc

SEQ ID NO: 1012958 - RNA, 22 nt, Human
ugccccugagaagcaugcacug

SEQ ID NO: 1012959 - RNA, 21 nt, Human
ugcggcaggcugccuaccgcu

SEQ ID NO: 1012960 - RNA, 20 nt, Human
uggaaaacuauuuucuacaa

SEQ ID NO: 1012961 - RNA, 18 nt, Human
uggaaucauuaagaaaug

SEQ ID NO: 1012962 - RNA, 20 nt, Human
uggcacgagcggguucugcc

SEQ ID NO: 1012963 - RNA, 18 nt, Human
ugggaacuacaggauugc

SEQ ID NO: 1012964 - RNA, 19 nt, Human
ugggaacuacaggauugca

SEQ ID NO: 1012965 - RNA, 20 nt, Human
uggugugaggaaggacagag

SEQ ID NO: 1012966 - RNA, 21 nt, Human
uggugugaggaaggacagagc

SEQ ID NO: 1012967 - RNA, 23 nt, Human
uguacacagggaguucaaucauc

SEQ ID NO: 1012968 - RNA, 22 nt, Human
uguguacauaauuaaucaugaa

SEQ ID NO: 1012969 - RNA, 26 nt, Human
uguuuuauuuaacacacauauguaca

SEQ ID NO: 1012970 - RNA, 19 nt, Human
uuacauuucucuagcuaug

SEQ ID NO: 1012971 - RNA, 20 nt, Human
uuagaagcauaaugaacacc

SEQ ID NO: 1012972 - RNA, 19 nt, Human
uugcuccucugggcccccu

SEQ ID NO: 1012973 - RNA, 23 nt, Human
aaaaaaacccaacagcacuuggg

SEQ ID NO: 1012974 - RNA, 24 nt, Human
aaaaauauauauucccugaauuag

SEQ ID NO: 1012975 - RNA, 19 nt, Human
aaaauauauauucccugaa

SEQ ID NO: 1012976 - RNA, 27 nt, Human
aaacaugcacucaaaucauuaaaaaua

SEQ ID NO: 1012977 - RNA, 25 nt, Human
aaaccaggagaucuuggacagaaga

SEQ ID NO: 1012978 - RNA, 19 nt, Human
aagaaaaaaaaaaaagugg

SEQ ID NO: 1012979 - RNA, 21 nt, Human
aagaagaaaaaaacccaacag

SEQ ID NO: 1012980 - RNA, 20 nt, Human
aagauuauggaagagcaaga

SEQ ID NO: 1012981 - RNA, 23 nt, Human
acaaagaccagcaagugcaaaua

SEQ ID NO: 1012982 - RNA, 21 nt, Human
agaaaaaaaaaaaagugguag

SEQ ID NO: 1012983 - RNA, 19 nt, Human
agaaaccauuucaaugaaa

SEQ ID NO: 1012984 - RNA, 18 nt, Human
agaauuccccagagcaca

SEQ ID NO: 1012985 - RNA, 23 nt, Human
agccaggggaagaaaaaaaaaaa

SEQ ID NO: 1012986 - RNA, 19 nt, Human
agcugacugggaggaaccc

SEQ ID NO: 1012987 - RNA, 19 nt, Human
aggaaaagccgugauagua

SEQ ID NO: 1012988 - RNA, 18 nt, Human
aggggaagaaaaaaaaaa

SEQ ID NO: 1012989 - RNA, 22 nt, Human
agucuuauagcaggccauuugu

SEQ ID NO: 1012990 - RNA, 20 nt, Human
agugcacaauuuaaaagaaa

SEQ ID NO: 1012991 - RNA, 24 nt, Human
auaaucaguaucuccagcugaaau

SEQ ID NO: 1012992 - RNA, 18 nt, Human
auggaagagcaagauuuu

SEQ ID NO: 1012993 - RNA, 23 nt, Human
augucuguacaagagcugacugg

SEQ ID NO: 1012994 - RNA, 24 nt, Human
caaauucagaaaauaacugcauga

SEQ ID NO: 1012995 - RNA, 23 nt, Human
caauggacuuucucuaauugccu

SEQ ID NO: 1012996 - RNA, 18 nt, Human
cacaugucuguacaagag

SEQ ID NO: 1012997 - RNA, 21 nt, Human
cagaaaauaacugcaugacac

SEQ ID NO: 1012998 - RNA, 23 nt, Human
cagaauuccccagagcacauguc

SEQ ID NO: 1012999 - RNA, 24 nt, Human
caugacaccauaguugucgugguc

SEQ ID NO: 1013000 - RNA, 23 nt, Human
cauucuacucaaguagccagggg

SEQ ID NO: 1013001 - RNA, 22 nt, Human
ccaccucuccaccuacagacuc

SEQ ID NO: 1013002 - RNA, 21 nt, Human
ccagagcacaugucuguacaa

SEQ ID NO: 1013003 - RNA, 22 nt, Human
ccuacagacucugcaauuuauu

SEQ ID NO: 1013004 - RNA, 24 nt, Human
ccucuccaccuacagacucugcaa

SEQ ID NO: 1013005 - RNA, 25 nt, Human
ccugugcugaaugcugcuacaaaga

SEQ ID NO: 1013006 - RNA, 22 nt, Human
ccuuuggaaaaaugccugauuu

SEQ ID NO: 1013007 - RNA, 22 nt, Human
cgcggggcgggaggcgggagcg

SEQ ID NO: 1013008 - RNA, 19 nt, Human
cuccaaagaugccaauaag

SEQ ID NO: 1013009 - RNA, 21 nt, Human
cugaaugcugcuacaaagacc

SEQ ID NO: 1013010 - RNA, 20 nt, Human
cugguccuagagguuuaaaa

SEQ ID NO: 1013011 - RNA, 22 nt, Human
cuuuuagcccuguacacucuau

SEQ ID NO: 1013012 - RNA, 20 nt, Human
gaaucaugucuucaaggccu

SEQ ID NO: 1013013 - RNA, 21 nt, Human
gcacucaaaucauuaaaaaua

SEQ ID NO: 1013014 - RNA, 21 nt, Human
gcgcggggcgggaggcgggag

SEQ ID NO: 1013015 - RNA, 22 nt, Human
gcgcggggcgggaggcgggagc

SEQ ID NO: 1013016 - RNA, 18 nt, Human
gggaagaaaaaaaaaaaa

SEQ ID NO: 1013017 - RNA, 19 nt, Human
uaaaacaaagagauggaga

SEQ ID NO: 1013018 - RNA, 24 nt, Human
uaaagaacacacuucuaaaucuaa

SEQ ID NO: 1013019 - RNA, 23 nt, Human
uaacugauuaagaccugccucuu

SEQ ID NO: 1013020 - RNA, 19 nt, Human
uaacugcaugacacuugcu

SEQ ID NO: 1013021 - RNA, 20 nt, Human
uaagaagaaaaaaacccaac

SEQ ID NO: 1013022 - RNA, 19 nt, Human
uaccagcacuuuauaaauu

SEQ ID NO: 1013023 - RNA, 19 nt, Human
uagaaaccauuucaaugaa

SEQ ID NO: 1013024 - RNA, 24 nt, Human
uagccaggggaagaaaaaaaaaaa

SEQ ID NO: 1013025 - RNA, 21 nt, Human
uauagaacagggguuagaaac

SEQ ID NO: 1013026 - RNA, 18 nt, Human
uauauagcauuuuguuag

SEQ ID NO: 1013027 - RNA, 24 nt, Human
uauguagucaaauacugucaaaau

SEQ ID NO: 1013028 - RNA, 23 nt, Human
uauuuccaacacucuacuucaga

SEQ ID NO: 1013029 - RNA, 22 nt, Human
ucaaauacugucaaaauagauc

SEQ ID NO: 1013030 - RNA, 21 nt, Human
ucagaaaauaacugcaugaca

SEQ ID NO: 1013031 - RNA, 18 nt, Human
ucccugaauuguaagaca

SEQ ID NO: 1013032 - RNA, 22 nt, Human
ucccugaauuguaagacaaaaa

SEQ ID NO: 1013033 - RNA, 25 nt, Human
uccuccaaagaugccaauaagggag

SEQ ID NO: 1013034 - RNA, 18 nt, Human
ucuuuccaccucuccacc

SEQ ID NO: 1013035 - RNA, 22 nt, Human
ugacaaauucagaaaauaacug

SEQ ID NO: 1013036 - RNA, 21 nt, Human
uggaaaggaauaguagucuua

SEQ ID NO: 1013037 - RNA, 23 nt, Human
uguaacuacuauagaacaggggu

SEQ ID NO: 1013038 - RNA, 23 nt, Human
uguaccaauuguuuucagaugcc

SEQ ID NO: 1013039 - RNA, 22 nt, Human
uguagucaaauacugucaaaau

SEQ ID NO: 1013040 - RNA, 23 nt, Human
ugucaaaauagaucugcccccaa

SEQ ID NO: 1013041 - RNA, 22 nt, Human
uuagugcacaauuuaaaagaaa

SEQ ID NO: 1013042 - RNA, 26 nt, Human
uuauauucuuccucuaaggaaucaug

SEQ ID NO: 1013043 - RNA, 21 nt, Human
uuguguaccaauuguuuucag

SEQ ID NO: 1013044 - RNA, 23 nt, Human
uuuagaaaauuccuccaaagaug

SEQ ID NO: 1013045 - RNA, 20 nt, Human
uuuccaccucuccaccuaca

SEQ ID NO: 1013046 - RNA, 19 nt, Human
uuuugaaauuuguucacuu

SEQ ID NO: 1013047 - RNA, 21 nt, Human
aagagggaauacagagucccg

SEQ ID NO: 1013048 - RNA, 21 nt, Human
aagagggaauacagagucccg

SEQ ID NO: 1013049 - RNA, 22 nt, Human
acugcucagccuggugguggcu

SEQ ID NO: 1013050 - RNA, 22 nt, Human
acugcucagccuggugguggcu

SEQ ID NO: 1013051 - RNA, 20 nt, Human
agaguggaagagauugacug

SEQ ID NO: 1013052 - RNA, 25 nt, Human
agccauugcggcagcauuucaucug

SEQ ID NO: 1013053 - RNA, 27 nt, Human
agccauugcggcagcauuucaucuggc

SEQ ID NO: 1013054 - RNA, 20 nt, Human
agccuggugguggcuggacc

SEQ ID NO: 1013055 - RNA, 20 nt, Human
aguggaagagauugacugaa

SEQ ID NO: 1013056 - RNA, 22 nt, Human
caagagggaauacagagucccg

SEQ ID NO: 1013057 - RNA, 20 nt, Human
cacugcucagccugguggug

SEQ ID NO: 1013058 - RNA, 20 nt, Human
cacugcucagccugguggug

SEQ ID NO: 1013059 - RNA, 20 nt, Human
cagcccaagagggaauacag

SEQ ID NO: 1013060 - RNA, 20 nt, Human
cagcccaagagggaauacag

SEQ ID NO: 1013061 - RNA, 25 nt, Human
cccuccuuaucuuugagagaguccc

SEQ ID NO: 1013062 - RNA, 19 nt, Human
ccugggggcaggaacccuc

SEQ ID NO: 1013063 - RNA, 24 nt, Human
cgaagggcgauacaguguccaggg

SEQ ID NO: 1013064 - RNA, 22 nt, Human
gaaagggagaagcuguggucag

SEQ ID NO: 1013065 - RNA, 22 nt, Human
gaaagggagaagcuguggucag

SEQ ID NO: 1013066 - RNA, 18 nt, Human
gggaaagggagaagcugu

SEQ ID NO: 1013067 - RNA, 18 nt, Human
gggaaagggagaagcugu

SEQ ID NO: 1013068 - RNA, 27 nt, Human
gggaaaguuaauguucaccugggggca

SEQ ID NO: 1013069 - RNA, 19 nt, Human
ggggagggcaggugggcug

SEQ ID NO: 1013070 - RNA, 19 nt, Human
ggggagggcaggugggcug

SEQ ID NO: 1013071 - RNA, 18 nt, Human
gguugggaaagggagaag

SEQ ID NO: 1013072 - RNA, 18 nt, Human
gguugggaaagggagaag

SEQ ID NO: 1013073 - RNA, 22 nt, Human
gugacacaggacaccuucccac

SEQ ID NO: 1013074 - RNA, 20 nt, Human
uacuuuauugguugggaaag

SEQ ID NO: 1013075 - RNA, 20 nt, Human
uacuuuauugguugggaaag

SEQ ID NO: 1013076 - RNA, 19 nt, Human
ugaaagacgacgaagggcg

SEQ ID NO: 1013077 - RNA, 20 nt, Human
ugguggcuggaccucagaaa

SEQ ID NO: 1013078 - RNA, 21 nt, Human
ugguggcuggaccucagaaau

SEQ ID NO: 1013079 - RNA, 23 nt, Human
uguucaccugggggcaggaaccc

SEQ ID NO: 1013080 - RNA, 22 nt, Human
uuucucuccucacugcucagcc

SEQ ID NO: 1013081 - RNA, 22 nt, Human
uuucucuccucacugcucagcc

SEQ ID NO: 1013082 - RNA, 19 nt, Human
uuuuuuuuuuuuuuuugcu

SEQ ID NO: 1013083 - RNA, 22 nt, Human
acaguccaguugggguucaugg

SEQ ID NO: 1013084 - RNA, 23 nt, Human
agacaaaucagcacagcuagggc

SEQ ID NO: 1013085 - RNA, 22 nt, Human
agcggcaggaggagaagcagag

SEQ ID NO: 1013086 - RNA, 27 nt, Human
aggaaaagcuuccagaauuaccaaaga

SEQ ID NO: 1013087 - RNA, 18 nt, Human
auccaggauuccagagac

SEQ ID NO: 1013088 - RNA, 21 nt, Human
augucacaagccccaggaugu

SEQ ID NO: 1013089 - RNA, 19 nt, Human
caagccccaggaugucacc

SEQ ID NO: 1013090 - RNA, 18 nt, Human
caccacacacccacuacc

SEQ ID NO: 1013091 - RNA, 21 nt, Human
caccacacacccacuacccaa

SEQ ID NO: 1013092 - RNA, 18 nt, Human
cacuacccaauccagggc

SEQ ID NO: 1013093 - RNA, 20 nt, Human
cagagacccaagagcaagaa

SEQ ID NO: 1013094 - RNA, 26 nt, Human
cagccuuuaucgggaaagagaagcac

SEQ ID NO: 1013095 - RNA, 24 nt, Human
caggaaaagcuuccagaauuacca

SEQ ID NO: 1013096 - RNA, 23 nt, Human
ccacuacccaauccagggcuauu

SEQ ID NO: 1013097 - RNA, 21 nt, Human
ccaggauuccagagacccaag

SEQ ID NO: 1013098 - RNA, 22 nt, Human
ccucacaguccaguugggguuu

SEQ ID NO: 1013099 - RNA, 23 nt, Human
ccugacuugcaacauuuuucucc

SEQ ID NO: 1013100 - RNA, 23 nt, Human
ccugcaguuauccaggauuccag

SEQ ID NO: 1013101 - RNA, 23 nt, Human
cggaaucagaccucacaguccag

SEQ ID NO: 1013102 - RNA, 22 nt, Human
gaaaagcuuccagaauuaccaa

SEQ ID NO: 1013103 - RNA, 18 nt, Human
gcaggaggagaagcagag

SEQ ID NO: 1013104 - RNA, 20 nt, Human
gccccaggaugucacccucu

SEQ ID NO: 1013105 - RNA, 19 nt, Human
ggaggagaagcagagcaga

SEQ ID NO: 1013106 - RNA, 20 nt, Human
gggaaagagaagcaccacac

SEQ ID NO: 1013107 - RNA, 23 nt, Human
uaccaaagaagcuccagacaaau

SEQ ID NO: 1013108 - RNA, 20 nt, Human
uaucgggaaagagaagcacc

SEQ ID NO: 1013109 - RNA, 23 nt, Human
ucacaagccccaggaugucaccc

SEQ ID NO: 1013110 - RNA, 18 nt, Human
ucagaccucacaguccag

SEQ ID NO: 1013111 - RNA, 20 nt, Human
uccagaauuaccaaagaagc

SEQ ID NO: 1013112 - RNA, 22 nt, Human
uccagaauuaccaaagaagcuc

SEQ ID NO: 1013113 - RNA, 23 nt, Human
ucuccagcuugacaauucucauc

SEQ ID NO: 1013114 - RNA, 20 nt, Human
ugacuugcaacauuuuucuc

SEQ ID NO: 1013115 - RNA, 20 nt, Human
ugagugccccuggaaauguc

SEQ ID NO: 1013116 - RNA, 22 nt, Human
ugcucuggucagcggcaggagg

SEQ ID NO: 1013117 - RNA, 19 nt, Human
uucccaugcucuggucagc

SEQ ID NO: 1013118 - RNA, 19 nt, Human
uucccaugcucuggucagc

SEQ ID NO: 1013119 - RNA, 20 nt, Human
uucccaugcucuggucagcg

SEQ ID NO: 1013120 - RNA, 18 nt, Human
uugggggcaggacuggug

SEQ ID NO: 1013121 - RNA, 26 nt, Human
caccaggacgggguggcgcaggcccc

SEQ ID NO: 1013122 - RNA, 23 nt, Human
ucaccaggacgggguggcgcagg

SEQ ID NO: 1013123 - RNA, 19 nt, Human
ugcguuuauucaccaggac

SEQ ID NO: 1013124 - RNA, 22 nt, Human
aaaauacccaaaacacuaugca

SEQ ID NO: 1013125 - RNA, 22 nt, Human
aagaaaagaaaauccuacagaa

SEQ ID NO: 1013126 - RNA, 20 nt, Human
agcucccgcguccgcccgcc

SEQ ID NO: 1013127 - RNA, 24 nt, Human
augaacacaauuucaaaguuacac

SEQ ID NO: 1013128 - RNA, 23 nt, Human
caccaggcaaccaacuuugcaau

SEQ ID NO: 1013129 - RNA, 20 nt, Human
caccgagugcaaaugaacac

SEQ ID NO: 1013130 - RNA, 22 nt, Human
cacgcggaggccuucgaugccc

SEQ ID NO: 1013131 - RNA, 21 nt, Human
cacguccgcagcucccgcguc

SEQ ID NO: 1013132 - RNA, 20 nt, Human
cagcaggacgcucgcgggcc

SEQ ID NO: 1013133 - RNA, 24 nt, Human
ccaccaggcaaccaacuuugcaau

SEQ ID NO: 1013134 - RNA, 18 nt, Human
ccccgcgccgcgagaccc

SEQ ID NO: 1013135 - RNA, 18 nt, Human
ccccgcgccgcgagaccc

SEQ ID NO: 1013136 - RNA, 22 nt, Human
ccccgcgccgcgagacccucgc

SEQ ID NO: 1013137 - RNA, 21 nt, Human
ccccggcgcccggcgcggccg

SEQ ID NO: 1013138 - RNA, 20 nt, Human
cccggcgcccggcgcggccg

SEQ ID NO: 1013139 - RNA, 22 nt, Human
cccggcgcccggcgcggccgca

SEQ ID NO: 1013140 - RNA, 21 nt, Human
cccuccgcuaggccccgcgcc

SEQ ID NO: 1013141 - RNA, 21 nt, Human
cccuuaaaaaagcaacauccu

SEQ ID NO: 1013142 - RNA, 21 nt, Human
ccgccgcccuccccggcgccc

SEQ ID NO: 1013143 - RNA, 21 nt, Human
cuccccggcgcccggcgcggc

SEQ ID NO: 1013144 - RNA, 23 nt, Human
cuccccggcgcccggcgcggccg

SEQ ID NO: 1013145 - RNA, 18 nt, Human
gcgcccggcgcggccgca

SEQ ID NO: 1013146 - RNA, 20 nt, Human
gucuguucuaacuuccacca

SEQ ID NO: 1013147 - RNA, 23 nt, Human
uaaccgcugcaccgagugcaaau

SEQ ID NO: 1013148 - RNA, 21 nt, Human
uaacuuccaccaggcaaccaa

SEQ ID NO: 1013149 - RNA, 22 nt, Human
ucaaaguuacacauuuauucga

SEQ ID NO: 1013150 - RNA, 20 nt, Human
uccgcagcucccgcguccgc

SEQ ID NO: 1013151 - RNA, 19 nt, Human
ucgcucggggaaccagcag

SEQ ID NO: 1013152 - RNA, 21 nt, Human
ucugcugucgugcccugagga

SEQ ID NO: 1013153 - RNA, 24 nt, Human
ugaaaugacauuaugacuuaaaua

SEQ ID NO: 1013154 - RNA, 19 nt, Human
uucauugcacaaagcugcc

SEQ ID NO: 1013155 - RNA, 26 nt, Human
uuuuuuuuuuuuuuuuuuuacuuuga

SEQ ID NO: 1013156 - RNA, 21 nt, Human
aaaaugcuccccucccaccca

SEQ ID NO: 1013157 - RNA, 18 nt, Human
aaacaaaauacccccaaa

SEQ ID NO: 1013158 - RNA, 26 nt, Human
aaacaucccucagccuagcacccuga

SEQ ID NO: 1013159 - RNA, 21 nt, Human
aaaguccuuugcagccccaca

SEQ ID NO: 1013160 - RNA, 24 nt, Human
aagaaguccucauccaaucagcuu

SEQ ID NO: 1013161 - RNA, 21 nt, Human
aagcaguggggugaggggucc

SEQ ID NO: 1013162 - RNA, 19 nt, Human
aaggcccaggcccacgccc

SEQ ID NO: 1013163 - RNA, 18 nt, Human
aauuccuugcccuuucuc

SEQ ID NO: 1013164 - RNA, 18 nt, Human
accugccaagcuuccccc

SEQ ID NO: 1013165 - RNA, 19 nt, Human
accugccaagcuuccccca

SEQ ID NO: 1013166 - RNA, 21 nt, Human
agaaaaccaaagcaucuggug

SEQ ID NO: 1013167 - RNA, 22 nt, Human
agaugagaugcauagauggaga

SEQ ID NO: 1013168 - RNA, 20 nt, Human
aggaaggauggaugcagggu

SEQ ID NO: 1013169 - RNA, 23 nt, Human
aggaaggauggaugcaggguuug

SEQ ID NO: 1013170 - RNA, 25 nt, Human
aggcuggagugcaguggcgcaaucu

SEQ ID NO: 1013171 - RNA, 19 nt, Human
aggguuugagauccuacug

SEQ ID NO: 1013172 - RNA, 22 nt, Human
agugcaguggcgcaaucucgug

SEQ ID NO: 1013173 - RNA, 21 nt, Human
aguggacaggagaaggaagga

SEQ ID NO: 1013174 - RNA, 20 nt, Human
augaaauauaauauaccugc

SEQ ID NO: 1013175 - RNA, 22 nt, Human
caaaaacaaaauacccccaaaa

SEQ ID NO: 1013176 - RNA, 19 nt, Human
caaauggcuccuguucccu

SEQ ID NO: 1013177 - RNA, 19 nt, Human
caacaaggcaccuuucccc

SEQ ID NO: 1013178 - RNA, 20 nt, Human
caacaaggcaccuuucccca

SEQ ID NO: 1013179 - RNA, 24 nt, Human
caccuuuccccaagaggaaggcag

SEQ ID NO: 1013180 - RNA, 20 nt, Human
cacuaaaaaugcuccccucc

SEQ ID NO: 1013181 - RNA, 22 nt, Human
cacuguucucucuccgucuuua

SEQ ID NO: 1013182 - RNA, 22 nt, Human
cagcaggugagaacaaaaacaa

SEQ ID NO: 1013183 - RNA, 19 nt, Human
cagcuccuuccaugagggg

SEQ ID NO: 1013184 - RNA, 20 nt, Human
cauccaaucagcuuccuacc

SEQ ID NO: 1013185 - RNA, 23 nt, Human
cauccaaucagcuuccuaccuag

SEQ ID NO: 1013186 - RNA, 18 nt, Human
cccacaaagccagcuccu

SEQ ID NO: 1013187 - RNA, 22 nt, Human
cccaggcuggagugcaguggcg

SEQ ID NO: 1013188 - RNA, 18 nt, Human
cccauccugcugucggaa

SEQ ID NO: 1013189 - RNA, 20 nt, Human
ccccaaaaauaaagcagacc

SEQ ID NO: 1013190 - RNA, 18 nt, Human
ccccacaaagccagcucc

SEQ ID NO: 1013191 - RNA, 20 nt, Human
ccccacaaagccagcuccuu

SEQ ID NO: 1013192 - RNA, 22 nt, Human
cccccaaaaauaaagcagaccc

SEQ ID NO: 1013193 - RNA, 24 nt, Human
cccccaaaaauaaagcagacccaa

SEQ ID NO: 1013194 - RNA, 23 nt, Human
ccggaagacaaagaaacaaccua

SEQ ID NO: 1013195 - RNA, 22 nt, Human
ccucuacacauagcaacaguug

SEQ ID NO: 1013196 - RNA, 23 nt, Human
ccugaggaacgggaccaagccag

SEQ ID NO: 1013197 - RNA, 21 nt, Human
ccugcccuucuuuguuauccu

SEQ ID NO: 1013198 - RNA, 22 nt, Human
ccugggaaggcaagggugguag

SEQ ID NO: 1013199 - RNA, 22 nt, Human
ccuggggugguggggugggggg

SEQ ID NO: 1013200 - RNA, 18 nt, Human
cuaaaaaugcuccccucc

SEQ ID NO: 1013201 - RNA, 25 nt, Human
cucacuucuucacccuucuguacuc

SEQ ID NO: 1013202 - RNA, 23 nt, Human
cucaugccacgcucugagcaccu

SEQ ID NO: 1013203 - RNA, 20 nt, Human
cucugucgcccaggcuggag

SEQ ID NO: 1013204 - RNA, 20 nt, Human
cugaaggacagaaagagcca

SEQ ID NO: 1013205 - RNA, 18 nt, Human
cugcuguguuaaaccgug

SEQ ID NO: 1013206 - RNA, 21 nt, Human
cuggcucugucgcccaggcug

SEQ ID NO: 1013207 - RNA, 19 nt, Human
cuuccuaccuagacugggg

SEQ ID NO: 1013208 - RNA, 21 nt, Human
cuuccuaucucccaccagagg

SEQ ID NO: 1013209 - RNA, 21 nt, Human
gaaaaacaucccucagccuag

SEQ ID NO: 1013210 - RNA, 24 nt, Human
gaacaaaaacaaaauacccccaaa

SEQ ID NO: 1013211 - RNA, 21 nt, Human
gagaacaaaaacaaaauaccc

SEQ ID NO: 1013212 - RNA, 20 nt, Human
gagaagaagagaagguccau

SEQ ID NO: 1013213 - RNA, 21 nt, Human
gagacggagucuggcucuguc

SEQ ID NO: 1013214 - RNA, 18 nt, Human
gaggaaggauggaugcag

SEQ ID NO: 1013215 - RNA, 18 nt, Human
gcauagaagaguaucuga

SEQ ID NO: 1013216 - RNA, 24 nt, Human
gccagucagaaaagacugaggcag

SEQ ID NO: 1013217 - RNA, 18 nt, Human
gcccaagagccccauccu

SEQ ID NO: 1013218 - RNA, 19 nt, Human
gcccaggcuggagugcagu

SEQ ID NO: 1013219 - RNA, 20 nt, Human
gcccaggcuggagugcagug

SEQ ID NO: 1013220 - RNA, 20 nt, Human
gcccuaucuuccuaucuccc

SEQ ID NO: 1013221 - RNA, 22 nt, Human
gcccuaucuuccuaucucccac

SEQ ID NO: 1013222 - RNA, 25 nt, Human
gcucugucgcccaggcuggagugca

SEQ ID NO: 1013223 - RNA, 23 nt, Human
gcugaaggacagaaagagccagu

SEQ ID NO: 1013224 - RNA, 19 nt, Human
gcuggagugcaguggcgca

SEQ ID NO: 1013225 - RNA, 20 nt, Human
ggaaaaaaagaaguccucau

SEQ ID NO: 1013226 - RNA, 18 nt, Human
ggacccggaagacaaaga

SEQ ID NO: 1013227 - RNA, 18 nt, Human
ggacuuaaaaguccuuug

SEQ ID NO: 1013228 - RNA, 24 nt, Human
ggggggcagcaggugagaacaaaa

SEQ ID NO: 1013229 - RNA, 22 nt, Human
gggugguggggugggggggcag

SEQ ID NO: 1013230 - RNA, 23 nt, Human
gguagagaaaggaacaggaagag

SEQ ID NO: 1013231 - RNA, 25 nt, Human
gguggggugggggggcagcagguga

SEQ ID NO: 1013232 - RNA, 26 nt, Human
guagagaaaggaacaggaagagucug

SEQ ID NO: 1013233 - RNA, 20 nt, Human
guggggugggggggcagcag

SEQ ID NO: 1013234 - RNA, 21 nt, Human
guuguagaaaaccaaagcauc

SEQ ID NO: 1013235 - RNA, 18 nt, Human
uaaaaaugcuccccuccc

SEQ ID NO: 1013236 - RNA, 24 nt, Human
uaaguccuggucaugccagccucc

SEQ ID NO: 1013237 - RNA, 25 nt, Human
uagauggaggugagcugggaggaca

SEQ ID NO: 1013238 - RNA, 23 nt, Human
uagcaacaguuguagaaaaccaa

SEQ ID NO: 1013239 - RNA, 23 nt, Human
uaguucuaaaauggucuucaguu

SEQ ID NO: 1013240 - RNA, 22 nt, Human
ucagaaaagacugaggcagaca

SEQ ID NO: 1013241 - RNA, 19 nt, Human
uccaaauaugaccuuuaaa

SEQ ID NO: 1013242 - RNA, 19 nt, Human
ucccaguuggcacuguucu

SEQ ID NO: 1013243 - RNA, 18 nt, Human
ucccucagccuagcaccc

SEQ ID NO: 1013244 - RNA, 21 nt, Human
uccuuccaugaggggcuucaa

SEQ ID NO: 1013245 - RNA, 24 nt, Human
ucgcccaggcuggagugcaguggc

SEQ ID NO: 1013246 - RNA, 22 nt, Human
ucuacacauagcaacaguugua

SEQ ID NO: 1013247 - RNA, 19 nt, Human
ucuggcucugucgcccagg

SEQ ID NO: 1013248 - RNA, 23 nt, Human
ucuggcucugucgcccaggcugg

SEQ ID NO: 1013249 - RNA, 24 nt, Human
ucuggcucugucgcccaggcugga

SEQ ID NO: 1013250 - RNA, 24 nt, Human
ucugucgcccaggcuggagugcag

SEQ ID NO: 1013251 - RNA, 22 nt, Human
ucuucaguuuauuucacccuuu

SEQ ID NO: 1013252 - RNA, 21 nt, Human
ugaaauauaauauaccugcca

SEQ ID NO: 1013253 - RNA, 22 nt, Human
ugaaauauaauauaccugccaa

SEQ ID NO: 1013254 - RNA, 20 nt, Human
ugagaacaaaaacaaaauac

SEQ ID NO: 1013255 - RNA, 20 nt, Human
ugagguuaaggcccaggccu

SEQ ID NO: 1013256 - RNA, 22 nt, Human
ugcauuggagaaacauguuagg

SEQ ID NO: 1013257 - RNA, 21 nt, Human
ugcugcagagaacugacuagu

SEQ ID NO: 1013258 - RNA, 27 nt, Human
ugcuucacuaaaaaugcuccccuccca

SEQ ID NO: 1013259 - RNA, 18 nt, Human
uggagugcaguggcgcaa

SEQ ID NO: 1013260 - RNA, 23 nt, Human
uggagugcaguggcgcaaucucg

SEQ ID NO: 1013261 - RNA, 24 nt, Human
uggcucugucgcccaggcuggagu

SEQ ID NO: 1013262 - RNA, 22 nt, Human
uggcuggcugccaaggaagauc

SEQ ID NO: 1013263 - RNA, 19 nt, Human
ugggaaggcaaggguggua

SEQ ID NO: 1013264 - RNA, 25 nt, Human
uggggugaggggucccagaggguuu

SEQ ID NO: 1013265 - RNA, 20 nt, Human
uggggugguggggugggggg

SEQ ID NO: 1013266 - RNA, 22 nt, Human
uggggugguggggugggggggc

SEQ ID NO: 1013267 - RNA, 19 nt, Human
ugguggggugggggggcag

SEQ ID NO: 1013268 - RNA, 21 nt, Human
uguagaaaaccaaagcaucug

SEQ ID NO: 1013269 - RNA, 21 nt, Human
uguuaggagcucucaugcagg

SEQ ID NO: 1013270 - RNA, 21 nt, Human
uucaggggaauggaagggacc

SEQ ID NO: 1013271 - RNA, 20 nt, Human
uuccuugcccuuucuccaaa

SEQ ID NO: 1013272 - RNA, 18 nt, Human
uucuguacucugcugugu

SEQ ID NO: 1013273 - RNA, 22 nt, Human
uuuuccccauccauuucaaaga

SEQ ID NO: 1013274 - RNA, 19 nt, Human
aaagccccucccuugcccu

SEQ ID NO: 1013275 - RNA, 20 nt, Human
aacguuacccacaacaaaga

SEQ ID NO: 1013276 - RNA, 21 nt, Human
aacuggacguugagagacccg

SEQ ID NO: 1013277 - RNA, 19 nt, Human
aagccccucccuugccccc

SEQ ID NO: 1013278 - RNA, 18 nt, Human
acaaagaagaggacagag

SEQ ID NO: 1013279 - RNA, 25 nt, Human
acaaagccccucccuugcccccccc

SEQ ID NO: 1013280 - RNA, 29 nt, Human
acccacaacaaagaagaggaccgguuucg

SEQ ID NO: 1013281 - RNA, 21 nt, Human
acucuuuauuacggccugcgg

SEQ ID NO: 1013282 - RNA, 23 nt, Human
agaacaaauugagacauauccuc

SEQ ID NO: 1013283 - RNA, 21 nt, Human
agaggcagugccgcggaaucc

SEQ ID NO: 1013284 - RNA, 18 nt, Human
agggaacuccucccaccu

SEQ ID NO: 1013285 - RNA, 23 nt, Human
aguugaaucuggggucaggaguu

SEQ ID NO: 1013286 - RNA, 19 nt, Human
auaauaauagaggcagugc

SEQ ID NO: 1013287 - RNA, 22 nt, Human
caaagccccucccuugcccccc

SEQ ID NO: 1013288 - RNA, 21 nt, Human
caaaggcccacacugcucucc

SEQ ID NO: 1013289 - RNA, 21 nt, Human
cacacagcuguugguuaccug

SEQ ID NO: 1013290 - RNA, 24 nt, Human
cagaacagacgaguaaccccagcg

SEQ ID NO: 1013291 - RNA, 18 nt, Human
cagauggugcgcucagga

SEQ ID NO: 1013292 - RNA, 20 nt, Human
caguaccuaacgguuccggg

SEQ ID NO: 1013293 - RNA, 21 nt, Human
caucaauuucaugggccuacg

SEQ ID NO: 1013294 - RNA, 20 nt, Human
caucagaacagacgaguaac

SEQ ID NO: 1013295 - RNA, 20 nt, Human
ccacaacaaagaagaggaca

SEQ ID NO: 1013296 - RNA, 19 nt, Human
ccacacugcucuccuaucu

SEQ ID NO: 1013297 - RNA, 18 nt, Human
ccauccccacuguggcau

SEQ ID NO: 1013298 - RNA, 18 nt, Human
ccccgcgcgcaguguggc

SEQ ID NO: 1013299 - RNA, 18 nt, Human
cccugcgacugcaggagu

SEQ ID NO: 1013300 - RNA, 19 nt, Human
ccuucggcugucugggccu

SEQ ID NO: 1013301 - RNA, 23 nt, Human
cgacaggcagcagcgaggucgag

SEQ ID NO: 1013302 - RNA, 25 nt, Human
cggagacuuccugucgggucccugg

SEQ ID NO: 1013303 - RNA, 21 nt, Human
cgggcauguggauccguuggg

SEQ ID NO: 1013304 - RNA, 22 nt, Human
cuaauccucagaacaacucuau

SEQ ID NO: 1013305 - RNA, 19 nt, Human
cuacguaucugcucuggcc

SEQ ID NO: 1013306 - RNA, 19 nt, Human
cucucaguucaucaauuuc

SEQ ID NO: 1013307 - RNA, 19 nt, Human
cucuccuaucuaauccuca

SEQ ID NO: 1013308 - RNA, 23 nt, Human
cucuuuaccgcugcgcuccauag

SEQ ID NO: 1013309 - RNA, 19 nt, Human
cugcagcuuucuuugccaa

SEQ ID NO: 1013310 - RNA, 22 nt, Human
cugcagcuuucuuugccaaucg

SEQ ID NO: 1013311 - RNA, 22 nt, Human
cugcuuuucucugggaccucga

SEQ ID NO: 1013312 - RNA, 23 nt, Human
cuguccuuaaacaguaguaguaa

SEQ ID NO: 1013313 - RNA, 19 nt, Human
cuuggccccgcaggcugca

SEQ ID NO: 1013314 - RNA, 23 nt, Human
cuuuuccccauuuuuuuccccuu

SEQ ID NO: 1013315 - RNA, 22 nt, Human
gaacaaauugagacauauccuc

SEQ ID NO: 1013316 - RNA, 24 nt, Human
gaacagcuguugggcugucuugcg

SEQ ID NO: 1013317 - RNA, 21 nt, Human
gaacguuacccacaacaaaga

SEQ ID NO: 1013318 - RNA, 23 nt, Human
gaaggugggugaaagaagggggc

SEQ ID NO: 1013319 - RNA, 20 nt, Human
gaguaaccccagcggcucca

SEQ ID NO: 1013320 - RNA, 19 nt, Human
gagucggcggggaggggag

SEQ ID NO: 1013321 - RNA, 18 nt, Human
gcagagcugagguuccau

SEQ ID NO: 1013322 - RNA, 18 nt, Human
gccccggggagaggcgcu

SEQ ID NO: 1013323 - RNA, 19 nt, Human
gcgaagggcgggccucgcg

SEQ ID NO: 1013324 - RNA, 19 nt, Human
ggaaaaccucaggucuccc

SEQ ID NO: 1013325 - RNA, 22 nt, Human
ggaauccuuucacugaggacuc

SEQ ID NO: 1013326 - RNA, 22 nt, Human
ggcgcccaguuuuccacagccu

SEQ ID NO: 1013327 - RNA, 21 nt, Human
ggcggggaggggaggaacagc

SEQ ID NO: 1013328 - RNA, 19 nt, Human
gggcgcgggccccggggag

SEQ ID NO: 1013329 - RNA, 23 nt, Human
gggcgcgggccccggggagaggc

SEQ ID NO: 1013330 - RNA, 21 nt, Human
gggcugucuugcgcguggggc

SEQ ID NO: 1013331 - RNA, 21 nt, Human
gguaagaaggugggugaaaga

SEQ ID NO: 1013332 - RNA, 21 nt, Human
gguuccgggcucccagauagg

SEQ ID NO: 1013333 - RNA, 22 nt, Human
gucuagggucacacagcuguug

SEQ ID NO: 1013334 - RNA, 20 nt, Human
gugggugaaagaagggggcg

SEQ ID NO: 1013335 - RNA, 23 nt, Human
guugaaucuggggucaggaguuc

SEQ ID NO: 1013336 - RNA, 24 nt, Human
guuguuugcaaaguugaaucuggg

SEQ ID NO: 1013337 - RNA, 22 nt, Human
uaaacaguaguaguaacaaaaa

SEQ ID NO: 1013338 - RNA, 26 nt, Human
uaaaguugauugagucaaaggcccac

SEQ ID NO: 1013339 - RNA, 22 nt, Human
uaacaaaaacuguaaaguugau

SEQ ID NO: 1013340 - RNA, 21 nt, Human
uaagaaggugggugaaagaag

SEQ ID NO: 1013341 - RNA, 27 nt, Human
uaaggaaacugaggcucagagagacug

SEQ ID NO: 1013342 - RNA, 22 nt, Human
uacagaucucggcgcugacagg

SEQ ID NO: 1013343 - RNA, 19 nt, Human
uacggccugcgggccccgc

SEQ ID NO: 1013344 - RNA, 21 nt, Human
ucacugaggacucucggggag

SEQ ID NO: 1013345 - RNA, 20 nt, Human
uccauagacugccucuccuu

SEQ ID NO: 1013346 - RNA, 19 nt, Human
ucccccuuggaaaaccuca

SEQ ID NO: 1013347 - RNA, 22 nt, Human
ucccuugccccccccuuuuuuu

SEQ ID NO: 1013348 - RNA, 23 nt, Human
uccgggcauguggauccguuggg

SEQ ID NO: 1013349 - RNA, 18 nt, Human
uccuccgacugcggcucc

SEQ ID NO: 1013350 - RNA, 23 nt, Human
ucuaauuguaaccucagacugga

SEQ ID NO: 1013351 - RNA, 18 nt, Human
ucucccgcgacaggcagc

SEQ ID NO: 1013352 - RNA, 23 nt, Human
ucucggggagcucggggaccauc

SEQ ID NO: 1013353 - RNA, 22 nt, Human
ugaaaugaucagaagaagcugg

SEQ ID NO: 1013354 - RNA, 21 nt, Human
ugaaucuggggucaggaguuc

SEQ ID NO: 1013355 - RNA, 19 nt, Human
ugcagaauaauuuuuuuuc

SEQ ID NO: 1013356 - RNA, 19 nt, Human
ugcagccccgagugggcag

SEQ ID NO: 1013357 - RNA, 24 nt, Human
ugccgcggaauccuuucacugagg

SEQ ID NO: 1013358 - RNA, 22 nt, Human
uggcuuagugucgccugggcuu

SEQ ID NO: 1013359 - RNA, 21 nt, Human
ugggugaaagaagggggcgcc

SEQ ID NO: 1013360 - RNA, 25 nt, Human
ugggugaaagaagggggcgcccagu

SEQ ID NO: 1013361 - RNA, 21 nt, Human
ugucgggucccugggguccuc

SEQ ID NO: 1013362 - RNA, 22 nt, Human
ugucgggucccugggguccucc

SEQ ID NO: 1013363 - RNA, 20 nt, Human
uuagcucugaagagguagag

SEQ ID NO: 1013364 - RNA, 20 nt, Human
uuccugucgggucccugggg

SEQ ID NO: 1013365 - RNA, 22 nt, Human
uugaaucuggggucaggaguuc

SEQ ID NO: 1013366 - RNA, 20 nt, Human
uuuccccauuuuuuuccccu

SEQ ID NO: 1013367 - RNA, 19 nt, Human
uuugaaaugaucagaagaa

SEQ ID NO: 1013368 - RNA, 23 nt, Human
uuuucuuuuccccauuuuuuucc

SEQ ID NO: 1013369 - RNA, 31 nt, Human
uuuuuucccucucucgugguuuuucuuuuuu

SEQ ID NO: 1013370 - RNA, 26 nt, Human
aacccagucaguccuagagcccacag

SEQ ID NO: 1013371 - RNA, 19 nt, Human
agacggcgcccgccucccc

SEQ ID NO: 1013372 - RNA, 19 nt, Human
agccaggggcgccggcgca

SEQ ID NO: 1013373 - RNA, 20 nt, Human
agcuuccauucauuccccac

SEQ ID NO: 1013374 - RNA, 19 nt, Human
aggaggcugucugggcccu

SEQ ID NO: 1013375 - RNA, 22 nt, Human
aggaggcugucugggcccuuua

SEQ ID NO: 1013376 - RNA, 26 nt, Human
caagaccguaagccucagagggccag

SEQ ID NO: 1013377 - RNA, 20 nt, Human
caagaggacaaguguugugu

SEQ ID NO: 1013378 - RNA, 19 nt, Human
cacccccgggcaccgcccu

SEQ ID NO: 1013379 - RNA, 18 nt, Human
caccgcccccagagugcc

SEQ ID NO: 1013380 - RNA, 24 nt, Human
cacgcaccccaccgcccccagagu

SEQ ID NO: 1013381 - RNA, 18 nt, Human
cagaagugaguggugggg

SEQ ID NO: 1013382 - RNA, 21 nt, Human
cagcaagaauguaaccuccaa

SEQ ID NO: 1013383 - RNA, 22 nt, Human
cagcaagaauguaaccuccaag

SEQ ID NO: 1013384 - RNA, 21 nt, Human
cagcacccccgggcaccgccc

SEQ ID NO: 1013385 - RNA, 19 nt, Human
cagcccaacugaacugucu

SEQ ID NO: 1013386 - RNA, 23 nt, Human
ccagcaagaauguaaccuccaag

SEQ ID NO: 1013387 - RNA, 22 nt, Human
cccacgcaccccaccgccccca

SEQ ID NO: 1013388 - RNA, 21 nt, Human
cccagcaagaauguaaccucc

SEQ ID NO: 1013389 - RNA, 21 nt, Human
ccccaccgcccccagagugcc

SEQ ID NO: 1013390 - RNA, 24 nt, Human
ccccaccgcccccagagugccgca

SEQ ID NO: 1013391 - RNA, 19 nt, Human
ccccacgcaccccaccgcc

SEQ ID NO: 1013392 - RNA, 21 nt, Human
cccccacgcaccccaccgccc

SEQ ID NO: 1013393 - RNA, 19 nt, Human
cccccagagugccgcaaag

SEQ ID NO: 1013394 - RNA, 23 nt, Human
ccccccagcaagaauguaaccuc

SEQ ID NO: 1013395 - RNA, 24 nt, Human
cccccgcgacaacucccggugccu

SEQ ID NO: 1013396 - RNA, 19 nt, Human
cccgcuccauggggcagca

SEQ ID NO: 1013397 - RNA, 19 nt, Human
cccggaggugcagcgggcu

SEQ ID NO: 1013398 - RNA, 20 nt, Human
cccucggggggggcgggggg

SEQ ID NO: 1013399 - RNA, 21 nt, Human
cccugacgggcugggaguggg

SEQ ID NO: 1013400 - RNA, 19 nt, Human
ccgaggcccccccgcgaca

SEQ ID NO: 1013401 - RNA, 21 nt, Human
ccucagagcugagggguuccu

SEQ ID NO: 1013402 - RNA, 22 nt, Human
ccuccagcgcagcgccgggagc

SEQ ID NO: 1013403 - RNA, 20 nt, Human
ccucgaucagggcccagggg

SEQ ID NO: 1013404 - RNA, 19 nt, Human
ccucggggggggcgggggg

SEQ ID NO: 1013405 - RNA, 19 nt, Human
ccucggggggggcgggggg

SEQ ID NO: 1013406 - RNA, 25 nt, Human
ccuugcauugccacccccacgcacc

SEQ ID NO: 1013407 - RNA, 22 nt, Human
cgaucacagaccucagagcuga

SEQ ID NO: 1013408 - RNA, 21 nt, Human
cgcagcgccgggagccugcgc

SEQ ID NO: 1013409 - RNA, 20 nt, Human
cgcaggcccugacgggcugg

SEQ ID NO: 1013410 - RNA, 23 nt, Human
cgcccucggggggggcggggggu

SEQ ID NO: 1013411 - RNA, 19 nt, Human
cgcgcaggcccugacgggc

SEQ ID NO: 1013412 - RNA, 21 nt, Human
cggcgcccgccuccccgcucc

SEQ ID NO: 1013413 - RNA, 22 nt, Human
gaagaacccagucaguccuaga

SEQ ID NO: 1013414 - RNA, 21 nt, Human
gacaaguguugugucucgcuu

SEQ ID NO: 1013415 - RNA, 22 nt, Human
gagcagacggcgcccgccuccc

SEQ ID NO: 1013416 - RNA, 19 nt, Human
gaggaggcugucugggccc

SEQ ID NO: 1013417 - RNA, 21 nt, Human
gaggcuggggugccggggaac

SEQ ID NO: 1013418 - RNA, 23 nt, Human
gaggcuggggugccggggaaccc

SEQ ID NO: 1013419 - RNA, 21 nt, Human
gcaccccaccgcccccagagu

SEQ ID NO: 1013420 - RNA, 20 nt, Human
gcagacggcgcccgccuccc

SEQ ID NO: 1013421 - RNA, 20 nt, Human
gcccaugccuccccccagca

SEQ ID NO: 1013422 - RNA, 23 nt, Human
gcccucggggggggcggggggug

SEQ ID NO: 1013423 - RNA, 20 nt, Human
gcggggggugaagagcgggc

SEQ ID NO: 1013424 - RNA, 18 nt, Human
gcuuccauucauucccca

SEQ ID NO: 1013425 - RNA, 19 nt, Human
ggacuggagagccaggggc

SEQ ID NO: 1013426 - RNA, 22 nt, Human
ggcccggaggugcagcgggcuc

SEQ ID NO: 1013427 - RNA, 22 nt, Human
gggaacccuccagcgcagcgcc

SEQ ID NO: 1013428 - RNA, 19 nt, Human
gggaaugguggaggaggcc

SEQ ID NO: 1013429 - RNA, 19 nt, Human
gggcccggaggugcagcgg

SEQ ID NO: 1013430 - RNA, 19 nt, Human
gggcuucggggagggagga

SEQ ID NO: 1013431 - RNA, 18 nt, Human
ggggacgggaggcugggg

SEQ ID NO: 1013432 - RNA, 23 nt, Human
ggggggcccggaggugcagcggg

SEQ ID NO: 1013433 - RNA, 23 nt, Human
ggggugaagagcgggcgaaccgg

SEQ ID NO: 1013434 - RNA, 22 nt, Human
ggugaaaggauggagacagacu

SEQ ID NO: 1013435 - RNA, 24 nt, Human
ggugcagcgggcuggggacgggag

SEQ ID NO: 1013436 - RNA, 23 nt, Human
gguggaggaggcugucugggccc

SEQ ID NO: 1013437 - RNA, 22 nt, Human
guuuauugcccaugccuccccc

SEQ ID NO: 1013438 - RNA, 23 nt, Human
uaagaucaugugguccaaucucc

SEQ ID NO: 1013439 - RNA, 21 nt, Human
uauugcccaugccucccccca

SEQ ID NO: 1013440 - RNA, 22 nt, Human
uauuucuuuuuuuuaauccucc

SEQ ID NO: 1013441 - RNA, 23 nt, Human
ucacagcccagugggacuggaga

SEQ ID NO: 1013442 - RNA, 21 nt, Human
ucaguccuagagcccacagaa

SEQ ID NO: 1013443 - RNA, 21 nt, Human
uccagggaaggggugaaagga

SEQ ID NO: 1013444 - RNA, 19 nt, Human
uccccaccucccaucucca

SEQ ID NO: 1013445 - RNA, 22 nt, Human
ucccgaggcccccccgcgacaa

SEQ ID NO: 1013446 - RNA, 20 nt, Human
uccuagagcccacagaagug

SEQ ID NO: 1013447 - RNA, 21 nt, Human
ucucucugcccgucagcuucc

SEQ ID NO: 1013448 - RNA, 24 nt, Human
ucucugcccgucagcuuccauuca

SEQ ID NO: 1013449 - RNA, 21 nt, Human
ucugggcuucggggagggagg

SEQ ID NO: 1013450 - RNA, 18 nt, Human
ugcagcgggcuggggacg

SEQ ID NO: 1013451 - RNA, 23 nt, Human
ugcauugccacccccacgcaccc

SEQ ID NO: 1013452 - RNA, 18 nt, Human
uggaggaggcugucuggg

SEQ ID NO: 1013453 - RNA, 21 nt, Human
uggaggaggcugucugggccc

SEQ ID NO: 1013454 - RNA, 25 nt, Human
uggcuggcgggggcggcgcugucug

SEQ ID NO: 1013455 - RNA, 18 nt, Human
ugggaguggggggcucac

SEQ ID NO: 1013456 - RNA, 24 nt, Human
uggugggguucagacaggccugga

SEQ ID NO: 1013457 - RNA, 21 nt, Human
uugcauugccacccccacgca

SEQ ID NO: 1013458 - RNA, 24 nt, Human
uugccuggcugaggcuuguuuuag

SEQ ID NO: 1013459 - RNA, 24 nt, Human
aaaauagaaacuuuuuaaacaaaa

SEQ ID NO: 1013460 - RNA, 20 nt, Human
aaacaagaaagaccacuuaa

SEQ ID NO: 1013461 - RNA, 24 nt, Human
aaagaucaaagauugcuauauacc

SEQ ID NO: 1013462 - RNA, 18 nt, Human
aacauuaaaaggccagca

SEQ ID NO: 1013463 - RNA, 23 nt, Human
aagaucaaagauugcuauauacc

SEQ ID NO: 1013464 - RNA, 19 nt, Human
aauaaccuuaugaguuaag

SEQ ID NO: 1013465 - RNA, 18 nt, Human
aauuguuucucugccuca

SEQ ID NO: 1013466 - RNA, 22 nt, Human
acaucuucuauccacacacaaa

SEQ ID NO: 1013467 - RNA, 19 nt, Human
agaaacuuuuuaaacaaaa

SEQ ID NO: 1013468 - RNA, 20 nt, Human
agaaauagaaugaagacugu

SEQ ID NO: 1013469 - RNA, 18 nt, Human
agaaucccaagaaaucca

SEQ ID NO: 1013470 - RNA, 21 nt, Human
aggaaccuuguaaaauaugau

SEQ ID NO: 1013471 - RNA, 19 nt, Human
agguuuuuccagauucucc

SEQ ID NO: 1013472 - RNA, 21 nt, Human
auaaaucauauaacuuaagua

SEQ ID NO: 1013473 - RNA, 24 nt, Human
augaugaauauacaugcaugaaua

SEQ ID NO: 1013474 - RNA, 27 nt, Human
caauuaaucuuacugcugaaauaacac

SEQ ID NO: 1013475 - RNA, 20 nt, Human
caccaaguuaucccucgccc

SEQ ID NO: 1013476 - RNA, 23 nt, Human
caccaaguuaucccucgcccucu

SEQ ID NO: 1013477 - RNA, 23 nt, Human
cauguuucaggauccucccccca

SEQ ID NO: 1013478 - RNA, 18 nt, Human
ccacuguuuaccucuccu

SEQ ID NO: 1013479 - RNA, 23 nt, Human
ccagcaccaaguuaucccucgcc

SEQ ID NO: 1013480 - RNA, 26 nt, Human
ccagcagugauagggacucucagcag

SEQ ID NO: 1013481 - RNA, 20 nt, Human
cccagcccagccgcuccucu

SEQ ID NO: 1013482 - RNA, 20 nt, Human
ccccagcccagccgcuccuc

SEQ ID NO: 1013483 - RNA, 23 nt, Human
cccccaguaucucagaggugggu

SEQ ID NO: 1013484 - RNA, 21 nt, Human
ccccccaguaucucagaggug

SEQ ID NO: 1013485 - RNA, 24 nt, Human
cccccgcauggagucccccagccc

SEQ ID NO: 1013486 - RNA, 18 nt, Human
ccuccccagaggcccuuc

SEQ ID NO: 1013487 - RNA, 20 nt, Human
cgcauggagucccccagccc

SEQ ID NO: 1013488 - RNA, 24 nt, Human
cugaggcaucuugcccaaggcugg

SEQ ID NO: 1013489 - RNA, 26 nt, Human
cugcuaaguuaaauucucuucgaugu

SEQ ID NO: 1013490 - RNA, 22 nt, Human
cuuuucaacauuagaaucccaa

SEQ ID NO: 1013491 - RNA, 23 nt, Human
gaaaaugaauauucucuuugucc

SEQ ID NO: 1013492 - RNA, 26 nt, Human
gaccacuuaacauucaaauagaaaug

SEQ ID NO: 1013493 - RNA, 18 nt, Human
gaucacuauucugauuua

SEQ ID NO: 1013494 - RNA, 22 nt, Human
gccagcagugauagggacucuc

SEQ ID NO: 1013495 - RNA, 19 nt, Human
ggcuuugcccucugugguu

SEQ ID NO: 1013496 - RNA, 22 nt, Human
guuugcagggagcuguaggaga

SEQ ID NO: 1013497 - RNA, 24 nt, Human
uaaaaacaagaaagaccacuuaac

SEQ ID NO: 1013498 - RNA, 22 nt, Human
uaaaaaugacuaauguucaccc

SEQ ID NO: 1013499 - RNA, 18 nt, Human
uaaaauuaaagagaaaua

SEQ ID NO: 1013500 - RNA, 19 nt, Human
uaaaauuaaagagaaauag

SEQ ID NO: 1013501 - RNA, 22 nt, Human
uaaagagaaauagaaugaagac

SEQ ID NO: 1013502 - RNA, 23 nt, Human
uaagaaaaugaauauucucuuug

SEQ ID NO: 1013503 - RNA, 20 nt, Human
uaagcauaacuaaugugaaa

SEQ ID NO: 1013504 - RNA, 23 nt, Human
uaagucagcacccaaugcuuaug

SEQ ID NO: 1013505 - RNA, 23 nt, Human
uaaucuuacugcugaaauaacac

SEQ ID NO: 1013506 - RNA, 20 nt, Human
uaccaggaaccuuguaaaau

SEQ ID NO: 1013507 - RNA, 20 nt, Human
uaccuuauggagguuuuucc

SEQ ID NO: 1013508 - RNA, 22 nt, Human
uagaaucccaagaaauccacau

SEQ ID NO: 1013509 - RNA, 22 nt, Human
uauaaaucauauaacuuaagua

SEQ ID NO: 1013510 - RNA, 23 nt, Human
uaucacuuaagaagauucuuuuu

SEQ ID NO: 1013511 - RNA, 24 nt, Human
uauguuaacuuuucaacaucuucu

SEQ ID NO: 1013512 - RNA, 19 nt, Human
ucaaauagaaaugcagcau

SEQ ID NO: 1013513 - RNA, 20 nt, Human
ucaauauauauuccccaaau

SEQ ID NO: 1013514 - RNA, 23 nt, Human
ucacccaccauuauugaguccug

SEQ ID NO: 1013515 - RNA, 20 nt, Human
ucacuaaacaucuguaauga

SEQ ID NO: 1013516 - RNA, 22 nt, Human
ucacuauucugauuuagauucu

SEQ ID NO: 1013517 - RNA, 20 nt, Human
uccaucuuucuggcuuugcc

SEQ ID NO: 1013518 - RNA, 24 nt, Human
ucccccagcccagccgcuccucuu

SEQ ID NO: 1013519 - RNA, 24 nt, Human
ucccucgcccucuuccuccuugca

SEQ ID NO: 1013520 - RNA, 24 nt, Human
ucuauaacauauaaaacugucauu

SEQ ID NO: 1013521 - RNA, 25 nt, Human
ucuccuccugcgcagggguggagau

SEQ ID NO: 1013522 - RNA, 23 nt, Human
ugaaauaacacaaauuuuugaua

SEQ ID NO: 1013523 - RNA, 22 nt, Human
ugaggcaucuugcccaaggcug

SEQ ID NO: 1013524 - RNA, 27 nt, Human
ugcaagagucaacuuuacuagcgcugc

SEQ ID NO: 1013525 - RNA, 19 nt, Human
ugcagggagcuguaggaga

SEQ ID NO: 1013526 - RNA, 18 nt, Human
ugccuuagcucuuaggcu

SEQ ID NO: 1013527 - RNA, 18 nt, Human
ugccuuuccaucuuucug

SEQ ID NO: 1013528 - RNA, 24 nt, Human
ugccuuuccaucuuucuggcuuug

SEQ ID NO: 1013529 - RNA, 22 nt, Human
uggagguuuuuccagauucucc

SEQ ID NO: 1013530 - RNA, 23 nt, Human
uggcaggccuccuggcauaaggg

SEQ ID NO: 1013531 - RNA, 22 nt, Human
ugucacuaaacaucuguaauga

SEQ ID NO: 1013532 - RNA, 19 nt, Human
uuagaaucccaagaaaucc

SEQ ID NO: 1013533 - RNA, 21 nt, Human
uuccauauucaaggaucuuau

SEQ ID NO: 1013534 - RNA, 21 nt, Human
uucuuuuuuccaguuaagacu

SEQ ID NO: 1013535 - RNA, 18 nt, Human
uugcacccccuccccaga

SEQ ID NO: 1013536 - RNA, 19 nt, Human
uuucaggauccucccccca

SEQ ID NO: 1013537 - RNA, 23 nt, Human
uuuuuuucacaguuaaaugcuua

SEQ ID NO: 1013538 - RNA, 24 nt, Human
uuuuuuucacaguuaaaugcuuag

SEQ ID NO: 1013539 - RNA, 22 nt, Human
uuuuuuuuuuuuuuuuucacag

SEQ ID NO: 1013540 - RNA, 26 nt, Human
uuuuuuuuuuuuuuuuucacaguuaa

SEQ ID NO: 1013541 - RNA, 24 nt, Human
uuuuuuuuuuuuuuuuuuucacag

SEQ ID NO: 1013542 - RNA, 19 nt, Human
aaaaagaagcucucuacag

SEQ ID NO: 1013543 - RNA, 22 nt, Human
aaacaaaaagaagcucucuaca

SEQ ID NO: 1013544 - RNA, 22 nt, Human
aaagugugauauaggagaaaga

SEQ ID NO: 1013545 - RNA, 19 nt, Human
aaccacauugcuugggcuc

SEQ ID NO: 1013546 - RNA, 22 nt, Human
aagcgguagcagcccagggugg

SEQ ID NO: 1013547 - RNA, 18 nt, Human
aaggaucuugugcuuuug

SEQ ID NO: 1013548 - RNA, 22 nt, Human
aauggaaccuuguccacuaugg

SEQ ID NO: 1013549 - RNA, 20 nt, Human
acaaaaagaagcucucuaca

SEQ ID NO: 1013550 - RNA, 22 nt, Human
acaccaagaagugucgggaagc

SEQ ID NO: 1013551 - RNA, 25 nt, Human
acucauuucacucuaaagacccccu

SEQ ID NO: 1013552 - RNA, 18 nt, Human
agaaaaaaggagccucaa

SEQ ID NO: 1013553 - RNA, 21 nt, Human
agcgggaaaucagggagcuug

SEQ ID NO: 1013554 - RNA, 22 nt, Human
aggaaagaaaaaaggagccuca

SEQ ID NO: 1013555 - RNA, 22 nt, Human
agggcuaaggaaccagccagga

SEQ ID NO: 1013556 - RNA, 21 nt, Human
aguugagaggcuugaauugga

SEQ ID NO: 1013557 - RNA, 18 nt, Human
augagcaugugaauggaa

SEQ ID NO: 1013558 - RNA, 19 nt, Human
auuuugcaaauuuuacaac

SEQ ID NO: 1013559 - RNA, 19 nt, Human
caaaaagaagcucucuaca

SEQ ID NO: 1013560 - RNA, 19 nt, Human
caaaagaggcagugcuguc

SEQ ID NO: 1013561 - RNA, 22 nt, Human
cagggcuaaggaaccagccagg

SEQ ID NO: 1013562 - RNA, 19 nt, Human
ccacugcauuccaccucag

SEQ ID NO: 1013563 - RNA, 19 nt, Human
ccacugcauuccaccucag

SEQ ID NO: 1013564 - RNA, 20 nt, Human
ccacugcauuccaccucagu

SEQ ID NO: 1013565 - RNA, 22 nt, Human
ccagagcgggaaaucagggagc

SEQ ID NO: 1013566 - RNA, 24 nt, Human
ccagggcuaaggaaccagccagga

SEQ ID NO: 1013567 - RNA, 20 nt, Human
ccaggguggaggguggagga

SEQ ID NO: 1013568 - RNA, 25 nt, Human
ccauggucccuauggauuacucucu

SEQ ID NO: 1013569 - RNA, 27 nt, Human
cccccuaucucuucuacucucccuuca

SEQ ID NO: 1013570 - RNA, 28 nt, Human
cccccuaucucuucuacucucccuucaa

SEQ ID NO: 1013571 - RNA, 22 nt, Human
ccccugacaacuccuucccagg

SEQ ID NO: 1013572 - RNA, 20 nt, Human
cccuaucucuucuacucucc

SEQ ID NO: 1013573 - RNA, 20 nt, Human
ccucuugcacaccaagaagu

SEQ ID NO: 1013574 - RNA, 23 nt, Human
cuaaagacccccuaucucuucua

SEQ ID NO: 1013575 - RNA, 22 nt, Human
gaaccuuguccacuauggcuaa

SEQ ID NO: 1013576 - RNA, 23 nt, Human
gaagcgguagcagcccagggugg

SEQ ID NO: 1013577 - RNA, 20 nt, Human
gaagcucucuacagguaccc

SEQ ID NO: 1013578 - RNA, 19 nt, Human
gaaugguagagagaaaaag

SEQ ID NO: 1013579 - RNA, 22 nt, Human
gacccccuaucucuucuacucu

SEQ ID NO: 1013580 - RNA, 18 nt, Human
gagacagcaguguuaaca

SEQ ID NO: 1013581 - RNA, 19 nt, Human
gccagguagaaacaaaaag

SEQ ID NO: 1013582 - RNA, 21 nt, Human
ggaaagaaaaaaggagccuca

SEQ ID NO: 1013583 - RNA, 23 nt, Human
ggccagguagaaacaaaaagaag

SEQ ID NO: 1013584 - RNA, 20 nt, Human
guagagagaaaaagagagaa

SEQ ID NO: 1013585 - RNA, 18 nt, Human
guagcagcccagggugga

SEQ ID NO: 1013586 - RNA, 22 nt, Human
uaaauagaagcgguagcagccc

SEQ ID NO: 1013587 - RNA, 23 nt, Human
uaaggaaccagccaggacaccau

SEQ ID NO: 1013588 - RNA, 23 nt, Human
uacccuuccucuugcacaccaag

SEQ ID NO: 1013589 - RNA, 21 nt, Human
uaucucuucuacucucccuuc

SEQ ID NO: 1013590 - RNA, 21 nt, Human
uccagagcgggaaaucaggga

SEQ ID NO: 1013591 - RNA, 18 nt, Human
ucccagggcuaaggaacc

SEQ ID NO: 1013592 - RNA, 19 nt, Human
ucccagggcuaaggaacca

SEQ ID NO: 1013593 - RNA, 18 nt, Human
uccccugacaacuccuuc

SEQ ID NO: 1013594 - RNA, 22 nt, Human
uccccugacaacuccuucccag

SEQ ID NO: 1013595 - RNA, 18 nt, Human
ucuaaagacccccuaucu

SEQ ID NO: 1013596 - RNA, 26 nt, Human
ucuaaagacccccuaucucuucuacu

SEQ ID NO: 1013597 - RNA, 18 nt, Human
ucuaacuuuggccaggua

SEQ ID NO: 1013598 - RNA, 23 nt, Human
ucucuacauccuuaaauagaagc

SEQ ID NO: 1013599 - RNA, 23 nt, Human
ucuugugcuuuugaguugagagg

SEQ ID NO: 1013600 - RNA, 21 nt, Human
ucuuucgggguaccagguagu

SEQ ID NO: 1013601 - RNA, 18 nt, Human
ugagaaugguagagagaa

SEQ ID NO: 1013602 - RNA, 19 nt, Human
ugccauucaucuuuguccc

SEQ ID NO: 1013603 - RNA, 24 nt, Human
uggccagguagaaacaaaaagaag

SEQ ID NO: 1013604 - RNA, 19 nt, Human
uguccaauacagguugaga

SEQ ID NO: 1013605 - RNA, 23 nt, Human
ugucccaucuaacuuuggccagu

SEQ ID NO: 1013606 - RNA, 23 nt, Human
uguuaugauucuuuuucuucuac

SEQ ID NO: 1013607 - RNA, 23 nt, Human
aaggucccucuagauauagaccc

SEQ ID NO: 1013608 - RNA, 21 nt, Human
accagguccagcucagggcca

SEQ ID NO: 1013609 - RNA, 20 nt, Human
acugcaauuuuccgauugcu

SEQ ID NO: 1013610 - RNA, 22 nt, Human
agaacucuuucguuuuuugcuu

SEQ ID NO: 1013611 - RNA, 22 nt, Human
agaacucuuucguuuuuugcuu

SEQ ID NO: 1013612 - RNA, 20 nt, Human
agauauagaccccaaaccaa

SEQ ID NO: 1013613 - RNA, 19 nt, Human
agcuggguuggacaugguc

SEQ ID NO: 1013614 - RNA, 19 nt, Human
agcuggguuggacaugguc

SEQ ID NO: 1013615 - RNA, 19 nt, Human
aggagugaggagagggcag

SEQ ID NO: 1013616 - RNA, 27 nt, Human
caaaccaaacucucccuguagaaagcu

SEQ ID NO: 1013617 - RNA, 20 nt, Human
cagcucagggccaaguccag

SEQ ID NO: 1013618 - RNA, 21 nt, Human
cagcucagggccaaguccaga

SEQ ID NO: 1013619 - RNA, 22 nt, Human
cagcuggauauaucuuagaagc

SEQ ID NO: 1013620 - RNA, 22 nt, Human
cagcuggauauaucuuagaagc

SEQ ID NO: 1013621 - RNA, 18 nt, Human
caggaaagaugaaauggg

SEQ ID NO: 1013622 - RNA, 23 nt, Human
ccaaagucaggaggcccagguuc

SEQ ID NO: 1013623 - RNA, 21 nt, Human
ccccaaaccaaacucucccug

SEQ ID NO: 1013624 - RNA, 18 nt, Human
ccugccuaccccagugga

SEQ ID NO: 1013625 - RNA, 21 nt, Human
cgcccugccuaccccagugga

SEQ ID NO: 1013626 - RNA, 19 nt, Human
cugggagucuguauuguuu

SEQ ID NO: 1013627 - RNA, 19 nt, Human
cugggagucuguauuguuu

SEQ ID NO: 1013628 - RNA, 21 nt, Human
cuucuauucuccugauuccca

SEQ ID NO: 1013629 - RNA, 21 nt, Human
cuucuauucuccugauuccca

SEQ ID NO: 1013630 - RNA, 22 nt, Human
gaccagguccagcucagggcca

SEQ ID NO: 1013631 - RNA, 19 nt, Human
gccaaagucaggaggccca

SEQ ID NO: 1013632 - RNA, 23 nt, Human
gcccugccuaccccaguggacca

SEQ ID NO: 1013633 - RNA, 21 nt, Human
gcucuucagaagucugaacag

SEQ ID NO: 1013634 - RNA, 21 nt, Human
gcucuucagaagucugaacag

SEQ ID NO: 1013635 - RNA, 19 nt, Human
gggaaaguaguuugcagga

SEQ ID NO: 1013636 - RNA, 21 nt, Human
gggaguaauagaagucccagc

SEQ ID NO: 1013637 - RNA, 21 nt, Human
gggaguaauagaagucccagc

SEQ ID NO: 1013638 - RNA, 19 nt, Human
gucuuccucaguauuuaug

SEQ ID NO: 1013639 - RNA, 19 nt, Human
uaccugccaaacacugaaa

SEQ ID NO: 1013640 - RNA, 20 nt, Human
ucagggccaaguccagagga

SEQ ID NO: 1013641 - RNA, 23 nt, Human
uccaauuucagccccgccaggaa

SEQ ID NO: 1013642 - RNA, 18 nt, Human
uccccuuccacugaugca

SEQ ID NO: 1013643 - RNA, 20 nt, Human
ucccucuagauauagacccc

SEQ ID NO: 1013644 - RNA, 22 nt, Human
ucuuccucaguauuuaugugag

SEQ ID NO: 1013645 - RNA, 24 nt, Human
ugaaaugggggucugccaaaguca

SEQ ID NO: 1013646 - RNA, 22 nt, Human
ugaggacuacagaccaaaacug

SEQ ID NO: 1013647 - RNA, 20 nt, Human
ugaggagagggcagggucuu

SEQ ID NO: 1013648 - RNA, 19 nt, Human
ugauucccagcagcacagc

SEQ ID NO: 1013649 - RNA, 19 nt, Human
ugauucccagcagcacagc

SEQ ID NO: 1013650 - RNA, 21 nt, Human
ugcauaaguacaggcacaaag

SEQ ID NO: 1013651 - RNA, 21 nt, Human
ugcuguagaaucuugggccuc

SEQ ID NO: 1013652 - RNA, 18 nt, Human
ugggaaaguaguuugcag

SEQ ID NO: 1013653 - RNA, 18 nt, Human
uguccccuuccacugaug

SEQ ID NO: 1013654 - RNA, 19 nt, Human
uuccaaagggaguaauaga

SEQ ID NO: 1013655 - RNA, 19 nt, Human
uuccaaagggaguaauaga

SEQ ID NO: 1013656 - RNA, 22 nt, Human
uugggauacagaagaaggguuu

SEQ ID NO: 1013657 - RNA, 22 nt, Human
uugggauacagaagaaggguuu

SEQ ID NO: 1013658 - RNA, 24 nt, Human
uuuguuaccugccaaacacugaaa

SEQ ID NO: 1013659 - RNA, 23 nt, Human
uuuuuugcuucuauucuccugau

SEQ ID NO: 1013660 - RNA, 23 nt, Human
uuuuuugcuucuauucuccugau

SEQ ID NO: 1013661 - RNA, 23 nt, Human
agaaaagaaccaaggauauagga

SEQ ID NO: 1013662 - RNA, 18 nt, Human
augacaguaugucuuuuc

SEQ ID NO: 1013663 - RNA, 24 nt, Human
caaaagaaaagcuaaaucuguaaa

SEQ ID NO: 1013664 - RNA, 22 nt, Human
caaaagacaguggucaaagaca

SEQ ID NO: 1013665 - RNA, 18 nt, Human
cgccuggguagagcgaua

SEQ ID NO: 1013666 - RNA, 22 nt, Human
uaaauuaucagaaaagaaccaa

SEQ ID NO: 1013667 - RNA, 25 nt, Human
uauauaacaaaagaaaagcuaaauc

SEQ ID NO: 1013668 - RNA, 24 nt, Human
ucaaggguagccuuuuacauaacu

SEQ ID NO: 1013669 - RNA, 18 nt, Human
uccacaugcgauuggaga

SEQ ID NO: 1013670 - RNA, 18 nt, Human
uuaucagaaaagaaccaa

SEQ ID NO: 1013671 - RNA, 22 nt, Human
uucugugaguuguuaagaguac

SEQ ID NO: 1013672 - RNA, 23 nt, Human
uuuuuuuuuuuuuaaagguccug

SEQ ID NO: 1013673 - RNA, 19 nt, Human
aaaaaaaaaaaaaaagaca

SEQ ID NO: 1013674 - RNA, 19 nt, Human
aaaaaaaaaaaaaaagaca

SEQ ID NO: 1013675 - RNA, 23 nt, Human
aaaaaaauauacagacagaaaac

SEQ ID NO: 1013676 - RNA, 23 nt, Human
aaaaaauagcacagagaaaccau

SEQ ID NO: 1013677 - RNA, 22 nt, Human
aaaaccaaauacauuucguaug

SEQ ID NO: 1013678 - RNA, 23 nt, Human
aaaagaaaaaaagaaagaaagaa

SEQ ID NO: 1013679 - RNA, 19 nt, Human
aaacaacagaaggcaaaag

SEQ ID NO: 1013680 - RNA, 19 nt, Human
aaacaacagaaggcaaaag

SEQ ID NO: 1013681 - RNA, 21 nt, Human
aaacagaguuuuuuuuuuuuu

SEQ ID NO: 1013682 - RNA, 21 nt, Human
aaaccacauuacaaaaugaaa

SEQ ID NO: 1013683 - RNA, 23 nt, Human
aaagaauuccaaaaaauagcaca

SEQ ID NO: 1013684 - RNA, 20 nt, Human
aaagauacauauuguggcuc

SEQ ID NO: 1013685 - RNA, 20 nt, Human
aaagauacauauuguggcuc

SEQ ID NO: 1013686 - RNA, 22 nt, Human
aaauacacacuuccgucaugug

SEQ ID NO: 1013687 - RNA, 19 nt, Human
aacagaaggcaaaagcaga

SEQ ID NO: 1013688 - RNA, 26 nt, Human
aaccacagacaauagacccuguaccc

SEQ ID NO: 1013689 - RNA, 18 nt, Human
aaccauuugaaagccaaa

SEQ ID NO: 1013690 - RNA, 18 nt, Human
aaccugcaauaaaaaggc

SEQ ID NO: 1013691 - RNA, 27 nt, Human
aagcagaaaguggacaucgagggaccc

SEQ ID NO: 1013692 - RNA, 23 nt, Human
aagcgccgacugcaaacgagaca

SEQ ID NO: 1013693 - RNA, 22 nt, Human
aagcuugagguuuguguuaagu

SEQ ID NO: 1013694 - RNA, 22 nt, Human
aagcuugagguuuguguuaagu

SEQ ID NO: 1013695 - RNA, 24 nt, Human
aaguagcuaggacuacaggugugc

SEQ ID NO: 1013696 - RNA, 24 nt, Human
aaguagcuaggacuacaggugugc

SEQ ID NO: 1013697 - RNA, 22 nt, Human
aauggcacaucuuauacuaaaa

SEQ ID NO: 1013698 - RNA, 25 nt, Human
acaaaaccaaauacauuucguaugg

SEQ ID NO: 1013699 - RNA, 21 nt, Human
acaacagaaggcaaaagcaga

SEQ ID NO: 1013700 - RNA, 18 nt, Human
acacucuccaacaaaacc

SEQ ID NO: 1013701 - RNA, 18 nt, Human
acacucuccaacaaaacc

SEQ ID NO: 1013702 - RNA, 19 nt, Human
acagaguuuuuuuuuuuuu

SEQ ID NO: 1013703 - RNA, 18 nt, Human
acaggguuucaucauguu

SEQ ID NO: 1013704 - RNA, 18 nt, Human
acaggguuucaucauguu

SEQ ID NO: 1013705 - RNA, 18 nt, Human
acaggguuucaucauguu

SEQ ID NO: 1013706 - RNA, 19 nt, Human
acaggguuucaucauguuu

SEQ ID NO: 1013707 - RNA, 20 nt, Human
acaggguuucaucauguuug

SEQ ID NO: 1013708 - RNA, 20 nt, Human
acaggguuucaucauguuug

SEQ ID NO: 1013709 - RNA, 24 nt, Human
acaggguuucaucauguuugccag

SEQ ID NO: 1013710 - RNA, 24 nt, Human
acaggguuucaucauguuugccag

SEQ ID NO: 1013711 - RNA, 19 nt, Human
accagcaccuguguacgua

SEQ ID NO: 1013712 - RNA, 21 nt, Human
accaucuaacucaguguccca

SEQ ID NO: 1013713 - RNA, 21 nt, Human
accaucuaacucaguguccca

SEQ ID NO: 1013714 - RNA, 18 nt, Human
acccccuucucuuuuuuu

SEQ ID NO: 1013715 - RNA, 21 nt, Human
acugcaaccuccaccuccugg

SEQ ID NO: 1013716 - RNA, 21 nt, Human
acugcaaccuccaccuccugg

SEQ ID NO: 1013717 - RNA, 21 nt, Human
acugcaaccuccaccuccugg

SEQ ID NO: 1013718 - RNA, 21 nt, Human
acugcaaccuccaccuccugg

SEQ ID NO: 1013719 - RNA, 21 nt, Human
acugcaaccuccaccuccugg

SEQ ID NO: 1013720 - RNA, 22 nt, Human
acugcaaccuccaccuccuggg

SEQ ID NO: 1013721 - RNA, 22 nt, Human
acugcaaccuccaccuccuggg

SEQ ID NO: 1013722 - RNA, 24 nt, Human
acugcaaccuccaccuccuggguu

SEQ ID NO: 1013723 - RNA, 18 nt, Human
acuuccgucauguguccc

SEQ ID NO: 1013724 - RNA, 24 nt, Human
agaaaagcaaaaggguccauucaa

SEQ ID NO: 1013725 - RNA, 21 nt, Human
agaacuaaaaaucagaaaagc

SEQ ID NO: 1013726 - RNA, 19 nt, Human
agagaaacagauacugcaa

SEQ ID NO: 1013727 - RNA, 23 nt, Human
agagaaggcacagcaaagaccau

SEQ ID NO: 1013728 - RNA, 22 nt, Human
agagaugccacucuuucugccc

SEQ ID NO: 1013729 - RNA, 18 nt, Human
agcuaacaccauugugcg

SEQ ID NO: 1013730 - RNA, 19 nt, Human
agcucuacgucuuggauga

SEQ ID NO: 1013731 - RNA, 19 nt, Human
agcucuacgucuuggauga

SEQ ID NO: 1013732 - RNA, 19 nt, Human
agcuuggaaggaaucggca

SEQ ID NO: 1013733 - RNA, 19 nt, Human
agggggaguaaaaaaaaaa

SEQ ID NO: 1013734 - RNA, 22 nt, Human
agggggaguaaaaaaaaaaaaa

SEQ ID NO: 1013735 - RNA, 22 nt, Human
agggggaguaaaaaaaaaaaaa

SEQ ID NO: 1013736 - RNA, 25 nt, Human
agguauguauguuuucacaguuagg

SEQ ID NO: 1013737 - RNA, 25 nt, Human
agguauguauguuuucacaguuagg

SEQ ID NO: 1013738 - RNA, 25 nt, Human
agguuggagugcaguggugugaucu

SEQ ID NO: 1013739 - RNA, 25 nt, Human
agguuggagugcaguggugugaucu

SEQ ID NO: 1013740 - RNA, 23 nt, Human
agugcaguggugugaucuuggcu

SEQ ID NO: 1013741 - RNA, 23 nt, Human
agugcaguggugugaucuuggcu

SEQ ID NO: 1013742 - RNA, 23 nt, Human
agugcaguggugugaucuuggcu

SEQ ID NO: 1013743 - RNA, 23 nt, Human
agugcaguggugugaucuuggcu

SEQ ID NO: 1013744 - RNA, 24 nt, Human
agugcaguggugugaucuuggcuu

SEQ ID NO: 1013745 - RNA, 24 nt, Human
agugcaguggugugaucuuggcuu

SEQ ID NO: 1013746 - RNA, 25 nt, Human
auaaaauaaaggcaaugcaauuuaa

SEQ ID NO: 1013747 - RNA, 20 nt, Human
auaaacaacagaaggcaaaa

SEQ ID NO: 1013748 - RNA, 20 nt, Human
auaaacaacagaaggcaaaa

SEQ ID NO: 1013749 - RNA, 22 nt, Human
auacugaaauccauuuauucca

SEQ ID NO: 1013750 - RNA, 19 nt, Human
auccuuuuugguuuuuuuu

SEQ ID NO: 1013751 - RNA, 25 nt, Human
augcaguagccaguaaugcuccauc

SEQ ID NO: 1013752 - RNA, 21 nt, Human
auucuccugccucagccuccc

SEQ ID NO: 1013753 - RNA, 22 nt, Human
caaaaugcaguacaagaacaua

SEQ ID NO: 1013754 - RNA, 22 nt, Human
caaaaugcaguacaagaacaua

SEQ ID NO: 1013755 - RNA, 21 nt, Human
caacaaaaccaaauacauuuc

SEQ ID NO: 1013756 - RNA, 21 nt, Human
caacaaaaccaaauacauuuc

SEQ ID NO: 1013757 - RNA, 23 nt, Human
caaccuccaccuccuggguucaa

SEQ ID NO: 1013758 - RNA, 23 nt, Human
caaccuccaccuccuggguucaa

SEQ ID NO: 1013759 - RNA, 22 nt, Human
caagcaauucuccugccucagc

SEQ ID NO: 1013760 - RNA, 22 nt, Human
caagcaauucuccugccucagc

SEQ ID NO: 1013761 - RNA, 27 nt, Human
caagcaauucuccugccucagccuccc

SEQ ID NO: 1013762 - RNA, 27 nt, Human
caagcaauucuccugccucagccuccc

SEQ ID NO: 1013763 - RNA, 19 nt, Human
cacaacaauuuauaauacu

SEQ ID NO: 1013764 - RNA, 19 nt, Human
cacaacaauuuauaauacu

SEQ ID NO: 1013765 - RNA, 24 nt, Human
cacagcaaagaccauugcucaaag

SEQ ID NO: 1013766 - RNA, 22 nt, Human
caccaccacgccuggcuaauuu

SEQ ID NO: 1013767 - RNA, 22 nt, Human
caccaccacgccuggcuaauuu

SEQ ID NO: 1013768 - RNA, 23 nt, Human
caccuugcagccgaaugcaaggu

SEQ ID NO: 1013769 - RNA, 19 nt, Human
cacuuuacagcaaagauac

SEQ ID NO: 1013770 - RNA, 19 nt, Human
cacuuuacagcaaagauac

SEQ ID NO: 1013771 - RNA, 22 nt, Human
cagaacuaaaaaucagaaaagc

SEQ ID NO: 1013772 - RNA, 24 nt, Human
cagaauagcucuaaacaggauucu

SEQ ID NO: 1013773 - RNA, 20 nt, Human
cagauauauacucgaguauc

SEQ ID NO: 1013774 - RNA, 18 nt, Human
cagcagcuaaaacacugc

SEQ ID NO: 1013775 - RNA, 20 nt, Human
cagcuccugaacuucuuggg

SEQ ID NO: 1013776 - RNA, 24 nt, Human
caggguuucaucauguuugccagg

SEQ ID NO: 1013777 - RNA, 24 nt, Human
caggguuucaucauguuugccagg

SEQ ID NO: 1013778 - RNA, 25 nt, Human
cauacagaggacaaaauggcacauc

SEQ ID NO: 1013779 - RNA, 24 nt, Human
caucauguuugccaggcuagucuc

SEQ ID NO: 1013780 - RNA, 24 nt, Human
caucuuauacuaaaacugcuaaau

SEQ ID NO: 1013781 - RNA, 26 nt, Human
caucuuauuuuucccaaacuaaccac

SEQ ID NO: 1013782 - RNA, 22 nt, Human
caugugucccagcagcuaaaac

SEQ ID NO: 1013783 - RNA, 21 nt, Human
cauguuugccaggcuagucuc

SEQ ID NO: 1013784 - RNA, 18 nt, Human
cauuugaaagccaaauac

SEQ ID NO: 1013785 - RNA, 22 nt, Human
cauuugaaagccaaauacuuua

SEQ ID NO: 1013786 - RNA, 26 nt, Human
ccaccuccuggguucaagcaauucuu

SEQ ID NO: 1013787 - RNA, 27 nt, Human
ccaccuccuggguucaagcaauucuuu

SEQ ID NO: 1013788 - RNA, 18 nt, Human
ccagguuggagugcagug

SEQ ID NO: 1013789 - RNA, 18 nt, Human
ccagguuggagugcagug

SEQ ID NO: 1013790 - RNA, 19 nt, Human
ccauuauguggaucccaga

SEQ ID NO: 1013791 - RNA, 22 nt, Human
cccaaguagcuaggacuacagg

SEQ ID NO: 1013792 - RNA, 22 nt, Human
cccaaguagcuaggacuacagg

SEQ ID NO: 1013793 - RNA, 18 nt, Human
ccccuucucuuuuuuuuc

SEQ ID NO: 1013794 - RNA, 21 nt, Human
cccuguacccagccucgcgcc

SEQ ID NO: 1013795 - RNA, 19 nt, Human
ccuccaccuccuggguuca

SEQ ID NO: 1013796 - RNA, 19 nt, Human
ccuccaccuccuggguuca

SEQ ID NO: 1013797 - RNA, 24 nt, Human
ccuccuggguucaagcaauucucc

SEQ ID NO: 1013798 - RNA, 24 nt, Human
ccuccuggguucaagcaauucucc

SEQ ID NO: 1013799 - RNA, 23 nt, Human
ccugccucagccucccaaguagc

SEQ ID NO: 1013800 - RNA, 23 nt, Human
ccugccucagccucccaaguagc

SEQ ID NO: 1013801 - RNA, 23 nt, Human
ccuggguucaagcaauucuccug

SEQ ID NO: 1013802 - RNA, 23 nt, Human
ccuggguucaagcaauucuccug

SEQ ID NO: 1013803 - RNA, 24 nt, Human
cgcgccugcggaggaagacaguuc

SEQ ID NO: 1013804 - RNA, 22 nt, Human
cggaaauaaauaggguuaagua

SEQ ID NO: 1013805 - RNA, 19 nt, Human
cuaaaauuaaggcagcagc

SEQ ID NO: 1013806 - RNA, 19 nt, Human
cuaaaauuaaggcagcagc

SEQ ID NO: 1013807 - RNA, 24 nt, Human
cucccaaguagcuaggacuacagg

SEQ ID NO: 1013808 - RNA, 24 nt, Human
cucccaaguagcuaggacuacagg

SEQ ID NO: 1013809 - RNA, 21 nt, Human
cuccuggguucaagcaauucu

SEQ ID NO: 1013810 - RNA, 21 nt, Human
cuccuggguucaagcaauucu

SEQ ID NO: 1013811 - RNA, 21 nt, Human
cugaccucaggugauuugccc

SEQ ID NO: 1013812 - RNA, 21 nt, Human
cugaccucaggugauuugccc

SEQ ID NO: 1013813 - RNA, 18 nt, Human
cugcaaccuccaccuccu

SEQ ID NO: 1013814 - RNA, 23 nt, Human
cugcaaccuccaccuccuggguu

SEQ ID NO: 1013815 - RNA, 23 nt, Human
cugcaaccuccaccuccuggguu

SEQ ID NO: 1013816 - RNA, 24 nt, Human
cugcaaccuccaccuccuggguuc

SEQ ID NO: 1013817 - RNA, 24 nt, Human
cugcaagcaaauagaauauucaca

SEQ ID NO: 1013818 - RNA, 23 nt, Human
cugcccagcuaacaccauugugc

SEQ ID NO: 1013819 - RNA, 23 nt, Human
cugccucagccucccaaguagcu

SEQ ID NO: 1013820 - RNA, 23 nt, Human
cugccucagccucccaaguagcu

SEQ ID NO: 1013821 - RNA, 26 nt, Human
cugcugaccucaggugauuugcccgc

SEQ ID NO: 1013822 - RNA, 26 nt, Human
cugcugaccucaggugauuugcccgc

SEQ ID NO: 1013823 - RNA, 19 nt, Human
cuguauugcuucuuuggca

SEQ ID NO: 1013824 - RNA, 23 nt, Human
cuucuaaauacgauacgagagaa

SEQ ID NO: 1013825 - RNA, 23 nt, Human
cuucucuuuuuuuuccagaaacu

SEQ ID NO: 1013826 - RNA, 19 nt, Human
cuugcacuggauaauccuc

SEQ ID NO: 1013827 - RNA, 18 nt, Human
cuuuauaccacaagggua

SEQ ID NO: 1013828 - RNA, 18 nt, Human
cuuuauaccacaagggua

SEQ ID NO: 1013829 - RNA, 22 nt, Human
gaaagaaagaaaagcagaaagu

SEQ ID NO: 1013830 - RNA, 20 nt, Human
gacaggguuucaucauguuu

SEQ ID NO: 1013831 - RNA, 24 nt, Human
gaccucaggugauuugcccgccuc

SEQ ID NO: 1013832 - RNA, 24 nt, Human
gaccucaggugauuugcccgccuc

SEQ ID NO: 1013833 - RNA, 19 nt, Human
gagacgggcgggggcggcc

SEQ ID NO: 1013834 - RNA, 23 nt, Human
gagagaaacuccaaaagcuugga

SEQ ID NO: 1013835 - RNA, 20 nt, Human
gagucaaccacagacaauag

SEQ ID NO: 1013836 - RNA, 20 nt, Human
gaguuuuuuuuuuuuuuuuu

SEQ ID NO: 1013837 - RNA, 22 nt, Human
gcaaccuccaccuccuggguuc

SEQ ID NO: 1013838 - RNA, 20 nt, Human
gcagguaagauaaacaacag

SEQ ID NO: 1013839 - RNA, 22 nt, Human
gccgacugcaaacgagacacug

SEQ ID NO: 1013840 - RNA, 21 nt, Human
gccugcggaggaagacaguuc

SEQ ID NO: 1013841 - RNA, 22 nt, Human
ggacuacaggugugcaccacca

SEQ ID NO: 1013842 - RNA, 22 nt, Human
ggacuacaggugugcaccacca

SEQ ID NO: 1013843 - RNA, 18 nt, Human
ggcggccgcugcggcuuc

SEQ ID NO: 1013844 - RNA, 26 nt, Human
gggcgggggcggccgcugcggcuucu

SEQ ID NO: 1013845 - RNA, 21 nt, Human
gggggaguaaaaaaaaaaaaa

SEQ ID NO: 1013846 - RNA, 21 nt, Human
gggggaguaaaaaaaaaaaaa

SEQ ID NO: 1013847 - RNA, 24 nt, Human
gguccauucaacauauagcagcuu

SEQ ID NO: 1013848 - RNA, 21 nt, Human
ggucccucccgggcccaggga

SEQ ID NO: 1013849 - RNA, 22 nt, Human
gguuggagugcaguggugugau

SEQ ID NO: 1013850 - RNA, 22 nt, Human
gguuggagugcaguggugugau

SEQ ID NO: 1013851 - RNA, 20 nt, Human
gugauuugcccgccucaccc

SEQ ID NO: 1013852 - RNA, 20 nt, Human
gugauuugcccgccucaccc

SEQ ID NO: 1013853 - RNA, 18 nt, Human
uaaaauuaaggcagcagc

SEQ ID NO: 1013854 - RNA, 18 nt, Human
uaaaauuaaggcagcagc

SEQ ID NO: 1013855 - RNA, 19 nt, Human
uaaaggucgcccccagccc

SEQ ID NO: 1013856 - RNA, 22 nt, Human
uaacuaaaauauacggaaauaa

SEQ ID NO: 1013857 - RNA, 19 nt, Human
uaacucagugucccagaau

SEQ ID NO: 1013858 - RNA, 19 nt, Human
uaacucagugucccagaau

SEQ ID NO: 1013859 - RNA, 19 nt, Human
uaacucagugucccagaau

SEQ ID NO: 1013860 - RNA, 19 nt, Human
uaacucagugucccagaau

SEQ ID NO: 1013861 - RNA, 23 nt, Human
uaagauaaacaacagaaggcaaa

SEQ ID NO: 1013862 - RNA, 23 nt, Human
uaagauaaacaacagaaggcaaa

SEQ ID NO: 1013863 - RNA, 23 nt, Human
uaagauaucucuggaaucugaaa

SEQ ID NO: 1013864 - RNA, 22 nt, Human
uaagaugcaguagccaguaaug

SEQ ID NO: 1013865 - RNA, 20 nt, Human
uaaguuaauuaaggcagaca

SEQ ID NO: 1013866 - RNA, 22 nt, Human
uacaggugugcaccaccacgcc

SEQ ID NO: 1013867 - RNA, 22 nt, Human
uacaggugugcaccaccacgcc

SEQ ID NO: 1013868 - RNA, 28 nt, Human
uacaugucagaacuaaaaaucagaaaag

SEQ ID NO: 1013869 - RNA, 28 nt, Human
uacaugucagaacuaaaaaucagaaaag

SEQ ID NO: 1013870 - RNA, 21 nt, Human
uacauucuuaauaucugcagg

SEQ ID NO: 1013871 - RNA, 21 nt, Human
uacauucuuaauaucugcagg

SEQ ID NO: 1013872 - RNA, 23 nt, Human
uacgauacgagagaaacuccaaa

SEQ ID NO: 1013873 - RNA, 20 nt, Human
uacuacaaacccccuucucu

SEQ ID NO: 1013874 - RNA, 21 nt, Human
uacugcaaccuccaccuccug

SEQ ID NO: 1013875 - RNA, 21 nt, Human
uacugcaaccuccaccuccug

SEQ ID NO: 1013876 - RNA, 23 nt, Human
uacugcaaccuccaccuccuggg

SEQ ID NO: 1013877 - RNA, 23 nt, Human
uacugcaaccuccaccuccuggg

SEQ ID NO: 1013878 - RNA, 22 nt, Human
uagagacaggguuucaucaugu

SEQ ID NO: 1013879 - RNA, 22 nt, Human
uagagacaggguuucaucaugu

SEQ ID NO: 1013880 - RNA, 24 nt, Human
uagagggggaguaaaaaaaaaaaa

SEQ ID NO: 1013881 - RNA, 25 nt, Human
uagcacagagaaaccauuugaaagc

SEQ ID NO: 1013882 - RNA, 21 nt, Human
uaggacuacaggugugcacca

SEQ ID NO: 1013883 - RNA, 21 nt, Human
uaggacuacaggugugcacca

SEQ ID NO: 1013884 - RNA, 24 nt, Human
uaggacuacaggugugcaccacca

SEQ ID NO: 1013885 - RNA, 24 nt, Human
uaggacuacaggugugcaccacca

SEQ ID NO: 1013886 - RNA, 24 nt, Human
uaguagagacaggguuucaucaug

SEQ ID NO: 1013887 - RNA, 24 nt, Human
uaguagagacaggguuucaucaug

SEQ ID NO: 1013888 - RNA, 24 nt, Human
uaguauaaacaaaauauuuagcaa

SEQ ID NO: 1013889 - RNA, 25 nt, Human
uaguauaaacaaaauauuuagcaau

SEQ ID NO: 1013890 - RNA, 22 nt, Human
uauaauacuuuauaccacaagg

SEQ ID NO: 1013891 - RNA, 22 nt, Human
uauaauacuuuauaccacaagg

SEQ ID NO: 1013892 - RNA, 19 nt, Human
uauauacaugucagaacua

SEQ ID NO: 1013893 - RNA, 19 nt, Human
uauauacaugucagaacua

SEQ ID NO: 1013894 - RNA, 21 nt, Human
uauucacagccaaaugaaauu

SEQ ID NO: 1013895 - RNA, 20 nt, Human
uauuucaaauguuucuguua

SEQ ID NO: 1013896 - RNA, 20 nt, Human
ucaaagacguaagauaucuc

SEQ ID NO: 1013897 - RNA, 19 nt, Human
ucaagcaauucuccugccu

SEQ ID NO: 1013898 - RNA, 19 nt, Human
ucaagcaauucuccugccu

SEQ ID NO: 1013899 - RNA, 21 nt, Human
ucacuuccagaucagucugac

SEQ ID NO: 1013900 - RNA, 21 nt, Human
ucacuuccagaucagucugac

SEQ ID NO: 1013901 - RNA, 24 nt, Human
ucagaccaaaguacggagucaacc

SEQ ID NO: 1013902 - RNA, 18 nt, Human
ucagccucccaaguagcu

SEQ ID NO: 1013903 - RNA, 20 nt, Human
ucagccucccaaguagcuag

SEQ ID NO: 1013904 - RNA, 20 nt, Human
ucagccucccaaguagcuag

SEQ ID NO: 1013905 - RNA, 25 nt, Human
ucagugucccagaauuuaaaauuuc

SEQ ID NO: 1013906 - RNA, 25 nt, Human
ucagugucccagaauuuaaaauuuc

SEQ ID NO: 1013907 - RNA, 21 nt, Human
ucauucagacauacagaggac

SEQ ID NO: 1013908 - RNA, 28 nt, Human
uccaaaaaauagcacagagaaaccauua

SEQ ID NO: 1013909 - RNA, 18 nt, Human
uccauuggcaucucccuu

SEQ ID NO: 1013910 - RNA, 24 nt, Human
ucccaaguagcuaggacuacaggu

SEQ ID NO: 1013911 - RNA, 24 nt, Human
ucccaaguagcuaggacuacaggu

SEQ ID NO: 1013912 - RNA, 24 nt, Human
ucccagaauuuaaaauuuccuugc

SEQ ID NO: 1013913 - RNA, 24 nt, Human
ucccagaauuuaaaauuuccuugc

SEQ ID NO: 1013914 - RNA, 18 nt, Human
ucccagcagcuaaaacac

SEQ ID NO: 1013915 - RNA, 19 nt, Human
ucccgaaggccucagacca

SEQ ID NO: 1013916 - RNA, 21 nt, Human
uccuggguucaagcaauucuc

SEQ ID NO: 1013917 - RNA, 21 nt, Human
uccuggguucaagcaauucuc

SEQ ID NO: 1013918 - RNA, 24 nt, Human
uccuggguucaagcaauucuccug

SEQ ID NO: 1013919 - RNA, 24 nt, Human
uccuggguucaagcaauucuccug

SEQ ID NO: 1013920 - RNA, 26 nt, Human
ucuccugccucagccucccaaguagc

SEQ ID NO: 1013921 - RNA, 26 nt, Human
ucuccugccucagccucccaaguagc

SEQ ID NO: 1013922 - RNA, 19 nt, Human
ucucgcucuguuguccagg

SEQ ID NO: 1013923 - RNA, 19 nt, Human
ucucgcucuguuguccagg

SEQ ID NO: 1013924 - RNA, 19 nt, Human
ucucgcucuguuguccagg

SEQ ID NO: 1013925 - RNA, 19 nt, Human
ucucgcucuguuguccagg

SEQ ID NO: 1013926 - RNA, 23 nt, Human
ucucgcucuguuguccagguugg

SEQ ID NO: 1013927 - RNA, 23 nt, Human
ucucgcucuguuguccagguugg

SEQ ID NO: 1013928 - RNA, 24 nt, Human
ucucgcucuguuguccagguugga

SEQ ID NO: 1013929 - RNA, 24 nt, Human
ucucgcucuguuguccagguugga

SEQ ID NO: 1013930 - RNA, 23 nt, Human
ucugcagguaagauaaacaacag

SEQ ID NO: 1013931 - RNA, 24 nt, Human
ucuguuguccagguuggagugcag

SEQ ID NO: 1013932 - RNA, 24 nt, Human
ucuguuguccagguuggagugcag

SEQ ID NO: 1013933 - RNA, 24 nt, Human
ugaaaaugcuauuuuaugaaaaua

SEQ ID NO: 1013934 - RNA, 18 nt, Human
ugaccucaggugauuugc

SEQ ID NO: 1013935 - RNA, 18 nt, Human
ugaccucaggugauuugc

SEQ ID NO: 1013936 - RNA, 24 nt, Human
ugaccucaggugauuugcccgccu

SEQ ID NO: 1013937 - RNA, 24 nt, Human
ugaccucaggugauuugcccgccu

SEQ ID NO: 1013938 - RNA, 22 nt, Human
ugagauggagucucgcucuguu

SEQ ID NO: 1013939 - RNA, 20 nt, Human
ugagguuuguguuaagugua

SEQ ID NO: 1013940 - RNA, 20 nt, Human
ugagguuuguguuaagugua

SEQ ID NO: 1013941 - RNA, 21 nt, Human
ugcagaaacagaguuuuuuuu

SEQ ID NO: 1013942 - RNA, 21 nt, Human
ugcagaaacagaguuuuuuuu

SEQ ID NO: 1013943 - RNA, 21 nt, Human
ugcaguggugugaucuuggcu

SEQ ID NO: 1013944 - RNA, 23 nt, Human
ugccucagccucccaaguagcua

SEQ ID NO: 1013945 - RNA, 24 nt, Human
ugccucagccucccaaguagcuag

SEQ ID NO: 1013946 - RNA, 24 nt, Human
ugccucagccucccaaguagcuag

SEQ ID NO: 1013947 - RNA, 20 nt, Human
uggaaggaaucggcagcucc

SEQ ID NO: 1013948 - RNA, 22 nt, Human
uggaaucugaaagaauuccaaa

SEQ ID NO: 1013949 - RNA, 19 nt, Human
uggagugcaguggugugau

SEQ ID NO: 1013950 - RNA, 19 nt, Human
uggagugcaguggugugau

SEQ ID NO: 1013951 - RNA, 23 nt, Human
uggagugcaguggugugaucuug

SEQ ID NO: 1013952 - RNA, 23 nt, Human
uggagugcaguggugugaucuug

SEQ ID NO: 1013953 - RNA, 24 nt, Human
uggagugcaguggugugaucuugg

SEQ ID NO: 1013954 - RNA, 24 nt, Human
uggagugcaguggugugaucuugg

SEQ ID NO: 1013955 - RNA, 21 nt, Human
uggcaucucccuuugagauaa

SEQ ID NO: 1013956 - RNA, 19 nt, Human
ugggugggcaucacucuuc

SEQ ID NO: 1013957 - RNA, 22 nt, Human
ugggugggcaucacucuucgga

SEQ ID NO: 1013958 - RNA, 21 nt, Human
uggguucaagcaauucuccug

SEQ ID NO: 1013959 - RNA, 21 nt, Human
uggguucaagcaauucuccug

SEQ ID NO: 1013960 - RNA, 23 nt, Human
uggguucaagcaauucuccugcc

SEQ ID NO: 1013961 - RNA, 23 nt, Human
uggguucaagcaauucuccugcc

SEQ ID NO: 1013962 - RNA, 24 nt, Human
uggguucaagcaauucuccugccu

SEQ ID NO: 1013963 - RNA, 24 nt, Human
uggguucaagcaauucuccugccu

SEQ ID NO: 1013964 - RNA, 20 nt, Human
uguccagguuggagugcagu

SEQ ID NO: 1013965 - RNA, 20 nt, Human
uguccagguuggagugcagu

SEQ ID NO: 1013966 - RNA, 24 nt, Human
uguccagguuggagugcaguggug

SEQ ID NO: 1013967 - RNA, 24 nt, Human
uguccagguuggagugcaguggug

SEQ ID NO: 1013968 - RNA, 23 nt, Human
ugucccagcagcuaaaacacugc

SEQ ID NO: 1013969 - RNA, 19 nt, Human
uguuguccagguuggagug

SEQ ID NO: 1013970 - RNA, 19 nt, Human
uguuguccagguuggagug

SEQ ID NO: 1013971 - RNA, 24 nt, Human
uuacugcaaccuccaccuccuggg

SEQ ID NO: 1013972 - RNA, 24 nt, Human
uuacugcaaccuccaccuccuggg

SEQ ID NO: 1013973 - RNA, 25 nt, Human
uuacugcaaccuccaccuccugggu

SEQ ID NO: 1013974 - RNA, 27 nt, Human
uuacugcaaccuccaccuccuggguuc

SEQ ID NO: 1013975 - RNA, 24 nt, Human
uuaguagagacaggguuucaucau

SEQ ID NO: 1013976 - RNA, 24 nt, Human
uuaguagagacaggguuucaucau

SEQ ID NO: 1013977 - RNA, 21 nt, Human
uucaagcaauucuccugccuc

SEQ ID NO: 1013978 - RNA, 21 nt, Human
uucaagcaauucuccugccuc

SEQ ID NO: 1013979 - RNA, 24 nt, Human
uucaagcaauucuccugccucagc

SEQ ID NO: 1013980 - RNA, 24 nt, Human
uucaagcaauucuccugccucagc

SEQ ID NO: 1013981 - RNA, 23 nt, Human
uucacaacaauuuauaauacuuu

SEQ ID NO: 1013982 - RNA, 23 nt, Human
uucacaacaauuuauaauacuuu

SEQ ID NO: 1013983 - RNA, 18 nt, Human
uucacaguuagaucuuua

SEQ ID NO: 1013984 - RNA, 18 nt, Human
uucacaguuagaucuuua

SEQ ID NO: 1013985 - RNA, 19 nt, Human
uuccaaaggaaaaccugca

SEQ ID NO: 1013986 - RNA, 18 nt, Human
uuccagaucagucugaca

SEQ ID NO: 1013987 - RNA, 19 nt, Human
uuccagaucagucugacac

SEQ ID NO: 1013988 - RNA, 22 nt, Human
uucucuuuuuuuuccagaaacu

SEQ ID NO: 1013989 - RNA, 19 nt, Human
uucuuuggcaacucaccaa

SEQ ID NO: 1013990 - RNA, 24 nt, Human
uuguccagguuggagugcaguggu

SEQ ID NO: 1013991 - RNA, 20 nt, Human
uuguuguuguuuuuaaauaa

SEQ ID NO: 1013992 - RNA, 20 nt, Human
uuguuguuguuuuuaaauaa

SEQ ID NO: 1013993 - RNA, 23 nt, Human
uuuauccauauuccaaaggaaaa

SEQ ID NO: 1013994 - RNA, 21 nt, Human
uuucaucauguuugccaggcu

SEQ ID NO: 1013995 - RNA, 21 nt, Human
uuucaucauguuugccaggcu

SEQ ID NO: 1013996 - RNA, 20 nt, Human
uuuugguuuuuuuuuuuucu

SEQ ID NO: 1013997 - RNA, 23 nt, Human
uuuuuaguagagacaggguuuca

SEQ ID NO: 1013998 - RNA, 24 nt, Human
uuuuuaguagagacaggguuucau

SEQ ID NO: 1013999 - RNA, 22 nt, Human
uuuuuguauuuuuaguagagaa

SEQ ID NO: 1014000 - RNA, 22 nt, Human
uuuuuguauuuuuaguagagaa

SEQ ID NO: 1014001 - RNA, 24 nt, Human
uuuuuuguauuuuuaguagagaca

SEQ ID NO: 1014002 - RNA, 24 nt, Human
uuuuuuguauuuuuaguagagaca

SEQ ID NO: 1014003 - RNA, 22 nt, Human
uuuuuuguauuuuuaguagagg

SEQ ID NO: 1014004 - RNA, 22 nt, Human
uuuuuuguauuuuuaguagagg

SEQ ID NO: 1014005 - RNA, 24 nt, Human
uuuuuuuucugcacagacacaaua

SEQ ID NO: 1014006 - RNA, 25 nt, Human
uuuuuuuuuuuuaaauccauggucu

SEQ ID NO: 1014007 - RNA, 20 nt, Human
uuuuuuuuuuuuacaagucu

SEQ ID NO: 1014008 - RNA, 25 nt, Human
uuuuuuuuuuuugagauggagucuc

SEQ ID NO: 1014009 - RNA, 22 nt, Human
uuuuuuuuuuuuuugagaugga

SEQ ID NO: 1014010 - RNA, 23 nt, Human
uuuuuuuuuuuuuuuuuuacaag

SEQ ID NO: 1014011 - RNA, 22 nt, Human
aaacaaacugacaaguucaagc

SEQ ID NO: 1014012 - RNA, 24 nt, Human
aaacugacaaguucaagcaccugu

SEQ ID NO: 1014013 - RNA, 21 nt, Human
aacccugucuguugaauccac

SEQ ID NO: 1014014 - RNA, 22 nt, Human
aaccugagacggagaugaaggu

SEQ ID NO: 1014015 - RNA, 18 nt, Human
aagcccuuaauaccuuuc

SEQ ID NO: 1014016 - RNA, 21 nt, Human
aaggcaucaccauuuuccugu

SEQ ID NO: 1014017 - RNA, 20 nt, Human
aagggagagaagaacaugga

SEQ ID NO: 1014018 - RNA, 22 nt, Human
aagucaguauuucuugaacugg

SEQ ID NO: 1014019 - RNA, 21 nt, Human
aaucuaucguugcuuuuccua

SEQ ID NO: 1014020 - RNA, 18 nt, Human
aauuugcacuuuuucccc

SEQ ID NO: 1014021 - RNA, 22 nt, Human
acagagcuuguuucaaaucuau

SEQ ID NO: 1014022 - RNA, 21 nt, Human
acagccaaccuggcaguuguc

SEQ ID NO: 1014023 - RNA, 22 nt, Human
acuuugagagguucggaaaauu

SEQ ID NO: 1014024 - RNA, 20 nt, Human
agagaagaacauggagcaau

SEQ ID NO: 1014025 - RNA, 25 nt, Human
agccagcagcauuuuuuuuuuuuuu

SEQ ID NO: 1014026 - RNA, 24 nt, Human
agcccuuaauaccuuucugaacag

SEQ ID NO: 1014027 - RNA, 22 nt, Human
auaagggagagaagaacaugga

SEQ ID NO: 1014028 - RNA, 23 nt, Human
auaagggagagaagaacauggag

SEQ ID NO: 1014029 - RNA, 28 nt, Human
aucuacaacuacuucuguauauauugcu

SEQ ID NO: 1014030 - RNA, 19 nt, Human
caaacugacaaguucaagc

SEQ ID NO: 1014031 - RNA, 21 nt, Human
cagaaaagccagcagcauuuu

SEQ ID NO: 1014032 - RNA, 22 nt, Human
caguggccaugucccaaaauuc

SEQ ID NO: 1014033 - RNA, 18 nt, Human
cauucuuguuuuccaagg

SEQ ID NO: 1014034 - RNA, 19 nt, Human
ccaaccuggcaguuguccu

SEQ ID NO: 1014035 - RNA, 20 nt, Human
ccacugugguuauuacuagu

SEQ ID NO: 1014036 - RNA, 18 nt, Human
ccagccuucuggcagggg

SEQ ID NO: 1014037 - RNA, 22 nt, Human
ccauaagggucauuuucugcag

SEQ ID NO: 1014038 - RNA, 22 nt, Human
cccuuaauaccuuucugaacag

SEQ ID NO: 1014039 - RNA, 21 nt, Human
ccugguggcaaagguccauaa

SEQ ID NO: 1014040 - RNA, 18 nt, Human
ccugucuucagaaaagcc

SEQ ID NO: 1014041 - RNA, 21 nt, Human
cuagcuucagauuccaauucu

SEQ ID NO: 1014042 - RNA, 20 nt, Human
cugaacagccaugcaacuaa

SEQ ID NO: 1014043 - RNA, 25 nt, Human
cugaaggcucuccauuuucauguaa

SEQ ID NO: 1014044 - RNA, 20 nt, Human
cugagacggagaugaaggug

SEQ ID NO: 1014045 - RNA, 18 nt, Human
cuugcugaaggcucucca

SEQ ID NO: 1014046 - RNA, 25 nt, Human
cuuuaugaaugaauggcugucaugu

SEQ ID NO: 1014047 - RNA, 21 nt, Human
cuuuuuccuggucagucauuu

SEQ ID NO: 1014048 - RNA, 18 nt, Human
gaaaaggaugaacuguuu

SEQ ID NO: 1014049 - RNA, 19 nt, Human
gaacagcuuauauacacua

SEQ ID NO: 1014050 - RNA, 21 nt, Human
uaagacacgauucccucuuuc

SEQ ID NO: 1014051 - RNA, 21 nt, Human
uaaggaugaucuuuuuccugg

SEQ ID NO: 1014052 - RNA, 20 nt, Human
uaaggcaucaccauuuuccu

SEQ ID NO: 1014053 - RNA, 22 nt, Human
uaccuuacaccuucacgaguau

SEQ ID NO: 1014054 - RNA, 25 nt, Human
uacuucuagcuucagauuccaauuc

SEQ ID NO: 1014055 - RNA, 24 nt, Human
uagaaaaggaugaacuguuuugca

SEQ ID NO: 1014056 - RNA, 18 nt, Human
uagaaggaauacauucau

SEQ ID NO: 1014057 - RNA, 24 nt, Human
uaguaucagaccuuggugaagcag

SEQ ID NO: 1014058 - RNA, 18 nt, Human
uauauacacuaucugugc

SEQ ID NO: 1014059 - RNA, 22 nt, Human
ucaccauuuuccuguauuucua

SEQ ID NO: 1014060 - RNA, 20 nt, Human
ucagauuccaauucugcacu

SEQ ID NO: 1014061 - RNA, 21 nt, Human
ucccaaaauucagcuaaaacu

SEQ ID NO: 1014062 - RNA, 23 nt, Human
ucccagccuucuggcagggguuc

SEQ ID NO: 1014063 - RNA, 19 nt, Human
uccuguauuucuaugguug

SEQ ID NO: 1014064 - RNA, 22 nt, Human
uccuugcugaaggcucuccauu

SEQ ID NO: 1014065 - RNA, 23 nt, Human
ucuaauauacuucuagcuucaga

SEQ ID NO: 1014066 - RNA, 22 nt, Human
ucuauaaaacuagagccacuau

SEQ ID NO: 1014067 - RNA, 18 nt, Human
ucuaugguuggagaugag

SEQ ID NO: 1014068 - RNA, 18 nt, Human
ucuguaagccuugaguuc

SEQ ID NO: 1014069 - RNA, 18 nt, Human
ucuguaagccuugaguuc

SEQ ID NO: 1014070 - RNA, 22 nt, Human
ucuuguguuaugaucaacaaag

SEQ ID NO: 1014071 - RNA, 21 nt, Human
ucuuugaauguuguuguucuu

SEQ ID NO: 1014072 - RNA, 23 nt, Human
ugauucacaaaguaaacccuguc

SEQ ID NO: 1014073 - RNA, 27 nt, Human
ugcaauuuuucuuggcugggguauuua

SEQ ID NO: 1014074 - RNA, 20 nt, Human
ugcacugguagaaggaauac

SEQ ID NO: 1014075 - RNA, 25 nt, Human
uggaagaacggaaaacauacuuuga

SEQ ID NO: 1014076 - RNA, 23 nt, Human
ugggguauuuaaaugcaagagcu

SEQ ID NO: 1014077 - RNA, 20 nt, Human
ugucaucggcaggcucagau

SEQ ID NO: 1014078 - RNA, 21 nt, Human
uguguaucaacagagcuuguu

SEQ ID NO: 1014079 - RNA, 19 nt, Human
uguguuaugaucaacaaag

SEQ ID NO: 1014080 - RNA, 22 nt, Human
uguuuauauagauauauaugua

SEQ ID NO: 1014081 - RNA, 21 nt, Human
uucaaaagcagaacuacuucu

SEQ ID NO: 1014082 - RNA, 23 nt, Human
uucugaggaagucaguauuucuu

SEQ ID NO: 1014083 - RNA, 22 nt, Human
uucuucagacacuacuggagua

SEQ ID NO: 1014084 - RNA, 23 nt, Human
uugcugaaggcucuccauuuuca

SEQ ID NO: 1014085 - RNA, 25 nt, Human
uuucccagccugguggcaaaggucc

SEQ ID NO: 1014086 - RNA, 20 nt, Human
uuuccuggucagucauuuca

SEQ ID NO: 1014087 - RNA, 18 nt, Human
aaaccacagagagcagca

SEQ ID NO: 1014088 - RNA, 21 nt, Human
aaagaacuuagcaacaaagag

SEQ ID NO: 1014089 - RNA, 22 nt, Human
aaccuccaacucagugcauccc

SEQ ID NO: 1014090 - RNA, 21 nt, Human
aagcagacggugguggucagg

SEQ ID NO: 1014091 - RNA, 19 nt, Human
aaggcacacagggcaaaga

SEQ ID NO: 1014092 - RNA, 23 nt, Human
aauccucuccuuaaaugucuggc

SEQ ID NO: 1014093 - RNA, 24 nt, Human
aaucuugccuucaccuaaguccac

SEQ ID NO: 1014094 - RNA, 19 nt, Human
aauggcagagaggagaggg

SEQ ID NO: 1014095 - RNA, 21 nt, Human
acgcuggacacaaacugggcc

SEQ ID NO: 1014096 - RNA, 22 nt, Human
agaaguuuccuguuuugccuaa

SEQ ID NO: 1014097 - RNA, 24 nt, Human
agagagcagcacaaagagguuuac

SEQ ID NO: 1014098 - RNA, 21 nt, Human
agagagugugauuugagggug

SEQ ID NO: 1014099 - RNA, 21 nt, Human
agaggaagaagaggaucaaag

SEQ ID NO: 1014100 - RNA, 21 nt, Human
agaggaagaagaggaucaaag

SEQ ID NO: 1014101 - RNA, 20 nt, Human
agccaagaaauggcagagag

SEQ ID NO: 1014102 - RNA, 24 nt, Human
auggaaucaacaauaauccucucc

SEQ ID NO: 1014103 - RNA, 18 nt, Human
caaaccacagagagcagc

SEQ ID NO: 1014104 - RNA, 18 nt, Human
caaagaaucauuagccca

SEQ ID NO: 1014105 - RNA, 24 nt, Human
caacagaagcaaaucuugccuuca

SEQ ID NO: 1014106 - RNA, 24 nt, Human
caacucagugcaucccaaacccag

SEQ ID NO: 1014107 - RNA, 20 nt, Human
cacaaaccacagagagcagc

SEQ ID NO: 1014108 - RNA, 21 nt, Human
cacagggcaaagaggacuuuc

SEQ ID NO: 1014109 - RNA, 23 nt, Human
cagacacgggagccaacaggugg

SEQ ID NO: 1014110 - RNA, 18 nt, Human
cagagagcagcacaaaga

SEQ ID NO: 1014111 - RNA, 21 nt, Human
cagagugcuccuuuuuuuuga

SEQ ID NO: 1014112 - RNA, 19 nt, Human
cagccaagaaauggcagag

SEQ ID NO: 1014113 - RNA, 21 nt, Human
cagccaagaaauggcagagag

SEQ ID NO: 1014114 - RNA, 21 nt, Human
cagccuaggauaaauccagcu

SEQ ID NO: 1014115 - RNA, 20 nt, Human
cagcggccaccaagcagacg

SEQ ID NO: 1014116 - RNA, 25 nt, Human
ccaaacccagacgggccuggaccga

SEQ ID NO: 1014117 - RNA, 19 nt, Human
cccaguuucugcccaugcc

SEQ ID NO: 1014118 - RNA, 24 nt, Human
ccuugggaaugcugcgaggcccag

SEQ ID NO: 1014119 - RNA, 19 nt, Human
cgaggcccagcagaggaag

SEQ ID NO: 1014120 - RNA, 24 nt, Human
cuccaacucagugcaucccaaacc

SEQ ID NO: 1014121 - RNA, 21 nt, Human
cucccagccaagaaauggcag

SEQ ID NO: 1014122 - RNA, 19 nt, Human
cuggagguagcggagggca

SEQ ID NO: 1014123 - RNA, 25 nt, Human
cugugcauuuacuccugaaugcccu

SEQ ID NO: 1014124 - RNA, 19 nt, Human
gaagcaaaucuugccuuca

SEQ ID NO: 1014125 - RNA, 20 nt, Human
gaaucaacaauaauccucuc

SEQ ID NO: 1014126 - RNA, 23 nt, Human
gaggaucaaagcuuucauaaccu

SEQ ID NO: 1014127 - RNA, 21 nt, Human
gaguggccuucugucuuccag

SEQ ID NO: 1014128 - RNA, 25 nt, Human
gaucacaccugggcacgcuggacac

SEQ ID NO: 1014129 - RNA, 19 nt, Human
gcaacaaagagagacacga

SEQ ID NO: 1014130 - RNA, 20 nt, Human
ggcacacagggcaaagagga

SEQ ID NO: 1014131 - RNA, 18 nt, Human
gggcaaagaaucauuagc

SEQ ID NO: 1014132 - RNA, 23 nt, Human
guuucaaggcauuuucuuugucu

SEQ ID NO: 1014133 - RNA, 18 nt, Human
uaaauccagcuagauuua

SEQ ID NO: 1014134 - RNA, 23 nt, Human
uaaccuccaacucagugcauccc

SEQ ID NO: 1014135 - RNA, 20 nt, Human
uaagaggacacaaaccacag

SEQ ID NO: 1014136 - RNA, 26 nt, Human
uaagaggacacaaaccacagagagca

SEQ ID NO: 1014137 - RNA, 22 nt, Human
uaucuggagguagcggagggca

SEQ ID NO: 1014138 - RNA, 22 nt, Human
uccaagagggaaagaacuuagc

SEQ ID NO: 1014139 - RNA, 19 nt, Human
uccaccagaucacaccugg

SEQ ID NO: 1014140 - RNA, 20 nt, Human
uccagagugcuccuuuuuuu

SEQ ID NO: 1014141 - RNA, 25 nt, Human
ucccaaacccagacgggccuggacc

SEQ ID NO: 1014142 - RNA, 25 nt, Human
uccuuuuuuuugagguggaccacag

SEQ ID NO: 1014143 - RNA, 23 nt, Human
ucgcagagcagugaaaggccaaa

SEQ ID NO: 1014144 - RNA, 19 nt, Human
ugaagugggcaaagaauca

SEQ ID NO: 1014145 - RNA, 22 nt, Human
ugccagggcaugugacccuugg

SEQ ID NO: 1014146 - RNA, 26 nt, Human
ugccagggcaugugacccuugggaau

SEQ ID NO: 1014147 - RNA, 24 nt, Human
ugcuccuuuuuuuugagguggacc

SEQ ID NO: 1014148 - RNA, 18 nt, Human
uggaguggccuucugucu

SEQ ID NO: 1014149 - RNA, 22 nt, Human
uggcagagaggagagggauccu

SEQ ID NO: 1014150 - RNA, 18 nt, Human
ugggaaugcugcgaggcc

SEQ ID NO: 1014151 - RNA, 20 nt, Human
uucugcccaugccagggcau

SEQ ID NO: 1014152 - RNA, 19 nt, Human
uucuucagcagaaaucugg

SEQ ID NO: 1014153 - RNA, 24 nt, Human
uugccuucaccuaaguccaccaga

SEQ ID NO: 1014154 - RNA, 22 nt, Human
uuucuuaaguagaaggugaaca

SEQ ID NO: 1014155 - RNA, 25 nt, Human
aaaugcaccugaguguauaccacac

SEQ ID NO: 1014156 - RNA, 19 nt, Human
uggaaaaaugcaccugagu

SEQ ID NO: 1014157 - RNA, 22 nt, Human
uguauaccacacuugagcacuu

SEQ ID NO: 1014158 - RNA, 22 nt, Human
uuggaaaaaugcaccugagugu

SEQ ID NO: 1014159 - RNA, 24 nt, Human
uugugauuggaaaaaugcaccuga

SEQ ID NO: 1014160 - RNA, 21 nt, Human
caacuccuagaacuaucuccu

SEQ ID NO: 1014161 - RNA, 25 nt, Human
caagaucuugacuugaaguuucaca

SEQ ID NO: 1014162 - RNA, 20 nt, Human
cacaacuccuagaacuaucu

SEQ ID NO: 1014163 - RNA, 18 nt, Human
caugaaaauaauguugua

SEQ ID NO: 1014164 - RNA, 19 nt, Human
cccauucgccuccuuuugg

SEQ ID NO: 1014165 - RNA, 22 nt, Human
cuccugagcccauucgccuccu

SEQ ID NO: 1014166 - RNA, 23 nt, Human
cugagcccauucgccuccuuuug

SEQ ID NO: 1014167 - RNA, 22 nt, Human
cugcgcuccggggguggcuggg

SEQ ID NO: 1014168 - RNA, 25 nt, Human
uaucuccugagcccauucgccuccu

SEQ ID NO: 1014169 - RNA, 21 nt, Human
ucacaacuccuagaacuaucu

SEQ ID NO: 1014170 - RNA, 22 nt, Human
uggauaguaacuaaaaccaaga

SEQ ID NO: 1014171 - RNA, 24 nt, Human
uggcugggucccaucauuugaauu

SEQ ID NO: 1014172 - RNA, 18 nt, Human
uggcugggucgcugucgc

SEQ ID NO: 1014173 - RNA, 18 nt, Human
uggcugggucgcugucgc

SEQ ID NO: 1014174 - RNA, 18 nt, Human
uuuuuuuuuuuuuuuuug

SEQ ID NO: 1014175 - RNA, 21 nt, Human
uuuuuuuuuuuuuuuuugcaa

SEQ ID NO: 1014176 - RNA, 20 nt, Human
agaaaaaaaaagugagagaa

SEQ ID NO: 1014177 - RNA, 23 nt, Human
auccccacaaauucaguagaaaa

SEQ ID NO: 1014178 - RNA, 18 nt, Human
ccuauguagcugcaaagg

SEQ ID NO: 1014179 - RNA, 22 nt, Human
gugggauacagaaaaaaaaagu

SEQ ID NO: 1014180 - RNA, 24 nt, Human
ucauauguuuaaccuugauuugga

SEQ ID NO: 1014181 - RNA, 25 nt, Human
ugagaaaaaaauauuuaccauagga

SEQ ID NO: 1014182 - RNA, 20 nt, Human
uggaaucugauauauguuuu

SEQ ID NO: 1014183 - RNA, 19 nt, Human
ugggauacagaaaaaaaaa

SEQ ID NO: 1014184 - RNA, 25 nt, Human
uucacuuuuauuauaggauccccac

SEQ ID NO: 1014185 - RNA, 18 nt, Human
aaagaaaccagccucagg

SEQ ID NO: 1014186 - RNA, 22 nt, Human
accuaccccuucagagccaggg

SEQ ID NO: 1014187 - RNA, 19 nt, Human
accuagccucagacagccg

SEQ ID NO: 1014188 - RNA, 22 nt, Human
agcaaaaauaaaaauuaguuug

SEQ ID NO: 1014189 - RNA, 18 nt, Human
aggaaccaaggguggacu

SEQ ID NO: 1014190 - RNA, 20 nt, Human
agugguagagaccagaaaaa

SEQ ID NO: 1014191 - RNA, 22 nt, Human
aucucucagucccuucuuguug

SEQ ID NO: 1014192 - RNA, 18 nt, Human
augaaagaaaccagccuc

SEQ ID NO: 1014193 - RNA, 19 nt, Human
caauguacuucuuagguau

SEQ ID NO: 1014194 - RNA, 24 nt, Human
caauguacuucuuagguauguuaa

SEQ ID NO: 1014195 - RNA, 23 nt, Human
caauuacagaguguaauaccuug

SEQ ID NO: 1014196 - RNA, 24 nt, Human
caccuaccccuucagagccaggga

SEQ ID NO: 1014197 - RNA, 21 nt, Human
ccaccuagccucagacagcca

SEQ ID NO: 1014198 - RNA, 24 nt, Human
ccuagccucagacagccaggaggc

SEQ ID NO: 1014199 - RNA, 21 nt, Human
ccucagacagccaggaggccu

SEQ ID NO: 1014200 - RNA, 22 nt, Human
ccucagacagccaggaggccuu

SEQ ID NO: 1014201 - RNA, 26 nt, Human
cuagccucagacagccaggaggccuu

SEQ ID NO: 1014202 - RNA, 21 nt, Human
cuccuuggcuuucaacccacc

SEQ ID NO: 1014203 - RNA, 23 nt, Human
cuuggucucagugacuccuuggc

SEQ ID NO: 1014204 - RNA, 18 nt, Human
gaaauaucaaaacugaaa

SEQ ID NO: 1014205 - RNA, 23 nt, Human
gaggauaggauccagacaggguu

SEQ ID NO: 1014206 - RNA, 25 nt, Human
gaguaaucuuccuuaguaaucauuu

SEQ ID NO: 1014207 - RNA, 19 nt, Human
gauccagacaggguuacaa

SEQ ID NO: 1014208 - RNA, 21 nt, Human
guagagaaagccuuggucuca

SEQ ID NO: 1014209 - RNA, 22 nt, Human
gugguagagaccagaaaaagua

SEQ ID NO: 1014210 - RNA, 22 nt, Human
uacuuuuuaaacaaauuacuga

SEQ ID NO: 1014211 - RNA, 22 nt, Human
uaucaaaacugaaaaaaauagc

SEQ ID NO: 1014212 - RNA, 18 nt, Human
ucaggugugucuccucau

SEQ ID NO: 1014213 - RNA, 26 nt, Human
uccccagcuggggcaggguaaggagc

SEQ ID NO: 1014214 - RNA, 24 nt, Human
uccugagcugauuccaguuaggaa

SEQ ID NO: 1014215 - RNA, 25 nt, Human
uccugagcugauuccaguuaggaac

SEQ ID NO: 1014216 - RNA, 19 nt, Human
ucucucagucccuucuugu

SEQ ID NO: 1014217 - RNA, 22 nt, Human
ucuuucagagcugaagaaaggg

SEQ ID NO: 1014218 - RNA, 21 nt, Human
ugaaaaaaauagcuucccaga

SEQ ID NO: 1014219 - RNA, 23 nt, Human
ugaaaaaaauagcuucccagaua

SEQ ID NO: 1014220 - RNA, 22 nt, Human
ugaaagaaaccagccucaggug

SEQ ID NO: 1014221 - RNA, 21 nt, Human
ugacuccuuggcuuucaaccc

SEQ ID NO: 1014222 - RNA, 18 nt, Human
ugccauucuuuugcucuu

SEQ ID NO: 1014223 - RNA, 21 nt, Human
uggugcacuccauaguccaau

SEQ ID NO: 1014224 - RNA, 26 nt, Human
uguucuauuucuuuauuuuagcuuua

SEQ ID NO: 1014225 - RNA, 22 nt, Human
uuaguaaucauuucuguaacuc

SEQ ID NO: 1014226 - RNA, 21 nt, Human
uuagucucagcaaaaauaaaa

SEQ ID NO: 1014227 - RNA, 20 nt, Human
uucagagccagggaaacacc

SEQ ID NO: 1014228 - RNA, 24 nt, Human
uuuacagucccugcugacagugua

SEQ ID NO: 1014229 - RNA, 22 nt, Human
uuucaggggcuaaacuuuucug

SEQ ID NO: 1014230 - RNA, 24 nt, Human
uuugcaaaacuccuuucucccagu

SEQ ID NO: 1014231 - RNA, 24 nt, Human
uuuuuuuuuuuuucuaaaugcuuu

SEQ ID NO: 1014232 - RNA, 23 nt, Human
uuuuuuuuuuuuuuuucuaaaug

SEQ ID NO: 1014233 - RNA, 18 nt, Human
aagugcaaaguucuccca

SEQ ID NO: 1014234 - RNA, 22 nt, Human
cacgcaggagcacagacacguc

SEQ ID NO: 1014235 - RNA, 22 nt, Human
ccugcaauugaggugcuccauc

SEQ ID NO: 1014236 - RNA, 20 nt, Human
gcaaaguucucccagggaag

SEQ ID NO: 1014237 - RNA, 18 nt, Human
uccaaagaguucuucuua

SEQ ID NO: 1014238 - RNA, 22 nt, Human
uccaaagaguucuucuuagccc

SEQ ID NO: 1014239 - RNA, 18 nt, Human
uccacccaugaauggaau

SEQ ID NO: 1014240 - RNA, 18 nt, Human
ugagucagaaaucagagc

SEQ ID NO: 1014241 - RNA, 20 nt, Human
aaacccagagcaccacacag

SEQ ID NO: 1014242 - RNA, 23 nt, Human
aagggaaagaagagaugacaaga

SEQ ID NO: 1014243 - RNA, 24 nt, Human
acaauagaaaauuucuagcaugaa

SEQ ID NO: 1014244 - RNA, 21 nt, Human
acaccacugcagucccgggac

SEQ ID NO: 1014245 - RNA, 19 nt, Human
acagaaacccagagcacca

SEQ ID NO: 1014246 - RNA, 23 nt, Human
accacacaggaagagggagcaac

SEQ ID NO: 1014247 - RNA, 18 nt, Human
accuugaggcuggggagg

SEQ ID NO: 1014248 - RNA, 24 nt, Human
agacagaauaguuuaagcccuaac

SEQ ID NO: 1014249 - RNA, 18 nt, Human
agcaacacaagacuccca

SEQ ID NO: 1014250 - RNA, 21 nt, Human
aggaggagcguuagcagcaac

SEQ ID NO: 1014251 - RNA, 21 nt, Human
agggaaagaagagaugacaag

SEQ ID NO: 1014252 - RNA, 25 nt, Human
aggugaccagauucuugcccaaagc

SEQ ID NO: 1014253 - RNA, 23 nt, Human
auaaacaauagaaaauuucuagc

SEQ ID NO: 1014254 - RNA, 23 nt, Human
auaaauacaacuacauccuccac

SEQ ID NO: 1014255 - RNA, 18 nt, Human
auccacagaaacccagag

SEQ ID NO: 1014256 - RNA, 22 nt, Human
auccauguccucucuuuacagg

SEQ ID NO: 1014257 - RNA, 21 nt, Human
cacagaaacccagagcaccac

SEQ ID NO: 1014258 - RNA, 19 nt, Human
cacagccccaaccagacag

SEQ ID NO: 1014259 - RNA, 24 nt, Human
cagaaacccagagcaccacacagg

SEQ ID NO: 1014260 - RNA, 23 nt, Human
cagacugaggggucauucaugga

SEQ ID NO: 1014261 - RNA, 21 nt, Human
cauccuccacagccccaacca

SEQ ID NO: 1014262 - RNA, 22 nt, Human
caugcagaugugcuuuagaguu

SEQ ID NO: 1014263 - RNA, 23 nt, Human
ccaaccagacaggaauaggcagc

SEQ ID NO: 1014264 - RNA, 20 nt, Human
ccacagaaacccagagcacc

SEQ ID NO: 1014265 - RNA, 23 nt, Human
ccacagccccaaccagacaggaa

SEQ ID NO: 1014266 - RNA, 23 nt, Human
ccagcccagcagcaaaagggcuc

SEQ ID NO: 1014267 - RNA, 18 nt, Human
ccaggcugacaguggugg

SEQ ID NO: 1014268 - RNA, 22 nt, Human
cccagcccugguccuuggaggu

SEQ ID NO: 1014269 - RNA, 18 nt, Human
ccuaacccagacaugccc

SEQ ID NO: 1014270 - RNA, 23 nt, Human
cgagagcgcacaccacugcaguc

SEQ ID NO: 1014271 - RNA, 21 nt, Human
cgaggaaggaugcccaaaagc

SEQ ID NO: 1014272 - RNA, 23 nt, Human
cggccaguaauaaccucagggcc

SEQ ID NO: 1014273 - RNA, 21 nt, Human
cuaaagacuucccagcccugg

SEQ ID NO: 1014274 - RNA, 24 nt, Human
cuacaaagggaaagaagagaugac

SEQ ID NO: 1014275 - RNA, 21 nt, Human
cuccagcuccagaccuggauc

SEQ ID NO: 1014276 - RNA, 22 nt, Human
cucggggaaacccucuugucag

SEQ ID NO: 1014277 - RNA, 18 nt, Human
cugcuuccccagcuuugc

SEQ ID NO: 1014278 - RNA, 24 nt, Human
cuggggaggccagacugagggguc

SEQ ID NO: 1014279 - RNA, 18 nt, Human
gaagcuggaggaggagcg

SEQ ID NO: 1014280 - RNA, 22 nt, Human
gagcguuagcagcaacucgcgc

SEQ ID NO: 1014281 - RNA, 21 nt, Human
gagggcuugugggagaagggc

SEQ ID NO: 1014282 - RNA, 24 nt, Human
gagguggcagugcaagaagggccu

SEQ ID NO: 1014283 - RNA, 25 nt, Human
gaugacaagaaaggccgaggaagga

SEQ ID NO: 1014284 - RNA, 27 nt, Human
gauucuugcccaaagcaaaguugagag

SEQ ID NO: 1014285 - RNA, 22 nt, Human
gcacuaaagacuucccagcccu

SEQ ID NO: 1014286 - RNA, 21 nt, Human
gcagcaaaagggcucaguggg

SEQ ID NO: 1014287 - RNA, 20 nt, Human
gcccagcagcaaaagggcuc

SEQ ID NO: 1014288 - RNA, 19 nt, Human
gcggcuuugcuagcugcuc

SEQ ID NO: 1014289 - RNA, 20 nt, Human
gcgggggugggaagcuggag

SEQ ID NO: 1014290 - RNA, 20 nt, Human
ggaaaagccaaaucuccaag

SEQ ID NO: 1014291 - RNA, 18 nt, Human
ggaagagggagcaacaca

SEQ ID NO: 1014292 - RNA, 22 nt, Human
ggaaggcaccuggacuuagucc

SEQ ID NO: 1014293 - RNA, 22 nt, Human
ggcuacaaagggaaagaagaga

SEQ ID NO: 1014294 - RNA, 19 nt, Human
gggggugggagggcuugug

SEQ ID NO: 1014295 - RNA, 20 nt, Human
gguacuguggcucuugugcc

SEQ ID NO: 1014296 - RNA, 22 nt, Human
gucuguauuauccuuggaugac

SEQ ID NO: 1014297 - RNA, 24 nt, Human
uacaaagggaaagaagagaugaca

SEQ ID NO: 1014298 - RNA, 19 nt, Human
uacagguauguggcugcac

SEQ ID NO: 1014299 - RNA, 21 nt, Human
uacagguugugaugugaaggc

SEQ ID NO: 1014300 - RNA, 18 nt, Human
uaccgggccgcggcgggc

SEQ ID NO: 1014301 - RNA, 23 nt, Human
uagacagaauaguuuaagcccua

SEQ ID NO: 1014302 - RNA, 21 nt, Human
uagcaccuaacccagacaugc

SEQ ID NO: 1014303 - RNA, 19 nt, Human
uagcaguagccuguaccau

SEQ ID NO: 1014304 - RNA, 19 nt, Human
uagccuaguuggucuguau

SEQ ID NO: 1014305 - RNA, 24 nt, Human
uagccuguaccauggaucccauca

SEQ ID NO: 1014306 - RNA, 22 nt, Human
uaguccuaggagaagaccagcg

SEQ ID NO: 1014307 - RNA, 22 nt, Human
ucacgauccacagaaacccaga

SEQ ID NO: 1014308 - RNA, 18 nt, Human
uccacagaaacccagagc

SEQ ID NO: 1014309 - RNA, 19 nt, Human
uccacagaaacccagagca

SEQ ID NO: 1014310 - RNA, 24 nt, Human
uccacagaaacccagagcaccaca

SEQ ID NO: 1014311 - RNA, 20 nt, Human
uccacagccccaaccagaca

SEQ ID NO: 1014312 - RNA, 21 nt, Human
uccacuucggcucucggggaa

SEQ ID NO: 1014313 - RNA, 22 nt, Human
ucccaacuucugcuuccccagc

SEQ ID NO: 1014314 - RNA, 24 nt, Human
uccuccacagccccaaccagacag

SEQ ID NO: 1014315 - RNA, 18 nt, Human
ucuccaaguagaauggga

SEQ ID NO: 1014316 - RNA, 21 nt, Human
ucuccagcuccagaccuggau

SEQ ID NO: 1014317 - RNA, 22 nt, Human
ugacaagaaaggccgaggaagg

SEQ ID NO: 1014318 - RNA, 20 nt, Human
ugaccaaguucucuucagca

SEQ ID NO: 1014319 - RNA, 21 nt, Human
ugagguggcagugcaagaagg

SEQ ID NO: 1014320 - RNA, 20 nt, Human
ugaguggaccuugaggcugg

SEQ ID NO: 1014321 - RNA, 24 nt, Human
ugcccaaagcaaaguugagagaac

SEQ ID NO: 1014322 - RNA, 23 nt, Human
ugccuuacggccaguaauaaccu

SEQ ID NO: 1014323 - RNA, 23 nt, Human
uggaagggcaagaugugugaacu

SEQ ID NO: 1014324 - RNA, 19 nt, Human
ugggaagaagccggcgcug

SEQ ID NO: 1014325 - RNA, 21 nt, Human
uggggaggccagacugagggg

SEQ ID NO: 1014326 - RNA, 18 nt, Human
uuaacucugccuuacggc

SEQ ID NO: 1014327 - RNA, 20 nt, Human
uucuugcccaaagcaaaguu

SEQ ID NO: 1014328 - RNA, 22 nt, Human
uugcuagcugcucaucacagau

SEQ ID NO: 1014329 - RNA, 20 nt, Human
uuucagugaccucuagaaug

SEQ ID NO: 1014330 - RNA, 25 nt, Human
uuuccugccagcccagcagcaaaag

SEQ ID NO: 1014331 - RNA, 18 nt, Human
uuucuuggaaaagccaaa

SEQ ID NO: 1014332 - RNA, 18 nt, Human
aaaaaucagcauggaucu

SEQ ID NO: 1014333 - RNA, 19 nt, Human
aaauagcauaaaacuguag

SEQ ID NO: 1014334 - RNA, 23 nt, Human
aagcaauaauaaauucagaucca

SEQ ID NO: 1014335 - RNA, 21 nt, Human
acuaaaguucagaaauuucug

SEQ ID NO: 1014336 - RNA, 21 nt, Human
agagacgggagcagcggcaga

SEQ ID NO: 1014337 - RNA, 18 nt, Human
auaaaaaucagcauggau

SEQ ID NO: 1014338 - RNA, 20 nt, Human
cacggcuggaggcggcggcc

SEQ ID NO: 1014339 - RNA, 21 nt, Human
cauaaaacuguagaaugauga

SEQ ID NO: 1014340 - RNA, 23 nt, Human
ccacaaauagcauaaaacuguag

SEQ ID NO: 1014341 - RNA, 24 nt, Human
cuuuccacaaauagcauaaaacug

SEQ ID NO: 1014342 - RNA, 25 nt, Human
gaaaucuuuccacaaauagcauuau

SEQ ID NO: 1014343 - RNA, 25 nt, Human
gacgggagcagcggcagagggcacc

SEQ ID NO: 1014344 - RNA, 18 nt, Human
gagcagcggcagagggca

SEQ ID NO: 1014345 - RNA, 21 nt, Human
gagcguaaccaaagagacggg

SEQ ID NO: 1014346 - RNA, 19 nt, Human
gcaauaaaaaucagcaugg

SEQ ID NO: 1014347 - RNA, 22 nt, Human
guacauuaaugaaauguuucca

SEQ ID NO: 1014348 - RNA, 20 nt, Human
uaaaagaaauacacaaagua

SEQ ID NO: 1014349 - RNA, 23 nt, Human
ucagauccacuguauuaugcaac

SEQ ID NO: 1014350 - RNA, 18 nt, Human
ugaaaggauuugggaaag

SEQ ID NO: 1014351 - RNA, 22 nt, Human
ugaaaggauuugggaaagcuuu

SEQ ID NO: 1014352 - RNA, 21 nt, Human
ugaaauccacagcugguuuca

SEQ ID NO: 1014353 - RNA, 18 nt, Human
ugagaaagaaaucuuucc

SEQ ID NO: 1014354 - RNA, 20 nt, Human
ugggaaagcuuuacaaaagc

SEQ ID NO: 1014355 - RNA, 18 nt, Human
uuccaaagaaauacugaa

SEQ ID NO: 1014356 - RNA, 25 nt, Human
uuuuuuuuuuuuuuuuuugaguuuu

SEQ ID NO: 1014357 - RNA, 20 nt, Human
uuuuuuuuuuuuuuuuuugg

SEQ ID NO: 1014358 - RNA, 23 nt, Human
aaaaaaaaaaaaaaaagaaagaa

SEQ ID NO: 1014359 - RNA, 26 nt, Human
aaaaaagaaauucaaacuagacagga

SEQ ID NO: 1014360 - RNA, 22 nt, Human
aauuaaaaaaaaaaaaaaaaga

SEQ ID NO: 1014361 - RNA, 20 nt, Human
acagacauggcccacuuccu

SEQ ID NO: 1014362 - RNA, 18 nt, Human
accucacuuccagugcac

SEQ ID NO: 1014363 - RNA, 20 nt, Human
agaaaaaaaagaaauucaaa

SEQ ID NO: 1014364 - RNA, 21 nt, Human
agagucuugacagagucuucu

SEQ ID NO: 1014365 - RNA, 21 nt, Human
agccacugcuccccacagaca

SEQ ID NO: 1014366 - RNA, 22 nt, Human
aggaaggugaggaagagcuggg

SEQ ID NO: 1014367 - RNA, 18 nt, Human
aggugaggaagagcuggg

SEQ ID NO: 1014368 - RNA, 19 nt, Human
aggugaggaagagcugggu

SEQ ID NO: 1014369 - RNA, 19 nt, Human
augugaccucacuuccagu

SEQ ID NO: 1014370 - RNA, 18 nt, Human
cacgagcaccacaggccc

SEQ ID NO: 1014371 - RNA, 26 nt, Human
cacgagcaccacaggcccagaauggg

SEQ ID NO: 1014372 - RNA, 22 nt, Human
cagagacaucagcaguaguuca

SEQ ID NO: 1014373 - RNA, 22 nt, Human
caggcccagccucgugcagaac

SEQ ID NO: 1014374 - RNA, 20 nt, Human
cauggcccacuuccuggggc

SEQ ID NO: 1014375 - RNA, 19 nt, Human
ccacaggcccagaaugggg

SEQ ID NO: 1014376 - RNA, 21 nt, Human
ccagaauggggcaugaggccc

SEQ ID NO: 1014377 - RNA, 20 nt, Human
cccagcccugcaacccggcc

SEQ ID NO: 1014378 - RNA, 19 nt, Human
ccccaacagagacaucagc

SEQ ID NO: 1014379 - RNA, 21 nt, Human
cccccccuccuccacgccuag

SEQ ID NO: 1014380 - RNA, 19 nt, Human
cccuccuccacgccuaggg

SEQ ID NO: 1014381 - RNA, 19 nt, Human
cccugacccugccuuuccc

SEQ ID NO: 1014382 - RNA, 22 nt, Human
cccugccuuucccauccagggg

SEQ ID NO: 1014383 - RNA, 18 nt, Human
ccggccgcgagcgcgcgc

SEQ ID NO: 1014384 - RNA, 18 nt, Human
ccugcccgggacgcgggg

SEQ ID NO: 1014385 - RNA, 23 nt, Human
ccugugggaggggacaccccucc

SEQ ID NO: 1014386 - RNA, 19 nt, Human
cgcccccccuccuccacgc

SEQ ID NO: 1014387 - RNA, 22 nt, Human
cuagagcccagcucugcagcgc

SEQ ID NO: 1014388 - RNA, 23 nt, Human
cucucccaaccacccauuuuccu

SEQ ID NO: 1014389 - RNA, 19 nt, Human
cugacccugccuuucccau

SEQ ID NO: 1014390 - RNA, 24 nt, Human
cuggaaacucugcaugggucucag

SEQ ID NO: 1014391 - RNA, 21 nt, Human
cuggcuacaaaagaacugucc

SEQ ID NO: 1014392 - RNA, 20 nt, Human
cuucuaggguccccuggcua

SEQ ID NO: 1014393 - RNA, 23 nt, Human
cuugcagcccuguggagccucag

SEQ ID NO: 1014394 - RNA, 21 nt, Human
gacccugccuuucccauccag

SEQ ID NO: 1014395 - RNA, 23 nt, Human
gagcgcgcgcacgggcgcggggc

SEQ ID NO: 1014396 - RNA, 23 nt, Human
gccacgagcaccacaggcccaga

SEQ ID NO: 1014397 - RNA, 19 nt, Human
gccacugcuccccacagac

SEQ ID NO: 1014398 - RNA, 21 nt, Human
gcccuggagccgccccacccc

SEQ ID NO: 1014399 - RNA, 18 nt, Human
gcgcgcacgggcgcgggg

SEQ ID NO: 1014400 - RNA, 19 nt, Human
gcgcgcacgggcgcggggc

SEQ ID NO: 1014401 - RNA, 18 nt, Human
gcgcgcgcacgggcgcgg

SEQ ID NO: 1014402 - RNA, 22 nt, Human
gcggggcugagccgcccccccu

SEQ ID NO: 1014403 - RNA, 21 nt, Human
gcugcucaugugaccucacuu

SEQ ID NO: 1014404 - RNA, 18 nt, Human
ggcucagcaagccacugc

SEQ ID NO: 1014405 - RNA, 20 nt, Human
guggaaugcugcuggugccc

SEQ ID NO: 1014406 - RNA, 22 nt, Human
uaaaaaaaaaaaaaaaagaaag

SEQ ID NO: 1014407 - RNA, 19 nt, Human
uacaaaagaacuguccugg

SEQ ID NO: 1014408 - RNA, 22 nt, Human
uauuucagacuucacgcugagc

SEQ ID NO: 1014409 - RNA, 21 nt, Human
ucccacgcugcucaugugacc

SEQ ID NO: 1014410 - RNA, 22 nt, Human
uccuggggcugcucugagcccu

SEQ ID NO: 1014411 - RNA, 19 nt, Human
ucucagugggcccugaccc

SEQ ID NO: 1014412 - RNA, 22 nt, Human
ucucccaaccacccauuuuccu

SEQ ID NO: 1014413 - RNA, 21 nt, Human
ucucgcguucccgccagcccu

SEQ ID NO: 1014414 - RNA, 20 nt, Human
ucuguucuaguuucucuccc

SEQ ID NO: 1014415 - RNA, 21 nt, Human
ucuugauggcugaaaugggug

SEQ ID NO: 1014416 - RNA, 20 nt, Human
ugagccgcccccccuccucc

SEQ ID NO: 1014417 - RNA, 20 nt, Human
ugagcuucaggcacaauuac

SEQ ID NO: 1014418 - RNA, 23 nt, Human
ugcuccccacagacauggcccac

SEQ ID NO: 1014419 - RNA, 19 nt, Human
ugcucugagcccuauugca

SEQ ID NO: 1014420 - RNA, 23 nt, Human
uggcccacuuccugguccccugg

SEQ ID NO: 1014421 - RNA, 21 nt, Human
ugggcccugacccugccuuuc

SEQ ID NO: 1014422 - RNA, 21 nt, Human
uguccaccuucccugccgucu

SEQ ID NO: 1014423 - RNA, 22 nt, Human
ugugcagccugggccucugguu

SEQ ID NO: 1014424 - RNA, 22 nt, Human
uuaaaaaaaaaaaaaaaagaaa

SEQ ID NO: 1014425 - RNA, 19 nt, Human
uucaaacuagacaggaagg

SEQ ID NO: 1014426 - RNA, 28 nt, Human
uucccugccgucuguguggguucuugau

SEQ ID NO: 1014427 - RNA, 22 nt, Human
uucuguucuaguuucucuccca

SEQ ID NO: 1014428 - RNA, 18 nt, Human
uugcagcccuguggagcc

SEQ ID NO: 1014429 - RNA, 22 nt, Human
uuucccggguccuccacgggua

SEQ ID NO: 1014430 - RNA, 24 nt, Human
aaacuggcauuugcagagcccuug

SEQ ID NO: 1014431 - RNA, 20 nt, Human
aaagcuccuucugucuacuc

SEQ ID NO: 1014432 - RNA, 18 nt, Human
aaaugcuauuuccuggac

SEQ ID NO: 1014433 - RNA, 21 nt, Human
aacaucauccuauuucugcua

SEQ ID NO: 1014434 - RNA, 20 nt, Human
aaccagaagaggugagacag

SEQ ID NO: 1014435 - RNA, 19 nt, Human
aaccuguaggacuugagga

SEQ ID NO: 1014436 - RNA, 21 nt, Human
aagucugaaaaucacacgucu

SEQ ID NO: 1014437 - RNA, 24 nt, Human
acccauucacagagggccuccccc

SEQ ID NO: 1014438 - RNA, 18 nt, Human
acccugggcaaggggacc

SEQ ID NO: 1014439 - RNA, 18 nt, Human
acuugucagcuucaacca

SEQ ID NO: 1014440 - RNA, 20 nt, Human
aggcggucuggacacauccu

SEQ ID NO: 1014441 - RNA, 23 nt, Human
aggcuggcaccagagucccccag

SEQ ID NO: 1014442 - RNA, 19 nt, Human
agguuguuggcugauccug

SEQ ID NO: 1014443 - RNA, 19 nt, Human
aguuugaacccaugguugg

SEQ ID NO: 1014444 - RNA, 20 nt, Human
auucacagagggccuccccc

SEQ ID NO: 1014445 - RNA, 24 nt, Human
auuuucaaggaucaaagaagguca

SEQ ID NO: 1014446 - RNA, 21 nt, Human
caaaaggcuuucccacuuacc

SEQ ID NO: 1014447 - RNA, 19 nt, Human
caagagaagcagaaaaaug

SEQ ID NO: 1014448 - RNA, 26 nt, Human
caagagaagcagaaaaaugaaccaaa

SEQ ID NO: 1014449 - RNA, 24 nt, Human
cacagugcagggacugagccaucc

SEQ ID NO: 1014450 - RNA, 21 nt, Human
cacccgcagcuugccaaaggc

SEQ ID NO: 1014451 - RNA, 19 nt, Human
caccggggccuuucccagg

SEQ ID NO: 1014452 - RNA, 24 nt, Human
cacuuucucuuucggccgaugaga

SEQ ID NO: 1014453 - RNA, 21 nt, Human
cagcaccggugugcaauugac

SEQ ID NO: 1014454 - RNA, 19 nt, Human
cagcagcccuaacuugugg

SEQ ID NO: 1014455 - RNA, 20 nt, Human
cagcagcccuaacuuguggc

SEQ ID NO: 1014456 - RNA, 19 nt, Human
cagccaagagaagcagaaa

SEQ ID NO: 1014457 - RNA, 25 nt, Human
cagcuugccaaaggcagguuguugg

SEQ ID NO: 1014458 - RNA, 24 nt, Human
caugaaauuaaaaaccaaaucuga

SEQ ID NO: 1014459 - RNA, 23 nt, Human
ccauucacagagggccuccccca

SEQ ID NO: 1014460 - RNA, 25 nt, Human
cccacaaccccucuggcugcuuucc

SEQ ID NO: 1014461 - RNA, 18 nt, Human
ccccaguuuuccuggcau

SEQ ID NO: 1014462 - RNA, 20 nt, Human
ccucaccggggccuuuccca

SEQ ID NO: 1014463 - RNA, 19 nt, Human
ccucagaacggaagggcuc

SEQ ID NO: 1014464 - RNA, 18 nt, Human
ccuggcaugaggcggucu

SEQ ID NO: 1014465 - RNA, 20 nt, Human
cgucuggggucagggguggg

SEQ ID NO: 1014466 - RNA, 19 nt, Human
cucaccggggccuuuccca

SEQ ID NO: 1014467 - RNA, 19 nt, Human
cuccaugggaaagggccca

SEQ ID NO: 1014468 - RNA, 23 nt, Human
cucccaacagcaccggugugcaa

SEQ ID NO: 1014469 - RNA, 20 nt, Human
cuccuaaggcugcagccucc

SEQ ID NO: 1014470 - RNA, 24 nt, Human
cuccuaaggcugcagccuccaugg

SEQ ID NO: 1014471 - RNA, 20 nt, Human
cuguccccgggaggcagcac

SEQ ID NO: 1014472 - RNA, 23 nt, Human
cuuaaaucauacuguuuuuuguu

SEQ ID NO: 1014473 - RNA, 18 nt, Human
cuucccguggcugcuguu

SEQ ID NO: 1014474 - RNA, 24 nt, Human
cuuguggcggcaguaagucucccc

SEQ ID NO: 1014475 - RNA, 22 nt, Human
gaaagaaaagucugaaaaucac

SEQ ID NO: 1014476 - RNA, 19 nt, Human
gaaauuaaaaaccaaaucu

SEQ ID NO: 1014477 - RNA, 19 nt, Human
gaaguucugcugcucgaaa

SEQ ID NO: 1014478 - RNA, 22 nt, Human
gagacagucacagugcagggac

SEQ ID NO: 1014479 - RNA, 24 nt, Human
gccccacaaccccucuggcugcuu

SEQ ID NO: 1014480 - RNA, 22 nt, Human
gcugagcuuugggagggaaccu

SEQ ID NO: 1014481 - RNA, 18 nt, Human
gcuucugcuuuugagucc

SEQ ID NO: 1014482 - RNA, 19 nt, Human
ggcagcaccucaccggggc

SEQ ID NO: 1014483 - RNA, 20 nt, Human
ggcagcaccucaccggggcc

SEQ ID NO: 1014484 - RNA, 19 nt, Human
ggucauggcugucaaaguu

SEQ ID NO: 1014485 - RNA, 24 nt, Human
guccuuuuccuuucuccugcuguu

SEQ ID NO: 1014486 - RNA, 20 nt, Human
gugcugcugugcugucuagc

SEQ ID NO: 1014487 - RNA, 19 nt, Human
gugcuucugcuuuugaguc

SEQ ID NO: 1014488 - RNA, 18 nt, Human
uaacucaacacuuaaauc

SEQ ID NO: 1014489 - RNA, 19 nt, Human
uacccugggcaaggggacc

SEQ ID NO: 1014490 - RNA, 19 nt, Human
uacuaaggagaauaguuca

SEQ ID NO: 1014491 - RNA, 21 nt, Human
uacuaaggagaauaguucaac

SEQ ID NO: 1014492 - RNA, 21 nt, Human
uccugcuguggcccacuccuc

SEQ ID NO: 1014493 - RNA, 18 nt, Human
ucucguuguugcugucug

SEQ ID NO: 1014494 - RNA, 20 nt, Human
ugaacccaugguuggucugg

SEQ ID NO: 1014495 - RNA, 19 nt, Human
ugaccugcugaccuucccu

SEQ ID NO: 1014496 - RNA, 20 nt, Human
ugaccugcugaccuucccuu

SEQ ID NO: 1014497 - RNA, 23 nt, Human
ugagacagucacagugcagggac

SEQ ID NO: 1014498 - RNA, 21 nt, Human
ugaggcggucuggacacaucc

SEQ ID NO: 1014499 - RNA, 20 nt, Human
ugaguccugggugcgaaguu

SEQ ID NO: 1014500 - RNA, 23 nt, Human
ugaguccugggugcgaaguugcu

SEQ ID NO: 1014501 - RNA, 21 nt, Human
ugccuugugaguuucaugguc

SEQ ID NO: 1014502 - RNA, 19 nt, Human
ugcucacaaacaucauccu

SEQ ID NO: 1014503 - RNA, 23 nt, Human
ugcuuugugaguuucaucgcguu

SEQ ID NO: 1014504 - RNA, 22 nt, Human
uggaaggggaagacaaggaacc

SEQ ID NO: 1014505 - RNA, 25 nt, Human
uggccaugccacaucaaaaggcuuu

SEQ ID NO: 1014506 - RNA, 18 nt, Human
uggccgaagggcaugaaa

SEQ ID NO: 1014507 - RNA, 18 nt, Human
uggcggcagugcuuggac

SEQ ID NO: 1014508 - RNA, 19 nt, Human
ugggaaagggcccacgacc

SEQ ID NO: 1014509 - RNA, 21 nt, Human
ugggaggccgggguucaggcc

SEQ ID NO: 1014510 - RNA, 22 nt, Human
ugggcagugcuugucaaacugg

SEQ ID NO: 1014511 - RNA, 18 nt, Human
uggggucaggggugggua

SEQ ID NO: 1014512 - RNA, 22 nt, Human
uggggucaggggugggucacug

SEQ ID NO: 1014513 - RNA, 22 nt, Human
ugggugcugcugugcugucuag

SEQ ID NO: 1014514 - RNA, 18 nt, Human
uggucuugagucuggugc

SEQ ID NO: 1014515 - RNA, 18 nt, Human
ugguuuggucacucccaa

SEQ ID NO: 1014516 - RNA, 22 nt, Human
uguccccgggaggcagcaccuc

SEQ ID NO: 1014517 - RNA, 20 nt, Human
uguggcuggaccuuggccau

SEQ ID NO: 1014518 - RNA, 24 nt, Human
uguucgcacuuucucuuucggccg

SEQ ID NO: 1014519 - RNA, 22 nt, Human
uguugcaugucccguugagccu

SEQ ID NO: 1014520 - RNA, 24 nt, Human
uucucguuguugcugucuguucgc

SEQ ID NO: 1014521 - RNA, 20 nt, Human
uuggccaugccacaucaaaa

SEQ ID NO: 1014522 - RNA, 18 nt, Human
uuggcugcggcucugucc

SEQ ID NO: 1014523 - RNA, 20 nt, Human
uuuauguugcaugucccguu

SEQ ID NO: 1014524 - RNA, 21 nt, Human
uuuauguugcaugucccguug

SEQ ID NO: 1014525 - RNA, 22 nt, Human
uuucaaggaucaaagaagguca

SEQ ID NO: 1014526 - RNA, 18 nt, Human
uuucauggucauggcugu

SEQ ID NO: 1014527 - RNA, 23 nt, Human
uuuccuggcaugaggcggucugg

SEQ ID NO: 1014528 - RNA, 28 nt, Human
aaucuaacaaauucuaacaaauuucuau

SEQ ID NO: 1014529 - RNA, 21 nt, Human
agaaauuggagaaaauaaacu

SEQ ID NO: 1014530 - RNA, 19 nt, Human
aggcaucauugcaauaaaa

SEQ ID NO: 1014531 - RNA, 18 nt, Human
cacuuaacugcagagacc

SEQ ID NO: 1014532 - RNA, 22 nt, Human
ugcaugguaggacagaagugac

SEQ ID NO: 1014533 - RNA, 23 nt, Human
aaaaugcuucaguccuaaagcua

SEQ ID NO: 1014534 - RNA, 21 nt, Human
aaacuugggguuguacugaug

SEQ ID NO: 1014535 - RNA, 19 nt, Human
aacagggucugaaacuugg

SEQ ID NO: 1014536 - RNA, 20 nt, Human
aacaugcugcugcaucugcu

SEQ ID NO: 1014537 - RNA, 20 nt, Human
aacauggcaagacccugucu

SEQ ID NO: 1014538 - RNA, 22 nt, Human
aagaagguggauuugugucaag

SEQ ID NO: 1014539 - RNA, 18 nt, Human
aagcugcucaagagcccc

SEQ ID NO: 1014540 - RNA, 22 nt, Human
aagugaggaagaggggguggcc

SEQ ID NO: 1014541 - RNA, 21 nt, Human
acacccuaugcgccaccaauc

SEQ ID NO: 1014542 - RNA, 20 nt, Human
acaugugugcugaagucuuc

SEQ ID NO: 1014543 - RNA, 19 nt, Human
acccuuuagggguuuccua

SEQ ID NO: 1014544 - RNA, 18 nt, Human
accgcggaucccucccgc

SEQ ID NO: 1014545 - RNA, 23 nt, Human
accuucucuaccuccuucugcug

SEQ ID NO: 1014546 - RNA, 22 nt, Human
agaagcuggcguagagcuugag

SEQ ID NO: 1014547 - RNA, 25 nt, Human
agcaaagguucccagcucuuuaaga

SEQ ID NO: 1014548 - RNA, 27 nt, Human
agcaauaaaagcacagaagggagggcc

SEQ ID NO: 1014549 - RNA, 24 nt, Human
agcacuuugggagguugaggcagg

SEQ ID NO: 1014550 - RNA, 18 nt, Human
agccuucuccaccuccuc

SEQ ID NO: 1014551 - RNA, 19 nt, Human
agcgaugagaguacaggga

SEQ ID NO: 1014552 - RNA, 20 nt, Human
aggaagaggggguggccgcc

SEQ ID NO: 1014553 - RNA, 24 nt, Human
aggaagaggggguggccgccaggg

SEQ ID NO: 1014554 - RNA, 22 nt, Human
aggcaggaagauuacuugagcc

SEQ ID NO: 1014555 - RNA, 24 nt, Human
aggcaggaagauuacuugagccua

SEQ ID NO: 1014556 - RNA, 20 nt, Human
agggaagugaggaagagggg

SEQ ID NO: 1014557 - RNA, 21 nt, Human
agguugaggcaggaagauuac

SEQ ID NO: 1014558 - RNA, 24 nt, Human
agguugaggcaggaagauuacuug

SEQ ID NO: 1014559 - RNA, 22 nt, Human
augcugcugcaucugcugcugg

SEQ ID NO: 1014560 - RNA, 21 nt, Human
caagaagguggauuuguguca

SEQ ID NO: 1014561 - RNA, 21 nt, Human
cacacgcuccuccucuucugg

SEQ ID NO: 1014562 - RNA, 21 nt, Human
cacacgcuccuccucuucugg

SEQ ID NO: 1014563 - RNA, 23 nt, Human
caccaaucggaggccgaagugaa

SEQ ID NO: 1014564 - RNA, 20 nt, Human
cacccuaugcgccaccaauc

SEQ ID NO: 1014565 - RNA, 19 nt, Human
caccgcggaucccucccgc

SEQ ID NO: 1014566 - RNA, 24 nt, Human
cagaaucagggucugaugaacuuc

SEQ ID NO: 1014567 - RNA, 24 nt, Human
cagcacuuugggagguugaggcag

SEQ ID NO: 1014568 - RNA, 24 nt, Human
cagcacuuugggagguugaggcag

SEQ ID NO: 1014569 - RNA, 21 nt, Human
caguaacagaagcuggcguag

SEQ ID NO: 1014570 - RNA, 18 nt, Human
caguugcaaaaucugggg

SEQ ID NO: 1014571 - RNA, 24 nt, Human
caucuucagcuguucaaauaguuc

SEQ ID NO: 1014572 - RNA, 22 nt, Human
cccaagccuucuccaccuccuc

SEQ ID NO: 1014573 - RNA, 25 nt, Human
cccauaacaaggagacuucacuuga

SEQ ID NO: 1014574 - RNA, 25 nt, Human
ccuaugcgccaccaaucggaggccg

SEQ ID NO: 1014575 - RNA, 21 nt, Human
ccuccgcuucccuggguccac

SEQ ID NO: 1014576 - RNA, 23 nt, Human
ccuuacacugggguuuaaccuuc

SEQ ID NO: 1014577 - RNA, 24 nt, Human
cucacugucaguuggcgggcaguc

SEQ ID NO: 1014578 - RNA, 22 nt, Human
cugcugcaucugcugcuggagu

SEQ ID NO: 1014579 - RNA, 19 nt, Human
cuguaauuccagcacuuug

SEQ ID NO: 1014580 - RNA, 22 nt, Human
cuuccauguuggagaaucccau

SEQ ID NO: 1014581 - RNA, 21 nt, Human
cuucugcuguuuggcugaagg

SEQ ID NO: 1014582 - RNA, 21 nt, Human
cuugagccuaugaguuccaga

SEQ ID NO: 1014583 - RNA, 21 nt, Human
cuugagggguguuaaaguuag

SEQ ID NO: 1014584 - RNA, 21 nt, Human
cuugagggguguuaaaguuag

SEQ ID NO: 1014585 - RNA, 20 nt, Human
cuuuagggguuuccuauugg

SEQ ID NO: 1014586 - RNA, 24 nt, Human
gaagauuacuugagccuaugaguu

SEQ ID NO: 1014587 - RNA, 25 nt, Human
gcaagaagguggauuucuccccugg

SEQ ID NO: 1014588 - RNA, 22 nt, Human
gccaccaaucggaggccgaagu

SEQ ID NO: 1014589 - RNA, 19 nt, Human
gccgaagugaaggcuccca

SEQ ID NO: 1014590 - RNA, 20 nt, Human
gcugcugcaucugcugcugg

SEQ ID NO: 1014591 - RNA, 22 nt, Human
ggaacagggucugaaacuuggg

SEQ ID NO: 1014592 - RNA, 20 nt, Human
ggcuccuccgcuucccuggg

SEQ ID NO: 1014593 - RNA, 21 nt, Human
uaaagcaagcugcucaagagc

SEQ ID NO: 1014594 - RNA, 23 nt, Human
uaaagcaagcugcucaagagccc

SEQ ID NO: 1014595 - RNA, 19 nt, Human
uaacaaggagacuucacuu

SEQ ID NO: 1014596 - RNA, 23 nt, Human
uaagaaacucagucccuucaaaa

SEQ ID NO: 1014597 - RNA, 22 nt, Human
uacccuuuagggguuuccuauu

SEQ ID NO: 1014598 - RNA, 21 nt, Human
uaugaguuccagaacauggca

SEQ ID NO: 1014599 - RNA, 19 nt, Human
uauuccacagagugggagc

SEQ ID NO: 1014600 - RNA, 22 nt, Human
uauugguuacacccuaugcgcc

SEQ ID NO: 1014601 - RNA, 18 nt, Human
ucagcggcgcgagcccaa

SEQ ID NO: 1014602 - RNA, 27 nt, Human
ucagcggcgcgagcccaagccuucucc

SEQ ID NO: 1014603 - RNA, 18 nt, Human
ucagggucugaugaacuu

SEQ ID NO: 1014604 - RNA, 24 nt, Human
ucccaaacagauacagcuuggccu

SEQ ID NO: 1014605 - RNA, 24 nt, Human
ucucacugucaguuggcgggcagu

SEQ ID NO: 1014606 - RNA, 22 nt, Human
ucuuggaaaguuucaaacagau

SEQ ID NO: 1014607 - RNA, 22 nt, Human
ucuuggaaaguuucaaacagau

SEQ ID NO: 1014608 - RNA, 24 nt, Human
ugaacaugcugcugcaucugcugc

SEQ ID NO: 1014609 - RNA, 20 nt, Human
ugaagcaaaaguauauuccc

SEQ ID NO: 1014610 - RNA, 21 nt, Human
ugacaguuuuaugagggcugc

SEQ ID NO: 1014611 - RNA, 19 nt, Human
ugaggaagaggggguggcc

SEQ ID NO: 1014612 - RNA, 24 nt, Human
ugaggcaggaagauuacuugagcc

SEQ ID NO: 1014613 - RNA, 25 nt, Human
ugaggcaggaagauuacuugagccu

SEQ ID NO: 1014614 - RNA, 18 nt, Human
ugcugcugcaucugcugc

SEQ ID NO: 1014615 - RNA, 23 nt, Human
ugcuggagucucuuccuuugugc

SEQ ID NO: 1014616 - RNA, 19 nt, Human
ugcuguuuggcugaagguu

SEQ ID NO: 1014617 - RNA, 18 nt, Human
uggagaaucccaucucau

SEQ ID NO: 1014618 - RNA, 23 nt, Human
uggcaagaagguggauuuguguc

SEQ ID NO: 1014619 - RNA, 21 nt, Human
uggccgccaggcuccuccgcu

SEQ ID NO: 1014620 - RNA, 23 nt, Human
ugggagguugaggcaggaagauu

SEQ ID NO: 1014621 - RNA, 18 nt, Human
uuacuugagccuaugagu

SEQ ID NO: 1014622 - RNA, 24 nt, Human
uuccagcacuuugggagguugagg

SEQ ID NO: 1014623 - RNA, 21 nt, Human
uuccauguuggagaaucccau

SEQ ID NO: 1014624 - RNA, 19 nt, Human
uucccuggguccaccgcgg

SEQ ID NO: 1014625 - RNA, 19 nt, Human
uugaagcaaaaguauauuc

SEQ ID NO: 1014626 - RNA, 26 nt, Human
uugaagcaauaaaagcacagauuuau

SEQ ID NO: 1014627 - RNA, 20 nt, Human
uugagauugggguugcaggu

SEQ ID NO: 1014628 - RNA, 22 nt, Human
uuugcuuccuuuucucccuggg

SEQ ID NO: 1014629 - RNA, 18 nt, Human
uuuuuuuuuuuuuuuuug

SEQ ID NO: 1014630 - RNA, 27 nt, Human
uuuuuuuuuuuuuuuuuuuuuuugggg

SEQ ID NO: 1014631 - RNA, 21 nt, Human
aaaaaaaacaaaaaacccaac

SEQ ID NO: 1014632 - RNA, 25 nt, Human
aaaaaaaacaaaaaacccaacaaaa

SEQ ID NO: 1014633 - RNA, 23 nt, Human
aaaaaaaucccaacaacaugcua

SEQ ID NO: 1014634 - RNA, 20 nt, Human
aaaaaacccaacaaaacaga

SEQ ID NO: 1014635 - RNA, 23 nt, Human
aaaaacaaaaaaaacaaaaaacc

SEQ ID NO: 1014636 - RNA, 20 nt, Human
aaaacaacuacaauaaccau

SEQ ID NO: 1014637 - RNA, 24 nt, Human
aaaaccaaccaaccaaccaacccc

SEQ ID NO: 1014638 - RNA, 23 nt, Human
aaacaaaaaaaacaaaaaaccca

SEQ ID NO: 1014639 - RNA, 24 nt, Human
aaacaaaaaaaacaaaaaacccaa

SEQ ID NO: 1014640 - RNA, 21 nt, Human
aaacaaaaaacccaacaaaac

SEQ ID NO: 1014641 - RNA, 22 nt, Human
aaacaaaaaacccaacaaaaca

SEQ ID NO: 1014642 - RNA, 18 nt, Human
aaacaaacaaaaagguau

SEQ ID NO: 1014643 - RNA, 21 nt, Human
aaacaagagaccacaucaagg

SEQ ID NO: 1014644 - RNA, 25 nt, Human
aaacauugaaagacccuuaaaacac

SEQ ID NO: 1014645 - RNA, 22 nt, Human
aaacccaacaaaacagaacaaa

SEQ ID NO: 1014646 - RNA, 23 nt, Human
aaaguaaaacagucuucagccuu

SEQ ID NO: 1014647 - RNA, 19 nt, Human
aaauaaagguauaaucaug

SEQ ID NO: 1014648 - RNA, 21 nt, Human
aacaaaaagguauuacauaag

SEQ ID NO: 1014649 - RNA, 20 nt, Human
aacaaaaugcacacccacaa

SEQ ID NO: 1014650 - RNA, 23 nt, Human
aacaagagaccacaucaaggcua

SEQ ID NO: 1014651 - RNA, 24 nt, Human
aacaggcucacuucccccagcccc

SEQ ID NO: 1014652 - RNA, 22 nt, Human
aaccaaccaaccaaccaacccc

SEQ ID NO: 1014653 - RNA, 23 nt, Human
aaccaaccaaccaaccaaccccc

SEQ ID NO: 1014654 - RNA, 23 nt, Human
aaccaacccccccaccgacccug

SEQ ID NO: 1014655 - RNA, 20 nt, Human
aaccacauaaacaaacaaaa

SEQ ID NO: 1014656 - RNA, 22 nt, Human
aaccccccccccaaacuuuccc

SEQ ID NO: 1014657 - RNA, 20 nt, Human
aacuucuuacuuccaacuuu

SEQ ID NO: 1014658 - RNA, 20 nt, Human
aagcaauucaagaauaccca

SEQ ID NO: 1014659 - RNA, 21 nt, Human
aagcggcgacggcugcgggcc

SEQ ID NO: 1014660 - RNA, 22 nt, Human
aaggacauaaaacaagagacca

SEQ ID NO: 1014661 - RNA, 23 nt, Human
aaggacucuuaggucuccuucag

SEQ ID NO: 1014662 - RNA, 22 nt, Human
aaggugguaaaaaaaaccagga

SEQ ID NO: 1014663 - RNA, 24 nt, Human
aaguaagaacaaucuugaaggcaa

SEQ ID NO: 1014664 - RNA, 23 nt, Human
aaucaugauuaucucuauuucuu

SEQ ID NO: 1014665 - RNA, 21 nt, Human
acaaaaccaaccaaccaacca

SEQ ID NO: 1014666 - RNA, 19 nt, Human
acacaauuaauuacuguua

SEQ ID NO: 1014667 - RNA, 23 nt, Human
acauuaacagcagcaauggacaa

SEQ ID NO: 1014668 - RNA, 22 nt, Human
accaaccaaccaacccccccac

SEQ ID NO: 1014669 - RNA, 19 nt, Human
accaacccccccaccgacc

SEQ ID NO: 1014670 - RNA, 23 nt, Human
accaacccccccaccgacccugc

SEQ ID NO: 1014671 - RNA, 19 nt, Human
accagauuuaaacuaccag

SEQ ID NO: 1014672 - RNA, 21 nt, Human
accaggaaaugaagauuuuac

SEQ ID NO: 1014673 - RNA, 22 nt, Human
acccaacaaaacagaacaaaau

SEQ ID NO: 1014674 - RNA, 21 nt, Human
acccccccaccgacccugcca

SEQ ID NO: 1014675 - RNA, 18 nt, Human
acuacaauaaccauccca

SEQ ID NO: 1014676 - RNA, 20 nt, Human
acuacucuaaaacuccaucu

SEQ ID NO: 1014677 - RNA, 22 nt, Human
acuuuuucaagauacagaaaac

SEQ ID NO: 1014678 - RNA, 18 nt, Human
agaaaacuuccaaagcua

SEQ ID NO: 1014679 - RNA, 21 nt, Human
agaaaauacugaaaguaaaac

SEQ ID NO: 1014680 - RNA, 22 nt, Human
agaaacauugaaagacccuuaa

SEQ ID NO: 1014681 - RNA, 21 nt, Human
agauaaucgagauuuaaauaa

SEQ ID NO: 1014682 - RNA, 20 nt, Human
agauuuaaacuaccagugaa

SEQ ID NO: 1014683 - RNA, 25 nt, Human
agcacucauuucucaggaccuuugg

SEQ ID NO: 1014684 - RNA, 20 nt, Human
agcacugaauauugccaccc

SEQ ID NO: 1014685 - RNA, 19 nt, Human
agugauugcauuuuuuuga

SEQ ID NO: 1014686 - RNA, 26 nt, Human
auaaaauugguuuauuguaaaagcaa

SEQ ID NO: 1014687 - RNA, 24 nt, Human
auaaacaaacaaaaagguauuaca

SEQ ID NO: 1014688 - RNA, 18 nt, Human
auaaaguucucuaucaag

SEQ ID NO: 1014689 - RNA, 20 nt, Human
auaaaguucucuaucaaggg

SEQ ID NO: 1014690 - RNA, 19 nt, Human
auagcaaaagaaauaaaaa

SEQ ID NO: 1014691 - RNA, 19 nt, Human
aucuaccguaugcccagag

SEQ ID NO: 1014692 - RNA, 21 nt, Human
aucuucacaacccccccccca

SEQ ID NO: 1014693 - RNA, 22 nt, Human
aucuucacaaccccccccccaa

SEQ ID NO: 1014694 - RNA, 18 nt, Human
augaacccuugaaaauaa

SEQ ID NO: 1014695 - RNA, 19 nt, Human
auuacaaaugagaacuaca

SEQ ID NO: 1014696 - RNA, 20 nt, Human
auuauccaccaaaaucuaua

SEQ ID NO: 1014697 - RNA, 24 nt, Human
caaaacagaacaaaaugcacaccc

SEQ ID NO: 1014698 - RNA, 31 nt, Human
caaaacagaacaaaaugcacacccacaaaag

SEQ ID NO: 1014699 - RNA, 20 nt, Human
caaaaccaaccaaccaacca

SEQ ID NO: 1014700 - RNA, 24 nt, Human
caaaaccaaccaaccaaccaaccc

SEQ ID NO: 1014701 - RNA, 27 nt, Human
caaaaccaaccaaccaaccaacccccc

SEQ ID NO: 1014702 - RNA, 20 nt, Human
caaaauacuuagauuuugua

SEQ ID NO: 1014703 - RNA, 18 nt, Human
caaacuuucccacccucc

SEQ ID NO: 1014704 - RNA, 22 nt, Human
caaagaaaacuuccaaagcuaa

SEQ ID NO: 1014705 - RNA, 20 nt, Human
caaagcacugugccagguau

SEQ ID NO: 1014706 - RNA, 24 nt, Human
caacacugagguauaacugggcaa

SEQ ID NO: 1014707 - RNA, 22 nt, Human
caaccaaccaaccaaccccccc

SEQ ID NO: 1014708 - RNA, 23 nt, Human
caaccaaccaaccaaccccccca

SEQ ID NO: 1014709 - RNA, 21 nt, Human
caaccaaccaacccccccacc

SEQ ID NO: 1014710 - RNA, 21 nt, Human
caaccaacccccccaccgacc

SEQ ID NO: 1014711 - RNA, 20 nt, Human
cacaaccccccccccaaacu

SEQ ID NO: 1014712 - RNA, 22 nt, Human
cacaaccccccccccaaacuuu

SEQ ID NO: 1014713 - RNA, 24 nt, Human
cacaaccccccccccaaacuuucc

SEQ ID NO: 1014714 - RNA, 26 nt, Human
cacaaccccccccccaaacuuuccca

SEQ ID NO: 1014715 - RNA, 21 nt, Human
cacccucccccuaagcuaaag

SEQ ID NO: 1014716 - RNA, 22 nt, Human
caccgacccugccaaaaacaaa

SEQ ID NO: 1014717 - RNA, 21 nt, Human
cacgggccgagguggagaagc

SEQ ID NO: 1014718 - RNA, 26 nt, Human
cagaaaacaauuguuaugauaggcac

SEQ ID NO: 1014719 - RNA, 27 nt, Human
cagcaacauuauuuguagcaaaggagg

SEQ ID NO: 1014720 - RNA, 28 nt, Human
cagcagcaauggacaaggaagagcaaaa

SEQ ID NO: 1014721 - RNA, 21 nt, Human
cagcuaacucaaaaccuuaua

SEQ ID NO: 1014722 - RNA, 23 nt, Human
caggcucacuucccccagccccc

SEQ ID NO: 1014723 - RNA, 27 nt, Human
caggcucacuucccccagcccccaaaa

SEQ ID NO: 1014724 - RNA, 25 nt, Human
caucccccgccccggcgccuccgcc

SEQ ID NO: 1014725 - RNA, 19 nt, Human
cauuacuacucuaaaacuc

SEQ ID NO: 1014726 - RNA, 22 nt, Human
ccaaccaacccccccaccgacc

SEQ ID NO: 1014727 - RNA, 24 nt, Human
ccaaccagauuuaaacuaccagug

SEQ ID NO: 1014728 - RNA, 19 nt, Human
ccaacccccccaccgaccc

SEQ ID NO: 1014729 - RNA, 22 nt, Human
ccaacccccccaccgacccugc

SEQ ID NO: 1014730 - RNA, 19 nt, Human
ccaaugcuacccaauacaa

SEQ ID NO: 1014731 - RNA, 20 nt, Human
ccacccucccccuaagcuaa

SEQ ID NO: 1014732 - RNA, 22 nt, Human
ccagauuuaaacuaccagugaa

SEQ ID NO: 1014733 - RNA, 19 nt, Human
ccccaccgacccugccaaa

SEQ ID NO: 1014734 - RNA, 20 nt, Human
ccccagcccccaaaaugaac

SEQ ID NO: 1014735 - RNA, 23 nt, Human
ccccccaaacuuucccacccucc

SEQ ID NO: 1014736 - RNA, 24 nt, Human
ccccccaaacuuucccacccuccc

SEQ ID NO: 1014737 - RNA, 25 nt, Human
ccccccaaacuuucccacccucccc

SEQ ID NO: 1014738 - RNA, 18 nt, Human
cccccccaccgacccugc

SEQ ID NO: 1014739 - RNA, 22 nt, Human
cccccgcccugcgccccggcuc

SEQ ID NO: 1014740 - RNA, 21 nt, Human
cccccuaaaucuucacaaccc

SEQ ID NO: 1014741 - RNA, 18 nt, Human
cccccugacccaggcgag

SEQ ID NO: 1014742 - RNA, 20 nt, Human
ccccgcccugcgccccggcc

SEQ ID NO: 1014743 - RNA, 23 nt, Human
ccccuaaaucuucacaacccccc

SEQ ID NO: 1014744 - RNA, 23 nt, Human
cccgacgcgcacccccugaccca

SEQ ID NO: 1014745 - RNA, 20 nt, Human
cccuaaaucuucacaacccc

SEQ ID NO: 1014746 - RNA, 21 nt, Human
ccgacgcgcacccccugaccc

SEQ ID NO: 1014747 - RNA, 25 nt, Human
ccgcaucccccgccccggcgccucc

SEQ ID NO: 1014748 - RNA, 18 nt, Human
ccgccccggcgccuccgc

SEQ ID NO: 1014749 - RNA, 21 nt, Human
ccggggggcugcgccgcggcc

SEQ ID NO: 1014750 - RNA, 18 nt, Human
ccuccgcccccgcccugc

SEQ ID NO: 1014751 - RNA, 21 nt, Human
cgacaaaaccaaccaaccaac

SEQ ID NO: 1014752 - RNA, 23 nt, Human
cgacaaaaccaaccaaccaacca

SEQ ID NO: 1014753 - RNA, 24 nt, Human
cgacccugccaaaaacaaaaaaaa

SEQ ID NO: 1014754 - RNA, 24 nt, Human
cgcccccgcccugcgccccggcuc

SEQ ID NO: 1014755 - RNA, 24 nt, Human
cgccuccgcccccgcccugcgccc

SEQ ID NO: 1014756 - RNA, 18 nt, Human
cgcggccccgcauccccc

SEQ ID NO: 1014757 - RNA, 19 nt, Human
cgggaggggcugcgaggca

SEQ ID NO: 1014758 - RNA, 19 nt, Human
cgggccgggcggcgcuguc

SEQ ID NO: 1014759 - RNA, 21 nt, Human
cgggcggcgcuguccucgcuc

SEQ ID NO: 1014760 - RNA, 25 nt, Human
cuaaaacuccaucugcaguggccau

SEQ ID NO: 1014761 - RNA, 24 nt, Human
cuaaaugcugugacaugaagcauc

SEQ ID NO: 1014762 - RNA, 23 nt, Human
cuaggaggaaaagaaaauacuga

SEQ ID NO: 1014763 - RNA, 20 nt, Human
cucaaaaagggaaaggacuc

SEQ ID NO: 1014764 - RNA, 19 nt, Human
cucacuucccccagccccc

SEQ ID NO: 1014765 - RNA, 18 nt, Human
cuccaaaucaaugugcuc

SEQ ID NO: 1014766 - RNA, 18 nt, Human
cugaauuccaaucgagac

SEQ ID NO: 1014767 - RNA, 25 nt, Human
cugcacauuaaaaaaaaucccaaca

SEQ ID NO: 1014768 - RNA, 22 nt, Human
cuggugccacuuuaauucacaa

SEQ ID NO: 1014769 - RNA, 26 nt, Human
cuuaaaauaaaacuucuuacuuccaa

SEQ ID NO: 1014770 - RNA, 22 nt, Human
cuuauaagcuccuaaaauaaaa

SEQ ID NO: 1014771 - RNA, 21 nt, Human
cuucccaagcugaggcuuuuc

SEQ ID NO: 1014772 - RNA, 19 nt, Human
gaaaacugcaacuggcuua

SEQ ID NO: 1014773 - RNA, 26 nt, Human
gaaauugucucaugccuuauaagcuc

SEQ ID NO: 1014774 - RNA, 18 nt, Human
gacgcgcacccccugacc

SEQ ID NO: 1014775 - RNA, 22 nt, Human
gaggaaaagaaaauacugaaag

SEQ ID NO: 1014776 - RNA, 19 nt, Human
gaggcuuuucauagcagcu

SEQ ID NO: 1014777 - RNA, 23 nt, Human
gaucacuuuuccagcuaacucaa

SEQ ID NO: 1014778 - RNA, 20 nt, Human
gccaaaaacaaaaaaaacaa

SEQ ID NO: 1014779 - RNA, 18 nt, Human
gcccccaaaaugaacagu

SEQ ID NO: 1014780 - RNA, 18 nt, Human
gccccggcgccuccgccc

SEQ ID NO: 1014781 - RNA, 21 nt, Human
gccgagguggagaagcggcga

SEQ ID NO: 1014782 - RNA, 20 nt, Human
gcuccacgggccgaggugga

SEQ ID NO: 1014783 - RNA, 19 nt, Human
gcugcgccucgggaggggc

SEQ ID NO: 1014784 - RNA, 21 nt, Human
ggaaaagaaaauacugaaagu

SEQ ID NO: 1014785 - RNA, 19 nt, Human
ggaaagcagggaaaccuaa

SEQ ID NO: 1014786 - RNA, 18 nt, Human
ggagaagcggcgacggcu

SEQ ID NO: 1014787 - RNA, 24 nt, Human
ggcaaagaaaacuuccaaagcuag

SEQ ID NO: 1014788 - RNA, 20 nt, Human
ggcaaauuauaggcacuccu

SEQ ID NO: 1014789 - RNA, 19 nt, Human
ggccggggggcugcgccgc

SEQ ID NO: 1014790 - RNA, 24 nt, Human
gguaaaaaaaaccaggaaaugaag

SEQ ID NO: 1014791 - RNA, 20 nt, Human
guguacuuaggugacugaaa

SEQ ID NO: 1014792 - RNA, 24 nt, Human
uaaaaaauacucuuuggaaaccau

SEQ ID NO: 1014793 - RNA, 19 nt, Human
uaaaacaagagaccacauc

SEQ ID NO: 1014794 - RNA, 20 nt, Human
uaaaacaagagaccacauca

SEQ ID NO: 1014795 - RNA, 20 nt, Human
uaaaacacagaggugcuagc

SEQ ID NO: 1014796 - RNA, 18 nt, Human
uaaaagagagagcagaua

SEQ ID NO: 1014797 - RNA, 18 nt, Human
uaaaauaaaaucaagguc

SEQ ID NO: 1014798 - RNA, 22 nt, Human
uaaaccacuauaaagcuuauuu

SEQ ID NO: 1014799 - RNA, 18 nt, Human
uaaacuaccagugaaaua

SEQ ID NO: 1014800 - RNA, 21 nt, Human
uaacaacaugcuugcgaggau

SEQ ID NO: 1014801 - RNA, 22 nt, Human
uaacacagcaacauuauuugua

SEQ ID NO: 1014802 - RNA, 21 nt, Human
uaagaucaaagcacugugcca

SEQ ID NO: 1014803 - RNA, 23 nt, Human
uaagggcuuauucuagaaacauu

SEQ ID NO: 1014804 - RNA, 19 nt, Human
uaaucugaucacuuuucca

SEQ ID NO: 1014805 - RNA, 27 nt, Human
uacaacacugagguauaacugggcaaa

SEQ ID NO: 1014806 - RNA, 25 nt, Human
uagcaaaagaaauaaaaaguuuuuu

SEQ ID NO: 1014807 - RNA, 21 nt, Human
uaggaacaaggacauaaaaca

SEQ ID NO: 1014808 - RNA, 19 nt, Human
uaugaauacuuaacacagc

SEQ ID NO: 1014809 - RNA, 19 nt, Human
uaugaauucugaauuacac

SEQ ID NO: 1014810 - RNA, 19 nt, Human
uauguuuggguguguguau

SEQ ID NO: 1014811 - RNA, 19 nt, Human
ucaaccauaaguagaucua

SEQ ID NO: 1014812 - RNA, 25 nt, Human
ucaaggcuaugauucaaacucaaaa

SEQ ID NO: 1014813 - RNA, 25 nt, Human
ucacaaccccccccccaaacuuucc

SEQ ID NO: 1014814 - RNA, 22 nt, Human
ucacuucccccagcccccaaaa

SEQ ID NO: 1014815 - RNA, 22 nt, Human
ucagauguaccaacgcuagaaa

SEQ ID NO: 1014816 - RNA, 20 nt, Human
uccaagggagaaaauaaagc

SEQ ID NO: 1014817 - RNA, 21 nt, Human
uccaagggagaaaauaaagcc

SEQ ID NO: 1014818 - RNA, 20 nt, Human
uccaucauccaaacaggcuc

SEQ ID NO: 1014819 - RNA, 22 nt, Human
uccaucauccaaacaggcucac

SEQ ID NO: 1014820 - RNA, 23 nt, Human
ucccacccucccccuaagcuaaa

SEQ ID NO: 1014821 - RNA, 24 nt, Human
ucccccuaaaucuucacaaccccc

SEQ ID NO: 1014822 - RNA, 22 nt, Human
ucucuauuucuuugcuaaauuc

SEQ ID NO: 1014823 - RNA, 21 nt, Human
ucugcagacugccccaaccag

SEQ ID NO: 1014824 - RNA, 18 nt, Human
ugaaaauaacacaaaugu

SEQ ID NO: 1014825 - RNA, 21 nt, Human
ugaaauauaaacuacuaguca

SEQ ID NO: 1014826 - RNA, 28 nt, Human
ugaaccacauaaacaaacaguuaaagag

SEQ ID NO: 1014827 - RNA, 26 nt, Human
ugaagaaacaacuguugaacaaacua

SEQ ID NO: 1014828 - RNA, 22 nt, Human
ugaauacuuaacacagcaacau

SEQ ID NO: 1014829 - RNA, 21 nt, Human
ugacugaaaauaacacaaaug

SEQ ID NO: 1014830 - RNA, 23 nt, Human
ugagggguaaaggaagaucucca

SEQ ID NO: 1014831 - RNA, 22 nt, Human
ugauaggcacacccacaauucu

SEQ ID NO: 1014832 - RNA, 20 nt, Human
ugauuggugaacauuuaacu

SEQ ID NO: 1014833 - RNA, 20 nt, Human
ugauuggugaacauuuaacu

SEQ ID NO: 1014834 - RNA, 19 nt, Human
ugcaguggccauuuccccc

SEQ ID NO: 1014835 - RNA, 21 nt, Human
ugccaaaaacaaaaaaaacaa

SEQ ID NO: 1014836 - RNA, 22 nt, Human
ugccaaaaacaaaaaaaacaaa

SEQ ID NO: 1014837 - RNA, 25 nt, Human
ugccaaaaacaaaaaaaacaaaaaa

SEQ ID NO: 1014838 - RNA, 22 nt, Human
ugcgccccggcuccacuggucu

SEQ ID NO: 1014839 - RNA, 19 nt, Human
uggaaagcagggaaaccua

SEQ ID NO: 1014840 - RNA, 23 nt, Human
uggaaagcagggaaaccuaaaaa

SEQ ID NO: 1014841 - RNA, 19 nt, Human
uggguguguguauguauau

SEQ ID NO: 1014842 - RNA, 18 nt, Human
ugguacuauauauauaua

SEQ ID NO: 1014843 - RNA, 20 nt, Human
ugguacuauauauauauauu

SEQ ID NO: 1014844 - RNA, 23 nt, Human
ugugaaagaggucagcaauacau

SEQ ID NO: 1014845 - RNA, 19 nt, Human
uguuaugaacccuugaaaa

SEQ ID NO: 1014846 - RNA, 23 nt, Human
uuaaagagaaagaaguuuauaaa

SEQ ID NO: 1014847 - RNA, 21 nt, Human
uuauauacaacacagugauug

SEQ ID NO: 1014848 - RNA, 23 nt, Human
uucaacacugauugguaugaauu

SEQ ID NO: 1014849 - RNA, 19 nt, Human
uucacaaccccccccccaa

SEQ ID NO: 1014850 - RNA, 22 nt, Human
uucacaaccccccccccaaacu

SEQ ID NO: 1014851 - RNA, 23 nt, Human
uucacaaccccccccccaaacuu

SEQ ID NO: 1014852 - RNA, 22 nt, Human
uucauagcuuauauugaagagu

SEQ ID NO: 1014853 - RNA, 21 nt, Human
uucccacccucccccuaagcu

SEQ ID NO: 1014854 - RNA, 19 nt, Human
uucccuguguucauuuuuc

SEQ ID NO: 1014855 - RNA, 21 nt, Human
uuccgacaaaaccaaccaacc

SEQ ID NO: 1014856 - RNA, 21 nt, Human
uugaucuucugcacauuaaaa

SEQ ID NO: 1014857 - RNA, 25 nt, Human
uugcuaaauucaacuaccaauauac

SEQ ID NO: 1014858 - RNA, 20 nt, Human
uuggaaaccauuauuacucc

SEQ ID NO: 1014859 - RNA, 22 nt, Human
aggggggaagaugcugggcugg

SEQ ID NO: 1014860 - RNA, 20 nt, Human
gaagaaggggggaagaugcu

SEQ ID NO: 1014861 - RNA, 20 nt, Human
ggggggaagaugcugggcug

SEQ ID NO: 1014862 - RNA, 21 nt, Human
ggggggaagaugcugggcugg

SEQ ID NO: 1014863 - RNA, 26 nt, Human
gugguggaagaaggggggaagaugcu

SEQ ID NO: 1014864 - RNA, 21 nt, Human
aacaccgacgcugccaagaag

SEQ ID NO: 1014865 - RNA, 24 nt, Human
aagcgcccgccuguaccgcuaccc

SEQ ID NO: 1014866 - RNA, 19 nt, Human
ccaacaccgacgcugccaa

SEQ ID NO: 1014867 - RNA, 22 nt, Human
ccaagaagcuguaguucgcagu

SEQ ID NO: 1014868 - RNA, 18 nt, Human
ccaggaugccgugcaccu

SEQ ID NO: 1014869 - RNA, 23 nt, Human
ccccaggaagccggccuccugcc

SEQ ID NO: 1014870 - RNA, 20 nt, Human
cccgcggccaacaccgacgc

SEQ ID NO: 1014871 - RNA, 21 nt, Human
ccgacgcugccaagaagcugu

SEQ ID NO: 1014872 - RNA, 21 nt, Human
ccgccgcggucuccccuucuc

SEQ ID NO: 1014873 - RNA, 22 nt, Human
ccuccugccucuucgcugcgca

SEQ ID NO: 1014874 - RNA, 21 nt, Human
ccuguaccgcuaccccaggaa

SEQ ID NO: 1014875 - RNA, 24 nt, Human
cugggggccgccgcggucuccccu

SEQ ID NO: 1014876 - RNA, 19 nt, Human
gaaagccgcucucacuggg

SEQ ID NO: 1014877 - RNA, 22 nt, Human
gaguaagcgcccgccuguaccg

SEQ ID NO: 1014878 - RNA, 22 nt, Human
gccuguaccgcuaccccaggaa

SEQ ID NO: 1014879 - RNA, 23 nt, Human
gcgcagcacaucgcaccguccug

SEQ ID NO: 1014880 - RNA, 23 nt, Human
ggaugccgugcaccuuuaccuca

SEQ ID NO: 1014881 - RNA, 21 nt, Human
ggucccauucauccgaggggg

SEQ ID NO: 1014882 - RNA, 23 nt, Human
uaccgcuaccccaggaagccggc

SEQ ID NO: 1014883 - RNA, 19 nt, Human
ucacugggggccgccgcgg

SEQ ID NO: 1014884 - RNA, 20 nt, Human
ucauccgagggggcguccga

SEQ ID NO: 1014885 - RNA, 21 nt, Human
ucccaggaugccgugcaccuu

SEQ ID NO: 1014886 - RNA, 21 nt, Human
ucucacugggggccgccgcgg

SEQ ID NO: 1014887 - RNA, 18 nt, Human
aaggacccaagaguccag

SEQ ID NO: 1014888 - RNA, 25 nt, Human
acccuauccucuuccuaagauccag

SEQ ID NO: 1014889 - RNA, 20 nt, Human
acugacccuauccucuuccu

SEQ ID NO: 1014890 - RNA, 21 nt, Human
agaagcagaaaccccagccca

SEQ ID NO: 1014891 - RNA, 19 nt, Human
agaggacccaggggucugg

SEQ ID NO: 1014892 - RNA, 19 nt, Human
aggacccaagaguccagcc

SEQ ID NO: 1014893 - RNA, 20 nt, Human
aggcccccagaccacucacc

SEQ ID NO: 1014894 - RNA, 24 nt, Human
cacucuuuccccgggagucgggag

SEQ ID NO: 1014895 - RNA, 24 nt, Human
cagaaccggacuuccacccacugg

SEQ ID NO: 1014896 - RNA, 20 nt, Human
cagcccuaaaccuccacccc

SEQ ID NO: 1014897 - RNA, 20 nt, Human
cccaagaguccagcccuaaa

SEQ ID NO: 1014898 - RNA, 22 nt, Human
cccagaccacucaccuuuaaag

SEQ ID NO: 1014899 - RNA, 24 nt, Human
cccagcccacucuuuccccgggag

SEQ ID NO: 1014900 - RNA, 18 nt, Human
ccccaagcccagaggccc

SEQ ID NO: 1014901 - RNA, 25 nt, Human
ccccaagcccagaggcccccagacc

SEQ ID NO: 1014902 - RNA, 20 nt, Human
ccccgggagucgggaguccg

SEQ ID NO: 1014903 - RNA, 19 nt, Human
cgcagaaccggacuuccac

SEQ ID NO: 1014904 - RNA, 20 nt, Human
cggagccccacuaccuuccc

SEQ ID NO: 1014905 - RNA, 18 nt, Human
cuggccccaagcccagag

SEQ ID NO: 1014906 - RNA, 21 nt, Human
gaagcagaaaccccagcccac

SEQ ID NO: 1014907 - RNA, 25 nt, Human
gauccagaagcagaaaccccagccc

SEQ ID NO: 1014908 - RNA, 22 nt, Human
gccccaagcccagaggccccca

SEQ ID NO: 1014909 - RNA, 18 nt, Human
gcccuaaaccuccacccc

SEQ ID NO: 1014910 - RNA, 20 nt, Human
gcccuaaaccuccaccccgc

SEQ ID NO: 1014911 - RNA, 21 nt, Human
gggaacgggggacccagguga

SEQ ID NO: 1014912 - RNA, 21 nt, Human
guccggagccccacuaccuuc

SEQ ID NO: 1014913 - RNA, 24 nt, Human
uaaaccuccaccccgcuuuccgca

SEQ ID NO: 1014914 - RNA, 18 nt, Human
uaguccagacugacccua

SEQ ID NO: 1014915 - RNA, 19 nt, Human
uaucagaacaaaagaguuc

SEQ ID NO: 1014916 - RNA, 25 nt, Human
ugacccuauccucuuccuaagaucc

SEQ ID NO: 1014917 - RNA, 19 nt, Human
ugcggugggaaaggagagg

SEQ ID NO: 1014918 - RNA, 23 nt, Human
uggccccaagcccagaggccccc

SEQ ID NO: 1014919 - RNA, 19 nt, Human
ugggaaaggagaggugcag

SEQ ID NO: 1014920 - RNA, 21 nt, Human
ugggaaaggagaggugcagug

SEQ ID NO: 1014921 - RNA, 24 nt, Human
uuccuaagauccagaagcagaaac

SEQ ID NO: 1014922 - RNA, 19 nt, Human
uugccgcccucuccuccca

SEQ ID NO: 1014923 - RNA, 23 nt, Human
uugccgcccucuccucccaccua

SEQ ID NO: 1014924 - RNA, 20 nt, Human
aaaaauacaccuuuggggac

SEQ ID NO: 1014925 - RNA, 21 nt, Human
aaagagcccuuuggcaucuac

SEQ ID NO: 1014926 - RNA, 18 nt, Human
aacaggagcaggggaucu

SEQ ID NO: 1014927 - RNA, 23 nt, Human
aacagucucagaaucugagaccc

SEQ ID NO: 1014928 - RNA, 24 nt, Human
aacccaacccacacacuccccgcc

SEQ ID NO: 1014929 - RNA, 21 nt, Human
aaggcaaguugcaagucaagg

SEQ ID NO: 1014930 - RNA, 22 nt, Human
aauucauaccuccauuuucccc

SEQ ID NO: 1014931 - RNA, 21 nt, Human
acagagccuucccaggguuag

SEQ ID NO: 1014932 - RNA, 19 nt, Human
accaaagaucgagaaacag

SEQ ID NO: 1014933 - RNA, 22 nt, Human
accaagaaggaacuagcaagcc

SEQ ID NO: 1014934 - RNA, 24 nt, Human
accacacauaugaauuugaacaau

SEQ ID NO: 1014935 - RNA, 24 nt, Human
accauaccacacugguucaaaacc

SEQ ID NO: 1014936 - RNA, 18 nt, Human
accccacccuccugccca

SEQ ID NO: 1014937 - RNA, 18 nt, Human
acccuccugcccagcccc

SEQ ID NO: 1014938 - RNA, 20 nt, Human
accuguguuugaucuucccc

SEQ ID NO: 1014939 - RNA, 23 nt, Human
agaaacagcuggcuccgaccucc

SEQ ID NO: 1014940 - RNA, 21 nt, Human
agaccccacccuccugcccag

SEQ ID NO: 1014941 - RNA, 19 nt, Human
agagucuucaaacuccacc

SEQ ID NO: 1014942 - RNA, 26 nt, Human
agcaggggaucuguggguggggcugg

SEQ ID NO: 1014943 - RNA, 21 nt, Human
agccagucggaguuuaugguu

SEQ ID NO: 1014944 - RNA, 18 nt, Human
aggagaggcuuucccaag

SEQ ID NO: 1014945 - RNA, 18 nt, Human
aggcaaguugcaagucaa

SEQ ID NO: 1014946 - RNA, 20 nt, Human
aggcaggggcugaccugcaa

SEQ ID NO: 1014947 - RNA, 19 nt, Human
aggccgcccgccugcccag

SEQ ID NO: 1014948 - RNA, 23 nt, Human
aggcugagucugggccucaaggg

SEQ ID NO: 1014949 - RNA, 27 nt, Human
agguggggugcugggaauccucggggc

SEQ ID NO: 1014950 - RNA, 21 nt, Human
agugacuguuccccccgcccc

SEQ ID NO: 1014951 - RNA, 24 nt, Human
agugucccagaggcccugggcagc

SEQ ID NO: 1014952 - RNA, 25 nt, Human
auauaccaaagaucgagaaacagcu

SEQ ID NO: 1014953 - RNA, 22 nt, Human
aucucacuuccucuuaccccaa

SEQ ID NO: 1014954 - RNA, 22 nt, Human
aucugagacccagugacuguuc

SEQ ID NO: 1014955 - RNA, 22 nt, Human
caaauccucccacaagccaccu

SEQ ID NO: 1014956 - RNA, 20 nt, Human
caaaugauuuacaacagaac

SEQ ID NO: 1014957 - RNA, 18 nt, Human
caacagaacacaacagga

SEQ ID NO: 1014958 - RNA, 28 nt, Human
caacaguggccccaggagaggcuuuccc

SEQ ID NO: 1014959 - RNA, 23 nt, Human
caagcggagaucucacuuccucu

SEQ ID NO: 1014960 - RNA, 21 nt, Human
caaggcaagugucccagaggc

SEQ ID NO: 1014961 - RNA, 23 nt, Human
caaggcaagugucccagaggccc

SEQ ID NO: 1014962 - RNA, 21 nt, Human
caaggggcccugggcuuaggg

SEQ ID NO: 1014963 - RNA, 20 nt, Human
cacagagucaaauaaaaauc

SEQ ID NO: 1014964 - RNA, 20 nt, Human
cacagcagaccccacccucc

SEQ ID NO: 1014965 - RNA, 19 nt, Human
cacagcuuagaccaaaccc

SEQ ID NO: 1014966 - RNA, 21 nt, Human
cacagcuuagaccaaacccuu

SEQ ID NO: 1014967 - RNA, 21 nt, Human
caccaggaaaacaucccccuu

SEQ ID NO: 1014968 - RNA, 21 nt, Human
caccagugggcaggcugaguc

SEQ ID NO: 1014969 - RNA, 22 nt, Human
caccauccauuucucgcaggaa

SEQ ID NO: 1014970 - RNA, 20 nt, Human
cacccaccccagcccuagca

SEQ ID NO: 1014971 - RNA, 19 nt, Human
cacccccaacaguggcccc

SEQ ID NO: 1014972 - RNA, 18 nt, Human
cacccuccugcccagccc

SEQ ID NO: 1014973 - RNA, 23 nt, Human
cacccuccugcccagccccugcc

SEQ ID NO: 1014974 - RNA, 20 nt, Human
cacuaggacccaagggaucc

SEQ ID NO: 1014975 - RNA, 24 nt, Human
cagaaucugagacccagugacugu

SEQ ID NO: 1014976 - RNA, 21 nt, Human
cagagcagagcucccaaggac

SEQ ID NO: 1014977 - RNA, 22 nt, Human
cagagcagagcucccaaggacc

SEQ ID NO: 1014978 - RNA, 19 nt, Human
cagagccuucccaggguua

SEQ ID NO: 1014979 - RNA, 21 nt, Human
cagagcucccaaggaccauac

SEQ ID NO: 1014980 - RNA, 22 nt, Human
cagcagaagcuuccaugggugc

SEQ ID NO: 1014981 - RNA, 19 nt, Human
cagcgcggccgccgccccu

SEQ ID NO: 1014982 - RNA, 21 nt, Human
cagggacuccccaccccccac

SEQ ID NO: 1014983 - RNA, 21 nt, Human
cagggacuccccaccccccac

SEQ ID NO: 1014984 - RNA, 21 nt, Human
caguguggcaagcucagagca

SEQ ID NO: 1014985 - RNA, 25 nt, Human
cauccaaacaccaggaaaacauccc

SEQ ID NO: 1014986 - RNA, 20 nt, Human
cauuuuaggcccaucuccug

SEQ ID NO: 1014987 - RNA, 26 nt, Human
ccaaauccucccacaagccggguguc

SEQ ID NO: 1014988 - RNA, 26 nt, Human
ccaagagucuucaaacuccacccacc

SEQ ID NO: 1014989 - RNA, 20 nt, Human
ccacacauaugaauuugaac

SEQ ID NO: 1014990 - RNA, 18 nt, Human
ccacagagccuucccagg

SEQ ID NO: 1014991 - RNA, 22 nt, Human
ccacagcaccugcugcuuugau

SEQ ID NO: 1014992 - RNA, 21 nt, Human
ccacagcagaccccacccucc

SEQ ID NO: 1014993 - RNA, 19 nt, Human
ccacccuccugcccagccc

SEQ ID NO: 1014994 - RNA, 21 nt, Human
ccacuccacuccgucuccggc

SEQ ID NO: 1014995 - RNA, 21 nt, Human
ccacugagacucuggucagga

SEQ ID NO: 1014996 - RNA, 19 nt, Human
ccagacaggcgccucucaa

SEQ ID NO: 1014997 - RNA, 23 nt, Human
ccagccccugcccacauuggggg

SEQ ID NO: 1014998 - RNA, 21 nt, Human
ccagcugaccauccaaacacc

SEQ ID NO: 1014999 - RNA, 23 nt, Human
cccacaaugcagcuccuuccaaa

SEQ ID NO: 1015000 - RNA, 22 nt, Human
cccacccccaacaguggcccca

SEQ ID NO: 1015001 - RNA, 18 nt, Human
ccccacccuccugcccag

SEQ ID NO: 1015002 - RNA, 19 nt, Human
ccccacccuccugcccagc

SEQ ID NO: 1015003 - RNA, 20 nt, Human
ccccaggguccucaaguggg

SEQ ID NO: 1015004 - RNA, 22 nt, Human
ccccccgccccaggccuugggc

SEQ ID NO: 1015005 - RNA, 22 nt, Human
ccccgccccaggccuugggccc

SEQ ID NO: 1015006 - RNA, 25 nt, Human
ccccucugcagcuaccucugaccaa

SEQ ID NO: 1015007 - RNA, 19 nt, Human
cccgcccccaucucucccc

SEQ ID NO: 1015008 - RNA, 20 nt, Human
cccgcccccaucucucccca

SEQ ID NO: 1015009 - RNA, 18 nt, Human
cccucaggccgcccgccu

SEQ ID NO: 1015010 - RNA, 20 nt, Human
cccucccacagagccuuccc

SEQ ID NO: 1015011 - RNA, 20 nt, Human
cccucugcagcuaccucuga

SEQ ID NO: 1015012 - RNA, 20 nt, Human
ccgcccgccugcccagcugc

SEQ ID NO: 1015013 - RNA, 19 nt, Human
ccgcgcccucaggccgccc

SEQ ID NO: 1015014 - RNA, 19 nt, Human
ccuccugcccagccccugc

SEQ ID NO: 1015015 - RNA, 20 nt, Human
ccuuccaccauccauuucuc

SEQ ID NO: 1015016 - RNA, 19 nt, Human
ccuugggccugaagugggg

SEQ ID NO: 1015017 - RNA, 20 nt, Human
cgaacccaacccacacacuc

SEQ ID NO: 1015018 - RNA, 18 nt, Human
cggcuggcacccacuccu

SEQ ID NO: 1015019 - RNA, 20 nt, Human
cggggccggcuggcacccac

SEQ ID NO: 1015020 - RNA, 22 nt, Human
cuccacccaccccagcccuagc

SEQ ID NO: 1015021 - RNA, 18 nt, Human
cucccacaagccaccuuu

SEQ ID NO: 1015022 - RNA, 22 nt, Human
cucccacccccaacaguggccc

SEQ ID NO: 1015023 - RNA, 21 nt, Human
cuccccaccccccacuggagu

SEQ ID NO: 1015024 - RNA, 22 nt, Human
cuccccccucugcagcuaccuc

SEQ ID NO: 1015025 - RNA, 21 nt, Human
cuccgcgcccucaggccgccc

SEQ ID NO: 1015026 - RNA, 25 nt, Human
cugaccauccaaacaccaggaaaac

SEQ ID NO: 1015027 - RNA, 24 nt, Human
cugcaagcggagaucucacuuccu

SEQ ID NO: 1015028 - RNA, 19 nt, Human
cugcccccacucuggcucc

SEQ ID NO: 1015029 - RNA, 23 nt, Human
cuggaacauaacacuaggaccca

SEQ ID NO: 1015030 - RNA, 19 nt, Human
cugggccucaaggggcccu

SEQ ID NO: 1015031 - RNA, 22 nt, Human
cugggccucaaggggcccuggg

SEQ ID NO: 1015032 - RNA, 19 nt, Human
cugucucuucuuuuccagg

SEQ ID NO: 1015033 - RNA, 23 nt, Human
cuguggccucuguggugggcuca

SEQ ID NO: 1015034 - RNA, 19 nt, Human
cuguuccccccgccccagg

SEQ ID NO: 1015035 - RNA, 23 nt, Human
cuucaaacuccacccaccccagc

SEQ ID NO: 1015036 - RNA, 23 nt, Human
gaacccaacccacacacuccccg

SEQ ID NO: 1015037 - RNA, 19 nt, Human
gaucucacuuccucuuacc

SEQ ID NO: 1015038 - RNA, 19 nt, Human
gcaagugucccagaggccc

SEQ ID NO: 1015039 - RNA, 23 nt, Human
gcugcauccugagcacagguggg

SEQ ID NO: 1015040 - RNA, 20 nt, Human
gcuggcuccgaccucccucc

SEQ ID NO: 1015041 - RNA, 21 nt, Human
ggaaaacaucccccuuuccug

SEQ ID NO: 1015042 - RNA, 25 nt, Human
ggagcaggggaucuguggguggggc

SEQ ID NO: 1015043 - RNA, 20 nt, Human
gggaagccaauccuagcaga

SEQ ID NO: 1015044 - RNA, 23 nt, Human
ggggccugccuguggccucugug

SEQ ID NO: 1015045 - RNA, 22 nt, Human
ggggugcugggaauccucgggg

SEQ ID NO: 1015046 - RNA, 19 nt, Human
ggguggggcugggcugggc

SEQ ID NO: 1015047 - RNA, 18 nt, Human
gugggcaggcugagucug

SEQ ID NO: 1015048 - RNA, 20 nt, Human
uaagcuaaacaacagucuca

SEQ ID NO: 1015049 - RNA, 22 nt, Human
uaccacacugguucaaaaccca

SEQ ID NO: 1015050 - RNA, 23 nt, Human
uaccuccauuuuccccgccccca

SEQ ID NO: 1015051 - RNA, 19 nt, Human
uacgaacccaacccacaca

SEQ ID NO: 1015052 - RNA, 25 nt, Human
uagaacacagggaaguuaggcagcc

SEQ ID NO: 1015053 - RNA, 21 nt, Human
uaggguaucuauggcaguagg

SEQ ID NO: 1015054 - RNA, 21 nt, Human
ucaaaacccauaggugacacc

SEQ ID NO: 1015055 - RNA, 22 nt, Human
ucaaaacccauaggugacacca

SEQ ID NO: 1015056 - RNA, 23 nt, Human
ucaaaacccauaggugacaccau

SEQ ID NO: 1015057 - RNA, 18 nt, Human
ucaaaauaaaaauggcca

SEQ ID NO: 1015058 - RNA, 21 nt, Human
ucaaaauaaaaauggccaguc

SEQ ID NO: 1015059 - RNA, 25 nt, Human
ucaaggcaagugucccagaggcccu

SEQ ID NO: 1015060 - RNA, 22 nt, Human
ucaaggggcccugggcuuaggg

SEQ ID NO: 1015061 - RNA, 19 nt, Human
ucaagugggaaagggagag

SEQ ID NO: 1015062 - RNA, 19 nt, Human
ucagagcagagcucccaag

SEQ ID NO: 1015063 - RNA, 23 nt, Human
ucagggacuccccaccccccacu

SEQ ID NO: 1015064 - RNA, 19 nt, Human
ucaguuccuagucuacuug

SEQ ID NO: 1015065 - RNA, 20 nt, Human
uccacccaccccagcccuag

SEQ ID NO: 1015066 - RNA, 21 nt, Human
uccacccaccccagcccuagc

SEQ ID NO: 1015067 - RNA, 22 nt, Human
uccacccaccccagcccuagca

SEQ ID NO: 1015068 - RNA, 20 nt, Human
uccaugggugcuggauccca

SEQ ID NO: 1015069 - RNA, 20 nt, Human
ucccacagagccuucccagg

SEQ ID NO: 1015070 - RNA, 21 nt, Human
ucccacagagccuucccaggg

SEQ ID NO: 1015071 - RNA, 19 nt, Human
ucccagaggcccugggcag

SEQ ID NO: 1015072 - RNA, 18 nt, Human
ucccagcugaccauccaa

SEQ ID NO: 1015073 - RNA, 22 nt, Human
uccccugaugauggacacuccc

SEQ ID NO: 1015074 - RNA, 20 nt, Human
uccuagcagaaagguaagcu

SEQ ID NO: 1015075 - RNA, 20 nt, Human
uccucuuaccccaaauucau

SEQ ID NO: 1015076 - RNA, 20 nt, Human
ucgccacccuuccaccauca

SEQ ID NO: 1015077 - RNA, 20 nt, Human
ucucacuuccucuuacccca

SEQ ID NO: 1015078 - RNA, 20 nt, Human
ucucagaaucugagacccag

SEQ ID NO: 1015079 - RNA, 18 nt, Human
ucugcagcuaccucugac

SEQ ID NO: 1015080 - RNA, 24 nt, Human
ucugcagcuaccucugaccaagaa

SEQ ID NO: 1015081 - RNA, 19 nt, Human
ucuggccagcaguacccag

SEQ ID NO: 1015082 - RNA, 20 nt, Human
ucuucaaacuccacccaccc

SEQ ID NO: 1015083 - RNA, 19 nt, Human
ugaaaaagagcccuuuggc

SEQ ID NO: 1015084 - RNA, 26 nt, Human
ugaccaagaaggaacuagcaagccua

SEQ ID NO: 1015085 - RNA, 20 nt, Human
ugagacucuggucaggacag

SEQ ID NO: 1015086 - RNA, 23 nt, Human
ugcgggaagccaauccuagcagg

SEQ ID NO: 1015087 - RNA, 19 nt, Human
ugcuggaucccagggcugc

SEQ ID NO: 1015088 - RNA, 22 nt, Human
ugcuggcaagaccauagguggg

SEQ ID NO: 1015089 - RNA, 21 nt, Human
uggacacucccagcugaccau

SEQ ID NO: 1015090 - RNA, 22 nt, Human
uggcaguaggaaaaugacaugg

SEQ ID NO: 1015091 - RNA, 18 nt, Human
uggccccaggagaggcuu

SEQ ID NO: 1015092 - RNA, 21 nt, Human
uggccuccccccucugcagcu

SEQ ID NO: 1015093 - RNA, 19 nt, Human
ugggcucacucccaccccc

SEQ ID NO: 1015094 - RNA, 18 nt, Human
uggguggggcugggcugg

SEQ ID NO: 1015095 - RNA, 20 nt, Human
uggguggggcugggcugggc

SEQ ID NO: 1015096 - RNA, 24 nt, Human
ugucccagaggcccugggcagcug

SEQ ID NO: 1015097 - RNA, 20 nt, Human
ugugggacuuggaagcugcu

SEQ ID NO: 1015098 - RNA, 18 nt, Human
uguggguggggcugggcu

SEQ ID NO: 1015099 - RNA, 23 nt, Human
uguggguggggcugggcugggcc

SEQ ID NO: 1015100 - RNA, 25 nt, Human
uucaaaacccauaggugacaccauc

SEQ ID NO: 1015101 - RNA, 24 nt, Human
uugggggucaggaccacugagacu

SEQ ID NO: 1015102 - RNA, 20 nt, Human
uuuuuuuuuuuuuuuuuugg

SEQ ID NO: 1015103 - RNA, 22 nt, Human
aaaaaaaagaacaugaaaaugc

SEQ ID NO: 1015104 - RNA, 22 nt, Human
aaaaaagaacaugaaaaugcac

SEQ ID NO: 1015105 - RNA, 21 nt, Human
aaaaagaacaugaaaaugcac

SEQ ID NO: 1015106 - RNA, 22 nt, Human
aaacggaaaauggccuccccuu

SEQ ID NO: 1015107 - RNA, 23 nt, Human
aaacugugccccucuguccacgg

SEQ ID NO: 1015108 - RNA, 23 nt, Human
aaaggcuauauuccuggcucugu

SEQ ID NO: 1015109 - RNA, 19 nt, Human
aaagugcugggauuacaga

SEQ ID NO: 1015110 - RNA, 23 nt, Human
aaagugcugggauuacagaugug

SEQ ID NO: 1015111 - RNA, 24 nt, Human
aaagugcugggauuacagauguga

SEQ ID NO: 1015112 - RNA, 20 nt, Human
aaagugcugggauuacaggc

SEQ ID NO: 1015113 - RNA, 23 nt, Human
aaagugcugggauuacaggcgug

SEQ ID NO: 1015114 - RNA, 24 nt, Human
aaagugcugggauuacaggcguga

SEQ ID NO: 1015115 - RNA, 20 nt, Human
aaccuccaucucccaggcuc

SEQ ID NO: 1015116 - RNA, 21 nt, Human
aacgucaagaauauaaucugg

SEQ ID NO: 1015117 - RNA, 22 nt, Human
aacugugccccucuguccacgg

SEQ ID NO: 1015118 - RNA, 23 nt, Human
aagaacaugaaaaugcacacagc

SEQ ID NO: 1015119 - RNA, 24 nt, Human
aagcaauccacccgccucagccuc

SEQ ID NO: 1015120 - RNA, 25 nt, Human
aagcaauucucgugccucagccucu

SEQ ID NO: 1015121 - RNA, 25 nt, Human
aagcacaguuauagucaaaaugagg

SEQ ID NO: 1015122 - RNA, 22 nt, Human
aaguagcugggauuccaggcau

SEQ ID NO: 1015123 - RNA, 24 nt, Human
aaguagcugggauuccaggcaugc

SEQ ID NO: 1015124 - RNA, 18 nt, Human
aagugcugggauuacaga

SEQ ID NO: 1015125 - RNA, 26 nt, Human
aagugcugggauuacagaugugagcc

SEQ ID NO: 1015126 - RNA, 19 nt, Human
aagugcugggauuacaggc

SEQ ID NO: 1015127 - RNA, 19 nt, Human
aagugcugggauuacaggc

SEQ ID NO: 1015128 - RNA, 20 nt, Human
aauucucgugccucagccuc

SEQ ID NO: 1015129 - RNA, 24 nt, Human
accacguuggccaggcuggucucg

SEQ ID NO: 1015130 - RNA, 18 nt, Human
accauguuggccaggcug

SEQ ID NO: 1015131 - RNA, 19 nt, Human
acccaggcuggagugcagu

SEQ ID NO: 1015132 - RNA, 25 nt, Human
acccguugccccucacuccucccag

SEQ ID NO: 1015133 - RNA, 24 nt, Human
acuccuggccucaagcaauccacc

SEQ ID NO: 1015134 - RNA, 18 nt, Human
acucugucacccaggcug

SEQ ID NO: 1015135 - RNA, 25 nt, Human
acucugucacccaggcuggagugca

SEQ ID NO: 1015136 - RNA, 21 nt, Human
agcaauccacccgccucagcc

SEQ ID NO: 1015137 - RNA, 24 nt, Human
agcaauucucgugccucagccucu

SEQ ID NO: 1015138 - RNA, 23 nt, Human
aggcacaauuuuuaucaaaucua

SEQ ID NO: 1015139 - RNA, 20 nt, Human
aggcgcugagcccuucuuuu

SEQ ID NO: 1015140 - RNA, 18 nt, Human
aggcuggagugcaguggc

SEQ ID NO: 1015141 - RNA, 25 nt, Human
aggcuggagugcaguggcaugaucu

SEQ ID NO: 1015142 - RNA, 24 nt, Human
aggugauuugcccgccuuggccuc

SEQ ID NO: 1015143 - RNA, 22 nt, Human
aguagagaugggguuucaccau

SEQ ID NO: 1015144 - RNA, 21 nt, Human
aguagcugggauuauaagcac

SEQ ID NO: 1015145 - RNA, 23 nt, Human
agugacaguaaugcuaaaaaaaa

SEQ ID NO: 1015146 - RNA, 19 nt, Human
agugcaguggcaugaucuc

SEQ ID NO: 1015147 - RNA, 21 nt, Human
agugcaguggcaugaucucag

SEQ ID NO: 1015148 - RNA, 23 nt, Human
agugcaguggcaugaucucagcu

SEQ ID NO: 1015149 - RNA, 24 nt, Human
agugcaguggcaugaucucagcuc

SEQ ID NO: 1015150 - RNA, 28 nt, Human
agugcaguggcuccugugaucuuggcuc

SEQ ID NO: 1015151 - RNA, 24 nt, Human
agugcugggauuacagaugugagc

SEQ ID NO: 1015152 - RNA, 18 nt, Human
agugcugggauuacaggc

SEQ ID NO: 1015153 - RNA, 18 nt, Human
agugcugggauuacaggc

SEQ ID NO: 1015154 - RNA, 24 nt, Human
aguggcaugaucucagcucacugc

SEQ ID NO: 1015155 - RNA, 18 nt, Human
aguggcuccugugaucuu

SEQ ID NO: 1015156 - RNA, 19 nt, Human
auaaaaccagcaagcaucc

SEQ ID NO: 1015157 - RNA, 21 nt, Human
auaagcaccugccaccaugcc

SEQ ID NO: 1015158 - RNA, 18 nt, Human
augggguuucaccauguu

SEQ ID NO: 1015159 - RNA, 22 nt, Human
augggguuucaccauguuggcc

SEQ ID NO: 1015160 - RNA, 23 nt, Human
augggguuucaccauguuggcca

SEQ ID NO: 1015161 - RNA, 24 nt, Human
augggguuucaccauguuggccag

SEQ ID NO: 1015162 - RNA, 24 nt, Human
auguauauagaaggcuaaaggcac

SEQ ID NO: 1015163 - RNA, 19 nt, Human
auuacagaugugagccaug

SEQ ID NO: 1015164 - RNA, 24 nt, Human
auuuuaguagagacagcguuucac

SEQ ID NO: 1015165 - RNA, 24 nt, Human
auuuuugcauguuuaguagagaug

SEQ ID NO: 1015166 - RNA, 19 nt, Human
auuuuuuuuugagacagag

SEQ ID NO: 1015167 - RNA, 19 nt, Human
auuuuuuuuugaggcagag

SEQ ID NO: 1015168 - RNA, 20 nt, Human
caaaagagcuguuuucaauc

SEQ ID NO: 1015169 - RNA, 24 nt, Human
caaaagugcugggauuacagaugu

SEQ ID NO: 1015170 - RNA, 23 nt, Human
caaccuccaccuccuggguucaa

SEQ ID NO: 1015171 - RNA, 23 nt, Human
caaccuccaucucccaggcucaa

SEQ ID NO: 1015172 - RNA, 24 nt, Human
caaccuccaucucccaggcucaag

SEQ ID NO: 1015173 - RNA, 22 nt, Human
caagcaauucuccugccuuggc

SEQ ID NO: 1015174 - RNA, 27 nt, Human
caagcaauucuccugccuuggccccca

SEQ ID NO: 1015175 - RNA, 27 nt, Human
caagcaauucucgugccucagccucuc

SEQ ID NO: 1015176 - RNA, 19 nt, Human
cacacccuucaauuacacc

SEQ ID NO: 1015177 - RNA, 19 nt, Human
cacacccuucaauuacacc

SEQ ID NO: 1015178 - RNA, 21 nt, Human
caccacguuggccaggcuggu

SEQ ID NO: 1015179 - RNA, 24 nt, Human
caccacguuggccaggcuggucuc

SEQ ID NO: 1015180 - RNA, 27 nt, Human
caccacguuggccaggcuggucucgaa

SEQ ID NO: 1015181 - RNA, 24 nt, Human
caccaugccaaaaggcuauauucc

SEQ ID NO: 1015182 - RNA, 21 nt, Human
caccauguuggccaggcuggu

SEQ ID NO: 1015183 - RNA, 24 nt, Human
caccauguuggccaggcuggucuc

SEQ ID NO: 1015184 - RNA, 27 nt, Human
caccauguuggccaggcuggucucaaa

SEQ ID NO: 1015185 - RNA, 20 nt, Human
caccuggcuauuuuuuuuug

SEQ ID NO: 1015186 - RNA, 24 nt, Human
cacguuggccaggcuggucucgaa

SEQ ID NO: 1015187 - RNA, 23 nt, Human
cacucugucacccaggcuggagu

SEQ ID NO: 1015188 - RNA, 24 nt, Human
cacucugucacccaggcuggagug

SEQ ID NO: 1015189 - RNA, 21 nt, Human
cacugcaaccuccaccuccug

SEQ ID NO: 1015190 - RNA, 23 nt, Human
cacugcaaccuccaccuccuggg

SEQ ID NO: 1015191 - RNA, 24 nt, Human
cagaguagcugggauuauaagcac

SEQ ID NO: 1015192 - RNA, 24 nt, Human
cagagucuugcucuguugcccagg

SEQ ID NO: 1015193 - RNA, 24 nt, Human
cagcguuucaccacguuggccagg

SEQ ID NO: 1015194 - RNA, 19 nt, Human
caugcaccccacaccuggc

SEQ ID NO: 1015195 - RNA, 24 nt, Human
cauguuggccaggcuggucucaaa

SEQ ID NO: 1015196 - RNA, 18 nt, Human
ccacccgccucagccucc

SEQ ID NO: 1015197 - RNA, 26 nt, Human
ccaccuccuggguucaagcaauucuu

SEQ ID NO: 1015198 - RNA, 27 nt, Human
ccaccuccuggguucaagcaauucuuu

SEQ ID NO: 1015199 - RNA, 18 nt, Human
ccagaguagcugggauua

SEQ ID NO: 1015200 - RNA, 19 nt, Human
ccagaguagcugggauuau

SEQ ID NO: 1015201 - RNA, 20 nt, Human
ccagaguagcugggauuauu

SEQ ID NO: 1015202 - RNA, 20 nt, Human
ccaggcaugcaccccacacc

SEQ ID NO: 1015203 - RNA, 21 nt, Human
cccaggcucaagcaauucucc

SEQ ID NO: 1015204 - RNA, 23 nt, Human
cccaggcuggagugcaguggcau

SEQ ID NO: 1015205 - RNA, 23 nt, Human
cccgccuuggccucugaaaagug

SEQ ID NO: 1015206 - RNA, 19 nt, Human
cccucagcgaccucacccg

SEQ ID NO: 1015207 - RNA, 18 nt, Human
ccgagacugcuuuuaauc

SEQ ID NO: 1015208 - RNA, 20 nt, Human
ccgccucagccuccaaaagu

SEQ ID NO: 1015209 - RNA, 22 nt, Human
ccucaagcaauccacccgccuc

SEQ ID NO: 1015210 - RNA, 18 nt, Human
ccucagcgaccucacccg

SEQ ID NO: 1015211 - RNA, 19 nt, Human
ccuccaccuccuggguuca

SEQ ID NO: 1015212 - RNA, 22 nt, Human
ccuccuggguucaagcaauucu

SEQ ID NO: 1015213 - RNA, 23 nt, Human
ccugccuuggcccccagaguagc

SEQ ID NO: 1015214 - RNA, 24 nt, Human
ccugccuuggcccccagaguagcu

SEQ ID NO: 1015215 - RNA, 19 nt, Human
ccuggccucaagcaaucca

SEQ ID NO: 1015216 - RNA, 22 nt, Human
ccuggccucaagcaauccaccc

SEQ ID NO: 1015217 - RNA, 23 nt, Human
ccuggccucaagcaauccacccg

SEQ ID NO: 1015218 - RNA, 20 nt, Human
ccuggguucaagcaauucuc

SEQ ID NO: 1015219 - RNA, 19 nt, Human
cgccucagccuccaaaagu

SEQ ID NO: 1015220 - RNA, 23 nt, Human
cggaaaauggccuccccuuccua

SEQ ID NO: 1015221 - RNA, 18 nt, Human
cuacagcuacugcaacga

SEQ ID NO: 1015222 - RNA, 22 nt, Human
cucaaaagagcuguuuucaauc

SEQ ID NO: 1015223 - RNA, 24 nt, Human
cucaagcaauucuccugccuuggc

SEQ ID NO: 1015224 - RNA, 23 nt, Human
cucaaguagcugggauuccaggc

SEQ ID NO: 1015225 - RNA, 24 nt, Human
cucacucugucacccaggcuggag

SEQ ID NO: 1015226 - RNA, 24 nt, Human
cucacugcaaccuccaccuccugg

SEQ ID NO: 1015227 - RNA, 26 nt, Human
cucacugcaaccuccaccuccugggu

SEQ ID NO: 1015228 - RNA, 27 nt, Human
cucacugcaaccuccaccuccuggguu

SEQ ID NO: 1015229 - RNA, 24 nt, Human
cucacugcaaccuccaucucccag

SEQ ID NO: 1015230 - RNA, 21 nt, Human
cucagccuccaaaagugcugg

SEQ ID NO: 1015231 - RNA, 24 nt, Human
cucagccucucaaguagcugggau

SEQ ID NO: 1015232 - RNA, 25 nt, Human
cucccaggcucaagcaauucuccug

SEQ ID NO: 1015233 - RNA, 23 nt, Human
cuccuggccucaagcaauccacc

SEQ ID NO: 1015234 - RNA, 21 nt, Human
cuccuggguucaagcaauucu

SEQ ID NO: 1015235 - RNA, 25 nt, Human
cucgugccucagccucucaaguagc

SEQ ID NO: 1015236 - RNA, 23 nt, Human
cucuguugcccaggcuggagugc

SEQ ID NO: 1015237 - RNA, 26 nt, Human
cucuugaccucaggugauuugcccgc

SEQ ID NO: 1015238 - RNA, 23 nt, Human
cugcaaccuccaccuccuggguu

SEQ ID NO: 1015239 - RNA, 24 nt, Human
cugcaaccuccaccuccuggguuc

SEQ ID NO: 1015240 - RNA, 23 nt, Human
cugcaaccuccaucucccaggcu

SEQ ID NO: 1015241 - RNA, 18 nt, Human
cugccaccaugcccaggu

SEQ ID NO: 1015242 - RNA, 23 nt, Human
cugccuuggcccccagaguagcu

SEQ ID NO: 1015243 - RNA, 19 nt, Human
cugcuuuuaaucccaacuu

SEQ ID NO: 1015244 - RNA, 24 nt, Human
cuggagugcaguggcaugaucuca

SEQ ID NO: 1015245 - RNA, 21 nt, Human
cuugcucuguugcccaggcug

SEQ ID NO: 1015246 - RNA, 24 nt, Human
cuuggcccccagaguagcugggau

SEQ ID NO: 1015247 - RNA, 21 nt, Human
gaaaaguaaacacaacuuggc

SEQ ID NO: 1015248 - RNA, 24 nt, Human
gaaaagugcugggauuacaggcgu

SEQ ID NO: 1015249 - RNA, 23 nt, Human
gaacuccuggccucaagcaaucc

SEQ ID NO: 1015250 - RNA, 19 nt, Human
gacccguugccccucacuc

SEQ ID NO: 1015251 - RNA, 23 nt, Human
gaccucaggugauuugcccgccu

SEQ ID NO: 1015252 - RNA, 18 nt, Human
gagaugggguuucaccau

SEQ ID NO: 1015253 - RNA, 24 nt, Human
gagaugggguuucaccauguuggc

SEQ ID NO: 1015254 - RNA, 21 nt, Human
gaggcgcugagcccuucuuuu

SEQ ID NO: 1015255 - RNA, 18 nt, Human
gagugcaguggcuccugu

SEQ ID NO: 1015256 - RNA, 18 nt, Human
gauuacagaugugagcca

SEQ ID NO: 1015257 - RNA, 23 nt, Human
gauuacagaugugagccauggca

SEQ ID NO: 1015258 - RNA, 27 nt, Human
gauuacagaugugagccauggcaccau

SEQ ID NO: 1015259 - RNA, 29 nt, Human
gauuacagaugugagccauggcaccaugc

SEQ ID NO: 1015260 - RNA, 24 nt, Human
gauuauaagcaccugccaccaugc

SEQ ID NO: 1015261 - RNA, 22 nt, Human
gcaaccuccaccuccuggguuc

SEQ ID NO: 1015262 - RNA, 22 nt, Human
gcaaccuccaucucccaggcuc

SEQ ID NO: 1015263 - RNA, 22 nt, Human
gcaauaggugucauaaugagaa

SEQ ID NO: 1015264 - RNA, 22 nt, Human
gcaauaggugucauaaugagaa

SEQ ID NO: 1015265 - RNA, 24 nt, Human
gcccaggcuggagugcaguggcau

SEQ ID NO: 1015266 - RNA, 22 nt, Human
gccccucacuccucccagaaac

SEQ ID NO: 1015267 - RNA, 23 nt, Human
gccucagccuccaaaagugcugg

SEQ ID NO: 1015268 - RNA, 23 nt, Human
gccuuggccucugaaaagugcug

SEQ ID NO: 1015269 - RNA, 25 nt, Human
gcucuguugcccaggcuggagugca

SEQ ID NO: 1015270 - RNA, 19 nt, Human
gcuggagugcaguggcaug

SEQ ID NO: 1015271 - RNA, 21 nt, Human
gcuggagugcaguggcuccug

SEQ ID NO: 1015272 - RNA, 23 nt, Human
gcuggucucgaacuccuggccuc

SEQ ID NO: 1015273 - RNA, 19 nt, Human
ggaaagcguuguaaaagua

SEQ ID NO: 1015274 - RNA, 18 nt, Human
ggcagagucuugcucugu

SEQ ID NO: 1015275 - RNA, 24 nt, Human
ggccucaagcaauccacccgccuc

SEQ ID NO: 1015276 - RNA, 19 nt, Human
ggccucugaaaagugcugg

SEQ ID NO: 1015277 - RNA, 24 nt, Human
ggcuggucucgaacuccuggccuc

SEQ ID NO: 1015278 - RNA, 22 nt, Human
gggguuucaccauguuggccag

SEQ ID NO: 1015279 - RNA, 23 nt, Human
guagagaugggguuucaccaugu

SEQ ID NO: 1015280 - RNA, 18 nt, Human
guagcugggauuauaagc

SEQ ID NO: 1015281 - RNA, 22 nt, Human
gucaaucuggaacauaauuacu

SEQ ID NO: 1015282 - RNA, 22 nt, Human
gugccucagccucucaaguagc

SEQ ID NO: 1015283 - RNA, 23 nt, Human
gugccucagccucucaaguagcu

SEQ ID NO: 1015284 - RNA, 23 nt, Human
uaaaaaaaagaacaugaaaaugc

SEQ ID NO: 1015285 - RNA, 18 nt, Human
uaaaaccagcaagcaucc

SEQ ID NO: 1015286 - RNA, 24 nt, Human
uaacagcauguucauauucacaaa

SEQ ID NO: 1015287 - RNA, 18 nt, Human
uaacuaauugacauuccu

SEQ ID NO: 1015288 - RNA, 19 nt, Human
uaacuaauugacauuccuc

SEQ ID NO: 1015289 - RNA, 22 nt, Human
uaacuaauugacauuccucaaa

SEQ ID NO: 1015290 - RNA, 24 nt, Human
uaauuuuugcauguuuaguagaga

SEQ ID NO: 1015291 - RNA, 19 nt, Human
uacaccacaucaagaauga

SEQ ID NO: 1015292 - RNA, 20 nt, Human
uacaccacaucaagaaugag

SEQ ID NO: 1015293 - RNA, 28 nt, Human
uagaaggcuaaaggcacaauuuuuauca

SEQ ID NO: 1015294 - RNA, 22 nt, Human
uagagaugggguuucaccaugu

SEQ ID NO: 1015295 - RNA, 18 nt, Human
uagcugggauuccaggca

SEQ ID NO: 1015296 - RNA, 24 nt, Human
uaguagagacagcguuucaccacg

SEQ ID NO: 1015297 - RNA, 24 nt, Human
uaguagagaugggguuucaccaug

SEQ ID NO: 1015298 - RNA, 25 nt, Human
uaguagagaugggguuucaccaugu

SEQ ID NO: 1015299 - RNA, 24 nt, Human
uauuuuuuuguauuuuaguagaga

SEQ ID NO: 1015300 - RNA, 23 nt, Human
ucaaaucuaguagaguaaccaaa

SEQ ID NO: 1015301 - RNA, 23 nt, Human
ucacacccuucaauuacaccaca

SEQ ID NO: 1015302 - RNA, 23 nt, Human
ucacacccuucaauuacaccaca

SEQ ID NO: 1015303 - RNA, 22 nt, Human
ucacccaggcuggagugcagug

SEQ ID NO: 1015304 - RNA, 24 nt, Human
ucacccaggcuggagugcaguggc

SEQ ID NO: 1015305 - RNA, 24 nt, Human
ucacucugucacccaggcuggagu

SEQ ID NO: 1015306 - RNA, 23 nt, Human
ucacugcaaccuccaccuccugg

SEQ ID NO: 1015307 - RNA, 24 nt, Human
ucacugcaaccuccaccuccuggg

SEQ ID NO: 1015308 - RNA, 25 nt, Human
ucacugcaaccuccaccuccugggu

SEQ ID NO: 1015309 - RNA, 26 nt, Human
ucacugcaaccuccaccuccuggguu

SEQ ID NO: 1015310 - RNA, 27 nt, Human
ucacugcaaccuccaccuccuggguuc

SEQ ID NO: 1015311 - RNA, 24 nt, Human
ucacugcaaccuccaucucccagg

SEQ ID NO: 1015312 - RNA, 25 nt, Human
ucacugcaaccuccaucucccaggc

SEQ ID NO: 1015313 - RNA, 26 nt, Human
ucagcucacugcaaccuccaucuccc

SEQ ID NO: 1015314 - RNA, 23 nt, Human
uccaaaagugcugggauuacaga

SEQ ID NO: 1015315 - RNA, 24 nt, Human
uccaaaagugcugggauuacagau

SEQ ID NO: 1015316 - RNA, 20 nt, Human
uccacccgccucagccucca

SEQ ID NO: 1015317 - RNA, 21 nt, Human
ucccagaaacggaaaauggcc

SEQ ID NO: 1015318 - RNA, 21 nt, Human
ucccaggcucaagcaauucuc

SEQ ID NO: 1015319 - RNA, 24 nt, Human
ucccaggcucaagcaauucuccug

SEQ ID NO: 1015320 - RNA, 21 nt, Human
uccuggguucaagcaauucuc

SEQ ID NO: 1015321 - RNA, 24 nt, Human
uccuggguucaagcaauucucgug

SEQ ID NO: 1015322 - RNA, 24 nt, Human
ucucaaguagcugggauuccaggc

SEQ ID NO: 1015323 - RNA, 23 nt, Human
ucucacucugucacccaggcugg

SEQ ID NO: 1015324 - RNA, 24 nt, Human
ucucacucugucacccaggcugga

SEQ ID NO: 1015325 - RNA, 26 nt, Human
ucucacucugucacccaggcuggagu

SEQ ID NO: 1015326 - RNA, 27 nt, Human
ucucacucugucacccaggcuggagug

SEQ ID NO: 1015327 - RNA, 24 nt, Human
ucucccaggcucaagcaauucucc

SEQ ID NO: 1015328 - RNA, 21 nt, Human
ucucgaacuccuggccucaag

SEQ ID NO: 1015329 - RNA, 24 nt, Human
ucugucacccaggcuggagugcag

SEQ ID NO: 1015330 - RNA, 19 nt, Human
ucuguguuuccgagacugc

SEQ ID NO: 1015331 - RNA, 18 nt, Human
ucuguugcccaggcugga

SEQ ID NO: 1015332 - RNA, 24 nt, Human
ucuguugcccaggcuggagugcag

SEQ ID NO: 1015333 - RNA, 23 nt, Human
ucuugcucuguugcccaggcugg

SEQ ID NO: 1015334 - RNA, 24 nt, Human
ucuugcucuguugcccaggcugga

SEQ ID NO: 1015335 - RNA, 22 nt, Human
ucuuuuuuccuuuuucuccgac

SEQ ID NO: 1015336 - RNA, 23 nt, Human
ugaaaccaagcacaguuauaguc

SEQ ID NO: 1015337 - RNA, 24 nt, Human
ugacaguaaugcuaaaaaaaagaa

SEQ ID NO: 1015338 - RNA, 18 nt, Human
ugaccucaggugauuugc

SEQ ID NO: 1015339 - RNA, 20 nt, Human
ugaccucaggugauuugccc

SEQ ID NO: 1015340 - RNA, 24 nt, Human
ugaccucaggugauuugcccgccu

SEQ ID NO: 1015341 - RNA, 21 nt, Human
ugagaauaacccaaacuggau

SEQ ID NO: 1015342 - RNA, 21 nt, Human
ugagaauaacccaaacuggau

SEQ ID NO: 1015343 - RNA, 18 nt, Human
ugagacagagucucacuc

SEQ ID NO: 1015344 - RNA, 22 nt, Human
ugagacagagucucacucuguc

SEQ ID NO: 1015345 - RNA, 20 nt, Human
ugagcaaccgcgcccagccc

SEQ ID NO: 1015346 - RNA, 22 nt, Human
ugaggcagagucuugcucuguu

SEQ ID NO: 1015347 - RNA, 22 nt, Human
ugcaguggcaugaucucagcuc

SEQ ID NO: 1015348 - RNA, 26 nt, Human
ugcaguggcuccugugaucuuggcuc

SEQ ID NO: 1015349 - RNA, 18 nt, Human
ugcccaggcuggagugca

SEQ ID NO: 1015350 - RNA, 21 nt, Human
ugcccaggcuggagugcagug

SEQ ID NO: 1015351 - RNA, 22 nt, Human
ugcccaggcuggagugcagugg

SEQ ID NO: 1015352 - RNA, 24 nt, Human
ugcccaggcuggagugcaguggca

SEQ ID NO: 1015353 - RNA, 24 nt, Human
ugccucagccucucaaguagcugg

SEQ ID NO: 1015354 - RNA, 21 nt, Human
ugccuuggcccccagaguagc

SEQ ID NO: 1015355 - RNA, 24 nt, Human
ugcucuguugcccaggcuggagug

SEQ ID NO: 1015356 - RNA, 18 nt, Human
ugcugggauuacagaugu

SEQ ID NO: 1015357 - RNA, 24 nt, Human
ugcugggauuacagaugugagcca

SEQ ID NO: 1015358 - RNA, 23 nt, Human
ugcugggauuacaggcgugagca

SEQ ID NO: 1015359 - RNA, 19 nt, Human
uggagugcaguggcaugau

SEQ ID NO: 1015360 - RNA, 24 nt, Human
uggagugcaguggcaugaucucag

SEQ ID NO: 1015361 - RNA, 24 nt, Human
uggagugcaguggcuccugugauc

SEQ ID NO: 1015362 - RNA, 27 nt, Human
uggagugcaguggcuccugugaucuug

SEQ ID NO: 1015363 - RNA, 28 nt, Human
uggagugcaguggcuccugugaucuugg

SEQ ID NO: 1015364 - RNA, 24 nt, Human
uggcaugaucucagcucacugcaa

SEQ ID NO: 1015365 - RNA, 24 nt, Human
uggccaggcuggucucaaacucuu

SEQ ID NO: 1015366 - RNA, 24 nt, Human
uggccaggcuggucucgaacuccu

SEQ ID NO: 1015367 - RNA, 22 nt, Human
uggccucaagcaauccacccgc

SEQ ID NO: 1015368 - RNA, 23 nt, Human
uggccucaagcaauccacccgcc

SEQ ID NO: 1015369 - RNA, 18 nt, Human
ugggauuacagaugugag

SEQ ID NO: 1015370 - RNA, 19 nt, Human
ugggauuacagaugugagc

SEQ ID NO: 1015371 - RNA, 21 nt, Human
ugggauuacagaugugagcca

SEQ ID NO: 1015372 - RNA, 22 nt, Human
ugggauuacagaugugagccau

SEQ ID NO: 1015373 - RNA, 22 nt, Human
ugggauuacagaugugagccau

SEQ ID NO: 1015374 - RNA, 30 nt, Human
ugggauuacagaugugagccauggcaccaa

SEQ ID NO: 1015375 - RNA, 18 nt, Human
ugggauuacaggcgugag

SEQ ID NO: 1015376 - RNA, 19 nt, Human
ugggauuacaggcgugagc

SEQ ID NO: 1015377 - RNA, 23 nt, Human
ugggauuacaggcgugagcaacc

SEQ ID NO: 1015378 - RNA, 24 nt, Human
ugggauuacaggcgugagcaaccg

SEQ ID NO: 1015379 - RNA, 27 nt, Human
ugggauuacaggcgugagcaaccgcgc

SEQ ID NO: 1015380 - RNA, 21 nt, Human
ugggauuauaagcaccugcca

SEQ ID NO: 1015381 - RNA, 22 nt, Human
ugggauuauaagcaccugccac

SEQ ID NO: 1015382 - RNA, 24 nt, Human
ugggauuauaagcaccugccacca

SEQ ID NO: 1015383 - RNA, 25 nt, Human
ugggauuauaagcaccugccaccau

SEQ ID NO: 1015384 - RNA, 23 nt, Human
ugggauuccaggcaugcacccca

SEQ ID NO: 1015385 - RNA, 24 nt, Human
ugggguuucaccauguuggccagg

SEQ ID NO: 1015386 - RNA, 19 nt, Human
uguccacggcccggcgggg

SEQ ID NO: 1015387 - RNA, 19 nt, Human
uguucauauucacaaaauc

SEQ ID NO: 1015388 - RNA, 21 nt, Human
uguugcccaggcuggagugca

SEQ ID NO: 1015389 - RNA, 24 nt, Human
uguuuaguagagaugggguuucac

SEQ ID NO: 1015390 - RNA, 22 nt, Human
uuaaauauucaucuguagaucc

SEQ ID NO: 1015391 - RNA, 18 nt, Human
uuaguagagacagcguuu

SEQ ID NO: 1015392 - RNA, 18 nt, Human
uuaguagagaugggguuu

SEQ ID NO: 1015393 - RNA, 22 nt, Human
uuaguagagaugggguuucacc

SEQ ID NO: 1015394 - RNA, 24 nt, Human
uuaguagagaugggguuucaccau

SEQ ID NO: 1015395 - RNA, 19 nt, Human
uuauaagcaccugccacca

SEQ ID NO: 1015396 - RNA, 24 nt, Human
uugcccaggcuggagugcaguggc

SEQ ID NO: 1015397 - RNA, 24 nt, Human
uugcucuguugcccaggcuggagu

SEQ ID NO: 1015398 - RNA, 21 nt, Human
uuggccucugaaaagugcugg

SEQ ID NO: 1015399 - RNA, 21 nt, Human
uuucaccacguuggccaggcu

SEQ ID NO: 1015400 - RNA, 24 nt, Human
uuucaccauguuggccaggcuggu

SEQ ID NO: 1015401 - RNA, 23 nt, Human
uuuuaguagagacagcguuucac

SEQ ID NO: 1015402 - RNA, 20 nt, Human
uuuuugcauguuuaguagag

SEQ ID NO: 1015403 - RNA, 20 nt, Human
uuuuuguauuuuaguagaga

SEQ ID NO: 1015404 - RNA, 20 nt, Human
uuuuuuguauuuuaguagag

SEQ ID NO: 1015405 - RNA, 24 nt, Human
uuuuuuuguauuuuaguagagaca

SEQ ID NO: 1015406 - RNA, 18 nt, Human
uuuuuuuuuuuuguuuuc

SEQ ID NO: 1015407 - RNA, 24 nt, Human
uuuuuuuuuuuuuuuuguuuucaa

SEQ ID NO: 1015408 - RNA, 18 nt, Human
uuuuuuuuuuuuuuuuug

SEQ ID NO: 1015409 - RNA, 24 nt, Human
uuuuuuuuuuuuuuuuuuuguuuu

SEQ ID NO: 1015410 - RNA, 24 nt, Human
ccaggagcagccgcuggagugcga

SEQ ID NO: 1015411 - RNA, 25 nt, Human
cucaauaauuauauaugaaauugcu

SEQ ID NO: 1015412 - RNA, 20 nt, Human
cucuucauugcagacaugua

SEQ ID NO: 1015413 - RNA, 20 nt, Human
gcaguuucuucaauuggugu

SEQ ID NO: 1015414 - RNA, 21 nt, Human
uauaaaacuggaccacuuuaa

SEQ ID NO: 1015415 - RNA, 24 nt, Human
ucacaguaauggcaguuucuucaa

SEQ ID NO: 1015416 - RNA, 24 nt, Human
uucaauugguguguaguccucaau

SEQ ID NO: 1015417 - RNA, 22 nt, Human
uucgggucucaaagacccacaa

SEQ ID NO: 1015418 - RNA, 19 nt, Human
aaaaaggaauacauuaaga

SEQ ID NO: 1015419 - RNA, 19 nt, Human
aaaagguuucuugaaggaa

SEQ ID NO: 1015420 - RNA, 23 nt, Human
aaacccccgaagaguaagggagg

SEQ ID NO: 1015421 - RNA, 18 nt, Human
aagagcauggaaaaguug

SEQ ID NO: 1015422 - RNA, 24 nt, Human
aauguccacuuuauuccauauaac

SEQ ID NO: 1015423 - RNA, 18 nt, Human
acaagaccuccguaugug

SEQ ID NO: 1015424 - RNA, 23 nt, Human
acaccaggaaggccaagacaaac

SEQ ID NO: 1015425 - RNA, 24 nt, Human
acaccaggaaggccaagacaaaca

SEQ ID NO: 1015426 - RNA, 22 nt, Human
agaacuacaaaggcaggaggug

SEQ ID NO: 1015427 - RNA, 22 nt, Human
agacaaacuggacacccucuca

SEQ ID NO: 1015428 - RNA, 26 nt, Human
aggaaggccaagacaaacacaaauca

SEQ ID NO: 1015429 - RNA, 19 nt, Human
aggcaggagguguaaguga

SEQ ID NO: 1015430 - RNA, 27 nt, Human
aggcaggagguguaagugaagggaccc

SEQ ID NO: 1015431 - RNA, 27 nt, Human
aggccaagacaaacacaaaucaaggaa

SEQ ID NO: 1015432 - RNA, 19 nt, Human
aguaaauucaccugucccu

SEQ ID NO: 1015433 - RNA, 18 nt, Human
auacacuuccaggcaucc

SEQ ID NO: 1015434 - RNA, 23 nt, Human
auuaagagcauggaaaaguugcu

SEQ ID NO: 1015435 - RNA, 19 nt, Human
caaaacacagucacuugca

SEQ ID NO: 1015436 - RNA, 23 nt, Human
caaaacacagucacuugcagaac

SEQ ID NO: 1015437 - RNA, 21 nt, Human
caagacaaacacaaaucaagg

SEQ ID NO: 1015438 - RNA, 22 nt, Human
caaucacuagacaaacuggaca

SEQ ID NO: 1015439 - RNA, 23 nt, Human
cacaccaggaaggccaagacaaa

SEQ ID NO: 1015440 - RNA, 22 nt, Human
cacaguaauacaaaacacaguc

SEQ ID NO: 1015441 - RNA, 22 nt, Human
cacccucucacaugugcacaaa

SEQ ID NO: 1015442 - RNA, 21 nt, Human
cagagauggcaagugcuuuuc

SEQ ID NO: 1015443 - RNA, 19 nt, Human
cagcagcaaauaaagagug

SEQ ID NO: 1015444 - RNA, 21 nt, Human
caguccaauuuuauacacuuc

SEQ ID NO: 1015445 - RNA, 29 nt, Human
caucccuagacaagugugucacaaugcac

SEQ ID NO: 1015446 - RNA, 24 nt, Human
cauuuuacauaaaagggaaguauc

SEQ ID NO: 1015447 - RNA, 22 nt, Human
ccaagacaaacacaaaucaagg

SEQ ID NO: 1015448 - RNA, 24 nt, Human
ccaagacaaacacaaaucaaggaa

SEQ ID NO: 1015449 - RNA, 18 nt, Human
ccggggccggggcggagg

SEQ ID NO: 1015450 - RNA, 21 nt, Human
cgcggggccggggccggggcg

SEQ ID NO: 1015451 - RNA, 24 nt, Human
gagacugaucuauaguaaaacacu

SEQ ID NO: 1015452 - RNA, 21 nt, Human
gccaagacaaacacaaaucaa

SEQ ID NO: 1015453 - RNA, 21 nt, Human
ggaaaaguugcuuacugaaag

SEQ ID NO: 1015454 - RNA, 22 nt, Human
ggaaauccaaguggaauaagga

SEQ ID NO: 1015455 - RNA, 27 nt, Human
gggccggggccggggcggagggcgagg

SEQ ID NO: 1015456 - RNA, 20 nt, Human
guaauacaaaacacagucac

SEQ ID NO: 1015457 - RNA, 20 nt, Human
guaauacaaaacacagucac

SEQ ID NO: 1015458 - RNA, 21 nt, Human
guacugcacaccaggaaggcc

SEQ ID NO: 1015459 - RNA, 20 nt, Human
uaaagugaauaccagaacua

SEQ ID NO: 1015460 - RNA, 23 nt, Human
uaaauaccagauacauuuuuagu

SEQ ID NO: 1015461 - RNA, 21 nt, Human
uaacaaucacuagacaaacuu

SEQ ID NO: 1015462 - RNA, 22 nt, Human
uaacacuuaaccagauaucauu

SEQ ID NO: 1015463 - RNA, 24 nt, Human
uaagaaaugcaguccaauuuuaua

SEQ ID NO: 1015464 - RNA, 20 nt, Human
uacaaagccauaguaaaugg

SEQ ID NO: 1015465 - RNA, 23 nt, Human
uacacaagaccuccguaugugau

SEQ ID NO: 1015466 - RNA, 23 nt, Human
uacaucugaggaagagauggccc

SEQ ID NO: 1015467 - RNA, 22 nt, Human
uaccagaacuacaaaggcagga

SEQ ID NO: 1015468 - RNA, 22 nt, Human
uaccagauacauuuuuaguccu

SEQ ID NO: 1015469 - RNA, 18 nt, Human
uacuuccggauuccuacu

SEQ ID NO: 1015470 - RNA, 23 nt, Human
uagacagagauggcaagugcuuu

SEQ ID NO: 1015471 - RNA, 24 nt, Human
ucaauaaacuuuagaaaguaguaa

SEQ ID NO: 1015472 - RNA, 20 nt, Human
ucacaaggcuuuuuugggac

SEQ ID NO: 1015473 - RNA, 22 nt, Human
uccccuuucuaguguauuaaga

SEQ ID NO: 1015474 - RNA, 23 nt, Human
ucccuuaaaauauggguaugcaa

SEQ ID NO: 1015475 - RNA, 21 nt, Human
ucuacagcaguacugcacacc

SEQ ID NO: 1015476 - RNA, 22 nt, Human
ugcaauuguuacaaagccauag

SEQ ID NO: 1015477 - RNA, 19 nt, Human
ugcauggaaaaguacuaaa

SEQ ID NO: 1015478 - RNA, 21 nt, Human
uggaaaaguacuaaaguuuua

SEQ ID NO: 1015479 - RNA, 18 nt, Human
ugggaggggagguuggcc

SEQ ID NO: 1015480 - RNA, 22 nt, Human
uuaaaauauggguaugcaauug

SEQ ID NO: 1015481 - RNA, 23 nt, Human
uuaaaauauggguaugcaauugu

SEQ ID NO: 1015482 - RNA, 22 nt, Human
uuuauacacuuccaggcauccc

SEQ ID NO: 1015483 - RNA, 23 nt, Human
aaaaaacaacccugguaggcuaa

SEQ ID NO: 1015484 - RNA, 20 nt, Human
aaaaacaauaaagugauaau

SEQ ID NO: 1015485 - RNA, 22 nt, Human
aaaaaccucaacacccacccau

SEQ ID NO: 1015486 - RNA, 22 nt, Human
aaaaacuggaaguguugucuuu

SEQ ID NO: 1015487 - RNA, 20 nt, Human
aaaaauaaaugcaaaaauua

SEQ ID NO: 1015488 - RNA, 19 nt, Human
aaaaaugugcccuagcccc

SEQ ID NO: 1015489 - RNA, 26 nt, Human
aaaagaaaaaagaagcaacaaaaaag

SEQ ID NO: 1015490 - RNA, 20 nt, Human
aaaagcagcaaaaggugccu

SEQ ID NO: 1015491 - RNA, 18 nt, Human
aaaaguagaauugauaag

SEQ ID NO: 1015492 - RNA, 24 nt, Human
aaaaguuuuuguuaaaaaaacaau

SEQ ID NO: 1015493 - RNA, 24 nt, Human
aaacaaaccaccacacauacccca

SEQ ID NO: 1015494 - RNA, 19 nt, Human
aaacaacccugguaggcua

SEQ ID NO: 1015495 - RNA, 22 nt, Human
aaacaacccugguaggcuaaac

SEQ ID NO: 1015496 - RNA, 25 nt, Human
aaacagacgcacaaagauaaaacaa

SEQ ID NO: 1015497 - RNA, 26 nt, Human
aaacagacgcacaaagauaaaacaau

SEQ ID NO: 1015498 - RNA, 26 nt, Human
aaacagacgcacaaagauaaaacuag

SEQ ID NO: 1015499 - RNA, 19 nt, Human
aaacucacaaaauucaggu

SEQ ID NO: 1015500 - RNA, 19 nt, Human
aaagagcaacagaaaaaau

SEQ ID NO: 1015501 - RNA, 24 nt, Human
aaagugcugggauuacaggcguga

SEQ ID NO: 1015502 - RNA, 23 nt, Human
aaauagucuuaccacacaagagu

SEQ ID NO: 1015503 - RNA, 19 nt, Human
aaaugugauuggccuaaaa

SEQ ID NO: 1015504 - RNA, 21 nt, Human
aacaaaggaaagcaaagaaaa

SEQ ID NO: 1015505 - RNA, 22 nt, Human
aacaaaggaaagcaaagaaaag

SEQ ID NO: 1015506 - RNA, 19 nt, Human
aacacugauaauugccauu

SEQ ID NO: 1015507 - RNA, 20 nt, Human
aacacugauaauugccauuu

SEQ ID NO: 1015508 - RNA, 18 nt, Human
aacagugccuugccaggc

SEQ ID NO: 1015509 - RNA, 20 nt, Human
aaccaccacacauaccccag

SEQ ID NO: 1015510 - RNA, 21 nt, Human
aaccccaugcuauuggcucuc

SEQ ID NO: 1015511 - RNA, 22 nt, Human
aaccucuaaauguacauuuuug

SEQ ID NO: 1015512 - RNA, 22 nt, Human
aagaaaaaaaaaguaugucaca

SEQ ID NO: 1015513 - RNA, 25 nt, Human
aagaaaaaaaaaguaugucacagaa

SEQ ID NO: 1015514 - RNA, 23 nt, Human
aagaagcaacaaaaaaccucaaa

SEQ ID NO: 1015515 - RNA, 23 nt, Human
aagagcaacagaaaaaaucuguu

SEQ ID NO: 1015516 - RNA, 24 nt, Human
aagcaaaaauaaaaguagaauuga

SEQ ID NO: 1015517 - RNA, 22 nt, Human
aagcaacaaaaaaccucaaacc

SEQ ID NO: 1015518 - RNA, 24 nt, Human
aagcaauccuccugccuuggccuc

SEQ ID NO: 1015519 - RNA, 25 nt, Human
aagcaauccuccugccuuggccucc

SEQ ID NO: 1015520 - RNA, 25 nt, Human
aagcaauccuccugccuuggccucc

SEQ ID NO: 1015521 - RNA, 22 nt, Human
aagcauuucacaaguuggaucc

SEQ ID NO: 1015522 - RNA, 18 nt, Human
aagccuaguuaugaucac

SEQ ID NO: 1015523 - RNA, 25 nt, Human
aaguaguuggaacuaaauccaacac

SEQ ID NO: 1015524 - RNA, 21 nt, Human
aaguaucugggacuacaggug

SEQ ID NO: 1015525 - RNA, 24 nt, Human
aaguaucugggacuacaggugugu

SEQ ID NO: 1015526 - RNA, 19 nt, Human
aagucagguaguacuucuc

SEQ ID NO: 1015527 - RNA, 19 nt, Human
aagugcugggauuacaggc

SEQ ID NO: 1015528 - RNA, 19 nt, Human
aagugcugggauuacaggc

SEQ ID NO: 1015529 - RNA, 19 nt, Human
aaguuuguugcuacccgac

SEQ ID NO: 1015530 - RNA, 19 nt, Human
aaugccaucuauucaaagc

SEQ ID NO: 1015531 - RNA, 22 nt, Human
acagagaaacuaguagcauggg

SEQ ID NO: 1015532 - RNA, 18 nt, Human
acagagaaggagcucuau

SEQ ID NO: 1015533 - RNA, 24 nt, Human
acaggcaacagagugcaaacaaag

SEQ ID NO: 1015534 - RNA, 18 nt, Human
acaggguuucaccauguu

SEQ ID NO: 1015535 - RNA, 23 nt, Human
acaggguuucaccauguuggcca

SEQ ID NO: 1015536 - RNA, 24 nt, Human
acaggguuucaccauguuggccag

SEQ ID NO: 1015537 - RNA, 21 nt, Human
acagugccuugccaggccaua

SEQ ID NO: 1015538 - RNA, 21 nt, Human
acauuauacaagauauuuggc

SEQ ID NO: 1015539 - RNA, 18 nt, Human
acauuucuuuuuuuuuuu

SEQ ID NO: 1015540 - RNA, 23 nt, Human
acauuucuuuuuuuuuuuuuuuu

SEQ ID NO: 1015541 - RNA, 24 nt, Human
accauguuggccaggcuggucucg

SEQ ID NO: 1015542 - RNA, 24 nt, Human
accauuacauuucuuuuuuuuuuu

SEQ ID NO: 1015543 - RNA, 22 nt, Human
acccaugggccuuguccuccuu

SEQ ID NO: 1015544 - RNA, 24 nt, Human
accccagggcaugcuggaaagaca

SEQ ID NO: 1015545 - RNA, 20 nt, Human
accucauuuuccuuccccuu

SEQ ID NO: 1015546 - RNA, 23 nt, Human
acgcugaagaucagcaaacagac

SEQ ID NO: 1015547 - RNA, 21 nt, Human
acuacaggugugugcuaccau

SEQ ID NO: 1015548 - RNA, 18 nt, Human
acucugucauccaggcug

SEQ ID NO: 1015549 - RNA, 25 nt, Human
acucugucauccaggcuggagugua

SEQ ID NO: 1015550 - RNA, 19 nt, Human
acugagcacacugucccug

SEQ ID NO: 1015551 - RNA, 20 nt, Human
acugagcacacugucccugg

SEQ ID NO: 1015552 - RNA, 24 nt, Human
agaaaaaaaaaguaugucacagaa

SEQ ID NO: 1015553 - RNA, 25 nt, Human
agaaaaaagaagcaacaaaaaaccu

SEQ ID NO: 1015554 - RNA, 19 nt, Human
agaaaaaggaggcuuuaaa

SEQ ID NO: 1015555 - RNA, 25 nt, Human
agaaaagaaaaaagaagcaacaaaa

SEQ ID NO: 1015556 - RNA, 28 nt, Human
agaaaagaaaaaagaagcaacaaaaaag

SEQ ID NO: 1015557 - RNA, 19 nt, Human
agaaagaaaagaaaaaaga

SEQ ID NO: 1015558 - RNA, 20 nt, Human
agaaagaaccacaaaucuag

SEQ ID NO: 1015559 - RNA, 23 nt, Human
agaacaaaggaaagcaaagaaaa

SEQ ID NO: 1015560 - RNA, 18 nt, Human
agagggggaaagaaagaa

SEQ ID NO: 1015561 - RNA, 22 nt, Human
agccacuuuccgugggccuggu

SEQ ID NO: 1015562 - RNA, 30 nt, Human
aggaaagcaaagaaaaguucacaucaaaag

SEQ ID NO: 1015563 - RNA, 23 nt, Human
aggagaaagaaaccauuuuuagg

SEQ ID NO: 1015564 - RNA, 26 nt, Human
aggcagaaaauauguguagugauuuu

SEQ ID NO: 1015565 - RNA, 21 nt, Human
aggggacauccaaaaaaaaga

SEQ ID NO: 1015566 - RNA, 24 nt, Human
aggugauccgcccaccuuggccuc

SEQ ID NO: 1015567 - RNA, 19 nt, Human
agguggagucugagaaaac

SEQ ID NO: 1015568 - RNA, 23 nt, Human
aguagcugggguuacuggcaugu

SEQ ID NO: 1015569 - RNA, 24 nt, Human
agugauucuccugccucagccucc

SEQ ID NO: 1015570 - RNA, 18 nt, Human
agugcagggaucccgaag

SEQ ID NO: 1015571 - RNA, 22 nt, Human
agugcaguggugccucauggcu

SEQ ID NO: 1015572 - RNA, 23 nt, Human
agugcaguggugccucauggcuc

SEQ ID NO: 1015573 - RNA, 20 nt, Human
agugggacacuauagaauuc

SEQ ID NO: 1015574 - RNA, 21 nt, Human
aguguaguggugcaaucucag

SEQ ID NO: 1015575 - RNA, 24 nt, Human
aguguaguggugcaaucucagcuc

SEQ ID NO: 1015576 - RNA, 21 nt, Human
auacacuguggacuuugugcu

SEQ ID NO: 1015577 - RNA, 27 nt, Human
auacagacacaaauaucuuacuaaaau

SEQ ID NO: 1015578 - RNA, 21 nt, Human
aucacuccuaaacccuccccc

SEQ ID NO: 1015579 - RNA, 21 nt, Human
aucacugguuaaaaacccacc

SEQ ID NO: 1015580 - RNA, 24 nt, Human
aucaggugauccgcccaccuuggc

SEQ ID NO: 1015581 - RNA, 18 nt, Human
aucauucuuaaaugagac

SEQ ID NO: 1015582 - RNA, 22 nt, Human
aucuauucaaagcucacacuca

SEQ ID NO: 1015583 - RNA, 24 nt, Human
auuggcucucucuucagguggcug

SEQ ID NO: 1015584 - RNA, 26 nt, Human
auuucuuuuuuuuuuuuuuuuuuuaa

SEQ ID NO: 1015585 - RNA, 21 nt, Human
auuugauaaguuugucagugg

SEQ ID NO: 1015586 - RNA, 21 nt, Human
caaaaaacaacccugguaggc

SEQ ID NO: 1015587 - RNA, 24 nt, Human
caaaaaacaacccugguaggcuaa

SEQ ID NO: 1015588 - RNA, 19 nt, Human
caaaaacagugagcuguag

SEQ ID NO: 1015589 - RNA, 21 nt, Human
caaaagcagcaaaaggugccu

SEQ ID NO: 1015590 - RNA, 24 nt, Human
caaagugcugggauuacaggcgug

SEQ ID NO: 1015591 - RNA, 19 nt, Human
caaaugugaacauaugaug

SEQ ID NO: 1015592 - RNA, 23 nt, Human
caacaaaaaaccucaaaccaaaa

SEQ ID NO: 1015593 - RNA, 20 nt, Human
caaccucugccucccggguu

SEQ ID NO: 1015594 - RNA, 22 nt, Human
caagcaauccuccugccuuggc

SEQ ID NO: 1015595 - RNA, 27 nt, Human
caagcaauccuccugccuuggccuccc

SEQ ID NO: 1015596 - RNA, 20 nt, Human
caagugauucuccugccuca

SEQ ID NO: 1015597 - RNA, 22 nt, Human
caagugauucuccugccucagc

SEQ ID NO: 1015598 - RNA, 18 nt, Human
caauuuuuguauuuuuag

SEQ ID NO: 1015599 - RNA, 21 nt, Human
cacagcugcucagagcugucu

SEQ ID NO: 1015600 - RNA, 21 nt, Human
caccauguuggccaggcuggu

SEQ ID NO: 1015601 - RNA, 24 nt, Human
caccauguuggccaggcuggucuc

SEQ ID NO: 1015602 - RNA, 27 nt, Human
caccauguuggccaggcuggucucgaa

SEQ ID NO: 1015603 - RNA, 18 nt, Human
caccccagggcaugcugg

SEQ ID NO: 1015604 - RNA, 26 nt, Human
caccccagggcaugcuggaaagacag

SEQ ID NO: 1015605 - RNA, 24 nt, Human
caccccaguugcugugacaaccaa

SEQ ID NO: 1015606 - RNA, 31 nt, Human
cacuaugccaccuagacugcuguacaccucu

SEQ ID NO: 1015607 - RNA, 23 nt, Human
cacucugucauccaggcuggagu

SEQ ID NO: 1015608 - RNA, 24 nt, Human
cacucugucauccaggcuggagug

SEQ ID NO: 1015609 - RNA, 21 nt, Human
cacugcaaccucugccucccg

SEQ ID NO: 1015610 - RNA, 23 nt, Human
cacugcaaccucugccucccggg

SEQ ID NO: 1015611 - RNA, 22 nt, Human
cacuugcuggaaaauacaggag

SEQ ID NO: 1015612 - RNA, 21 nt, Human
cagagcaccaaaaacagugag

SEQ ID NO: 1015613 - RNA, 23 nt, Human
cagcagugguaugaaaguuugca

SEQ ID NO: 1015614 - RNA, 19 nt, Human
cagccucagccaaaaggaa

SEQ ID NO: 1015615 - RNA, 21 nt, Human
cagccucagccaaaaggaaaa

SEQ ID NO: 1015616 - RNA, 22 nt, Human
cagcggcccgcgcggcucccac

SEQ ID NO: 1015617 - RNA, 24 nt, Human
caggaucuuguucucuugcccagg

SEQ ID NO: 1015618 - RNA, 18 nt, Human
caggccauauugcagccu

SEQ ID NO: 1015619 - RNA, 24 nt, Human
caggguuucaccauguuggccagg

SEQ ID NO: 1015620 - RNA, 19 nt, Human
cagugccuugccaggccau

SEQ ID NO: 1015621 - RNA, 20 nt, Human
caguggugccucauggcuca

SEQ ID NO: 1015622 - RNA, 19 nt, Human
cauaaaaagacccaccaaa

SEQ ID NO: 1015623 - RNA, 21 nt, Human
cauaaaaagacccaccaaaaa

SEQ ID NO: 1015624 - RNA, 25 nt, Human
cauauacuuaucaaaugugaacaua

SEQ ID NO: 1015625 - RNA, 24 nt, Human
cauccaggcuggaguguaguggug

SEQ ID NO: 1015626 - RNA, 23 nt, Human
cauggcucacugcagcccugacu

SEQ ID NO: 1015627 - RNA, 24 nt, Human
cauguuggccaggcuggucucgaa

SEQ ID NO: 1015628 - RNA, 20 nt, Human
ccaaaaaaaagagggggaaa

SEQ ID NO: 1015629 - RNA, 22 nt, Human
ccaaagugcugggauuacaggc

SEQ ID NO: 1015630 - RNA, 22 nt, Human
ccaaagugcugggauuacaggc

SEQ ID NO: 1015631 - RNA, 24 nt, Human
ccaaagugcugggauuacaggcgu

SEQ ID NO: 1015632 - RNA, 22 nt, Human
ccacacccagccaauuuuugua

SEQ ID NO: 1015633 - RNA, 22 nt, Human
ccacccaugggccuuguccucc

SEQ ID NO: 1015634 - RNA, 24 nt, Human
ccaccgugcccugccccuuuugga

SEQ ID NO: 1015635 - RNA, 25 nt, Human
ccagagcaccaaaaacagugagcug

SEQ ID NO: 1015636 - RNA, 24 nt, Human
ccagcagugguaugaaaguuugca

SEQ ID NO: 1015637 - RNA, 21 nt, Human
ccaggcuggaguguaguggug

SEQ ID NO: 1015638 - RNA, 23 nt, Human
ccauuucugcccuaagcugcaga

SEQ ID NO: 1015639 - RNA, 24 nt, Human
cccaaguaucugggacuacaggug

SEQ ID NO: 1015640 - RNA, 18 nt, Human
ccccaaagauccccuugc

SEQ ID NO: 1015641 - RNA, 20 nt, Human
ccccaacacucucaaacacc

SEQ ID NO: 1015642 - RNA, 21 nt, Human
cccccauuucugcccuaagcu

SEQ ID NO: 1015643 - RNA, 21 nt, Human
ccccccauuucugcccuaagc

SEQ ID NO: 1015644 - RNA, 23 nt, Human
ccccccguuuuucuguaagcaaa

SEQ ID NO: 1015645 - RNA, 23 nt, Human
cccggguucaagugauucuccuc

SEQ ID NO: 1015646 - RNA, 23 nt, Human
cccggguucaagugauucuccug

SEQ ID NO: 1015647 - RNA, 20 nt, Human
cccuaguagcugggguuacu

SEQ ID NO: 1015648 - RNA, 25 nt, Human
cccucuaaaaaacaaaccaccacac

SEQ ID NO: 1015649 - RNA, 22 nt, Human
ccgaccccuaauuccuugauuu

SEQ ID NO: 1015650 - RNA, 23 nt, Human
ccuagccccaacacucucaaaca

SEQ ID NO: 1015651 - RNA, 24 nt, Human
ccucaacacccacccaugggccuu

SEQ ID NO: 1015652 - RNA, 24 nt, Human
ccucccggguucaagugauucucc

SEQ ID NO: 1015653 - RNA, 19 nt, Human
ccuccugccuuggccuccc

SEQ ID NO: 1015654 - RNA, 24 nt, Human
ccugacaucaggugauccgcccac

SEQ ID NO: 1015655 - RNA, 19 nt, Human
ccuggcccugcuaaccaga

SEQ ID NO: 1015656 - RNA, 23 nt, Human
ccuucugcucuacuccaagcuuu

SEQ ID NO: 1015657 - RNA, 21 nt, Human
ccuuggccucccaaguaucug

SEQ ID NO: 1015658 - RNA, 23 nt, Human
cgcggaggccccgcgcgcgacga

SEQ ID NO: 1015659 - RNA, 23 nt, Human
cuaaaacaccaacauuauuaagc

SEQ ID NO: 1015660 - RNA, 24 nt, Human
cuagccccaacacucucaaacacc

SEQ ID NO: 1015661 - RNA, 19 nt, Human
cucaaauguuaccuuauca

SEQ ID NO: 1015662 - RNA, 20 nt, Human
cucaagcaauccuccugccu

SEQ ID NO: 1015663 - RNA, 24 nt, Human
cucaagcaauccuccugccuuggc

SEQ ID NO: 1015664 - RNA, 24 nt, Human
cucacucugucauccaggcuggag

SEQ ID NO: 1015665 - RNA, 24 nt, Human
cucacugcaaccucugccucccgg

SEQ ID NO: 1015666 - RNA, 22 nt, Human
cucagccucccuaguagcuggg

SEQ ID NO: 1015667 - RNA, 18 nt, Human
cucccacguuuccgccgc

SEQ ID NO: 1015668 - RNA, 18 nt, Human
cuccccccguuuuucugu

SEQ ID NO: 1015669 - RNA, 20 nt, Human
cucccccgaccccuaauucc

SEQ ID NO: 1015670 - RNA, 20 nt, Human
cucccggguucaagugauuc

SEQ ID NO: 1015671 - RNA, 23 nt, Human
cuccugccucagccucccuagua

SEQ ID NO: 1015672 - RNA, 23 nt, Human
cucuugcccaggcuagagugcag

SEQ ID NO: 1015673 - RNA, 25 nt, Human
cucuuugcuccuuuggugaaauuua

SEQ ID NO: 1015674 - RNA, 24 nt, Human
cugcaaccucugccucccggguuc

SEQ ID NO: 1015675 - RNA, 21 nt, Human
cugcaccccagggcaugcugg

SEQ ID NO: 1015676 - RNA, 23 nt, Human
cugccucagccucccuaguagcu

SEQ ID NO: 1015677 - RNA, 23 nt, Human
cugccucccggguucaagugauu

SEQ ID NO: 1015678 - RNA, 20 nt, Human
cugccuccuuacuguuuuug

SEQ ID NO: 1015679 - RNA, 24 nt, Human
cuuaaacaggaaaacagucuuacu

SEQ ID NO: 1015680 - RNA, 19 nt, Human
cuugcucugugucuguuuu

SEQ ID NO: 1015681 - RNA, 25 nt, Human
cuuugcccacagcugcucagagcug

SEQ ID NO: 1015682 - RNA, 19 nt, Human
gaaaagaaaaaagaagcaa

SEQ ID NO: 1015683 - RNA, 19 nt, Human
gaaaauauuauuugaaacu

SEQ ID NO: 1015684 - RNA, 21 nt, Human
gaacagugucuggcacagaga

SEQ ID NO: 1015685 - RNA, 22 nt, Human
gaaguaaauaaucacaugccag

SEQ ID NO: 1015686 - RNA, 23 nt, Human
gacagcggcccgcgcggcucccc

SEQ ID NO: 1015687 - RNA, 24 nt, Human
gacaucaggugauccgcccaccuu

SEQ ID NO: 1015688 - RNA, 18 nt, Human
gaccucauuuuccuuccc

SEQ ID NO: 1015689 - RNA, 19 nt, Human
gacgacagcggcccgcgcg

SEQ ID NO: 1015690 - RNA, 24 nt, Human
gacuacaggugugugcuaccaugc

SEQ ID NO: 1015691 - RNA, 20 nt, Human
gagaacacugcucaggcuuu

SEQ ID NO: 1015692 - RNA, 26 nt, Human
gagaugagugagguaccugccuuggg

SEQ ID NO: 1015693 - RNA, 18 nt, Human
gagcagcagccgggggcg

SEQ ID NO: 1015694 - RNA, 18 nt, Human
gagcagcagccgggggcg

SEQ ID NO: 1015695 - RNA, 22 nt, Human
gagcagcagccgggggcgcgga

SEQ ID NO: 1015696 - RNA, 22 nt, Human
gagcagcagccgggggcgcgga

SEQ ID NO: 1015697 - RNA, 18 nt, Human
gaguaaugagcuaugacc

SEQ ID NO: 1015698 - RNA, 18 nt, Human
gaguagaaaaaggaggcu

SEQ ID NO: 1015699 - RNA, 21 nt, Human
gagucccaagcccucccuucu

SEQ ID NO: 1015700 - RNA, 19 nt, Human
gagucuaaagucuuccaaa

SEQ ID NO: 1015701 - RNA, 20 nt, Human
gaucagcaaacagacgcaca

SEQ ID NO: 1015702 - RNA, 18 nt, Human
gauuacaggcgugagcca

SEQ ID NO: 1015703 - RNA, 21 nt, Human
gauuacaggcgugagccaccg

SEQ ID NO: 1015704 - RNA, 24 nt, Human
gauuacaggcgugagccaccgugc

SEQ ID NO: 1015705 - RNA, 23 nt, Human
gcaacaaaaaaccucaaaccaaa

SEQ ID NO: 1015706 - RNA, 22 nt, Human
gcaaccucugccucccggguuc

SEQ ID NO: 1015707 - RNA, 21 nt, Human
gcagcagccgggggcgcggag

SEQ ID NO: 1015708 - RNA, 21 nt, Human
gcagcagccgggggcgcggag

SEQ ID NO: 1015709 - RNA, 23 nt, Human
gccucauggcucacugcagcccu

SEQ ID NO: 1015710 - RNA, 19 nt, Human
gcuaugcuacaaucgagag

SEQ ID NO: 1015711 - RNA, 18 nt, Human
gcucacugcagcccugac

SEQ ID NO: 1015712 - RNA, 24 nt, Human
ggacuacaggugugugcuaccaug

SEQ ID NO: 1015713 - RNA, 18 nt, Human
ggacuuugugcuggaaua

SEQ ID NO: 1015714 - RNA, 19 nt, Human
ggauccccccauuucugcc

SEQ ID NO: 1015715 - RNA, 20 nt, Human
ggcgugagcagcagccgggg

SEQ ID NO: 1015716 - RNA, 20 nt, Human
ggcgugagcagcagccgggg

SEQ ID NO: 1015717 - RNA, 22 nt, Human
gggaucauauuaucaaaaacca

SEQ ID NO: 1015718 - RNA, 24 nt, Human
gggauguuuuaacauuuucaaacc

SEQ ID NO: 1015719 - RNA, 19 nt, Human
gggccuuuccugaccacac

SEQ ID NO: 1015720 - RNA, 18 nt, Human
ggggguugggacgacagc

SEQ ID NO: 1015721 - RNA, 18 nt, Human
ggguaugugggggaaucc

SEQ ID NO: 1015722 - RNA, 22 nt, Human
ggguucaagugauucuccugcc

SEQ ID NO: 1015723 - RNA, 23 nt, Human
ggguucaagugauucuccugccu

SEQ ID NO: 1015724 - RNA, 22 nt, Human
ggguuucaccauguuggccagg

SEQ ID NO: 1015725 - RNA, 21 nt, Human
guaaaaagauggcauaaccuu

SEQ ID NO: 1015726 - RNA, 20 nt, Human
guacagacugagauaaacaa

SEQ ID NO: 1015727 - RNA, 20 nt, Human
gucuaaagucuuccaaauga

SEQ ID NO: 1015728 - RNA, 24 nt, Human
gugauucuccugccucagccuccc

SEQ ID NO: 1015729 - RNA, 24 nt, Human
guuuguugcuacccgacuuuuugg

SEQ ID NO: 1015730 - RNA, 20 nt, Human
uaaaaaccucaacacccacc

SEQ ID NO: 1015731 - RNA, 19 nt, Human
uaaaacaaaaaacaacccu

SEQ ID NO: 1015732 - RNA, 23 nt, Human
uaaaacaaaaaacaacccuggua

SEQ ID NO: 1015733 - RNA, 22 nt, Human
uaaaacaugaagcauuucacaa

SEQ ID NO: 1015734 - RNA, 24 nt, Human
uaaaacugucuuucauaaaacucu

SEQ ID NO: 1015735 - RNA, 20 nt, Human
uaaaagaaaaagccagaaug

SEQ ID NO: 1015736 - RNA, 18 nt, Human
uaaaagauauacuauucu

SEQ ID NO: 1015737 - RNA, 21 nt, Human
uaaaauaaauacuaaauacua

SEQ ID NO: 1015738 - RNA, 23 nt, Human
uaaaauaaauacuaaauacuaac

SEQ ID NO: 1015739 - RNA, 20 nt, Human
uaaaauagcugagcauaugc

SEQ ID NO: 1015740 - RNA, 18 nt, Human
uaaagcacaagcacagcc

SEQ ID NO: 1015741 - RNA, 19 nt, Human
uaaauaaucacaugccaga

SEQ ID NO: 1015742 - RNA, 21 nt, Human
uaaauuaagaaaaaaugucca

SEQ ID NO: 1015743 - RNA, 18 nt, Human
uaaccagaauaucagugg

SEQ ID NO: 1015744 - RNA, 22 nt, Human
uaagaaauuacggucauguaaa

SEQ ID NO: 1015745 - RNA, 22 nt, Human
uaagaggcuuccauggccagca

SEQ ID NO: 1015746 - RNA, 22 nt, Human
uaagauaaagccacgaaacuca

SEQ ID NO: 1015747 - RNA, 21 nt, Human
uaagcugcagacagucuccuu

SEQ ID NO: 1015748 - RNA, 18 nt, Human
uaaggggacauccaaaaa

SEQ ID NO: 1015749 - RNA, 28 nt, Human
uaaggggacauccaaaaaaaagaggggg

SEQ ID NO: 1015750 - RNA, 24 nt, Human
uacaauaucaucauuagaaauucu

SEQ ID NO: 1015751 - RNA, 23 nt, Human
uacaggcgugagccaccgugccc

SEQ ID NO: 1015752 - RNA, 24 nt, Human
uacaggcgugagccaccgugcccu

SEQ ID NO: 1015753 - RNA, 21 nt, Human
uagaaaauaguauuugaaagc

SEQ ID NO: 1015754 - RNA, 23 nt, Human
uagaaauucugcauauggcuaau

SEQ ID NO: 1015755 - RNA, 24 nt, Human
uagaauccuggauuauuaugcccc

SEQ ID NO: 1015756 - RNA, 24 nt, Human
uagaauugauaagaaauuacgguc

SEQ ID NO: 1015757 - RNA, 20 nt, Human
uagagugcaguggugccuca

SEQ ID NO: 1015758 - RNA, 21 nt, Human
uagagugcaguggugccucau

SEQ ID NO: 1015759 - RNA, 23 nt, Human
uagagugcaguggugccucaugg

SEQ ID NO: 1015760 - RNA, 20 nt, Human
uagcaacaggguuucaccau

SEQ ID NO: 1015761 - RNA, 20 nt, Human
uaggugcuuggaacucuagu

SEQ ID NO: 1015762 - RNA, 18 nt, Human
uagguucuuggugguaga

SEQ ID NO: 1015763 - RNA, 25 nt, Human
uaguagagacgaagucuuacuaggu

SEQ ID NO: 1015764 - RNA, 24 nt, Human
uaguagcaacaggguuucaccaug

SEQ ID NO: 1015765 - RNA, 20 nt, Human
uaguagcuaacauuagccac

SEQ ID NO: 1015766 - RNA, 20 nt, Human
uaguagcugggguuacuggc

SEQ ID NO: 1015767 - RNA, 24 nt, Human
uaguuuuuuaauuauuaguagaga

SEQ ID NO: 1015768 - RNA, 22 nt, Human
uauaaucaggcaccacauuugc

SEQ ID NO: 1015769 - RNA, 25 nt, Human
uauagaacuguagcuaucucaauga

SEQ ID NO: 1015770 - RNA, 21 nt, Human
uaugccccucuaaaaaacaaa

SEQ ID NO: 1015771 - RNA, 20 nt, Human
uauuacugaaaaaugacaag

SEQ ID NO: 1015772 - RNA, 19 nt, Human
uauuaugccccucuaaaaa

SEQ ID NO: 1015773 - RNA, 30 nt, Human
ucaaaugugaacauaugaugcauuugcuuu

SEQ ID NO: 1015774 - RNA, 18 nt, Human
ucaacacccacccauggg

SEQ ID NO: 1015775 - RNA, 19 nt, Human
ucaagugauucuccugccu

SEQ ID NO: 1015776 - RNA, 23 nt, Human
ucacuccuaaacccucccccgac

SEQ ID NO: 1015777 - RNA, 24 nt, Human
ucacucugucauccaggcuggagu

SEQ ID NO: 1015778 - RNA, 22 nt, Human
ucacugaggccaauucugcugu

SEQ ID NO: 1015779 - RNA, 24 nt, Human
ucacugaggccaauucugcuguau

SEQ ID NO: 1015780 - RNA, 24 nt, Human
ucacugcaaccucugccucccggg

SEQ ID NO: 1015781 - RNA, 25 nt, Human
ucacugcaaccucugccucccgggu

SEQ ID NO: 1015782 - RNA, 20 nt, Human
ucagccucccuaguagcugg

SEQ ID NO: 1015783 - RNA, 24 nt, Human
ucauccaggcuggaguguaguggu

SEQ ID NO: 1015784 - RNA, 18 nt, Human
uccacaaaaucuggcucc

SEQ ID NO: 1015785 - RNA, 20 nt, Human
uccacaaaaucuggcucccg

SEQ ID NO: 1015786 - RNA, 23 nt, Human
uccacaaaaucuggcucccgggc

SEQ ID NO: 1015787 - RNA, 23 nt, Human
uccacaaaaucuggcucccgggc

SEQ ID NO: 1015788 - RNA, 24 nt, Human
ucccaaagugcugggauuacaggc

SEQ ID NO: 1015789 - RNA, 24 nt, Human
ucccaaguaucugggacuacaggu

SEQ ID NO: 1015790 - RNA, 21 nt, Human
uccccuuguccuggcccugcu

SEQ ID NO: 1015791 - RNA, 21 nt, Human
ucccggguucaagugauucuc

SEQ ID NO: 1015792 - RNA, 24 nt, Human
ucccggguucaagugauucuccug

SEQ ID NO: 1015793 - RNA, 21 nt, Human
uccuaaacccucccccgaccc

SEQ ID NO: 1015794 - RNA, 22 nt, Human
uccuaaacccucccccgacccc

SEQ ID NO: 1015795 - RNA, 19 nt, Human
uccucacaggcaacagagu

SEQ ID NO: 1015796 - RNA, 23 nt, Human
ucuacgaggagaacaauuuuaag

SEQ ID NO: 1015797 - RNA, 21 nt, Human
ucuacuaguuauuucucccca

SEQ ID NO: 1015798 - RNA, 22 nt, Human
ucucacucugucauccaggcug

SEQ ID NO: 1015799 - RNA, 23 nt, Human
ucucacucugucauccaggcugg

SEQ ID NO: 1015800 - RNA, 24 nt, Human
ucucacucugucauccaggcugga

SEQ ID NO: 1015801 - RNA, 24 nt, Human
ucucuugcccaggcuagagugcag

SEQ ID NO: 1015802 - RNA, 21 nt, Human
ucugcacggcgccaaugagga

SEQ ID NO: 1015803 - RNA, 22 nt, Human
ucuggcgaugcuuaacacuuaa

SEQ ID NO: 1015804 - RNA, 24 nt, Human
ucugucauccaggcuggaguguag

SEQ ID NO: 1015805 - RNA, 22 nt, Human
ucuugcccaggcuagagugcag

SEQ ID NO: 1015806 - RNA, 19 nt, Human
ucuuguucucuugcccagg

SEQ ID NO: 1015807 - RNA, 23 nt, Human
ugaaaaauaaaguuguacgcaca

SEQ ID NO: 1015808 - RNA, 22 nt, Human
ugaagggaucauauuaucaaaa

SEQ ID NO: 1015809 - RNA, 22 nt, Human
ugaaguaaauaaucacaugcca

SEQ ID NO: 1015810 - RNA, 21 nt, Human
ugaauagacagagaaacuagu

SEQ ID NO: 1015811 - RNA, 18 nt, Human
ugacaaccaaaaaugugc

SEQ ID NO: 1015812 - RNA, 18 nt, Human
ugacaucaggugauccgc

SEQ ID NO: 1015813 - RNA, 20 nt, Human
ugaccaauauccauaauuuu

SEQ ID NO: 1015814 - RNA, 28 nt, Human
ugaccacacuuuaaaaaccucaacaccc

SEQ ID NO: 1015815 - RNA, 21 nt, Human
ugagaacacugcucaggcuuu

SEQ ID NO: 1015816 - RNA, 22 nt, Human
ugagaugaagucucacucuguc

SEQ ID NO: 1015817 - RNA, 20 nt, Human
ugagaugagugagguaccug

SEQ ID NO: 1015818 - RNA, 18 nt, Human
ugagcccaggauucugag

SEQ ID NO: 1015819 - RNA, 18 nt, Human
ugaggaaaauauuaccua

SEQ ID NO: 1015820 - RNA, 20 nt, Human
ugaggaaaauggcagcagua

SEQ ID NO: 1015821 - RNA, 24 nt, Human
ugagguaccugccuugggcacaaa

SEQ ID NO: 1015822 - RNA, 22 nt, Human
ugagugagguaccugccuuggg

SEQ ID NO: 1015823 - RNA, 24 nt, Human
ugauauggaaaggaccugugcuuu

SEQ ID NO: 1015824 - RNA, 24 nt, Human
ugauccgcccaccuuggccuccca

SEQ ID NO: 1015825 - RNA, 20 nt, Human
ugauucuccugccucagccu

SEQ ID NO: 1015826 - RNA, 23 nt, Human
ugcaaaauggagucuuagaacaa

SEQ ID NO: 1015827 - RNA, 21 nt, Human
ugcccaggcuagagugcagug

SEQ ID NO: 1015828 - RNA, 24 nt, Human
ugcccaggcuagagugcaguggug

SEQ ID NO: 1015829 - RNA, 22 nt, Human
ugcccuaagcugcagacagucu

SEQ ID NO: 1015830 - RNA, 18 nt, Human
ugcccuggugcauuuggc

SEQ ID NO: 1015831 - RNA, 21 nt, Human
ugcccuggugcauuuggcugu

SEQ ID NO: 1015832 - RNA, 24 nt, Human
ugccucagccucccuaguagcugg

SEQ ID NO: 1015833 - RNA, 24 nt, Human
ugcugggauuacaggcgugagcca

SEQ ID NO: 1015834 - RNA, 24 nt, Human
ugcuuuauuuaucaucgaucuuca

SEQ ID NO: 1015835 - RNA, 23 nt, Human
uggaguguaguggugcaaucuca

SEQ ID NO: 1015836 - RNA, 24 nt, Human
uggaguguaguggugcaaucucag

SEQ ID NO: 1015837 - RNA, 22 nt, Human
uggauccccccauuucugcccu

SEQ ID NO: 1015838 - RNA, 20 nt, Human
uggcacagagaaggagcucu

SEQ ID NO: 1015839 - RNA, 24 nt, Human
uggcagcaguaaagaaaugaggaa

SEQ ID NO: 1015840 - RNA, 22 nt, Human
uggcauaaccuuuccucuaaaa

SEQ ID NO: 1015841 - RNA, 24 nt, Human
uggccaggcuggucucgaaccccu

SEQ ID NO: 1015842 - RNA, 22 nt, Human
uggcugaccacugcaccccagg

SEQ ID NO: 1015843 - RNA, 22 nt, Human
ugggacuacaggugugugcuac

SEQ ID NO: 1015844 - RNA, 24 nt, Human
ugggacuacaggugugugcuacca

SEQ ID NO: 1015845 - RNA, 25 nt, Human
ugggacuacaggugugugcuaccau

SEQ ID NO: 1015846 - RNA, 21 nt, Human
ugggauuacaggcgugagcca

SEQ ID NO: 1015847 - RNA, 22 nt, Human
ugggauuacaggcgugagccac

SEQ ID NO: 1015848 - RNA, 23 nt, Human
ugggauuacaggcgugagccacc

SEQ ID NO: 1015849 - RNA, 23 nt, Human
ugggauuacaggcgugagccacc

SEQ ID NO: 1015850 - RNA, 24 nt, Human
ugggauuacaggcgugagccaccg

SEQ ID NO: 1015851 - RNA, 21 nt, Human
ugguaugaaaguuugcaacau

SEQ ID NO: 1015852 - RNA, 24 nt, Human
uggugcaaucucagcucacugcaa

SEQ ID NO: 1015853 - RNA, 23 nt, Human
uggugccucauggcucacugcag

SEQ ID NO: 1015854 - RNA, 18 nt, Human
uguacauaugugugaaua

SEQ ID NO: 1015855 - RNA, 23 nt, Human
ugucacagaauuacuacgugucu

SEQ ID NO: 1015856 - RNA, 21 nt, Human
uguccuuucuuuaaacuucca

SEQ ID NO: 1015857 - RNA, 23 nt, Human
ugucucaacuuuaaaaauccuau

SEQ ID NO: 1015858 - RNA, 28 nt, Human
uguguucauguauuuguacauaugugug

SEQ ID NO: 1015859 - RNA, 23 nt, Human
uguuacuauuccuggcacugggc

SEQ ID NO: 1015860 - RNA, 24 nt, Human
uguuauugucuugcucugugucug

SEQ ID NO: 1015861 - RNA, 24 nt, Human
uguucauguauuuguacauaugug

SEQ ID NO: 1015862 - RNA, 24 nt, Human
uguucucuugcccaggcuagagug

SEQ ID NO: 1015863 - RNA, 18 nt, Human
uguucucuuuaucuuucc

SEQ ID NO: 1015864 - RNA, 22 nt, Human
uuaaaagaaaaagccagaaugu

SEQ ID NO: 1015865 - RNA, 19 nt, Human
uuaaauuucucuggcuuuu

SEQ ID NO: 1015866 - RNA, 20 nt, Human
uuagaaacacgucacgcuuc

SEQ ID NO: 1015867 - RNA, 24 nt, Human
uuaguagcaacaggguuucaccau

SEQ ID NO: 1015868 - RNA, 21 nt, Human
uuaucuacuguuuuuguguuu

SEQ ID NO: 1015869 - RNA, 18 nt, Human
uucaaaaggcugcaauaa

SEQ ID NO: 1015870 - RNA, 25 nt, Human
uucaaacacugaucugaaaagugaa

SEQ ID NO: 1015871 - RNA, 18 nt, Human
uucaacgucuuuucacug

SEQ ID NO: 1015872 - RNA, 24 nt, Human
uucaacucugaccaucauacagac

SEQ ID NO: 1015873 - RNA, 21 nt, Human
uucaagugauucuccugccuc

SEQ ID NO: 1015874 - RNA, 23 nt, Human
uucaagugauucuccugccucag

SEQ ID NO: 1015875 - RNA, 24 nt, Human
uucaagugauucuccugccucagc

SEQ ID NO: 1015876 - RNA, 20 nt, Human
uucacaaguuggaucccccc

SEQ ID NO: 1015877 - RNA, 25 nt, Human
uuccagaagguuacugaaaucacuu

SEQ ID NO: 1015878 - RNA, 18 nt, Human
uuccagagcaccaaaaac

SEQ ID NO: 1015879 - RNA, 22 nt, Human
uucccaauccaaaaacuggaag

SEQ ID NO: 1015880 - RNA, 18 nt, Human
uuccgugggccuggugcu

SEQ ID NO: 1015881 - RNA, 24 nt, Human
uucuaauuccuuuuagguucuugg

SEQ ID NO: 1015882 - RNA, 18 nt, Human
uucucuugcccaggcuag

SEQ ID NO: 1015883 - RNA, 22 nt, Human
uugaaacugauagcuuuccaga

SEQ ID NO: 1015884 - RNA, 18 nt, Human
uugcccaggcuagagugc

SEQ ID NO: 1015885 - RNA, 18 nt, Human
uuggccucccaaagugcu

SEQ ID NO: 1015886 - RNA, 33 nt, Human
uugggacgacagcggcccgcgcggcucccuuuu

SEQ ID NO: 1015887 - RNA, 27 nt, Human
uuguuaaaaaaacaauaaagugauaau

SEQ ID NO: 1015888 - RNA, 23 nt, Human
uuguuuuauccucuuugcuccuu

SEQ ID NO: 1015889 - RNA, 21 nt, Human
uuuaaaauuaauagagucuaa

SEQ ID NO: 1015890 - RNA, 22 nt, Human
uuuaaggggacauccaaaaaaa

SEQ ID NO: 1015891 - RNA, 24 nt, Human
uuucaccauguuggccaggcuggu

SEQ ID NO: 1015892 - RNA, 19 nt, Human
uuuccgccgcaguuaggag

SEQ ID NO: 1015893 - RNA, 25 nt, Human
uuucugauaaaucguaaugaaugag

SEQ ID NO: 1015894 - RNA, 23 nt, Human
uuucugcccuaagcugcagacag

SEQ ID NO: 1015895 - RNA, 24 nt, Human
uuuggcccuauuuggcugcuuuuc

SEQ ID NO: 1015896 - RNA, 19 nt, Human
uuuguaaaacaugaagcau

SEQ ID NO: 1015897 - RNA, 24 nt, Human
uuuguaaaacaugaagcauuucac

SEQ ID NO: 1015898 - RNA, 21 nt, Human
uuuuccaaacauuugugauuu

SEQ ID NO: 1015899 - RNA, 20 nt, Human
uuuuuaauuauuaguagaga

SEQ ID NO: 1015900 - RNA, 24 nt, Human
uuuuuaguagcaacaggguuucac

SEQ ID NO: 1015901 - RNA, 24 nt, Human
uuuuucuguaagcaaaaauaaaag

SEQ ID NO: 1015902 - RNA, 23 nt, Human
uuuuuguauuuuuaguagcaaca

SEQ ID NO: 1015903 - RNA, 21 nt, Human
uuuuuuuuuuuuuuuuuggau

SEQ ID NO: 1015904 - RNA, 24 nt, Human
uuuuuuuuuuuuuuuuuuaaccug

SEQ ID NO: 1015905 - RNA, 25 nt, Human
uuuuuuuuuuuuuuuuuuuuugggg

SEQ ID NO: 1015906 - RNA, 22 nt, Human
aaccuccacuuuauguuggaaa

SEQ ID NO: 1015907 - RNA, 25 nt, Human
aauacacauacacacacuaaaugug

SEQ ID NO: 1015908 - RNA, 19 nt, Human
agauguuuccaggagagau

SEQ ID NO: 1015909 - RNA, 22 nt, Human
auguggcagauguuuccaggag

SEQ ID NO: 1015910 - RNA, 18 nt, Human
cagagaggccacaugauc

SEQ ID NO: 1015911 - RNA, 19 nt, Human
ccacaugaucaaauaaaau

SEQ ID NO: 1015912 - RNA, 19 nt, Human
ccagaccaaauauagacac

SEQ ID NO: 1015913 - RNA, 19 nt, Human
cuugcuuaaagucuccugu

SEQ ID NO: 1015914 - RNA, 21 nt, Human
gcaacagagaggccacaugau

SEQ ID NO: 1015915 - RNA, 24 nt, Human
gcaacagagaggccacaugaucaa

SEQ ID NO: 1015916 - RNA, 23 nt, Human
gcagagcugucugcuaacgugag

SEQ ID NO: 1015917 - RNA, 24 nt, Human
guugaaaccuccacuuuauguugg

SEQ ID NO: 1015918 - RNA, 21 nt, Human
uaacgugagcggggaaggcca

SEQ ID NO: 1015919 - RNA, 29 nt, Human
ucagccagaccaaauauagacacacugga

SEQ ID NO: 1015920 - RNA, 22 nt, Human
uccagccgaucagccagaccaa

SEQ ID NO: 1015921 - RNA, 18 nt, Human
ugaauacacauacacaca

SEQ ID NO: 1015922 - RNA, 20 nt, Human
ugagcggggaaggccagagu

SEQ ID NO: 1015923 - RNA, 19 nt, Human
uguggcagauguuuccagg

SEQ ID NO: 1015924 - RNA, 21 nt, Human
uuuuuuuuuuuuacugguaaa

SEQ ID NO: 1015925 - RNA, 21 nt, Human
uuuuuuuuuuuuuuuuacugg

SEQ ID NO: 1015926 - RNA, 23 nt, Human
uuuuuuuuuuuuuuuuuuacugg

SEQ ID NO: 1015927 - RNA, 26 nt, Human
aaaaaaaacuaaagcaguagaaacaa

SEQ ID NO: 1015928 - RNA, 25 nt, Human
aaaaaacagaaacagccacaaagcc

SEQ ID NO: 1015929 - RNA, 21 nt, Human
aaaaacagaaacagccacaaa

SEQ ID NO: 1015930 - RNA, 24 nt, Human
aaaacagaaacagccacaaagcaa

SEQ ID NO: 1015931 - RNA, 18 nt, Human
aaaagacacaggaguagg

SEQ ID NO: 1015932 - RNA, 18 nt, Human
aaacaaaacaagaacuga

SEQ ID NO: 1015933 - RNA, 21 nt, Human
aaacaaaacaagaacugaaac

SEQ ID NO: 1015934 - RNA, 19 nt, Human
aaacaagaacugaaacgug

SEQ ID NO: 1015935 - RNA, 21 nt, Human
aaacaagaacugaaacgugga

SEQ ID NO: 1015936 - RNA, 26 nt, Human
aaacaagaacugaaacguggaagcaa

SEQ ID NO: 1015937 - RNA, 21 nt, Human
aaacuaaagcaguagaaacaa

SEQ ID NO: 1015938 - RNA, 20 nt, Human
aacuaaagcaguagaaacaa

SEQ ID NO: 1015939 - RNA, 23 nt, Human
aacuuuaaaaaaaacuaaagcag

SEQ ID NO: 1015940 - RNA, 19 nt, Human
aagcgaaccaccuuagagg

SEQ ID NO: 1015941 - RNA, 19 nt, Human
acaaaacaagaacugaaac

SEQ ID NO: 1015942 - RNA, 25 nt, Human
acuuuaaaaaaaacuaaagcaguag

SEQ ID NO: 1015943 - RNA, 20 nt, Human
agacccccgccuggcuucag

SEQ ID NO: 1015944 - RNA, 22 nt, Human
agcaguagaaacaaaacaagaa

SEQ ID NO: 1015945 - RNA, 24 nt, Human
aguaaaaaacagaaacagccacaa

SEQ ID NO: 1015946 - RNA, 21 nt, Human
aguaaaaaacagaaacagccc

SEQ ID NO: 1015947 - RNA, 24 nt, Human
aguagaaacaaaacaagaacugaa

SEQ ID NO: 1015948 - RNA, 20 nt, Human
cacucccucccuccccaaaa

SEQ ID NO: 1015949 - RNA, 21 nt, Human
cagaaccaaaagacacaggag

SEQ ID NO: 1015950 - RNA, 20 nt, Human
cagcaguuaagcuaucaccg

SEQ ID NO: 1015951 - RNA, 23 nt, Human
cagcaguuaagcuaucacucccu

SEQ ID NO: 1015952 - RNA, 24 nt, Human
caguaaaaaacagaaacagccaca

SEQ ID NO: 1015953 - RNA, 25 nt, Human
ccaaaagacacaggaguaggaagca

SEQ ID NO: 1015954 - RNA, 23 nt, Human
ccacaaagcaaugaugauagaga

SEQ ID NO: 1015955 - RNA, 18 nt, Human
ccagcugauugcaacgga

SEQ ID NO: 1015956 - RNA, 21 nt, Human
ccuugaucagaugagaaugaa

SEQ ID NO: 1015957 - RNA, 24 nt, Human
cuaaagcaguagaaacaaaacaag

SEQ ID NO: 1015958 - RNA, 23 nt, Human
cucccuccccaaaacaguuaaaa

SEQ ID NO: 1015959 - RNA, 21 nt, Human
cuggagaacuuuaaaaaaaac

SEQ ID NO: 1015960 - RNA, 18 nt, Human
cuggaggcugguggaacu

SEQ ID NO: 1015961 - RNA, 18 nt, Human
gaaacaaaacaagaacug

SEQ ID NO: 1015962 - RNA, 20 nt, Human
gaacugaaacguggaagcaa

SEQ ID NO: 1015963 - RNA, 20 nt, Human
gaauccuccagcagaccccc

SEQ ID NO: 1015964 - RNA, 25 nt, Human
ggaauccuccagcagacccccgccu

SEQ ID NO: 1015965 - RNA, 24 nt, Human
ggaccagcugauugcaacggagga

SEQ ID NO: 1015966 - RNA, 22 nt, Human
ggagaacuuuaaaaaaaacuaa

SEQ ID NO: 1015967 - RNA, 18 nt, Human
ggaguaggaagcagugcu

SEQ ID NO: 1015968 - RNA, 24 nt, Human
ggcugguggaacuggggcugcugu

SEQ ID NO: 1015969 - RNA, 23 nt, Human
gggggagguauuccuggaggagg

SEQ ID NO: 1015970 - RNA, 23 nt, Human
gguaaguugucgguggggcagaa

SEQ ID NO: 1015971 - RNA, 25 nt, Human
guaaaaaacagaaacagccacaaag

SEQ ID NO: 1015972 - RNA, 22 nt, Human
gugacacacaaagaagcuccgc

SEQ ID NO: 1015973 - RNA, 24 nt, Human
gugcuggucuagguuucucuggaa

SEQ ID NO: 1015974 - RNA, 20 nt, Human
uaaaaaaaacuaaagcagua

SEQ ID NO: 1015975 - RNA, 24 nt, Human
uaaaaaaaacuaaagcaguagaaa

SEQ ID NO: 1015976 - RNA, 20 nt, Human
uaaaaaacagaaacagccac

SEQ ID NO: 1015977 - RNA, 21 nt, Human
uaaaaaacagaaacagccaca

SEQ ID NO: 1015978 - RNA, 27 nt, Human
uaaaaaacagaaacagccacaaagcaa

SEQ ID NO: 1015979 - RNA, 24 nt, Human
uaaagcaguagaaacaaaacaaga

SEQ ID NO: 1015980 - RNA, 28 nt, Human
uaacugaggagguaucccuuguggaacu

SEQ ID NO: 1015981 - RNA, 23 nt, Human
uaucacucccucccuccccaaaa

SEQ ID NO: 1015982 - RNA, 18 nt, Human
uauggcagagcagacuug

SEQ ID NO: 1015983 - RNA, 23 nt, Human
uccccaaaacaguuaaaagaaaa

SEQ ID NO: 1015984 - RNA, 21 nt, Human
uccccaaguccuugaucagau

SEQ ID NO: 1015985 - RNA, 21 nt, Human
uccuccagcagacccccgccu

SEQ ID NO: 1015986 - RNA, 20 nt, Human
ucuguuggaauccuccagca

SEQ ID NO: 1015987 - RNA, 23 nt, Human
ugacacacaaagaagcuccgcga

SEQ ID NO: 1015988 - RNA, 22 nt, Human
ugcagugauuggcugagaugga

SEQ ID NO: 1015989 - RNA, 21 nt, Human
uggaagcaaggugacacacaa

SEQ ID NO: 1015990 - RNA, 21 nt, Human
uggaauccuccagcagacccc

SEQ ID NO: 1015991 - RNA, 21 nt, Human
uggaauccuccagcagacccc

SEQ ID NO: 1015992 - RNA, 22 nt, Human
uggaauccuccagcagaccccc

SEQ ID NO: 1015993 - RNA, 25 nt, Human
uggcagagcagacuugcucaaagga

SEQ ID NO: 1015994 - RNA, 24 nt, Human
uggcuucagcaguuaagcuaucac

SEQ ID NO: 1015995 - RNA, 19 nt, Human
ugguggaacuggggcugcu

SEQ ID NO: 1015996 - RNA, 20 nt, Human
ugguggaacuggggcugcug

SEQ ID NO: 1015997 - RNA, 18 nt, Human
aaaaguacuugggcuucc

SEQ ID NO: 1015998 - RNA, 22 nt, Human
aaaguacuugggcuuccuuuac

SEQ ID NO: 1015999 - RNA, 20 nt, Human
aaccccaaauccacuuccuc

SEQ ID NO: 1016000 - RNA, 23 nt, Human
aauccacuuccucccucuucagg

SEQ ID NO: 1016001 - RNA, 28 nt, Human
accaacugccccuuaugaagcuuuucag

SEQ ID NO: 1016002 - RNA, 21 nt, Human
auccacuuccucccucuucag

SEQ ID NO: 1016003 - RNA, 19 nt, Human
caaaguucugaaaguuuau

SEQ ID NO: 1016004 - RNA, 24 nt, Human
caaauuuuugcucaacccuuuucc

SEQ ID NO: 1016005 - RNA, 20 nt, Human
caacugccccuuaugaagcu

SEQ ID NO: 1016006 - RNA, 21 nt, Human
caagaaauggugaaccccaaa

SEQ ID NO: 1016007 - RNA, 23 nt, Human
ccaaauccacuuccucccucuuc

SEQ ID NO: 1016008 - RNA, 18 nt, Human
ccaagaaauggugaaccc

SEQ ID NO: 1016009 - RNA, 24 nt, Human
cccaaauccacuuccucccucuuc

SEQ ID NO: 1016010 - RNA, 19 nt, Human
ccccaagaaauggugaacc

SEQ ID NO: 1016011 - RNA, 21 nt, Human
ccccaagaaauggugaacccc

SEQ ID NO: 1016012 - RNA, 19 nt, Human
ccccuuaugaagcuuuuca

SEQ ID NO: 1016013 - RNA, 19 nt, Human
ccugaggagucagaaccuc

SEQ ID NO: 1016014 - RNA, 21 nt, Human
cuucagguuauguuuuuugcu

SEQ ID NO: 1016015 - RNA, 27 nt, Human
cuuuucagucacugcaacacucccgac

SEQ ID NO: 1016016 - RNA, 22 nt, Human
gcuccugaggagucagaaccuc

SEQ ID NO: 1016017 - RNA, 19 nt, Human
uaaggaaacugaauugaca

SEQ ID NO: 1016018 - RNA, 23 nt, Human
uacaaaguucugaaaguuuaugg

SEQ ID NO: 1016019 - RNA, 24 nt, Human
ucagaaccucuauuuucuccagau

SEQ ID NO: 1016020 - RNA, 23 nt, Human
ucucucaguguaugcuuuucggc

SEQ ID NO: 1016021 - RNA, 23 nt, Human
ugaaccccaaauccacuuccucc

SEQ ID NO: 1016022 - RNA, 19 nt, Human
ugccccaagaaauggugaa

SEQ ID NO: 1016023 - RNA, 21 nt, Human
uggaagacagcauucaacugg

SEQ ID NO: 1016024 - RNA, 21 nt, Human
uugacacagucgagcaauugc

SEQ ID NO: 1016025 - RNA, 24 nt, Human
uuucggccacauaaugaacuacaa

SEQ ID NO: 1016026 - RNA, 21 nt, Human
aagaaacaaggagagacaagc

SEQ ID NO: 1016027 - RNA, 27 nt, Human
aagcaccacagugcagugggaagaaac

SEQ ID NO: 1016028 - RNA, 20 nt, Human
aagcuccuccuuccuggaga

SEQ ID NO: 1016029 - RNA, 19 nt, Human
agaaacaaggagagacaag

SEQ ID NO: 1016030 - RNA, 24 nt, Human
aggcugggggccaaggggaggagc

SEQ ID NO: 1016031 - RNA, 20 nt, Human
agugcuuuucggggccucgg

SEQ ID NO: 1016032 - RNA, 24 nt, Human
caaaaguaggaagcuccuccuucc

SEQ ID NO: 1016033 - RNA, 25 nt, Human
cagaaagaugcugguguaugugacg

SEQ ID NO: 1016034 - RNA, 20 nt, Human
cagggcuggcacaggcuggg

SEQ ID NO: 1016035 - RNA, 18 nt, Human
caggucaccaaagggagg

SEQ ID NO: 1016036 - RNA, 21 nt, Human
ccauuuccuccgccgcuccca

SEQ ID NO: 1016037 - RNA, 19 nt, Human
gagcauggagaaggccagc

SEQ ID NO: 1016038 - RNA, 21 nt, Human
gccuaggaaacagaggugugg

SEQ ID NO: 1016039 - RNA, 22 nt, Human
ggcuucauucccuggcuuuuca

SEQ ID NO: 1016040 - RNA, 18 nt, Human
guaugugacgaggcuggu

SEQ ID NO: 1016041 - RNA, 21 nt, Human
uacagaaagaugcugguguau

SEQ ID NO: 1016042 - RNA, 23 nt, Human
uccccagccuaggaaacagaggu

SEQ ID NO: 1016043 - RNA, 22 nt, Human
uccccgcucccgcgggcuucau

SEQ ID NO: 1016044 - RNA, 25 nt, Human
uccccgcucccgcgggcuucauucc

SEQ ID NO: 1016045 - RNA, 19 nt, Human
ucccugacgaccagugcuu

SEQ ID NO: 1016046 - RNA, 19 nt, Human
uccuccgccgcucccaccg

SEQ ID NO: 1016047 - RNA, 23 nt, Human
ugaaucccagauuccccgcuccc

SEQ ID NO: 1016048 - RNA, 20 nt, Human
ugacgaggcugguggccacu

SEQ ID NO: 1016049 - RNA, 23 nt, Human
uggcagccgggccagggcuggca

SEQ ID NO: 1016050 - RNA, 22 nt, Human
uggcagccgggccagggcuggg

SEQ ID NO: 1016051 - RNA, 22 nt, Human
uggugccccucacuuuugcucc

SEQ ID NO: 1016052 - RNA, 19 nt, Human
ugugacgaggcugguggcc

SEQ ID NO: 1016053 - RNA, 18 nt, Human
uuagggaaacaagauuca

SEQ ID NO: 1016054 - RNA, 24 nt, Human
uucugaaucccagauuccccgcuc

SEQ ID NO: 1016055 - RNA, 18 nt, Human
uugcaagaaauugccugu

SEQ ID NO: 1016056 - RNA, 26 nt, Human
uuuuuuuuuuuuuuuuuuuuuuaggg

SEQ ID NO: 1016057 - RNA, 20 nt, Human
aaauguuugcugacuugaaa

SEQ ID NO: 1016058 - RNA, 21 nt, Human
agacccagacuggcugggccu

SEQ ID NO: 1016059 - RNA, 21 nt, Human
auuggagcaucacagccggug

SEQ ID NO: 1016060 - RNA, 22 nt, Human
cacgccuggccuuccacccucc

SEQ ID NO: 1016061 - RNA, 21 nt, Human
cagaugggcccugccaaaguc

SEQ ID NO: 1016062 - RNA, 24 nt, Human
cagcugcgcgccgcggaggccgug

SEQ ID NO: 1016063 - RNA, 23 nt, Human
ccagaugggcccugccaaaguca

SEQ ID NO: 1016064 - RNA, 25 nt, Human
ccccacgccuggccuuccacccucc

SEQ ID NO: 1016065 - RNA, 18 nt, Human
ccccggggcagccgcgcc

SEQ ID NO: 1016066 - RNA, 18 nt, Human
cccuccggccucucggcc

SEQ ID NO: 1016067 - RNA, 19 nt, Human
ccucgagcucuggcucugg

SEQ ID NO: 1016068 - RNA, 18 nt, Human
ccuggccuuccacccucc

SEQ ID NO: 1016069 - RNA, 19 nt, Human
ccuggccuuccacccuccc

SEQ ID NO: 1016070 - RNA, 21 nt, Human
ccuggccuuccacccuccccg

SEQ ID NO: 1016071 - RNA, 20 nt, Human
cggccgcccggcgcccuggg

SEQ ID NO: 1016072 - RNA, 18 nt, Human
cggcgcccugggcucgcc

SEQ ID NO: 1016073 - RNA, 22 nt, Human
cggcuccggcuccagcaggcug

SEQ ID NO: 1016074 - RNA, 24 nt, Human
cggcuccggcuccggcuccggcuc

SEQ ID NO: 1016075 - RNA, 24 nt, Human
cggcuccggcuccggcuccggcuc

SEQ ID NO: 1016076 - RNA, 24 nt, Human
cggcuccggcuccggcuccggcuc

SEQ ID NO: 1016077 - RNA, 18 nt, Human
cgugggggagggaggccg

SEQ ID NO: 1016078 - RNA, 20 nt, Human
cucuggcuccggcuccggcu

SEQ ID NO: 1016079 - RNA, 18 nt, Human
cucuggcucuggcuccgg

SEQ ID NO: 1016080 - RNA, 22 nt, Human
cugacuugaaaacagcugcgcg

SEQ ID NO: 1016081 - RNA, 21 nt, Human
cugggcucgccgcugcucggg

SEQ ID NO: 1016082 - RNA, 25 nt, Human
gaaaacagcugcgcgccgcggaggc

SEQ ID NO: 1016083 - RNA, 25 nt, Human
gacugggcggcaacgcgcccgggag

SEQ ID NO: 1016084 - RNA, 25 nt, Human
ggcaacgcgcccgggagcggggccc

SEQ ID NO: 1016085 - RNA, 23 nt, Human
ggcccuccggccucucggcccag

SEQ ID NO: 1016086 - RNA, 19 nt, Human
uaagccagaccagccuccc

SEQ ID NO: 1016087 - RNA, 18 nt, Human
ucagccagagguucgggc

SEQ ID NO: 1016088 - RNA, 21 nt, Human
ucccggccgcccggcgcccug

SEQ ID NO: 1016089 - RNA, 23 nt, Human
ucccggccgcccggcgcccuggg

SEQ ID NO: 1016090 - RNA, 19 nt, Human
uccggcuccagcaggcugg

SEQ ID NO: 1016091 - RNA, 19 nt, Human
ucgggccccacgccuggcc

SEQ ID NO: 1016092 - RNA, 21 nt, Human
ucucggcccagcuaagccaga

SEQ ID NO: 1016093 - RNA, 19 nt, Human
ugaaaacagcugcgcgccg

SEQ ID NO: 1016094 - RNA, 18 nt, Human
ugcggcaaggauggggug

SEQ ID NO: 1016095 - RNA, 23 nt, Human
ugcugacuugaaaacagcugcgc

SEQ ID NO: 1016096 - RNA, 24 nt, Human
uggcuccggcuccggcuccggcuc

SEQ ID NO: 1016097 - RNA, 24 nt, Human
uggcucuggcuccggcuccggcuc

SEQ ID NO: 1016098 - RNA, 22 nt, Human
ugggccggugaguccucgagcu

SEQ ID NO: 1016099 - RNA, 23 nt, Human
ugggguguugcauagagagucag

SEQ ID NO: 1016100 - RNA, 24 nt, Human
uugcugacuugaaaacagcugcgc

SEQ ID NO: 1016101 - RNA, 21 nt, Human
aaaaaaaaaaaaaaaaacaaa

SEQ ID NO: 1016102 - RNA, 25 nt, Human
aaaaaaaaaaaaaaaaacaaaccug

SEQ ID NO: 1016103 - RNA, 23 nt, Human
aaaaaaaaacaaaccugacuuca

SEQ ID NO: 1016104 - RNA, 21 nt, Human
aaaaaaacaaaccugacuuca

SEQ ID NO: 1016105 - RNA, 29 nt, Human
aaacaaaaggcuggaauuaaggggacccc

SEQ ID NO: 1016106 - RNA, 24 nt, Human
aaaccugacuucauauaauucuua

SEQ ID NO: 1016107 - RNA, 20 nt, Human
aaacugacaaaagaauguca

SEQ ID NO: 1016108 - RNA, 19 nt, Human
aaauagugcauacaaggca

SEQ ID NO: 1016109 - RNA, 21 nt, Human
aacuaaucaauucauauucug

SEQ ID NO: 1016110 - RNA, 20 nt, Human
aacuccccaucccgcagccc

SEQ ID NO: 1016111 - RNA, 18 nt, Human
aagccaaacugacaaaag

SEQ ID NO: 1016112 - RNA, 23 nt, Human
accccuggcuggacgggcuccug

SEQ ID NO: 1016113 - RNA, 23 nt, Human
acugaagcugaacauucuggcau

SEQ ID NO: 1016114 - RNA, 19 nt, Human
acuugaaaucucugaaauc

SEQ ID NO: 1016115 - RNA, 22 nt, Human
agacugcagauauuucuauugu

SEQ ID NO: 1016116 - RNA, 20 nt, Human
agcugaacauucuggcauca

SEQ ID NO: 1016117 - RNA, 23 nt, Human
aggccgaggaggcggaggggggc

SEQ ID NO: 1016118 - RNA, 18 nt, Human
aggcggcggcgucgggag

SEQ ID NO: 1016119 - RNA, 18 nt, Human
aggcuggaauuaagugag

SEQ ID NO: 1016120 - RNA, 27 nt, Human
aucuaaaaagagauuuuuagaaagcca

SEQ ID NO: 1016121 - RNA, 18 nt, Human
caaaaaagcauacagagu

SEQ ID NO: 1016122 - RNA, 28 nt, Human
caaacugacaaaagaaugucauaaaaca

SEQ ID NO: 1016123 - RNA, 23 nt, Human
caacacacuuuaguuuaucucaa

SEQ ID NO: 1016124 - RNA, 21 nt, Human
caacaggagaaauaaucuaaa

SEQ ID NO: 1016125 - RNA, 22 nt, Human
caacugcuuugagagcucaagc

SEQ ID NO: 1016126 - RNA, 18 nt, Human
caagaagagaugaaaaua

SEQ ID NO: 1016127 - RNA, 20 nt, Human
cacaauuaauauaaaacuau

SEQ ID NO: 1016128 - RNA, 18 nt, Human
caccccuggcuggacggg

SEQ ID NO: 1016129 - RNA, 23 nt, Human
cagcagaaaacaaaaggcuggaa

SEQ ID NO: 1016130 - RNA, 26 nt, Human
cagcauaauacaaaucugugaaagac

SEQ ID NO: 1016131 - RNA, 21 nt, Human
cagccaaagggacauaggcac

SEQ ID NO: 1016132 - RNA, 19 nt, Human
caucccgcagccccgagcc

SEQ ID NO: 1016133 - RNA, 20 nt, Human
ccaccuggacucuguaauga

SEQ ID NO: 1016134 - RNA, 22 nt, Human
cccccgccguuccccgccgccc

SEQ ID NO: 1016135 - RNA, 23 nt, Human
ccccgccgcccggccgccucccc

SEQ ID NO: 1016136 - RNA, 25 nt, Human
ccccgccgcccggccgccuccccug

SEQ ID NO: 1016137 - RNA, 20 nt, Human
ccccuggcuggacgggcucc

SEQ ID NO: 1016138 - RNA, 18 nt, Human
cccggcggaggcggaggc

SEQ ID NO: 1016139 - RNA, 18 nt, Human
cccuggcuggacgggcuc

SEQ ID NO: 1016140 - RNA, 18 nt, Human
ccgcccccgccguucccc

SEQ ID NO: 1016141 - RNA, 22 nt, Human
ccgcccgcgggccuggcuccgg

SEQ ID NO: 1016142 - RNA, 23 nt, Human
ccgccgcccgcgggccuggcucc

SEQ ID NO: 1016143 - RNA, 19 nt, Human
ccgccgccguggcgcuaac

SEQ ID NO: 1016144 - RNA, 18 nt, Human
ccgccguuccccgccgcc

SEQ ID NO: 1016145 - RNA, 18 nt, Human
ccgccguuccccgccgcc

SEQ ID NO: 1016146 - RNA, 19 nt, Human
ccgccguuccccgccgccc

SEQ ID NO: 1016147 - RNA, 23 nt, Human
ccgcgggccuggcuccggggcgg

SEQ ID NO: 1016148 - RNA, 23 nt, Human
ccugcccagcuccgccgccgccc

SEQ ID NO: 1016149 - RNA, 19 nt, Human
ccugggcggcggcggggug

SEQ ID NO: 1016150 - RNA, 18 nt, Human
cgagcggaggccgaggag

SEQ ID NO: 1016151 - RNA, 18 nt, Human
cggcggcugcgagcggag

SEQ ID NO: 1016152 - RNA, 18 nt, Human
cgggcgggcucugcgggg

SEQ ID NO: 1016153 - RNA, 24 nt, Human
cucaaacuaaauuuccaaauagca

SEQ ID NO: 1016154 - RNA, 23 nt, Human
cuccccaucccgcagccccgagc

SEQ ID NO: 1016155 - RNA, 20 nt, Human
cucgggccaccucgcgggcu

SEQ ID NO: 1016156 - RNA, 18 nt, Human
cugccgccgccguggcgc

SEQ ID NO: 1016157 - RNA, 24 nt, Human
gaagccucuuccauccaucuacag

SEQ ID NO: 1016158 - RNA, 22 nt, Human
gaccaaaacgugcucuaaaaug

SEQ ID NO: 1016159 - RNA, 21 nt, Human
gcagaaaacaaaaggcuggaa

SEQ ID NO: 1016160 - RNA, 18 nt, Human
gcccccgccguuccccgc

SEQ ID NO: 1016161 - RNA, 21 nt, Human
gcccggccgccuccccuggcg

SEQ ID NO: 1016162 - RNA, 20 nt, Human
gcgggccuggcuccggggcg

SEQ ID NO: 1016163 - RNA, 18 nt, Human
gcggggugcgcugcggcc

SEQ ID NO: 1016164 - RNA, 20 nt, Human
ggcuccggggcgggcugggc

SEQ ID NO: 1016165 - RNA, 24 nt, Human
gggcgggcucugcggggaugcggg

SEQ ID NO: 1016166 - RNA, 18 nt, Human
gggcugggcgggcccggc

SEQ ID NO: 1016167 - RNA, 19 nt, Human
gggggcggugaggcggcgg

SEQ ID NO: 1016168 - RNA, 20 nt, Human
guauuauucuaauuguuaac

SEQ ID NO: 1016169 - RNA, 18 nt, Human
uaaaaagagauuuuuaga

SEQ ID NO: 1016170 - RNA, 21 nt, Human
uaacaguacugugcuuugaaa

SEQ ID NO: 1016171 - RNA, 23 nt, Human
uaacaguacugugcuuugaaaaa

SEQ ID NO: 1016172 - RNA, 23 nt, Human
uaagcacaauuaauauaaaacua

SEQ ID NO: 1016173 - RNA, 21 nt, Human
uacaaaucugugaaagacugc

SEQ ID NO: 1016174 - RNA, 23 nt, Human
uacaaaucugugaaagacugcag

SEQ ID NO: 1016175 - RNA, 23 nt, Human
uacuggacucaaauaaaaaaaac

SEQ ID NO: 1016176 - RNA, 24 nt, Human
uagcaugccauuuuaguucauguu

SEQ ID NO: 1016177 - RNA, 20 nt, Human
uaucauuauaaugugacuug

SEQ ID NO: 1016178 - RNA, 21 nt, Human
uauuuuguguugaauguuugg

SEQ ID NO: 1016179 - RNA, 19 nt, Human
ucaacacacuuuaguuuau

SEQ ID NO: 1016180 - RNA, 22 nt, Human
ucaacacacuuuaguuuaucuc

SEQ ID NO: 1016181 - RNA, 24 nt, Human
ucaacacacuuuaguuuaucucaa

SEQ ID NO: 1016182 - RNA, 19 nt, Human
ucaacaggagaaauaaucu

SEQ ID NO: 1016183 - RNA, 18 nt, Human
uccccaucccgcagcccc

SEQ ID NO: 1016184 - RNA, 18 nt, Human
uccugugcugcuguuggu

SEQ ID NO: 1016185 - RNA, 23 nt, Human
ucugagauuucuugaagcagauu

SEQ ID NO: 1016186 - RNA, 19 nt, Human
ugaagcugaacauucuggc

SEQ ID NO: 1016187 - RNA, 23 nt, Human
ugacuucauauaauucuuaauac

SEQ ID NO: 1016188 - RNA, 19 nt, Human
ugaugagacgagaaagaaa

SEQ ID NO: 1016189 - RNA, 24 nt, Human
uggcaccuuccugugggaagccuc

SEQ ID NO: 1016190 - RNA, 21 nt, Human
uggcaggcugcgcccucgggc

SEQ ID NO: 1016191 - RNA, 21 nt, Human
uggcuggacgggcuccugggc

SEQ ID NO: 1016192 - RNA, 27 nt, Human
uggguaaaaacugguccuuggauuuau

SEQ ID NO: 1016193 - RNA, 21 nt, Human
ugguggcaccuuccuguggga

SEQ ID NO: 1016194 - RNA, 20 nt, Human
ugugaaagacugcagauauu

SEQ ID NO: 1016195 - RNA, 23 nt, Human
uuaaauucucaaaaucaguauca

SEQ ID NO: 1016196 - RNA, 19 nt, Human
uuaacauuuacaugaauua

SEQ ID NO: 1016197 - RNA, 22 nt, Human
uuaccugucaucauuuugauga

SEQ ID NO: 1016198 - RNA, 18 nt, Human
uuccaaauagcaugccau

SEQ ID NO: 1016199 - RNA, 22 nt, Human
uugaauguuugguuuaacaaag

SEQ ID NO: 1016200 - RNA, 23 nt, Human
uuggagaagauguuuuccccguu

SEQ ID NO: 1016201 - RNA, 24 nt, Human
uugguuuuuuuaagacuucuagca

SEQ ID NO: 1016202 - RNA, 21 nt, Human
uuuuaagcaauggcuuggaga

SEQ ID NO: 1016203 - RNA, 21 nt, Human
aagcagaugaaacaaaggaaa

SEQ ID NO: 1016204 - RNA, 23 nt, Human
aagcuaaaaaaggggguuucugg

SEQ ID NO: 1016205 - RNA, 21 nt, Human
aaggggaugaugguggggcug

SEQ ID NO: 1016206 - RNA, 21 nt, Human
aaggguggggacugugaggua

SEQ ID NO: 1016207 - RNA, 25 nt, Human
aauuguguaauuuuuuuuccucuug

SEQ ID NO: 1016208 - RNA, 23 nt, Human
accaccuccuucaaacaagacug

SEQ ID NO: 1016209 - RNA, 21 nt, Human
accagguguccagacuauucc

SEQ ID NO: 1016210 - RNA, 21 nt, Human
acuccuacccccaccccaagc

SEQ ID NO: 1016211 - RNA, 20 nt, Human
agaaaucgaaaggaugguuu

SEQ ID NO: 1016212 - RNA, 20 nt, Human
agaaggggaugauggugggg

SEQ ID NO: 1016213 - RNA, 25 nt, Human
agacagacagcagagagaaaccaga

SEQ ID NO: 1016214 - RNA, 22 nt, Human
agacagcagagagaaaccagag

SEQ ID NO: 1016215 - RNA, 24 nt, Human
agagaggaagcagaugaaacaaag

SEQ ID NO: 1016216 - RNA, 21 nt, Human
agagagggagaugggguggug

SEQ ID NO: 1016217 - RNA, 19 nt, Human
aggggaugaugguggggcu

SEQ ID NO: 1016218 - RNA, 21 nt, Human
aggucccuucugauccugccc

SEQ ID NO: 1016219 - RNA, 24 nt, Human
caaacaagacugacacaggaagug

SEQ ID NO: 1016220 - RNA, 21 nt, Human
caaggcaggcaauugcuuugc

SEQ ID NO: 1016221 - RNA, 26 nt, Human
cacagguacgugcacauuuauggggg

SEQ ID NO: 1016222 - RNA, 21 nt, Human
caccccaagcccauaaaguac

SEQ ID NO: 1016223 - RNA, 22 nt, Human
caccucuauccaccaucaccac

SEQ ID NO: 1016224 - RNA, 21 nt, Human
cacuuggagggcacucccuac

SEQ ID NO: 1016225 - RNA, 19 nt, Human
cagacagcagagagaaacc

SEQ ID NO: 1016226 - RNA, 24 nt, Human
caggauugaauaaaccuuaacucc

SEQ ID NO: 1016227 - RNA, 24 nt, Human
cagguuaaaauauagauaagacac

SEQ ID NO: 1016228 - RNA, 19 nt, Human
cagugccacaggcuuaggu

SEQ ID NO: 1016229 - RNA, 22 nt, Human
caucaccaccuccuucaaacaa

SEQ ID NO: 1016230 - RNA, 28 nt, Human
cauucuacacaccccaagcccauaaagu

SEQ ID NO: 1016231 - RNA, 18 nt, Human
ccaagcccauaaaguaca

SEQ ID NO: 1016232 - RNA, 20 nt, Human
ccacugccuccugggcagug

SEQ ID NO: 1016233 - RNA, 21 nt, Human
ccauaugucaacuuugaaagg

SEQ ID NO: 1016234 - RNA, 23 nt, Human
cccaccccaagcaaaagcuaaaa

SEQ ID NO: 1016235 - RNA, 21 nt, Human
ccccaccccaagcaaaagcua

SEQ ID NO: 1016236 - RNA, 23 nt, Human
ccccaccccaagcaaaagcuaaa

SEQ ID NO: 1016237 - RNA, 20 nt, Human
ccccacucccccgcaaaauc

SEQ ID NO: 1016238 - RNA, 24 nt, Human
cccccaccccaagcaaaagcuaaa

SEQ ID NO: 1016239 - RNA, 18 nt, Human
ccccgguggggcucccgc

SEQ ID NO: 1016240 - RNA, 19 nt, Human
cccgccacugccuccuggg

SEQ ID NO: 1016241 - RNA, 20 nt, Human
cccggccucgggcuucggcc

SEQ ID NO: 1016242 - RNA, 22 nt, Human
cccuacccaggacaggauugaa

SEQ ID NO: 1016243 - RNA, 20 nt, Human
ccgccgccgccgccgcugcc

SEQ ID NO: 1016244 - RNA, 20 nt, Human
ccgccgccgccgccgcugcc

SEQ ID NO: 1016245 - RNA, 25 nt, Human
ccgccgccgccgcugccuuccccug

SEQ ID NO: 1016246 - RNA, 19 nt, Human
ccgcugccuuccccugcag

SEQ ID NO: 1016247 - RNA, 18 nt, Human
ccuccuggcuuucccaug

SEQ ID NO: 1016248 - RNA, 21 nt, Human
ccuccuucaaacaagacugac

SEQ ID NO: 1016249 - RNA, 22 nt, Human
ccugcaguccccaacccgggac

SEQ ID NO: 1016250 - RNA, 22 nt, Human
ccuuaacuccuacccccacccc

SEQ ID NO: 1016251 - RNA, 23 nt, Human
ccuucaccucuauccaccaucac

SEQ ID NO: 1016252 - RNA, 22 nt, Human
ccuucugauccugcccuucuca

SEQ ID NO: 1016253 - RNA, 23 nt, Human
cggccucgggcuucggcgauggc

SEQ ID NO: 1016254 - RNA, 24 nt, Human
cuccaugccaggacaacagucucc

SEQ ID NO: 1016255 - RNA, 23 nt, Human
cucccccgcaaaaucauucuaca

SEQ ID NO: 1016256 - RNA, 22 nt, Human
cucuuucaucuuucuccccacu

SEQ ID NO: 1016257 - RNA, 24 nt, Human
cuggccaaugggauggccauaugu

SEQ ID NO: 1016258 - RNA, 21 nt, Human
cugugccaaggucccuucuga

SEQ ID NO: 1016259 - RNA, 20 nt, Human
gaaaaucuauucugucccag

SEQ ID NO: 1016260 - RNA, 21 nt, Human
gagcccgccacugccuccugg

SEQ ID NO: 1016261 - RNA, 19 nt, Human
gagggcacucccuaccucc

SEQ ID NO: 1016262 - RNA, 23 nt, Human
gcacuggugccuauugcagucag

SEQ ID NO: 1016263 - RNA, 23 nt, Human
gcagagagaaaccagaggccaga

SEQ ID NO: 1016264 - RNA, 20 nt, Human
gcagaugaaacaaaggaaaa

SEQ ID NO: 1016265 - RNA, 19 nt, Human
gcagugggaggucagggcc

SEQ ID NO: 1016266 - RNA, 18 nt, Human
gccacugccuccugggca

SEQ ID NO: 1016267 - RNA, 21 nt, Human
gccaggacaacagucucccag

SEQ ID NO: 1016268 - RNA, 19 nt, Human
gcucccgccgccgccgccg

SEQ ID NO: 1016269 - RNA, 20 nt, Human
gcucccgccgccgccgccgc

SEQ ID NO: 1016270 - RNA, 24 nt, Human
ggagaugggguggugagagaggaa

SEQ ID NO: 1016271 - RNA, 24 nt, Human
ggaggucagggcccuccuggcuuu

SEQ ID NO: 1016272 - RNA, 19 nt, Human
ggcaucgugaagccggagg

SEQ ID NO: 1016273 - RNA, 23 nt, Human
ggcuuucccaugcaucccccacc

SEQ ID NO: 1016274 - RNA, 19 nt, Human
gggcacagcgcgagacagc

SEQ ID NO: 1016275 - RNA, 19 nt, Human
gggcagugggaggucaggg

SEQ ID NO: 1016276 - RNA, 19 nt, Human
ggucagggcccuccuggcu

SEQ ID NO: 1016277 - RNA, 22 nt, Human
gucccagaccccgguggggcuc

SEQ ID NO: 1016278 - RNA, 24 nt, Human
gucuguggauucuggccaauggga

SEQ ID NO: 1016279 - RNA, 22 nt, Human
gucuuuccuacacacucuucca

SEQ ID NO: 1016280 - RNA, 21 nt, Human
gugaagccggaggcaguuccc

SEQ ID NO: 1016281 - RNA, 21 nt, Human
guggggacuuuuuuuuuucuc

SEQ ID NO: 1016282 - RNA, 22 nt, Human
guuaaaauauagauaagacaca

SEQ ID NO: 1016283 - RNA, 18 nt, Human
uaaaaaacaaaucaaugu

SEQ ID NO: 1016284 - RNA, 19 nt, Human
uaacuccuacccccacccc

SEQ ID NO: 1016285 - RNA, 23 nt, Human
uacacaccccaagcccauaaagu

SEQ ID NO: 1016286 - RNA, 24 nt, Human
uacccccaccccaagcaaaagcug

SEQ ID NO: 1016287 - RNA, 21 nt, Human
uaccuccuucaccucuaucca

SEQ ID NO: 1016288 - RNA, 21 nt, Human
uaguagaaugggcacagcgcg

SEQ ID NO: 1016289 - RNA, 22 nt, Human
uagugcugugguguggacuugu

SEQ ID NO: 1016290 - RNA, 18 nt, Human
uauuuuugcacuuggagg

SEQ ID NO: 1016291 - RNA, 21 nt, Human
ucagggcccuccuggcuuucc

SEQ ID NO: 1016292 - RNA, 19 nt, Human
ucaugccagacagacagca

SEQ ID NO: 1016293 - RNA, 18 nt, Human
uccaccaucaccaccucc

SEQ ID NO: 1016294 - RNA, 19 nt, Human
uccaccaucaccaccuccu

SEQ ID NO: 1016295 - RNA, 20 nt, Human
ucccaugcaucccccaccag

SEQ ID NO: 1016296 - RNA, 25 nt, Human
uccccgauggucaauaagugcguca

SEQ ID NO: 1016297 - RNA, 20 nt, Human
ucccgccgccgccgccgcug

SEQ ID NO: 1016298 - RNA, 20 nt, Human
uccuacacacucuuccaaau

SEQ ID NO: 1016299 - RNA, 20 nt, Human
ucggccagacaccgggcggc

SEQ ID NO: 1016300 - RNA, 20 nt, Human
ucugaaaaaucacauggcua

SEQ ID NO: 1016301 - RNA, 23 nt, Human
ucugaguggccaugccggucggg

SEQ ID NO: 1016302 - RNA, 19 nt, Human
ucuuucaucuuucucccca

SEQ ID NO: 1016303 - RNA, 23 nt, Human
ugaauaaaccuuaacuccuaccc

SEQ ID NO: 1016304 - RNA, 20 nt, Human
ugagaaggggaugauggugg

SEQ ID NO: 1016305 - RNA, 20 nt, Human
ugagacauaaaaaaaguuuu

SEQ ID NO: 1016306 - RNA, 21 nt, Human
ugagguuuuaugucccaucgg

SEQ ID NO: 1016307 - RNA, 24 nt, Human
ugauccugcccuucucaggccuca

SEQ ID NO: 1016308 - RNA, 21 nt, Human
ugccuuccccugcagucccca

SEQ ID NO: 1016309 - RNA, 23 nt, Human
uggcuagauuaacuuucgcccua

SEQ ID NO: 1016310 - RNA, 18 nt, Human
ugggcagugggaggucag

SEQ ID NO: 1016311 - RNA, 22 nt, Human
uggggacugugagguaacccca

SEQ ID NO: 1016312 - RNA, 19 nt, Human
ugggguggugagagaggaa

SEQ ID NO: 1016313 - RNA, 22 nt, Human
ugggguggugagagaggaagca

SEQ ID NO: 1016314 - RNA, 20 nt, Human
uguuuugcuuuuucgauuua

SEQ ID NO: 1016315 - RNA, 22 nt, Human
uucacacugcuuaauugacauc

SEQ ID NO: 1016316 - RNA, 24 nt, Human
uuccccugcaguccccaacccggg

SEQ ID NO: 1016317 - RNA, 21 nt, Human
uuuccuacacacucuuccaaa

SEQ ID NO: 1016318 - RNA, 24 nt, Human
uuuguuauuuuugcacuuggaggg

SEQ ID NO: 1016319 - RNA, 18 nt, Human
aacgaggauccacaugug

SEQ ID NO: 1016320 - RNA, 18 nt, Human
aagccccuccuguccaca

SEQ ID NO: 1016321 - RNA, 21 nt, Human
acagcagaaaucaaaacaaac

SEQ ID NO: 1016322 - RNA, 27 nt, Human
acccauuuuccccucucucccuugccc

SEQ ID NO: 1016323 - RNA, 21 nt, Human
agaaaucaaaacaaacaagcc

SEQ ID NO: 1016324 - RNA, 19 nt, Human
agagcacagccaggcacua

SEQ ID NO: 1016325 - RNA, 21 nt, Human
aggcacuaacgcgcaggcgcu

SEQ ID NO: 1016326 - RNA, 18 nt, Human
aucaauucaacacccaca

SEQ ID NO: 1016327 - RNA, 21 nt, Human
cacacaggucagagacacggc

SEQ ID NO: 1016328 - RNA, 22 nt, Human
caccgaaagugauuuauaagca

SEQ ID NO: 1016329 - RNA, 21 nt, Human
caccuagaaccucugagaagu

SEQ ID NO: 1016330 - RNA, 19 nt, Human
cagcagaaaucaaaacaaa

SEQ ID NO: 1016331 - RNA, 23 nt, Human
ccaggcacuaacgcgcaggcgcu

SEQ ID NO: 1016332 - RNA, 19 nt, Human
ccugcagauuucucuuggu

SEQ ID NO: 1016333 - RNA, 20 nt, Human
ccuguccacaugcccagagu

SEQ ID NO: 1016334 - RNA, 21 nt, Human
cucagcaucaccuagaaccuc

SEQ ID NO: 1016335 - RNA, 25 nt, Human
gagaauagagggggcauaaaagaga

SEQ ID NO: 1016336 - RNA, 24 nt, Human
gagcacagccaggcacuaacgcgc

SEQ ID NO: 1016337 - RNA, 25 nt, Human
gauaauucaaacagcagcuccucuu

SEQ ID NO: 1016338 - RNA, 22 nt, Human
ggggagagaggagaauagaggg

SEQ ID NO: 1016339 - RNA, 20 nt, Human
uaagcacagcagaaaucaaa

SEQ ID NO: 1016340 - RNA, 22 nt, Human
uaagcacagcagaaaucaaaac

SEQ ID NO: 1016341 - RNA, 27 nt, Human
ucagccggcagcucuggcauuccucuu

SEQ ID NO: 1016342 - RNA, 25 nt, Human
uccacauguguaaauaaacgggaac

SEQ ID NO: 1016343 - RNA, 19 nt, Human
ucuguuguugagaugaaaa

SEQ ID NO: 1016344 - RNA, 20 nt, Human
ugcccagaguuuagagacac

SEQ ID NO: 1016345 - RNA, 20 nt, Human
ugccuggcaugaccaguagc

SEQ ID NO: 1016346 - RNA, 19 nt, Human
uggaaaacgaggauccaca

SEQ ID NO: 1016347 - RNA, 19 nt, Human
ugguucuuccaggagccug

SEQ ID NO: 1016348 - RNA, 20 nt, Human
uucacagauaauucaaacag

SEQ ID NO: 1016349 - RNA, 21 nt, Human
uuccaggagccuggaucuggc

SEQ ID NO: 1016350 - RNA, 22 nt, Human
aaaaaaacuuugggcaaagaaa

SEQ ID NO: 1016351 - RNA, 21 nt, Human
aaaaaaauagaauccguaaca

SEQ ID NO: 1016352 - RNA, 27 nt, Human
aaaacacuccucauccucuuggaaucg

SEQ ID NO: 1016353 - RNA, 18 nt, Human
aaaagaaaaccagggaaa

SEQ ID NO: 1016354 - RNA, 23 nt, Human
aaaagaaaaccagggaaacagaa

SEQ ID NO: 1016355 - RNA, 18 nt, Human
aaaagaucucaaaugaag

SEQ ID NO: 1016356 - RNA, 22 nt, Human
aaaaucaaguuaacuguguaag

SEQ ID NO: 1016357 - RNA, 18 nt, Human
aaaauuccagacucaccu

SEQ ID NO: 1016358 - RNA, 22 nt, Human
aaacacuccucauccucuugga

SEQ ID NO: 1016359 - RNA, 23 nt, Human
aagaaaaccagggaaacagaaaa
